United States Patent 10,706,955 (BIOINFORMATIC PROCESSES FOR DETERMINATION OF PEPTIDE BINDING) - sequence listing, part 15

SEQ ID NO: 576208 - protein, 5 aa, Mycobacterium
SDLTS

SEQ ID NO: 576209 - protein, 6 aa, Mycobacterium
SDLVGS

SEQ ID NO: 576210 - protein, 7 aa, Mycobacterium
SDLVGSP

SEQ ID NO: 576211 - protein, 4 aa, Mycobacterium
SDMA

SEQ ID NO: 576212 - protein, 5 aa, Mycobacterium
SDMDQ

SEQ ID NO: 576213 - protein, 6 aa, Mycobacterium
SDMNDP

SEQ ID NO: 576214 - protein, 7 aa, Mycobacterium
SDMNQSE

SEQ ID NO: 576215 - protein, 13 aa, Mycobacterium
SDMPGQTPPSPPT

SEQ ID NO: 576216 - protein, 14 aa, Mycobacterium
SDMQQARRAARKAA

SEQ ID NO: 576217 - protein, 24 aa, Mycobacterium
SDMRTDSDTDVEPGRDSEARPVRS

SEQ ID NO: 576218 - protein, 6 aa, Mycobacterium
SDMTEA

SEQ ID NO: 576219 - protein, 9 aa, Mycobacterium
SDMTGGMDA

SEQ ID NO: 576220 - protein, 5 aa, Mycobacterium
SDMVD

SEQ ID NO: 576221 - protein, 4 aa, Mycobacterium
SDNA

SEQ ID NO: 576222 - protein, 5 aa, Mycobacterium
SDNAL

SEQ ID NO: 576223 - protein, 10 aa, Mycobacterium
SDNARAPGVV

SEQ ID NO: 576224 - protein, 6 aa, Mycobacterium
SDNARG

SEQ ID NO: 576225 - protein, 9 aa, Mycobacterium
SDNATGNAY

SEQ ID NO: 576226 - protein, 5 aa, Mycobacterium
SDNDE

SEQ ID NO: 576227 - protein, 26 aa, Mycobacterium
SDNDGSLDPIQTDKKLAEGDQGASLR

SEQ ID NO: 576228 - protein, 8 aa, Mycobacterium
SDNDLERS

SEQ ID NO: 576229 - protein, 14 aa, Mycobacterium
SDNDSSVRRTAAEG

SEQ ID NO: 576230 - protein, 4 aa, Mycobacterium
SDNE

SEQ ID NO: 576231 - protein, 7 aa, Mycobacterium
SDNEAAQ

SEQ ID NO: 576232 - protein, 7 aa, Mycobacterium
SDNEKLG

SEQ ID NO: 576233 - protein, 7 aa, Mycobacterium
SDNETVD

SEQ ID NO: 576234 - protein, 6 aa, Mycobacterium
SDNEVR

SEQ ID NO: 576235 - protein, 11 aa, Mycobacterium
SDNKAEAAPTW

SEQ ID NO: 576236 - protein, 11 aa, Mycobacterium
SDNKEVATPTW

SEQ ID NO: 576237 - protein, 15 aa, Mycobacterium
SDNKQRAKVATGFAK

SEQ ID NO: 576238 - protein, 16 aa, Mycobacterium
SDNKQRAKVATGFGKP

SEQ ID NO: 576239 - protein, 10 aa, Mycobacterium
SDNLADPGGF

SEQ ID NO: 576240 - protein, 5 aa, Mycobacterium
SDNLD

SEQ ID NO: 576241 - protein, 9 aa, Mycobacterium
SDNLPGDEA

SEQ ID NO: 576242 - protein, 8 aa, Mycobacterium
SDNPDLVS

SEQ ID NO: 576243 - protein, 10 aa, Mycobacterium
SDNPDSIVDK

SEQ ID NO: 576244 - protein, 8 aa, Mycobacterium
SDNPGRYQ

SEQ ID NO: 576245 - protein, 7 aa, Mycobacterium
SDNPHGI

SEQ ID NO: 576246 - protein, 8 aa, Mycobacterium
SDNPPARV

SEQ ID NO: 576247 - protein, 21 aa, Mycobacterium
SDNPVPLTEDTPARGSPEHYY

SEQ ID NO: 576248 - protein, 4 aa, Mycobacterium
SDNQ

SEQ ID NO: 576249 - protein, 8 aa, Mycobacterium
SDNSGVSA

SEQ ID NO: 576250 - protein, 7 aa, Mycobacterium
SDNTGRV

SEQ ID NO: 576251 - protein, 7 aa, Mycobacterium
SDNTGYD

SEQ ID NO: 576252 - protein, 10 aa, Mycobacterium
SDNTSEPAEV

SEQ ID NO: 576253 - protein, 11 aa, Mycobacterium
SDNVGVGNGGG

SEQ ID NO: 576254 - protein, 5 aa, Mycobacterium
SDNYS

SEQ ID NO: 576255 - protein, 6 aa, Mycobacterium
SDPAAE

SEQ ID NO: 576256 - protein, 8 aa, Mycobacterium
SDPAAVPD

SEQ ID NO: 576257 - protein, 5 aa, Mycobacterium
SDPAD

SEQ ID NO: 576258 - protein, 6 aa, Mycobacterium
SDPADM

SEQ ID NO: 576259 - protein, 33 aa, Mycobacterium
SDPAESRETSSPVRKAPARQPKSAAKPSTEIPA

SEQ ID NO: 576260 - protein, 7 aa, Mycobacterium
SDPAGAP

SEQ ID NO: 576261 - protein, 7 aa, Mycobacterium
SDPAGDA

SEQ ID NO: 576262 - protein, 11 aa, Mycobacterium
SDPAGFEDGPN

SEQ ID NO: 576263 - protein, 10 aa, Mycobacterium
SDPAGGPAEP

SEQ ID NO: 576264 - protein, 10 aa, Mycobacterium
SDPAGGPPEP

SEQ ID NO: 576265 - protein, 8 aa, Mycobacterium
SDPAGRDR

SEQ ID NO: 576266 - protein, 8 aa, Mycobacterium
SDPAGRTL

SEQ ID NO: 576267 - protein, 6 aa, Mycobacterium
SDPAGV

SEQ ID NO: 576268 - protein, 5 aa, Mycobacterium
SDPAH

SEQ ID NO: 576269 - protein, 10 aa, Mycobacterium
SDPAISRADA

SEQ ID NO: 576270 - protein, 5 aa, Mycobacterium
SDPAK

SEQ ID NO: 576271 - protein, 5 aa, Mycobacterium
SDPAL

SEQ ID NO: 576272 - protein, 9 aa, Mycobacterium
SDPALGEPA

SEQ ID NO: 576273 - protein, 10 aa, Mycobacterium
SDPALGSAAI

SEQ ID NO: 576274 - protein, 8 aa, Mycobacterium
SDPAPQRL

SEQ ID NO: 576275 - protein, 17 aa, Mycobacterium
SDPAQPVPGAADQLVGR

SEQ ID NO: 576276 - protein, 6 aa, Mycobacterium
SDPARA

SEQ ID NO: 576277 - protein, 6 aa, Mycobacterium
SDPARL

SEQ ID NO: 576278 - protein, 9 aa, Mycobacterium
SDPASARAA

SEQ ID NO: 576279 - protein, 6 aa, Mycobacterium
SDPASI

SEQ ID NO: 576280 - protein, 8 aa, Mycobacterium
SDPASLDL

SEQ ID NO: 576281 - protein, 7 aa, Mycobacterium
SDPATGF

SEQ ID NO: 576282 - protein, 8 aa, Mycobacterium
SDPATQQA

SEQ ID NO: 576283 - protein, 7 aa, Mycobacterium
SDPATRA

SEQ ID NO: 576284 - protein, 6 aa, Mycobacterium
SDPATV

SEQ ID NO: 576285 - protein, 5 aa, Mycobacterium
SDPAV

SEQ ID NO: 576286 - protein, 9 aa, Mycobacterium
SDPAVRGQG

SEQ ID NO: 576287 - protein, 5 aa, Mycobacterium
SDPDA

SEQ ID NO: 576288 - protein, 8 aa, Mycobacterium
SDPDAEAR

SEQ ID NO: 576289 - protein, 8 aa, Mycobacterium
SDPDAGAR

SEQ ID NO: 576290 - protein, 9 aa, Mycobacterium
SDPDAQRHQ

SEQ ID NO: 576291 - protein, 6 aa, Mycobacterium
SDPDAV

SEQ ID NO: 576292 - protein, 7 aa, Mycobacterium
SDPDAVT

SEQ ID NO: 576293 - protein, 9 aa, Mycobacterium
SDPDDPRLD

SEQ ID NO: 576294 - protein, 20 aa, Mycobacterium
SDPDDWNPPTLDENTDIPGE

SEQ ID NO: 576295 - protein, 11 aa, Mycobacterium
SDPDDWTPPTF

SEQ ID NO: 576296 - protein, 7 aa, Mycobacterium
SDPDEAR

SEQ ID NO: 576297 - protein, 7 aa, Mycobacterium
SDPDEAV

SEQ ID NO: 576298 - protein, 8 aa, Mycobacterium
SDPDERGM

SEQ ID NO: 576299 - protein, 5 aa, Mycobacterium
SDPDG

SEQ ID NO: 576300 - protein, 14 aa, Mycobacterium
SDPDGAVDGNGTDL

SEQ ID NO: 576301 - protein, 14 aa, Mycobacterium
SDPDGSVGGQGSDL

SEQ ID NO: 576302 - protein, 5 aa, Mycobacterium
SDPDH

SEQ ID NO: 576303 - protein, 6 aa, Mycobacterium
SDPDLA

SEQ ID NO: 576304 - protein, 8 aa, Mycobacterium
SDPDLEST

SEQ ID NO: 576305 - protein, 21 aa, Mycobacterium
SDPDLTAEEKAAAIAELRRAL

SEQ ID NO: 576306 - protein, 5 aa, Mycobacterium
SDPDQ

SEQ ID NO: 576307 - protein, 17 aa, Mycobacterium
SDPDRRRRYQRARGKGG

SEQ ID NO: 576308 - protein, 7 aa, Mycobacterium
SDPDRVA

SEQ ID NO: 576309 - protein, 7 aa, Mycobacterium
SDPDSQR

SEQ ID NO: 576310 - protein, 7 aa, Mycobacterium
SDPDSVD

SEQ ID NO: 576311 - protein, 7 aa, Mycobacterium
SDPDTAR

SEQ ID NO: 576312 - protein, 5 aa, Mycobacterium
SDPDV

SEQ ID NO: 576313 - protein, 9 aa, Mycobacterium
SDPDVRGGG

SEQ ID NO: 576314 - protein, 4 aa, Mycobacterium
SDPE

SEQ ID NO: 576315 - protein, 8 aa, Mycobacterium
SDPEANAD

SEQ ID NO: 576316 - protein, 6 aa, Mycobacterium
SDPEFP

SEQ ID NO: 576317 - protein, 7 aa, Mycobacterium
SDPEFRA

SEQ ID NO: 576318 - protein, 6 aa, Mycobacterium
SDPEGY

SEQ ID NO: 576319 - protein, 6 aa, Mycobacterium
SDPEHP

SEQ ID NO: 576320 - protein, 6 aa, Mycobacterium
SDPEIF

SEQ ID NO: 576321 - protein, 5 aa, Mycobacterium
SDPEL

SEQ ID NO: 576322 - protein, 7 aa, Mycobacterium
SDPEQAG

SEQ ID NO: 576323 - protein, 21 aa, Mycobacterium
SDPEQGNWPPGFPEDKRPSYS

SEQ ID NO: 576324 - protein, 9 aa, Mycobacterium
SDPEQGSEA

SEQ ID NO: 576325 - protein, 14 aa, Mycobacterium
SDPERWTSAPDAQA

SEQ ID NO: 576326 - protein, 8 aa, Mycobacterium
SDPETGRT

SEQ ID NO: 576327 - protein, 7 aa, Mycobacterium
SDPETRW

SEQ ID NO: 576328 - protein, 6 aa, Mycobacterium
SDPEVP

SEQ ID NO: 576329 - protein, 8 aa, Mycobacterium
SDPEYVPD

SEQ ID NO: 576330 - protein, 5 aa, Mycobacterium
SDPFG

SEQ ID NO: 576331 - protein, 4 aa, Mycobacterium
SDPG

SEQ ID NO: 576332 - protein, 9 aa, Mycobacterium
SDPGADYTG

SEQ ID NO: 576333 - protein, 9 aa, Mycobacterium
SDPGAERHN

SEQ ID NO: 576334 - protein, 6 aa, Mycobacterium
SDPGAL

SEQ ID NO: 576335 - protein, 8 aa, Mycobacterium
SDPGATGL

SEQ ID NO: 576336 - protein, 9 aa, Mycobacterium
SDPGGPVTA

SEQ ID NO: 576337 - protein, 11 aa, Mycobacterium
SDPGGRASAEQ

SEQ ID NO: 576338 - protein, 7 aa, Mycobacterium
SDPGGVD

SEQ ID NO: 576339 - protein, 38 aa, Mycobacterium
SDPGHVSPEAARAAAQRLSTPTTNGPSGFGTGTSAVND

SEQ ID NO: 576340 - protein, 6 aa, Mycobacterium
SDPGLD

SEQ ID NO: 576341 - protein, 5 aa, Mycobacterium
SDPGM

SEQ ID NO: 576342 - protein, 11 aa, Mycobacterium
SDPGQAPHGGE

SEQ ID NO: 576343 - protein, 6 aa, Mycobacterium
SDPGQR

SEQ ID NO: 576344 - protein, 7 aa, Mycobacterium
SDPGRTV

SEQ ID NO: 576345 - protein, 10 aa, Mycobacterium
SDPGSCADAA

SEQ ID NO: 576346 - protein, 9 aa, Mycobacterium
SDPGSITSE

SEQ ID NO: 576347 - protein, 8 aa, Mycobacterium
SDPGTQAA

SEQ ID NO: 576348 - protein, 9 aa, Mycobacterium
SDPGVRGRG

SEQ ID NO: 576349 - protein, 7 aa, Mycobacterium
SDPHDPL

SEQ ID NO: 576350 - protein, 5 aa, Mycobacterium
SDPHG

SEQ ID NO: 576351 - protein, 13 aa, Mycobacterium
SDPHPRYRASAQS

SEQ ID NO: 576352 - protein, 5 aa, Mycobacterium
SDPHY

SEQ ID NO: 576353 - protein, 9 aa, Mycobacterium
SDPIDPVEV

SEQ ID NO: 576354 - protein, 13 aa, Mycobacterium
SDPIDRAGHARGK

SEQ ID NO: 576355 - protein, 6 aa, Mycobacterium
SDPIHP

SEQ ID NO: 576356 - protein, 5 aa, Mycobacterium
SDPIP

SEQ ID NO: 576357 - protein, 9 aa, Mycobacterium
SDPITRGAD

SEQ ID NO: 576358 - protein, 9 aa, Mycobacterium
SDPKAREKA

SEQ ID NO: 576359 - protein, 11 aa, Mycobacterium
SDPKGRASAEQ

SEQ ID NO: 576360 - protein, 7 aa, Mycobacterium
SDPKSVE

SEQ ID NO: 576361 - protein, 4 aa, Mycobacterium
SDPL

SEQ ID NO: 576362 - protein, 5 aa, Mycobacterium
SDPLG

SEQ ID NO: 576363 - protein, 12 aa, Mycobacterium
SDPLGQDSEGND

SEQ ID NO: 576364 - protein, 7 aa, Mycobacterium
SDPLNDT

SEQ ID NO: 576365 - protein, 6 aa, Mycobacterium
SDPLPA

SEQ ID NO: 576366 - protein, 9 aa, Mycobacterium
SDPLTEQDQ

SEQ ID NO: 576367 - protein, 5 aa, Mycobacterium
SDPME

SEQ ID NO: 576368 - protein, 11 aa, Mycobacterium
SDPNGRASAEQ

SEQ ID NO: 576369 - protein, 8 aa, Mycobacterium
SDPPADPF

SEQ ID NO: 576370 - protein, 9 aa, Mycobacterium
SDPPATPQA

SEQ ID NO: 576371 - protein, 9 aa, Mycobacterium
SDPPETQEL

SEQ ID NO: 576372 - protein, 6 aa, Mycobacterium
SDPPGL

SEQ ID NO: 576373 - protein, 14 aa, Mycobacterium
SDPPGLAPLPDEEP

SEQ ID NO: 576374 - protein, 14 aa, Mycobacterium
SDPPGLTPLPEEEP

SEQ ID NO: 576375 - protein, 8 aa, Mycobacterium
SDPPHGPE

SEQ ID NO: 576376 - protein, 7 aa, Mycobacterium
SDPPMTG

SEQ ID NO: 576377 - protein, 8 aa, Mycobacterium
SDPPPGTV

SEQ ID NO: 576378 - protein, 7 aa, Mycobacterium
SDPPPPR

SEQ ID NO: 576379 - protein, 9 aa, Mycobacterium
SDPPTAEEI

SEQ ID NO: 576380 - protein, 10 aa, Mycobacterium
SDPPTAPEVA

SEQ ID NO: 576381 - protein, 9 aa, Mycobacterium
SDPPTPAEV

SEQ ID NO: 576382 - protein, 9 aa, Mycobacterium
SDPPTPDEV

SEQ ID NO: 576383 - protein, 10 aa, Mycobacterium
SDPPTPDEVA

SEQ ID NO: 576384 - protein, 8 aa, Mycobacterium
SDPPVADE

SEQ ID NO: 576385 - protein, 5 aa, Mycobacterium
SDPQA

SEQ ID NO: 576386 - protein, 5 aa, Mycobacterium
SDPQE

SEQ ID NO: 576387 - protein, 5 aa, Mycobacterium
SDPQG

SEQ ID NO: 576388 - protein, 6 aa, Mycobacterium
SDPQLR

SEQ ID NO: 576389 - protein, 6 aa, Mycobacterium
SDPQQA

SEQ ID NO: 576390 - protein, 6 aa, Mycobacterium
SDPQRA

SEQ ID NO: 576391 - protein, 8 aa, Mycobacterium
SDPQTAEA

SEQ ID NO: 576392 - protein, 6 aa, Mycobacterium
SDPQVA

SEQ ID NO: 576393 - protein, 6 aa, Mycobacterium
SDPQWG

SEQ ID NO: 576394 - protein, 4 aa, Mycobacterium
SDPR

SEQ ID NO: 576395 - protein, 14 aa, Mycobacterium
SDPRGAQRERNEGI

SEQ ID NO: 576396 - protein, 8 aa, Mycobacterium
SDPRGGGV

SEQ ID NO: 576397 - protein, 6 aa, Mycobacterium
SDPRLR

SEQ ID NO: 576398 - protein, 6 aa, Mycobacterium
SDPRRA

SEQ ID NO: 576399 - protein, 7 aa, Mycobacterium
SDPRRDQ

SEQ ID NO: 576400 - protein, 7 aa, Mycobacterium
SDPRREE

SEQ ID NO: 576401 - protein, 6 aa, Mycobacterium
SDPRSA

SEQ ID NO: 576402 - protein, 8 aa, Mycobacterium
SDPRSAEI

SEQ ID NO: 576403 - protein, 4 aa, Mycobacterium
SDPS

SEQ ID NO: 576404 - protein, 9 aa, Mycobacterium
SDPSAERHR

SEQ ID NO: 576405 - protein, 14 aa, Mycobacterium
SDPSALADTSGYAS

SEQ ID NO: 576406 - protein, 14 aa, Mycobacterium
SDPSGGRRRLSKVH

SEQ ID NO: 576407 - protein, 6 aa, Mycobacterium
SDPSGM

SEQ ID NO: 576408 - protein, 5 aa, Mycobacterium
SDPSL

SEQ ID NO: 576409 - protein, 5 aa, Mycobacterium
SDPSQ

SEQ ID NO: 576410 - protein, 10 aa, Mycobacterium
SDPSQSASRE

SEQ ID NO: 576411 - protein, 10 aa, Mycobacterium
SDPSSTSANK

SEQ ID NO: 576412 - protein, 7 aa, Mycobacterium
SDPSTQA

SEQ ID NO: 576413 - protein, 7 aa, Mycobacterium
SDPSTRA

SEQ ID NO: 576414 - protein, 9 aa, Mycobacterium
SDPSVAEEA

SEQ ID NO: 576415 - protein, 10 aa, Mycobacterium
SDPSYPGLES

SEQ ID NO: 576416 - protein, 12 aa, Mycobacterium
SDPSYRQDPAIK

SEQ ID NO: 576417 - protein, 6 aa, Mycobacterium
SDPTGA

SEQ ID NO: 576418 - protein, 7 aa, Mycobacterium
SDPTGLA

SEQ ID NO: 576419 - protein, 7 aa, Mycobacterium
SDPTHPA

SEQ ID NO: 576420 - protein, 5 aa, Mycobacterium
SDPTI

SEQ ID NO: 576421 - protein, 5 aa, Mycobacterium
SDPTM

SEQ ID NO: 576422 - protein, 10 aa, Mycobacterium
SDPTQLGTAP

SEQ ID NO: 576423 - protein, 5 aa, Mycobacterium
SDPTR

SEQ ID NO: 576424 - protein, 8 aa, Mycobacterium
SDPTTATA

SEQ ID NO: 576425 - protein, 9 aa, Mycobacterium
SDPTVRGQG

SEQ ID NO: 576426 - protein, 8 aa, Mycobacterium
SDPTVSAP

SEQ ID NO: 576427 - protein, 5 aa, Mycobacterium
SDPVA

SEQ ID NO: 576428 - protein, 6 aa, Mycobacterium
SDPVAQ

SEQ ID NO: 576429 - protein, 9 aa, Mycobacterium
SDPVARGGF

SEQ ID NO: 576430 - protein, 9 aa, Mycobacterium
SDPVAVPAD

SEQ ID NO: 576431 - protein, 6 aa, Mycobacterium
SDPVEA

SEQ ID NO: 576432 - protein, 7 aa, Mycobacterium
SDPVGEV

SEQ ID NO: 576433 - protein, 27 aa, Mycobacterium
SDPVPADQEDLAEQAVNECPRAALIRK

SEQ ID NO: 576434 - protein, 6 aa, Mycobacterium
SDPVPP

SEQ ID NO: 576435 - protein, 14 aa, Mycobacterium
SDPVTTDVKRILSR

SEQ ID NO: 576436 - protein, 8 aa, Mycobacterium
SDQAISNE

SEQ ID NO: 576437 - protein, 22 aa, Mycobacterium
SDQALDRSRDNRQVEIHGRSPM

SEQ ID NO: 576438 - protein, 5 aa, Mycobacterium
SDQAP

SEQ ID NO: 576439 - protein, 8 aa, Mycobacterium
SDQAPADV

SEQ ID NO: 576440 - protein, 5 aa, Mycobacterium
SDQAR

SEQ ID NO: 576441 - protein, 6 aa, Mycobacterium
SDQARF

SEQ ID NO: 576442 - protein, 16 aa, Mycobacterium
SDQATIDRAPRVATGT

SEQ ID NO: 576443 - protein, 17 aa, Mycobacterium
SDQDELDESCDASPMRD

SEQ ID NO: 576444 - protein, 7 aa, Mycobacterium
SDQDERK

SEQ ID NO: 576445 - protein, 8 aa, Mycobacterium
SDQERSAG

SEQ ID NO: 576446 - protein, 13 aa, Mycobacterium
SDQGLADRQKVPA

SEQ ID NO: 576447 - protein, 14 aa, Mycobacterium
SDQGLADRQKVPAR

SEQ ID NO: 576448 - protein, 15 aa, Mycobacterium
SDQGLADRQKVPARL

SEQ ID NO: 576449 - protein, 16 aa, Mycobacterium
SDQGLADRQKVPARLG

SEQ ID NO: 576450 - protein, 15 aa, Mycobacterium
SDQGLADRQKVPARM

SEQ ID NO: 576451 - protein, 10 aa, Mycobacterium
SDQGLGDRQK

SEQ ID NO: 576452 - protein, 10 aa, Mycobacterium
SDQGVRHRGR

SEQ ID NO: 576453 - protein, 7 aa, Mycobacterium
SDQGYDA

SEQ ID NO: 576454 - protein, 7 aa, Mycobacterium
SDQGYDN

SEQ ID NO: 576455 - protein, 8 aa, Mycobacterium
SDQIDEAT

SEQ ID NO: 576456 - protein, 22 aa, Mycobacterium
SDQIGVRDANDANLRTQPGTPM

SEQ ID NO: 576457 - protein, 12 aa, Mycobacterium
SDQIKAAGELRL

SEQ ID NO: 576458 - protein, 10 aa, Mycobacterium
SDQITDPELK

SEQ ID NO: 576459 - protein, 6 aa, Mycobacterium
SDQLAQ

SEQ ID NO: 576460 - protein, 9 aa, Mycobacterium
SDQLPEPGR

SEQ ID NO: 576461 - protein, 9 aa, Mycobacterium
SDQPGRSTV

SEQ ID NO: 576462 - protein, 8 aa, Mycobacterium
SDQPGTGV

SEQ ID NO: 576463 - protein, 5 aa, Mycobacterium
SDQPI

SEQ ID NO: 576464 - protein, 7 aa, Mycobacterium
SDQPLTG

SEQ ID NO: 576465 - protein, 7 aa, Mycobacterium
SDQPTAL

SEQ ID NO: 576466 - protein, 12 aa, Mycobacterium
SDQQRAAGELRL

SEQ ID NO: 576467 - protein, 6 aa, Mycobacterium
SDQRAA

SEQ ID NO: 576468 - protein, 7 aa, Mycobacterium
SDQREPA

SEQ ID NO: 576469 - protein, 10 aa, Mycobacterium
SDQSDSDAPL

SEQ ID NO: 576470 - protein, 9 aa, Mycobacterium
SDQTGSPTY

SEQ ID NO: 576471 - protein, 12 aa, Mycobacterium
SDQTRKALAGTG

SEQ ID NO: 576472 - protein, 19 aa, Mycobacterium
SDQVDGYDYAGGAATNPRV

SEQ ID NO: 576473 - protein, 4 aa, Mycobacterium
SDQY

SEQ ID NO: 576474 - protein, 6 aa, Mycobacterium
SDRAAA

SEQ ID NO: 576475 - protein, 8 aa, Mycobacterium
SDRAAQTA

SEQ ID NO: 576476 - protein, 9 aa, Mycobacterium
SDRADDAER

SEQ ID NO: 576477 - protein, 11 aa, Mycobacterium
SDRAEAETEEL

SEQ ID NO: 576478 - protein, 7 aa, Mycobacterium
SDRAEAV

SEQ ID NO: 576479 - protein, 20 aa, Mycobacterium
SDRAGRRQCAHPGTAGASAH

SEQ ID NO: 576480 - protein, 7 aa, Mycobacterium
SDRAGTI

SEQ ID NO: 576481 - protein, 12 aa, Mycobacterium
SDRAGTQRWTAD

SEQ ID NO: 576482 - protein, 12 aa, Mycobacterium
SDRAGTRRWTAD

SEQ ID NO: 576483 - protein, 8 aa, Mycobacterium
SDRAPDTR

SEQ ID NO: 576484 - protein, 6 aa, Mycobacterium
SDRARF

SEQ ID NO: 576485 - protein, 7 aa, Mycobacterium
SDRARQV

SEQ ID NO: 576486 - protein, 8 aa, Mycobacterium
SDRASEVI

SEQ ID NO: 576487 - protein, 5 aa, Mycobacterium
SDRAT

SEQ ID NO: 576488 - protein, 16 aa, Mycobacterium
SDRDQKSLRDAVPATG

SEQ ID NO: 576489 - protein, 7 aa, Mycobacterium
SDRDRSM

SEQ ID NO: 576490 - protein, 7 aa, Mycobacterium
SDRDTLR

SEQ ID NO: 576491 - protein, 7 aa, Mycobacterium
SDRERDG

SEQ ID NO: 576492 - protein, 9 aa, Mycobacterium
SDRESVQSA

SEQ ID NO: 576493 - protein, 6 aa, Mycobacterium
SDRETG

SEQ ID NO: 576494 - protein, 13 aa, Mycobacterium
SDRFPGEDQAPAH

SEQ ID NO: 576495 - protein, 6 aa, Mycobacterium
SDRGAD

SEQ ID NO: 576496 - protein, 9 aa, Mycobacterium
SDRGARAAA

SEQ ID NO: 576497 - protein, 8 aa, Mycobacterium
SDRGDAER

SEQ ID NO: 576498 - protein, 11 aa, Mycobacterium
SDRGDAPDALS

SEQ ID NO: 576499 - protein, 6 aa, Mycobacterium
SDRGET

SEQ ID NO: 576500 - protein, 7 aa, Mycobacterium
SDRGGAI

SEQ ID NO: 576501 - protein, 8 aa, Mycobacterium
SDRGGERL

SEQ ID NO: 576502 - protein, 6 aa, Mycobacterium
SDRGKY

SEQ ID NO: 576503 - protein, 7 aa, Mycobacterium
SDRGLAE

SEQ ID NO: 576504 - protein, 8 aa, Mycobacterium
SDRGLAPR

SEQ ID NO: 576505 - protein, 9 aa, Mycobacterium
SDRGLGPRA

SEQ ID NO: 576506 - protein, 6 aa, Mycobacterium
SDRGLT

SEQ ID NO: 576507 - protein, 5 aa, Mycobacterium
SDRGM

SEQ ID NO: 576508 - protein, 7 aa, Mycobacterium
SDRGRSW

SEQ ID NO: 576509 - protein, 7 aa, Mycobacterium
SDRGRVD

SEQ ID NO: 576510 - protein, 5 aa, Mycobacterium
SDRGW

SEQ ID NO: 576511 - protein, 5 aa, Mycobacterium
SDRIG

SEQ ID NO: 576512 - protein, 10 aa, Mycobacterium
SDRKDEAATV

SEQ ID NO: 576513 - protein, 6 aa, Mycobacterium
SDRKLT

SEQ ID NO: 576514 - protein, 6 aa, Mycobacterium
SDRKRY

SEQ ID NO: 576515 - protein, 5 aa, Mycobacterium
SDRLA

SEQ ID NO: 576516 - protein, 6 aa, Mycobacterium
SDRLAQ

SEQ ID NO: 576517 - protein, 7 aa, Mycobacterium
SDRLNQR

SEQ ID NO: 576518 - protein, 7 aa, Mycobacterium
SDRLSGI

SEQ ID NO: 576519 - protein, 7 aa, Mycobacterium
SDRLTDG

SEQ ID NO: 576520 - protein, 6 aa, Mycobacterium
SDRMGP

SEQ ID NO: 576521 - protein, 12 aa, Mycobacterium
SDRMTRPRPASL

SEQ ID NO: 576522 - protein, 6 aa, Mycobacterium
SDRNPR

SEQ ID NO: 576523 - protein, 4 aa, Mycobacterium
SDRP

SEQ ID NO: 576524 - protein, 7 aa, Mycobacterium
SDRPAAE

SEQ ID NO: 576525 - protein, 30 aa, Mycobacterium
SDRPADAAEPVAPSDDRGMHRATSADQDVQ

SEQ ID NO: 576526 - protein, 8 aa, Mycobacterium
SDRPAPTM

SEQ ID NO: 576527 - protein, 19 aa, Mycobacterium
SDRPCGGEQATFEEVRGGA

SEQ ID NO: 576528 - protein, 6 aa, Mycobacterium
SDRPDA

SEQ ID NO: 576529 - protein, 8 aa, Mycobacterium
SDRPDLVP

SEQ ID NO: 576530 - protein, 7 aa, Mycobacterium
SDRPDTV

SEQ ID NO: 576531 - protein, 8 aa, Mycobacterium
SDRPEDYR

SEQ ID NO: 576532 - protein, 5 aa, Mycobacterium
SDRPG

SEQ ID NO: 576533 - protein, 6 aa, Mycobacterium
SDRPGF

SEQ ID NO: 576534 - protein, 6 aa, Mycobacterium
SDRPGT

SEQ ID NO: 576535 - protein, 8 aa, Mycobacterium
SDRPMPAD

SEQ ID NO: 576536 - protein, 6 aa, Mycobacterium
SDRPNR

SEQ ID NO: 576537 - protein, 9 aa, Mycobacterium
SDRPPKGLA

SEQ ID NO: 576538 - protein, 8 aa, Mycobacterium
SDRPREDH

SEQ ID NO: 576539 - protein, 7 aa, Mycobacterium
SDRPRIP

SEQ ID NO: 576540 - protein, 8 aa, Mycobacterium
SDRPSSYA

SEQ ID NO: 576541 - protein, 8 aa, Mycobacterium
SDRPVGPR

SEQ ID NO: 576542 - protein, 6 aa, Mycobacterium
SDRQGL

SEQ ID NO: 576543 - protein, 5 aa, Mycobacterium
SDRQR

SEQ ID NO: 576544 - protein, 6 aa, Mycobacterium
SDRQRR

SEQ ID NO: 576545 - protein, 6 aa, Mycobacterium
SDRRDF

SEQ ID NO: 576546 - protein, 9 aa, Mycobacterium
SDRRGDQAP

SEQ ID NO: 576547 - protein, 6 aa, Mycobacterium
SDRRGE

SEQ ID NO: 576548 - protein, 12 aa, Mycobacterium
SDRRGKVPWTAD

SEQ ID NO: 576549 - protein, 15 aa, Mycobacterium
SDRRPMEDQADEYGD

SEQ ID NO: 576550 - protein, 9 aa, Mycobacterium
SDRRPRTPY

SEQ ID NO: 576551 - protein, 8 aa, Mycobacterium
SDRRQEIS

SEQ ID NO: 576552 - protein, 5 aa, Mycobacterium
SDRRR

SEQ ID NO: 576553 - protein, 6 aa, Mycobacterium
SDRRSQ

SEQ ID NO: 576554 - protein, 12 aa, Mycobacterium
SDRRSSGPEGRM

SEQ ID NO: 576555 - protein, 6 aa, Mycobacterium
SDRRTS

SEQ ID NO: 576556 - protein, 4 aa, Mycobacterium
SDRS

SEQ ID NO: 576557 - protein, 7 aa, Mycobacterium
SDRSARA

SEQ ID NO: 576558 - protein, 11 aa, Mycobacterium
SDRSDDPGVPD

SEQ ID NO: 576559 - protein, 7 aa, Mycobacterium
SDRSDRV

SEQ ID NO: 576560 - protein, 6 aa, Mycobacterium
SDRSDT

SEQ ID NO: 576561 - protein, 5 aa, Mycobacterium
SDRSL

SEQ ID NO: 576562 - protein, 9 aa, Mycobacterium
SDRSQPQTY

SEQ ID NO: 576563 - protein, 12 aa, Mycobacterium
SDRTEDDARANT

SEQ ID NO: 576564 - protein, 10 aa, Mycobacterium
SDRTENDTRA

SEQ ID NO: 576565 - protein, 6 aa, Mycobacterium
SDRTKA

SEQ ID NO: 576566 - protein, 6 aa, Mycobacterium
SDRTPE

SEQ ID NO: 576567 - protein, 6 aa, Mycobacterium
SDRTVT

SEQ ID NO: 576568 - protein, 14 aa, Mycobacterium
SDRTYGTLSEGERK

SEQ ID NO: 576569 - protein, 9 aa, Mycobacterium
SDRVSAETA

SEQ ID NO: 576570 - protein, 9 aa, Mycobacterium
SDRVSAGPL

SEQ ID NO: 576571 - protein, 4 aa, Mycobacterium
SDRY

SEQ ID NO: 576572 - protein, 7 aa, Mycobacterium
SDRYGHT

SEQ ID NO: 576573 - protein, 12 aa, Mycobacterium
SDRYPAEDQAPA

SEQ ID NO: 576574 - protein, 4 aa, Mycobacterium
SDSA

SEQ ID NO: 576575 - protein, 9 aa, Mycobacterium
SDSAAEAAL

SEQ ID NO: 576576 - protein, 13 aa, Mycobacterium
SDSADGKPNPASS

SEQ ID NO: 576577 - protein, 17 aa, Mycobacterium
SDSAESAKREIALWFPD

SEQ ID NO: 576578 - protein, 17 aa, Mycobacterium
SDSAESAQREIALWFPG

SEQ ID NO: 576579 - protein, 17 aa, Mycobacterium
SDSAESAQREIALWFPS

SEQ ID NO: 576580 - protein, 8 aa, Mycobacterium
SDSAGATH

SEQ ID NO: 576581 - protein, 17 aa, Mycobacterium
SDSAGDDGVGKNTGPIQ

SEQ ID NO: 576582 - protein, 5 aa, Mycobacterium
SDSAM

SEQ ID NO: 576583 - protein, 14 aa, Mycobacterium
SDSAPQLGADPQAR

SEQ ID NO: 576584 - protein, 15 aa, Mycobacterium
SDSDAAGAAAQRGLS

SEQ ID NO: 576585 - protein, 9 aa, Mycobacterium
SDSDCAPQW

SEQ ID NO: 576586 - protein, 9 aa, Mycobacterium
SDSDDGAEE

SEQ ID NO: 576587 - protein, 17 aa, Mycobacterium
SDSDEEFGPTPRRGFRS

SEQ ID NO: 576588 - protein, 6 aa, Mycobacterium
SDSDER

SEQ ID NO: 576589 - protein, 6 aa, Mycobacterium
SDSDPE

SEQ ID NO: 576590 - protein, 5 aa, Mycobacterium
SDSDT

SEQ ID NO: 576591 - protein, 5 aa, Mycobacterium
SDSDV

SEQ ID NO: 576592 - protein, 10 aa, Mycobacterium
SDSDWDREKL

SEQ ID NO: 576593 - protein, 20 aa, Mycobacterium
SDSEADAAEVERTCGAGARG

SEQ ID NO: 576594 - protein, 5 aa, Mycobacterium
SDSEK

SEQ ID NO: 576595 - protein, 6 aa, Mycobacterium
SDSERE

SEQ ID NO: 576596 - protein, 7 aa, Mycobacterium
SDSEVTH

SEQ ID NO: 576597 - protein, 9 aa, Mycobacterium
SDSFEGRSS

SEQ ID NO: 576598 - protein, 8 aa, Mycobacterium
SDSGAAGA

SEQ ID NO: 576599 - protein, 11 aa, Mycobacterium
SDSGAAPDPGA

SEQ ID NO: 576600 - protein, 6 aa, Mycobacterium
SDSGAE

SEQ ID NO: 576601 - protein, 10 aa, Mycobacterium
SDSGAGSGTT

SEQ ID NO: 576602 - protein, 8 aa, Mycobacterium
SDSGGQTE

SEQ ID NO: 576603 - protein, 6 aa, Mycobacterium
SDSGLD

SEQ ID NO: 576604 - protein, 7 aa, Mycobacterium
SDSGRAV

SEQ ID NO: 576605 - protein, 7 aa, Mycobacterium
SDSGRIP

SEQ ID NO: 576606 - protein, 15 aa, Mycobacterium
SDSGSAPEPQSDPSV

SEQ ID NO: 576607 - protein, 6 aa, Mycobacterium
SDSGVR

SEQ ID NO: 576608 - protein, 6 aa, Mycobacterium
SDSGYA

SEQ ID NO: 576609 - protein, 8 aa, Mycobacterium
SDSGYARY

SEQ ID NO: 576610 - protein, 6 aa, Mycobacterium
SDSGYQ

SEQ ID NO: 576611 - protein, 7 aa, Mycobacterium
SDSGYSE

SEQ ID NO: 576612 - protein, 4 aa, Mycobacterium
SDSH

SEQ ID NO: 576613 - protein, 15 aa, Mycobacterium
SDSHESGKLPGTDIR

SEQ ID NO: 576614 - protein, 5 aa, Mycobacterium
SDSHP

SEQ ID NO: 576615 - protein, 10 aa, Mycobacterium
SDSIDDPAGI

SEQ ID NO: 576616 - protein, 17 aa, Mycobacterium
SDSIESAKREIGLWFPD

SEQ ID NO: 576617 - protein, 10 aa, Mycobacterium
SDSKAQQAER

SEQ ID NO: 576618 - protein, 6 aa, Mycobacterium
SDSLRQ

SEQ ID NO: 576619 - protein, 5 aa, Mycobacterium
SDSMS

SEQ ID NO: 576620 - protein, 21 aa, Mycobacterium
SDSNAYGPSQLDGGPLHATRG

SEQ ID NO: 576621 - protein, 13 aa, Mycobacterium
SDSNWPNSRKRAA

SEQ ID NO: 576622 - protein, 4 aa, Mycobacterium
SDSP

SEQ ID NO: 576623 - protein, 8 aa, Mycobacterium
SDSPGGVG

SEQ ID NO: 576624 - protein, 10 aa, Mycobacterium
SDSPKPPPRR

SEQ ID NO: 576625 - protein, 7 aa, Mycobacterium
SDSPVTD

SEQ ID NO: 576626 - protein, 9 aa, Mycobacterium
SDSQLEENP

SEQ ID NO: 576627 - protein, 6 aa, Mycobacterium
SDSQTI

SEQ ID NO: 576628 - protein, 5 aa, Mycobacterium
SDSRA

SEQ ID NO: 576629 - protein, 6 aa, Mycobacterium
SDSRAI

SEQ ID NO: 576630 - protein, 9 aa, Mycobacterium
SDSRLDTPD

SEQ ID NO: 576631 - protein, 12 aa, Mycobacterium
SDSRPGPSTSTH

SEQ ID NO: 576632 - protein, 9 aa, Mycobacterium
SDSRRNSPL

SEQ ID NO: 576633 - protein, 17 aa, Mycobacterium
SDSRTDAHGNPLSDQER

SEQ ID NO: 576634 - protein, 10 aa, Mycobacterium
SDSSGTTDNV

SEQ ID NO: 576635 - protein, 7 aa, Mycobacterium
SDSSGYV

SEQ ID NO: 576636 - protein, 8 aa, Mycobacterium
SDSSHAPA

SEQ ID NO: 576637 - protein, 9 aa, Mycobacterium
SDSSPSAVA

SEQ ID NO: 576638 - protein, 8 aa, Mycobacterium
SDSSSPTV

SEQ ID NO: 576639 - protein, 8 aa, Mycobacterium
SDSTDNSM

SEQ ID NO: 576640 - protein, 6 aa, Mycobacterium
SDSTGK

SEQ ID NO: 576641 - protein, 8 aa, Mycobacterium
SDSTSLNT

SEQ ID NO: 576642 - protein, 9 aa, Mycobacterium
SDSTTLGDG

SEQ ID NO: 576643 - protein, 7 aa, Mycobacterium
SDSVEDT

SEQ ID NO: 576644 - protein, 7 aa, Mycobacterium
SDSVPDP

SEQ ID NO: 576645 - protein, 5 aa, Mycobacterium
SDSVT

SEQ ID NO: 576646 - protein, 7 aa, Mycobacterium
SDSYADD

SEQ ID NO: 576647 - protein, 12 aa, Mycobacterium
SDSYDQQSRNPE

SEQ ID NO: 576648 - protein, 8 aa, Mycobacterium
SDSYYGRE

SEQ ID NO: 576649 - protein, 4 aa, Mycobacterium
SDTA

SEQ ID NO: 576650 - protein, 14 aa, Mycobacterium
SDTAADVSPIGTPL

SEQ ID NO: 576651 - protein, 12 aa, Mycobacterium
SDTAARPLTGTP

SEQ ID NO: 576652 - protein, 22 aa, Mycobacterium
SDTADAPKSAQEKAAESTAPHK

SEQ ID NO: 576653 - protein, 7 aa, Mycobacterium
SDTADTV

SEQ ID NO: 576654 - protein, 7 aa, Mycobacterium
SDTADYT

SEQ ID NO: 576655 - protein, 11 aa, Mycobacterium
SDTAEAGGKVI

SEQ ID NO: 576656 - protein, 23 aa, Mycobacterium
SDTAEAPKNAEEQAAESSAPHKV

SEQ ID NO: 576657 - protein, 22 aa, Mycobacterium
SDTAEAPKSAEEKAAESTAPHK

SEQ ID NO: 576658 - protein, 23 aa, Mycobacterium
SDTAEAPKSAQEKAAESTAPHKV

SEQ ID NO: 576659 - protein, 8 aa, Mycobacterium
SDTAGATH

SEQ ID NO: 576660 - protein, 8 aa, Mycobacterium
SDTAGIDA

SEQ ID NO: 576661 - protein, 11 aa, Mycobacterium
SDTAMEQRAQQ

SEQ ID NO: 576662 - protein, 10 aa, Mycobacterium
SDTAPRDEEP

SEQ ID NO: 576663 - protein, 7 aa, Mycobacterium
SDTASVS

SEQ ID NO: 576664 - protein, 4 aa, Mycobacterium
SDTD

SEQ ID NO: 576665 - protein, 13 aa, Mycobacterium
SDTDAGVAHTRPG

SEQ ID NO: 576666 - protein, 9 aa, Mycobacterium
SDTDEVRSA

SEQ ID NO: 576667 - protein, 10 aa, Mycobacterium
SDTDGSVDGA

SEQ ID NO: 576668 - protein, 10 aa, Mycobacterium
SDTDGTEGQT

SEQ ID NO: 576669 - protein, 7 aa, Mycobacterium
SDTDNDL

SEQ ID NO: 576670 - protein, 11 aa, Mycobacterium
SDTDNDLTDHP

SEQ ID NO: 576671 - protein, 17 aa, Mycobacterium
SDTDPAASEAFSADDYT

SEQ ID NO: 576672 - protein, 8 aa, Mycobacterium
SDTDPGYH

SEQ ID NO: 576673 - protein, 8 aa, Mycobacterium
SDTDPVKV

SEQ ID NO: 576674 - protein, 6 aa, Mycobacterium
SDTDVE

SEQ ID NO: 576675 - protein, 14 aa, Mycobacterium
SDTDVTKVDDSVEP

SEQ ID NO: 576676 - protein, 11 aa, Mycobacterium
SDTEASAALAQ

SEQ ID NO: 576677 - protein, 7 aa, Mycobacterium
SDTEGYD

SEQ ID NO: 576678 - protein, 8 aa, Mycobacterium
SDTERQRV

SEQ ID NO: 576679 - protein, 8 aa, Mycobacterium
SDTESAGA

SEQ ID NO: 576680 - protein, 6 aa, Mycobacterium
SDTESI

SEQ ID NO: 576681 - protein, 20 aa, Mycobacterium
SDTETGDRDELTPGVPDRSW

SEQ ID NO: 576682 - protein, 7 aa, Mycobacterium
SDTEYDE

SEQ ID NO: 576683 - protein, 8 aa, Mycobacterium
SDTEYDEH

SEQ ID NO: 576684 - protein, 4 aa, Mycobacterium
SDTF

SEQ ID NO: 576685 - protein, 17 aa, Mycobacterium
SDTFGATADEPEAACCR

SEQ ID NO: 576686 - protein, 17 aa, Mycobacterium
SDTFGVSPQHSDGGAEG

SEQ ID NO: 576687 - protein, 11 aa, Mycobacterium
SDTFKSNYEVQ

SEQ ID NO: 576688 - protein, 12 aa, Mycobacterium
SDTGADQRRAPH

SEQ ID NO: 576689 - protein, 8 aa, Mycobacterium
SDTGAGSS

SEQ ID NO: 576690 - protein, 10 aa, Mycobacterium
SDTGAGSSTT

SEQ ID NO: 576691 - protein, 7 aa, Mycobacterium
SDTGAQV

SEQ ID NO: 576692 - protein, 6 aa, Mycobacterium
SDTGDV

SEQ ID NO: 576693 - protein, 10 aa, Mycobacterium
SDTGFDRSRT

SEQ ID NO: 576694 - protein, 10 aa, Mycobacterium
SDTGGKISSA

SEQ ID NO: 576695 - protein, 11 aa, Mycobacterium
SDTGGYTPPWP

SEQ ID NO: 576696 - protein, 12 aa, Mycobacterium
SDTGKPGPAEMI

SEQ ID NO: 576697 - protein, 7 aa, Mycobacterium
SDTGRGF

SEQ ID NO: 576698 - protein, 7 aa, Mycobacterium
SDTGRLD

SEQ ID NO: 576699 - protein, 6 aa, Mycobacterium
SDTGRW

SEQ ID NO: 576700 - protein, 11 aa, Mycobacterium
SDTGTGVPADE

SEQ ID NO: 576701 - protein, 9 aa, Mycobacterium
SDTGVPRPG

SEQ ID NO: 576702 - protein, 6 aa, Mycobacterium
SDTHPQ

SEQ ID NO: 576703 - protein, 6 aa, Mycobacterium
SDTHPR

SEQ ID NO: 576704 - protein, 15 aa, Mycobacterium
SDTHTDTEKPDTWQA

SEQ ID NO: 576705 - protein, 23 aa, Mycobacterium
SDTKPDEDAELADETKEGEEDAM

SEQ ID NO: 576706 - protein, 15 aa, Mycobacterium
SDTNDRRAHPPTRTS

SEQ ID NO: 576707 - protein, 6 aa, Mycobacterium
SDTNVT

SEQ ID NO: 576708 - protein, 10 aa, Mycobacterium
SDTPAKSGQG

SEQ ID NO: 576709 - protein, 7 aa, Mycobacterium
SDTPEGI

SEQ ID NO: 576710 - protein, 8 aa, Mycobacterium
SDTPGAPA

SEQ ID NO: 576711 - protein, 9 aa, Mycobacterium
SDTPGSNQG

SEQ ID NO: 576712 - protein, 9 aa, Mycobacterium
SDTPRAEAA

SEQ ID NO: 576713 - protein, 14 aa, Mycobacterium
SDTPTAPAAPPFPY

SEQ ID NO: 576714 - protein, 7 aa, Mycobacterium
SDTPTVA

SEQ ID NO: 576715 - protein, 7 aa, Mycobacterium
SDTPVTS

SEQ ID NO: 576716 - protein, 9 aa, Mycobacterium
SDTPVVDTG

SEQ ID NO: 576717 - protein, 8 aa, Mycobacterium
SDTQGMGR

SEQ ID NO: 576718 - protein, 9 aa, Mycobacterium
SDTQGRGHI

SEQ ID NO: 576719 - protein, 6 aa, Mycobacterium
SDTQTI

SEQ ID NO: 576720 - protein, 16 aa, Mycobacterium
SDTRDYSAAAETEQFD

SEQ ID NO: 576721 - protein, 5 aa, Mycobacterium
SDTRG

SEQ ID NO: 576722 - protein, 10 aa, Mycobacterium
SDTRGELTEV

SEQ ID NO: 576723 - protein, 9 aa, Mycobacterium
SDTRPAARR

SEQ ID NO: 576724 - protein, 6 aa, Mycobacterium
SDTSAY

SEQ ID NO: 576725 - protein, 12 aa, Mycobacterium
SDTSDVTTDRHP

SEQ ID NO: 576726 - protein, 10 aa, Mycobacterium
SDTSEAGGKV

SEQ ID NO: 576727 - protein, 10 aa, Mycobacterium
SDTSQSGGRV

SEQ ID NO: 576728 - protein, 9 aa, Mycobacterium
SDTTTGAPM

SEQ ID NO: 576729 - protein, 6 aa, Mycobacterium
SDTTTM

SEQ ID NO: 576730 - protein, 9 aa, Mycobacterium
SDVADGSFG

SEQ ID NO: 576731 - protein, 10 aa, Mycobacterium
SDVADPGSDA

SEQ ID NO: 576732 - protein, 13 aa, Mycobacterium
SDVAGASAQRGLN

SEQ ID NO: 576733 - protein, 5 aa, Mycobacterium
SDVAR

SEQ ID NO: 576734 - protein, 5 aa, Mycobacterium
SDVAS

SEQ ID NO: 576735 - protein, 6 aa, Mycobacterium
SDVDDA

SEQ ID NO: 576736 - protein, 13 aa, Mycobacterium
SDVDGARANELAD

SEQ ID NO: 576737 - protein, 6 aa, Mycobacterium
SDVDRA

SEQ ID NO: 576738 - protein, 45 aa, Mycobacterium
SDVDRPPEAAAAAAVPPTETHPEPTGGRRARRRADQAADATPTTV

SEQ ID NO: 576739 - protein, 4 aa, Mycobacterium
SDVE

SEQ ID NO: 576740 - protein, 10 aa, Mycobacterium
SDVEANRRSH

SEQ ID NO: 576741 - protein, 7 aa, Mycobacterium
SDVEGNT

SEQ ID NO: 576742 - protein, 8 aa, Mycobacterium
SDVFTSEA

SEQ ID NO: 576743 - protein, 5 aa, Mycobacterium
SDVGA

SEQ ID NO: 576744 - protein, 12 aa, Mycobacterium
SDVGAGRDTAKS

SEQ ID NO: 576745 - protein, 6 aa, Mycobacterium
SDVGAS

SEQ ID NO: 576746 - protein, 9 aa, Mycobacterium
SDVGDEEQV

SEQ ID NO: 576747 - protein, 5 aa, Mycobacterium
SDVGG

SEQ ID NO: 576748 - protein, 28 aa, Mycobacterium
SDVGNANIGDQNVGSGNIGSGNVGSGNI

SEQ ID NO: 576749 - protein, 8 aa, Mycobacterium
SDVGRQVD

SEQ ID NO: 576750 - protein, 6 aa, Mycobacterium
SDVGRS

SEQ ID NO: 576751 - protein, 6 aa, Mycobacterium
SDVHNP

SEQ ID NO: 576752 - protein, 6 aa, Mycobacterium
SDVKDG

SEQ ID NO: 576753 - protein, 10 aa, Mycobacterium
SDVPDQTGKT

SEQ ID NO: 576754 - protein, 18 aa, Mycobacterium
SDVPHPAEQAETPTGQQQ

SEQ ID NO: 576755 - protein, 10 aa, Mycobacterium
SDVPKKKPRP

SEQ ID NO: 576756 - protein, 6 aa, Mycobacterium
SDVPVQ

SEQ ID NO: 576757 - protein, 8 aa, Mycobacterium
SDVQRTPL

SEQ ID NO: 576758 - protein, 13 aa, Mycobacterium
SDVRKSVQNLAAL

SEQ ID NO: 576759 - protein, 5 aa, Mycobacterium
SDVRP

SEQ ID NO: 576760 - protein, 4 aa, Mycobacterium
SDVS

SEQ ID NO: 576761 - protein, 12 aa, Mycobacterium
SDVSDRKGLSDK

SEQ ID NO: 576762 - protein, 9 aa, Mycobacterium
SDVSKSFGG

SEQ ID NO: 576763 - protein, 4 aa, Mycobacterium
SDVT

SEQ ID NO: 576764 - protein, 19 aa, Mycobacterium
SDVTNRKQLSDKISEHRRQ

SEQ ID NO: 576765 - protein, 7 aa, Mycobacterium
SDVTPTG

SEQ ID NO: 576766 - protein, 15 aa, Mycobacterium
SDVTSQSAALPTPQV

SEQ ID NO: 576767 - protein, 9 aa, Mycobacterium
SDVVANGSA

SEQ ID NO: 576768 - protein, 7 aa, Mycobacterium
SDWEAAA

SEQ ID NO: 576769 - protein, 4 aa, Mycobacterium
SDWG

SEQ ID NO: 576770 - protein, 9 aa, Mycobacterium
SDWGTQTGA

SEQ ID NO: 576771 - protein, 7 aa, Mycobacterium
SDWPGGA

SEQ ID NO: 576772 - protein, 7 aa, Mycobacterium
SDWPRTD

SEQ ID NO: 576773 - protein, 13 aa, Mycobacterium
SDWPRYSGKAIAG

SEQ ID NO: 576774 - protein, 4 aa, Mycobacterium
SDWS

SEQ ID NO: 576775 - protein, 17 aa, Mycobacterium
SDWSERSAGTNAPGTAL

SEQ ID NO: 576776 - protein, 6 aa, Mycobacterium
SDWSPL

SEQ ID NO: 576777 - protein, 6 aa, Mycobacterium
SDYAGR

SEQ ID NO: 576778 - protein, 9 aa, Mycobacterium
SDYAPDGSF

SEQ ID NO: 576779 - protein, 10 aa, Mycobacterium
SDYDATKGSP

SEQ ID NO: 576780 - protein, 24 aa, Mycobacterium
SDYDEKDHEVVGEPDPLIVGRALA

SEQ ID NO: 576781 - protein, 10 aa, Mycobacterium
SDYDESTGIP

SEQ ID NO: 576782 - protein, 8 aa, Mycobacterium
SDYDGPEM

SEQ ID NO: 576783 - protein, 12 aa, Mycobacterium
SDYDVRQKARPS

SEQ ID NO: 576784 - protein, 15 aa, Mycobacterium
SDYGDQGARSKPTIS

SEQ ID NO: 576785 - protein, 8 aa, Mycobacterium
SDYGDWPR

SEQ ID NO: 576786 - protein, 9 aa, Mycobacterium
SDYGPGQNY

SEQ ID NO: 576787 - protein, 6 aa, Mycobacterium
SDYGSS

SEQ ID NO: 576788 - protein, 15 aa, Mycobacterium
SDYHPERPGGSAVGR

SEQ ID NO: 576789 - protein, 5 aa, Mycobacterium
SDYKG

SEQ ID NO: 576790 - protein, 12 aa, Mycobacterium
SDYMRSASADDR

SEQ ID NO: 576791 - protein, 4 aa, Mycobacterium
SDYP

SEQ ID NO: 576792 - protein, 8 aa, Mycobacterium
SDYPAGVA

SEQ ID NO: 576793 - protein, 6 aa, Mycobacterium
SDYPDG

SEQ ID NO: 576794 - protein, 8 aa, Mycobacterium
SDYPPGVA

SEQ ID NO: 576795 - protein, 17 aa, Mycobacterium
SDYRASRDQSLNDGEGW

SEQ ID NO: 576796 - protein, 5 aa, Mycobacterium
SDYRG

SEQ ID NO: 576797 - protein, 19 aa, Mycobacterium
SDYSEDKTVDETLSTDQPL

SEQ ID NO: 576798 - protein, 4 aa, Mycobacterium
SDYV

SEQ ID NO: 576799 - protein, 6 aa, Mycobacterium
SEAAAD

SEQ ID NO: 576800 - protein, 8 aa, Mycobacterium
SEAAADRV

SEQ ID NO: 576801 - protein, 10 aa, Mycobacterium
SEAAAEVPES

SEQ ID NO: 576802 - protein, 7 aa, Mycobacterium
SEAAAHG

SEQ ID NO: 576803 - protein, 21 aa, Mycobacterium
SEAAAKVRNQINEQVEGSEEV

SEQ ID NO: 576804 - protein, 9 aa, Mycobacterium
SEAAATGEI

SEQ ID NO: 576805 - protein, 13 aa, Mycobacterium
SEAAGAGSPPPRR

SEQ ID NO: 576806 - protein, 7 aa, Mycobacterium
SEAAGNG

SEQ ID NO: 576807 - protein, 9 aa, Mycobacterium
SEAAGPPGD

SEQ ID NO: 576808 - protein, 6 aa, Mycobacterium
SEAAIT

SEQ ID NO: 576809 - protein, 10 aa, Mycobacterium
SEAAKEGKDV

SEQ ID NO: 576810 - protein, 20 aa, Mycobacterium
SEAAKGDESPSESPQFDKRS

SEQ ID NO: 576811 - protein, 5 aa, Mycobacterium
SEAAM

SEQ ID NO: 576812 - protein, 5 aa, Mycobacterium
SEAAN

SEQ ID NO: 576813 - protein, 95 aa, Mycobacterium
SEAAPVASPPAEAAPPPPPAAAPPSAPTPPPAAAPPPRQAEPRPVPAPAPEAKPVTPEPDPEPPPPMRAPAAPAVEAPPATPAAAVAAGEPNAAA

SEQ ID NO: 576814 - protein, 9 aa, Mycobacterium
SEAAQGNYA

SEQ ID NO: 576815 - protein, 6 aa, Mycobacterium
SEAAQQ

SEQ ID NO: 576816 - protein, 7 aa, Mycobacterium
SEAARAD

SEQ ID NO: 576817 - protein, 8 aa, Mycobacterium
SEAARADL

SEQ ID NO: 576818 - protein, 7 aa, Mycobacterium
SEAARQG

SEQ ID NO: 576819 - protein, 9 aa, Mycobacterium
SEAARRYER

SEQ ID NO: 576820 - protein, 14 aa, Mycobacterium
SEAARRYERGVDPA

SEQ ID NO: 576821 - protein, 5 aa, Mycobacterium
SEAAT

SEQ ID NO: 576822 - protein, 5 aa, Mycobacterium
SEAAV

SEQ ID NO: 576823 - protein, 6 aa, Mycobacterium
SEAAVT

SEQ ID NO: 576824 - protein, 8 aa, Mycobacterium
SEADERGM

SEQ ID NO: 576825 - protein, 15 aa, Mycobacterium
SEADERLTESVSRAA

SEQ ID NO: 576826 - protein, 6 aa, Mycobacterium
SEADGD

SEQ ID NO: 576827 - protein, 9 aa, Mycobacterium
SEADKMDPQ

SEQ ID NO: 576828 - protein, 7 aa, Mycobacterium
SEADSPL

SEQ ID NO: 576829 - protein, 8 aa, Mycobacterium
SEADTRKI

SEQ ID NO: 576830 - protein, 13 aa, Mycobacterium
SEADTTSDFPTDR

SEQ ID NO: 576831 - protein, 5 aa, Mycobacterium
SEAEA

SEQ ID NO: 576832 - protein, 6 aa, Mycobacterium
SEAEAG

SEQ ID NO: 576833 - protein, 6 aa, Mycobacterium
SEAEEL

SEQ ID NO: 576834 - protein, 6 aa, Mycobacterium
SEAEFG

SEQ ID NO: 576835 - protein, 6 aa, Mycobacterium
SEAEGR

SEQ ID NO: 576836 - protein, 12 aa, Mycobacterium
SEAENELREQGV

SEQ ID NO: 576837 - protein, 5 aa, Mycobacterium
SEAEP

SEQ ID NO: 576838 - protein, 7 aa, Mycobacterium
SEAEQSA

SEQ ID NO: 576839 - protein, 7 aa, Mycobacterium
SEAERHQ

SEQ ID NO: 576840 - protein, 8 aa, Mycobacterium
SEAERHQR

SEQ ID NO: 576841 - protein, 8 aa, Mycobacterium
SEAERNAF

SEQ ID NO: 576842 - protein, 8 aa, Mycobacterium
SEAESREL

SEQ ID NO: 576843 - protein, 5 aa, Mycobacterium
SEAEV

SEQ ID NO: 576844 - protein, 4 aa, Mycobacterium
SEAG

SEQ ID NO: 576845 - protein, 5 aa, Mycobacterium
SEAGA

SEQ ID NO: 576846 - protein, 15 aa, Mycobacterium
SEAGAADLARASTYT

SEQ ID NO: 576847 - protein, 6 aa, Mycobacterium
SEAGAE

SEQ ID NO: 576848 - protein, 12 aa, Mycobacterium
SEAGAGGKLPAP

SEQ ID NO: 576849 - protein, 24 aa, Mycobacterium
SEAGAGSDFSSATTTATPDGKGGY

SEQ ID NO: 576850 - protein, 13 aa, Mycobacterium
SEAGAGTEEPLPE

SEQ ID NO: 576851 - protein, 11 aa, Mycobacterium
SEAGASVYSAS

SEQ ID NO: 576852 - protein, 7 aa, Mycobacterium
SEAGDLR

SEQ ID NO: 576853 - protein, 12 aa, Mycobacterium
SEAGDPPPRDEE

SEQ ID NO: 576854 - protein, 8 aa, Mycobacterium
SEAGELGP

SEQ ID NO: 576855 - protein, 11 aa, Mycobacterium
SEAGEPAGIGG

SEQ ID NO: 576856 - protein, 5 aa, Mycobacterium
SEAGH

SEQ ID NO: 576857 - protein, 6 aa, Mycobacterium
SEAGIS

SEQ ID NO: 576858 - protein, 11 aa, Mycobacterium
SEAGISERTLP

SEQ ID NO: 576859 - protein, 13 aa, Mycobacterium
SEAGPREDLGARG

SEQ ID NO: 576860 - protein, 5 aa, Mycobacterium
SEAGR

SEQ ID NO: 576861 - protein, 6 aa, Mycobacterium
SEAGRE

SEQ ID NO: 576862 - protein, 6 aa, Mycobacterium
SEAGRL

SEQ ID NO: 576863 - protein, 9 aa, Mycobacterium
SEAGSRSEM

SEQ ID NO: 576864 - protein, 8 aa, Mycobacterium
SEAGVQAN

SEQ ID NO: 576865 - protein, 6 aa, Mycobacterium
SEAIRE

SEQ ID NO: 576866 - protein, 11 aa, Mycobacterium
SEAISTAGGTI

SEQ ID NO: 576867 - protein, 12 aa, Mycobacterium
SEAKAGKDAAEL

SEQ ID NO: 576868 - protein, 14 aa, Mycobacterium
SEAKAGKDAAELAG

SEQ ID NO: 576869 - protein, 8 aa, Mycobacterium
SEAKGDEF

SEQ ID NO: 576870 - protein, 9 aa, Mycobacterium
SEAKTTAVA

SEQ ID NO: 576871 - protein, 4 aa, Mycobacterium
SEAL

SEQ ID NO: 576872 - protein, 9 aa, Mycobacterium
SEALGPPSG

SEQ ID NO: 576873 - protein, 37 aa, Mycobacterium
SEALPEPSAAVPPAANVAPAPRRGGQHRKQSTSAAKG

SEQ ID NO: 576874 - protein, 11 aa, Mycobacterium
SEALRTGTTPE

SEQ ID NO: 576875 - protein, 5 aa, Mycobacterium
SEALS

SEQ ID NO: 576876 - protein, 7 aa, Mycobacterium
SEAMSAE

SEQ ID NO: 576877 - protein, 5 aa, Mycobacterium
SEAMT

SEQ ID NO: 576878 - protein, 6 aa, Mycobacterium
SEANDL

SEQ ID NO: 576879 - protein, 7 aa, Mycobacterium
SEANPLE

SEQ ID NO: 576880 - protein, 19 aa, Mycobacterium
SEANSVLSDPAKRKEYDET

SEQ ID NO: 576881 - protein, 4 aa, Mycobacterium
SEAP

SEQ ID NO: 576882 - protein, 7 aa, Mycobacterium
SEAPARA

SEQ ID NO: 576883 - protein, 8 aa, Mycobacterium
SEAPGYGT

SEQ ID NO: 576884 - protein, 10 aa, Mycobacterium
SEAPNDRRDR

SEQ ID NO: 576885 - protein, 13 aa, Mycobacterium
SEAPPAAAAATAA

SEQ ID NO: 576886 - protein, 9 aa, Mycobacterium
SEAPPLPTP

SEQ ID NO: 576887 - protein, 7 aa, Mycobacterium
SEAPRHQ

SEQ ID NO: 576888 - protein, 7 aa, Mycobacterium
SEAPSAE

SEQ ID NO: 576889 - protein, 16 aa, Mycobacterium
SEAPSAVAASPALPMG

SEQ ID NO: 576890 - protein, 8 aa, Mycobacterium
SEAPTFAD

SEQ ID NO: 576891 - protein, 5 aa, Mycobacterium
SEAQD

SEQ ID NO: 576892 - protein, 16 aa, Mycobacterium
SEAQGGDYDLSTAAGR

SEQ ID NO: 576893 - protein, 6 aa, Mycobacterium
SEAQGR

SEQ ID NO: 576894 - protein, 6 aa, Mycobacterium
SEAQQD

SEQ ID NO: 576895 - protein, 7 aa, Mycobacterium
SEAQQDR

SEQ ID NO: 576896 - protein, 11 aa, Mycobacterium
SEAQRQEVEDV

SEQ ID NO: 576897 - protein, 8 aa, Mycobacterium
SEAQSREL

SEQ ID NO: 576898 - protein, 8 aa, Mycobacterium
SEARPEEV

SEQ ID NO: 576899 - protein, 7 aa, Mycobacterium
SEARPSG

SEQ ID NO: 576900 - protein, 19 aa, Mycobacterium
SEARYGGTPGRVTVQEQGG

SEQ ID NO: 576901 - protein, 4 aa, Mycobacterium
SEAS

SEQ ID NO: 576902 - protein, 12 aa, Mycobacterium
SEASDGGRRGPV

SEQ ID NO: 576903 - protein, 9 aa, Mycobacterium
SEASRADVH

SEQ ID NO: 576904 - protein, 19 aa, Mycobacterium
SEASSAADHSAAAPIPTSS

SEQ ID NO: 576905 - protein, 5 aa, Mycobacterium
SEASV

SEQ ID NO: 576906 - protein, 6 aa, Mycobacterium
SEASYF

SEQ ID NO: 576907 - protein, 4 aa, Mycobacterium
SEAT

SEQ ID NO: 576908 - protein, 6 aa, Mycobacterium
SEATAV

SEQ ID NO: 576909 - protein, 5 aa, Mycobacterium
SEATD

SEQ ID NO: 576910 - protein, 6 aa, Mycobacterium
SEATGA

SEQ ID NO: 576911 - protein, 9 aa, Mycobacterium
SEATGRQRH

SEQ ID NO: 576912 - protein, 20 aa, Mycobacterium
SEATGTSARLTDQRSGESFD

SEQ ID NO: 576913 - protein, 10 aa, Mycobacterium
SEATPSPELA

SEQ ID NO: 576914 - protein, 10 aa, Mycobacterium
SEATPTLQPV

SEQ ID NO: 576915 - protein, 8 aa, Mycobacterium
SEATREVQ

SEQ ID NO: 576916 - protein, 19 aa, Mycobacterium
SEATRTAGIDPATAGGAHS

SEQ ID NO: 576917 - protein, 15 aa, Mycobacterium
SEATTAARHTTEALH

SEQ ID NO: 576918 - protein, 4 aa, Mycobacterium
SEAV

SEQ ID NO: 576919 - protein, 8 aa, Mycobacterium
SEAVSAGA

SEQ ID NO: 576920 - protein, 10 aa, Mycobacterium
SEAYGGTKET

SEQ ID NO: 576921 - protein, 15 aa, Mycobacterium
SECEDRRRDAAGAAA

SEQ ID NO: 576922 - protein, 4 aa, Mycobacterium
SECG

SEQ ID NO: 576923 - protein, 6 aa, Mycobacterium
SEDADL

SEQ ID NO: 576924 - protein, 9 aa, Mycobacterium
SEDADMGEA

SEQ ID NO: 576925 - protein, 15 aa, Mycobacterium
SEDAEGGVSPIGGPL

SEQ ID NO: 576926 - protein, 7 aa, Mycobacterium
SEDAELV

SEQ ID NO: 576927 - protein, 8 aa, Mycobacterium
SEDARASL

SEQ ID NO: 576928 - protein, 8 aa, Mycobacterium
SEDAREGP

SEQ ID NO: 576929 - protein, 14 aa, Mycobacterium
SEDATGAATEPPKG

SEQ ID NO: 576930 - protein, 6 aa, Mycobacterium
SEDDAA

SEQ ID NO: 576931 - protein, 17 aa, Mycobacterium
SEDDGAEKGSSYNKVRG

SEQ ID NO: 576932 - protein, 9 aa, Mycobacterium
SEDDGDRLT

SEQ ID NO: 576933 - protein, 18 aa, Mycobacterium
SEDDLQRPVGPAEGPWAD

SEQ ID NO: 576934 - protein, 8 aa, Mycobacterium
SEDDPKRR

SEQ ID NO: 576935 - protein, 6 aa, Mycobacterium
SEDDRF

SEQ ID NO: 576936 - protein, 9 aa, Mycobacterium
SEDDSPELR

SEQ ID NO: 576937 - protein, 5 aa, Mycobacterium
SEDDV

SEQ ID NO: 576938 - protein, 6 aa, Mycobacterium
SEDEAN

SEQ ID NO: 576939 - protein, 11 aa, Mycobacterium
SEDEAPNAKGV

SEQ ID NO: 576940 - protein, 6 aa, Mycobacterium
SEDEGA

SEQ ID NO: 576941 - protein, 18 aa, Mycobacterium
SEDEHQREQRARYEHRRD

SEQ ID NO: 576942 - protein, 5 aa, Mycobacterium
SEDEI

SEQ ID NO: 576943 - protein, 20 aa, Mycobacterium
SEDERRALKRRNARARARSA

SEQ ID NO: 576944 - protein, 20 aa, Mycobacterium
SEDERRALKRRNARTKARTG

SEQ ID NO: 576945 - protein, 20 aa, Mycobacterium
SEDERRALKRRNARTKARTN

SEQ ID NO: 576946 - protein, 9 aa, Mycobacterium
SEDERSAGG

SEQ ID NO: 576947 - protein, 9 aa, Mycobacterium
SEDESKTFT

SEQ ID NO: 576948 - protein, 9 aa, Mycobacterium
SEDETERAV

SEQ ID NO: 576949 - protein, 4 aa, Mycobacterium
SEDG

SEQ ID NO: 576950 - protein, 8 aa, Mycobacterium
SEDGDRAT

SEQ ID NO: 576951 - protein, 5 aa, Mycobacterium
SEDGP

SEQ ID NO: 576952 - protein, 20 aa, Mycobacterium
SEDGPVLDDRTDPHGNARSE

SEQ ID NO: 576953 - protein, 8 aa, Mycobacterium
SEDGRDRA

SEQ ID NO: 576954 - protein, 22 aa, Mycobacterium
SEDGRPAVGSAGSNQPPGPQFG

SEQ ID NO: 576955 - protein, 8 aa, Mycobacterium
SEDGSQVD

SEQ ID NO: 576956 - protein, 8 aa, Mycobacterium
SEDGSRVD

SEQ ID NO: 576957 - protein, 8 aa, Mycobacterium
SEDGSTVD

SEQ ID NO: 576958 - protein, 5 aa, Mycobacterium
SEDLK

SEQ ID NO: 576959 - protein, 5 aa, Mycobacterium
SEDLP

SEQ ID NO: 576960 - protein, 4 aa, Mycobacterium
SEDP

SEQ ID NO: 576961 - protein, 13 aa, Mycobacterium
SEDPAPRGSAPAQ

SEQ ID NO: 576962 - protein, 19 aa, Mycobacterium
SEDPDANGAVDPGPSAGPA

SEQ ID NO: 576963 - protein, 8 aa, Mycobacterium
SEDPHSWG

SEQ ID NO: 576964 - protein, 8 aa, Mycobacterium
SEDPREWG

SEQ ID NO: 576965 - protein, 9 aa, Mycobacterium
SEDPSDPGL

SEQ ID NO: 576966 - protein, 8 aa, Mycobacterium
SEDQELGG

SEQ ID NO: 576967 - protein, 8 aa, Mycobacterium
SEDQGPRL

SEQ ID NO: 576968 - protein, 10 aa, Mycobacterium
SEDQPDGLPG

SEQ ID NO: 576969 - protein, 6 aa, Mycobacterium
SEDQQE

SEQ ID NO: 576970 - protein, 9 aa, Mycobacterium
SEDRDPQDV

SEQ ID NO: 576971 - protein, 14 aa, Mycobacterium
SEDRPDDAPAPYAT

SEQ ID NO: 576972 - protein, 4 aa, Mycobacterium
SEDS

SEQ ID NO: 576973 - protein, 20 aa, Mycobacterium
SEDSEATVTAGNASGQNDAA

SEQ ID NO: 576974 - protein, 8 aa, Mycobacterium
SEDSRTVA

SEQ ID NO: 576975 - protein, 9 aa, Mycobacterium
SEDTKTRPP

SEQ ID NO: 576976 - protein, 4 aa, Mycobacterium
SEDV

SEQ ID NO: 576977 - protein, 9 aa, Mycobacterium
SEDVEGPRA

SEQ ID NO: 576978 - protein, 7 aa, Mycobacterium
SEDVPAD

SEQ ID NO: 576979 - protein, 10 aa, Mycobacterium
SEDVQGVPGA

SEQ ID NO: 576980 - protein, 7 aa, Mycobacterium
SEDVRTA

SEQ ID NO: 576981 - protein, 7 aa, Mycobacterium
SEDYASA

SEQ ID NO: 576982 - protein, 5 aa, Mycobacterium
SEDYD

SEQ ID NO: 576983 - protein, 20 aa, Mycobacterium
SEDYSGAQREFNDDDWKGAT

SEQ ID NO: 576984 - protein, 6 aa, Mycobacterium
SEEAAE

SEQ ID NO: 576985 - protein, 13 aa, Mycobacterium
SEEAGKSQGLTPR

SEQ ID NO: 576986 - protein, 19 aa, Mycobacterium
SEEAGNTRPRYAAEVARRN

SEQ ID NO: 576987 - protein, 5 aa, Mycobacterium
SEEAH

SEQ ID NO: 576988 - protein, 36 aa, Mycobacterium
SEEAKTALAAGAELAGTGICSGEGGMLPEEQQENSR

SEQ ID NO: 576989 - protein, 12 aa, Mycobacterium
SEEAPKDGARHP

SEQ ID NO: 576990 - protein, 6 aa, Mycobacterium
SEEASL

SEQ ID NO: 576991 - protein, 18 aa, Mycobacterium
SEEDADGIGSWGHPDRTY

SEQ ID NO: 576992 - protein, 16 aa, Mycobacterium
SEEDGAEKGTGYNKIR

SEQ ID NO: 576993 - protein, 12 aa, Mycobacterium
SEEDGPRVHPDD

SEQ ID NO: 576994 - protein, 7 aa, Mycobacterium
SEEDPAQ

SEQ ID NO: 576995 - protein, 9 aa, Mycobacterium
SEEDRAAGD

SEQ ID NO: 576996 - protein, 19 aa, Mycobacterium
SEEDVDSDENVATSREGGR

SEQ ID NO: 576997 - protein, 4 aa, Mycobacterium
SEEE

SEQ ID NO: 576998 - protein, 7 aa, Mycobacterium
SEEEQAK

SEQ ID NO: 576999 - protein, 5 aa, Mycobacterium
SEEEV

SEQ ID NO: 577000 - protein, 9 aa, Mycobacterium
SEEGADDPV

SEQ ID NO: 577001 - protein, 5 aa, Mycobacterium
SEEGC

SEQ ID NO: 577002 - protein, 5 aa, Mycobacterium
SEEGL

SEQ ID NO: 577003 - protein, 9 aa, Mycobacterium
SEEGNSELT

SEQ ID NO: 577004 - protein, 6 aa, Mycobacterium
SEEGPV

SEQ ID NO: 577005 - protein, 12 aa, Mycobacterium
SEEGVDDPARLD

SEQ ID NO: 577006 - protein, 4 aa, Mycobacterium
SEEH

SEQ ID NO: 577007 - protein, 17 aa, Mycobacterium
SEEHKDPTGSAGTDPDG

SEQ ID NO: 577008 - protein, 5 aa, Mycobacterium
SEEHS

SEQ ID NO: 577009 - protein, 4 aa, Mycobacterium
SEEI

SEQ ID NO: 577010 - protein, 29 aa, Mycobacterium
SEEKAAMARQAGATDAVQDAEDARAIGGR

SEQ ID NO: 577011 - protein, 8 aa, Mycobacterium
SEEKARAQ

SEQ ID NO: 577012 - protein, 13 aa, Mycobacterium
SEEKDEATAAAEQ

SEQ ID NO: 577013 - protein, 12 aa, Mycobacterium
SEEKDEATMAEE

SEQ ID NO: 577014 - protein, 27 aa, Mycobacterium
SEEKDEATMAEEQAALDAGQHAGGVEE

SEQ ID NO: 577015 - protein, 17 aa, Mycobacterium
SEEKDEATMAEEQAQME

SEQ ID NO: 577016 - protein, 12 aa, Mycobacterium
SEEKDESTMAEE

SEQ ID NO: 577017 - protein, 27 aa, Mycobacterium
SEEKDESTMAEEQAALEAGQHAGGVEE

SEQ ID NO: 577018 - protein, 14 aa, Mycobacterium
SEEKSAIATAAGAT

SEQ ID NO: 577019 - protein, 31 aa, Mycobacterium
SEEKTPPPGDATLPEPIPTTTPKQPAAGGGL

SEQ ID NO: 577020 - protein, 4 aa, Mycobacterium
SEEL

SEQ ID NO: 577021 - protein, 9 aa, Mycobacterium
SEELDADAG

SEQ ID NO: 577022 - protein, 7 aa, Mycobacterium
SEELDGY

SEQ ID NO: 577023 - protein, 8 aa, Mycobacterium
SEELGTDP

SEQ ID NO: 577024 - protein, 10 aa, Mycobacterium
SEELQKESGK

SEQ ID NO: 577025 - protein, 7 aa, Mycobacterium
SEELSAG

SEQ ID NO: 577026 - protein, 12 aa, Mycobacterium
SEENEPYSPDRA

SEQ ID NO: 577027 - protein, 4 aa, Mycobacterium
SEEP

SEQ ID NO: 577028 - protein, 7 aa, Mycobacterium
SEEPDVF

SEQ ID NO: 577029 - protein, 16 aa, Mycobacterium
SEEPGHEADSWTPDQT

SEQ ID NO: 577030 - protein, 7 aa, Mycobacterium
SEEPRHQ

SEQ ID NO: 577031 - protein, 9 aa, Mycobacterium
SEEPVAQNE

SEQ ID NO: 577032 - protein, 21 aa, Mycobacterium
SEEPVTEDEAAKIKDLIAALG

SEQ ID NO: 577033 - protein, 8 aa, Mycobacterium
SEEQGIPA

SEQ ID NO: 577034 - protein, 6 aa, Mycobacterium
SEEQKA

SEQ ID NO: 577035 - protein, 7 aa, Mycobacterium
SEEQKQE

SEQ ID NO: 577036 - protein, 6 aa, Mycobacterium
SEEQKR

SEQ ID NO: 577037 - protein, 6 aa, Mycobacterium
SEEQLT

SEQ ID NO: 577038 - protein, 7 aa, Mycobacterium
SEEQNRH

SEQ ID NO: 577039 - protein, 10 aa, Mycobacterium
SEEQPGSGPA

SEQ ID NO: 577040 - protein, 15 aa, Mycobacterium
SEEQQAQAMSLRSSI

SEQ ID NO: 577041 - protein, 9 aa, Mycobacterium
SEERERAAG

SEQ ID NO: 577042 - protein, 6 aa, Mycobacterium
SEERLG

SEQ ID NO: 577043 - protein, 6 aa, Mycobacterium
SEERRI

SEQ ID NO: 577044 - protein, 28 aa, Mycobacterium
SEERRSKLRTAPPQEPAASRETDPVGGQ

SEQ ID NO: 577045 - protein, 4 aa, Mycobacterium
SEES

SEQ ID NO: 577046 - protein, 8 aa, Mycobacterium
SEESAPID

SEQ ID NO: 577047 - protein, 7 aa, Mycobacterium
SEESATE

SEQ ID NO: 577048 - protein, 7 aa, Mycobacterium
SEESDVG

SEQ ID NO: 577049 - protein, 5 aa, Mycobacterium
SEESF

SEQ ID NO: 577050 - protein, 6 aa, Mycobacterium
SEESGL

SEQ ID NO: 577051 - protein, 7 aa, Mycobacterium
SEESITE

SEQ ID NO: 577052 - protein, 12 aa, Mycobacterium
SEESPPSVSAVG

SEQ ID NO: 577053 - protein, 22 aa, Mycobacterium
SEESVDAGESATAATSSAAAPK

SEQ ID NO: 577054 - protein, 18 aa, Mycobacterium
SEETASDINDNHRNSKYL

SEQ ID NO: 577055 - protein, 6 aa, Mycobacterium
SEETDL

SEQ ID NO: 577056 - protein, 6 aa, Mycobacterium
SEETLT

SEQ ID NO: 577057 - protein, 11 aa, Mycobacterium
SEETPQIDPDL

SEQ ID NO: 577058 - protein, 5 aa, Mycobacterium
SEEVE

SEQ ID NO: 577059 - protein, 7 aa, Mycobacterium
SEEWDEG

SEQ ID NO: 577060 - protein, 9 aa, Mycobacterium
SEEWQTGQV

SEQ ID NO: 577061 - protein, 4 aa, Mycobacterium
SEEY

SEQ ID NO: 577062 - protein, 14 aa, Mycobacterium
SEEYSAARREFNDD

SEQ ID NO: 577063 - protein, 4 aa, Mycobacterium
SEFA

SEQ ID NO: 577064 - protein, 7 aa, Mycobacterium
SEFDPDR

SEQ ID NO: 577065 - protein, 11 aa, Mycobacterium
SEFDSNQPIAA

SEQ ID NO: 577066 - protein, 12 aa, Mycobacterium
SEFDSNRPIAAP

SEQ ID NO: 577067 - protein, 17 aa, Mycobacterium
SEFDSNRPVAAPLSGDI

SEQ ID NO: 577068 - protein, 12 aa, Mycobacterium
SEFDSSTVDDDS

SEQ ID NO: 577069 - protein, 14 aa, Mycobacterium
SEFEDKDGNRRQVT

SEQ ID NO: 577070 - protein, 9 aa, Mycobacterium
SEFGDGSKL

SEQ ID NO: 577071 - protein, 9 aa, Mycobacterium
SEFGNGTTT

SEQ ID NO: 577072 - protein, 9 aa, Mycobacterium
SEFGPQGRT

SEQ ID NO: 577073 - protein, 5 aa, Mycobacterium
SEFGR

SEQ ID NO: 577074 - protein, 14 aa, Mycobacterium
SEFGRDTADIGDRE

SEQ ID NO: 577075 - protein, 4 aa, Mycobacterium
SEFP

SEQ ID NO: 577076 - protein, 5 aa, Mycobacterium
SEFPD

SEQ ID NO: 577077 - protein, 8 aa, Mycobacterium
SEFSGDRS

SEQ ID NO: 577078 - protein, 5 aa, Mycobacterium
SEFSR

SEQ ID NO: 577079 - protein, 14 aa, Mycobacterium
SEFSRSPGGPGRIT

SEQ ID NO: 577080 - protein, 11 aa, Mycobacterium
SEFSSNTEQIS

SEQ ID NO: 577081 - protein, 6 aa, Mycobacterium
SEFTAS

SEQ ID NO: 577082 - protein, 5 aa, Mycobacterium
SEFTH

SEQ ID NO: 577083 - protein, 14 aa, Mycobacterium
SEGAAAPGTDQQRI

SEQ ID NO: 577084 - protein, 11 aa, Mycobacterium
SEGAAGSNYER

SEQ ID NO: 577085 - protein, 5 aa, Mycobacterium
SEGAD

SEQ ID NO: 577086 - protein, 15 aa, Mycobacterium
SEGATPDIDVDTTSP

SEQ ID NO: 577087 - protein, 9 aa, Mycobacterium
SEGATVGLG

SEQ ID NO: 577088 - protein, 10 aa, Mycobacterium
SEGDAPGGNR

SEQ ID NO: 577089 - protein, 11 aa, Mycobacterium
SEGDGGAAERV

SEQ ID NO: 577090 - protein, 16 aa, Mycobacterium
SEGDGGSAKAGFGDSG

SEQ ID NO: 577091 - protein, 6 aa, Mycobacterium
SEGDHT

SEQ ID NO: 577092 - protein, 9 aa, Mycobacterium
SEGDPDYGV

SEQ ID NO: 577093 - protein, 6 aa, Mycobacterium
SEGDSW

SEQ ID NO: 577094 - protein, 7 aa, Mycobacterium
SEGEHGA

SEQ ID NO: 577095 - protein, 7 aa, Mycobacterium
SEGELPK

SEQ ID NO: 577096 - protein, 8 aa, Mycobacterium
SEGEPTAA

SEQ ID NO: 577097 - protein, 9 aa, Mycobacterium
SEGERRTAG

SEQ ID NO: 577098 - protein, 9 aa, Mycobacterium
SEGEVPPVK

SEQ ID NO: 577099 - protein, 15 aa, Mycobacterium
SEGEYKTDAAKAFGE

SEQ ID NO: 577100 - protein, 8 aa, Mycobacterium
SEGGAGSS

SEQ ID NO: 577101 - protein, 12 aa, Mycobacterium
SEGGAGTSGSET

SEQ ID NO: 577102 - protein, 5 aa, Mycobacterium
SEGGF

SEQ ID NO: 577103 - protein, 9 aa, Mycobacterium
SEGGGGDAT

SEQ ID NO: 577104 - protein, 10 aa, Mycobacterium
SEGGGVYSRE

SEQ ID NO: 577105 - protein, 8 aa, Mycobacterium
SEGGITEK

SEQ ID NO: 577106 - protein, 8 aa, Mycobacterium
SEGGITQN

SEQ ID NO: 577107 - protein, 8 aa, Mycobacterium
SEGGITQR

SEQ ID NO: 577108 - protein, 10 aa, Mycobacterium
SEGGNINATA

SEQ ID NO: 577109 - protein, 6 aa, Mycobacterium
SEGGPA

SEQ ID NO: 577110 - protein, 6 aa, Mycobacterium
SEGGRR

SEQ ID NO: 577111 - protein, 9 aa, Mycobacterium
SEGGSGREL

SEQ ID NO: 577112 - protein, 15 aa, Mycobacterium
SEGGSPGGHSTPAAL

SEQ ID NO: 577113 - protein, 7 aa, Mycobacterium
SEGGVHR

SEQ ID NO: 577114 - protein, 4 aa, Mycobacterium
SEGH

SEQ ID NO: 577115 - protein, 5 aa, Mycobacterium
SEGHR

SEQ ID NO: 577116 - protein, 5 aa, Mycobacterium
SEGIG

SEQ ID NO: 577117 - protein, 6 aa, Mycobacterium
SEGIRT

SEQ ID NO: 577118 - protein, 6 aa, Mycobacterium
SEGKDS

SEQ ID NO: 577119 - protein, 9 aa, Mycobacterium
SEGKRSTTR

SEQ ID NO: 577120 - protein, 9 aa, Mycobacterium
SEGLGPDYA

SEQ ID NO: 577121 - protein, 7 aa, Mycobacterium
SEGLPDG

SEQ ID NO: 577122 - protein, 11 aa, Mycobacterium
SEGLTAEEAEA

SEQ ID NO: 577123 - protein, 14 aa, Mycobacterium
SEGMAKAKRSLQDY

SEQ ID NO: 577124 - protein, 11 aa, Mycobacterium
SEGMTGPSGRP

SEQ ID NO: 577125 - protein, 6 aa, Mycobacterium
SEGNER

SEQ ID NO: 577126 - protein, 8 aa, Mycobacterium
SEGNFGNP

SEQ ID NO: 577127 - protein, 5 aa, Mycobacterium
SEGNG

SEQ ID NO: 577128 - protein, 7 aa, Mycobacterium
SEGNPTV

SEQ ID NO: 577129 - protein, 6 aa, Mycobacterium
SEGNTA

SEQ ID NO: 577130 - protein, 16 aa, Mycobacterium
SEGPAPVSEPGHPAAA

SEQ ID NO: 577131 - protein, 7 aa, Mycobacterium
SEGPQGP

SEQ ID NO: 577132 - protein, 7 aa, Mycobacterium
SEGPRRL

SEQ ID NO: 577133 - protein, 6 aa, Mycobacterium
SEGPVE

SEQ ID NO: 577134 - protein, 4 aa, Mycobacterium
SEGQ

SEQ ID NO: 577135 - protein, 7 aa, Mycobacterium
SEGQNLQ

SEQ ID NO: 577136 - protein, 9 aa, Mycobacterium
SEGRAHGLP

SEQ ID NO: 577137 - protein, 6 aa, Mycobacterium
SEGRDA

SEQ ID NO: 577138 - protein, 11 aa, Mycobacterium
SEGRDYRTDKN

SEQ ID NO: 577139 - protein, 6 aa, Mycobacterium
SEGRGL

SEQ ID NO: 577140 - protein, 17 aa, Mycobacterium
SEGRRSVSNMGSSSREE

SEQ ID NO: 577141 - protein, 5 aa, Mycobacterium
SEGSE

SEQ ID NO: 577142 - protein, 7 aa, Mycobacterium
SEGSFSS

SEQ ID NO: 577143 - protein, 10 aa, Mycobacterium
SEGSGFENYG

SEQ ID NO: 577144 - protein, 20 aa, Mycobacterium
SEGSGRAGAGSKAAASDTDE

SEQ ID NO: 577145 - protein, 5 aa, Mycobacterium
SEGSR

SEQ ID NO: 577146 - protein, 8 aa, Mycobacterium
SEGSTPGA

SEQ ID NO: 577147 - protein, 6 aa, Mycobacterium
SEGSVR

SEQ ID NO: 577148 - protein, 8 aa, Mycobacterium
SEGTAPKG

SEQ ID NO: 577149 - protein, 5 aa, Mycobacterium
SEGTL

SEQ ID NO: 577150 - protein, 7 aa, Mycobacterium
SEGTLPA

SEQ ID NO: 577151 - protein, 5 aa, Mycobacterium
SEGTP

SEQ ID NO: 577152 - protein, 5 aa, Mycobacterium
SEGTR

SEQ ID NO: 577153 - protein, 6 aa, Mycobacterium
SEGTRR

SEQ ID NO: 577154 - protein, 5 aa, Mycobacterium
SEGTV

SEQ ID NO: 577155 - protein, 4 aa, Mycobacterium
SEGV

SEQ ID NO: 577156 - protein, 6 aa, Mycobacterium
SEGVAR

SEQ ID NO: 577157 - protein, 10 aa, Mycobacterium
SEGVKEDDIR

SEQ ID NO: 577158 - protein, 9 aa, Mycobacterium
SEGVREEDI

SEQ ID NO: 577159 - protein, 9 aa, Mycobacterium
SEGVRGTGP

SEQ ID NO: 577160 - protein, 4 aa, Mycobacterium
SEGW

SEQ ID NO: 577161 - protein, 4 aa, Mycobacterium
SEGY

SEQ ID NO: 577162 - protein, 8 aa, Mycobacterium
SEGYQKAA

SEQ ID NO: 577163 - protein, 5 aa, Mycobacterium
SEHAD

SEQ ID NO: 577164 - protein, 5 aa, Mycobacterium
SEHAG

SEQ ID NO: 577165 - protein, 11 aa, Mycobacterium
SEHAGSGEFSD

SEQ ID NO: 577166 - protein, 14 aa, Mycobacterium
SEHDGFDPGERLGT

SEQ ID NO: 577167 - protein, 10 aa, Mycobacterium
SEHDPKSVPI

SEQ ID NO: 577168 - protein, 9 aa, Mycobacterium
SEHDRTATA

SEQ ID NO: 577169 - protein, 4 aa, Mycobacterium
SEHE

SEQ ID NO: 577170 - protein, 5 aa, Mycobacterium
SEHEA

SEQ ID NO: 577171 - protein, 11 aa, Mycobacterium
SEHEADAGGNM

SEQ ID NO: 577172 - protein, 7 aa, Mycobacterium
SEHEYGN

SEQ ID NO: 577173 - protein, 6 aa, Mycobacterium
SEHGAG

SEQ ID NO: 577174 - protein, 15 aa, Mycobacterium
SEHGEGSDPDLSDEG

SEQ ID NO: 577175 - protein, 15 aa, Mycobacterium
SEHGEGSDPDLSETG

SEQ ID NO: 577176 - protein, 15 aa, Mycobacterium
SEHGEGSDPVLSDTG

SEQ ID NO: 577177 - protein, 11 aa, Mycobacterium
SEHGFNSPHTD

SEQ ID NO: 577178 - protein, 12 aa, Mycobacterium
SEHGGTTGHPAT

SEQ ID NO: 577179 - protein, 23 aa, Mycobacterium
SEHGGTTISYTGDPEDSVADFEP

SEQ ID NO: 577180 - protein, 15 aa, Mycobacterium
SEHGQGSDPDLSAEG

SEQ ID NO: 577181 - protein, 5 aa, Mycobacterium
SEHGR

SEQ ID NO: 577182 - protein, 14 aa, Mycobacterium
SEHGSWPAAIAAGA

SEQ ID NO: 577183 - protein, 6 aa, Mycobacterium
SEHHGD

SEQ ID NO: 577184 - protein, 5 aa, Mycobacterium
SEHIK

SEQ ID NO: 577185 - protein, 15 aa, Mycobacterium
SEHIKEPDEPRPGFD

SEQ ID NO: 577186 - protein, 5 aa, Mycobacterium
SEHNR

SEQ ID NO: 577187 - protein, 6 aa, Mycobacterium
SEHNRV

SEQ ID NO: 577188 - protein, 37 aa, Mycobacterium
SEHPAATPSTPPPAASTAHPDPIPDSRGGPPLPPATA

SEQ ID NO: 577189 - protein, 10 aa, Mycobacterium
SEHPEYQNRD

SEQ ID NO: 577190 - protein, 10 aa, Mycobacterium
SEHPGGIPPE

SEQ ID NO: 577191 - protein, 10 aa, Mycobacterium
SEHPHEKEGL

SEQ ID NO: 577192 - protein, 5 aa, Mycobacterium
SEHPR

SEQ ID NO: 577193 - protein, 5 aa, Mycobacterium
SEHPS

SEQ ID NO: 577194 - protein, 6 aa, Mycobacterium
SEHPSF

SEQ ID NO: 577195 - protein, 7 aa, Mycobacterium
SEHPSSG

SEQ ID NO: 577196 - protein, 6 aa, Mycobacterium
SEHPSV

SEQ ID NO: 577197 - protein, 6 aa, Mycobacterium
SEHRDG

SEQ ID NO: 577198 - protein, 7 aa, Mycobacterium
SEHRRAQ

SEQ ID NO: 577199 - protein, 8 aa, Mycobacterium
SEHSASAG

SEQ ID NO: 577200 - protein, 5 aa, Mycobacterium
SEHSD

SEQ ID NO: 577201 - protein, 6 aa, Mycobacterium
SEHSGY

SEQ ID NO: 577202 - protein, 9 aa, Mycobacterium
SEHSKYNGH

SEQ ID NO: 577203 - protein, 5 aa, Mycobacterium
SEHSQ

SEQ ID NO: 577204 - protein, 6 aa, Mycobacterium
SEHSRQ

SEQ ID NO: 577205 - protein, 16 aa, Mycobacterium
SEHSSGASRVQGAITK

SEQ ID NO: 577206 - protein, 10 aa, Mycobacterium
SEHTTAESPR

SEQ ID NO: 577207 - protein, 8 aa, Mycobacterium
SEHTTHES

SEQ ID NO: 577208 - protein, 6 aa, Mycobacterium
SEHTTL

SEQ ID NO: 577209 - protein, 9 aa, Mycobacterium
SEHTTQESS

SEQ ID NO: 577210 - protein, 11 aa, Mycobacterium
SEIADDEPDAA

SEQ ID NO: 577211 - protein, 7 aa, Mycobacterium
SEIAEAS

SEQ ID NO: 577212 - protein, 5 aa, Mycobacterium
SEIAP

SEQ ID NO: 577213 - protein, 6 aa, Mycobacterium
SEIAPE

SEQ ID NO: 577214 - protein, 6 aa, Mycobacterium
SEIDGQ

SEQ ID NO: 577215 - protein, 5 aa, Mycobacterium
SEIDP

SEQ ID NO: 577216 - protein, 17 aa, Mycobacterium
SEIDPEDLEDADPFEEG

SEQ ID NO: 577217 - protein, 6 aa, Mycobacterium
SEIDRS

SEQ ID NO: 577218 - protein, 9 aa, Mycobacterium
SEIEQRAQE

SEQ ID NO: 577219 - protein, 14 aa, Mycobacterium
SEIETTDSDWDREK

SEQ ID NO: 577220 - protein, 12 aa, Mycobacterium
SEIGEPDESALG

SEQ ID NO: 577221 - protein, 22 aa, Mycobacterium
SEIGQDTAGAPGASDIATRGSD

SEQ ID NO: 577222 - protein, 17 aa, Mycobacterium
SEIPENMPDPDNDDEGC

SEQ ID NO: 577223 - protein, 17 aa, Mycobacterium
SEIPETMPDPDDDEEGC

SEQ ID NO: 577224 - protein, 17 aa, Mycobacterium
SEIPETMPDPDNDEEGC

SEQ ID NO: 577225 - protein, 7 aa, Mycobacterium
SEIPHDG

SEQ ID NO: 577226 - protein, 28 aa, Mycobacterium
SEIPKNPQIPGERKVPAAAQQNSESKRR

SEQ ID NO: 577227 - protein, 12 aa, Mycobacterium
SEIPKSRSAQPN

SEQ ID NO: 577228 - protein, 13 aa, Mycobacterium
SEIPSATAESTAM

SEQ ID NO: 577229 - protein, 15 aa, Mycobacterium
SEISPAWTLYAWEPR

SEQ ID NO: 577230 - protein, 13 aa, Mycobacterium
SEISSDTAQSEGL

SEQ ID NO: 577231 - protein, 6 aa, Mycobacterium
SEITNK

SEQ ID NO: 577232 - protein, 9 aa, Mycobacterium
SEKAIADAP

SEQ ID NO: 577233 - protein, 8 aa, Mycobacterium
SEKAQPLT

SEQ ID NO: 577234 - protein, 15 aa, Mycobacterium
SEKEEADRKNKLRGG

SEQ ID NO: 577235 - protein, 16 aa, Mycobacterium
SEKEEADRKNKLRGGD

SEQ ID NO: 577236 - protein, 15 aa, Mycobacterium
SEKEEADRKNKVRGG

SEQ ID NO: 577237 - protein, 6 aa, Mycobacterium
SEKEVA

SEQ ID NO: 577238 - protein, 4 aa, Mycobacterium
SEKF

SEQ ID NO: 577239 - protein, 7 aa, Mycobacterium
SEKGSRS

SEQ ID NO: 577240 - protein, 9 aa, Mycobacterium
SEKGSYSKA

SEQ ID NO: 577241 - protein, 4 aa, Mycobacterium
SEKL

SEQ ID NO: 577242 - protein, 12 aa, Mycobacterium
SEKLGADPDLTS

SEQ ID NO: 577243 - protein, 8 aa, Mycobacterium
SEKLSNPV

SEQ ID NO: 577244 - protein, 10 aa, Mycobacterium
SEKNDSATEP

SEQ ID NO: 577245 - protein, 13 aa, Mycobacterium
SEKPAKPTPEKVG

SEQ ID NO: 577246 - protein, 8 aa, Mycobacterium
SEKPDSVQ

SEQ ID NO: 577247 - protein, 8 aa, Mycobacterium
SEKPGGMP

SEQ ID NO: 577248 - protein, 10 aa, Mycobacterium
SEKPTAESVS

SEQ ID NO: 577249 - protein, 9 aa, Mycobacterium
SEKPTEESV

SEQ ID NO: 577250 - protein, 6 aa, Mycobacterium
SEKQGA

SEQ ID NO: 577251 - protein, 10 aa, Mycobacterium
SEKQRAAAPV

SEQ ID NO: 577252 - protein, 7 aa, Mycobacterium
SEKREPK

SEQ ID NO: 577253 - protein, 9 aa, Mycobacterium
SEKRQSTLA

SEQ ID NO: 577254 - protein, 13 aa, Mycobacterium
SEKSPSGTRVVVT

SEQ ID NO: 577255 - protein, 7 aa, Mycobacterium
SEKSQTY

SEQ ID NO: 577256 - protein, 5 aa, Mycobacterium
SEKSR

SEQ ID NO: 577257 - protein, 4 aa, Mycobacterium
SELA

SEQ ID NO: 577258 - protein, 11 aa, Mycobacterium
SELADAGDQLT

SEQ ID NO: 577259 - protein, 15 aa, Mycobacterium
SELADDRRAHPGDDL

SEQ ID NO: 577260 - protein, 9 aa, Mycobacterium
SELAEQGRP

SEQ ID NO: 577261 - protein, 6 aa, Mycobacterium
SELAGN

SEQ ID NO: 577262 - protein, 11 aa, Mycobacterium
SELAKTAKPVD

SEQ ID NO: 577263 - protein, 8 aa, Mycobacterium
SELAPATS

SEQ ID NO: 577264 - protein, 6 aa, Mycobacterium
SELAPS

SEQ ID NO: 577265 - protein, 7 aa, Mycobacterium
SELAPVS

SEQ ID NO: 577266 - protein, 12 aa, Mycobacterium
SELARKGISRGR

SEQ ID NO: 577267 - protein, 14 aa, Mycobacterium
SELASRSANTPYES

SEQ ID NO: 577268 - protein, 4 aa, Mycobacterium
SELD

SEQ ID NO: 577269 - protein, 22 aa, Mycobacterium
SELDEPAAPPEPALHAPPDTSL

SEQ ID NO: 577270 - protein, 21 aa, Mycobacterium
SELDEPAAPPEPALQAPPDTA

SEQ ID NO: 577271 - protein, 12 aa, Mycobacterium
SELDESEQIAAG

SEQ ID NO: 577272 - protein, 18 aa, Mycobacterium
SELDGVPDGCTSDPEYAD

SEQ ID NO: 577273 - protein, 4 aa, Mycobacterium
SELE

SEQ ID NO: 577274 - protein, 8 aa, Mycobacterium
SELERDDA

SEQ ID NO: 577275 - protein, 12 aa, Mycobacterium
SELESASFSRTE

SEQ ID NO: 577276 - protein, 16 aa, Mycobacterium
SELGASGPPAPRRGGG

SEQ ID NO: 577277 - protein, 7 aa, Mycobacterium
SELGGDS

SEQ ID NO: 577278 - protein, 6 aa, Mycobacterium
SELGGH

SEQ ID NO: 577279 - protein, 8 aa, Mycobacterium
SELGPDGV

SEQ ID NO: 577280 - protein, 15 aa, Mycobacterium
SELGREKSPLALAVT

SEQ ID NO: 577281 - protein, 11 aa, Mycobacterium
SELGTGRGGPR

SEQ ID NO: 577282 - protein, 5 aa, Mycobacterium
SELGY

SEQ ID NO: 577283 - protein, 4 aa, Mycobacterium
SELH

SEQ ID NO: 577284 - protein, 5 aa, Mycobacterium
SELHG

SEQ ID NO: 577285 - protein, 12 aa, Mycobacterium
SELNASGRTPGL

SEQ ID NO: 577286 - protein, 8 aa, Mycobacterium
SELNSETQ

SEQ ID NO: 577287 - protein, 5 aa, Mycobacterium
SELPA

SEQ ID NO: 577288 - protein, 23 aa, Mycobacterium
SELPAAATGAAAPATVPGKPPLV

SEQ ID NO: 577289 - protein, 8 aa, Mycobacterium
SELPADVA

SEQ ID NO: 577290 - protein, 6 aa, Mycobacterium
SELPAE

SEQ ID NO: 577291 - protein, 8 aa, Mycobacterium
SELPAGHG

SEQ ID NO: 577292 - protein, 9 aa, Mycobacterium
SELPAGHGL

SEQ ID NO: 577293 - protein, 6 aa, Mycobacterium
SELPAT

SEQ ID NO: 577294 - protein, 9 aa, Mycobacterium
SELPDGAVT

SEQ ID NO: 577295 - protein, 12 aa, Mycobacterium
SELPDRSGEGLK

SEQ ID NO: 577296 - protein, 14 aa, Mycobacterium
SELPGHVSADGDEL

SEQ ID NO: 577297 - protein, 9 aa, Mycobacterium
SELPGPGTY

SEQ ID NO: 577298 - protein, 10 aa, Mycobacterium
SELPKGQGFN

SEQ ID NO: 577299 - protein, 7 aa, Mycobacterium
SELPPPL

SEQ ID NO: 577300 - protein, 8 aa, Mycobacterium
SELPPPLH

SEQ ID NO: 577301 - protein, 19 aa, Mycobacterium
SELPPPSNKTRAMKPPVNP

SEQ ID NO: 577302 - protein, 13 aa, Mycobacterium
SELPSVDDVNEKR

SEQ ID NO: 577303 - protein, 4 aa, Mycobacterium
SELR

SEQ ID NO: 577304 - protein, 8 aa, Mycobacterium
SELRSSTG

SEQ ID NO: 577305 - protein, 9 aa, Mycobacterium
SELRTEAGQ

SEQ ID NO: 577306 - protein, 10 aa, Mycobacterium
SELRTEEGQE

SEQ ID NO: 577307 - protein, 18 aa, Mycobacterium
SELSESGPPAPPRPDGLS

SEQ ID NO: 577308 - protein, 5 aa, Mycobacterium
SELSG

SEQ ID NO: 577309 - protein, 7 aa, Mycobacterium
SELSGGN

SEQ ID NO: 577310 - protein, 6 aa, Mycobacterium
SELSRT

SEQ ID NO: 577311 - protein, 11 aa, Mycobacterium
SELSSAADGYQ

SEQ ID NO: 577312 - protein, 15 aa, Mycobacterium
SELTASAAAAAGHPV

SEQ ID NO: 577313 - protein, 5 aa, Mycobacterium
SELTK

SEQ ID NO: 577314 - protein, 5 aa, Mycobacterium
SELTP

SEQ ID NO: 577315 - protein, 14 aa, Mycobacterium
SELTPVAMAAASQL

SEQ ID NO: 577316 - protein, 15 aa, Mycobacterium
SELTRGYEERTRSSE

SEQ ID NO: 577317 - protein, 6 aa, Mycobacterium
SEMAEG

SEQ ID NO: 577318 - protein, 5 aa, Mycobacterium
SEMRN

SEQ ID NO: 577319 - protein, 5 aa, Mycobacterium
SEMTP

SEQ ID NO: 577320 - protein, 6 aa, Mycobacterium
SEMTPA

SEQ ID NO: 577321 - protein, 4 aa, Mycobacterium
SENA

SEQ ID NO: 577322 - protein, 5 aa, Mycobacterium
SENAA

SEQ ID NO: 577323 - protein, 5 aa, Mycobacterium
SENDN

SEQ ID NO: 577324 - protein, 7 aa, Mycobacterium
SENDSRN

SEQ ID NO: 577325 - protein, 8 aa, Mycobacterium
SENDTEVG

SEQ ID NO: 577326 - protein, 6 aa, Mycobacterium
SENERS

SEQ ID NO: 577327 - protein, 5 aa, Mycobacterium
SENET

SEQ ID NO: 577328 - protein, 7 aa, Mycobacterium
SENGAEH

SEQ ID NO: 577329 - protein, 7 aa, Mycobacterium
SENGASH

SEQ ID NO: 577330 - protein, 12 aa, Mycobacterium
SENGGDTGYSDD

SEQ ID NO: 577331 - protein, 7 aa, Mycobacterium
SENGHTV

SEQ ID NO: 577332 - protein, 51 aa, Mycobacterium
SENGIGGTGGDAGLIGNGGDGGAGAPAAQGGIGGLGGSGGKLFGTAGAPGP

SEQ ID NO: 577333 - protein, 9 aa, Mycobacterium
SENHGNGYS

SEQ ID NO: 577334 - protein, 13 aa, Mycobacterium
SENIGRRRARQQV

SEQ ID NO: 577335 - protein, 7 aa, Mycobacterium
SENKAAA

SEQ ID NO: 577336 - protein, 8 aa, Mycobacterium
SENLTSTS

SEQ ID NO: 577337 - protein, 7 aa, Mycobacterium
SENMPDA

SEQ ID NO: 577338 - protein, 9 aa, Mycobacterium
SENNRREYD

SEQ ID NO: 577339 - protein, 4 aa, Mycobacterium
SENP

SEQ ID NO: 577340 - protein, 5 aa, Mycobacterium
SENPA

SEQ ID NO: 577341 - protein, 8 aa, Mycobacterium
SENPAPGA

SEQ ID NO: 577342 - protein, 15 aa, Mycobacterium
SENPFDPATAPTTAQ

SEQ ID NO: 577343 - protein, 5 aa, Mycobacterium
SENPQ

SEQ ID NO: 577344 - protein, 11 aa, Mycobacterium
SENPQRLPTKR

SEQ ID NO: 577345 - protein, 8 aa, Mycobacterium
SENREESA

SEQ ID NO: 577346 - protein, 10 aa, Mycobacterium
SENRKDEGVV

SEQ ID NO: 577347 - protein, 6 aa, Mycobacterium
SENRPE

SEQ ID NO: 577348 - protein, 5 aa, Mycobacterium
SENSA

SEQ ID NO: 577349 - protein, 7 aa, Mycobacterium
SENSLVS

SEQ ID NO: 577350 - protein, 9 aa, Mycobacterium
SENSTADCG

SEQ ID NO: 577351 - protein, 8 aa, Mycobacterium
SENTPWYS

SEQ ID NO: 577352 - protein, 4 aa, Mycobacterium
SENV

SEQ ID NO: 577353 - protein, 9 aa, Mycobacterium
SENYDDPAA

SEQ ID NO: 577354 - protein, 7 aa, Mycobacterium
SENYKKA

SEQ ID NO: 577355 - protein, 10 aa, Mycobacterium
SEPAAGSDLA

SEQ ID NO: 577356 - protein, 12 aa, Mycobacterium
SEPADGVGGGVT

SEQ ID NO: 577357 - protein, 5 aa, Mycobacterium
SEPAG

SEQ ID NO: 577358 - protein, 7 aa, Mycobacterium
SEPAGIA

SEQ ID NO: 577359 - protein, 8 aa, Mycobacterium
SEPAGRTT

SEQ ID NO: 577360 - protein, 16 aa, Mycobacterium
SEPANGRPNHVRSTPA

SEQ ID NO: 577361 - protein, 10 aa, Mycobacterium
SEPAPAPKRS

SEQ ID NO: 577362 - protein, 6 aa, Mycobacterium
SEPAPK

SEQ ID NO: 577363 - protein, 9 aa, Mycobacterium
SEPASDPTH

SEQ ID NO: 577364 - protein, 7 aa, Mycobacterium
SEPDAAT

SEQ ID NO: 577365 - protein, 14 aa, Mycobacterium
SEPDAAVPQVRDAD

SEQ ID NO: 577366 - protein, 9 aa, Mycobacterium
SEPDAGSDL

SEQ ID NO: 577367 - protein, 10 aa, Mycobacterium
SEPDAGSDLA

SEQ ID NO: 577368 - protein, 21 aa, Mycobacterium
SEPDAGSDLGSMRTTARTSGA

SEQ ID NO: 577369 - protein, 10 aa, Mycobacterium
SEPDAGSDVG

SEQ ID NO: 577370 - protein, 6 aa, Mycobacterium
SEPDAH

SEQ ID NO: 577371 - protein, 9 aa, Mycobacterium
SEPDDVTKG

SEQ ID NO: 577372 - protein, 7 aa, Mycobacterium
SEPDERG

SEQ ID NO: 577373 - protein, 5 aa, Mycobacterium
SEPDG

SEQ ID NO: 577374 - protein, 6 aa, Mycobacterium
SEPDGL

SEQ ID NO: 577375 - protein, 5 aa, Mycobacterium
SEPDI

SEQ ID NO: 577376 - protein, 6 aa, Mycobacterium
SEPDIS

SEQ ID NO: 577377 - protein, 5 aa, Mycobacterium
SEPDP

SEQ ID NO: 577378 - protein, 6 aa, Mycobacterium
SEPDPR

SEQ ID NO: 577379 - protein, 12 aa, Mycobacterium
SEPDSGSDLASV

SEQ ID NO: 577380 - protein, 25 aa, Mycobacterium
SEPDSGSDLASVRTKASPVDGGWSV

SEQ ID NO: 577381 - protein, 20 aa, Mycobacterium
SEPDSGSDLASVRTRAERVE

SEQ ID NO: 577382 - protein, 11 aa, Mycobacterium
SEPDSPRTRTR

SEQ ID NO: 577383 - protein, 7 aa, Mycobacterium
SEPDTAS

SEQ ID NO: 577384 - protein, 5 aa, Mycobacterium
SEPDY

SEQ ID NO: 577385 - protein, 4 aa, Mycobacterium
SEPE

SEQ ID NO: 577386 - protein, 8 aa, Mycobacterium
SEPEAGSD

SEQ ID NO: 577387 - protein, 20 aa, Mycobacterium
SEPEAGSDLASLRTSARRVD

SEQ ID NO: 577388 - protein, 8 aa, Mycobacterium
SEPEAGTD

SEQ ID NO: 577389 - protein, 6 aa, Mycobacterium
SEPEFT

SEQ ID NO: 577390 - protein, 6 aa, Mycobacterium
SEPERV

SEQ ID NO: 577391 - protein, 8 aa, Mycobacterium
SEPERYAK

SEQ ID NO: 577392 - protein, 9 aa, Mycobacterium
SEPESGSDL

SEQ ID NO: 577393 - protein, 23 aa, Mycobacterium
SEPESGSDLASLRSPARKVDGGW

SEQ ID NO: 577394 - protein, 22 aa, Mycobacterium
SEPESGSDLASLRSTATATDGG

SEQ ID NO: 577395 - protein, 22 aa, Mycobacterium
SEPESGSDLASLRSTATKTDGG

SEQ ID NO: 577396 - protein, 22 aa, Mycobacterium
SEPESGSDLASLRSTATKTEGG

SEQ ID NO: 577397 - protein, 21 aa, Mycobacterium
SEPESGSDLASLRSTATRTEG

SEQ ID NO: 577398 - protein, 8 aa, Mycobacterium
SEPFSPER

SEQ ID NO: 577399 - protein, 4 aa, Mycobacterium
SEPG

SEQ ID NO: 577400 - protein, 6 aa, Mycobacterium
SEPGAC

SEQ ID NO: 577401 - protein, 21 aa, Mycobacterium
SEPGAGSDLASITTRATQKGD

SEQ ID NO: 577402 - protein, 21 aa, Mycobacterium
SEPGAGSDLASLTTTATREGD

SEQ ID NO: 577403 - protein, 22 aa, Mycobacterium
SEPGAGSDLASLTTTAVKDGDE

SEQ ID NO: 577404 - protein, 19 aa, Mycobacterium
SEPGAGSDLSSLSTRAVRD

SEQ ID NO: 577405 - protein, 7 aa, Mycobacterium
SEPGDGG

SEQ ID NO: 577406 - protein, 17 aa, Mycobacterium
SEPGDPPAPVDIPNDSP

SEQ ID NO: 577407 - protein, 6 aa, Mycobacterium
SEPGDQ

SEQ ID NO: 577408 - protein, 5 aa, Mycobacterium
SEPGF

SEQ ID NO: 577409 - protein, 6 aa, Mycobacterium
SEPGGE

SEQ ID NO: 577410 - protein, 10 aa, Mycobacterium
SEPGKIGRPR

SEQ ID NO: 577411 - protein, 12 aa, Mycobacterium
SEPGKPVDDATI

SEQ ID NO: 577412 - protein, 10 aa, Mycobacterium
SEPGKTESQL

SEQ ID NO: 577413 - protein, 6 aa, Mycobacterium
SEPGLS

SEQ ID NO: 577414 - protein, 6 aa, Mycobacterium
SEPGNT

SEQ ID NO: 577415 - protein, 5 aa, Mycobacterium
SEPGP

SEQ ID NO: 577416 - protein, 7 aa, Mycobacterium
SEPGPAA

SEQ ID NO: 577417 - protein, 7 aa, Mycobacterium
SEPGPHL

SEQ ID NO: 577418 - protein, 8 aa, Mycobacterium
SEPGPQTL

SEQ ID NO: 577419 - protein, 7 aa, Mycobacterium
SEPGRGT

SEQ ID NO: 577420 - protein, 7 aa, Mycobacterium
SEPGRGW

SEQ ID NO: 577421 - protein, 9 aa, Mycobacterium
SEPGRGWDP

SEQ ID NO: 577422 - protein, 7 aa, Mycobacterium
SEPGRPP

SEQ ID NO: 577423 - protein, 12 aa, Mycobacterium
SEPGSGADLDSP

SEQ ID NO: 577424 - protein, 12 aa, Mycobacterium
SEPGSGSDLASL

SEQ ID NO: 577425 - protein, 21 aa, Mycobacterium
SEPGSGSDLASLSTRAAPRGD

SEQ ID NO: 577426 - protein, 21 aa, Mycobacterium
SEPGSGSDLASLSTRATPRGD

SEQ ID NO: 577427 - protein, 21 aa, Mycobacterium
SEPGSGSDLASLTTRATPRGD

SEQ ID NO: 577428 - protein, 21 aa, Mycobacterium
SEPGSGSDLASLTTRATQQGD

SEQ ID NO: 577429 - protein, 8 aa, Mycobacterium
SEPGSTAK

SEQ ID NO: 577430 - protein, 6 aa, Mycobacterium
SEPGVA

SEQ ID NO: 577431 - protein, 10 aa, Mycobacterium
SEPGVAEASR

SEQ ID NO: 577432 - protein, 5 aa, Mycobacterium
SEPGW

SEQ ID NO: 577433 - protein, 7 aa, Mycobacterium
SEPGYTL

SEQ ID NO: 577434 - protein, 4 aa, Mycobacterium
SEPH

SEQ ID NO: 577435 - protein, 7 aa, Mycobacterium
SEPHQSA

SEQ ID NO: 577436 - protein, 13 aa, Mycobacterium
SEPHSGTDIRAGR

SEQ ID NO: 577437 - protein, 7 aa, Mycobacterium
SEPIDSH

SEQ ID NO: 577438 - protein, 6 aa, Mycobacterium
SEPISA

SEQ ID NO: 577439 - protein, 12 aa, Mycobacterium
SEPISSAPARQR

SEQ ID NO: 577440 - protein, 16 aa, Mycobacterium
SEPKRRGGQAASAAPL

SEQ ID NO: 577441 - protein, 6 aa, Mycobacterium
SEPLGP

SEQ ID NO: 577442 - protein, 7 aa, Mycobacterium
SEPLPGA

SEQ ID NO: 577443 - protein, 9 aa, Mycobacterium
SEPLPPPDL

SEQ ID NO: 577444 - protein, 17 aa, Mycobacterium
SEPLSSAPKQGGPGDAA

SEQ ID NO: 577445 - protein, 7 aa, Mycobacterium
SEPMPDD

SEQ ID NO: 577446 - protein, 10 aa, Mycobacterium
SEPNKIGRPR

SEQ ID NO: 577447 - protein, 9 aa, Mycobacterium
SEPNRSPKQ

SEQ ID NO: 577448 - protein, 7 aa, Mycobacterium
SEPPAAQ

SEQ ID NO: 577449 - protein, 8 aa, Mycobacterium
SEPPDELR

SEQ ID NO: 577450 - protein, 11 aa, Mycobacterium
SEPPPPGTRQR

SEQ ID NO: 577451 - protein, 5 aa, Mycobacterium
SEPPV

SEQ ID NO: 577452 - protein, 13 aa, Mycobacterium
SEPQDGGAELRPI

SEQ ID NO: 577453 - protein, 7 aa, Mycobacterium
SEPQLTR

SEQ ID NO: 577454 - protein, 10 aa, Mycobacterium
SEPQPGGTEF

SEQ ID NO: 577455 - protein, 11 aa, Mycobacterium
SEPQQDDRWDE

SEQ ID NO: 577456 - protein, 14 aa, Mycobacterium
SEPRESSDEADVDV

SEQ ID NO: 577457 - protein, 5 aa, Mycobacterium
SEPRH

SEQ ID NO: 577458 - protein, 7 aa, Mycobacterium
SEPRPGQ

SEQ ID NO: 577459 - protein, 9 aa, Mycobacterium
SEPRPSAEA

SEQ ID NO: 577460 - protein, 10 aa, Mycobacterium
SEPRPVPGEP

SEQ ID NO: 577461 - protein, 16 aa, Mycobacterium
SEPRQDATTVLPSLQT

SEQ ID NO: 577462 - protein, 7 aa, Mycobacterium
SEPRRLD

SEQ ID NO: 577463 - protein, 10 aa, Mycobacterium
SEPRRTGGSV

SEQ ID NO: 577464 - protein, 5 aa, Mycobacterium
SEPRV

SEQ ID NO: 577465 - protein, 4 aa, Mycobacterium
SEPS

SEQ ID NO: 577466 - protein, 7 aa, Mycobacterium
SEPSSGG

SEQ ID NO: 577467 - protein, 5 aa, Mycobacterium
SEPSV

SEQ ID NO: 577468 - protein, 4 aa, Mycobacterium
SEPT

SEQ ID NO: 577469 - protein, 5 aa, Mycobacterium
SEPTG

SEQ ID NO: 577470 - protein, 5 aa, Mycobacterium
SEPTH

SEQ ID NO: 577471 - protein, 6 aa, Mycobacterium
SEPTHA

SEQ ID NO: 577472 - protein, 7 aa, Mycobacterium
SEPTPRR

SEQ ID NO: 577473 - protein, 6 aa, Mycobacterium
SEPTSG

SEQ ID NO: 577474 - protein, 6 aa, Mycobacterium
SEPTTA

SEQ ID NO: 577475 - protein, 12 aa, Mycobacterium
SEPVAGTPVSPL

SEQ ID NO: 577476 - protein, 8 aa, Mycobacterium
SEPVAQPG

SEQ ID NO: 577477 - protein, 17 aa, Mycobacterium
SEPVGPDSPHADETAVR

SEQ ID NO: 577478 - protein, 5 aa, Mycobacterium
SEPVR

SEQ ID NO: 577479 - protein, 12 aa, Mycobacterium
SEPVSAPPPNTV

SEQ ID NO: 577480 - protein, 7 aa, Mycobacterium
SEPWDKQ

SEQ ID NO: 577481 - protein, 7 aa, Mycobacterium
SEPYATR

SEQ ID NO: 577482 - protein, 13 aa, Mycobacterium
SEPYDDDDDWTDV

SEQ ID NO: 577483 - protein, 12 aa, Mycobacterium
SEPYDDDPAWEE

SEQ ID NO: 577484 - protein, 13 aa, Mycobacterium
SEPYDDDPGWSDI

SEQ ID NO: 577485 - protein, 9 aa, Mycobacterium
SEPYDDDPS

SEQ ID NO: 577486 - protein, 13 aa, Mycobacterium
SEPYDNDSDWEDV

SEQ ID NO: 577487 - protein, 13 aa, Mycobacterium
SEPYDNDSGWEDV

SEQ ID NO: 577488 - protein, 13 aa, Mycobacterium
SEPYDNDTDWEDV

SEQ ID NO: 577489 - protein, 6 aa, Mycobacterium
SEQAAG

SEQ ID NO: 577490 - protein, 8 aa, Mycobacterium
SEQAAPEL

SEQ ID NO: 577491 - protein, 7 aa, Mycobacterium
SEQAPLA

SEQ ID NO: 577492 - protein, 5 aa, Mycobacterium
SEQAR

SEQ ID NO: 577493 - protein, 26 aa, Mycobacterium
SEQARDAATQAGVPLAESGAAAASTA

SEQ ID NO: 577494 - protein, 9 aa, Mycobacterium
SEQDARTRI

SEQ ID NO: 577495 - protein, 7 aa, Mycobacterium
SEQDASG

SEQ ID NO: 577496 - protein, 13 aa, Mycobacterium
SEQDDQSSIARAQ

SEQ ID NO: 577497 - protein, 7 aa, Mycobacterium
SEQDETA

SEQ ID NO: 577498 - protein, 10 aa, Mycobacterium
SEQDGAGGKD

SEQ ID NO: 577499 - protein, 9 aa, Mycobacterium
SEQDPAVSE

SEQ ID NO: 577500 - protein, 6 aa, Mycobacterium
SEQDQI

SEQ ID NO: 577501 - protein, 6 aa, Mycobacterium
SEQDSV

SEQ ID NO: 577502 - protein, 5 aa, Mycobacterium
SEQEA

SEQ ID NO: 577503 - protein, 27 aa, Mycobacterium
SEQEKADKQAQEREKRRYKKLGWDVEF

SEQ ID NO: 577504 - protein, 15 aa, Mycobacterium
SEQEKAEKAAREREV

SEQ ID NO: 577505 - protein, 6 aa, Mycobacterium
SEQEQV

SEQ ID NO: 577506 - protein, 12 aa, Mycobacterium
SEQFSGHPDANW

SEQ ID NO: 577507 - protein, 4 aa, Mycobacterium
SEQG

SEQ ID NO: 577508 - protein, 17 aa, Mycobacterium
SEQGARPDEHPGRSGNP

SEQ ID NO: 577509 - protein, 9 aa, Mycobacterium
SEQGGREDL

SEQ ID NO: 577510 - protein, 5 aa, Mycobacterium
SEQGL

SEQ ID NO: 577511 - protein, 10 aa, Mycobacterium
SEQGRITPGD

SEQ ID NO: 577512 - protein, 6 aa, Mycobacterium
SEQGVT

SEQ ID NO: 577513 - protein, 10 aa, Mycobacterium
SEQKAQSEAE

SEQ ID NO: 577514 - protein, 7 aa, Mycobacterium
SEQLGGG

SEQ ID NO: 577515 - protein, 17 aa, Mycobacterium
SEQNDPNLLSPEGKSRR

SEQ ID NO: 577516 - protein, 19 aa, Mycobacterium
SEQNDPNMLSPEGKSRRFA

SEQ ID NO: 577517 - protein, 19 aa, Mycobacterium
SEQNSDDEFTGDVPTDAEK

SEQ ID NO: 577518 - protein, 7 aa, Mycobacterium
SEQNTAI

SEQ ID NO: 577519 - protein, 10 aa, Mycobacterium
SEQPDLPAHS

SEQ ID NO: 577520 - protein, 5 aa, Mycobacterium
SEQPE

SEQ ID NO: 577521 - protein, 13 aa, Mycobacterium
SEQPESSTQDSLN

SEQ ID NO: 577522 - protein, 7 aa, Mycobacterium
SEQPETV

SEQ ID NO: 577523 - protein, 10 aa, Mycobacterium
SEQPKYENAA

SEQ ID NO: 577524 - protein, 13 aa, Mycobacterium
SEQQDGGGRTFNP

SEQ ID NO: 577525 - protein, 7 aa, Mycobacterium
SEQRAAV

SEQ ID NO: 577526 - protein, 8 aa, Mycobacterium
SEQRAREL

SEQ ID NO: 577527 - protein, 11 aa, Mycobacterium
SEQRARRPKIG

SEQ ID NO: 577528 - protein, 5 aa, Mycobacterium
SEQRD

SEQ ID NO: 577529 - protein, 7 aa, Mycobacterium
SEQRGRE

SEQ ID NO: 577530 - protein, 6 aa, Mycobacterium
SEQRNA

SEQ ID NO: 577531 - protein, 7 aa, Mycobacterium
SEQRREG

SEQ ID NO: 577532 - protein, 19 aa, Mycobacterium
SEQSDPNMLSAEGKSRRFA

SEQ ID NO: 577533 - protein, 8 aa, Mycobacterium
SEQTDEGT

SEQ ID NO: 577534 - protein, 12 aa, Mycobacterium
SEQTEGFSAPSS

SEQ ID NO: 577535 - protein, 10 aa, Mycobacterium
SEQTESLGPQ

SEQ ID NO: 577536 - protein, 7 aa, Mycobacterium
SEQTRRL

SEQ ID NO: 577537 - protein, 4 aa, Mycobacterium
SEQV

SEQ ID NO: 577538 - protein, 16 aa, Mycobacterium
SEQVAGVATDGTVDDM

SEQ ID NO: 577539 - protein, 10 aa, Mycobacterium
SEQVTGTAGH

SEQ ID NO: 577540 - protein, 4 aa, Mycobacterium
SEQY

SEQ ID NO: 577541 - protein, 8 aa, Mycobacterium
SERAAPKI

SEQ ID NO: 577542 - protein, 6 aa, Mycobacterium
SERAFA

SEQ ID NO: 577543 - protein, 8 aa, Mycobacterium
SERAGVGR

SEQ ID NO: 577544 - protein, 11 aa, Mycobacterium
SERALTNQARR

SEQ ID NO: 577545 - protein, 17 aa, Mycobacterium
SERAPDYARRGGYIASP

SEQ ID NO: 577546 - protein, 5 aa, Mycobacterium
SERAQ

SEQ ID NO: 577547 - protein, 12 aa, Mycobacterium
SERARAGASARL

SEQ ID NO: 577548 - protein, 5 aa, Mycobacterium
SERAV

SEQ ID NO: 577549 - protein, 10 aa, Mycobacterium
SERDAAEVPA

SEQ ID NO: 577550 - protein, 10 aa, Mycobacterium
SERDARDQIE

SEQ ID NO: 577551 - protein, 5 aa, Mycobacterium
SERDE

SEQ ID NO: 577552 - protein, 9 aa, Mycobacterium
SERDPAASE

SEQ ID NO: 577553 - protein, 18 aa, Mycobacterium
SERDRADTQDGKDAARTA

SEQ ID NO: 577554 - protein, 7 aa, Mycobacterium
SERDSYA

SEQ ID NO: 577555 - protein, 5 aa, Mycobacterium
SERDY

SEQ ID NO: 577556 - protein, 22 aa, Mycobacterium
SEREAGSDAASMRTRAKADGED

SEQ ID NO: 577557 - protein, 21 aa, Mycobacterium
SEREAGSDAASMRTRARADGD

SEQ ID NO: 577558 - protein, 22 aa, Mycobacterium
SEREAGSDAGAMRTRAKADGDD

SEQ ID NO: 577559 - protein, 22 aa, Mycobacterium
SEREAGSDAGSMRTRAKADGDD

SEQ ID NO: 577560 - protein, 5 aa, Mycobacterium
SEREC

SEQ ID NO: 577561 - protein, 11 aa, Mycobacterium
SEREGRPEGSE

SEQ ID NO: 577562 - protein, 12 aa, Mycobacterium
SERERRRLKRGI

SEQ ID NO: 577563 - protein, 9 aa, Mycobacterium
SERERSQGR

SEQ ID NO: 577564 - protein, 4 aa, Mycobacterium
SERF

SEQ ID NO: 577565 - protein, 13 aa, Mycobacterium
SERFPKGERRSVA

SEQ ID NO: 577566 - protein, 15 aa, Mycobacterium
SERGAAAGDADAQRI

SEQ ID NO: 577567 - protein, 5 aa, Mycobacterium
SERGD

SEQ ID NO: 577568 - protein, 16 aa, Mycobacterium
SERGGPATAQATRDLE

SEQ ID NO: 577569 - protein, 15 aa, Mycobacterium
SERGGSVGAQADRDL

SEQ ID NO: 577570 - protein, 7 aa, Mycobacterium
SERGGYE

SEQ ID NO: 577571 - protein, 5 aa, Mycobacterium
SERGR

SEQ ID NO: 577572 - protein, 8 aa, Mycobacterium
SERGRFSA

SEQ ID NO: 577573 - protein, 14 aa, Mycobacterium
SERGRLKPDDLDDA

SEQ ID NO: 577574 - protein, 9 aa, Mycobacterium
SERGRSGLD

SEQ ID NO: 577575 - protein, 7 aa, Mycobacterium
SERGYHQ

SEQ ID NO: 577576 - protein, 7 aa, Mycobacterium
SERIGRP

SEQ ID NO: 577577 - protein, 16 aa, Mycobacterium
SERKQTDAWTADPKGA

SEQ ID NO: 577578 - protein, 17 aa, Mycobacterium
SERLADGAAQLAAEKPD

SEQ ID NO: 577579 - protein, 9 aa, Mycobacterium
SERLTDAEA

SEQ ID NO: 577580 - protein, 4 aa, Mycobacterium
SERM

SEQ ID NO: 577581 - protein, 5 aa, Mycobacterium
SERNA

SEQ ID NO: 577582 - protein, 20 aa, Mycobacterium
SERNALAERRQEDFESPRRR

SEQ ID NO: 577583 - protein, 10 aa, Mycobacterium
SERNDSPSEP

SEQ ID NO: 577584 - protein, 7 aa, Mycobacterium
SERNPGL

SEQ ID NO: 577585 - protein, 5 aa, Mycobacterium
SERPD

SEQ ID NO: 577586 - protein, 10 aa, Mycobacterium
SERPDAADEP

SEQ ID NO: 577587 - protein, 7 aa, Mycobacterium
SERPDGS

SEQ ID NO: 577588 - protein, 10 aa, Mycobacterium
SERPEYASAQ

SEQ ID NO: 577589 - protein, 9 aa, Mycobacterium
SERPGGSDP

SEQ ID NO: 577590 - protein, 6 aa, Mycobacterium
SERPGH

SEQ ID NO: 577591 - protein, 8 aa, Mycobacterium
SERPPSPS

SEQ ID NO: 577592 - protein, 5 aa, Mycobacterium
SERPR

SEQ ID NO: 577593 - protein, 17 aa, Mycobacterium
SERPRGRKSVWLVSAIK

SEQ ID NO: 577594 - protein, 10 aa, Mycobacterium
SERPTYENAK

SEQ ID NO: 577595 - protein, 10 aa, Mycobacterium
SERPTYENAR

SEQ ID NO: 577596 - protein, 5 aa, Mycobacterium
SERPV

SEQ ID NO: 577597 - protein, 6 aa, Mycobacterium
SERQDE

SEQ ID NO: 577598 - protein, 9 aa, Mycobacterium
SERQGAPLR

SEQ ID NO: 577599 - protein, 4 aa, Mycobacterium
SERR

SEQ ID NO: 577600 - protein, 6 aa, Mycobacterium
SERRAS

SEQ ID NO: 577601 - protein, 6 aa, Mycobacterium
SERREH

SEQ ID NO: 577602 - protein, 6 aa, Mycobacterium
SERRRE

SEQ ID NO: 577603 - protein, 11 aa, Mycobacterium
SERRTYHGETD

SEQ ID NO: 577604 - protein, 4 aa, Mycobacterium
SERS

SEQ ID NO: 577605 - protein, 6 aa, Mycobacterium
SERSAG

SEQ ID NO: 577606 - protein, 5 aa, Mycobacterium
SERSD

SEQ ID NO: 577607 - protein, 9 aa, Mycobacterium
SERSGAPLR

SEQ ID NO: 577608 - protein, 8 aa, Mycobacterium
SERSGSGI

SEQ ID NO: 577609 - protein, 5 aa, Mycobacterium
SERSH

SEQ ID NO: 577610 - protein, 6 aa, Mycobacterium
SERSPI

SEQ ID NO: 577611 - protein, 7 aa, Mycobacterium
SERSPLT

SEQ ID NO: 577612 - protein, 12 aa, Mycobacterium
SERSSASRPDQA

SEQ ID NO: 577613 - protein, 13 aa, Mycobacterium
SERTAGDTRANAV

SEQ ID NO: 577614 - protein, 8 aa, Mycobacterium
SERTATDL

SEQ ID NO: 577615 - protein, 9 aa, Mycobacterium
SERTDQHRT

SEQ ID NO: 577616 - protein, 7 aa, Mycobacterium
SERTDTG

SEQ ID NO: 577617 - protein, 6 aa, Mycobacterium
SERTPF

SEQ ID NO: 577618 - protein, 8 aa, Mycobacterium
SERTQQIA

SEQ ID NO: 577619 - protein, 9 aa, Mycobacterium
SERTRRPAA

SEQ ID NO: 577620 - protein, 13 aa, Mycobacterium
SERTTSLSKRAVT

SEQ ID NO: 577621 - protein, 4 aa, Mycobacterium
SERV

SEQ ID NO: 577622 - protein, 9 aa, Mycobacterium
SERVPTDGD

SEQ ID NO: 577623 - protein, 7 aa, Mycobacterium
SERVQPA

SEQ ID NO: 577624 - protein, 11 aa, Mycobacterium
SERVSKGGNPL

SEQ ID NO: 577625 - protein, 6 aa, Mycobacterium
SERYPE

SEQ ID NO: 577626 - protein, 18 aa, Mycobacterium
SERYPEYKANRSSTPDEF

SEQ ID NO: 577627 - protein, 6 aa, Mycobacterium
SERYTE

SEQ ID NO: 577628 - protein, 14 aa, Mycobacterium
SERYTPTGPEIARD

SEQ ID NO: 577629 - protein, 7 aa, Mycobacterium
SESAAEV

SEQ ID NO: 577630 - protein, 14 aa, Mycobacterium
SESAGADPHVPFGG

SEQ ID NO: 577631 - protein, 29 aa, Mycobacterium
SESAGADPHVPFGGAKKSGLGPKEQGRAA

SEQ ID NO: 577632 - protein, 29 aa, Mycobacterium
SESAGADPHVPFGGDKKSGLGPKEQGAAA

SEQ ID NO: 577633 - protein, 13 aa, Mycobacterium
SESAGKAAGLTPR

SEQ ID NO: 577634 - protein, 11 aa, Mycobacterium
SESALDGAEKG

SEQ ID NO: 577635 - protein, 10 aa, Mycobacterium
SESAQRGGAP

SEQ ID NO: 577636 - protein, 18 aa, Mycobacterium
SESAQRRRAGERRQEATI

SEQ ID NO: 577637 - protein, 16 aa, Mycobacterium
SESASIQLTTPVVPGG

SEQ ID NO: 577638 - protein, 11 aa, Mycobacterium
SESASNKKVSP

SEQ ID NO: 577639 - protein, 4 aa, Mycobacterium
SESD

SEQ ID NO: 577640 - protein, 16 aa, Mycobacterium
SESDGAEKGRGYNKVR

SEQ ID NO: 577641 - protein, 9 aa, Mycobacterium
SESDPAVSE

SEQ ID NO: 577642 - protein, 10 aa, Mycobacterium
SESDPAVSEA

SEQ ID NO: 577643 - protein, 14 aa, Mycobacterium
SESDPAVSEAFSSE

SEQ ID NO: 577644 - protein, 8 aa, Mycobacterium
SESDTAEL

SEQ ID NO: 577645 - protein, 13 aa, Mycobacterium
SESDTVAHPDPST

SEQ ID NO: 577646 - protein, 13 aa, Mycobacterium
SESDTVANPDPST

SEQ ID NO: 577647 - protein, 10 aa, Mycobacterium
SESDVPDQSG

SEQ ID NO: 577648 - protein, 9 aa, Mycobacterium
SESEADQAR

SEQ ID NO: 577649 - protein, 9 aa, Mycobacterium
SESEADQQR

SEQ ID NO: 577650 - protein, 9 aa, Mycobacterium
SESEADRKR

SEQ ID NO: 577651 - protein, 7 aa, Mycobacterium
SESEEAT

SEQ ID NO: 577652 - protein, 7 aa, Mycobacterium
SESEEHE

SEQ ID NO: 577653 - protein, 8 aa, Mycobacterium
SESEHHGS

SEQ ID NO: 577654 - protein, 12 aa, Mycobacterium
SESEKPSRVGEL

SEQ ID NO: 577655 - protein, 8 aa, Mycobacterium
SESGGHKA

SEQ ID NO: 577656 - protein, 7 aa, Mycobacterium
SESGHAT

SEQ ID NO: 577657 - protein, 6 aa, Mycobacterium
SESGQV

SEQ ID NO: 577658 - protein, 6 aa, Mycobacterium
SESGSI

SEQ ID NO: 577659 - protein, 7 aa, Mycobacterium
SESGTAE

SEQ ID NO: 577660 - protein, 9 aa, Mycobacterium
SESHGESLQ

SEQ ID NO: 577661 - protein, 4 aa, Mycobacterium
SESI

SEQ ID NO: 577662 - protein, 5 aa, Mycobacterium
SESIE

SEQ ID NO: 577663 - protein, 9 aa, Mycobacterium
SESKGVERL

SEQ ID NO: 577664 - protein, 6 aa, Mycobacterium
SESKSV

SEQ ID NO: 577665 - protein, 9 aa, Mycobacterium
SESLPKRTV

SEQ ID NO: 577666 - protein, 5 aa, Mycobacterium
SESLR

SEQ ID NO: 577667 - protein, 6 aa, Mycobacterium
SESLRD

SEQ ID NO: 577668 - protein, 7 aa, Mycobacterium
SESPAAG

SEQ ID NO: 577669 - protein, 8 aa, Mycobacterium
SESPAAGM

SEQ ID NO: 577670 - protein, 19 aa, Mycobacterium
SESPAGGLASSREQSEEYA

SEQ ID NO: 577671 - protein, 13 aa, Mycobacterium
SESPALHARNVTK

SEQ ID NO: 577672 - protein, 6 aa, Mycobacterium
SESPAR

SEQ ID NO: 577673 - protein, 14 aa, Mycobacterium
SESPASGLTRSKEV

SEQ ID NO: 577674 - protein, 17 aa, Mycobacterium
SESPASGMVRSPETAAE

SEQ ID NO: 577675 - protein, 14 aa, Mycobacterium
SESPDGEDVTESAR

SEQ ID NO: 577676 - protein, 21 aa, Mycobacterium
SESPGGVRNAGPARPGQDNDD

SEQ ID NO: 577677 - protein, 19 aa, Mycobacterium
SESPGQVRSAGPARPGQHN

SEQ ID NO: 577678 - protein, 6 aa, Mycobacterium
SESPRV

SEQ ID NO: 577679 - protein, 8 aa, Mycobacterium
SESRAGFN

SEQ ID NO: 577680 - protein, 6 aa, Mycobacterium
SESRAT

SEQ ID NO: 577681 - protein, 8 aa, Mycobacterium
SESRGRPI

SEQ ID NO: 577682 - protein, 7 aa, Mycobacterium
SESRKYY

SEQ ID NO: 577683 - protein, 15 aa, Mycobacterium
SESRSVSRSFEFREG

SEQ ID NO: 577684 - protein, 13 aa, Mycobacterium
SESRYGADGVGVS

SEQ ID NO: 577685 - protein, 9 aa, Mycobacterium
SESSERTKG

SEQ ID NO: 577686 - protein, 17 aa, Mycobacterium
SESSGGVTVRTPGETFT

SEQ ID NO: 577687 - protein, 9 aa, Mycobacterium
SESSNADDF

SEQ ID NO: 577688 - protein, 10 aa, Mycobacterium
SESSSAGRHD

SEQ ID NO: 577689 - protein, 22 aa, Mycobacterium
SESSTAVTRDLGNGHSENDLRP

SEQ ID NO: 577690 - protein, 5 aa, Mycobacterium
SESSV

SEQ ID NO: 577691 - protein, 12 aa, Mycobacterium
SESTASSNIENL

SEQ ID NO: 577692 - protein, 8 aa, Mycobacterium
SESTEPQR

SEQ ID NO: 577693 - protein, 7 aa, Mycobacterium
SESTGKR

SEQ ID NO: 577694 - protein, 5 aa, Mycobacterium
SESTV

SEQ ID NO: 577695 - protein, 9 aa, Mycobacterium
SESVADAHR

SEQ ID NO: 577696 - protein, 15 aa, Mycobacterium
SESVKRKKASKRQVG

SEQ ID NO: 577697 - protein, 5 aa, Mycobacterium
SESVR

SEQ ID NO: 577698 - protein, 9 aa, Mycobacterium
SESVRQTDT

SEQ ID NO: 577699 - protein, 6 aa, Mycobacterium
SESYNF

SEQ ID NO: 577700 - protein, 5 aa, Mycobacterium
SETAG

SEQ ID NO: 577701 - protein, 18 aa, Mycobacterium
SETAPEDLGYGDPRGHPR

SEQ ID NO: 577702 - protein, 7 aa, Mycobacterium
SETAPQE

SEQ ID NO: 577703 - protein, 5 aa, Mycobacterium
SETAT

SEQ ID NO: 577704 - protein, 6 aa, Mycobacterium
SETATV

SEQ ID NO: 577705 - protein, 5 aa, Mycobacterium
SETCS

SEQ ID NO: 577706 - protein, 7 aa, Mycobacterium
SETDEPH

SEQ ID NO: 577707 - protein, 8 aa, Mycobacterium
SETDPAIS

SEQ ID NO: 577708 - protein, 10 aa, Mycobacterium
SETDPAVSEA

SEQ ID NO: 577709 - protein, 11 aa, Mycobacterium
SETDPAVSEAF

SEQ ID NO: 577710 - protein, 13 aa, Mycobacterium
SETDPQETQARKA

SEQ ID NO: 577711 - protein, 9 aa, Mycobacterium
SETDQDLGD

SEQ ID NO: 577712 - protein, 5 aa, Mycobacterium
SETDR

SEQ ID NO: 577713 - protein, 7 aa, Mycobacterium
SETDRGA

SEQ ID NO: 577714 - protein, 9 aa, Mycobacterium
SETDSPDLA

SEQ ID NO: 577715 - protein, 7 aa, Mycobacterium
SETDVDP

SEQ ID NO: 577716 - protein, 4 aa, Mycobacterium
SETE

SEQ ID NO: 577717 - protein, 6 aa, Mycobacterium
SETEAT

SEQ ID NO: 577718 - protein, 17 aa, Mycobacterium
SETEDGDAETPEGLSSQ

SEQ ID NO: 577719 - protein, 12 aa, Mycobacterium
SETEKPSRVGEL

SEQ ID NO: 577720 - protein, 7 aa, Mycobacterium
SETEPGL

SEQ ID NO: 577721 - protein, 12 aa, Mycobacterium
SETEQPGPHTSY

SEQ ID NO: 577722 - protein, 26 aa, Mycobacterium
SETFGDTPRLTDKNPGGSTAPSCCAT

SEQ ID NO: 577723 - protein, 7 aa, Mycobacterium
SETFGRT

SEQ ID NO: 577724 - protein, 19 aa, Mycobacterium
SETFGTGPQRAGSDVEGDK

SEQ ID NO: 577725 - protein, 23 aa, Mycobacterium
SETFGTSPQHPADQESDAAEAGG

SEQ ID NO: 577726 - protein, 9 aa, Mycobacterium
SETGAAQAA

SEQ ID NO: 577727 - protein, 9 aa, Mycobacterium
SETGARGEG

SEQ ID NO: 577728 - protein, 7 aa, Mycobacterium
SETGDPE

SEQ ID NO: 577729 - protein, 16 aa, Mycobacterium
SETGDPPEPVDIPNDS

SEQ ID NO: 577730 - protein, 12 aa, Mycobacterium
SETGDYQERGLR

SEQ ID NO: 577731 - protein, 10 aa, Mycobacterium
SETGEENSGD

SEQ ID NO: 577732 - protein, 5 aa, Mycobacterium
SETGG

SEQ ID NO: 577733 - protein, 7 aa, Mycobacterium
SETGGPE

SEQ ID NO: 577734 - protein, 5 aa, Mycobacterium
SETGL

SEQ ID NO: 577735 - protein, 9 aa, Mycobacterium
SETGNGRLK

SEQ ID NO: 577736 - protein, 10 aa, Mycobacterium
SETGNGRLKT

SEQ ID NO: 577737 - protein, 7 aa, Mycobacterium
SETGRLE

SEQ ID NO: 577738 - protein, 8 aa, Mycobacterium
SETGSDVS

SEQ ID NO: 577739 - protein, 9 aa, Mycobacterium
SETGSGSAT

SEQ ID NO: 577740 - protein, 6 aa, Mycobacterium
SETGVT

SEQ ID NO: 577741 - protein, 6 aa, Mycobacterium
SETHTA

SEQ ID NO: 577742 - protein, 5 aa, Mycobacterium
SETIR

SEQ ID NO: 577743 - protein, 10 aa, Mycobacterium
SETKASEGVI

SEQ ID NO: 577744 - protein, 11 aa, Mycobacterium
SETKASEGVIP

SEQ ID NO: 577745 - protein, 22 aa, Mycobacterium
SETKGSEGVIPSAEQVPGEEYH

SEQ ID NO: 577746 - protein, 9 aa, Mycobacterium
SETKGVERI

SEQ ID NO: 577747 - protein, 4 aa, Mycobacterium
SETL

SEQ ID NO: 577748 - protein, 5 aa, Mycobacterium
SETLA

SEQ ID NO: 577749 - protein, 9 aa, Mycobacterium
SETLAQQGF

SEQ ID NO: 577750 - protein, 6 aa, Mycobacterium
SETLSA

SEQ ID NO: 577751 - protein, 4 aa, Mycobacterium
SETM

SEQ ID NO: 577752 - protein, 10 aa, Mycobacterium
SETNDSQSQP

SEQ ID NO: 577753 - protein, 7 aa, Mycobacterium
SETNLKT

SEQ ID NO: 577754 - protein, 7 aa, Mycobacterium
SETNPGV

SEQ ID NO: 577755 - protein, 6 aa, Mycobacterium
SETNPS

SEQ ID NO: 577756 - protein, 7 aa, Mycobacterium
SETNPSV

SEQ ID NO: 577757 - protein, 11 aa, Mycobacterium
SETNVGADDVA

SEQ ID NO: 577758 - protein, 6 aa, Mycobacterium
SETNVT

SEQ ID NO: 577759 - protein, 6 aa, Mycobacterium
SETPFD

SEQ ID NO: 577760 - protein, 26 aa, Mycobacterium
SETPIGAAAQRATQLKQGSVRLPKPA

SEQ ID NO: 577761 - protein, 7 aa, Mycobacterium
SETPLSA

SEQ ID NO: 577762 - protein, 8 aa, Mycobacterium
SETPRPGP

SEQ ID NO: 577763 - protein, 25 aa, Mycobacterium
SETPTNGTAAAAKYNSATTQAQPNV

SEQ ID NO: 577764 - protein, 15 aa, Mycobacterium
SETPYDAAPVPTTQY

SEQ ID NO: 577765 - protein, 9 aa, Mycobacterium
SETQGPARI

SEQ ID NO: 577766 - protein, 9 aa, Mycobacterium
SETQPAAAD

SEQ ID NO: 577767 - protein, 7 aa, Mycobacterium
SETQSRE

SEQ ID NO: 577768 - protein, 5 aa, Mycobacterium
SETRA

SEQ ID NO: 577769 - protein, 6 aa, Mycobacterium
SETRAG

SEQ ID NO: 577770 - protein, 9 aa, Mycobacterium
SETRTNPDH

SEQ ID NO: 577771 - protein, 6 aa, Mycobacterium
SETRTR

SEQ ID NO: 577772 - protein, 12 aa, Mycobacterium
SETRYDPGGGGI

SEQ ID NO: 577773 - protein, 12 aa, Mycobacterium
SETSADDDHLSA

SEQ ID NO: 577774 - protein, 24 aa, Mycobacterium
SETSPTASFNHPDRERKPGSIGTP

SEQ ID NO: 577775 - protein, 11 aa, Mycobacterium
SETSRECPPDA

SEQ ID NO: 577776 - protein, 6 aa, Mycobacterium
SETSSY

SEQ ID NO: 577777 - protein, 4 aa, Mycobacterium
SETT

SEQ ID NO: 577778 - protein, 13 aa, Mycobacterium
SETTAECGGGTPI

SEQ ID NO: 577779 - protein, 8 aa, Mycobacterium
SETTATAG

SEQ ID NO: 577780 - protein, 11 aa, Mycobacterium
SETTGISESTL

SEQ ID NO: 577781 - protein, 7 aa, Mycobacterium
SETTGTD

SEQ ID NO: 577782 - protein, 6 aa, Mycobacterium
SETTSI

SEQ ID NO: 577783 - protein, 17 aa, Mycobacterium
SETTSSRDVDTAKPEPG

SEQ ID NO: 577784 - protein, 6 aa, Mycobacterium
SETVDP

SEQ ID NO: 577785 - protein, 9 aa, Mycobacterium
SETVDPAKI

SEQ ID NO: 577786 - protein, 8 aa, Mycobacterium
SETVEDRV

SEQ ID NO: 577787 - protein, 5 aa, Mycobacterium
SETVG

SEQ ID NO: 577788 - protein, 6 aa, Mycobacterium
SETVND

SEQ ID NO: 577789 - protein, 9 aa, Mycobacterium
SETVPEGGG

SEQ ID NO: 577790 - protein, 13 aa, Mycobacterium
SETVTASRGGTMG

SEQ ID NO: 577791 - protein, 16 aa, Mycobacterium
SEVAAPVAPDPDTEGV

SEQ ID NO: 577792 - protein, 5 aa, Mycobacterium
SEVAG

SEQ ID NO: 577793 - protein, 8 aa, Mycobacterium
SEVAPASS

SEQ ID NO: 577794 - protein, 8 aa, Mycobacterium
SEVARGRH

SEQ ID NO: 577795 - protein, 4 aa, Mycobacterium
SEVD

SEQ ID NO: 577796 - protein, 10 aa, Mycobacterium
SEVDAEPTRT

SEQ ID NO: 577797 - protein, 8 aa, Mycobacterium
SEVDRGTT

SEQ ID NO: 577798 - protein, 17 aa, Mycobacterium
SEVEGAALDGHAEDFSG

SEQ ID NO: 577799 - protein, 9 aa, Mycobacterium
SEVEGAQPA

SEQ ID NO: 577800 - protein, 10 aa, Mycobacterium
SEVEQADDQV

SEQ ID NO: 577801 - protein, 12 aa, Mycobacterium
SEVGPKPGGPRR

SEQ ID NO: 577802 - protein, 10 aa, Mycobacterium
SEVHGQAGGG

SEQ ID NO: 577803 - protein, 12 aa, Mycobacterium
SEVKAGRGTPHG

SEQ ID NO: 577804 - protein, 4 aa, Mycobacterium
SEVP

SEQ ID NO: 577805 - protein, 17 aa, Mycobacterium
SEVPETMPDPDEDEEGC

SEQ ID NO: 577806 - protein, 17 aa, Mycobacterium
SEVPETMPDPDNDDEGC

SEQ ID NO: 577807 - protein, 17 aa, Mycobacterium
SEVPETMPDPEDDDEGC

SEQ ID NO: 577808 - protein, 8 aa, Mycobacterium
SEVPGDRW

SEQ ID NO: 577809 - protein, 7 aa, Mycobacterium
SEVPGLD

SEQ ID NO: 577810 - protein, 9 aa, Mycobacterium
SEVPKTKPR

SEQ ID NO: 577811 - protein, 9 aa, Mycobacterium
SEVPPPVEG

SEQ ID NO: 577812 - protein, 8 aa, Mycobacterium
SEVPQDGD

SEQ ID NO: 577813 - protein, 9 aa, Mycobacterium
SEVPRARRE

SEQ ID NO: 577814 - protein, 6 aa, Mycobacterium
SEVPRD

SEQ ID NO: 577815 - protein, 7 aa, Mycobacterium
SEVQRTP

SEQ ID NO: 577816 - protein, 4 aa, Mycobacterium
SEVS

SEQ ID NO: 577817 - protein, 12 aa, Mycobacterium
SEVSDGPGDVAD

SEQ ID NO: 577818 - protein, 8 aa, Mycobacterium
SEVSEPGD

SEQ ID NO: 577819 - protein, 9 aa, Mycobacterium
SEVSGDDRV

SEQ ID NO: 577820 - protein, 9 aa, Mycobacterium
SEVSQAGDY

SEQ ID NO: 577821 - protein, 7 aa, Mycobacterium
SEVSRTH

SEQ ID NO: 577822 - protein, 5 aa, Mycobacterium
SEVTA

SEQ ID NO: 577823 - protein, 11 aa, Mycobacterium
SEVTDADGKPI

SEQ ID NO: 577824 - protein, 13 aa, Mycobacterium
SEVTDADGKPVAT

SEQ ID NO: 577825 - protein, 5 aa, Mycobacterium
SEVTG

SEQ ID NO: 577826 - protein, 5 aa, Mycobacterium
SEVTP

SEQ ID NO: 577827 - protein, 5 aa, Mycobacterium
SEVTS

SEQ ID NO: 577828 - protein, 5 aa, Mycobacterium
SEVTT

SEQ ID NO: 577829 - protein, 5 aa, Mycobacterium
SEVYA

SEQ ID NO: 577830 - protein, 6 aa, Mycobacterium
SEVYEE

SEQ ID NO: 577831 - protein, 15 aa, Mycobacterium
SEVYGDPEVHPQPER

SEQ ID NO: 577832 - protein, 6 aa, Mycobacterium
SEWAQG

SEQ ID NO: 577833 - protein, 7 aa, Mycobacterium
SEWPPAG

SEQ ID NO: 577834 - protein, 5 aa, Mycobacterium
SEYAA

SEQ ID NO: 577835 - protein, 13 aa, Mycobacterium
SEYATRRQQCQTA

SEQ ID NO: 577836 - protein, 5 aa, Mycobacterium
SEYDA

SEQ ID NO: 577837 - protein, 10 aa, Mycobacterium
SEYDAVKGSP

SEQ ID NO: 577838 - protein, 33 aa, Mycobacterium
SEYDPEGPLPDVDPTGDASITRGKARHGDPREI

SEQ ID NO: 577839 - protein, 10 aa, Mycobacterium
SEYEASEDYL

SEQ ID NO: 577840 - protein, 14 aa, Mycobacterium
SEYEASPDYQDDKA

SEQ ID NO: 577841 - protein, 13 aa, Mycobacterium
SEYEDRDGNRRSS

SEQ ID NO: 577842 - protein, 7 aa, Mycobacterium
SEYETEL

SEQ ID NO: 577843 - protein, 4 aa, Mycobacterium
SEYG

SEQ ID NO: 577844 - protein, 5 aa, Mycobacterium
SEYGG

SEQ ID NO: 577845 - protein, 8 aa, Mycobacterium
SEYGKANR

SEQ ID NO: 577846 - protein, 5 aa, Mycobacterium
SEYGP

SEQ ID NO: 577847 - protein, 33 aa, Mycobacterium
SEYGPQATTQTLRSNETNGDTIDSARGDGSNHR

SEQ ID NO: 577848 - protein, 7 aa, Mycobacterium
SEYGSST

SEQ ID NO: 577849 - protein, 5 aa, Mycobacterium
SEYGT

SEQ ID NO: 577850 - protein, 6 aa, Mycobacterium
SEYKGY

SEQ ID NO: 577851 - protein, 4 aa, Mycobacterium
SEYQ

SEQ ID NO: 577852 - protein, 8 aa, Mycobacterium
SEYYGNPR

SEQ ID NO: 577853 - protein, 4 aa, Mycobacterium
SFAA

SEQ ID NO: 577854 - protein, 12 aa, Mycobacterium
SFAAGDSGLQPL

SEQ ID NO: 577855 - protein, 13 aa, Mycobacterium
SFAAGDSNLQPLN

SEQ ID NO: 577856 - protein, 13 aa, Mycobacterium
SFAAGNSDLQPLN

SEQ ID NO: 577857 - protein, 11 aa, Mycobacterium
SFAATTQESLA

SEQ ID NO: 577858 - protein, 13 aa, Mycobacterium
SFADKASGTTTDQ

SEQ ID NO: 577859 - protein, 4 aa, Mycobacterium
SFAE

SEQ ID NO: 577860 - protein, 9 aa, Mycobacterium
SFAENATAP

SEQ ID NO: 577861 - protein, 13 aa, Mycobacterium
SFAENGSAGTTVR

SEQ ID NO: 577862 - protein, 7 aa, Mycobacterium
SFAESTH

SEQ ID NO: 577863 - protein, 14 aa, Mycobacterium
SFAETARTAQRSFD

SEQ ID NO: 577864 - protein, 6 aa, Mycobacterium
SFANPS

SEQ ID NO: 577865 - protein, 5 aa, Mycobacterium
SFAPQ

SEQ ID NO: 577866 - protein, 6 aa, Mycobacterium
SFARNA

SEQ ID NO: 577867 - protein, 6 aa, Mycobacterium
SFDATD

SEQ ID NO: 577868 - protein, 6 aa, Mycobacterium
SFDDPD

SEQ ID NO: 577869 - protein, 20 aa, Mycobacterium
SFDEGSFDEGSFDGGGSARL

SEQ ID NO: 577870 - protein, 6 aa, Mycobacterium
SFDEKR

SEQ ID NO: 577871 - protein, 12 aa, Mycobacterium
SFDEKSLAENYG

SEQ ID NO: 577872 - protein, 6 aa, Mycobacterium
SFDEPV

SEQ ID NO: 577873 - protein, 6 aa, Mycobacterium
SFDETK

SEQ ID NO: 577874 - protein, 9 aa, Mycobacterium
SFDETPSPD

SEQ ID NO: 577875 - protein, 4 aa, Mycobacterium
SFDG

SEQ ID NO: 577876 - protein, 18 aa, Mycobacterium
SFDPAGGDGGNGGQGGNA

SEQ ID NO: 577877 - protein, 6 aa, Mycobacterium
SFDPAK

SEQ ID NO: 577878 - protein, 17 aa, Mycobacterium
SFDPDDAGSEPSPPLGK

SEQ ID NO: 577879 - protein, 17 aa, Mycobacterium
SFDPDDASSEPSPPLSK

SEQ ID NO: 577880 - protein, 10 aa, Mycobacterium
SFDPREQPTC

SEQ ID NO: 577881 - protein, 9 aa, Mycobacterium
SFDPRERPR

SEQ ID NO: 577882 - protein, 12 aa, Mycobacterium
SFDSAQDGTVLS

SEQ ID NO: 577883 - protein, 9 aa, Mycobacterium
SFDSPDRGW

SEQ ID NO: 577884 - protein, 10 aa, Mycobacterium
SFDTSDDGLK

SEQ ID NO: 577885 - protein, 10 aa, Mycobacterium
SFEELEDRSR

SEQ ID NO: 577886 - protein, 5 aa, Mycobacterium
SFEEN

SEQ ID NO: 577887 - protein, 7 aa, Mycobacterium
SFEGRQE

SEQ ID NO: 577888 - protein, 11 aa, Mycobacterium
SFETKTGETRT

SEQ ID NO: 577889 - protein, 7 aa, Mycobacterium
SFGAARS

SEQ ID NO: 577890 - protein, 7 aa, Mycobacterium
SFGADGR

SEQ ID NO: 577891 - protein, 8 aa, Mycobacterium
SFGAGGAN

SEQ ID NO: 577892 - protein, 9 aa, Mycobacterium
SFGAGGANA

SEQ ID NO: 577893 - protein, 8 aa, Mycobacterium
SFGAGGTN

SEQ ID NO: 577894 - protein, 10 aa, Mycobacterium
SFGAKGYRIT

SEQ ID NO: 577895 - protein, 9 aa, Mycobacterium
SFGASASGL

SEQ ID NO: 577896 - protein, 7 aa, Mycobacterium
SFGDDKD

SEQ ID NO: 577897 - protein, 10 aa, Mycobacterium
SFGDDSGVLD

SEQ ID NO: 577898 - protein, 13 aa, Mycobacterium
SFGDSDGDGVGDI

SEQ ID NO: 577899 - protein, 14 aa, Mycobacterium
SFGERRQPNTESFW

SEQ ID NO: 577900 - protein, 16 aa, Mycobacterium
SFGETARGAQAAFDSR

SEQ ID NO: 577901 - protein, 9 aa, Mycobacterium
SFGETPAPD

SEQ ID NO: 577902 - protein, 4 aa, Mycobacterium
SFGG

SEQ ID NO: 577903 - protein, 13 aa, Mycobacterium
SFGGEAQHQPDAR

SEQ ID NO: 577904 - protein, 43 aa, Mycobacterium
SFGGGKSAPAKGSDTGAAKGVAKAPQKVPGVSPAAKAPDRSLD

SEQ ID NO: 577905 - protein, 8 aa, Mycobacterium
SFGGNPDA

SEQ ID NO: 577906 - protein, 5 aa, Mycobacterium
SFGGS

SEQ ID NO: 577907 - protein, 12 aa, Mycobacterium
SFGGTPPPYPGW

SEQ ID NO: 577908 - protein, 5 aa, Mycobacterium
SFGID

SEQ ID NO: 577909 - protein, 14 aa, Mycobacterium
SFGKSAKAWKADDT

SEQ ID NO: 577910 - protein, 9 aa, Mycobacterium
SFGKTKAVD

SEQ ID NO: 577911 - protein, 8 aa, Mycobacterium
SFGPGRPG

SEQ ID NO: 577912 - protein, 7 aa, Mycobacterium
SFGPNGL

SEQ ID NO: 577913 - protein, 11 aa, Mycobacterium
SFGPPSISTDD

SEQ ID NO: 577914 - protein, 6 aa, Mycobacterium
SFGRGP

SEQ ID NO: 577915 - protein, 6 aa, Mycobacterium
SFGRTR

SEQ ID NO: 577916 - protein, 9 aa, Mycobacterium
SFGSADAAT

SEQ ID NO: 577917 - protein, 9 aa, Mycobacterium
SFGSASRTW

SEQ ID NO: 577918 - protein, 13 aa, Mycobacterium
SFGSGKGKDAITS

SEQ ID NO: 577919 - protein, 5 aa, Mycobacterium
SFGSN

SEQ ID NO: 577920 - protein, 9 aa, Mycobacterium
SFGSRENRP

SEQ ID NO: 577921 - protein, 10 aa, Mycobacterium
SFGTQTDSER

SEQ ID NO: 577922 - protein, 14 aa, Mycobacterium
SFGTVEERQDPNKA

SEQ ID NO: 577923 - protein, 4 aa, Mycobacterium
SFHQ

SEQ ID NO: 577924 - protein, 10 aa, Mycobacterium
SFKRSTENTR

SEQ ID NO: 577925 - protein, 5 aa, Mycobacterium
SFLSP

SEQ ID NO: 577926 - protein, 10 aa, Mycobacterium
SFNGADESEL

SEQ ID NO: 577927 - protein, 8 aa, Mycobacterium
SFNGGPVG

SEQ ID NO: 577928 - protein, 5 aa, Mycobacterium
SFNPV

SEQ ID NO: 577929 - protein, 11 aa, Mycobacterium
SFNRPKLPGIP

SEQ ID NO: 577930 - protein, 46 aa, Mycobacterium
SFNTGSGNSGSFNTGSGNSGNVNTGFGSTTDTGLTNSGFNNTGTLS

SEQ ID NO: 577931 - protein, 4 aa, Mycobacterium
SFPA

SEQ ID NO: 577932 - protein, 7 aa, Mycobacterium
SFPAKNE

SEQ ID NO: 577933 - protein, 42 aa, Mycobacterium
SFPASDPGQATNGHADDHKVQSAAAHSKGRVSSPVTVKSDEL

SEQ ID NO: 577934 - protein, 10 aa, Mycobacterium
SFPDGDMSTN

SEQ ID NO: 577935 - protein, 10 aa, Mycobacterium
SFPDNRNLDK

SEQ ID NO: 577936 - protein, 10 aa, Mycobacterium
SFPDPSALSG

SEQ ID NO: 577937 - protein, 4 aa, Mycobacterium
SFPE

SEQ ID NO: 577938 - protein, 10 aa, Mycobacterium
SFPEGKSGTY

SEQ ID NO: 577939 - protein, 6 aa, Mycobacterium
SFPEPE

SEQ ID NO: 577940 - protein, 7 aa, Mycobacterium
SFPEPGP

SEQ ID NO: 577941 - protein, 5 aa, Mycobacterium
SFPET

SEQ ID NO: 577942 - protein, 9 aa, Mycobacterium
SFPETEQPT

SEQ ID NO: 577943 - protein, 12 aa, Mycobacterium
SFPEVDPAERAQ

SEQ ID NO: 577944 - protein, 12 aa, Mycobacterium
SFPEVGGTERAE

SEQ ID NO: 577945 - protein, 4 aa, Mycobacterium
SFPG

SEQ ID NO: 577946 - protein, 7 aa, Mycobacterium
SFPGAPP

SEQ ID NO: 577947 - protein, 8 aa, Mycobacterium
SFPGDDAA

SEQ ID NO: 577948 - protein, 9 aa, Mycobacterium
SFPGEPPYV

SEQ ID NO: 577949 - protein, 13 aa, Mycobacterium
SFPGTGAVPPSPF

SEQ ID NO: 577950 - protein, 4 aa, Mycobacterium
SFPN

SEQ ID NO: 577951 - protein, 13 aa, Mycobacterium
SFPNHEANPLEPA

SEQ ID NO: 577952 - protein, 17 aa, Mycobacterium
SFPPAGGGRRRSAIEHD

SEQ ID NO: 577953 - protein, 6 aa, Mycobacterium
SFPRTE

SEQ ID NO: 577954 - protein, 11 aa, Mycobacterium
SFPRTPPSGWH

SEQ ID NO: 577955 - protein, 9 aa, Mycobacterium
SFPSEDGVP

SEQ ID NO: 577956 - protein, 8 aa, Mycobacterium
SFPSLTPD

SEQ ID NO: 577957 - protein, 7 aa, Mycobacterium
SFPTDRG

SEQ ID NO: 577958 - protein, 32 aa, Mycobacterium
SFPTDRTLAPRSRRSPASARHLPDGSRFDPMS

SEQ ID NO: 577959 - protein, 4 aa, Mycobacterium
SFQS

SEQ ID NO: 577960 - protein, 11 aa, Mycobacterium
SFQSKRDRLGS

SEQ ID NO: 577961 - protein, 7 aa, Mycobacterium
SFQSPRH

SEQ ID NO: 577962 - protein, 10 aa, Mycobacterium
SFRDPSGNNI

SEQ ID NO: 577963 - protein, 7 aa, Mycobacterium
SFRDSGV

SEQ ID NO: 577964 - protein, 13 aa, Mycobacterium
SFRDSNGDGVGDL

SEQ ID NO: 577965 - protein, 9 aa, Mycobacterium
SFRDSTSRE

SEQ ID NO: 577966 - protein, 9 aa, Mycobacterium
SFRENADAP

SEQ ID NO: 577967 - protein, 6 aa, Mycobacterium
SFRGES

SEQ ID NO: 577968 - protein, 7 aa, Mycobacterium
SFRGPGL

SEQ ID NO: 577969 - protein, 8 aa, Mycobacterium
SFRGPTKR

SEQ ID NO: 577970 - protein, 5 aa, Mycobacterium
SFRSG

SEQ ID NO: 577971 - protein, 5 aa, Mycobacterium
SFRTG

SEQ ID NO: 577972 - protein, 12 aa, Mycobacterium
SFSADARGRFPG

SEQ ID NO: 577973 - protein, 5 aa, Mycobacterium
SFSDP

SEQ ID NO: 577974 - protein, 16 aa, Mycobacterium
SFSDTRGPHPSARRSA

SEQ ID NO: 577975 - protein, 8 aa, Mycobacterium
SFSENATA

SEQ ID NO: 577976 - protein, 7 aa, Mycobacterium
SFSGDPQ

SEQ ID NO: 577977 - protein, 12 aa, Mycobacterium
SFSGNGNDGLFP

SEQ ID NO: 577978 - protein, 21 aa, Mycobacterium
SFSGRNAERNEKTAAEAAAAG

SEQ ID NO: 577979 - protein, 10 aa, Mycobacterium
SFSPSTSSRT

SEQ ID NO: 577980 - protein, 13 aa, Mycobacterium
SFSPTGPRGAGRH

SEQ ID NO: 577981 - protein, 16 aa, Mycobacterium
SFSQDANGYSRSEGGG

SEQ ID NO: 577982 - protein, 10 aa, Mycobacterium
SFSQSGAAMT

SEQ ID NO: 577983 - protein, 5 aa, Mycobacterium
SFSSV

SEQ ID NO: 577984 - protein, 29 aa, Mycobacterium
SFSSVTSGLAGDAWQGAASAAMTAAASSY

SEQ ID NO: 577985 - protein, 7 aa, Mycobacterium
SFSTGAD

SEQ ID NO: 577986 - protein, 5 aa, Mycobacterium
SFTAT

SEQ ID NO: 577987 - protein, 14 aa, Mycobacterium
SFTEGDRAVTDDRH

SEQ ID NO: 577988 - protein, 9 aa, Mycobacterium
SFTENATGE

SEQ ID NO: 577989 - protein, 9 aa, Mycobacterium
SFTEPADAL

SEQ ID NO: 577990 - protein, 7 aa, Mycobacterium
SFTEPER

SEQ ID NO: 577991 - protein, 5 aa, Mycobacterium
SFTGY

SEQ ID NO: 577992 - protein, 5 aa, Mycobacterium
SFTHP

SEQ ID NO: 577993 - protein, 12 aa, Mycobacterium
SFTNDPKRTWTT

SEQ ID NO: 577994 - protein, 8 aa, Mycobacterium
SFTPTEQL

SEQ ID NO: 577995 - protein, 12 aa, Mycobacterium
SFTSGDDRLDSQ

SEQ ID NO: 577996 - protein, 6 aa, Mycobacterium
SFTTDG

SEQ ID NO: 577997 - protein, 10 aa, Mycobacterium
SFTTENSHDI

SEQ ID NO: 577998 - protein, 16 aa, Mycobacterium
SFTTGSTVTADGGFNQ

SEQ ID NO: 577999 - protein, 11 aa, Mycobacterium
SFVGRDNKAMG

SEQ ID NO: 578000 - protein, 7 aa, Mycobacterium
SGAAAAA

SEQ ID NO: 578001 - protein, 6 aa, Mycobacterium
SGAAAE

SEQ ID NO: 578002 - protein, 13 aa, Mycobacterium
SGAAANATNEALG

SEQ ID NO: 578003 - protein, 5 aa, Mycobacterium
SGAAD

SEQ ID NO: 578004 - protein, 10 aa, Mycobacterium
SGAADGRDAE

SEQ ID NO: 578005 - protein, 13 aa, Mycobacterium
SGAADPTTSDEDL

SEQ ID NO: 578006 - protein, 11 aa, Mycobacterium
SGAADREQERY

SEQ ID NO: 578007 - protein, 5 aa, Mycobacterium
SGAAE

SEQ ID NO: 578008 - protein, 6 aa, Mycobacterium
SGAAEA

SEQ ID NO: 578009 - protein, 5 aa, Mycobacterium
SGAAG

SEQ ID NO: 578010 - protein, 8 aa, Mycobacterium
SGAAGGAT

SEQ ID NO: 578011 - protein, 31 aa, Mycobacterium
SGAAGGNSGLNNSGGTSSGGFNSDPGTSGFF

SEQ ID NO: 578012 - protein, 8 aa, Mycobacterium
SGAAGNLA

SEQ ID NO: 578013 - protein, 8 aa, Mycobacterium
SGAAGQYD

SEQ ID NO: 578014 - protein, 9 aa, Mycobacterium
SGAAGQYDP

SEQ ID NO: 578015 - protein, 16 aa, Mycobacterium
SGAAGSGGHGGTGGAA

SEQ ID NO: 578016 - protein, 8 aa, Mycobacterium
SGAAGVGR

SEQ ID NO: 578017 - protein, 5 aa, Mycobacterium
SGAAI

SEQ ID NO: 578018 - protein, 5 aa, Mycobacterium
SGAAL

SEQ ID NO: 578019 - protein, 6 aa, Mycobacterium
SGAALS

SEQ ID NO: 578020 - protein, 17 aa, Mycobacterium
SGAANLSALRERGVTEL

SEQ ID NO: 578021 - protein, 13 aa, Mycobacterium
SGAANRDETAGES

SEQ ID NO: 578022 - protein, 11 aa, Mycobacterium
SGAAPGAGETR

SEQ ID NO: 578023 - protein, 7 aa, Mycobacterium
SGAAPKL

SEQ ID NO: 578024 - protein, 8 aa, Mycobacterium
SGAAPPER

SEQ ID NO: 578025 - protein, 14 aa, Mycobacterium
SGAAQGRPAITTGE

SEQ ID NO: 578026 - protein, 12 aa, Mycobacterium
SGAAQKDQPAAQ

SEQ ID NO: 578027 - protein, 10 aa, Mycobacterium
SGAARARELA

SEQ ID NO: 578028 - protein, 10 aa, Mycobacterium
SGAARGDFGS

SEQ ID NO: 578029 - protein, 6 aa, Mycobacterium
SGAARS

SEQ ID NO: 578030 - protein, 6 aa, Mycobacterium
SGAART

SEQ ID NO: 578031 - protein, 14 aa, Mycobacterium
SGAASAVGATAVGP

SEQ ID NO: 578032 - protein, 10 aa, Mycobacterium
SGAASDDPYT

SEQ ID NO: 578033 - protein, 20 aa, Mycobacterium
SGAASGPSVEIRSGSADSGW

SEQ ID NO: 578034 - protein, 15 aa, Mycobacterium
SGAASSRIGTGPAHA

SEQ ID NO: 578035 - protein, 14 aa, Mycobacterium
SGAASYAGAEATSV

SEQ ID NO: 578036 - protein, 10 aa, Mycobacterium
SGAATPTAAV

SEQ ID NO: 578037 - protein, 14 aa, Mycobacterium
SGAAVGSAAAYPGI

SEQ ID NO: 578038 - protein, 6 aa, Mycobacterium
SGAAVI

SEQ ID NO: 578039 - protein, 13 aa, Mycobacterium
SGAAVSVTSGHDT

SEQ ID NO: 578040 - protein, 13 aa, Mycobacterium
SGAAYSADSAKTF

SEQ ID NO: 578041 - protein, 9 aa, Mycobacterium
SGAAYSAES

SEQ ID NO: 578042 - protein, 6 aa, Mycobacterium
SGACKG

SEQ ID NO: 578043 - protein, 5 aa, Mycobacterium
SGACS

SEQ ID NO: 578044 - protein, 9 aa, Mycobacterium
SGADAERAN

SEQ ID NO: 578045 - protein, 15 aa, Mycobacterium
SGADAGSAEARARAE

SEQ ID NO: 578046 - protein, 6 aa, Mycobacterium
SGADDD

SEQ ID NO: 578047 - protein, 9 aa, Mycobacterium
SGADDDTIE

SEQ ID NO: 578048 - protein, 15 aa, Mycobacterium
SGADDTVGTTRQSLG

SEQ ID NO: 578049 - protein, 8 aa, Mycobacterium
SGADEVSA

SEQ ID NO: 578050 - protein, 32 aa, Mycobacterium
SGADGEATGISAGGDGGSATGADSLGGRGGTS

SEQ ID NO: 578051 - protein, 7 aa, Mycobacterium
SGADGGQ

SEQ ID NO: 578052 - protein, 10 aa, Mycobacterium
SGADGTEIDR

SEQ ID NO: 578053 - protein, 8 aa, Mycobacterium
SGADLPRG

SEQ ID NO: 578054 - protein, 6 aa, Mycobacterium
SGADLT

SEQ ID NO: 578055 - protein, 11 aa, Mycobacterium
SGADPDAVRGQ

SEQ ID NO: 578056 - protein, 10 aa, Mycobacterium
SGADPDTVRE

SEQ ID NO: 578057 - protein, 7 aa, Mycobacterium
SGADPFA

SEQ ID NO: 578058 - protein, 7 aa, Mycobacterium
SGADPRI

SEQ ID NO: 578059 - protein, 9 aa, Mycobacterium
SGADPRTFD

SEQ ID NO: 578060 - protein, 8 aa, Mycobacterium
SGADPTPV

SEQ ID NO: 578061 - protein, 10 aa, Mycobacterium
SGADRDEDGS

SEQ ID NO: 578062 - protein, 6 aa, Mycobacterium
SGADRT

SEQ ID NO: 578063 - protein, 9 aa, Mycobacterium
SGADTDPHS

SEQ ID NO: 578064 - protein, 15 aa, Mycobacterium
SGADTPSPFGPGPAA

SEQ ID NO: 578065 - protein, 7 aa, Mycobacterium
SGADTTG

SEQ ID NO: 578066 - protein, 6 aa, Mycobacterium
SGADVR

SEQ ID NO: 578067 - protein, 11 aa, Mycobacterium
SGAEAASSRAA

SEQ ID NO: 578068 - protein, 7 aa, Mycobacterium
SGAEAVE

SEQ ID NO: 578069 - protein, 9 aa, Mycobacterium
SGAEAVESG

SEQ ID NO: 578070 - protein, 5 aa, Mycobacterium
SGAEI

SEQ ID NO: 578071 - protein, 9 aa, Mycobacterium
SGAENCASD

SEQ ID NO: 578072 - protein, 6 aa, Mycobacterium
SGAENQ

SEQ ID NO: 578073 - protein, 5 aa, Mycobacterium
SGAEP

SEQ ID NO: 578074 - protein, 8 aa, Mycobacterium
SGAEPGRL

SEQ ID NO: 578075 - protein, 24 aa, Mycobacterium
SGAEPQRLGSAAPYAAPNEALPTA

SEQ ID NO: 578076 - protein, 14 aa, Mycobacterium
SGAEPRRWPGQAPE

SEQ ID NO: 578077 - protein, 6 aa, Mycobacterium
SGAEPV

SEQ ID NO: 578078 - protein, 9 aa, Mycobacterium
SGAEQCRGN

SEQ ID NO: 578079 - protein, 18 aa, Mycobacterium
SGAEQHQAPVGDAPTCGF

SEQ ID NO: 578080 - protein, 8 aa, Mycobacterium
SGAEREQL

SEQ ID NO: 578081 - protein, 5 aa, Mycobacterium
SGAES

SEQ ID NO: 578082 - protein, 9 aa, Mycobacterium
SGAESGEGV

SEQ ID NO: 578083 - protein, 6 aa, Mycobacterium
SGAESI

SEQ ID NO: 578084 - protein, 6 aa, Mycobacterium
SGAETA

SEQ ID NO: 578085 - protein, 8 aa, Mycobacterium
SGAETAET

SEQ ID NO: 578086 - protein, 7 aa, Mycobacterium
SGAETPR

SEQ ID NO: 578087 - protein, 5 aa, Mycobacterium
SGAEV

SEQ ID NO: 578088 - protein, 8 aa, Mycobacterium
SGAEVGGA

SEQ ID NO: 578089 - protein, 4 aa, Mycobacterium
SGAF

SEQ ID NO: 578090 - protein, 5 aa, Mycobacterium
SGAFT

SEQ ID NO: 578091 - protein, 14 aa, Mycobacterium
SGAFTDSEAQSRDL

SEQ ID NO: 578092 - protein, 9 aa, Mycobacterium
SGAGAGADF

SEQ ID NO: 578093 - protein, 10 aa, Mycobacterium
SGAGAGAVSQ

SEQ ID NO: 578094 - protein, 7 aa, Mycobacterium
SGAGAGV

SEQ ID NO: 578095 - protein, 7 aa, Mycobacterium
SGAGARS

SEQ ID NO: 578096 - protein, 7 aa, Mycobacterium
SGAGASD

SEQ ID NO: 578097 - protein, 18 aa, Mycobacterium
SGAGAYTSAEAASAASIA

SEQ ID NO: 578098 - protein, 11 aa, Mycobacterium
SGAGDGSSISD

SEQ ID NO: 578099 - protein, 17 aa, Mycobacterium
SGAGDGSSISDADFKRA

SEQ ID NO: 578100 - protein, 6 aa, Mycobacterium
SGAGDI

SEQ ID NO: 578101 - protein, 17 aa, Mycobacterium
SGAGDKESLAAGTSTER

SEQ ID NO: 578102 - protein, 8 aa, Mycobacterium
SGAGEGAL

SEQ ID NO: 578103 - protein, 5 aa, Mycobacterium
SGAGF

SEQ ID NO: 578104 - protein, 5 aa, Mycobacterium
SGAGG

SEQ ID NO: 578105 - protein, 15 aa, Mycobacterium
SGAGGAGGDGGNGGY

SEQ ID NO: 578106 - protein, 9 aa, Mycobacterium
SGAGGASGL

SEQ ID NO: 578107 - protein, 14 aa, Mycobacterium
SGAGGDALRERTSA

SEQ ID NO: 578108 - protein, 6 aa, Mycobacterium
SGAGGG

SEQ ID NO: 578109 - protein, 9 aa, Mycobacterium
SGAGGGNTG

SEQ ID NO: 578110 - protein, 22 aa, Mycobacterium
SGAGGGSGSASALAGGSGLNGI

SEQ ID NO: 578111 - protein, 7 aa, Mycobacterium
SGAGGMT

SEQ ID NO: 578112 - protein, 16 aa, Mycobacterium
SGAGGNSGLGNNGSGL

SEQ ID NO: 578113 - protein, 12 aa, Mycobacterium
SGAGGSSGFGNF

SEQ ID NO: 578114 - protein, 10 aa, Mycobacterium
SGAGGTGKDA

SEQ ID NO: 578115 - protein, 9 aa, Mycobacterium
SGAGGTGKE

SEQ ID NO: 578116 - protein, 24 aa, Mycobacterium
SGAGHTAAGDDNDAFSEVVTRFVL

SEQ ID NO: 578117 - protein, 7 aa, Mycobacterium
SGAGKSS

SEQ ID NO: 578118 - protein, 11 aa, Mycobacterium
SGAGKSSVATR

SEQ ID NO: 578119 - protein, 7 aa, Mycobacterium
SGAGKST

SEQ ID NO: 578120 - protein, 16 aa, Mycobacterium
SGAGKTKLAGGSLEAG

SEQ ID NO: 578121 - protein, 9 aa, Mycobacterium
SGAGLSATT

SEQ ID NO: 578122 - protein, 8 aa, Mycobacterium
SGAGNSYA

SEQ ID NO: 578123 - protein, 7 aa, Mycobacterium
SGAGPAL

SEQ ID NO: 578124 - protein, 6 aa, Mycobacterium
SGAGPS

SEQ ID NO: 578125 - protein, 25 aa, Mycobacterium
SGAGPSAAQLAAAQKATRPAKPEQL

SEQ ID NO: 578126 - protein, 17 aa, Mycobacterium
SGAGQNAVAAGAVSEGT

SEQ ID NO: 578127 - protein, 7 aa, Mycobacterium
SGAGQRA

SEQ ID NO: 578128 - protein, 6 aa, Mycobacterium
SGAGRF

SEQ ID NO: 578129 - protein, 10 aa, Mycobacterium
SGAGRGTTAK

SEQ ID NO: 578130 - protein, 6 aa, Mycobacterium
SGAGRR

SEQ ID NO: 578131 - protein, 6 aa, Mycobacterium
SGAGRT

SEQ ID NO: 578132 - protein, 7 aa, Mycobacterium
SGAGSAL

SEQ ID NO: 578133 - protein, 18 aa, Mycobacterium
SGAGSASGFGNSGADNSG

SEQ ID NO: 578134 - protein, 7 aa, Mycobacterium
SGAGSLS

SEQ ID NO: 578135 - protein, 8 aa, Mycobacterium
SGAGSTEN

SEQ ID NO: 578136 - protein, 6 aa, Mycobacterium
SGAGTL

SEQ ID NO: 578137 - protein, 6 aa, Mycobacterium
SGAGTS

SEQ ID NO: 578138 - protein, 7 aa, Mycobacterium
SGAGTSD

SEQ ID NO: 578139 - protein, 7 aa, Mycobacterium
SGAGTSF

SEQ ID NO: 578140 - protein, 10 aa, Mycobacterium
SGAGTTAAGL

SEQ ID NO: 578141 - protein, 15 aa, Mycobacterium
SGAGVGGPAAYAARA

SEQ ID NO: 578142 - protein, 11 aa, Mycobacterium
SGAGVGGPAGY

SEQ ID NO: 578143 - protein, 14 aa, Mycobacterium
SGAGVQVIEHAAGV

SEQ ID NO: 578144 - protein, 16 aa, Mycobacterium
SGAHAEQAAEQAKTAA

SEQ ID NO: 578145 - protein, 6 aa, Mycobacterium
SGAHAP

SEQ ID NO: 578146 - protein, 7 aa, Mycobacterium
SGAHAST

SEQ ID NO: 578147 - protein, 6 aa, Mycobacterium
SGAHDR

SEQ ID NO: 578148 - protein, 5 aa, Mycobacterium
SGAHR

SEQ ID NO: 578149 - protein, 13 aa, Mycobacterium
SGAHSHLSGGQAE

SEQ ID NO: 578150 - protein, 4 aa, Mycobacterium
SGAI

SEQ ID NO: 578151 - protein, 14 aa, Mycobacterium
SGAIEKAKKAAEPL

SEQ ID NO: 578152 - protein, 10 aa, Mycobacterium
SGAIPDPQRE

SEQ ID NO: 578153 - protein, 5 aa, Mycobacterium
SGAIT

SEQ ID NO: 578154 - protein, 7 aa, Mycobacterium
SGAKAIV

SEQ ID NO: 578155 - protein, 8 aa, Mycobacterium
SGAKAIVG

SEQ ID NO: 578156 - protein, 6 aa, Mycobacterium
SGAKAL

SEQ ID NO: 578157 - protein, 6 aa, Mycobacterium
SGAKDQ

SEQ ID NO: 578158 - protein, 8 aa, Mycobacterium
SGAKKRIS

SEQ ID NO: 578159 - protein, 11 aa, Mycobacterium
SGAKPASDDEA

SEQ ID NO: 578160 - protein, 4 aa, Mycobacterium
SGAL

SEQ ID NO: 578161 - protein, 40 aa, Mycobacterium
SGALDSARAGSGRAASPTDAPGAANAALASGAGARRSGGA

SEQ ID NO: 578162 - protein, 5 aa, Mycobacterium
SGALG

SEQ ID NO: 578163 - protein, 8 aa, Mycobacterium
SGALGAQD

SEQ ID NO: 578164 - protein, 12 aa, Mycobacterium
SGALGDDEIAAP

SEQ ID NO: 578165 - protein, 5 aa, Mycobacterium
SGALP

SEQ ID NO: 578166 - protein, 7 aa, Mycobacterium
SGALPAA

SEQ ID NO: 578167 - protein, 9 aa, Mycobacterium
SGALPGPLT

SEQ ID NO: 578168 - protein, 11 aa, Mycobacterium
SGALSHRGDDA

SEQ ID NO: 578169 - protein, 20 aa, Mycobacterium
SGALSNVNTATDLRVPAQPR

SEQ ID NO: 578170 - protein, 11 aa, Mycobacterium
SGALTNADEAV

SEQ ID NO: 578171 - protein, 11 aa, Mycobacterium
SGAMGGSASEE

SEQ ID NO: 578172 - protein, 8 aa, Mycobacterium
SGAMPPDS

SEQ ID NO: 578173 - protein, 9 aa, Mycobacterium
SGANAEADS

SEQ ID NO: 578174 - protein, 5 aa, Mycobacterium
SGANE

SEQ ID NO: 578175 - protein, 9 aa, Mycobacterium
SGANHNERH

SEQ ID NO: 578176 - protein, 12 aa, Mycobacterium
SGANLTIAPSDA

SEQ ID NO: 578177 - protein, 9 aa, Mycobacterium
SGANNGERH

SEQ ID NO: 578178 - protein, 9 aa, Mycobacterium
SGANNGQRH

SEQ ID NO: 578179 - protein, 8 aa, Mycobacterium
SGANQSMP

SEQ ID NO: 578180 - protein, 9 aa, Mycobacterium
SGANSNERH

SEQ ID NO: 578181 - protein, 11 aa, Mycobacterium
SGANSSADAGV

SEQ ID NO: 578182 - protein, 14 aa, Mycobacterium
SGANTVTANHPDMA

SEQ ID NO: 578183 - protein, 7 aa, Mycobacterium
SGANVNS

SEQ ID NO: 578184 - protein, 4 aa, Mycobacterium
SGAP

SEQ ID NO: 578185 - protein, 18 aa, Mycobacterium
SGAPAELTYSADSARAAW

SEQ ID NO: 578186 - protein, 8 aa, Mycobacterium
SGAPAVRA

SEQ ID NO: 578187 - protein, 7 aa, Mycobacterium
SGAPDTA

SEQ ID NO: 578188 - protein, 5 aa, Mycobacterium
SGAPE

SEQ ID NO: 578189 - protein, 7 aa, Mycobacterium
SGAPEHR

SEQ ID NO: 578190 - protein, 13 aa, Mycobacterium
SGAPEPPPVRHSP

SEQ ID NO: 578191 - protein, 9 aa, Mycobacterium
SGAPHGTTQ

SEQ ID NO: 578192 - protein, 7 aa, Mycobacterium
SGAPIST

SEQ ID NO: 578193 - protein, 10 aa, Mycobacterium
SGAPKFPPTM

SEQ ID NO: 578194 - protein, 8 aa, Mycobacterium
SGAPLQQS

SEQ ID NO: 578195 - protein, 6 aa, Mycobacterium
SGAPLT

SEQ ID NO: 578196 - protein, 6 aa, Mycobacterium
SGAPRL

SEQ ID NO: 578197 - protein, 7 aa, Mycobacterium
SGAPRTL

SEQ ID NO: 578198 - protein, 16 aa, Mycobacterium
SGAPSSKVGAGDGPVA

SEQ ID NO: 578199 - protein, 18 aa, Mycobacterium
SGAPTSTVSNSGDNGNLQ

SEQ ID NO: 578200 - protein, 6 aa, Mycobacterium
SGAPTY

SEQ ID NO: 578201 - protein, 13 aa, Mycobacterium
SGAPVPAESGPTL

SEQ ID NO: 578202 - protein, 25 aa, Mycobacterium
SGAPVSQPDDDRTSDRWSDDEDAWR

SEQ ID NO: 578203 - protein, 5 aa, Mycobacterium
SGAQA

SEQ ID NO: 578204 - protein, 7 aa, Mycobacterium
SGAQARQ

SEQ ID NO: 578205 - protein, 9 aa, Mycobacterium
SGAQPSPVK

SEQ ID NO: 578206 - protein, 6 aa, Mycobacterium
SGAQPV

SEQ ID NO: 578207 - protein, 22 aa, Mycobacterium
SGAQQAAIDPDNAYVTENADGE

SEQ ID NO: 578208 - protein, 17 aa, Mycobacterium
SGAQRGPAARRREVQQD

SEQ ID NO: 578209 - protein, 9 aa, Mycobacterium
SGAQSPRES

SEQ ID NO: 578210 - protein, 12 aa, Mycobacterium
SGAQSVDTAAQT

SEQ ID NO: 578211 - protein, 7 aa, Mycobacterium
SGARADR

SEQ ID NO: 578212 - protein, 7 aa, Mycobacterium
SGARAGD

SEQ ID NO: 578213 - protein, 11 aa, Mycobacterium
SGARDDDRPEL

SEQ ID NO: 578214 - protein, 8 aa, Mycobacterium
SGAREDLP

SEQ ID NO: 578215 - protein, 8 aa, Mycobacterium
SGAREDLS

SEQ ID NO: 578216 - protein, 6 aa, Mycobacterium
SGARGM

SEQ ID NO: 578217 - protein, 5 aa, Mycobacterium
SGARH

SEQ ID NO: 578218 - protein, 10 aa, Mycobacterium
SGARPGEGES

SEQ ID NO: 578219 - protein, 6 aa, Mycobacterium
SGARPQ

SEQ ID NO: 578220 - protein, 8 aa, Mycobacterium
SGARSADM

SEQ ID NO: 578221 - protein, 9 aa, Mycobacterium
SGARSDVSD

SEQ ID NO: 578222 - protein, 13 aa, Mycobacterium
SGARSRLKRFRID

SEQ ID NO: 578223 - protein, 11 aa, Mycobacterium
SGARTLDDGRE

SEQ ID NO: 578224 - protein, 11 aa, Mycobacterium
SGARYRGDHSA

SEQ ID NO: 578225 - protein, 4 aa, Mycobacterium
SGAS

SEQ ID NO: 578226 - protein, 10 aa, Mycobacterium
SGASADKLGD

SEQ ID NO: 578227 - protein, 9 aa, Mycobacterium
SGASDAEVA

SEQ ID NO: 578228 - protein, 20 aa, Mycobacterium
SGASGAYAAAEAASTSPLQN

SEQ ID NO: 578229 - protein, 7 aa, Mycobacterium
SGASGNR

SEQ ID NO: 578230 - protein, 6 aa, Mycobacterium
SGASGP

SEQ ID NO: 578231 - protein, 16 aa, Mycobacterium
SGASGQLRNAATTGGN

SEQ ID NO: 578232 - protein, 16 aa, Mycobacterium
SGASGQLRNTATTAGN

SEQ ID NO: 578233 - protein, 10 aa, Mycobacterium
SGASLPGEPL

SEQ ID NO: 578234 - protein, 29 aa, Mycobacterium
SGASNTSFANAEAARRAAANSMNTTSSKL

SEQ ID NO: 578235 - protein, 9 aa, Mycobacterium
SGASSAAAS

SEQ ID NO: 578236 - protein, 9 aa, Mycobacterium
SGASSGRPA

SEQ ID NO: 578237 - protein, 5 aa, Mycobacterium
SGAST

SEQ ID NO: 578238 - protein, 9 aa, Mycobacterium
SGASTDGLT

SEQ ID NO: 578239 - protein, 7 aa, Mycobacterium
SGASVGE

SEQ ID NO: 578240 - protein, 8 aa, Mycobacterium
SGASVGKD

SEQ ID NO: 578241 - protein, 20 aa, Mycobacterium
SGASYLRDSSENREYDDADG

SEQ ID NO: 578242 - protein, 26 aa, Mycobacterium
SGASYSRDGEPFGDPRAAFDGGDGQR

SEQ ID NO: 578243 - protein, 11 aa, Mycobacterium
SGATALANDQP

SEQ ID NO: 578244 - protein, 8 aa, Mycobacterium
SGATALSE

SEQ ID NO: 578245 - protein, 11 aa, Mycobacterium
SGATALSNDAP

SEQ ID NO: 578246 - protein, 11 aa, Mycobacterium
SGATALSNEAP

SEQ ID NO: 578247 - protein, 8 aa, Mycobacterium
SGATAQRP

SEQ ID NO: 578248 - protein, 8 aa, Mycobacterium
SGATATAE

SEQ ID NO: 578249 - protein, 12 aa, Mycobacterium
SGATDDDPAVDA

SEQ ID NO: 578250 - protein, 8 aa, Mycobacterium
SGATDRHG

SEQ ID NO: 578251 - protein, 5 aa, Mycobacterium
SGATE

SEQ ID NO: 578252 - protein, 6 aa, Mycobacterium
SGATEF

SEQ ID NO: 578253 - protein, 8 aa, Mycobacterium
SGATEFAA

SEQ ID NO: 578254 - protein, 8 aa, Mycobacterium
SGATESNN

SEQ ID NO: 578255 - protein, 11 aa, Mycobacterium
SGATFDGRPVR

SEQ ID NO: 578256 - protein, 11 aa, Mycobacterium
SGATGNFTQTR

SEQ ID NO: 578257 - protein, 12 aa, Mycobacterium
SGATGNLTQTRT

SEQ ID NO: 578258 - protein, 5 aa, Mycobacterium
SGATL

SEQ ID NO: 578259 - protein, 9 aa, Mycobacterium
SGATLQTGI

SEQ ID NO: 578260 - protein, 8 aa, Mycobacterium
SGATNAQL

SEQ ID NO: 578261 - protein, 8 aa, Mycobacterium
SGATNSEI

SEQ ID NO: 578262 - protein, 8 aa, Mycobacterium
SGATPDLP

SEQ ID NO: 578263 - protein, 10 aa, Mycobacterium
SGATQTHPSA

SEQ ID NO: 578264 - protein, 24 aa, Mycobacterium
SGATRYATNETTSPAEMAAVQPRL

SEQ ID NO: 578265 - protein, 9 aa, Mycobacterium
SGATSQKPL

SEQ ID NO: 578266 - protein, 9 aa, Mycobacterium
SGATSQRPV

SEQ ID NO: 578267 - protein, 6 aa, Mycobacterium
SGATSV

SEQ ID NO: 578268 - protein, 6 aa, Mycobacterium
SGATTA

SEQ ID NO: 578269 - protein, 7 aa, Mycobacterium
SGATTAQ

SEQ ID NO: 578270 - protein, 9 aa, Mycobacterium
SGATTSDAV

SEQ ID NO: 578271 - protein, 9 aa, Mycobacterium
SGATTVGGR

SEQ ID NO: 578272 - protein, 4 aa, Mycobacterium
SGAV

SEQ ID NO: 578273 - protein, 15 aa, Mycobacterium
SGAVATGTFNAGPDT

SEQ ID NO: 578274 - protein, 10 aa, Mycobacterium
SGAVDPSTPL

SEQ ID NO: 578275 - protein, 7 aa, Mycobacterium
SGAVETE

SEQ ID NO: 578276 - protein, 6 aa, Mycobacterium
SGAVGA

SEQ ID NO: 578277 - protein, 7 aa, Mycobacterium
SGAVGAA

SEQ ID NO: 578278 - protein, 8 aa, Mycobacterium
SGAVPDHD

SEQ ID NO: 578279 - protein, 19 aa, Mycobacterium
SGAVPPRPLPSHRSARRRA

SEQ ID NO: 578280 - protein, 19 aa, Mycobacterium
SGAVQTYDGREVAPAAATE

SEQ ID NO: 578281 - protein, 19 aa, Mycobacterium
SGAVSTGTFNAGPDTNVAA

SEQ ID NO: 578282 - protein, 9 aa, Mycobacterium
SGAVTAPTS

SEQ ID NO: 578283 - protein, 6 aa, Mycobacterium
SGAVTE

SEQ ID NO: 578284 - protein, 14 aa, Mycobacterium
SGAWKDYTERGGRA

SEQ ID NO: 578285 - protein, 11 aa, Mycobacterium
SGAWQGPASAA

SEQ ID NO: 578286 - protein, 5 aa, Mycobacterium
SGAWT

SEQ ID NO: 578287 - protein, 4 aa, Mycobacterium
SGAY

SEQ ID NO: 578288 - protein, 10 aa, Mycobacterium
SGAYKPDPEA

SEQ ID NO: 578289 - protein, 10 aa, Mycobacterium
SGAYSPDPAA

SEQ ID NO: 578290 - protein, 8 aa, Mycobacterium
SGAYTGEV

SEQ ID NO: 578291 - protein, 6 aa, Mycobacterium
SGCDRD

SEQ ID NO: 578292 - protein, 8 aa, Mycobacterium
SGCEPNRR

SEQ ID NO: 578293 - protein, 7 aa, Mycobacterium
SGCGKST

SEQ ID NO: 578294 - protein, 5 aa, Mycobacterium
SGCPE

SEQ ID NO: 578295 - protein, 5 aa, Mycobacterium
SGCPG

SEQ ID NO: 578296 - protein, 13 aa, Mycobacterium
SGCPKKAEIAERV

SEQ ID NO: 578297 - protein, 9 aa, Mycobacterium
SGCRPGDRR

SEQ ID NO: 578298 - protein, 25 aa, Mycobacterium
SGCTEKPTNETPSTLATSTTKIASA

SEQ ID NO: 578299 - protein, 4 aa, Mycobacterium
SGDA

SEQ ID NO: 578300 - protein, 6 aa, Mycobacterium
SGDAAA

SEQ ID NO: 578301 - protein, 7 aa, Mycobacterium
SGDAAAA

SEQ ID NO: 578302 - protein, 9 aa, Mycobacterium
SGDAAEAAH

SEQ ID NO: 578303 - protein, 15 aa, Mycobacterium
SGDADDVVTSAQSAA

SEQ ID NO: 578304 - protein, 12 aa, Mycobacterium
SGDADSSASPIG

SEQ ID NO: 578305 - protein, 5 aa, Mycobacterium
SGDAE

SEQ ID NO: 578306 - protein, 8 aa, Mycobacterium
SGDAEAQN

SEQ ID NO: 578307 - protein, 8 aa, Mycobacterium
SGDAGALD

SEQ ID NO: 578308 - protein, 8 aa, Mycobacterium
SGDAGQGV

SEQ ID NO: 578309 - protein, 5 aa, Mycobacterium
SGDAK

SEQ ID NO: 578310 - protein, 10 aa, Mycobacterium
SGDALGGQSL

SEQ ID NO: 578311 - protein, 17 aa, Mycobacterium
SGDALTAASMGRERISL

SEQ ID NO: 578312 - protein, 22 aa, Mycobacterium
SGDAPDEVQERLSDGHSRYYRE

SEQ ID NO: 578313 - protein, 6 aa, Mycobacterium
SGDASD

SEQ ID NO: 578314 - protein, 6 aa, Mycobacterium
SGDASR

SEQ ID NO: 578315 - protein, 7 aa, Mycobacterium
SGDATLA

SEQ ID NO: 578316 - protein, 8 aa, Mycobacterium
SGDAVDAI

SEQ ID NO: 578317 - protein, 9 aa, Mycobacterium
SGDDENSTA

SEQ ID NO: 578318 - protein, 9 aa, Mycobacterium
SGDDGAPLR

SEQ ID NO: 578319 - protein, 10 aa, Mycobacterium
SGDDGGPLSR

SEQ ID NO: 578320 - protein, 10 aa, Mycobacterium
SGDDGNVSTA

SEQ ID NO: 578321 - protein, 10 aa, Mycobacterium
SGDDLSKAPK

SEQ ID NO: 578322 - protein, 9 aa, Mycobacterium
SGDDPGAVD

SEQ ID NO: 578323 - protein, 9 aa, Mycobacterium
SGDDPGTDW

SEQ ID NO: 578324 - protein, 6 aa, Mycobacterium
SGDDPL

SEQ ID NO: 578325 - protein, 4 aa, Mycobacterium
SGDE

SEQ ID NO: 578326 - protein, 8 aa, Mycobacterium
SGDEATGA

SEQ ID NO: 578327 - protein, 9 aa, Mycobacterium
SGDEATGAN

SEQ ID NO: 578328 - protein, 8 aa, Mycobacterium
SGDEKAVS

SEQ ID NO: 578329 - protein, 8 aa, Mycobacterium
SGDELDPR

SEQ ID NO: 578330 - protein, 13 aa, Mycobacterium
SGDEQSPGRAPTP

SEQ ID NO: 578331 - protein, 6 aa, Mycobacterium
SGDERS

SEQ ID NO: 578332 - protein, 16 aa, Mycobacterium
SGDESRHFTAGDGPSV

SEQ ID NO: 578333 - protein, 9 aa, Mycobacterium
SGDETEPTV

SEQ ID NO: 578334 - protein, 5 aa, Mycobacterium
SGDEV

SEQ ID NO: 578335 - protein, 5 aa, Mycobacterium
SGDFY

SEQ ID NO: 578336 - protein, 5 aa, Mycobacterium
SGDGA

SEQ ID NO: 578337 - protein, 7 aa, Mycobacterium
SGDGAAQ

SEQ ID NO: 578338 - protein, 7 aa, Mycobacterium
SGDGAPI

SEQ ID NO: 578339 - protein, 9 aa, Mycobacterium
SGDGDAAEA

SEQ ID NO: 578340 - protein, 9 aa, Mycobacterium
SGDGDPQNR

SEQ ID NO: 578341 - protein, 6 aa, Mycobacterium
SGDGDT

SEQ ID NO: 578342 - protein, 14 aa, Mycobacterium
SGDGEVRLEPGGSG

SEQ ID NO: 578343 - protein, 5 aa, Mycobacterium
SGDGG

SEQ ID NO: 578344 - protein, 6 aa, Mycobacterium
SGDGGA

SEQ ID NO: 578345 - protein, 43 aa, Mycobacterium
SGDGGAGGAGGAGGLIGTGGAGGHGGTTPAAGAGGAGGAGGAG

SEQ ID NO: 578346 - protein, 12 aa, Mycobacterium
SGDGGNADPYAP

SEQ ID NO: 578347 - protein, 31 aa, Mycobacterium
SGDGGTGGTGGAATFNGATGGNGGDAGNGGL

SEQ ID NO: 578348 - protein, 6 aa, Mycobacterium
SGDGKI

SEQ ID NO: 578349 - protein, 6 aa, Mycobacterium
SGDGLP

SEQ ID NO: 578350 - protein, 11 aa, Mycobacterium
SGDGNGRGPAI

SEQ ID NO: 578351 - protein, 16 aa, Mycobacterium
SGDGNTGFGNSGGVNS

SEQ ID NO: 578352 - protein, 28 aa, Mycobacterium
SGDGNWGIGNSGDVNTGIANSGNTNTGI

SEQ ID NO: 578353 - protein, 6 aa, Mycobacterium
SGDGPE

SEQ ID NO: 578354 - protein, 8 aa, Mycobacterium
SGDGPRDL

SEQ ID NO: 578355 - protein, 6 aa, Mycobacterium
SGDGQI

SEQ ID NO: 578356 - protein, 10 aa, Mycobacterium
SGDGQLTGKG

SEQ ID NO: 578357 - protein, 9 aa, Mycobacterium
SGDGRAGEA

SEQ ID NO: 578358 - protein, 8 aa, Mycobacterium
SGDGSPGL

SEQ ID NO: 578359 - protein, 6 aa, Mycobacterium
SGDGVV

SEQ ID NO: 578360 - protein, 7 aa, Mycobacterium
SGDGYGE

SEQ ID NO: 578361 - protein, 8 aa, Mycobacterium
SGDHGDDI

SEQ ID NO: 578362 - protein, 7 aa, Mycobacterium
SGDHGNR

SEQ ID NO: 578363 - protein, 7 aa, Mycobacterium
SGDHGTY

SEQ ID NO: 578364 - protein, 8 aa, Mycobacterium
SGDHNPIH

SEQ ID NO: 578365 - protein, 41 aa, Mycobacterium
SGDHNTGVGNQGSNSSGFGNSGHYNSGGFNAGDYQSGFFGR

SEQ ID NO: 578366 - protein, 9 aa, Mycobacterium
SGDHRRSAA

SEQ ID NO: 578367 - protein, 7 aa, Mycobacterium
SGDIATA

SEQ ID NO: 578368 - protein, 10 aa, Mycobacterium
SGDIATARKI

SEQ ID NO: 578369 - protein, 5 aa, Mycobacterium
SGDIE

SEQ ID NO: 578370 - protein, 16 aa, Mycobacterium
SGDIEAGRELAFTTDH

SEQ ID NO: 578371 - protein, 17 aa, Mycobacterium
SGDIGRATVDGEFGAPG

SEQ ID NO: 578372 - protein, 4 aa, Mycobacterium
SGDK

SEQ ID NO: 578373 - protein, 8 aa, Mycobacterium
SGDKGDIS

SEQ ID NO: 578374 - protein, 8 aa, Mycobacterium
SGDKPDVQ

SEQ ID NO: 578375 - protein, 9 aa, Mycobacterium
SGDKVGLGD

SEQ ID NO: 578376 - protein, 17 aa, Mycobacterium
SGDLDRPFATEAASAEL

SEQ ID NO: 578377 - protein, 9 aa, Mycobacterium
SGDLQEGHN

SEQ ID NO: 578378 - protein, 9 aa, Mycobacterium
SGDLSEGMQ

SEQ ID NO: 578379 - protein, 8 aa, Mycobacterium
SGDLTPSM

SEQ ID NO: 578380 - protein, 4 aa, Mycobacterium
SGDN

SEQ ID NO: 578381 - protein, 18 aa, Mycobacterium
SGDNGDALNAASQKWREN

SEQ ID NO: 578382 - protein, 6 aa, Mycobacterium
SGDNKG

SEQ ID NO: 578383 - protein, 11 aa, Mycobacterium
SGDPAAVSANK

SEQ ID NO: 578384 - protein, 11 aa, Mycobacterium
SGDPAGPGYGS

SEQ ID NO: 578385 - protein, 6 aa, Mycobacterium
SGDPAL

SEQ ID NO: 578386 - protein, 14 aa, Mycobacterium
SGDPDQLAETEAKS

SEQ ID NO: 578387 - protein, 9 aa, Mycobacterium
SGDPDRTAV

SEQ ID NO: 578388 - protein, 10 aa, Mycobacterium
SGDPDTPVPT

SEQ ID NO: 578389 - protein, 27 aa, Mycobacterium
SGDPFAEDVPASGPAGPGTDAGAAEAE

SEQ ID NO: 578390 - protein, 7 aa, Mycobacterium
SGDPGAV

SEQ ID NO: 578391 - protein, 8 aa, Mycobacterium
SGDPGAVS

SEQ ID NO: 578392 - protein, 6 aa, Mycobacterium
SGDPGW

SEQ ID NO: 578393 - protein, 5 aa, Mycobacterium
SGDPH

SEQ ID NO: 578394 - protein, 6 aa, Mycobacterium
SGDPHP

SEQ ID NO: 578395 - protein, 8 aa, Mycobacterium
SGDPHRPL

SEQ ID NO: 578396 - protein, 7 aa, Mycobacterium
SGDPLTK

SEQ ID NO: 578397 - protein, 5 aa, Mycobacterium
SGDPQ

SEQ ID NO: 578398 - protein, 11 aa, Mycobacterium
SGDPRDNDRAR

SEQ ID NO: 578399 - protein, 6 aa, Mycobacterium
SGDPSI

SEQ ID NO: 578400 - protein, 6 aa, Mycobacterium
SGDPSL

SEQ ID NO: 578401 - protein, 8 aa, Mycobacterium
SGDPTRDR

SEQ ID NO: 578402 - protein, 8 aa, Mycobacterium
SGDPVPAG

SEQ ID NO: 578403 - protein, 4 aa, Mycobacterium
SGDQ

SEQ ID NO: 578404 - protein, 7 aa, Mycobacterium
SGDQAFN

SEQ ID NO: 578405 - protein, 6 aa, Mycobacterium
SGDQGA

SEQ ID NO: 578406 - protein, 7 aa, Mycobacterium
SGDQGAL

SEQ ID NO: 578407 - protein, 8 aa, Mycobacterium
SGDQLQGI

SEQ ID NO: 578408 - protein, 5 aa, Mycobacterium
SGDQR

SEQ ID NO: 578409 - protein, 8 aa, Mycobacterium
SGDQRAAV

SEQ ID NO: 578410 - protein, 10 aa, Mycobacterium
SGDRARWTQD

SEQ ID NO: 578411 - protein, 22 aa, Mycobacterium
SGDRAVAAAAERAKVTAGRNIP

SEQ ID NO: 578412 - protein, 5 aa, Mycobacterium
SGDRF

SEQ ID NO: 578413 - protein, 7 aa, Mycobacterium
SGDRGAA

SEQ ID NO: 578414 - protein, 11 aa, Mycobacterium
SGDRGAYTRRA

SEQ ID NO: 578415 - protein, 9 aa, Mycobacterium
SGDRGHLRP

SEQ ID NO: 578416 - protein, 7 aa, Mycobacterium
SGDRHTI

SEQ ID NO: 578417 - protein, 8 aa, Mycobacterium
SGDRIASS

SEQ ID NO: 578418 - protein, 31 aa, Mycobacterium
SGDRIQGAGFGQAPPPDSPSQGDPPPHGKDP

SEQ ID NO: 578419 - protein, 9 aa, Mycobacterium
SGDRPRYSA

SEQ ID NO: 578420 - protein, 8 aa, Mycobacterium
SGDRPTDF

SEQ ID NO: 578421 - protein, 8 aa, Mycobacterium
SGDRSGLA

SEQ ID NO: 578422 - protein, 6 aa, Mycobacterium
SGDRVS

SEQ ID NO: 578423 - protein, 5 aa, Mycobacterium
SGDRY

SEQ ID NO: 578424 - protein, 7 aa, Mycobacterium
SGDRYAE

SEQ ID NO: 578425 - protein, 8 aa, Mycobacterium
SGDRYTDT

SEQ ID NO: 578426 - protein, 4 aa, Mycobacterium
SGDS

SEQ ID NO: 578427 - protein, 10 aa, Mycobacterium
SGDSAEPALR

SEQ ID NO: 578428 - protein, 7 aa, Mycobacterium
SGDSDAA

SEQ ID NO: 578429 - protein, 8 aa, Mycobacterium
SGDSETST

SEQ ID NO: 578430 - protein, 34 aa, Mycobacterium
SGDSFDRAAAEAARTAPPRENGGNQDIKNLTKGS

SEQ ID NO: 578431 - protein, 5 aa, Mycobacterium
SGDSH

SEQ ID NO: 578432 - protein, 8 aa, Mycobacterium
SGDSIDDA

SEQ ID NO: 578433 - protein, 6 aa, Mycobacterium
SGDSMG

SEQ ID NO: 578434 - protein, 9 aa, Mycobacterium
SGDSRVPFD

SEQ ID NO: 578435 - protein, 7 aa, Mycobacterium
SGDSTDV

SEQ ID NO: 578436 - protein, 10 aa, Mycobacterium
SGDSTSGQRA

SEQ ID NO: 578437 - protein, 4 aa, Mycobacterium
SGDT

SEQ ID NO: 578438 - protein, 5 aa, Mycobacterium
SGDTA

SEQ ID NO: 578439 - protein, 9 aa, Mycobacterium
SGDTAPKPL

SEQ ID NO: 578440 - protein, 12 aa, Mycobacterium
SGDTEPQDAATT

SEQ ID NO: 578441 - protein, 5 aa, Mycobacterium
SGDTG

SEQ ID NO: 578442 - protein, 9 aa, Mycobacterium
SGDTGVDER

SEQ ID NO: 578443 - protein, 9 aa, Mycobacterium
SGDTHRATK

SEQ ID NO: 578444 - protein, 9 aa, Mycobacterium
SGDTHYEGK

SEQ ID NO: 578445 - protein, 7 aa, Mycobacterium
SGDTKPL

SEQ ID NO: 578446 - protein, 25 aa, Mycobacterium
SGDTNTGFENSGSVNTGVQNAGAAN

SEQ ID NO: 578447 - protein, 18 aa, Mycobacterium
SGDTNTGIGNSGNTNTGF

SEQ ID NO: 578448 - protein, 5 aa, Mycobacterium
SGDTP

SEQ ID NO: 578449 - protein, 8 aa, Mycobacterium
SGDTPAAA

SEQ ID NO: 578450 - protein, 7 aa, Mycobacterium
SGDTPLL

SEQ ID NO: 578451 - protein, 9 aa, Mycobacterium
SGDTPLLDP

SEQ ID NO: 578452 - protein, 9 aa, Mycobacterium
SGDTSLGAA

SEQ ID NO: 578453 - protein, 7 aa, Mycobacterium
SGDTTLA

SEQ ID NO: 578454 - protein, 14 aa, Mycobacterium
SGDTVDTATLAERT

SEQ ID NO: 578455 - protein, 4 aa, Mycobacterium
SGDV

SEQ ID NO: 578456 - protein, 22 aa, Mycobacterium
SGDVAGEGAGASVIEDDEPDAE

SEQ ID NO: 578457 - protein, 8 aa, Mycobacterium
SGDVEATR

SEQ ID NO: 578458 - protein, 13 aa, Mycobacterium
SGDVSGKVILRVD

SEQ ID NO: 578459 - protein, 4 aa, Mycobacterium
SGDW

SEQ ID NO: 578460 - protein, 11 aa, Mycobacterium
SGDWAQQADGT

SEQ ID NO: 578461 - protein, 4 aa, Mycobacterium
SGDY

SEQ ID NO: 578462 - protein, 6 aa, Mycobacterium
SGDYAP

SEQ ID NO: 578463 - protein, 7 aa, Mycobacterium
SGDYEKT

SEQ ID NO: 578464 - protein, 8 aa, Mycobacterium
SGDYGTYT

SEQ ID NO: 578465 - protein, 17 aa, Mycobacterium
SGDYNTGLANSGDVNTG

SEQ ID NO: 578466 - protein, 8 aa, Mycobacterium
SGEAAGAS

SEQ ID NO: 578467 - protein, 6 aa, Mycobacterium
SGEAAV

SEQ ID NO: 578468 - protein, 17 aa, Mycobacterium
SGEAELGAGVTGPQAEE

SEQ ID NO: 578469 - protein, 8 aa, Mycobacterium
SGEAGGLE

SEQ ID NO: 578470 - protein, 9 aa, Mycobacterium
SGEAGPQAT

SEQ ID NO: 578471 - protein, 10 aa, Mycobacterium
SGEAKRGAPL

SEQ ID NO: 578472 - protein, 14 aa, Mycobacterium
SGEALAEHGKAPAV

SEQ ID NO: 578473 - protein, 5 aa, Mycobacterium
SGEAM

SEQ ID NO: 578474 - protein, 8 aa, Mycobacterium
SGEAMPSP

SEQ ID NO: 578475 - protein, 7 aa, Mycobacterium
SGEAPAL

SEQ ID NO: 578476 - protein, 6 aa, Mycobacterium
SGEAPL

SEQ ID NO: 578477 - protein, 16 aa, Mycobacterium
SGEAPRTAPFADPGNP

SEQ ID NO: 578478 - protein, 7 aa, Mycobacterium
SGEAQPA

SEQ ID NO: 578479 - protein, 6 aa, Mycobacterium
SGEARP

SEQ ID NO: 578480 - protein, 9 aa, Mycobacterium
SGEAVPSPI

SEQ ID NO: 578481 - protein, 14 aa, Mycobacterium
SGECPEVGSDDDHG

SEQ ID NO: 578482 - protein, 7 aa, Mycobacterium
SGECREC

SEQ ID NO: 578483 - protein, 10 aa, Mycobacterium
SGEDPASVRE

SEQ ID NO: 578484 - protein, 9 aa, Mycobacterium
SGEDPVDPA

SEQ ID NO: 578485 - protein, 6 aa, Mycobacterium
SGEDRL

SEQ ID NO: 578486 - protein, 12 aa, Mycobacterium
SGEDYRRASPNV

SEQ ID NO: 578487 - protein, 4 aa, Mycobacterium
SGEE

SEQ ID NO: 578488 - protein, 7 aa, Mycobacterium
SGEEDID

SEQ ID NO: 578489 - protein, 6 aa, Mycobacterium
SGEEHH

SEQ ID NO: 578490 - protein, 6 aa, Mycobacterium
SGEEHR

SEQ ID NO: 578491 - protein, 6 aa, Mycobacterium
SGEELE

SEQ ID NO: 578492 - protein, 15 aa, Mycobacterium
SGEEPTPGSGDALEP

SEQ ID NO: 578493 - protein, 5 aa, Mycobacterium
SGEEV

SEQ ID NO: 578494 - protein, 16 aa, Mycobacterium
SGEFAPDLDRPTTGLD

SEQ ID NO: 578495 - protein, 8 aa, Mycobacterium
SGEFPPQP

SEQ ID NO: 578496 - protein, 5 aa, Mycobacterium
SGEFR

SEQ ID NO: 578497 - protein, 15 aa, Mycobacterium
SGEGAAGTAATARPA

SEQ ID NO: 578498 - protein, 19 aa, Mycobacterium
SGEGDPTVHTAGEPAATSW

SEQ ID NO: 578499 - protein, 5 aa, Mycobacterium
SGEGF

SEQ ID NO: 578500 - protein, 6 aa, Mycobacterium
SGEGHT

SEQ ID NO: 578501 - protein, 6 aa, Mycobacterium
SGEGLT

SEQ ID NO: 578502 - protein, 35 aa, Mycobacterium
SGEGNFGIGNTGSYNTGIGNTSTANTGIGNTGSFN

SEQ ID NO: 578503 - protein, 5 aa, Mycobacterium
SGEGT

SEQ ID NO: 578504 - protein, 5 aa, Mycobacterium
SGEGY

SEQ ID NO: 578505 - protein, 27 aa, Mycobacterium
SGEHDSGRPHAIGRPDGDVAAGAAPGA

SEQ ID NO: 578506 - protein, 5 aa, Mycobacterium
SGEHG

SEQ ID NO: 578507 - protein, 7 aa, Mycobacterium
SGEHPDW

SEQ ID NO: 578508 - protein, 11 aa, Mycobacterium
SGEHSATVRTT

SEQ ID NO: 578509 - protein, 7 aa, Mycobacterium
SGEHWDS

SEQ ID NO: 578510 - protein, 4 aa, Mycobacterium
SGEI

SEQ ID NO: 578511 - protein, 13 aa, Mycobacterium
SGEIDADGPETPF

SEQ ID NO: 578512 - protein, 7 aa, Mycobacterium
SGEINGS

SEQ ID NO: 578513 - protein, 5 aa, Mycobacterium
SGEIR

SEQ ID NO: 578514 - protein, 9 aa, Mycobacterium
SGEITGPEL

SEQ ID NO: 578515 - protein, 13 aa, Mycobacterium
SGEKPKQVDPQRV

SEQ ID NO: 578516 - protein, 5 aa, Mycobacterium
SGELD

SEQ ID NO: 578517 - protein, 9 aa, Mycobacterium
SGELDPAEL

SEQ ID NO: 578518 - protein, 10 aa, Mycobacterium
SGELDPEELE

SEQ ID NO: 578519 - protein, 5 aa, Mycobacterium
SGELE

SEQ ID NO: 578520 - protein, 12 aa, Mycobacterium
SGELKTKPTQHS

SEQ ID NO: 578521 - protein, 5 aa, Mycobacterium
SGELQ

SEQ ID NO: 578522 - protein, 15 aa, Mycobacterium
SGELQRRRGLPAPVA

SEQ ID NO: 578523 - protein, 10 aa, Mycobacterium
SGELRGRDTN

SEQ ID NO: 578524 - protein, 13 aa, Mycobacterium
SGELRTEGGANGM

SEQ ID NO: 578525 - protein, 5 aa, Mycobacterium
SGELT

SEQ ID NO: 578526 - protein, 9 aa, Mycobacterium
SGELTPEDL

SEQ ID NO: 578527 - protein, 9 aa, Mycobacterium
SGELTTDKR

SEQ ID NO: 578528 - protein, 4 aa, Mycobacterium
SGEM

SEQ ID NO: 578529 - protein, 6 aa, Mycobacterium
SGEMGD

SEQ ID NO: 578530 - protein, 6 aa, Mycobacterium
SGEMSG

SEQ ID NO: 578531 - protein, 6 aa, Mycobacterium
SGENSV

SEQ ID NO: 578532 - protein, 7 aa, Mycobacterium
SGEPAEV

SEQ ID NO: 578533 - protein, 11 aa, Mycobacterium
SGEPAPSAEPL

SEQ ID NO: 578534 - protein, 13 aa, Mycobacterium
SGEPARVRRGNGR

SEQ ID NO: 578535 - protein, 5 aa, Mycobacterium
SGEPC

SEQ ID NO: 578536 - protein, 7 aa, Mycobacterium
SGEPFDA

SEQ ID NO: 578537 - protein, 9 aa, Mycobacterium
SGEPGQVGA

SEQ ID NO: 578538 - protein, 5 aa, Mycobacterium
SGEPI

SEQ ID NO: 578539 - protein, 7 aa, Mycobacterium
SGEPIGA

SEQ ID NO: 578540 - protein, 9 aa, Mycobacterium
SGEPIGPKA

SEQ ID NO: 578541 - protein, 9 aa, Mycobacterium
SGEPLSTAG

SEQ ID NO: 578542 - protein, 5 aa, Mycobacterium
SGEPP

SEQ ID NO: 578543 - protein, 7 aa, Mycobacterium
SGEPQTV

SEQ ID NO: 578544 - protein, 8 aa, Mycobacterium
SGEPVPEP

SEQ ID NO: 578545 - protein, 6 aa, Mycobacterium
SGEPYE

SEQ ID NO: 578546 - protein, 4 aa, Mycobacterium
SGEQ

SEQ ID NO: 578547 - protein, 9 aa, Mycobacterium
SGEQADASV

SEQ ID NO: 578548 - protein, 10 aa, Mycobacterium
SGEQAREAAD

SEQ ID NO: 578549 - protein, 16 aa, Mycobacterium
SGEQITDSEPDDCDVR

SEQ ID NO: 578550 - protein, 7 aa, Mycobacterium
SGEQQDR

SEQ ID NO: 578551 - protein, 9 aa, Mycobacterium
SGEQQGFPD

SEQ ID NO: 578552 - protein, 5 aa, Mycobacterium
SGEQR

SEQ ID NO: 578553 - protein, 7 aa, Mycobacterium
SGEQREY

SEQ ID NO: 578554 - protein, 6 aa, Mycobacterium
SGEQRK

SEQ ID NO: 578555 - protein, 6 aa, Mycobacterium
SGEQRW

SEQ ID NO: 578556 - protein, 7 aa, Mycobacterium
SGEQVGA

SEQ ID NO: 578557 - protein, 4 aa, Mycobacterium
SGER

SEQ ID NO: 578558 - protein, 9 aa, Mycobacterium
SGERAPEGF

SEQ ID NO: 578559 - protein, 7 aa, Mycobacterium
SGERAQV

SEQ ID NO: 578560 - protein, 7 aa, Mycobacterium
SGERCSP

SEQ ID NO: 578561 - protein, 9 aa, Mycobacterium
SGERDEIGA

SEQ ID NO: 578562 - protein, 6 aa, Mycobacterium
SGEREN

SEQ ID NO: 578563 - protein, 12 aa, Mycobacterium
SGERFEAPPATL

SEQ ID NO: 578564 - protein, 9 aa, Mycobacterium
SGERPDAGY

SEQ ID NO: 578565 - protein, 10 aa, Mycobacterium
SGERPKAGAA

SEQ ID NO: 578566 - protein, 7 aa, Mycobacterium
SGERQGY

SEQ ID NO: 578567 - protein, 7 aa, Mycobacterium
SGERRPG

SEQ ID NO: 578568 - protein, 6 aa, Mycobacterium
SGERRS

SEQ ID NO: 578569 - protein, 13 aa, Mycobacterium
SGERSRGDSRLQD

SEQ ID NO: 578570 - protein, 5 aa, Mycobacterium
SGERT

SEQ ID NO: 578571 - protein, 7 aa, Mycobacterium
SGERVDG

SEQ ID NO: 578572 - protein, 7 aa, Mycobacterium
SGESFSS

SEQ ID NO: 578573 - protein, 5 aa, Mycobacterium
SGESI

SEQ ID NO: 578574 - protein, 9 aa, Mycobacterium
SGESRSALE

SEQ ID NO: 578575 - protein, 6 aa, Mycobacterium
SGESRV

SEQ ID NO: 578576 - protein, 14 aa, Mycobacterium
SGESTIKAENYVTA

SEQ ID NO: 578577 - protein, 8 aa, Mycobacterium
SGESTTAA

SEQ ID NO: 578578 - protein, 6 aa, Mycobacterium
SGETAI

SEQ ID NO: 578579 - protein, 7 aa, Mycobacterium
SGETAKR

SEQ ID NO: 578580 - protein, 7 aa, Mycobacterium
SGETARR

SEQ ID NO: 578581 - protein, 5 aa, Mycobacterium
SGETD

SEQ ID NO: 578582 - protein, 9 aa, Mycobacterium
SGETETLSG

SEQ ID NO: 578583 - protein, 6 aa, Mycobacterium
SGETIG

SEQ ID NO: 578584 - protein, 5 aa, Mycobacterium
SGETL

SEQ ID NO: 578585 - protein, 7 aa, Mycobacterium
SGETLGD

SEQ ID NO: 578586 - protein, 9 aa, Mycobacterium
SGETPGSVD

SEQ ID NO: 578587 - protein, 12 aa, Mycobacterium
SGETVTASAEDH

SEQ ID NO: 578588 - protein, 4 aa, Mycobacterium
SGEV

SEQ ID NO: 578589 - protein, 5 aa, Mycobacterium
SGEVA

SEQ ID NO: 578590 - protein, 5 aa, Mycobacterium
SGEVP

SEQ ID NO: 578591 - protein, 5 aa, Mycobacterium
SGEVQ

SEQ ID NO: 578592 - protein, 16 aa, Mycobacterium
SGEVSGTGALDAGGRA

SEQ ID NO: 578593 - protein, 5 aa, Mycobacterium
SGEVT

SEQ ID NO: 578594 - protein, 12 aa, Mycobacterium
SGEWTGATGKRI

SEQ ID NO: 578595 - protein, 4 aa, Mycobacterium
SGEY

SEQ ID NO: 578596 - protein, 6 aa, Mycobacterium
SGEYAA

SEQ ID NO: 578597 - protein, 5 aa, Mycobacterium
SGEYD

SEQ ID NO: 578598 - protein, 15 aa, Mycobacterium
SGEYGEADELSPEDL

SEQ ID NO: 578599 - protein, 19 aa, Mycobacterium
SGEYLSKTGGEFGVTTGRR

SEQ ID NO: 578600 - protein, 9 aa, Mycobacterium
SGEYPKPWT

SEQ ID NO: 578601 - protein, 19 aa, Mycobacterium
SGEYRGAARGFASGTTDGL

SEQ ID NO: 578602 - protein, 6 aa, Mycobacterium
SGFAED

SEQ ID NO: 578603 - protein, 6 aa, Mycobacterium
SGFANT

SEQ ID NO: 578604 - protein, 15 aa, Mycobacterium
SGFASAAQRCPDRPG

SEQ ID NO: 578605 - protein, 17 aa, Mycobacterium
SGFATGQSTGPGGQAFS

SEQ ID NO: 578606 - protein, 9 aa, Mycobacterium
SGFDATRPS

SEQ ID NO: 578607 - protein, 8 aa, Mycobacterium
SGFDDDEA

SEQ ID NO: 578608 - protein, 7 aa, Mycobacterium
SGFDGTL

SEQ ID NO: 578609 - protein, 12 aa, Mycobacterium
SGFDPRRPTSWS

SEQ ID NO: 578610 - protein, 10 aa, Mycobacterium
SGFDPSKPTA

SEQ ID NO: 578611 - protein, 4 aa, Mycobacterium
SGFE

SEQ ID NO: 578612 - protein, 13 aa, Mycobacterium
SGFEGTDDDGTSL

SEQ ID NO: 578613 - protein, 13 aa, Mycobacterium
SGFEGTDESGTTL

SEQ ID NO: 578614 - protein, 7 aa, Mycobacterium
SGFENTS

SEQ ID NO: 578615 - protein, 9 aa, Mycobacterium
SGFEPTESN

SEQ ID NO: 578616 - protein, 10 aa, Mycobacterium
SGFEPTESNP

SEQ ID NO: 578617 - protein, 14 aa, Mycobacterium
SGFGATAETVATAR

SEQ ID NO: 578618 - protein, 9 aa, Mycobacterium
SGFGEAGAG

SEQ ID NO: 578619 - protein, 18 aa, Mycobacterium
SGFGENLQTDGSGRTSVP

SEQ ID NO: 578620 - protein, 7 aa, Mycobacterium
SGFGKST

SEQ ID NO: 578621 - protein, 10 aa, Mycobacterium
SGFGNTGSVT

SEQ ID NO: 578622 - protein, 45 aa, Mycobacterium
SGFGNTGTGNSGFNNFGDNNSGYGNAGVAGGPGQNNAGIGNQGTL

SEQ ID NO: 578623 - protein, 11 aa, Mycobacterium
SGFGPDGGTTD

SEQ ID NO: 578624 - protein, 22 aa, Mycobacterium
SGFGPQKSKHFASSMSDTAVTA

SEQ ID NO: 578625 - protein, 5 aa, Mycobacterium
SGFGQ

SEQ ID NO: 578626 - protein, 19 aa, Mycobacterium
SGFGQGGPSSNSGAGLPAA

SEQ ID NO: 578627 - protein, 17 aa, Mycobacterium
SGFGRATAEALAKRGAT

SEQ ID NO: 578628 - protein, 8 aa, Mycobacterium
SGFGRTPL

SEQ ID NO: 578629 - protein, 4 aa, Mycobacterium
SGFI

SEQ ID NO: 578630 - protein, 6 aa, Mycobacterium
SGFNSG

SEQ ID NO: 578631 - protein, 5 aa, Mycobacterium
SGFPE

SEQ ID NO: 578632 - protein, 7 aa, Mycobacterium
SGFPPQA

SEQ ID NO: 578633 - protein, 8 aa, Mycobacterium
SGFQPGRA

SEQ ID NO: 578634 - protein, 6 aa, Mycobacterium
SGFQRG

SEQ ID NO: 578635 - protein, 6 aa, Mycobacterium
SGFRPG

SEQ ID NO: 578636 - protein, 8 aa, Mycobacterium
SGFRPGQA

SEQ ID NO: 578637 - protein, 7 aa, Mycobacterium
SGFRPGS

SEQ ID NO: 578638 - protein, 10 aa, Mycobacterium
SGFRQGTSIG

SEQ ID NO: 578639 - protein, 6 aa, Mycobacterium
SGFSDA

SEQ ID NO: 578640 - protein, 10 aa, Mycobacterium
SGFSNLGSGV

SEQ ID NO: 578641 - protein, 23 aa, Mycobacterium
SGFSPTEISQRNGLADRRRRRDF

SEQ ID NO: 578642 - protein, 4 aa, Mycobacterium
SGFT

SEQ ID NO: 578643 - protein, 51 aa, Mycobacterium
SGFTDDTADSRSQTSKTTGSETHAKQAADTEPDTAIARGNDLSEKPAIPPE

SEQ ID NO: 578644 - protein, 5 aa, Mycobacterium
SGFTR

SEQ ID NO: 578645 - protein, 5 aa, Mycobacterium
SGFTS

SEQ ID NO: 578646 - protein, 7 aa, Mycobacterium
SGFTSPS

SEQ ID NO: 578647 - protein, 18 aa, Mycobacterium
SGFTTSYSSVGGNTPQSL

SEQ ID NO: 578648 - protein, 4 aa, Mycobacterium
SGGA

SEQ ID NO: 578649 - protein, 5 aa, Mycobacterium
SGGAA

SEQ ID NO: 578650 - protein, 14 aa, Mycobacterium
SGGAADAANGELGT

SEQ ID NO: 578651 - protein, 14 aa, Mycobacterium
SGGAANAANGALGA

SEQ ID NO: 578652 - protein, 15 aa, Mycobacterium
SGGAASAANGALGGN

SEQ ID NO: 578653 - protein, 7 aa, Mycobacterium
SGGAATA

SEQ ID NO: 578654 - protein, 9 aa, Mycobacterium
SGGADAPAL

SEQ ID NO: 578655 - protein, 20 aa, Mycobacterium
SGGADLGDGAPQHLSDWIVH

SEQ ID NO: 578656 - protein, 12 aa, Mycobacterium
SGGADPAVRAAR

SEQ ID NO: 578657 - protein, 10 aa, Mycobacterium
SGGADQDDAM

SEQ ID NO: 578658 - protein, 7 aa, Mycobacterium
SGGADSL

SEQ ID NO: 578659 - protein, 10 aa, Mycobacterium
SGGAEPAVRA

SEQ ID NO: 578660 - protein, 7 aa, Mycobacterium
SGGAEPP

SEQ ID NO: 578661 - protein, 7 aa, Mycobacterium
SGGAESL

SEQ ID NO: 578662 - protein, 7 aa, Mycobacterium
SGGAFDD

SEQ ID NO: 578663 - protein, 18 aa, Mycobacterium
SGGAGAYAAAEAANASPL

SEQ ID NO: 578664 - protein, 10 aa, Mycobacterium
SGGAGGAGAF

SEQ ID NO: 578665 - protein, 11 aa, Mycobacterium
SGGAGGAGGAA

SEQ ID NO: 578666 - protein, 11 aa, Mycobacterium
SGGAGGAGGNA

SEQ ID NO: 578667 - protein, 24 aa, Mycobacterium
SGGAGGDGGFGPGAGGTGGRGGNA

SEQ ID NO: 578668 - protein, 19 aa, Mycobacterium
SGGAGGGLPAGEVPTSPRD

SEQ ID NO: 578669 - protein, 26 aa, Mycobacterium
SGGAGGPGGVGGSGGVGGAGGAGWDA

SEQ ID NO: 578670 - protein, 54 aa, Mycobacterium
SGGAGGQGGFTSVGTGGIGGAGGKAGLIGNGGAGGAGGQGAPGATGGDGGRGGD

SEQ ID NO: 578671 - protein, 20 aa, Mycobacterium
SGGAGGQGGTGVAGTNGSNP

SEQ ID NO: 578672 - protein, 21 aa, Mycobacterium
SGGAGGSGAGGQDGGAGGRAG

SEQ ID NO: 578673 - protein, 13 aa, Mycobacterium
SGGAGGSGGEGVT

SEQ ID NO: 578674 - protein, 15 aa, Mycobacterium
SGGAGGTGGAGAAGA

SEQ ID NO: 578675 - protein, 10 aa, Mycobacterium
SGGAGGTGGI

SEQ ID NO: 578676 - protein, 28 aa, Mycobacterium
SGGAGGTGGTGGTDMSDSGGTGGAGGNA

SEQ ID NO: 578677 - protein, 17 aa, Mycobacterium
SGGAGGVGGNGAIGGTG

SEQ ID NO: 578678 - protein, 74 aa, Mycobacterium
SGGAGGVSGTGGVGGTGGAGGAGGIGGIGGNTSSSSTASVAGEGGHGGDGGDGGDGGNGGAAGAVAGAGGRGGL

SEQ ID NO: 578679 - protein, 7 aa, Mycobacterium
SGGAGNV

SEQ ID NO: 578680 - protein, 9 aa, Mycobacterium
SGGAGTGKT

SEQ ID NO: 578681 - protein, 12 aa, Mycobacterium
SGGAGVGGTGGI

SEQ ID NO: 578682 - protein, 15 aa, Mycobacterium
SGGAGYALGTPANRR

SEQ ID NO: 578683 - protein, 6 aa, Mycobacterium
SGGAIE

SEQ ID NO: 578684 - protein, 5 aa, Mycobacterium
SGGAM

SEQ ID NO: 578685 - protein, 8 aa, Mycobacterium
SGGANACT

SEQ ID NO: 578686 - protein, 21 aa, Mycobacterium
SGGANACTGPGGFQDTHATAE

SEQ ID NO: 578687 - protein, 24 aa, Mycobacterium
SGGANACTGPQGFQDSHATAEEVA

SEQ ID NO: 578688 - protein, 9 aa, Mycobacterium
SGGAPFERA

SEQ ID NO: 578689 - protein, 8 aa, Mycobacterium
SGGAPLGE

SEQ ID NO: 578690 - protein, 5 aa, Mycobacterium
SGGAS

SEQ ID NO: 578691 - protein, 10 aa, Mycobacterium
SGGASPTDPL

SEQ ID NO: 578692 - protein, 6 aa, Mycobacterium
SGGATA

SEQ ID NO: 578693 - protein, 8 aa, Mycobacterium
SGGATSAD

SEQ ID NO: 578694 - protein, 26 aa, Mycobacterium
SGGATYHNSDQEAQQHIASVAGHLRF

SEQ ID NO: 578695 - protein, 7 aa, Mycobacterium
SGGAWSQ

SEQ ID NO: 578696 - protein, 5 aa, Mycobacterium
SGGAY

SEQ ID NO: 578697 - protein, 4 aa, Mycobacterium
SGGD

SEQ ID NO: 578698 - protein, 9 aa, Mycobacterium
SGGDATSAV

SEQ ID NO: 578699 - protein, 10 aa, Mycobacterium
SGGDDAEQRR

SEQ ID NO: 578700 - protein, 6 aa, Mycobacterium
SGGDEG

SEQ ID NO: 578701 - protein, 8 aa, Mycobacterium
SGGDETST

SEQ ID NO: 578702 - protein, 45 aa, Mycobacterium
SGGDGAAGGVAGQAGGSGGSAGLIGDGGNGGTGGFGAAGGTGGAG

SEQ ID NO: 578703 - protein, 24 aa, Mycobacterium
SGGDGGDGGAAGLDGGAGGSGGKA

SEQ ID NO: 578704 - protein, 38 aa, Mycobacterium
SGGDGGQGGTGLVGADGSNPTPTGTQAGDGSSAGPNAA

SEQ ID NO: 578705 - protein, 17 aa, Mycobacterium
SGGDGPVGMTADGASAV

SEQ ID NO: 578706 - protein, 5 aa, Mycobacterium
SGGDL

SEQ ID NO: 578707 - protein, 10 aa, Mycobacterium
SGGDLGTLTE

SEQ ID NO: 578708 - protein, 6 aa, Mycobacterium
SGGDLQ

SEQ ID NO: 578709 - protein, 7 aa, Mycobacterium
SGGDNLA

SEQ ID NO: 578710 - protein, 9 aa, Mycobacterium
SGGDNPADL

SEQ ID NO: 578711 - protein, 7 aa, Mycobacterium
SGGDREA

SEQ ID NO: 578712 - protein, 6 aa, Mycobacterium
SGGDSV

SEQ ID NO: 578713 - protein, 6 aa, Mycobacterium
SGGDTV

SEQ ID NO: 578714 - protein, 7 aa, Mycobacterium
SGGDTVT

SEQ ID NO: 578715 - protein, 13 aa, Mycobacterium
SGGDVTKAAYTGD

SEQ ID NO: 578716 - protein, 7 aa, Mycobacterium
SGGEAAV

SEQ ID NO: 578717 - protein, 8 aa, Mycobacterium
SGGEADIG

SEQ ID NO: 578718 - protein, 7 aa, Mycobacterium
SGGEAQR

SEQ ID NO: 578719 - protein, 8 aa, Mycobacterium
SGGEAQRV

SEQ ID NO: 578720 - protein, 17 aa, Mycobacterium
SGGEDDYQAAVREFGAS

SEQ ID NO: 578721 - protein, 8 aa, Mycobacterium
SGGEEPTT

SEQ ID NO: 578722 - protein, 8 aa, Mycobacterium
SGGEGRYI

SEQ ID NO: 578723 - protein, 5 aa, Mycobacterium
SGGEK

SEQ ID NO: 578724 - protein, 7 aa, Mycobacterium
SGGEKRR

SEQ ID NO: 578725 - protein, 5 aa, Mycobacterium
SGGEM

SEQ ID NO: 578726 - protein, 9 aa, Mycobacterium
SGGEPVTRE

SEQ ID NO: 578727 - protein, 6 aa, Mycobacterium
SGGEQR

SEQ ID NO: 578728 - protein, 6 aa, Mycobacterium
SGGERF

SEQ ID NO: 578729 - protein, 6 aa, Mycobacterium
SGGERL

SEQ ID NO: 578730 - protein, 7 aa, Mycobacterium
SGGERPP

SEQ ID NO: 578731 - protein, 8 aa, Mycobacterium
SGGERPPF

SEQ ID NO: 578732 - protein, 6 aa, Mycobacterium
SGGERQ

SEQ ID NO: 578733 - protein, 7 aa, Mycobacterium
SGGERQR

SEQ ID NO: 578734 - protein, 7 aa, Mycobacterium
SGGESAA

SEQ ID NO: 578735 - protein, 5 aa, Mycobacterium
SGGEV

SEQ ID NO: 578736 - protein, 7 aa, Mycobacterium
SGGFATT

SEQ ID NO: 578737 - protein, 9 aa, Mycobacterium
SGGFGTSGL

SEQ ID NO: 578738 - protein, 14 aa, Mycobacterium
SGGGASYAAAEAAA

SEQ ID NO: 578739 - protein, 9 aa, Mycobacterium
SGGGDTVAE

SEQ ID NO: 578740 - protein, 9 aa, Mycobacterium
SGGGEAVDV

SEQ ID NO: 578741 - protein, 14 aa, Mycobacterium
SGGGEGAVSGPADT

SEQ ID NO: 578742 - protein, 15 aa, Mycobacterium
SGGGEKAVSGPAPTR

SEQ ID NO: 578743 - protein, 7 aa, Mycobacterium
SGGGEQR

SEQ ID NO: 578744 - protein, 6 aa, Mycobacterium
SGGGFD

SEQ ID NO: 578745 - protein, 53 aa, Mycobacterium
SGGGGGAGGDGGVGGTGAQGAPGTQSFSAGTGGNGGDGGSGGVAGAGGSGGFL

SEQ ID NO: 578746 - protein, 12 aa, Mycobacterium
SGGGGGDGGFAP

SEQ ID NO: 578747 - protein, 27 aa, Mycobacterium
SGGGGGGGGNGTGATTTTGGTGGIGGH

SEQ ID NO: 578748 - protein, 10 aa, Mycobacterium
SGGGGLTPSD

SEQ ID NO: 578749 - protein, 20 aa, Mycobacterium
SGGGGLTPSDIAPAQLDQQQ

SEQ ID NO: 578750 - protein, 19 aa, Mycobacterium
SGGGGLTPSDIAPARLSQQ

SEQ ID NO: 578751 - protein, 20 aa, Mycobacterium
SGGGGLTPSDLAPARLNQPQ

SEQ ID NO: 578752 - protein, 8 aa, Mycobacterium
SGGGGRGM

SEQ ID NO: 578753 - protein, 7 aa, Mycobacterium
SGGGKEL

SEQ ID NO: 578754 - protein, 8 aa, Mycobacterium
SGGGKPPF

SEQ ID NO: 578755 - protein, 8 aa, Mycobacterium
SGGGMAES

SEQ ID NO: 578756 - protein, 5 aa, Mycobacterium
SGGGN

SEQ ID NO: 578757 - protein, 8 aa, Mycobacterium
SGGGPDAQ

SEQ ID NO: 578758 - protein, 9 aa, Mycobacterium
SGGGPGAME

SEQ ID NO: 578759 - protein, 9 aa, Mycobacterium
SGGGPGTME

SEQ ID NO: 578760 - protein, 10 aa, Mycobacterium
SGGGPLPESL

SEQ ID NO: 578761 - protein, 5 aa, Mycobacterium
SGGGQ

SEQ ID NO: 578762 - protein, 9 aa, Mycobacterium
SGGGRAKAL

SEQ ID NO: 578763 - protein, 9 aa, Mycobacterium
SGGGRPEGL

SEQ ID NO: 578764 - protein, 6 aa, Mycobacterium
SGGGRR

SEQ ID NO: 578765 - protein, 9 aa, Mycobacterium
SGGGSGHEP

SEQ ID NO: 578766 - protein, 8 aa, Mycobacterium
SGGGTATA

SEQ ID NO: 578767 - protein, 8 aa, Mycobacterium
SGGGTRNP

SEQ ID NO: 578768 - protein, 7 aa, Mycobacterium
SGGGTRV

SEQ ID NO: 578769 - protein, 12 aa, Mycobacterium
SGGGTSEDSGLG

SEQ ID NO: 578770 - protein, 8 aa, Mycobacterium
SGGGVIEP

SEQ ID NO: 578771 - protein, 6 aa, Mycobacterium
SGGHAL

SEQ ID NO: 578772 - protein, 14 aa, Mycobacterium
SGGHGGGASGGDSL

SEQ ID NO: 578773 - protein, 5 aa, Mycobacterium
SGGHS

SEQ ID NO: 578774 - protein, 10 aa, Mycobacterium
SGGHTSTSRV

SEQ ID NO: 578775 - protein, 6 aa, Mycobacterium
SGGHVG

SEQ ID NO: 578776 - protein, 6 aa, Mycobacterium
SGGIDP

SEQ ID NO: 578777 - protein, 8 aa, Mycobacterium
SGGIEEAV

SEQ ID NO: 578778 - protein, 5 aa, Mycobacterium
SGGIG

SEQ ID NO: 578779 - protein, 21 aa, Mycobacterium
SGGIGGSGAAGAAGGTGGNGG

SEQ ID NO: 578780 - protein, 6 aa, Mycobacterium
SGGIPT

SEQ ID NO: 578781 - protein, 5 aa, Mycobacterium
SGGIS

SEQ ID NO: 578782 - protein, 10 aa, Mycobacterium
SGGITAENAR

SEQ ID NO: 578783 - protein, 7 aa, Mycobacterium
SGGITSA

SEQ ID NO: 578784 - protein, 4 aa, Mycobacterium
SGGK

SEQ ID NO: 578785 - protein, 8 aa, Mycobacterium
SGGKDSSA

SEQ ID NO: 578786 - protein, 11 aa, Mycobacterium
SGGKGRSFETV

SEQ ID NO: 578787 - protein, 5 aa, Mycobacterium
SGGLD

SEQ ID NO: 578788 - protein, 13 aa, Mycobacterium
SGGLDDRKSSGHY

SEQ ID NO: 578789 - protein, 11 aa, Mycobacterium
SGGLDDRRTSH

SEQ ID NO: 578790 - protein, 14 aa, Mycobacterium
SGGLDDRRTSNKYL

SEQ ID NO: 578791 - protein, 7 aa, Mycobacterium
SGGLPEG

SEQ ID NO: 578792 - protein, 11 aa, Mycobacterium
SGGLPKGDALA

SEQ ID NO: 578793 - protein, 9 aa, Mycobacterium
SGGLPPEHT

SEQ ID NO: 578794 - protein, 13 aa, Mycobacterium
SGGLTGYGGGLDR

SEQ ID NO: 578795 - protein, 15 aa, Mycobacterium
SGGLTPSGVLLLRAD

SEQ ID NO: 578796 - protein, 15 aa, Mycobacterium
SGGLTPSGVLLLRTD

SEQ ID NO: 578797 - protein, 15 aa, Mycobacterium
SGGLTPSGVMLLRTG

SEQ ID NO: 578798 - protein, 4 aa, Mycobacterium
SGGM

SEQ ID NO: 578799 - protein, 6 aa, Mycobacterium
SGGMAK

SEQ ID NO: 578800 - protein, 6 aa, Mycobacterium
SGGMAN

SEQ ID NO: 578801 - protein, 5 aa, Mycobacterium
SGGMQ

SEQ ID NO: 578802 - protein, 7 aa, Mycobacterium
SGGMSAN

SEQ ID NO: 578803 - protein, 4 aa, Mycobacterium
SGGN

SEQ ID NO: 578804 - protein, 10 aa, Mycobacterium
SGGNADDVDD

SEQ ID NO: 578805 - protein, 17 aa, Mycobacterium
SGGNAPKSIMTVIATHF

SEQ ID NO: 578806 - protein, 46 aa, Mycobacterium
SGGNGAAGAAGQAGGSGGSAGLLGNGGAGGAGGTGGARGGNGGSGG

SEQ ID NO: 578807 - protein, 27 aa, Mycobacterium
SGGNGGAGAGGGDGGYLSGNGGNGGDG

SEQ ID NO: 578808 - protein, 12 aa, Mycobacterium
SGGNGGAGGNAV

SEQ ID NO: 578809 - protein, 7 aa, Mycobacterium
SGGNGGS

SEQ ID NO: 578810 - protein, 45 aa, Mycobacterium
SGGNGGSGGAGRDGADGGVDPKSGRTGATGDGGDGGDGGDGGDAA

SEQ ID NO: 578811 - protein, 71 aa, Mycobacterium
SGGNGGTGGTGGTGGTGAAAGVGGIGGDGGDATAASSATGGHGGDGGDSDPSVGTGGNGGTGGNGGNGGAA

SEQ ID NO: 578812 - protein, 5 aa, Mycobacterium
SGGNP

SEQ ID NO: 578813 - protein, 11 aa, Mycobacterium
SGGNPPGDGSA

SEQ ID NO: 578814 - protein, 13 aa, Mycobacterium
SGGNPPGDQSGGI

SEQ ID NO: 578815 - protein, 18 aa, Mycobacterium
SGGNPVFPSETDERGLGL

SEQ ID NO: 578816 - protein, 6 aa, Mycobacterium
SGGNPY

SEQ ID NO: 578817 - protein, 8 aa, Mycobacterium
SGGNQQKA

SEQ ID NO: 578818 - protein, 6 aa, Mycobacterium
SGGNRR

SEQ ID NO: 578819 - protein, 15 aa, Mycobacterium
SGGNVSSEHGVGTRK

SEQ ID NO: 578820 - protein, 4 aa, Mycobacterium
SGGP

SEQ ID NO: 578821 - protein, 7 aa, Mycobacterium
SGGPAGM

SEQ ID NO: 578822 - protein, 9 aa, Mycobacterium
SGGPASAAP

SEQ ID NO: 578823 - protein, 17 aa, Mycobacterium
SGGPDIRPALGDPAEVA

SEQ ID NO: 578824 - protein, 6 aa, Mycobacterium
SGGPFA

SEQ ID NO: 578825 - protein, 6 aa, Mycobacterium
SGGPFR

SEQ ID NO: 578826 - protein, 6 aa, Mycobacterium
SGGPGA

SEQ ID NO: 578827 - protein, 11 aa, Mycobacterium
SGGPGATGRSF

SEQ ID NO: 578828 - protein, 6 aa, Mycobacterium
SGGPLA

SEQ ID NO: 578829 - protein, 9 aa, Mycobacterium
SGGPNSDMN

SEQ ID NO: 578830 - protein, 6 aa, Mycobacterium
SGGPPR

SEQ ID NO: 578831 - protein, 8 aa, Mycobacterium
SGGPSAVT

SEQ ID NO: 578832 - protein, 7 aa, Mycobacterium
SGGPTGA

SEQ ID NO: 578833 - protein, 8 aa, Mycobacterium
SGGPTTSA

SEQ ID NO: 578834 - protein, 4 aa, Mycobacterium
SGGQ

SEQ ID NO: 578835 - protein, 7 aa, Mycobacterium
SGGQAHE

SEQ ID NO: 578836 - protein, 13 aa, Mycobacterium
SGGQARGGGPATL

SEQ ID NO: 578837 - protein, 15 aa, Mycobacterium
SGGQDIETNRTSQRG

SEQ ID NO: 578838 - protein, 8 aa, Mycobacterium
SGGQDSAL

SEQ ID NO: 578839 - protein, 9 aa, Mycobacterium
SGGQITQET

SEQ ID NO: 578840 - protein, 11 aa, Mycobacterium
SGGQRAGRAVE

SEQ ID NO: 578841 - protein, 7 aa, Mycobacterium
SGGQRQQ

SEQ ID NO: 578842 - protein, 9 aa, Mycobacterium
SGGQTAAET

SEQ ID NO: 578843 - protein, 16 aa, Mycobacterium
SGGQTAVVAAGDVVHL

SEQ ID NO: 578844 - protein, 7 aa, Mycobacterium
SGGRAHG

SEQ ID NO: 578845 - protein, 6 aa, Mycobacterium
SGGRAR

SEQ ID NO: 578846 - protein, 7 aa, Mycobacterium
SGGRATL

SEQ ID NO: 578847 - protein, 5 aa, Mycobacterium
SGGRC

SEQ ID NO: 578848 - protein, 17 aa, Mycobacterium
SGGRDGRTDHRGQRPGV

SEQ ID NO: 578849 - protein, 18 aa, Mycobacterium
SGGRDVDDSLDLIAIAVA

SEQ ID NO: 578850 - protein, 7 aa, Mycobacterium
SGGRIGD

SEQ ID NO: 578851 - protein, 8 aa, Mycobacterium
SGGRIRAS

SEQ ID NO: 578852 - protein, 5 aa, Mycobacterium
SGGRM

SEQ ID NO: 578853 - protein, 7 aa, Mycobacterium
SGGRPFD

SEQ ID NO: 578854 - protein, 11 aa, Mycobacterium
SGGRQPGGDAI

SEQ ID NO: 578855 - protein, 7 aa, Mycobacterium
SGGRRSA

SEQ ID NO: 578856 - protein, 6 aa, Mycobacterium
SGGRTR

SEQ ID NO: 578857 - protein, 8 aa, Mycobacterium
SGGRTTSV

SEQ ID NO: 578858 - protein, 12 aa, Mycobacterium
SGGRVQEPRTSR

SEQ ID NO: 578859 - protein, 8 aa, Mycobacterium
SGGSADTV

SEQ ID NO: 578860 - protein, 7 aa, Mycobacterium
SGGSDAA

SEQ ID NO: 578861 - protein, 7 aa, Mycobacterium
SGGSEAN

SEQ ID NO: 578862 - protein, 8 aa, Mycobacterium
SGGSEANT

SEQ ID NO: 578863 - protein, 8 aa, Mycobacterium
SGGSEARP

SEQ ID NO: 578864 - protein, 5 aa, Mycobacterium
SGGSF

SEQ ID NO: 578865 - protein, 34 aa, Mycobacterium
SGGSGGAGGAGTASFYPGSTGGNGGNGGNGGAAQ

SEQ ID NO: 578866 - protein, 34 aa, Mycobacterium
SGGSGGAGGAGTASIYPGSTGGNGGNGGNGGAAQ

SEQ ID NO: 578867 - protein, 27 aa, Mycobacterium
SGGSGGGGGAGAINDGGSGGAGGNGGR

SEQ ID NO: 578868 - protein, 33 aa, Mycobacterium
SGGSGGIGGVGGSGTIGAPSGHGGSGGLGGGTG

SEQ ID NO: 578869 - protein, 26 aa, Mycobacterium
SGGSGGVGGAGSIDGGAGGAGGDAGW

SEQ ID NO: 578870 - protein, 9 aa, Mycobacterium
SGGSGPADP

SEQ ID NO: 578871 - protein, 23 aa, Mycobacterium
SGGSGYNSATSGVGGGAGGAAGL

SEQ ID NO: 578872 - protein, 5 aa, Mycobacterium
SGGSI

SEQ ID NO: 578873 - protein, 6 aa, Mycobacterium
SGGSRR

SEQ ID NO: 578874 - protein, 7 aa, Mycobacterium
SGGSRRN

SEQ ID NO: 578875 - protein, 5 aa, Mycobacterium
SGGST

SEQ ID NO: 578876 - protein, 6 aa, Mycobacterium
SGGSTA

SEQ ID NO: 578877 - protein, 6 aa, Mycobacterium
SGGSVP

SEQ ID NO: 578878 - protein, 7 aa, Mycobacterium
SGGSVSA

SEQ ID NO: 578879 - protein, 18 aa, Mycobacterium
SGGSWDAEVPGPGLVLVL

SEQ ID NO: 578880 - protein, 7 aa, Mycobacterium
SGGTADT

SEQ ID NO: 578881 - protein, 9 aa, Mycobacterium
SGGTAPAAD

SEQ ID NO: 578882 - protein, 9 aa, Mycobacterium
SGGTAPAAV

SEQ ID NO: 578883 - protein, 27 aa, Mycobacterium
SGGTGGDGGFAKGGNGGAGGAGGDAGL

SEQ ID NO: 578884 - protein, 29 aa, Mycobacterium
SGGTGGFGGVGGVGTSTGIGGAGGRGGNA

SEQ ID NO: 578885 - protein, 504 aa, Mycobacterium
SGGTGGMGGDGGDAGTAGLAGTGGSGGTVGAYSAGGAAGNGGTGGAGAQGAPAQFGSTGFAGGDGGAGGDGGTGGGGNGGTNGNGGHGGTGGAGGQGGVGYTDDGSNNATTGGDGGDGGQGGQGGVPGATGTGGTVGMAGNGGAGGAGGQGGDTTTSGNSAGFGGQGGQGGQGGAGLSGLTGGDGYDGGQGGAGGTGGAGGDAVSGAYNGHGGAGGDGGAGGQGGTGHADDGSNNAGAGGNGGMGGQGGQGGGAGAGAGAGSGAGSAGTGGDGGTGGDGGATTTIGHTAGAGGVGGQGGDGGDGLADAASSGGKGGAGGLGGNGGDAVSGAYNGQGGMGGQGGTGGQGGDAGPEGNGGNGGNGGDGGTAGAAGTGGLGGTAGTAGAGGTGGGGGQGGDTTTAGHTAGWGGNGGYGGQGGGGAAGPAGGSGSDGGQGGQGGAGGTGGDAVAGATNGSGGTGGYGGQGGQGGAGGTDDGGDNAGTGGAGGTGGTGGAAGATGSGGT

SEQ ID NO: 578886 - protein, 14 aa, Mycobacterium
SGGTGGQGGGGGDG

SEQ ID NO: 578887 - protein, 26 aa, Mycobacterium
SGGTGGTGGAGVSSGFGGTGGNGGLG

SEQ ID NO: 578888 - protein, 23 aa, Mycobacterium
SGGTGGTGGYGASAGDGGHGGSA

SEQ ID NO: 578889 - protein, 16 aa, Mycobacterium
SGGTGISPTDATPQIT

SEQ ID NO: 578890 - protein, 6 aa, Mycobacterium
SGGTGP

SEQ ID NO: 578891 - protein, 10 aa, Mycobacterium
SGGTMSASRR

SEQ ID NO: 578892 - protein, 8 aa, Mycobacterium
SGGTPNGP

SEQ ID NO: 578893 - protein, 5 aa, Mycobacterium
SGGTQ

SEQ ID NO: 578894 - protein, 6 aa, Mycobacterium
SGGTQL

SEQ ID NO: 578895 - protein, 9 aa, Mycobacterium
SGGTRAPAP

SEQ ID NO: 578896 - protein, 7 aa, Mycobacterium
SGGTTSV

SEQ ID NO: 578897 - protein, 12 aa, Mycobacterium
SGGVAAAARRHR

SEQ ID NO: 578898 - protein, 10 aa, Mycobacterium
SGGVDGTIPS

SEQ ID NO: 578899 - protein, 5 aa, Mycobacterium
SGGVE

SEQ ID NO: 578900 - protein, 29 aa, Mycobacterium
SGGVGGAGTTPDADSGYAGGDGGNGGNGG

SEQ ID NO: 578901 - protein, 24 aa, Mycobacterium
SGGVGGDGGSGHGNGGDGGGGGNA

SEQ ID NO: 578902 - protein, 13 aa, Mycobacterium
SGGVGGTGGTGGL

SEQ ID NO: 578903 - protein, 9 aa, Mycobacterium
SGGVGKSRL

SEQ ID NO: 578904 - protein, 9 aa, Mycobacterium
SGGVGTAQA

SEQ ID NO: 578905 - protein, 6 aa, Mycobacterium
SGGVGV

SEQ ID NO: 578906 - protein, 12 aa, Mycobacterium
SGGVPGGGAAGL

SEQ ID NO: 578907 - protein, 8 aa, Mycobacterium
SGGVQSTV

SEQ ID NO: 578908 - protein, 8 aa, Mycobacterium
SGGVRRER

SEQ ID NO: 578909 - protein, 5 aa, Mycobacterium
SGGVY

SEQ ID NO: 578910 - protein, 22 aa, Mycobacterium
SGGYAKRTAIEEYSAQGRGGKG

SEQ ID NO: 578911 - protein, 12 aa, Mycobacterium
SGGYAKRTSIDE

SEQ ID NO: 578912 - protein, 9 aa, Mycobacterium
SGGYGGPGF

SEQ ID NO: 578913 - protein, 15 aa, Mycobacterium
SGGYNTGVGSTVDQP

SEQ ID NO: 578914 - protein, 5 aa, Mycobacterium
SGGYR

SEQ ID NO: 578915 - protein, 12 aa, Mycobacterium
SGGYRPRDRVRP

SEQ ID NO: 578916 - protein, 10 aa, Mycobacterium
SGGYSKRTAI

SEQ ID NO: 578917 - protein, 15 aa, Mycobacterium
SGGYTRDFTQDDAPQ

SEQ ID NO: 578918 - protein, 6 aa, Mycobacterium
SGHAFG

SEQ ID NO: 578919 - protein, 8 aa, Mycobacterium
SGHCSPGG

SEQ ID NO: 578920 - protein, 21 aa, Mycobacterium
SGHDATATSLRAATAAPAGIG

SEQ ID NO: 578921 - protein, 7 aa, Mycobacterium
SGHDGAK

SEQ ID NO: 578922 - protein, 5 aa, Mycobacterium
SGHDR

SEQ ID NO: 578923 - protein, 4 aa, Mycobacterium
SGHE

SEQ ID NO: 578924 - protein, 6 aa, Mycobacterium
SGHEPV

SEQ ID NO: 578925 - protein, 4 aa, Mycobacterium
SGHG

SEQ ID NO: 578926 - protein, 5 aa, Mycobacterium
SGHGA

SEQ ID NO: 578927 - protein, 10 aa, Mycobacterium
SGHGAGPGDA

SEQ ID NO: 578928 - protein, 6 aa, Mycobacterium
SGHGAP

SEQ ID NO: 578929 - protein, 17 aa, Mycobacterium
SGHGPKGPDSDKPGYDG

SEQ ID NO: 578930 - protein, 12 aa, Mycobacterium
SGHGSASHAAER

SEQ ID NO: 578931 - protein, 4 aa, Mycobacterium
SGHH

SEQ ID NO: 578932 - protein, 14 aa, Mycobacterium
SGHHGSCSTYSVDG

SEQ ID NO: 578933 - protein, 24 aa, Mycobacterium
SGHHRTGVAPDQAGPVAAAARSAG

SEQ ID NO: 578934 - protein, 5 aa, Mycobacterium
SGHLN

SEQ ID NO: 578935 - protein, 6 aa, Mycobacterium
SGHNPR

SEQ ID NO: 578936 - protein, 41 aa, Mycobacterium
SGHNYANADAVSTIGGGAPTGGVKGKFDETKPVDARDSPSL

SEQ ID NO: 578937 - protein, 9 aa, Mycobacterium
SGHPAAETG

SEQ ID NO: 578938 - protein, 5 aa, Mycobacterium
SGHPD

SEQ ID NO: 578939 - protein, 8 aa, Mycobacterium
SGHPDRLA

SEQ ID NO: 578940 - protein, 6 aa, Mycobacterium
SGHPET

SEQ ID NO: 578941 - protein, 13 aa, Mycobacterium
SGHPSGTAKDVED

SEQ ID NO: 578942 - protein, 12 aa, Mycobacterium
SGHPSGTAREVE

SEQ ID NO: 578943 - protein, 8 aa, Mycobacterium
SGHQPDGY

SEQ ID NO: 578944 - protein, 11 aa, Mycobacterium
SGHQPTPEPRE

SEQ ID NO: 578945 - protein, 6 aa, Mycobacterium
SGHRDE

SEQ ID NO: 578946 - protein, 8 aa, Mycobacterium
SGHRDGAV

SEQ ID NO: 578947 - protein, 6 aa, Mycobacterium
SGHREA

SEQ ID NO: 578948 - protein, 12 aa, Mycobacterium
SGHRERPVTESL

SEQ ID NO: 578949 - protein, 22 aa, Mycobacterium
SGHRPTPGTAAYGAAKAGIDNL

SEQ ID NO: 578950 - protein, 10 aa, Mycobacterium
SGHSASNNAE

SEQ ID NO: 578951 - protein, 18 aa, Mycobacterium
SGHSRAGRLPKSAVSGAR

SEQ ID NO: 578952 - protein, 10 aa, Mycobacterium
SGHSVQSDQP

SEQ ID NO: 578953 - protein, 4 aa, Mycobacterium
SGHT

SEQ ID NO: 578954 - protein, 15 aa, Mycobacterium
SGHTEDDVTVVTLRR

SEQ ID NO: 578955 - protein, 11 aa, Mycobacterium
SGHTERGRDGC

SEQ ID NO: 578956 - protein, 9 aa, Mycobacterium
SGHTGSPAM

SEQ ID NO: 578957 - protein, 18 aa, Mycobacterium
SGHTNTGALNSGTLNTGF

SEQ ID NO: 578958 - protein, 5 aa, Mycobacterium
SGHVR

SEQ ID NO: 578959 - protein, 5 aa, Mycobacterium
SGHWD

SEQ ID NO: 578960 - protein, 4 aa, Mycobacterium
SGIA

SEQ ID NO: 578961 - protein, 7 aa, Mycobacterium
SGIAEGE

SEQ ID NO: 578962 - protein, 9 aa, Mycobacterium
SGIAESPHP

SEQ ID NO: 578963 - protein, 13 aa, Mycobacterium
SGIAGVDGQGAAV

SEQ ID NO: 578964 - protein, 7 aa, Mycobacterium
SGIARNG

SEQ ID NO: 578965 - protein, 7 aa, Mycobacterium
SGIATDA

SEQ ID NO: 578966 - protein, 16 aa, Mycobacterium
SGIATDSRLDHPTTTL

SEQ ID NO: 578967 - protein, 15 aa, Mycobacterium
SGIDAATGATSGPAV

SEQ ID NO: 578968 - protein, 12 aa, Mycobacterium
SGIDGGSDDGAH

SEQ ID NO: 578969 - protein, 9 aa, Mycobacterium
SGIDNTSGL

SEQ ID NO: 578970 - protein, 9 aa, Mycobacterium
SGIDPGEYS

SEQ ID NO: 578971 - protein, 6 aa, Mycobacterium
SGIDPR

SEQ ID NO: 578972 - protein, 13 aa, Mycobacterium
SGIDPTGLRGSAT

SEQ ID NO: 578973 - protein, 7 aa, Mycobacterium
SGIDRTQ

SEQ ID NO: 578974 - protein, 6 aa, Mycobacterium
SGIDSA

SEQ ID NO: 578975 - protein, 6 aa, Mycobacterium
SGIDSG

SEQ ID NO: 578976 - protein, 81 aa, Mycobacterium
SGIDTDRTITAGPTDSPNSAGAADPAVSSDQSAVTASAAGATGTAVTARAPGLSAREDHRRSRSSTQAGTTVTTRATITDQ

SEQ ID NO: 578977 - protein, 8 aa, Mycobacterium
SGIEGDGV

SEQ ID NO: 578978 - protein, 13 aa, Mycobacterium
SGIEPTDPRVSPL

SEQ ID NO: 578979 - protein, 5 aa, Mycobacterium
SGIEV

SEQ ID NO: 578980 - protein, 4 aa, Mycobacterium
SGIG

SEQ ID NO: 578981 - protein, 5 aa, Mycobacterium
SGIGA

SEQ ID NO: 578982 - protein, 6 aa, Mycobacterium
SGIGAE

SEQ ID NO: 578983 - protein, 6 aa, Mycobacterium
SGIGAQ

SEQ ID NO: 578984 - protein, 23 aa, Mycobacterium
SGIGASAGAASEGVRSARPDPLL

SEQ ID NO: 578985 - protein, 8 aa, Mycobacterium
SGIGDNEL

SEQ ID NO: 578986 - protein, 5 aa, Mycobacterium
SGIGE

SEQ ID NO: 578987 - protein, 11 aa, Mycobacterium
SGIGKAADAVS

SEQ ID NO: 578988 - protein, 5 aa, Mycobacterium
SGIGN

SEQ ID NO: 578989 - protein, 8 aa, Mycobacterium
SGIGNEGV

SEQ ID NO: 578990 - protein, 15 aa, Mycobacterium
SGIGNGSCCPTVCRN

SEQ ID NO: 578991 - protein, 12 aa, Mycobacterium
SGIGNSGDGDAG

SEQ ID NO: 578992 - protein, 17 aa, Mycobacterium
SGIGNTGSNNDSGFGNT

SEQ ID NO: 578993 - protein, 10 aa, Mycobacterium
SGIGREFGPE

SEQ ID NO: 578994 - protein, 8 aa, Mycobacterium
SGIGREGG

SEQ ID NO: 578995 - protein, 11 aa, Mycobacterium
SGIGSPDRARE

SEQ ID NO: 578996 - protein, 12 aa, Mycobacterium
SGIGTADRAREL

SEQ ID NO: 578997 - protein, 9 aa, Mycobacterium
SGIGTDAGA

SEQ ID NO: 578998 - protein, 11 aa, Mycobacterium
SGIGTPDRAAE

SEQ ID NO: 578999 - protein, 12 aa, Mycobacterium
SGIGTPDRAAEL

SEQ ID NO: 579000 - protein, 11 aa, Mycobacterium
SGIGTPGRARE

SEQ ID NO: 579001 - protein, 11 aa, Mycobacterium
SGIGTSGRARE

SEQ ID NO: 579002 - protein, 6 aa, Mycobacterium
SGIIGR

SEQ ID NO: 579003 - protein, 7 aa, Mycobacterium
SGIIGRG

SEQ ID NO: 579004 - protein, 12 aa, Mycobacterium
SGIKRDPDDTSE

SEQ ID NO: 579005 - protein, 9 aa, Mycobacterium
SGINPTARQ

SEQ ID NO: 579006 - protein, 7 aa, Mycobacterium
SGIPDAE

SEQ ID NO: 579007 - protein, 7 aa, Mycobacterium
SGIPDPG

SEQ ID NO: 579008 - protein, 8 aa, Mycobacterium
SGIPEAKG

SEQ ID NO: 579009 - protein, 7 aa, Mycobacterium
SGIPEEV

SEQ ID NO: 579010 - protein, 7 aa, Mycobacterium
SGIPEPN

SEQ ID NO: 579011 - protein, 5 aa, Mycobacterium
SGIPG

SEQ ID NO: 579012 - protein, 8 aa, Mycobacterium
SGIPGRQP

SEQ ID NO: 579013 - protein, 54 aa, Mycobacterium
SGIPGVGGNGGAGGTSGLIGSGGAGGAGGTGGANHASTNSIGGVGGAGGTGGAA

SEQ ID NO: 579014 - protein, 8 aa, Mycobacterium
SGIPKADG

SEQ ID NO: 579015 - protein, 5 aa, Mycobacterium
SGIPR

SEQ ID NO: 579016 - protein, 23 aa, Mycobacterium
SGIPRRNDHRPDVAGARGGVRRS

SEQ ID NO: 579017 - protein, 9 aa, Mycobacterium
SGIPSTQAF

SEQ ID NO: 579018 - protein, 5 aa, Mycobacterium
SGIPT

SEQ ID NO: 579019 - protein, 5 aa, Mycobacterium
SGIQS

SEQ ID NO: 579020 - protein, 4 aa, Mycobacterium
SGIR

SEQ ID NO: 579021 - protein, 6 aa, Mycobacterium
SGIRDG

SEQ ID NO: 579022 - protein, 11 aa, Mycobacterium
SGIRTRDGVEH

SEQ ID NO: 579023 - protein, 6 aa, Mycobacterium
SGISAD

SEQ ID NO: 579024 - protein, 8 aa, Mycobacterium
SGISAPRS

SEQ ID NO: 579025 - protein, 10 aa, Mycobacterium
SGISDPGAIG

SEQ ID NO: 579026 - protein, 17 aa, Mycobacterium
SGISGGFSGNLPPVQTP

SEQ ID NO: 579027 - protein, 11 aa, Mycobacterium
SGISKAADAVS

SEQ ID NO: 579028 - protein, 6 aa, Mycobacterium
SGISPD

SEQ ID NO: 579029 - protein, 8 aa, Mycobacterium
SGISPDRV

SEQ ID NO: 579030 - protein, 11 aa, Mycobacterium
SGISSGAPSLE

SEQ ID NO: 579031 - protein, 7 aa, Mycobacterium
SGISSHP

SEQ ID NO: 579032 - protein, 5 aa, Mycobacterium
SGITD

SEQ ID NO: 579033 - protein, 16 aa, Mycobacterium
SGITDPAHERYKEAAE

SEQ ID NO: 579034 - protein, 16 aa, Mycobacterium
SGITDPEHERYKEAAE

SEQ ID NO: 579035 - protein, 16 aa, Mycobacterium
SGITDPNHERYKEAAE

SEQ ID NO: 579036 - protein, 6 aa, Mycobacterium
SGITGE

SEQ ID NO: 579037 - protein, 16 aa, Mycobacterium
SGITGQALDVNCGEFK

SEQ ID NO: 579038 - protein, 5 aa, Mycobacterium
SGITP

SEQ ID NO: 579039 - protein, 7 aa, Mycobacterium
SGITQPP

SEQ ID NO: 579040 - protein, 12 aa, Mycobacterium
SGKAAPDRARTG

SEQ ID NO: 579041 - protein, 6 aa, Mycobacterium
SGKAEV

SEQ ID NO: 579042 - protein, 9 aa, Mycobacterium
SGKAGRQLA

SEQ ID NO: 579043 - protein, 10 aa, Mycobacterium
SGKAGTEEAA

SEQ ID NO: 579044 - protein, 12 aa, Mycobacterium
SGKAMPTFTPPV

SEQ ID NO: 579045 - protein, 8 aa, Mycobacterium
SGKANRLP

SEQ ID NO: 579046 - protein, 18 aa, Mycobacterium
SGKANRLPDELSGGEQQR

SEQ ID NO: 579047 - protein, 10 aa, Mycobacterium
SGKDASRPQL

SEQ ID NO: 579048 - protein, 7 aa, Mycobacterium
SGKDFST

SEQ ID NO: 579049 - protein, 16 aa, Mycobacterium
SGKDKTVGPSGACGQN

SEQ ID NO: 579050 - protein, 6 aa, Mycobacterium
SGKDLG

SEQ ID NO: 579051 - protein, 9 aa, Mycobacterium
SGKDPHRVD

SEQ ID NO: 579052 - protein, 6 aa, Mycobacterium
SGKDTC

SEQ ID NO: 579053 - protein, 11 aa, Mycobacterium
SGKEPDQASDV

SEQ ID NO: 579054 - protein, 7 aa, Mycobacterium
SGKESIE

SEQ ID NO: 579055 - protein, 4 aa, Mycobacterium
SGKG

SEQ ID NO: 579056 - protein, 8 aa, Mycobacterium
SGKGAELY

SEQ ID NO: 579057 - protein, 10 aa, Mycobacterium
SGKGAGAAAV

SEQ ID NO: 579058 - protein, 8 aa, Mycobacterium
SGKGEGHE

SEQ ID NO: 579059 - protein, 17 aa, Mycobacterium
SGKGGAWTDEPSLKAAQ

SEQ ID NO: 579060 - protein, 11 aa, Mycobacterium
SGKGGVGKSSV

SEQ ID NO: 579061 - protein, 14 aa, Mycobacterium
SGKGHRIATPDEAN

SEQ ID NO: 579062 - protein, 6 aa, Mycobacterium
SGKGLA

SEQ ID NO: 579063 - protein, 8 aa, Mycobacterium
SGKGPGHE

SEQ ID NO: 579064 - protein, 6 aa, Mycobacterium
SGKGRQ

SEQ ID NO: 579065 - protein, 6 aa, Mycobacterium
SGKGSR

SEQ ID NO: 579066 - protein, 5 aa, Mycobacterium
SGKGT

SEQ ID NO: 579067 - protein, 5 aa, Mycobacterium
SGKHL

SEQ ID NO: 579068 - protein, 7 aa, Mycobacterium
SGKKGER

SEQ ID NO: 579069 - protein, 5 aa, Mycobacterium
SGKKL

SEQ ID NO: 579070 - protein, 5 aa, Mycobacterium
SGKLT

SEQ ID NO: 579071 - protein, 10 aa, Mycobacterium
SGKNLSPSNI

SEQ ID NO: 579072 - protein, 9 aa, Mycobacterium
SGKNLSPTN

SEQ ID NO: 579073 - protein, 18 aa, Mycobacterium
SGKNPDGSQRAPGTPPLA

SEQ ID NO: 579074 - protein, 7 aa, Mycobacterium
SGKNTHV

SEQ ID NO: 579075 - protein, 9 aa, Mycobacterium
SGKPAKNDL

SEQ ID NO: 579076 - protein, 9 aa, Mycobacterium
SGKPGKEQL

SEQ ID NO: 579077 - protein, 12 aa, Mycobacterium
SGKPGRDPDAKR

SEQ ID NO: 579078 - protein, 7 aa, Mycobacterium
SGKPISV

SEQ ID NO: 579079 - protein, 5 aa, Mycobacterium
SGKPL

SEQ ID NO: 579080 - protein, 6 aa, Mycobacterium
SGKPPF

SEQ ID NO: 579081 - protein, 8 aa, Mycobacterium
SGKPSTVT

SEQ ID NO: 579082 - protein, 5 aa, Mycobacterium
SGKQP

SEQ ID NO: 579083 - protein, 4 aa, Mycobacterium
SGKR

SEQ ID NO: 579084 - protein, 14 aa, Mycobacterium
SGKRGAAAGGQSDR

SEQ ID NO: 579085 - protein, 8 aa, Mycobacterium
SGKRNSAL

SEQ ID NO: 579086 - protein, 10 aa, Mycobacterium
SGKRPFTGDG

SEQ ID NO: 579087 - protein, 14 aa, Mycobacterium
SGKRPLPRRTPYTA

SEQ ID NO: 579088 - protein, 7 aa, Mycobacterium
SGKRTGN

SEQ ID NO: 579089 - protein, 8 aa, Mycobacterium
SGKSALSA

SEQ ID NO: 579090 - protein, 8 aa, Mycobacterium
SGKSLPSG

SEQ ID NO: 579091 - protein, 6 aa, Mycobacterium
SGKSQL

SEQ ID NO: 579092 - protein, 7 aa, Mycobacterium
SGKSRFA

SEQ ID NO: 579093 - protein, 19 aa, Mycobacterium
SGKSSRITEIAGPGGPVDE

SEQ ID NO: 579094 - protein, 5 aa, Mycobacterium
SGKSV

SEQ ID NO: 579095 - protein, 4 aa, Mycobacterium
SGKT

SEQ ID NO: 579096 - protein, 11 aa, Mycobacterium
SGKTAPKDKGL

SEQ ID NO: 579097 - protein, 16 aa, Mycobacterium
SGKTAPSVSKEINPTK

SEQ ID NO: 579098 - protein, 8 aa, Mycobacterium
SGKTAQRV

SEQ ID NO: 579099 - protein, 9 aa, Mycobacterium
SGKTGAGVG

SEQ ID NO: 579100 - protein, 12 aa, Mycobacterium
SGKTGTTEAHRS

SEQ ID NO: 579101 - protein, 13 aa, Mycobacterium
SGKTGTTEDNRSS

SEQ ID NO: 579102 - protein, 17 aa, Mycobacterium
SGKTNTGFGNSGHENTG

SEQ ID NO: 579103 - protein, 29 aa, Mycobacterium
SGKTPLSSQDEPEAAPAEPTLKYSPEPDT

SEQ ID NO: 579104 - protein, 5 aa, Mycobacterium
SGKTQ

SEQ ID NO: 579105 - protein, 6 aa, Mycobacterium
SGKTQA

SEQ ID NO: 579106 - protein, 18 aa, Mycobacterium
SGKTSRITSIEGPGGPVQ

SEQ ID NO: 579107 - protein, 6 aa, Mycobacterium
SGKTVQ

SEQ ID NO: 579108 - protein, 6 aa, Mycobacterium
SGKVAA

SEQ ID NO: 579109 - protein, 13 aa, Mycobacterium
SGKVGEEMRRLYG

SEQ ID NO: 579110 - protein, 5 aa, Mycobacterium
SGKVS

SEQ ID NO: 579111 - protein, 13 aa, Mycobacterium
SGKVTGKVLLRVS

SEQ ID NO: 579112 - protein, 20 aa, Mycobacterium
SGKYDSGAINTRTGQSGFFG

SEQ ID NO: 579113 - protein, 14 aa, Mycobacterium
SGLAASRAAVTQRD

SEQ ID NO: 579114 - protein, 10 aa, Mycobacterium
SGLADAGATV

SEQ ID NO: 579115 - protein, 7 aa, Mycobacterium
SGLAERA

SEQ ID NO: 579116 - protein, 16 aa, Mycobacterium
SGLAETLRDAEKTVPG

SEQ ID NO: 579117 - protein, 5 aa, Mycobacterium
SGLAG

SEQ ID NO: 579118 - protein, 9 aa, Mycobacterium
SGLAGGPTG

SEQ ID NO: 579119 - protein, 24 aa, Mycobacterium
SGLAGQAWQGAASAAMTAAASPYA

SEQ ID NO: 579120 - protein, 14 aa, Mycobacterium
SGLAGQAWQGPAAA

SEQ ID NO: 579121 - protein, 89 aa, Mycobacterium
SGLAGQGGGDGFKDTGAHDHGKSDDFEDGPHGKGDSDGGKNNDGAAGKDDTGSKNGQTQPAGTTQPAPSTQPAPPAAVPASAGGDPSQV

SEQ ID NO: 579122 - protein, 14 aa, Mycobacterium
SGLAHDSTGPADGD

SEQ ID NO: 579123 - protein, 16 aa, Mycobacterium
SGLANESWQGPAAAAM

SEQ ID NO: 579124 - protein, 16 aa, Mycobacterium
SGLANQSTCTDSADGL

SEQ ID NO: 579125 - protein, 7 aa, Mycobacterium
SGLAPDA

SEQ ID NO: 579126 - protein, 12 aa, Mycobacterium
SGLAPPGKHAAS

SEQ ID NO: 579127 - protein, 10 aa, Mycobacterium
SGLARPQSGR

SEQ ID NO: 579128 - protein, 7 aa, Mycobacterium
SGLARTG

SEQ ID NO: 579129 - protein, 6 aa, Mycobacterium
SGLATG

SEQ ID NO: 579130 - protein, 10 aa, Mycobacterium
SGLDADRDEV

SEQ ID NO: 579131 - protein, 9 aa, Mycobacterium
SGLDDQGRA

SEQ ID NO: 579132 - protein, 6 aa, Mycobacterium
SGLDEG

SEQ ID NO: 579133 - protein, 6 aa, Mycobacterium
SGLDPA

SEQ ID NO: 579134 - protein, 6 aa, Mycobacterium
SGLDPH

SEQ ID NO: 579135 - protein, 9 aa, Mycobacterium
SGLDRANAV

SEQ ID NO: 579136 - protein, 5 aa, Mycobacterium
SGLDT

SEQ ID NO: 579137 - protein, 13 aa, Mycobacterium
SGLDTDSVAPPSL

SEQ ID NO: 579138 - protein, 4 aa, Mycobacterium
SGLE

SEQ ID NO: 579139 - protein, 5 aa, Mycobacterium
SGLEG

SEQ ID NO: 579140 - protein, 7 aa, Mycobacterium
SGLEGDP

SEQ ID NO: 579141 - protein, 7 aa, Mycobacterium
SGLEPAD

SEQ ID NO: 579142 - protein, 6 aa, Mycobacterium
SGLEPE

SEQ ID NO: 579143 - protein, 6 aa, Mycobacterium
SGLEPH

SEQ ID NO: 579144 - protein, 10 aa, Mycobacterium
SGLEPQTADR

SEQ ID NO: 579145 - protein, 8 aa, Mycobacterium
SGLEQPRS

SEQ ID NO: 579146 - protein, 6 aa, Mycobacterium
SGLESA

SEQ ID NO: 579147 - protein, 6 aa, Mycobacterium
SGLESD

SEQ ID NO: 579148 - protein, 7 aa, Mycobacterium
SGLESDP

SEQ ID NO: 579149 - protein, 6 aa, Mycobacterium
SGLETD

SEQ ID NO: 579150 - protein, 8 aa, Mycobacterium
SGLGANST

SEQ ID NO: 579151 - protein, 99 aa, Mycobacterium
SGLGDQGNHEHPSDTTDKADDSPEHAKDSKDAKADATKTDTTTSPDAAQTAAGQQAQNAGNSTAGDPPSPAAAPAPASPTVTLPDGSTATARNPQTAQA

SEQ ID NO: 579152 - protein, 8 aa, Mycobacterium
SGLGGSPA

SEQ ID NO: 579153 - protein, 72 aa, Mycobacterium
SGLGGSSDKTGSGLPLGSTTAAGYSSPSSSGSGAGTLSGPGALRGGAGVPGLGGGAGTNPTGIGGAGVRGGA

SEQ ID NO: 579154 - protein, 11 aa, Mycobacterium
SGLGGTYGGNP

SEQ ID NO: 579155 - protein, 5 aa, Mycobacterium
SGLGI

SEQ ID NO: 579156 - protein, 6 aa, Mycobacterium
SGLGKQ

SEQ ID NO: 579157 - protein, 11 aa, Mycobacterium
SGLGLSTRGYT

SEQ ID NO: 579158 - protein, 9 aa, Mycobacterium
SGLGNLGNS

SEQ ID NO: 579159 - protein, 6 aa, Mycobacterium
SGLGPE

SEQ ID NO: 579160 - protein, 11 aa, Mycobacterium
SGLGRDDPRRR

SEQ ID NO: 579161 - protein, 7 aa, Mycobacterium
SGLGSAP

SEQ ID NO: 579162 - protein, 7 aa, Mycobacterium
SGLGTAG

SEQ ID NO: 579163 - protein, 12 aa, Mycobacterium
SGLGTRSGGAEG

SEQ ID NO: 579164 - protein, 10 aa, Mycobacterium
SGLIESPRKA

SEQ ID NO: 579165 - protein, 11 aa, Mycobacterium
SGLIESPRKAR

SEQ ID NO: 579166 - protein, 22 aa, Mycobacterium
SGLKNTNSSGLGTSGVGNVGDS

SEQ ID NO: 579167 - protein, 8 aa, Mycobacterium
SGLKPQDI

SEQ ID NO: 579168 - protein, 8 aa, Mycobacterium
SGLKPSDI

SEQ ID NO: 579169 - protein, 9 aa, Mycobacterium
SGLKPSDIQ

SEQ ID NO: 579170 - protein, 6 aa, Mycobacterium
SGLNES

SEQ ID NO: 579171 - protein, 13 aa, Mycobacterium
SGLNPAGLAGSAT

SEQ ID NO: 579172 - protein, 16 aa, Mycobacterium
SGLPAADSGPEAGTTQ

SEQ ID NO: 579173 - protein, 7 aa, Mycobacterium
SGLPADT

SEQ ID NO: 579174 - protein, 11 aa, Mycobacterium
SGLPANGDPRA

SEQ ID NO: 579175 - protein, 14 aa, Mycobacterium
SGLPAPTENSASTL

SEQ ID NO: 579176 - protein, 6 aa, Mycobacterium
SGLPAR

SEQ ID NO: 579177 - protein, 7 aa, Mycobacterium
SGLPAVP

SEQ ID NO: 579178 - protein, 5 aa, Mycobacterium
SGLPD

SEQ ID NO: 579179 - protein, 6 aa, Mycobacterium
SGLPEG

SEQ ID NO: 579180 - protein, 5 aa, Mycobacterium
SGLPG

SEQ ID NO: 579181 - protein, 11 aa, Mycobacterium
SGLPGGGPDVA

SEQ ID NO: 579182 - protein, 10 aa, Mycobacterium
SGLPGGLRPG

SEQ ID NO: 579183 - protein, 18 aa, Mycobacterium
SGLPGGPADPDPARASRH

SEQ ID NO: 579184 - protein, 11 aa, Mycobacterium
SGLPGKGEPLS

SEQ ID NO: 579185 - protein, 6 aa, Mycobacterium
SGLPGQ

SEQ ID NO: 579186 - protein, 5 aa, Mycobacterium
SGLPI

SEQ ID NO: 579187 - protein, 9 aa, Mycobacterium
SGLPKPGRQ

SEQ ID NO: 579188 - protein, 6 aa, Mycobacterium
SGLPKR

SEQ ID NO: 579189 - protein, 11 aa, Mycobacterium
SGLPNLAGSDR

SEQ ID NO: 579190 - protein, 8 aa, Mycobacterium
SGLPNQTD

SEQ ID NO: 579191 - protein, 10 aa, Mycobacterium
SGLPPAATPQ

SEQ ID NO: 579192 - protein, 7 aa, Mycobacterium
SGLPPGT

SEQ ID NO: 579193 - protein, 7 aa, Mycobacterium
SGLPQPR

SEQ ID NO: 579194 - protein, 9 aa, Mycobacterium
SGLPRPQTQ

SEQ ID NO: 579195 - protein, 6 aa, Mycobacterium
SGLPSG

SEQ ID NO: 579196 - protein, 6 aa, Mycobacterium
SGLPTA

SEQ ID NO: 579197 - protein, 9 aa, Mycobacterium
SGLPYETSD

SEQ ID NO: 579198 - protein, 14 aa, Mycobacterium
SGLQGDDAQCYQRF

SEQ ID NO: 579199 - protein, 5 aa, Mycobacterium
SGLQH

SEQ ID NO: 579200 - protein, 10 aa, Mycobacterium
SGLQPTSPVA

SEQ ID NO: 579201 - protein, 6 aa, Mycobacterium
SGLREH

SEQ ID NO: 579202 - protein, 10 aa, Mycobacterium
SGLRGASQED

SEQ ID NO: 579203 - protein, 19 aa, Mycobacterium
SGLRGKGRLTDADIDATAR

SEQ ID NO: 579204 - protein, 15 aa, Mycobacterium
SGLRGRGGAGFPTGT

SEQ ID NO: 579205 - protein, 14 aa, Mycobacterium
SGLRGRGGAGFSTG

SEQ ID NO: 579206 - protein, 8 aa, Mycobacterium
SGLRPENV

SEQ ID NO: 579207 - protein, 15 aa, Mycobacterium
SGLRRAGDAAGGTVN

SEQ ID NO: 579208 - protein, 11 aa, Mycobacterium
SGLRSGAGSAR

SEQ ID NO: 579209 - protein, 5 aa, Mycobacterium
SGLRT

SEQ ID NO: 579210 - protein, 5 aa, Mycobacterium
SGLSA

SEQ ID NO: 579211 - protein, 7 aa, Mycobacterium
SGLSADD

SEQ ID NO: 579212 - protein, 7 aa, Mycobacterium
SGLSAEQ

SEQ ID NO: 579213 - protein, 12 aa, Mycobacterium
SGLSAGGAAYEG

SEQ ID NO: 579214 - protein, 5 aa, Mycobacterium
SGLSG

SEQ ID NO: 579215 - protein, 17 aa, Mycobacterium
SGLSGLANRAAQSGGTF

SEQ ID NO: 579216 - protein, 7 aa, Mycobacterium
SGLSISG

SEQ ID NO: 579217 - protein, 7 aa, Mycobacterium
SGLSNRE

SEQ ID NO: 579218 - protein, 8 aa, Mycobacterium
SGLSNRQV

SEQ ID NO: 579219 - protein, 35 aa, Mycobacterium
SGLSNTGSFNAGDVNTGDFNSGSTNTGWGNSGDIN

SEQ ID NO: 579220 - protein, 9 aa, Mycobacterium
SGLSPDDGL

SEQ ID NO: 579221 - protein, 14 aa, Mycobacterium
SGLSPGGHPRPTHR

SEQ ID NO: 579222 - protein, 7 aa, Mycobacterium
SGLSTGQ

SEQ ID NO: 579223 - protein, 6 aa, Mycobacterium
SGLSTP

SEQ ID NO: 579224 - protein, 6 aa, Mycobacterium
SGLSVD

SEQ ID NO: 579225 - protein, 7 aa, Mycobacterium
SGLSYGD

SEQ ID NO: 579226 - protein, 11 aa, Mycobacterium
SGLTADDGSRV

SEQ ID NO: 579227 - protein, 12 aa, Mycobacterium
SGLTAGSWQGPA

SEQ ID NO: 579228 - protein, 9 aa, Mycobacterium
SGLTDATGE

SEQ ID NO: 579229 - protein, 7 aa, Mycobacterium
SGLTDQA

SEQ ID NO: 579230 - protein, 5 aa, Mycobacterium
SGLTE

SEQ ID NO: 579231 - protein, 5 aa, Mycobacterium
SGLTG

SEQ ID NO: 579232 - protein, 12 aa, Mycobacterium
SGLTGQLDQTDY

SEQ ID NO: 579233 - protein, 6 aa, Mycobacterium
SGLTNG

SEQ ID NO: 579234 - protein, 10 aa, Mycobacterium
SGLTPAGAQT

SEQ ID NO: 579235 - protein, 8 aa, Mycobacterium
SGLTPDDI

SEQ ID NO: 579236 - protein, 8 aa, Mycobacterium
SGLTPNDI

SEQ ID NO: 579237 - protein, 8 aa, Mycobacterium
SGLTPQDI

SEQ ID NO: 579238 - protein, 8 aa, Mycobacterium
SGLTVPES

SEQ ID NO: 579239 - protein, 10 aa, Mycobacterium
SGLVRPDDTE

SEQ ID NO: 579240 - protein, 7 aa, Mycobacterium
SGMAETE

SEQ ID NO: 579241 - protein, 13 aa, Mycobacterium
SGMAGTPSRGRQR

SEQ ID NO: 579242 - protein, 9 aa, Mycobacterium
SGMAGTTEV

SEQ ID NO: 579243 - protein, 10 aa, Mycobacterium
SGMAHSADQV

SEQ ID NO: 579244 - protein, 8 aa, Mycobacterium
SGMANPAN

SEQ ID NO: 579245 - protein, 21 aa, Mycobacterium
SGMDPAQAREMADRTTAAYTA

SEQ ID NO: 579246 - protein, 6 aa, Mycobacterium
SGMEGR

SEQ ID NO: 579247 - protein, 6 aa, Mycobacterium
SGMGEA

SEQ ID NO: 579248 - protein, 17 aa, Mycobacterium
SGMGSTGFGNSGVTSTG

SEQ ID NO: 579249 - protein, 6 aa, Mycobacterium
SGMNPR

SEQ ID NO: 579250 - protein, 10 aa, Mycobacterium
SGMPGQNAAR

SEQ ID NO: 579251 - protein, 14 aa, Mycobacterium
SGMPGTATPTNGGF

SEQ ID NO: 579252 - protein, 8 aa, Mycobacterium
SGMPHEES

SEQ ID NO: 579253 - protein, 8 aa, Mycobacterium
SGMPPDQV

SEQ ID NO: 579254 - protein, 8 aa, Mycobacterium
SGMQPGDK

SEQ ID NO: 579255 - protein, 4 aa, Mycobacterium
SGMR

SEQ ID NO: 579256 - protein, 5 aa, Mycobacterium
SGMRA

SEQ ID NO: 579257 - protein, 9 aa, Mycobacterium
SGMREEATQ

SEQ ID NO: 579258 - protein, 5 aa, Mycobacterium
SGMRS

SEQ ID NO: 579259 - protein, 4 aa, Mycobacterium
SGMS

SEQ ID NO: 579260 - protein, 12 aa, Mycobacterium
SGMSTRDQRPGL

SEQ ID NO: 579261 - protein, 6 aa, Mycobacterium
SGMTPE

SEQ ID NO: 579262 - protein, 8 aa, Mycobacterium
SGMTTEKA

SEQ ID NO: 579263 - protein, 15 aa, Mycobacterium
SGMTTGMPTPSGKPQ

SEQ ID NO: 579264 - protein, 15 aa, Mycobacterium
SGMTTGMPTPTGKPQ

SEQ ID NO: 579265 - protein, 5 aa, Mycobacterium
SGNAA

SEQ ID NO: 579266 - protein, 6 aa, Mycobacterium
SGNADE

SEQ ID NO: 579267 - protein, 17 aa, Mycobacterium
SGNAGAGGAGGTGGDAG

SEQ ID NO: 579268 - protein, 11 aa, Mycobacterium
SGNAGANTAAD

SEQ ID NO: 579269 - protein, 26 aa, Mycobacterium
SGNAGGAGGYANTSDGGQGGQGGDGG

SEQ ID NO: 579270 - protein, 7 aa, Mycobacterium
SGNAGGG

SEQ ID NO: 579271 - protein, 7 aa, Mycobacterium
SGNAGSY

SEQ ID NO: 579272 - protein, 8 aa, Mycobacterium
SGNANPQL

SEQ ID NO: 579273 - protein, 5 aa, Mycobacterium
SGNAQ

SEQ ID NO: 579274 - protein, 8 aa, Mycobacterium
SGNDAAAL

SEQ ID NO: 579275 - protein, 9 aa, Mycobacterium
SGNDARDAL

SEQ ID NO: 579276 - protein, 6 aa, Mycobacterium
SGNDVP

SEQ ID NO: 579277 - protein, 5 aa, Mycobacterium
SGNEA

SEQ ID NO: 579278 - protein, 8 aa, Mycobacterium
SGNENTGW

SEQ ID NO: 579279 - protein, 4 aa, Mycobacterium
SGNF

SEQ ID NO: 579280 - protein, 5 aa, Mycobacterium
SGNFG

SEQ ID NO: 579281 - protein, 14 aa, Mycobacterium
SGNFGGTNFGSGNI

SEQ ID NO: 579282 - protein, 10 aa, Mycobacterium
SGNFGNANGM

SEQ ID NO: 579283 - protein, 14 aa, Mycobacterium
SGNFGSQNLGSGNI

SEQ ID NO: 579284 - protein, 6 aa, Mycobacterium
SGNFSA

SEQ ID NO: 579285 - protein, 8 aa, Mycobacterium
SGNGARGA

SEQ ID NO: 579286 - protein, 14 aa, Mycobacterium
SGNGGAGGNGGNGG

SEQ ID NO: 579287 - protein, 42 aa, Mycobacterium
SGNGGDGGAGGQGGDGGHGGSPGGFDGKSGVGGDGGDGGNAR

SEQ ID NO: 579288 - protein, 7 aa, Mycobacterium
SGNGGFA

SEQ ID NO: 579289 - protein, 9 aa, Mycobacterium
SGNGNLGIG

SEQ ID NO: 579290 - protein, 6 aa, Mycobacterium
SGNGNV

SEQ ID NO: 579291 - protein, 17 aa, Mycobacterium
SGNGNVGFGNSGATNGG

SEQ ID NO: 579292 - protein, 6 aa, Mycobacterium
SGNGNY

SEQ ID NO: 579293 - protein, 5 aa, Mycobacterium
SGNGQ

SEQ ID NO: 579294 - protein, 12 aa, Mycobacterium
SGNGQGPGRSLP

SEQ ID NO: 579295 - protein, 7 aa, Mycobacterium
SGNGRAQ

SEQ ID NO: 579296 - protein, 20 aa, Mycobacterium
SGNGRTKSSGVRRIEDEDRV

SEQ ID NO: 579297 - protein, 8 aa, Mycobacterium
SGNGSTGL

SEQ ID NO: 579298 - protein, 8 aa, Mycobacterium
SGNGTEQA

SEQ ID NO: 579299 - protein, 9 aa, Mycobacterium
SGNGYRPVT

SEQ ID NO: 579300 - protein, 6 aa, Mycobacterium
SGNHDN

SEQ ID NO: 579301 - protein, 11 aa, Mycobacterium
SGNHGDDAGNT

SEQ ID NO: 579302 - protein, 8 aa, Mycobacterium
SGNHKNRP

SEQ ID NO: 579303 - protein, 11 aa, Mycobacterium
SGNHQTPNGTY

SEQ ID NO: 579304 - protein, 29 aa, Mycobacterium
SGNIGDHNIGSGNLGGANVGSGNLGSGNI

SEQ ID NO: 579305 - protein, 18 aa, Mycobacterium
SGNIGGTNLGGGNQGDFN

SEQ ID NO: 579306 - protein, 8 aa, Mycobacterium
SGNIGKGN

SEQ ID NO: 579307 - protein, 20 aa, Mycobacterium
SGNIGNGNNGDGNLGGGNLG

SEQ ID NO: 579308 - protein, 6 aa, Mycobacterium
SGNINT

SEQ ID NO: 579309 - protein, 11 aa, Mycobacterium
SGNKVGEGEHY

SEQ ID NO: 579310 - protein, 5 aa, Mycobacterium
SGNLG

SEQ ID NO: 579311 - protein, 12 aa, Mycobacterium
SGNLGDNPPNNL

SEQ ID NO: 579312 - protein, 8 aa, Mycobacterium
SGNLGNAN

SEQ ID NO: 579313 - protein, 49 aa, Mycobacterium
SGNLGNTNLGSGNVGNQNVGSGNYGSGNWGGGNTGTGNTGSGNAGDYNF

SEQ ID NO: 579314 - protein, 13 aa, Mycobacterium
SGNLGSANAGWAN

SEQ ID NO: 579315 - protein, 9 aa, Mycobacterium
SGNLGSNNV

SEQ ID NO: 579316 - protein, 31 aa, Mycobacterium
SGNLRSAQRALQRAGASVEVTADRDAAAAAD

SEQ ID NO: 579317 - protein, 5 aa, Mycobacterium
SGNLS

SEQ ID NO: 579318 - protein, 4 aa, Mycobacterium
SGNN

SEQ ID NO: 579319 - protein, 13 aa, Mycobacterium
SGNNFGDANQGAF

SEQ ID NO: 579320 - protein, 5 aa, Mycobacterium
SGNNN

SEQ ID NO: 579321 - protein, 7 aa, Mycobacterium
SGNPDYG

SEQ ID NO: 579322 - protein, 9 aa, Mycobacterium
SGNPIPSQT

SEQ ID NO: 579323 - protein, 22 aa, Mycobacterium
SGNPPTKERIQSPTDRARYDDT

SEQ ID NO: 579324 - protein, 22 aa, Mycobacterium
SGNPPTRERIQSPTDRARYDDT

SEQ ID NO: 579325 - protein, 22 aa, Mycobacterium
SGNPPTRERIQSQTDRARYDDT

SEQ ID NO: 579326 - protein, 11 aa, Mycobacterium
SGNPRPNRTPW

SEQ ID NO: 579327 - protein, 8 aa, Mycobacterium
SGNPTDEE

SEQ ID NO: 579328 - protein, 15 aa, Mycobacterium
SGNPVNRIRGGGTQL

SEQ ID NO: 579329 - protein, 17 aa, Mycobacterium
SGNPYGAFTGEQAARVT

SEQ ID NO: 579330 - protein, 12 aa, Mycobacterium
SGNQHDAEDLTQ

SEQ ID NO: 579331 - protein, 12 aa, Mycobacterium
SGNQLTTGARRT

SEQ ID NO: 579332 - protein, 10 aa, Mycobacterium
SGNQPGRGLR

SEQ ID NO: 579333 - protein, 22 aa, Mycobacterium
SGNQPTRERIQSQTDRARYDDT

SEQ ID NO: 579334 - protein, 12 aa, Mycobacterium
SGNQQDAEDLTQ

SEQ ID NO: 579335 - protein, 4 aa, Mycobacterium
SGNR

SEQ ID NO: 579336 - protein, 14 aa, Mycobacterium
SGNRDEREFGPDAA

SEQ ID NO: 579337 - protein, 22 aa, Mycobacterium
SGNRDERHFGDDAGELDVTRRP

SEQ ID NO: 579338 - protein, 7 aa, Mycobacterium
SGNRDTA

SEQ ID NO: 579339 - protein, 7 aa, Mycobacterium
SGNRGDS

SEQ ID NO: 579340 - protein, 7 aa, Mycobacterium
SGNRSKI

SEQ ID NO: 579341 - protein, 11 aa, Mycobacterium
SGNRTNPSTAT

SEQ ID NO: 579342 - protein, 5 aa, Mycobacterium
SGNSA

SEQ ID NO: 579343 - protein, 8 aa, Mycobacterium
SGNSPGVH

SEQ ID NO: 579344 - protein, 10 aa, Mycobacterium
SGNSPLNPAQ

SEQ ID NO: 579345 - protein, 13 aa, Mycobacterium
SGNSPRARGADGR

SEQ ID NO: 579346 - protein, 5 aa, Mycobacterium
SGNTD

SEQ ID NO: 579347 - protein, 9 aa, Mycobacterium
SGNTDDPAA

SEQ ID NO: 579348 - protein, 18 aa, Mycobacterium
SGNTGNTNFGNGNRGNLN

SEQ ID NO: 579349 - protein, 15 aa, Mycobacterium
SGNTGNTNFGYGNRG

SEQ ID NO: 579350 - protein, 4 aa, Mycobacterium
SGNV

SEQ ID NO: 579351 - protein, 13 aa, Mycobacterium
SGNVGFGNTGNNN

SEQ ID NO: 579352 - protein, 6 aa, Mycobacterium
SGNVGS

SEQ ID NO: 579353 - protein, 11 aa, Mycobacterium
SGNVPGDLHKP

SEQ ID NO: 579354 - protein, 5 aa, Mycobacterium
SGNVR

SEQ ID NO: 579355 - protein, 5 aa, Mycobacterium
SGNVS

SEQ ID NO: 579356 - protein, 9 aa, Mycobacterium
SGNVSTPIG

SEQ ID NO: 579357 - protein, 6 aa, Mycobacterium
SGNYDT

SEQ ID NO: 579358 - protein, 17 aa, Mycobacterium
SGNYNTGFANSGDVNTG

SEQ ID NO: 579359 - protein, 15 aa, Mycobacterium
SGNYPPATPCTITAD

SEQ ID NO: 579360 - protein, 18 aa, Mycobacterium
SGNYSSALAGSGSGNAAV

SEQ ID NO: 579361 - protein, 5 aa, Mycobacterium
SGPAA

SEQ ID NO: 579362 - protein, 8 aa, Mycobacterium
SGPAAATV

SEQ ID NO: 579363 - protein, 12 aa, Mycobacterium
SGPAAGRPAITT

SEQ ID NO: 579364 - protein, 14 aa, Mycobacterium
SGPAAGRPAITTAE

SEQ ID NO: 579365 - protein, 8 aa, Mycobacterium
SGPAAGYG

SEQ ID NO: 579366 - protein, 9 aa, Mycobacterium
SGPAATVHP

SEQ ID NO: 579367 - protein, 6 aa, Mycobacterium
SGPADL

SEQ ID NO: 579368 - protein, 15 aa, Mycobacterium
SGPADLTDAQRDRLA

SEQ ID NO: 579369 - protein, 11 aa, Mycobacterium
SGPADREQERY

SEQ ID NO: 579370 - protein, 10 aa, Mycobacterium
SGPADTVHPT

SEQ ID NO: 579371 - protein, 17 aa, Mycobacterium
SGPAERRAPRPEAATPA

SEQ ID NO: 579372 - protein, 14 aa, Mycobacterium
SGPAESTRYRGCNA

SEQ ID NO: 579373 - protein, 6 aa, Mycobacterium
SGPAEV

SEQ ID NO: 579374 - protein, 29 aa, Mycobacterium
SGPAFGHTRNPWSREHTPGGSSGGSAAAV

SEQ ID NO: 579375 - protein, 8 aa, Mycobacterium
SGPAGGPA

SEQ ID NO: 579376 - protein, 7 aa, Mycobacterium
SGPAKTA

SEQ ID NO: 579377 - protein, 5 aa, Mycobacterium
SGPAM

SEQ ID NO: 579378 - protein, 14 aa, Mycobacterium
SGPAPGEFTGPDPV

SEQ ID NO: 579379 - protein, 14 aa, Mycobacterium
SGPAPGEYTGPERV

SEQ ID NO: 579380 - protein, 18 aa, Mycobacterium
SGPAPSNTPALPAGRPVS

SEQ ID NO: 579381 - protein, 9 aa, Mycobacterium
SGPAPTSVH

SEQ ID NO: 579382 - protein, 5 aa, Mycobacterium
SGPAR

SEQ ID NO: 579383 - protein, 21 aa, Mycobacterium
SGPARQHEPQRDAARRLRGLA

SEQ ID NO: 579384 - protein, 23 aa, Mycobacterium
SGPASAPADIDGVPTSRSPAAAR

SEQ ID NO: 579385 - protein, 18 aa, Mycobacterium
SGPASAPLGVSSNYPRSV

SEQ ID NO: 579386 - protein, 16 aa, Mycobacterium
SGPATDSDSAASQDWD

SEQ ID NO: 579387 - protein, 6 aa, Mycobacterium
SGPATG

SEQ ID NO: 579388 - protein, 11 aa, Mycobacterium
SGPATGETDSA

SEQ ID NO: 579389 - protein, 6 aa, Mycobacterium
SGPAVE

SEQ ID NO: 579390 - protein, 12 aa, Mycobacterium
SGPDAMQRDRRR

SEQ ID NO: 579391 - protein, 6 aa, Mycobacterium
SGPDAV

SEQ ID NO: 579392 - protein, 13 aa, Mycobacterium
SGPDGHGPAEIAG

SEQ ID NO: 579393 - protein, 6 aa, Mycobacterium
SGPDGM

SEQ ID NO: 579394 - protein, 9 aa, Mycobacterium
SGPDGQAES

SEQ ID NO: 579395 - protein, 5 aa, Mycobacterium
SGPDL

SEQ ID NO: 579396 - protein, 27 aa, Mycobacterium
SGPDQIQSTVTASEAVAPPINADDSVA

SEQ ID NO: 579397 - protein, 16 aa, Mycobacterium
SGPDTAMARASTDMGN

SEQ ID NO: 579398 - protein, 9 aa, Mycobacterium
SGPDTPTGK

SEQ ID NO: 579399 - protein, 4 aa, Mycobacterium
SGPE

SEQ ID NO: 579400 - protein, 7 aa, Mycobacterium
SGPEAAT

SEQ ID NO: 579401 - protein, 6 aa, Mycobacterium
SGPEAF

SEQ ID NO: 579402 - protein, 7 aa, Mycobacterium
SGPEAKE

SEQ ID NO: 579403 - protein, 6 aa, Mycobacterium
SGPEDP

SEQ ID NO: 579404 - protein, 5 aa, Mycobacterium
SGPEH

SEQ ID NO: 579405 - protein, 6 aa, Mycobacterium
SGPEHP

SEQ ID NO: 579406 - protein, 7 aa, Mycobacterium
SGPELRS

SEQ ID NO: 579407 - protein, 9 aa, Mycobacterium
SGPEPDRFE

SEQ ID NO: 579408 - protein, 7 aa, Mycobacterium
SGPEPLS

SEQ ID NO: 579409 - protein, 13 aa, Mycobacterium
SGPERDGVDAERR

SEQ ID NO: 579410 - protein, 5 aa, Mycobacterium
SGPES

SEQ ID NO: 579411 - protein, 7 aa, Mycobacterium
SGPESQL

SEQ ID NO: 579412 - protein, 10 aa, Mycobacterium
SGPESVAASA

SEQ ID NO: 579413 - protein, 4 aa, Mycobacterium
SGPF

SEQ ID NO: 579414 - protein, 5 aa, Mycobacterium
SGPGA

SEQ ID NO: 579415 - protein, 7 aa, Mycobacterium
SGPGAAP

SEQ ID NO: 579416 - protein, 7 aa, Mycobacterium
SGPGAAV

SEQ ID NO: 579417 - protein, 8 aa, Mycobacterium
SGPGAGSL

SEQ ID NO: 579418 - protein, 8 aa, Mycobacterium
SGPGAGSM

SEQ ID NO: 579419 - protein, 11 aa, Mycobacterium
SGPGAGSMREA

SEQ ID NO: 579420 - protein, 8 aa, Mycobacterium
SGPGDPGL

SEQ ID NO: 579421 - protein, 7 aa, Mycobacterium
SGPGDRP

SEQ ID NO: 579422 - protein, 6 aa, Mycobacterium
SGPGDV

SEQ ID NO: 579423 - protein, 7 aa, Mycobacterium
SGPGEAD

SEQ ID NO: 579424 - protein, 5 aa, Mycobacterium
SGPGF

SEQ ID NO: 579425 - protein, 7 aa, Mycobacterium
SGPGGER

SEQ ID NO: 579426 - protein, 8 aa, Mycobacterium
SGPGGKTA

SEQ ID NO: 579427 - protein, 9 aa, Mycobacterium
SGPGGPVTA

SEQ ID NO: 579428 - protein, 15 aa, Mycobacterium
SGPGGQKAAIASAKL

SEQ ID NO: 579429 - protein, 17 aa, Mycobacterium
SGPGGQKAAIASAKLGK

SEQ ID NO: 579430 - protein, 8 aa, Mycobacterium
SGPGHADG

SEQ ID NO: 579431 - protein, 7 aa, Mycobacterium
SGPGLPP

SEQ ID NO: 579432 - protein, 8 aa, Mycobacterium
SGPGLRPV

SEQ ID NO: 579433 - protein, 17 aa, Mycobacterium
SGPGLSELASRDVPGSG

SEQ ID NO: 579434 - protein, 6 aa, Mycobacterium
SGPGNL

SEQ ID NO: 579435 - protein, 11 aa, Mycobacterium
SGPGPADSTLA

SEQ ID NO: 579436 - protein, 8 aa, Mycobacterium
SGPGPESL

SEQ ID NO: 579437 - protein, 8 aa, Mycobacterium
SGPGPQSL

SEQ ID NO: 579438 - protein, 14 aa, Mycobacterium
SGPGRALTQDLSRE

SEQ ID NO: 579439 - protein, 7 aa, Mycobacterium
SGPGRAQ

SEQ ID NO: 579440 - protein, 9 aa, Mycobacterium
SGPGRGVRR

SEQ ID NO: 579441 - protein, 8 aa, Mycobacterium
SGPGSAPM

SEQ ID NO: 579442 - protein, 12 aa, Mycobacterium
SGPGSEPGESYQ

SEQ ID NO: 579443 - protein, 6 aa, Mycobacterium
SGPGSF

SEQ ID NO: 579444 - protein, 8 aa, Mycobacterium
SGPGSGSM

SEQ ID NO: 579445 - protein, 10 aa, Mycobacterium
SGPGSGTDSI

SEQ ID NO: 579446 - protein, 7 aa, Mycobacterium
SGPGSVI

SEQ ID NO: 579447 - protein, 5 aa, Mycobacterium
SGPGT

SEQ ID NO: 579448 - protein, 7 aa, Mycobacterium
SGPGTAD

SEQ ID NO: 579449 - protein, 10 aa, Mycobacterium
SGPGTAEGEV

SEQ ID NO: 579450 - protein, 5 aa, Mycobacterium
SGPGY

SEQ ID NO: 579451 - protein, 8 aa, Mycobacterium
SGPHAADP

SEQ ID NO: 579452 - protein, 10 aa, Mycobacterium
SGPHEPPHQR

SEQ ID NO: 579453 - protein, 9 aa, Mycobacterium
SGPHGADPH

SEQ ID NO: 579454 - protein, 7 aa, Mycobacterium
SGPHQVG

SEQ ID NO: 579455 - protein, 11 aa, Mycobacterium
SGPHRLSPGDK

SEQ ID NO: 579456 - protein, 6 aa, Mycobacterium
SGPIAA

SEQ ID NO: 579457 - protein, 5 aa, Mycobacterium
SGPID

SEQ ID NO: 579458 - protein, 9 aa, Mycobacterium
SGPIDPTAS

SEQ ID NO: 579459 - protein, 5 aa, Mycobacterium
SGPIT

SEQ ID NO: 579460 - protein, 12 aa, Mycobacterium
SGPKAVGDDRHV

SEQ ID NO: 579461 - protein, 14 aa, Mycobacterium
SGPKHTRGTPPNVV

SEQ ID NO: 579462 - protein, 16 aa, Mycobacterium
SGPKHTRGTPPNVVET

SEQ ID NO: 579463 - protein, 10 aa, Mycobacterium
SGPKSLPEPV

SEQ ID NO: 579464 - protein, 5 aa, Mycobacterium
SGPLD

SEQ ID NO: 579465 - protein, 12 aa, Mycobacterium
SGPLDPETRDEF

SEQ ID NO: 579466 - protein, 9 aa, Mycobacterium
SGPLDPKRL

SEQ ID NO: 579467 - protein, 7 aa, Mycobacterium
SGPLDRD

SEQ ID NO: 579468 - protein, 6 aa, Mycobacterium
SGPLDT

SEQ ID NO: 579469 - protein, 6 aa, Mycobacterium
SGPLPA

SEQ ID NO: 579470 - protein, 14 aa, Mycobacterium
SGPLPPRAVDDPVA

SEQ ID NO: 579471 - protein, 4 aa, Mycobacterium
SGPM

SEQ ID NO: 579472 - protein, 6 aa, Mycobacterium
SGPNFC

SEQ ID NO: 579473 - protein, 12 aa, Mycobacterium
SGPNGADPHHEC

SEQ ID NO: 579474 - protein, 10 aa, Mycobacterium
SGPNGSQCND

SEQ ID NO: 579475 - protein, 5 aa, Mycobacterium
SGPNP

SEQ ID NO: 579476 - protein, 4 aa, Mycobacterium
SGPP

SEQ ID NO: 579477 - protein, 6 aa, Mycobacterium
SGPPAG

SEQ ID NO: 579478 - protein, 8 aa, Mycobacterium
SGPPKLGR

SEQ ID NO: 579479 - protein, 5 aa, Mycobacterium
SGPPL

SEQ ID NO: 579480 - protein, 16 aa, Mycobacterium
SGPPNFPEAAGRTKGY

SEQ ID NO: 579481 - protein, 10 aa, Mycobacterium
SGPPPGSPRD

SEQ ID NO: 579482 - protein, 6 aa, Mycobacterium
SGPPPI

SEQ ID NO: 579483 - protein, 12 aa, Mycobacterium
SGPPPSNPTVPQ

SEQ ID NO: 579484 - protein, 12 aa, Mycobacterium
SGPPQPDPDEVS

SEQ ID NO: 579485 - protein, 8 aa, Mycobacterium
SGPPRYRP

SEQ ID NO: 579486 - protein, 6 aa, Mycobacterium
SGPPVS

SEQ ID NO: 579487 - protein, 5 aa, Mycobacterium
SGPQA

SEQ ID NO: 579488 - protein, 8 aa, Mycobacterium
SGPQDDRV

SEQ ID NO: 579489 - protein, 8 aa, Mycobacterium
SGPQEDDV

SEQ ID NO: 579490 - protein, 7 aa, Mycobacterium
SGPQGTG

SEQ ID NO: 579491 - protein, 9 aa, Mycobacterium
SGPQSGPRQ

SEQ ID NO: 579492 - protein, 8 aa, Mycobacterium
SGPQSTPR

SEQ ID NO: 579493 - protein, 12 aa, Mycobacterium
SGPQYSRGQGMQ

SEQ ID NO: 579494 - protein, 4 aa, Mycobacterium
SGPR

SEQ ID NO: 579495 - protein, 7 aa, Mycobacterium
SGPRAGF

SEQ ID NO: 579496 - protein, 7 aa, Mycobacterium
SGPRPAK

SEQ ID NO: 579497 - protein, 9 aa, Mycobacterium
SGPRPPAGA

SEQ ID NO: 579498 - protein, 9 aa, Mycobacterium
SGPRQTRLR

SEQ ID NO: 579499 - protein, 6 aa, Mycobacterium
SGPRRA

SEQ ID NO: 579500 - protein, 21 aa, Mycobacterium
SGPRRSGAPAHRQRQRPPRLS

SEQ ID NO: 579501 - protein, 7 aa, Mycobacterium
SGPRSFE

SEQ ID NO: 579502 - protein, 6 aa, Mycobacterium
SGPRSL

SEQ ID NO: 579503 - protein, 24 aa, Mycobacterium
SGPRSMRTPSASSVSAPPDSDDAA

SEQ ID NO: 579504 - protein, 6 aa, Mycobacterium
SGPRVG

SEQ ID NO: 579505 - protein, 11 aa, Mycobacterium
SGPSAEPKANG

SEQ ID NO: 579506 - protein, 6 aa, Mycobacterium
SGPSGF

SEQ ID NO: 579507 - protein, 6 aa, Mycobacterium
SGPSGY

SEQ ID NO: 579508 - protein, 8 aa, Mycobacterium
SGPSRRRR

SEQ ID NO: 579509 - protein, 9 aa, Mycobacterium
SGPSTDEQI

SEQ ID NO: 579510 - protein, 6 aa, Mycobacterium
SGPSYR

SEQ ID NO: 579511 - protein, 4 aa, Mycobacterium
SGPT

SEQ ID NO: 579512 - protein, 7 aa, Mycobacterium
SGPTARM

SEQ ID NO: 579513 - protein, 6 aa, Mycobacterium
SGPTHP

SEQ ID NO: 579514 - protein, 16 aa, Mycobacterium
SGPTLTSTIGNTDGST

SEQ ID NO: 579515 - protein, 9 aa, Mycobacterium
SGPTRKLGG

SEQ ID NO: 579516 - protein, 9 aa, Mycobacterium
SGPTTGNRE

SEQ ID NO: 579517 - protein, 6 aa, Mycobacterium
SGPTTV

SEQ ID NO: 579518 - protein, 8 aa, Mycobacterium
SGPTVTRG

SEQ ID NO: 579519 - protein, 5 aa, Mycobacterium
SGPTY

SEQ ID NO: 579520 - protein, 15 aa, Mycobacterium
SGPVAGARVVPAPTE

SEQ ID NO: 579521 - protein, 9 aa, Mycobacterium
SGPVAPVGG

SEQ ID NO: 579522 - protein, 10 aa, Mycobacterium
SGPVDPPARD

SEQ ID NO: 579523 - protein, 13 aa, Mycobacterium
SGPVDRIGRRPAA

SEQ ID NO: 579524 - protein, 14 aa, Mycobacterium
SGPVDYDRRDPATQ

SEQ ID NO: 579525 - protein, 6 aa, Mycobacterium
SGPVGG

SEQ ID NO: 579526 - protein, 22 aa, Mycobacterium
SGPVGGPDGNPPYPNGATPTMI

SEQ ID NO: 579527 - protein, 5 aa, Mycobacterium
SGPVK

SEQ ID NO: 579528 - protein, 5 aa, Mycobacterium
SGPVN

SEQ ID NO: 579529 - protein, 12 aa, Mycobacterium
SGPVPGEHTGVG

SEQ ID NO: 579530 - protein, 16 aa, Mycobacterium
SGPVQGARVVPAPSTA

SEQ ID NO: 579531 - protein, 12 aa, Mycobacterium
SGPVQGDTPEEI

SEQ ID NO: 579532 - protein, 9 aa, Mycobacterium
SGPVREGDT

SEQ ID NO: 579533 - protein, 5 aa, Mycobacterium
SGPVT

SEQ ID NO: 579534 - protein, 6 aa, Mycobacterium
SGPWGT

SEQ ID NO: 579535 - protein, 5 aa, Mycobacterium
SGPWL

SEQ ID NO: 579536 - protein, 16 aa, Mycobacterium
SGPWRGPASTSMASAA

SEQ ID NO: 579537 - protein, 4 aa, Mycobacterium
SGPY

SEQ ID NO: 579538 - protein, 11 aa, Mycobacterium
SGPYADRAASE

SEQ ID NO: 579539 - protein, 6 aa, Mycobacterium
SGQAGV

SEQ ID NO: 579540 - protein, 10 aa, Mycobacterium
SGQANGAPPL

SEQ ID NO: 579541 - protein, 8 aa, Mycobacterium
SGQANTGL

SEQ ID NO: 579542 - protein, 9 aa, Mycobacterium
SGQASIGTL

SEQ ID NO: 579543 - protein, 5 aa, Mycobacterium
SGQAT

SEQ ID NO: 579544 - protein, 6 aa, Mycobacterium
SGQATV

SEQ ID NO: 579545 - protein, 8 aa, Mycobacterium
SGQATVAG

SEQ ID NO: 579546 - protein, 5 aa, Mycobacterium
SGQAV

SEQ ID NO: 579547 - protein, 8 aa, Mycobacterium
SGQDCTAA

SEQ ID NO: 579548 - protein, 9 aa, Mycobacterium
SGQDCTAAT

SEQ ID NO: 579549 - protein, 7 aa, Mycobacterium
SGQDIPV

SEQ ID NO: 579550 - protein, 11 aa, Mycobacterium
SGQDTQRGTFT

SEQ ID NO: 579551 - protein, 17 aa, Mycobacterium
SGQEQGDVRSDRSAQEI

SEQ ID NO: 579552 - protein, 13 aa, Mycobacterium
SGQEQNPDLTGKD

SEQ ID NO: 579553 - protein, 5 aa, Mycobacterium
SGQFQ

SEQ ID NO: 579554 - protein, 27 aa, Mycobacterium
SGQGPMDPATNTYIGEGDVRAQTRRTL

SEQ ID NO: 579555 - protein, 7 aa, Mycobacterium
SGQGRQL

SEQ ID NO: 579556 - protein, 5 aa, Mycobacterium
SGQGT

SEQ ID NO: 579557 - protein, 5 aa, Mycobacterium
SGQGV

SEQ ID NO: 579558 - protein, 10 aa, Mycobacterium
SGQGYPGRQE

SEQ ID NO: 579559 - protein, 5 aa, Mycobacterium
SGQHC

SEQ ID NO: 579560 - protein, 4 aa, Mycobacterium
SGQK

SEQ ID NO: 579561 - protein, 8 aa, Mycobacterium
SGQKPPQS

SEQ ID NO: 579562 - protein, 5 aa, Mycobacterium
SGQKY

SEQ ID NO: 579563 - protein, 4 aa, Mycobacterium
SGQL

SEQ ID NO: 579564 - protein, 7 aa, Mycobacterium
SGQLAGY

SEQ ID NO: 579565 - protein, 9 aa, Mycobacterium
SGQLDPDYA

SEQ ID NO: 579566 - protein, 13 aa, Mycobacterium
SGQLGEKPSDAKQ

SEQ ID NO: 579567 - protein, 12 aa, Mycobacterium
SGQLKPDRITEE

SEQ ID NO: 579568 - protein, 6 aa, Mycobacterium
SGQLNP

SEQ ID NO: 579569 - protein, 5 aa, Mycobacterium
SGQLP

SEQ ID NO: 579570 - protein, 6 aa, Mycobacterium
SGQLPH

SEQ ID NO: 579571 - protein, 10 aa, Mycobacterium
SGQMSDSSQL

SEQ ID NO: 579572 - protein, 6 aa, Mycobacterium
SGQNGD

SEQ ID NO: 579573 - protein, 5 aa, Mycobacterium
SGQNL

SEQ ID NO: 579574 - protein, 5 aa, Mycobacterium
SGQNP

SEQ ID NO: 579575 - protein, 8 aa, Mycobacterium
SGQNPEGL

SEQ ID NO: 579576 - protein, 14 aa, Mycobacterium
SGQNVSVKGPKGTL

SEQ ID NO: 579577 - protein, 8 aa, Mycobacterium
SGQPERRR

SEQ ID NO: 579578 - protein, 13 aa, Mycobacterium
SGQPGEPIPGPPP

SEQ ID NO: 579579 - protein, 6 aa, Mycobacterium
SGQPGL

SEQ ID NO: 579580 - protein, 8 aa, Mycobacterium
SGQPIEHG

SEQ ID NO: 579581 - protein, 6 aa, Mycobacterium
SGQPIN

SEQ ID NO: 579582 - protein, 5 aa, Mycobacterium
SGQPL

SEQ ID NO: 579583 - protein, 15 aa, Mycobacterium
SGQPPAVPQPDADSC

SEQ ID NO: 579584 - protein, 10 aa, Mycobacterium
SGQPQRAAAT

SEQ ID NO: 579585 - protein, 14 aa, Mycobacterium
SGQPRGARTLSGGE

SEQ ID NO: 579586 - protein, 11 aa, Mycobacterium
SGQPRRAAAEY

SEQ ID NO: 579587 - protein, 6 aa, Mycobacterium
SGQPTF

SEQ ID NO: 579588 - protein, 7 aa, Mycobacterium
SGQPVNS

SEQ ID NO: 579589 - protein, 7 aa, Mycobacterium
SGQPVPT

SEQ ID NO: 579590 - protein, 7 aa, Mycobacterium
SGQPVPV

SEQ ID NO: 579591 - protein, 6 aa, Mycobacterium
SGQPVR

SEQ ID NO: 579592 - protein, 26 aa, Mycobacterium
SGQPVSRVDGPLKVTGKASYAADNQI

SEQ ID NO: 579593 - protein, 7 aa, Mycobacterium
SGQQEGA

SEQ ID NO: 579594 - protein, 9 aa, Mycobacterium
SGQQGRNIA

SEQ ID NO: 579595 - protein, 5 aa, Mycobacterium
SGQQL

SEQ ID NO: 579596 - protein, 10 aa, Mycobacterium
SGQQRSQEGS

SEQ ID NO: 579597 - protein, 6 aa, Mycobacterium
SGQRAP

SEQ ID NO: 579598 - protein, 6 aa, Mycobacterium
SGQRET

SEQ ID NO: 579599 - protein, 7 aa, Mycobacterium
SGQRLGS

SEQ ID NO: 579600 - protein, 6 aa, Mycobacterium
SGQRRT

SEQ ID NO: 579601 - protein, 4 aa, Mycobacterium
SGQS

SEQ ID NO: 579602 - protein, 7 aa, Mycobacterium
SGQSEQE

SEQ ID NO: 579603 - protein, 5 aa, Mycobacterium
SGQSI

SEQ ID NO: 579604 - protein, 6 aa, Mycobacterium
SGQSWG

SEQ ID NO: 579605 - protein, 4 aa, Mycobacterium
SGQT

SEQ ID NO: 579606 - protein, 5 aa, Mycobacterium
SGQTA

SEQ ID NO: 579607 - protein, 5 aa, Mycobacterium
SGQTL

SEQ ID NO: 579608 - protein, 6 aa, Mycobacterium
SGQTLG

SEQ ID NO: 579609 - protein, 5 aa, Mycobacterium
SGQTV

SEQ ID NO: 579610 - protein, 8 aa, Mycobacterium
SGQTYGAA

SEQ ID NO: 579611 - protein, 14 aa, Mycobacterium
SGQVDAESDAQRNR

SEQ ID NO: 579612 - protein, 20 aa, Mycobacterium
SGQVPIDRTSADAAENALST

SEQ ID NO: 579613 - protein, 15 aa, Mycobacterium
SGQWTGAAAAAYSEA

SEQ ID NO: 579614 - protein, 6 aa, Mycobacterium
SGQYPE

SEQ ID NO: 579615 - protein, 5 aa, Mycobacterium
SGRAA

SEQ ID NO: 579616 - protein, 8 aa, Mycobacterium
SGRAAAEP

SEQ ID NO: 579617 - protein, 6 aa, Mycobacterium
SGRAAE

SEQ ID NO: 579618 - protein, 11 aa, Mycobacterium
SGRAATASEPT

SEQ ID NO: 579619 - protein, 6 aa, Mycobacterium
SGRADD

SEQ ID NO: 579620 - protein, 7 aa, Mycobacterium
SGRADDK

SEQ ID NO: 579621 - protein, 16 aa, Mycobacterium
SGRADKVNISGHENTE

SEQ ID NO: 579622 - protein, 14 aa, Mycobacterium
SGRADYRPITDGEA

SEQ ID NO: 579623 - protein, 6 aa, Mycobacterium
SGRAES

SEQ ID NO: 579624 - protein, 14 aa, Mycobacterium
SGRAEYRPITDSEA

SEQ ID NO: 579625 - protein, 11 aa, Mycobacterium
SGRAGSNTAAD

SEQ ID NO: 579626 - protein, 23 aa, Mycobacterium
SGRAGVASTTQPADGEVPAGDNL

SEQ ID NO: 579627 - protein, 23 aa, Mycobacterium
SGRAGVASTVEPANGEVPEGDNL

SEQ ID NO: 579628 - protein, 23 aa, Mycobacterium
SGRAGVASTVQPADGEVPEGDNL

SEQ ID NO: 579629 - protein, 18 aa, Mycobacterium
SGRALGTPPTAATAGAHA

SEQ ID NO: 579630 - protein, 18 aa, Mycobacterium
SGRALGTPPTASTAGAHA

SEQ ID NO: 579631 - protein, 7 aa, Mycobacterium
SGRALSA

SEQ ID NO: 579632 - protein, 8 aa, Mycobacterium
SGRANPDG

SEQ ID NO: 579633 - protein, 6 aa, Mycobacterium
SGRAPA

SEQ ID NO: 579634 - protein, 14 aa, Mycobacterium
SGRAPSSTFGLSGF

SEQ ID NO: 579635 - protein, 7 aa, Mycobacterium
SGRARDG

SEQ ID NO: 579636 - protein, 10 aa, Mycobacterium
SGRARPGSLQ

SEQ ID NO: 579637 - protein, 7 aa, Mycobacterium
SGRATAS

SEQ ID NO: 579638 - protein, 9 aa, Mycobacterium
SGRATKDTI

SEQ ID NO: 579639 - protein, 4 aa, Mycobacterium
SGRC

SEQ ID NO: 579640 - protein, 4 aa, Mycobacterium
SGRD

SEQ ID NO: 579641 - protein, 5 aa, Mycobacterium
SGRDD

SEQ ID NO: 579642 - protein, 23 aa, Mycobacterium
SGRDEPLGDPGGAAKLGRVGADT

SEQ ID NO: 579643 - protein, 7 aa, Mycobacterium
SGRDFDS

SEQ ID NO: 579644 - protein, 6 aa, Mycobacterium
SGRDGV

SEQ ID NO: 579645 - protein, 6 aa, Mycobacterium
SGRDHR

SEQ ID NO: 579646 - protein, 9 aa, Mycobacterium
SGRDPGHYA

SEQ ID NO: 579647 - protein, 9 aa, Mycobacterium
SGRDPRSIG

SEQ ID NO: 579648 - protein, 9 aa, Mycobacterium
SGRDRDGGL

SEQ ID NO: 579649 - protein, 6 aa, Mycobacterium
SGRDVR

SEQ ID NO: 579650 - protein, 10 aa, Mycobacterium
SGREAMAAPG

SEQ ID NO: 579651 - protein, 12 aa, Mycobacterium
SGREMTSEDWGS

SEQ ID NO: 579652 - protein, 10 aa, Mycobacterium
SGREPTPVRE

SEQ ID NO: 579653 - protein, 8 aa, Mycobacterium
SGRESIEQ

SEQ ID NO: 579654 - protein, 6 aa, Mycobacterium
SGRFPG

SEQ ID NO: 579655 - protein, 9 aa, Mycobacterium
SGRFREGDR

SEQ ID NO: 579656 - protein, 10 aa, Mycobacterium
SGRGAIPYPD

SEQ ID NO: 579657 - protein, 15 aa, Mycobacterium
SGRGAPRHPGGAPNL

SEQ ID NO: 579658 - protein, 13 aa, Mycobacterium
SGRGARAGQRRRP

SEQ ID NO: 579659 - protein, 11 aa, Mycobacterium
SGRGAVEVPRP

SEQ ID NO: 579660 - protein, 5 aa, Mycobacterium
SGRGD

SEQ ID NO: 579661 - protein, 8 aa, Mycobacterium
SGRGDSAV

SEQ ID NO: 579662 - protein, 8 aa, Mycobacterium
SGRGESGW

SEQ ID NO: 579663 - protein, 10 aa, Mycobacterium
SGRGFSAGTD

SEQ ID NO: 579664 - protein, 11 aa, Mycobacterium
SGRGFSAGTDL

SEQ ID NO: 579665 - protein, 5 aa, Mycobacterium
SGRGG

SEQ ID NO: 579666 - protein, 21 aa, Mycobacterium
SGRGGPQPLPFGRSSAGGDTI

SEQ ID NO: 579667 - protein, 8 aa, Mycobacterium
SGRGGQVD

SEQ ID NO: 579668 - protein, 21 aa, Mycobacterium
SGRGGRQMSPRGGSNAGGDTI

SEQ ID NO: 579669 - protein, 17 aa, Mycobacterium
SGRGGTSGFGNFGPDTS

SEQ ID NO: 579670 - protein, 10 aa, Mycobacterium
SGRGPLRPNA

SEQ ID NO: 579671 - protein, 5 aa, Mycobacterium
SGRGR

SEQ ID NO: 579672 - protein, 14 aa, Mycobacterium
SGRGSQHTAAAAKG

SEQ ID NO: 579673 - protein, 9 aa, Mycobacterium
SGRGTETPE

SEQ ID NO: 579674 - protein, 11 aa, Mycobacterium
SGRGVEETRNA

SEQ ID NO: 579675 - protein, 11 aa, Mycobacterium
SGRHDGGTGVD

SEQ ID NO: 579676 - protein, 4 aa, Mycobacterium
SGRI

SEQ ID NO: 579677 - protein, 11 aa, Mycobacterium
SGRISEESSQL

SEQ ID NO: 579678 - protein, 9 aa, Mycobacterium
SGRKDEAAA

SEQ ID NO: 579679 - protein, 10 aa, Mycobacterium
SGRKDEAAKV

SEQ ID NO: 579680 - protein, 12 aa, Mycobacterium
SGRKDGKERAAS

SEQ ID NO: 579681 - protein, 15 aa, Mycobacterium
SGRLAPGTRLPSSRA

SEQ ID NO: 579682 - protein, 5 aa, Mycobacterium
SGRLD

SEQ ID NO: 579683 - protein, 6 aa, Mycobacterium
SGRLDR

SEQ ID NO: 579684 - protein, 11 aa, Mycobacterium
SGRLDTEEGTN

SEQ ID NO: 579685 - protein, 7 aa, Mycobacterium
SGRLEEA

SEQ ID NO: 579686 - protein, 14 aa, Mycobacterium
SGRLNPAPAISPEH

SEQ ID NO: 579687 - protein, 26 aa, Mycobacterium
SGRLPSPHRAGGDGRRRRAGARAARA

SEQ ID NO: 579688 - protein, 6 aa, Mycobacterium
SGRLPV

SEQ ID NO: 579689 - protein, 9 aa, Mycobacterium
SGRLRPNHH

SEQ ID NO: 579690 - protein, 5 aa, Mycobacterium
SGRLS

SEQ ID NO: 579691 - protein, 6 aa, Mycobacterium
SGRLST

SEQ ID NO: 579692 - protein, 10 aa, Mycobacterium
SGRLTTESGT

SEQ ID NO: 579693 - protein, 4 aa, Mycobacterium
SGRM

SEQ ID NO: 579694 - protein, 7 aa, Mycobacterium
SGRMTDD

SEQ ID NO: 579695 - protein, 13 aa, Mycobacterium
SGRMYSGPGAGPM

SEQ ID NO: 579696 - protein, 4 aa, Mycobacterium
SGRN

SEQ ID NO: 579697 - protein, 5 aa, Mycobacterium
SGRNF

SEQ ID NO: 579698 - protein, 5 aa, Mycobacterium
SGRNR

SEQ ID NO: 579699 - protein, 9 aa, Mycobacterium
SGRPAELSG

SEQ ID NO: 579700 - protein, 16 aa, Mycobacterium
SGRPAGSVDITPLEVS

SEQ ID NO: 579701 - protein, 8 aa, Mycobacterium
SGRPAPHL

SEQ ID NO: 579702 - protein, 15 aa, Mycobacterium
SGRPAPKHPGGAPNC

SEQ ID NO: 579703 - protein, 7 aa, Mycobacterium
SGRPAQG

SEQ ID NO: 579704 - protein, 7 aa, Mycobacterium
SGRPARH

SEQ ID NO: 579705 - protein, 8 aa, Mycobacterium
SGRPDDLA

SEQ ID NO: 579706 - protein, 10 aa, Mycobacterium
SGRPDELSGV

SEQ ID NO: 579707 - protein, 9 aa, Mycobacterium
SGRPDKDDL

SEQ ID NO: 579708 - protein, 6 aa, Mycobacterium
SGRPDT

SEQ ID NO: 579709 - protein, 8 aa, Mycobacterium
SGRPFVST

SEQ ID NO: 579710 - protein, 13 aa, Mycobacterium
SGRPGAEESGEEF

SEQ ID NO: 579711 - protein, 12 aa, Mycobacterium
SGRPGIEDPRRP

SEQ ID NO: 579712 - protein, 7 aa, Mycobacterium
SGRPGNV

SEQ ID NO: 579713 - protein, 8 aa, Mycobacterium
SGRPGRAA

SEQ ID NO: 579714 - protein, 5 aa, Mycobacterium
SGRPI

SEQ ID NO: 579715 - protein, 11 aa, Mycobacterium
SGRPKTGTCSS

SEQ ID NO: 579716 - protein, 7 aa, Mycobacterium
SGRPLEE

SEQ ID NO: 579717 - protein, 5 aa, Mycobacterium
SGRPM

SEQ ID NO: 579718 - protein, 8 aa, Mycobacterium
SGRPPELA

SEQ ID NO: 579719 - protein, 9 aa, Mycobacterium
SGRPPELTG

SEQ ID NO: 579720 - protein, 8 aa, Mycobacterium
SGRPPGDV

SEQ ID NO: 579721 - protein, 8 aa, Mycobacterium
SGRPPRGM

SEQ ID NO: 579722 - protein, 13 aa, Mycobacterium
SGRPRNSRPRDAL

SEQ ID NO: 579723 - protein, 8 aa, Mycobacterium
SGRPSEAE

SEQ ID NO: 579724 - protein, 6 aa, Mycobacterium
SGRPTL

SEQ ID NO: 579725 - protein, 5 aa, Mycobacterium
SGRPV

SEQ ID NO: 579726 - protein, 6 aa, Mycobacterium
SGRPVD

SEQ ID NO: 579727 - protein, 5 aa, Mycobacterium
SGRPW

SEQ ID NO: 579728 - protein, 18 aa, Mycobacterium
SGRPYRDVETEIALAFSR

SEQ ID NO: 579729 - protein, 4 aa, Mycobacterium
SGRQ

SEQ ID NO: 579730 - protein, 7 aa, Mycobacterium
SGRQVGP

SEQ ID NO: 579731 - protein, 6 aa, Mycobacterium
SGRRAR

SEQ ID NO: 579732 - protein, 7 aa, Mycobacterium
SGRRDEP

SEQ ID NO: 579733 - protein, 11 aa, Mycobacterium
SGRRDEPLPER

SEQ ID NO: 579734 - protein, 8 aa, Mycobacterium
SGRRDGYP

SEQ ID NO: 579735 - protein, 5 aa, Mycobacterium
SGRRE

SEQ ID NO: 579736 - protein, 7 aa, Mycobacterium
SGRREPN

SEQ ID NO: 579737 - protein, 5 aa, Mycobacterium
SGRRG

SEQ ID NO: 579738 - protein, 23 aa, Mycobacterium
SGRRGERDHRRAGAAGELTGATR

SEQ ID NO: 579739 - protein, 24 aa, Mycobacterium
SGRRGERDHRRAGAAGELTGATRP

SEQ ID NO: 579740 - protein, 13 aa, Mycobacterium
SGRRGKPEPSPVA

SEQ ID NO: 579741 - protein, 6 aa, Mycobacterium
SGRRGR

SEQ ID NO: 579742 - protein, 7 aa, Mycobacterium
SGRRGRV

SEQ ID NO: 579743 - protein, 5 aa, Mycobacterium
SGRRR

SEQ ID NO: 579744 - protein, 7 aa, Mycobacterium
SGRRRGK

SEQ ID NO: 579745 - protein, 12 aa, Mycobacterium
SGRRRKGRRALS

SEQ ID NO: 579746 - protein, 12 aa, Mycobacterium
SGRRRKGRRALT

SEQ ID NO: 579747 - protein, 6 aa, Mycobacterium
SGRRRQ

SEQ ID NO: 579748 - protein, 11 aa, Mycobacterium
SGRRSPASSAV

SEQ ID NO: 579749 - protein, 6 aa, Mycobacterium
SGRRVE

SEQ ID NO: 579750 - protein, 6 aa, Mycobacterium
SGRRYE

SEQ ID NO: 579751 - protein, 4 aa, Mycobacterium
SGRS

SEQ ID NO: 579752 - protein, 9 aa, Mycobacterium
SGRSCPDSV

SEQ ID NO: 579753 - protein, 7 aa, Mycobacterium
SGRSDID

SEQ ID NO: 579754 - protein, 7 aa, Mycobacterium
SGRSGDA

SEQ ID NO: 579755 - protein, 7 aa, Mycobacterium
SGRSITL

SEQ ID NO: 579756 - protein, 17 aa, Mycobacterium
SGRSKSEITEEDIRDAA

SEQ ID NO: 579757 - protein, 5 aa, Mycobacterium
SGRSM

SEQ ID NO: 579758 - protein, 13 aa, Mycobacterium
SGRSQGEITEEQI

SEQ ID NO: 579759 - protein, 6 aa, Mycobacterium
SGRSSL

SEQ ID NO: 579760 - protein, 6 aa, Mycobacterium
SGRSSV

SEQ ID NO: 579761 - protein, 7 aa, Mycobacterium
SGRSTFN

SEQ ID NO: 579762 - protein, 13 aa, Mycobacterium
SGRSVSSAVAGGR

SEQ ID NO: 579763 - protein, 12 aa, Mycobacterium
SGRTARAGNAGD

SEQ ID NO: 579764 - protein, 5 aa, Mycobacterium
SGRTE

SEQ ID NO: 579765 - protein, 15 aa, Mycobacterium
SGRTEDVYNRPGHPY

SEQ ID NO: 579766 - protein, 12 aa, Mycobacterium
SGRTEPREQLTD

SEQ ID NO: 579767 - protein, 5 aa, Mycobacterium
SGRTF

SEQ ID NO: 579768 - protein, 6 aa, Mycobacterium
SGRTGH

SEQ ID NO: 579769 - protein, 7 aa, Mycobacterium
SGRTHPR

SEQ ID NO: 579770 - protein, 6 aa, Mycobacterium
SGRTIT

SEQ ID NO: 579771 - protein, 17 aa, Mycobacterium
SGRTKSEITEEDIRDAA

SEQ ID NO: 579772 - protein, 8 aa, Mycobacterium
SGRTPRSV

SEQ ID NO: 579773 - protein, 9 aa, Mycobacterium
SGRTPVTGA

SEQ ID NO: 579774 - protein, 13 aa, Mycobacterium
SGRTSRLKRFRVS

SEQ ID NO: 579775 - protein, 7 aa, Mycobacterium
SGRTVPY

SEQ ID NO: 579776 - protein, 7 aa, Mycobacterium
SGRTVSE

SEQ ID NO: 579777 - protein, 8 aa, Mycobacterium
SGRTWSTA

SEQ ID NO: 579778 - protein, 4 aa, Mycobacterium
SGRV

SEQ ID NO: 579779 - protein, 6 aa, Mycobacterium
SGRVDQ

SEQ ID NO: 579780 - protein, 10 aa, Mycobacterium
SGRVKRPQTG

SEQ ID NO: 579781 - protein, 5 aa, Mycobacterium
SGRVS

SEQ ID NO: 579782 - protein, 12 aa, Mycobacterium
SGRVSDSGEGRW

SEQ ID NO: 579783 - protein, 9 aa, Mycobacterium
SGRWGDPAT

SEQ ID NO: 579784 - protein, 12 aa, Mycobacterium
SGRWPGRPLGSV

SEQ ID NO: 579785 - protein, 17 aa, Mycobacterium
SGRWPQAANAPGTKGGS

SEQ ID NO: 579786 - protein, 7 aa, Mycobacterium
SGRYGRP

SEQ ID NO: 579787 - protein, 15 aa, Mycobacterium
SGRYGSRAGVPARNI

SEQ ID NO: 579788 - protein, 13 aa, Mycobacterium
SGRYRATVPHGMY

SEQ ID NO: 579789 - protein, 4 aa, Mycobacterium
SGSA

SEQ ID NO: 579790 - protein, 8 aa, Mycobacterium
SGSAAATE

SEQ ID NO: 579791 - protein, 8 aa, Mycobacterium
SGSAAPAG

SEQ ID NO: 579792 - protein, 5 aa, Mycobacterium
SGSAD

SEQ ID NO: 579793 - protein, 13 aa, Mycobacterium
SGSADGARSASAT

SEQ ID NO: 579794 - protein, 7 aa, Mycobacterium
SGSADPF

SEQ ID NO: 579795 - protein, 11 aa, Mycobacterium
SGSAFNPRRSV

SEQ ID NO: 579796 - protein, 13 aa, Mycobacterium
SGSAGADVAPEPV

SEQ ID NO: 579797 - protein, 16 aa, Mycobacterium
SGSAGSRLAPEDLPDD

SEQ ID NO: 579798 - protein, 7 aa, Mycobacterium
SGSAGSV

SEQ ID NO: 579799 - protein, 9 aa, Mycobacterium
SGSAGVDAE

SEQ ID NO: 579800 - protein, 9 aa, Mycobacterium
SGSAGVNSG

SEQ ID NO: 579801 - protein, 7 aa, Mycobacterium
SGSAPLA

SEQ ID NO: 579802 - protein, 6 aa, Mycobacterium
SGSARL

SEQ ID NO: 579803 - protein, 10 aa, Mycobacterium
SGSARQVERD

SEQ ID NO: 579804 - protein, 5 aa, Mycobacterium
SGSAS

SEQ ID NO: 579805 - protein, 14 aa, Mycobacterium
SGSATDADQRGNRV

SEQ ID NO: 579806 - protein, 11 aa, Mycobacterium
SGSATDTDPAG

SEQ ID NO: 579807 - protein, 10 aa, Mycobacterium
SGSATDTDPV

SEQ ID NO: 579808 - protein, 13 aa, Mycobacterium
SGSATDTDREGRA

SEQ ID NO: 579809 - protein, 9 aa, Mycobacterium
SGSATYPGA

SEQ ID NO: 579810 - protein, 6 aa, Mycobacterium
SGSAVA

SEQ ID NO: 579811 - protein, 6 aa, Mycobacterium
SGSAVP

SEQ ID NO: 579812 - protein, 9 aa, Mycobacterium
SGSAVPSAP

SEQ ID NO: 579813 - protein, 18 aa, Mycobacterium
SGSAVTSIPQTGPAPPIL

SEQ ID NO: 579814 - protein, 6 aa, Mycobacterium
SGSAYE

SEQ ID NO: 579815 - protein, 6 aa, Mycobacterium
SGSCTT

SEQ ID NO: 579816 - protein, 4 aa, Mycobacterium
SGSD

SEQ ID NO: 579817 - protein, 8 aa, Mycobacterium
SGSDDQVV

SEQ ID NO: 579818 - protein, 5 aa, Mycobacterium
SGSDG

SEQ ID NO: 579819 - protein, 19 aa, Mycobacterium
SGSDGREESPEQHLNPRSG

SEQ ID NO: 579820 - protein, 10 aa, Mycobacterium
SGSDGREESQ

SEQ ID NO: 579821 - protein, 12 aa, Mycobacterium
SGSDHDDIDDDP

SEQ ID NO: 579822 - protein, 9 aa, Mycobacterium
SGSDLEQAR

SEQ ID NO: 579823 - protein, 13 aa, Mycobacterium
SGSDNADGTTTVH

SEQ ID NO: 579824 - protein, 6 aa, Mycobacterium
SGSDNW

SEQ ID NO: 579825 - protein, 5 aa, Mycobacterium
SGSDQ

SEQ ID NO: 579826 - protein, 6 aa, Mycobacterium
SGSDTA

SEQ ID NO: 579827 - protein, 14 aa, Mycobacterium
SGSDVRIASWQWGR

SEQ ID NO: 579828 - protein, 9 aa, Mycobacterium
SGSEADYQA

SEQ ID NO: 579829 - protein, 7 aa, Mycobacterium
SGSEAGD

SEQ ID NO: 579830 - protein, 6 aa, Mycobacterium
SGSEAI

SEQ ID NO: 579831 - protein, 16 aa, Mycobacterium
SGSEAIANRDAEAGVT

SEQ ID NO: 579832 - protein, 17 aa, Mycobacterium
SGSEAITTREAEPGATA

SEQ ID NO: 579833 - protein, 7 aa, Mycobacterium
SGSEAVE

SEQ ID NO: 579834 - protein, 10 aa, Mycobacterium
SGSEEDETAW

SEQ ID NO: 579835 - protein, 9 aa, Mycobacterium
SGSEEDYQA

SEQ ID NO: 579836 - protein, 18 aa, Mycobacterium
SGSEEDYQAAVKRFKEAQ

SEQ ID NO: 579837 - protein, 7 aa, Mycobacterium
SGSEFES

SEQ ID NO: 579838 - protein, 7 aa, Mycobacterium
SGSEGAL

SEQ ID NO: 579839 - protein, 8 aa, Mycobacterium
SGSEGQFS

SEQ ID NO: 579840 - protein, 8 aa, Mycobacterium
SGSENKGF

SEQ ID NO: 579841 - protein, 16 aa, Mycobacterium
SGSEQNPDITGKSRKA

SEQ ID NO: 579842 - protein, 6 aa, Mycobacterium
SGSESA

SEQ ID NO: 579843 - protein, 22 aa, Mycobacterium
SGSESDIRQAAAAAEEALARSV

SEQ ID NO: 579844 - protein, 7 aa, Mycobacterium
SGSFGPV

SEQ ID NO: 579845 - protein, 4 aa, Mycobacterium
SGSG

SEQ ID NO: 579846 - protein, 6 aa, Mycobacterium
SGSGAF

SEQ ID NO: 579847 - protein, 6 aa, Mycobacterium
SGSGAM

SEQ ID NO: 579848 - protein, 5 aa, Mycobacterium
SGSGC

SEQ ID NO: 579849 - protein, 11 aa, Mycobacterium
SGSGDGKADEV

SEQ ID NO: 579850 - protein, 7 aa, Mycobacterium
SGSGDHA

SEQ ID NO: 579851 - protein, 12 aa, Mycobacterium
SGSGDWEATKDD

SEQ ID NO: 579852 - protein, 11 aa, Mycobacterium
SGSGEGAAREP

SEQ ID NO: 579853 - protein, 8 aa, Mycobacterium
SGSGELRG

SEQ ID NO: 579854 - protein, 18 aa, Mycobacterium
SGSGEPYRCTCGDALVPV

SEQ ID NO: 579855 - protein, 5 aa, Mycobacterium
SGSGF

SEQ ID NO: 579856 - protein, 17 aa, Mycobacterium
SGSGGIGGGGGAGGYGG

SEQ ID NO: 579857 - protein, 31 aa, Mycobacterium
SGSGGVGGAGGATSDVGAAGGAGGDGGAGGL

SEQ ID NO: 579858 - protein, 9 aa, Mycobacterium
SGSGGYNSG

SEQ ID NO: 579859 - protein, 5 aa, Mycobacterium
SGSGH

SEQ ID NO: 579860 - protein, 6 aa, Mycobacterium
SGSGHP

SEQ ID NO: 579861 - protein, 9 aa, Mycobacterium
SGSGKSSVA

SEQ ID NO: 579862 - protein, 7 aa, Mycobacterium
SGSGKST

SEQ ID NO: 579863 - protein, 9 aa, Mycobacterium
SGSGKSTVG

SEQ ID NO: 579864 - protein, 7 aa, Mycobacterium
SGSGLDD

SEQ ID NO: 579865 - protein, 6 aa, Mycobacterium
SGSGLG

SEQ ID NO: 579866 - protein, 6 aa, Mycobacterium
SGSGNI

SEQ ID NO: 579867 - protein, 18 aa, Mycobacterium
SGSGNIGIGNSGSGNTGL

SEQ ID NO: 579868 - protein, 13 aa, Mycobacterium
SGSGNTGFGNAGN

SEQ ID NO: 579869 - protein, 6 aa, Mycobacterium
SGSGNV

SEQ ID NO: 579870 - protein, 10 aa, Mycobacterium
SGSGPASTLA

SEQ ID NO: 579871 - protein, 10 aa, Mycobacterium
SGSGPGKSWQ

SEQ ID NO: 579872 - protein, 8 aa, Mycobacterium
SGSGPLRP

SEQ ID NO: 579873 - protein, 7 aa, Mycobacterium
SGSGPQL

SEQ ID NO: 579874 - protein, 15 aa, Mycobacterium
SGSGPRNPGNGPVRT

SEQ ID NO: 579875 - protein, 5 aa, Mycobacterium
SGSGR

SEQ ID NO: 579876 - protein, 8 aa, Mycobacterium
SGSGRCVP

SEQ ID NO: 579877 - protein, 17 aa, Mycobacterium
SGSGRNVSPGTASYSAS

SEQ ID NO: 579878 - protein, 17 aa, Mycobacterium
SGSGSRTGPRGSGTIEE

SEQ ID NO: 579879 - protein, 19 aa, Mycobacterium
SGSGSTGDYNSGDGNFGSF

SEQ ID NO: 579880 - protein, 7 aa, Mycobacterium
SGSHAAY

SEQ ID NO: 579881 - protein, 11 aa, Mycobacterium
SGSHGDDAGNT

SEQ ID NO: 579882 - protein, 8 aa, Mycobacterium
SGSIQRAQ

SEQ ID NO: 579883 - protein, 7 aa, Mycobacterium
SGSISGP

SEQ ID NO: 579884 - protein, 17 aa, Mycobacterium
SGSITEAARQLMQHDDL

SEQ ID NO: 579885 - protein, 8 aa, Mycobacterium
SGSKAQRT

SEQ ID NO: 579886 - protein, 10 aa, Mycobacterium
SGSKPQRAAS

SEQ ID NO: 579887 - protein, 11 aa, Mycobacterium
SGSLADGKTAL

SEQ ID NO: 579888 - protein, 7 aa, Mycobacterium
SGSLAGD

SEQ ID NO: 579889 - protein, 7 aa, Mycobacterium
SGSLAGE

SEQ ID NO: 579890 - protein, 17 aa, Mycobacterium
SGSLDHAARDRDVRRRA

SEQ ID NO: 579891 - protein, 6 aa, Mycobacterium
SGSLDT

SEQ ID NO: 579892 - protein, 6 aa, Mycobacterium
SGSLGQ

SEQ ID NO: 579893 - protein, 5 aa, Mycobacterium
SGSMG

SEQ ID NO: 579894 - protein, 7 aa, Mycobacterium
SGSMSGL

SEQ ID NO: 579895 - protein, 11 aa, Mycobacterium
SGSNGREESPA

SEQ ID NO: 579896 - protein, 10 aa, Mycobacterium
SGSNIGGIAE

SEQ ID NO: 579897 - protein, 10 aa, Mycobacterium
SGSNITPYPR

SEQ ID NO: 579898 - protein, 4 aa, Mycobacterium
SGSP

SEQ ID NO: 579899 - protein, 12 aa, Mycobacterium
SGSPAADAFSAA

SEQ ID NO: 579900 - protein, 10 aa, Mycobacterium
SGSPDAVEEA

SEQ ID NO: 579901 - protein, 7 aa, Mycobacterium
SGSPEAA

SEQ ID NO: 579902 - protein, 10 aa, Mycobacterium
SGSPEDETAW

SEQ ID NO: 579903 - protein, 16 aa, Mycobacterium
SGSPGVTPSDAVPHGT

SEQ ID NO: 579904 - protein, 6 aa, Mycobacterium
SGSPHE

SEQ ID NO: 579905 - protein, 8 aa, Mycobacterium
SGSPHPHD

SEQ ID NO: 579906 - protein, 10 aa, Mycobacterium
SGSPITVGRA

SEQ ID NO: 579907 - protein, 5 aa, Mycobacterium
SGSPL

SEQ ID NO: 579908 - protein, 8 aa, Mycobacterium
SGSPLGNI

SEQ ID NO: 579909 - protein, 6 aa, Mycobacterium
SGSPMY

SEQ ID NO: 579910 - protein, 16 aa, Mycobacterium
SGSPPAALGPRGINGQ

SEQ ID NO: 579911 - protein, 8 aa, Mycobacterium
SGSPREIA

SEQ ID NO: 579912 - protein, 7 aa, Mycobacterium
SGSPRLR

SEQ ID NO: 579913 - protein, 10 aa, Mycobacterium
SGSPRNAPAK

SEQ ID NO: 579914 - protein, 5 aa, Mycobacterium
SGSPV

SEQ ID NO: 579915 - protein, 7 aa, Mycobacterium
SGSQALY

SEQ ID NO: 579916 - protein, 9 aa, Mycobacterium
SGSQDHGLE

SEQ ID NO: 579917 - protein, 5 aa, Mycobacterium
SGSQF

SEQ ID NO: 579918 - protein, 7 aa, Mycobacterium
SGSQGMS

SEQ ID NO: 579919 - protein, 8 aa, Mycobacterium
SGSQPLYD

SEQ ID NO: 579920 - protein, 12 aa, Mycobacterium
SGSQQDAEDLTQ

SEQ ID NO: 579921 - protein, 13 aa, Mycobacterium
SGSQRKDPAAQQL

SEQ ID NO: 579922 - protein, 23 aa, Mycobacterium
SGSQTADRTPTATARIGPDGSAT

SEQ ID NO: 579923 - protein, 18 aa, Mycobacterium
SGSQYNAGRKVPSSQMQR

SEQ ID NO: 579924 - protein, 17 aa, Mycobacterium
SGSQYNAGRKVPSSQMR

SEQ ID NO: 579925 - protein, 17 aa, Mycobacterium
SGSRADEIGHWLPLIDL

SEQ ID NO: 579926 - protein, 17 aa, Mycobacterium
SGSRAGEIDHCLPLFDV

SEQ ID NO: 579927 - protein, 9 aa, Mycobacterium
SGSRAGRSL

SEQ ID NO: 579928 - protein, 17 aa, Mycobacterium
SGSRAREIAAALPLVPL

SEQ ID NO: 579929 - protein, 8 aa, Mycobacterium
SGSRDPTA

SEQ ID NO: 579930 - protein, 10 aa, Mycobacterium
SGSRGAGPAH

SEQ ID NO: 579931 - protein, 10 aa, Mycobacterium
SGSRGGAPAL

SEQ ID NO: 579932 - protein, 6 aa, Mycobacterium
SGSRMR

SEQ ID NO: 579933 - protein, 5 aa, Mycobacterium
SGSRP

SEQ ID NO: 579934 - protein, 5 aa, Mycobacterium
SGSRR

SEQ ID NO: 579935 - protein, 23 aa, Mycobacterium
SGSRRGGAVSGIGGHNAAMAVLE

SEQ ID NO: 579936 - protein, 24 aa, Mycobacterium
SGSRRGGAVSGVGGHNAAMAVLER

SEQ ID NO: 579937 - protein, 13 aa, Mycobacterium
SGSRRGGGVSGLG

SEQ ID NO: 579938 - protein, 8 aa, Mycobacterium
SGSRRRGV

SEQ ID NO: 579939 - protein, 5 aa, Mycobacterium
SGSRS

SEQ ID NO: 579940 - protein, 5 aa, Mycobacterium
SGSRT

SEQ ID NO: 579941 - protein, 19 aa, Mycobacterium
SGSRTASVGQLTPEEAGNR

SEQ ID NO: 579942 - protein, 10 aa, Mycobacterium
SGSRYSQRPV

SEQ ID NO: 579943 - protein, 8 aa, Mycobacterium
SGSSAADL

SEQ ID NO: 579944 - protein, 6 aa, Mycobacterium
SGSSAN

SEQ ID NO: 579945 - protein, 10 aa, Mycobacterium
SGSSASATGG

SEQ ID NO: 579946 - protein, 6 aa, Mycobacterium
SGSSDR

SEQ ID NO: 579947 - protein, 6 aa, Mycobacterium
SGSSDV

SEQ ID NO: 579948 - protein, 10 aa, Mycobacterium
SGSSGAPKGV

SEQ ID NO: 579949 - protein, 11 aa, Mycobacterium
SGSSGETIANP

SEQ ID NO: 579950 - protein, 10 aa, Mycobacterium
SGSSGISGYQ

SEQ ID NO: 579951 - protein, 5 aa, Mycobacterium
SGSSH

SEQ ID NO: 579952 - protein, 5 aa, Mycobacterium
SGSSM

SEQ ID NO: 579953 - protein, 10 aa, Mycobacterium
SGSSNLEAQR

SEQ ID NO: 579954 - protein, 8 aa, Mycobacterium
SGSSNPTL

SEQ ID NO: 579955 - protein, 6 aa, Mycobacterium
SGSSPA

SEQ ID NO: 579956 - protein, 6 aa, Mycobacterium
SGSSSL

SEQ ID NO: 579957 - protein, 6 aa, Mycobacterium
SGSSSV

SEQ ID NO: 579958 - protein, 14 aa, Mycobacterium
SGSSTTSRVQDPEE

SEQ ID NO: 579959 - protein, 5 aa, Mycobacterium
SGSSV

SEQ ID NO: 579960 - protein, 5 aa, Mycobacterium
SGSTA

SEQ ID NO: 579961 - protein, 19 aa, Mycobacterium
SGSTAASGGAPSAQATLQG

SEQ ID NO: 579962 - protein, 9 aa, Mycobacterium
SGSTAQANA

SEQ ID NO: 579963 - protein, 7 aa, Mycobacterium
SGSTDCP

SEQ ID NO: 579964 - protein, 9 aa, Mycobacterium
SGSTDDTAI

SEQ ID NO: 579965 - protein, 9 aa, Mycobacterium
SGSTDETEI

SEQ ID NO: 579966 - protein, 5 aa, Mycobacterium
SGSTG

SEQ ID NO: 579967 - protein, 11 aa, Mycobacterium
SGSTGAPKGAM

SEQ ID NO: 579968 - protein, 12 aa, Mycobacterium
SGSTGAPKGAMH

SEQ ID NO: 579969 - protein, 12 aa, Mycobacterium
SGSTGAPKGAMY

SEQ ID NO: 579970 - protein, 13 aa, Mycobacterium
SGSTGAPKGAMYP

SEQ ID NO: 579971 - protein, 9 aa, Mycobacterium
SGSTGDPKA

SEQ ID NO: 579972 - protein, 13 aa, Mycobacterium
SGSTGDPKGPVHT

SEQ ID NO: 579973 - protein, 9 aa, Mycobacterium
SGSTGEPKG

SEQ ID NO: 579974 - protein, 10 aa, Mycobacterium
SGSTGEPKGV

SEQ ID NO: 579975 - protein, 13 aa, Mycobacterium
SGSTGEPKGVIGT

SEQ ID NO: 579976 - protein, 9 aa, Mycobacterium
SGSTGESKP

SEQ ID NO: 579977 - protein, 9 aa, Mycobacterium
SGSTGGGVA

SEQ ID NO: 579978 - protein, 9 aa, Mycobacterium
SGSTGHPKA

SEQ ID NO: 579979 - protein, 14 aa, Mycobacterium
SGSTGKPKGAVGTH

SEQ ID NO: 579980 - protein, 10 aa, Mycobacterium
SGSTGLPKGV

SEQ ID NO: 579981 - protein, 13 aa, Mycobacterium
SGSTGLPKGVPVP

SEQ ID NO: 579982 - protein, 13 aa, Mycobacterium
SGSTGQPKGVPVP

SEQ ID NO: 579983 - protein, 11 aa, Mycobacterium
SGSTGQPKGVQ

SEQ ID NO: 579984 - protein, 8 aa, Mycobacterium
SGSTGRPK

SEQ ID NO: 579985 - protein, 9 aa, Mycobacterium
SGSTGRPKA

SEQ ID NO: 579986 - protein, 13 aa, Mycobacterium
SGSTGRPKAVTSS

SEQ ID NO: 579987 - protein, 11 aa, Mycobacterium
SGSTGRPKGVE

SEQ ID NO: 579988 - protein, 10 aa, Mycobacterium
SGSTGTPKAV

SEQ ID NO: 579989 - protein, 10 aa, Mycobacterium
SGSTGTPKGA

SEQ ID NO: 579990 - protein, 13 aa, Mycobacterium
SGSTGTPKGALNT

SEQ ID NO: 579991 - protein, 11 aa, Mycobacterium
SGSTGTPKGAM

SEQ ID NO: 579992 - protein, 18 aa, Mycobacterium
SGSTGTPKGAMYPESKTA

SEQ ID NO: 579993 - protein, 14 aa, Mycobacterium
SGSTGTPKGATYSE

SEQ ID NO: 579994 - protein, 11 aa, Mycobacterium
SGSTGTPKGVD

SEQ ID NO: 579995 - protein, 15 aa, Mycobacterium
SGSTGTPKGVDVPDS

SEQ ID NO: 579996 - protein, 8 aa, Mycobacterium
SGSTHIDS

SEQ ID NO: 579997 - protein, 5 aa, Mycobacterium
SGSTL

SEQ ID NO: 579998 - protein, 9 aa, Mycobacterium
SGSTNDPKG

SEQ ID NO: 579999 - protein, 16 aa, Mycobacterium
SGSTNTGAGNSGEVNT

SEQ ID NO: 580000 - protein, 8 aa, Mycobacterium
SGSTNTGL

SEQ ID NO: 580001 - protein, 5 aa, Mycobacterium
SGSTP

SEQ ID NO: 580002 - protein, 8 aa, Mycobacterium
SGSTPYAP

SEQ ID NO: 580003 - protein, 8 aa, Mycobacterium
SGSTQDLD

SEQ ID NO: 580004 - protein, 9 aa, Mycobacterium
SGSTRIPTG

SEQ ID NO: 580005 - protein, 9 aa, Mycobacterium
SGSTRTPAG

SEQ ID NO: 580006 - protein, 9 aa, Mycobacterium
SGSTSAPRG

SEQ ID NO: 580007 - protein, 10 aa, Mycobacterium
SGSTSDPKGV

SEQ ID NO: 580008 - protein, 7 aa, Mycobacterium
SGSTTEI

SEQ ID NO: 580009 - protein, 7 aa, Mycobacterium
SGSTTPL

SEQ ID NO: 580010 - protein, 8 aa, Mycobacterium
SGSTVADE

SEQ ID NO: 580011 - protein, 5 aa, Mycobacterium
SGSVD

SEQ ID NO: 580012 - protein, 17 aa, Mycobacterium
SGSVGAGVDSFSALVNG

SEQ ID NO: 580013 - protein, 8 aa, Mycobacterium
SGSVRTDR

SEQ ID NO: 580014 - protein, 9 aa, Mycobacterium
SGSVTEGRR

SEQ ID NO: 580015 - protein, 6 aa, Mycobacterium
SGSVTP

SEQ ID NO: 580016 - protein, 9 aa, Mycobacterium
SGSVTPPQG

SEQ ID NO: 580017 - protein, 48 aa, Mycobacterium
SGSVTTSKTEARVSAKPAPARSDAPDGVGDENSTSDESADVSSSPLTR

SEQ ID NO: 580018 - protein, 17 aa, Mycobacterium
SGSWKKPAADPGNGGRG

SEQ ID NO: 580019 - protein, 4 aa, Mycobacterium
SGSY

SEQ ID NO: 580020 - protein, 7 aa, Mycobacterium
SGSYAGL

SEQ ID NO: 580021 - protein, 6 aa, Mycobacterium
SGSYAP

SEQ ID NO: 580022 - protein, 8 aa, Mycobacterium
SGSYNSGL

SEQ ID NO: 580023 - protein, 7 aa, Mycobacterium
SGSYPAD

SEQ ID NO: 580024 - protein, 16 aa, Mycobacterium
SGSYPPATPCTITAPQ

SEQ ID NO: 580025 - protein, 5 aa, Mycobacterium
SGTAA

SEQ ID NO: 580026 - protein, 6 aa, Mycobacterium
SGTAAQ

SEQ ID NO: 580027 - protein, 7 aa, Mycobacterium
SGTAASE

SEQ ID NO: 580028 - protein, 6 aa, Mycobacterium
SGTAAY

SEQ ID NO: 580029 - protein, 7 aa, Mycobacterium
SGTADDR

SEQ ID NO: 580030 - protein, 8 aa, Mycobacterium
SGTADELA

SEQ ID NO: 580031 - protein, 5 aa, Mycobacterium
SGTAE

SEQ ID NO: 580032 - protein, 8 aa, Mycobacterium
SGTAEAGA

SEQ ID NO: 580033 - protein, 10 aa, Mycobacterium
SGTAEPDAAL

SEQ ID NO: 580034 - protein, 11 aa, Mycobacterium
SGTAEPDAELT

SEQ ID NO: 580035 - protein, 12 aa, Mycobacterium
SGTAEPDKELTQ

SEQ ID NO: 580036 - protein, 12 aa, Mycobacterium
SGTAEPDRELTQ

SEQ ID NO: 580037 - protein, 18 aa, Mycobacterium
SGTAGDAELAPQAETAQP

SEQ ID NO: 580038 - protein, 6 aa, Mycobacterium
SGTAGF

SEQ ID NO: 580039 - protein, 17 aa, Mycobacterium
SGTAGPDDPPEPPATLD

SEQ ID NO: 580040 - protein, 17 aa, Mycobacterium
SGTAGVPGSVACDDRHR

SEQ ID NO: 580041 - protein, 10 aa, Mycobacterium
SGTAKMGRDP

SEQ ID NO: 580042 - protein, 5 aa, Mycobacterium
SGTAL

SEQ ID NO: 580043 - protein, 8 aa, Mycobacterium
SGTALGNP

SEQ ID NO: 580044 - protein, 13 aa, Mycobacterium
SGTALSAADAERL

SEQ ID NO: 580045 - protein, 5 aa, Mycobacterium
SGTAP

SEQ ID NO: 580046 - protein, 9 aa, Mycobacterium
SGTAPKAPM

SEQ ID NO: 580047 - protein, 14 aa, Mycobacterium
SGTAPLSADDAEAF

SEQ ID NO: 580048 - protein, 8 aa, Mycobacterium
SGTAPNGQ

SEQ ID NO: 580049 - protein, 7 aa, Mycobacterium
SGTAPSE

SEQ ID NO: 580050 - protein, 13 aa, Mycobacterium
SGTARERDPQAPV

SEQ ID NO: 580051 - protein, 6 aa, Mycobacterium
SGTARR

SEQ ID NO: 580052 - protein, 14 aa, Mycobacterium
SGTARTDTALATGS

SEQ ID NO: 580053 - protein, 7 aa, Mycobacterium
SGTATDW

SEQ ID NO: 580054 - protein, 7 aa, Mycobacterium
SGTATPA

SEQ ID NO: 580055 - protein, 7 aa, Mycobacterium
SGTATSV

SEQ ID NO: 580056 - protein, 6 aa, Mycobacterium
SGTATV

SEQ ID NO: 580057 - protein, 5 aa, Mycobacterium
SGTAV

SEQ ID NO: 580058 - protein, 14 aa, Mycobacterium
SGTAVGGSGGNGGG

SEQ ID NO: 580059 - protein, 5 aa, Mycobacterium
SGTCG

SEQ ID NO: 580060 - protein, 14 aa, Mycobacterium
SGTCGAAERTAADL

SEQ ID NO: 580061 - protein, 15 aa, Mycobacterium
SGTCRAAERTAADLD

SEQ ID NO: 580062 - protein, 7 aa, Mycobacterium
SGTCTRP

SEQ ID NO: 580063 - protein, 7 aa, Mycobacterium
SGTDAGE

SEQ ID NO: 580064 - protein, 6 aa, Mycobacterium
SGTDFR

SEQ ID NO: 580065 - protein, 14 aa, Mycobacterium
SGTDLGRYDPQTPL

SEQ ID NO: 580066 - protein, 36 aa, Mycobacterium
SGTDNVGIGNSGTGNSGIGNSGSYNTGIGNSGLANT

SEQ ID NO: 580067 - protein, 6 aa, Mycobacterium
SGTDPA

SEQ ID NO: 580068 - protein, 8 aa, Mycobacterium
SGTDPDGL

SEQ ID NO: 580069 - protein, 6 aa, Mycobacterium
SGTDTA

SEQ ID NO: 580070 - protein, 6 aa, Mycobacterium
SGTDYR

SEQ ID NO: 580071 - protein, 9 aa, Mycobacterium
SGTEAEGSK

SEQ ID NO: 580072 - protein, 12 aa, Mycobacterium
SGTEAGQIATRA

SEQ ID NO: 580073 - protein, 8 aa, Mycobacterium
SGTEANEA

SEQ ID NO: 580074 - protein, 17 aa, Mycobacterium
SGTEDDYQAAVRAFAEE

SEQ ID NO: 580075 - protein, 6 aa, Mycobacterium
SGTEPA

SEQ ID NO: 580076 - protein, 12 aa, Mycobacterium
SGTERIGTPDDI

SEQ ID NO: 580077 - protein, 13 aa, Mycobacterium
SGTESHPKGAMHS

SEQ ID NO: 580078 - protein, 13 aa, Mycobacterium
SGTESRPKAAIHT

SEQ ID NO: 580079 - protein, 13 aa, Mycobacterium
SGTESRPKGAMHT

SEQ ID NO: 580080 - protein, 10 aa, Mycobacterium
SGTESRPKGV

SEQ ID NO: 580081 - protein, 5 aa, Mycobacterium
SGTET

SEQ ID NO: 580082 - protein, 10 aa, Mycobacterium
SGTETADRRA

SEQ ID NO: 580083 - protein, 10 aa, Mycobacterium
SGTFDGRDPD

SEQ ID NO: 580084 - protein, 6 aa, Mycobacterium
SGTFEH

SEQ ID NO: 580085 - protein, 6 aa, Mycobacterium
SGTFGS

SEQ ID NO: 580086 - protein, 5 aa, Mycobacterium
SGTGA

SEQ ID NO: 580087 - protein, 16 aa, Mycobacterium
SGTGAQIRDTRKTLPG

SEQ ID NO: 580088 - protein, 13 aa, Mycobacterium
SGTGARSVENHSS

SEQ ID NO: 580089 - protein, 6 aa, Mycobacterium
SGTGDP

SEQ ID NO: 580090 - protein, 10 aa, Mycobacterium
SGTGDTSGYG

SEQ ID NO: 580091 - protein, 5 aa, Mycobacterium
SGTGE

SEQ ID NO: 580092 - protein, 8 aa, Mycobacterium
SGTGENFN

SEQ ID NO: 580093 - protein, 8 aa, Mycobacterium
SGTGEQAD

SEQ ID NO: 580094 - protein, 7 aa, Mycobacterium
SGTGFAS

SEQ ID NO: 580095 - protein, 10 aa, Mycobacterium
SGTGFEDRGS

SEQ ID NO: 580096 - protein, 10 aa, Mycobacterium
SGTGFPAPRA

SEQ ID NO: 580097 - protein, 38 aa, Mycobacterium
SGTGGAGGSGGAGGDGGVLGSGDGGAGGAGGSGGAGGL

SEQ ID NO: 580098 - protein, 32 aa, Mycobacterium
SGTGGAGGSGGPNMAGGGGNGGAGGGGGAGGL

SEQ ID NO: 580099 - protein, 9 aa, Mycobacterium
SGTGGGMAT

SEQ ID NO: 580100 - protein, 62 aa, Mycobacterium
SGTGGVGGQGGVGGFGEGGAGGSGGGAGLIGNGGSGGTGGNAVGNSGVGGHGGAGGQGGRLY

SEQ ID NO: 580101 - protein, 8 aa, Mycobacterium
SGTGIPAA

SEQ ID NO: 580102 - protein, 6 aa, Mycobacterium
SGTGMS

SEQ ID NO: 580103 - protein, 8 aa, Mycobacterium
SGTGNFGI

SEQ ID NO: 580104 - protein, 7 aa, Mycobacterium
SGTGNVG

SEQ ID NO: 580105 - protein, 14 aa, Mycobacterium
SGTGPLRPGAAAGI

SEQ ID NO: 580106 - protein, 9 aa, Mycobacterium
SGTGPTSGF

SEQ ID NO: 580107 - protein, 10 aa, Mycobacterium
SGTGQEDLSS

SEQ ID NO: 580108 - protein, 11 aa, Mycobacterium
SGTGQGETDPG

SEQ ID NO: 580109 - protein, 5 aa, Mycobacterium
SGTGR

SEQ ID NO: 580110 - protein, 16 aa, Mycobacterium
SGTGSMTYGERQGVGH

SEQ ID NO: 580111 - protein, 18 aa, Mycobacterium
SGTGTASGFGNVGANNSG

SEQ ID NO: 580112 - protein, 6 aa, Mycobacterium
SGTGTE

SEQ ID NO: 580113 - protein, 10 aa, Mycobacterium
SGTGTNGALA

SEQ ID NO: 580114 - protein, 15 aa, Mycobacterium
SGTGVPTSGLILAPD

SEQ ID NO: 580115 - protein, 15 aa, Mycobacterium
SGTGVPTSGLILAQA

SEQ ID NO: 580116 - protein, 5 aa, Mycobacterium
SGTGW

SEQ ID NO: 580117 - protein, 11 aa, Mycobacterium
SGTHGDDAANT

SEQ ID NO: 580118 - protein, 11 aa, Mycobacterium
SGTHGNDAANT

SEQ ID NO: 580119 - protein, 18 aa, Mycobacterium
SGTHRGDAARRRASQDER

SEQ ID NO: 580120 - protein, 5 aa, Mycobacterium
SGTID

SEQ ID NO: 580121 - protein, 16 aa, Mycobacterium
SGTIPHTDGRVEGSAN

SEQ ID NO: 580122 - protein, 7 aa, Mycobacterium
SGTITPA

SEQ ID NO: 580123 - protein, 10 aa, Mycobacterium
SGTITSRAKL

SEQ ID NO: 580124 - protein, 5 aa, Mycobacterium
SGTKA

SEQ ID NO: 580125 - protein, 6 aa, Mycobacterium
SGTKGL

SEQ ID NO: 580126 - protein, 9 aa, Mycobacterium
SGTKRHPKG

SEQ ID NO: 580127 - protein, 16 aa, Mycobacterium
SGTKSGGAIKPVEPEE

SEQ ID NO: 580128 - protein, 8 aa, Mycobacterium
SGTKTLPE

SEQ ID NO: 580129 - protein, 17 aa, Mycobacterium
SGTKVGSKGRPLPGGGK

SEQ ID NO: 580130 - protein, 7 aa, Mycobacterium
SGTLADR

SEQ ID NO: 580131 - protein, 14 aa, Mycobacterium
SGTLAEPVRDATAR

SEQ ID NO: 580132 - protein, 14 aa, Mycobacterium
SGTLAEPVRTATAA

SEQ ID NO: 580133 - protein, 5 aa, Mycobacterium
SGTLD

SEQ ID NO: 580134 - protein, 36 aa, Mycobacterium
SGTLQGNRSSRREEWRDPEPPADDDPDVPTAGPGTP

SEQ ID NO: 580135 - protein, 27 aa, Mycobacterium
SGTLQPAAQSVANAGSSGTSSAELTTP

SEQ ID NO: 580136 - protein, 9 aa, Mycobacterium
SGTLTDDDV

SEQ ID NO: 580137 - protein, 4 aa, Mycobacterium
SGTM

SEQ ID NO: 580138 - protein, 7 aa, Mycobacterium
SGTMYNR

SEQ ID NO: 580139 - protein, 14 aa, Mycobacterium
SGTNAVTEVPADRW

SEQ ID NO: 580140 - protein, 19 aa, Mycobacterium
SGTNGGFSTAPKRRLPRPL

SEQ ID NO: 580141 - protein, 9 aa, Mycobacterium
SGTNPYSAN

SEQ ID NO: 580142 - protein, 7 aa, Mycobacterium
SGTNTEW

SEQ ID NO: 580143 - protein, 5 aa, Mycobacterium
SGTNV

SEQ ID NO: 580144 - protein, 6 aa, Mycobacterium
SGTPAA

SEQ ID NO: 580145 - protein, 33 aa, Mycobacterium
SGTPATPAAPATPSTPAAPEPKPAPVRAASDTS

SEQ ID NO: 580146 - protein, 7 aa, Mycobacterium
SGTPDEV

SEQ ID NO: 580147 - protein, 10 aa, Mycobacterium
SGTPDGGDGH

SEQ ID NO: 580148 - protein, 8 aa, Mycobacterium
SGTPEAGA

SEQ ID NO: 580149 - protein, 13 aa, Mycobacterium
SGTPFSRPVQGTD

SEQ ID NO: 580150 - protein, 5 aa, Mycobacterium
SGTPG

SEQ ID NO: 580151 - protein, 6 aa, Mycobacterium
SGTPGF

SEQ ID NO: 580152 - protein, 5 aa, Mycobacterium
SGTPI

SEQ ID NO: 580153 - protein, 9 aa, Mycobacterium
SGTPIPPPD

SEQ ID NO: 580154 - protein, 6 aa, Mycobacterium
SGTPIT

SEQ ID NO: 580155 - protein, 5 aa, Mycobacterium
SGTPL

SEQ ID NO: 580156 - protein, 12 aa, Mycobacterium
SGTPNTTRRPAP

SEQ ID NO: 580157 - protein, 5 aa, Mycobacterium
SGTPP

SEQ ID NO: 580158 - protein, 8 aa, Mycobacterium
SGTPPDDA

SEQ ID NO: 580159 - protein, 7 aa, Mycobacterium
SGTPPSE

SEQ ID NO: 580160 - protein, 6 aa, Mycobacterium
SGTPSQ

SEQ ID NO: 580161 - protein, 21 aa, Mycobacterium
SGTPSQQQIDHDERGASERRH

SEQ ID NO: 580162 - protein, 5 aa, Mycobacterium
SGTPV

SEQ ID NO: 580163 - protein, 10 aa, Mycobacterium
SGTPYQAGGI

SEQ ID NO: 580164 - protein, 7 aa, Mycobacterium
SGTQARQ

SEQ ID NO: 580165 - protein, 6 aa, Mycobacterium
SGTQFD

SEQ ID NO: 580166 - protein, 6 aa, Mycobacterium
SGTQPA

SEQ ID NO: 580167 - protein, 8 aa, Mycobacterium
SGTQTRTL

SEQ ID NO: 580168 - protein, 4 aa, Mycobacterium
SGTR

SEQ ID NO: 580169 - protein, 8 aa, Mycobacterium
SGTREDIP

SEQ ID NO: 580170 - protein, 20 aa, Mycobacterium
SGTREPADGEYSDPFDKGDF

SEQ ID NO: 580171 - protein, 5 aa, Mycobacterium
SGTRG

SEQ ID NO: 580172 - protein, 6 aa, Mycobacterium
SGTRGD

SEQ ID NO: 580173 - protein, 7 aa, Mycobacterium
SGTRGRQ

SEQ ID NO: 580174 - protein, 5 aa, Mycobacterium
SGTRP

SEQ ID NO: 580175 - protein, 15 aa, Mycobacterium
SGTRPTHILNPEVLA

SEQ ID NO: 580176 - protein, 10 aa, Mycobacterium
SGTRTPTGAA

SEQ ID NO: 580177 - protein, 4 aa, Mycobacterium
SGTS

SEQ ID NO: 580178 - protein, 8 aa, Mycobacterium
SGTSASPK

SEQ ID NO: 580179 - protein, 16 aa, Mycobacterium
SGTSESAVAAATVSEG

SEQ ID NO: 580180 - protein, 10 aa, Mycobacterium
SGTSFADRGN

SEQ ID NO: 580181 - protein, 12 aa, Mycobacterium
SGTSGAGKSAKV

SEQ ID NO: 580182 - protein, 10 aa, Mycobacterium
SGTSGAGRAA

SEQ ID NO: 580183 - protein, 10 aa, Mycobacterium
SGTSGDPKAV

SEQ ID NO: 580184 - protein, 11 aa, Mycobacterium
SGTSGDPKAVK

SEQ ID NO: 580185 - protein, 8 aa, Mycobacterium
SGTSGQVG

SEQ ID NO: 580186 - protein, 9 aa, Mycobacterium
SGTSGTPKA

SEQ ID NO: 580187 - protein, 7 aa, Mycobacterium
SGTSNAG

SEQ ID NO: 580188 - protein, 8 aa, Mycobacterium
SGTSPDGH

SEQ ID NO: 580189 - protein, 6 aa, Mycobacterium
SGTSRM

SEQ ID NO: 580190 - protein, 8 aa, Mycobacterium
SGTSRPHH

SEQ ID NO: 580191 - protein, 5 aa, Mycobacterium
SGTSS

SEQ ID NO: 580192 - protein, 6 aa, Mycobacterium
SGTSSA

SEQ ID NO: 580193 - protein, 11 aa, Mycobacterium
SGTSSARQRRA

SEQ ID NO: 580194 - protein, 5 aa, Mycobacterium
SGTSV

SEQ ID NO: 580195 - protein, 7 aa, Mycobacterium
SGTSVGA

SEQ ID NO: 580196 - protein, 12 aa, Mycobacterium
SGTTAAPKGARH

SEQ ID NO: 580197 - protein, 13 aa, Mycobacterium
SGTTAAPKGIRHT

SEQ ID NO: 580198 - protein, 8 aa, Mycobacterium
SGTTALPK

SEQ ID NO: 580199 - protein, 9 aa, Mycobacterium
SGTTARPKG

SEQ ID NO: 580200 - protein, 9 aa, Mycobacterium
SGTTDVDAA

SEQ ID NO: 580201 - protein, 13 aa, Mycobacterium
SGTTGAGRAPKAE

SEQ ID NO: 580202 - protein, 11 aa, Mycobacterium
SGTTGAPKGVR

SEQ ID NO: 580203 - protein, 10 aa, Mycobacterium
SGTTGAPKRI

SEQ ID NO: 580204 - protein, 7 aa, Mycobacterium
SGTTGAS

SEQ ID NO: 580205 - protein, 11 aa, Mycobacterium
SGTTGEPKGAM

SEQ ID NO: 580206 - protein, 8 aa, Mycobacterium
SGTTGFPK

SEQ ID NO: 580207 - protein, 8 aa, Mycobacterium
SGTTGHPK

SEQ ID NO: 580208 - protein, 10 aa, Mycobacterium
SGTTGKPKGA

SEQ ID NO: 580209 - protein, 12 aa, Mycobacterium
SGTTGKPKGAEL

SEQ ID NO: 580210 - protein, 15 aa, Mycobacterium
SGTTGKPKGAISTNS

SEQ ID NO: 580211 - protein, 10 aa, Mycobacterium
SGTTGKPKGV

SEQ ID NO: 580212 - protein, 11 aa, Mycobacterium
SGTTGKPKGVI

SEQ ID NO: 580213 - protein, 16 aa, Mycobacterium
SGTTGKPKGVPRAPQL

SEQ ID NO: 580214 - protein, 11 aa, Mycobacterium
SGTTGKSKGAM

SEQ ID NO: 580215 - protein, 7 aa, Mycobacterium
SGTTGLP

SEQ ID NO: 580216 - protein, 18 aa, Mycobacterium
SGTTGLPKGAPRDSVSPL

SEQ ID NO: 580217 - protein, 7 aa, Mycobacterium
SGTTGMP

SEQ ID NO: 580218 - protein, 8 aa, Mycobacterium
SGTTGMPK

SEQ ID NO: 580219 - protein, 11 aa, Mycobacterium
SGTTGPPKGVE

SEQ ID NO: 580220 - protein, 11 aa, Mycobacterium
SGTTGPPKGVQ

SEQ ID NO: 580221 - protein, 11 aa, Mycobacterium
SGTTGPPKPVP

SEQ ID NO: 580222 - protein, 11 aa, Mycobacterium
SGTTGPPKRQA

SEQ ID NO: 580223 - protein, 11 aa, Mycobacterium
SGTTGQPKGCQ

SEQ ID NO: 580224 - protein, 8 aa, Mycobacterium
SGTTGRPK

SEQ ID NO: 580225 - protein, 9 aa, Mycobacterium
SGTTGRPKA

SEQ ID NO: 580226 - protein, 22 aa, Mycobacterium
SGTTGRPKAVRRPLPEDGNGSW

SEQ ID NO: 580227 - protein, 10 aa, Mycobacterium
SGTTGRPKGI

SEQ ID NO: 580228 - protein, 11 aa, Mycobacterium
SGTTGRPKGVE

SEQ ID NO: 580229 - protein, 8 aa, Mycobacterium
SGTTGSEA

SEQ ID NO: 580230 - protein, 9 aa, Mycobacterium
SGTTGSPKG

SEQ ID NO: 580231 - protein, 10 aa, Mycobacterium
SGTTGSPKGV

SEQ ID NO: 580232 - protein, 19 aa, Mycobacterium
SGTTGTPKGAKHSGGDPGV

SEQ ID NO: 580233 - protein, 18 aa, Mycobacterium
SGTTGTPKGAKHSGGGPE

SEQ ID NO: 580234 - protein, 20 aa, Mycobacterium
SGTTGTPKGAKQSGGNAGIG

SEQ ID NO: 580235 - protein, 13 aa, Mycobacterium
SGTTGTPKGAPRK

SEQ ID NO: 580236 - protein, 20 aa, Mycobacterium
SGTTGTPKGATHSGGSGGVR

SEQ ID NO: 580237 - protein, 17 aa, Mycobacterium
SGTTGTPKGVPRSPQLR

SEQ ID NO: 580238 - protein, 10 aa, Mycobacterium
SGTTGVPKGV

SEQ ID NO: 580239 - protein, 14 aa, Mycobacterium
SGTTKTRSQPPSAV

SEQ ID NO: 580240 - protein, 14 aa, Mycobacterium
SGTTLDDERQRRLR

SEQ ID NO: 580241 - protein, 17 aa, Mycobacterium
SGTTMRSRGGPNHRSRP

SEQ ID NO: 580242 - protein, 7 aa, Mycobacterium
SGTTPTC

SEQ ID NO: 580243 - protein, 15 aa, Mycobacterium
SGTTQVESGDLLLVI

SEQ ID NO: 580244 - protein, 9 aa, Mycobacterium
SGTTRDPKG

SEQ ID NO: 580245 - protein, 16 aa, Mycobacterium
SGTTRRDPAELGDHPE

SEQ ID NO: 580246 - protein, 16 aa, Mycobacterium
SGTTRVQAKSTVKARE

SEQ ID NO: 580247 - protein, 10 aa, Mycobacterium
SGTTSKPKAV

SEQ ID NO: 580248 - protein, 9 aa, Mycobacterium
SGTTSKPKL

SEQ ID NO: 580249 - protein, 10 aa, Mycobacterium
SGTTSKPKLV

SEQ ID NO: 580250 - protein, 24 aa, Mycobacterium
SGTTSVTASFSTNPTWTASGGSIT

SEQ ID NO: 580251 - protein, 17 aa, Mycobacterium
SGTTTSRIASRAGATRG

SEQ ID NO: 580252 - protein, 13 aa, Mycobacterium
SGTTYPGGGNPIG

SEQ ID NO: 580253 - protein, 8 aa, Mycobacterium
SGTVEGFT

SEQ ID NO: 580254 - protein, 6 aa, Mycobacterium
SGTVET

SEQ ID NO: 580255 - protein, 10 aa, Mycobacterium
SGTVHGHPAG

SEQ ID NO: 580256 - protein, 6 aa, Mycobacterium
SGTVNG

SEQ ID NO: 580257 - protein, 9 aa, Mycobacterium
SGTVNTVRP

SEQ ID NO: 580258 - protein, 7 aa, Mycobacterium
SGTVQTR

SEQ ID NO: 580259 - protein, 13 aa, Mycobacterium
SGTVSGPQKHQRG

SEQ ID NO: 580260 - protein, 6 aa, Mycobacterium
SGTVTA

SEQ ID NO: 580261 - protein, 26 aa, Mycobacterium
SGTWRSPNPVGADGLAAAGEQAAAAA

SEQ ID NO: 580262 - protein, 7 aa, Mycobacterium
SGTYRNK

SEQ ID NO: 580263 - protein, 4 aa, Mycobacterium
SGVA

SEQ ID NO: 580264 - protein, 13 aa, Mycobacterium
SGVAAGPMNRPPD

SEQ ID NO: 580265 - protein, 10 aa, Mycobacterium
SGVADDLTQE

SEQ ID NO: 580266 - protein, 7 aa, Mycobacterium
SGVADNE

SEQ ID NO: 580267 - protein, 5 aa, Mycobacterium
SGVAE

SEQ ID NO: 580268 - protein, 11 aa, Mycobacterium
SGVAKDSTTET

SEQ ID NO: 580269 - protein, 6 aa, Mycobacterium
SGVANP

SEQ ID NO: 580270 - protein, 24 aa, Mycobacterium
SGVANSATLSSGGFNTGTSLSGFF

SEQ ID NO: 580271 - protein, 9 aa, Mycobacterium
SGVAPESGL

SEQ ID NO: 580272 - protein, 8 aa, Mycobacterium
SGVAPGQL

SEQ ID NO: 580273 - protein, 9 aa, Mycobacterium
SGVARGKDA

SEQ ID NO: 580274 - protein, 13 aa, Mycobacterium
SGVASTGRHESKQ

SEQ ID NO: 580275 - protein, 9 aa, Mycobacterium
SGVAYGGRV

SEQ ID NO: 580276 - protein, 4 aa, Mycobacterium
SGVD

SEQ ID NO: 580277 - protein, 5 aa, Mycobacterium
SGVDA

SEQ ID NO: 580278 - protein, 6 aa, Mycobacterium
SGVDGT

SEQ ID NO: 580279 - protein, 20 aa, Mycobacterium
SGVDNAGQQVHKPFEVDVTC

SEQ ID NO: 580280 - protein, 7 aa, Mycobacterium
SGVDPAA

SEQ ID NO: 580281 - protein, 7 aa, Mycobacterium
SGVDPAD

SEQ ID NO: 580282 - protein, 9 aa, Mycobacterium
SGVDPDLQP

SEQ ID NO: 580283 - protein, 7 aa, Mycobacterium
SGVDPTA

SEQ ID NO: 580284 - protein, 16 aa, Mycobacterium
SGVDPYTGAADGAHVT

SEQ ID NO: 580285 - protein, 10 aa, Mycobacterium
SGVDSTGMSS

SEQ ID NO: 580286 - protein, 5 aa, Mycobacterium
SGVDT

SEQ ID NO: 580287 - protein, 17 aa, Mycobacterium
SGVDTDKFRPDPAGRAA

SEQ ID NO: 580288 - protein, 5 aa, Mycobacterium
SGVDV

SEQ ID NO: 580289 - protein, 12 aa, Mycobacterium
SGVDVQDSRRTQ

SEQ ID NO: 580290 - protein, 10 aa, Mycobacterium
SGVDYDSMTP

SEQ ID NO: 580291 - protein, 4 aa, Mycobacterium
SGVE

SEQ ID NO: 580292 - protein, 5 aa, Mycobacterium
SGVEA

SEQ ID NO: 580293 - protein, 6 aa, Mycobacterium
SGVEDR

SEQ ID NO: 580294 - protein, 6 aa, Mycobacterium
SGVEDS

SEQ ID NO: 580295 - protein, 8 aa, Mycobacterium
SGVEDSTQ

SEQ ID NO: 580296 - protein, 5 aa, Mycobacterium
SGVEE

SEQ ID NO: 580297 - protein, 11 aa, Mycobacterium
SGVEGPDPDEL

SEQ ID NO: 580298 - protein, 7 aa, Mycobacterium
SGVEPAF

SEQ ID NO: 580299 - protein, 12 aa, Mycobacterium
SGVEPQRRPHGA

SEQ ID NO: 580300 - protein, 5 aa, Mycobacterium
SGVES

SEQ ID NO: 580301 - protein, 9 aa, Mycobacterium
SGVESGSVI

SEQ ID NO: 580302 - protein, 6 aa, Mycobacterium
SGVETD

SEQ ID NO: 580303 - protein, 4 aa, Mycobacterium
SGVG

SEQ ID NO: 580304 - protein, 14 aa, Mycobacterium
SGVGAKDRMPSPYL

SEQ ID NO: 580305 - protein, 14 aa, Mycobacterium
SGVGAKDRMPTPYL

SEQ ID NO: 580306 - protein, 9 aa, Mycobacterium
SGVGATATA

SEQ ID NO: 580307 - protein, 18 aa, Mycobacterium
SGVGDSPAAAGDLEDPVD

SEQ ID NO: 580308 - protein, 10 aa, Mycobacterium
SGVGEAGLDD

SEQ ID NO: 580309 - protein, 9 aa, Mycobacterium
SGVGEIGDL

SEQ ID NO: 580310 - protein, 20 aa, Mycobacterium
SGVGGGGGNRCGRDWVGGGC

SEQ ID NO: 580311 - protein, 13 aa, Mycobacterium
SGVGGPRAAARAA

SEQ ID NO: 580312 - protein, 7 aa, Mycobacterium
SGVGGPS

SEQ ID NO: 580313 - protein, 7 aa, Mycobacterium
SGVGKGD

SEQ ID NO: 580314 - protein, 8 aa, Mycobacterium
SGVGKGTR

SEQ ID NO: 580315 - protein, 7 aa, Mycobacterium
SGVGKST

SEQ ID NO: 580316 - protein, 6 aa, Mycobacterium
SGVGRE

SEQ ID NO: 580317 - protein, 9 aa, Mycobacterium
SGVGRQNGI

SEQ ID NO: 580318 - protein, 11 aa, Mycobacterium
SGVGRTPVTGA

SEQ ID NO: 580319 - protein, 7 aa, Mycobacterium
SGVGTAS

SEQ ID NO: 580320 - protein, 8 aa, Mycobacterium
SGVGTATG

SEQ ID NO: 580321 - protein, 11 aa, Mycobacterium
SGVGTSGRARE

SEQ ID NO: 580322 - protein, 12 aa, Mycobacterium
SGVGVGPDGSGI

SEQ ID NO: 580323 - protein, 6 aa, Mycobacterium
SGVHER

SEQ ID NO: 580324 - protein, 14 aa, Mycobacterium
SGVHGGAGSAVTAA

SEQ ID NO: 580325 - protein, 4 aa, Mycobacterium
SGVI

SEQ ID NO: 580326 - protein, 7 aa, Mycobacterium
SGVIGRD

SEQ ID NO: 580327 - protein, 8 aa, Mycobacterium
SGVKNVGQ

SEQ ID NO: 580328 - protein, 5 aa, Mycobacterium
SGVKV

SEQ ID NO: 580329 - protein, 12 aa, Mycobacterium
SGVLEEDPQQIA

SEQ ID NO: 580330 - protein, 12 aa, Mycobacterium
SGVNKDAARREH

SEQ ID NO: 580331 - protein, 9 aa, Mycobacterium
SGVNQDGRT

SEQ ID NO: 580332 - protein, 6 aa, Mycobacterium
SGVPDY

SEQ ID NO: 580333 - protein, 15 aa, Mycobacterium
SGVPGDGWPTYGPPD

SEQ ID NO: 580334 - protein, 6 aa, Mycobacterium
SGVPHT

SEQ ID NO: 580335 - protein, 17 aa, Mycobacterium
SGVPISQSRPLAAAQSS

SEQ ID NO: 580336 - protein, 7 aa, Mycobacterium
SGVPKQR

SEQ ID NO: 580337 - protein, 7 aa, Mycobacterium
SGVPQPD

SEQ ID NO: 580338 - protein, 6 aa, Mycobacterium
SGVPTF

SEQ ID NO: 580339 - protein, 9 aa, Mycobacterium
SGVPTPSAS

SEQ ID NO: 580340 - protein, 4 aa, Mycobacterium
SGVQ

SEQ ID NO: 580341 - protein, 7 aa, Mycobacterium
SGVQAGS

SEQ ID NO: 580342 - protein, 5 aa, Mycobacterium
SGVQI

SEQ ID NO: 580343 - protein, 4 aa, Mycobacterium
SGVR

SEQ ID NO: 580344 - protein, 9 aa, Mycobacterium
SGVRADSDD

SEQ ID NO: 580345 - protein, 7 aa, Mycobacterium
SGVRDGS

SEQ ID NO: 580346 - protein, 7 aa, Mycobacterium
SGVRGLG

SEQ ID NO: 580347 - protein, 7 aa, Mycobacterium
SGVRGTN

SEQ ID NO: 580348 - protein, 10 aa, Mycobacterium
SGVRPPGRSL

SEQ ID NO: 580349 - protein, 8 aa, Mycobacterium
SGVRSGGV

SEQ ID NO: 580350 - protein, 9 aa, Mycobacterium
SGVRSSRKI

SEQ ID NO: 580351 - protein, 7 aa, Mycobacterium
SGVRTDA

SEQ ID NO: 580352 - protein, 21 aa, Mycobacterium
SGVSALSSTLDHTGPLGRTVD

SEQ ID NO: 580353 - protein, 13 aa, Mycobacterium
SGVSDLSAASLSY

SEQ ID NO: 580354 - protein, 5 aa, Mycobacterium
SGVSG

SEQ ID NO: 580355 - protein, 8 aa, Mycobacterium
SGVSNFGS

SEQ ID NO: 580356 - protein, 5 aa, Mycobacterium
SGVSP

SEQ ID NO: 580357 - protein, 9 aa, Mycobacterium
SGVTEPFSR

SEQ ID NO: 580358 - protein, 8 aa, Mycobacterium
SGVTGAPT

SEQ ID NO: 580359 - protein, 7 aa, Mycobacterium
SGVTQDR

SEQ ID NO: 580360 - protein, 7 aa, Mycobacterium
SGVTQTM

SEQ ID NO: 580361 - protein, 15 aa, Mycobacterium
SGVTSEPEVDVRDDE

SEQ ID NO: 580362 - protein, 8 aa, Mycobacterium
SGVTTDRQ

SEQ ID NO: 580363 - protein, 4 aa, Mycobacterium
SGVY

SEQ ID NO: 580364 - protein, 6 aa, Mycobacterium
SGWATR

SEQ ID NO: 580365 - protein, 17 aa, Mycobacterium
SGWDAGTVDSLTDDPDV

SEQ ID NO: 580366 - protein, 6 aa, Mycobacterium
SGWDNG

SEQ ID NO: 580367 - protein, 17 aa, Mycobacterium
SGWDPAAADRITDNPAA

SEQ ID NO: 580368 - protein, 17 aa, Mycobacterium
SGWDPDAAERLSDNPEV

SEQ ID NO: 580369 - protein, 4 aa, Mycobacterium
SGWG

SEQ ID NO: 580370 - protein, 16 aa, Mycobacterium
SGWGETGPLTHKAGQD

SEQ ID NO: 580371 - protein, 7 aa, Mycobacterium
SGWGPKA

SEQ ID NO: 580372 - protein, 6 aa, Mycobacterium
SGWNPA

SEQ ID NO: 580373 - protein, 9 aa, Mycobacterium
SGWQGPSSL

SEQ ID NO: 580374 - protein, 6 aa, Mycobacterium
SGWQPG

SEQ ID NO: 580375 - protein, 4 aa, Mycobacterium
SGWR

SEQ ID NO: 580376 - protein, 5 aa, Mycobacterium
SGWSE

SEQ ID NO: 580377 - protein, 6 aa, Mycobacterium
SGWSEA

SEQ ID NO: 580378 - protein, 14 aa, Mycobacterium
SGWSGAQATAERMR

SEQ ID NO: 580379 - protein, 6 aa, Mycobacterium
SGWSPP

SEQ ID NO: 580380 - protein, 5 aa, Mycobacterium
SGWTT

SEQ ID NO: 580381 - protein, 5 aa, Mycobacterium
SGYAA

SEQ ID NO: 580382 - protein, 31 aa, Mycobacterium
SGYAAAGSFPLPAPSGYNSPSAEVPGSCREG

SEQ ID NO: 580383 - protein, 15 aa, Mycobacterium
SGYADERDPAARTAR

SEQ ID NO: 580384 - protein, 9 aa, Mycobacterium
SGYAEEPGR

SEQ ID NO: 580385 - protein, 14 aa, Mycobacterium
SGYAPTDLADSNTG

SEQ ID NO: 580386 - protein, 8 aa, Mycobacterium
SGYAQTAQ

SEQ ID NO: 580387 - protein, 4 aa, Mycobacterium
SGYD

SEQ ID NO: 580388 - protein, 9 aa, Mycobacterium
SGYDEEQGI

SEQ ID NO: 580389 - protein, 9 aa, Mycobacterium
SGYDESAGI

SEQ ID NO: 580390 - protein, 9 aa, Mycobacterium
SGYDESTGI

SEQ ID NO: 580391 - protein, 8 aa, Mycobacterium
SGYDGPEV

SEQ ID NO: 580392 - protein, 12 aa, Mycobacterium
SGYDPDGPLPDV

SEQ ID NO: 580393 - protein, 6 aa, Mycobacterium
SGYDRD

SEQ ID NO: 580394 - protein, 6 aa, Mycobacterium
SGYDRE

SEQ ID NO: 580395 - protein, 8 aa, Mycobacterium
SGYDTGNP

SEQ ID NO: 580396 - protein, 4 aa, Mycobacterium
SGYE

SEQ ID NO: 580397 - protein, 10 aa, Mycobacterium
SGYEASTDYL

SEQ ID NO: 580398 - protein, 6 aa, Mycobacterium
SGYEGD

SEQ ID NO: 580399 - protein, 10 aa, Mycobacterium
SGYEPEAGTV

SEQ ID NO: 580400 - protein, 13 aa, Mycobacterium
SGYEPHPGEPGRE

SEQ ID NO: 580401 - protein, 8 aa, Mycobacterium
SGYEQTSV

SEQ ID NO: 580402 - protein, 6 aa, Mycobacterium
SGYGAS

SEQ ID NO: 580403 - protein, 6 aa, Mycobacterium
SGYGKD

SEQ ID NO: 580404 - protein, 7 aa, Mycobacterium
SGYGKST

SEQ ID NO: 580405 - protein, 6 aa, Mycobacterium
SGYGLP

SEQ ID NO: 580406 - protein, 6 aa, Mycobacterium
SGYGPA

SEQ ID NO: 580407 - protein, 19 aa, Mycobacterium
SGYGPAGSIERTYRRNAQR

SEQ ID NO: 580408 - protein, 19 aa, Mycobacterium
SGYGPAPAVDRTYGRNAQR

SEQ ID NO: 580409 - protein, 12 aa, Mycobacterium
SGYGQDGPWRDR

SEQ ID NO: 580410 - protein, 18 aa, Mycobacterium
SGYGQRGDAFAAAVRAAV

SEQ ID NO: 580411 - protein, 34 aa, Mycobacterium
SGYGSTLGGNATGTATAGKGGEASNGGVAGNGGN

SEQ ID NO: 580412 - protein, 20 aa, Mycobacterium
SGYGSVDGDPARPKAASNPD

SEQ ID NO: 580413 - protein, 8 aa, Mycobacterium
SGYGVDGP

SEQ ID NO: 580414 - protein, 8 aa, Mycobacterium
SGYHGTGI

SEQ ID NO: 580415 - protein, 7 aa, Mycobacterium
SGYNSGQ

SEQ ID NO: 580416 - protein, 4 aa, Mycobacterium
SGYP

SEQ ID NO: 580417 - protein, 16 aa, Mycobacterium
SGYPDRPYDGVDDNAY

SEQ ID NO: 580418 - protein, 16 aa, Mycobacterium
SGYPDRPYDGVDNNAY

SEQ ID NO: 580419 - protein, 10 aa, Mycobacterium
SGYPEPGVPL

SEQ ID NO: 580420 - protein, 7 aa, Mycobacterium
SGYPGAG

SEQ ID NO: 580421 - protein, 8 aa, Mycobacterium
SGYPGAGL

SEQ ID NO: 580422 - protein, 9 aa, Mycobacterium
SGYPGDRDD

SEQ ID NO: 580423 - protein, 16 aa, Mycobacterium
SGYPGKEYDGIDNNAY

SEQ ID NO: 580424 - protein, 16 aa, Mycobacterium
SGYPGREYDGVDNNAY

SEQ ID NO: 580425 - protein, 8 aa, Mycobacterium
SGYPIPSQ

SEQ ID NO: 580426 - protein, 6 aa, Mycobacterium
SGYQAK

SEQ ID NO: 580427 - protein, 16 aa, Mycobacterium
SGYQQRRYHDASGEEV

SEQ ID NO: 580428 - protein, 7 aa, Mycobacterium
SGYRGGV

SEQ ID NO: 580429 - protein, 26 aa, Mycobacterium
SGYRHKRQKRKHDGTKHRGRLTRFGS

SEQ ID NO: 580430 - protein, 22 aa, Mycobacterium
SGYSANATNTTSATAASPTSVS

SEQ ID NO: 580431 - protein, 7 aa, Mycobacterium
SGYSDSE

SEQ ID NO: 580432 - protein, 8 aa, Mycobacterium
SGYSDSEL

SEQ ID NO: 580433 - protein, 10 aa, Mycobacterium
SGYSDSQPGL

SEQ ID NO: 580434 - protein, 9 aa, Mycobacterium
SGYSEETTQ

SEQ ID NO: 580435 - protein, 18 aa, Mycobacterium
SGYSERGDRFAAAVHALT

SEQ ID NO: 580436 - protein, 5 aa, Mycobacterium
SGYSG

SEQ ID NO: 580437 - protein, 11 aa, Mycobacterium
SGYSGCTQYSE

SEQ ID NO: 580438 - protein, 6 aa, Mycobacterium
SGYSGG

SEQ ID NO: 580439 - protein, 6 aa, Mycobacterium
SGYSTL

SEQ ID NO: 580440 - protein, 4 aa, Mycobacterium
SGYT

SEQ ID NO: 580441 - protein, 4 aa, Mycobacterium
SGYV

SEQ ID NO: 580442 - protein, 14 aa, Mycobacterium
SHAAEQQAKQSRTS

SEQ ID NO: 580443 - protein, 25 aa, Mycobacterium
SHAAGAPTERGRRSHVAAGGSCGAR

SEQ ID NO: 580444 - protein, 12 aa, Mycobacterium
SHAAGGRLPDPL

SEQ ID NO: 580445 - protein, 9 aa, Mycobacterium
SHAAGYSAT

SEQ ID NO: 580446 - protein, 17 aa, Mycobacterium
SHAAPTPPKPSAPPSNM

SEQ ID NO: 580447 - protein, 6 aa, Mycobacterium
SHAAYS

SEQ ID NO: 580448 - protein, 4 aa, Mycobacterium
SHAD

SEQ ID NO: 580449 - protein, 7 aa, Mycobacterium
SHADATV

SEQ ID NO: 580450 - protein, 7 aa, Mycobacterium
SHADRTV

SEQ ID NO: 580451 - protein, 8 aa, Mycobacterium
SHADSEDS

SEQ ID NO: 580452 - protein, 10 aa, Mycobacterium
SHAEARGAQA

SEQ ID NO: 580453 - protein, 4 aa, Mycobacterium
SHAG

SEQ ID NO: 580454 - protein, 6 aa, Mycobacterium
SHAGGV

SEQ ID NO: 580455 - protein, 7 aa, Mycobacterium
SHAGPRS

SEQ ID NO: 580456 - protein, 6 aa, Mycobacterium
SHAGPT

SEQ ID NO: 580457 - protein, 8 aa, Mycobacterium
SHAGRSFD

SEQ ID NO: 580458 - protein, 6 aa, Mycobacterium
SHAGTQ

SEQ ID NO: 580459 - protein, 5 aa, Mycobacterium
SHAHQ

SEQ ID NO: 580460 - protein, 11 aa, Mycobacterium
SHAPGSGEEPV

SEQ ID NO: 580461 - protein, 8 aa, Mycobacterium
SHAPRPAA

SEQ ID NO: 580462 - protein, 9 aa, Mycobacterium
SHAPRPATA

SEQ ID NO: 580463 - protein, 18 aa, Mycobacterium
SHAPTDVDLDGSNALSAA

SEQ ID NO: 580464 - protein, 12 aa, Mycobacterium
SHARPDGTRNGP

SEQ ID NO: 580465 - protein, 12 aa, Mycobacterium
SHASAATLGELS

SEQ ID NO: 580466 - protein, 16 aa, Mycobacterium
SHASTHHTVPEGYREP

SEQ ID NO: 580467 - protein, 7 aa, Mycobacterium
SHASTRN

SEQ ID NO: 580468 - protein, 6 aa, Mycobacterium
SHATDR

SEQ ID NO: 580469 - protein, 4 aa, Mycobacterium
SHCG

SEQ ID NO: 580470 - protein, 7 aa, Mycobacterium
SHCSTRT

SEQ ID NO: 580471 - protein, 7 aa, Mycobacterium
SHDAAGR

SEQ ID NO: 580472 - protein, 5 aa, Mycobacterium
SHDDE

SEQ ID NO: 580473 - protein, 6 aa, Mycobacterium
SHDDGL

SEQ ID NO: 580474 - protein, 18 aa, Mycobacterium
SHDDGTGHLDIESIRDRH

SEQ ID NO: 580475 - protein, 10 aa, Mycobacterium
SHDDPASRKP

SEQ ID NO: 580476 - protein, 10 aa, Mycobacterium
SHDEAESEKR

SEQ ID NO: 580477 - protein, 9 aa, Mycobacterium
SHDGAGTTA

SEQ ID NO: 580478 - protein, 6 aa, Mycobacterium
SHDGSA

SEQ ID NO: 580479 - protein, 8 aa, Mycobacterium
SHDPETHV

SEQ ID NO: 580480 - protein, 6 aa, Mycobacterium
SHDPVR

SEQ ID NO: 580481 - protein, 6 aa, Mycobacterium
SHDPVS

SEQ ID NO: 580482 - protein, 7 aa, Mycobacterium
SHDQTPH

SEQ ID NO: 580483 - protein, 15 aa, Mycobacterium
SHDRDQAVAASASEA

SEQ ID NO: 580484 - protein, 18 aa, Mycobacterium
SHDRGVGGIGGGIGDEAW

SEQ ID NO: 580485 - protein, 9 aa, Mycobacterium
SHDRRSPTF

SEQ ID NO: 580486 - protein, 6 aa, Mycobacterium
SHDSAT

SEQ ID NO: 580487 - protein, 7 aa, Mycobacterium
SHDSTRE

SEQ ID NO: 580488 - protein, 12 aa, Mycobacterium
SHDTADAAGQLE

SEQ ID NO: 580489 - protein, 7 aa, Mycobacterium
SHDTASA

SEQ ID NO: 580490 - protein, 11 aa, Mycobacterium
SHDTGEPATDL

SEQ ID NO: 580491 - protein, 6 aa, Mycobacterium
SHDTLT

SEQ ID NO: 580492 - protein, 9 aa, Mycobacterium
SHDTLTTRT

SEQ ID NO: 580493 - protein, 6 aa, Mycobacterium
SHDTMT

SEQ ID NO: 580494 - protein, 6 aa, Mycobacterium
SHDVEG

SEQ ID NO: 580495 - protein, 8 aa, Mycobacterium
SHDVEGAA

SEQ ID NO: 580496 - protein, 11 aa, Mycobacterium
SHDVGRGRGGI

SEQ ID NO: 580497 - protein, 7 aa, Mycobacterium
SHEADSQ

SEQ ID NO: 580498 - protein, 14 aa, Mycobacterium
SHEEPSRVDGQHAH

SEQ ID NO: 580499 - protein, 10 aa, Mycobacterium
SHEEREETGN

SEQ ID NO: 580500 - protein, 8 aa, Mycobacterium
SHEERGAD

SEQ ID NO: 580501 - protein, 6 aa, Mycobacterium
SHEGAR

SEQ ID NO: 580502 - protein, 7 aa, Mycobacterium
SHEGDRP

SEQ ID NO: 580503 - protein, 16 aa, Mycobacterium
SHEGPGPRDIDEARDM

SEQ ID NO: 580504 - protein, 15 aa, Mycobacterium
SHEKAAAAQDSGAFD

SEQ ID NO: 580505 - protein, 14 aa, Mycobacterium
SHENPDNSPHRDLD

SEQ ID NO: 580506 - protein, 4 aa, Mycobacterium
SHEP

SEQ ID NO: 580507 - protein, 12 aa, Mycobacterium
SHEPASDDPDWQ

SEQ ID NO: 580508 - protein, 6 aa, Mycobacterium
SHEPGQ

SEQ ID NO: 580509 - protein, 15 aa, Mycobacterium
SHERAAAAQDSGAFE

SEQ ID NO: 580510 - protein, 21 aa, Mycobacterium
SHERPREQNPPESRGRHAATA

SEQ ID NO: 580511 - protein, 8 aa, Mycobacterium
SHERPSAD

SEQ ID NO: 580512 - protein, 14 aa, Mycobacterium
SHERRAVTDPTKRH

SEQ ID NO: 580513 - protein, 8 aa, Mycobacterium
SHESGAWT

SEQ ID NO: 580514 - protein, 6 aa, Mycobacterium
SHEYAR

SEQ ID NO: 580515 - protein, 4 aa, Mycobacterium
SHFG

SEQ ID NO: 580516 - protein, 13 aa, Mycobacterium
SHFGGGGARSFSP

SEQ ID NO: 580517 - protein, 12 aa, Mycobacterium
SHFGGSTALSGG

SEQ ID NO: 580518 - protein, 7 aa, Mycobacterium
SHGAGVS

SEQ ID NO: 580519 - protein, 13 aa, Mycobacterium
SHGAQRAGPVRDR

SEQ ID NO: 580520 - protein, 7 aa, Mycobacterium
SHGATRD

SEQ ID NO: 580521 - protein, 11 aa, Mycobacterium
SHGDGYTNTDL

SEQ ID NO: 580522 - protein, 11 aa, Mycobacterium
SHGDPADPKTY

SEQ ID NO: 580523 - protein, 9 aa, Mycobacterium
SHGDPLPAA

SEQ ID NO: 580524 - protein, 9 aa, Mycobacterium
SHGDVAPLT

SEQ ID NO: 580525 - protein, 12 aa, Mycobacterium
SHGEEQPARSAA

SEQ ID NO: 580526 - protein, 9 aa, Mycobacterium
SHGEGDIPV

SEQ ID NO: 580527 - protein, 8 aa, Mycobacterium
SHGEREPA

SEQ ID NO: 580528 - protein, 17 aa, Mycobacterium
SHGGAGMPHQASRSEQI

SEQ ID NO: 580529 - protein, 8 aa, Mycobacterium
SHGGARQT

SEQ ID NO: 580530 - protein, 11 aa, Mycobacterium
SHGGEPATALQ

SEQ ID NO: 580531 - protein, 29 aa, Mycobacterium
SHGGGTSPNRRGRPPAHGAAATRKHQMPP

SEQ ID NO: 580532 - protein, 7 aa, Mycobacterium
SHGGTRD

SEQ ID NO: 580533 - protein, 6 aa, Mycobacterium
SHGKDR

SEQ ID NO: 580534 - protein, 11 aa, Mycobacterium
SHGLPSEIASA

SEQ ID NO: 580535 - protein, 5 aa, Mycobacterium
SHGLS

SEQ ID NO: 580536 - protein, 11 aa, Mycobacterium
SHGLSAQAQQE

SEQ ID NO: 580537 - protein, 8 aa, Mycobacterium
SHGNTRRV

SEQ ID NO: 580538 - protein, 10 aa, Mycobacterium
SHGPDGTTAR

SEQ ID NO: 580539 - protein, 32 aa, Mycobacterium
SHGPPEPEHQAAPTHPTRSFSEPIRQPDLFSE

SEQ ID NO: 580540 - protein, 8 aa, Mycobacterium
SHGPVQAR

SEQ ID NO: 580541 - protein, 8 aa, Mycobacterium
SHGQREPA

SEQ ID NO: 580542 - protein, 6 aa, Mycobacterium
SHGQVD

SEQ ID NO: 580543 - protein, 6 aa, Mycobacterium
SHGRAD

SEQ ID NO: 580544 - protein, 18 aa, Mycobacterium
SHGRADSGVFDSRGDDDR

SEQ ID NO: 580545 - protein, 10 aa, Mycobacterium
SHGRDEELGR

SEQ ID NO: 580546 - protein, 7 aa, Mycobacterium
SHGRGGF

SEQ ID NO: 580547 - protein, 12 aa, Mycobacterium
SHGRIGDVTGDP

SEQ ID NO: 580548 - protein, 8 aa, Mycobacterium
SHGRNPLE

SEQ ID NO: 580549 - protein, 9 aa, Mycobacterium
SHGSDAPPL

SEQ ID NO: 580550 - protein, 9 aa, Mycobacterium
SHGSFSTGG

SEQ ID NO: 580551 - protein, 9 aa, Mycobacterium
SHGSGDAAA

SEQ ID NO: 580552 - protein, 6 aa, Mycobacterium
SHGSTL

SEQ ID NO: 580553 - protein, 6 aa, Mycobacterium
SHGTDG

SEQ ID NO: 580554 - protein, 9 aa, Mycobacterium
SHGTGHPPQ

SEQ ID NO: 580555 - protein, 55 aa, Mycobacterium
SHGTTVRGTVEGEITSDTEAAGRTVRASADQPQYKVRSDKTGADAVHKPDALRRA

SEQ ID NO: 580556 - protein, 6 aa, Mycobacterium
SHGYTA

SEQ ID NO: 580557 - protein, 4 aa, Mycobacterium
SHHA

SEQ ID NO: 580558 - protein, 6 aa, Mycobacterium
SHHAAD

SEQ ID NO: 580559 - protein, 4 aa, Mycobacterium
SHHD

SEQ ID NO: 580560 - protein, 17 aa, Mycobacterium
SHHEGMDPVGPDVGTPT

SEQ ID NO: 580561 - protein, 23 aa, Mycobacterium
SHHERSSKPLQESRADEGSSNVA

SEQ ID NO: 580562 - protein, 7 aa, Mycobacterium
SHHPDNV

SEQ ID NO: 580563 - protein, 5 aa, Mycobacterium
SHHPR

SEQ ID NO: 580564 - protein, 11 aa, Mycobacterium
SHIGKAPRGTM

SEQ ID NO: 580565 - protein, 9 aa, Mycobacterium
SHIPTRSGN

SEQ ID NO: 580566 - protein, 7 aa, Mycobacterium
SHITSDS

SEQ ID NO: 580567 - protein, 16 aa, Mycobacterium
SHKGAPAGSSRPANDL

SEQ ID NO: 580568 - protein, 5 aa, Mycobacterium
SHLAD

SEQ ID NO: 580569 - protein, 7 aa, Mycobacterium
SHLDDAA

SEQ ID NO: 580570 - protein, 4 aa, Mycobacterium
SHLE

SEQ ID NO: 580571 - protein, 7 aa, Mycobacterium
SHLEQAG

SEQ ID NO: 580572 - protein, 4 aa, Mycobacterium
SHLP

SEQ ID NO: 580573 - protein, 6 aa, Mycobacterium
SHLPDA

SEQ ID NO: 580574 - protein, 6 aa, Mycobacterium
SHLPDG

SEQ ID NO: 580575 - protein, 14 aa, Mycobacterium
SHLPDPGGLPAERA

SEQ ID NO: 580576 - protein, 6 aa, Mycobacterium
SHLPEA

SEQ ID NO: 580577 - protein, 6 aa, Mycobacterium
SHLQAA

SEQ ID NO: 580578 - protein, 31 aa, Mycobacterium
SHLSATSSRTTTSSPTRSSPRRPNRSRCRPA

SEQ ID NO: 580579 - protein, 16 aa, Mycobacterium
SHNESDPGALAPGRTT

SEQ ID NO: 580580 - protein, 15 aa, Mycobacterium
SHNESEHGALAPGRT

SEQ ID NO: 580581 - protein, 5 aa, Mycobacterium
SHNHP

SEQ ID NO: 580582 - protein, 4 aa, Mycobacterium
SHNM

SEQ ID NO: 580583 - protein, 10 aa, Mycobacterium
SHNNDPPQID

SEQ ID NO: 580584 - protein, 6 aa, Mycobacterium
SHNPDL

SEQ ID NO: 580585 - protein, 10 aa, Mycobacterium
SHNPKTDNGY

SEQ ID NO: 580586 - protein, 9 aa, Mycobacterium
SHNPPADNG

SEQ ID NO: 580587 - protein, 9 aa, Mycobacterium
SHNPPTDNG

SEQ ID NO: 580588 - protein, 10 aa, Mycobacterium
SHNPSSYKAQ

SEQ ID NO: 580589 - protein, 8 aa, Mycobacterium
SHPAAPPI

SEQ ID NO: 580590 - protein, 8 aa, Mycobacterium
SHPAARGI

SEQ ID NO: 580591 - protein, 16 aa, Mycobacterium
SHPAEPANEFNRATAK

SEQ ID NO: 580592 - protein, 11 aa, Mycobacterium
SHPAGRFSPAI

SEQ ID NO: 580593 - protein, 5 aa, Mycobacterium
SHPAI

SEQ ID NO: 580594 - protein, 6 aa, Mycobacterium
SHPAIG

SEQ ID NO: 580595 - protein, 6 aa, Mycobacterium
SHPAQL

SEQ ID NO: 580596 - protein, 19 aa, Mycobacterium
SHPATARAGTEALKSSPEF

SEQ ID NO: 580597 - protein, 19 aa, Mycobacterium
SHPATPEPGGQRRGDKQRQ

SEQ ID NO: 580598 - protein, 6 aa, Mycobacterium
SHPATS

SEQ ID NO: 580599 - protein, 5 aa, Mycobacterium
SHPAV

SEQ ID NO: 580600 - protein, 6 aa, Mycobacterium
SHPAVG

SEQ ID NO: 580601 - protein, 4 aa, Mycobacterium
SHPD

SEQ ID NO: 580602 - protein, 7 aa, Mycobacterium
SHPDEAY

SEQ ID NO: 580603 - protein, 8 aa, Mycobacterium
SHPEAQSI

SEQ ID NO: 580604 - protein, 10 aa, Mycobacterium
SHPEASQADV

SEQ ID NO: 580605 - protein, 8 aa, Mycobacterium
SHPEHKDG

SEQ ID NO: 580606 - protein, 7 aa, Mycobacterium
SHPERDI

SEQ ID NO: 580607 - protein, 9 aa, Mycobacterium
SHPEYQNRD

SEQ ID NO: 580608 - protein, 14 aa, Mycobacterium
SHPGRGESHDEEAD

SEQ ID NO: 580609 - protein, 9 aa, Mycobacterium
SHPGRSADF

SEQ ID NO: 580610 - protein, 5 aa, Mycobacterium
SHPHH

SEQ ID NO: 580611 - protein, 19 aa, Mycobacterium
SHPKAKPETPSIPPKPTGV

SEQ ID NO: 580612 - protein, 6 aa, Mycobacterium
SHPNGR

SEQ ID NO: 580613 - protein, 5 aa, Mycobacterium
SHPPA

SEQ ID NO: 580614 - protein, 7 aa, Mycobacterium
SHPPGSL

SEQ ID NO: 580615 - protein, 10 aa, Mycobacterium
SHPPTAEAPA

SEQ ID NO: 580616 - protein, 4 aa, Mycobacterium
SHPR

SEQ ID NO: 580617 - protein, 9 aa, Mycobacterium
SHPRDARLG

SEQ ID NO: 580618 - protein, 9 aa, Mycobacterium
SHPREARLG

SEQ ID NO: 580619 - protein, 6 aa, Mycobacterium
SHPREV

SEQ ID NO: 580620 - protein, 6 aa, Mycobacterium
SHPSDD

SEQ ID NO: 580621 - protein, 9 aa, Mycobacterium
SHPSKNPMR

SEQ ID NO: 580622 - protein, 13 aa, Mycobacterium
SHPSRHRVRTENR

SEQ ID NO: 580623 - protein, 12 aa, Mycobacterium
SHPTGLAATTDI

SEQ ID NO: 580624 - protein, 6 aa, Mycobacterium
SHPTGY

SEQ ID NO: 580625 - protein, 5 aa, Mycobacterium
SHPTP

SEQ ID NO: 580626 - protein, 17 aa, Mycobacterium
SHPTRGSDASHRGGPPG

SEQ ID NO: 580627 - protein, 5 aa, Mycobacterium
SHQAG

SEQ ID NO: 580628 - protein, 4 aa, Mycobacterium
SHQD

SEQ ID NO: 580629 - protein, 12 aa, Mycobacterium
SHQENKDPRMER

SEQ ID NO: 580630 - protein, 38 aa, Mycobacterium
SHQGQIQRSPLGGAPPAQHPGQQQAQAVTGGGDGFTGI

SEQ ID NO: 580631 - protein, 4 aa, Mycobacterium
SHQL

SEQ ID NO: 580632 - protein, 10 aa, Mycobacterium
SHQPDNSPLT

SEQ ID NO: 580633 - protein, 4 aa, Mycobacterium
SHQR

SEQ ID NO: 580634 - protein, 13 aa, Mycobacterium
SHQRQRSFAQSSK

SEQ ID NO: 580635 - protein, 10 aa, Mycobacterium
SHQSPRLAEA

SEQ ID NO: 580636 - protein, 10 aa, Mycobacterium
SHQSTAAELA

SEQ ID NO: 580637 - protein, 7 aa, Mycobacterium
SHQTGAA

SEQ ID NO: 580638 - protein, 4 aa, Mycobacterium
SHRA

SEQ ID NO: 580639 - protein, 5 aa, Mycobacterium
SHRAT

SEQ ID NO: 580640 - protein, 5 aa, Mycobacterium
SHRDA

SEQ ID NO: 580641 - protein, 18 aa, Mycobacterium
SHRDEAAWSTEQKKKGYA

SEQ ID NO: 580642 - protein, 5 aa, Mycobacterium
SHRDG

SEQ ID NO: 580643 - protein, 9 aa, Mycobacterium
SHRDSTGNH

SEQ ID NO: 580644 - protein, 28 aa, Mycobacterium
SHRGEGTREAAVTPGAPLTVPEEDEREL

SEQ ID NO: 580645 - protein, 6 aa, Mycobacterium
SHRGPD

SEQ ID NO: 580646 - protein, 7 aa, Mycobacterium
SHRGQRM

SEQ ID NO: 580647 - protein, 6 aa, Mycobacterium
SHRGSV

SEQ ID NO: 580648 - protein, 5 aa, Mycobacterium
SHRGT

SEQ ID NO: 580649 - protein, 5 aa, Mycobacterium
SHRHG

SEQ ID NO: 580650 - protein, 6 aa, Mycobacterium
SHRLEQ

SEQ ID NO: 580651 - protein, 8 aa, Mycobacterium
SHRNATDL

SEQ ID NO: 580652 - protein, 6 aa, Mycobacterium
SHRNTG

SEQ ID NO: 580653 - protein, 13 aa, Mycobacterium
SHRNTGKACEEPI

SEQ ID NO: 580654 - protein, 13 aa, Mycobacterium
SHRNTGKACNDPI

SEQ ID NO: 580655 - protein, 13 aa, Mycobacterium
SHRNTGKACNDTI

SEQ ID NO: 580656 - protein, 12 aa, Mycobacterium
SHRNTGKASGCP

SEQ ID NO: 580657 - protein, 14 aa, Mycobacterium
SHRNTGKASNDPIA

SEQ ID NO: 580658 - protein, 14 aa, Mycobacterium
SHRNTGKASQDPIA

SEQ ID NO: 580659 - protein, 12 aa, Mycobacterium
SHRNTGKVCDDP

SEQ ID NO: 580660 - protein, 12 aa, Mycobacterium
SHRNTGRACNET

SEQ ID NO: 580661 - protein, 13 aa, Mycobacterium
SHRNTGRASNDTI

SEQ ID NO: 580662 - protein, 7 aa, Mycobacterium
SHRPATE

SEQ ID NO: 580663 - protein, 6 aa, Mycobacterium
SHRQAP

SEQ ID NO: 580664 - protein, 7 aa, Mycobacterium
SHRQAPV

SEQ ID NO: 580665 - protein, 7 aa, Mycobacterium
SHRQSPV

SEQ ID NO: 580666 - protein, 6 aa, Mycobacterium
SHRQTD

SEQ ID NO: 580667 - protein, 10 aa, Mycobacterium
SHRRPDSVTE

SEQ ID NO: 580668 - protein, 24 aa, Mycobacterium
SHRRRQRAGGGAQSEQGSVESSAQ

SEQ ID NO: 580669 - protein, 17 aa, Mycobacterium
SHRSPAGMTAAEERADF

SEQ ID NO: 580670 - protein, 5 aa, Mycobacterium
SHRTA

SEQ ID NO: 580671 - protein, 9 aa, Mycobacterium
SHRTGRKDQ

SEQ ID NO: 580672 - protein, 7 aa, Mycobacterium
SHRTISP

SEQ ID NO: 580673 - protein, 4 aa, Mycobacterium
SHRV

SEQ ID NO: 580674 - protein, 10 aa, Mycobacterium
SHRVGSDTPL

SEQ ID NO: 580675 - protein, 14 aa, Mycobacterium
SHSADQAGAAAVSE

SEQ ID NO: 580676 - protein, 9 aa, Mycobacterium
SHSAQPDTW

SEQ ID NO: 580677 - protein, 7 aa, Mycobacterium
SHSARTP

SEQ ID NO: 580678 - protein, 15 aa, Mycobacterium
SHSDPTFDPETARAA

SEQ ID NO: 580679 - protein, 7 aa, Mycobacterium
SHSGADD

SEQ ID NO: 580680 - protein, 12 aa, Mycobacterium
SHSGDGGAKEDV

SEQ ID NO: 580681 - protein, 6 aa, Mycobacterium
SHSGPD

SEQ ID NO: 580682 - protein, 6 aa, Mycobacterium
SHSGSD

SEQ ID NO: 580683 - protein, 11 aa, Mycobacterium
SHSHRRTNRRW

SEQ ID NO: 580684 - protein, 11 aa, Mycobacterium
SHSHRRTSRRW

SEQ ID NO: 580685 - protein, 13 aa, Mycobacterium
SHSKDSAETPTLA

SEQ ID NO: 580686 - protein, 9 aa, Mycobacterium
SHSKESQAI

SEQ ID NO: 580687 - protein, 4 aa, Mycobacterium
SHSP

SEQ ID NO: 580688 - protein, 6 aa, Mycobacterium
SHSPDE

SEQ ID NO: 580689 - protein, 18 aa, Mycobacterium
SHSPDRLREAGSIIARIA

SEQ ID NO: 580690 - protein, 6 aa, Mycobacterium
SHSPQV

SEQ ID NO: 580691 - protein, 4 aa, Mycobacterium
SHSR

SEQ ID NO: 580692 - protein, 11 aa, Mycobacterium
SHSSDGGRSDL

SEQ ID NO: 580693 - protein, 12 aa, Mycobacterium
SHSSESATSGGR

SEQ ID NO: 580694 - protein, 5 aa, Mycobacterium
SHSSI

SEQ ID NO: 580695 - protein, 5 aa, Mycobacterium
SHSSS

SEQ ID NO: 580696 - protein, 4 aa, Mycobacterium
SHST

SEQ ID NO: 580697 - protein, 16 aa, Mycobacterium
SHSTDNDQAPGERRMA

SEQ ID NO: 580698 - protein, 10 aa, Mycobacterium
SHSVRPRGEL

SEQ ID NO: 580699 - protein, 9 aa, Mycobacterium
SHSVSAPPL

SEQ ID NO: 580700 - protein, 14 aa, Mycobacterium
SHTAATHGGPDRQR

SEQ ID NO: 580701 - protein, 6 aa, Mycobacterium
SHTADR

SEQ ID NO: 580702 - protein, 9 aa, Mycobacterium
SHTAGTARA

SEQ ID NO: 580703 - protein, 10 aa, Mycobacterium
SHTAPAQSHR

SEQ ID NO: 580704 - protein, 11 aa, Mycobacterium
SHTAPGRTPHS

SEQ ID NO: 580705 - protein, 10 aa, Mycobacterium
SHTARDGDTF

SEQ ID NO: 580706 - protein, 5 aa, Mycobacterium
SHTDE

SEQ ID NO: 580707 - protein, 13 aa, Mycobacterium
SHTDGNGARNAAQ

SEQ ID NO: 580708 - protein, 11 aa, Mycobacterium
SHTEQPSDTMT

SEQ ID NO: 580709 - protein, 17 aa, Mycobacterium
SHTERTTARRLSASPPG

SEQ ID NO: 580710 - protein, 7 aa, Mycobacterium
SHTESRG

SEQ ID NO: 580711 - protein, 7 aa, Mycobacterium
SHTGAAA

SEQ ID NO: 580712 - protein, 9 aa, Mycobacterium
SHTGAVPEL

SEQ ID NO: 580713 - protein, 7 aa, Mycobacterium
SHTGTPG

SEQ ID NO: 580714 - protein, 4 aa, Mycobacterium
SHTN

SEQ ID NO: 580715 - protein, 18 aa, Mycobacterium
SHTPATEEATREELTAVA

SEQ ID NO: 580716 - protein, 13 aa, Mycobacterium
SHTPSRSAIDADG

SEQ ID NO: 580717 - protein, 40 aa, Mycobacterium
SHTPTIHSDPGHNGKRATEVKDRPPAIPVNGRGPGRKSTF

SEQ ID NO: 580718 - protein, 6 aa, Mycobacterium
SHTRTV

SEQ ID NO: 580719 - protein, 9 aa, Mycobacterium
SHTSEPAAA

SEQ ID NO: 580720 - protein, 4 aa, Mycobacterium
SHTT

SEQ ID NO: 580721 - protein, 7 aa, Mycobacterium
SHVDTEE

SEQ ID NO: 580722 - protein, 4 aa, Mycobacterium
SHVG

SEQ ID NO: 580723 - protein, 4 aa, Mycobacterium
SHVP

SEQ ID NO: 580724 - protein, 5 aa, Mycobacterium
SHVTT

SEQ ID NO: 580725 - protein, 9 aa, Mycobacterium
SHWNRGKKS

SEQ ID NO: 580726 - protein, 5 aa, Mycobacterium
SHWTS

SEQ ID NO: 580727 - protein, 7 aa, Mycobacterium
SHYPKDN

SEQ ID NO: 580728 - protein, 6 aa, Mycobacterium
SHYRNA

SEQ ID NO: 580729 - protein, 6 aa, Mycobacterium
SIAAAS

SEQ ID NO: 580730 - protein, 17 aa, Mycobacterium
SIAAGQSPFPADGRDPW

SEQ ID NO: 580731 - protein, 9 aa, Mycobacterium
SIAARSGEI

SEQ ID NO: 580732 - protein, 12 aa, Mycobacterium
SIADASKAISGE

SEQ ID NO: 580733 - protein, 11 aa, Mycobacterium
SIADTGYAETT

SEQ ID NO: 580734 - protein, 11 aa, Mycobacterium
SIAEDGYAKTT

SEQ ID NO: 580735 - protein, 22 aa, Mycobacterium
SIAEERGVSAEITTATESPNHR

SEQ ID NO: 580736 - protein, 7 aa, Mycobacterium
SIAENTA

SEQ ID NO: 580737 - protein, 10 aa, Mycobacterium
SIAEPKSVAP

SEQ ID NO: 580738 - protein, 6 aa, Mycobacterium
SIAETE

SEQ ID NO: 580739 - protein, 5 aa, Mycobacterium
SIAGA

SEQ ID NO: 580740 - protein, 5 aa, Mycobacterium
SIAGE

SEQ ID NO: 580741 - protein, 7 aa, Mycobacterium
SIAGGKN

SEQ ID NO: 580742 - protein, 5 aa, Mycobacterium
SIAGH

SEQ ID NO: 580743 - protein, 9 aa, Mycobacterium
SIAGPDDDD

SEQ ID NO: 580744 - protein, 14 aa, Mycobacterium
SIAGPKRPQDRIPL

SEQ ID NO: 580745 - protein, 32 aa, Mycobacterium
SIAGPLAASPTVASPRQPADYPPPPAVAPPRQ

SEQ ID NO: 580746 - protein, 12 aa, Mycobacterium
SIAGTDTSGRSI

SEQ ID NO: 580747 - protein, 5 aa, Mycobacterium
SIAMQ

SEQ ID NO: 580748 - protein, 4 aa, Mycobacterium
SIAP

SEQ ID NO: 580749 - protein, 9 aa, Mycobacterium
SIAPDDAAI

SEQ ID NO: 580750 - protein, 6 aa, Mycobacterium
SIAPEE

SEQ ID NO: 580751 - protein, 7 aa, Mycobacterium
SIAPNPQ

SEQ ID NO: 580752 - protein, 7 aa, Mycobacterium
SIAPTGT

SEQ ID NO: 580753 - protein, 5 aa, Mycobacterium
SIAQA

SEQ ID NO: 580754 - protein, 20 aa, Mycobacterium
SIARTSSGKIARSAARTSYL

SEQ ID NO: 580755 - protein, 4 aa, Mycobacterium
SIAT

SEQ ID NO: 580756 - protein, 10 aa, Mycobacterium
SIATAGSAAI

SEQ ID NO: 580757 - protein, 10 aa, Mycobacterium
SIATAGSAAV

SEQ ID NO: 580758 - protein, 5 aa, Mycobacterium
SIDAA

SEQ ID NO: 580759 - protein, 15 aa, Mycobacterium
SIDASGTKSSFRTGD

SEQ ID NO: 580760 - protein, 6 aa, Mycobacterium
SIDDEQ

SEQ ID NO: 580761 - protein, 8 aa, Mycobacterium
SIDDPAET

SEQ ID NO: 580762 - protein, 9 aa, Mycobacterium
SIDDPDDDR

SEQ ID NO: 580763 - protein, 7 aa, Mycobacterium
SIDDTAA

SEQ ID NO: 580764 - protein, 6 aa, Mycobacterium
SIDDVP

SEQ ID NO: 580765 - protein, 4 aa, Mycobacterium
SIDE

SEQ ID NO: 580766 - protein, 5 aa, Mycobacterium
SIDEP

SEQ ID NO: 580767 - protein, 7 aa, Mycobacterium
SIDGARQ

SEQ ID NO: 580768 - protein, 8 aa, Mycobacterium
SIDGARQA

SEQ ID NO: 580769 - protein, 11 aa, Mycobacterium
SIDGARSASAT

SEQ ID NO: 580770 - protein, 5 aa, Mycobacterium
SIDGI

SEQ ID NO: 580771 - protein, 5 aa, Mycobacterium
SIDGP

SEQ ID NO: 580772 - protein, 6 aa, Mycobacterium
SIDGRP

SEQ ID NO: 580773 - protein, 15 aa, Mycobacterium
SIDGRSAAADGSSQW

SEQ ID NO: 580774 - protein, 4 aa, Mycobacterium
SIDN

SEQ ID NO: 580775 - protein, 10 aa, Mycobacterium
SIDNPDGPQL

SEQ ID NO: 580776 - protein, 4 aa, Mycobacterium
SIDP

SEQ ID NO: 580777 - protein, 5 aa, Mycobacterium
SIDPD

SEQ ID NO: 580778 - protein, 8 aa, Mycobacterium
SIDPGSAV

SEQ ID NO: 580779 - protein, 6 aa, Mycobacterium
SIDPGT

SEQ ID NO: 580780 - protein, 8 aa, Mycobacterium
SIDPGTTR

SEQ ID NO: 580781 - protein, 10 aa, Mycobacterium
SIDPKGPIAD

SEQ ID NO: 580782 - protein, 6 aa, Mycobacterium
SIDPNS

SEQ ID NO: 580783 - protein, 11 aa, Mycobacterium
SIDPRQCTSDL

SEQ ID NO: 580784 - protein, 18 aa, Mycobacterium
SIDPSRRSYDVTATGATW

SEQ ID NO: 580785 - protein, 15 aa, Mycobacterium
SIDPTGPALTPAEYS

SEQ ID NO: 580786 - protein, 9 aa, Mycobacterium
SIDQRSGVS

SEQ ID NO: 580787 - protein, 6 aa, Mycobacterium
SIDRTA

SEQ ID NO: 580788 - protein, 14 aa, Mycobacterium
SIDSPSAGTPTGPW

SEQ ID NO: 580789 - protein, 16 aa, Mycobacterium
SIDSSEPGNSDYSGPL

SEQ ID NO: 580790 - protein, 14 aa, Mycobacterium
SIDSSGKITKRGAE

SEQ ID NO: 580791 - protein, 5 aa, Mycobacterium
SIDTA

SEQ ID NO: 580792 - protein, 7 aa, Mycobacterium
SIDTDDD

SEQ ID NO: 580793 - protein, 13 aa, Mycobacterium
SIDTGDKMATTAG

SEQ ID NO: 580794 - protein, 5 aa, Mycobacterium
SIDTP

SEQ ID NO: 580795 - protein, 5 aa, Mycobacterium
SIDTS

SEQ ID NO: 580796 - protein, 4 aa, Mycobacterium
SIED

SEQ ID NO: 580797 - protein, 25 aa, Mycobacterium
SIEDGAGGSGKGALIGGPAAGAAPV

SEQ ID NO: 580798 - protein, 8 aa, Mycobacterium
SIEDPAET

SEQ ID NO: 580799 - protein, 7 aa, Mycobacterium
SIEDPPA

SEQ ID NO: 580800 - protein, 10 aa, Mycobacterium
SIEDSDEPAV

SEQ ID NO: 580801 - protein, 12 aa, Mycobacterium
SIEDTQRAQDAA

SEQ ID NO: 580802 - protein, 4 aa, Mycobacterium
SIEE

SEQ ID NO: 580803 - protein, 8 aa, Mycobacterium
SIEGGTSE

SEQ ID NO: 580804 - protein, 5 aa, Mycobacterium
SIEGP

SEQ ID NO: 580805 - protein, 5 aa, Mycobacterium
SIEPE

SEQ ID NO: 580806 - protein, 7 aa, Mycobacterium
SIEPESP

SEQ ID NO: 580807 - protein, 7 aa, Mycobacterium
SIEPGDV

SEQ ID NO: 580808 - protein, 6 aa, Mycobacterium
SIEPSA

SEQ ID NO: 580809 - protein, 7 aa, Mycobacterium
SIEPTAD

SEQ ID NO: 580810 - protein, 6 aa, Mycobacterium
SIEPTD

SEQ ID NO: 580811 - protein, 6 aa, Mycobacterium
SIEQAK

SEQ ID NO: 580812 - protein, 6 aa, Mycobacterium
SIEQAR

SEQ ID NO: 580813 - protein, 5 aa, Mycobacterium
SIERY

SEQ ID NO: 580814 - protein, 9 aa, Mycobacterium
SIESAAPNR

SEQ ID NO: 580815 - protein, 5 aa, Mycobacterium
SIESP

SEQ ID NO: 580816 - protein, 13 aa, Mycobacterium
SIESPHPSPLSAS

SEQ ID NO: 580817 - protein, 8 aa, Mycobacterium
SIETAGKL

SEQ ID NO: 580818 - protein, 16 aa, Mycobacterium
SIEVGARQRYSEILTA

SEQ ID NO: 580819 - protein, 4 aa, Mycobacterium
SIFG

SEQ ID NO: 580820 - protein, 4 aa, Mycobacterium
SIGA

SEQ ID NO: 580821 - protein, 6 aa, Mycobacterium
SIGADE

SEQ ID NO: 580822 - protein, 12 aa, Mycobacterium
SIGAQGNTNVTN

SEQ ID NO: 580823 - protein, 13 aa, Mycobacterium
SIGASKKDGQRAK

SEQ ID NO: 580824 - protein, 6 aa, Mycobacterium
SIGDRS

SEQ ID NO: 580825 - protein, 4 aa, Mycobacterium
SIGE

SEQ ID NO: 580826 - protein, 10 aa, Mycobacterium
SIGEPDPEVA

SEQ ID NO: 580827 - protein, 7 aa, Mycobacterium
SIGEPEP

SEQ ID NO: 580828 - protein, 6 aa, Mycobacterium
SIGERT

SEQ ID NO: 580829 - protein, 11 aa, Mycobacterium
SIGGAPPELSA

SEQ ID NO: 580830 - protein, 14 aa, Mycobacterium
SIGGGIDHKATAEQ

SEQ ID NO: 580831 - protein, 15 aa, Mycobacterium
SIGGGSGGVTGTTPD

SEQ ID NO: 580832 - protein, 11 aa, Mycobacterium
SIGGNAATNAG

SEQ ID NO: 580833 - protein, 9 aa, Mycobacterium
SIGGSGGYY

SEQ ID NO: 580834 - protein, 9 aa, Mycobacterium
SIGGTDTCG

SEQ ID NO: 580835 - protein, 5 aa, Mycobacterium
SIGKT

SEQ ID NO: 580836 - protein, 11 aa, Mycobacterium
SIGNDLSTPMP

SEQ ID NO: 580837 - protein, 12 aa, Mycobacterium
SIGNDLSTPVPE

SEQ ID NO: 580838 - protein, 9 aa, Mycobacterium
SIGNEVNKT

SEQ ID NO: 580839 - protein, 6 aa, Mycobacterium
SIGPAN

SEQ ID NO: 580840 - protein, 10 aa, Mycobacterium
SIGPGGNAKR

SEQ ID NO: 580841 - protein, 7 aa, Mycobacterium
SIGPGGW

SEQ ID NO: 580842 - protein, 9 aa, Mycobacterium
SIGPGSTNM

SEQ ID NO: 580843 - protein, 4 aa, Mycobacterium
SIGQ

SEQ ID NO: 580844 - protein, 16 aa, Mycobacterium
SIGQGSSAADAFDPND

SEQ ID NO: 580845 - protein, 4 aa, Mycobacterium
SIGR

SEQ ID NO: 580846 - protein, 24 aa, Mycobacterium
SIGRNGGSAVSSDYPARYSLTGGT

SEQ ID NO: 580847 - protein, 6 aa, Mycobacterium
SIGRPG

SEQ ID NO: 580848 - protein, 21 aa, Mycobacterium
SIGSNAAQYAKGESPEPVPTL

SEQ ID NO: 580849 - protein, 9 aa, Mycobacterium
SIGSPETSQ

SEQ ID NO: 580850 - protein, 5 aa, Mycobacterium
SIGSR

SEQ ID NO: 580851 - protein, 11 aa, Mycobacterium
SIGSRTELESE

SEQ ID NO: 580852 - protein, 5 aa, Mycobacterium
SIGSS

SEQ ID NO: 580853 - protein, 7 aa, Mycobacterium
SIGSSDA

SEQ ID NO: 580854 - protein, 9 aa, Mycobacterium
SIGSSEPPF

SEQ ID NO: 580855 - protein, 10 aa, Mycobacterium
SIGSSETGFG

SEQ ID NO: 580856 - protein, 13 aa, Mycobacterium
SIGSSETGFGGTS

SEQ ID NO: 580857 - protein, 7 aa, Mycobacterium
SIGSTDN

SEQ ID NO: 580858 - protein, 5 aa, Mycobacterium
SIGSY

SEQ ID NO: 580859 - protein, 13 aa, Mycobacterium
SIGTGGAATNAKY

SEQ ID NO: 580860 - protein, 13 aa, Mycobacterium
SIGTIGDSYDNAL

SEQ ID NO: 580861 - protein, 22 aa, Mycobacterium
SIGTMTAKGPAVGGTRYEAERQ

SEQ ID NO: 580862 - protein, 23 aa, Mycobacterium
SIIGSSSVNSDSPNPALAPYAAT

SEQ ID NO: 580863 - protein, 8 aa, Mycobacterium
SIKANAKT

SEQ ID NO: 580864 - protein, 11 aa, Mycobacterium
SIKAPDGRPVN

SEQ ID NO: 580865 - protein, 8 aa, Mycobacterium
SIKAQEAC

SEQ ID NO: 580866 - protein, 8 aa, Mycobacterium
SIKESAAE

SEQ ID NO: 580867 - protein, 22 aa, Mycobacterium
SIKGTDTGARDDDHEAIATAPT

SEQ ID NO: 580868 - protein, 12 aa, Mycobacterium
SIKPGDPDDART

SEQ ID NO: 580869 - protein, 6 aa, Mycobacterium
SINATG

SEQ ID NO: 580870 - protein, 4 aa, Mycobacterium
SIND

SEQ ID NO: 580871 - protein, 6 aa, Mycobacterium
SINGTT

SEQ ID NO: 580872 - protein, 7 aa, Mycobacterium
SINPATG

SEQ ID NO: 580873 - protein, 7 aa, Mycobacterium
SINPDVD

SEQ ID NO: 580874 - protein, 9 aa, Mycobacterium
SINPKTPVY

SEQ ID NO: 580875 - protein, 5 aa, Mycobacterium
SINPS

SEQ ID NO: 580876 - protein, 16 aa, Mycobacterium
SINRSPSAFDRNPEAD

SEQ ID NO: 580877 - protein, 9 aa, Mycobacterium
SINRYPDNG

SEQ ID NO: 580878 - protein, 13 aa, Mycobacterium
SINSRPSWARPST

SEQ ID NO: 580879 - protein, 61 aa, Mycobacterium
SINTGAGNAGDVNTGFGSATDTGATNSGFGNTGTGTSGFNNHGNSTSGWENTGNSSEGYGN

SEQ ID NO: 580880 - protein, 11 aa, Mycobacterium
SINTGVGHAGA

SEQ ID NO: 580881 - protein, 4 aa, Mycobacterium
SIPA

SEQ ID NO: 580882 - protein, 6 aa, Mycobacterium
SIPAEG

SEQ ID NO: 580883 - protein, 13 aa, Mycobacterium
SIPAGALGTPEDI

SEQ ID NO: 580884 - protein, 8 aa, Mycobacterium
SIPAPGIG

SEQ ID NO: 580885 - protein, 5 aa, Mycobacterium
SIPAS

SEQ ID NO: 580886 - protein, 16 aa, Mycobacterium
SIPASSPDATEKASGA

SEQ ID NO: 580887 - protein, 6 aa, Mycobacterium
SIPCGP

SEQ ID NO: 580888 - protein, 4 aa, Mycobacterium
SIPD

SEQ ID NO: 580889 - protein, 5 aa, Mycobacterium
SIPDL

SEQ ID NO: 580890 - protein, 10 aa, Mycobacterium
SIPDPVRETD

SEQ ID NO: 580891 - protein, 5 aa, Mycobacterium
SIPEA

SEQ ID NO: 580892 - protein, 13 aa, Mycobacterium
SIPEGARAANSTF

SEQ ID NO: 580893 - protein, 9 aa, Mycobacterium
SIPEGEQAP

SEQ ID NO: 580894 - protein, 13 aa, Mycobacterium
SIPEPDPARNPHR

SEQ ID NO: 580895 - protein, 11 aa, Mycobacterium
SIPEPDPELNP

SEQ ID NO: 580896 - protein, 6 aa, Mycobacterium
SIPERP

SEQ ID NO: 580897 - protein, 6 aa, Mycobacterium
SIPEYN

SEQ ID NO: 580898 - protein, 14 aa, Mycobacterium
SIPGALGGAAGSLP

SEQ ID NO: 580899 - protein, 11 aa, Mycobacterium
SIPGANRDGDS

SEQ ID NO: 580900 - protein, 8 aa, Mycobacterium
SIPGGDGQ

SEQ ID NO: 580901 - protein, 6 aa, Mycobacterium
SIPGNV

SEQ ID NO: 580902 - protein, 5 aa, Mycobacterium
SIPGP

SEQ ID NO: 580903 - protein, 10 aa, Mycobacterium
SIPGPAGPLA

SEQ ID NO: 580904 - protein, 6 aa, Mycobacterium
SIPGRD

SEQ ID NO: 580905 - protein, 16 aa, Mycobacterium
SIPGRSLSDDLTAAEG

SEQ ID NO: 580906 - protein, 12 aa, Mycobacterium
SIPLTTSGKVRR

SEQ ID NO: 580907 - protein, 4 aa, Mycobacterium
SIPN

SEQ ID NO: 580908 - protein, 9 aa, Mycobacterium
SIPNEEIKN

SEQ ID NO: 580909 - protein, 9 aa, Mycobacterium
SIPNEKIKN

SEQ ID NO: 580910 - protein, 6 aa, Mycobacterium
SIPPDA

SEQ ID NO: 580911 - protein, 7 aa, Mycobacterium
SIPPDFE

SEQ ID NO: 580912 - protein, 18 aa, Mycobacterium
SIPPGARPTQMTEDAEQS

SEQ ID NO: 580913 - protein, 7 aa, Mycobacterium
SIPPGER

SEQ ID NO: 580914 - protein, 20 aa, Mycobacterium
SIPPTTTSAGPASGIPGDGT

SEQ ID NO: 580915 - protein, 4 aa, Mycobacterium
SIPQ

SEQ ID NO: 580916 - protein, 10 aa, Mycobacterium
SIPQTNDSVS

SEQ ID NO: 580917 - protein, 4 aa, Mycobacterium
SIPS

SEQ ID NO: 580918 - protein, 6 aa, Mycobacterium
SIPSEQ

SEQ ID NO: 580919 - protein, 9 aa, Mycobacterium
SIPSGPDSV

SEQ ID NO: 580920 - protein, 6 aa, Mycobacterium
SIPSSA

SEQ ID NO: 580921 - protein, 7 aa, Mycobacterium
SIPSWDD

SEQ ID NO: 580922 - protein, 29 aa, Mycobacterium
SIPTPDETQMDDVTSTSTTTSTKAKTYYY

SEQ ID NO: 580923 - protein, 6 aa, Mycobacterium
SIPTTA

SEQ ID NO: 580924 - protein, 6 aa, Mycobacterium
SIPTTD

SEQ ID NO: 580925 - protein, 6 aa, Mycobacterium
SIPTTS

SEQ ID NO: 580926 - protein, 5 aa, Mycobacterium
SIPTV

SEQ ID NO: 580927 - protein, 10 aa, Mycobacterium
SIPVESPTAT

SEQ ID NO: 580928 - protein, 7 aa, Mycobacterium
SIPVQGK

SEQ ID NO: 580929 - protein, 6 aa, Mycobacterium
SIPVSP

SEQ ID NO: 580930 - protein, 13 aa, Mycobacterium
SIPVSRGADEPLH

SEQ ID NO: 580931 - protein, 5 aa, Mycobacterium
SIPVT

SEQ ID NO: 580932 - protein, 17 aa, Mycobacterium
SIPWGKAAKDNGQFRSR

SEQ ID NO: 580933 - protein, 5 aa, Mycobacterium
SIQEG

SEQ ID NO: 580934 - protein, 5 aa, Mycobacterium
SIQRY

SEQ ID NO: 580935 - protein, 12 aa, Mycobacterium
SIQTLSPKSGRI

SEQ ID NO: 580936 - protein, 6 aa, Mycobacterium
SIRADD

SEQ ID NO: 580937 - protein, 5 aa, Mycobacterium
SIRAG

SEQ ID NO: 580938 - protein, 12 aa, Mycobacterium
SIRDEARKAGYD

SEQ ID NO: 580939 - protein, 10 aa, Mycobacterium
SIRDGDRSAL

SEQ ID NO: 580940 - protein, 5 aa, Mycobacterium
SIRDT

SEQ ID NO: 580941 - protein, 21 aa, Mycobacterium
SIRESASQALPGLLQRLPALL

SEQ ID NO: 580942 - protein, 19 aa, Mycobacterium
SIRGDGANATSQAKVSDVQ

SEQ ID NO: 580943 - protein, 9 aa, Mycobacterium
SIRGTAGIQ

SEQ ID NO: 580944 - protein, 6 aa, Mycobacterium
SIRPQD

SEQ ID NO: 580945 - protein, 14 aa, Mycobacterium
SIRPSASWCLRCCR

SEQ ID NO: 580946 - protein, 9 aa, Mycobacterium
SIRQERENS

SEQ ID NO: 580947 - protein, 8 aa, Mycobacterium
SIRQPDAA

SEQ ID NO: 580948 - protein, 6 aa, Mycobacterium
SIRTST

SEQ ID NO: 580949 - protein, 8 aa, Mycobacterium
SISAEQRS

SEQ ID NO: 580950 - protein, 5 aa, Mycobacterium
SISAN

SEQ ID NO: 580951 - protein, 14 aa, Mycobacterium
SISGASDSSDTDVT

SEQ ID NO: 580952 - protein, 28 aa, Mycobacterium
SISGDEPLGGRAEGGDEPLEGRAEGTVS

SEQ ID NO: 580953 - protein, 6 aa, Mycobacterium
SISGED

SEQ ID NO: 580954 - protein, 7 aa, Mycobacterium
SISGGTD

SEQ ID NO: 580955 - protein, 11 aa, Mycobacterium
SISGQVKGGEV

SEQ ID NO: 580956 - protein, 6 aa, Mycobacterium
SISPAQ

SEQ ID NO: 580957 - protein, 5 aa, Mycobacterium
SISPD

SEQ ID NO: 580958 - protein, 7 aa, Mycobacterium
SISPDEL

SEQ ID NO: 580959 - protein, 8 aa, Mycobacterium
SISPDGDV

SEQ ID NO: 580960 - protein, 6 aa, Mycobacterium
SISPGY

SEQ ID NO: 580961 - protein, 15 aa, Mycobacterium
SISQGSNADTPSTTW

SEQ ID NO: 580962 - protein, 11 aa, Mycobacterium
SISQQGGPESV

SEQ ID NO: 580963 - protein, 7 aa, Mycobacterium
SISQYAP

SEQ ID NO: 580964 - protein, 8 aa, Mycobacterium
SISREPGG

SEQ ID NO: 580965 - protein, 5 aa, Mycobacterium
SISRT

SEQ ID NO: 580966 - protein, 8 aa, Mycobacterium
SISSRLSS

SEQ ID NO: 580967 - protein, 13 aa, Mycobacterium
SISTDPKATGAAR

SEQ ID NO: 580968 - protein, 7 aa, Mycobacterium
SITAGEI

SEQ ID NO: 580969 - protein, 10 aa, Mycobacterium
SITAPDGRPI

SEQ ID NO: 580970 - protein, 13 aa, Mycobacterium
SITARNSAAVTTR

SEQ ID NO: 580971 - protein, 10 aa, Mycobacterium
SITDDGTRYN

SEQ ID NO: 580972 - protein, 26 aa, Mycobacterium
SITDSSATSGHGGAAQGGNGGNGGNG

SEQ ID NO: 580973 - protein, 9 aa, Mycobacterium
SITEKGSGV

SEQ ID NO: 580974 - protein, 11 aa, Mycobacterium
SITERGYRAST

SEQ ID NO: 580975 - protein, 6 aa, Mycobacterium
SITPDE

SEQ ID NO: 580976 - protein, 6 aa, Mycobacterium
SITPEL

SEQ ID NO: 580977 - protein, 6 aa, Mycobacterium
SITPGL

SEQ ID NO: 580978 - protein, 8 aa, Mycobacterium
SITPGTRG

SEQ ID NO: 580979 - protein, 10 aa, Mycobacterium
SITPPEGESF

SEQ ID NO: 580980 - protein, 10 aa, Mycobacterium
SITPPGGESF

SEQ ID NO: 580981 - protein, 7 aa, Mycobacterium
SITPRGA

SEQ ID NO: 580982 - protein, 11 aa, Mycobacterium
SITQDSGGVTV

SEQ ID NO: 580983 - protein, 14 aa, Mycobacterium
SITQPDGAGAGPDL

SEQ ID NO: 580984 - protein, 4 aa, Mycobacterium
SITR

SEQ ID NO: 580985 - protein, 10 aa, Mycobacterium
SITRSERTAK

SEQ ID NO: 580986 - protein, 12 aa, Mycobacterium
SITSGTASAERS

SEQ ID NO: 580987 - protein, 6 aa, Mycobacterium
SITSPE

SEQ ID NO: 580988 - protein, 5 aa, Mycobacterium
SITTA

SEQ ID NO: 580989 - protein, 6 aa, Mycobacterium
SITTET

SEQ ID NO: 580990 - protein, 12 aa, Mycobacterium
SITTFGPYSPGQ

SEQ ID NO: 580991 - protein, 10 aa, Mycobacterium
SITTPADERR

SEQ ID NO: 580992 - protein, 13 aa, Mycobacterium
SITVTSPKREAAG

SEQ ID NO: 580993 - protein, 16 aa, Mycobacterium
SIVGPDGTALARAGEG

SEQ ID NO: 580994 - protein, 7 aa, Mycobacterium
SIVSGDD

SEQ ID NO: 580995 - protein, 9 aa, Mycobacterium
SIYGGSNEV

SEQ ID NO: 580996 - protein, 20 aa, Mycobacterium
SIYGGSNEVQRTIIASTILG

SEQ ID NO: 580997 - protein, 20 aa, Mycobacterium
SIYGGSNEVQRTIISSTILG

SEQ ID NO: 580998 - protein, 20 aa, Mycobacterium
SIYGGSSEVQRNIIASTILG

SEQ ID NO: 580999 - protein, 4 aa, Mycobacterium
SKAA

SEQ ID NO: 581000 - protein, 5 aa, Mycobacterium
SKAAA

SEQ ID NO: 581001 - protein, 14 aa, Mycobacterium
SKAAARRAGRLGSG

SEQ ID NO: 581002 - protein, 6 aa, Mycobacterium
SKAADA

SEQ ID NO: 581003 - protein, 13 aa, Mycobacterium
SKAADLDDEQLAK

SEQ ID NO: 581004 - protein, 7 aa, Mycobacterium
SKAADRP

SEQ ID NO: 581005 - protein, 8 aa, Mycobacterium
SKAAGASV

SEQ ID NO: 581006 - protein, 6 aa, Mycobacterium
SKAAGE

SEQ ID NO: 581007 - protein, 14 aa, Mycobacterium
SKAALGHSLGSAGA

SEQ ID NO: 581008 - protein, 6 aa, Mycobacterium
SKAALS

SEQ ID NO: 581009 - protein, 8 aa, Mycobacterium
SKAALSAV

SEQ ID NO: 581010 - protein, 7 aa, Mycobacterium
SKAALSS

SEQ ID NO: 581011 - protein, 9 aa, Mycobacterium
SKAALSSVT

SEQ ID NO: 581012 - protein, 19 aa, Mycobacterium
SKAALSSVTKNLSKSLAKD

SEQ ID NO: 581013 - protein, 5 aa, Mycobacterium
SKAAS

SEQ ID NO: 581014 - protein, 5 aa, Mycobacterium
SKAAV

SEQ ID NO: 581015 - protein, 6 aa, Mycobacterium
SKAAVN

SEQ ID NO: 581016 - protein, 10 aa, Mycobacterium
SKADALADTV

SEQ ID NO: 581017 - protein, 5 aa, Mycobacterium
SKADG

SEQ ID NO: 581018 - protein, 15 aa, Mycobacterium
SKADHPDLAAAGEQA

SEQ ID NO: 581019 - protein, 10 aa, Mycobacterium
SKADQSLGDA

SEQ ID NO: 581020 - protein, 6 aa, Mycobacterium
SKADTV

SEQ ID NO: 581021 - protein, 4 aa, Mycobacterium
SKAE

SEQ ID NO: 581022 - protein, 5 aa, Mycobacterium
SKAEA

SEQ ID NO: 581023 - protein, 7 aa, Mycobacterium
SKAEAAP

SEQ ID NO: 581024 - protein, 30 aa, Mycobacterium
SKAEGGAAPEHGRSASSAPEHGRSASSAPP

SEQ ID NO: 581025 - protein, 7 aa, Mycobacterium
SKAEGVG

SEQ ID NO: 581026 - protein, 8 aa, Mycobacterium
SKAEIDTQ

SEQ ID NO: 581027 - protein, 14 aa, Mycobacterium
SKAESYQKELKYMN

SEQ ID NO: 581028 - protein, 8 aa, Mycobacterium
SKAGDDNR

SEQ ID NO: 581029 - protein, 10 aa, Mycobacterium
SKAGLAQKAK

SEQ ID NO: 581030 - protein, 7 aa, Mycobacterium
SKAGLGA

SEQ ID NO: 581031 - protein, 7 aa, Mycobacterium
SKAGLPD

SEQ ID NO: 581032 - protein, 24 aa, Mycobacterium
SKAGNGDAVVRPSGAGIHEVDVKI

SEQ ID NO: 581033 - protein, 7 aa, Mycobacterium
SKAGRAH

SEQ ID NO: 581034 - protein, 7 aa, Mycobacterium
SKAGRQV

SEQ ID NO: 581035 - protein, 8 aa, Mycobacterium
SKAGVAQK

SEQ ID NO: 581036 - protein, 6 aa, Mycobacterium
SKAGVT

SEQ ID NO: 581037 - protein, 14 aa, Mycobacterium
SKAGYRNDSRLASR

SEQ ID NO: 581038 - protein, 6 aa, Mycobacterium
SKAHKD

SEQ ID NO: 581039 - protein, 13 aa, Mycobacterium
SKAKASGQRQAGS

SEQ ID NO: 581040 - protein, 4 aa, Mycobacterium
SKAL

SEQ ID NO: 581041 - protein, 7 aa, Mycobacterium
SKALPAS

SEQ ID NO: 581042 - protein, 13 aa, Mycobacterium
SKAMSAASGYAPR

SEQ ID NO: 581043 - protein, 9 aa, Mycobacterium
SKANAAARS

SEQ ID NO: 581044 - protein, 8 aa, Mycobacterium
SKAPGEKV

SEQ ID NO: 581045 - protein, 7 aa, Mycobacterium
SKAPGIN

SEQ ID NO: 581046 - protein, 7 aa, Mycobacterium
SKAPGTW

SEQ ID NO: 581047 - protein, 8 aa, Mycobacterium
SKAPLDTG

SEQ ID NO: 581048 - protein, 7 aa, Mycobacterium
SKAPTHD

SEQ ID NO: 581049 - protein, 15 aa, Mycobacterium
SKAQWESNDDGLSPL

SEQ ID NO: 581050 - protein, 4 aa, Mycobacterium
SKAR

SEQ ID NO: 581051 - protein, 9 aa, Mycobacterium
SKARAAAQG

SEQ ID NO: 581052 - protein, 8 aa, Mycobacterium
SKARALEQ

SEQ ID NO: 581053 - protein, 6 aa, Mycobacterium
SKAREL

SEQ ID NO: 581054 - protein, 6 aa, Mycobacterium
SKAREW

SEQ ID NO: 581055 - protein, 9 aa, Mycobacterium
SKARPSSDG

SEQ ID NO: 581056 - protein, 7 aa, Mycobacterium
SKARWDE

SEQ ID NO: 581057 - protein, 22 aa, Mycobacterium
SKASAATKATATAGLAKDTFKP

SEQ ID NO: 581058 - protein, 18 aa, Mycobacterium
SKASAETQSHVDQALLTL

SEQ ID NO: 581059 - protein, 10 aa, Mycobacterium
SKASAGTKAL

SEQ ID NO: 581060 - protein, 10 aa, Mycobacterium
SKASASTKVA

SEQ ID NO: 581061 - protein, 13 aa, Mycobacterium
SKASATTKAAATA

SEQ ID NO: 581062 - protein, 14 aa, Mycobacterium
SKASATTKAAATAL

SEQ ID NO: 581063 - protein, 14 aa, Mycobacterium
SKASATTKAGATAL

SEQ ID NO: 581064 - protein, 10 aa, Mycobacterium
SKASESPNHR

SEQ ID NO: 581065 - protein, 6 aa, Mycobacterium
SKASLN

SEQ ID NO: 581066 - protein, 11 aa, Mycobacterium
SKASTRNKADA

SEQ ID NO: 581067 - protein, 9 aa, Mycobacterium
SKASTTPLD

SEQ ID NO: 581068 - protein, 9 aa, Mycobacterium
SKASVGKPI

SEQ ID NO: 581069 - protein, 14 aa, Mycobacterium
SKASVTTKAAATAL

SEQ ID NO: 581070 - protein, 6 aa, Mycobacterium
SKATFR

SEQ ID NO: 581071 - protein, 8 aa, Mycobacterium
SKATGARI

SEQ ID NO: 581072 - protein, 9 aa, Mycobacterium
SKATGARIT

SEQ ID NO: 581073 - protein, 9 aa, Mycobacterium
SKATKVEEN

SEQ ID NO: 581074 - protein, 14 aa, Mycobacterium
SKATNPHAAQASIT

SEQ ID NO: 581075 - protein, 8 aa, Mycobacterium
SKATPSQL

SEQ ID NO: 581076 - protein, 6 aa, Mycobacterium
SKATVT

SEQ ID NO: 581077 - protein, 4 aa, Mycobacterium
SKDA

SEQ ID NO: 581078 - protein, 10 aa, Mycobacterium
SKDAARIEGS

SEQ ID NO: 581079 - protein, 11 aa, Mycobacterium
SKDAGGDGQLR

SEQ ID NO: 581080 - protein, 18 aa, Mycobacterium
SKDAVGSGTAAGSAGAAG

SEQ ID NO: 581081 - protein, 7 aa, Mycobacterium
SKDDDSY

SEQ ID NO: 581082 - protein, 10 aa, Mycobacterium
SKDDINAKVA

SEQ ID NO: 581083 - protein, 19 aa, Mycobacterium
SKDEAALAAPVGPAEGPWA

SEQ ID NO: 581084 - protein, 13 aa, Mycobacterium
SKDEARAELASEP

SEQ ID NO: 581085 - protein, 8 aa, Mycobacterium
SKDELDSA

SEQ ID NO: 581086 - protein, 9 aa, Mycobacterium
SKDERARAA

SEQ ID NO: 581087 - protein, 8 aa, Mycobacterium
SKDESREK

SEQ ID NO: 581088 - protein, 4 aa, Mycobacterium
SKDG

SEQ ID NO: 581089 - protein, 6 aa, Mycobacterium
SKDGAM

SEQ ID NO: 581090 - protein, 7 aa, Mycobacterium
SKDGLGA

SEQ ID NO: 581091 - protein, 8 aa, Mycobacterium
SKDGLRQA

SEQ ID NO: 581092 - protein, 10 aa, Mycobacterium
SKDGNTQELK

SEQ ID NO: 581093 - protein, 9 aa, Mycobacterium
SKDGQESEL

SEQ ID NO: 581094 - protein, 7 aa, Mycobacterium
SKDGQPE

SEQ ID NO: 581095 - protein, 7 aa, Mycobacterium
SKDGRRN

SEQ ID NO: 581096 - protein, 9 aa, Mycobacterium
SKDGTLRGP

SEQ ID NO: 581097 - protein, 7 aa, Mycobacterium
SKDGTPI

SEQ ID NO: 581098 - protein, 12 aa, Mycobacterium
SKDPYGTYAPAS

SEQ ID NO: 581099 - protein, 6 aa, Mycobacterium
SKDQAA

SEQ ID NO: 581100 - protein, 13 aa, Mycobacterium
SKDQAREELANEP

SEQ ID NO: 581101 - protein, 7 aa, Mycobacterium
SKDQVTS

SEQ ID NO: 581102 - protein, 4 aa, Mycobacterium
SKDR

SEQ ID NO: 581103 - protein, 7 aa, Mycobacterium
SKDRIAN

SEQ ID NO: 581104 - protein, 9 aa, Mycobacterium
SKDRPDTLA

SEQ ID NO: 581105 - protein, 8 aa, Mycobacterium
SKDRPGLG

SEQ ID NO: 581106 - protein, 20 aa, Mycobacterium
SKDRSNKKEIKQVKPTHADV

SEQ ID NO: 581107 - protein, 17 aa, Mycobacterium
SKDRSTKKDVKQVKPTF

SEQ ID NO: 581108 - protein, 9 aa, Mycobacterium
SKDSATPVN

SEQ ID NO: 581109 - protein, 9 aa, Mycobacterium
SKDTERAKK

SEQ ID NO: 581110 - protein, 6 aa, Mycobacterium
SKDTRF

SEQ ID NO: 581111 - protein, 6 aa, Mycobacterium
SKDYEG

SEQ ID NO: 581112 - protein, 6 aa, Mycobacterium
SKEADA

SEQ ID NO: 581113 - protein, 6 aa, Mycobacterium
SKECYS

SEQ ID NO: 581114 - protein, 12 aa, Mycobacterium
SKEEDEASKQRL

SEQ ID NO: 581115 - protein, 7 aa, Mycobacterium
SKEFTPG

SEQ ID NO: 581116 - protein, 4 aa, Mycobacterium
SKEG

SEQ ID NO: 581117 - protein, 7 aa, Mycobacterium
SKEGKAV

SEQ ID NO: 581118 - protein, 8 aa, Mycobacterium
SKEGKTVD

SEQ ID NO: 581119 - protein, 6 aa, Mycobacterium
SKEGQL

SEQ ID NO: 581120 - protein, 9 aa, Mycobacterium
SKEISPIAK

SEQ ID NO: 581121 - protein, 18 aa, Mycobacterium
SKELGEAQAVGGPATAER

SEQ ID NO: 581122 - protein, 7 aa, Mycobacterium
SKENRRS

SEQ ID NO: 581123 - protein, 7 aa, Mycobacterium
SKEPGLY

SEQ ID NO: 581124 - protein, 10 aa, Mycobacterium
SKEPRKGDYK

SEQ ID NO: 581125 - protein, 11 aa, Mycobacterium
SKEQADSGGNM

SEQ ID NO: 581126 - protein, 5 aa, Mycobacterium
SKEQL

SEQ ID NO: 581127 - protein, 7 aa, Mycobacterium
SKERSYC

SEQ ID NO: 581128 - protein, 7 aa, Mycobacterium
SKESEGN

SEQ ID NO: 581129 - protein, 7 aa, Mycobacterium
SKESRRS

SEQ ID NO: 581130 - protein, 9 aa, Mycobacterium
SKESTRSEL

SEQ ID NO: 581131 - protein, 8 aa, Mycobacterium
SKESTRTE

SEQ ID NO: 581132 - protein, 11 aa, Mycobacterium
SKETAADEAQR

SEQ ID NO: 581133 - protein, 6 aa, Mycobacterium
SKETGV

SEQ ID NO: 581134 - protein, 10 aa, Mycobacterium
SKETGVSASD

SEQ ID NO: 581135 - protein, 8 aa, Mycobacterium
SKETNDQA

SEQ ID NO: 581136 - protein, 4 aa, Mycobacterium
SKFD

SEQ ID NO: 581137 - protein, 7 aa, Mycobacterium
SKFGASP

SEQ ID NO: 581138 - protein, 13 aa, Mycobacterium
SKFGGTTAYSGGG

SEQ ID NO: 581139 - protein, 10 aa, Mycobacterium
SKFSRPNDRR

SEQ ID NO: 581140 - protein, 5 aa, Mycobacterium
SKFST

SEQ ID NO: 581141 - protein, 7 aa, Mycobacterium
SKFTETD

SEQ ID NO: 581142 - protein, 5 aa, Mycobacterium
SKFYS

SEQ ID NO: 581143 - protein, 6 aa, Mycobacterium
SKGAAA

SEQ ID NO: 581144 - protein, 8 aa, Mycobacterium
SKGADEVR

SEQ ID NO: 581145 - protein, 12 aa, Mycobacterium
SKGAGTPGSLPD

SEQ ID NO: 581146 - protein, 15 aa, Mycobacterium
SKGASDKGSGAGQYF

SEQ ID NO: 581147 - protein, 10 aa, Mycobacterium
SKGASDSEIK

SEQ ID NO: 581148 - protein, 11 aa, Mycobacterium
SKGASDSEIKR

SEQ ID NO: 581149 - protein, 11 aa, Mycobacterium
SKGASDSELKR

SEQ ID NO: 581150 - protein, 15 aa, Mycobacterium
SKGDKPKVVPSDSQL

SEQ ID NO: 581151 - protein, 4 aa, Mycobacterium
SKGE

SEQ ID NO: 581152 - protein, 5 aa, Mycobacterium
SKGEL

SEQ ID NO: 581153 - protein, 8 aa, Mycobacterium
SKGELTAI

SEQ ID NO: 581154 - protein, 10 aa, Mycobacterium
SKGESAQVAA

SEQ ID NO: 581155 - protein, 8 aa, Mycobacterium
SKGGADKN

SEQ ID NO: 581156 - protein, 9 aa, Mycobacterium
SKGGADTHP

SEQ ID NO: 581157 - protein, 8 aa, Mycobacterium
SKGGAPEH

SEQ ID NO: 581158 - protein, 9 aa, Mycobacterium
SKGGDPKHP

SEQ ID NO: 581159 - protein, 10 aa, Mycobacterium
SKGGDPRAPG

SEQ ID NO: 581160 - protein, 10 aa, Mycobacterium
SKGGEPKAPG

SEQ ID NO: 581161 - protein, 6 aa, Mycobacterium
SKGGQK

SEQ ID NO: 581162 - protein, 8 aa, Mycobacterium
SKGGSAKN

SEQ ID NO: 581163 - protein, 8 aa, Mycobacterium
SKGGSDKH

SEQ ID NO: 581164 - protein, 9 aa, Mycobacterium
SKGGSDKNP

SEQ ID NO: 581165 - protein, 10 aa, Mycobacterium
SKGGSHRRLG

SEQ ID NO: 581166 - protein, 10 aa, Mycobacterium
SKGGSSDHPD

SEQ ID NO: 581167 - protein, 5 aa, Mycobacterium
SKGGT

SEQ ID NO: 581168 - protein, 6 aa, Mycobacterium
SKGGYE

SEQ ID NO: 581169 - protein, 14 aa, Mycobacterium
SKGGYRNDSRLARR

SEQ ID NO: 581170 - protein, 4 aa, Mycobacterium
SKGI

SEQ ID NO: 581171 - protein, 6 aa, Mycobacterium
SKGIDA

SEQ ID NO: 581172 - protein, 6 aa, Mycobacterium
SKGIGR

SEQ ID NO: 581173 - protein, 7 aa, Mycobacterium
SKGIGRA

SEQ ID NO: 581174 - protein, 12 aa, Mycobacterium
SKGIGSPGSVPD

SEQ ID NO: 581175 - protein, 9 aa, Mycobacterium
SKGKRSTTR

SEQ ID NO: 581176 - protein, 23 aa, Mycobacterium
SKGKTSRQAHRDLPDSSSNGTLL

SEQ ID NO: 581177 - protein, 4 aa, Mycobacterium
SKGL

SEQ ID NO: 581178 - protein, 7 aa, Mycobacterium
SKGLPDG

SEQ ID NO: 581179 - protein, 9 aa, Mycobacterium
SKGLPPIGS

SEQ ID NO: 581180 - protein, 13 aa, Mycobacterium
SKGPQGRRLGKTT

SEQ ID NO: 581181 - protein, 8 aa, Mycobacterium
SKGPQVSQ

SEQ ID NO: 581182 - protein, 4 aa, Mycobacterium
SKGR

SEQ ID NO: 581183 - protein, 11 aa, Mycobacterium
SKGRQTRQAIE

SEQ ID NO: 581184 - protein, 8 aa, Mycobacterium
SKGRSAAL

SEQ ID NO: 581185 - protein, 8 aa, Mycobacterium
SKGRSAQV

SEQ ID NO: 581186 - protein, 8 aa, Mycobacterium
SKGTFKTQ

SEQ ID NO: 581187 - protein, 12 aa, Mycobacterium
SKGVAPRPSPVG

SEQ ID NO: 581188 - protein, 5 aa, Mycobacterium
SKGVE

SEQ ID NO: 581189 - protein, 7 aa, Mycobacterium
SKGVQEP

SEQ ID NO: 581190 - protein, 6 aa, Mycobacterium
SKGVTA

SEQ ID NO: 581191 - protein, 4 aa, Mycobacterium
SKGY

SEQ ID NO: 581192 - protein, 7 aa, Mycobacterium
SKGYAGS

SEQ ID NO: 581193 - protein, 6 aa, Mycobacterium
SKGYGI

SEQ ID NO: 581194 - protein, 22 aa, Mycobacterium
SKGYNSEDDPIGAKQRRRQAEG

SEQ ID NO: 581195 - protein, 8 aa, Mycobacterium
SKGYPYDE

SEQ ID NO: 581196 - protein, 12 aa, Mycobacterium
SKHAGAHGGPSG

SEQ ID NO: 581197 - protein, 8 aa, Mycobacterium
SKHAGSWP

SEQ ID NO: 581198 - protein, 7 aa, Mycobacterium
SKHAPDA

SEQ ID NO: 581199 - protein, 6 aa, Mycobacterium
SKHAPG

SEQ ID NO: 581200 - protein, 12 aa, Mycobacterium
SKHAPGDDPSVV

SEQ ID NO: 581201 - protein, 7 aa, Mycobacterium
SKHAPTA

SEQ ID NO: 581202 - protein, 9 aa, Mycobacterium
SKHHGGDDQ

SEQ ID NO: 581203 - protein, 8 aa, Mycobacterium
SKHPQLSD

SEQ ID NO: 581204 - protein, 4 aa, Mycobacterium
SKIE

SEQ ID NO: 581205 - protein, 25 aa, Mycobacterium
SKIEDATAAGAGPTTTVAAAASDDV

SEQ ID NO: 581206 - protein, 10 aa, Mycobacterium
SKIESDPANP

SEQ ID NO: 581207 - protein, 36 aa, Mycobacterium
SKIPPGNRFTTTGRRLGNNAVGAAQEPESTHHPQPA

SEQ ID NO: 581208 - protein, 10 aa, Mycobacterium
SKITGTLPTD

SEQ ID NO: 581209 - protein, 8 aa, Mycobacterium
SKKAARRR

SEQ ID NO: 581210 - protein, 10 aa, Mycobacterium
SKKDKTGASF

SEQ ID NO: 581211 - protein, 8 aa, Mycobacterium
SKKGAKTD

SEQ ID NO: 581212 - protein, 8 aa, Mycobacterium
SKKGNAHG

SEQ ID NO: 581213 - protein, 11 aa, Mycobacterium
SKKGPVPTEPG

SEQ ID NO: 581214 - protein, 13 aa, Mycobacterium
SKKIGTTGRGIGP

SEQ ID NO: 581215 - protein, 6 aa, Mycobacterium
SKKPGI

SEQ ID NO: 581216 - protein, 7 aa, Mycobacterium
SKKPHQV

SEQ ID NO: 581217 - protein, 8 aa, Mycobacterium
SKKPVPEQ

SEQ ID NO: 581218 - protein, 8 aa, Mycobacterium
SKKTDAGS

SEQ ID NO: 581219 - protein, 23 aa, Mycobacterium
SKKYDEKAKDLTDEQLTKAAKKL

SEQ ID NO: 581220 - protein, 7 aa, Mycobacterium
SKLAGEQ

SEQ ID NO: 581221 - protein, 7 aa, Mycobacterium
SKLAGGA

SEQ ID NO: 581222 - protein, 10 aa, Mycobacterium
SKLDDDGRGA

SEQ ID NO: 581223 - protein, 18 aa, Mycobacterium
SKLEGGAAAAGFGATSTV

SEQ ID NO: 581224 - protein, 10 aa, Mycobacterium
SKLEPEDARA

SEQ ID NO: 581225 - protein, 8 aa, Mycobacterium
SKLEPQGE

SEQ ID NO: 581226 - protein, 12 aa, Mycobacterium
SKLESGDLSHTE

SEQ ID NO: 581227 - protein, 7 aa, Mycobacterium
SKLGGVG

SEQ ID NO: 581228 - protein, 4 aa, Mycobacterium
SKLN

SEQ ID NO: 581229 - protein, 15 aa, Mycobacterium
SKLPPRGLTQAASRY

SEQ ID NO: 581230 - protein, 17 aa, Mycobacterium
SKLQKPAGDRVKTDARD

SEQ ID NO: 581231 - protein, 16 aa, Mycobacterium
SKLRGTEEAREQQKRR

SEQ ID NO: 581232 - protein, 9 aa, Mycobacterium
SKLSDDGRA

SEQ ID NO: 581233 - protein, 13 aa, Mycobacterium
SKLSDFDSNRSGG

SEQ ID NO: 581234 - protein, 6 aa, Mycobacterium
SKLSER

SEQ ID NO: 581235 - protein, 18 aa, Mycobacterium
SKLSSALSQTLGNDTVTR

SEQ ID NO: 581236 - protein, 18 aa, Mycobacterium
SKLTSFDSSGDTAGLRNA

SEQ ID NO: 581237 - protein, 4 aa, Mycobacterium
SKME

SEQ ID NO: 581238 - protein, 8 aa, Mycobacterium
SKMPPRGL

SEQ ID NO: 581239 - protein, 9 aa, Mycobacterium
SKNADKVDT

SEQ ID NO: 581240 - protein, 8 aa, Mycobacterium
SKNAQGGC

SEQ ID NO: 581241 - protein, 7 aa, Mycobacterium
SKNDDEL

SEQ ID NO: 581242 - protein, 11 aa, Mycobacterium
SKNDKTEELKA

SEQ ID NO: 581243 - protein, 5 aa, Mycobacterium
SKNGA

SEQ ID NO: 581244 - protein, 7 aa, Mycobacterium
SKNGAAK

SEQ ID NO: 581245 - protein, 7 aa, Mycobacterium
SKNGARR

SEQ ID NO: 581246 - protein, 7 aa, Mycobacterium
SKNGHPI

SEQ ID NO: 581247 - protein, 8 aa, Mycobacterium
SKNSSNSV

SEQ ID NO: 581248 - protein, 8 aa, Mycobacterium
SKNTARRG

SEQ ID NO: 581249 - protein, 8 aa, Mycobacterium
SKPAEDFD

SEQ ID NO: 581250 - protein, 10 aa, Mycobacterium
SKPAESVATT

SEQ ID NO: 581251 - protein, 10 aa, Mycobacterium
SKPARRALAG

SEQ ID NO: 581252 - protein, 8 aa, Mycobacterium
SKPASTLA

SEQ ID NO: 581253 - protein, 8 aa, Mycobacterium
SKPDSGAF

SEQ ID NO: 581254 - protein, 6 aa, Mycobacterium
SKPFAD

SEQ ID NO: 581255 - protein, 7 aa, Mycobacterium
SKPGGKV

SEQ ID NO: 581256 - protein, 10 aa, Mycobacterium
SKPGPDGVAP

SEQ ID NO: 581257 - protein, 10 aa, Mycobacterium
SKPGQTIPGV

SEQ ID NO: 581258 - protein, 7 aa, Mycobacterium
SKPGTVI

SEQ ID NO: 581259 - protein, 20 aa, Mycobacterium
SKPHDSVSKAADLLEAKASH

SEQ ID NO: 581260 - protein, 6 aa, Mycobacterium
SKPITG

SEQ ID NO: 581261 - protein, 15 aa, Mycobacterium
SKPKRRSSPSSRLGS

SEQ ID NO: 581262 - protein, 4 aa, Mycobacterium
SKPL

SEQ ID NO: 581263 - protein, 9 aa, Mycobacterium
SKPLPEGMR

SEQ ID NO: 581264 - protein, 5 aa, Mycobacterium
SKPLR

SEQ ID NO: 581265 - protein, 4 aa, Mycobacterium
SKPN

SEQ ID NO: 581266 - protein, 7 aa, Mycobacterium
SKPNLAA

SEQ ID NO: 581267 - protein, 7 aa, Mycobacterium
SKPNNAR

SEQ ID NO: 581268 - protein, 12 aa, Mycobacterium
SKPNPKTATNAG

SEQ ID NO: 581269 - protein, 12 aa, Mycobacterium
SKPNPRTATNES

SEQ ID NO: 581270 - protein, 7 aa, Mycobacterium
SKPNTAR

SEQ ID NO: 581271 - protein, 8 aa, Mycobacterium
SKPPKLGR

SEQ ID NO: 581272 - protein, 8 aa, Mycobacterium
SKPPKPAV

SEQ ID NO: 581273 - protein, 10 aa, Mycobacterium
SKPPRPLEET

SEQ ID NO: 581274 - protein, 17 aa, Mycobacterium
SKPPRPLEETEIPAGGI

SEQ ID NO: 581275 - protein, 5 aa, Mycobacterium
SKPQL

SEQ ID NO: 581276 - protein, 12 aa, Mycobacterium
SKPRPDFTPNPE

SEQ ID NO: 581277 - protein, 12 aa, Mycobacterium
SKPRPDYVPNPE

SEQ ID NO: 581278 - protein, 9 aa, Mycobacterium
SKPRSGKDV

SEQ ID NO: 581279 - protein, 6 aa, Mycobacterium
SKPRVK

SEQ ID NO: 581280 - protein, 4 aa, Mycobacterium
SKPS

SEQ ID NO: 581281 - protein, 18 aa, Mycobacterium
SKPSGPIDPGVRGPDQPA

SEQ ID NO: 581282 - protein, 6 aa, Mycobacterium
SKPSLR

SEQ ID NO: 581283 - protein, 8 aa, Mycobacterium
SKPSTETV

SEQ ID NO: 581284 - protein, 10 aa, Mycobacterium
SKPSTLTTGE

SEQ ID NO: 581285 - protein, 8 aa, Mycobacterium
SKPTGTIT

SEQ ID NO: 581286 - protein, 7 aa, Mycobacterium
SKPTLPN

SEQ ID NO: 581287 - protein, 4 aa, Mycobacterium
SKPV

SEQ ID NO: 581288 - protein, 5 aa, Mycobacterium
SKPYP

SEQ ID NO: 581289 - protein, 7 aa, Mycobacterium
SKQADAY

SEQ ID NO: 581290 - protein, 7 aa, Mycobacterium
SKQAGAT

SEQ ID NO: 581291 - protein, 16 aa, Mycobacterium
SKQAGHKPIFVLDASG

SEQ ID NO: 581292 - protein, 13 aa, Mycobacterium
SKQAIGRATNNVA

SEQ ID NO: 581293 - protein, 6 aa, Mycobacterium
SKQDAT

SEQ ID NO: 581294 - protein, 20 aa, Mycobacterium
SKQDPLKPQLPPSAQAAGQV

SEQ ID NO: 581295 - protein, 12 aa, Mycobacterium
SKQGHGEPNPTW

SEQ ID NO: 581296 - protein, 8 aa, Mycobacterium
SKQGKLPA

SEQ ID NO: 581297 - protein, 12 aa, Mycobacterium
SKQKAGAKDHSP

SEQ ID NO: 581298 - protein, 9 aa, Mycobacterium
SKQMPPTSF

SEQ ID NO: 581299 - protein, 24 aa, Mycobacterium
SKQPGNPAASGAGKPDDRTPPEQR

SEQ ID NO: 581300 - protein, 6 aa, Mycobacterium
SKQPQP

SEQ ID NO: 581301 - protein, 10 aa, Mycobacterium
SKQQAGPATL

SEQ ID NO: 581302 - protein, 7 aa, Mycobacterium
SKQQREA

SEQ ID NO: 581303 - protein, 11 aa, Mycobacterium
SKQRSPRSSTA

SEQ ID NO: 581304 - protein, 9 aa, Mycobacterium
SKQSGAEKN

SEQ ID NO: 581305 - protein, 9 aa, Mycobacterium
SKQTAAPSI

SEQ ID NO: 581306 - protein, 4 aa, Mycobacterium
SKQV

SEQ ID NO: 581307 - protein, 5 aa, Mycobacterium
SKQVT

SEQ ID NO: 581308 - protein, 9 aa, Mycobacterium
SKRAATTAL

SEQ ID NO: 581309 - protein, 7 aa, Mycobacterium
SKRADHN

SEQ ID NO: 581310 - protein, 10 aa, Mycobacterium
SKRAGGPAQY

SEQ ID NO: 581311 - protein, 9 aa, Mycobacterium
SKRARAERL

SEQ ID NO: 581312 - protein, 11 aa, Mycobacterium
SKRDPSMAKTA

SEQ ID NO: 581313 - protein, 9 aa, Mycobacterium
SKRENPTDD

SEQ ID NO: 581314 - protein, 27 aa, Mycobacterium
SKRGEAMSAPFSAPRTSFNSTITSRRN

SEQ ID NO: 581315 - protein, 52 aa, Mycobacterium
SKRGEAPDVDSPEAIQARKKEAERKARHERSKRIAAQRKAAEEPVEIPERSD

SEQ ID NO: 581316 - protein, 8 aa, Mycobacterium
SKRGGPPV

SEQ ID NO: 581317 - protein, 9 aa, Mycobacterium
SKRIPPTRG

SEQ ID NO: 581318 - protein, 8 aa, Mycobacterium
SKRPDQVR

SEQ ID NO: 581319 - protein, 8 aa, Mycobacterium
SKRPLGDG

SEQ ID NO: 581320 - protein, 7 aa, Mycobacterium
SKRPLPS

SEQ ID NO: 581321 - protein, 9 aa, Mycobacterium
SKRPRGSQL

SEQ ID NO: 581322 - protein, 17 aa, Mycobacterium
SKRPTDLATKQAAASVG

SEQ ID NO: 581323 - protein, 8 aa, Mycobacterium
SKRRNDAE

SEQ ID NO: 581324 - protein, 19 aa, Mycobacterium
SKRRPGATAPRIMPRGVER

SEQ ID NO: 581325 - protein, 16 aa, Mycobacterium
SKRRTRDMIATLATEV

SEQ ID NO: 581326 - protein, 16 aa, Mycobacterium
SKRRTREMIASLAAEL

SEQ ID NO: 581327 - protein, 9 aa, Mycobacterium
SKRRVDDTV

SEQ ID NO: 581328 - protein, 4 aa, Mycobacterium
SKRS

SEQ ID NO: 581329 - protein, 8 aa, Mycobacterium
SKRSKRMT

SEQ ID NO: 581330 - protein, 9 aa, Mycobacterium
SKRSKRMTA

SEQ ID NO: 581331 - protein, 11 aa, Mycobacterium
SKRSPAEVARH

SEQ ID NO: 581332 - protein, 8 aa, Mycobacterium
SKRSRKEK

SEQ ID NO: 581333 - protein, 6 aa, Mycobacterium
SKRTGA

SEQ ID NO: 581334 - protein, 7 aa, Mycobacterium
SKRTSQR

SEQ ID NO: 581335 - protein, 8 aa, Mycobacterium
SKRTSSDA

SEQ ID NO: 581336 - protein, 8 aa, Mycobacterium
SKSAHPDV

SEQ ID NO: 581337 - protein, 6 aa, Mycobacterium
SKSAPI

SEQ ID NO: 581338 - protein, 18 aa, Mycobacterium
SKSARARQKRKDHPSGVG

SEQ ID NO: 581339 - protein, 9 aa, Mycobacterium
SKSASTPAG

SEQ ID NO: 581340 - protein, 10 aa, Mycobacterium
SKSAVGDVPD

SEQ ID NO: 581341 - protein, 8 aa, Mycobacterium
SKSDLDAR

SEQ ID NO: 581342 - protein, 8 aa, Mycobacterium
SKSDPQFA

SEQ ID NO: 581343 - protein, 7 aa, Mycobacterium
SKSEFQA

SEQ ID NO: 581344 - protein, 7 aa, Mycobacterium
SKSEPIA

SEQ ID NO: 581345 - protein, 6 aa, Mycobacterium
SKSFRG

SEQ ID NO: 581346 - protein, 9 aa, Mycobacterium
SKSGLAPES

SEQ ID NO: 581347 - protein, 10 aa, Mycobacterium
SKSGLAQPVD

SEQ ID NO: 581348 - protein, 7 aa, Mycobacterium
SKSLGAE

SEQ ID NO: 581349 - protein, 12 aa, Mycobacterium
SKSLMDTATKGL

SEQ ID NO: 581350 - protein, 4 aa, Mycobacterium
SKSM

SEQ ID NO: 581351 - protein, 11 aa, Mycobacterium
SKSNDARYDTR

SEQ ID NO: 581352 - protein, 8 aa, Mycobacterium
SKSPEPHQ

SEQ ID NO: 581353 - protein, 6 aa, Mycobacterium
SKSPRC

SEQ ID NO: 581354 - protein, 7 aa, Mycobacterium
SKSPRCS

SEQ ID NO: 581355 - protein, 8 aa, Mycobacterium
SKSPRSAF

SEQ ID NO: 581356 - protein, 6 aa, Mycobacterium
SKSPVA

SEQ ID NO: 581357 - protein, 10 aa, Mycobacterium
SKSRASDEYR

SEQ ID NO: 581358 - protein, 21 aa, Mycobacterium
SKSRAVNDTPSEQEATPAALT

SEQ ID NO: 581359 - protein, 20 aa, Mycobacterium
SKSRETDTLASRAGPGDIAR

SEQ ID NO: 581360 - protein, 13 aa, Mycobacterium
SKSRNAVTIPGDL

SEQ ID NO: 581361 - protein, 8 aa, Mycobacterium
SKSSETLG

SEQ ID NO: 581362 - protein, 8 aa, Mycobacterium
SKSSSLAG

SEQ ID NO: 581363 - protein, 8 aa, Mycobacterium
SKSTAELQ

SEQ ID NO: 581364 - protein, 11 aa, Mycobacterium
SKSTSEGAVDA

SEQ ID NO: 581365 - protein, 6 aa, Mycobacterium
SKSVGA

SEQ ID NO: 581366 - protein, 6 aa, Mycobacterium
SKSVYQ

SEQ ID NO: 581367 - protein, 5 aa, Mycobacterium
SKSYG

SEQ ID NO: 581368 - protein, 19 aa, Mycobacterium
SKTAAELRARAADTGLSRT

SEQ ID NO: 581369 - protein, 6 aa, Mycobacterium
SKTEGR

SEQ ID NO: 581370 - protein, 8 aa, Mycobacterium
SKTFADDP

SEQ ID NO: 581371 - protein, 9 aa, Mycobacterium
SKTGQRRGT

SEQ ID NO: 581372 - protein, 7 aa, Mycobacterium
SKTGRSI

SEQ ID NO: 581373 - protein, 9 aa, Mycobacterium
SKTGSASRA

SEQ ID NO: 581374 - protein, 7 aa, Mycobacterium
SKTGYVR

SEQ ID NO: 581375 - protein, 7 aa, Mycobacterium
SKTHEPL

SEQ ID NO: 581376 - protein, 8 aa, Mycobacterium
SKTIPAES

SEQ ID NO: 581377 - protein, 7 aa, Mycobacterium
SKTLPAS

SEQ ID NO: 581378 - protein, 9 aa, Mycobacterium
SKTNALGTS

SEQ ID NO: 581379 - protein, 8 aa, Mycobacterium
SKTNGGEV

SEQ ID NO: 581380 - protein, 8 aa, Mycobacterium
SKTPAPLE

SEQ ID NO: 581381 - protein, 11 aa, Mycobacterium
SKTPASLRPRR

SEQ ID NO: 581382 - protein, 7 aa, Mycobacterium
SKTPEGY

SEQ ID NO: 581383 - protein, 11 aa, Mycobacterium
SKTPESLRPKR

SEQ ID NO: 581384 - protein, 9 aa, Mycobacterium
SKTPGDRRT

SEQ ID NO: 581385 - protein, 6 aa, Mycobacterium
SKTPIG

SEQ ID NO: 581386 - protein, 6 aa, Mycobacterium
SKTPQR

SEQ ID NO: 581387 - protein, 12 aa, Mycobacterium
SKTQANEKARTE

SEQ ID NO: 581388 - protein, 7 aa, Mycobacterium
SKTRDAE

SEQ ID NO: 581389 - protein, 8 aa, Mycobacterium
SKTRRPSV

SEQ ID NO: 581390 - protein, 12 aa, Mycobacterium
SKTSASPPLPPF

SEQ ID NO: 581391 - protein, 9 aa, Mycobacterium
SKTSSLAGY

SEQ ID NO: 581392 - protein, 121 aa, Mycobacterium
SKTSTTAAKTATAEQKTAVEGTKAAESKATTSKSSPEAEPAKAGATKPATPAEAVTPAEPAKPAEPAKSATPAEPVKAAEPAKPATPADAATPAEPAKPATAADAAAKPVDAAKPAEPKVN

SEQ ID NO: 581393 - protein, 5 aa, Mycobacterium
SKTVS

SEQ ID NO: 581394 - protein, 5 aa, Mycobacterium
SKTYG

SEQ ID NO: 581395 - protein, 5 aa, Mycobacterium
SKTYP

SEQ ID NO: 581396 - protein, 7 aa, Mycobacterium
SKVAEAI

SEQ ID NO: 581397 - protein, 15 aa, Mycobacterium
SKVDPAAPRRDPEEA

SEQ ID NO: 581398 - protein, 19 aa, Mycobacterium
SKVDRRALPAPAATKPLTA

SEQ ID NO: 581399 - protein, 9 aa, Mycobacterium
SKVEPRDRQ

SEQ ID NO: 581400 - protein, 6 aa, Mycobacterium
SKVGPM

SEQ ID NO: 581401 - protein, 6 aa, Mycobacterium
SKVGTV

SEQ ID NO: 581402 - protein, 7 aa, Mycobacterium
SKVPHRD

SEQ ID NO: 581403 - protein, 7 aa, Mycobacterium
SKVPSMA

SEQ ID NO: 581404 - protein, 7 aa, Mycobacterium
SKVPTTD

SEQ ID NO: 581405 - protein, 4 aa, Mycobacterium
SKVQ

SEQ ID NO: 581406 - protein, 6 aa, Mycobacterium
SKVSAG

SEQ ID NO: 581407 - protein, 5 aa, Mycobacterium
SKVSD

SEQ ID NO: 581408 - protein, 13 aa, Mycobacterium
SKVSSSPSSPQTR

SEQ ID NO: 581409 - protein, 11 aa, Mycobacterium
SKWDSTEGYRI

SEQ ID NO: 581410 - protein, 14 aa, Mycobacterium
SKWESAQSPTPHAE

SEQ ID NO: 581411 - protein, 13 aa, Mycobacterium
SKWKPQHSPSPAE

SEQ ID NO: 581412 - protein, 6 aa, Mycobacterium
SKWTDS

SEQ ID NO: 581413 - protein, 16 aa, Mycobacterium
SKWTSSRDLPEPPKET

SEQ ID NO: 581414 - protein, 14 aa, Mycobacterium
SKYGKVTKSYDDHP

SEQ ID NO: 581415 - protein, 14 aa, Mycobacterium
SKYGPVSKSYDDHP

SEQ ID NO: 581416 - protein, 9 aa, Mycobacterium
SKYHGGDDQ

SEQ ID NO: 581417 - protein, 16 aa, Mycobacterium
SKYRSNALAQEKTGEA

SEQ ID NO: 581418 - protein, 10 aa, Mycobacterium
SKYSEDTGSV

SEQ ID NO: 581419 - protein, 4 aa, Mycobacterium
SKYT

SEQ ID NO: 581420 - protein, 7 aa, Mycobacterium
SKYTDNS

SEQ ID NO: 581421 - protein, 8 aa, Mycobacterium
SLAAAEKP

SEQ ID NO: 581422 - protein, 10 aa, Mycobacterium
SLAAAEKPRQ

SEQ ID NO: 581423 - protein, 12 aa, Mycobacterium
SLAAAKSKSALA

SEQ ID NO: 581424 - protein, 8 aa, Mycobacterium
SLAAPATY

SEQ ID NO: 581425 - protein, 26 aa, Mycobacterium
SLAAPGSSTALAAAADPTAPASLASS

SEQ ID NO: 581426 - protein, 10 aa, Mycobacterium
SLAAPPNPVP

SEQ ID NO: 581427 - protein, 8 aa, Mycobacterium
SLAASGPY

SEQ ID NO: 581428 - protein, 9 aa, Mycobacterium
SLAATGVPV

SEQ ID NO: 581429 - protein, 9 aa, Mycobacterium
SLAATKGGN

SEQ ID NO: 581430 - protein, 11 aa, Mycobacterium
SLAATTGVEHA

SEQ ID NO: 581431 - protein, 4 aa, Mycobacterium
SLAD

SEQ ID NO: 581432 - protein, 8 aa, Mycobacterium
SLADAAGE

SEQ ID NO: 581433 - protein, 10 aa, Mycobacterium
SLADDARAAG

SEQ ID NO: 581434 - protein, 6 aa, Mycobacterium
SLADEV

SEQ ID NO: 581435 - protein, 9 aa, Mycobacterium
SLAEAEDAT

SEQ ID NO: 581436 - protein, 5 aa, Mycobacterium
SLAEG

SEQ ID NO: 581437 - protein, 9 aa, Mycobacterium
SLAENEDTI

SEQ ID NO: 581438 - protein, 13 aa, Mycobacterium
SLAEPGDRNPYAG

SEQ ID NO: 581439 - protein, 6 aa, Mycobacterium
SLAERT

SEQ ID NO: 581440 - protein, 8 aa, Mycobacterium
SLAETGTP

SEQ ID NO: 581441 - protein, 5 aa, Mycobacterium
SLAGA

SEQ ID NO: 581442 - protein, 16 aa, Mycobacterium
SLAGADGTARPDQATV

SEQ ID NO: 581443 - protein, 19 aa, Mycobacterium
SLAGDGRAADAARATNQTL

SEQ ID NO: 581444 - protein, 8 aa, Mycobacterium
SLAGGQPV

SEQ ID NO: 581445 - protein, 6 aa, Mycobacterium
SLAGGT

SEQ ID NO: 581446 - protein, 6 aa, Mycobacterium
SLAGPV

SEQ ID NO: 581447 - protein, 8 aa, Mycobacterium
SLAGSALE

SEQ ID NO: 581448 - protein, 7 aa, Mycobacterium
SLAGSAQ

SEQ ID NO: 581449 - protein, 8 aa, Mycobacterium
SLAKNEET

SEQ ID NO: 581450 - protein, 5 aa, Mycobacterium
SLAKR

SEQ ID NO: 581451 - protein, 5 aa, Mycobacterium
SLANG

SEQ ID NO: 581452 - protein, 7 aa, Mycobacterium
SLAPDDD

SEQ ID NO: 581453 - protein, 16 aa, Mycobacterium
SLAPDEVTRRSGLPVS

SEQ ID NO: 581454 - protein, 10 aa, Mycobacterium
SLAPDQDDQR

SEQ ID NO: 581455 - protein, 7 aa, Mycobacterium
SLAPEEV

SEQ ID NO: 581456 - protein, 6 aa, Mycobacterium
SLAPEL

SEQ ID NO: 581457 - protein, 8 aa, Mycobacterium
SLAPGARQ

SEQ ID NO: 581458 - protein, 12 aa, Mycobacterium
SLAPGESNSEIA

SEQ ID NO: 581459 - protein, 7 aa, Mycobacterium
SLAPGSR

SEQ ID NO: 581460 - protein, 10 aa, Mycobacterium
SLAPGTTATT

SEQ ID NO: 581461 - protein, 15 aa, Mycobacterium
SLAPNALAADPSPVE

SEQ ID NO: 581462 - protein, 6 aa, Mycobacterium
SLAPPE

SEQ ID NO: 581463 - protein, 11 aa, Mycobacterium
SLAPRQASPLE

SEQ ID NO: 581464 - protein, 19 aa, Mycobacterium
SLAPTRPHPLAPDHPPANK

SEQ ID NO: 581465 - protein, 5 aa, Mycobacterium
SLAQA

SEQ ID NO: 581466 - protein, 41 aa, Mycobacterium
SLAQGASAGGAAGPGLASSLTGQNDEPERDDSGVELPGQRL

SEQ ID NO: 581467 - protein, 14 aa, Mycobacterium
SLAQGRTPARGSAR

SEQ ID NO: 581468 - protein, 6 aa, Mycobacterium
SLARAG

SEQ ID NO: 581469 - protein, 6 aa, Mycobacterium
SLARGQ

SEQ ID NO: 581470 - protein, 7 aa, Mycobacterium
SLARPGD

SEQ ID NO: 581471 - protein, 23 aa, Mycobacterium
SLARPPTQPPPAVAPCPGPTGER

SEQ ID NO: 581472 - protein, 16 aa, Mycobacterium
SLARQDADISSADKLS

SEQ ID NO: 581473 - protein, 6 aa, Mycobacterium
SLARRA

SEQ ID NO: 581474 - protein, 10 aa, Mycobacterium
SLARSGAIAP

SEQ ID NO: 581475 - protein, 10 aa, Mycobacterium
SLASAGAATA

SEQ ID NO: 581476 - protein, 9 aa, Mycobacterium
SLASATTDV

SEQ ID NO: 581477 - protein, 12 aa, Mycobacterium
SLASEALAEPDI

SEQ ID NO: 581478 - protein, 8 aa, Mycobacterium
SLASETGV

SEQ ID NO: 581479 - protein, 6 aa, Mycobacterium
SLASGE

SEQ ID NO: 581480 - protein, 8 aa, Mycobacterium
SLASRNSK

SEQ ID NO: 581481 - protein, 5 aa, Mycobacterium
SLATA

SEQ ID NO: 581482 - protein, 14 aa, Mycobacterium
SLATAARALSDPTR

SEQ ID NO: 581483 - protein, 5 aa, Mycobacterium
SLATD

SEQ ID NO: 581484 - protein, 9 aa, Mycobacterium
SLATDRGQV

SEQ ID NO: 581485 - protein, 5 aa, Mycobacterium
SLATE

SEQ ID NO: 581486 - protein, 6 aa, Mycobacterium
SLATNQ

SEQ ID NO: 581487 - protein, 12 aa, Mycobacterium
SLATRATKVDGG

SEQ ID NO: 581488 - protein, 17 aa, Mycobacterium
SLCPPGTGNASSRGVAV

SEQ ID NO: 581489 - protein, 7 aa, Mycobacterium
SLDADEA

SEQ ID NO: 581490 - protein, 5 aa, Mycobacterium
SLDAE

SEQ ID NO: 581491 - protein, 6 aa, Mycobacterium
SLDAEE

SEQ ID NO: 581492 - protein, 5 aa, Mycobacterium
SLDAS

SEQ ID NO: 581493 - protein, 11 aa, Mycobacterium
SLDDADHLPAP

SEQ ID NO: 581494 - protein, 6 aa, Mycobacterium
SLDDDE

SEQ ID NO: 581495 - protein, 13 aa, Mycobacterium
SLDDEDVQAVERT

SEQ ID NO: 581496 - protein, 11 aa, Mycobacterium
SLDDETKAEID

SEQ ID NO: 581497 - protein, 7 aa, Mycobacterium
SLDDPEM

SEQ ID NO: 581498 - protein, 9 aa, Mycobacterium
SLDDPGCPV

SEQ ID NO: 581499 - protein, 8 aa, Mycobacterium
SLDDPGGM

SEQ ID NO: 581500 - protein, 8 aa, Mycobacterium
SLDDTSKA

SEQ ID NO: 581501 - protein, 16 aa, Mycobacterium
SLDEPGGHGMPSSTPI

SEQ ID NO: 581502 - protein, 37 aa, Mycobacterium
SLDEQRRRRERANAEKKASALRTQAAKMGAKATKAVA

SEQ ID NO: 581503 - protein, 12 aa, Mycobacterium
SLDERPKDTATV

SEQ ID NO: 581504 - protein, 7 aa, Mycobacterium
SLDESRR

SEQ ID NO: 581505 - protein, 5 aa, Mycobacterium
SLDET

SEQ ID NO: 581506 - protein, 4 aa, Mycobacterium
SLDG

SEQ ID NO: 581507 - protein, 10 aa, Mycobacterium
SLDGDADGHV

SEQ ID NO: 581508 - protein, 13 aa, Mycobacterium
SLDGGTLPRSTRE

SEQ ID NO: 581509 - protein, 5 aa, Mycobacterium
SLDGR

SEQ ID NO: 581510 - protein, 9 aa, Mycobacterium
SLDGRADPG

SEQ ID NO: 581511 - protein, 25 aa, Mycobacterium
SLDGRDSAAGPSITEPAAPEETDAE

SEQ ID NO: 581512 - protein, 6 aa, Mycobacterium
SLDGSK

SEQ ID NO: 581513 - protein, 8 aa, Mycobacterium
SLDGSPDL

SEQ ID NO: 581514 - protein, 5 aa, Mycobacterium
SLDGT

SEQ ID NO: 581515 - protein, 9 aa, Mycobacterium
SLDGTLPGN

SEQ ID NO: 581516 - protein, 7 aa, Mycobacterium
SLDGYDG

SEQ ID NO: 581517 - protein, 7 aa, Mycobacterium
SLDNDEN

SEQ ID NO: 581518 - protein, 8 aa, Mycobacterium
SLDNERQV

SEQ ID NO: 581519 - protein, 4 aa, Mycobacterium
SLDP

SEQ ID NO: 581520 - protein, 13 aa, Mycobacterium
SLDPADRAAAERD

SEQ ID NO: 581521 - protein, 16 aa, Mycobacterium
SLDPAQVEALRAFAKA

SEQ ID NO: 581522 - protein, 5 aa, Mycobacterium
SLDPD

SEQ ID NO: 581523 - protein, 8 aa, Mycobacterium
SLDPETRS

SEQ ID NO: 581524 - protein, 8 aa, Mycobacterium
SLDPETRT

SEQ ID NO: 581525 - protein, 9 aa, Mycobacterium
SLDPHDDAQ

SEQ ID NO: 581526 - protein, 8 aa, Mycobacterium
SLDPQTRT

SEQ ID NO: 581527 - protein, 8 aa, Mycobacterium
SLDPRSGA

SEQ ID NO: 581528 - protein, 9 aa, Mycobacterium
SLDPTTRAG

SEQ ID NO: 581529 - protein, 4 aa, Mycobacterium
SLDQ

SEQ ID NO: 581530 - protein, 5 aa, Mycobacterium
SLDRR

SEQ ID NO: 581531 - protein, 9 aa, Mycobacterium
SLDSGEARK

SEQ ID NO: 581532 - protein, 6 aa, Mycobacterium
SLDSGP

SEQ ID NO: 581533 - protein, 7 aa, Mycobacterium
SLDSGPV

SEQ ID NO: 581534 - protein, 11 aa, Mycobacterium
SLDSKAEQPVT

SEQ ID NO: 581535 - protein, 5 aa, Mycobacterium
SLDSL

SEQ ID NO: 581536 - protein, 16 aa, Mycobacterium
SLDSPVSTTCPAPQES

SEQ ID NO: 581537 - protein, 4 aa, Mycobacterium
SLDT

SEQ ID NO: 581538 - protein, 7 aa, Mycobacterium
SLDTATA

SEQ ID NO: 581539 - protein, 5 aa, Mycobacterium
SLDTR

SEQ ID NO: 581540 - protein, 5 aa, Mycobacterium
SLDTS

SEQ ID NO: 581541 - protein, 4 aa, Mycobacterium
SLDV

SEQ ID NO: 581542 - protein, 11 aa, Mycobacterium
SLEDADNLPAP

SEQ ID NO: 581543 - protein, 19 aa, Mycobacterium
SLEDDGSGETDEDQKLRHE

SEQ ID NO: 581544 - protein, 10 aa, Mycobacterium
SLEDGSESLN

SEQ ID NO: 581545 - protein, 10 aa, Mycobacterium
SLEDPDDDRR

SEQ ID NO: 581546 - protein, 8 aa, Mycobacterium
SLEDSGTP

SEQ ID NO: 581547 - protein, 10 aa, Mycobacterium
SLEEEAQRSL

SEQ ID NO: 581548 - protein, 6 aa, Mycobacterium
SLEENQ

SEQ ID NO: 581549 - protein, 4 aa, Mycobacterium
SLEL

SEQ ID NO: 581550 - protein, 12 aa, Mycobacterium
SLEPAEGPDAAD

SEQ ID NO: 581551 - protein, 7 aa, Mycobacterium
SLEPGDC

SEQ ID NO: 581552 - protein, 15 aa, Mycobacterium
SLEPRPPSESLSPDA

SEQ ID NO: 581553 - protein, 8 aa, Mycobacterium
SLEPTDPL

SEQ ID NO: 581554 - protein, 10 aa, Mycobacterium
SLEQRTSNLP

SEQ ID NO: 581555 - protein, 5 aa, Mycobacterium
SLESA

SEQ ID NO: 581556 - protein, 13 aa, Mycobacterium
SLESAAGGYSSAV

SEQ ID NO: 581557 - protein, 6 aa, Mycobacterium
SLESPE

SEQ ID NO: 581558 - protein, 9 aa, Mycobacterium
SLESPEGKR

SEQ ID NO: 581559 - protein, 8 aa, Mycobacterium
SLESRGAA

SEQ ID NO: 581560 - protein, 4 aa, Mycobacterium
SLET

SEQ ID NO: 581561 - protein, 5 aa, Mycobacterium
SLGAA

SEQ ID NO: 581562 - protein, 16 aa, Mycobacterium
SLGAAARQHGISQPAA

SEQ ID NO: 581563 - protein, 17 aa, Mycobacterium
SLGAAGATVDDDKVPQS

SEQ ID NO: 581564 - protein, 11 aa, Mycobacterium
SLGADDPHYRQ

SEQ ID NO: 581565 - protein, 13 aa, Mycobacterium
SLGAEPKADVRPV

SEQ ID NO: 581566 - protein, 5 aa, Mycobacterium
SLGAG

SEQ ID NO: 581567 - protein, 8 aa, Mycobacterium
SLGAGDSR

SEQ ID NO: 581568 - protein, 5 aa, Mycobacterium
SLGAR

SEQ ID NO: 581569 - protein, 61 aa, Mycobacterium
SLGASGWDAAPAGYTRQASSGAAFGSATALNTKNITTTDGSVAQTGGQSGQSYAAATVEII

SEQ ID NO: 581570 - protein, 6 aa, Mycobacterium
SLGDDQ

SEQ ID NO: 581571 - protein, 5 aa, Mycobacterium
SLGDG

SEQ ID NO: 581572 - protein, 28 aa, Mycobacterium
SLGDNDALQPPEVASTSDDALAPPEVGA

SEQ ID NO: 581573 - protein, 8 aa, Mycobacterium
SLGDPPEA

SEQ ID NO: 581574 - protein, 9 aa, Mycobacterium
SLGDQARRS

SEQ ID NO: 581575 - protein, 7 aa, Mycobacterium
SLGDQGL

SEQ ID NO: 581576 - protein, 9 aa, Mycobacterium
SLGDQSDQF

SEQ ID NO: 581577 - protein, 15 aa, Mycobacterium
SLGDTEADRHEARST

SEQ ID NO: 581578 - protein, 6 aa, Mycobacterium
SLGEAA

SEQ ID NO: 581579 - protein, 7 aa, Mycobacterium
SLGEAKG

SEQ ID NO: 581580 - protein, 12 aa, Mycobacterium
SLGEDDSYSLAT

SEQ ID NO: 581581 - protein, 5 aa, Mycobacterium
SLGEP

SEQ ID NO: 581582 - protein, 8 aa, Mycobacterium
SLGEPASA

SEQ ID NO: 581583 - protein, 7 aa, Mycobacterium
SLGEQAK

SEQ ID NO: 581584 - protein, 5 aa, Mycobacterium
SLGES

SEQ ID NO: 581585 - protein, 8 aa, Mycobacterium
SLGESATY

SEQ ID NO: 581586 - protein, 8 aa, Mycobacterium
SLGEVSPE

SEQ ID NO: 581587 - protein, 11 aa, Mycobacterium
SLGGAGAGARE

SEQ ID NO: 581588 - protein, 11 aa, Mycobacterium
SLGGAGASARE

SEQ ID NO: 581589 - protein, 12 aa, Mycobacterium
SLGGAGASAREA

SEQ ID NO: 581590 - protein, 6 aa, Mycobacterium
SLGGAT

SEQ ID NO: 581591 - protein, 19 aa, Mycobacterium
SLGGAVGASRAAVDSGYYP

SEQ ID NO: 581592 - protein, 12 aa, Mycobacterium
SLGGAVREGHRP

SEQ ID NO: 581593 - protein, 11 aa, Mycobacterium
SLGGDNPGSTP

SEQ ID NO: 581594 - protein, 9 aa, Mycobacterium
SLGGDVRSD

SEQ ID NO: 581595 - protein, 8 aa, Mycobacterium
SLGGEKSS

SEQ ID NO: 581596 - protein, 9 aa, Mycobacterium
SLGGEKSTE

SEQ ID NO: 581597 - protein, 8 aa, Mycobacterium
SLGGEQSG

SEQ ID NO: 581598 - protein, 8 aa, Mycobacterium
SLGGESQS

SEQ ID NO: 581599 - protein, 5 aa, Mycobacterium
SLGGG

SEQ ID NO: 581600 - protein, 12 aa, Mycobacterium
SLGGGGGAANGV

SEQ ID NO: 581601 - protein, 12 aa, Mycobacterium
SLGGGGGGLGGM

SEQ ID NO: 581602 - protein, 15 aa, Mycobacterium
SLGGGKSVAPDGGGD

SEQ ID NO: 581603 - protein, 7 aa, Mycobacterium
SLGGKGI

SEQ ID NO: 581604 - protein, 15 aa, Mycobacterium
SLGGSSSRLADGTYR

SEQ ID NO: 581605 - protein, 6 aa, Mycobacterium
SLGGVR

SEQ ID NO: 581606 - protein, 5 aa, Mycobacterium
SLGHE

SEQ ID NO: 581607 - protein, 9 aa, Mycobacterium
SLGKRGRSR

SEQ ID NO: 581608 - protein, 9 aa, Mycobacterium
SLGLGGDPR

SEQ ID NO: 581609 - protein, 10 aa, Mycobacterium
SLGNKNNTVT

SEQ ID NO: 581610 - protein, 8 aa, Mycobacterium
SLGNSGFK

SEQ ID NO: 581611 - protein, 9 aa, Mycobacterium
SLGNSGIKN

SEQ ID NO: 581612 - protein, 11 aa, Mycobacterium
SLGNSRNHAAP

SEQ ID NO: 581613 - protein, 6 aa, Mycobacterium
SLGPDA

SEQ ID NO: 581614 - protein, 10 aa, Mycobacterium
SLGPDAAANV

SEQ ID NO: 581615 - protein, 6 aa, Mycobacterium
SLGPDG

SEQ ID NO: 581616 - protein, 5 aa, Mycobacterium
SLGPE

SEQ ID NO: 581617 - protein, 8 aa, Mycobacterium
SLGPENTK

SEQ ID NO: 581618 - protein, 13 aa, Mycobacterium
SLGPPDGSIPAGD

SEQ ID NO: 581619 - protein, 7 aa, Mycobacterium
SLGPQGF

SEQ ID NO: 581620 - protein, 5 aa, Mycobacterium
SLGPR

SEQ ID NO: 581621 - protein, 9 aa, Mycobacterium
SLGPRDNDS

SEQ ID NO: 581622 - protein, 7 aa, Mycobacterium
SLGPRSV

SEQ ID NO: 581623 - protein, 5 aa, Mycobacterium
SLGPS

SEQ ID NO: 581624 - protein, 8 aa, Mycobacterium
SLGPSGRI

SEQ ID NO: 581625 - protein, 9 aa, Mycobacterium
SLGPTDNGG

SEQ ID NO: 581626 - protein, 8 aa, Mycobacterium
SLGPTTRF

SEQ ID NO: 581627 - protein, 6 aa, Mycobacterium
SLGQRA

SEQ ID NO: 581628 - protein, 5 aa, Mycobacterium
SLGRA

SEQ ID NO: 581629 - protein, 5 aa, Mycobacterium
SLGRD

SEQ ID NO: 581630 - protein, 9 aa, Mycobacterium
SLGRDRDAV

SEQ ID NO: 581631 - protein, 10 aa, Mycobacterium
SLGRDTAALE

SEQ ID NO: 581632 - protein, 9 aa, Mycobacterium
SLGRPATTM

SEQ ID NO: 581633 - protein, 20 aa, Mycobacterium
SLGSDVADGSFEPLPTDEDV

SEQ ID NO: 581634 - protein, 12 aa, Mycobacterium
SLGSDVADGSFG

SEQ ID NO: 581635 - protein, 9 aa, Mycobacterium
SLGSEGALQ

SEQ ID NO: 581636 - protein, 14 aa, Mycobacterium
SLGSEGLQQETERL

SEQ ID NO: 581637 - protein, 14 aa, Mycobacterium
SLGSPGQYGAKPDV

SEQ ID NO: 581638 - protein, 7 aa, Mycobacterium
SLGSQQD

SEQ ID NO: 581639 - protein, 10 aa, Mycobacterium
SLGSSEPPFL

SEQ ID NO: 581640 - protein, 10 aa, Mycobacterium
SLGSSSDLRV

SEQ ID NO: 581641 - protein, 9 aa, Mycobacterium
SLGSSTTYT

SEQ ID NO: 581642 - protein, 10 aa, Mycobacterium
SLGTAQSSFP

SEQ ID NO: 581643 - protein, 12 aa, Mycobacterium
SLGTDPAELQSR

SEQ ID NO: 581644 - protein, 9 aa, Mycobacterium
SLGTDRDDV

SEQ ID NO: 581645 - protein, 9 aa, Mycobacterium
SLGTNIADP

SEQ ID NO: 581646 - protein, 10 aa, Mycobacterium
SLGTRTGRVA

SEQ ID NO: 581647 - protein, 11 aa, Mycobacterium
SLGTRTGRVAR

SEQ ID NO: 581648 - protein, 7 aa, Mycobacterium
SLGTSER

SEQ ID NO: 581649 - protein, 6 aa, Mycobacterium
SLGTTA

SEQ ID NO: 581650 - protein, 6 aa, Mycobacterium
SLGTTT

SEQ ID NO: 581651 - protein, 16 aa, Mycobacterium
SLGVGARGDYYDQSGA

SEQ ID NO: 581652 - protein, 11 aa, Mycobacterium
SLGYGSAREYR

SEQ ID NO: 581653 - protein, 7 aa, Mycobacterium
SLHARSG

SEQ ID NO: 581654 - protein, 6 aa, Mycobacterium
SLHGDT

SEQ ID NO: 581655 - protein, 4 aa, Mycobacterium
SLHN

SEQ ID NO: 581656 - protein, 5 aa, Mycobacterium
SLHNS

SEQ ID NO: 581657 - protein, 5 aa, Mycobacterium
SLHNT

SEQ ID NO: 581658 - protein, 9 aa, Mycobacterium
SLHPEPGPT

SEQ ID NO: 581659 - protein, 7 aa, Mycobacterium
SLHPPST

SEQ ID NO: 581660 - protein, 15 aa, Mycobacterium
SLHRQDERKAGAPDH

SEQ ID NO: 581661 - protein, 14 aa, Mycobacterium
SLHTPEDEDVPDTG

SEQ ID NO: 581662 - protein, 9 aa, Mycobacterium
SLKAAPGNN

SEQ ID NO: 581663 - protein, 86 aa, Mycobacterium
SLKDPSGSHTGDDKPRDGTQPAGLHDPGDKADKGDKAGTENAGSGSTPPPSAPAAPGQTPTPSTQVQLPDQSVRTAANGALAQAGR

SEQ ID NO: 581664 - protein, 8 aa, Mycobacterium
SLKGNVKD

SEQ ID NO: 581665 - protein, 6 aa, Mycobacterium
SLKGRD

SEQ ID NO: 581666 - protein, 9 aa, Mycobacterium
SLKNSISPD

SEQ ID NO: 581667 - protein, 6 aa, Mycobacterium
SLKPGG

SEQ ID NO: 581668 - protein, 7 aa, Mycobacterium
SLKPGGL

SEQ ID NO: 581669 - protein, 22 aa, Mycobacterium
SLKPKGAKEFGTRTETKNVNSL

SEQ ID NO: 581670 - protein, 5 aa, Mycobacterium
SLKTL

SEQ ID NO: 581671 - protein, 9 aa, Mycobacterium
SLLGNKDRD

SEQ ID NO: 581672 - protein, 7 aa, Mycobacterium
SLLGPDR

SEQ ID NO: 581673 - protein, 8 aa, Mycobacterium
SLLGPDRP

SEQ ID NO: 581674 - protein, 10 aa, Mycobacterium
SLLGSPGQTA

SEQ ID NO: 581675 - protein, 8 aa, Mycobacterium
SLLPGSDA

SEQ ID NO: 581676 - protein, 6 aa, Mycobacterium
SLLPSA

SEQ ID NO: 581677 - protein, 4 aa, Mycobacterium
SLNA

SEQ ID NO: 581678 - protein, 14 aa, Mycobacterium
SLNDAERKAGSDGA

SEQ ID NO: 581679 - protein, 13 aa, Mycobacterium
SLNDAETKAGVGG

SEQ ID NO: 581680 - protein, 7 aa, Mycobacterium
SLNDDEK

SEQ ID NO: 581681 - protein, 6 aa, Mycobacterium
SLNDEE

SEQ ID NO: 581682 - protein, 12 aa, Mycobacterium
SLNEAATDRDGF

SEQ ID NO: 581683 - protein, 15 aa, Mycobacterium
SLNEATSDADGFHHR

SEQ ID NO: 581684 - protein, 6 aa, Mycobacterium
SLNEGI

SEQ ID NO: 581685 - protein, 4 aa, Mycobacterium
SLNG

SEQ ID NO: 581686 - protein, 17 aa, Mycobacterium
SLNGDGIDRSGSATAAA

SEQ ID NO: 581687 - protein, 14 aa, Mycobacterium
SLNGGAAAAADPLS

SEQ ID NO: 581688 - protein, 8 aa, Mycobacterium
SLNGGPQY

SEQ ID NO: 581689 - protein, 14 aa, Mycobacterium
SLNGTQARRDDDGH

SEQ ID NO: 581690 - protein, 8 aa, Mycobacterium
SLNKDGVA

SEQ ID NO: 581691 - protein, 18 aa, Mycobacterium
SLNKSTASRNPDKPTTDF

SEQ ID NO: 581692 - protein, 7 aa, Mycobacterium
SLNNGPQ

SEQ ID NO: 581693 - protein, 14 aa, Mycobacterium
SLNNSQAQADPDGK

SEQ ID NO: 581694 - protein, 4 aa, Mycobacterium
SLNP

SEQ ID NO: 581695 - protein, 12 aa, Mycobacterium
SLNPAKAGAAEI

SEQ ID NO: 581696 - protein, 7 aa, Mycobacterium
SLNPDAS

SEQ ID NO: 581697 - protein, 7 aa, Mycobacterium
SLNPGER

SEQ ID NO: 581698 - protein, 7 aa, Mycobacterium
SLNPPIP

SEQ ID NO: 581699 - protein, 13 aa, Mycobacterium
SLNPRARVGTTIG

SEQ ID NO: 581700 - protein, 13 aa, Mycobacterium
SLNPSSAAAVSAG

SEQ ID NO: 581701 - protein, 13 aa, Mycobacterium
SLNQRRAETARTA

SEQ ID NO: 581702 - protein, 10 aa, Mycobacterium
SLNSTGSGRL

SEQ ID NO: 581703 - protein, 4 aa, Mycobacterium
SLNT

SEQ ID NO: 581704 - protein, 5 aa, Mycobacterium
SLPAA

SEQ ID NO: 581705 - protein, 10 aa, Mycobacterium
SLPAAEQIGA

SEQ ID NO: 581706 - protein, 8 aa, Mycobacterium
SLPADGHT

SEQ ID NO: 581707 - protein, 5 aa, Mycobacterium
SLPAE

SEQ ID NO: 581708 - protein, 9 aa, Mycobacterium
SLPAESSRE

SEQ ID NO: 581709 - protein, 5 aa, Mycobacterium
SLPAG

SEQ ID NO: 581710 - protein, 7 aa, Mycobacterium
SLPAGIA

SEQ ID NO: 581711 - protein, 6 aa, Mycobacterium
SLPAGS

SEQ ID NO: 581712 - protein, 6 aa, Mycobacterium
SLPAGY

SEQ ID NO: 581713 - protein, 10 aa, Mycobacterium
SLPAKPPEFD

SEQ ID NO: 581714 - protein, 6 aa, Mycobacterium
SLPANA

SEQ ID NO: 581715 - protein, 10 aa, Mycobacterium
SLPAQDDSLS

SEQ ID NO: 581716 - protein, 12 aa, Mycobacterium
SLPARAVPGDGA

SEQ ID NO: 581717 - protein, 8 aa, Mycobacterium
SLPARDAP

SEQ ID NO: 581718 - protein, 12 aa, Mycobacterium
SLPASARPLPGR

SEQ ID NO: 581719 - protein, 9 aa, Mycobacterium
SLPASQREE

SEQ ID NO: 581720 - protein, 18 aa, Mycobacterium
SLPASRAVAADPLRKAEE

SEQ ID NO: 581721 - protein, 6 aa, Mycobacterium
SLPATN

SEQ ID NO: 581722 - protein, 12 aa, Mycobacterium
SLPATSQQDRER

SEQ ID NO: 581723 - protein, 9 aa, Mycobacterium
SLPDDGRSP

SEQ ID NO: 581724 - protein, 6 aa, Mycobacterium
SLPDEA

SEQ ID NO: 581725 - protein, 6 aa, Mycobacterium
SLPDEG

SEQ ID NO: 581726 - protein, 6 aa, Mycobacterium
SLPDGD

SEQ ID NO: 581727 - protein, 13 aa, Mycobacterium
SLPDGGQAAADRV

SEQ ID NO: 581728 - protein, 10 aa, Mycobacterium
SLPDNQRKSS

SEQ ID NO: 581729 - protein, 5 aa, Mycobacterium
SLPDS

SEQ ID NO: 581730 - protein, 7 aa, Mycobacterium
SLPDSEI

SEQ ID NO: 581731 - protein, 12 aa, Mycobacterium
SLPDTPSAQTAV

SEQ ID NO: 581732 - protein, 6 aa, Mycobacterium
SLPEAS

SEQ ID NO: 581733 - protein, 5 aa, Mycobacterium
SLPEE

SEQ ID NO: 581734 - protein, 7 aa, Mycobacterium
SLPERPV

SEQ ID NO: 581735 - protein, 15 aa, Mycobacterium
SLPERVRTALASLHV

SEQ ID NO: 581736 - protein, 5 aa, Mycobacterium
SLPEW

SEQ ID NO: 581737 - protein, 12 aa, Mycobacterium
SLPGAGGLSART

SEQ ID NO: 581738 - protein, 14 aa, Mycobacterium
SLPGAGGSAPQTPL

SEQ ID NO: 581739 - protein, 7 aa, Mycobacterium
SLPGALG

SEQ ID NO: 581740 - protein, 9 aa, Mycobacterium
SLPGDRESQ

SEQ ID NO: 581741 - protein, 5 aa, Mycobacterium
SLPGG

SEQ ID NO: 581742 - protein, 5 aa, Mycobacterium
SLPGL

SEQ ID NO: 581743 - protein, 10 aa, Mycobacterium
SLPGPAGDIG

SEQ ID NO: 581744 - protein, 7 aa, Mycobacterium
SLPGPDG

SEQ ID NO: 581745 - protein, 9 aa, Mycobacterium
SLPGPDGWQ

SEQ ID NO: 581746 - protein, 10 aa, Mycobacterium
SLPGPGGEIP

SEQ ID NO: 581747 - protein, 15 aa, Mycobacterium
SLPGQAATLSGHASQ

SEQ ID NO: 581748 - protein, 12 aa, Mycobacterium
SLPGTEGGGPGA

SEQ ID NO: 581749 - protein, 10 aa, Mycobacterium
SLPGVGPKTA

SEQ ID NO: 581750 - protein, 10 aa, Mycobacterium
SLPHGAHAPD

SEQ ID NO: 581751 - protein, 7 aa, Mycobacterium
SLPHSVP

SEQ ID NO: 581752 - protein, 14 aa, Mycobacterium
SLPKADRADAGKRV

SEQ ID NO: 581753 - protein, 5 aa, Mycobacterium
SLPKN

SEQ ID NO: 581754 - protein, 11 aa, Mycobacterium
SLPKSGSRAPW

SEQ ID NO: 581755 - protein, 9 aa, Mycobacterium
SLPKTLDAA

SEQ ID NO: 581756 - protein, 4 aa, Mycobacterium
SLPN

SEQ ID NO: 581757 - protein, 7 aa, Mycobacterium
SLPNASA

SEQ ID NO: 581758 - protein, 5 aa, Mycobacterium
SLPNG

SEQ ID NO: 581759 - protein, 6 aa, Mycobacterium
SLPNIT

SEQ ID NO: 581760 - protein, 7 aa, Mycobacterium
SLPPAAG

SEQ ID NO: 581761 - protein, 11 aa, Mycobacterium
SLPPADEVGAG

SEQ ID NO: 581762 - protein, 6 aa, Mycobacterium
SLPPAQ

SEQ ID NO: 581763 - protein, 7 aa, Mycobacterium
SLPPASV

SEQ ID NO: 581764 - protein, 6 aa, Mycobacterium
SLPPDR

SEQ ID NO: 581765 - protein, 6 aa, Mycobacterium
SLPPEF

SEQ ID NO: 581766 - protein, 14 aa, Mycobacterium
SLPPEGQGHDHLTA

SEQ ID NO: 581767 - protein, 8 aa, Mycobacterium
SLPPGADP

SEQ ID NO: 581768 - protein, 18 aa, Mycobacterium
SLPPGARVGPGAADGQKS

SEQ ID NO: 581769 - protein, 6 aa, Mycobacterium
SLPPGR

SEQ ID NO: 581770 - protein, 7 aa, Mycobacterium
SLPPGVP

SEQ ID NO: 581771 - protein, 8 aa, Mycobacterium
SLPPGVPA

SEQ ID NO: 581772 - protein, 8 aa, Mycobacterium
SLPPGVPP

SEQ ID NO: 581773 - protein, 8 aa, Mycobacterium
SLPPLPGD

SEQ ID NO: 581774 - protein, 6 aa, Mycobacterium
SLPPLS

SEQ ID NO: 581775 - protein, 10 aa, Mycobacterium
SLPPNQVGRQ

SEQ ID NO: 581776 - protein, 9 aa, Mycobacterium
SLPPPAGHA

SEQ ID NO: 581777 - protein, 16 aa, Mycobacterium
SLPPPSTANPNIRAAG

SEQ ID NO: 581778 - protein, 7 aa, Mycobacterium
SLPPRTA

SEQ ID NO: 581779 - protein, 10 aa, Mycobacterium
SLPPTEQIGA

SEQ ID NO: 581780 - protein, 6 aa, Mycobacterium
SLPPTL

SEQ ID NO: 581781 - protein, 5 aa, Mycobacterium
SLPPY

SEQ ID NO: 581782 - protein, 6 aa, Mycobacterium
SLPQDR

SEQ ID NO: 581783 - protein, 6 aa, Mycobacterium
SLPQGS

SEQ ID NO: 581784 - protein, 6 aa, Mycobacterium
SLPQPL

SEQ ID NO: 581785 - protein, 22 aa, Mycobacterium
SLPQPPGVETTTSTIPGPDGND

SEQ ID NO: 581786 - protein, 6 aa, Mycobacterium
SLPRGD

SEQ ID NO: 581787 - protein, 7 aa, Mycobacterium
SLPRGKR

SEQ ID NO: 581788 - protein, 7 aa, Mycobacterium
SLPRQPQ

SEQ ID NO: 581789 - protein, 13 aa, Mycobacterium
SLPSASGTSRPER

SEQ ID NO: 581790 - protein, 14 aa, Mycobacterium
SLPSDFTSAGVTST

SEQ ID NO: 581791 - protein, 8 aa, Mycobacterium
SLPSGRRD

SEQ ID NO: 581792 - protein, 17 aa, Mycobacterium
SLPSQETTPARGIPSGP

SEQ ID NO: 581793 - protein, 5 aa, Mycobacterium
SLPSY

SEQ ID NO: 581794 - protein, 7 aa, Mycobacterium
SLPTAIR

SEQ ID NO: 581795 - protein, 6 aa, Mycobacterium
SLPTAT

SEQ ID NO: 581796 - protein, 10 aa, Mycobacterium
SLPTEQRRRD

SEQ ID NO: 581797 - protein, 8 aa, Mycobacterium
SLPTGVTS

SEQ ID NO: 581798 - protein, 9 aa, Mycobacterium
SLPTPEGDT

SEQ ID NO: 581799 - protein, 5 aa, Mycobacterium
SLPTR

SEQ ID NO: 581800 - protein, 7 aa, Mycobacterium
SLPTRED

SEQ ID NO: 581801 - protein, 8 aa, Mycobacterium
SLPTRPAA

SEQ ID NO: 581802 - protein, 11 aa, Mycobacterium
SLPTSWDPGAV

SEQ ID NO: 581803 - protein, 7 aa, Mycobacterium
SLPTTAV

SEQ ID NO: 581804 - protein, 9 aa, Mycobacterium
SLPTTAVGK

SEQ ID NO: 581805 - protein, 9 aa, Mycobacterium
SLPTVPAPV

SEQ ID NO: 581806 - protein, 6 aa, Mycobacterium
SLPTVS

SEQ ID NO: 581807 - protein, 8 aa, Mycobacterium
SLPVPGGA

SEQ ID NO: 581808 - protein, 16 aa, Mycobacterium
SLPVPSGRRKVHRPPV

SEQ ID NO: 581809 - protein, 6 aa, Mycobacterium
SLPYPE

SEQ ID NO: 581810 - protein, 8 aa, Mycobacterium
SLQGDAPV

SEQ ID NO: 581811 - protein, 9 aa, Mycobacterium
SLQGNASGT

SEQ ID NO: 581812 - protein, 5 aa, Mycobacterium
SLQGQ

SEQ ID NO: 581813 - protein, 10 aa, Mycobacterium
SLQGSADADV

SEQ ID NO: 581814 - protein, 4 aa, Mycobacterium
SLQP

SEQ ID NO: 581815 - protein, 5 aa, Mycobacterium
SLQPH

SEQ ID NO: 581816 - protein, 7 aa, Mycobacterium
SLQPNDT

SEQ ID NO: 581817 - protein, 15 aa, Mycobacterium
SLQPRPLGAAEGRHP

SEQ ID NO: 581818 - protein, 12 aa, Mycobacterium
SLQPSAARPADR

SEQ ID NO: 581819 - protein, 8 aa, Mycobacterium
SLQQYDEP

SEQ ID NO: 581820 - protein, 21 aa, Mycobacterium
SLQRAGRRLPDTPVLPPPDVA

SEQ ID NO: 581821 - protein, 8 aa, Mycobacterium
SLQRRRDR

SEQ ID NO: 581822 - protein, 14 aa, Mycobacterium
SLQRTARDAELQSY

SEQ ID NO: 581823 - protein, 5 aa, Mycobacterium
SLQSD

SEQ ID NO: 581824 - protein, 8 aa, Mycobacterium
SLQSPELA

SEQ ID NO: 581825 - protein, 17 aa, Mycobacterium
SLQTGQSLTSITPKSDR

SEQ ID NO: 581826 - protein, 10 aa, Mycobacterium
SLRAANDAAV

SEQ ID NO: 581827 - protein, 9 aa, Mycobacterium
SLRAAPGSS

SEQ ID NO: 581828 - protein, 5 aa, Mycobacterium
SLRAG

SEQ ID NO: 581829 - protein, 9 aa, Mycobacterium
SLRAPSSEV

SEQ ID NO: 581830 - protein, 9 aa, Mycobacterium
SLRDDGTEL

SEQ ID NO: 581831 - protein, 6 aa, Mycobacterium
SLRDDP

SEQ ID NO: 581832 - protein, 9 aa, Mycobacterium
SLRDGTASL

SEQ ID NO: 581833 - protein, 4 aa, Mycobacterium
SLRE

SEQ ID NO: 581834 - protein, 6 aa, Mycobacterium
SLREGH

SEQ ID NO: 581835 - protein, 9 aa, Mycobacterium
SLREGQASL

SEQ ID NO: 581836 - protein, 8 aa, Mycobacterium
SLRENEDT

SEQ ID NO: 581837 - protein, 5 aa, Mycobacterium
SLRES

SEQ ID NO: 581838 - protein, 12 aa, Mycobacterium
SLRGASAARARA

SEQ ID NO: 581839 - protein, 12 aa, Mycobacterium
SLRGASAGRARE

SEQ ID NO: 581840 - protein, 38 aa, Mycobacterium
SLRGEAKQLREAADQLGTAISTAGDGWQAKSADAATTK

SEQ ID NO: 581841 - protein, 10 aa, Mycobacterium
SLRGELKGTG

SEQ ID NO: 581842 - protein, 10 aa, Mycobacterium
SLRGEVKSTG

SEQ ID NO: 581843 - protein, 13 aa, Mycobacterium
SLRGKPKGQAVAG

SEQ ID NO: 581844 - protein, 12 aa, Mycobacterium
SLRGKSPYGAPQ

SEQ ID NO: 581845 - protein, 5 aa, Mycobacterium
SLRGN

SEQ ID NO: 581846 - protein, 10 aa, Mycobacterium
SLRGNGASAV

SEQ ID NO: 581847 - protein, 12 aa, Mycobacterium
SLRGSDVKERVD

SEQ ID NO: 581848 - protein, 10 aa, Mycobacterium
SLRGSRTPDR

SEQ ID NO: 581849 - protein, 14 aa, Mycobacterium
SLRGSTQQAGQSDH

SEQ ID NO: 581850 - protein, 9 aa, Mycobacterium
SLRKEGRER

SEQ ID NO: 581851 - protein, 5 aa, Mycobacterium
SLRNQ

SEQ ID NO: 581852 - protein, 5 aa, Mycobacterium
SLRPD

SEQ ID NO: 581853 - protein, 13 aa, Mycobacterium
SLRPDGSSGAVSG

SEQ ID NO: 581854 - protein, 5 aa, Mycobacterium
SLRPG

SEQ ID NO: 581855 - protein, 13 aa, Mycobacterium
SLRPGWQKERQRN

SEQ ID NO: 581856 - protein, 6 aa, Mycobacterium
SLRPPK

SEQ ID NO: 581857 - protein, 11 aa, Mycobacterium
SLRPPSDQVRS

SEQ ID NO: 581858 - protein, 7 aa, Mycobacterium
SLRPSDV

SEQ ID NO: 581859 - protein, 7 aa, Mycobacterium
SLRPVSG

SEQ ID NO: 581860 - protein, 5 aa, Mycobacterium
SLRQA

SEQ ID NO: 581861 - protein, 9 aa, Mycobacterium
SLRQADEPL

SEQ ID NO: 581862 - protein, 5 aa, Mycobacterium
SLRQR

SEQ ID NO: 581863 - protein, 11 aa, Mycobacterium
SLRRGRGEKLP

SEQ ID NO: 581864 - protein, 11 aa, Mycobacterium
SLRRRGENISS

SEQ ID NO: 581865 - protein, 6 aa, Mycobacterium
SLRRSD

SEQ ID NO: 581866 - protein, 5 aa, Mycobacterium
SLRSG

SEQ ID NO: 581867 - protein, 15 aa, Mycobacterium
SLRSGKVANAFPDEV

SEQ ID NO: 581868 - protein, 10 aa, Mycobacterium
SLRSPDGVTL

SEQ ID NO: 581869 - protein, 8 aa, Mycobacterium
SLRSQAAR

SEQ ID NO: 581870 - protein, 10 aa, Mycobacterium
SLRSTAAPHD

SEQ ID NO: 581871 - protein, 12 aa, Mycobacterium
SLRSTATKTEGG

SEQ ID NO: 581872 - protein, 13 aa, Mycobacterium
SLRTAARSTPQRT

SEQ ID NO: 581873 - protein, 8 aa, Mycobacterium
SLRTGDSD

SEQ ID NO: 581874 - protein, 8 aa, Mycobacterium
SLRTGEGD

SEQ ID NO: 581875 - protein, 9 aa, Mycobacterium
SLRTRKAGA

SEQ ID NO: 581876 - protein, 26 aa, Mycobacterium
SLRTVRDKEAAGSIPGSLGTARKVVA

SEQ ID NO: 581877 - protein, 33 aa, Mycobacterium
SLSAAAGQGGDAETDARTPAPAARQASRAQGRG

SEQ ID NO: 581878 - protein, 9 aa, Mycobacterium
SLSADGAPW

SEQ ID NO: 581879 - protein, 16 aa, Mycobacterium
SLSADLGAASAAASGN

SEQ ID NO: 581880 - protein, 17 aa, Mycobacterium
SLSASASWAANGKITAD

SEQ ID NO: 581881 - protein, 18 aa, Mycobacterium
SLSASASWAANGKITSDD

SEQ ID NO: 581882 - protein, 6 aa, Mycobacterium
SLSDDG

SEQ ID NO: 581883 - protein, 10 aa, Mycobacterium
SLSDDKHTID

SEQ ID NO: 581884 - protein, 6 aa, Mycobacterium
SLSDEQ

SEQ ID NO: 581885 - protein, 9 aa, Mycobacterium
SLSDGRAGI

SEQ ID NO: 581886 - protein, 6 aa, Mycobacterium
SLSDNS

SEQ ID NO: 581887 - protein, 9 aa, Mycobacterium
SLSDRDHTI

SEQ ID NO: 581888 - protein, 8 aa, Mycobacterium
SLSEAGQD

SEQ ID NO: 581889 - protein, 7 aa, Mycobacterium
SLSEDEK

SEQ ID NO: 581890 - protein, 5 aa, Mycobacterium
SLSEG

SEQ ID NO: 581891 - protein, 12 aa, Mycobacterium
SLSEGASDDAEK

SEQ ID NO: 581892 - protein, 10 aa, Mycobacterium
SLSEPGPMSH

SEQ ID NO: 581893 - protein, 5 aa, Mycobacterium
SLSET

SEQ ID NO: 581894 - protein, 6 aa, Mycobacterium
SLSETA

SEQ ID NO: 581895 - protein, 4 aa, Mycobacterium
SLSG

SEQ ID NO: 581896 - protein, 7 aa, Mycobacterium
SLSGADH

SEQ ID NO: 581897 - protein, 22 aa, Mycobacterium
SLSGAGGLSPVGDGFASAPGHG

SEQ ID NO: 581898 - protein, 8 aa, Mycobacterium
SLSGDATA

SEQ ID NO: 581899 - protein, 11 aa, Mycobacterium
SLSGDTPRRPT

SEQ ID NO: 581900 - protein, 10 aa, Mycobacterium
SLSGEGGPGV

SEQ ID NO: 581901 - protein, 8 aa, Mycobacterium
SLSGENST

SEQ ID NO: 581902 - protein, 9 aa, Mycobacterium
SLSGEPDDV

SEQ ID NO: 581903 - protein, 8 aa, Mycobacterium
SLSGESAA

SEQ ID NO: 581904 - protein, 16 aa, Mycobacterium
SLSGGGEFTLPDTAGA

SEQ ID NO: 581905 - protein, 8 aa, Mycobacterium
SLSGGQKQ

SEQ ID NO: 581906 - protein, 13 aa, Mycobacterium
SLSGPDPADRNLD

SEQ ID NO: 581907 - protein, 10 aa, Mycobacterium
SLSGSATYSV

SEQ ID NO: 581908 - protein, 14 aa, Mycobacterium
SLSGSGGPPPGGDG

SEQ ID NO: 581909 - protein, 15 aa, Mycobacterium
SLSGSGPALAPAGDG

SEQ ID NO: 581910 - protein, 19 aa, Mycobacterium
SLSGSVTEAARQLIAHDDL

SEQ ID NO: 581911 - protein, 7 aa, Mycobacterium
SLSGYDG

SEQ ID NO: 581912 - protein, 10 aa, Mycobacterium
SLSKEGPAKL

SEQ ID NO: 581913 - protein, 9 aa, Mycobacterium
SLSKGGPDF

SEQ ID NO: 581914 - protein, 8 aa, Mycobacterium
SLSLSGAA

SEQ ID NO: 581915 - protein, 6 aa, Mycobacterium
SLSMPA

SEQ ID NO: 581916 - protein, 7 aa, Mycobacterium
SLSPAGM

SEQ ID NO: 581917 - protein, 7 aa, Mycobacterium
SLSPASA

SEQ ID NO: 581918 - protein, 13 aa, Mycobacterium
SLSPDRAETIRPS

SEQ ID NO: 581919 - protein, 8 aa, Mycobacterium
SLSPGATY

SEQ ID NO: 581920 - protein, 13 aa, Mycobacterium
SLSPGATYRSTVT

SEQ ID NO: 581921 - protein, 13 aa, Mycobacterium
SLSPGDRSSLSES

SEQ ID NO: 581922 - protein, 9 aa, Mycobacterium
SLSPPGGLE

SEQ ID NO: 581923 - protein, 16 aa, Mycobacterium
SLSPPPFAGGVGSGSH

SEQ ID NO: 581924 - protein, 9 aa, Mycobacterium
SLSPPVVTS

SEQ ID NO: 581925 - protein, 7 aa, Mycobacterium
SLSPSAY

SEQ ID NO: 581926 - protein, 10 aa, Mycobacterium
SLSPSPAKAV

SEQ ID NO: 581927 - protein, 6 aa, Mycobacterium
SLSRDG

SEQ ID NO: 581928 - protein, 7 aa, Mycobacterium
SLSRRGV

SEQ ID NO: 581929 - protein, 8 aa, Mycobacterium
SLSSGANV

SEQ ID NO: 581930 - protein, 6 aa, Mycobacterium
SLSSPG

SEQ ID NO: 581931 - protein, 8 aa, Mycobacterium
SLSTDSGY

SEQ ID NO: 581932 - protein, 17 aa, Mycobacterium
SLSTGQAKQCESGAGTQ

SEQ ID NO: 581933 - protein, 7 aa, Mycobacterium
SLSTGQT

SEQ ID NO: 581934 - protein, 15 aa, Mycobacterium
SLSTPGSSSSTGLSQ

SEQ ID NO: 581935 - protein, 6 aa, Mycobacterium
SLSTPS

SEQ ID NO: 581936 - protein, 8 aa, Mycobacterium
SLSTVSEG

SEQ ID NO: 581937 - protein, 9 aa, Mycobacterium
SLSVPGGAA

SEQ ID NO: 581938 - protein, 4 aa, Mycobacterium
SLTA

SEQ ID NO: 581939 - protein, 9 aa, Mycobacterium
SLTAEEAER

SEQ ID NO: 581940 - protein, 13 aa, Mycobacterium
SLTAFGPNPLDPR

SEQ ID NO: 581941 - protein, 5 aa, Mycobacterium
SLTAG

SEQ ID NO: 581942 - protein, 16 aa, Mycobacterium
SLTARLPDGTLADRQP

SEQ ID NO: 581943 - protein, 7 aa, Mycobacterium
SLTATQD

SEQ ID NO: 581944 - protein, 13 aa, Mycobacterium
SLTDKRKVGTAEL

SEQ ID NO: 581945 - protein, 5 aa, Mycobacterium
SLTDS

SEQ ID NO: 581946 - protein, 17 aa, Mycobacterium
SLTEDEVGEYSGERKEI

SEQ ID NO: 581947 - protein, 17 aa, Mycobacterium
SLTEEEIGEYSGERKEI

SEQ ID NO: 581948 - protein, 10 aa, Mycobacterium
SLTERERDYA

SEQ ID NO: 581949 - protein, 10 aa, Mycobacterium
SLTERPPRTH

SEQ ID NO: 581950 - protein, 5 aa, Mycobacterium
SLTES

SEQ ID NO: 581951 - protein, 9 aa, Mycobacterium
SLTESSSRE

SEQ ID NO: 581952 - protein, 8 aa, Mycobacterium
SLTETPAP

SEQ ID NO: 581953 - protein, 7 aa, Mycobacterium
SLTGADA

SEQ ID NO: 581954 - protein, 10 aa, Mycobacterium
SLTGADAVHP

SEQ ID NO: 581955 - protein, 7 aa, Mycobacterium
SLTGEDA

SEQ ID NO: 581956 - protein, 13 aa, Mycobacterium
SLTGHGPDSRPGK

SEQ ID NO: 581957 - protein, 5 aa, Mycobacterium
SLTGN

SEQ ID NO: 581958 - protein, 9 aa, Mycobacterium
SLTGPAKFS

SEQ ID NO: 581959 - protein, 10 aa, Mycobacterium
SLTGRDGPAL

SEQ ID NO: 581960 - protein, 58 aa, Mycobacterium
SLTGSPAKTQKQQKSLSGKGSDAGDSGKSTEKSSNEKKSEKKSTEKSSEKKHKSGKHA

SEQ ID NO: 581961 - protein, 5 aa, Mycobacterium
SLTGY

SEQ ID NO: 581962 - protein, 13 aa, Mycobacterium
SLTITERATRNAG

SEQ ID NO: 581963 - protein, 11 aa, Mycobacterium
SLTKGGLNAAT

SEQ ID NO: 581964 - protein, 17 aa, Mycobacterium
SLTKSGYGSYLLDLLER

SEQ ID NO: 581965 - protein, 6 aa, Mycobacterium
SLTNGG

SEQ ID NO: 581966 - protein, 7 aa, Mycobacterium
SLTNPDD

SEQ ID NO: 581967 - protein, 10 aa, Mycobacterium
SLTNSDSRGL

SEQ ID NO: 581968 - protein, 6 aa, Mycobacterium
SLTPAA

SEQ ID NO: 581969 - protein, 7 aa, Mycobacterium
SLTPAEQ

SEQ ID NO: 581970 - protein, 5 aa, Mycobacterium
SLTPE

SEQ ID NO: 581971 - protein, 7 aa, Mycobacterium
SLTPEQP

SEQ ID NO: 581972 - protein, 7 aa, Mycobacterium
SLTPGRP

SEQ ID NO: 581973 - protein, 7 aa, Mycobacterium
SLTPHEA

SEQ ID NO: 581974 - protein, 5 aa, Mycobacterium
SLTPP

SEQ ID NO: 581975 - protein, 8 aa, Mycobacterium
SLTPQEAQ

SEQ ID NO: 581976 - protein, 7 aa, Mycobacterium
SLTPQER

SEQ ID NO: 581977 - protein, 4 aa, Mycobacterium
SLTQ

SEQ ID NO: 581978 - protein, 5 aa, Mycobacterium
SLTQA

SEQ ID NO: 581979 - protein, 6 aa, Mycobacterium
SLTQAA

SEQ ID NO: 581980 - protein, 8 aa, Mycobacterium
SLTQPDYE

SEQ ID NO: 581981 - protein, 16 aa, Mycobacterium
SLTQSELNERVDGLVS

SEQ ID NO: 581982 - protein, 23 aa, Mycobacterium
SLTRDGNNVFSDGAGALSAEGSR

SEQ ID NO: 581983 - protein, 13 aa, Mycobacterium
SLTRGEDDHPDAT

SEQ ID NO: 581984 - protein, 8 aa, Mycobacterium
SLTRGGDV

SEQ ID NO: 581985 - protein, 7 aa, Mycobacterium
SLTRGGG

SEQ ID NO: 581986 - protein, 9 aa, Mycobacterium
SLTRNGQEV

SEQ ID NO: 581987 - protein, 6 aa, Mycobacterium
SLTRRN

SEQ ID NO: 581988 - protein, 12 aa, Mycobacterium
SLTSDAHAARDA

SEQ ID NO: 581989 - protein, 6 aa, Mycobacterium
SLTSDT

SEQ ID NO: 581990 - protein, 7 aa, Mycobacterium
SLTSTDR

SEQ ID NO: 581991 - protein, 6 aa, Mycobacterium
SLTTDQ

SEQ ID NO: 581992 - protein, 12 aa, Mycobacterium
SLTTPDESFTAA

SEQ ID NO: 581993 - protein, 14 aa, Mycobacterium
SLTVSRDGTTERIE

SEQ ID NO: 581994 - protein, 5 aa, Mycobacterium
SLTWS

SEQ ID NO: 581995 - protein, 6 aa, Mycobacterium
SLVDGR

SEQ ID NO: 581996 - protein, 13 aa, Mycobacterium
SLVDPDNRRPIDY

SEQ ID NO: 581997 - protein, 5 aa, Mycobacterium
SLVGT

SEQ ID NO: 581998 - protein, 12 aa, Mycobacterium
SLVGTSSPRRAA

SEQ ID NO: 581999 - protein, 6 aa, Mycobacterium
SLVPAA

SEQ ID NO: 582000 - protein, 6 aa, Mycobacterium
SLVSGD

SEQ ID NO: 582001 - protein, 7 aa, Mycobacterium
SLVSPDT

SEQ ID NO: 582002 - protein, 9 aa, Mycobacterium
SLYAPQAQN

SEQ ID NO: 582003 - protein, 14 aa, Mycobacterium
SLYGTPGAPGIRPG

SEQ ID NO: 582004 - protein, 9 aa, Mycobacterium
SMAGGEEVA

SEQ ID NO: 582005 - protein, 15 aa, Mycobacterium
SMAGSAGATAGTQIA

SEQ ID NO: 582006 - protein, 11 aa, Mycobacterium
SMAPDAAESLA

SEQ ID NO: 582007 - protein, 6 aa, Mycobacterium
SMAPGP

SEQ ID NO: 582008 - protein, 8 aa, Mycobacterium
SMARSGAP

SEQ ID NO: 582009 - protein, 8 aa, Mycobacterium
SMASETGV

SEQ ID NO: 582010 - protein, 17 aa, Mycobacterium
SMATTEDINRTGQQVSQ

SEQ ID NO: 582011 - protein, 6 aa, Mycobacterium
SMDPSR

SEQ ID NO: 582012 - protein, 8 aa, Mycobacterium
SMDTAQRG

SEQ ID NO: 582013 - protein, 5 aa, Mycobacterium
SMEGA

SEQ ID NO: 582014 - protein, 6 aa, Mycobacterium
SMEGGL

SEQ ID NO: 582015 - protein, 4 aa, Mycobacterium
SMEL

SEQ ID NO: 582016 - protein, 8 aa, Mycobacterium
SMENRGSP

SEQ ID NO: 582017 - protein, 14 aa, Mycobacterium
SMEQANGGPSDNDE

SEQ ID NO: 582018 - protein, 13 aa, Mycobacterium
SMEQTGGFEGRTK

SEQ ID NO: 582019 - protein, 7 aa, Mycobacterium
SMGAAAR

SEQ ID NO: 582020 - protein, 9 aa, Mycobacterium
SMGDSEVRD

SEQ ID NO: 582021 - protein, 7 aa, Mycobacterium
SMGDTTA

SEQ ID NO: 582022 - protein, 20 aa, Mycobacterium
SMGGAVSPLGGAAGAESAAQ

SEQ ID NO: 582023 - protein, 5 aa, Mycobacterium
SMGGR

SEQ ID NO: 582024 - protein, 8 aa, Mycobacterium
SMGGSERA

SEQ ID NO: 582025 - protein, 9 aa, Mycobacterium
SMGKDTLDG

SEQ ID NO: 582026 - protein, 8 aa, Mycobacterium
SMGNPENE

SEQ ID NO: 582027 - protein, 10 aa, Mycobacterium
SMGQEDDGLD

SEQ ID NO: 582028 - protein, 10 aa, Mycobacterium
SMGQEGDGLD

SEQ ID NO: 582029 - protein, 12 aa, Mycobacterium
SMGQEGDGRDRL

SEQ ID NO: 582030 - protein, 11 aa, Mycobacterium
SMGQENDGVDR

SEQ ID NO: 582031 - protein, 10 aa, Mycobacterium
SMGRPEFETP

SEQ ID NO: 582032 - protein, 11 aa, Mycobacterium
SMGRPEFPTPV

SEQ ID NO: 582033 - protein, 5 aa, Mycobacterium
SMGRS

SEQ ID NO: 582034 - protein, 12 aa, Mycobacterium
SMGRSEYPTPVG

SEQ ID NO: 582035 - protein, 9 aa, Mycobacterium
SMGRSPGNP

SEQ ID NO: 582036 - protein, 15 aa, Mycobacterium
SMGSAARAWPSADSP

SEQ ID NO: 582037 - protein, 5 aa, Mycobacterium
SMGSE

SEQ ID NO: 582038 - protein, 11 aa, Mycobacterium
SMGTAKPGDFG

SEQ ID NO: 582039 - protein, 7 aa, Mycobacterium
SMGTTRT

SEQ ID NO: 582040 - protein, 5 aa, Mycobacterium
SMGVG

SEQ ID NO: 582041 - protein, 16 aa, Mycobacterium
SMHGSTAVGASGRPGR

SEQ ID NO: 582042 - protein, 8 aa, Mycobacterium
SMHSTGRV

SEQ ID NO: 582043 - protein, 9 aa, Mycobacterium
SMHTSGRVE

SEQ ID NO: 582044 - protein, 8 aa, Mycobacterium
SMHTTGRV

SEQ ID NO: 582045 - protein, 12 aa, Mycobacterium
SMKDQTYNTPAV

SEQ ID NO: 582046 - protein, 5 aa, Mycobacterium
SMKTR

SEQ ID NO: 582047 - protein, 4 aa, Mycobacterium
SMNP

SEQ ID NO: 582048 - protein, 11 aa, Mycobacterium
SMNPSPYSVNE

SEQ ID NO: 582049 - protein, 10 aa, Mycobacterium
SMPAPDGPNT

SEQ ID NO: 582050 - protein, 7 aa, Mycobacterium
SMPATGG

SEQ ID NO: 582051 - protein, 8 aa, Mycobacterium
SMPDAEPT

SEQ ID NO: 582052 - protein, 6 aa, Mycobacterium
SMPDDA

SEQ ID NO: 582053 - protein, 7 aa, Mycobacterium
SMPDDEA

SEQ ID NO: 582054 - protein, 14 aa, Mycobacterium
SMPEGPANAVTEDE

SEQ ID NO: 582055 - protein, 6 aa, Mycobacterium
SMPGSA

SEQ ID NO: 582056 - protein, 13 aa, Mycobacterium
SMPGTAGHGGGAY

SEQ ID NO: 582057 - protein, 9 aa, Mycobacterium
SMPKPKRRY

SEQ ID NO: 582058 - protein, 9 aa, Mycobacterium
SMPPETSGF

SEQ ID NO: 582059 - protein, 12 aa, Mycobacterium
SMPPKLTADTGV

SEQ ID NO: 582060 - protein, 12 aa, Mycobacterium
SMPPPQLDPAEP

SEQ ID NO: 582061 - protein, 12 aa, Mycobacterium
SMPQQLTADTGI

SEQ ID NO: 582062 - protein, 6 aa, Mycobacterium
SMPQRA

SEQ ID NO: 582063 - protein, 7 aa, Mycobacterium
SMPTDDA

SEQ ID NO: 582064 - protein, 4 aa, Mycobacterium
SMPY

SEQ ID NO: 582065 - protein, 6 aa, Mycobacterium
SMPYKS

SEQ ID NO: 582066 - protein, 11 aa, Mycobacterium
SMQGTSPELDQ

SEQ ID NO: 582067 - protein, 14 aa, Mycobacterium
SMRATAHPGTDDLE

SEQ ID NO: 582068 - protein, 17 aa, Mycobacterium
SMRATANPGVIDTDQHR

SEQ ID NO: 582069 - protein, 22 aa, Mycobacterium
SMRDASKTPEPVPAAKPAVGQG

SEQ ID NO: 582070 - protein, 7 aa, Mycobacterium
SMRDDET

SEQ ID NO: 582071 - protein, 7 aa, Mycobacterium
SMRPDSK

SEQ ID NO: 582072 - protein, 9 aa, Mycobacterium
SMRPSHDPA

SEQ ID NO: 582073 - protein, 4 aa, Mycobacterium
SMRS

SEQ ID NO: 582074 - protein, 6 aa, Mycobacterium
SMRSDG

SEQ ID NO: 582075 - protein, 5 aa, Mycobacterium
SMSAD

SEQ ID NO: 582076 - protein, 5 aa, Mycobacterium
SMSDN

SEQ ID NO: 582077 - protein, 8 aa, Mycobacterium
SMSERRTD

SEQ ID NO: 582078 - protein, 6 aa, Mycobacterium
SMSGED

SEQ ID NO: 582079 - protein, 12 aa, Mycobacterium
SMSGPAPAKYPL

SEQ ID NO: 582080 - protein, 10 aa, Mycobacterium
SMSGTPGPSY

SEQ ID NO: 582081 - protein, 7 aa, Mycobacterium
SMSGTQE

SEQ ID NO: 582082 - protein, 7 aa, Mycobacterium
SMSPAVK

SEQ ID NO: 582083 - protein, 7 aa, Mycobacterium
SMSSNPR

SEQ ID NO: 582084 - protein, 9 aa, Mycobacterium
SMSSRERAD

SEQ ID NO: 582085 - protein, 6 aa, Mycobacterium
SMSTGA

SEQ ID NO: 582086 - protein, 5 aa, Mycobacterium
SMSTQ

SEQ ID NO: 582087 - protein, 6 aa, Mycobacterium
SMTDDE

SEQ ID NO: 582088 - protein, 7 aa, Mycobacterium
SMTDDSA

SEQ ID NO: 582089 - protein, 47 aa, Mycobacterium
SMTGGLGSMPGGGGMGGGLGSGGGLGGGLPGGLGQLPGTQAAGLGNL

SEQ ID NO: 582090 - protein, 62 aa, Mycobacterium
SMTGGLGSMPGGGGMGGLGSGGGLGGLPGGMGQLPGTQAAGLGNLPANAAPAAGAPAQLGPA

SEQ ID NO: 582091 - protein, 10 aa, Mycobacterium
SMTGHAKGGA

SEQ ID NO: 582092 - protein, 7 aa, Mycobacterium
SMTNTAS

SEQ ID NO: 582093 - protein, 7 aa, Mycobacterium
SMTPEET

SEQ ID NO: 582094 - protein, 8 aa, Mycobacterium
SMTPEETS

SEQ ID NO: 582095 - protein, 18 aa, Mycobacterium
SMTPQQKRAVRDEVASGA

SEQ ID NO: 582096 - protein, 6 aa, Mycobacterium
SMTPVS

SEQ ID NO: 582097 - protein, 14 aa, Mycobacterium
SMTTGRRFGGEEAA

SEQ ID NO: 582098 - protein, 14 aa, Mycobacterium
SMTTGRRFTGPDAA

SEQ ID NO: 582099 - protein, 13 aa, Mycobacterium
SMTTNGETVSRNT

SEQ ID NO: 582100 - protein, 10 aa, Mycobacterium
SMTTNGLSTQ

SEQ ID NO: 582101 - protein, 12 aa, Mycobacterium
SMTTTDGTETNV

SEQ ID NO: 582102 - protein, 8 aa, Mycobacterium
SMTVDKDR

SEQ ID NO: 582103 - protein, 4 aa, Mycobacterium
SNAA

SEQ ID NO: 582104 - protein, 19 aa, Mycobacterium
SNAAEAQPGWAARNPQQRA

SEQ ID NO: 582105 - protein, 6 aa, Mycobacterium
SNAAEG

SEQ ID NO: 582106 - protein, 7 aa, Mycobacterium
SNAAGLG

SEQ ID NO: 582107 - protein, 8 aa, Mycobacterium
SNAAGLGT

SEQ ID NO: 582108 - protein, 5 aa, Mycobacterium
SNAAN

SEQ ID NO: 582109 - protein, 7 aa, Mycobacterium
SNAAPEL

SEQ ID NO: 582110 - protein, 7 aa, Mycobacterium
SNAARQH

SEQ ID NO: 582111 - protein, 7 aa, Mycobacterium
SNAASDI

SEQ ID NO: 582112 - protein, 7 aa, Mycobacterium
SNAAYSA

SEQ ID NO: 582113 - protein, 14 aa, Mycobacterium
SNADAARQVADGRV

SEQ ID NO: 582114 - protein, 7 aa, Mycobacterium
SNADEAK

SEQ ID NO: 582115 - protein, 8 aa, Mycobacterium
SNADGIGD

SEQ ID NO: 582116 - protein, 7 aa, Mycobacterium
SNADLGR

SEQ ID NO: 582117 - protein, 6 aa, Mycobacterium
SNADQL

SEQ ID NO: 582118 - protein, 9 aa, Mycobacterium
SNADRTYGG

SEQ ID NO: 582119 - protein, 4 aa, Mycobacterium
SNAE

SEQ ID NO: 582120 - protein, 8 aa, Mycobacterium
SNAEAAVT

SEQ ID NO: 582121 - protein, 6 aa, Mycobacterium
SNAEFG

SEQ ID NO: 582122 - protein, 13 aa, Mycobacterium
SNAEHSSTGLRSA

SEQ ID NO: 582123 - protein, 14 aa, Mycobacterium
SNAEHSSTGLRSAE

SEQ ID NO: 582124 - protein, 12 aa, Mycobacterium
SNAERRETVGSA

SEQ ID NO: 582125 - protein, 6 aa, Mycobacterium
SNAEVA

SEQ ID NO: 582126 - protein, 8 aa, Mycobacterium
SNAGAQGA

SEQ ID NO: 582127 - protein, 16 aa, Mycobacterium
SNAGAYATAEAANANP

SEQ ID NO: 582128 - protein, 14 aa, Mycobacterium
SNAGDGAADRNDAI

SEQ ID NO: 582129 - protein, 12 aa, Mycobacterium
SNAGDNSGGEQE

SEQ ID NO: 582130 - protein, 19 aa, Mycobacterium
SNAGNAGDDGDDGDANGPR

SEQ ID NO: 582131 - protein, 6 aa, Mycobacterium
SNAGNL

SEQ ID NO: 582132 - protein, 5 aa, Mycobacterium
SNAGR

SEQ ID NO: 582133 - protein, 5 aa, Mycobacterium
SNANL

SEQ ID NO: 582134 - protein, 5 aa, Mycobacterium
SNANS

SEQ ID NO: 582135 - protein, 7 aa, Mycobacterium
SNAPFGD

SEQ ID NO: 582136 - protein, 5 aa, Mycobacterium
SNAPH

SEQ ID NO: 582137 - protein, 6 aa, Mycobacterium
SNAQKR

SEQ ID NO: 582138 - protein, 5 aa, Mycobacterium
SNAQN

SEQ ID NO: 582139 - protein, 7 aa, Mycobacterium
SNAQRTL

SEQ ID NO: 582140 - protein, 7 aa, Mycobacterium
SNAQTRE

SEQ ID NO: 582141 - protein, 8 aa, Mycobacterium
SNARDTKE

SEQ ID NO: 582142 - protein, 6 aa, Mycobacterium
SNARPV

SEQ ID NO: 582143 - protein, 40 aa, Mycobacterium
SNARRDAASGSAGSAVAGSAAVASGAASGAAVAGPASTAY

SEQ ID NO: 582144 - protein, 4 aa, Mycobacterium
SNAS

SEQ ID NO: 582145 - protein, 9 aa, Mycobacterium
SNASAVASR

SEQ ID NO: 582146 - protein, 5 aa, Mycobacterium
SNASF

SEQ ID NO: 582147 - protein, 16 aa, Mycobacterium
SNASGNDRGGSSSTGV

SEQ ID NO: 582148 - protein, 16 aa, Mycobacterium
SNASLEPTATDRLDAK

SEQ ID NO: 582149 - protein, 7 aa, Mycobacterium
SNASRQK

SEQ ID NO: 582150 - protein, 20 aa, Mycobacterium
SNATGTSARLTDQRSGQSFD

SEQ ID NO: 582151 - protein, 7 aa, Mycobacterium
SNATITR

SEQ ID NO: 582152 - protein, 9 aa, Mycobacterium
SNATSTEGT

SEQ ID NO: 582153 - protein, 4 aa, Mycobacterium
SNAV

SEQ ID NO: 582154 - protein, 8 aa, Mycobacterium
SNAVADGD

SEQ ID NO: 582155 - protein, 7 aa, Mycobacterium
SNAVDRE

SEQ ID NO: 582156 - protein, 14 aa, Mycobacterium
SNAVYGARNPHRNA

SEQ ID NO: 582157 - protein, 10 aa, Mycobacterium
SNCGEGGEHI

SEQ ID NO: 582158 - protein, 4 aa, Mycobacterium
SNDA

SEQ ID NO: 582159 - protein, 6 aa, Mycobacterium
SNDAFG

SEQ ID NO: 582160 - protein, 21 aa, Mycobacterium
SNDAKEGPRAFAEKRAPNFTG

SEQ ID NO: 582161 - protein, 18 aa, Mycobacterium
SNDAYTAEEIATPGPDNR

SEQ ID NO: 582162 - protein, 10 aa, Mycobacterium
SNDDTARAAY

SEQ ID NO: 582163 - protein, 6 aa, Mycobacterium
SNDDVP

SEQ ID NO: 582164 - protein, 7 aa, Mycobacterium
SNDEAQG

SEQ ID NO: 582165 - protein, 16 aa, Mycobacterium
SNDELRSPMEKATPMR

SEQ ID NO: 582166 - protein, 6 aa, Mycobacterium
SNDEVK

SEQ ID NO: 582167 - protein, 4 aa, Mycobacterium
SNDG

SEQ ID NO: 582168 - protein, 7 aa, Mycobacterium
SNDGDRD

SEQ ID NO: 582169 - protein, 5 aa, Mycobacterium
SNDGR

SEQ ID NO: 582170 - protein, 18 aa, Mycobacterium
SNDGRAIDRPKPAATEPP

SEQ ID NO: 582171 - protein, 11 aa, Mycobacterium
SNDGRRPRSGD

SEQ ID NO: 582172 - protein, 6 aa, Mycobacterium
SNDHDR

SEQ ID NO: 582173 - protein, 13 aa, Mycobacterium
SNDHDVNNQRRGY

SEQ ID NO: 582174 - protein, 223 aa, Mycobacterium
SNDIGGGTGGDGGTGGAGGSGGAGGKGGTAAAGNAGEQGHGGAGGDGGTGGIAGNGGDGANAVNPGQAGGAGGNGGDPGAGGALGKGGAGSVEGASGVSGAAADHGGNGGNGGNGATATSAGAAGGAGGAGGNGGLVGDGGDGGNGGNGASGVAGAAGADGSVGRPTDGEDGGTGGIGGAGGNGGKGGSLAGDGGAGGTGGSGGTGGVGGRGTDGVETGSTGL

SEQ ID NO: 582175 - protein, 7 aa, Mycobacterium
SNDKDHL

SEQ ID NO: 582176 - protein, 9 aa, Mycobacterium
SNDKKRARI

SEQ ID NO: 582177 - protein, 9 aa, Mycobacterium
SNDKKRARL

SEQ ID NO: 582178 - protein, 8 aa, Mycobacterium
SNDKSGTL

SEQ ID NO: 582179 - protein, 13 aa, Mycobacterium
SNDLESAVKHGST

SEQ ID NO: 582180 - protein, 12 aa, Mycobacterium
SNDLGGLQAPEN

SEQ ID NO: 582181 - protein, 8 aa, Mycobacterium
SNDLRRGD

SEQ ID NO: 582182 - protein, 7 aa, Mycobacterium
SNDPDGE

SEQ ID NO: 582183 - protein, 5 aa, Mycobacterium
SNDPQ

SEQ ID NO: 582184 - protein, 25 aa, Mycobacterium
SNDRGAREDDRDAHDFAETAEQEAS

SEQ ID NO: 582185 - protein, 8 aa, Mycobacterium
SNDRRAAA

SEQ ID NO: 582186 - protein, 14 aa, Mycobacterium
SNDSAVDTAKPLTE

SEQ ID NO: 582187 - protein, 17 aa, Mycobacterium
SNDSNNKRSDTDSAPKL

SEQ ID NO: 582188 - protein, 9 aa, Mycobacterium
SNDTTRHAS

SEQ ID NO: 582189 - protein, 9 aa, Mycobacterium
SNDVDDAAQ

SEQ ID NO: 582190 - protein, 4 aa, Mycobacterium
SNDW

SEQ ID NO: 582191 - protein, 4 aa, Mycobacterium
SNDY

SEQ ID NO: 582192 - protein, 6 aa, Mycobacterium
SNEAAR

SEQ ID NO: 582193 - protein, 6 aa, Mycobacterium
SNEAKA

SEQ ID NO: 582194 - protein, 5 aa, Mycobacterium
SNEDF

SEQ ID NO: 582195 - protein, 18 aa, Mycobacterium
SNEEWNAATTTPAGPDSY

SEQ ID NO: 582196 - protein, 6 aa, Mycobacterium
SNEGGR

SEQ ID NO: 582197 - protein, 5 aa, Mycobacterium
SNELP

SEQ ID NO: 582198 - protein, 6 aa, Mycobacterium
SNEMPT

SEQ ID NO: 582199 - protein, 19 aa, Mycobacterium
SNENTRTQQPHPVRGGPGV

SEQ ID NO: 582200 - protein, 10 aa, Mycobacterium
SNEPGLSGAE

SEQ ID NO: 582201 - protein, 5 aa, Mycobacterium
SNEPP

SEQ ID NO: 582202 - protein, 6 aa, Mycobacterium
SNEQDG

SEQ ID NO: 582203 - protein, 4 aa, Mycobacterium
SNER

SEQ ID NO: 582204 - protein, 6 aa, Mycobacterium
SNERED

SEQ ID NO: 582205 - protein, 11 aa, Mycobacterium
SNESAAVGLPT

SEQ ID NO: 582206 - protein, 6 aa, Mycobacterium
SNESRD

SEQ ID NO: 582207 - protein, 8 aa, Mycobacterium
SNESTKDL

SEQ ID NO: 582208 - protein, 5 aa, Mycobacterium
SNETI

SEQ ID NO: 582209 - protein, 5 aa, Mycobacterium
SNETL

SEQ ID NO: 582210 - protein, 7 aa, Mycobacterium
SNETTAH

SEQ ID NO: 582211 - protein, 9 aa, Mycobacterium
SNETVHGPL

SEQ ID NO: 582212 - protein, 10 aa, Mycobacterium
SNETVHGPLP

SEQ ID NO: 582213 - protein, 11 aa, Mycobacterium
SNETVHGPLPS

SEQ ID NO: 582214 - protein, 11 aa, Mycobacterium
SNETVQEPLPS

SEQ ID NO: 582215 - protein, 8 aa, Mycobacterium
SNETVYGP

SEQ ID NO: 582216 - protein, 9 aa, Mycobacterium
SNFEPQSVA

SEQ ID NO: 582217 - protein, 8 aa, Mycobacterium
SNFGDDKD

SEQ ID NO: 582218 - protein, 5 aa, Mycobacterium
SNFKG

SEQ ID NO: 582219 - protein, 6 aa, Mycobacterium
SNFKGV

SEQ ID NO: 582220 - protein, 6 aa, Mycobacterium
SNFNNR

SEQ ID NO: 582221 - protein, 5 aa, Mycobacterium
SNFRG

SEQ ID NO: 582222 - protein, 5 aa, Mycobacterium
SNFRH

SEQ ID NO: 582223 - protein, 11 aa, Mycobacterium
SNFRPPSDPDT

SEQ ID NO: 582224 - protein, 12 aa, Mycobacterium
SNFRPPSDPDTP

SEQ ID NO: 582225 - protein, 11 aa, Mycobacterium
SNFRPPSDPRT

SEQ ID NO: 582226 - protein, 14 aa, Mycobacterium
SNFSRTSTSALSGY

SEQ ID NO: 582227 - protein, 14 aa, Mycobacterium
SNFSRTSTSAMSGY

SEQ ID NO: 582228 - protein, 11 aa, Mycobacterium
SNGAAADPAGV

SEQ ID NO: 582229 - protein, 10 aa, Mycobacterium
SNGAGKSTAM

SEQ ID NO: 582230 - protein, 8 aa, Mycobacterium
SNGAMDTG

SEQ ID NO: 582231 - protein, 7 aa, Mycobacterium
SNGANIG

SEQ ID NO: 582232 - protein, 7 aa, Mycobacterium
SNGARQH

SEQ ID NO: 582233 - protein, 7 aa, Mycobacterium
SNGATSA

SEQ ID NO: 582234 - protein, 4 aa, Mycobacterium
SNGD

SEQ ID NO: 582235 - protein, 20 aa, Mycobacterium
SNGDGSVRGPWNEGQGPWPG

SEQ ID NO: 582236 - protein, 8 aa, Mycobacterium
SNGDHTHG

SEQ ID NO: 582237 - protein, 6 aa, Mycobacterium
SNGDND

SEQ ID NO: 582238 - protein, 4 aa, Mycobacterium
SNGE

SEQ ID NO: 582239 - protein, 9 aa, Mycobacterium
SNGEAAQAA

SEQ ID NO: 582240 - protein, 6 aa, Mycobacterium
SNGEKK

SEQ ID NO: 582241 - protein, 4 aa, Mycobacterium
SNGF

SEQ ID NO: 582242 - protein, 6 aa, Mycobacterium
SNGFGG

SEQ ID NO: 582243 - protein, 6 aa, Mycobacterium
SNGGAG

SEQ ID NO: 582244 - protein, 28 aa, Mycobacterium
SNGGAGGNGGSAGLVGNGGAGGAGGQGG

SEQ ID NO: 582245 - protein, 11 aa, Mycobacterium
SNGGAPLSPTV

SEQ ID NO: 582246 - protein, 10 aa, Mycobacterium
SNGGDGGQGG

SEQ ID NO: 582247 - protein, 18 aa, Mycobacterium
SNGGERQAIAPNYPRGRE

SEQ ID NO: 582248 - protein, 23 aa, Mycobacterium
SNGGGESVRGPWNQGQGPWPEGT

SEQ ID NO: 582249 - protein, 9 aa, Mycobacterium
SNGGQERPP

SEQ ID NO: 582250 - protein, 5 aa, Mycobacterium
SNGHA

SEQ ID NO: 582251 - protein, 7 aa, Mycobacterium
SNGHETA

SEQ ID NO: 582252 - protein, 6 aa, Mycobacterium
SNGHGA

SEQ ID NO: 582253 - protein, 5 aa, Mycobacterium
SNGHP

SEQ ID NO: 582254 - protein, 6 aa, Mycobacterium
SNGHPI

SEQ ID NO: 582255 - protein, 6 aa, Mycobacterium
SNGHPV

SEQ ID NO: 582256 - protein, 17 aa, Mycobacterium
SNGLGASVKRREDTHKM

SEQ ID NO: 582257 - protein, 7 aa, Mycobacterium
SNGLPQN

SEQ ID NO: 582258 - protein, 26 aa, Mycobacterium
SNGNPNYNDGDAAGSGGAGGNGGAAG

SEQ ID NO: 582259 - protein, 6 aa, Mycobacterium
SNGPLT

SEQ ID NO: 582260 - protein, 12 aa, Mycobacterium
SNGQPLSDHSPP

SEQ ID NO: 582261 - protein, 7 aa, Mycobacterium
SNGRGAL

SEQ ID NO: 582262 - protein, 6 aa, Mycobacterium
SNGRGG

SEQ ID NO: 582263 - protein, 5 aa, Mycobacterium
SNGRP

SEQ ID NO: 582264 - protein, 9 aa, Mycobacterium
SNGRPVGRP

SEQ ID NO: 582265 - protein, 14 aa, Mycobacterium
SNGSLTGYGGGLQR

SEQ ID NO: 582266 - protein, 12 aa, Mycobacterium
SNGTQLSAAGAQ

SEQ ID NO: 582267 - protein, 12 aa, Mycobacterium
SNGTVPERVGNS

SEQ ID NO: 582268 - protein, 9 aa, Mycobacterium
SNGVDEEPE

SEQ ID NO: 582269 - protein, 15 aa, Mycobacterium
SNGVGGETYRTDPVD

SEQ ID NO: 582270 - protein, 7 aa, Mycobacterium
SNGVSEP

SEQ ID NO: 582271 - protein, 12 aa, Mycobacterium
SNHAAARQRYAD

SEQ ID NO: 582272 - protein, 4 aa, Mycobacterium
SNHD

SEQ ID NO: 582273 - protein, 6 aa, Mycobacterium
SNHDAL

SEQ ID NO: 582274 - protein, 6 aa, Mycobacterium
SNHEGE

SEQ ID NO: 582275 - protein, 5 aa, Mycobacterium
SNHEI

SEQ ID NO: 582276 - protein, 13 aa, Mycobacterium
SNHGGNNLDGTPA

SEQ ID NO: 582277 - protein, 14 aa, Mycobacterium
SNHGGNNLDGTPAA

SEQ ID NO: 582278 - protein, 14 aa, Mycobacterium
SNHGGNNLDGTPAS

SEQ ID NO: 582279 - protein, 15 aa, Mycobacterium
SNHGGRQANGGVPAI

SEQ ID NO: 582280 - protein, 7 aa, Mycobacterium
SNHGQWR

SEQ ID NO: 582281 - protein, 12 aa, Mycobacterium
SNHGTCANQSPI

SEQ ID NO: 582282 - protein, 5 aa, Mycobacterium
SNHGV

SEQ ID NO: 582283 - protein, 4 aa, Mycobacterium
SNHN

SEQ ID NO: 582284 - protein, 11 aa, Mycobacterium
SNHPPAGKADY

SEQ ID NO: 582285 - protein, 7 aa, Mycobacterium
SNHRPKA

SEQ ID NO: 582286 - protein, 19 aa, Mycobacterium
SNIAQDGKGYASGTQLGEG

SEQ ID NO: 582287 - protein, 4 aa, Mycobacterium
SNIG

SEQ ID NO: 582288 - protein, 10 aa, Mycobacterium
SNIGDRSEFT

SEQ ID NO: 582289 - protein, 13 aa, Mycobacterium
SNIGHAQAAAGPL

SEQ ID NO: 582290 - protein, 14 aa, Mycobacterium
SNIGHTESASGAAG

SEQ ID NO: 582291 - protein, 13 aa, Mycobacterium
SNIGHTQAAAGAA

SEQ ID NO: 582292 - protein, 12 aa, Mycobacterium
SNIGHTQHAAGA

SEQ ID NO: 582293 - protein, 6 aa, Mycobacterium
SNIRNN

SEQ ID NO: 582294 - protein, 15 aa, Mycobacterium
SNISQTARTRAESEL

SEQ ID NO: 582295 - protein, 8 aa, Mycobacterium
SNIYQSAD

SEQ ID NO: 582296 - protein, 10 aa, Mycobacterium
SNKEKTGTTF

SEQ ID NO: 582297 - protein, 6 aa, Mycobacterium
SNKFPT

SEQ ID NO: 582298 - protein, 10 aa, Mycobacterium
SNKGGVAKTA

SEQ ID NO: 582299 - protein, 17 aa, Mycobacterium
SNKHSGVRHMPVTLVGR

SEQ ID NO: 582300 - protein, 6 aa, Mycobacterium
SNKKDL

SEQ ID NO: 582301 - protein, 8 aa, Mycobacterium
SNKKSHDV

SEQ ID NO: 582302 - protein, 7 aa, Mycobacterium
SNKPEPI

SEQ ID NO: 582303 - protein, 8 aa, Mycobacterium
SNKSPSAR

SEQ ID NO: 582304 - protein, 10 aa, Mycobacterium
SNKTNGATPR

SEQ ID NO: 582305 - protein, 4 aa, Mycobacterium
SNLA

SEQ ID NO: 582306 - protein, 13 aa, Mycobacterium
SNLAANARTAKVA

SEQ ID NO: 582307 - protein, 14 aa, Mycobacterium
SNLAGAVEGTGINK

SEQ ID NO: 582308 - protein, 18 aa, Mycobacterium
SNLAQDGKGYASGTQLGE

SEQ ID NO: 582309 - protein, 9 aa, Mycobacterium
SNLAQTDAT

SEQ ID NO: 582310 - protein, 13 aa, Mycobacterium
SNLASTKRHWPTS

SEQ ID NO: 582311 - protein, 6 aa, Mycobacterium
SNLDPG

SEQ ID NO: 582312 - protein, 10 aa, Mycobacterium
SNLDPTEGYR

SEQ ID NO: 582313 - protein, 7 aa, Mycobacterium
SNLGDSP

SEQ ID NO: 582314 - protein, 7 aa, Mycobacterium
SNLNNRS

SEQ ID NO: 582315 - protein, 4 aa, Mycobacterium
SNLP

SEQ ID NO: 582316 - protein, 8 aa, Mycobacterium
SNLPGLNA

SEQ ID NO: 582317 - protein, 11 aa, Mycobacterium
SNLPYDKPPLS

SEQ ID NO: 582318 - protein, 13 aa, Mycobacterium
SNLSGKSWTAGVA

SEQ ID NO: 582319 - protein, 5 aa, Mycobacterium
SNLSQ

SEQ ID NO: 582320 - protein, 6 aa, Mycobacterium
SNLTPD

SEQ ID NO: 582321 - protein, 7 aa, Mycobacterium
SNMPAAQ

SEQ ID NO: 582322 - protein, 7 aa, Mycobacterium
SNMSEST

SEQ ID NO: 582323 - protein, 6 aa, Mycobacterium
SNMTGG

SEQ ID NO: 582324 - protein, 8 aa, Mycobacterium
SNNCGGNG

SEQ ID NO: 582325 - protein, 4 aa, Mycobacterium
SNNI

SEQ ID NO: 582326 - protein, 14 aa, Mycobacterium
SNNIGGANSGGNNL

SEQ ID NO: 582327 - protein, 13 aa, Mycobacterium
SNNIGNANIGNAN

SEQ ID NO: 582328 - protein, 6 aa, Mycobacterium
SNNKIG

SEQ ID NO: 582329 - protein, 8 aa, Mycobacterium
SNNPKELG

SEQ ID NO: 582330 - protein, 7 aa, Mycobacterium
SNNPTRW

SEQ ID NO: 582331 - protein, 11 aa, Mycobacterium
SNNTATEASAV

SEQ ID NO: 582332 - protein, 6 aa, Mycobacterium
SNNTVA

SEQ ID NO: 582333 - protein, 7 aa, Mycobacterium
SNNTVTT

SEQ ID NO: 582334 - protein, 16 aa, Mycobacterium
SNPAAAGSSGFATGAG

SEQ ID NO: 582335 - protein, 10 aa, Mycobacterium
SNPAAPATDG

SEQ ID NO: 582336 - protein, 9 aa, Mycobacterium
SNPAAPFGG

SEQ ID NO: 582337 - protein, 6 aa, Mycobacterium
SNPAAQ

SEQ ID NO: 582338 - protein, 9 aa, Mycobacterium
SNPADAKTV

SEQ ID NO: 582339 - protein, 8 aa, Mycobacterium
SNPAEAKT

SEQ ID NO: 582340 - protein, 13 aa, Mycobacterium
SNPAFQEASQTGF

SEQ ID NO: 582341 - protein, 5 aa, Mycobacterium
SNPAI

SEQ ID NO: 582342 - protein, 5 aa, Mycobacterium
SNPAK

SEQ ID NO: 582343 - protein, 5 aa, Mycobacterium
SNPAL

SEQ ID NO: 582344 - protein, 7 aa, Mycobacterium
SNPAMSR

SEQ ID NO: 582345 - protein, 8 aa, Mycobacterium
SNPANDSV

SEQ ID NO: 582346 - protein, 18 aa, Mycobacterium
SNPAPRRSRTRADERAAR

SEQ ID NO: 582347 - protein, 9 aa, Mycobacterium
SNPARAALN

SEQ ID NO: 582348 - protein, 5 aa, Mycobacterium
SNPAS

SEQ ID NO: 582349 - protein, 16 aa, Mycobacterium
SNPASEAAETRSKAAG

SEQ ID NO: 582350 - protein, 5 aa, Mycobacterium
SNPAT

SEQ ID NO: 582351 - protein, 6 aa, Mycobacterium
SNPATQ

SEQ ID NO: 582352 - protein, 7 aa, Mycobacterium
SNPDARR

SEQ ID NO: 582353 - protein, 8 aa, Mycobacterium
SNPDFRPA

SEQ ID NO: 582354 - protein, 6 aa, Mycobacterium
SNPDGD

SEQ ID NO: 582355 - protein, 8 aa, Mycobacterium
SNPDGPLS

SEQ ID NO: 582356 - protein, 14 aa, Mycobacterium
SNPDPTPQYAASKA

SEQ ID NO: 582357 - protein, 7 aa, Mycobacterium
SNPDVAK

SEQ ID NO: 582358 - protein, 7 aa, Mycobacterium
SNPEIPP

SEQ ID NO: 582359 - protein, 8 aa, Mycobacterium
SNPEIPPA

SEQ ID NO: 582360 - protein, 6 aa, Mycobacterium
SNPEKF

SEQ ID NO: 582361 - protein, 5 aa, Mycobacterium
SNPEL

SEQ ID NO: 582362 - protein, 6 aa, Mycobacterium
SNPELR

SEQ ID NO: 582363 - protein, 6 aa, Mycobacterium
SNPERF

SEQ ID NO: 582364 - protein, 4 aa, Mycobacterium
SNPG

SEQ ID NO: 582365 - protein, 18 aa, Mycobacterium
SNPGDRATLVSPESRDAL

SEQ ID NO: 582366 - protein, 5 aa, Mycobacterium
SNPGM

SEQ ID NO: 582367 - protein, 5 aa, Mycobacterium
SNPGQ

SEQ ID NO: 582368 - protein, 6 aa, Mycobacterium
SNPGRH

SEQ ID NO: 582369 - protein, 4 aa, Mycobacterium
SNPH

SEQ ID NO: 582370 - protein, 5 aa, Mycobacterium
SNPHA

SEQ ID NO: 582371 - protein, 4 aa, Mycobacterium
SNPK

SEQ ID NO: 582372 - protein, 13 aa, Mycobacterium
SNPKPAKPGDTEV

SEQ ID NO: 582373 - protein, 13 aa, Mycobacterium
SNPLQPDSDPVPI

SEQ ID NO: 582374 - protein, 9 aa, Mycobacterium
SNPNNPDGG

SEQ ID NO: 582375 - protein, 14 aa, Mycobacterium
SNPPTPDDQAFPRR

SEQ ID NO: 582376 - protein, 5 aa, Mycobacterium
SNPPV

SEQ ID NO: 582377 - protein, 13 aa, Mycobacterium
SNPPVNAVQGEPT

SEQ ID NO: 582378 - protein, 6 aa, Mycobacterium
SNPQAT

SEQ ID NO: 582379 - protein, 6 aa, Mycobacterium
SNPQEL

SEQ ID NO: 582380 - protein, 15 aa, Mycobacterium
SNPQHERTKAFLSKV

SEQ ID NO: 582381 - protein, 16 aa, Mycobacterium
SNPQMSTDATPGQGDD

SEQ ID NO: 582382 - protein, 16 aa, Mycobacterium
SNPREKSTEDYISGRF

SEQ ID NO: 582383 - protein, 6 aa, Mycobacterium
SNPRVA

SEQ ID NO: 582384 - protein, 10 aa, Mycobacterium
SNPSATDPLA

SEQ ID NO: 582385 - protein, 13 aa, Mycobacterium
SNPSDPPRDADEL

SEQ ID NO: 582386 - protein, 8 aa, Mycobacterium
SNPSGEIA

SEQ ID NO: 582387 - protein, 9 aa, Mycobacterium
SNPSGVTIA

SEQ ID NO: 582388 - protein, 10 aa, Mycobacterium
SNPSKTRAIA

SEQ ID NO: 582389 - protein, 5 aa, Mycobacterium
SNPSV

SEQ ID NO: 582390 - protein, 9 aa, Mycobacterium
SNPTGATIA

SEQ ID NO: 582391 - protein, 5 aa, Mycobacterium
SNPTL

SEQ ID NO: 582392 - protein, 13 aa, Mycobacterium
SNPVPDDGQPTVT

SEQ ID NO: 582393 - protein, 5 aa, Mycobacterium
SNPVR

SEQ ID NO: 582394 - protein, 8 aa, Mycobacterium
SNPYGNGT

SEQ ID NO: 582395 - protein, 8 aa, Mycobacterium
SNQADPLA

SEQ ID NO: 582396 - protein, 11 aa, Mycobacterium
SNQAEGGGTPY

SEQ ID NO: 582397 - protein, 7 aa, Mycobacterium
SNQALDS

SEQ ID NO: 582398 - protein, 10 aa, Mycobacterium
SNQDGEITRH

SEQ ID NO: 582399 - protein, 8 aa, Mycobacterium
SNQDKLRP

SEQ ID NO: 582400 - protein, 13 aa, Mycobacterium
SNQETAVARSTGI

SEQ ID NO: 582401 - protein, 5 aa, Mycobacterium
SNQEY

SEQ ID NO: 582402 - protein, 7 aa, Mycobacterium
SNQHRPN

SEQ ID NO: 582403 - protein, 10 aa, Mycobacterium
SNQKDKAAEI

SEQ ID NO: 582404 - protein, 6 aa, Mycobacterium
SNQLGE

SEQ ID NO: 582405 - protein, 27 aa, Mycobacterium
SNQPKKDLAAAEQISASAVSQRAGRDG

SEQ ID NO: 582406 - protein, 14 aa, Mycobacterium
SNQQDGDKAKDAIA

SEQ ID NO: 582407 - protein, 5 aa, Mycobacterium
SNQQV

SEQ ID NO: 582408 - protein, 20 aa, Mycobacterium
SNQRKSLAALNDSKKLTEKM

SEQ ID NO: 582409 - protein, 9 aa, Mycobacterium
SNQRPRPVN

SEQ ID NO: 582410 - protein, 5 aa, Mycobacterium
SNQRV

SEQ ID NO: 582411 - protein, 6 aa, Mycobacterium
SNQTGV

SEQ ID NO: 582412 - protein, 8 aa, Mycobacterium
SNQTRSED

SEQ ID NO: 582413 - protein, 22 aa, Mycobacterium
SNQVSGSSTAVSTQKIPEASQI

SEQ ID NO: 582414 - protein, 9 aa, Mycobacterium
SNQYGSPQA

SEQ ID NO: 582415 - protein, 4 aa, Mycobacterium
SNRA

SEQ ID NO: 582416 - protein, 8 aa, Mycobacterium
SNRAGVAR

SEQ ID NO: 582417 - protein, 5 aa, Mycobacterium
SNRAI

SEQ ID NO: 582418 - protein, 14 aa, Mycobacterium
SNRDGKPVASAPAA

SEQ ID NO: 582419 - protein, 12 aa, Mycobacterium
SNRDGKPVTSAA

SEQ ID NO: 582420 - protein, 5 aa, Mycobacterium
SNRDN

SEQ ID NO: 582421 - protein, 5 aa, Mycobacterium
SNRGI

SEQ ID NO: 582422 - protein, 9 aa, Mycobacterium
SNRGSVDGR

SEQ ID NO: 582423 - protein, 14 aa, Mycobacterium
SNRGVAGIDGTVST

SEQ ID NO: 582424 - protein, 9 aa, Mycobacterium
SNRKDEAAE

SEQ ID NO: 582425 - protein, 9 aa, Mycobacterium
SNRLTGTAT

SEQ ID NO: 582426 - protein, 9 aa, Mycobacterium
SNRNLGGAG

SEQ ID NO: 582427 - protein, 8 aa, Mycobacterium
SNRPVGDG

SEQ ID NO: 582428 - protein, 5 aa, Mycobacterium
SNRQF

SEQ ID NO: 582429 - protein, 6 aa, Mycobacterium
SNRSGG

SEQ ID NO: 582430 - protein, 8 aa, Mycobacterium
SNRSLTHS

SEQ ID NO: 582431 - protein, 7 aa, Mycobacterium
SNRSRDL

SEQ ID NO: 582432 - protein, 5 aa, Mycobacterium
SNRST

SEQ ID NO: 582433 - protein, 13 aa, Mycobacterium
SNRWDPDSGPSVA

SEQ ID NO: 582434 - protein, 6 aa, Mycobacterium
SNRYPE

SEQ ID NO: 582435 - protein, 8 aa, Mycobacterium
SNSAGLGE

SEQ ID NO: 582436 - protein, 9 aa, Mycobacterium
SNSAPDGDR

SEQ ID NO: 582437 - protein, 5 aa, Mycobacterium
SNSAV

SEQ ID NO: 582438 - protein, 10 aa, Mycobacterium
SNSDDKEARR

SEQ ID NO: 582439 - protein, 8 aa, Mycobacterium
SNSDGTYD

SEQ ID NO: 582440 - protein, 9 aa, Mycobacterium
SNSDQPPPD

SEQ ID NO: 582441 - protein, 7 aa, Mycobacterium
SNSELPA

SEQ ID NO: 582442 - protein, 9 aa, Mycobacterium
SNSERIRGA

SEQ ID NO: 582443 - protein, 7 aa, Mycobacterium
SNSGAKA

SEQ ID NO: 582444 - protein, 5 aa, Mycobacterium
SNSGD

SEQ ID NO: 582445 - protein, 17 aa, Mycobacterium
SNSGGGVLQPRTGNRLL

SEQ ID NO: 582446 - protein, 9 aa, Mycobacterium
SNSGHPIGQ

SEQ ID NO: 582447 - protein, 7 aa, Mycobacterium
SNSGPDR

SEQ ID NO: 582448 - protein, 6 aa, Mycobacterium
SNSNVQ

SEQ ID NO: 582449 - protein, 9 aa, Mycobacterium
SNSPSFDDD

SEQ ID NO: 582450 - protein, 13 aa, Mycobacterium
SNSPSGVGTTIFH

SEQ ID NO: 582451 - protein, 6 aa, Mycobacterium
SNSPVN

SEQ ID NO: 582452 - protein, 10 aa, Mycobacterium
SNSRAATTAV

SEQ ID NO: 582453 - protein, 9 aa, Mycobacterium
SNSRDPVGD

SEQ ID NO: 582454 - protein, 16 aa, Mycobacterium
SNSRRRSPEGTWEPGN

SEQ ID NO: 582455 - protein, 15 aa, Mycobacterium
SNSRRRTAEGGWEPG

SEQ ID NO: 582456 - protein, 17 aa, Mycobacterium
SNSRRRTAEGTWEPGNS

SEQ ID NO: 582457 - protein, 15 aa, Mycobacterium
SNSRRRTSDGGWEPG

SEQ ID NO: 582458 - protein, 5 aa, Mycobacterium
SNSSA

SEQ ID NO: 582459 - protein, 7 aa, Mycobacterium
SNSSAFG

SEQ ID NO: 582460 - protein, 10 aa, Mycobacterium
SNSSATMARP

SEQ ID NO: 582461 - protein, 13 aa, Mycobacterium
SNSSAWTSRYEQG

SEQ ID NO: 582462 - protein, 9 aa, Mycobacterium
SNSSRGRRP

SEQ ID NO: 582463 - protein, 6 aa, Mycobacterium
SNSSSR

SEQ ID NO: 582464 - protein, 4 aa, Mycobacterium
SNST

SEQ ID NO: 582465 - protein, 8 aa, Mycobacterium
SNSTASIP

SEQ ID NO: 582466 - protein, 6 aa, Mycobacterium
SNSTDI

SEQ ID NO: 582467 - protein, 6 aa, Mycobacterium
SNSTDV

SEQ ID NO: 582468 - protein, 12 aa, Mycobacterium
SNSTTTTPAVPA

SEQ ID NO: 582469 - protein, 13 aa, Mycobacterium
SNSTTTTPAVPGR

SEQ ID NO: 582470 - protein, 10 aa, Mycobacterium
SNSTTTVPAV

SEQ ID NO: 582471 - protein, 12 aa, Mycobacterium
SNSTTTVPAVPR

SEQ ID NO: 582472 - protein, 6 aa, Mycobacterium
SNSWPQ

SEQ ID NO: 582473 - protein, 6 aa, Mycobacterium
SNSYAA

SEQ ID NO: 582474 - protein, 4 aa, Mycobacterium
SNTA

SEQ ID NO: 582475 - protein, 6 aa, Mycobacterium
SNTAAN

SEQ ID NO: 582476 - protein, 6 aa, Mycobacterium
SNTAEP

SEQ ID NO: 582477 - protein, 7 aa, Mycobacterium
SNTAGWG

SEQ ID NO: 582478 - protein, 7 aa, Mycobacterium
SNTANIG

SEQ ID NO: 582479 - protein, 4 aa, Mycobacterium
SNTD

SEQ ID NO: 582480 - protein, 7 aa, Mycobacterium
SNTDAPG

SEQ ID NO: 582481 - protein, 9 aa, Mycobacterium
SNTDSAAAP

SEQ ID NO: 582482 - protein, 6 aa, Mycobacterium
SNTEAP

SEQ ID NO: 582483 - protein, 8 aa, Mycobacterium
SNTFQDDD

SEQ ID NO: 582484 - protein, 6 aa, Mycobacterium
SNTGEG

SEQ ID NO: 582485 - protein, 8 aa, Mycobacterium
SNTHGGMA

SEQ ID NO: 582486 - protein, 5 aa, Mycobacterium
SNTIR

SEQ ID NO: 582487 - protein, 7 aa, Mycobacterium
SNTKDEL

SEQ ID NO: 582488 - protein, 60 aa, Mycobacterium
SNTLGFGRPEDGERFTDGARQFSEANDELQQAVPPPDWQGDASDAYGLRNTEQQQRAGSM

SEQ ID NO: 582489 - protein, 20 aa, Mycobacterium
SNTPAQESGKAGDSGHATPI

SEQ ID NO: 582490 - protein, 5 aa, Mycobacterium
SNTPD

SEQ ID NO: 582491 - protein, 10 aa, Mycobacterium
SNTPDEFTGA

SEQ ID NO: 582492 - protein, 15 aa, Mycobacterium
SNTPENGAGPGAVGS

SEQ ID NO: 582493 - protein, 5 aa, Mycobacterium
SNTPG

SEQ ID NO: 582494 - protein, 8 aa, Mycobacterium
SNTPVQQA

SEQ ID NO: 582495 - protein, 16 aa, Mycobacterium
SNTPWPTGSAHPRRAA

SEQ ID NO: 582496 - protein, 4 aa, Mycobacterium
SNTQ

SEQ ID NO: 582497 - protein, 6 aa, Mycobacterium
SNTQRM

SEQ ID NO: 582498 - protein, 9 aa, Mycobacterium
SNTSGLAAY

SEQ ID NO: 582499 - protein, 8 aa, Mycobacterium
SNTSSAIE

SEQ ID NO: 582500 - protein, 5 aa, Mycobacterium
SNTTM

SEQ ID NO: 582501 - protein, 5 aa, Mycobacterium
SNTTR

SEQ ID NO: 582502 - protein, 6 aa, Mycobacterium
SNTTSI

SEQ ID NO: 582503 - protein, 24 aa, Mycobacterium
SNTTTASRPVATRPAAPMSSGDKR

SEQ ID NO: 582504 - protein, 21 aa, Mycobacterium
SNTTTAVTRPASSGAVARGYT

SEQ ID NO: 582505 - protein, 4 aa, Mycobacterium
SNTV

SEQ ID NO: 582506 - protein, 5 aa, Mycobacterium
SNTVG

SEQ ID NO: 582507 - protein, 8 aa, Mycobacterium
SNVAPGET

SEQ ID NO: 582508 - protein, 4 aa, Mycobacterium
SNVG

SEQ ID NO: 582509 - protein, 15 aa, Mycobacterium
SNVGAAGSAAAGPTA

SEQ ID NO: 582510 - protein, 13 aa, Mycobacterium
SNVGDRSEHTRRV

SEQ ID NO: 582511 - protein, 5 aa, Mycobacterium
SNVGH

SEQ ID NO: 582512 - protein, 13 aa, Mycobacterium
SNVGHAQAAAGGL

SEQ ID NO: 582513 - protein, 11 aa, Mycobacterium
SNVHGADDPLA

SEQ ID NO: 582514 - protein, 8 aa, Mycobacterium
SNVPGLNA

SEQ ID NO: 582515 - protein, 7 aa, Mycobacterium
SNVPVYP

SEQ ID NO: 582516 - protein, 7 aa, Mycobacterium
SNVQGDR

SEQ ID NO: 582517 - protein, 8 aa, Mycobacterium
SNVSGATE

SEQ ID NO: 582518 - protein, 5 aa, Mycobacterium
SNVTA

SEQ ID NO: 582519 - protein, 12 aa, Mycobacterium
SNVTANSSAVQR

SEQ ID NO: 582520 - protein, 7 aa, Mycobacterium
SNVTARG

SEQ ID NO: 582521 - protein, 6 aa, Mycobacterium
SNVTGA

SEQ ID NO: 582522 - protein, 8 aa, Mycobacterium
SNVTGGTQ

SEQ ID NO: 582523 - protein, 4 aa, Mycobacterium
SNWG

SEQ ID NO: 582524 - protein, 9 aa, Mycobacterium
SNYGAAKTG

SEQ ID NO: 582525 - protein, 5 aa, Mycobacterium
SNYGR

SEQ ID NO: 582526 - protein, 6 aa, Mycobacterium
SNYGSE

SEQ ID NO: 582527 - protein, 4 aa, Mycobacterium
SNYS

SEQ ID NO: 582528 - protein, 6 aa, Mycobacterium
SNYSGI

SEQ ID NO: 582529 - protein, 4 aa, Mycobacterium
SNYT

SEQ ID NO: 582530 - protein, 5 aa, Mycobacterium
SNYTT

SEQ ID NO: 582531 - protein, 8 aa, Mycobacterium
SPAAAAAA

SEQ ID NO: 582532 - protein, 12 aa, Mycobacterium
SPAAAPPAYDES

SEQ ID NO: 582533 - protein, 9 aa, Mycobacterium
SPAAARGRG

SEQ ID NO: 582534 - protein, 5 aa, Mycobacterium
SPAAD

SEQ ID NO: 582535 - protein, 6 aa, Mycobacterium
SPAADG

SEQ ID NO: 582536 - protein, 8 aa, Mycobacterium
SPAAEAVP

SEQ ID NO: 582537 - protein, 7 aa, Mycobacterium
SPAAEGA

SEQ ID NO: 582538 - protein, 17 aa, Mycobacterium
SPAAGGGTLLRWSAPLI

SEQ ID NO: 582539 - protein, 17 aa, Mycobacterium
SPAAGSITECASTPSLP

SEQ ID NO: 582540 - protein, 5 aa, Mycobacterium
SPAAL

SEQ ID NO: 582541 - protein, 6 aa, Mycobacterium
SPAANA

SEQ ID NO: 582542 - protein, 7 aa, Mycobacterium
SPAAPKI

SEQ ID NO: 582543 - protein, 9 aa, Mycobacterium
SPAAPRTPV

SEQ ID NO: 582544 - protein, 8 aa, Mycobacterium
SPAAQGAI

SEQ ID NO: 582545 - protein, 5 aa, Mycobacterium
SPAAR

SEQ ID NO: 582546 - protein, 12 aa, Mycobacterium
SPAARKVARDSQ

SEQ ID NO: 582547 - protein, 13 aa, Mycobacterium
SPAARSVAQASQQ

SEQ ID NO: 582548 - protein, 15 aa, Mycobacterium
SPAARVRGDEGNRRL

SEQ ID NO: 582549 - protein, 6 aa, Mycobacterium
SPAASA

SEQ ID NO: 582550 - protein, 6 aa, Mycobacterium
SPAATG

SEQ ID NO: 582551 - protein, 6 aa, Mycobacterium
SPAAVA

SEQ ID NO: 582552 - protein, 9 aa, Mycobacterium
SPAAVSAQP

SEQ ID NO: 582553 - protein, 6 aa, Mycobacterium
SPAAYT

SEQ ID NO: 582554 - protein, 5 aa, Mycobacterium
SPADA

SEQ ID NO: 582555 - protein, 7 aa, Mycobacterium
SPADAAK

SEQ ID NO: 582556 - protein, 7 aa, Mycobacterium
SPADAAR

SEQ ID NO: 582557 - protein, 9 aa, Mycobacterium
SPADAETVA

SEQ ID NO: 582558 - protein, 5 aa, Mycobacterium
SPADC

SEQ ID NO: 582559 - protein, 10 aa, Mycobacterium
SPADDAEHGS

SEQ ID NO: 582560 - protein, 6 aa, Mycobacterium
SPADFE

SEQ ID NO: 582561 - protein, 10 aa, Mycobacterium
SPADGEEVRD

SEQ ID NO: 582562 - protein, 8 aa, Mycobacterium
SPADQERT

SEQ ID NO: 582563 - protein, 7 aa, Mycobacterium
SPADQQS

SEQ ID NO: 582564 - protein, 5 aa, Mycobacterium
SPADV

SEQ ID NO: 582565 - protein, 5 aa, Mycobacterium
SPADY

SEQ ID NO: 582566 - protein, 7 aa, Mycobacterium
SPAEAAA

SEQ ID NO: 582567 - protein, 9 aa, Mycobacterium
SPAEARDPL

SEQ ID NO: 582568 - protein, 5 aa, Mycobacterium
SPAEE

SEQ ID NO: 582569 - protein, 5 aa, Mycobacterium
SPAEL

SEQ ID NO: 582570 - protein, 8 aa, Mycobacterium
SPAELDDA

SEQ ID NO: 582571 - protein, 9 aa, Mycobacterium
SPAELDDAA

SEQ ID NO: 582572 - protein, 33 aa, Mycobacterium
SPAENPYGSAAVGSKYQGQRGPTPSRSHLNFIK

SEQ ID NO: 582573 - protein, 7 aa, Mycobacterium
SPAEQTL

SEQ ID NO: 582574 - protein, 6 aa, Mycobacterium
SPAEVA

SEQ ID NO: 582575 - protein, 11 aa, Mycobacterium
SPAEYTGERTH

SEQ ID NO: 582576 - protein, 15 aa, Mycobacterium
SPAFADAASTATSRL

SEQ ID NO: 582577 - protein, 9 aa, Mycobacterium
SPAFADGAP

SEQ ID NO: 582578 - protein, 12 aa, Mycobacterium
SPAGAAGAPKVG

SEQ ID NO: 582579 - protein, 6 aa, Mycobacterium
SPAGAK

SEQ ID NO: 582580 - protein, 6 aa, Mycobacterium
SPAGAR

SEQ ID NO: 582581 - protein, 21 aa, Mycobacterium
SPAGATLADGSGTGTIRDRTI

SEQ ID NO: 582582 - protein, 7 aa, Mycobacterium
SPAGAYL

SEQ ID NO: 582583 - protein, 8 aa, Mycobacterium
SPAGFPSG

SEQ ID NO: 582584 - protein, 5 aa, Mycobacterium
SPAGH

SEQ ID NO: 582585 - protein, 8 aa, Mycobacterium
SPAGHDRA

SEQ ID NO: 582586 - protein, 12 aa, Mycobacterium
SPAGMRSTDPLP

SEQ ID NO: 582587 - protein, 5 aa, Mycobacterium
SPAGP

SEQ ID NO: 582588 - protein, 7 aa, Mycobacterium
SPAGPKV

SEQ ID NO: 582589 - protein, 7 aa, Mycobacterium
SPAGPPH

SEQ ID NO: 582590 - protein, 13 aa, Mycobacterium
SPAGPTGPGTHPP

SEQ ID NO: 582591 - protein, 13 aa, Mycobacterium
SPAGQTYVTTPGS

SEQ ID NO: 582592 - protein, 10 aa, Mycobacterium
SPAGRPSWQA

SEQ ID NO: 582593 - protein, 13 aa, Mycobacterium
SPAGRTHVTTPGS

SEQ ID NO: 582594 - protein, 13 aa, Mycobacterium
SPAGRTYVTTPGS

SEQ ID NO: 582595 - protein, 9 aa, Mycobacterium
SPAGSEREA

SEQ ID NO: 582596 - protein, 6 aa, Mycobacterium
SPAGSF

SEQ ID NO: 582597 - protein, 8 aa, Mycobacterium
SPAGSYLT

SEQ ID NO: 582598 - protein, 9 aa, Mycobacterium
SPAGTAGGT

SEQ ID NO: 582599 - protein, 12 aa, Mycobacterium
SPAGTGTTVFDM

SEQ ID NO: 582600 - protein, 6 aa, Mycobacterium
SPAGTR

SEQ ID NO: 582601 - protein, 4 aa, Mycobacterium
SPAH

SEQ ID NO: 582602 - protein, 11 aa, Mycobacterium
SPAHAEGGARR

SEQ ID NO: 582603 - protein, 11 aa, Mycobacterium
SPAHAEGGRRR

SEQ ID NO: 582604 - protein, 6 aa, Mycobacterium
SPAHDD

SEQ ID NO: 582605 - protein, 7 aa, Mycobacterium
SPAHDDG

SEQ ID NO: 582606 - protein, 13 aa, Mycobacterium
SPAHGALDGGGHQ

SEQ ID NO: 582607 - protein, 5 aa, Mycobacterium
SPAHS

SEQ ID NO: 582608 - protein, 12 aa, Mycobacterium
SPAIDESPTESV

SEQ ID NO: 582609 - protein, 6 aa, Mycobacterium
SPAISN

SEQ ID NO: 582610 - protein, 9 aa, Mycobacterium
SPAKTPTEI

SEQ ID NO: 582611 - protein, 4 aa, Mycobacterium
SPAL

SEQ ID NO: 582612 - protein, 5 aa, Mycobacterium
SPALA

SEQ ID NO: 582613 - protein, 6 aa, Mycobacterium
SPALPG

SEQ ID NO: 582614 - protein, 7 aa, Mycobacterium
SPALPPA

SEQ ID NO: 582615 - protein, 6 aa, Mycobacterium
SPALPQ

SEQ ID NO: 582616 - protein, 5 aa, Mycobacterium
SPALR

SEQ ID NO: 582617 - protein, 6 aa, Mycobacterium
SPALRG

SEQ ID NO: 582618 - protein, 16 aa, Mycobacterium
SPALRGEIEEAPGTGL

SEQ ID NO: 582619 - protein, 8 aa, Mycobacterium
SPALTTRG

SEQ ID NO: 582620 - protein, 7 aa, Mycobacterium
SPAMPDA

SEQ ID NO: 582621 - protein, 5 aa, Mycobacterium
SPANA

SEQ ID NO: 582622 - protein, 10 aa, Mycobacterium
SPANAEGAAT

SEQ ID NO: 582623 - protein, 9 aa, Mycobacterium
SPANAEGAR

SEQ ID NO: 582624 - protein, 10 aa, Mycobacterium
SPANAEGSET

SEQ ID NO: 582625 - protein, 11 aa, Mycobacterium
SPANAEGSPTL

SEQ ID NO: 582626 - protein, 11 aa, Mycobacterium
SPANEENSGDL

SEQ ID NO: 582627 - protein, 6 aa, Mycobacterium
SPANNG

SEQ ID NO: 582628 - protein, 24 aa, Mycobacterium
SPANPPFPATEAGTFTGTPSLATR

SEQ ID NO: 582629 - protein, 9 aa, Mycobacterium
SPANPTGTI

SEQ ID NO: 582630 - protein, 13 aa, Mycobacterium
SPANPTGTVIPPE

SEQ ID NO: 582631 - protein, 8 aa, Mycobacterium
SPAPADLD

SEQ ID NO: 582632 - protein, 6 aa, Mycobacterium
SPAPCT

SEQ ID NO: 582633 - protein, 5 aa, Mycobacterium
SPAPD

SEQ ID NO: 582634 - protein, 18 aa, Mycobacterium
SPAPERPRRVQTRPGPLR

SEQ ID NO: 582635 - protein, 13 aa, Mycobacterium
SPAPETSLSGPVT

SEQ ID NO: 582636 - protein, 7 aa, Mycobacterium
SPAPGLT

SEQ ID NO: 582637 - protein, 6 aa, Mycobacterium
SPAPIG

SEQ ID NO: 582638 - protein, 10 aa, Mycobacterium
SPAPLGSTGA

SEQ ID NO: 582639 - protein, 9 aa, Mycobacterium
SPAPNGNIQ

SEQ ID NO: 582640 - protein, 15 aa, Mycobacterium
SPAPPYGTGKVNTRH

SEQ ID NO: 582641 - protein, 8 aa, Mycobacterium
SPAPQAPL

SEQ ID NO: 582642 - protein, 6 aa, Mycobacterium
SPAPQL

SEQ ID NO: 582643 - protein, 5 aa, Mycobacterium
SPAPR

SEQ ID NO: 582644 - protein, 16 aa, Mycobacterium
SPAPSDDQSLTIGPDG

SEQ ID NO: 582645 - protein, 17 aa, Mycobacterium
SPAPSDDQSLTVGPDGP

SEQ ID NO: 582646 - protein, 8 aa, Mycobacterium
SPAPSEPV

SEQ ID NO: 582647 - protein, 8 aa, Mycobacterium
SPAPSQPV

SEQ ID NO: 582648 - protein, 10 aa, Mycobacterium
SPAPSSSTVS

SEQ ID NO: 582649 - protein, 6 aa, Mycobacterium
SPAPTF

SEQ ID NO: 582650 - protein, 6 aa, Mycobacterium
SPAPYT

SEQ ID NO: 582651 - protein, 6 aa, Mycobacterium
SPAQES

SEQ ID NO: 582652 - protein, 15 aa, Mycobacterium
SPAQFDDDPASLTRA

SEQ ID NO: 582653 - protein, 5 aa, Mycobacterium
SPAQH

SEQ ID NO: 582654 - protein, 8 aa, Mycobacterium
SPAQPDAT

SEQ ID NO: 582655 - protein, 6 aa, Mycobacterium
SPAQQQ

SEQ ID NO: 582656 - protein, 7 aa, Mycobacterium
SPAQTDT

SEQ ID NO: 582657 - protein, 6 aa, Mycobacterium
SPARAA

SEQ ID NO: 582658 - protein, 8 aa, Mycobacterium
SPARAAAH

SEQ ID NO: 582659 - protein, 7 aa, Mycobacterium
SPARAAE

SEQ ID NO: 582660 - protein, 9 aa, Mycobacterium
SPARAEEIA

SEQ ID NO: 582661 - protein, 9 aa, Mycobacterium
SPARDADSA

SEQ ID NO: 582662 - protein, 7 aa, Mycobacterium
SPARDLG

SEQ ID NO: 582663 - protein, 5 aa, Mycobacterium
SPARK

SEQ ID NO: 582664 - protein, 8 aa, Mycobacterium
SPARPDDA

SEQ ID NO: 582665 - protein, 6 aa, Mycobacterium
SPARRL

SEQ ID NO: 582666 - protein, 17 aa, Mycobacterium
SPARTAGTTPYVVRIIE

SEQ ID NO: 582667 - protein, 5 aa, Mycobacterium
SPASA

SEQ ID NO: 582668 - protein, 7 aa, Mycobacterium
SPASADA

SEQ ID NO: 582669 - protein, 5 aa, Mycobacterium
SPASE

SEQ ID NO: 582670 - protein, 8 aa, Mycobacterium
SPASEGVN

SEQ ID NO: 582671 - protein, 10 aa, Mycobacterium
SPASGDGAGA

SEQ ID NO: 582672 - protein, 11 aa, Mycobacterium
SPASHAKATRE

SEQ ID NO: 582673 - protein, 6 aa, Mycobacterium
SPASIS

SEQ ID NO: 582674 - protein, 10 aa, Mycobacterium
SPASITQGTY

SEQ ID NO: 582675 - protein, 6 aa, Mycobacterium
SPASLR

SEQ ID NO: 582676 - protein, 14 aa, Mycobacterium
SPASMSPGQSGPGS

SEQ ID NO: 582677 - protein, 10 aa, Mycobacterium
SPASNAVTGN

SEQ ID NO: 582678 - protein, 7 aa, Mycobacterium
SPASNYT

SEQ ID NO: 582679 - protein, 9 aa, Mycobacterium
SPASPAGRR

SEQ ID NO: 582680 - protein, 17 aa, Mycobacterium
SPASPLTLSGDTATEGT

SEQ ID NO: 582681 - protein, 8 aa, Mycobacterium
SPASPVDY

SEQ ID NO: 582682 - protein, 6 aa, Mycobacterium
SPASTL

SEQ ID NO: 582683 - protein, 7 aa, Mycobacterium
SPASWTS

SEQ ID NO: 582684 - protein, 4 aa, Mycobacterium
SPAT

SEQ ID NO: 582685 - protein, 14 aa, Mycobacterium
SPATAAADPGITNG

SEQ ID NO: 582686 - protein, 12 aa, Mycobacterium
SPATDTGDGPSV

SEQ ID NO: 582687 - protein, 6 aa, Mycobacterium
SPATGA

SEQ ID NO: 582688 - protein, 7 aa, Mycobacterium
SPATITG

SEQ ID NO: 582689 - protein, 6 aa, Mycobacterium
SPATKE

SEQ ID NO: 582690 - protein, 9 aa, Mycobacterium
SPATPELPA

SEQ ID NO: 582691 - protein, 11 aa, Mycobacterium
SPATPELPDDT

SEQ ID NO: 582692 - protein, 9 aa, Mycobacterium
SPATPTTAF

SEQ ID NO: 582693 - protein, 6 aa, Mycobacterium
SPATRE

SEQ ID NO: 582694 - protein, 10 aa, Mycobacterium
SPATSADQTA

SEQ ID NO: 582695 - protein, 8 aa, Mycobacterium
SPATVRDE

SEQ ID NO: 582696 - protein, 5 aa, Mycobacterium
SPAVA

SEQ ID NO: 582697 - protein, 12 aa, Mycobacterium
SPAVGAAGTTEA

SEQ ID NO: 582698 - protein, 8 aa, Mycobacterium
SPAVGVTD

SEQ ID NO: 582699 - protein, 16 aa, Mycobacterium
SPAVPEAPGCPVAHAK

SEQ ID NO: 582700 - protein, 5 aa, Mycobacterium
SPAVT

SEQ ID NO: 582701 - protein, 9 aa, Mycobacterium
SPAVTGKAS

SEQ ID NO: 582702 - protein, 4 aa, Mycobacterium
SPAW

SEQ ID NO: 582703 - protein, 8 aa, Mycobacterium
SPAWSDVD

SEQ ID NO: 582704 - protein, 7 aa, Mycobacterium
SPAYEDG

SEQ ID NO: 582705 - protein, 8 aa, Mycobacterium
SPCGNGKG

SEQ ID NO: 582706 - protein, 9 aa, Mycobacterium
SPCHSTGQP

SEQ ID NO: 582707 - protein, 4 aa, Mycobacterium
SPCP

SEQ ID NO: 582708 - protein, 21 aa, Mycobacterium
SPCPATQSAGADEYAAAARRA

SEQ ID NO: 582709 - protein, 4 aa, Mycobacterium
SPCS

SEQ ID NO: 582710 - protein, 9 aa, Mycobacterium
SPDAAAELR

SEQ ID NO: 582711 - protein, 9 aa, Mycobacterium
SPDAAAGRP

SEQ ID NO: 582712 - protein, 15 aa, Mycobacterium
SPDAAGTTVHLSARI

SEQ ID NO: 582713 - protein, 9 aa, Mycobacterium
SPDAAVGAG

SEQ ID NO: 582714 - protein, 18 aa, Mycobacterium
SPDAEVRYRSDGGEHTVA

SEQ ID NO: 582715 - protein, 9 aa, Mycobacterium
SPDAGHGDC

SEQ ID NO: 582716 - protein, 10 aa, Mycobacterium
SPDAGTGTAD

SEQ ID NO: 582717 - protein, 13 aa, Mycobacterium
SPDAISSTAYGPE

SEQ ID NO: 582718 - protein, 14 aa, Mycobacterium
SPDAKDTVKSENPR

SEQ ID NO: 582719 - protein, 16 aa, Mycobacterium
SPDALADTRQSGGGED

SEQ ID NO: 582720 - protein, 8 aa, Mycobacterium
SPDAPAKL

SEQ ID NO: 582721 - protein, 13 aa, Mycobacterium
SPDAQGAKYYGPR

SEQ ID NO: 582722 - protein, 7 aa, Mycobacterium
SPDASRV

SEQ ID NO: 582723 - protein, 5 aa, Mycobacterium
SPDAT

SEQ ID NO: 582724 - protein, 8 aa, Mycobacterium
SPDATDPL

SEQ ID NO: 582725 - protein, 20 aa, Mycobacterium
SPDATEPLDSYGRSSNPSWR

SEQ ID NO: 582726 - protein, 5 aa, Mycobacterium
SPDCA

SEQ ID NO: 582727 - protein, 11 aa, Mycobacterium
SPDDEADDGPF

SEQ ID NO: 582728 - protein, 8 aa, Mycobacterium
SPDDHPVP

SEQ ID NO: 582729 - protein, 9 aa, Mycobacterium
SPDDHQKPR

SEQ ID NO: 582730 - protein, 8 aa, Mycobacterium
SPDDLNDL

SEQ ID NO: 582731 - protein, 11 aa, Mycobacterium
SPDDLSQGIKD

SEQ ID NO: 582732 - protein, 9 aa, Mycobacterium
SPDDPAVAA

SEQ ID NO: 582733 - protein, 9 aa, Mycobacterium
SPDDRPALK

SEQ ID NO: 582734 - protein, 12 aa, Mycobacterium
SPDDVEYDNPQT

SEQ ID NO: 582735 - protein, 15 aa, Mycobacterium
SPDDVGNPYNTTPDY

SEQ ID NO: 582736 - protein, 5 aa, Mycobacterium
SPDEA

SEQ ID NO: 582737 - protein, 6 aa, Mycobacterium
SPDEAK

SEQ ID NO: 582738 - protein, 6 aa, Mycobacterium
SPDEAR

SEQ ID NO: 582739 - protein, 7 aa, Mycobacterium
SPDEFSK

SEQ ID NO: 582740 - protein, 9 aa, Mycobacterium
SPDEIDPDL

SEQ ID NO: 582741 - protein, 6 aa, Mycobacterium
SPDEIP

SEQ ID NO: 582742 - protein, 6 aa, Mycobacterium
SPDEKY

SEQ ID NO: 582743 - protein, 6 aa, Mycobacterium
SPDELE

SEQ ID NO: 582744 - protein, 8 aa, Mycobacterium
SPDEPDRT

SEQ ID NO: 582745 - protein, 14 aa, Mycobacterium
SPDESSGPIEVPDR

SEQ ID NO: 582746 - protein, 11 aa, Mycobacterium
SPDEYTGKRTH

SEQ ID NO: 582747 - protein, 19 aa, Mycobacterium
SPDEYTGKRTHMPDYPEEG

SEQ ID NO: 582748 - protein, 5 aa, Mycobacterium
SPDFG

SEQ ID NO: 582749 - protein, 6 aa, Mycobacterium
SPDFQR

SEQ ID NO: 582750 - protein, 8 aa, Mycobacterium
SPDGARGR

SEQ ID NO: 582751 - protein, 5 aa, Mycobacterium
SPDGD

SEQ ID NO: 582752 - protein, 12 aa, Mycobacterium
SPDGGDKPTGEL

SEQ ID NO: 582753 - protein, 9 aa, Mycobacterium
SPDGGRAQL

SEQ ID NO: 582754 - protein, 7 aa, Mycobacterium
SPDGIEG

SEQ ID NO: 582755 - protein, 12 aa, Mycobacterium
SPDGKNHGTRSL

SEQ ID NO: 582756 - protein, 12 aa, Mycobacterium
SPDGKNRGTSSL

SEQ ID NO: 582757 - protein, 7 aa, Mycobacterium
SPDGNGR

SEQ ID NO: 582758 - protein, 5 aa, Mycobacterium
SPDGP

SEQ ID NO: 582759 - protein, 13 aa, Mycobacterium
SPDGPEDQTTPSH

SEQ ID NO: 582760 - protein, 12 aa, Mycobacterium
SPDGPQASRDAY

SEQ ID NO: 582761 - protein, 7 aa, Mycobacterium
SPDGPWT

SEQ ID NO: 582762 - protein, 7 aa, Mycobacterium
SPDGQGR

SEQ ID NO: 582763 - protein, 10 aa, Mycobacterium
SPDGQPVTTA

SEQ ID NO: 582764 - protein, 9 aa, Mycobacterium
SPDGQTSVS

SEQ ID NO: 582765 - protein, 5 aa, Mycobacterium
SPDGR

SEQ ID NO: 582766 - protein, 7 aa, Mycobacterium
SPDGRAR

SEQ ID NO: 582767 - protein, 16 aa, Mycobacterium
SPDGRATTVIEDPDGA

SEQ ID NO: 582768 - protein, 6 aa, Mycobacterium
SPDGRP

SEQ ID NO: 582769 - protein, 9 aa, Mycobacterium
SPDGRRSAR

SEQ ID NO: 582770 - protein, 9 aa, Mycobacterium
SPDGRSVDG

SEQ ID NO: 582771 - protein, 5 aa, Mycobacterium
SPDGS

SEQ ID NO: 582772 - protein, 5 aa, Mycobacterium
SPDGT

SEQ ID NO: 582773 - protein, 12 aa, Mycobacterium
SPDGTESPQAAH

SEQ ID NO: 582774 - protein, 8 aa, Mycobacterium
SPDGTVNS

SEQ ID NO: 582775 - protein, 8 aa, Mycobacterium
SPDGYYTK

SEQ ID NO: 582776 - protein, 4 aa, Mycobacterium
SPDH

SEQ ID NO: 582777 - protein, 8 aa, Mycobacterium
SPDIGGAL

SEQ ID NO: 582778 - protein, 6 aa, Mycobacterium
SPDIGT

SEQ ID NO: 582779 - protein, 4 aa, Mycobacterium
SPDK

SEQ ID NO: 582780 - protein, 10 aa, Mycobacterium
SPDKIEGGMQ

SEQ ID NO: 582781 - protein, 16 aa, Mycobacterium
SPDKTDRMTRFLERQT

SEQ ID NO: 582782 - protein, 9 aa, Mycobacterium
SPDKVEGGM

SEQ ID NO: 582783 - protein, 10 aa, Mycobacterium
SPDKVEGGMR

SEQ ID NO: 582784 - protein, 4 aa, Mycobacterium
SPDL

SEQ ID NO: 582785 - protein, 6 aa, Mycobacterium
SPDLDA

SEQ ID NO: 582786 - protein, 5 aa, Mycobacterium
SPDLE

SEQ ID NO: 582787 - protein, 6 aa, Mycobacterium
SPDLQE

SEQ ID NO: 582788 - protein, 4 aa, Mycobacterium
SPDN

SEQ ID NO: 582789 - protein, 5 aa, Mycobacterium
SPDNA

SEQ ID NO: 582790 - protein, 11 aa, Mycobacterium
SPDNATAALRS

SEQ ID NO: 582791 - protein, 6 aa, Mycobacterium
SPDNEV

SEQ ID NO: 582792 - protein, 22 aa, Mycobacterium
SPDNPPPGTTVTPQGPQQSPNV

SEQ ID NO: 582793 - protein, 7 aa, Mycobacterium
SPDNPRL

SEQ ID NO: 582794 - protein, 4 aa, Mycobacterium
SPDP

SEQ ID NO: 582795 - protein, 11 aa, Mycobacterium
SPDPAAPPIDR

SEQ ID NO: 582796 - protein, 11 aa, Mycobacterium
SPDPAEEAQHD

SEQ ID NO: 582797 - protein, 9 aa, Mycobacterium
SPDPDNVDQ

SEQ ID NO: 582798 - protein, 8 aa, Mycobacterium
SPDPDPEK

SEQ ID NO: 582799 - protein, 6 aa, Mycobacterium
SPDPDR

SEQ ID NO: 582800 - protein, 8 aa, Mycobacterium
SPDPGPVT

SEQ ID NO: 582801 - protein, 7 aa, Mycobacterium
SPDPGSV

SEQ ID NO: 582802 - protein, 9 aa, Mycobacterium
SPDPKPSVG

SEQ ID NO: 582803 - protein, 6 aa, Mycobacterium
SPDPPP

SEQ ID NO: 582804 - protein, 9 aa, Mycobacterium
SPDPRAEAG

SEQ ID NO: 582805 - protein, 7 aa, Mycobacterium
SPDPSIR

SEQ ID NO: 582806 - protein, 7 aa, Mycobacterium
SPDPTEG

SEQ ID NO: 582807 - protein, 9 aa, Mycobacterium
SPDPVDPAD

SEQ ID NO: 582808 - protein, 9 aa, Mycobacterium
SPDPVDPAE

SEQ ID NO: 582809 - protein, 9 aa, Mycobacterium
SPDPWTTRP

SEQ ID NO: 582810 - protein, 5 aa, Mycobacterium
SPDQA

SEQ ID NO: 582811 - protein, 24 aa, Mycobacterium
SPDQAARKGIEKRTTRPRIPQEVS

SEQ ID NO: 582812 - protein, 8 aa, Mycobacterium
SPDQARAQ

SEQ ID NO: 582813 - protein, 7 aa, Mycobacterium
SPDQGPR

SEQ ID NO: 582814 - protein, 5 aa, Mycobacterium
SPDQL

SEQ ID NO: 582815 - protein, 7 aa, Mycobacterium
SPDQVAR

SEQ ID NO: 582816 - protein, 5 aa, Mycobacterium
SPDQW

SEQ ID NO: 582817 - protein, 13 aa, Mycobacterium
SPDQYRKTSALTG

SEQ ID NO: 582818 - protein, 8 aa, Mycobacterium
SPDRGGHF

SEQ ID NO: 582819 - protein, 6 aa, Mycobacterium
SPDRKL

SEQ ID NO: 582820 - protein, 5 aa, Mycobacterium
SPDRL

SEQ ID NO: 582821 - protein, 8 aa, Mycobacterium
SPDRMAGG

SEQ ID NO: 582822 - protein, 5 aa, Mycobacterium
SPDRR

SEQ ID NO: 582823 - protein, 5 aa, Mycobacterium
SPDRT

SEQ ID NO: 582824 - protein, 4 aa, Mycobacterium
SPDS

SEQ ID NO: 582825 - protein, 10 aa, Mycobacterium
SPDSFQGRSS

SEQ ID NO: 582826 - protein, 8 aa, Mycobacterium
SPDSGRVR

SEQ ID NO: 582827 - protein, 8 aa, Mycobacterium
SPDSGWDR

SEQ ID NO: 582828 - protein, 8 aa, Mycobacterium
SPDSLGTE

SEQ ID NO: 582829 - protein, 8 aa, Mycobacterium
SPDSPRGR

SEQ ID NO: 582830 - protein, 8 aa, Mycobacterium
SPDSVADQ

SEQ ID NO: 582831 - protein, 10 aa, Mycobacterium
SPDTHTTVNG

SEQ ID NO: 582832 - protein, 10 aa, Mycobacterium
SPDTPQELAD

SEQ ID NO: 582833 - protein, 9 aa, Mycobacterium
SPDTQAGIN

SEQ ID NO: 582834 - protein, 7 aa, Mycobacterium
SPDTSGA

SEQ ID NO: 582835 - protein, 6 aa, Mycobacterium
SPDTVT

SEQ ID NO: 582836 - protein, 4 aa, Mycobacterium
SPDV

SEQ ID NO: 582837 - protein, 5 aa, Mycobacterium
SPDVH

SEQ ID NO: 582838 - protein, 7 aa, Mycobacterium
SPDVRSG

SEQ ID NO: 582839 - protein, 10 aa, Mycobacterium
SPDVSSSTNL

SEQ ID NO: 582840 - protein, 11 aa, Mycobacterium
SPDVSSTTNLG

SEQ ID NO: 582841 - protein, 17 aa, Mycobacterium
SPDWSGPDDDENDLPPA

SEQ ID NO: 582842 - protein, 6 aa, Mycobacterium
SPDYET

SEQ ID NO: 582843 - protein, 4 aa, Mycobacterium
SPEA

SEQ ID NO: 582844 - protein, 9 aa, Mycobacterium
SPEAAAGGT

SEQ ID NO: 582845 - protein, 8 aa, Mycobacterium
SPEAADID

SEQ ID NO: 582846 - protein, 12 aa, Mycobacterium
SPEAAELGEIDR

SEQ ID NO: 582847 - protein, 7 aa, Mycobacterium
SPEAARA

SEQ ID NO: 582848 - protein, 5 aa, Mycobacterium
SPEAL

SEQ ID NO: 582849 - protein, 10 aa, Mycobacterium
SPEARADLDD

SEQ ID NO: 582850 - protein, 15 aa, Mycobacterium
SPEAREELGDVDRAQ

SEQ ID NO: 582851 - protein, 10 aa, Mycobacterium
SPEASDSASF

SEQ ID NO: 582852 - protein, 12 aa, Mycobacterium
SPEATTKSGTLS

SEQ ID NO: 582853 - protein, 5 aa, Mycobacterium
SPEAV

SEQ ID NO: 582854 - protein, 4 aa, Mycobacterium
SPED

SEQ ID NO: 582855 - protein, 16 aa, Mycobacterium
SPEDAPGEEDAARLAT

SEQ ID NO: 582856 - protein, 10 aa, Mycobacterium
SPEDGGGIPW

SEQ ID NO: 582857 - protein, 5 aa, Mycobacterium
SPEDH

SEQ ID NO: 582858 - protein, 5 aa, Mycobacterium
SPEDI

SEQ ID NO: 582859 - protein, 8 aa, Mycobacterium
SPEDIESL

SEQ ID NO: 582860 - protein, 6 aa, Mycobacterium
SPEDLS

SEQ ID NO: 582861 - protein, 10 aa, Mycobacterium
SPEDRAPAAI

SEQ ID NO: 582862 - protein, 7 aa, Mycobacterium
SPEDTAD

SEQ ID NO: 582863 - protein, 6 aa, Mycobacterium
SPEEIA

SEQ ID NO: 582864 - protein, 6 aa, Mycobacterium
SPEEQA

SEQ ID NO: 582865 - protein, 5 aa, Mycobacterium
SPEES

SEQ ID NO: 582866 - protein, 7 aa, Mycobacterium
SPEESAR

SEQ ID NO: 582867 - protein, 8 aa, Mycobacterium
SPEESPRS

SEQ ID NO: 582868 - protein, 8 aa, Mycobacterium
SPEESRAQ

SEQ ID NO: 582869 - protein, 5 aa, Mycobacterium
SPEEV

SEQ ID NO: 582870 - protein, 9 aa, Mycobacterium
SPEFRDDPY

SEQ ID NO: 582871 - protein, 4 aa, Mycobacterium
SPEG

SEQ ID NO: 582872 - protein, 5 aa, Mycobacterium
SPEGA

SEQ ID NO: 582873 - protein, 5 aa, Mycobacterium
SPEGD

SEQ ID NO: 582874 - protein, 7 aa, Mycobacterium
SPEGDRR

SEQ ID NO: 582875 - protein, 11 aa, Mycobacterium
SPEGDTGKSTV

SEQ ID NO: 582876 - protein, 7 aa, Mycobacterium
SPEGGNA

SEQ ID NO: 582877 - protein, 17 aa, Mycobacterium
SPEGQQIKADAQTAEAD

SEQ ID NO: 582878 - protein, 9 aa, Mycobacterium
SPEGQRPEV

SEQ ID NO: 582879 - protein, 8 aa, Mycobacterium
SPEGTRGR

SEQ ID NO: 582880 - protein, 12 aa, Mycobacterium
SPEGWPSRPTYS

SEQ ID NO: 582881 - protein, 4 aa, Mycobacterium
SPEH

SEQ ID NO: 582882 - protein, 17 aa, Mycobacterium
SPEHQPPTFPDPRGSQQ

SEQ ID NO: 582883 - protein, 4 aa, Mycobacterium
SPEI

SEQ ID NO: 582884 - protein, 14 aa, Mycobacterium
SPEIETGEIAPETC

SEQ ID NO: 582885 - protein, 6 aa, Mycobacterium
SPEIGA

SEQ ID NO: 582886 - protein, 5 aa, Mycobacterium
SPEIS

SEQ ID NO: 582887 - protein, 4 aa, Mycobacterium
SPEK

SEQ ID NO: 582888 - protein, 13 aa, Mycobacterium
SPEKAGKDAGDLA

SEQ ID NO: 582889 - protein, 8 aa, Mycobacterium
SPEKGNSA

SEQ ID NO: 582890 - protein, 5 aa, Mycobacterium
SPEKL

SEQ ID NO: 582891 - protein, 10 aa, Mycobacterium
SPEKPDDIDN

SEQ ID NO: 582892 - protein, 19 aa, Mycobacterium
SPEKVGTDTGEFAGVGTNG

SEQ ID NO: 582893 - protein, 9 aa, Mycobacterium
SPEKVTARE

SEQ ID NO: 582894 - protein, 17 aa, Mycobacterium
SPELADDPRFSTNPQRV

SEQ ID NO: 582895 - protein, 6 aa, Mycobacterium
SPELEE

SEQ ID NO: 582896 - protein, 10 aa, Mycobacterium
SPELEPGEKE

SEQ ID NO: 582897 - protein, 7 aa, Mycobacterium
SPELTPE

SEQ ID NO: 582898 - protein, 13 aa, Mycobacterium
SPELVRNSQRAAV

SEQ ID NO: 582899 - protein, 6 aa, Mycobacterium
SPENAR

SEQ ID NO: 582900 - protein, 8 aa, Mycobacterium
SPENARKR

SEQ ID NO: 582901 - protein, 4 aa, Mycobacterium
SPEP

SEQ ID NO: 582902 - protein, 6 aa, Mycobacterium
SPEPDS

SEQ ID NO: 582903 - protein, 8 aa, Mycobacterium
SPEPGPQA

SEQ ID NO: 582904 - protein, 11 aa, Mycobacterium
SPEPKASAGLG

SEQ ID NO: 582905 - protein, 11 aa, Mycobacterium
SPEPKASDGLG

SEQ ID NO: 582906 - protein, 10 aa, Mycobacterium
SPEPKPCEGL

SEQ ID NO: 582907 - protein, 11 aa, Mycobacterium
SPEPKPSAGLG

SEQ ID NO: 582908 - protein, 5 aa, Mycobacterium
SPEPM

SEQ ID NO: 582909 - protein, 7 aa, Mycobacterium
SPEPQTV

SEQ ID NO: 582910 - protein, 7 aa, Mycobacterium
SPEPSEL

SEQ ID NO: 582911 - protein, 6 aa, Mycobacterium
SPEPTA

SEQ ID NO: 582912 - protein, 120 aa, Mycobacterium
SPEPTNEPATSTRPSSNGKPAAKAPTSPAEPAPAPKPTGTNGSTAPAKSDKPAAKSPEKPAAKSSSSEKPADKTAQKTTDKAAQKTESKTDGKSAEKAAPAKTSEKSAPAAASEDESQVL

SEQ ID NO: 582913 - protein, 64 aa, Mycobacterium
SPEPTTDSASNGRTTTAAPVTPPTPAPAPAPEPKAAPKPAAKTEAKPAKPAKSATPAKGDESQI

SEQ ID NO: 582914 - protein, 5 aa, Mycobacterium
SPEPV

SEQ ID NO: 582915 - protein, 4 aa, Mycobacterium
SPEQ

SEQ ID NO: 582916 - protein, 5 aa, Mycobacterium
SPEQI

SEQ ID NO: 582917 - protein, 5 aa, Mycobacterium
SPEQL

SEQ ID NO: 582918 - protein, 8 aa, Mycobacterium
SPEQPGCQ

SEQ ID NO: 582919 - protein, 9 aa, Mycobacterium
SPEQVRTRT

SEQ ID NO: 582920 - protein, 4 aa, Mycobacterium
SPER

SEQ ID NO: 582921 - protein, 12 aa, Mycobacterium
SPERAKDLKQRP

SEQ ID NO: 582922 - protein, 9 aa, Mycobacterium
SPERESEQV

SEQ ID NO: 582923 - protein, 5 aa, Mycobacterium
SPERF

SEQ ID NO: 582924 - protein, 7 aa, Mycobacterium
SPERFDP

SEQ ID NO: 582925 - protein, 6 aa, Mycobacterium
SPERIA

SEQ ID NO: 582926 - protein, 5 aa, Mycobacterium
SPERL

SEQ ID NO: 582927 - protein, 7 aa, Mycobacterium
SPERLAE

SEQ ID NO: 582928 - protein, 8 aa, Mycobacterium
SPERPSGT

SEQ ID NO: 582929 - protein, 8 aa, Mycobacterium
SPERRAGV

SEQ ID NO: 582930 - protein, 6 aa, Mycobacterium
SPERRR

SEQ ID NO: 582931 - protein, 7 aa, Mycobacterium
SPERTGE

SEQ ID NO: 582932 - protein, 15 aa, Mycobacterium
SPERTTGGGRRYSQR

SEQ ID NO: 582933 - protein, 6 aa, Mycobacterium
SPERVR

SEQ ID NO: 582934 - protein, 6 aa, Mycobacterium
SPERYR

SEQ ID NO: 582935 - protein, 8 aa, Mycobacterium
SPESAESM

SEQ ID NO: 582936 - protein, 7 aa, Mycobacterium
SPESAGG

SEQ ID NO: 582937 - protein, 9 aa, Mycobacterium
SPESAPDAA

SEQ ID NO: 582938 - protein, 5 aa, Mycobacterium
SPESG

SEQ ID NO: 582939 - protein, 18 aa, Mycobacterium
SPESGWDRGGDQPPPPLP

SEQ ID NO: 582940 - protein, 5 aa, Mycobacterium
SPESL

SEQ ID NO: 582941 - protein, 8 aa, Mycobacterium
SPESTAMA

SEQ ID NO: 582942 - protein, 9 aa, Mycobacterium
SPESTQALR

SEQ ID NO: 582943 - protein, 7 aa, Mycobacterium
SPESVAD

SEQ ID NO: 582944 - protein, 9 aa, Mycobacterium
SPESYTGTE

SEQ ID NO: 582945 - protein, 7 aa, Mycobacterium
SPETAAS

SEQ ID NO: 582946 - protein, 15 aa, Mycobacterium
SPETASRFEASSATF

SEQ ID NO: 582947 - protein, 5 aa, Mycobacterium
SPETD

SEQ ID NO: 582948 - protein, 24 aa, Mycobacterium
SPETGQVLGPGQVGEIQARSTSLT

SEQ ID NO: 582949 - protein, 5 aa, Mycobacterium
SPETL

SEQ ID NO: 582950 - protein, 6 aa, Mycobacterium
SPETSI

SEQ ID NO: 582951 - protein, 6 aa, Mycobacterium
SPETTA

SEQ ID NO: 582952 - protein, 21 aa, Mycobacterium
SPETTGKPAGDDLAARKATSV

SEQ ID NO: 582953 - protein, 6 aa, Mycobacterium
SPEVSS

SEQ ID NO: 582954 - protein, 14 aa, Mycobacterium
SPEWSGSETGGRRY

SEQ ID NO: 582955 - protein, 5 aa, Mycobacterium
SPEWT

SEQ ID NO: 582956 - protein, 5 aa, Mycobacterium
SPEWY

SEQ ID NO: 582957 - protein, 4 aa, Mycobacterium
SPEY

SEQ ID NO: 582958 - protein, 7 aa, Mycobacterium
SPEYAAS

SEQ ID NO: 582959 - protein, 6 aa, Mycobacterium
SPEYAG

SEQ ID NO: 582960 - protein, 6 aa, Mycobacterium
SPEYVP

SEQ ID NO: 582961 - protein, 8 aa, Mycobacterium
SPFARTDN

SEQ ID NO: 582962 - protein, 5 aa, Mycobacterium
SPFAT

SEQ ID NO: 582963 - protein, 5 aa, Mycobacterium
SPFDA

SEQ ID NO: 582964 - protein, 6 aa, Mycobacterium
SPFDTG

SEQ ID NO: 582965 - protein, 5 aa, Mycobacterium
SPFDY

SEQ ID NO: 582966 - protein, 4 aa, Mycobacterium
SPFE

SEQ ID NO: 582967 - protein, 11 aa, Mycobacterium
SPFEGPTPPER

SEQ ID NO: 582968 - protein, 11 aa, Mycobacterium
SPFEGPTPPQR

SEQ ID NO: 582969 - protein, 5 aa, Mycobacterium
SPFEH

SEQ ID NO: 582970 - protein, 21 aa, Mycobacterium
SPFGGTKQSGLGYRNGEEGYK

SEQ ID NO: 582971 - protein, 32 aa, Mycobacterium
SPFGGTKQSGLGYRNGEEGYKEYLEAKTIGMP

SEQ ID NO: 582972 - protein, 6 aa, Mycobacterium
SPFGQR

SEQ ID NO: 582973 - protein, 12 aa, Mycobacterium
SPFPADDENDAA

SEQ ID NO: 582974 - protein, 10 aa, Mycobacterium
SPFPGAAAPS

SEQ ID NO: 582975 - protein, 5 aa, Mycobacterium
SPFPK

SEQ ID NO: 582976 - protein, 28 aa, Mycobacterium
SPFPQSPAPGGPMPLDPAPTAPVTSRDQ

SEQ ID NO: 582977 - protein, 4 aa, Mycobacterium
SPFQ

SEQ ID NO: 582978 - protein, 5 aa, Mycobacterium
SPFQH

SEQ ID NO: 582979 - protein, 4 aa, Mycobacterium
SPFS

SEQ ID NO: 582980 - protein, 21 aa, Mycobacterium
SPFSPQTSYAPTFAPETTTDL

SEQ ID NO: 582981 - protein, 7 aa, Mycobacterium
SPFTGDP

SEQ ID NO: 582982 - protein, 14 aa, Mycobacterium
SPFWDGEDTGYASN

SEQ ID NO: 582983 - protein, 13 aa, Mycobacterium
SPGAAALARRALG

SEQ ID NO: 582984 - protein, 7 aa, Mycobacterium
SPGAARR

SEQ ID NO: 582985 - protein, 5 aa, Mycobacterium
SPGAD

SEQ ID NO: 582986 - protein, 8 aa, Mycobacterium
SPGADAVS

SEQ ID NO: 582987 - protein, 6 aa, Mycobacterium
SPGADV

SEQ ID NO: 582988 - protein, 8 aa, Mycobacterium
SPGAGGTL

SEQ ID NO: 582989 - protein, 6 aa, Mycobacterium
SPGAGK

SEQ ID NO: 582990 - protein, 20 aa, Mycobacterium
SPGAIDTPLQRRGRTPEEAQ

SEQ ID NO: 582991 - protein, 17 aa, Mycobacterium
SPGAPPFGPGATPWPGP

SEQ ID NO: 582992 - protein, 5 aa, Mycobacterium
SPGAR

SEQ ID NO: 582993 - protein, 9 aa, Mycobacterium
SPGASEPLS

SEQ ID NO: 582994 - protein, 9 aa, Mycobacterium
SPGASTAIE

SEQ ID NO: 582995 - protein, 6 aa, Mycobacterium
SPGDDE

SEQ ID NO: 582996 - protein, 10 aa, Mycobacterium
SPGDDPATIT

SEQ ID NO: 582997 - protein, 8 aa, Mycobacterium
SPGDEGPG

SEQ ID NO: 582998 - protein, 5 aa, Mycobacterium
SPGDL

SEQ ID NO: 582999 - protein, 10 aa, Mycobacterium
SPGDRRAARA

SEQ ID NO: 583000 - protein, 4 aa, Mycobacterium
SPGE

SEQ ID NO: 583001 - protein, 5 aa, Mycobacterium
SPGED

SEQ ID NO: 583002 - protein, 24 aa, Mycobacterium
SPGEDPDKHGKKDPDSGSNPSDPF

SEQ ID NO: 583003 - protein, 22 aa, Mycobacterium
SPGEGGSPDDEDDIEESAGEIG

SEQ ID NO: 583004 - protein, 7 aa, Mycobacterium
SPGEGQL

SEQ ID NO: 583005 - protein, 5 aa, Mycobacterium
SPGER

SEQ ID NO: 583006 - protein, 16 aa, Mycobacterium
SPGESGRGSVDTADHP

SEQ ID NO: 583007 - protein, 7 aa, Mycobacterium
SPGEYAE

SEQ ID NO: 583008 - protein, 7 aa, Mycobacterium
SPGEYDD

SEQ ID NO: 583009 - protein, 4 aa, Mycobacterium
SPGF

SEQ ID NO: 583010 - protein, 6 aa, Mycobacterium
SPGFNE

SEQ ID NO: 583011 - protein, 12 aa, Mycobacterium
SPGFRGAPGYEG

SEQ ID NO: 583012 - protein, 6 aa, Mycobacterium
SPGGAM

SEQ ID NO: 583013 - protein, 6 aa, Mycobacterium
SPGGEL

SEQ ID NO: 583014 - protein, 6 aa, Mycobacterium
SPGGEP

SEQ ID NO: 583015 - protein, 7 aa, Mycobacterium
SPGGHDP

SEQ ID NO: 583016 - protein, 11 aa, Mycobacterium
SPGGNDEGRGL

SEQ ID NO: 583017 - protein, 14 aa, Mycobacterium
SPGGPLQGAPPPVD

SEQ ID NO: 583018 - protein, 12 aa, Mycobacterium
SPGGQTFTTHPG

SEQ ID NO: 583019 - protein, 13 aa, Mycobacterium
SPGGRKSSSANGW

SEQ ID NO: 583020 - protein, 10 aa, Mycobacterium
SPGGRTSGDG

SEQ ID NO: 583021 - protein, 9 aa, Mycobacterium
SPGGRTSGE

SEQ ID NO: 583022 - protein, 8 aa, Mycobacterium
SPGGSDAS

SEQ ID NO: 583023 - protein, 53 aa, Mycobacterium
SPGGTGGTGGAGPSQLGGFGGSGGSGGLFSSGGAGGAGGFGDIGGPGGSGGFG

SEQ ID NO: 583024 - protein, 9 aa, Mycobacterium
SPGGTITAS

SEQ ID NO: 583025 - protein, 5 aa, Mycobacterium
SPGGV

SEQ ID NO: 583026 - protein, 6 aa, Mycobacterium
SPGGYD

SEQ ID NO: 583027 - protein, 4 aa, Mycobacterium
SPGH

SEQ ID NO: 583028 - protein, 6 aa, Mycobacterium
SPGHDD

SEQ ID NO: 583029 - protein, 10 aa, Mycobacterium
SPGHNGSPVL

SEQ ID NO: 583030 - protein, 5 aa, Mycobacterium
SPGHP

SEQ ID NO: 583031 - protein, 7 aa, Mycobacterium
SPGHTNG

SEQ ID NO: 583032 - protein, 5 aa, Mycobacterium
SPGID

SEQ ID NO: 583033 - protein, 10 aa, Mycobacterium
SPGIDRPLTS

SEQ ID NO: 583034 - protein, 7 aa, Mycobacterium
SPGLDKA

SEQ ID NO: 583035 - protein, 7 aa, Mycobacterium
SPGLDRA

SEQ ID NO: 583036 - protein, 7 aa, Mycobacterium
SPGLGTA

SEQ ID NO: 583037 - protein, 7 aa, Mycobacterium
SPGLSSA

SEQ ID NO: 583038 - protein, 5 aa, Mycobacterium
SPGLT

SEQ ID NO: 583039 - protein, 14 aa, Mycobacterium
SPGLTKAKETVASY

SEQ ID NO: 583040 - protein, 6 aa, Mycobacterium
SPGLTP

SEQ ID NO: 583041 - protein, 7 aa, Mycobacterium
SPGMAKA

SEQ ID NO: 583042 - protein, 8 aa, Mycobacterium
SPGMARAK

SEQ ID NO: 583043 - protein, 6 aa, Mycobacterium
SPGMDQ

SEQ ID NO: 583044 - protein, 6 aa, Mycobacterium
SPGMEP

SEQ ID NO: 583045 - protein, 5 aa, Mycobacterium
SPGMF

SEQ ID NO: 583046 - protein, 16 aa, Mycobacterium
SPGNDRDGRPIDYSSA

SEQ ID NO: 583047 - protein, 9 aa, Mycobacterium
SPGPGPALA

SEQ ID NO: 583048 - protein, 12 aa, Mycobacterium
SPGPGTPERAGA

SEQ ID NO: 583049 - protein, 13 aa, Mycobacterium
SPGPGTPESAGAS

SEQ ID NO: 583050 - protein, 7 aa, Mycobacterium
SPGPIGA

SEQ ID NO: 583051 - protein, 7 aa, Mycobacterium
SPGPMHD

SEQ ID NO: 583052 - protein, 17 aa, Mycobacterium
SPGPPRADGRPSTPQDL

SEQ ID NO: 583053 - protein, 17 aa, Mycobacterium
SPGPRTRRQAGVGGQAR

SEQ ID NO: 583054 - protein, 6 aa, Mycobacterium
SPGPTT

SEQ ID NO: 583055 - protein, 5 aa, Mycobacterium
SPGQP

SEQ ID NO: 583056 - protein, 18 aa, Mycobacterium
SPGQRAGELSPAAAEATG

SEQ ID NO: 583057 - protein, 17 aa, Mycobacterium
SPGQTGDRAGRNDALGF

SEQ ID NO: 583058 - protein, 4 aa, Mycobacterium
SPGR

SEQ ID NO: 583059 - protein, 8 aa, Mycobacterium
SPGRDTPI

SEQ ID NO: 583060 - protein, 7 aa, Mycobacterium
SPGRGPH

SEQ ID NO: 583061 - protein, 7 aa, Mycobacterium
SPGRHAA

SEQ ID NO: 583062 - protein, 5 aa, Mycobacterium
SPGRL

SEQ ID NO: 583063 - protein, 7 aa, Mycobacterium
SPGRNNP

SEQ ID NO: 583064 - protein, 5 aa, Mycobacterium
SPGRP

SEQ ID NO: 583065 - protein, 13 aa, Mycobacterium
SPGRPGGSWATPD

SEQ ID NO: 583066 - protein, 16 aa, Mycobacterium
SPGRQPGRTKVGNTPV

SEQ ID NO: 583067 - protein, 4 aa, Mycobacterium
SPGS

SEQ ID NO: 583068 - protein, 5 aa, Mycobacterium
SPGSA

SEQ ID NO: 583069 - protein, 6 aa, Mycobacterium
SPGSAV

SEQ ID NO: 583070 - protein, 11 aa, Mycobacterium
SPGSDASAPAS

SEQ ID NO: 583071 - protein, 8 aa, Mycobacterium
SPGSIDTE

SEQ ID NO: 583072 - protein, 9 aa, Mycobacterium
SPGSPADAR

SEQ ID NO: 583073 - protein, 9 aa, Mycobacterium
SPGSPAGRR

SEQ ID NO: 583074 - protein, 8 aa, Mycobacterium
SPGSPRRL

SEQ ID NO: 583075 - protein, 7 aa, Mycobacterium
SPGSQVH

SEQ ID NO: 583076 - protein, 10 aa, Mycobacterium
SPGSRGDIGG

SEQ ID NO: 583077 - protein, 11 aa, Mycobacterium
SPGSRSDIGGA

SEQ ID NO: 583078 - protein, 11 aa, Mycobacterium
SPGSRSDISGA

SEQ ID NO: 583079 - protein, 4 aa, Mycobacterium
SPGT

SEQ ID NO: 583080 - protein, 6 aa, Mycobacterium
SPGTAA

SEQ ID NO: 583081 - protein, 13 aa, Mycobacterium
SPGTADDPDDPDH

SEQ ID NO: 583082 - protein, 8 aa, Mycobacterium
SPGTDPGQ

SEQ ID NO: 583083 - protein, 5 aa, Mycobacterium
SPGTH

SEQ ID NO: 583084 - protein, 22 aa, Mycobacterium
SPGTVGNRHTDPETRRAPGFRG

SEQ ID NO: 583085 - protein, 5 aa, Mycobacterium
SPGVA

SEQ ID NO: 583086 - protein, 13 aa, Mycobacterium
SPGVDRPLTEEKH

SEQ ID NO: 583087 - protein, 11 aa, Mycobacterium
SPGVDRPLTTE

SEQ ID NO: 583088 - protein, 5 aa, Mycobacterium
SPGVE

SEQ ID NO: 583089 - protein, 6 aa, Mycobacterium
SPGVET

SEQ ID NO: 583090 - protein, 6 aa, Mycobacterium
SPGVFP

SEQ ID NO: 583091 - protein, 6 aa, Mycobacterium
SPGVYQ

SEQ ID NO: 583092 - protein, 5 aa, Mycobacterium
SPGWA

SEQ ID NO: 583093 - protein, 7 aa, Mycobacterium
SPGWDNS

SEQ ID NO: 583094 - protein, 4 aa, Mycobacterium
SPGY

SEQ ID NO: 583095 - protein, 6 aa, Mycobacterium
SPGYHG

SEQ ID NO: 583096 - protein, 8 aa, Mycobacterium
SPGYPAPL

SEQ ID NO: 583097 - protein, 9 aa, Mycobacterium
SPGYQDQRR

SEQ ID NO: 583098 - protein, 13 aa, Mycobacterium
SPHAAYEAGRRGA

SEQ ID NO: 583099 - protein, 6 aa, Mycobacterium
SPHAES

SEQ ID NO: 583100 - protein, 7 aa, Mycobacterium
SPHAGSW

SEQ ID NO: 583101 - protein, 21 aa, Mycobacterium
SPHAPAAETARKYECPTGPEF

SEQ ID NO: 583102 - protein, 34 aa, Mycobacterium
SPHAVTPDPWSGSETGTATLNYTSGTTSRPKGVQ

SEQ ID NO: 583103 - protein, 7 aa, Mycobacterium
SPHDAEE

SEQ ID NO: 583104 - protein, 5 aa, Mycobacterium
SPHDD

SEQ ID NO: 583105 - protein, 11 aa, Mycobacterium
SPHDGAAIGTA

SEQ ID NO: 583106 - protein, 8 aa, Mycobacterium
SPHDPAPS

SEQ ID NO: 583107 - protein, 6 aa, Mycobacterium
SPHDVG

SEQ ID NO: 583108 - protein, 4 aa, Mycobacterium
SPHE

SEQ ID NO: 583109 - protein, 5 aa, Mycobacterium
SPHED

SEQ ID NO: 583110 - protein, 5 aa, Mycobacterium
SPHEG

SEQ ID NO: 583111 - protein, 11 aa, Mycobacterium
SPHEGAAIGTA

SEQ ID NO: 583112 - protein, 14 aa, Mycobacterium
SPHEQTFDADGRSF

SEQ ID NO: 583113 - protein, 4 aa, Mycobacterium
SPHG

SEQ ID NO: 583114 - protein, 7 aa, Mycobacterium
SPHGDGY

SEQ ID NO: 583115 - protein, 5 aa, Mycobacterium
SPHGE

SEQ ID NO: 583116 - protein, 14 aa, Mycobacterium
SPHGGDKPEGELGG

SEQ ID NO: 583117 - protein, 13 aa, Mycobacterium
SPHGGDKPTGDLA

SEQ ID NO: 583118 - protein, 6 aa, Mycobacterium
SPHGGL

SEQ ID NO: 583119 - protein, 13 aa, Mycobacterium
SPHGGLGVDRDGG

SEQ ID NO: 583120 - protein, 5 aa, Mycobacterium
SPHGK

SEQ ID NO: 583121 - protein, 8 aa, Mycobacterium
SPHGSVDG

SEQ ID NO: 583122 - protein, 4 aa, Mycobacterium
SPHI

SEQ ID NO: 583123 - protein, 8 aa, Mycobacterium
SPHIDGAQ

SEQ ID NO: 583124 - protein, 4 aa, Mycobacterium
SPHL

SEQ ID NO: 583125 - protein, 6 aa, Mycobacterium
SPHLTP

SEQ ID NO: 583126 - protein, 6 aa, Mycobacterium
SPHNPD

SEQ ID NO: 583127 - protein, 8 aa, Mycobacterium
SPHNPTGA

SEQ ID NO: 583128 - protein, 14 aa, Mycobacterium
SPHNPTGAVASDAE

SEQ ID NO: 583129 - protein, 8 aa, Mycobacterium
SPHNPTGK

SEQ ID NO: 583130 - protein, 8 aa, Mycobacterium
SPHNPTGT

SEQ ID NO: 583131 - protein, 9 aa, Mycobacterium
SPHNPTGTV

SEQ ID NO: 583132 - protein, 7 aa, Mycobacterium
SPHNRNA

SEQ ID NO: 583133 - protein, 4 aa, Mycobacterium
SPHP

SEQ ID NO: 583134 - protein, 8 aa, Mycobacterium
SPHPDGPG

SEQ ID NO: 583135 - protein, 6 aa, Mycobacterium
SPHPEG

SEQ ID NO: 583136 - protein, 7 aa, Mycobacterium
SPHPEGG

SEQ ID NO: 583137 - protein, 7 aa, Mycobacterium
SPHPSAR

SEQ ID NO: 583138 - protein, 5 aa, Mycobacterium
SPHQD

SEQ ID NO: 583139 - protein, 5 aa, Mycobacterium
SPHRP

SEQ ID NO: 583140 - protein, 5 aa, Mycobacterium
SPHRR

SEQ ID NO: 583141 - protein, 6 aa, Mycobacterium
SPHRRI

SEQ ID NO: 583142 - protein, 5 aa, Mycobacterium
SPHRV

SEQ ID NO: 583143 - protein, 7 aa, Mycobacterium
SPHSPFS

SEQ ID NO: 583144 - protein, 8 aa, Mycobacterium
SPHSSDRA

SEQ ID NO: 583145 - protein, 5 aa, Mycobacterium
SPHTA

SEQ ID NO: 583146 - protein, 13 aa, Mycobacterium
SPHTRHGDASAPV

SEQ ID NO: 583147 - protein, 16 aa, Mycobacterium
SPHTSDPGRVDDGGHR

SEQ ID NO: 583148 - protein, 13 aa, Mycobacterium
SPHTTAPAFQPHS

SEQ ID NO: 583149 - protein, 6 aa, Mycobacterium
SPHYEQ

SEQ ID NO: 583150 - protein, 18 aa, Mycobacterium
SPIAAEAAARAGLSGECR

SEQ ID NO: 583151 - protein, 5 aa, Mycobacterium
SPIAG

SEQ ID NO: 583152 - protein, 6 aa, Mycobacterium
SPIAGS

SEQ ID NO: 583153 - protein, 5 aa, Mycobacterium
SPIAK

SEQ ID NO: 583154 - protein, 7 aa, Mycobacterium
SPIAPER

SEQ ID NO: 583155 - protein, 6 aa, Mycobacterium
SPIEGR

SEQ ID NO: 583156 - protein, 6 aa, Mycobacterium
SPIENT

SEQ ID NO: 583157 - protein, 4 aa, Mycobacterium
SPIG

SEQ ID NO: 583158 - protein, 7 aa, Mycobacterium
SPIGKRN

SEQ ID NO: 583159 - protein, 5 aa, Mycobacterium
SPIGR

SEQ ID NO: 583160 - protein, 10 aa, Mycobacterium
SPIGRAGKGS

SEQ ID NO: 583161 - protein, 11 aa, Mycobacterium
SPIGRAGKGSL

SEQ ID NO: 583162 - protein, 9 aa, Mycobacterium
SPIGRANKG

SEQ ID NO: 583163 - protein, 19 aa, Mycobacterium
SPIGRTRDAAPGAPPDRPV

SEQ ID NO: 583164 - protein, 5 aa, Mycobacterium
SPIGT

SEQ ID NO: 583165 - protein, 4 aa, Mycobacterium
SPIK

SEQ ID NO: 583166 - protein, 6 aa, Mycobacterium
SPINPS

SEQ ID NO: 583167 - protein, 4 aa, Mycobacterium
SPIP

SEQ ID NO: 583168 - protein, 18 aa, Mycobacterium
SPIPAATPRPAPSRQAVP

SEQ ID NO: 583169 - protein, 5 aa, Mycobacterium
SPIPG

SEQ ID NO: 583170 - protein, 17 aa, Mycobacterium
SPIPPNKPNIREDESDR

SEQ ID NO: 583171 - protein, 17 aa, Mycobacterium
SPIPPNKPNIRKDETDR

SEQ ID NO: 583172 - protein, 17 aa, Mycobacterium
SPIPPNTPNIREDQPDR

SEQ ID NO: 583173 - protein, 17 aa, Mycobacterium
SPIPPNTPNIRKDEPDR

SEQ ID NO: 583174 - protein, 14 aa, Mycobacterium
SPIPPPPQTRQTHS

SEQ ID NO: 583175 - protein, 6 aa, Mycobacterium
SPIREV

SEQ ID NO: 583176 - protein, 14 aa, Mycobacterium
SPIRGSRRSNPATY

SEQ ID NO: 583177 - protein, 4 aa, Mycobacterium
SPIS

SEQ ID NO: 583178 - protein, 7 aa, Mycobacterium
SPISPRD

SEQ ID NO: 583179 - protein, 4 aa, Mycobacterium
SPIT

SEQ ID NO: 583180 - protein, 19 aa, Mycobacterium
SPITKSEREQALGYDAATG

SEQ ID NO: 583181 - protein, 6 aa, Mycobacterium
SPITSI

SEQ ID NO: 583182 - protein, 6 aa, Mycobacterium
SPITSV

SEQ ID NO: 583183 - protein, 6 aa, Mycobacterium
SPIVGE

SEQ ID NO: 583184 - protein, 11 aa, Mycobacterium
SPKAARLGAEE

SEQ ID NO: 583185 - protein, 10 aa, Mycobacterium
SPKAARLGAQ

SEQ ID NO: 583186 - protein, 11 aa, Mycobacterium
SPKAARMGAQE

SEQ ID NO: 583187 - protein, 9 aa, Mycobacterium
SPKAPGGYA

SEQ ID NO: 583188 - protein, 9 aa, Mycobacterium
SPKAQAELD

SEQ ID NO: 583189 - protein, 5 aa, Mycobacterium
SPKAR

SEQ ID NO: 583190 - protein, 14 aa, Mycobacterium
SPKAYRDRFRTAAR

SEQ ID NO: 583191 - protein, 15 aa, Mycobacterium
SPKCGNGNDPLDKDG

SEQ ID NO: 583192 - protein, 14 aa, Mycobacterium
SPKCGNGNSPLDKR

SEQ ID NO: 583193 - protein, 4 aa, Mycobacterium
SPKE

SEQ ID NO: 583194 - protein, 6 aa, Mycobacterium
SPKGKS

SEQ ID NO: 583195 - protein, 8 aa, Mycobacterium
SPKGQATL

SEQ ID NO: 583196 - protein, 6 aa, Mycobacterium
SPKGSA

SEQ ID NO: 583197 - protein, 10 aa, Mycobacterium
SPKGTYPPIT

SEQ ID NO: 583198 - protein, 7 aa, Mycobacterium
SPKLPDD

SEQ ID NO: 583199 - protein, 6 aa, Mycobacterium
SPKLYR

SEQ ID NO: 583200 - protein, 5 aa, Mycobacterium
SPKNA

SEQ ID NO: 583201 - protein, 8 aa, Mycobacterium
SPKNSATL

SEQ ID NO: 583202 - protein, 8 aa, Mycobacterium
SPKPLQDN

SEQ ID NO: 583203 - protein, 11 aa, Mycobacterium
SPKQFDGKGNY

SEQ ID NO: 583204 - protein, 11 aa, Mycobacterium
SPKQFDGTGNY

SEQ ID NO: 583205 - protein, 5 aa, Mycobacterium
SPKQR

SEQ ID NO: 583206 - protein, 8 aa, Mycobacterium
SPKRHTAA

SEQ ID NO: 583207 - protein, 5 aa, Mycobacterium
SPKRL

SEQ ID NO: 583208 - protein, 6 aa, Mycobacterium
SPKSYQ

SEQ ID NO: 583209 - protein, 10 aa, Mycobacterium
SPKTATASGG

SEQ ID NO: 583210 - protein, 7 aa, Mycobacterium
SPKTLND

SEQ ID NO: 583211 - protein, 10 aa, Mycobacterium
SPKTLNDDNA

SEQ ID NO: 583212 - protein, 9 aa, Mycobacterium
SPKTRADLK

SEQ ID NO: 583213 - protein, 9 aa, Mycobacterium
SPKTSDLAE

SEQ ID NO: 583214 - protein, 6 aa, Mycobacterium
SPKTTL

SEQ ID NO: 583215 - protein, 8 aa, Mycobacterium
SPKWTTAE

SEQ ID NO: 583216 - protein, 9 aa, Mycobacterium
SPKWTTGEA

SEQ ID NO: 583217 - protein, 9 aa, Mycobacterium
SPKYGWRGP

SEQ ID NO: 583218 - protein, 12 aa, Mycobacterium
SPKYRQSQSKSY

SEQ ID NO: 583219 - protein, 6 aa, Mycobacterium
SPLAAA

SEQ ID NO: 583220 - protein, 9 aa, Mycobacterium
SPLADGSRG

SEQ ID NO: 583221 - protein, 8 aa, Mycobacterium
SPLAGEPP

SEQ ID NO: 583222 - protein, 17 aa, Mycobacterium
SPLAPTGRGVAADGGVR

SEQ ID NO: 583223 - protein, 6 aa, Mycobacterium
SPLARA

SEQ ID NO: 583224 - protein, 14 aa, Mycobacterium
SPLASAASSTAGPI

SEQ ID NO: 583225 - protein, 14 aa, Mycobacterium
SPLASAVSATAGPI

SEQ ID NO: 583226 - protein, 4 aa, Mycobacterium
SPLD

SEQ ID NO: 583227 - protein, 5 aa, Mycobacterium
SPLDD

SEQ ID NO: 583228 - protein, 6 aa, Mycobacterium
SPLDRR

SEQ ID NO: 583229 - protein, 8 aa, Mycobacterium
SPLDSETQ

SEQ ID NO: 583230 - protein, 9 aa, Mycobacterium
SPLDSRVGD

SEQ ID NO: 583231 - protein, 12 aa, Mycobacterium
SPLEGQETPERG

SEQ ID NO: 583232 - protein, 13 aa, Mycobacterium
SPLETAKADYENR

SEQ ID NO: 583233 - protein, 13 aa, Mycobacterium
SPLETAKADYESR

SEQ ID NO: 583234 - protein, 6 aa, Mycobacterium
SPLGAQ

SEQ ID NO: 583235 - protein, 13 aa, Mycobacterium
SPLGKRNGGLSGV

SEQ ID NO: 583236 - protein, 5 aa, Mycobacterium
SPLGL

SEQ ID NO: 583237 - protein, 6 aa, Mycobacterium
SPLGQG

SEQ ID NO: 583238 - protein, 7 aa, Mycobacterium
SPLGQRK

SEQ ID NO: 583239 - protein, 6 aa, Mycobacterium
SPLGRD

SEQ ID NO: 583240 - protein, 6 aa, Mycobacterium
SPLGRG

SEQ ID NO: 583241 - protein, 6 aa, Mycobacterium
SPLGRQ

SEQ ID NO: 583242 - protein, 7 aa, Mycobacterium
SPLGRSG

SEQ ID NO: 583243 - protein, 8 aa, Mycobacterium
SPLGRTVG

SEQ ID NO: 583244 - protein, 11 aa, Mycobacterium
SPLGSSSGSAV

SEQ ID NO: 583245 - protein, 4 aa, Mycobacterium
SPLL

SEQ ID NO: 583246 - protein, 5 aa, Mycobacterium
SPLLA

SEQ ID NO: 583247 - protein, 10 aa, Mycobacterium
SPLPAGDSGF

SEQ ID NO: 583248 - protein, 13 aa, Mycobacterium
SPLPDDGPWPGLT

SEQ ID NO: 583249 - protein, 6 aa, Mycobacterium
SPLPGD

SEQ ID NO: 583250 - protein, 19 aa, Mycobacterium
SPLPGNAPAPGTPSREQTI

SEQ ID NO: 583251 - protein, 9 aa, Mycobacterium
SPLPPGADE

SEQ ID NO: 583252 - protein, 11 aa, Mycobacterium
SPLPPGGAEPP

SEQ ID NO: 583253 - protein, 7 aa, Mycobacterium
SPLPQDA

SEQ ID NO: 583254 - protein, 4 aa, Mycobacterium
SPLQ

SEQ ID NO: 583255 - protein, 9 aa, Mycobacterium
SPLQDSPRA

SEQ ID NO: 583256 - protein, 4 aa, Mycobacterium
SPLR

SEQ ID NO: 583257 - protein, 5 aa, Mycobacterium
SPLRD

SEQ ID NO: 583258 - protein, 13 aa, Mycobacterium
SPLSAADIDNAAE

SEQ ID NO: 583259 - protein, 11 aa, Mycobacterium
SPLSADPPGLS

SEQ ID NO: 583260 - protein, 13 aa, Mycobacterium
SPLSGLAESSSSL

SEQ ID NO: 583261 - protein, 10 aa, Mycobacterium
SPLSGTGPYA

SEQ ID NO: 583262 - protein, 14 aa, Mycobacterium
SPLSITQQANEKAE

SEQ ID NO: 583263 - protein, 7 aa, Mycobacterium
SPLSPYT

SEQ ID NO: 583264 - protein, 16 aa, Mycobacterium
SPLSRAKETAAAAAGA

SEQ ID NO: 583265 - protein, 19 aa, Mycobacterium
SPLSSHPLAGGSGPRTGAG

SEQ ID NO: 583266 - protein, 8 aa, Mycobacterium
SPLSTDAA

SEQ ID NO: 583267 - protein, 17 aa, Mycobacterium
SPLSTPDLTGSATRANV

SEQ ID NO: 583268 - protein, 8 aa, Mycobacterium
SPLTKPQT

SEQ ID NO: 583269 - protein, 12 aa, Mycobacterium
SPLTKSVATAAA

SEQ ID NO: 583270 - protein, 5 aa, Mycobacterium
SPLTP

SEQ ID NO: 583271 - protein, 6 aa, Mycobacterium
SPLTPL

SEQ ID NO: 583272 - protein, 8 aa, Mycobacterium
SPLYTAGQ

SEQ ID NO: 583273 - protein, 5 aa, Mycobacterium
SPMAG

SEQ ID NO: 583274 - protein, 18 aa, Mycobacterium
SPMASTVSRAKSAKLARR

SEQ ID NO: 583275 - protein, 7 aa, Mycobacterium
SPMGGPG

SEQ ID NO: 583276 - protein, 19 aa, Mycobacterium
SPMGRTRDAAPDSPPDRPV

SEQ ID NO: 583277 - protein, 4 aa, Mycobacterium
SPMK

SEQ ID NO: 583278 - protein, 4 aa, Mycobacterium
SPMP

SEQ ID NO: 583279 - protein, 4 aa, Mycobacterium
SPMQ

SEQ ID NO: 583280 - protein, 12 aa, Mycobacterium
SPMRNRVDTVEF

SEQ ID NO: 583281 - protein, 29 aa, Mycobacterium
SPMTAGTATLTDVGGTTAGTVTDSATSSL

SEQ ID NO: 583282 - protein, 7 aa, Mycobacterium
SPMTGDD

SEQ ID NO: 583283 - protein, 6 aa, Mycobacterium
SPNAPI

SEQ ID NO: 583284 - protein, 7 aa, Mycobacterium
SPNARAA

SEQ ID NO: 583285 - protein, 10 aa, Mycobacterium
SPNASLPPHT

SEQ ID NO: 583286 - protein, 9 aa, Mycobacterium
SPNATEGVE

SEQ ID NO: 583287 - protein, 8 aa, Mycobacterium
SPNDPEPS

SEQ ID NO: 583288 - protein, 6 aa, Mycobacterium
SPNFQR

SEQ ID NO: 583289 - protein, 4 aa, Mycobacterium
SPNG

SEQ ID NO: 583290 - protein, 8 aa, Mycobacterium
SPNGDHNH

SEQ ID NO: 583291 - protein, 8 aa, Mycobacterium
SPNGEAQA

SEQ ID NO: 583292 - protein, 12 aa, Mycobacterium
SPNGGDKPTGDL

SEQ ID NO: 583293 - protein, 6 aa, Mycobacterium
SPNGGW

SEQ ID NO: 583294 - protein, 6 aa, Mycobacterium
SPNGHH

SEQ ID NO: 583295 - protein, 13 aa, Mycobacterium
SPNGQTYTTRPGS

SEQ ID NO: 583296 - protein, 8 aa, Mycobacterium
SPNGVGAA

SEQ ID NO: 583297 - protein, 5 aa, Mycobacterium
SPNHG

SEQ ID NO: 583298 - protein, 6 aa, Mycobacterium
SPNHLP

SEQ ID NO: 583299 - protein, 5 aa, Mycobacterium
SPNHS

SEQ ID NO: 583300 - protein, 13 aa, Mycobacterium
SPNITVNDNAPEI

SEQ ID NO: 583301 - protein, 12 aa, Mycobacterium
SPNKLPVTFTPA

SEQ ID NO: 583302 - protein, 5 aa, Mycobacterium
SPNLH

SEQ ID NO: 583303 - protein, 6 aa, Mycobacterium
SPNLHT

SEQ ID NO: 583304 - protein, 5 aa, Mycobacterium
SPNLT

SEQ ID NO: 583305 - protein, 4 aa, Mycobacterium
SPNM

SEQ ID NO: 583306 - protein, 11 aa, Mycobacterium
SPNNPSGQSVP

SEQ ID NO: 583307 - protein, 11 aa, Mycobacterium
SPNNPSGQSVS

SEQ ID NO: 583308 - protein, 11 aa, Mycobacterium
SPNNPTGQSIP

SEQ ID NO: 583309 - protein, 11 aa, Mycobacterium
SPNNPTGQSVS

SEQ ID NO: 583310 - protein, 6 aa, Mycobacterium
SPNNSL

SEQ ID NO: 583311 - protein, 8 aa, Mycobacterium
SPNPGETD

SEQ ID NO: 583312 - protein, 9 aa, Mycobacterium
SPNPGSDRS

SEQ ID NO: 583313 - protein, 8 aa, Mycobacterium
SPNPRVRD

SEQ ID NO: 583314 - protein, 13 aa, Mycobacterium
SPNQWRGGGAGKF

SEQ ID NO: 583315 - protein, 11 aa, Mycobacterium
SPNRLQTDPIG

SEQ ID NO: 583316 - protein, 8 aa, Mycobacterium
SPNRVPRT

SEQ ID NO: 583317 - protein, 4 aa, Mycobacterium
SPNS

SEQ ID NO: 583318 - protein, 18 aa, Mycobacterium
SPNSFRGKYRGAGASQYA

SEQ ID NO: 583319 - protein, 5 aa, Mycobacterium
SPNSL

SEQ ID NO: 583320 - protein, 9 aa, Mycobacterium
SPNSLGAKA

SEQ ID NO: 583321 - protein, 8 aa, Mycobacterium
SPNSPLGG

SEQ ID NO: 583322 - protein, 12 aa, Mycobacterium
SPNTHSAVETSS

SEQ ID NO: 583323 - protein, 4 aa, Mycobacterium
SPPA

SEQ ID NO: 583324 - protein, 9 aa, Mycobacterium
SPPAADSAR

SEQ ID NO: 583325 - protein, 12 aa, Mycobacterium
SPPADRMTPATA

SEQ ID NO: 583326 - protein, 11 aa, Mycobacterium
SPPAGPPRRAV

SEQ ID NO: 583327 - protein, 15 aa, Mycobacterium
SPPAGVSGLGQPGLF

SEQ ID NO: 583328 - protein, 7 aa, Mycobacterium
SPPAIDA

SEQ ID NO: 583329 - protein, 6 aa, Mycobacterium
SPPAQA

SEQ ID NO: 583330 - protein, 6 aa, Mycobacterium
SPPARA

SEQ ID NO: 583331 - protein, 13 aa, Mycobacterium
SPPARGTDSEHIS

SEQ ID NO: 583332 - protein, 15 aa, Mycobacterium
SPPASATGLGQAGLF

SEQ ID NO: 583333 - protein, 5 aa, Mycobacterium
SPPAV

SEQ ID NO: 583334 - protein, 9 aa, Mycobacterium
SPPDGTPRV

SEQ ID NO: 583335 - protein, 9 aa, Mycobacterium
SPPDGVAEG

SEQ ID NO: 583336 - protein, 4 aa, Mycobacterium
SPPE

SEQ ID NO: 583337 - protein, 6 aa, Mycobacterium
SPPEIN

SEQ ID NO: 583338 - protein, 6 aa, Mycobacterium
SPPEMD

SEQ ID NO: 583339 - protein, 8 aa, Mycobacterium
SPPESMRG

SEQ ID NO: 583340 - protein, 19 aa, Mycobacterium
SPPEVVNPAGAAAQTTAVT

SEQ ID NO: 583341 - protein, 17 aa, Mycobacterium
SPPFRGGPALKDGDTIG

SEQ ID NO: 583342 - protein, 11 aa, Mycobacterium
SPPGESGAQCG

SEQ ID NO: 583343 - protein, 9 aa, Mycobacterium
SPPGETIAQ

SEQ ID NO: 583344 - protein, 13 aa, Mycobacterium
SPPGFGAPLPDGF

SEQ ID NO: 583345 - protein, 9 aa, Mycobacterium
SPPGFPSSA

SEQ ID NO: 583346 - protein, 9 aa, Mycobacterium
SPPGGRREL

SEQ ID NO: 583347 - protein, 9 aa, Mycobacterium
SPPGGSPRN

SEQ ID NO: 583348 - protein, 8 aa, Mycobacterium
SPPGQRQQ

SEQ ID NO: 583349 - protein, 7 aa, Mycobacterium
SPPGSQR

SEQ ID NO: 583350 - protein, 17 aa, Mycobacterium
SPPGTAKARTRDPDRKN

SEQ ID NO: 583351 - protein, 4 aa, Mycobacterium
SPPI

SEQ ID NO: 583352 - protein, 9 aa, Mycobacterium
SPPKETRDF

SEQ ID NO: 583353 - protein, 9 aa, Mycobacterium
SPPKETREF

SEQ ID NO: 583354 - protein, 10 aa, Mycobacterium
SPPKETREFD

SEQ ID NO: 583355 - protein, 7 aa, Mycobacterium
SPPKQLA

SEQ ID NO: 583356 - protein, 8 aa, Mycobacterium
SPPKQLAD

SEQ ID NO: 583357 - protein, 6 aa, Mycobacterium
SPPLDK

SEQ ID NO: 583358 - protein, 16 aa, Mycobacterium
SPPLPPEPPFPTAPQL

SEQ ID NO: 583359 - protein, 7 aa, Mycobacterium
SPPNPAE

SEQ ID NO: 583360 - protein, 9 aa, Mycobacterium
SPPNRPEAA

SEQ ID NO: 583361 - protein, 6 aa, Mycobacterium
SPPNRR

SEQ ID NO: 583362 - protein, 6 aa, Mycobacterium
SPPNTN

SEQ ID NO: 583363 - protein, 7 aa, Mycobacterium
SPPPATV

SEQ ID NO: 583364 - protein, 7 aa, Mycobacterium
SPPPEAA

SEQ ID NO: 583365 - protein, 15 aa, Mycobacterium
SPPPEPTKPPPAPDA

SEQ ID NO: 583366 - protein, 8 aa, Mycobacterium
SPPPHHDT

SEQ ID NO: 583367 - protein, 7 aa, Mycobacterium
SPPPKLG

SEQ ID NO: 583368 - protein, 7 aa, Mycobacterium
SPPQAGT

SEQ ID NO: 583369 - protein, 6 aa, Mycobacterium
SPPQAR

SEQ ID NO: 583370 - protein, 12 aa, Mycobacterium
SPPQASHGGLPH

SEQ ID NO: 583371 - protein, 8 aa, Mycobacterium
SPPQDPDV

SEQ ID NO: 583372 - protein, 11 aa, Mycobacterium
SPPQKTNPDRF

SEQ ID NO: 583373 - protein, 21 aa, Mycobacterium
SPPQQLPDDVARTQLEEFIVE

SEQ ID NO: 583374 - protein, 33 aa, Mycobacterium
SPPQTTNPTAAATQAGTLSRAAATTTGTAQSTL

SEQ ID NO: 583375 - protein, 33 aa, Mycobacterium
SPPQTTSPAASATQAAAVTSAAATAAGATQSTL

SEQ ID NO: 583376 - protein, 11 aa, Mycobacterium
SPPRDGDPRDY

SEQ ID NO: 583377 - protein, 14 aa, Mycobacterium
SPPRPGLPADTGSV

SEQ ID NO: 583378 - protein, 7 aa, Mycobacterium
SPPRTAR

SEQ ID NO: 583379 - protein, 25 aa, Mycobacterium
SPPRVRASGSGHERLRTDAPPGDRH

SEQ ID NO: 583380 - protein, 8 aa, Mycobacterium
SPPSGPGV

SEQ ID NO: 583381 - protein, 6 aa, Mycobacterium
SPPSLT

SEQ ID NO: 583382 - protein, 17 aa, Mycobacterium
SPPSPRELELAGVSGKE

SEQ ID NO: 583383 - protein, 9 aa, Mycobacterium
SPPSYRDPR

SEQ ID NO: 583384 - protein, 9 aa, Mycobacterium
SPPSYRNPA

SEQ ID NO: 583385 - protein, 4 aa, Mycobacterium
SPPT

SEQ ID NO: 583386 - protein, 6 aa, Mycobacterium
SPPTAR

SEQ ID NO: 583387 - protein, 4 aa, Mycobacterium
SPPV

SEQ ID NO: 583388 - protein, 6 aa, Mycobacterium
SPPVNA

SEQ ID NO: 583389 - protein, 8 aa, Mycobacterium
SPPVTGPL

SEQ ID NO: 583390 - protein, 4 aa, Mycobacterium
SPQA

SEQ ID NO: 583391 - protein, 16 aa, Mycobacterium
SPQAATHSERLTSDTV

SEQ ID NO: 583392 - protein, 6 aa, Mycobacterium
SPQARD

SEQ ID NO: 583393 - protein, 6 aa, Mycobacterium
SPQARE

SEQ ID NO: 583394 - protein, 11 aa, Mycobacterium
SPQASANKRGL

SEQ ID NO: 583395 - protein, 5 aa, Mycobacterium
SPQAT

SEQ ID NO: 583396 - protein, 8 aa, Mycobacterium
SPQATAQL

SEQ ID NO: 583397 - protein, 8 aa, Mycobacterium
SPQCPPQR

SEQ ID NO: 583398 - protein, 5 aa, Mycobacterium
SPQDA

SEQ ID NO: 583399 - protein, 6 aa, Mycobacterium
SPQDDT

SEQ ID NO: 583400 - protein, 9 aa, Mycobacterium
SPQDGHSVR

SEQ ID NO: 583401 - protein, 5 aa, Mycobacterium
SPQDQ

SEQ ID NO: 583402 - protein, 9 aa, Mycobacterium
SPQDSLPDN

SEQ ID NO: 583403 - protein, 7 aa, Mycobacterium
SPQDSRP

SEQ ID NO: 583404 - protein, 11 aa, Mycobacterium
SPQEAEQRRVT

SEQ ID NO: 583405 - protein, 13 aa, Mycobacterium
SPQERERHGANKT

SEQ ID NO: 583406 - protein, 5 aa, Mycobacterium
SPQEY

SEQ ID NO: 583407 - protein, 13 aa, Mycobacterium
SPQFGGSTALSGG

SEQ ID NO: 583408 - protein, 6 aa, Mycobacterium
SPQGAH

SEQ ID NO: 583409 - protein, 8 aa, Mycobacterium
SPQGARDV

SEQ ID NO: 583410 - protein, 10 aa, Mycobacterium
SPQGDPRVQG

SEQ ID NO: 583411 - protein, 11 aa, Mycobacterium
SPQGEPRTQSA

SEQ ID NO: 583412 - protein, 5 aa, Mycobacterium
SPQGR

SEQ ID NO: 583413 - protein, 10 aa, Mycobacterium
SPQGRSAPQL

SEQ ID NO: 583414 - protein, 6 aa, Mycobacterium
SPQGYR

SEQ ID NO: 583415 - protein, 6 aa, Mycobacterium
SPQGYT

SEQ ID NO: 583416 - protein, 10 aa, Mycobacterium
SPQKGADAAT

SEQ ID NO: 583417 - protein, 4 aa, Mycobacterium
SPQL

SEQ ID NO: 583418 - protein, 5 aa, Mycobacterium
SPQLE

SEQ ID NO: 583419 - protein, 7 aa, Mycobacterium
SPQLQGK

SEQ ID NO: 583420 - protein, 4 aa, Mycobacterium
SPQN

SEQ ID NO: 583421 - protein, 8 aa, Mycobacterium
SPQNAQSL

SEQ ID NO: 583422 - protein, 4 aa, Mycobacterium
SPQP

SEQ ID NO: 583423 - protein, 8 aa, Mycobacterium
SPQPAPRL

SEQ ID NO: 583424 - protein, 7 aa, Mycobacterium
SPQPSHY

SEQ ID NO: 583425 - protein, 7 aa, Mycobacterium
SPQQGYP

SEQ ID NO: 583426 - protein, 12 aa, Mycobacterium
SPQQKVREAQRL

SEQ ID NO: 583427 - protein, 14 aa, Mycobacterium
SPQQLPAGMSPNLE

SEQ ID NO: 583428 - protein, 10 aa, Mycobacterium
SPQQLPPGLS

SEQ ID NO: 583429 - protein, 8 aa, Mycobacterium
SPQQLPSA

SEQ ID NO: 583430 - protein, 12 aa, Mycobacterium
SPQQPGHTPAQL

SEQ ID NO: 583431 - protein, 14 aa, Mycobacterium
SPQQPRDVAEREGR

SEQ ID NO: 583432 - protein, 13 aa, Mycobacterium
SPQQRAAQLAERR

SEQ ID NO: 583433 - protein, 7 aa, Mycobacterium
SPQQRDK

SEQ ID NO: 583434 - protein, 10 aa, Mycobacterium
SPQQSNPSWV

SEQ ID NO: 583435 - protein, 4 aa, Mycobacterium
SPQR

SEQ ID NO: 583436 - protein, 5 aa, Mycobacterium
SPQRA

SEQ ID NO: 583437 - protein, 16 aa, Mycobacterium
SPQRRAVQTAEPVATA

SEQ ID NO: 583438 - protein, 6 aa, Mycobacterium
SPQRRG

SEQ ID NO: 583439 - protein, 11 aa, Mycobacterium
SPQRSADYAPA

SEQ ID NO: 583440 - protein, 18 aa, Mycobacterium
SPQRSGDSRSECCNVVVV

SEQ ID NO: 583441 - protein, 15 aa, Mycobacterium
SPQRSSGGGRRYSQR

SEQ ID NO: 583442 - protein, 11 aa, Mycobacterium
SPQRVAADPSR

SEQ ID NO: 583443 - protein, 9 aa, Mycobacterium
SPQSDGGPG

SEQ ID NO: 583444 - protein, 7 aa, Mycobacterium
SPQSDSL

SEQ ID NO: 583445 - protein, 6 aa, Mycobacterium
SPQSTV

SEQ ID NO: 583446 - protein, 13 aa, Mycobacterium
SPQSTVIGGATEA

SEQ ID NO: 583447 - protein, 13 aa, Mycobacterium
SPQSTVVGGATAS

SEQ ID NO: 583448 - protein, 14 aa, Mycobacterium
SPQSTVVGGATDTV

SEQ ID NO: 583449 - protein, 13 aa, Mycobacterium
SPQSTVVGGATET

SEQ ID NO: 583450 - protein, 12 aa, Mycobacterium
SPQTHASAGTAQ

SEQ ID NO: 583451 - protein, 7 aa, Mycobacterium
SPQTNRL

SEQ ID NO: 583452 - protein, 7 aa, Mycobacterium
SPQTRTA

SEQ ID NO: 583453 - protein, 4 aa, Mycobacterium
SPQV

SEQ ID NO: 583454 - protein, 8 aa, Mycobacterium
SPQVETDS

SEQ ID NO: 583455 - protein, 5 aa, Mycobacterium
SPQYS

SEQ ID NO: 583456 - protein, 6 aa, Mycobacterium
SPRAAR

SEQ ID NO: 583457 - protein, 5 aa, Mycobacterium
SPRAC

SEQ ID NO: 583458 - protein, 17 aa, Mycobacterium
SPRAEPAPGSTNWDTPR

SEQ ID NO: 583459 - protein, 13 aa, Mycobacterium
SPRAGIGPGGAYR

SEQ ID NO: 583460 - protein, 6 aa, Mycobacterium
SPRAHD

SEQ ID NO: 583461 - protein, 9 aa, Mycobacterium
SPRAPDRTD

SEQ ID NO: 583462 - protein, 17 aa, Mycobacterium
SPRAPQPEGAADRPAPQ

SEQ ID NO: 583463 - protein, 7 aa, Mycobacterium
SPRAQRR

SEQ ID NO: 583464 - protein, 18 aa, Mycobacterium
SPRARQRGIAAGGDDTVR

SEQ ID NO: 583465 - protein, 5 aa, Mycobacterium
SPRAS

SEQ ID NO: 583466 - protein, 19 aa, Mycobacterium
SPRDPSASPPIARSGYDTR

SEQ ID NO: 583467 - protein, 16 aa, Mycobacterium
SPRDQWHDNDDGLSPL

SEQ ID NO: 583468 - protein, 6 aa, Mycobacterium
SPREAS

SEQ ID NO: 583469 - protein, 16 aa, Mycobacterium
SPREDWDANDDGMSPL

SEQ ID NO: 583470 - protein, 7 aa, Mycobacterium
SPREGRE

SEQ ID NO: 583471 - protein, 5 aa, Mycobacterium
SPREL

SEQ ID NO: 583472 - protein, 6 aa, Mycobacterium
SPRESR

SEQ ID NO: 583473 - protein, 5 aa, Mycobacterium
SPREV

SEQ ID NO: 583474 - protein, 13 aa, Mycobacterium
SPREVGGHTRSGI

SEQ ID NO: 583475 - protein, 4 aa, Mycobacterium
SPRF

SEQ ID NO: 583476 - protein, 13 aa, Mycobacterium
SPRFGGSTALSGG

SEQ ID NO: 583477 - protein, 12 aa, Mycobacterium
SPRGAEYLARTS

SEQ ID NO: 583478 - protein, 7 aa, Mycobacterium
SPRGATS

SEQ ID NO: 583479 - protein, 8 aa, Mycobacterium
SPRGDTQW

SEQ ID NO: 583480 - protein, 5 aa, Mycobacterium
SPRGE

SEQ ID NO: 583481 - protein, 8 aa, Mycobacterium
SPRGEAAT

SEQ ID NO: 583482 - protein, 10 aa, Mycobacterium
SPRGGPASAL

SEQ ID NO: 583483 - protein, 5 aa, Mycobacterium
SPRGM

SEQ ID NO: 583484 - protein, 8 aa, Mycobacterium
SPRGNTQW

SEQ ID NO: 583485 - protein, 5 aa, Mycobacterium
SPRGR

SEQ ID NO: 583486 - protein, 6 aa, Mycobacterium
SPRGRI

SEQ ID NO: 583487 - protein, 17 aa, Mycobacterium
SPRGRITRTYREARTIE

SEQ ID NO: 583488 - protein, 16 aa, Mycobacterium
SPRGRVTRTYLPAGQQ

SEQ ID NO: 583489 - protein, 5 aa, Mycobacterium
SPRHE

SEQ ID NO: 583490 - protein, 17 aa, Mycobacterium
SPRHGGARGEGLTADEF

SEQ ID NO: 583491 - protein, 9 aa, Mycobacterium
SPRIGPNRE

SEQ ID NO: 583492 - protein, 8 aa, Mycobacterium
SPRKHGYD

SEQ ID NO: 583493 - protein, 18 aa, Mycobacterium
SPRKRAGVSSIPPIEADA

SEQ ID NO: 583494 - protein, 11 aa, Mycobacterium
SPRKRAGVSSV

SEQ ID NO: 583495 - protein, 9 aa, Mycobacterium
SPRKRALTT

SEQ ID NO: 583496 - protein, 8 aa, Mycobacterium
SPRKRTLA

SEQ ID NO: 583497 - protein, 4 aa, Mycobacterium
SPRL

SEQ ID NO: 583498 - protein, 26 aa, Mycobacterium
SPRLKKNDGVPTTDQPQKGKDFTSDQ

SEQ ID NO: 583499 - protein, 6 aa, Mycobacterium
SPRLTD

SEQ ID NO: 583500 - protein, 5 aa, Mycobacterium
SPRMR

SEQ ID NO: 583501 - protein, 15 aa, Mycobacterium
SPRNFDPDADLAPET

SEQ ID NO: 583502 - protein, 4 aa, Mycobacterium
SPRP

SEQ ID NO: 583503 - protein, 15 aa, Mycobacterium
SPRPARVGPQASLPR

SEQ ID NO: 583504 - protein, 7 aa, Mycobacterium
SPRPEAG

SEQ ID NO: 583505 - protein, 10 aa, Mycobacterium
SPRPEPGEPR

SEQ ID NO: 583506 - protein, 15 aa, Mycobacterium
SPRPGEETAGEGTRL

SEQ ID NO: 583507 - protein, 9 aa, Mycobacterium
SPRPGEIQA

SEQ ID NO: 583508 - protein, 9 aa, Mycobacterium
SPRPGTAPL

SEQ ID NO: 583509 - protein, 16 aa, Mycobacterium
SPRPGTPAADMPDQIP

SEQ ID NO: 583510 - protein, 5 aa, Mycobacterium
SPRPP

SEQ ID NO: 583511 - protein, 7 aa, Mycobacterium
SPRPQRE

SEQ ID NO: 583512 - protein, 6 aa, Mycobacterium
SPRPRG

SEQ ID NO: 583513 - protein, 8 aa, Mycobacterium
SPRPRRAN

SEQ ID NO: 583514 - protein, 5 aa, Mycobacterium
SPRPV

SEQ ID NO: 583515 - protein, 5 aa, Mycobacterium
SPRQA

SEQ ID NO: 583516 - protein, 11 aa, Mycobacterium
SPRQCTPRTPA

SEQ ID NO: 583517 - protein, 5 aa, Mycobacterium
SPRQL

SEQ ID NO: 583518 - protein, 7 aa, Mycobacterium
SPRQPEA

SEQ ID NO: 583519 - protein, 8 aa, Mycobacterium
SPRQQDYD

SEQ ID NO: 583520 - protein, 14 aa, Mycobacterium
SPRQTRLEQAETAT

SEQ ID NO: 583521 - protein, 18 aa, Mycobacterium
SPRQTRLEQSETAELDTA

SEQ ID NO: 583522 - protein, 5 aa, Mycobacterium
SPRRE

SEQ ID NO: 583523 - protein, 10 aa, Mycobacterium
SPRRGNRRRG

SEQ ID NO: 583524 - protein, 8 aa, Mycobacterium
SPRRLGRR

SEQ ID NO: 583525 - protein, 11 aa, Mycobacterium
SPRRLGRRTGV

SEQ ID NO: 583526 - protein, 5 aa, Mycobacterium
SPRRR

SEQ ID NO: 583527 - protein, 7 aa, Mycobacterium
SPRRRAL

SEQ ID NO: 583528 - protein, 6 aa, Mycobacterium
SPRRRS

SEQ ID NO: 583529 - protein, 8 aa, Mycobacterium
SPRRRTIE

SEQ ID NO: 583530 - protein, 6 aa, Mycobacterium
SPRSAV

SEQ ID NO: 583531 - protein, 9 aa, Mycobacterium
SPRSEGKKL

SEQ ID NO: 583532 - protein, 8 aa, Mycobacterium
SPRSGGAD

SEQ ID NO: 583533 - protein, 6 aa, Mycobacterium
SPRSGQ

SEQ ID NO: 583534 - protein, 5 aa, Mycobacterium
SPRSL

SEQ ID NO: 583535 - protein, 7 aa, Mycobacterium
SPRSPLG

SEQ ID NO: 583536 - protein, 16 aa, Mycobacterium
SPRSPLPGDDGLSPVT

SEQ ID NO: 583537 - protein, 44 aa, Mycobacterium
SPRSRSPLTVGGDPQRPASPRSRSPLTDGGDPQRPASPRSRSPL

SEQ ID NO: 583538 - protein, 6 aa, Mycobacterium
SPRSTF

SEQ ID NO: 583539 - protein, 8 aa, Mycobacterium
SPRSTPLT

SEQ ID NO: 583540 - protein, 6 aa, Mycobacterium
SPRTDR

SEQ ID NO: 583541 - protein, 7 aa, Mycobacterium
SPRTFAP

SEQ ID NO: 583542 - protein, 6 aa, Mycobacterium
SPRTPC

SEQ ID NO: 583543 - protein, 6 aa, Mycobacterium
SPRTPR

SEQ ID NO: 583544 - protein, 7 aa, Mycobacterium
SPRTPRA

SEQ ID NO: 583545 - protein, 5 aa, Mycobacterium
SPRTY

SEQ ID NO: 583546 - protein, 6 aa, Mycobacterium
SPRWAD

SEQ ID NO: 583547 - protein, 12 aa, Mycobacterium
SPRWDDEDGKPH

SEQ ID NO: 583548 - protein, 12 aa, Mycobacterium
SPRYAGQRVPRV

SEQ ID NO: 583549 - protein, 7 aa, Mycobacterium
SPRYPDT

SEQ ID NO: 583550 - protein, 13 aa, Mycobacterium
SPSAAPADDIHWD

SEQ ID NO: 583551 - protein, 17 aa, Mycobacterium
SPSAEEAASVARAAHSD

SEQ ID NO: 583552 - protein, 6 aa, Mycobacterium
SPSAIQ

SEQ ID NO: 583553 - protein, 15 aa, Mycobacterium
SPSARARDSVRRRRR

SEQ ID NO: 583554 - protein, 5 aa, Mycobacterium
SPSAT

SEQ ID NO: 583555 - protein, 8 aa, Mycobacterium
SPSDDGPG

SEQ ID NO: 583556 - protein, 9 aa, Mycobacterium
SPSDDGRVT

SEQ ID NO: 583557 - protein, 6 aa, Mycobacterium
SPSDFA

SEQ ID NO: 583558 - protein, 16 aa, Mycobacterium
SPSDIGRKAVAQNAAD

SEQ ID NO: 583559 - protein, 5 aa, Mycobacterium
SPSDL

SEQ ID NO: 583560 - protein, 8 aa, Mycobacterium
SPSDTMRR

SEQ ID NO: 583561 - protein, 5 aa, Mycobacterium
SPSDV

SEQ ID NO: 583562 - protein, 34 aa, Mycobacterium
SPSEHPYGSSGVGSKYQGQRGPTPSRSYQNFIRS

SEQ ID NO: 583563 - protein, 11 aa, Mycobacterium
SPSEHVTESQH

SEQ ID NO: 583564 - protein, 8 aa, Mycobacterium
SPSEWNSE

SEQ ID NO: 583565 - protein, 11 aa, Mycobacterium
SPSFDPTDANH

SEQ ID NO: 583566 - protein, 7 aa, Mycobacterium
SPSFEDG

SEQ ID NO: 583567 - protein, 7 aa, Mycobacterium
SPSFGGD

SEQ ID NO: 583568 - protein, 13 aa, Mycobacterium
SPSGADETGGVSA

SEQ ID NO: 583569 - protein, 6 aa, Mycobacterium
SPSGAE

SEQ ID NO: 583570 - protein, 8 aa, Mycobacterium
SPSGCEPA

SEQ ID NO: 583571 - protein, 13 aa, Mycobacterium
SPSGDTYVTTPGS

SEQ ID NO: 583572 - protein, 7 aa, Mycobacterium
SPSGETL

SEQ ID NO: 583573 - protein, 12 aa, Mycobacterium
SPSGGTFSDDEL

SEQ ID NO: 583574 - protein, 23 aa, Mycobacterium
SPSGLTTIPGTEEAAAAGSPGFP

SEQ ID NO: 583575 - protein, 24 aa, Mycobacterium
SPSGNGDASVAPSGAGIHEVDVKV

SEQ ID NO: 583576 - protein, 8 aa, Mycobacterium
SPSGPRLA

SEQ ID NO: 583577 - protein, 9 aa, Mycobacterium
SPSGPRLAG

SEQ ID NO: 583578 - protein, 11 aa, Mycobacterium
SPSGPRLAGSL

SEQ ID NO: 583579 - protein, 9 aa, Mycobacterium
SPSGRDGGF

SEQ ID NO: 583580 - protein, 10 aa, Mycobacterium
SPSGRPVGTT

SEQ ID NO: 583581 - protein, 8 aa, Mycobacterium
SPSGRTAD

SEQ ID NO: 583582 - protein, 11 aa, Mycobacterium
SPSGRTIGTKS

SEQ ID NO: 583583 - protein, 7 aa, Mycobacterium
SPSGTDC

SEQ ID NO: 583584 - protein, 7 aa, Mycobacterium
SPSGTDP

SEQ ID NO: 583585 - protein, 18 aa, Mycobacterium
SPSGTETVITSNDGASYI

SEQ ID NO: 583586 - protein, 5 aa, Mycobacterium
SPSGV

SEQ ID NO: 583587 - protein, 4 aa, Mycobacterium
SPSH

SEQ ID NO: 583588 - protein, 12 aa, Mycobacterium
SPSIGGETVTGP

SEQ ID NO: 583589 - protein, 6 aa, Mycobacterium
SPSISA

SEQ ID NO: 583590 - protein, 7 aa, Mycobacterium
SPSKAAG

SEQ ID NO: 583591 - protein, 18 aa, Mycobacterium
SPSKAAGYWGSPDESRAT

SEQ ID NO: 583592 - protein, 9 aa, Mycobacterium
SPSKERVTD

SEQ ID NO: 583593 - protein, 6 aa, Mycobacterium
SPSLEP

SEQ ID NO: 583594 - protein, 12 aa, Mycobacterium
SPSLRNGPVTPM

SEQ ID NO: 583595 - protein, 22 aa, Mycobacterium
SPSLTGEGRATLASVSDPAAPR

SEQ ID NO: 583596 - protein, 4 aa, Mycobacterium
SPSN

SEQ ID NO: 583597 - protein, 5 aa, Mycobacterium
SPSNA

SEQ ID NO: 583598 - protein, 32 aa, Mycobacterium
SPSNGGAKPEVTKSGRSYKIAGPATAGLSTPA

SEQ ID NO: 583599 - protein, 8 aa, Mycobacterium
SPSNPTGK

SEQ ID NO: 583600 - protein, 9 aa, Mycobacterium
SPSNPTGRV

SEQ ID NO: 583601 - protein, 9 aa, Mycobacterium
SPSNSAPPV

SEQ ID NO: 583602 - protein, 9 aa, Mycobacterium
SPSPEQLSR

SEQ ID NO: 583603 - protein, 5 aa, Mycobacterium
SPSPF

SEQ ID NO: 583604 - protein, 8 aa, Mycobacterium
SPSPQRTP

SEQ ID NO: 583605 - protein, 13 aa, Mycobacterium
SPSPSKRRTATRD

SEQ ID NO: 583606 - protein, 14 aa, Mycobacterium
SPSPSKRRTATRDV

SEQ ID NO: 583607 - protein, 40 aa, Mycobacterium
SPSRGAAAEVNSGDHPAHRTGGERRHRPAARGPLPHQPCE

SEQ ID NO: 583608 - protein, 6 aa, Mycobacterium
SPSRST

SEQ ID NO: 583609 - protein, 6 aa, Mycobacterium
SPSRTR

SEQ ID NO: 583610 - protein, 4 aa, Mycobacterium
SPSS

SEQ ID NO: 583611 - protein, 12 aa, Mycobacterium
SPSSAATPGEVA

SEQ ID NO: 583612 - protein, 8 aa, Mycobacterium
SPSSADRV

SEQ ID NO: 583613 - protein, 8 aa, Mycobacterium
SPSSADTL

SEQ ID NO: 583614 - protein, 6 aa, Mycobacterium
SPSSGE

SEQ ID NO: 583615 - protein, 6 aa, Mycobacterium
SPSSGS

SEQ ID NO: 583616 - protein, 7 aa, Mycobacterium
SPSSHRA

SEQ ID NO: 583617 - protein, 5 aa, Mycobacterium
SPSSP

SEQ ID NO: 583618 - protein, 7 aa, Mycobacterium
SPSSRYR

SEQ ID NO: 583619 - protein, 4 aa, Mycobacterium
SPST

SEQ ID NO: 583620 - protein, 7 aa, Mycobacterium
SPSTPEA

SEQ ID NO: 583621 - protein, 6 aa, Mycobacterium
SPSTVS

SEQ ID NO: 583622 - protein, 5 aa, Mycobacterium
SPSVG

SEQ ID NO: 583623 - protein, 9 aa, Mycobacterium
SPSVKRGAV

SEQ ID NO: 583624 - protein, 5 aa, Mycobacterium
SPSVR

SEQ ID NO: 583625 - protein, 4 aa, Mycobacterium
SPSW

SEQ ID NO: 583626 - protein, 19 aa, Mycobacterium
SPSWATDPGLTTHAGRSEH

SEQ ID NO: 583627 - protein, 13 aa, Mycobacterium
SPSWRGDHPGWGT

SEQ ID NO: 583628 - protein, 5 aa, Mycobacterium
SPTAA

SEQ ID NO: 583629 - protein, 9 aa, Mycobacterium
SPTAAAEDD

SEQ ID NO: 583630 - protein, 10 aa, Mycobacterium
SPTAAGFGSQ

SEQ ID NO: 583631 - protein, 5 aa, Mycobacterium
SPTAM

SEQ ID NO: 583632 - protein, 16 aa, Mycobacterium
SPTANGICSSGSTGVP

SEQ ID NO: 583633 - protein, 6 aa, Mycobacterium
SPTARM

SEQ ID NO: 583634 - protein, 12 aa, Mycobacterium
SPTASDSTIASL

SEQ ID NO: 583635 - protein, 12 aa, Mycobacterium
SPTASGSAGLAS

SEQ ID NO: 583636 - protein, 7 aa, Mycobacterium
SPTATAA

SEQ ID NO: 583637 - protein, 5 aa, Mycobacterium
SPTDA

SEQ ID NO: 583638 - protein, 8 aa, Mycobacterium
SPTDALGA

SEQ ID NO: 583639 - protein, 6 aa, Mycobacterium
SPTDLA

SEQ ID NO: 583640 - protein, 7 aa, Mycobacterium
SPTDREI

SEQ ID NO: 583641 - protein, 9 aa, Mycobacterium
SPTDRRVAA

SEQ ID NO: 583642 - protein, 6 aa, Mycobacterium
SPTDVT

SEQ ID NO: 583643 - protein, 16 aa, Mycobacterium
SPTEIARTGSDRVDGG

SEQ ID NO: 583644 - protein, 7 aa, Mycobacterium
SPTEQSE

SEQ ID NO: 583645 - protein, 9 aa, Mycobacterium
SPTEVRSRT

SEQ ID NO: 583646 - protein, 17 aa, Mycobacterium
SPTGCGPTRVPTSPTPI

SEQ ID NO: 583647 - protein, 8 aa, Mycobacterium
SPTGGGTH

SEQ ID NO: 583648 - protein, 6 aa, Mycobacterium
SPTGHT

SEQ ID NO: 583649 - protein, 12 aa, Mycobacterium
SPTGKTYRTVPA

SEQ ID NO: 583650 - protein, 19 aa, Mycobacterium
SPTGLPWQEPDETWESTGR

SEQ ID NO: 583651 - protein, 12 aa, Mycobacterium
SPTGLTSEVPAR

SEQ ID NO: 583652 - protein, 15 aa, Mycobacterium
SPTGNIYRTSPAGAD

SEQ ID NO: 583653 - protein, 10 aa, Mycobacterium
SPTGTQGFSG

SEQ ID NO: 583654 - protein, 5 aa, Mycobacterium
SPTGY

SEQ ID NO: 583655 - protein, 13 aa, Mycobacterium
SPTGYRTTARPGA

SEQ ID NO: 583656 - protein, 6 aa, Mycobacterium
SPTHLG

SEQ ID NO: 583657 - protein, 7 aa, Mycobacterium
SPTHPDA

SEQ ID NO: 583658 - protein, 8 aa, Mycobacterium
SPTHPDAT

SEQ ID NO: 583659 - protein, 7 aa, Mycobacterium
SPTHPSP

SEQ ID NO: 583660 - protein, 16 aa, Mycobacterium
SPTHSSAETLSALAAA

SEQ ID NO: 583661 - protein, 4 aa, Mycobacterium
SPTI

SEQ ID NO: 583662 - protein, 6 aa, Mycobacterium
SPTIAE

SEQ ID NO: 583663 - protein, 4 aa, Mycobacterium
SPTK

SEQ ID NO: 583664 - protein, 9 aa, Mycobacterium
SPTKEFEQH

SEQ ID NO: 583665 - protein, 9 aa, Mycobacterium
SPTKHRTEN

SEQ ID NO: 583666 - protein, 15 aa, Mycobacterium
SPTKTSARSTAYPPP

SEQ ID NO: 583667 - protein, 16 aa, Mycobacterium
SPTLAGKDKTIGPSGA

SEQ ID NO: 583668 - protein, 9 aa, Mycobacterium
SPTPAAAGR

SEQ ID NO: 583669 - protein, 10 aa, Mycobacterium
SPTPASAGRV

SEQ ID NO: 583670 - protein, 6 aa, Mycobacterium
SPTPGE

SEQ ID NO: 583671 - protein, 19 aa, Mycobacterium
SPTPGRPCQPTTAAVGGAH

SEQ ID NO: 583672 - protein, 7 aa, Mycobacterium
SPTPGRR

SEQ ID NO: 583673 - protein, 16 aa, Mycobacterium
SPTPGWAGNPAGIASG

SEQ ID NO: 583674 - protein, 9 aa, Mycobacterium
SPTPLSTQN

SEQ ID NO: 583675 - protein, 8 aa, Mycobacterium
SPTPRKPS

SEQ ID NO: 583676 - protein, 19 aa, Mycobacterium
SPTPSARKDYIGGAAETAT

SEQ ID NO: 583677 - protein, 19 aa, Mycobacterium
SPTPSSRKDYIGGAAETAR

SEQ ID NO: 583678 - protein, 9 aa, Mycobacterium
SPTPSTTGR

SEQ ID NO: 583679 - protein, 19 aa, Mycobacterium
SPTPTARKDYIGGAAETAR

SEQ ID NO: 583680 - protein, 5 aa, Mycobacterium
SPTPV

SEQ ID NO: 583681 - protein, 5 aa, Mycobacterium
SPTQA

SEQ ID NO: 583682 - protein, 10 aa, Mycobacterium
SPTQAKRQIA

SEQ ID NO: 583683 - protein, 5 aa, Mycobacterium
SPTQY

SEQ ID NO: 583684 - protein, 6 aa, Mycobacterium
SPTRAG

SEQ ID NO: 583685 - protein, 10 aa, Mycobacterium
SPTRAGFGSQ

SEQ ID NO: 583686 - protein, 20 aa, Mycobacterium
SPTRSRRDPGAAESSNPLTA

SEQ ID NO: 583687 - protein, 26 aa, Mycobacterium
SPTSFETLPERTTAATTQAKSAGATL

SEQ ID NO: 583688 - protein, 5 aa, Mycobacterium
SPTSQ

SEQ ID NO: 583689 - protein, 6 aa, Mycobacterium
SPTSSV

SEQ ID NO: 583690 - protein, 8 aa, Mycobacterium
SPTSTRVT

SEQ ID NO: 583691 - protein, 13 aa, Mycobacterium
SPTSTVVGGDAQA

SEQ ID NO: 583692 - protein, 14 aa, Mycobacterium
SPTSTVVGGDTQTI

SEQ ID NO: 583693 - protein, 6 aa, Mycobacterium
SPTSWQ

SEQ ID NO: 583694 - protein, 4 aa, Mycobacterium
SPTT

SEQ ID NO: 583695 - protein, 6 aa, Mycobacterium
SPTTDI

SEQ ID NO: 583696 - protein, 7 aa, Mycobacterium
SPTTKSI

SEQ ID NO: 583697 - protein, 5 aa, Mycobacterium
SPTTS

SEQ ID NO: 583698 - protein, 13 aa, Mycobacterium
SPTVPLRTDSERL

SEQ ID NO: 583699 - protein, 9 aa, Mycobacterium
SPTWPPAPD

SEQ ID NO: 583700 - protein, 4 aa, Mycobacterium
SPVA

SEQ ID NO: 583701 - protein, 9 aa, Mycobacterium
SPVADTSVT

SEQ ID NO: 583702 - protein, 11 aa, Mycobacterium
SPVADTTVSVD

SEQ ID NO: 583703 - protein, 9 aa, Mycobacterium
SPVADTTVT

SEQ ID NO: 583704 - protein, 14 aa, Mycobacterium
SPVAGETLSGTAER

SEQ ID NO: 583705 - protein, 13 aa, Mycobacterium
SPVATAPSSTATV

SEQ ID NO: 583706 - protein, 6 aa, Mycobacterium
SPVDAN

SEQ ID NO: 583707 - protein, 6 aa, Mycobacterium
SPVDAP

SEQ ID NO: 583708 - protein, 7 aa, Mycobacterium
SPVDDPY

SEQ ID NO: 583709 - protein, 15 aa, Mycobacterium
SPVDGSPTKPARAGW

SEQ ID NO: 583710 - protein, 7 aa, Mycobacterium
SPVDSGN

SEQ ID NO: 583711 - protein, 30 aa, Mycobacterium
SPVEPSPLDPPAVPAPPTADEDLSTKPAAQ

SEQ ID NO: 583712 - protein, 9 aa, Mycobacterium
SPVGAGDVA

SEQ ID NO: 583713 - protein, 21 aa, Mycobacterium
SPVGGLAPTPTIPSMIAAPEP

SEQ ID NO: 583714 - protein, 6 aa, Mycobacterium
SPVGHG

SEQ ID NO: 583715 - protein, 10 aa, Mycobacterium
SPVGKRNGAL

SEQ ID NO: 583716 - protein, 11 aa, Mycobacterium
SPVGKRNGALS

SEQ ID NO: 583717 - protein, 5 aa, Mycobacterium
SPVGN

SEQ ID NO: 583718 - protein, 8 aa, Mycobacterium
SPVGNSQG

SEQ ID NO: 583719 - protein, 7 aa, Mycobacterium
SPVGRST

SEQ ID NO: 583720 - protein, 6 aa, Mycobacterium
SPVGTA

SEQ ID NO: 583721 - protein, 6 aa, Mycobacterium
SPVGTF

SEQ ID NO: 583722 - protein, 9 aa, Mycobacterium
SPVGTFPPN

SEQ ID NO: 583723 - protein, 5 aa, Mycobacterium
SPVHS

SEQ ID NO: 583724 - protein, 12 aa, Mycobacterium
SPVPAGGGVAGD

SEQ ID NO: 583725 - protein, 6 aa, Mycobacterium
SPVPDV

SEQ ID NO: 583726 - protein, 11 aa, Mycobacterium
SPVPEPDSSVR

SEQ ID NO: 583727 - protein, 7 aa, Mycobacterium
SPVPEPE

SEQ ID NO: 583728 - protein, 10 aa, Mycobacterium
SPVPERSPDL

SEQ ID NO: 583729 - protein, 8 aa, Mycobacterium
SPVPGGGP

SEQ ID NO: 583730 - protein, 12 aa, Mycobacterium
SPVPPEPAPEDL

SEQ ID NO: 583731 - protein, 27 aa, Mycobacterium
SPVPPGTGWPGDPATPSTPVAKTPAQV

SEQ ID NO: 583732 - protein, 15 aa, Mycobacterium
SPVPYPTSCSPQAWA

SEQ ID NO: 583733 - protein, 4 aa, Mycobacterium
SPVR

SEQ ID NO: 583734 - protein, 5 aa, Mycobacterium
SPVRA

SEQ ID NO: 583735 - protein, 9 aa, Mycobacterium
SPVRAQGMR

SEQ ID NO: 583736 - protein, 12 aa, Mycobacterium
SPVRGAPYGLAG

SEQ ID NO: 583737 - protein, 13 aa, Mycobacterium
SPVRNYRDRNHKP

SEQ ID NO: 583738 - protein, 6 aa, Mycobacterium
SPVRPR

SEQ ID NO: 583739 - protein, 6 aa, Mycobacterium
SPVRYG

SEQ ID NO: 583740 - protein, 4 aa, Mycobacterium
SPVS

SEQ ID NO: 583741 - protein, 8 aa, Mycobacterium
SPVSPQAA

SEQ ID NO: 583742 - protein, 11 aa, Mycobacterium
SPVTAAPNSTV

SEQ ID NO: 583743 - protein, 8 aa, Mycobacterium
SPVTAQYP

SEQ ID NO: 583744 - protein, 5 aa, Mycobacterium
SPVTE

SEQ ID NO: 583745 - protein, 6 aa, Mycobacterium
SPVTEA

SEQ ID NO: 583746 - protein, 18 aa, Mycobacterium
SPVTEISQGRAVTARGTV

SEQ ID NO: 583747 - protein, 7 aa, Mycobacterium
SPVTSGA

SEQ ID NO: 583748 - protein, 6 aa, Mycobacterium
SPVTTE

SEQ ID NO: 583749 - protein, 17 aa, Mycobacterium
SPVTVGNSAQDATATGA

SEQ ID NO: 583750 - protein, 4 aa, Mycobacterium
SPVY

SEQ ID NO: 583751 - protein, 4 aa, Mycobacterium
SPWM

SEQ ID NO: 583752 - protein, 12 aa, Mycobacterium
SPWPSGKKTTEE

SEQ ID NO: 583753 - protein, 13 aa, Mycobacterium
SPWQRGSNENANG

SEQ ID NO: 583754 - protein, 13 aa, Mycobacterium
SPWQRGSNENTNG

SEQ ID NO: 583755 - protein, 13 aa, Mycobacterium
SPWQRGTNENTNG

SEQ ID NO: 583756 - protein, 13 aa, Mycobacterium
SPWQRPTNENTNG

SEQ ID NO: 583757 - protein, 7 aa, Mycobacterium
SPWSPRE

SEQ ID NO: 583758 - protein, 5 aa, Mycobacterium
SPWWG

SEQ ID NO: 583759 - protein, 5 aa, Mycobacterium
SPYCT

SEQ ID NO: 583760 - protein, 6 aa, Mycobacterium
SPYDAT

SEQ ID NO: 583761 - protein, 9 aa, Mycobacterium
SPYDSTVTT

SEQ ID NO: 583762 - protein, 12 aa, Mycobacterium
SPYENVSPANYP

SEQ ID NO: 583763 - protein, 12 aa, Mycobacterium
SPYENVTTQDYP

SEQ ID NO: 583764 - protein, 4 aa, Mycobacterium
SPYG

SEQ ID NO: 583765 - protein, 7 aa, Mycobacterium
SPYGDHN

SEQ ID NO: 583766 - protein, 5 aa, Mycobacterium
SPYGP

SEQ ID NO: 583767 - protein, 6 aa, Mycobacterium
SPYPAD

SEQ ID NO: 583768 - protein, 10 aa, Mycobacterium
SPYPLDGKGT

SEQ ID NO: 583769 - protein, 5 aa, Mycobacterium
SPYPV

SEQ ID NO: 583770 - protein, 5 aa, Mycobacterium
SPYQN

SEQ ID NO: 583771 - protein, 13 aa, Mycobacterium
SPYQNISADGKYP

SEQ ID NO: 583772 - protein, 10 aa, Mycobacterium
SPYQTRNPAL

SEQ ID NO: 583773 - protein, 6 aa, Mycobacterium
SPYRPE

SEQ ID NO: 583774 - protein, 7 aa, Mycobacterium
SPYRQYS

SEQ ID NO: 583775 - protein, 10 aa, Mycobacterium
SPYRRAKERG

SEQ ID NO: 583776 - protein, 7 aa, Mycobacterium
SPYTDAA

SEQ ID NO: 583777 - protein, 99 aa, Mycobacterium
SQAAAAPAAETAASPAPAPQPPRPAPEPPAPIPGPAPEPPAPRPEPEPAPEPEPAPEPTPIPEPPAPEPAPEPEPEPAPVPEPEPAREPRQPGALDTTA

SEQ ID NO: 583778 - protein, 104 aa, Mycobacterium
SQAAAASPPAAEPAPATPPTPAAPPTPAAPPAPAVAAPPAPAPAPQAPRPEPPVARPAPEPPPRPAPEPVAPPPPAAPVPAAAPAAPAPAAETGSVPGQPNAAA

SEQ ID NO: 583779 - protein, 11 aa, Mycobacterium
SQAADKTGVAR

SEQ ID NO: 583780 - protein, 7 aa, Mycobacterium
SQAADVQ

SEQ ID NO: 583781 - protein, 8 aa, Mycobacterium
SQAAEGYA

SEQ ID NO: 583782 - protein, 8 aa, Mycobacterium
SQAAGREA

SEQ ID NO: 583783 - protein, 12 aa, Mycobacterium
SQAAGYLPPNET

SEQ ID NO: 583784 - protein, 7 aa, Mycobacterium
SQAAPKL

SEQ ID NO: 583785 - protein, 6 aa, Mycobacterium
SQAAPP

SEQ ID NO: 583786 - protein, 9 aa, Mycobacterium
SQAAQAPAQ

SEQ ID NO: 583787 - protein, 6 aa, Mycobacterium
SQAATV

SEQ ID NO: 583788 - protein, 5 aa, Mycobacterium
SQAAV

SEQ ID NO: 583789 - protein, 9 aa, Mycobacterium
SQADAGEAR

SEQ ID NO: 583790 - protein, 14 aa, Mycobacterium
SQADGVASAEVAGP

SEQ ID NO: 583791 - protein, 8 aa, Mycobacterium
SQADHTYG

SEQ ID NO: 583792 - protein, 10 aa, Mycobacterium
SQADTLDPAH

SEQ ID NO: 583793 - protein, 5 aa, Mycobacterium
SQADV

SEQ ID NO: 583794 - protein, 7 aa, Mycobacterium
SQADVDA

SEQ ID NO: 583795 - protein, 13 aa, Mycobacterium
SQAEPVPDDADFA

SEQ ID NO: 583796 - protein, 9 aa, Mycobacterium
SQAERDGDT

SEQ ID NO: 583797 - protein, 5 aa, Mycobacterium
SQAES

SEQ ID NO: 583798 - protein, 9 aa, Mycobacterium
SQAESSTTE

SEQ ID NO: 583799 - protein, 10 aa, Mycobacterium
SQAGAGNQVS

SEQ ID NO: 583800 - protein, 9 aa, Mycobacterium
SQAGEEADK

SEQ ID NO: 583801 - protein, 5 aa, Mycobacterium
SQAGG

SEQ ID NO: 583802 - protein, 8 aa, Mycobacterium
SQAGKGSL

SEQ ID NO: 583803 - protein, 7 aa, Mycobacterium
SQAGVPT

SEQ ID NO: 583804 - protein, 4 aa, Mycobacterium
SQAH

SEQ ID NO: 583805 - protein, 5 aa, Mycobacterium
SQAHY

SEQ ID NO: 583806 - protein, 9 aa, Mycobacterium
SQAKDARTT

SEQ ID NO: 583807 - protein, 12 aa, Mycobacterium
SQAKTSGQPQAG

SEQ ID NO: 583808 - protein, 12 aa, Mycobacterium
SQALKKAAAQAQ

SEQ ID NO: 583809 - protein, 12 aa, Mycobacterium
SQALKKAAQAAQ

SEQ ID NO: 583810 - protein, 7 aa, Mycobacterium
SQALRRG

SEQ ID NO: 583811 - protein, 16 aa, Mycobacterium
SQALRRGAAEHLREAT

SEQ ID NO: 583812 - protein, 4 aa, Mycobacterium
SQAN

SEQ ID NO: 583813 - protein, 12 aa, Mycobacterium
SQANLPGKGSTR

SEQ ID NO: 583814 - protein, 8 aa, Mycobacterium
SQANTDQH

SEQ ID NO: 583815 - protein, 7 aa, Mycobacterium
SQANVAG

SEQ ID NO: 583816 - protein, 10 aa, Mycobacterium
SQAPDSGNSE

SEQ ID NO: 583817 - protein, 6 aa, Mycobacterium
SQAPHA

SEQ ID NO: 583818 - protein, 5 aa, Mycobacterium
SQAPL

SEQ ID NO: 583819 - protein, 9 aa, Mycobacterium
SQAPPETRA

SEQ ID NO: 583820 - protein, 4 aa, Mycobacterium
SQAQ

SEQ ID NO: 583821 - protein, 7 aa, Mycobacterium
SQAQTVA

SEQ ID NO: 583822 - protein, 6 aa, Mycobacterium
SQARAA

SEQ ID NO: 583823 - protein, 7 aa, Mycobacterium
SQARAAE

SEQ ID NO: 583824 - protein, 12 aa, Mycobacterium
SQARAKQAWDEG

SEQ ID NO: 583825 - protein, 7 aa, Mycobacterium
SQARDGG

SEQ ID NO: 583826 - protein, 7 aa, Mycobacterium
SQARGTP

SEQ ID NO: 583827 - protein, 15 aa, Mycobacterium
SQARQAGKKPSLASS

SEQ ID NO: 583828 - protein, 11 aa, Mycobacterium
SQARSRDMKKD

SEQ ID NO: 583829 - protein, 13 aa, Mycobacterium
SQARSRRSGSYDT

SEQ ID NO: 583830 - protein, 10 aa, Mycobacterium
SQARYGGTPG

SEQ ID NO: 583831 - protein, 17 aa, Mycobacterium
SQASAAQRSGRSGRTAP

SEQ ID NO: 583832 - protein, 14 aa, Mycobacterium
SQASAQQRAGRCGR

SEQ ID NO: 583833 - protein, 5 aa, Mycobacterium
SQASG

SEQ ID NO: 583834 - protein, 8 aa, Mycobacterium
SQASNDQL

SEQ ID NO: 583835 - protein, 6 aa, Mycobacterium
SQASRT

SEQ ID NO: 583836 - protein, 10 aa, Mycobacterium
SQASSSSGGI

SEQ ID NO: 583837 - protein, 10 aa, Mycobacterium
SQATEGLAAR

SEQ ID NO: 583838 - protein, 13 aa, Mycobacterium
SQATMPALPLIEI

SEQ ID NO: 583839 - protein, 8 aa, Mycobacterium
SQATSGEL

SEQ ID NO: 583840 - protein, 8 aa, Mycobacterium
SQATTLND

SEQ ID NO: 583841 - protein, 10 aa, Mycobacterium
SQAVDPNVTP

SEQ ID NO: 583842 - protein, 28 aa, Mycobacterium
SQAVDPNVTPLAGTRPAAGVNELPTADG

SEQ ID NO: 583843 - protein, 9 aa, Mycobacterium
SQAVEPNVT

SEQ ID NO: 583844 - protein, 10 aa, Mycobacterium
SQAVEPNVTP

SEQ ID NO: 583845 - protein, 6 aa, Mycobacterium
SQAVGP

SEQ ID NO: 583846 - protein, 6 aa, Mycobacterium
SQAYGR

SEQ ID NO: 583847 - protein, 7 aa, Mycobacterium
SQAYPAA

SEQ ID NO: 583848 - protein, 9 aa, Mycobacterium
SQCSDAPHV

SEQ ID NO: 583849 - protein, 4 aa, Mycobacterium
SQDA

SEQ ID NO: 583850 - protein, 14 aa, Mycobacterium
SQDAARSAPEAGDV

SEQ ID NO: 583851 - protein, 9 aa, Mycobacterium
SQDADGEGA

SEQ ID NO: 583852 - protein, 9 aa, Mycobacterium
SQDAHEDDL

SEQ ID NO: 583853 - protein, 9 aa, Mycobacterium
SQDASGDHA

SEQ ID NO: 583854 - protein, 4 aa, Mycobacterium
SQDD

SEQ ID NO: 583855 - protein, 16 aa, Mycobacterium
SQDDAATALQRETGGR

SEQ ID NO: 583856 - protein, 6 aa, Mycobacterium
SQDDTR

SEQ ID NO: 583857 - protein, 8 aa, Mycobacterium
SQDEIEQT

SEQ ID NO: 583858 - protein, 6 aa, Mycobacterium
SQDGFD

SEQ ID NO: 583859 - protein, 21 aa, Mycobacterium
SQDGRPAPQRAARAQAAAAEN

SEQ ID NO: 583860 - protein, 8 aa, Mycobacterium
SQDGRSGI

SEQ ID NO: 583861 - protein, 9 aa, Mycobacterium
SQDGRSGIA

SEQ ID NO: 583862 - protein, 9 aa, Mycobacterium
SQDGSSDDT

SEQ ID NO: 583863 - protein, 8 aa, Mycobacterium
SQDGTDVD

SEQ ID NO: 583864 - protein, 7 aa, Mycobacterium
SQDGTPI

SEQ ID NO: 583865 - protein, 4 aa, Mycobacterium
SQDH

SEQ ID NO: 583866 - protein, 8 aa, Mycobacterium
SQDLPGDS

SEQ ID NO: 583867 - protein, 8 aa, Mycobacterium
SQDLPGDT

SEQ ID NO: 583868 - protein, 38 aa, Mycobacterium
SQDLPGDTYIGPDGPFEAKGYPTRVGRSGRAQDTETAK

SEQ ID NO: 583869 - protein, 6 aa, Mycobacterium
SQDLTG

SEQ ID NO: 583870 - protein, 8 aa, Mycobacterium
SQDNAAKS

SEQ ID NO: 583871 - protein, 10 aa, Mycobacterium
SQDPDTPGLA

SEQ ID NO: 583872 - protein, 17 aa, Mycobacterium
SQDPDTPGLADSVRRES

SEQ ID NO: 583873 - protein, 11 aa, Mycobacterium
SQDPDTPGLAE

SEQ ID NO: 583874 - protein, 6 aa, Mycobacterium
SQDRAD

SEQ ID NO: 583875 - protein, 7 aa, Mycobacterium
SQDRKPD

SEQ ID NO: 583876 - protein, 9 aa, Mycobacterium
SQDRYVDDP

SEQ ID NO: 583877 - protein, 5 aa, Mycobacterium
SQDSA

SEQ ID NO: 583878 - protein, 9 aa, Mycobacterium
SQDSARATE

SEQ ID NO: 583879 - protein, 9 aa, Mycobacterium
SQDSNTKLT

SEQ ID NO: 583880 - protein, 8 aa, Mycobacterium
SQDSNVPL

SEQ ID NO: 583881 - protein, 7 aa, Mycobacterium
SQDSRTA

SEQ ID NO: 583882 - protein, 6 aa, Mycobacterium
SQDSVY

SEQ ID NO: 583883 - protein, 8 aa, Mycobacterium
SQDTDYQA

SEQ ID NO: 583884 - protein, 10 aa, Mycobacterium
SQDTNAPVEQ

SEQ ID NO: 583885 - protein, 7 aa, Mycobacterium
SQDTNTP

SEQ ID NO: 583886 - protein, 10 aa, Mycobacterium
SQDTSGQAVG

SEQ ID NO: 583887 - protein, 5 aa, Mycobacterium
SQDVA

SEQ ID NO: 583888 - protein, 9 aa, Mycobacterium
SQDVGENGW

SEQ ID NO: 583889 - protein, 5 aa, Mycobacterium
SQDVP

SEQ ID NO: 583890 - protein, 5 aa, Mycobacterium
SQDVR

SEQ ID NO: 583891 - protein, 5 aa, Mycobacterium
SQDVS

SEQ ID NO: 583892 - protein, 7 aa, Mycobacterium
SQDYSEA

SEQ ID NO: 583893 - protein, 4 aa, Mycobacterium
SQEA

SEQ ID NO: 583894 - protein, 6 aa, Mycobacterium
SQEAAN

SEQ ID NO: 583895 - protein, 16 aa, Mycobacterium
SQEAARSAPEAGDAAP

SEQ ID NO: 583896 - protein, 9 aa, Mycobacterium
SQEAREKYE

SEQ ID NO: 583897 - protein, 17 aa, Mycobacterium
SQEARTAEEIYEPSPKN

SEQ ID NO: 583898 - protein, 5 aa, Mycobacterium
SQEDA

SEQ ID NO: 583899 - protein, 5 aa, Mycobacterium
SQEEA

SEQ ID NO: 583900 - protein, 6 aa, Mycobacterium
SQEEGV

SEQ ID NO: 583901 - protein, 13 aa, Mycobacterium
SQEEPHGTQARER

SEQ ID NO: 583902 - protein, 5 aa, Mycobacterium
SQEEV

SEQ ID NO: 583903 - protein, 8 aa, Mycobacterium
SQEGAKYN

SEQ ID NO: 583904 - protein, 4 aa, Mycobacterium
SQEL

SEQ ID NO: 583905 - protein, 5 aa, Mycobacterium
SQELD

SEQ ID NO: 583906 - protein, 6 aa, Mycobacterium
SQELPT

SEQ ID NO: 583907 - protein, 7 aa, Mycobacterium
SQENPRE

SEQ ID NO: 583908 - protein, 9 aa, Mycobacterium
SQENQKPLG

SEQ ID NO: 583909 - protein, 5 aa, Mycobacterium
SQEPA

SEQ ID NO: 583910 - protein, 8 aa, Mycobacterium
SQEQKDRY

SEQ ID NO: 583911 - protein, 7 aa, Mycobacterium
SQEQKRE

SEQ ID NO: 583912 - protein, 6 aa, Mycobacterium
SQEQRD

SEQ ID NO: 583913 - protein, 8 aa, Mycobacterium
SQERESFG

SEQ ID NO: 583914 - protein, 6 aa, Mycobacterium
SQERTR

SEQ ID NO: 583915 - protein, 7 aa, Mycobacterium
SQESNTK

SEQ ID NO: 583916 - protein, 10 aa, Mycobacterium
SQESNTPVAE

SEQ ID NO: 583917 - protein, 5 aa, Mycobacterium
SQESQ

SEQ ID NO: 583918 - protein, 7 aa, Mycobacterium
SQESQTK

SEQ ID NO: 583919 - protein, 4 aa, Mycobacterium
SQET

SEQ ID NO: 583920 - protein, 7 aa, Mycobacterium
SQETNAK

SEQ ID NO: 583921 - protein, 8 aa, Mycobacterium
SQETNTKL

SEQ ID NO: 583922 - protein, 8 aa, Mycobacterium
SQETNTKV

SEQ ID NO: 583923 - protein, 7 aa, Mycobacterium
SQEVAQQ

SEQ ID NO: 583924 - protein, 6 aa, Mycobacterium
SQEVGE

SEQ ID NO: 583925 - protein, 13 aa, Mycobacterium
SQFDGYTSGTTKD

SEQ ID NO: 583926 - protein, 4 aa, Mycobacterium
SQFE

SEQ ID NO: 583927 - protein, 4 aa, Mycobacterium
SQFG

SEQ ID NO: 583928 - protein, 10 aa, Mycobacterium
SQFGGRDGSN

SEQ ID NO: 583929 - protein, 4 aa, Mycobacterium
SQFT

SEQ ID NO: 583930 - protein, 5 aa, Mycobacterium
SQGAA

SEQ ID NO: 583931 - protein, 6 aa, Mycobacterium
SQGAEL

SEQ ID NO: 583932 - protein, 5 aa, Mycobacterium
SQGAG

SEQ ID NO: 583933 - protein, 6 aa, Mycobacterium
SQGAGI

SEQ ID NO: 583934 - protein, 10 aa, Mycobacterium
SQGAKPGLGG

SEQ ID NO: 583935 - protein, 8 aa, Mycobacterium
SQGANTPL

SEQ ID NO: 583936 - protein, 9 aa, Mycobacterium
SQGAQSINR

SEQ ID NO: 583937 - protein, 19 aa, Mycobacterium
SQGAQSLNRAVSGAAEGLA

SEQ ID NO: 583938 - protein, 6 aa, Mycobacterium
SQGARV

SEQ ID NO: 583939 - protein, 9 aa, Mycobacterium
SQGASGSLR

SEQ ID NO: 583940 - protein, 5 aa, Mycobacterium
SQGDS

SEQ ID NO: 583941 - protein, 7 aa, Mycobacterium
SQGDVDG

SEQ ID NO: 583942 - protein, 9 aa, Mycobacterium
SQGDYDQAE

SEQ ID NO: 583943 - protein, 11 aa, Mycobacterium
SQGEDAKTTAT

SEQ ID NO: 583944 - protein, 8 aa, Mycobacterium
SQGEDRLS

SEQ ID NO: 583945 - protein, 16 aa, Mycobacterium
SQGEPAIPTTLIPAGR

SEQ ID NO: 583946 - protein, 8 aa, Mycobacterium
SQGERGRT

SEQ ID NO: 583947 - protein, 8 aa, Mycobacterium
SQGETRPM

SEQ ID NO: 583948 - protein, 11 aa, Mycobacterium
SQGETRPTEAI

SEQ ID NO: 583949 - protein, 17 aa, Mycobacterium
SQGGENGAKPSLPQPRH

SEQ ID NO: 583950 - protein, 11 aa, Mycobacterium
SQGGEVKTTAT

SEQ ID NO: 583951 - protein, 10 aa, Mycobacterium
SQGGRASNPA

SEQ ID NO: 583952 - protein, 5 aa, Mycobacterium
SQGHA

SEQ ID NO: 583953 - protein, 8 aa, Mycobacterium
SQGHEGAQ

SEQ ID NO: 583954 - protein, 5 aa, Mycobacterium
SQGIE

SEQ ID NO: 583955 - protein, 6 aa, Mycobacterium
SQGIEH

SEQ ID NO: 583956 - protein, 6 aa, Mycobacterium
SQGIGA

SEQ ID NO: 583957 - protein, 8 aa, Mycobacterium
SQGIRKAK

SEQ ID NO: 583958 - protein, 11 aa, Mycobacterium
SQGISAGSTAA

SEQ ID NO: 583959 - protein, 11 aa, Mycobacterium
SQGKWYPGEPL

SEQ ID NO: 583960 - protein, 13 aa, Mycobacterium
SQGLADEQAREAA

SEQ ID NO: 583961 - protein, 5 aa, Mycobacterium
SQGLG

SEQ ID NO: 583962 - protein, 8 aa, Mycobacterium
SQGLQGAN

SEQ ID NO: 583963 - protein, 74 aa, Mycobacterium
SQGLSTGSALGSLPPATGTGTPAAGQTAATPAAGLTSGAGVPSAGVAAAGATPPTVNPAGAGVANSAGTAGAAP

SEQ ID NO: 583964 - protein, 8 aa, Mycobacterium
SQGNAKTA

SEQ ID NO: 583965 - protein, 12 aa, Mycobacterium
SQGPGAKPAFVG

SEQ ID NO: 583966 - protein, 7 aa, Mycobacterium
SQGPGET

SEQ ID NO: 583967 - protein, 19 aa, Mycobacterium
SQGPGQGTAPITQGSTLGN

SEQ ID NO: 583968 - protein, 7 aa, Mycobacterium
SQGPQID

SEQ ID NO: 583969 - protein, 6 aa, Mycobacterium
SQGPVR

SEQ ID NO: 583970 - protein, 6 aa, Mycobacterium
SQGQLT

SEQ ID NO: 583971 - protein, 6 aa, Mycobacterium
SQGQTL

SEQ ID NO: 583972 - protein, 6 aa, Mycobacterium
SQGQTV

SEQ ID NO: 583973 - protein, 5 aa, Mycobacterium
SQGRD

SEQ ID NO: 583974 - protein, 10 aa, Mycobacterium
SQGRGSAANS

SEQ ID NO: 583975 - protein, 5 aa, Mycobacterium
SQGRI

SEQ ID NO: 583976 - protein, 17 aa, Mycobacterium
SQGRPDTYESGTWGPQS

SEQ ID NO: 583977 - protein, 7 aa, Mycobacterium
SQGRPVS

SEQ ID NO: 583978 - protein, 5 aa, Mycobacterium
SQGRR

SEQ ID NO: 583979 - protein, 8 aa, Mycobacterium
SQGSQVPS

SEQ ID NO: 583980 - protein, 8 aa, Mycobacterium
SQGTGGGV

SEQ ID NO: 583981 - protein, 7 aa, Mycobacterium
SQGTKDY

SEQ ID NO: 583982 - protein, 4 aa, Mycobacterium
SQGV

SEQ ID NO: 583983 - protein, 9 aa, Mycobacterium
SQGWRGPAS

SEQ ID NO: 583984 - protein, 6 aa, Mycobacterium
SQHDAA

SEQ ID NO: 583985 - protein, 9 aa, Mycobacterium
SQHDDKPPH

SEQ ID NO: 583986 - protein, 5 aa, Mycobacterium
SQHDR

SEQ ID NO: 583987 - protein, 5 aa, Mycobacterium
SQHER

SEQ ID NO: 583988 - protein, 5 aa, Mycobacterium
SQHNE

SEQ ID NO: 583989 - protein, 6 aa, Mycobacterium
SQHPHV

SEQ ID NO: 583990 - protein, 8 aa, Mycobacterium
SQHPSTGP

SEQ ID NO: 583991 - protein, 6 aa, Mycobacterium
SQHRDP

SEQ ID NO: 583992 - protein, 9 aa, Mycobacterium
SQIAKKYTA

SEQ ID NO: 583993 - protein, 10 aa, Mycobacterium
SQIDLPDDEV

SEQ ID NO: 583994 - protein, 4 aa, Mycobacterium
SQIG

SEQ ID NO: 583995 - protein, 6 aa, Mycobacterium
SQIGAG

SEQ ID NO: 583996 - protein, 11 aa, Mycobacterium
SQIGATDGAGV

SEQ ID NO: 583997 - protein, 13 aa, Mycobacterium
SQIGGSGRGTMPA

SEQ ID NO: 583998 - protein, 9 aa, Mycobacterium
SQIGSSGLG

SEQ ID NO: 583999 - protein, 9 aa, Mycobacterium
SQIGSSTGV

SEQ ID NO: 584000 - protein, 5 aa, Mycobacterium
SQIGT

SEQ ID NO: 584001 - protein, 5 aa, Mycobacterium
SQIKT

SEQ ID NO: 584002 - protein, 17 aa, Mycobacterium
SQIPETMPDPDNDDEGC

SEQ ID NO: 584003 - protein, 13 aa, Mycobacterium
SQIPGHNPAHEKL

SEQ ID NO: 584004 - protein, 7 aa, Mycobacterium
SQIPPDS

SEQ ID NO: 584005 - protein, 5 aa, Mycobacterium
SQIQA

SEQ ID NO: 584006 - protein, 7 aa, Mycobacterium
SQISDGA

SEQ ID NO: 584007 - protein, 11 aa, Mycobacterium
SQISDGGSATL

SEQ ID NO: 584008 - protein, 7 aa, Mycobacterium
SQKAGPV

SEQ ID NO: 584009 - protein, 9 aa, Mycobacterium
SQKDISDTI

SEQ ID NO: 584010 - protein, 6 aa, Mycobacterium
SQKGER

SEQ ID NO: 584011 - protein, 9 aa, Mycobacterium
SQKKSDRLK

SEQ ID NO: 584012 - protein, 8 aa, Mycobacterium
SQKPFPDP

SEQ ID NO: 584013 - protein, 5 aa, Mycobacterium
SQKRR

SEQ ID NO: 584014 - protein, 6 aa, Mycobacterium
SQKSGQ

SEQ ID NO: 584015 - protein, 7 aa, Mycobacterium
SQKSNTK

SEQ ID NO: 584016 - protein, 7 aa, Mycobacterium
SQKSNTR

SEQ ID NO: 584017 - protein, 25 aa, Mycobacterium
SQKTLKRDLQESQKTREEDLAHDRQ

SEQ ID NO: 584018 - protein, 7 aa, Mycobacterium
SQKTQTL

SEQ ID NO: 584019 - protein, 5 aa, Mycobacterium
SQLAE

SEQ ID NO: 584020 - protein, 6 aa, Mycobacterium
SQLAPE

SEQ ID NO: 584021 - protein, 14 aa, Mycobacterium
SQLARAGRITEARA

SEQ ID NO: 584022 - protein, 7 aa, Mycobacterium
SQLASGA

SEQ ID NO: 584023 - protein, 14 aa, Mycobacterium
SQLDEASHAAGAAV

SEQ ID NO: 584024 - protein, 6 aa, Mycobacterium
SQLDRD

SEQ ID NO: 584025 - protein, 9 aa, Mycobacterium
SQLEPGDRA

SEQ ID NO: 584026 - protein, 24 aa, Mycobacterium
SQLETVRPSAEDRLSAPDSPQAQD

SEQ ID NO: 584027 - protein, 4 aa, Mycobacterium
SQLG

SEQ ID NO: 584028 - protein, 6 aa, Mycobacterium
SQLGDS

SEQ ID NO: 584029 - protein, 8 aa, Mycobacterium
SQLGGELA

SEQ ID NO: 584030 - protein, 6 aa, Mycobacterium
SQLGGV

SEQ ID NO: 584031 - protein, 8 aa, Mycobacterium
SQLGVQPG

SEQ ID NO: 584032 - protein, 10 aa, Mycobacterium
SQLKSDRAGL

SEQ ID NO: 584033 - protein, 16 aa, Mycobacterium
SQLNGAGGLGDAVGRS

SEQ ID NO: 584034 - protein, 8 aa, Mycobacterium
SQLNPAAG

SEQ ID NO: 584035 - protein, 11 aa, Mycobacterium
SQLNPGSDAVD

SEQ ID NO: 584036 - protein, 15 aa, Mycobacterium
SQLPDAAQPTSDDVR

SEQ ID NO: 584037 - protein, 16 aa, Mycobacterium
SQLPGNRSDVRERSTT

SEQ ID NO: 584038 - protein, 6 aa, Mycobacterium
SQLPGS

SEQ ID NO: 584039 - protein, 6 aa, Mycobacterium
SQLPHS

SEQ ID NO: 584040 - protein, 7 aa, Mycobacterium
SQLPNPE

SEQ ID NO: 584041 - protein, 9 aa, Mycobacterium
SQLRARAND

SEQ ID NO: 584042 - protein, 8 aa, Mycobacterium
SQLRDEGR

SEQ ID NO: 584043 - protein, 12 aa, Mycobacterium
SQLRGSPGTPTL

SEQ ID NO: 584044 - protein, 7 aa, Mycobacterium
SQLSGGM

SEQ ID NO: 584045 - protein, 10 aa, Mycobacterium
SQLSGGQRQR

SEQ ID NO: 584046 - protein, 5 aa, Mycobacterium
SQLSN

SEQ ID NO: 584047 - protein, 6 aa, Mycobacterium
SQLSNI

SEQ ID NO: 584048 - protein, 7 aa, Mycobacterium
SQLSQNG

SEQ ID NO: 584049 - protein, 4 aa, Mycobacterium
SQLT

SEQ ID NO: 584050 - protein, 4 aa, Mycobacterium
SQMA

SEQ ID NO: 584051 - protein, 6 aa, Mycobacterium
SQMDNS

SEQ ID NO: 584052 - protein, 8 aa, Mycobacterium
SQMTDAQV

SEQ ID NO: 584053 - protein, 9 aa, Mycobacterium
SQNADKVDT

SEQ ID NO: 584054 - protein, 8 aa, Mycobacterium
SQNADKVE

SEQ ID NO: 584055 - protein, 6 aa, Mycobacterium
SQNDID

SEQ ID NO: 584056 - protein, 10 aa, Mycobacterium
SQNDPVGGER

SEQ ID NO: 584057 - protein, 4 aa, Mycobacterium
SQNF

SEQ ID NO: 584058 - protein, 14 aa, Mycobacterium
SQNGASPNGSARQR

SEQ ID NO: 584059 - protein, 10 aa, Mycobacterium
SQNGDPGYKA

SEQ ID NO: 584060 - protein, 11 aa, Mycobacterium
SQNGPSADAEA

SEQ ID NO: 584061 - protein, 16 aa, Mycobacterium
SQNPAAQQVAQNPAAQ

SEQ ID NO: 584062 - protein, 7 aa, Mycobacterium
SQNPESP

SEQ ID NO: 584063 - protein, 8 aa, Mycobacterium
SQNPGSIL

SEQ ID NO: 584064 - protein, 6 aa, Mycobacterium
SQNPRQ

SEQ ID NO: 584065 - protein, 23 aa, Mycobacterium
SQNQGKTAENPIARYSEGEQSRL

SEQ ID NO: 584066 - protein, 8 aa, Mycobacterium
SQNRAEKA

SEQ ID NO: 584067 - protein, 7 aa, Mycobacterium
SQNREGL

SEQ ID NO: 584068 - protein, 19 aa, Mycobacterium
SQNSGGGVGSTGDESLSHS

SEQ ID NO: 584069 - protein, 9 aa, Mycobacterium
SQNSSNSQR

SEQ ID NO: 584070 - protein, 4 aa, Mycobacterium
SQNT

SEQ ID NO: 584071 - protein, 18 aa, Mycobacterium
SQNTTHRPFAEALMARFF

SEQ ID NO: 584072 - protein, 17 aa, Mycobacterium
SQPALEGAASRVEEYTD

SEQ ID NO: 584073 - protein, 8 aa, Mycobacterium
SQPAQRAR

SEQ ID NO: 584074 - protein, 7 aa, Mycobacterium
SQPATSD

SEQ ID NO: 584075 - protein, 7 aa, Mycobacterium
SQPAVSR

SEQ ID NO: 584076 - protein, 4 aa, Mycobacterium
SQPD

SEQ ID NO: 584077 - protein, 5 aa, Mycobacterium
SQPDL

SEQ ID NO: 584078 - protein, 9 aa, Mycobacterium
SQPDSDSIA

SEQ ID NO: 584079 - protein, 6 aa, Mycobacterium
SQPDVN

SEQ ID NO: 584080 - protein, 6 aa, Mycobacterium
SQPEHI

SEQ ID NO: 584081 - protein, 6 aa, Mycobacterium
SQPERV

SEQ ID NO: 584082 - protein, 8 aa, Mycobacterium
SQPEYDGR

SEQ ID NO: 584083 - protein, 4 aa, Mycobacterium
SQPF

SEQ ID NO: 584084 - protein, 7 aa, Mycobacterium
SQPFEAT

SEQ ID NO: 584085 - protein, 7 aa, Mycobacterium
SQPFNAV

SEQ ID NO: 584086 - protein, 4 aa, Mycobacterium
SQPG

SEQ ID NO: 584087 - protein, 6 aa, Mycobacterium
SQPGAG

SEQ ID NO: 584088 - protein, 6 aa, Mycobacterium
SQPGEG

SEQ ID NO: 584089 - protein, 5 aa, Mycobacterium
SQPGF

SEQ ID NO: 584090 - protein, 8 aa, Mycobacterium
SQPGFDDR

SEQ ID NO: 584091 - protein, 8 aa, Mycobacterium
SQPGKRGA

SEQ ID NO: 584092 - protein, 8 aa, Mycobacterium
SQPGNGGR

SEQ ID NO: 584093 - protein, 9 aa, Mycobacterium
SQPGPMTES

SEQ ID NO: 584094 - protein, 6 aa, Mycobacterium
SQPGVG

SEQ ID NO: 584095 - protein, 5 aa, Mycobacterium
SQPGW

SEQ ID NO: 584096 - protein, 13 aa, Mycobacterium
SQPGYPETRARSD

SEQ ID NO: 584097 - protein, 4 aa, Mycobacterium
SQPI

SEQ ID NO: 584098 - protein, 9 aa, Mycobacterium
SQPIADGPA

SEQ ID NO: 584099 - protein, 9 aa, Mycobacterium
SQPITEQDQ

SEQ ID NO: 584100 - protein, 7 aa, Mycobacterium
SQPKMPD

SEQ ID NO: 584101 - protein, 7 aa, Mycobacterium
SQPKYGA

SEQ ID NO: 584102 - protein, 9 aa, Mycobacterium
SQPLTEQDQ

SEQ ID NO: 584103 - protein, 6 aa, Mycobacterium
SQPLVD

SEQ ID NO: 584104 - protein, 6 aa, Mycobacterium
SQPNCK

SEQ ID NO: 584105 - protein, 8 aa, Mycobacterium
SQPNTGEL

SEQ ID NO: 584106 - protein, 8 aa, Mycobacterium
SQPPDYRD

SEQ ID NO: 584107 - protein, 10 aa, Mycobacterium
SQPPEYGGRN

SEQ ID NO: 584108 - protein, 6 aa, Mycobacterium
SQPPFD

SEQ ID NO: 584109 - protein, 6 aa, Mycobacterium
SQPPSL

SEQ ID NO: 584110 - protein, 5 aa, Mycobacterium
SQPQE

SEQ ID NO: 584111 - protein, 12 aa, Mycobacterium
SQPQERFEGFVE

SEQ ID NO: 584112 - protein, 5 aa, Mycobacterium
SQPQF

SEQ ID NO: 584113 - protein, 7 aa, Mycobacterium
SQPRPVG

SEQ ID NO: 584114 - protein, 6 aa, Mycobacterium
SQPRRR

SEQ ID NO: 584115 - protein, 6 aa, Mycobacterium
SQPSAG

SEQ ID NO: 584116 - protein, 7 aa, Mycobacterium
SQPSASD

SEQ ID NO: 584117 - protein, 11 aa, Mycobacterium
SQPSGVSAPGR

SEQ ID NO: 584118 - protein, 9 aa, Mycobacterium
SQPSPGDTA

SEQ ID NO: 584119 - protein, 6 aa, Mycobacterium
SQPSSY

SEQ ID NO: 584120 - protein, 6 aa, Mycobacterium
SQPSVS

SEQ ID NO: 584121 - protein, 9 aa, Mycobacterium
SQPSYDGRP

SEQ ID NO: 584122 - protein, 16 aa, Mycobacterium
SQPTDDLPTADGTGSM

SEQ ID NO: 584123 - protein, 6 aa, Mycobacterium
SQPTER

SEQ ID NO: 584124 - protein, 98 aa, Mycobacterium
SQPTLDRPSGPMPAAPGAPVESAPGRADGRRARRRAESRTSAASTPSPLVPTRAQPPGPTRAQPPRTAAPAQPATEPLPDAGAPAEQSKKPNKPVPQR

SEQ ID NO: 584125 - protein, 13 aa, Mycobacterium
SQPTSVDAADGLR

SEQ ID NO: 584126 - protein, 16 aa, Mycobacterium
SQPVSGSNVIQIRSRA

SEQ ID NO: 584127 - protein, 5 aa, Mycobacterium
SQQAD

SEQ ID NO: 584128 - protein, 14 aa, Mycobacterium
SQQAEIDTMQAMLD

SEQ ID NO: 584129 - protein, 11 aa, Mycobacterium
SQQAGRDALAP

SEQ ID NO: 584130 - protein, 9 aa, Mycobacterium
SQQAPPAMQ

SEQ ID NO: 584131 - protein, 6 aa, Mycobacterium
SQQDVA

SEQ ID NO: 584132 - protein, 14 aa, Mycobacterium
SQQGAATGTDEQRI

SEQ ID NO: 584133 - protein, 198 aa, Mycobacterium
SQQGESGDAETMTDGTPTGTPPGTRPTNYGTNDAQSLGYGTEEQSPPDPSDVESGSDGVSRETPPGGNAESNEQSGSKGNPATTPSTEGTGAPSPPDPSSLENAYTATGTPTPMPAPMTPAGGGLSSTGSSGGGLKMPGAGGLSGAGSVSPASGAGGLGSGGLNPAAAAGLSPTSSGAGLPSAASAGTPTPSSDFSRG

SEQ ID NO: 584134 - protein, 10 aa, Mycobacterium
SQQGEVKTNA

SEQ ID NO: 584135 - protein, 20 aa, Mycobacterium
SQQLQASKSNLRTQDGYEAP

SEQ ID NO: 584136 - protein, 8 aa, Mycobacterium
SQQNTFTG

SEQ ID NO: 584137 - protein, 7 aa, Mycobacterium
SQQQSEQ

SEQ ID NO: 584138 - protein, 4 aa, Mycobacterium
SQQR

SEQ ID NO: 584139 - protein, 8 aa, Mycobacterium
SQQRESFG

SEQ ID NO: 584140 - protein, 20 aa, Mycobacterium
SQQRRQDGKYTFTPQGDKTH

SEQ ID NO: 584141 - protein, 4 aa, Mycobacterium
SQQS

SEQ ID NO: 584142 - protein, 8 aa, Mycobacterium
SQQTGSVH

SEQ ID NO: 584143 - protein, 8 aa, Mycobacterium
SQQTNTKL

SEQ ID NO: 584144 - protein, 8 aa, Mycobacterium
SQQTNTRV

SEQ ID NO: 584145 - protein, 11 aa, Mycobacterium
SQQTTPAAIGA

SEQ ID NO: 584146 - protein, 6 aa, Mycobacterium
SQQTVG

SEQ ID NO: 584147 - protein, 5 aa, Mycobacterium
SQQVY

SEQ ID NO: 584148 - protein, 6 aa, Mycobacterium
SQRAEA

SEQ ID NO: 584149 - protein, 14 aa, Mycobacterium
SQRAGTDHPAVEQG

SEQ ID NO: 584150 - protein, 10 aa, Mycobacterium
SQRARGEDPA

SEQ ID NO: 584151 - protein, 8 aa, Mycobacterium
SQRASVDG

SEQ ID NO: 584152 - protein, 4 aa, Mycobacterium
SQRD

SEQ ID NO: 584153 - protein, 9 aa, Mycobacterium
SQRDADVSV

SEQ ID NO: 584154 - protein, 11 aa, Mycobacterium
SQRDAQDLEDS

SEQ ID NO: 584155 - protein, 7 aa, Mycobacterium
SQRDDIA

SEQ ID NO: 584156 - protein, 7 aa, Mycobacterium
SQRDGIA

SEQ ID NO: 584157 - protein, 14 aa, Mycobacterium
SQRDGQPAAERDQL

SEQ ID NO: 584158 - protein, 9 aa, Mycobacterium
SQRDVGSGP

SEQ ID NO: 584159 - protein, 8 aa, Mycobacterium
SQREDRDD

SEQ ID NO: 584160 - protein, 9 aa, Mycobacterium
SQREPEPGD

SEQ ID NO: 584161 - protein, 6 aa, Mycobacterium
SQREPV

SEQ ID NO: 584162 - protein, 4 aa, Mycobacterium
SQRG

SEQ ID NO: 584163 - protein, 5 aa, Mycobacterium
SQRGL

SEQ ID NO: 584164 - protein, 5 aa, Mycobacterium
SQRGR

SEQ ID NO: 584165 - protein, 9 aa, Mycobacterium
SQRGRPSIP

SEQ ID NO: 584166 - protein, 10 aa, Mycobacterium
SQRGSVGPRG

SEQ ID NO: 584167 - protein, 4 aa, Mycobacterium
SQRH

SEQ ID NO: 584168 - protein, 6 aa, Mycobacterium
SQRHKG

SEQ ID NO: 584169 - protein, 5 aa, Mycobacterium
SQRHP

SEQ ID NO: 584170 - protein, 15 aa, Mycobacterium
SQRHPDLTGTDNSSV

SEQ ID NO: 584171 - protein, 18 aa, Mycobacterium
SQRHPELGRSENDPVAGS

SEQ ID NO: 584172 - protein, 16 aa, Mycobacterium
SQRHPGAPRLTGGQRQ

SEQ ID NO: 584173 - protein, 7 aa, Mycobacterium
SQRIDPQ

SEQ ID NO: 584174 - protein, 7 aa, Mycobacterium
SQRIGRP

SEQ ID NO: 584175 - protein, 10 aa, Mycobacterium
SQRIPDDETV

SEQ ID NO: 584176 - protein, 8 aa, Mycobacterium
SQRIRPSG

SEQ ID NO: 584177 - protein, 6 aa, Mycobacterium
SQRLDR

SEQ ID NO: 584178 - protein, 5 aa, Mycobacterium
SQRLE

SEQ ID NO: 584179 - protein, 5 aa, Mycobacterium
SQRPG

SEQ ID NO: 584180 - protein, 7 aa, Mycobacterium
SQRPPAR

SEQ ID NO: 584181 - protein, 8 aa, Mycobacterium
SQRPSSAG

SEQ ID NO: 584182 - protein, 9 aa, Mycobacterium
SQRPTERDL

SEQ ID NO: 584183 - protein, 4 aa, Mycobacterium
SQRR

SEQ ID NO: 584184 - protein, 9 aa, Mycobacterium
SQRRLGRRG

SEQ ID NO: 584185 - protein, 5 aa, Mycobacterium
SQRRM

SEQ ID NO: 584186 - protein, 5 aa, Mycobacterium
SQRRR

SEQ ID NO: 584187 - protein, 15 aa, Mycobacterium
SQRRVYPDPSPEQVQ

SEQ ID NO: 584188 - protein, 11 aa, Mycobacterium
SQRSAQAGLTP

SEQ ID NO: 584189 - protein, 10 aa, Mycobacterium
SQRSRNRHVG

SEQ ID NO: 584190 - protein, 18 aa, Mycobacterium
SQRSRNRHVGEQLGAGKK

SEQ ID NO: 584191 - protein, 18 aa, Mycobacterium
SQRSRNRHVGEQLGQGKT

SEQ ID NO: 584192 - protein, 7 aa, Mycobacterium
SQRSSQL

SEQ ID NO: 584193 - protein, 5 aa, Mycobacterium
SQRTD

SEQ ID NO: 584194 - protein, 6 aa, Mycobacterium
SQRTEN

SEQ ID NO: 584195 - protein, 5 aa, Mycobacterium
SQRTG

SEQ ID NO: 584196 - protein, 11 aa, Mycobacterium
SQRTPEKAAEG

SEQ ID NO: 584197 - protein, 7 aa, Mycobacterium
SQRTQAR

SEQ ID NO: 584198 - protein, 5 aa, Mycobacterium
SQRWG

SEQ ID NO: 584199 - protein, 18 aa, Mycobacterium
SQRYGRDVTAAEPAWSTW

SEQ ID NO: 584200 - protein, 4 aa, Mycobacterium
SQSA

SEQ ID NO: 584201 - protein, 8 aa, Mycobacterium
SQSAPGNV

SEQ ID NO: 584202 - protein, 18 aa, Mycobacterium
SQSAQQGSSQGGAAPAQL

SEQ ID NO: 584203 - protein, 7 aa, Mycobacterium
SQSARER

SEQ ID NO: 584204 - protein, 7 aa, Mycobacterium
SQSAYNA

SEQ ID NO: 584205 - protein, 7 aa, Mycobacterium
SQSDQDA

SEQ ID NO: 584206 - protein, 10 aa, Mycobacterium
SQSDTLDPGH

SEQ ID NO: 584207 - protein, 8 aa, Mycobacterium
SQSGASAY

SEQ ID NO: 584208 - protein, 8 aa, Mycobacterium
SQSGDDVQ

SEQ ID NO: 584209 - protein, 10 aa, Mycobacterium
SQSGETADTL

SEQ ID NO: 584210 - protein, 11 aa, Mycobacterium
SQSGGGGSGAA

SEQ ID NO: 584211 - protein, 8 aa, Mycobacterium
SQSGGHGD

SEQ ID NO: 584212 - protein, 9 aa, Mycobacterium
SQSGGSPDL

SEQ ID NO: 584213 - protein, 10 aa, Mycobacterium
SQSGHGDLEA

SEQ ID NO: 584214 - protein, 8 aa, Mycobacterium
SQSGKGGV

SEQ ID NO: 584215 - protein, 7 aa, Mycobacterium
SQSGRDD

SEQ ID NO: 584216 - protein, 8 aa, Mycobacterium
SQSGVDEK

SEQ ID NO: 584217 - protein, 7 aa, Mycobacterium
SQSHPTD

SEQ ID NO: 584218 - protein, 47 aa, Mycobacterium
SQSIQQKEQQQQRQQSRTPPAPTSGSGSRLLSGGSAASNAEAGVGQA

SEQ ID NO: 584219 - protein, 8 aa, Mycobacterium
SQSKNTKL

SEQ ID NO: 584220 - protein, 4 aa, Mycobacterium
SQSL

SEQ ID NO: 584221 - protein, 7 aa, Mycobacterium
SQSLGTK

SEQ ID NO: 584222 - protein, 12 aa, Mycobacterium
SQSNLPGKEFTR

SEQ ID NO: 584223 - protein, 13 aa, Mycobacterium
SQSPAGALSRSQE

SEQ ID NO: 584224 - protein, 7 aa, Mycobacterium
SQSPEVY

SEQ ID NO: 584225 - protein, 5 aa, Mycobacterium
SQSPI

SEQ ID NO: 584226 - protein, 30 aa, Mycobacterium
SQSPPMPQTSADPATQQSAAPTPDSTPDTV

SEQ ID NO: 584227 - protein, 6 aa, Mycobacterium
SQSPVP

SEQ ID NO: 584228 - protein, 13 aa, Mycobacterium
SQSPVQRRGPFPP

SEQ ID NO: 584229 - protein, 10 aa, Mycobacterium
SQSQKYRNIA

SEQ ID NO: 584230 - protein, 14 aa, Mycobacterium
SQSRDTSSFLRLTS

SEQ ID NO: 584231 - protein, 8 aa, Mycobacterium
SQSRGALT

SEQ ID NO: 584232 - protein, 85 aa, Mycobacterium
SQSSPMAAAAANAGSSAMSGAAPMGSGMGAGSSAGGASKPGLVSATGPADEEEERKDSAAAGEQNGLADVGQREDASGSHPVERL

SEQ ID NO: 584233 - protein, 8 aa, Mycobacterium
SQSTEARR

SEQ ID NO: 584234 - protein, 12 aa, Mycobacterium
SQSTEPIVGFSE

SEQ ID NO: 584235 - protein, 9 aa, Mycobacterium
SQSTNTPLR

SEQ ID NO: 584236 - protein, 5 aa, Mycobacterium
SQSVT

SEQ ID NO: 584237 - protein, 11 aa, Mycobacterium
SQTAATAGTLQ

SEQ ID NO: 584238 - protein, 31 aa, Mycobacterium
SQTAGEDNATIADTAVGADDDPQHWPRRSRQ

SEQ ID NO: 584239 - protein, 18 aa, Mycobacterium
SQTARGERPITVDQTNES

SEQ ID NO: 584240 - protein, 4 aa, Mycobacterium
SQTD

SEQ ID NO: 584241 - protein, 6 aa, Mycobacterium
SQTDEL

SEQ ID NO: 584242 - protein, 15 aa, Mycobacterium
SQTFEPAGLAGQPVD

SEQ ID NO: 584243 - protein, 8 aa, Mycobacterium
SQTGDEVD

SEQ ID NO: 584244 - protein, 5 aa, Mycobacterium
SQTGG

SEQ ID NO: 584245 - protein, 11 aa, Mycobacterium
SQTGGENDYER

SEQ ID NO: 584246 - protein, 9 aa, Mycobacterium
SQTGGGIAT

SEQ ID NO: 584247 - protein, 8 aa, Mycobacterium
SQTGGHGD

SEQ ID NO: 584248 - protein, 8 aa, Mycobacterium
SQTGGTYQ

SEQ ID NO: 584249 - protein, 15 aa, Mycobacterium
SQTGLDDASARAEGY

SEQ ID NO: 584250 - protein, 6 aa, Mycobacterium
SQTGLS

SEQ ID NO: 584251 - protein, 6 aa, Mycobacterium
SQTGPT

SEQ ID NO: 584252 - protein, 17 aa, Mycobacterium
SQTGTIAQSGRSGGRPA

SEQ ID NO: 584253 - protein, 10 aa, Mycobacterium
SQTGTPGEDW

SEQ ID NO: 584254 - protein, 10 aa, Mycobacterium
SQTGTSGYQA

SEQ ID NO: 584255 - protein, 13 aa, Mycobacterium
SQTKPEPSGSARM

SEQ ID NO: 584256 - protein, 33 aa, Mycobacterium
SQTLGSPVGKTTGKKRYKSTTTTRNLRTLHKLV

SEQ ID NO: 584257 - protein, 13 aa, Mycobacterium
SQTLNDGTPAPDE

SEQ ID NO: 584258 - protein, 12 aa, Mycobacterium
SQTLRAAAESGR

SEQ ID NO: 584259 - protein, 4 aa, Mycobacterium
SQTP

SEQ ID NO: 584260 - protein, 10 aa, Mycobacterium
SQTPEDAEDA

SEQ ID NO: 584261 - protein, 5 aa, Mycobacterium
SQTPQ

SEQ ID NO: 584262 - protein, 16 aa, Mycobacterium
SQTPSAAGVLSPDGLE

SEQ ID NO: 584263 - protein, 16 aa, Mycobacterium
SQTPSAAGVLSPEGLE

SEQ ID NO: 584264 - protein, 15 aa, Mycobacterium
SQTPSEAGALSPEGL

SEQ ID NO: 584265 - protein, 8 aa, Mycobacterium
SQTPTTAG

SEQ ID NO: 584266 - protein, 4 aa, Mycobacterium
SQTQ

SEQ ID NO: 584267 - protein, 5 aa, Mycobacterium
SQTQW

SEQ ID NO: 584268 - protein, 22 aa, Mycobacterium
SQTQWYAGDSGDRVFTPRRYPL

SEQ ID NO: 584269 - protein, 6 aa, Mycobacterium
SQTRQV

SEQ ID NO: 584270 - protein, 13 aa, Mycobacterium
SQTSRMTGKLILE

SEQ ID NO: 584271 - protein, 8 aa, Mycobacterium
SQTTREER

SEQ ID NO: 584272 - protein, 6 aa, Mycobacterium
SQTVDA

SEQ ID NO: 584273 - protein, 15 aa, Mycobacterium
SQTVGDIPRRSARRH

SEQ ID NO: 584274 - protein, 6 aa, Mycobacterium
SQTYDP

SEQ ID NO: 584275 - protein, 4 aa, Mycobacterium
SQVA

SEQ ID NO: 584276 - protein, 12 aa, Mycobacterium
SQVAPQDTLAGQ

SEQ ID NO: 584277 - protein, 7 aa, Mycobacterium
SQVDPNG

SEQ ID NO: 584278 - protein, 13 aa, Mycobacterium
SQVEKVKADGYRP

SEQ ID NO: 584279 - protein, 5 aa, Mycobacterium
SQVGA

SEQ ID NO: 584280 - protein, 5 aa, Mycobacterium
SQVGR

SEQ ID NO: 584281 - protein, 7 aa, Mycobacterium
SQVGSGG

SEQ ID NO: 584282 - protein, 14 aa, Mycobacterium
SQVLPNDGKAVGEV

SEQ ID NO: 584283 - protein, 8 aa, Mycobacterium
SQVPDEAA

SEQ ID NO: 584284 - protein, 6 aa, Mycobacterium
SQVPED

SEQ ID NO: 584285 - protein, 8 aa, Mycobacterium
SQVPEEAA

SEQ ID NO: 584286 - protein, 9 aa, Mycobacterium
SQVPGETLT

SEQ ID NO: 584287 - protein, 8 aa, Mycobacterium
SQVPGGEN

SEQ ID NO: 584288 - protein, 6 aa, Mycobacterium
SQVPHS

SEQ ID NO: 584289 - protein, 8 aa, Mycobacterium
SQVPNPGD

SEQ ID NO: 584290 - protein, 8 aa, Mycobacterium
SQVPPTQA

SEQ ID NO: 584291 - protein, 6 aa, Mycobacterium
SQVPTG

SEQ ID NO: 584292 - protein, 6 aa, Mycobacterium
SQVPTR

SEQ ID NO: 584293 - protein, 22 aa, Mycobacterium
SQVRPVASRQTYRAENSHDEHT

SEQ ID NO: 584294 - protein, 13 aa, Mycobacterium
SQVSPGSNPFGEG

SEQ ID NO: 584295 - protein, 5 aa, Mycobacterium
SQVYA

SEQ ID NO: 584296 - protein, 12 aa, Mycobacterium
SQWGGYETAPTT

SEQ ID NO: 584297 - protein, 4 aa, Mycobacterium
SQWN

SEQ ID NO: 584298 - protein, 4 aa, Mycobacterium
SQWS

SEQ ID NO: 584299 - protein, 6 aa, Mycobacterium
SQWTTR

SEQ ID NO: 584300 - protein, 5 aa, Mycobacterium
SQYAP

SEQ ID NO: 584301 - protein, 8 aa, Mycobacterium
SQYPPGVA

SEQ ID NO: 584302 - protein, 7 aa, Mycobacterium
SQYTGPY

SEQ ID NO: 584303 - protein, 15 aa, Mycobacterium
SRAAARATAFVCRPS

SEQ ID NO: 584304 - protein, 15 aa, Mycobacterium
SRAAARPRGLRPPAA

SEQ ID NO: 584305 - protein, 12 aa, Mycobacterium
SRAAARRAGRFG

SEQ ID NO: 584306 - protein, 12 aa, Mycobacterium
SRAAARRAGRLG

SEQ ID NO: 584307 - protein, 5 aa, Mycobacterium
SRAAD

SEQ ID NO: 584308 - protein, 9 aa, Mycobacterium
SRAAEGDEN

SEQ ID NO: 584309 - protein, 8 aa, Mycobacterium
SRAAEIAP

SEQ ID NO: 584310 - protein, 6 aa, Mycobacterium
SRAAGE

SEQ ID NO: 584311 - protein, 6 aa, Mycobacterium
SRAAGH

SEQ ID NO: 584312 - protein, 11 aa, Mycobacterium
SRAAGPGPYPG

SEQ ID NO: 584313 - protein, 8 aa, Mycobacterium
SRAAGSTV

SEQ ID NO: 584314 - protein, 7 aa, Mycobacterium
SRAAPNA

SEQ ID NO: 584315 - protein, 10 aa, Mycobacterium
SRAAQPDSSW

SEQ ID NO: 584316 - protein, 5 aa, Mycobacterium
SRAAR

SEQ ID NO: 584317 - protein, 12 aa, Mycobacterium
SRAARTPGDPAN

SEQ ID NO: 584318 - protein, 10 aa, Mycobacterium
SRAASEDEDQ

SEQ ID NO: 584319 - protein, 9 aa, Mycobacterium
SRAASRGEY

SEQ ID NO: 584320 - protein, 19 aa, Mycobacterium
SRAATARTTGTSAVADSAA

SEQ ID NO: 584321 - protein, 16 aa, Mycobacterium
SRADAAEFGAAPTVGA

SEQ ID NO: 584322 - protein, 14 aa, Mycobacterium
SRADADALAGADAV

SEQ ID NO: 584323 - protein, 8 aa, Mycobacterium
SRADAERD

SEQ ID NO: 584324 - protein, 7 aa, Mycobacterium
SRADAGA

SEQ ID NO: 584325 - protein, 10 aa, Mycobacterium
SRADATSTDH

SEQ ID NO: 584326 - protein, 5 aa, Mycobacterium
SRADG

SEQ ID NO: 584327 - protein, 9 aa, Mycobacterium
SRADGTWTT

SEQ ID NO: 584328 - protein, 12 aa, Mycobacterium
SRADHENERAPS

SEQ ID NO: 584329 - protein, 9 aa, Mycobacterium
SRADQGDPQ

SEQ ID NO: 584330 - protein, 7 aa, Mycobacterium
SRADRVK

SEQ ID NO: 584331 - protein, 11 aa, Mycobacterium
SRADSADSTEA

SEQ ID NO: 584332 - protein, 8 aa, Mycobacterium
SRADSSAS

SEQ ID NO: 584333 - protein, 6 aa, Mycobacterium
SRADST

SEQ ID NO: 584334 - protein, 14 aa, Mycobacterium
SRADYRANPDDFRS

SEQ ID NO: 584335 - protein, 9 aa, Mycobacterium
SRAEFNDKA

SEQ ID NO: 584336 - protein, 8 aa, Mycobacterium
SRAEKLGG

SEQ ID NO: 584337 - protein, 11 aa, Mycobacterium
SRAEPNDAASV

SEQ ID NO: 584338 - protein, 8 aa, Mycobacterium
SRAEQDEL

SEQ ID NO: 584339 - protein, 8 aa, Mycobacterium
SRAEQTLG

SEQ ID NO: 584340 - protein, 8 aa, Mycobacterium
SRAESAQV

SEQ ID NO: 584341 - protein, 15 aa, Mycobacterium
SRAETGDTLSDKAEP

SEQ ID NO: 584342 - protein, 15 aa, Mycobacterium
SRAETGDTLSDKTDP

SEQ ID NO: 584343 - protein, 5 aa, Mycobacterium
SRAFD

SEQ ID NO: 584344 - protein, 6 aa, Mycobacterium
SRAFPK

SEQ ID NO: 584345 - protein, 7 aa, Mycobacterium
SRAFPQR

SEQ ID NO: 584346 - protein, 20 aa, Mycobacterium
SRAGADLPDRAALRAQANRR

SEQ ID NO: 584347 - protein, 11 aa, Mycobacterium
SRAGAEALRQG

SEQ ID NO: 584348 - protein, 10 aa, Mycobacterium
SRAGALPTTV

SEQ ID NO: 584349 - protein, 8 aa, Mycobacterium
SRAGDADA

SEQ ID NO: 584350 - protein, 7 aa, Mycobacterium
SRAGDAI

SEQ ID NO: 584351 - protein, 7 aa, Mycobacterium
SRAGDAV

SEQ ID NO: 584352 - protein, 13 aa, Mycobacterium
SRAGDAWQQTPDF

SEQ ID NO: 584353 - protein, 14 aa, Mycobacterium
SRAGDFDDGDRPAR

SEQ ID NO: 584354 - protein, 7 aa, Mycobacterium
SRAGDRQ

SEQ ID NO: 584355 - protein, 8 aa, Mycobacterium
SRAGDRQL

SEQ ID NO: 584356 - protein, 6 aa, Mycobacterium
SRAGDT

SEQ ID NO: 584357 - protein, 8 aa, Mycobacterium
SRAGEHTD

SEQ ID NO: 584358 - protein, 5 aa, Mycobacterium
SRAGG

SEQ ID NO: 584359 - protein, 8 aa, Mycobacterium
SRAGGARG

SEQ ID NO: 584360 - protein, 6 aa, Mycobacterium
SRAGGN

SEQ ID NO: 584361 - protein, 5 aa, Mycobacterium
SRAGI

SEQ ID NO: 584362 - protein, 9 aa, Mycobacterium
SRAGLTAAP

SEQ ID NO: 584363 - protein, 5 aa, Mycobacterium
SRAGQ

SEQ ID NO: 584364 - protein, 9 aa, Mycobacterium
SRAGQGGAL

SEQ ID NO: 584365 - protein, 7 aa, Mycobacterium
SRAGQPQ

SEQ ID NO: 584366 - protein, 17 aa, Mycobacterium
SRAGRAAAAHAEQAGSV

SEQ ID NO: 584367 - protein, 6 aa, Mycobacterium
SRAGRG

SEQ ID NO: 584368 - protein, 8 aa, Mycobacterium
SRAGRGRT

SEQ ID NO: 584369 - protein, 9 aa, Mycobacterium
SRAGSSTVR

SEQ ID NO: 584370 - protein, 30 aa, Mycobacterium
SRAGTDTSFTEASQAITTSSTQVRSSGAEL

SEQ ID NO: 584371 - protein, 6 aa, Mycobacterium
SRAGTP

SEQ ID NO: 584372 - protein, 5 aa, Mycobacterium
SRAGV

SEQ ID NO: 584373 - protein, 12 aa, Mycobacterium
SRAGVGRPGAAL

SEQ ID NO: 584374 - protein, 8 aa, Mycobacterium
SRAGVNKT

SEQ ID NO: 584375 - protein, 4 aa, Mycobacterium
SRAI

SEQ ID NO: 584376 - protein, 11 aa, Mycobacterium
SRAIGSNGEPI

SEQ ID NO: 584377 - protein, 5 aa, Mycobacterium
SRAKD

SEQ ID NO: 584378 - protein, 7 aa, Mycobacterium
SRAKPEF

SEQ ID NO: 584379 - protein, 12 aa, Mycobacterium
SRAKSTIRQKQG

SEQ ID NO: 584380 - protein, 7 aa, Mycobacterium
SRALAPG

SEQ ID NO: 584381 - protein, 14 aa, Mycobacterium
SRANGADWEDLDSR

SEQ ID NO: 584382 - protein, 8 aa, Mycobacterium
SRANIRQT

SEQ ID NO: 584383 - protein, 8 aa, Mycobacterium
SRANPRPA

SEQ ID NO: 584384 - protein, 18 aa, Mycobacterium
SRANSEVSDASSLSQQPM

SEQ ID NO: 584385 - protein, 5 aa, Mycobacterium
SRAPA

SEQ ID NO: 584386 - protein, 5 aa, Mycobacterium
SRAPE

SEQ ID NO: 584387 - protein, 6 aa, Mycobacterium
SRAPEL

SEQ ID NO: 584388 - protein, 8 aa, Mycobacterium
SRAPFDDT

SEQ ID NO: 584389 - protein, 19 aa, Mycobacterium
SRAPHADEITRAPVTTGGL

SEQ ID NO: 584390 - protein, 10 aa, Mycobacterium
SRAPKELQDK

SEQ ID NO: 584391 - protein, 10 aa, Mycobacterium
SRAPNRPTID

SEQ ID NO: 584392 - protein, 14 aa, Mycobacterium
SRAPQEFPSDSRRE

SEQ ID NO: 584393 - protein, 10 aa, Mycobacterium
SRAPSVHNSQ

SEQ ID NO: 584394 - protein, 8 aa, Mycobacterium
SRAPTDDE

SEQ ID NO: 584395 - protein, 5 aa, Mycobacterium
SRAPY

SEQ ID NO: 584396 - protein, 5 aa, Mycobacterium
SRAQD

SEQ ID NO: 584397 - protein, 8 aa, Mycobacterium
SRAQGIST

SEQ ID NO: 584398 - protein, 7 aa, Mycobacterium
SRAQPRI

SEQ ID NO: 584399 - protein, 9 aa, Mycobacterium
SRAQTAEVA

SEQ ID NO: 584400 - protein, 6 aa, Mycobacterium
SRAQTF

SEQ ID NO: 584401 - protein, 5 aa, Mycobacterium
SRARA

SEQ ID NO: 584402 - protein, 7 aa, Mycobacterium
SRARAAG

SEQ ID NO: 584403 - protein, 12 aa, Mycobacterium
SRARAGDRQQWS

SEQ ID NO: 584404 - protein, 9 aa, Mycobacterium
SRARATAQG

SEQ ID NO: 584405 - protein, 6 aa, Mycobacterium
SRARAY

SEQ ID NO: 584406 - protein, 5 aa, Mycobacterium
SRARD

SEQ ID NO: 584407 - protein, 9 aa, Mycobacterium
SRARDPQGR

SEQ ID NO: 584408 - protein, 5 aa, Mycobacterium
SRARE

SEQ ID NO: 584409 - protein, 9 aa, Mycobacterium
SRARLRPEE

SEQ ID NO: 584410 - protein, 8 aa, Mycobacterium
SRARQRAQ

SEQ ID NO: 584411 - protein, 6 aa, Mycobacterium
SRARVG

SEQ ID NO: 584412 - protein, 5 aa, Mycobacterium
SRASA

SEQ ID NO: 584413 - protein, 6 aa, Mycobacterium
SRASAR

SEQ ID NO: 584414 - protein, 8 aa, Mycobacterium
SRASGNDL

SEQ ID NO: 584415 - protein, 11 aa, Mycobacterium
SRASHADEDLS

SEQ ID NO: 584416 - protein, 5 aa, Mycobacterium
SRASL

SEQ ID NO: 584417 - protein, 12 aa, Mycobacterium
SRASQQAFRTGT

SEQ ID NO: 584418 - protein, 6 aa, Mycobacterium
SRASRA

SEQ ID NO: 584419 - protein, 24 aa, Mycobacterium
SRASRQRAQQRLPDTPVVPPPDVA

SEQ ID NO: 584420 - protein, 11 aa, Mycobacterium
SRASRTTTAEP

SEQ ID NO: 584421 - protein, 7 aa, Mycobacterium
SRASSEI

SEQ ID NO: 584422 - protein, 6 aa, Mycobacterium
SRASSS

SEQ ID NO: 584423 - protein, 5 aa, Mycobacterium
SRASV

SEQ ID NO: 584424 - protein, 12 aa, Mycobacterium
SRASVDDRLPGY

SEQ ID NO: 584425 - protein, 5 aa, Mycobacterium
SRATG

SEQ ID NO: 584426 - protein, 6 aa, Mycobacterium
SRATGV

SEQ ID NO: 584427 - protein, 8 aa, Mycobacterium
SRATITAA

SEQ ID NO: 584428 - protein, 7 aa, Mycobacterium
SRATRAA

SEQ ID NO: 584429 - protein, 12 aa, Mycobacterium
SRATRAYPEADQ

SEQ ID NO: 584430 - protein, 7 aa, Mycobacterium
SRATRSH

SEQ ID NO: 584431 - protein, 9 aa, Mycobacterium
SRATSRDEY

SEQ ID NO: 584432 - protein, 17 aa, Mycobacterium
SRATVEPTRGATVEPTV

SEQ ID NO: 584433 - protein, 4 aa, Mycobacterium
SRAV

SEQ ID NO: 584434 - protein, 19 aa, Mycobacterium
SRAVNDTPTEQEDTPAALT

SEQ ID NO: 584435 - protein, 4 aa, Mycobacterium
SRAW

SEQ ID NO: 584436 - protein, 4 aa, Mycobacterium
SRAY

SEQ ID NO: 584437 - protein, 15 aa, Mycobacterium
SRCGGGGRELENQPR

SEQ ID NO: 584438 - protein, 6 aa, Mycobacterium
SRCGPD

SEQ ID NO: 584439 - protein, 13 aa, Mycobacterium
SRCTAQASEGVGA

SEQ ID NO: 584440 - protein, 7 aa, Mycobacterium
SRDAKGA

SEQ ID NO: 584441 - protein, 13 aa, Mycobacterium
SRDAKGRRTHLRG

SEQ ID NO: 584442 - protein, 9 aa, Mycobacterium
SRDAPETAT

SEQ ID NO: 584443 - protein, 9 aa, Mycobacterium
SRDAPVDSG

SEQ ID NO: 584444 - protein, 11 aa, Mycobacterium
SRDATARGATP

SEQ ID NO: 584445 - protein, 7 aa, Mycobacterium
SRDATGQ

SEQ ID NO: 584446 - protein, 5 aa, Mycobacterium
SRDAY

SEQ ID NO: 584447 - protein, 11 aa, Mycobacterium
SRDDDPAPRRW

SEQ ID NO: 584448 - protein, 12 aa, Mycobacterium
SRDDLDDGSAHL

SEQ ID NO: 584449 - protein, 9 aa, Mycobacterium
SRDDPEGNI

SEQ ID NO: 584450 - protein, 12 aa, Mycobacterium
SRDDVGEAALPG

SEQ ID NO: 584451 - protein, 4 aa, Mycobacterium
SRDE

SEQ ID NO: 584452 - protein, 6 aa, Mycobacterium
SRDEAT

SEQ ID NO: 584453 - protein, 8 aa, Mycobacterium
SRDEGGFG

SEQ ID NO: 584454 - protein, 9 aa, Mycobacterium
SRDEGRSVA

SEQ ID NO: 584455 - protein, 8 aa, Mycobacterium
SRDEGSAP

SEQ ID NO: 584456 - protein, 8 aa, Mycobacterium
SRDEGSGR

SEQ ID NO: 584457 - protein, 8 aa, Mycobacterium
SRDEGVTV

SEQ ID NO: 584458 - protein, 23 aa, Mycobacterium
SRDEHAGHHDQIEEASSGWIGKS

SEQ ID NO: 584459 - protein, 16 aa, Mycobacterium
SRDELPQEYLDLVHAS

SEQ ID NO: 584460 - protein, 6 aa, Mycobacterium
SRDELR

SEQ ID NO: 584461 - protein, 7 aa, Mycobacterium
SRDERDD

SEQ ID NO: 584462 - protein, 11 aa, Mycobacterium
SRDEREKLNGH

SEQ ID NO: 584463 - protein, 6 aa, Mycobacterium
SRDETL

SEQ ID NO: 584464 - protein, 4 aa, Mycobacterium
SRDG

SEQ ID NO: 584465 - protein, 6 aa, Mycobacterium
SRDGAR

SEQ ID NO: 584466 - protein, 7 aa, Mycobacterium
SRDGERA

SEQ ID NO: 584467 - protein, 5 aa, Mycobacterium
SRDGG

SEQ ID NO: 584468 - protein, 17 aa, Mycobacterium
SRDGGEYPRAMLHARAG

SEQ ID NO: 584469 - protein, 10 aa, Mycobacterium
SRDGHDGEDI

SEQ ID NO: 584470 - protein, 10 aa, Mycobacterium
SRDGHDGEEL

SEQ ID NO: 584471 - protein, 15 aa, Mycobacterium
SRDGNTAYRAGRDIK

SEQ ID NO: 584472 - protein, 16 aa, Mycobacterium
SRDGNTAYRAGRDIKA

SEQ ID NO: 584473 - protein, 9 aa, Mycobacterium
SRDGPSRAY

SEQ ID NO: 584474 - protein, 7 aa, Mycobacterium
SRDGRHS

SEQ ID NO: 584475 - protein, 6 aa, Mycobacterium
SRDGRR

SEQ ID NO: 584476 - protein, 13 aa, Mycobacterium
SRDGTASETFEPR

SEQ ID NO: 584477 - protein, 6 aa, Mycobacterium
SRDGVR

SEQ ID NO: 584478 - protein, 9 aa, Mycobacterium
SRDHSGERV

SEQ ID NO: 584479 - protein, 8 aa, Mycobacterium
SRDHTPGF

SEQ ID NO: 584480 - protein, 5 aa, Mycobacterium
SRDIT

SEQ ID NO: 584481 - protein, 9 aa, Mycobacterium
SRDKRESAE

SEQ ID NO: 584482 - protein, 5 aa, Mycobacterium
SRDLG

SEQ ID NO: 584483 - protein, 5 aa, Mycobacterium
SRDLP

SEQ ID NO: 584484 - protein, 4 aa, Mycobacterium
SRDM

SEQ ID NO: 584485 - protein, 12 aa, Mycobacterium
SRDMTEPRAALS

SEQ ID NO: 584486 - protein, 6 aa, Mycobacterium
SRDNAV

SEQ ID NO: 584487 - protein, 10 aa, Mycobacterium
SRDNGKPVRE

SEQ ID NO: 584488 - protein, 5 aa, Mycobacterium
SRDNL

SEQ ID NO: 584489 - protein, 10 aa, Mycobacterium
SRDNPGNQNA

SEQ ID NO: 584490 - protein, 9 aa, Mycobacterium
SRDPAARPT

SEQ ID NO: 584491 - protein, 9 aa, Mycobacterium
SRDPAGNPL

SEQ ID NO: 584492 - protein, 12 aa, Mycobacterium
SRDPARRPDTAE

SEQ ID NO: 584493 - protein, 7 aa, Mycobacterium
SRDPDGE

SEQ ID NO: 584494 - protein, 8 aa, Mycobacterium
SRDPDGHG

SEQ ID NO: 584495 - protein, 7 aa, Mycobacterium
SRDPEGE

SEQ ID NO: 584496 - protein, 9 aa, Mycobacterium
SRDPEPGTR

SEQ ID NO: 584497 - protein, 8 aa, Mycobacterium
SRDPGSDI

SEQ ID NO: 584498 - protein, 8 aa, Mycobacterium
SRDPKAAL

SEQ ID NO: 584499 - protein, 9 aa, Mycobacterium
SRDPNADAA

SEQ ID NO: 584500 - protein, 5 aa, Mycobacterium
SRDPQ

SEQ ID NO: 584501 - protein, 7 aa, Mycobacterium
SRDPRSL

SEQ ID NO: 584502 - protein, 6 aa, Mycobacterium
SRDPSV

SEQ ID NO: 584503 - protein, 8 aa, Mycobacterium
SRDPVAAT

SEQ ID NO: 584504 - protein, 4 aa, Mycobacterium
SRDQ

SEQ ID NO: 584505 - protein, 6 aa, Mycobacterium
SRDQAT

SEQ ID NO: 584506 - protein, 14 aa, Mycobacterium
SRDQGLRDTTLSGL

SEQ ID NO: 584507 - protein, 12 aa, Mycobacterium
SRDQGLRETTCR

SEQ ID NO: 584508 - protein, 14 aa, Mycobacterium
SRDQPGRNFPHHPH

SEQ ID NO: 584509 - protein, 7 aa, Mycobacterium
SRDQQQK

SEQ ID NO: 584510 - protein, 6 aa, Mycobacterium
SRDRED

SEQ ID NO: 584511 - protein, 7 aa, Mycobacterium
SRDRGHG

SEQ ID NO: 584512 - protein, 19 aa, Mycobacterium
SRDRGPVRLPDPPGGATNL

SEQ ID NO: 584513 - protein, 6 aa, Mycobacterium
SRDRLG

SEQ ID NO: 584514 - protein, 4 aa, Mycobacterium
SRDS

SEQ ID NO: 584515 - protein, 7 aa, Mycobacterium
SRDSADW

SEQ ID NO: 584516 - protein, 7 aa, Mycobacterium
SRDSAVN

SEQ ID NO: 584517 - protein, 5 aa, Mycobacterium
SRDSG

SEQ ID NO: 584518 - protein, 9 aa, Mycobacterium
SRDSMPSRR

SEQ ID NO: 584519 - protein, 7 aa, Mycobacterium
SRDTEGT

SEQ ID NO: 584520 - protein, 6 aa, Mycobacterium
SRDTGA

SEQ ID NO: 584521 - protein, 7 aa, Mycobacterium
SRDTGRC

SEQ ID NO: 584522 - protein, 8 aa, Mycobacterium
SRDTQHRL

SEQ ID NO: 584523 - protein, 9 aa, Mycobacterium
SRDTQHRLA

SEQ ID NO: 584524 - protein, 6 aa, Mycobacterium
SRDTRF

SEQ ID NO: 584525 - protein, 7 aa, Mycobacterium
SRDTSAA

SEQ ID NO: 584526 - protein, 8 aa, Mycobacterium
SRDTSEAA

SEQ ID NO: 584527 - protein, 11 aa, Mycobacterium
SRDTSEEAWAQ

SEQ ID NO: 584528 - protein, 14 aa, Mycobacterium
SRDTYDGSAQQRAD

SEQ ID NO: 584529 - protein, 10 aa, Mycobacterium
SRDVGGPVSE

SEQ ID NO: 584530 - protein, 4 aa, Mycobacterium
SRDW

SEQ ID NO: 584531 - protein, 7 aa, Mycobacterium
SRDYDDE

SEQ ID NO: 584532 - protein, 5 aa, Mycobacterium
SREAD

SEQ ID NO: 584533 - protein, 26 aa, Mycobacterium
SREADKTPSAPGPSIPAAPNPTPADD

SEQ ID NO: 584534 - protein, 10 aa, Mycobacterium
SREAETLGGQ

SEQ ID NO: 584535 - protein, 9 aa, Mycobacterium
SREAGRTIG

SEQ ID NO: 584536 - protein, 11 aa, Mycobacterium
SREAIDNGTPV

SEQ ID NO: 584537 - protein, 25 aa, Mycobacterium
SREAPGAESDDAAAAARAAGGVPDE

SEQ ID NO: 584538 - protein, 25 aa, Mycobacterium
SREAPGASPDDAAAAARAAGGVPDE

SEQ ID NO: 584539 - protein, 5 aa, Mycobacterium
SREAS

SEQ ID NO: 584540 - protein, 6 aa, Mycobacterium
SREASL

SEQ ID NO: 584541 - protein, 19 aa, Mycobacterium
SREDGEARYNDGVAEHEPG

SEQ ID NO: 584542 - protein, 7 aa, Mycobacterium
SREDNEK

SEQ ID NO: 584543 - protein, 8 aa, Mycobacterium
SREDRATE

SEQ ID NO: 584544 - protein, 7 aa, Mycobacterium
SREEFEE

SEQ ID NO: 584545 - protein, 9 aa, Mycobacterium
SREERRRPE

SEQ ID NO: 584546 - protein, 6 aa, Mycobacterium
SREFPA

SEQ ID NO: 584547 - protein, 8 aa, Mycobacterium
SREFPAKN

SEQ ID NO: 584548 - protein, 4 aa, Mycobacterium
SREG

SEQ ID NO: 584549 - protein, 13 aa, Mycobacterium
SREGAAMESGVPD

SEQ ID NO: 584550 - protein, 5 aa, Mycobacterium
SREGL

SEQ ID NO: 584551 - protein, 22 aa, Mycobacterium
SREGNASDTFQPRDGASVVSAD

SEQ ID NO: 584552 - protein, 6 aa, Mycobacterium
SREGRA

SEQ ID NO: 584553 - protein, 5 aa, Mycobacterium
SREGV

SEQ ID NO: 584554 - protein, 4 aa, Mycobacterium
SREH

SEQ ID NO: 584555 - protein, 5 aa, Mycobacterium
SREHP

SEQ ID NO: 584556 - protein, 8 aa, Mycobacterium
SREHTDPF

SEQ ID NO: 584557 - protein, 7 aa, Mycobacterium
SREIAAP

SEQ ID NO: 584558 - protein, 10 aa, Mycobacterium
SREIERRREA

SEQ ID NO: 584559 - protein, 7 aa, Mycobacterium
SREKPNS

SEQ ID NO: 584560 - protein, 5 aa, Mycobacterium
SRELA

SEQ ID NO: 584561 - protein, 13 aa, Mycobacterium
SRELAADPDVEPF

SEQ ID NO: 584562 - protein, 7 aa, Mycobacterium
SRELGGQ

SEQ ID NO: 584563 - protein, 8 aa, Mycobacterium
SRELGGQN

SEQ ID NO: 584564 - protein, 11 aa, Mycobacterium
SRELGQDAGEV

SEQ ID NO: 584565 - protein, 9 aa, Mycobacterium
SRELRNDTA

SEQ ID NO: 584566 - protein, 4 aa, Mycobacterium
SREP

SEQ ID NO: 584567 - protein, 8 aa, Mycobacterium
SREPAPDN

SEQ ID NO: 584568 - protein, 9 aa, Mycobacterium
SREPDLPVE

SEQ ID NO: 584569 - protein, 7 aa, Mycobacterium
SREPDTG

SEQ ID NO: 584570 - protein, 8 aa, Mycobacterium
SREPGGEA

SEQ ID NO: 584571 - protein, 8 aa, Mycobacterium
SREPIGVS

SEQ ID NO: 584572 - protein, 7 aa, Mycobacterium
SREPLGV

SEQ ID NO: 584573 - protein, 16 aa, Mycobacterium
SREPRQDKPAAPATDD

SEQ ID NO: 584574 - protein, 7 aa, Mycobacterium
SREPTDR

SEQ ID NO: 584575 - protein, 16 aa, Mycobacterium
SREPVAAAPQRGARTE

SEQ ID NO: 584576 - protein, 21 aa, Mycobacterium
SREQADKYSESGGTEGTEMKG

SEQ ID NO: 584577 - protein, 6 aa, Mycobacterium
SREQSS

SEQ ID NO: 584578 - protein, 8 aa, Mycobacterium
SRERASYS

SEQ ID NO: 584579 - protein, 6 aa, Mycobacterium
SRERED

SEQ ID NO: 584580 - protein, 8 aa, Mycobacterium
SRERGQHP

SEQ ID NO: 584581 - protein, 7 aa, Mycobacterium
SRERPEL

SEQ ID NO: 584582 - protein, 11 aa, Mycobacterium
SRERRGSPPTV

SEQ ID NO: 584583 - protein, 6 aa, Mycobacterium
SRERVE

SEQ ID NO: 584584 - protein, 6 aa, Mycobacterium
SRERYD

SEQ ID NO: 584585 - protein, 9 aa, Mycobacterium
SRERYSGGG

SEQ ID NO: 584586 - protein, 5 aa, Mycobacterium
SRESA

SEQ ID NO: 584587 - protein, 8 aa, Mycobacterium
SRESASYT

SEQ ID NO: 584588 - protein, 10 aa, Mycobacterium
SRESETRSAP

SEQ ID NO: 584589 - protein, 6 aa, Mycobacterium
SRESHG

SEQ ID NO: 584590 - protein, 9 aa, Mycobacterium
SRESQYQGF

SEQ ID NO: 584591 - protein, 7 aa, Mycobacterium
SRESTVP

SEQ ID NO: 584592 - protein, 7 aa, Mycobacterium
SRETNAP

SEQ ID NO: 584593 - protein, 11 aa, Mycobacterium
SRETQGSRLSD

SEQ ID NO: 584594 - protein, 6 aa, Mycobacterium
SRETVN

SEQ ID NO: 584595 - protein, 7 aa, Mycobacterium
SREVKPG

SEQ ID NO: 584596 - protein, 8 aa, Mycobacterium
SREYTGNS

SEQ ID NO: 584597 - protein, 11 aa, Mycobacterium
SRFAGAGPLRA

SEQ ID NO: 584598 - protein, 6 aa, Mycobacterium
SRFDDD

SEQ ID NO: 584599 - protein, 8 aa, Mycobacterium
SRFEPEPR

SEQ ID NO: 584600 - protein, 5 aa, Mycobacterium
SRFET

SEQ ID NO: 584601 - protein, 11 aa, Mycobacterium
SRFGGRDGTNV

SEQ ID NO: 584602 - protein, 18 aa, Mycobacterium
SRFGRNAPLDQTFPEPPD

SEQ ID NO: 584603 - protein, 18 aa, Mycobacterium
SRFPPAPAHSASRTTASV

SEQ ID NO: 584604 - protein, 12 aa, Mycobacterium
SRFSEYKPRWGT

SEQ ID NO: 584605 - protein, 12 aa, Mycobacterium
SRFTQTDKAQSR

SEQ ID NO: 584606 - protein, 5 aa, Mycobacterium
SRGAA

SEQ ID NO: 584607 - protein, 6 aa, Mycobacterium
SRGAAA

SEQ ID NO: 584608 - protein, 7 aa, Mycobacterium
SRGAAIT

SEQ ID NO: 584609 - protein, 6 aa, Mycobacterium
SRGAAL

SEQ ID NO: 584610 - protein, 6 aa, Mycobacterium
SRGADL

SEQ ID NO: 584611 - protein, 6 aa, Mycobacterium
SRGAEL

SEQ ID NO: 584612 - protein, 6 aa, Mycobacterium
SRGAEP

SEQ ID NO: 584613 - protein, 18 aa, Mycobacterium
SRGAERQAEEIRRARESK

SEQ ID NO: 584614 - protein, 9 aa, Mycobacterium
SRGAGPGES

SEQ ID NO: 584615 - protein, 8 aa, Mycobacterium
SRGAGRGI

SEQ ID NO: 584616 - protein, 9 aa, Mycobacterium
SRGAGRSPG

SEQ ID NO: 584617 - protein, 8 aa, Mycobacterium
SRGAHGDG

SEQ ID NO: 584618 - protein, 20 aa, Mycobacterium
SRGAQKQADDIRRARETKAV

SEQ ID NO: 584619 - protein, 21 aa, Mycobacterium
SRGAQKQADEIRRSRENKAVR

SEQ ID NO: 584620 - protein, 6 aa, Mycobacterium
SRGAQV

SEQ ID NO: 584621 - protein, 20 aa, Mycobacterium
SRGARYAGADGEYSVPSPAV

SEQ ID NO: 584622 - protein, 5 aa, Mycobacterium
SRGAS

SEQ ID NO: 584623 - protein, 8 aa, Mycobacterium
SRGATRSP

SEQ ID NO: 584624 - protein, 5 aa, Mycobacterium
SRGAV

SEQ ID NO: 584625 - protein, 6 aa, Mycobacterium
SRGCVD

SEQ ID NO: 584626 - protein, 7 aa, Mycobacterium
SRGDAGS

SEQ ID NO: 584627 - protein, 18 aa, Mycobacterium
SRGDAQGVPAGTDVPTAG

SEQ ID NO: 584628 - protein, 6 aa, Mycobacterium
SRGDDG

SEQ ID NO: 584629 - protein, 8 aa, Mycobacterium
SRGDDVVP

SEQ ID NO: 584630 - protein, 8 aa, Mycobacterium
SRGDEGTP

SEQ ID NO: 584631 - protein, 9 aa, Mycobacterium
SRGDETDLA

SEQ ID NO: 584632 - protein, 5 aa, Mycobacterium
SRGDF

SEQ ID NO: 584633 - protein, 7 aa, Mycobacterium
SRGDGAL

SEQ ID NO: 584634 - protein, 6 aa, Mycobacterium
SRGDGE

SEQ ID NO: 584635 - protein, 10 aa, Mycobacterium
SRGDGQARSI

SEQ ID NO: 584636 - protein, 7 aa, Mycobacterium
SRGDKAP

SEQ ID NO: 584637 - protein, 6 aa, Mycobacterium
SRGDMN

SEQ ID NO: 584638 - protein, 10 aa, Mycobacterium
SRGDPERYRE

SEQ ID NO: 584639 - protein, 7 aa, Mycobacterium
SRGDSAY

SEQ ID NO: 584640 - protein, 17 aa, Mycobacterium
SRGDTVSATGEAPTAAL

SEQ ID NO: 584641 - protein, 5 aa, Mycobacterium
SRGEA

SEQ ID NO: 584642 - protein, 18 aa, Mycobacterium
SRGEAAVPSRMIAPARGR

SEQ ID NO: 584643 - protein, 7 aa, Mycobacterium
SRGEAGI

SEQ ID NO: 584644 - protein, 11 aa, Mycobacterium
SRGEARMDGEA

SEQ ID NO: 584645 - protein, 9 aa, Mycobacterium
SRGEASRRL

SEQ ID NO: 584646 - protein, 10 aa, Mycobacterium
SRGEDATEAA

SEQ ID NO: 584647 - protein, 14 aa, Mycobacterium
SRGEGGGPDDTPMP

SEQ ID NO: 584648 - protein, 9 aa, Mycobacterium
SRGEGHARS

SEQ ID NO: 584649 - protein, 6 aa, Mycobacterium
SRGEHR

SEQ ID NO: 584650 - protein, 5 aa, Mycobacterium
SRGEL

SEQ ID NO: 584651 - protein, 5 aa, Mycobacterium
SRGEP

SEQ ID NO: 584652 - protein, 15 aa, Mycobacterium
SRGEPAIPTRMTADE

SEQ ID NO: 584653 - protein, 8 aa, Mycobacterium
SRGERAAA

SEQ ID NO: 584654 - protein, 11 aa, Mycobacterium
SRGEREELNGH

SEQ ID NO: 584655 - protein, 6 aa, Mycobacterium
SRGESL

SEQ ID NO: 584656 - protein, 5 aa, Mycobacterium
SRGFG

SEQ ID NO: 584657 - protein, 11 aa, Mycobacterium
SRGGDGPGAAF

SEQ ID NO: 584658 - protein, 12 aa, Mycobacterium
SRGGDRVSGAVA

SEQ ID NO: 584659 - protein, 11 aa, Mycobacterium
SRGGGRPGREE

SEQ ID NO: 584660 - protein, 13 aa, Mycobacterium
SRGGGTSLAGQTC

SEQ ID NO: 584661 - protein, 5 aa, Mycobacterium
SRGGR

SEQ ID NO: 584662 - protein, 10 aa, Mycobacterium
SRGGRAEATL

SEQ ID NO: 584663 - protein, 7 aa, Mycobacterium
SRGGRAG

SEQ ID NO: 584664 - protein, 9 aa, Mycobacterium
SRGGRPDLA

SEQ ID NO: 584665 - protein, 11 aa, Mycobacterium
SRGGRPDLAGD

SEQ ID NO: 584666 - protein, 7 aa, Mycobacterium
SRGGSDA

SEQ ID NO: 584667 - protein, 9 aa, Mycobacterium
SRGGTAVSD

SEQ ID NO: 584668 - protein, 7 aa, Mycobacterium
SRGGTSS

SEQ ID NO: 584669 - protein, 6 aa, Mycobacterium
SRGGVG

SEQ ID NO: 584670 - protein, 9 aa, Mycobacterium
SRGHDRHDT

SEQ ID NO: 584671 - protein, 15 aa, Mycobacterium
SRGHGDSDRAPNADY

SEQ ID NO: 584672 - protein, 15 aa, Mycobacterium
SRGHGDSDRSPDADY

SEQ ID NO: 584673 - protein, 15 aa, Mycobacterium
SRGHGDSDRSPDARY

SEQ ID NO: 584674 - protein, 7 aa, Mycobacterium
SRGHPRA

SEQ ID NO: 584675 - protein, 12 aa, Mycobacterium
SRGIEPNGQGTC

SEQ ID NO: 584676 - protein, 5 aa, Mycobacterium
SRGIG

SEQ ID NO: 584677 - protein, 14 aa, Mycobacterium
SRGKEEAAQAIPDE

SEQ ID NO: 584678 - protein, 5 aa, Mycobacterium
SRGLG

SEQ ID NO: 584679 - protein, 17 aa, Mycobacterium
SRGLGQEVGTLSGGNQQ

SEQ ID NO: 584680 - protein, 5 aa, Mycobacterium
SRGLP

SEQ ID NO: 584681 - protein, 5 aa, Mycobacterium
SRGLT

SEQ ID NO: 584682 - protein, 4 aa, Mycobacterium
SRGM

SEQ ID NO: 584683 - protein, 11 aa, Mycobacterium
SRGMTGGPSRL

SEQ ID NO: 584684 - protein, 4 aa, Mycobacterium
SRGN

SEQ ID NO: 584685 - protein, 7 aa, Mycobacterium
SRGNPTV

SEQ ID NO: 584686 - protein, 8 aa, Mycobacterium
SRGPARER

SEQ ID NO: 584687 - protein, 6 aa, Mycobacterium
SRGPEL

SEQ ID NO: 584688 - protein, 7 aa, Mycobacterium
SRGPFGA

SEQ ID NO: 584689 - protein, 17 aa, Mycobacterium
SRGPGRPPAAKAAETRE

SEQ ID NO: 584690 - protein, 16 aa, Mycobacterium
SRGPGTEWASEAAAGD

SEQ ID NO: 584691 - protein, 11 aa, Mycobacterium
SRGPIDPTASV

SEQ ID NO: 584692 - protein, 11 aa, Mycobacterium
SRGPKATGALR

SEQ ID NO: 584693 - protein, 11 aa, Mycobacterium
SRGPKATGELR

SEQ ID NO: 584694 - protein, 5 aa, Mycobacterium
SRGPL

SEQ ID NO: 584695 - protein, 10 aa, Mycobacterium
SRGPLPGSRD

SEQ ID NO: 584696 - protein, 8 aa, Mycobacterium
SRGPNGVA

SEQ ID NO: 584697 - protein, 6 aa, Mycobacterium
SRGPRS

SEQ ID NO: 584698 - protein, 6 aa, Mycobacterium
SRGPVG

SEQ ID NO: 584699 - protein, 4 aa, Mycobacterium
SRGQ

SEQ ID NO: 584700 - protein, 10 aa, Mycobacterium
SRGQDAADTI

SEQ ID NO: 584701 - protein, 6 aa, Mycobacterium
SRGQDN

SEQ ID NO: 584702 - protein, 11 aa, Mycobacterium
SRGQGNKAAEL

SEQ ID NO: 584703 - protein, 7 aa, Mycobacterium
SRGQGTV

SEQ ID NO: 584704 - protein, 6 aa, Mycobacterium
SRGQIG

SEQ ID NO: 584705 - protein, 16 aa, Mycobacterium
SRGQKAGAAPASSPGI

SEQ ID NO: 584706 - protein, 8 aa, Mycobacterium
SRGQSFDG

SEQ ID NO: 584707 - protein, 5 aa, Mycobacterium
SRGRA

SEQ ID NO: 584708 - protein, 11 aa, Mycobacterium
SRGRAEAARRL

SEQ ID NO: 584709 - protein, 8 aa, Mycobacterium
SRGRASGR

SEQ ID NO: 584710 - protein, 10 aa, Mycobacterium
SRGRDGVPRY

SEQ ID NO: 584711 - protein, 8 aa, Mycobacterium
SRGRGGFA

SEQ ID NO: 584712 - protein, 7 aa, Mycobacterium
SRGRGGI

SEQ ID NO: 584713 - protein, 5 aa, Mycobacterium
SRGRL

SEQ ID NO: 584714 - protein, 7 aa, Mycobacterium
SRGRPAL

SEQ ID NO: 584715 - protein, 7 aa, Mycobacterium
SRGRPGK

SEQ ID NO: 584716 - protein, 7 aa, Mycobacterium
SRGRPTI

SEQ ID NO: 584717 - protein, 6 aa, Mycobacterium
SRGRRP

SEQ ID NO: 584718 - protein, 14 aa, Mycobacterium
SRGRRSLQKASAAV

SEQ ID NO: 584719 - protein, 5 aa, Mycobacterium
SRGRS

SEQ ID NO: 584720 - protein, 12 aa, Mycobacterium
SRGRTGRSPGSV

SEQ ID NO: 584721 - protein, 9 aa, Mycobacterium
SRGRVSEDA

SEQ ID NO: 584722 - protein, 9 aa, Mycobacterium
SRGRVSESL

SEQ ID NO: 584723 - protein, 4 aa, Mycobacterium
SRGS

SEQ ID NO: 584724 - protein, 18 aa, Mycobacterium
SRGSDEPSGVEAPTPGLR

SEQ ID NO: 584725 - protein, 7 aa, Mycobacterium
SRGSEFA

SEQ ID NO: 584726 - protein, 5 aa, Mycobacterium
SRGSF

SEQ ID NO: 584727 - protein, 5 aa, Mycobacterium
SRGSG

SEQ ID NO: 584728 - protein, 12 aa, Mycobacterium
SRGSGPEVTGPA

SEQ ID NO: 584729 - protein, 20 aa, Mycobacterium
SRGSPPQRTGREREPSIPPR

SEQ ID NO: 584730 - protein, 7 aa, Mycobacterium
SRGSREP

SEQ ID NO: 584731 - protein, 8 aa, Mycobacterium
SRGSTAGD

SEQ ID NO: 584732 - protein, 8 aa, Mycobacterium
SRGSTGDV

SEQ ID NO: 584733 - protein, 8 aa, Mycobacterium
SRGSTLPT

SEQ ID NO: 584734 - protein, 5 aa, Mycobacterium
SRGSV

SEQ ID NO: 584735 - protein, 5 aa, Mycobacterium
SRGSW

SEQ ID NO: 584736 - protein, 12 aa, Mycobacterium
SRGTASHRAHGQ

SEQ ID NO: 584737 - protein, 7 aa, Mycobacterium
SRGTAST

SEQ ID NO: 584738 - protein, 8 aa, Mycobacterium
SRGTDSLN

SEQ ID NO: 584739 - protein, 6 aa, Mycobacterium
SRGTGL

SEQ ID NO: 584740 - protein, 10 aa, Mycobacterium
SRGTGSPVPA

SEQ ID NO: 584741 - protein, 11 aa, Mycobacterium
SRGTIEGDEDV

SEQ ID NO: 584742 - protein, 6 aa, Mycobacterium
SRGTPA

SEQ ID NO: 584743 - protein, 17 aa, Mycobacterium
SRGTPESATARPVSRSL

SEQ ID NO: 584744 - protein, 7 aa, Mycobacterium
SRGTPGD

SEQ ID NO: 584745 - protein, 12 aa, Mycobacterium
SRGTVEGDEDVI

SEQ ID NO: 584746 - protein, 11 aa, Mycobacterium
SRGTVQGDEDV

SEQ ID NO: 584747 - protein, 6 aa, Mycobacterium
SRGTYG

SEQ ID NO: 584748 - protein, 8 aa, Mycobacterium
SRGTYGRK

SEQ ID NO: 584749 - protein, 4 aa, Mycobacterium
SRGV

SEQ ID NO: 584750 - protein, 22 aa, Mycobacterium
SRGVGADASLPDGALRSKNARC

SEQ ID NO: 584751 - protein, 7 aa, Mycobacterium
SRGVGNK

SEQ ID NO: 584752 - protein, 8 aa, Mycobacterium
SRGVQPTH

SEQ ID NO: 584753 - protein, 6 aa, Mycobacterium
SRGYAP

SEQ ID NO: 584754 - protein, 7 aa, Mycobacterium
SRHAETR

SEQ ID NO: 584755 - protein, 21 aa, Mycobacterium
SRHARPPGVGDDTVEAAGKMS

SEQ ID NO: 584756 - protein, 14 aa, Mycobacterium
SRHDDDGADLPPEA

SEQ ID NO: 584757 - protein, 13 aa, Mycobacterium
SRHDDSGADLPPE

SEQ ID NO: 584758 - protein, 14 aa, Mycobacterium
SRHDDSGADLPPEA

SEQ ID NO: 584759 - protein, 14 aa, Mycobacterium
SRHDDSGADLPPQA

SEQ ID NO: 584760 - protein, 15 aa, Mycobacterium
SRHDDSGADLPPQSM

SEQ ID NO: 584761 - protein, 7 aa, Mycobacterium
SRHDGTR

SEQ ID NO: 584762 - protein, 7 aa, Mycobacterium
SRHDTDW

SEQ ID NO: 584763 - protein, 4 aa, Mycobacterium
SRHE

SEQ ID NO: 584764 - protein, 6 aa, Mycobacterium
SRHGEE

SEQ ID NO: 584765 - protein, 7 aa, Mycobacterium
SRHGKGA

SEQ ID NO: 584766 - protein, 21 aa, Mycobacterium
SRHGKGALARTADGAAPAGVG

SEQ ID NO: 584767 - protein, 6 aa, Mycobacterium
SRHGKN

SEQ ID NO: 584768 - protein, 16 aa, Mycobacterium
SRHPAGHPATVARDRP

SEQ ID NO: 584769 - protein, 11 aa, Mycobacterium
SRHPDSAGLPA

SEQ ID NO: 584770 - protein, 11 aa, Mycobacterium
SRHPGAHGGPA

SEQ ID NO: 584771 - protein, 6 aa, Mycobacterium
SRHPHR

SEQ ID NO: 584772 - protein, 5 aa, Mycobacterium
SRHPR

SEQ ID NO: 584773 - protein, 6 aa, Mycobacterium
SRHPRS

SEQ ID NO: 584774 - protein, 12 aa, Mycobacterium
SRHRDRIKPAPL

SEQ ID NO: 584775 - protein, 7 aa, Mycobacterium
SRHRGPP

SEQ ID NO: 584776 - protein, 7 aa, Mycobacterium
SRHSDPV

SEQ ID NO: 584777 - protein, 9 aa, Mycobacterium
SRHSSKPFR

SEQ ID NO: 584778 - protein, 7 aa, Mycobacterium
SRHTPEA

SEQ ID NO: 584779 - protein, 16 aa, Mycobacterium
SRHTTGRSRPSGVKVE

SEQ ID NO: 584780 - protein, 4 aa, Mycobacterium
SRIA

SEQ ID NO: 584781 - protein, 10 aa, Mycobacterium
SRIDDEGGGL

SEQ ID NO: 584782 - protein, 6 aa, Mycobacterium
SRIDGS

SEQ ID NO: 584783 - protein, 11 aa, Mycobacterium
SRIEGIGRPRV

SEQ ID NO: 584784 - protein, 10 aa, Mycobacterium
SRIGATGEAQ

SEQ ID NO: 584785 - protein, 14 aa, Mycobacterium
SRIGDESTTSRPTA

SEQ ID NO: 584786 - protein, 8 aa, Mycobacterium
SRIGDSRS

SEQ ID NO: 584787 - protein, 7 aa, Mycobacterium
SRIGENG

SEQ ID NO: 584788 - protein, 8 aa, Mycobacterium
SRIGPGKA

SEQ ID NO: 584789 - protein, 7 aa, Mycobacterium
SRIGPTR

SEQ ID NO: 584790 - protein, 11 aa, Mycobacterium
SRIGSGRSAVR

SEQ ID NO: 584791 - protein, 7 aa, Mycobacterium
SRINSTW

SEQ ID NO: 584792 - protein, 6 aa, Mycobacterium
SRIPAL

SEQ ID NO: 584793 - protein, 16 aa, Mycobacterium
SRIPASHAEGAPDDAN

SEQ ID NO: 584794 - protein, 24 aa, Mycobacterium
SRIPDGGGWRAHGRSEEVRGRGNG

SEQ ID NO: 584795 - protein, 5 aa, Mycobacterium
SRIPE

SEQ ID NO: 584796 - protein, 4 aa, Mycobacterium
SRIS

SEQ ID NO: 584797 - protein, 8 aa, Mycobacterium
SRISPPSH

SEQ ID NO: 584798 - protein, 24 aa, Mycobacterium
SRISPQGPYGGYKQSGSGRTGGLE

SEQ ID NO: 584799 - protein, 7 aa, Mycobacterium
SRISQDS

SEQ ID NO: 584800 - protein, 7 aa, Mycobacterium
SRISRAR

SEQ ID NO: 584801 - protein, 9 aa, Mycobacterium
SRKARGAKP

SEQ ID NO: 584802 - protein, 4 aa, Mycobacterium
SRKD

SEQ ID NO: 584803 - protein, 10 aa, Mycobacterium
SRKDAARDAA

SEQ ID NO: 584804 - protein, 10 aa, Mycobacterium
SRKDQDGNDL

SEQ ID NO: 584805 - protein, 8 aa, Mycobacterium
SRKDQERV

SEQ ID NO: 584806 - protein, 4 aa, Mycobacterium
SRKE

SEQ ID NO: 584807 - protein, 8 aa, Mycobacterium
SRKEAAGT

SEQ ID NO: 584808 - protein, 8 aa, Mycobacterium
SRKEFTGT

SEQ ID NO: 584809 - protein, 8 aa, Mycobacterium
SRKEVATE

SEQ ID NO: 584810 - protein, 12 aa, Mycobacterium
SRKGNPHGFGKS

SEQ ID NO: 584811 - protein, 9 aa, Mycobacterium
SRKKAAAAA

SEQ ID NO: 584812 - protein, 5 aa, Mycobacterium
SRKLA

SEQ ID NO: 584813 - protein, 21 aa, Mycobacterium
SRKLAGEPGLDGSPAPAEPMT

SEQ ID NO: 584814 - protein, 8 aa, Mycobacterium
SRKLDKAV

SEQ ID NO: 584815 - protein, 10 aa, Mycobacterium
SRKPDACETA

SEQ ID NO: 584816 - protein, 7 aa, Mycobacterium
SRKPDAR

SEQ ID NO: 584817 - protein, 9 aa, Mycobacterium
SRKPEACTE

SEQ ID NO: 584818 - protein, 8 aa, Mycobacterium
SRKPEARR

SEQ ID NO: 584819 - protein, 8 aa, Mycobacterium
SRKQTVGT

SEQ ID NO: 584820 - protein, 13 aa, Mycobacterium
SRKRPRGRPRKVA

SEQ ID NO: 584821 - protein, 8 aa, Mycobacterium
SRKRQSYT

SEQ ID NO: 584822 - protein, 18 aa, Mycobacterium
SRKSAPDAVNAAVNASGN

SEQ ID NO: 584823 - protein, 5 aa, Mycobacterium
SRKSR

SEQ ID NO: 584824 - protein, 6 aa, Mycobacterium
SRKTDG

SEQ ID NO: 584825 - protein, 8 aa, Mycobacterium
SRKTDIEG

SEQ ID NO: 584826 - protein, 11 aa, Mycobacterium
SRKTQGSRLSD

SEQ ID NO: 584827 - protein, 7 aa, Mycobacterium
SRKTSHD

SEQ ID NO: 584828 - protein, 21 aa, Mycobacterium
SRKTTDTDPYSSGQNDPFPVA

SEQ ID NO: 584829 - protein, 9 aa, Mycobacterium
SRKTWSNPA

SEQ ID NO: 584830 - protein, 8 aa, Mycobacterium
SRKTYGRL

SEQ ID NO: 584831 - protein, 4 aa, Mycobacterium
SRKV

SEQ ID NO: 584832 - protein, 20 aa, Mycobacterium
SRLAESSTFPWGTTDPRTVA

SEQ ID NO: 584833 - protein, 13 aa, Mycobacterium
SRLASREDEDVSA

SEQ ID NO: 584834 - protein, 13 aa, Mycobacterium
SRLDAAARPARRA

SEQ ID NO: 584835 - protein, 10 aa, Mycobacterium
SRLDDAGRET

SEQ ID NO: 584836 - protein, 8 aa, Mycobacterium
SRLDDEGR

SEQ ID NO: 584837 - protein, 6 aa, Mycobacterium
SRLDES

SEQ ID NO: 584838 - protein, 5 aa, Mycobacterium
SRLDG

SEQ ID NO: 584839 - protein, 7 aa, Mycobacterium
SRLDGGP

SEQ ID NO: 584840 - protein, 7 aa, Mycobacterium
SRLDKSD

SEQ ID NO: 584841 - protein, 9 aa, Mycobacterium
SRLDNTRAR

SEQ ID NO: 584842 - protein, 6 aa, Mycobacterium
SRLDPA

SEQ ID NO: 584843 - protein, 10 aa, Mycobacterium
SRLDPDRPGH

SEQ ID NO: 584844 - protein, 7 aa, Mycobacterium
SRLDPSA

SEQ ID NO: 584845 - protein, 8 aa, Mycobacterium
SRLDRTGG

SEQ ID NO: 584846 - protein, 12 aa, Mycobacterium
SRLDSPMPDQSE

SEQ ID NO: 584847 - protein, 21 aa, Mycobacterium
SRLEADPDADRRPLWQDVTSI

SEQ ID NO: 584848 - protein, 13 aa, Mycobacterium
SRLEDATKQISSL

SEQ ID NO: 584849 - protein, 10 aa, Mycobacterium
SRLEDSPRPV

SEQ ID NO: 584850 - protein, 7 aa, Mycobacterium
SRLEGSG

SEQ ID NO: 584851 - protein, 17 aa, Mycobacterium
SRLEPEDARQAREALTP

SEQ ID NO: 584852 - protein, 8 aa, Mycobacterium
SRLERARG

SEQ ID NO: 584853 - protein, 12 aa, Mycobacterium
SRLESEQPPIAR

SEQ ID NO: 584854 - protein, 11 aa, Mycobacterium
SRLESGQRRPT

SEQ ID NO: 584855 - protein, 4 aa, Mycobacterium
SRLG

SEQ ID NO: 584856 - protein, 5 aa, Mycobacterium
SRLGE

SEQ ID NO: 584857 - protein, 14 aa, Mycobacterium
SRLGEGATQKKQQG

SEQ ID NO: 584858 - protein, 7 aa, Mycobacterium
SRLGGKT

SEQ ID NO: 584859 - protein, 16 aa, Mycobacterium
SRLGGSASRVTRTGKT

SEQ ID NO: 584860 - protein, 13 aa, Mycobacterium
SRLGSPAPQSDPL

SEQ ID NO: 584861 - protein, 7 aa, Mycobacterium
SRLGSPR

SEQ ID NO: 584862 - protein, 6 aa, Mycobacterium
SRLKEN

SEQ ID NO: 584863 - protein, 5 aa, Mycobacterium
SRLKQ

SEQ ID NO: 584864 - protein, 6 aa, Mycobacterium
SRLKQN

SEQ ID NO: 584865 - protein, 10 aa, Mycobacterium
SRLNPAAGAQ

SEQ ID NO: 584866 - protein, 8 aa, Mycobacterium
SRLNPATG

SEQ ID NO: 584867 - protein, 8 aa, Mycobacterium
SRLNPGAG

SEQ ID NO: 584868 - protein, 4 aa, Mycobacterium
SRLP

SEQ ID NO: 584869 - protein, 7 aa, Mycobacterium
SRLPADN

SEQ ID NO: 584870 - protein, 6 aa, Mycobacterium
SRLPDE

SEQ ID NO: 584871 - protein, 7 aa, Mycobacterium
SRLPDGE

SEQ ID NO: 584872 - protein, 19 aa, Mycobacterium
SRLPDSAADRFAPRPAAGL

SEQ ID NO: 584873 - protein, 9 aa, Mycobacterium
SRLPDSAPE

SEQ ID NO: 584874 - protein, 26 aa, Mycobacterium
SRLPGDGPYADRSGGVLPGYGGSKAA

SEQ ID NO: 584875 - protein, 15 aa, Mycobacterium
SRLPGDGPYPDRSGG

SEQ ID NO: 584876 - protein, 26 aa, Mycobacterium
SRLPGNGPYPDRSGGVLPGYGGSKAA

SEQ ID NO: 584877 - protein, 6 aa, Mycobacterium
SRLPTE

SEQ ID NO: 584878 - protein, 7 aa, Mycobacterium
SRLPTGS

SEQ ID NO: 584879 - protein, 7 aa, Mycobacterium
SRLSPDS

SEQ ID NO: 584880 - protein, 7 aa, Mycobacterium
SRLSPES

SEQ ID NO: 584881 - protein, 14 aa, Mycobacterium
SRLSRTRWPEPETV

SEQ ID NO: 584882 - protein, 8 aa, Mycobacterium
SRLTADGQ

SEQ ID NO: 584883 - protein, 14 aa, Mycobacterium
SRLTEQLRRSDTSY

SEQ ID NO: 584884 - protein, 7 aa, Mycobacterium
SRLTRGE

SEQ ID NO: 584885 - protein, 6 aa, Mycobacterium
SRMAKD

SEQ ID NO: 584886 - protein, 6 aa, Mycobacterium
SRMAKE

SEQ ID NO: 584887 - protein, 6 aa, Mycobacterium
SRMKAG

SEQ ID NO: 584888 - protein, 9 aa, Mycobacterium
SRMPQSGGM

SEQ ID NO: 584889 - protein, 7 aa, Mycobacterium
SRMSPEE

SEQ ID NO: 584890 - protein, 7 aa, Mycobacterium
SRMTGGP

SEQ ID NO: 584891 - protein, 4 aa, Mycobacterium
SRMY

SEQ ID NO: 584892 - protein, 7 aa, Mycobacterium
SRNAATG

SEQ ID NO: 584893 - protein, 7 aa, Mycobacterium
SRNAPGV

SEQ ID NO: 584894 - protein, 12 aa, Mycobacterium
SRNARDRPTAPV

SEQ ID NO: 584895 - protein, 7 aa, Mycobacterium
SRNAYAD

SEQ ID NO: 584896 - protein, 4 aa, Mycobacterium
SRND

SEQ ID NO: 584897 - protein, 9 aa, Mycobacterium
SRNEPDLDD

SEQ ID NO: 584898 - protein, 4 aa, Mycobacterium
SRNG

SEQ ID NO: 584899 - protein, 5 aa, Mycobacterium
SRNGA

SEQ ID NO: 584900 - protein, 9 aa, Mycobacterium
SRNGAPPVT

SEQ ID NO: 584901 - protein, 8 aa, Mycobacterium
SRNGARGA

SEQ ID NO: 584902 - protein, 10 aa, Mycobacterium
SRNGGPDQLR

SEQ ID NO: 584903 - protein, 16 aa, Mycobacterium
SRNGNTAYRAGRDIKA

SEQ ID NO: 584904 - protein, 14 aa, Mycobacterium
SRNGSDDADPAGDN

SEQ ID NO: 584905 - protein, 11 aa, Mycobacterium
SRNGSSRHDDS

SEQ ID NO: 584906 - protein, 7 aa, Mycobacterium
SRNGTGD

SEQ ID NO: 584907 - protein, 6 aa, Mycobacterium
SRNGVE

SEQ ID NO: 584908 - protein, 7 aa, Mycobacterium
SRNHGGS

SEQ ID NO: 584909 - protein, 7 aa, Mycobacterium
SRNKKSI

SEQ ID NO: 584910 - protein, 14 aa, Mycobacterium
SRNNGGGHRAKGQR

SEQ ID NO: 584911 - protein, 7 aa, Mycobacterium
SRNPATG

SEQ ID NO: 584912 - protein, 5 aa, Mycobacterium
SRNPD

SEQ ID NO: 584913 - protein, 7 aa, Mycobacterium
SRNPGDR

SEQ ID NO: 584914 - protein, 8 aa, Mycobacterium
SRNPGQRL

SEQ ID NO: 584915 - protein, 8 aa, Mycobacterium
SRNPGTRL

SEQ ID NO: 584916 - protein, 7 aa, Mycobacterium
SRNPHGT

SEQ ID NO: 584917 - protein, 12 aa, Mycobacterium
SRNPITGANEPF

SEQ ID NO: 584918 - protein, 12 aa, Mycobacterium
SRNPITGASEPF

SEQ ID NO: 584919 - protein, 7 aa, Mycobacterium
SRNPNPH

SEQ ID NO: 584920 - protein, 7 aa, Mycobacterium
SRNPNYP

SEQ ID NO: 584921 - protein, 9 aa, Mycobacterium
SRNPRPVKY

SEQ ID NO: 584922 - protein, 7 aa, Mycobacterium
SRNPTRW

SEQ ID NO: 584923 - protein, 6 aa, Mycobacterium
SRNPWD

SEQ ID NO: 584924 - protein, 9 aa, Mycobacterium
SRNQATPRP

SEQ ID NO: 584925 - protein, 5 aa, Mycobacterium
SRNRW

SEQ ID NO: 584926 - protein, 7 aa, Mycobacterium
SRNRYER

SEQ ID NO: 584927 - protein, 11 aa, Mycobacterium
SRNSWGTGDLT

SEQ ID NO: 584928 - protein, 15 aa, Mycobacterium
SRNTDLAAQLHDDPF

SEQ ID NO: 584929 - protein, 5 aa, Mycobacterium
SRNVT

SEQ ID NO: 584930 - protein, 8 aa, Mycobacterium
SRPAAHAR

SEQ ID NO: 584931 - protein, 6 aa, Mycobacterium
SRPAAT

SEQ ID NO: 584932 - protein, 19 aa, Mycobacterium
SRPADDDHSRAARNNRATY

SEQ ID NO: 584933 - protein, 10 aa, Mycobacterium
SRPADDKGAG

SEQ ID NO: 584934 - protein, 8 aa, Mycobacterium
SRPADEQQ

SEQ ID NO: 584935 - protein, 15 aa, Mycobacterium
SRPADGDNSRRARTY

SEQ ID NO: 584936 - protein, 7 aa, Mycobacterium
SRPADSV

SEQ ID NO: 584937 - protein, 8 aa, Mycobacterium
SRPAEALD

SEQ ID NO: 584938 - protein, 6 aa, Mycobacterium
SRPAEL

SEQ ID NO: 584939 - protein, 12 aa, Mycobacterium
SRPAEPLSDPAL

SEQ ID NO: 584940 - protein, 22 aa, Mycobacterium
SRPAGARAAYASEDGHSAVAQS

SEQ ID NO: 584941 - protein, 8 aa, Mycobacterium
SRPAGEHA

SEQ ID NO: 584942 - protein, 9 aa, Mycobacterium
SRPAGRAVK

SEQ ID NO: 584943 - protein, 8 aa, Mycobacterium
SRPAGVPE

SEQ ID NO: 584944 - protein, 5 aa, Mycobacterium
SRPAI

SEQ ID NO: 584945 - protein, 68 aa, Mycobacterium
SRPAKDERSSKSSRARRAEGSKAAAKAGPGSGAKKAASKAPAKKAATKAPAKKSPAKTSETSEAKGGS

SEQ ID NO: 584946 - protein, 67 aa, Mycobacterium
SRPAKDQRSAKSTRARRAEASKAAAKAPAKKAASKAPAKKAPAKKAAAKSAPAKKTTSETSEAKGGS

SEQ ID NO: 584947 - protein, 70 aa, Mycobacterium
SRPAKDQRSAKSTRARRAEASKAAAKKAPATKAPASKAPAKKAAAKAPAKKAAPKAEAKTSETSDAKGGS

SEQ ID NO: 584948 - protein, 31 aa, Mycobacterium
SRPAKKQGASASAARARRAQASKAASQKEGS

SEQ ID NO: 584949 - protein, 8 aa, Mycobacterium
SRPAKVDN

SEQ ID NO: 584950 - protein, 5 aa, Mycobacterium
SRPAN

SEQ ID NO: 584951 - protein, 9 aa, Mycobacterium
SRPAPAPPT

SEQ ID NO: 584952 - protein, 9 aa, Mycobacterium
SRPAPDPVS

SEQ ID NO: 584953 - protein, 6 aa, Mycobacterium
SRPAQA

SEQ ID NO: 584954 - protein, 6 aa, Mycobacterium
SRPARV

SEQ ID NO: 584955 - protein, 7 aa, Mycobacterium
SRPARVD

SEQ ID NO: 584956 - protein, 17 aa, Mycobacterium
SRPASSGHVTDGPNSPV

SEQ ID NO: 584957 - protein, 9 aa, Mycobacterium
SRPASTPAH

SEQ ID NO: 584958 - protein, 6 aa, Mycobacterium
SRPATE

SEQ ID NO: 584959 - protein, 7 aa, Mycobacterium
SRPAVRR

SEQ ID NO: 584960 - protein, 4 aa, Mycobacterium
SRPC

SEQ ID NO: 584961 - protein, 21 aa, Mycobacterium
SRPCGGTKSSAVQAHATKPTS

SEQ ID NO: 584962 - protein, 5 aa, Mycobacterium
SRPCT

SEQ ID NO: 584963 - protein, 7 aa, Mycobacterium
SRPDAAG

SEQ ID NO: 584964 - protein, 12 aa, Mycobacterium
SRPDAPAAAEER

SEQ ID NO: 584965 - protein, 9 aa, Mycobacterium
SRPDAPAGT

SEQ ID NO: 584966 - protein, 9 aa, Mycobacterium
SRPDDTAAV

SEQ ID NO: 584967 - protein, 6 aa, Mycobacterium
SRPDDV

SEQ ID NO: 584968 - protein, 7 aa, Mycobacterium
SRPDDVD

SEQ ID NO: 584969 - protein, 6 aa, Mycobacterium
SRPDEV

SEQ ID NO: 584970 - protein, 5 aa, Mycobacterium
SRPDG

SEQ ID NO: 584971 - protein, 14 aa, Mycobacterium
SRPDGASLERADPE

SEQ ID NO: 584972 - protein, 9 aa, Mycobacterium
SRPDPAAKR

SEQ ID NO: 584973 - protein, 10 aa, Mycobacterium
SRPDPSAKRP

SEQ ID NO: 584974 - protein, 9 aa, Mycobacterium
SRPDPTAQR

SEQ ID NO: 584975 - protein, 6 aa, Mycobacterium
SRPDQL

SEQ ID NO: 584976 - protein, 7 aa, Mycobacterium
SRPDRTL

SEQ ID NO: 584977 - protein, 10 aa, Mycobacterium
SRPDSLSDEQ

SEQ ID NO: 584978 - protein, 5 aa, Mycobacterium
SRPDT

SEQ ID NO: 584979 - protein, 6 aa, Mycobacterium
SRPDTG

SEQ ID NO: 584980 - protein, 17 aa, Mycobacterium
SRPDTSSRFKHDRGNRL

SEQ ID NO: 584981 - protein, 10 aa, Mycobacterium
SRPDTSSRFR

SEQ ID NO: 584982 - protein, 6 aa, Mycobacterium
SRPEDL

SEQ ID NO: 584983 - protein, 6 aa, Mycobacterium
SRPEDR

SEQ ID NO: 584984 - protein, 6 aa, Mycobacterium
SRPEER

SEQ ID NO: 584985 - protein, 7 aa, Mycobacterium
SRPEEVE

SEQ ID NO: 584986 - protein, 6 aa, Mycobacterium
SRPEHA

SEQ ID NO: 584987 - protein, 8 aa, Mycobacterium
SRPEHDRR

SEQ ID NO: 584988 - protein, 6 aa, Mycobacterium
SRPEKL

SEQ ID NO: 584989 - protein, 5 aa, Mycobacterium
SRPEL

SEQ ID NO: 584990 - protein, 6 aa, Mycobacterium
SRPEPD

SEQ ID NO: 584991 - protein, 16 aa, Mycobacterium
SRPEPDTSSDDSNAVN

SEQ ID NO: 584992 - protein, 6 aa, Mycobacterium
SRPEPE

SEQ ID NO: 584993 - protein, 6 aa, Mycobacterium
SRPEPR

SEQ ID NO: 584994 - protein, 25 aa, Mycobacterium
SRPERAGAGRTDRGRSSPTSPGVRP

SEQ ID NO: 584995 - protein, 8 aa, Mycobacterium
SRPERSRR

SEQ ID NO: 584996 - protein, 5 aa, Mycobacterium
SRPES

SEQ ID NO: 584997 - protein, 9 aa, Mycobacterium
SRPETMGRG

SEQ ID NO: 584998 - protein, 4 aa, Mycobacterium
SRPF

SEQ ID NO: 584999 - protein, 5 aa, Mycobacterium
SRPFD

SEQ ID NO: 585000 - protein, 8 aa, Mycobacterium
SRPFDEQH

SEQ ID NO: 585001 - protein, 5 aa, Mycobacterium
SRPGD

SEQ ID NO: 585002 - protein, 9 aa, Mycobacterium
SRPGERPTR

SEQ ID NO: 585003 - protein, 10 aa, Mycobacterium
SRPGIPPTHP

SEQ ID NO: 585004 - protein, 7 aa, Mycobacterium
SRPGLAD

SEQ ID NO: 585005 - protein, 14 aa, Mycobacterium
SRPGLGNEVDTGRK

SEQ ID NO: 585006 - protein, 7 aa, Mycobacterium
SRPGLTD

SEQ ID NO: 585007 - protein, 7 aa, Mycobacterium
SRPGNDR

SEQ ID NO: 585008 - protein, 8 aa, Mycobacterium
SRPGPAGR

SEQ ID NO: 585009 - protein, 6 aa, Mycobacterium
SRPGRI

SEQ ID NO: 585010 - protein, 8 aa, Mycobacterium
SRPGRSAL

SEQ ID NO: 585011 - protein, 10 aa, Mycobacterium
SRPGRSALAD

SEQ ID NO: 585012 - protein, 11 aa, Mycobacterium
SRPGSVTDGTT

SEQ ID NO: 585013 - protein, 14 aa, Mycobacterium
SRPGTIDRADEETV

SEQ ID NO: 585014 - protein, 12 aa, Mycobacterium
SRPGTPLHDPGK

SEQ ID NO: 585015 - protein, 7 aa, Mycobacterium
SRPGVDW

SEQ ID NO: 585016 - protein, 6 aa, Mycobacterium
SRPGYD

SEQ ID NO: 585017 - protein, 9 aa, Mycobacterium
SRPGYPSEL

SEQ ID NO: 585018 - protein, 4 aa, Mycobacterium
SRPH

SEQ ID NO: 585019 - protein, 5 aa, Mycobacterium
SRPHD

SEQ ID NO: 585020 - protein, 5 aa, Mycobacterium
SRPHG

SEQ ID NO: 585021 - protein, 5 aa, Mycobacterium
SRPHP

SEQ ID NO: 585022 - protein, 8 aa, Mycobacterium
SRPHSAEE

SEQ ID NO: 585023 - protein, 12 aa, Mycobacterium
SRPHSEKSRGEQ

SEQ ID NO: 585024 - protein, 7 aa, Mycobacterium
SRPHSGT

SEQ ID NO: 585025 - protein, 17 aa, Mycobacterium
SRPHTPNIAGEDTFEGP

SEQ ID NO: 585026 - protein, 4 aa, Mycobacterium
SRPI

SEQ ID NO: 585027 - protein, 16 aa, Mycobacterium
SRPIRNREAAAGGPDL

SEQ ID NO: 585028 - protein, 40 aa, Mycobacterium
SRPKQEKGGKAGASKASSRAARAQGSKAAAAKKTESKGGT

SEQ ID NO: 585029 - protein, 9 aa, Mycobacterium
SRPKSAKDV

SEQ ID NO: 585030 - protein, 6 aa, Mycobacterium
SRPLDR

SEQ ID NO: 585031 - protein, 7 aa, Mycobacterium
SRPLDRS

SEQ ID NO: 585032 - protein, 7 aa, Mycobacterium
SRPLGNN

SEQ ID NO: 585033 - protein, 12 aa, Mycobacterium
SRPLPDGLDQPL

SEQ ID NO: 585034 - protein, 9 aa, Mycobacterium
SRPLPEGMR

SEQ ID NO: 585035 - protein, 5 aa, Mycobacterium
SRPLR

SEQ ID NO: 585036 - protein, 10 aa, Mycobacterium
SRPLTAERDR

SEQ ID NO: 585037 - protein, 5 aa, Mycobacterium
SRPNH

SEQ ID NO: 585038 - protein, 7 aa, Mycobacterium
SRPNHPP

SEQ ID NO: 585039 - protein, 7 aa, Mycobacterium
SRPNPSW

SEQ ID NO: 585040 - protein, 4 aa, Mycobacterium
SRPP

SEQ ID NO: 585041 - protein, 9 aa, Mycobacterium
SRPPATPDH

SEQ ID NO: 585042 - protein, 20 aa, Mycobacterium
SRPPDDPAWAENQTKNGKSV

SEQ ID NO: 585043 - protein, 7 aa, Mycobacterium
SRPPDRH

SEQ ID NO: 585044 - protein, 8 aa, Mycobacterium
SRPPGAGH

SEQ ID NO: 585045 - protein, 7 aa, Mycobacterium
SRPPHGV

SEQ ID NO: 585046 - protein, 5 aa, Mycobacterium
SRPPI

SEQ ID NO: 585047 - protein, 37 aa, Mycobacterium
SRPPKQKGASAASARSRRAQGSKAAATKKSAETKEGS

SEQ ID NO: 585048 - protein, 21 aa, Mycobacterium
SRPPNRSPSDAERAQTANGVG

SEQ ID NO: 585049 - protein, 23 aa, Mycobacterium
SRPPRDPRTAASGERENWRPPTT

SEQ ID NO: 585050 - protein, 7 aa, Mycobacterium
SRPPRGV

SEQ ID NO: 585051 - protein, 9 aa, Mycobacterium
SRPPRQMPG

SEQ ID NO: 585052 - protein, 12 aa, Mycobacterium
SRPPTELVFNLG

SEQ ID NO: 585053 - protein, 8 aa, Mycobacterium
SRPPTNTF

SEQ ID NO: 585054 - protein, 8 aa, Mycobacterium
SRPPTRRT

SEQ ID NO: 585055 - protein, 9 aa, Mycobacterium
SRPQGPSHD

SEQ ID NO: 585056 - protein, 11 aa, Mycobacterium
SRPQLTAGGKG

SEQ ID NO: 585057 - protein, 10 aa, Mycobacterium
SRPQPNDSVP

SEQ ID NO: 585058 - protein, 5 aa, Mycobacterium
SRPQT

SEQ ID NO: 585059 - protein, 4 aa, Mycobacterium
SRPR

SEQ ID NO: 585060 - protein, 12 aa, Mycobacterium
SRPRAKQRMPYA

SEQ ID NO: 585061 - protein, 8 aa, Mycobacterium
SRPRGAEN

SEQ ID NO: 585062 - protein, 7 aa, Mycobacterium
SRPRPAA

SEQ ID NO: 585063 - protein, 9 aa, Mycobacterium
SRPRRGQGL

SEQ ID NO: 585064 - protein, 7 aa, Mycobacterium
SRPRRRP

SEQ ID NO: 585065 - protein, 59 aa, Mycobacterium
SRPRSRSRRPSGGAISSISGAAGVSGAGVSGAGVSGSGGAAGIGGGATVSGSGRSTSEM

SEQ ID NO: 585066 - protein, 16 aa, Mycobacterium
SRPRTEPETTGEKGDG

SEQ ID NO: 585067 - protein, 7 aa, Mycobacterium
SRPRTPV

SEQ ID NO: 585068 - protein, 6 aa, Mycobacterium
SRPRVP

SEQ ID NO: 585069 - protein, 4 aa, Mycobacterium
SRPS

SEQ ID NO: 585070 - protein, 11 aa, Mycobacterium
SRPSEDGDDAL

SEQ ID NO: 585071 - protein, 11 aa, Mycobacterium
SRPSEDGEEEL

SEQ ID NO: 585072 - protein, 60 aa, Mycobacterium
SRPSKDQRSSKSSRARRAEGSKAAATAPAKKSSASKAPAKKAATKAESKTSETSEAKGGS

SEQ ID NO: 585073 - protein, 5 aa, Mycobacterium
SRPSP

SEQ ID NO: 585074 - protein, 9 aa, Mycobacterium
SRPSRSALA

SEQ ID NO: 585075 - protein, 8 aa, Mycobacterium
SRPSSEYT

SEQ ID NO: 585076 - protein, 5 aa, Mycobacterium
SRPSV

SEQ ID NO: 585077 - protein, 16 aa, Mycobacterium
SRPTAADDSASVPAVG

SEQ ID NO: 585078 - protein, 12 aa, Mycobacterium
SRPTDGRPLTTA

SEQ ID NO: 585079 - protein, 6 aa, Mycobacterium
SRPTFQ

SEQ ID NO: 585080 - protein, 6 aa, Mycobacterium
SRPTHE

SEQ ID NO: 585081 - protein, 5 aa, Mycobacterium
SRPTL

SEQ ID NO: 585082 - protein, 8 aa, Mycobacterium
SRPTLPDL

SEQ ID NO: 585083 - protein, 13 aa, Mycobacterium
SRPTLTASQVGAG

SEQ ID NO: 585084 - protein, 8 aa, Mycobacterium
SRPTQDNP

SEQ ID NO: 585085 - protein, 6 aa, Mycobacterium
SRPTQG

SEQ ID NO: 585086 - protein, 10 aa, Mycobacterium
SRPTTLNDDE

SEQ ID NO: 585087 - protein, 7 aa, Mycobacterium
SRPTTRR

SEQ ID NO: 585088 - protein, 15 aa, Mycobacterium
SRPTVGQADLLAPHR

SEQ ID NO: 585089 - protein, 12 aa, Mycobacterium
SRPTVSPESVDA

SEQ ID NO: 585090 - protein, 13 aa, Mycobacterium
SRPTYDDAARQQV

SEQ ID NO: 585091 - protein, 24 aa, Mycobacterium
SRPTYDDAARSQVQAARASKPFDD

SEQ ID NO: 585092 - protein, 7 aa, Mycobacterium
SRPVDSP

SEQ ID NO: 585093 - protein, 9 aa, Mycobacterium
SRPVPNPDL

SEQ ID NO: 585094 - protein, 10 aa, Mycobacterium
SRPVTGRGSK

SEQ ID NO: 585095 - protein, 10 aa, Mycobacterium
SRPVTPAEGA

SEQ ID NO: 585096 - protein, 5 aa, Mycobacterium
SRPVV

SEQ ID NO: 585097 - protein, 4 aa, Mycobacterium
SRPW

SEQ ID NO: 585098 - protein, 5 aa, Mycobacterium
SRPWA

SEQ ID NO: 585099 - protein, 5 aa, Mycobacterium
SRPWG

SEQ ID NO: 585100 - protein, 6 aa, Mycobacterium
SRQADD

SEQ ID NO: 585101 - protein, 15 aa, Mycobacterium
SRQAPAEPVSRTMIM

SEQ ID NO: 585102 - protein, 6 aa, Mycobacterium
SRQARE

SEQ ID NO: 585103 - protein, 16 aa, Mycobacterium
SRQDNTFAGNEDETEF

SEQ ID NO: 585104 - protein, 11 aa, Mycobacterium
SRQDSEEEGSL

SEQ ID NO: 585105 - protein, 9 aa, Mycobacterium
SRQEAEDSY

SEQ ID NO: 585106 - protein, 10 aa, Mycobacterium
SRQEDSPAMK

SEQ ID NO: 585107 - protein, 10 aa, Mycobacterium
SRQEDSPTMK

SEQ ID NO: 585108 - protein, 7 aa, Mycobacterium
SRQEEQL

SEQ ID NO: 585109 - protein, 7 aa, Mycobacterium
SRQELDE

SEQ ID NO: 585110 - protein, 6 aa, Mycobacterium
SRQENE

SEQ ID NO: 585111 - protein, 7 aa, Mycobacterium
SRQGAGT

SEQ ID NO: 585112 - protein, 6 aa, Mycobacterium
SRQGAK

SEQ ID NO: 585113 - protein, 16 aa, Mycobacterium
SRQGAVGGALLLMEVV

SEQ ID NO: 585114 - protein, 7 aa, Mycobacterium
SRQGGAA

SEQ ID NO: 585115 - protein, 8 aa, Mycobacterium
SRQGGRAA

SEQ ID NO: 585116 - protein, 6 aa, Mycobacterium
SRQGLA

SEQ ID NO: 585117 - protein, 12 aa, Mycobacterium
SRQGPSGDDDSL

SEQ ID NO: 585118 - protein, 7 aa, Mycobacterium
SRQGRAA

SEQ ID NO: 585119 - protein, 31 aa, Mycobacterium
SRQGSGTRVVNRGKDQLPPRPRGAGTPPPHN

SEQ ID NO: 585120 - protein, 7 aa, Mycobacterium
SRQGTAE

SEQ ID NO: 585121 - protein, 7 aa, Mycobacterium
SRQGTYL

SEQ ID NO: 585122 - protein, 5 aa, Mycobacterium
SRQGW

SEQ ID NO: 585123 - protein, 13 aa, Mycobacterium
SRQIGTGEARFEE

SEQ ID NO: 585124 - protein, 4 aa, Mycobacterium
SRQL

SEQ ID NO: 585125 - protein, 6 aa, Mycobacterium
SRQNAD

SEQ ID NO: 585126 - protein, 13 aa, Mycobacterium
SRQPESSTQDSLN

SEQ ID NO: 585127 - protein, 7 aa, Mycobacterium
SRQPWDA

SEQ ID NO: 585128 - protein, 9 aa, Mycobacterium
SRQQAGPTI

SEQ ID NO: 585129 - protein, 9 aa, Mycobacterium
SRQQRDSTY

SEQ ID NO: 585130 - protein, 5 aa, Mycobacterium
SRQRD

SEQ ID NO: 585131 - protein, 7 aa, Mycobacterium
SRQRGAL

SEQ ID NO: 585132 - protein, 8 aa, Mycobacterium
SRQRRAAQ

SEQ ID NO: 585133 - protein, 9 aa, Mycobacterium
SRQRRAAQA

SEQ ID NO: 585134 - protein, 8 aa, Mycobacterium
SRQTRHGR

SEQ ID NO: 585135 - protein, 10 aa, Mycobacterium
SRQVKAPRPA

SEQ ID NO: 585136 - protein, 7 aa, Mycobacterium
SRQVSPG

SEQ ID NO: 585137 - protein, 8 aa, Mycobacterium
SRQWGQRE

SEQ ID NO: 585138 - protein, 5 aa, Mycobacterium
SRQWR

SEQ ID NO: 585139 - protein, 5 aa, Mycobacterium
SRRAA

SEQ ID NO: 585140 - protein, 10 aa, Mycobacterium
SRRAAPSEDA

SEQ ID NO: 585141 - protein, 12 aa, Mycobacterium
SRRAARRTSRGE

SEQ ID NO: 585142 - protein, 6 aa, Mycobacterium
SRRADA

SEQ ID NO: 585143 - protein, 5 aa, Mycobacterium
SRRAE

SEQ ID NO: 585144 - protein, 13 aa, Mycobacterium
SRRAERADWSERD

SEQ ID NO: 585145 - protein, 5 aa, Mycobacterium
SRRAG

SEQ ID NO: 585146 - protein, 6 aa, Mycobacterium
SRRAGE

SEQ ID NO: 585147 - protein, 12 aa, Mycobacterium
SRRAGELTQTDV

SEQ ID NO: 585148 - protein, 9 aa, Mycobacterium
SRRAGVSRQ

SEQ ID NO: 585149 - protein, 13 aa, Mycobacterium
SRRALGLRAPREK

SEQ ID NO: 585150 - protein, 5 aa, Mycobacterium
SRRAM

SEQ ID NO: 585151 - protein, 20 aa, Mycobacterium
SRRAPHRGGHADRAHPRRVR

SEQ ID NO: 585152 - protein, 8 aa, Mycobacterium
SRRAQEDI

SEQ ID NO: 585153 - protein, 6 aa, Mycobacterium
SRRASR

SEQ ID NO: 585154 - protein, 10 aa, Mycobacterium
SRRATDRSGL

SEQ ID NO: 585155 - protein, 24 aa, Mycobacterium
SRRATKDKTHVSAQPCKEEQVNGH

SEQ ID NO: 585156 - protein, 6 aa, Mycobacterium
SRRATT

SEQ ID NO: 585157 - protein, 9 aa, Mycobacterium
SRRAVDPGL

SEQ ID NO: 585158 - protein, 4 aa, Mycobacterium
SRRD

SEQ ID NO: 585159 - protein, 10 aa, Mycobacterium
SRRDASGVGA

SEQ ID NO: 585160 - protein, 7 aa, Mycobacterium
SRRDEAD

SEQ ID NO: 585161 - protein, 7 aa, Mycobacterium
SRRDGKA

SEQ ID NO: 585162 - protein, 18 aa, Mycobacterium
SRRDGQGPGDGSDIPTGR

SEQ ID NO: 585163 - protein, 6 aa, Mycobacterium
SRRDIP

SEQ ID NO: 585164 - protein, 7 aa, Mycobacterium
SRRDIPD

SEQ ID NO: 585165 - protein, 5 aa, Mycobacterium
SRRDL

SEQ ID NO: 585166 - protein, 12 aa, Mycobacterium
SRRDPDESAQRA

SEQ ID NO: 585167 - protein, 10 aa, Mycobacterium
SRRDPDGPYG

SEQ ID NO: 585168 - protein, 5 aa, Mycobacterium
SRRDR

SEQ ID NO: 585169 - protein, 6 aa, Mycobacterium
SRRDTP

SEQ ID NO: 585170 - protein, 9 aa, Mycobacterium
SRRDTQTDT

SEQ ID NO: 585171 - protein, 4 aa, Mycobacterium
SRRE

SEQ ID NO: 585172 - protein, 9 aa, Mycobacterium
SRREDRPGV

SEQ ID NO: 585173 - protein, 12 aa, Mycobacterium
SRREDSGPAQLR

SEQ ID NO: 585174 - protein, 9 aa, Mycobacterium
SRREHPTED

SEQ ID NO: 585175 - protein, 10 aa, Mycobacterium
SRREPGADAQ

SEQ ID NO: 585176 - protein, 13 aa, Mycobacterium
SRREPGDDARRRL

SEQ ID NO: 585177 - protein, 6 aa, Mycobacterium
SRRERN

SEQ ID NO: 585178 - protein, 4 aa, Mycobacterium
SRRG

SEQ ID NO: 585179 - protein, 12 aa, Mycobacterium
SRRGEQPAAGPH

SEQ ID NO: 585180 - protein, 7 aa, Mycobacterium
SRRGGHG

SEQ ID NO: 585181 - protein, 9 aa, Mycobacterium
SRRGGQFDP

SEQ ID NO: 585182 - protein, 14 aa, Mycobacterium
SRRGGRGSVIPAGR

SEQ ID NO: 585183 - protein, 5 aa, Mycobacterium
SRRGL

SEQ ID NO: 585184 - protein, 8 aa, Mycobacterium
SRRGLDPG

SEQ ID NO: 585185 - protein, 5 aa, Mycobacterium
SRRGN

SEQ ID NO: 585186 - protein, 6 aa, Mycobacterium
SRRGPG

SEQ ID NO: 585187 - protein, 6 aa, Mycobacterium
SRRGPH

SEQ ID NO: 585188 - protein, 7 aa, Mycobacterium
SRRGQPP

SEQ ID NO: 585189 - protein, 7 aa, Mycobacterium
SRRGQRL

SEQ ID NO: 585190 - protein, 5 aa, Mycobacterium
SRRGR

SEQ ID NO: 585191 - protein, 13 aa, Mycobacterium
SRRGREVTNEYPD

SEQ ID NO: 585192 - protein, 10 aa, Mycobacterium
SRRGREVTQE

SEQ ID NO: 585193 - protein, 6 aa, Mycobacterium
SRRGRP

SEQ ID NO: 585194 - protein, 15 aa, Mycobacterium
SRRGRRYMLDRIIAS

SEQ ID NO: 585195 - protein, 5 aa, Mycobacterium
SRRGS

SEQ ID NO: 585196 - protein, 8 aa, Mycobacterium
SRRGTAEL

SEQ ID NO: 585197 - protein, 5 aa, Mycobacterium
SRRGV

SEQ ID NO: 585198 - protein, 8 aa, Mycobacterium
SRRKALPE

SEQ ID NO: 585199 - protein, 12 aa, Mycobacterium
SRRLAGKAGLKP

SEQ ID NO: 585200 - protein, 5 aa, Mycobacterium
SRRLG

SEQ ID NO: 585201 - protein, 12 aa, Mycobacterium
SRRLGRPDATGP

SEQ ID NO: 585202 - protein, 6 aa, Mycobacterium
SRRLQG

SEQ ID NO: 585203 - protein, 10 aa, Mycobacterium
SRRMSTPEEV

SEQ ID NO: 585204 - protein, 11 aa, Mycobacterium
SRRNGGGHRAV

SEQ ID NO: 585205 - protein, 7 aa, Mycobacterium
SRRPANA

SEQ ID NO: 585206 - protein, 5 aa, Mycobacterium
SRRPD

SEQ ID NO: 585207 - protein, 14 aa, Mycobacterium
SRRPDESVVASDGT

SEQ ID NO: 585208 - protein, 9 aa, Mycobacterium
SRRPDRPGV

SEQ ID NO: 585209 - protein, 17 aa, Mycobacterium
SRRPEAVDAAGWRAIDA

SEQ ID NO: 585210 - protein, 14 aa, Mycobacterium
SRRPGDFSSGQGTQ

SEQ ID NO: 585211 - protein, 8 aa, Mycobacterium
SRRPGETA

SEQ ID NO: 585212 - protein, 14 aa, Mycobacterium
SRRPGREWTNRPVD

SEQ ID NO: 585213 - protein, 5 aa, Mycobacterium
SRRPI

SEQ ID NO: 585214 - protein, 14 aa, Mycobacterium
SRRPISEVTPPSRE

SEQ ID NO: 585215 - protein, 9 aa, Mycobacterium
SRRPNALDS

SEQ ID NO: 585216 - protein, 5 aa, Mycobacterium
SRRPP

SEQ ID NO: 585217 - protein, 18 aa, Mycobacterium
SRRPPTPRPSRLRRFVRR

SEQ ID NO: 585218 - protein, 7 aa, Mycobacterium
SRRPRAG

SEQ ID NO: 585219 - protein, 15 aa, Mycobacterium
SRRPSEVKASAPARV

SEQ ID NO: 585220 - protein, 6 aa, Mycobacterium
SRRPTL

SEQ ID NO: 585221 - protein, 7 aa, Mycobacterium
SRRPVNP

SEQ ID NO: 585222 - protein, 7 aa, Mycobacterium
SRRQADA

SEQ ID NO: 585223 - protein, 6 aa, Mycobacterium
SRRQLE

SEQ ID NO: 585224 - protein, 4 aa, Mycobacterium
SRRR

SEQ ID NO: 585225 - protein, 5 aa, Mycobacterium
SRRRA

SEQ ID NO: 585226 - protein, 10 aa, Mycobacterium
SRRRAKARAD

SEQ ID NO: 585227 - protein, 15 aa, Mycobacterium
SRRRDHSRAMGGDER

SEQ ID NO: 585228 - protein, 7 aa, Mycobacterium
SRRREGD

SEQ ID NO: 585229 - protein, 8 aa, Mycobacterium
SRRRGGGE

SEQ ID NO: 585230 - protein, 15 aa, Mycobacterium
SRRRPSESGIGCTAT

SEQ ID NO: 585231 - protein, 9 aa, Mycobacterium
SRRRRGPET

SEQ ID NO: 585232 - protein, 14 aa, Mycobacterium
SRRRRRQPESNIST

SEQ ID NO: 585233 - protein, 16 aa, Mycobacterium
SRRSIGSCDSPRYHVL

SEQ ID NO: 585234 - protein, 8 aa, Mycobacterium
SRRSQAIP

SEQ ID NO: 585235 - protein, 15 aa, Mycobacterium
SRRSRTAHSSPARSR

SEQ ID NO: 585236 - protein, 11 aa, Mycobacterium
SRRSSRPDGEL

SEQ ID NO: 585237 - protein, 6 aa, Mycobacterium
SRRSTQ

SEQ ID NO: 585238 - protein, 10 aa, Mycobacterium
SRRSTRTDHT

SEQ ID NO: 585239 - protein, 6 aa, Mycobacterium
SRRTAN

SEQ ID NO: 585240 - protein, 13 aa, Mycobacterium
SRRTATRTATKNQ

SEQ ID NO: 585241 - protein, 13 aa, Mycobacterium
SRRTDAGADLPAE

SEQ ID NO: 585242 - protein, 13 aa, Mycobacterium
SRRTGGNQRRYAR

SEQ ID NO: 585243 - protein, 7 aa, Mycobacterium
SRRTGLA

SEQ ID NO: 585244 - protein, 7 aa, Mycobacterium
SRRTHED

SEQ ID NO: 585245 - protein, 8 aa, Mycobacterium
SRRTQGEL

SEQ ID NO: 585246 - protein, 7 aa, Mycobacterium
SRRTRPS

SEQ ID NO: 585247 - protein, 12 aa, Mycobacterium
SRRTRSSKDVST

SEQ ID NO: 585248 - protein, 12 aa, Mycobacterium
SRRTRSSQDVST

SEQ ID NO: 585249 - protein, 31 aa, Mycobacterium
SRRTTSRPLTLPGSETYASIKKGSGKQEVAT

SEQ ID NO: 585250 - protein, 11 aa, Mycobacterium
SRRVASEAGLK

SEQ ID NO: 585251 - protein, 13 aa, Mycobacterium
SRRVATRSATKNQ

SEQ ID NO: 585252 - protein, 19 aa, Mycobacterium
SRRVPTSSSLPSGHSASAA

SEQ ID NO: 585253 - protein, 5 aa, Mycobacterium
SRRVT

SEQ ID NO: 585254 - protein, 5 aa, Mycobacterium
SRRWG

SEQ ID NO: 585255 - protein, 6 aa, Mycobacterium
SRRYPG

SEQ ID NO: 585256 - protein, 7 aa, Mycobacterium
SRRYSTT

SEQ ID NO: 585257 - protein, 4 aa, Mycobacterium
SRSA

SEQ ID NO: 585258 - protein, 8 aa, Mycobacterium
SRSAAAAR

SEQ ID NO: 585259 - protein, 15 aa, Mycobacterium
SRSAAGGSGATLGPG

SEQ ID NO: 585260 - protein, 7 aa, Mycobacterium
SRSAARM

SEQ ID NO: 585261 - protein, 14 aa, Mycobacterium
SRSAATSREDPEPC

SEQ ID NO: 585262 - protein, 7 aa, Mycobacterium
SRSADAY

SEQ ID NO: 585263 - protein, 6 aa, Mycobacterium
SRSADQ

SEQ ID NO: 585264 - protein, 18 aa, Mycobacterium
SRSADQIRAATASHSDPL

SEQ ID NO: 585265 - protein, 18 aa, Mycobacterium
SRSADQIRAATDGHTDPL

SEQ ID NO: 585266 - protein, 19 aa, Mycobacterium
SRSADQIRAATESQADPLE

SEQ ID NO: 585267 - protein, 18 aa, Mycobacterium
SRSADQIRAATETHADPL

SEQ ID NO: 585268 - protein, 19 aa, Mycobacterium
SRSAEQIRAATSGQESPID

SEQ ID NO: 585269 - protein, 8 aa, Mycobacterium
SRSAGEEV

SEQ ID NO: 585270 - protein, 12 aa, Mycobacterium
SRSALRSPLDPA

SEQ ID NO: 585271 - protein, 10 aa, Mycobacterium
SRSAPSQKAL

SEQ ID NO: 585272 - protein, 10 aa, Mycobacterium
SRSARSRQLK

SEQ ID NO: 585273 - protein, 5 aa, Mycobacterium
SRSAS

SEQ ID NO: 585274 - protein, 8 aa, Mycobacterium
SRSASEEV

SEQ ID NO: 585275 - protein, 9 aa, Mycobacterium
SRSASEEVS

SEQ ID NO: 585276 - protein, 10 aa, Mycobacterium
SRSASEEVSV

SEQ ID NO: 585277 - protein, 6 aa, Mycobacterium
SRSASL

SEQ ID NO: 585278 - protein, 9 aa, Mycobacterium
SRSASRMAK

SEQ ID NO: 585279 - protein, 8 aa, Mycobacterium
SRSASSEV

SEQ ID NO: 585280 - protein, 5 aa, Mycobacterium
SRSAT

SEQ ID NO: 585281 - protein, 9 aa, Mycobacterium
SRSATADIE

SEQ ID NO: 585282 - protein, 9 aa, Mycobacterium
SRSATDEIE

SEQ ID NO: 585283 - protein, 9 aa, Mycobacterium
SRSATEEVS

SEQ ID NO: 585284 - protein, 10 aa, Mycobacterium
SRSATGRTWT

SEQ ID NO: 585285 - protein, 8 aa, Mycobacterium
SRSATRMA

SEQ ID NO: 585286 - protein, 6 aa, Mycobacterium
SRSCER

SEQ ID NO: 585287 - protein, 11 aa, Mycobacterium
SRSCTNDIDPV

SEQ ID NO: 585288 - protein, 13 aa, Mycobacterium
SRSDAHGNPLSQE

SEQ ID NO: 585289 - protein, 8 aa, Mycobacterium
SRSDDGRT

SEQ ID NO: 585290 - protein, 9 aa, Mycobacterium
SRSDDTPVN

SEQ ID NO: 585291 - protein, 6 aa, Mycobacterium
SRSDEL

SEQ ID NO: 585292 - protein, 8 aa, Mycobacterium
SRSDGRSR

SEQ ID NO: 585293 - protein, 9 aa, Mycobacterium
SRSDSGNCP

SEQ ID NO: 585294 - protein, 9 aa, Mycobacterium
SRSDSGTCP

SEQ ID NO: 585295 - protein, 6 aa, Mycobacterium
SRSDTK

SEQ ID NO: 585296 - protein, 14 aa, Mycobacterium
SRSDVASRFGADGV

SEQ ID NO: 585297 - protein, 4 aa, Mycobacterium
SRSE

SEQ ID NO: 585298 - protein, 9 aa, Mycobacterium
SRSEAGTWT

SEQ ID NO: 585299 - protein, 14 aa, Mycobacterium
SRSEITGSDQGRSF

SEQ ID NO: 585300 - protein, 6 aa, Mycobacterium
SRSEKA

SEQ ID NO: 585301 - protein, 6 aa, Mycobacterium
SRSELR

SEQ ID NO: 585302 - protein, 9 aa, Mycobacterium
SRSEVESWE

SEQ ID NO: 585303 - protein, 4 aa, Mycobacterium
SRSG

SEQ ID NO: 585304 - protein, 13 aa, Mycobacterium
SRSGAADAPTVSD

SEQ ID NO: 585305 - protein, 10 aa, Mycobacterium
SRSGAAMNGA

SEQ ID NO: 585306 - protein, 6 aa, Mycobacterium
SRSGAD

SEQ ID NO: 585307 - protein, 6 aa, Mycobacterium
SRSGAG

SEQ ID NO: 585308 - protein, 6 aa, Mycobacterium
SRSGAI

SEQ ID NO: 585309 - protein, 16 aa, Mycobacterium
SRSGAPGDDWPAYTTA

SEQ ID NO: 585310 - protein, 12 aa, Mycobacterium
SRSGASPASQVR

SEQ ID NO: 585311 - protein, 7 aa, Mycobacterium
SRSGDWY

SEQ ID NO: 585312 - protein, 12 aa, Mycobacterium
SRSGEHLKVHLV

SEQ ID NO: 585313 - protein, 15 aa, Mycobacterium
SRSGEQLVLSVHDVA

SEQ ID NO: 585314 - protein, 8 aa, Mycobacterium
SRSGGNAM

SEQ ID NO: 585315 - protein, 10 aa, Mycobacterium
SRSGGTAQEA

SEQ ID NO: 585316 - protein, 7 aa, Mycobacterium
SRSGLGS

SEQ ID NO: 585317 - protein, 10 aa, Mycobacterium
SRSGLTEEVR

SEQ ID NO: 585318 - protein, 7 aa, Mycobacterium
SRSGNPH

SEQ ID NO: 585319 - protein, 8 aa, Mycobacterium
SRSGPGWA

SEQ ID NO: 585320 - protein, 9 aa, Mycobacterium
SRSGPTIGT

SEQ ID NO: 585321 - protein, 25 aa, Mycobacterium
SRSGPTTGTPVLPPDGIASATAAVQ

SEQ ID NO: 585322 - protein, 6 aa, Mycobacterium
SRSGQP

SEQ ID NO: 585323 - protein, 12 aa, Mycobacterium
SRSGQRHPAPQR

SEQ ID NO: 585324 - protein, 12 aa, Mycobacterium
SRSGRDVTAEYP

SEQ ID NO: 585325 - protein, 13 aa, Mycobacterium
SRSGRDVTKEYPQ

SEQ ID NO: 585326 - protein, 13 aa, Mycobacterium
SRSGRGAPSGVDE

SEQ ID NO: 585327 - protein, 6 aa, Mycobacterium
SRSGRL

SEQ ID NO: 585328 - protein, 6 aa, Mycobacterium
SRSGSI

SEQ ID NO: 585329 - protein, 10 aa, Mycobacterium
SRSIAGPGGQ

SEQ ID NO: 585330 - protein, 10 aa, Mycobacterium
SRSIGPSDDP

SEQ ID NO: 585331 - protein, 8 aa, Mycobacterium
SRSKAGWA

SEQ ID NO: 585332 - protein, 5 aa, Mycobacterium
SRSKS

SEQ ID NO: 585333 - protein, 10 aa, Mycobacterium
SRSLDGETIR

SEQ ID NO: 585334 - protein, 9 aa, Mycobacterium
SRSLEDGTA

SEQ ID NO: 585335 - protein, 10 aa, Mycobacterium
SRSLEDGTTA

SEQ ID NO: 585336 - protein, 9 aa, Mycobacterium
SRSLPRAQD

SEQ ID NO: 585337 - protein, 4 aa, Mycobacterium
SRSP

SEQ ID NO: 585338 - protein, 9 aa, Mycobacterium
SRSPADRGT

SEQ ID NO: 585339 - protein, 11 aa, Mycobacterium
SRSPGEALGKS

SEQ ID NO: 585340 - protein, 9 aa, Mycobacterium
SRSPNGDFR

SEQ ID NO: 585341 - protein, 8 aa, Mycobacterium
SRSPNPHL

SEQ ID NO: 585342 - protein, 8 aa, Mycobacterium
SRSPNPHV

SEQ ID NO: 585343 - protein, 9 aa, Mycobacterium
SRSPRDPEF

SEQ ID NO: 585344 - protein, 11 aa, Mycobacterium
SRSPRPPADEV

SEQ ID NO: 585345 - protein, 18 aa, Mycobacterium
SRSPRRDGTVPADDPSLR

SEQ ID NO: 585346 - protein, 13 aa, Mycobacterium
SRSPRTPPTPRSG

SEQ ID NO: 585347 - protein, 9 aa, Mycobacterium
SRSPSMPYD

SEQ ID NO: 585348 - protein, 11 aa, Mycobacterium
SRSPTTDNPSR

SEQ ID NO: 585349 - protein, 6 aa, Mycobacterium
SRSPVR

SEQ ID NO: 585350 - protein, 7 aa, Mycobacterium
SRSPWPQ

SEQ ID NO: 585351 - protein, 8 aa, Mycobacterium
SRSQDPAH

SEQ ID NO: 585352 - protein, 8 aa, Mycobacterium
SRSQEETL

SEQ ID NO: 585353 - protein, 10 aa, Mycobacterium
SRSQGKKRRS

SEQ ID NO: 585354 - protein, 6 aa, Mycobacterium
SRSQPD

SEQ ID NO: 585355 - protein, 11 aa, Mycobacterium
SRSQPNEQARQ

SEQ ID NO: 585356 - protein, 9 aa, Mycobacterium
SRSQPTPEA

SEQ ID NO: 585357 - protein, 9 aa, Mycobacterium
SRSQRLRAT

SEQ ID NO: 585358 - protein, 7 aa, Mycobacterium
SRSRDAE

SEQ ID NO: 585359 - protein, 7 aa, Mycobacterium
SRSREDS

SEQ ID NO: 585360 - protein, 13 aa, Mycobacterium
SRSREERKEATRR

SEQ ID NO: 585361 - protein, 7 aa, Mycobacterium
SRSRESA

SEQ ID NO: 585362 - protein, 7 aa, Mycobacterium
SRSRGEQ

SEQ ID NO: 585363 - protein, 8 aa, Mycobacterium
SRSRGEQW

SEQ ID NO: 585364 - protein, 11 aa, Mycobacterium
SRSRPADDPDY

SEQ ID NO: 585365 - protein, 6 aa, Mycobacterium
SRSRTG

SEQ ID NO: 585366 - protein, 15 aa, Mycobacterium
SRSRVRTLSGGQRRR

SEQ ID NO: 585367 - protein, 10 aa, Mycobacterium
SRSSGPPPIV

SEQ ID NO: 585368 - protein, 10 aa, Mycobacterium
SRSSGPPPVV

SEQ ID NO: 585369 - protein, 19 aa, Mycobacterium
SRSSRGRMSSASSATRKTA

SEQ ID NO: 585370 - protein, 9 aa, Mycobacterium
SRSSSAVAT

SEQ ID NO: 585371 - protein, 7 aa, Mycobacterium
SRSSWEP

SEQ ID NO: 585372 - protein, 4 aa, Mycobacterium
SRST

SEQ ID NO: 585373 - protein, 7 aa, Mycobacterium
SRSTAMG

SEQ ID NO: 585374 - protein, 8 aa, Mycobacterium
SRSTDDPD

SEQ ID NO: 585375 - protein, 6 aa, Mycobacterium
SRSTEF

SEQ ID NO: 585376 - protein, 8 aa, Mycobacterium
SRSTESPA

SEQ ID NO: 585377 - protein, 5 aa, Mycobacterium
SRSTI

SEQ ID NO: 585378 - protein, 11 aa, Mycobacterium
SRSTPNGIDGY

SEQ ID NO: 585379 - protein, 38 aa, Mycobacterium
SRSTRASAATGDQARASEATGDQARASAATGDQARASS

SEQ ID NO: 585380 - protein, 8 aa, Mycobacterium
SRSTTEEV

SEQ ID NO: 585381 - protein, 8 aa, Mycobacterium
SRSTTGST

SEQ ID NO: 585382 - protein, 11 aa, Mycobacterium
SRSVGDAPGWA

SEQ ID NO: 585383 - protein, 19 aa, Mycobacterium
SRSVGQQAATLKGEKRSGL

SEQ ID NO: 585384 - protein, 7 aa, Mycobacterium
SRSWGPD

SEQ ID NO: 585385 - protein, 4 aa, Mycobacterium
SRSY

SEQ ID NO: 585386 - protein, 6 aa, Mycobacterium
SRTAAA

SEQ ID NO: 585387 - protein, 14 aa, Mycobacterium
SRTAAAATSYTSAA

SEQ ID NO: 585388 - protein, 9 aa, Mycobacterium
SRTAAGRVP

SEQ ID NO: 585389 - protein, 6 aa, Mycobacterium
SRTAAS

SEQ ID NO: 585390 - protein, 8 aa, Mycobacterium
SRTAASAG

SEQ ID NO: 585391 - protein, 10 aa, Mycobacterium
SRTADPGDAR

SEQ ID NO: 585392 - protein, 6 aa, Mycobacterium
SRTAEI

SEQ ID NO: 585393 - protein, 15 aa, Mycobacterium
SRTAEPAAEFADPDS

SEQ ID NO: 585394 - protein, 10 aa, Mycobacterium
SRTAGTAGTL

SEQ ID NO: 585395 - protein, 9 aa, Mycobacterium
SRTAPPATS

SEQ ID NO: 585396 - protein, 15 aa, Mycobacterium
SRTAPSATAATDPTA

SEQ ID NO: 585397 - protein, 11 aa, Mycobacterium
SRTARNPRPTA

SEQ ID NO: 585398 - protein, 23 aa, Mycobacterium
SRTASRTAARTARADRATSTQEA

SEQ ID NO: 585399 - protein, 5 aa, Mycobacterium
SRTAT

SEQ ID NO: 585400 - protein, 8 aa, Mycobacterium
SRTATGDF

SEQ ID NO: 585401 - protein, 10 aa, Mycobacterium
SRTCGDWPNP

SEQ ID NO: 585402 - protein, 8 aa, Mycobacterium
SRTCPTRQ

SEQ ID NO: 585403 - protein, 15 aa, Mycobacterium
SRTDAHGNPLSPEEL

SEQ ID NO: 585404 - protein, 8 aa, Mycobacterium
SRTDDADA

SEQ ID NO: 585405 - protein, 7 aa, Mycobacterium
SRTDDGL

SEQ ID NO: 585406 - protein, 27 aa, Mycobacterium
SRTDHTKNPYDLDRETGGSSAGTAAAV

SEQ ID NO: 585407 - protein, 5 aa, Mycobacterium
SRTDI

SEQ ID NO: 585408 - protein, 6 aa, Mycobacterium
SRTDPA

SEQ ID NO: 585409 - protein, 13 aa, Mycobacterium
SRTDRDGRLPERT

SEQ ID NO: 585410 - protein, 5 aa, Mycobacterium
SRTDT

SEQ ID NO: 585411 - protein, 8 aa, Mycobacterium
SRTDTDAG

SEQ ID NO: 585412 - protein, 13 aa, Mycobacterium
SRTDVDGQVPPKT

SEQ ID NO: 585413 - protein, 8 aa, Mycobacterium
SRTEQDEL

SEQ ID NO: 585414 - protein, 16 aa, Mycobacterium
SRTEQPGGKTSPEELA

SEQ ID NO: 585415 - protein, 5 aa, Mycobacterium
SRTES

SEQ ID NO: 585416 - protein, 7 aa, Mycobacterium
SRTESYA

SEQ ID NO: 585417 - protein, 9 aa, Mycobacterium
SRTETPDGY

SEQ ID NO: 585418 - protein, 11 aa, Mycobacterium
SRTETRDGYRQ

SEQ ID NO: 585419 - protein, 14 aa, Mycobacterium
SRTETSGMSGGTGL

SEQ ID NO: 585420 - protein, 13 aa, Mycobacterium
SRTFRDRREAGRA

SEQ ID NO: 585421 - protein, 6 aa, Mycobacterium
SRTGAA

SEQ ID NO: 585422 - protein, 6 aa, Mycobacterium
SRTGAT

SEQ ID NO: 585423 - protein, 6 aa, Mycobacterium
SRTGDA

SEQ ID NO: 585424 - protein, 8 aa, Mycobacterium
SRTGGGIA

SEQ ID NO: 585425 - protein, 7 aa, Mycobacterium
SRTGHSV

SEQ ID NO: 585426 - protein, 6 aa, Mycobacterium
SRTGLD

SEQ ID NO: 585427 - protein, 6 aa, Mycobacterium
SRTGMG

SEQ ID NO: 585428 - protein, 12 aa, Mycobacterium
SRTGREVTGEYP

SEQ ID NO: 585429 - protein, 6 aa, Mycobacterium
SRTGRK

SEQ ID NO: 585430 - protein, 9 aa, Mycobacterium
SRTGTGWTT

SEQ ID NO: 585431 - protein, 16 aa, Mycobacterium
SRTGTLATIGPDGQPH

SEQ ID NO: 585432 - protein, 16 aa, Mycobacterium
SRTGTLATVGPDGQPH

SEQ ID NO: 585433 - protein, 6 aa, Mycobacterium
SRTGTP

SEQ ID NO: 585434 - protein, 9 aa, Mycobacterium
SRTGVGPGD

SEQ ID NO: 585435 - protein, 7 aa, Mycobacterium
SRTGVNA

SEQ ID NO: 585436 - protein, 10 aa, Mycobacterium
SRTGVSAPDY

SEQ ID NO: 585437 - protein, 5 aa, Mycobacterium
SRTHP

SEQ ID NO: 585438 - protein, 7 aa, Mycobacterium
SRTISSG

SEQ ID NO: 585439 - protein, 7 aa, Mycobacterium
SRTITNS

SEQ ID NO: 585440 - protein, 9 aa, Mycobacterium
SRTKDSAVT

SEQ ID NO: 585441 - protein, 8 aa, Mycobacterium
SRTKTGCA

SEQ ID NO: 585442 - protein, 9 aa, Mycobacterium
SRTKTVESF

SEQ ID NO: 585443 - protein, 4 aa, Mycobacterium
SRTL

SEQ ID NO: 585444 - protein, 13 aa, Mycobacterium
SRTLAPADCAHCA

SEQ ID NO: 585445 - protein, 10 aa, Mycobacterium
SRTLEGRTVP

SEQ ID NO: 585446 - protein, 12 aa, Mycobacterium
SRTLGAPGRTQI

SEQ ID NO: 585447 - protein, 7 aa, Mycobacterium
SRTLPAG

SEQ ID NO: 585448 - protein, 8 aa, Mycobacterium
SRTLPASA

SEQ ID NO: 585449 - protein, 10 aa, Mycobacterium
SRTLSADEVA

SEQ ID NO: 585450 - protein, 20 aa, Mycobacterium
SRTLSKGKYTGHNVRTGESH

SEQ ID NO: 585451 - protein, 16 aa, Mycobacterium
SRTNPSHAEGATDDAT

SEQ ID NO: 585452 - protein, 9 aa, Mycobacterium
SRTPAPGVY

SEQ ID NO: 585453 - protein, 8 aa, Mycobacterium
SRTPAQAR

SEQ ID NO: 585454 - protein, 7 aa, Mycobacterium
SRTPEQE

SEQ ID NO: 585455 - protein, 6 aa, Mycobacterium
SRTPER

SEQ ID NO: 585456 - protein, 14 aa, Mycobacterium
SRTPESLRPKREYS

SEQ ID NO: 585457 - protein, 8 aa, Mycobacterium
SRTPGETA

SEQ ID NO: 585458 - protein, 18 aa, Mycobacterium
SRTPGQIRHPGPAVGEHN

SEQ ID NO: 585459 - protein, 9 aa, Mycobacterium
SRTPGSGQV

SEQ ID NO: 585460 - protein, 10 aa, Mycobacterium
SRTPGSPEPV

SEQ ID NO: 585461 - protein, 9 aa, Mycobacterium
SRTPGTGQV

SEQ ID NO: 585462 - protein, 15 aa, Mycobacterium
SRTPGTPAGALGPLP

SEQ ID NO: 585463 - protein, 8 aa, Mycobacterium
SRTPGYDG

SEQ ID NO: 585464 - protein, 5 aa, Mycobacterium
SRTPM

SEQ ID NO: 585465 - protein, 14 aa, Mycobacterium
SRTPQEFPSDARRG

SEQ ID NO: 585466 - protein, 7 aa, Mycobacterium
SRTPQSI

SEQ ID NO: 585467 - protein, 12 aa, Mycobacterium
SRTPRRGHAPCP

SEQ ID NO: 585468 - protein, 7 aa, Mycobacterium
SRTPSEH

SEQ ID NO: 585469 - protein, 6 aa, Mycobacterium
SRTPTV

SEQ ID NO: 585470 - protein, 8 aa, Mycobacterium
SRTQSGLP

SEQ ID NO: 585471 - protein, 6 aa, Mycobacterium
SRTQVP

SEQ ID NO: 585472 - protein, 4 aa, Mycobacterium
SRTR

SEQ ID NO: 585473 - protein, 6 aa, Mycobacterium
SRTRGY

SEQ ID NO: 585474 - protein, 7 aa, Mycobacterium
SRTRGYA

SEQ ID NO: 585475 - protein, 7 aa, Mycobacterium
SRTRSAA

SEQ ID NO: 585476 - protein, 8 aa, Mycobacterium
SRTRSNAR

SEQ ID NO: 585477 - protein, 6 aa, Mycobacterium
SRTRSW

SEQ ID NO: 585478 - protein, 11 aa, Mycobacterium
SRTSADEHELG

SEQ ID NO: 585479 - protein, 9 aa, Mycobacterium
SRTSGASLS

SEQ ID NO: 585480 - protein, 7 aa, Mycobacterium
SRTSLGN

SEQ ID NO: 585481 - protein, 5 aa, Mycobacterium
SRTSV

SEQ ID NO: 585482 - protein, 6 aa, Mycobacterium
SRTSVS

SEQ ID NO: 585483 - protein, 4 aa, Mycobacterium
SRTT

SEQ ID NO: 585484 - protein, 7 aa, Mycobacterium
SRTTDDY

SEQ ID NO: 585485 - protein, 8 aa, Mycobacterium
SRTTDDYE

SEQ ID NO: 585486 - protein, 6 aa, Mycobacterium
SRTTHS

SEQ ID NO: 585487 - protein, 16 aa, Mycobacterium
SRTTPSHAEGADADAT

SEQ ID NO: 585488 - protein, 5 aa, Mycobacterium
SRTTS

SEQ ID NO: 585489 - protein, 11 aa, Mycobacterium
SRTTTLNEDEL

SEQ ID NO: 585490 - protein, 7 aa, Mycobacterium
SRTTTMA

SEQ ID NO: 585491 - protein, 14 aa, Mycobacterium
SRTTTSAMSAGTGL

SEQ ID NO: 585492 - protein, 4 aa, Mycobacterium
SRTV

SEQ ID NO: 585493 - protein, 5 aa, Mycobacterium
SRTVQ

SEQ ID NO: 585494 - protein, 13 aa, Mycobacterium
SRTVTSAGTFGTG

SEQ ID NO: 585495 - protein, 5 aa, Mycobacterium
SRTYG

SEQ ID NO: 585496 - protein, 4 aa, Mycobacterium
SRVA

SEQ ID NO: 585497 - protein, 12 aa, Mycobacterium
SRVAEHTREVPA

SEQ ID NO: 585498 - protein, 16 aa, Mycobacterium
SRVAQSATTPVMVVRP

SEQ ID NO: 585499 - protein, 19 aa, Mycobacterium
SRVASARGRVTSTSQRKID

SEQ ID NO: 585500 - protein, 22 aa, Mycobacterium
SRVDNDPHADRRKAWEGFQVLG

SEQ ID NO: 585501 - protein, 11 aa, Mycobacterium
SRVDNPAGSGR

SEQ ID NO: 585502 - protein, 8 aa, Mycobacterium
SRVDPRAR

SEQ ID NO: 585503 - protein, 8 aa, Mycobacterium
SRVDRARR

SEQ ID NO: 585504 - protein, 9 aa, Mycobacterium
SRVGAAAER

SEQ ID NO: 585505 - protein, 5 aa, Mycobacterium
SRVGD

SEQ ID NO: 585506 - protein, 8 aa, Mycobacterium
SRVGEENA

SEQ ID NO: 585507 - protein, 6 aa, Mycobacterium
SRVGEL

SEQ ID NO: 585508 - protein, 9 aa, Mycobacterium
SRVGGKSVR

SEQ ID NO: 585509 - protein, 6 aa, Mycobacterium
SRVGGT

SEQ ID NO: 585510 - protein, 8 aa, Mycobacterium
SRVGNNSA

SEQ ID NO: 585511 - protein, 17 aa, Mycobacterium
SRVGPETLGRVRRLLGG

SEQ ID NO: 585512 - protein, 13 aa, Mycobacterium
SRVGSGKALQGNL

SEQ ID NO: 585513 - protein, 12 aa, Mycobacterium
SRVISGAPLALA

SEQ ID NO: 585514 - protein, 12 aa, Mycobacterium
SRVKEADDPLTE

SEQ ID NO: 585515 - protein, 10 aa, Mycobacterium
SRVPADPETV

SEQ ID NO: 585516 - protein, 53 aa, Mycobacterium
SRVPAGTPRLGGSVRGRAAAPRASAYGASAAGSWATDHTNGTDQRESNDAPMA

SEQ ID NO: 585517 - protein, 5 aa, Mycobacterium
SRVPG

SEQ ID NO: 585518 - protein, 7 aa, Mycobacterium
SRVPGAG

SEQ ID NO: 585519 - protein, 14 aa, Mycobacterium
SRVPPSDAADAERT

SEQ ID NO: 585520 - protein, 6 aa, Mycobacterium
SRVPSA

SEQ ID NO: 585521 - protein, 6 aa, Mycobacterium
SRVQGA

SEQ ID NO: 585522 - protein, 9 aa, Mycobacterium
SRVQPRDRQ

SEQ ID NO: 585523 - protein, 4 aa, Mycobacterium
SRVR

SEQ ID NO: 585524 - protein, 5 aa, Mycobacterium
SRVRA

SEQ ID NO: 585525 - protein, 5 aa, Mycobacterium
SRVRP

SEQ ID NO: 585526 - protein, 5 aa, Mycobacterium
SRVRQ

SEQ ID NO: 585527 - protein, 6 aa, Mycobacterium
SRVRQK

SEQ ID NO: 585528 - protein, 7 aa, Mycobacterium
SRVRSDM

SEQ ID NO: 585529 - protein, 13 aa, Mycobacterium
SRVRSPVGMAFWR

SEQ ID NO: 585530 - protein, 12 aa, Mycobacterium
SRVSARQAKEEL

SEQ ID NO: 585531 - protein, 10 aa, Mycobacterium
SRVSSPDALG

SEQ ID NO: 585532 - protein, 32 aa, Mycobacterium
SRVSSPTPGPAPAPEPSPVPAPQPDPPSPTPS

SEQ ID NO: 585533 - protein, 13 aa, Mycobacterium
SRVSTGDADVHEA

SEQ ID NO: 585534 - protein, 5 aa, Mycobacterium
SRVTA

SEQ ID NO: 585535 - protein, 8 aa, Mycobacterium
SRVTEPGE

SEQ ID NO: 585536 - protein, 11 aa, Mycobacterium
SRVTEPGRLPR

SEQ ID NO: 585537 - protein, 6 aa, Mycobacterium
SRVTES

SEQ ID NO: 585538 - protein, 9 aa, Mycobacterium
SRVTGRSIN

SEQ ID NO: 585539 - protein, 5 aa, Mycobacterium
SRVTN

SEQ ID NO: 585540 - protein, 8 aa, Mycobacterium
SRVTPVGR

SEQ ID NO: 585541 - protein, 4 aa, Mycobacterium
SRWK

SEQ ID NO: 585542 - protein, 21 aa, Mycobacterium
SRWPDGRPLTTTELDTAASGR

SEQ ID NO: 585543 - protein, 21 aa, Mycobacterium
SRWPESPPGWNPADHERSDEY

SEQ ID NO: 585544 - protein, 17 aa, Mycobacterium
SRWPRRASAAGPAPQSL

SEQ ID NO: 585545 - protein, 4 aa, Mycobacterium
SRYA

SEQ ID NO: 585546 - protein, 5 aa, Mycobacterium
SRYAG

SEQ ID NO: 585547 - protein, 12 aa, Mycobacterium
SRYASPVSASRA

SEQ ID NO: 585548 - protein, 6 aa, Mycobacterium
SRYATP

SEQ ID NO: 585549 - protein, 15 aa, Mycobacterium
SRYDAATSKTQGLIF

SEQ ID NO: 585550 - protein, 7 aa, Mycobacterium
SRYDEAR

SEQ ID NO: 585551 - protein, 9 aa, Mycobacterium
SRYDKADSW

SEQ ID NO: 585552 - protein, 9 aa, Mycobacterium
SRYDKANSW

SEQ ID NO: 585553 - protein, 12 aa, Mycobacterium
SRYEASADYRRD

SEQ ID NO: 585554 - protein, 7 aa, Mycobacterium
SRYESGV

SEQ ID NO: 585555 - protein, 5 aa, Mycobacterium
SRYGD

SEQ ID NO: 585556 - protein, 11 aa, Mycobacterium
SRYGDSPATRR

SEQ ID NO: 585557 - protein, 8 aa, Mycobacterium
SRYGEAEE

SEQ ID NO: 585558 - protein, 5 aa, Mycobacterium
SRYGG

SEQ ID NO: 585559 - protein, 6 aa, Mycobacterium
SRYGRT

SEQ ID NO: 585560 - protein, 6 aa, Mycobacterium
SRYGYA

SEQ ID NO: 585561 - protein, 6 aa, Mycobacterium
SRYPDD

SEQ ID NO: 585562 - protein, 9 aa, Mycobacterium
SRYPMADPG

SEQ ID NO: 585563 - protein, 14 aa, Mycobacterium
SRYPNQLSGGQRQR

SEQ ID NO: 585564 - protein, 7 aa, Mycobacterium
SRYPYSE

SEQ ID NO: 585565 - protein, 15 aa, Mycobacterium
SRYQQERDPAAHSAR

SEQ ID NO: 585566 - protein, 6 aa, Mycobacterium
SRYRSN

SEQ ID NO: 585567 - protein, 17 aa, Mycobacterium
SRYRSNALAQEKTGESW

SEQ ID NO: 585568 - protein, 6 aa, Mycobacterium
SRYTGG

SEQ ID NO: 585569 - protein, 13 aa, Mycobacterium
SRYTGWDADGGYA

SEQ ID NO: 585570 - protein, 14 aa, Mycobacterium
SRYTGWDADGGYAE

SEQ ID NO: 585571 - protein, 5 aa, Mycobacterium
SSAAA

SEQ ID NO: 585572 - protein, 7 aa, Mycobacterium
SSAAADT

SEQ ID NO: 585573 - protein, 7 aa, Mycobacterium
SSAAAEA

SEQ ID NO: 585574 - protein, 9 aa, Mycobacterium
SSAAAGPVA

SEQ ID NO: 585575 - protein, 10 aa, Mycobacterium
SSAAAGPVAA

SEQ ID NO: 585576 - protein, 11 aa, Mycobacterium
SSAAAGPVAAK

SEQ ID NO: 585577 - protein, 6 aa, Mycobacterium
SSAAAQ

SEQ ID NO: 585578 - protein, 8 aa, Mycobacterium
SSAAASAR

SEQ ID NO: 585579 - protein, 12 aa, Mycobacterium
SSAAASARDGGG

SEQ ID NO: 585580 - protein, 6 aa, Mycobacterium
SSAADM

SEQ ID NO: 585581 - protein, 7 aa, Mycobacterium
SSAADQL

SEQ ID NO: 585582 - protein, 7 aa, Mycobacterium
SSAAEEE

SEQ ID NO: 585583 - protein, 9 aa, Mycobacterium
SSAAEPGVA

SEQ ID NO: 585584 - protein, 14 aa, Mycobacterium
SSAAGEDGAEHSFA

SEQ ID NO: 585585 - protein, 10 aa, Mycobacterium
SSAAGGTPPY

SEQ ID NO: 585586 - protein, 10 aa, Mycobacterium
SSAAGRAGDA

SEQ ID NO: 585587 - protein, 13 aa, Mycobacterium
SSAAHSLPPIARP

SEQ ID NO: 585588 - protein, 12 aa, Mycobacterium
SSAAKAREAEAA

SEQ ID NO: 585589 - protein, 19 aa, Mycobacterium
SSAAKGDQSTSDTTEFDRR

SEQ ID NO: 585590 - protein, 31 aa, Mycobacterium
SSAAKGSESQSGTTELDKRSETFVQATRGIH

SEQ ID NO: 585591 - protein, 12 aa, Mycobacterium
SSAAKSHGPEAN

SEQ ID NO: 585592 - protein, 11 aa, Mycobacterium
SSAAMAAAATS

SEQ ID NO: 585593 - protein, 23 aa, Mycobacterium
SSAANPSQATAAATKGPDPGPAY

SEQ ID NO: 585594 - protein, 8 aa, Mycobacterium
SSAAPDVT

SEQ ID NO: 585595 - protein, 12 aa, Mycobacterium
SSAAQANFANQE

SEQ ID NO: 585596 - protein, 8 aa, Mycobacterium
SSAAQRAE

SEQ ID NO: 585597 - protein, 7 aa, Mycobacterium
SSAAQSA

SEQ ID NO: 585598 - protein, 8 aa, Mycobacterium
SSAARAHG

SEQ ID NO: 585599 - protein, 10 aa, Mycobacterium
SSAARGASGV

SEQ ID NO: 585600 - protein, 5 aa, Mycobacterium
SSAAS

SEQ ID NO: 585601 - protein, 20 aa, Mycobacterium
SSAASAAMAAQQEVAAGAYT

SEQ ID NO: 585602 - protein, 19 aa, Mycobacterium
SSAASPAAQAAATPGNTPL

SEQ ID NO: 585603 - protein, 8 aa, Mycobacterium
SSAASTVE

SEQ ID NO: 585604 - protein, 18 aa, Mycobacterium
SSAATAVGATAVGPSLPA

SEQ ID NO: 585605 - protein, 22 aa, Mycobacterium
SSAATSLTPFTPPPPTANPAGL

SEQ ID NO: 585606 - protein, 8 aa, Mycobacterium
SSADAQRS

SEQ ID NO: 585607 - protein, 8 aa, Mycobacterium
SSADDTAL

SEQ ID NO: 585608 - protein, 6 aa, Mycobacterium
SSADGG

SEQ ID NO: 585609 - protein, 9 aa, Mycobacterium
SSADGPKTG

SEQ ID NO: 585610 - protein, 14 aa, Mycobacterium
SSADGREPKRPRLE

SEQ ID NO: 585611 - protein, 7 aa, Mycobacterium
SSADGRL

SEQ ID NO: 585612 - protein, 9 aa, Mycobacterium
SSADGSGDL

SEQ ID NO: 585613 - protein, 8 aa, Mycobacterium
SSADGTVT

SEQ ID NO: 585614 - protein, 8 aa, Mycobacterium
SSADGVDA

SEQ ID NO: 585615 - protein, 5 aa, Mycobacterium
SSADL

SEQ ID NO: 585616 - protein, 6 aa, Mycobacterium
SSADRI

SEQ ID NO: 585617 - protein, 10 aa, Mycobacterium
SSADSSGRES

SEQ ID NO: 585618 - protein, 6 aa, Mycobacterium
SSADVS

SEQ ID NO: 585619 - protein, 6 aa, Mycobacterium
SSADVV

SEQ ID NO: 585620 - protein, 13 aa, Mycobacterium
SSADYGAAAGPIG

SEQ ID NO: 585621 - protein, 7 aa, Mycobacterium
SSADYPG

SEQ ID NO: 585622 - protein, 13 aa, Mycobacterium
SSADYSGGAEPLG

SEQ ID NO: 585623 - protein, 14 aa, Mycobacterium
SSADYTGESPPVGS

SEQ ID NO: 585624 - protein, 10 aa, Mycobacterium
SSAEAGRRLQ

SEQ ID NO: 585625 - protein, 13 aa, Mycobacterium
SSAEATYERLGGA

SEQ ID NO: 585626 - protein, 7 aa, Mycobacterium
SSAEDVA

SEQ ID NO: 585627 - protein, 5 aa, Mycobacterium
SSAEE

SEQ ID NO: 585628 - protein, 5 aa, Mycobacterium
SSAEG

SEQ ID NO: 585629 - protein, 8 aa, Mycobacterium
SSAEGGIR

SEQ ID NO: 585630 - protein, 5 aa, Mycobacterium
SSAEQ

SEQ ID NO: 585631 - protein, 12 aa, Mycobacterium
SSAEQAQSLSQR

SEQ ID NO: 585632 - protein, 6 aa, Mycobacterium
SSAEQL

SEQ ID NO: 585633 - protein, 9 aa, Mycobacterium
SSAEQSAMS

SEQ ID NO: 585634 - protein, 14 aa, Mycobacterium
SSAEVSASMGKADK

SEQ ID NO: 585635 - protein, 5 aa, Mycobacterium
SSAFD

SEQ ID NO: 585636 - protein, 5 aa, Mycobacterium
SSAFE

SEQ ID NO: 585637 - protein, 16 aa, Mycobacterium
SSAGAATVRKKAEAAL

SEQ ID NO: 585638 - protein, 7 aa, Mycobacterium
SSAGAAV

SEQ ID NO: 585639 - protein, 9 aa, Mycobacterium
SSAGAPVAG

SEQ ID NO: 585640 - protein, 13 aa, Mycobacterium
SSAGDTHSPVAAR

SEQ ID NO: 585641 - protein, 7 aa, Mycobacterium
SSAGEGT

SEQ ID NO: 585642 - protein, 8 aa, Mycobacterium
SSAGGDRF

SEQ ID NO: 585643 - protein, 9 aa, Mycobacterium
SSAGGTDTG

SEQ ID NO: 585644 - protein, 18 aa, Mycobacterium
SSAGGYSSGVGNSGGGGY

SEQ ID NO: 585645 - protein, 8 aa, Mycobacterium
SSAGHPPP

SEQ ID NO: 585646 - protein, 7 aa, Mycobacterium
SSAGIKA

SEQ ID NO: 585647 - protein, 8 aa, Mycobacterium
SSAGIKGT

SEQ ID NO: 585648 - protein, 15 aa, Mycobacterium
SSAGIKGTPLHTPYT

SEQ ID NO: 585649 - protein, 8 aa, Mycobacterium
SSAGITGT

SEQ ID NO: 585650 - protein, 13 aa, Mycobacterium
SSAGLESETADTA

SEQ ID NO: 585651 - protein, 7 aa, Mycobacterium
SSAGLGI

SEQ ID NO: 585652 - protein, 6 aa, Mycobacterium
SSAGLL

SEQ ID NO: 585653 - protein, 5 aa, Mycobacterium
SSAGM

SEQ ID NO: 585654 - protein, 6 aa, Mycobacterium
SSAGMG

SEQ ID NO: 585655 - protein, 24 aa, Mycobacterium
SSAGNGNVTVAPTGAGIHEVDVKV

SEQ ID NO: 585656 - protein, 25 aa, Mycobacterium
SSAGNGTATVSPTGAGIHEVDIKIE

SEQ ID NO: 585657 - protein, 10 aa, Mycobacterium
SSAGPSERIE

SEQ ID NO: 585658 - protein, 5 aa, Mycobacterium
SSAGQ

SEQ ID NO: 585659 - protein, 10 aa, Mycobacterium
SSAGRPTNPA

SEQ ID NO: 585660 - protein, 13 aa, Mycobacterium
SSAGSYSAAEAQS

SEQ ID NO: 585661 - protein, 20 aa, Mycobacterium
SSAGTGILPGGYTDPNPNVQ

SEQ ID NO: 585662 - protein, 22 aa, Mycobacterium
SSAGVAEPTSHDPDARGHFGPY

SEQ ID NO: 585663 - protein, 5 aa, Mycobacterium
SSAGW

SEQ ID NO: 585664 - protein, 11 aa, Mycobacterium
SSAHGLEPGEI

SEQ ID NO: 585665 - protein, 8 aa, Mycobacterium
SSAIEAGR

SEQ ID NO: 585666 - protein, 6 aa, Mycobacterium
SSAIRD

SEQ ID NO: 585667 - protein, 14 aa, Mycobacterium
SSAKALIGSRATRD

SEQ ID NO: 585668 - protein, 7 aa, Mycobacterium
SSAKAQA

SEQ ID NO: 585669 - protein, 19 aa, Mycobacterium
SSAKFSPASDRSRAGVGDV

SEQ ID NO: 585670 - protein, 8 aa, Mycobacterium
SSAKITPQ

SEQ ID NO: 585671 - protein, 4 aa, Mycobacterium
SSAL

SEQ ID NO: 585672 - protein, 19 aa, Mycobacterium
SSALARESAPPDSALARDA

SEQ ID NO: 585673 - protein, 7 aa, Mycobacterium
SSALATP

SEQ ID NO: 585674 - protein, 5 aa, Mycobacterium
SSALD

SEQ ID NO: 585675 - protein, 14 aa, Mycobacterium
SSALPGSDDGFETD

SEQ ID NO: 585676 - protein, 10 aa, Mycobacterium
SSALPGSDDV

SEQ ID NO: 585677 - protein, 9 aa, Mycobacterium
SSALSQPTA

SEQ ID NO: 585678 - protein, 19 aa, Mycobacterium
SSALSRDAGGTPDRSLGAA

SEQ ID NO: 585679 - protein, 5 aa, Mycobacterium
SSAMA

SEQ ID NO: 585680 - protein, 13 aa, Mycobacterium
SSANDHDARSHAN

SEQ ID NO: 585681 - protein, 6 aa, Mycobacterium
SSANGR

SEQ ID NO: 585682 - protein, 8 aa, Mycobacterium
SSANPGLR

SEQ ID NO: 585683 - protein, 5 aa, Mycobacterium
SSANR

SEQ ID NO: 585684 - protein, 9 aa, Mycobacterium
SSANSPTLP

SEQ ID NO: 585685 - protein, 17 aa, Mycobacterium
SSANTAGLAGAQAAGLA

SEQ ID NO: 585686 - protein, 19 aa, Mycobacterium
SSAPAADADETPRLSDRET

SEQ ID NO: 585687 - protein, 10 aa, Mycobacterium
SSAPADATPL

SEQ ID NO: 585688 - protein, 9 aa, Mycobacterium
SSAPAVAPI

SEQ ID NO: 585689 - protein, 7 aa, Mycobacterium
SSAPDQL

SEQ ID NO: 585690 - protein, 13 aa, Mycobacterium
SSAPDTESARAME

SEQ ID NO: 585691 - protein, 10 aa, Mycobacterium
SSAPDTPEQR

SEQ ID NO: 585692 - protein, 5 aa, Mycobacterium
SSAPE

SEQ ID NO: 585693 - protein, 7 aa, Mycobacterium
SSAPEDE

SEQ ID NO: 585694 - protein, 6 aa, Mycobacterium
SSAPEL

SEQ ID NO: 585695 - protein, 7 aa, Mycobacterium
SSAPGEL

SEQ ID NO: 585696 - protein, 8 aa, Mycobacterium
SSAPGELD

SEQ ID NO: 585697 - protein, 6 aa, Mycobacterium
SSAPGY

SEQ ID NO: 585698 - protein, 8 aa, Mycobacterium
SSAPHAPK

SEQ ID NO: 585699 - protein, 8 aa, Mycobacterium
SSAPPGYR

SEQ ID NO: 585700 - protein, 24 aa, Mycobacterium
SSAPPVGDPPRALDRTPARWATTM

SEQ ID NO: 585701 - protein, 8 aa, Mycobacterium
SSAPSANV

SEQ ID NO: 585702 - protein, 8 aa, Mycobacterium
SSAPSASV

SEQ ID NO: 585703 - protein, 9 aa, Mycobacterium
SSAPSASVD

SEQ ID NO: 585704 - protein, 10 aa, Mycobacterium
SSAPSTSADE

SEQ ID NO: 585705 - protein, 7 aa, Mycobacterium
SSAPTTA

SEQ ID NO: 585706 - protein, 7 aa, Mycobacterium
SSAPYDK

SEQ ID NO: 585707 - protein, 6 aa, Mycobacterium
SSAQDV

SEQ ID NO: 585708 - protein, 15 aa, Mycobacterium
SSAQDVDQSVASPPR

SEQ ID NO: 585709 - protein, 5 aa, Mycobacterium
SSAQI

SEQ ID NO: 585710 - protein, 5 aa, Mycobacterium
SSAQL

SEQ ID NO: 585711 - protein, 24 aa, Mycobacterium
SSAQNRTGREADELARRAGGAMGI

SEQ ID NO: 585712 - protein, 10 aa, Mycobacterium
SSAQRGSPGM

SEQ ID NO: 585713 - protein, 9 aa, Mycobacterium
SSAQSHDAD

SEQ ID NO: 585714 - protein, 10 aa, Mycobacterium
SSAQSHDEDL

SEQ ID NO: 585715 - protein, 8 aa, Mycobacterium
SSAQSVEI

SEQ ID NO: 585716 - protein, 8 aa, Mycobacterium
SSAQVSGQ

SEQ ID NO: 585717 - protein, 4 aa, Mycobacterium
SSAR

SEQ ID NO: 585718 - protein, 6 aa, Mycobacterium
SSARAI

SEQ ID NO: 585719 - protein, 9 aa, Mycobacterium
SSARARALA

SEQ ID NO: 585720 - protein, 5 aa, Mycobacterium
SSARD

SEQ ID NO: 585721 - protein, 6 aa, Mycobacterium
SSARGD

SEQ ID NO: 585722 - protein, 12 aa, Mycobacterium
SSARGKLGHPAG

SEQ ID NO: 585723 - protein, 9 aa, Mycobacterium
SSARGRPLG

SEQ ID NO: 585724 - protein, 11 aa, Mycobacterium
SSARGRPPEEI

SEQ ID NO: 585725 - protein, 9 aa, Mycobacterium
SSARGRPVG

SEQ ID NO: 585726 - protein, 16 aa, Mycobacterium
SSARGVDVSPPELGEA

SEQ ID NO: 585727 - protein, 10 aa, Mycobacterium
SSARHPSADI

SEQ ID NO: 585728 - protein, 9 aa, Mycobacterium
SSARPDMPT

SEQ ID NO: 585729 - protein, 9 aa, Mycobacterium
SSARRHTAR

SEQ ID NO: 585730 - protein, 5 aa, Mycobacterium
SSARS

SEQ ID NO: 585731 - protein, 4 aa, Mycobacterium
SSAS

SEQ ID NO: 585732 - protein, 13 aa, Mycobacterium
SSASASSLGGDGF

SEQ ID NO: 585733 - protein, 7 aa, Mycobacterium
SSASATV

SEQ ID NO: 585734 - protein, 6 aa, Mycobacterium
SSASAV

SEQ ID NO: 585735 - protein, 5 aa, Mycobacterium
SSASG

SEQ ID NO: 585736 - protein, 7 aa, Mycobacterium
SSASGDW

SEQ ID NO: 585737 - protein, 12 aa, Mycobacterium
SSASGPDAPSPE

SEQ ID NO: 585738 - protein, 9 aa, Mycobacterium
SSASKSKVI

SEQ ID NO: 585739 - protein, 24 aa, Mycobacterium
SSASPLSTAGLGGVPQAEAAAPGG

SEQ ID NO: 585740 - protein, 9 aa, Mycobacterium
SSASPTELT

SEQ ID NO: 585741 - protein, 13 aa, Mycobacterium
SSASPVAGKPNLG

SEQ ID NO: 585742 - protein, 10 aa, Mycobacterium
SSASQRESSF

SEQ ID NO: 585743 - protein, 8 aa, Mycobacterium
SSASRARA

SEQ ID NO: 585744 - protein, 12 aa, Mycobacterium
SSASRSKAIADS

SEQ ID NO: 585745 - protein, 9 aa, Mycobacterium
SSASRTTFE

SEQ ID NO: 585746 - protein, 7 aa, Mycobacterium
SSASSYR

SEQ ID NO: 585747 - protein, 5 aa, Mycobacterium
SSASV

SEQ ID NO: 585748 - protein, 12 aa, Mycobacterium
SSATAAAAIPTT

SEQ ID NO: 585749 - protein, 9 aa, Mycobacterium
SSATASNKL

SEQ ID NO: 585750 - protein, 10 aa, Mycobacterium
SSATASNSLQ

SEQ ID NO: 585751 - protein, 11 aa, Mycobacterium
SSATDEDRERL

SEQ ID NO: 585752 - protein, 14 aa, Mycobacterium
SSATGEDGADASFA

SEQ ID NO: 585753 - protein, 13 aa, Mycobacterium
SSATGEDGRDASF

SEQ ID NO: 585754 - protein, 8 aa, Mycobacterium
SSATGSRL

SEQ ID NO: 585755 - protein, 11 aa, Mycobacterium
SSATPDGIPGA

SEQ ID NO: 585756 - protein, 8 aa, Mycobacterium
SSATPEQL

SEQ ID NO: 585757 - protein, 6 aa, Mycobacterium
SSATPL

SEQ ID NO: 585758 - protein, 12 aa, Mycobacterium
SSATQPTESSEP

SEQ ID NO: 585759 - protein, 50 aa, Mycobacterium
SSATTTTTTTTTTTSTTPVTLPEGAQACPNVSGPAGGFAQSAAGTPATSC

SEQ ID NO: 585760 - protein, 4 aa, Mycobacterium
SSAV

SEQ ID NO: 585761 - protein, 11 aa, Mycobacterium
SSAVADKAQQG

SEQ ID NO: 585762 - protein, 5 aa, Mycobacterium
SSAVD

SEQ ID NO: 585763 - protein, 11 aa, Mycobacterium
SSAVGKEIGRR

SEQ ID NO: 585764 - protein, 13 aa, Mycobacterium
SSAVGKEVGKRAA

SEQ ID NO: 585765 - protein, 12 aa, Mycobacterium
SSAVTGEPGPLA

SEQ ID NO: 585766 - protein, 10 aa, Mycobacterium
SSAVTGGVSS

SEQ ID NO: 585767 - protein, 10 aa, Mycobacterium
SSAVTGSTAA

SEQ ID NO: 585768 - protein, 9 aa, Mycobacterium
SSAWRKDPD

SEQ ID NO: 585769 - protein, 9 aa, Mycobacterium
SSAWRKDPE

SEQ ID NO: 585770 - protein, 11 aa, Mycobacterium
SSAYGDQGPWS

SEQ ID NO: 585771 - protein, 6 aa, Mycobacterium
SSCRLK

SEQ ID NO: 585772 - protein, 22 aa, Mycobacterium
SSCSDQTKSTVAQRRVEEEPAL

SEQ ID NO: 585773 - protein, 5 aa, Mycobacterium
SSCSS

SEQ ID NO: 585774 - protein, 4 aa, Mycobacterium
SSCT

SEQ ID NO: 585775 - protein, 11 aa, Mycobacterium
SSDAAAARSAA

SEQ ID NO: 585776 - protein, 6 aa, Mycobacterium
SSDAAV

SEQ ID NO: 585777 - protein, 5 aa, Mycobacterium
SSDAE

SEQ ID NO: 585778 - protein, 18 aa, Mycobacterium
SSDAGPEQRAIEADSVSR

SEQ ID NO: 585779 - protein, 8 aa, Mycobacterium
SSDAGQQV

SEQ ID NO: 585780 - protein, 16 aa, Mycobacterium
SSDAGQSWENESLHGS

SEQ ID NO: 585781 - protein, 6 aa, Mycobacterium
SSDALT

SEQ ID NO: 585782 - protein, 13 aa, Mycobacterium
SSDARAPADPGQV

SEQ ID NO: 585783 - protein, 8 aa, Mycobacterium
SSDATTTA

SEQ ID NO: 585784 - protein, 9 aa, Mycobacterium
SSDAYGPPE

SEQ ID NO: 585785 - protein, 6 aa, Mycobacterium
SSDAYT

SEQ ID NO: 585786 - protein, 5 aa, Mycobacterium
SSDDA

SEQ ID NO: 585787 - protein, 7 aa, Mycobacterium
SSDDAAV

SEQ ID NO: 585788 - protein, 8 aa, Mycobacterium
SSDDDEPV

SEQ ID NO: 585789 - protein, 6 aa, Mycobacterium
SSDDGD

SEQ ID NO: 585790 - protein, 10 aa, Mycobacterium
SSDDGGPLSR

SEQ ID NO: 585791 - protein, 6 aa, Mycobacterium
SSDDHD

SEQ ID NO: 585792 - protein, 10 aa, Mycobacterium
SSDDPAERAA

SEQ ID NO: 585793 - protein, 10 aa, Mycobacterium
SSDDPPPVGE

SEQ ID NO: 585794 - protein, 10 aa, Mycobacterium
SSDDPRTQPE

SEQ ID NO: 585795 - protein, 4 aa, Mycobacterium
SSDE

SEQ ID NO: 585796 - protein, 12 aa, Mycobacterium
SSDEAFGRAAEP

SEQ ID NO: 585797 - protein, 17 aa, Mycobacterium
SSDEDVEESDLSNRGTQ

SEQ ID NO: 585798 - protein, 7 aa, Mycobacterium
SSDEEAI

SEQ ID NO: 585799 - protein, 5 aa, Mycobacterium
SSDEL

SEQ ID NO: 585800 - protein, 9 aa, Mycobacterium
SSDELEAAD

SEQ ID NO: 585801 - protein, 12 aa, Mycobacterium
SSDENRPLTGAP

SEQ ID NO: 585802 - protein, 18 aa, Mycobacterium
SSDEVSVTAGDPTGSSVS

SEQ ID NO: 585803 - protein, 4 aa, Mycobacterium
SSDG

SEQ ID NO: 585804 - protein, 7 aa, Mycobacterium
SSDGAIA

SEQ ID NO: 585805 - protein, 7 aa, Mycobacterium
SSDGESA

SEQ ID NO: 585806 - protein, 18 aa, Mycobacterium
SSDGESLNPADASAAKVY

SEQ ID NO: 585807 - protein, 8 aa, Mycobacterium
SSDGPDRV

SEQ ID NO: 585808 - protein, 10 aa, Mycobacterium
SSDGRPNANF

SEQ ID NO: 585809 - protein, 9 aa, Mycobacterium
SSDGSNNPL

SEQ ID NO: 585810 - protein, 8 aa, Mycobacterium
SSDGTERL

SEQ ID NO: 585811 - protein, 7 aa, Mycobacterium
SSDGTVQ

SEQ ID NO: 585812 - protein, 5 aa, Mycobacterium
SSDHG

SEQ ID NO: 585813 - protein, 6 aa, Mycobacterium
SSDHGV

SEQ ID NO: 585814 - protein, 6 aa, Mycobacterium
SSDHSI

SEQ ID NO: 585815 - protein, 6 aa, Mycobacterium
SSDHSV

SEQ ID NO: 585816 - protein, 17 aa, Mycobacterium
SSDIGQVRRAAEVVADF

SEQ ID NO: 585817 - protein, 5 aa, Mycobacterium
SSDIS

SEQ ID NO: 585818 - protein, 9 aa, Mycobacterium
SSDKDDKDY

SEQ ID NO: 585819 - protein, 6 aa, Mycobacterium
SSDLAA

SEQ ID NO: 585820 - protein, 15 aa, Mycobacterium
SSDLDAPTKSPFGER

SEQ ID NO: 585821 - protein, 8 aa, Mycobacterium
SSDLDSQR

SEQ ID NO: 585822 - protein, 18 aa, Mycobacterium
SSDMENATTHRKGSLRNA

SEQ ID NO: 585823 - protein, 7 aa, Mycobacterium
SSDNPNV

SEQ ID NO: 585824 - protein, 7 aa, Mycobacterium
SSDPDGI

SEQ ID NO: 585825 - protein, 15 aa, Mycobacterium
SSDPDQLSETESKSM

SEQ ID NO: 585826 - protein, 13 aa, Mycobacterium
SSDPEAPNQANHV

SEQ ID NO: 585827 - protein, 6 aa, Mycobacterium
SSDPFT

SEQ ID NO: 585828 - protein, 9 aa, Mycobacterium
SSDPIDHDR

SEQ ID NO: 585829 - protein, 8 aa, Mycobacterium
SSDPKQLG

SEQ ID NO: 585830 - protein, 9 aa, Mycobacterium
SSDPNGEPV

SEQ ID NO: 585831 - protein, 5 aa, Mycobacterium
SSDPQ

SEQ ID NO: 585832 - protein, 6 aa, Mycobacterium
SSDPQL

SEQ ID NO: 585833 - protein, 7 aa, Mycobacterium
SSDPQLR

SEQ ID NO: 585834 - protein, 8 aa, Mycobacterium
SSDPRDVE

SEQ ID NO: 585835 - protein, 15 aa, Mycobacterium
SSDPSRLSGAGKRDG

SEQ ID NO: 585836 - protein, 7 aa, Mycobacterium
SSDPTAA

SEQ ID NO: 585837 - protein, 7 aa, Mycobacterium
SSDPVSG

SEQ ID NO: 585838 - protein, 7 aa, Mycobacterium
SSDQDAL

SEQ ID NO: 585839 - protein, 5 aa, Mycobacterium
SSDQF

SEQ ID NO: 585840 - protein, 6 aa, Mycobacterium
SSDRDI

SEQ ID NO: 585841 - protein, 6 aa, Mycobacterium
SSDRDL

SEQ ID NO: 585842 - protein, 11 aa, Mycobacterium
SSDRGIAASER

SEQ ID NO: 585843 - protein, 5 aa, Mycobacterium
SSDRI

SEQ ID NO: 585844 - protein, 5 aa, Mycobacterium
SSDRL

SEQ ID NO: 585845 - protein, 14 aa, Mycobacterium
SSDRNDANELGAEQ

SEQ ID NO: 585846 - protein, 8 aa, Mycobacterium
SSDRPDCG

SEQ ID NO: 585847 - protein, 7 aa, Mycobacterium
SSDSELT

SEQ ID NO: 585848 - protein, 9 aa, Mycobacterium
SSDSGAADT

SEQ ID NO: 585849 - protein, 9 aa, Mycobacterium
SSDSGYARY

SEQ ID NO: 585850 - protein, 16 aa, Mycobacterium
SSDSGYSRYTSEWDGA

SEQ ID NO: 585851 - protein, 17 aa, Mycobacterium
SSDSGYSRYTSEWDGAA

SEQ ID NO: 585852 - protein, 17 aa, Mycobacterium
SSDSGYSRYTSEWDGAD

SEQ ID NO: 585853 - protein, 17 aa, Mycobacterium
SSDSGYSRYTSEWDGAE

SEQ ID NO: 585854 - protein, 8 aa, Mycobacterium
SSDSNQLR

SEQ ID NO: 585855 - protein, 9 aa, Mycobacterium
SSDSSGREA

SEQ ID NO: 585856 - protein, 8 aa, Mycobacterium
SSDSYGRR

SEQ ID NO: 585857 - protein, 8 aa, Mycobacterium
SSDSYRPR

SEQ ID NO: 585858 - protein, 8 aa, Mycobacterium
SSDTERRR

SEQ ID NO: 585859 - protein, 17 aa, Mycobacterium
SSDTFGGGTADELPQRG

SEQ ID NO: 585860 - protein, 7 aa, Mycobacterium
SSDTGRD

SEQ ID NO: 585861 - protein, 14 aa, Mycobacterium
SSDTGTGVSTTELA

SEQ ID NO: 585862 - protein, 11 aa, Mycobacterium
SSDTPDRARRT

SEQ ID NO: 585863 - protein, 10 aa, Mycobacterium
SSDTPPELDD

SEQ ID NO: 585864 - protein, 9 aa, Mycobacterium
SSDTPSSGF

SEQ ID NO: 585865 - protein, 9 aa, Mycobacterium
SSDTSGEPD

SEQ ID NO: 585866 - protein, 8 aa, Mycobacterium
SSDTSTDP

SEQ ID NO: 585867 - protein, 4 aa, Mycobacterium
SSDV

SEQ ID NO: 585868 - protein, 13 aa, Mycobacterium
SSDVGGSTARSGG

SEQ ID NO: 585869 - protein, 4 aa, Mycobacterium
SSDY

SEQ ID NO: 585870 - protein, 5 aa, Mycobacterium
SSEAA

SEQ ID NO: 585871 - protein, 8 aa, Mycobacterium
SSEAATEV

SEQ ID NO: 585872 - protein, 6 aa, Mycobacterium
SSEAIG

SEQ ID NO: 585873 - protein, 7 aa, Mycobacterium
SSEAPAI

SEQ ID NO: 585874 - protein, 5 aa, Mycobacterium
SSEAS

SEQ ID NO: 585875 - protein, 27 aa, Mycobacterium
SSEASAAASGASATERFRSDKSPFDAV

SEQ ID NO: 585876 - protein, 6 aa, Mycobacterium
SSEASL

SEQ ID NO: 585877 - protein, 21 aa, Mycobacterium
SSEAYTEYSAETEQRASDIDP

SEQ ID NO: 585878 - protein, 5 aa, Mycobacterium
SSECA

SEQ ID NO: 585879 - protein, 4 aa, Mycobacterium
SSED

SEQ ID NO: 585880 - protein, 7 aa, Mycobacterium
SSEDAMT

SEQ ID NO: 585881 - protein, 5 aa, Mycobacterium
SSEDI

SEQ ID NO: 585882 - protein, 5 aa, Mycobacterium
SSEDV

SEQ ID NO: 585883 - protein, 4 aa, Mycobacterium
SSEE

SEQ ID NO: 585884 - protein, 5 aa, Mycobacterium
SSEEA

SEQ ID NO: 585885 - protein, 5 aa, Mycobacterium
SSEEC

SEQ ID NO: 585886 - protein, 4 aa, Mycobacterium
SSEF

SEQ ID NO: 585887 - protein, 5 aa, Mycobacterium
SSEGA

SEQ ID NO: 585888 - protein, 7 aa, Mycobacterium
SSEGAPV

SEQ ID NO: 585889 - protein, 6 aa, Mycobacterium
SSEGNA

SEQ ID NO: 585890 - protein, 6 aa, Mycobacterium
SSEGNT

SEQ ID NO: 585891 - protein, 7 aa, Mycobacterium
SSEGSRF

SEQ ID NO: 585892 - protein, 5 aa, Mycobacterium
SSEHG

SEQ ID NO: 585893 - protein, 19 aa, Mycobacterium
SSEKPDPALTNTVPPSFLP

SEQ ID NO: 585894 - protein, 7 aa, Mycobacterium
SSEKPSL

SEQ ID NO: 585895 - protein, 9 aa, Mycobacterium
SSEKQAATW

SEQ ID NO: 585896 - protein, 6 aa, Mycobacterium
SSEKRA

SEQ ID NO: 585897 - protein, 7 aa, Mycobacterium
SSEKYTD

SEQ ID NO: 585898 - protein, 4 aa, Mycobacterium
SSEL

SEQ ID NO: 585899 - protein, 11 aa, Mycobacterium
SSELGNTPAVA

SEQ ID NO: 585900 - protein, 5 aa, Mycobacterium
SSELR

SEQ ID NO: 585901 - protein, 13 aa, Mycobacterium
SSELSLSAGAAQY

SEQ ID NO: 585902 - protein, 4 aa, Mycobacterium
SSEM

SEQ ID NO: 585903 - protein, 8 aa, Mycobacterium
SSEMSDPT

SEQ ID NO: 585904 - protein, 9 aa, Mycobacterium
SSEMSDPTI

SEQ ID NO: 585905 - protein, 6 aa, Mycobacterium
SSENAT

SEQ ID NO: 585906 - protein, 12 aa, Mycobacterium
SSENPAEVTPSD

SEQ ID NO: 585907 - protein, 60 aa, Mycobacterium
SSEPAAPETESAPATEPETAAEKAAPRKAPAKKAAAKKAPAKKAAPAVPAESADPNAPDV

SEQ ID NO: 585908 - protein, 17 aa, Mycobacterium
SSEPAASSIGQRDPPRL

SEQ ID NO: 585909 - protein, 13 aa, Mycobacterium
SSEPDAGSDVGAI

SEQ ID NO: 585910 - protein, 15 aa, Mycobacterium
SSEPKPPNPGTAPRH

SEQ ID NO: 585911 - protein, 11 aa, Mycobacterium
SSEPNAGSDVG

SEQ ID NO: 585912 - protein, 8 aa, Mycobacterium
SSEPPADV

SEQ ID NO: 585913 - protein, 8 aa, Mycobacterium
SSEPSGTS

SEQ ID NO: 585914 - protein, 9 aa, Mycobacterium
SSEQTPGSA

SEQ ID NO: 585915 - protein, 7 aa, Mycobacterium
SSEQVRG

SEQ ID NO: 585916 - protein, 10 aa, Mycobacterium
SSERGTPDRI

SEQ ID NO: 585917 - protein, 6 aa, Mycobacterium
SSERQL

SEQ ID NO: 585918 - protein, 7 aa, Mycobacterium
SSERSAL

SEQ ID NO: 585919 - protein, 5 aa, Mycobacterium
SSERT

SEQ ID NO: 585920 - protein, 8 aa, Mycobacterium
SSESAGAV

SEQ ID NO: 585921 - protein, 8 aa, Mycobacterium
SSESPAQV

SEQ ID NO: 585922 - protein, 7 aa, Mycobacterium
SSESPFA

SEQ ID NO: 585923 - protein, 6 aa, Mycobacterium
SSESPH

SEQ ID NO: 585924 - protein, 6 aa, Mycobacterium
SSESRD

SEQ ID NO: 585925 - protein, 15 aa, Mycobacterium
SSESRLEQESMDSAR

SEQ ID NO: 585926 - protein, 7 aa, Mycobacterium
SSESSFA

SEQ ID NO: 585927 - protein, 9 aa, Mycobacterium
SSESSFGAD

SEQ ID NO: 585928 - protein, 10 aa, Mycobacterium
SSESTFSDGE

SEQ ID NO: 585929 - protein, 6 aa, Mycobacterium
SSETAH

SEQ ID NO: 585930 - protein, 8 aa, Mycobacterium
SSETATDV

SEQ ID NO: 585931 - protein, 6 aa, Mycobacterium
SSETDN

SEQ ID NO: 585932 - protein, 14 aa, Mycobacterium
SSETGKPRVHPDDQ

SEQ ID NO: 585933 - protein, 5 aa, Mycobacterium
SSETL

SEQ ID NO: 585934 - protein, 8 aa, Mycobacterium
SSETPDRI

SEQ ID NO: 585935 - protein, 10 aa, Mycobacterium
SSETRPGDAK

SEQ ID NO: 585936 - protein, 8 aa, Mycobacterium
SSETTEEF

SEQ ID NO: 585937 - protein, 4 aa, Mycobacterium
SSEV

SEQ ID NO: 585938 - protein, 7 aa, Mycobacterium
SSEVPTE

SEQ ID NO: 585939 - protein, 10 aa, Mycobacterium
SSEVQEAARD

SEQ ID NO: 585940 - protein, 6 aa, Mycobacterium
SSEYRS

SEQ ID NO: 585941 - protein, 4 aa, Mycobacterium
SSFA

SEQ ID NO: 585942 - protein, 8 aa, Mycobacterium
SSFADSDY

SEQ ID NO: 585943 - protein, 20 aa, Mycobacterium
SSFDESSSIAEDSPAWAPQD

SEQ ID NO: 585944 - protein, 4 aa, Mycobacterium
SSFG

SEQ ID NO: 585945 - protein, 13 aa, Mycobacterium
SSFGTESQKQATE

SEQ ID NO: 585946 - protein, 6 aa, Mycobacterium
SSFKAA

SEQ ID NO: 585947 - protein, 8 aa, Mycobacterium
SSFKTSDY

SEQ ID NO: 585948 - protein, 16 aa, Mycobacterium
SSFPDAIPNDSDDFDE

SEQ ID NO: 585949 - protein, 17 aa, Mycobacterium
SSFPPAPPHSASRTMAS

SEQ ID NO: 585950 - protein, 16 aa, Mycobacterium
SSFRRTDKRGGANGGR

SEQ ID NO: 585951 - protein, 11 aa, Mycobacterium
SSFRSPSDPHT

SEQ ID NO: 585952 - protein, 5 aa, Mycobacterium
SSFSG

SEQ ID NO: 585953 - protein, 45 aa, Mycobacterium
SSFSTPTAPTLPGGWQGSAQTASESGARPAGVGGGGLYGAPGGRG

SEQ ID NO: 585954 - protein, 7 aa, Mycobacterium
SSFTPGL

SEQ ID NO: 585955 - protein, 30 aa, Mycobacterium
SSFTSASGPVRNPWDTTRETGGSSSGSGAL

SEQ ID NO: 585956 - protein, 15 aa, Mycobacterium
SSFTTGSIVRADGGL

SEQ ID NO: 585957 - protein, 15 aa, Mycobacterium
SSFTTGSIVRADGGS

SEQ ID NO: 585958 - protein, 8 aa, Mycobacterium
SSFYPGRG

SEQ ID NO: 585959 - protein, 9 aa, Mycobacterium
SSGAAPVGS

SEQ ID NO: 585960 - protein, 8 aa, Mycobacterium
SSGADRAA

SEQ ID NO: 585961 - protein, 9 aa, Mycobacterium
SSGAETGRK

SEQ ID NO: 585962 - protein, 5 aa, Mycobacterium
SSGAG

SEQ ID NO: 585963 - protein, 9 aa, Mycobacterium
SSGAGPGPL

SEQ ID NO: 585964 - protein, 7 aa, Mycobacterium
SSGAGSE

SEQ ID NO: 585965 - protein, 7 aa, Mycobacterium
SSGAKAV

SEQ ID NO: 585966 - protein, 14 aa, Mycobacterium
SSGANGLPAGSWTR

SEQ ID NO: 585967 - protein, 5 aa, Mycobacterium
SSGAP

SEQ ID NO: 585968 - protein, 14 aa, Mycobacterium
SSGAPGLPAGGWTR

SEQ ID NO: 585969 - protein, 12 aa, Mycobacterium
SSGAPGRPGAGG

SEQ ID NO: 585970 - protein, 9 aa, Mycobacterium
SSGAPSGQH

SEQ ID NO: 585971 - protein, 8 aa, Mycobacterium
SSGAPVSP

SEQ ID NO: 585972 - protein, 6 aa, Mycobacterium
SSGASA

SEQ ID NO: 585973 - protein, 6 aa, Mycobacterium
SSGASI

SEQ ID NO: 585974 - protein, 17 aa, Mycobacterium
SSGASRVQGAITKAGNA

SEQ ID NO: 585975 - protein, 8 aa, Mycobacterium
SSGASTFN

SEQ ID NO: 585976 - protein, 14 aa, Mycobacterium
SSGATGLPAGGWTR

SEQ ID NO: 585977 - protein, 10 aa, Mycobacterium
SSGAVSVTTA

SEQ ID NO: 585978 - protein, 7 aa, Mycobacterium
SSGCPPT

SEQ ID NO: 585979 - protein, 8 aa, Mycobacterium
SSGDAEVR

SEQ ID NO: 585980 - protein, 8 aa, Mycobacterium
SSGDDISM

SEQ ID NO: 585981 - protein, 9 aa, Mycobacterium
SSGDETTTL

SEQ ID NO: 585982 - protein, 20 aa, Mycobacterium
SSGDKPKVTLPDARLGKAGS

SEQ ID NO: 585983 - protein, 13 aa, Mycobacterium
SSGDLDAARQEGD

SEQ ID NO: 585984 - protein, 6 aa, Mycobacterium
SSGDLS

SEQ ID NO: 585985 - protein, 6 aa, Mycobacterium
SSGDQW

SEQ ID NO: 585986 - protein, 17 aa, Mycobacterium
SSGDSTRHTDSQLNEVQ

SEQ ID NO: 585987 - protein, 11 aa, Mycobacterium
SSGDTAARFAP

SEQ ID NO: 585988 - protein, 10 aa, Mycobacterium
SSGDTPAGFE

SEQ ID NO: 585989 - protein, 6 aa, Mycobacterium
SSGDVE

SEQ ID NO: 585990 - protein, 5 aa, Mycobacterium
SSGDW

SEQ ID NO: 585991 - protein, 4 aa, Mycobacterium
SSGE

SEQ ID NO: 585992 - protein, 8 aa, Mycobacterium
SSGEETRR

SEQ ID NO: 585993 - protein, 10 aa, Mycobacterium
SSGEEVSGAQ

SEQ ID NO: 585994 - protein, 11 aa, Mycobacterium
SSGEFSAATPG

SEQ ID NO: 585995 - protein, 6 aa, Mycobacterium
SSGEMT

SEQ ID NO: 585996 - protein, 17 aa, Mycobacterium
SSGEPDRALTNTTEPTF

SEQ ID NO: 585997 - protein, 5 aa, Mycobacterium
SSGEV

SEQ ID NO: 585998 - protein, 14 aa, Mycobacterium
SSGEYDENAAHPIT

SEQ ID NO: 585999 - protein, 6 aa, Mycobacterium
SSGEYG

SEQ ID NO: 586000 - protein, 6 aa, Mycobacterium
SSGFGR

SEQ ID NO: 586001 - protein, 17 aa, Mycobacterium
SSGFSGDRVCALPETGR

SEQ ID NO: 586002 - protein, 7 aa, Mycobacterium
SSGFSSD

SEQ ID NO: 586003 - protein, 15 aa, Mycobacterium
SSGGADESTPNPITA

SEQ ID NO: 586004 - protein, 7 aa, Mycobacterium
SSGGARG

SEQ ID NO: 586005 - protein, 8 aa, Mycobacterium
SSGGDAHD

SEQ ID NO: 586006 - protein, 7 aa, Mycobacterium
SSGGDYR

SEQ ID NO: 586007 - protein, 6 aa, Mycobacterium
SSGGGQ

SEQ ID NO: 586008 - protein, 10 aa, Mycobacterium
SSGGKDEATV

SEQ ID NO: 586009 - protein, 18 aa, Mycobacterium
SSGGKTAEAAAHQNEGLR

SEQ ID NO: 586010 - protein, 11 aa, Mycobacterium
SSGGNGKSTLA

SEQ ID NO: 586011 - protein, 6 aa, Mycobacterium
SSGGNP

SEQ ID NO: 586012 - protein, 14 aa, Mycobacterium
SSGGPDDATTHPIT

SEQ ID NO: 586013 - protein, 14 aa, Mycobacterium
SSGGRPDLGQAEGG

SEQ ID NO: 586014 - protein, 11 aa, Mycobacterium
SSGGSAPDAAI

SEQ ID NO: 586015 - protein, 11 aa, Mycobacterium
SSGGSDDATVH

SEQ ID NO: 586016 - protein, 14 aa, Mycobacterium
SSGGTDDATTHPIT

SEQ ID NO: 586017 - protein, 10 aa, Mycobacterium
SSGGVGSGRA

SEQ ID NO: 586018 - protein, 4 aa, Mycobacterium
SSGH

SEQ ID NO: 586019 - protein, 10 aa, Mycobacterium
SSGHATNATL

SEQ ID NO: 586020 - protein, 9 aa, Mycobacterium
SSGHEGNAA

SEQ ID NO: 586021 - protein, 6 aa, Mycobacterium
SSGHGG

SEQ ID NO: 586022 - protein, 8 aa, Mycobacterium
SSGIGAKV

SEQ ID NO: 586023 - protein, 6 aa, Mycobacterium
SSGIGD

SEQ ID NO: 586024 - protein, 7 aa, Mycobacterium
SSGIGNP

SEQ ID NO: 586025 - protein, 14 aa, Mycobacterium
SSGKGGQGVNTTDS

SEQ ID NO: 586026 - protein, 8 aa, Mycobacterium
SSGKITMT

SEQ ID NO: 586027 - protein, 11 aa, Mycobacterium
SSGKNMSPANI

SEQ ID NO: 586028 - protein, 12 aa, Mycobacterium
SSGKPDPALTNT

SEQ ID NO: 586029 - protein, 14 aa, Mycobacterium
SSGKPGKDPEAGRY

SEQ ID NO: 586030 - protein, 14 aa, Mycobacterium
SSGKPGNHKEAKRY

SEQ ID NO: 586031 - protein, 13 aa, Mycobacterium
SSGKPGPHREAKR

SEQ ID NO: 586032 - protein, 6 aa, Mycobacterium
SSGKPV

SEQ ID NO: 586033 - protein, 5 aa, Mycobacterium
SSGKR

SEQ ID NO: 586034 - protein, 13 aa, Mycobacterium
SSGKRDPGELSTR

SEQ ID NO: 586035 - protein, 13 aa, Mycobacterium
SSGKRDPRELSTQ

SEQ ID NO: 586036 - protein, 9 aa, Mycobacterium
SSGLDEEPE

SEQ ID NO: 586037 - protein, 9 aa, Mycobacterium
SSGLEQPRS

SEQ ID NO: 586038 - protein, 5 aa, Mycobacterium
SSGLP

SEQ ID NO: 586039 - protein, 7 aa, Mycobacterium
SSGLPQL

SEQ ID NO: 586040 - protein, 23 aa, Mycobacterium
SSGLRTDRQASREGVGGEVLAYV

SEQ ID NO: 586041 - protein, 33 aa, Mycobacterium
SSGLRTSLQETADAAGIPPGSRYDHFESKEAIL

SEQ ID NO: 586042 - protein, 8 aa, Mycobacterium
SSGLSSAG

SEQ ID NO: 586043 - protein, 6 aa, Mycobacterium
SSGLYG

SEQ ID NO: 586044 - protein, 7 aa, Mycobacterium
SSGMTER

SEQ ID NO: 586045 - protein, 6 aa, Mycobacterium
SSGMTG

SEQ ID NO: 586046 - protein, 13 aa, Mycobacterium
SSGMTPYAIRLIE

SEQ ID NO: 586047 - protein, 4 aa, Mycobacterium
SSGN

SEQ ID NO: 586048 - protein, 6 aa, Mycobacterium
SSGNAH

SEQ ID NO: 586049 - protein, 8 aa, Mycobacterium
SSGNGDAV

SEQ ID NO: 586050 - protein, 4 aa, Mycobacterium
SSGP

SEQ ID NO: 586051 - protein, 6 aa, Mycobacterium
SSGPCL

SEQ ID NO: 586052 - protein, 9 aa, Mycobacterium
SSGPGPASL

SEQ ID NO: 586053 - protein, 8 aa, Mycobacterium
SSGPGPGP

SEQ ID NO: 586054 - protein, 8 aa, Mycobacterium
SSGPIDTS

SEQ ID NO: 586055 - protein, 5 aa, Mycobacterium
SSGPL

SEQ ID NO: 586056 - protein, 11 aa, Mycobacterium
SSGPPVEAGQH

SEQ ID NO: 586057 - protein, 16 aa, Mycobacterium
SSGPRPDRHPGLSELG

SEQ ID NO: 586058 - protein, 7 aa, Mycobacterium
SSGPVDD

SEQ ID NO: 586059 - protein, 11 aa, Mycobacterium
SSGQAVTPETV

SEQ ID NO: 586060 - protein, 11 aa, Mycobacterium
SSGQNTRGPSK

SEQ ID NO: 586061 - protein, 6 aa, Mycobacterium
SSGRAG

SEQ ID NO: 586062 - protein, 6 aa, Mycobacterium
SSGRAY

SEQ ID NO: 586063 - protein, 8 aa, Mycobacterium
SSGRESYS

SEQ ID NO: 586064 - protein, 6 aa, Mycobacterium
SSGRGA

SEQ ID NO: 586065 - protein, 11 aa, Mycobacterium
SSGRIAPGDAA

SEQ ID NO: 586066 - protein, 12 aa, Mycobacterium
SSGRNDKVRAQR

SEQ ID NO: 586067 - protein, 7 aa, Mycobacterium
SSGRPAL

SEQ ID NO: 586068 - protein, 7 aa, Mycobacterium
SSGRPGA

SEQ ID NO: 586069 - protein, 10 aa, Mycobacterium
SSGRRADGLH

SEQ ID NO: 586070 - protein, 13 aa, Mycobacterium
SSGRRDPRELSTR

SEQ ID NO: 586071 - protein, 5 aa, Mycobacterium
SSGRS

SEQ ID NO: 586072 - protein, 8 aa, Mycobacterium
SSGRSSED

SEQ ID NO: 586073 - protein, 10 aa, Mycobacterium
SSGRVKRPQM

SEQ ID NO: 586074 - protein, 7 aa, Mycobacterium
SSGSAGI

SEQ ID NO: 586075 - protein, 6 aa, Mycobacterium
SSGSAR

SEQ ID NO: 586076 - protein, 7 aa, Mycobacterium
SSGSEHA

SEQ ID NO: 586077 - protein, 5 aa, Mycobacterium
SSGSG

SEQ ID NO: 586078 - protein, 10 aa, Mycobacterium
SSGSGKTTVA

SEQ ID NO: 586079 - protein, 9 aa, Mycobacterium
SSGSGLTRS

SEQ ID NO: 586080 - protein, 7 aa, Mycobacterium
SSGSLAA

SEQ ID NO: 586081 - protein, 8 aa, Mycobacterium
SSGSLRPD

SEQ ID NO: 586082 - protein, 5 aa, Mycobacterium
SSGSP

SEQ ID NO: 586083 - protein, 24 aa, Mycobacterium
SSGSTDGAHSRNTVDGGGSSTTFS

SEQ ID NO: 586084 - protein, 9 aa, Mycobacterium
SSGSTGKPK

SEQ ID NO: 586085 - protein, 27 aa, Mycobacterium
SSGSVRSSGGIGSGRARGDTSNGFPGD

SEQ ID NO: 586086 - protein, 7 aa, Mycobacterium
SSGSVTG

SEQ ID NO: 586087 - protein, 7 aa, Mycobacterium
SSGTAED

SEQ ID NO: 586088 - protein, 6 aa, Mycobacterium
SSGTAL

SEQ ID NO: 586089 - protein, 5 aa, Mycobacterium
SSGTF

SEQ ID NO: 586090 - protein, 8 aa, Mycobacterium
SSGTFPGS

SEQ ID NO: 586091 - protein, 13 aa, Mycobacterium
SSGTGVRPLTGAP

SEQ ID NO: 586092 - protein, 5 aa, Mycobacterium
SSGTP

SEQ ID NO: 586093 - protein, 17 aa, Mycobacterium
SSGTPVSGSAAEAAAAL

SEQ ID NO: 586094 - protein, 28 aa, Mycobacterium
SSGTRTSARIGATGLSGKGIFPPGQGRR

SEQ ID NO: 586095 - protein, 6 aa, Mycobacterium
SSGTSL

SEQ ID NO: 586096 - protein, 8 aa, Mycobacterium
SSGTTALA

SEQ ID NO: 586097 - protein, 9 aa, Mycobacterium
SSGTTGKAK

SEQ ID NO: 586098 - protein, 9 aa, Mycobacterium
SSGTTGKPA

SEQ ID NO: 586099 - protein, 10 aa, Mycobacterium
SSGTTGRPKG

SEQ ID NO: 586100 - protein, 11 aa, Mycobacterium
SSGTTGRPKGI

SEQ ID NO: 586101 - protein, 12 aa, Mycobacterium
SSGTTGRPKGIR

SEQ ID NO: 586102 - protein, 7 aa, Mycobacterium
SSGTTGT

SEQ ID NO: 586103 - protein, 18 aa, Mycobacterium
SSGTVSAAGALDAGGRAT

SEQ ID NO: 586104 - protein, 4 aa, Mycobacterium
SSGV

SEQ ID NO: 586105 - protein, 5 aa, Mycobacterium
SSGVD

SEQ ID NO: 586106 - protein, 9 aa, Mycobacterium
SSGVDEEPE

SEQ ID NO: 586107 - protein, 12 aa, Mycobacterium
SSGVGGRNGGAA

SEQ ID NO: 586108 - protein, 8 aa, Mycobacterium
SSGVGNPP

SEQ ID NO: 586109 - protein, 16 aa, Mycobacterium
SSGVGTGAAGLSPARP

SEQ ID NO: 586110 - protein, 8 aa, Mycobacterium
SSGVIGRD

SEQ ID NO: 586111 - protein, 5 aa, Mycobacterium
SSGVP

SEQ ID NO: 586112 - protein, 10 aa, Mycobacterium
SSGVPDETVR

SEQ ID NO: 586113 - protein, 7 aa, Mycobacterium
SSGVPGE

SEQ ID NO: 586114 - protein, 7 aa, Mycobacterium
SSGVPSF

SEQ ID NO: 586115 - protein, 7 aa, Mycobacterium
SSGVSER

SEQ ID NO: 586116 - protein, 6 aa, Mycobacterium
SSGVSG

SEQ ID NO: 586117 - protein, 9 aa, Mycobacterium
SSGVTPSSD

SEQ ID NO: 586118 - protein, 6 aa, Mycobacterium
SSGWAR

SEQ ID NO: 586119 - protein, 4 aa, Mycobacterium
SSGY

SEQ ID NO: 586120 - protein, 7 aa, Mycobacterium
SSGYQNV

SEQ ID NO: 586121 - protein, 4 aa, Mycobacterium
SSHA

SEQ ID NO: 586122 - protein, 11 aa, Mycobacterium
SSHAKGRPQRY

SEQ ID NO: 586123 - protein, 6 aa, Mycobacterium
SSHAPT

SEQ ID NO: 586124 - protein, 9 aa, Mycobacterium
SSHASSALS

SEQ ID NO: 586125 - protein, 8 aa, Mycobacterium
SSHASTAL

SEQ ID NO: 586126 - protein, 5 aa, Mycobacterium
SSHAT

SEQ ID NO: 586127 - protein, 8 aa, Mycobacterium
SSHATDRE

SEQ ID NO: 586128 - protein, 6 aa, Mycobacterium
SSHATH

SEQ ID NO: 586129 - protein, 9 aa, Mycobacterium
SSHDGRPHR

SEQ ID NO: 586130 - protein, 13 aa, Mycobacterium
SSHDVGRGRGGVE

SEQ ID NO: 586131 - protein, 9 aa, Mycobacterium
SSHEAIQDS

SEQ ID NO: 586132 - protein, 11 aa, Mycobacterium
SSHEEARSRLE

SEQ ID NO: 586133 - protein, 7 aa, Mycobacterium
SSHGTEE

SEQ ID NO: 586134 - protein, 7 aa, Mycobacterium
SSHGTSR

SEQ ID NO: 586135 - protein, 5 aa, Mycobacterium
SSHIT

SEQ ID NO: 586136 - protein, 4 aa, Mycobacterium
SSHP

SEQ ID NO: 586137 - protein, 10 aa, Mycobacterium
SSHPTAEQTL

SEQ ID NO: 586138 - protein, 8 aa, Mycobacterium
SSHQDRAD

SEQ ID NO: 586139 - protein, 12 aa, Mycobacterium
SSHQRAGRRQCG

SEQ ID NO: 586140 - protein, 11 aa, Mycobacterium
SSHREETPTRP

SEQ ID NO: 586141 - protein, 8 aa, Mycobacterium
SSHRPQRG

SEQ ID NO: 586142 - protein, 15 aa, Mycobacterium
SSHSGDDRAGAPTTG

SEQ ID NO: 586143 - protein, 9 aa, Mycobacterium
SSHSGPASL

SEQ ID NO: 586144 - protein, 12 aa, Mycobacterium
SSHSGPASLRRD

SEQ ID NO: 586145 - protein, 11 aa, Mycobacterium
SSHTVTEQDAP

SEQ ID NO: 586146 - protein, 8 aa, Mycobacterium
SSIAAGSE

SEQ ID NO: 586147 - protein, 7 aa, Mycobacterium
SSIAPAA

SEQ ID NO: 586148 - protein, 8 aa, Mycobacterium
SSIAPGAW

SEQ ID NO: 586149 - protein, 6 aa, Mycobacterium
SSIAQS

SEQ ID NO: 586150 - protein, 11 aa, Mycobacterium
SSIARGGGAEG

SEQ ID NO: 586151 - protein, 19 aa, Mycobacterium
SSIDDPADLPQNLTDDPID

SEQ ID NO: 586152 - protein, 8 aa, Mycobacterium
SSIDPDHA

SEQ ID NO: 586153 - protein, 4 aa, Mycobacterium
SSIE

SEQ ID NO: 586154 - protein, 5 aa, Mycobacterium
SSIES

SEQ ID NO: 586155 - protein, 6 aa, Mycobacterium
SSIEST

SEQ ID NO: 586156 - protein, 4 aa, Mycobacterium
SSIG

SEQ ID NO: 586157 - protein, 9 aa, Mycobacterium
SSIGATSAQ

SEQ ID NO: 586158 - protein, 8 aa, Mycobacterium
SSIGENLQ

SEQ ID NO: 586159 - protein, 9 aa, Mycobacterium
SSIGENLQP

SEQ ID NO: 586160 - protein, 6 aa, Mycobacterium
SSIGGL

SEQ ID NO: 586161 - protein, 6 aa, Mycobacterium
SSIGGP

SEQ ID NO: 586162 - protein, 7 aa, Mycobacterium
SSIGGPS

SEQ ID NO: 586163 - protein, 6 aa, Mycobacterium
SSIGHA

SEQ ID NO: 586164 - protein, 9 aa, Mycobacterium
SSIGQAASG

SEQ ID NO: 586165 - protein, 7 aa, Mycobacterium
SSIGRVP

SEQ ID NO: 586166 - protein, 11 aa, Mycobacterium
SSIGSGGFSPY

SEQ ID NO: 586167 - protein, 15 aa, Mycobacterium
SSIGSLQGNPELPAY

SEQ ID NO: 586168 - protein, 5 aa, Mycobacterium
SSIGV

SEQ ID NO: 586169 - protein, 6 aa, Mycobacterium
SSILGK

SEQ ID NO: 586170 - protein, 14 aa, Mycobacterium
SSIPPDSHSAGETY

SEQ ID NO: 586171 - protein, 6 aa, Mycobacterium
SSIPQV

SEQ ID NO: 586172 - protein, 12 aa, Mycobacterium
SSIPSRGGCTGS

SEQ ID NO: 586173 - protein, 5 aa, Mycobacterium
SSIPT

SEQ ID NO: 586174 - protein, 7 aa, Mycobacterium
SSIQPKT

SEQ ID NO: 586175 - protein, 14 aa, Mycobacterium
SSIRPGDPKDPGTV

SEQ ID NO: 586176 - protein, 9 aa, Mycobacterium
SSIRREPVG

SEQ ID NO: 586177 - protein, 9 aa, Mycobacterium
SSIRRQQAD

SEQ ID NO: 586178 - protein, 6 aa, Mycobacterium
SSISSK

SEQ ID NO: 586179 - protein, 11 aa, Mycobacterium
SSITAPDGRPV

SEQ ID NO: 586180 - protein, 12 aa, Mycobacterium
SSITAPDGRPVN

SEQ ID NO: 586181 - protein, 6 aa, Mycobacterium
SSITSE

SEQ ID NO: 586182 - protein, 5 aa, Mycobacterium
SSITV

SEQ ID NO: 586183 - protein, 8 aa, Mycobacterium
SSKAEKAA

SEQ ID NO: 586184 - protein, 21 aa, Mycobacterium
SSKASGASEPPGSDEDTKRKF

SEQ ID NO: 586185 - protein, 9 aa, Mycobacterium
SSKDDVDTA

SEQ ID NO: 586186 - protein, 8 aa, Mycobacterium
SSKDGQNK

SEQ ID NO: 586187 - protein, 8 aa, Mycobacterium
SSKDGREC

SEQ ID NO: 586188 - protein, 6 aa, Mycobacterium
SSKDKV

SEQ ID NO: 586189 - protein, 8 aa, Mycobacterium
SSKEFTPG

SEQ ID NO: 586190 - protein, 5 aa, Mycobacterium
SSKEN

SEQ ID NO: 586191 - protein, 11 aa, Mycobacterium
SSKGESARVAG

SEQ ID NO: 586192 - protein, 13 aa, Mycobacterium
SSKGLSVKADRSM

SEQ ID NO: 586193 - protein, 13 aa, Mycobacterium
SSKGQSASVAAAQ

SEQ ID NO: 586194 - protein, 15 aa, Mycobacterium
SSKKNLSTPDRLAGY

SEQ ID NO: 586195 - protein, 8 aa, Mycobacterium
SSKLNNAG

SEQ ID NO: 586196 - protein, 7 aa, Mycobacterium
SSKMGQE

SEQ ID NO: 586197 - protein, 9 aa, Mycobacterium
SSKNAAKLR

SEQ ID NO: 586198 - protein, 9 aa, Mycobacterium
SSKNAEKLR

SEQ ID NO: 586199 - protein, 14 aa, Mycobacterium
SSKNRGGAAKNTDK

SEQ ID NO: 586200 - protein, 8 aa, Mycobacterium
SSKPENIP

SEQ ID NO: 586201 - protein, 10 aa, Mycobacterium
SSKPQRPQRP

SEQ ID NO: 586202 - protein, 15 aa, Mycobacterium
SSKQVDKSGNAVEKV

SEQ ID NO: 586203 - protein, 5 aa, Mycobacterium
SSKRE

SEQ ID NO: 586204 - protein, 7 aa, Mycobacterium
SSKRGEL

SEQ ID NO: 586205 - protein, 10 aa, Mycobacterium
SSKRGGGTDK

SEQ ID NO: 586206 - protein, 12 aa, Mycobacterium
SSKRGGQNSTDK

SEQ ID NO: 586207 - protein, 10 aa, Mycobacterium
SSKSGTDQAN

SEQ ID NO: 586208 - protein, 7 aa, Mycobacterium
SSKTSEH

SEQ ID NO: 586209 - protein, 11 aa, Mycobacterium
SSKVDSKKQAE

SEQ ID NO: 586210 - protein, 10 aa, Mycobacterium
SSLADNRSRV

SEQ ID NO: 586211 - protein, 8 aa, Mycobacterium
SSLAEAAA

SEQ ID NO: 586212 - protein, 6 aa, Mycobacterium
SSLAEG

SEQ ID NO: 586213 - protein, 23 aa, Mycobacterium
SSLAEGAWQGAASQAMASAAAPY

SEQ ID NO: 586214 - protein, 7 aa, Mycobacterium
SSLASGA

SEQ ID NO: 586215 - protein, 5 aa, Mycobacterium
SSLAT

SEQ ID NO: 586216 - protein, 6 aa, Mycobacterium
SSLDGG

SEQ ID NO: 586217 - protein, 6 aa, Mycobacterium
SSLDND

SEQ ID NO: 586218 - protein, 4 aa, Mycobacterium
SSLE

SEQ ID NO: 586219 - protein, 16 aa, Mycobacterium
SSLEAVPAGTTSAEEA

SEQ ID NO: 586220 - protein, 8 aa, Mycobacterium
SSLEDGRA

SEQ ID NO: 586221 - protein, 8 aa, Mycobacterium
SSLEGPSA

SEQ ID NO: 586222 - protein, 26 aa, Mycobacterium
SSLEVSDSLTAEARPSCVTQSADGTR

SEQ ID NO: 586223 - protein, 18 aa, Mycobacterium
SSLGMSGSRSIPSPDALR

SEQ ID NO: 586224 - protein, 20 aa, Mycobacterium
SSLGPDEQDRHGGAAGRPAV

SEQ ID NO: 586225 - protein, 9 aa, Mycobacterium
SSLGRSEAH

SEQ ID NO: 586226 - protein, 8 aa, Mycobacterium
SSLGSTAL

SEQ ID NO: 586227 - protein, 5 aa, Mycobacterium
SSLHT

SEQ ID NO: 586228 - protein, 4 aa, Mycobacterium
SSLN

SEQ ID NO: 586229 - protein, 9 aa, Mycobacterium
SSLNEPADQ

SEQ ID NO: 586230 - protein, 4 aa, Mycobacterium
SSLP

SEQ ID NO: 586231 - protein, 8 aa, Mycobacterium
SSLPAGSL

SEQ ID NO: 586232 - protein, 7 aa, Mycobacterium
SSLPAPR

SEQ ID NO: 586233 - protein, 7 aa, Mycobacterium
SSLPASN

SEQ ID NO: 586234 - protein, 5 aa, Mycobacterium
SSLPE

SEQ ID NO: 586235 - protein, 7 aa, Mycobacterium
SSLPEGY

SEQ ID NO: 586236 - protein, 8 aa, Mycobacterium
SSLPKTEY

SEQ ID NO: 586237 - protein, 8 aa, Mycobacterium
SSLPPADD

SEQ ID NO: 586238 - protein, 8 aa, Mycobacterium
SSLPPRDQ

SEQ ID NO: 586239 - protein, 8 aa, Mycobacterium
SSLPRRGV

SEQ ID NO: 586240 - protein, 10 aa, Mycobacterium
SSLPSARESA

SEQ ID NO: 586241 - protein, 61 aa, Mycobacterium
SSLPTPSGGAGGDGGNGSNGGAPGAGGSAGAGTGGSTGGQGTGGDGGNGGNGGNGADGANA

SEQ ID NO: 586242 - protein, 5 aa, Mycobacterium
SSLQT

SEQ ID NO: 586243 - protein, 9 aa, Mycobacterium
SSLRDEESA

SEQ ID NO: 586244 - protein, 6 aa, Mycobacterium
SSLREP

SEQ ID NO: 586245 - protein, 5 aa, Mycobacterium
SSLRG

SEQ ID NO: 586246 - protein, 6 aa, Mycobacterium
SSLRGQ

SEQ ID NO: 586247 - protein, 6 aa, Mycobacterium
SSLRKA

SEQ ID NO: 586248 - protein, 8 aa, Mycobacterium
SSLSDAEA

SEQ ID NO: 586249 - protein, 11 aa, Mycobacterium
SSLSDAEAREG

SEQ ID NO: 586250 - protein, 21 aa, Mycobacterium
SSLSSIGSTITSANAAAAPAT

SEQ ID NO: 586251 - protein, 16 aa, Mycobacterium
SSLSTTYASAADELSA

SEQ ID NO: 586252 - protein, 5 aa, Mycobacterium
SSLTA

SEQ ID NO: 586253 - protein, 8 aa, Mycobacterium
SSLTAQSD

SEQ ID NO: 586254 - protein, 25 aa, Mycobacterium
SSLTGASGKSATKSVSTGAGAASGL

SEQ ID NO: 586255 - protein, 12 aa, Mycobacterium
SSLTSEEWHGPA

SEQ ID NO: 586256 - protein, 6 aa, Mycobacterium
SSLTSY

SEQ ID NO: 586257 - protein, 4 aa, Mycobacterium
SSMA

SEQ ID NO: 586258 - protein, 26 aa, Mycobacterium
SSMATRSGAMGANVGQASESTARATS

SEQ ID NO: 586259 - protein, 4 aa, Mycobacterium
SSMD

SEQ ID NO: 586260 - protein, 4 aa, Mycobacterium
SSMG

SEQ ID NO: 586261 - protein, 5 aa, Mycobacterium
SSMGG

SEQ ID NO: 586262 - protein, 6 aa, Mycobacterium
SSMITG

SEQ ID NO: 586263 - protein, 6 aa, Mycobacterium
SSMPGY

SEQ ID NO: 586264 - protein, 14 aa, Mycobacterium
SSMPVAGQTLIAPV

SEQ ID NO: 586265 - protein, 6 aa, Mycobacterium
SSMQQN

SEQ ID NO: 586266 - protein, 10 aa, Mycobacterium
SSMSGPRVGV

SEQ ID NO: 586267 - protein, 4 aa, Mycobacterium
SSMT

SEQ ID NO: 586268 - protein, 12 aa, Mycobacterium
SSMTTNGESVKR

SEQ ID NO: 586269 - protein, 4 aa, Mycobacterium
SSMV

SEQ ID NO: 586270 - protein, 6 aa, Mycobacterium
SSNAAV

SEQ ID NO: 586271 - protein, 21 aa, Mycobacterium
SSNAAVNSHTAQVGPKLAEGT

SEQ ID NO: 586272 - protein, 17 aa, Mycobacterium
SSNCPARPGGAVAPTGA

SEQ ID NO: 586273 - protein, 4 aa, Mycobacterium
SSND

SEQ ID NO: 586274 - protein, 7 aa, Mycobacterium
SSNDRFA

SEQ ID NO: 586275 - protein, 9 aa, Mycobacterium
SSNDTRADA

SEQ ID NO: 586276 - protein, 15 aa, Mycobacterium
SSNEDIPASTPEDLA

SEQ ID NO: 586277 - protein, 5 aa, Mycobacterium
SSNFQ

SEQ ID NO: 586278 - protein, 4 aa, Mycobacterium
SSNG

SEQ ID NO: 586279 - protein, 7 aa, Mycobacterium
SSNGHKM

SEQ ID NO: 586280 - protein, 8 aa, Mycobacterium
SSNGPTDL

SEQ ID NO: 586281 - protein, 11 aa, Mycobacterium
SSNGSQPLDED

SEQ ID NO: 586282 - protein, 6 aa, Mycobacterium
SSNGTI

SEQ ID NO: 586283 - protein, 18 aa, Mycobacterium
SSNHPPLDGSGQPPTPRL

SEQ ID NO: 586284 - protein, 4 aa, Mycobacterium
SSNL

SEQ ID NO: 586285 - protein, 7 aa, Mycobacterium
SSNLDGY

SEQ ID NO: 586286 - protein, 26 aa, Mycobacterium
SSNLRTGQYRARGAVNPDVQPRPSVH

SEQ ID NO: 586287 - protein, 67 aa, Mycobacterium
SSNLRTGQYRARGAVNPDVQPRPTDKDAVRPQSNNAFGDERGVAPMTDNSSYRGDQGPGRPGDEYYD

SEQ ID NO: 586288 - protein, 30 aa, Mycobacterium
SSNLTGGAGEDGKAGGVTVAGGNGGNGGVA

SEQ ID NO: 586289 - protein, 7 aa, Mycobacterium
SSNNDYS

SEQ ID NO: 586290 - protein, 9 aa, Mycobacterium
SSNPAHSLA

SEQ ID NO: 586291 - protein, 14 aa, Mycobacterium
SSNPAHSLADSARC

SEQ ID NO: 586292 - protein, 15 aa, Mycobacterium
SSNPAHSLADSTACR

SEQ ID NO: 586293 - protein, 9 aa, Mycobacterium
SSNPAHSVA

SEQ ID NO: 586294 - protein, 10 aa, Mycobacterium
SSNPAHSVAD

SEQ ID NO: 586295 - protein, 10 aa, Mycobacterium
SSNPALAANS

SEQ ID NO: 586296 - protein, 7 aa, Mycobacterium
SSNPIGA

SEQ ID NO: 586297 - protein, 6 aa, Mycobacterium
SSNPQY

SEQ ID NO: 586298 - protein, 19 aa, Mycobacterium
SSNPTAGGASVGSGIGPTR

SEQ ID NO: 586299 - protein, 9 aa, Mycobacterium
SSNQDKLRP

SEQ ID NO: 586300 - protein, 10 aa, Mycobacterium
SSNQFGSPQA

SEQ ID NO: 586301 - protein, 10 aa, Mycobacterium
SSNQYGSPQA

SEQ ID NO: 586302 - protein, 7 aa, Mycobacterium
SSNRLGH

SEQ ID NO: 586303 - protein, 7 aa, Mycobacterium
SSNRPPA

SEQ ID NO: 586304 - protein, 8 aa, Mycobacterium
SSNRPYGG

SEQ ID NO: 586305 - protein, 9 aa, Mycobacterium
SSNSASLAE

SEQ ID NO: 586306 - protein, 18 aa, Mycobacterium
SSNSGDGPDFPAIAFIPA

SEQ ID NO: 586307 - protein, 7 aa, Mycobacterium
SSNSIRG

SEQ ID NO: 586308 - protein, 19 aa, Mycobacterium
SSNSQGGAGWSEWDDPTEM

SEQ ID NO: 586309 - protein, 17 aa, Mycobacterium
SSNSYGDTEAVNASQAA

SEQ ID NO: 586310 - protein, 12 aa, Mycobacterium
SSNTAANARTAQ

SEQ ID NO: 586311 - protein, 7 aa, Mycobacterium
SSNTAGV

SEQ ID NO: 586312 - protein, 12 aa, Mycobacterium
SSNTDANARTAR

SEQ ID NO: 586313 - protein, 9 aa, Mycobacterium
SSNTEGRTD

SEQ ID NO: 586314 - protein, 9 aa, Mycobacterium
SSNTPPDVV

SEQ ID NO: 586315 - protein, 8 aa, Mycobacterium
SSNTPVQQ

SEQ ID NO: 586316 - protein, 9 aa, Mycobacterium
SSNTPVQQE

SEQ ID NO: 586317 - protein, 11 aa, Mycobacterium
SSNTVSNAQEM

SEQ ID NO: 586318 - protein, 9 aa, Mycobacterium
SSNTVSTAH

SEQ ID NO: 586319 - protein, 10 aa, Mycobacterium
SSNTVSTANE

SEQ ID NO: 586320 - protein, 32 aa, Mycobacterium
SSNYVGGDQTSVGGDWGSDNTQDNSVSSAVEY

SEQ ID NO: 586321 - protein, 4 aa, Mycobacterium
SSPA

SEQ ID NO: 586322 - protein, 5 aa, Mycobacterium
SSPAA

SEQ ID NO: 586323 - protein, 9 aa, Mycobacterium
SSPAAAEQT

SEQ ID NO: 586324 - protein, 12 aa, Mycobacterium
SSPADGGRPVEH

SEQ ID NO: 586325 - protein, 10 aa, Mycobacterium
SSPAFADGAP

SEQ ID NO: 586326 - protein, 13 aa, Mycobacterium
SSPAFQNGLPEDP

SEQ ID NO: 586327 - protein, 13 aa, Mycobacterium
SSPAFQNGMPEDP

SEQ ID NO: 586328 - protein, 6 aa, Mycobacterium
SSPAGE

SEQ ID NO: 586329 - protein, 8 aa, Mycobacterium
SSPAGVTF

SEQ ID NO: 586330 - protein, 30 aa, Mycobacterium
SSPAHPVPGSVAGPASPAPAAADGGAQGPV

SEQ ID NO: 586331 - protein, 12 aa, Mycobacterium
SSPAKEGPFSGA

SEQ ID NO: 586332 - protein, 6 aa, Mycobacterium
SSPAMT

SEQ ID NO: 586333 - protein, 6 aa, Mycobacterium
SSPAPV

SEQ ID NO: 586334 - protein, 6 aa, Mycobacterium
SSPAVP

SEQ ID NO: 586335 - protein, 5 aa, Mycobacterium
SSPCT

SEQ ID NO: 586336 - protein, 9 aa, Mycobacterium
SSPDAAEDD

SEQ ID NO: 586337 - protein, 7 aa, Mycobacterium
SSPDADE

SEQ ID NO: 586338 - protein, 8 aa, Mycobacterium
SSPDASVG

SEQ ID NO: 586339 - protein, 9 aa, Mycobacterium
SSPDGESID

SEQ ID NO: 586340 - protein, 7 aa, Mycobacterium
SSPDGID

SEQ ID NO: 586341 - protein, 7 aa, Mycobacterium
SSPDPVI

SEQ ID NO: 586342 - protein, 6 aa, Mycobacterium
SSPDRA

SEQ ID NO: 586343 - protein, 12 aa, Mycobacterium
SSPDYPDAEEAR

SEQ ID NO: 586344 - protein, 12 aa, Mycobacterium
SSPDYPDPAEAR

SEQ ID NO: 586345 - protein, 13 aa, Mycobacterium
SSPDYPDREEARL

SEQ ID NO: 586346 - protein, 4 aa, Mycobacterium
SSPE

SEQ ID NO: 586347 - protein, 5 aa, Mycobacterium
SSPEA

SEQ ID NO: 586348 - protein, 8 aa, Mycobacterium
SSPEAERV

SEQ ID NO: 586349 - protein, 9 aa, Mycobacterium
SSPEGLSDT

SEQ ID NO: 586350 - protein, 10 aa, Mycobacterium
SSPELPTPQF

SEQ ID NO: 586351 - protein, 8 aa, Mycobacterium
SSPEQFDQ

SEQ ID NO: 586352 - protein, 8 aa, Mycobacterium
SSPERPEV

SEQ ID NO: 586353 - protein, 9 aa, Mycobacterium
SSPESVTEE

SEQ ID NO: 586354 - protein, 10 aa, Mycobacterium
SSPFEGEQDP

SEQ ID NO: 586355 - protein, 15 aa, Mycobacterium
SSPFWDGEDTGYASN

SEQ ID NO: 586356 - protein, 5 aa, Mycobacterium
SSPGA

SEQ ID NO: 586357 - protein, 15 aa, Mycobacterium
SSPGAGEGPAGPGPI

SEQ ID NO: 586358 - protein, 13 aa, Mycobacterium
SSPGGTGGATEHG

SEQ ID NO: 586359 - protein, 8 aa, Mycobacterium
SSPGRTHR

SEQ ID NO: 586360 - protein, 34 aa, Mycobacterium
SSPGSPGSSSGGAELRAGAARRARSVGPEARPVP

SEQ ID NO: 586361 - protein, 7 aa, Mycobacterium
SSPGTFR

SEQ ID NO: 586362 - protein, 12 aa, Mycobacterium
SSPGVDGVLPGD

SEQ ID NO: 586363 - protein, 12 aa, Mycobacterium
SSPGVDRPLTSE

SEQ ID NO: 586364 - protein, 12 aa, Mycobacterium
SSPGVERPLTSE

SEQ ID NO: 586365 - protein, 15 aa, Mycobacterium
SSPGYREAAQRAAAS

SEQ ID NO: 586366 - protein, 29 aa, Mycobacterium
SSPGYRGAAQQAAAGAAEVADPVRVCHEA

SEQ ID NO: 586367 - protein, 9 aa, Mycobacterium
SSPHDPQPS

SEQ ID NO: 586368 - protein, 6 aa, Mycobacterium
SSPHGA

SEQ ID NO: 586369 - protein, 6 aa, Mycobacterium
SSPHGV

SEQ ID NO: 586370 - protein, 6 aa, Mycobacterium
SSPHPA

SEQ ID NO: 586371 - protein, 8 aa, Mycobacterium
SSPHPSAL

SEQ ID NO: 586372 - protein, 19 aa, Mycobacterium
SSPHSRNRSFGERLGRGAT

SEQ ID NO: 586373 - protein, 9 aa, Mycobacterium
SSPHSTGPE

SEQ ID NO: 586374 - protein, 9 aa, Mycobacterium
SSPHTDDAH

SEQ ID NO: 586375 - protein, 7 aa, Mycobacterium
SSPHVGP

SEQ ID NO: 586376 - protein, 10 aa, Mycobacterium
SSPIDDADDT

SEQ ID NO: 586377 - protein, 12 aa, Mycobacterium
SSPINPSAGQQV

SEQ ID NO: 586378 - protein, 5 aa, Mycobacterium
SSPIY

SEQ ID NO: 586379 - protein, 8 aa, Mycobacterium
SSPLAGDP

SEQ ID NO: 586380 - protein, 6 aa, Mycobacterium
SSPLDE

SEQ ID NO: 586381 - protein, 7 aa, Mycobacterium
SSPLEPG

SEQ ID NO: 586382 - protein, 9 aa, Mycobacterium
SSPLQAGDP

SEQ ID NO: 586383 - protein, 15 aa, Mycobacterium
SSPMWEGQDTGYASN

SEQ ID NO: 586384 - protein, 15 aa, Mycobacterium
SSPNITINDNTPEIS

SEQ ID NO: 586385 - protein, 5 aa, Mycobacterium
SSPNK

SEQ ID NO: 586386 - protein, 9 aa, Mycobacterium
SSPNTLGDK

SEQ ID NO: 586387 - protein, 10 aa, Mycobacterium
SSPNTLGDKE

SEQ ID NO: 586388 - protein, 4 aa, Mycobacterium
SSPP

SEQ ID NO: 586389 - protein, 31 aa, Mycobacterium
SSPPAQRSRNRLSRRGHQTAIGTQPHKRSGI

SEQ ID NO: 586390 - protein, 7 aa, Mycobacterium
SSPPNPL

SEQ ID NO: 586391 - protein, 9 aa, Mycobacterium
SSPPRTAVP

SEQ ID NO: 586392 - protein, 41 aa, Mycobacterium
SSPPSSAAPSTKAPRRDPSAAATARERGAGEAATDRGLGSW

SEQ ID NO: 586393 - protein, 9 aa, Mycobacterium
SSPPTRVPA

SEQ ID NO: 586394 - protein, 5 aa, Mycobacterium
SSPPW

SEQ ID NO: 586395 - protein, 14 aa, Mycobacterium
SSPQAAHRELGSER

SEQ ID NO: 586396 - protein, 6 aa, Mycobacterium
SSPQDA

SEQ ID NO: 586397 - protein, 7 aa, Mycobacterium
SSPQERT

SEQ ID NO: 586398 - protein, 15 aa, Mycobacterium
SSPQGKFADSAGAVD

SEQ ID NO: 586399 - protein, 16 aa, Mycobacterium
SSPQGRFADGAAAVSG

SEQ ID NO: 586400 - protein, 52 aa, Mycobacterium
SSPQHESSQPGTTPPVKTAAPTSSGEATTPAPAGGSLSAELKTPDGRTAATA

SEQ ID NO: 586401 - protein, 5 aa, Mycobacterium
SSPQM

SEQ ID NO: 586402 - protein, 32 aa, Mycobacterium
SSPQQTTNPAGLSAQSAAVNQADATAAAANPL

SEQ ID NO: 586403 - protein, 14 aa, Mycobacterium
SSPQRRAIQTAEPV

SEQ ID NO: 586404 - protein, 18 aa, Mycobacterium
SSPQRRAIQTAEPVAADR

SEQ ID NO: 586405 - protein, 15 aa, Mycobacterium
SSPQRRAVQTAEPVA

SEQ ID NO: 586406 - protein, 15 aa, Mycobacterium
SSPQRRAVQTGEPLA

SEQ ID NO: 586407 - protein, 8 aa, Mycobacterium
SSPQSGYG

SEQ ID NO: 586408 - protein, 4 aa, Mycobacterium
SSPR

SEQ ID NO: 586409 - protein, 7 aa, Mycobacterium
SSPRAGE

SEQ ID NO: 586410 - protein, 6 aa, Mycobacterium
SSPRAP

SEQ ID NO: 586411 - protein, 6 aa, Mycobacterium
SSPRAR

SEQ ID NO: 586412 - protein, 13 aa, Mycobacterium
SSPRCEYGAADRA

SEQ ID NO: 586413 - protein, 9 aa, Mycobacterium
SSPRGAAVT

SEQ ID NO: 586414 - protein, 8 aa, Mycobacterium
SSPRPAQE

SEQ ID NO: 586415 - protein, 6 aa, Mycobacterium
SSPRRG

SEQ ID NO: 586416 - protein, 10 aa, Mycobacterium
SSPRRSAEPA

SEQ ID NO: 586417 - protein, 8 aa, Mycobacterium
SSPRSSRR

SEQ ID NO: 586418 - protein, 7 aa, Mycobacterium
SSPRTQL

SEQ ID NO: 586419 - protein, 21 aa, Mycobacterium
SSPSAAMATTTPGASRSAVSA

SEQ ID NO: 586420 - protein, 11 aa, Mycobacterium
SSPSAGGGRAL

SEQ ID NO: 586421 - protein, 8 aa, Mycobacterium
SSPSASEV

SEQ ID NO: 586422 - protein, 12 aa, Mycobacterium
SSPSDRAELSET

SEQ ID NO: 586423 - protein, 13 aa, Mycobacterium
SSPSFQNGLPEDP

SEQ ID NO: 586424 - protein, 5 aa, Mycobacterium
SSPSG

SEQ ID NO: 586425 - protein, 5 aa, Mycobacterium
SSPSH

SEQ ID NO: 586426 - protein, 7 aa, Mycobacterium
SSPSNRV

SEQ ID NO: 586427 - protein, 17 aa, Mycobacterium
SSPSPEAAHGLTTESRA

SEQ ID NO: 586428 - protein, 29 aa, Mycobacterium
SSPSTPADARAAAQSELNRQPRDASPVRV

SEQ ID NO: 586429 - protein, 6 aa, Mycobacterium
SSPSTV

SEQ ID NO: 586430 - protein, 10 aa, Mycobacterium
SSPSVASDRE

SEQ ID NO: 586431 - protein, 5 aa, Mycobacterium
SSPTL

SEQ ID NO: 586432 - protein, 6 aa, Mycobacterium
SSPTLN

SEQ ID NO: 586433 - protein, 16 aa, Mycobacterium
SSPTLVTTQSPGAESG

SEQ ID NO: 586434 - protein, 8 aa, Mycobacterium
SSPTNESK

SEQ ID NO: 586435 - protein, 8 aa, Mycobacterium
SSPTPLPE

SEQ ID NO: 586436 - protein, 8 aa, Mycobacterium
SSPTSNST

SEQ ID NO: 586437 - protein, 7 aa, Mycobacterium
SSPTTAT

SEQ ID NO: 586438 - protein, 4 aa, Mycobacterium
SSPV

SEQ ID NO: 586439 - protein, 12 aa, Mycobacterium
SSPVAADSRGLG

SEQ ID NO: 586440 - protein, 13 aa, Mycobacterium
SSPVDRADDVEPG

SEQ ID NO: 586441 - protein, 15 aa, Mycobacterium
SSPVSSIGSRRQAPV

SEQ ID NO: 586442 - protein, 12 aa, Mycobacterium
SSPWEPSSNRDS

SEQ ID NO: 586443 - protein, 15 aa, Mycobacterium
SSPWWGGEDTGYASN

SEQ ID NO: 586444 - protein, 4 aa, Mycobacterium
SSPY

SEQ ID NO: 586445 - protein, 6 aa, Mycobacterium
SSPYGT

SEQ ID NO: 586446 - protein, 4 aa, Mycobacterium
SSQA

SEQ ID NO: 586447 - protein, 6 aa, Mycobacterium
SSQAAA

SEQ ID NO: 586448 - protein, 5 aa, Mycobacterium
SSQAD

SEQ ID NO: 586449 - protein, 9 aa, Mycobacterium
SSQAGFDPG

SEQ ID NO: 586450 - protein, 10 aa, Mycobacterium
SSQALPPGAR

SEQ ID NO: 586451 - protein, 7 aa, Mycobacterium
SSQANVA

SEQ ID NO: 586452 - protein, 9 aa, Mycobacterium
SSQAPGGAS

SEQ ID NO: 586453 - protein, 7 aa, Mycobacterium
SSQARKY

SEQ ID NO: 586454 - protein, 6 aa, Mycobacterium
SSQARQ

SEQ ID NO: 586455 - protein, 7 aa, Mycobacterium
SSQCQPC

SEQ ID NO: 586456 - protein, 4 aa, Mycobacterium
SSQD

SEQ ID NO: 586457 - protein, 7 aa, Mycobacterium
SSQDDSR

SEQ ID NO: 586458 - protein, 7 aa, Mycobacterium
SSQDDTR

SEQ ID NO: 586459 - protein, 15 aa, Mycobacterium
SSQDEAPSPADASAA

SEQ ID NO: 586460 - protein, 8 aa, Mycobacterium
SSQDHGLD

SEQ ID NO: 586461 - protein, 10 aa, Mycobacterium
SSQEGKPISL

SEQ ID NO: 586462 - protein, 5 aa, Mycobacterium
SSQEL

SEQ ID NO: 586463 - protein, 9 aa, Mycobacterium
SSQFKTGPE

SEQ ID NO: 586464 - protein, 5 aa, Mycobacterium
SSQFT

SEQ ID NO: 586465 - protein, 5 aa, Mycobacterium
SSQGH

SEQ ID NO: 586466 - protein, 7 aa, Mycobacterium
SSQGVGE

SEQ ID NO: 586467 - protein, 8 aa, Mycobacterium
SSQGVRPE

SEQ ID NO: 586468 - protein, 6 aa, Mycobacterium
SSQGVT

SEQ ID NO: 586469 - protein, 5 aa, Mycobacterium
SSQIG

SEQ ID NO: 586470 - protein, 8 aa, Mycobacterium
SSQLPSIS

SEQ ID NO: 586471 - protein, 6 aa, Mycobacterium
SSQLSQ

SEQ ID NO: 586472 - protein, 10 aa, Mycobacterium
SSQNDEVGQR

SEQ ID NO: 586473 - protein, 26 aa, Mycobacterium
SSQPCPPPSSVEGADPRIPDDPKGEM

SEQ ID NO: 586474 - protein, 11 aa, Mycobacterium
SSQPGVQTQRT

SEQ ID NO: 586475 - protein, 5 aa, Mycobacterium
SSQPV

SEQ ID NO: 586476 - protein, 4 aa, Mycobacterium
SSQQ

SEQ ID NO: 586477 - protein, 15 aa, Mycobacterium
SSQQAEIDTMQGMLD

SEQ ID NO: 586478 - protein, 10 aa, Mycobacterium
SSQQKAQDGK

SEQ ID NO: 586479 - protein, 21 aa, Mycobacterium
SSQQPDPALTDTAPPAFAEAG

SEQ ID NO: 586480 - protein, 15 aa, Mycobacterium
SSQQSEIDQMRAMLA

SEQ ID NO: 586481 - protein, 4 aa, Mycobacterium
SSQR

SEQ ID NO: 586482 - protein, 13 aa, Mycobacterium
SSQRGGFSGTGTY

SEQ ID NO: 586483 - protein, 6 aa, Mycobacterium
SSQRPV

SEQ ID NO: 586484 - protein, 5 aa, Mycobacterium
SSQSE

SEQ ID NO: 586485 - protein, 9 aa, Mycobacterium
SSQSGAPIS

SEQ ID NO: 586486 - protein, 6 aa, Mycobacterium
SSQSGG

SEQ ID NO: 586487 - protein, 7 aa, Mycobacterium
SSQSPFA

SEQ ID NO: 586488 - protein, 7 aa, Mycobacterium
SSQSQFA

SEQ ID NO: 586489 - protein, 5 aa, Mycobacterium
SSQTP

SEQ ID NO: 586490 - protein, 8 aa, Mycobacterium
SSQVSARR

SEQ ID NO: 586491 - protein, 14 aa, Mycobacterium
SSRAELGRRMDQPG

SEQ ID NO: 586492 - protein, 11 aa, Mycobacterium
SSRAEPYTTRT

SEQ ID NO: 586493 - protein, 7 aa, Mycobacterium
SSRAGYR

SEQ ID NO: 586494 - protein, 9 aa, Mycobacterium
SSRAIDPST

SEQ ID NO: 586495 - protein, 9 aa, Mycobacterium
SSRASATVK

SEQ ID NO: 586496 - protein, 15 aa, Mycobacterium
SSRATGNTVTLSTRS

SEQ ID NO: 586497 - protein, 7 aa, Mycobacterium
SSRCTNE

SEQ ID NO: 586498 - protein, 4 aa, Mycobacterium
SSRD

SEQ ID NO: 586499 - protein, 11 aa, Mycobacterium
SSRDAAEQDGG

SEQ ID NO: 586500 - protein, 5 aa, Mycobacterium
SSRDE

SEQ ID NO: 586501 - protein, 8 aa, Mycobacterium
SSRDGQNK

SEQ ID NO: 586502 - protein, 10 aa, Mycobacterium
SSRDPDPQAD

SEQ ID NO: 586503 - protein, 8 aa, Mycobacterium
SSRDTDRT

SEQ ID NO: 586504 - protein, 5 aa, Mycobacterium
SSRDV

SEQ ID NO: 586505 - protein, 6 aa, Mycobacterium
SSRDVN

SEQ ID NO: 586506 - protein, 4 aa, Mycobacterium
SSRE

SEQ ID NO: 586507 - protein, 7 aa, Mycobacterium
SSREAPY

SEQ ID NO: 586508 - protein, 8 aa, Mycobacterium
SSRELTRE

SEQ ID NO: 586509 - protein, 24 aa, Mycobacterium
SSRELTRRAGAGLRARGSVPRLAQ

SEQ ID NO: 586510 - protein, 20 aa, Mycobacterium
SSRENVDAYTGTGNSHSITA

SEQ ID NO: 586511 - protein, 8 aa, Mycobacterium
SSREPESL

SEQ ID NO: 586512 - protein, 8 aa, Mycobacterium
SSRETVNK

SEQ ID NO: 586513 - protein, 8 aa, Mycobacterium
SSRFNRPI

SEQ ID NO: 586514 - protein, 14 aa, Mycobacterium
SSRFPPGERLPSEA

SEQ ID NO: 586515 - protein, 13 aa, Mycobacterium
SSRFSKRPALPEG

SEQ ID NO: 586516 - protein, 4 aa, Mycobacterium
SSRG

SEQ ID NO: 586517 - protein, 13 aa, Mycobacterium
SSRGAPETRADSA

SEQ ID NO: 586518 - protein, 9 aa, Mycobacterium
SSRGEVPAA

SEQ ID NO: 586519 - protein, 9 aa, Mycobacterium
SSRGGNADH

SEQ ID NO: 586520 - protein, 8 aa, Mycobacterium
SSRGGQGL

SEQ ID NO: 586521 - protein, 9 aa, Mycobacterium
SSRGGSPVG

SEQ ID NO: 586522 - protein, 7 aa, Mycobacterium
SSRGHYE

SEQ ID NO: 586523 - protein, 5 aa, Mycobacterium
SSRGL

SEQ ID NO: 586524 - protein, 7 aa, Mycobacterium
SSRGPEH

SEQ ID NO: 586525 - protein, 36 aa, Mycobacterium
SSRGPTGDGRAKPDLVAPGERITSAAAGTRRSTVTN

SEQ ID NO: 586526 - protein, 7 aa, Mycobacterium
SSRGPVR

SEQ ID NO: 586527 - protein, 8 aa, Mycobacterium
SSRGRRLD

SEQ ID NO: 586528 - protein, 6 aa, Mycobacterium
SSRIGS

SEQ ID NO: 586529 - protein, 7 aa, Mycobacterium
SSRIRPP

SEQ ID NO: 586530 - protein, 13 aa, Mycobacterium
SSRISATVEGRPK

SEQ ID NO: 586531 - protein, 13 aa, Mycobacterium
SSRISGDSLEGVS

SEQ ID NO: 586532 - protein, 29 aa, Mycobacterium
SSRITERGATRGDDRVSEAAMEDRKREGY

SEQ ID NO: 586533 - protein, 8 aa, Mycobacterium
SSRKPERV

SEQ ID NO: 586534 - protein, 11 aa, Mycobacterium
SSRKSDACTAA

SEQ ID NO: 586535 - protein, 6 aa, Mycobacterium
SSRKTG

SEQ ID NO: 586536 - protein, 7 aa, Mycobacterium
SSRLDPA

SEQ ID NO: 586537 - protein, 12 aa, Mycobacterium
SSRLEDNVGNPM

SEQ ID NO: 586538 - protein, 6 aa, Mycobacterium
SSRLEE

SEQ ID NO: 586539 - protein, 4 aa, Mycobacterium
SSRM

SEQ ID NO: 586540 - protein, 14 aa, Mycobacterium
SSRMVGGSGALPAA

SEQ ID NO: 586541 - protein, 8 aa, Mycobacterium
SSRNGWNT

SEQ ID NO: 586542 - protein, 6 aa, Mycobacterium
SSRNRW

SEQ ID NO: 586543 - protein, 17 aa, Mycobacterium
SSRNRYLDKDQREQAGA

SEQ ID NO: 586544 - protein, 8 aa, Mycobacterium
SSRPAALQ

SEQ ID NO: 586545 - protein, 35 aa, Mycobacterium
SSRPAVSADAVETAAKRALSPFDGPTDGAPAENPY

SEQ ID NO: 586546 - protein, 14 aa, Mycobacterium
SSRPDREENDGGPD

SEQ ID NO: 586547 - protein, 5 aa, Mycobacterium
SSRPG

SEQ ID NO: 586548 - protein, 7 aa, Mycobacterium
SSRPGSF

SEQ ID NO: 586549 - protein, 8 aa, Mycobacterium
SSRPPLTD

SEQ ID NO: 586550 - protein, 7 aa, Mycobacterium
SSRPRTG

SEQ ID NO: 586551 - protein, 6 aa, Mycobacterium
SSRPTA

SEQ ID NO: 586552 - protein, 10 aa, Mycobacterium
SSRPTATYRS

SEQ ID NO: 586553 - protein, 35 aa, Mycobacterium
SSRPTISSEAVDAAAKQALKPFEGPTDGSAPENPY

SEQ ID NO: 586554 - protein, 35 aa, Mycobacterium
SSRPTVGDGAVEAAAKRALSPFEAPAGGGPGENPY

SEQ ID NO: 586555 - protein, 8 aa, Mycobacterium
SSRPVEDE

SEQ ID NO: 586556 - protein, 6 aa, Mycobacterium
SSRQKL

SEQ ID NO: 586557 - protein, 4 aa, Mycobacterium
SSRR

SEQ ID NO: 586558 - protein, 21 aa, Mycobacterium
SSRRAVADAGLTKEDIDGFGG

SEQ ID NO: 586559 - protein, 8 aa, Mycobacterium
SSRRDAAA

SEQ ID NO: 586560 - protein, 11 aa, Mycobacterium
SSRRDENTGDA

SEQ ID NO: 586561 - protein, 5 aa, Mycobacterium
SSRRI

SEQ ID NO: 586562 - protein, 14 aa, Mycobacterium
SSRRSISSMRPPIC

SEQ ID NO: 586563 - protein, 4 aa, Mycobacterium
SSRS

SEQ ID NO: 586564 - protein, 6 aa, Mycobacterium
SSRSAA

SEQ ID NO: 586565 - protein, 12 aa, Mycobacterium
SSRSAGPGTRAN

SEQ ID NO: 586566 - protein, 16 aa, Mycobacterium
SSRSDWSDNDDGLSPL

SEQ ID NO: 586567 - protein, 9 aa, Mycobacterium
SSRSEDFKE

SEQ ID NO: 586568 - protein, 6 aa, Mycobacterium
SSRSGD

SEQ ID NO: 586569 - protein, 6 aa, Mycobacterium
SSRSGQ

SEQ ID NO: 586570 - protein, 15 aa, Mycobacterium
SSRSLADQYDPEAMD

SEQ ID NO: 586571 - protein, 12 aa, Mycobacterium
SSRSMPATDHTG

SEQ ID NO: 586572 - protein, 8 aa, Mycobacterium
SSRSPGAY

SEQ ID NO: 586573 - protein, 9 aa, Mycobacterium
SSRSPKDLP

SEQ ID NO: 586574 - protein, 9 aa, Mycobacterium
SSRSPSDLP

SEQ ID NO: 586575 - protein, 5 aa, Mycobacterium
SSRSQ

SEQ ID NO: 586576 - protein, 9 aa, Mycobacterium
SSRSQGHNG

SEQ ID NO: 586577 - protein, 9 aa, Mycobacterium
SSRSTTLTE

SEQ ID NO: 586578 - protein, 7 aa, Mycobacterium
SSRSVTA

SEQ ID NO: 586579 - protein, 5 aa, Mycobacterium
SSRSW

SEQ ID NO: 586580 - protein, 5 aa, Mycobacterium
SSRTA

SEQ ID NO: 586581 - protein, 15 aa, Mycobacterium
SSRTATDFNPGIGAP

SEQ ID NO: 586582 - protein, 11 aa, Mycobacterium
SSRTDDTGGVE

SEQ ID NO: 586583 - protein, 7 aa, Mycobacterium
SSRTDPA

SEQ ID NO: 586584 - protein, 11 aa, Mycobacterium
SSRTDSATEAL

SEQ ID NO: 586585 - protein, 8 aa, Mycobacterium
SSRTDSAV

SEQ ID NO: 586586 - protein, 5 aa, Mycobacterium
SSRTG

SEQ ID NO: 586587 - protein, 5 aa, Mycobacterium
SSRTP

SEQ ID NO: 586588 - protein, 6 aa, Mycobacterium
SSRTPQ

SEQ ID NO: 586589 - protein, 6 aa, Mycobacterium
SSRTSR

SEQ ID NO: 586590 - protein, 5 aa, Mycobacterium
SSRTV

SEQ ID NO: 586591 - protein, 11 aa, Mycobacterium
SSRVGRKRTDL

SEQ ID NO: 586592 - protein, 11 aa, Mycobacterium
SSRVPATTAAR

SEQ ID NO: 586593 - protein, 8 aa, Mycobacterium
SSRVPSAE

SEQ ID NO: 586594 - protein, 8 aa, Mycobacterium
SSRVPSGM

SEQ ID NO: 586595 - protein, 6 aa, Mycobacterium
SSRVSQ

SEQ ID NO: 586596 - protein, 5 aa, Mycobacterium
SSRYE

SEQ ID NO: 586597 - protein, 14 aa, Mycobacterium
SSRYPELDGRWKVD

SEQ ID NO: 586598 - protein, 7 aa, Mycobacterium
SSSAAAL

SEQ ID NO: 586599 - protein, 6 aa, Mycobacterium
SSSAAD

SEQ ID NO: 586600 - protein, 9 aa, Mycobacterium
SSSAAERRR

SEQ ID NO: 586601 - protein, 6 aa, Mycobacterium
SSSAAN

SEQ ID NO: 586602 - protein, 8 aa, Mycobacterium
SSSAAQRE

SEQ ID NO: 586603 - protein, 9 aa, Mycobacterium
SSSAGADAR

SEQ ID NO: 586604 - protein, 23 aa, Mycobacterium
SSSAGLKGTGTDRAGGQAYTAAK

SEQ ID NO: 586605 - protein, 12 aa, Mycobacterium
SSSAKDFDSEVA

SEQ ID NO: 586606 - protein, 9 aa, Mycobacterium
SSSAKDRAA

SEQ ID NO: 586607 - protein, 8 aa, Mycobacterium
SSSANAHT

SEQ ID NO: 586608 - protein, 15 aa, Mycobacterium
SSSAPERDDTYDGAA

SEQ ID NO: 586609 - protein, 6 aa, Mycobacterium
SSSAQL

SEQ ID NO: 586610 - protein, 9 aa, Mycobacterium
SSSAQRGTP

SEQ ID NO: 586611 - protein, 9 aa, Mycobacterium
SSSARENKA

SEQ ID NO: 586612 - protein, 7 aa, Mycobacterium
SSSASHA

SEQ ID NO: 586613 - protein, 8 aa, Mycobacterium
SSSAVQSA

SEQ ID NO: 586614 - protein, 14 aa, Mycobacterium
SSSDAAQVRATAEA

SEQ ID NO: 586615 - protein, 13 aa, Mycobacterium
SSSDCRKRAEEQR

SEQ ID NO: 586616 - protein, 7 aa, Mycobacterium
SSSDGGA

SEQ ID NO: 586617 - protein, 22 aa, Mycobacterium
SSSDPAFDATDMETAAAQAVAD

SEQ ID NO: 586618 - protein, 8 aa, Mycobacterium
SSSDPAVG

SEQ ID NO: 586619 - protein, 9 aa, Mycobacterium
SSSDREFSG

SEQ ID NO: 586620 - protein, 5 aa, Mycobacterium
SSSDV

SEQ ID NO: 586621 - protein, 7 aa, Mycobacterium
SSSEAAR

SEQ ID NO: 586622 - protein, 9 aa, Mycobacterium
SSSEARRHR

SEQ ID NO: 586623 - protein, 26 aa, Mycobacterium
SSSEGAGLGTSTFTRSSGPVSMGPGR

SEQ ID NO: 586624 - protein, 24 aa, Mycobacterium
SSSELYGATPPPQNEDTPFYPRSP

SEQ ID NO: 586625 - protein, 5 aa, Mycobacterium
SSSEM

SEQ ID NO: 586626 - protein, 7 aa, Mycobacterium
SSSEPFK

SEQ ID NO: 586627 - protein, 10 aa, Mycobacterium
SSSEPSSSVD

SEQ ID NO: 586628 - protein, 7 aa, Mycobacterium
SSSGDCR

SEQ ID NO: 586629 - protein, 9 aa, Mycobacterium
SSSGDGEPF

SEQ ID NO: 586630 - protein, 5 aa, Mycobacterium
SSSGH

SEQ ID NO: 586631 - protein, 17 aa, Mycobacterium
SSSGKGQSKIDGPEDVA

SEQ ID NO: 586632 - protein, 17 aa, Mycobacterium
SSSGKGQSKLDGPADVE

SEQ ID NO: 586633 - protein, 8 aa, Mycobacterium
SSSGLGGA

SEQ ID NO: 586634 - protein, 16 aa, Mycobacterium
SSSGPEAGEALTTSPD

SEQ ID NO: 586635 - protein, 9 aa, Mycobacterium
SSSGPHDGV

SEQ ID NO: 586636 - protein, 9 aa, Mycobacterium
SSSGSEAAR

SEQ ID NO: 586637 - protein, 8 aa, Mycobacterium
SSSHDSDG

SEQ ID NO: 586638 - protein, 9 aa, Mycobacterium
SSSHPAASF

SEQ ID NO: 586639 - protein, 5 aa, Mycobacterium
SSSHR

SEQ ID NO: 586640 - protein, 12 aa, Mycobacterium
SSSIEYADQTDE

SEQ ID NO: 586641 - protein, 7 aa, Mycobacterium
SSSKVTR

SEQ ID NO: 586642 - protein, 4 aa, Mycobacterium
SSSL

SEQ ID NO: 586643 - protein, 21 aa, Mycobacterium
SSSLSGDRRTYQQEAGNSREA

SEQ ID NO: 586644 - protein, 20 aa, Mycobacterium
SSSLSGDRRTYQQESGNYRE

SEQ ID NO: 586645 - protein, 19 aa, Mycobacterium
SSSLTGDRRTYQQDAGNIR

SEQ ID NO: 586646 - protein, 4 aa, Mycobacterium
SSSM

SEQ ID NO: 586647 - protein, 5 aa, Mycobacterium
SSSME

SEQ ID NO: 586648 - protein, 5 aa, Mycobacterium
SSSMP

SEQ ID NO: 586649 - protein, 13 aa, Mycobacterium
SSSNIGSSTTTWA

SEQ ID NO: 586650 - protein, 11 aa, Mycobacterium
SSSNQYGSPQA

SEQ ID NO: 586651 - protein, 7 aa, Mycobacterium
SSSPADR

SEQ ID NO: 586652 - protein, 17 aa, Mycobacterium
SSSPAPAPTSTAMPGHN

SEQ ID NO: 586653 - protein, 11 aa, Mycobacterium
SSSPGASPELA

SEQ ID NO: 586654 - protein, 25 aa, Mycobacterium
SSSPGTLRSGSRGCCSKEDASDARR

SEQ ID NO: 586655 - protein, 9 aa, Mycobacterium
SSSPGTTPA

SEQ ID NO: 586656 - protein, 9 aa, Mycobacterium
SSSPKECPG

SEQ ID NO: 586657 - protein, 10 aa, Mycobacterium
SSSPKEHPGE

SEQ ID NO: 586658 - protein, 10 aa, Mycobacterium
SSSPKENPGE

SEQ ID NO: 586659 - protein, 10 aa, Mycobacterium
SSSPKQHPGE

SEQ ID NO: 586660 - protein, 13 aa, Mycobacterium
SSSPSTHFRLQRR

SEQ ID NO: 586661 - protein, 12 aa, Mycobacterium
SSSPTPEGAEQL

SEQ ID NO: 586662 - protein, 9 aa, Mycobacterium
SSSPTTDDR

SEQ ID NO: 586663 - protein, 6 aa, Mycobacterium
SSSQIY

SEQ ID NO: 586664 - protein, 5 aa, Mycobacterium
SSSQK

SEQ ID NO: 586665 - protein, 10 aa, Mycobacterium
SSSQPRPRAA

SEQ ID NO: 586666 - protein, 12 aa, Mycobacterium
SSSQQKAQDGKY

SEQ ID NO: 586667 - protein, 8 aa, Mycobacterium
SSSQTLYD

SEQ ID NO: 586668 - protein, 4 aa, Mycobacterium
SSSR

SEQ ID NO: 586669 - protein, 6 aa, Mycobacterium
SSSRAP

SEQ ID NO: 586670 - protein, 32 aa, Mycobacterium
SSSRKSGGDGAGPPGADAPTHRTTSTTRGAHA

SEQ ID NO: 586671 - protein, 7 aa, Mycobacterium
SSSRLEN

SEQ ID NO: 586672 - protein, 10 aa, Mycobacterium
SSSRPGASSI

SEQ ID NO: 586673 - protein, 7 aa, Mycobacterium
SSSRSAV

SEQ ID NO: 586674 - protein, 8 aa, Mycobacterium
SSSSAADI

SEQ ID NO: 586675 - protein, 7 aa, Mycobacterium
SSSSEVP

SEQ ID NO: 586676 - protein, 9 aa, Mycobacterium
SSSSHAEPG

SEQ ID NO: 586677 - protein, 9 aa, Mycobacterium
SSSSISGPF

SEQ ID NO: 586678 - protein, 15 aa, Mycobacterium
SSSSLTKSSPDSPHV

SEQ ID NO: 586679 - protein, 9 aa, Mycobacterium
SSSSPPYEG

SEQ ID NO: 586680 - protein, 20 aa, Mycobacterium
SSSSSAAGEQPEQESDEVGR

SEQ ID NO: 586681 - protein, 9 aa, Mycobacterium
SSSSTHSGV

SEQ ID NO: 586682 - protein, 7 aa, Mycobacterium
SSSTAES

SEQ ID NO: 586683 - protein, 10 aa, Mycobacterium
SSSTEGLRQT

SEQ ID NO: 586684 - protein, 8 aa, Mycobacterium
SSSTGEPA

SEQ ID NO: 586685 - protein, 5 aa, Mycobacterium
SSSTI

SEQ ID NO: 586686 - protein, 8 aa, Mycobacterium
SSSTLPTA

SEQ ID NO: 586687 - protein, 6 aa, Mycobacterium
SSSTLV

SEQ ID NO: 586688 - protein, 16 aa, Mycobacterium
SSSTRLSSPAGDPHTG

SEQ ID NO: 586689 - protein, 8 aa, Mycobacterium
SSSTSAPV

SEQ ID NO: 586690 - protein, 5 aa, Mycobacterium
SSSTW

SEQ ID NO: 586691 - protein, 5 aa, Mycobacterium
SSSTY

SEQ ID NO: 586692 - protein, 7 aa, Mycobacterium
SSSVDSS

SEQ ID NO: 586693 - protein, 15 aa, Mycobacterium
SSSVSPTTSPDAPFG

SEQ ID NO: 586694 - protein, 15 aa, Mycobacterium
SSSVYSRTRDAQPRA

SEQ ID NO: 586695 - protein, 7 aa, Mycobacterium
SSSYGAQ

SEQ ID NO: 586696 - protein, 6 aa, Mycobacterium
SSSYGQ

SEQ ID NO: 586697 - protein, 10 aa, Mycobacterium
SSSYNDPDEI

SEQ ID NO: 586698 - protein, 8 aa, Mycobacterium
SSTAAEAD

SEQ ID NO: 586699 - protein, 10 aa, Mycobacterium
SSTAATVSPA

SEQ ID NO: 586700 - protein, 5 aa, Mycobacterium
SSTAE

SEQ ID NO: 586701 - protein, 7 aa, Mycobacterium
SSTAPAV

SEQ ID NO: 586702 - protein, 8 aa, Mycobacterium
SSTAPSSG

SEQ ID NO: 586703 - protein, 7 aa, Mycobacterium
SSTARLA

SEQ ID NO: 586704 - protein, 9 aa, Mycobacterium
SSTASGVDA

SEQ ID NO: 586705 - protein, 5 aa, Mycobacterium
SSTAT

SEQ ID NO: 586706 - protein, 5 aa, Mycobacterium
SSTDE

SEQ ID NO: 586707 - protein, 5 aa, Mycobacterium
SSTDF

SEQ ID NO: 586708 - protein, 10 aa, Mycobacterium
SSTDLDPPGV

SEQ ID NO: 586709 - protein, 7 aa, Mycobacterium
SSTDRGD

SEQ ID NO: 586710 - protein, 15 aa, Mycobacterium
SSTDTAPSPADASAA

SEQ ID NO: 586711 - protein, 13 aa, Mycobacterium
SSTDVAADLVFTR

SEQ ID NO: 586712 - protein, 11 aa, Mycobacterium
SSTEEEGPAGS

SEQ ID NO: 586713 - protein, 8 aa, Mycobacterium
SSTEGNGV

SEQ ID NO: 586714 - protein, 8 aa, Mycobacterium
SSTENLPD

SEQ ID NO: 586715 - protein, 8 aa, Mycobacterium
SSTEPGDR

SEQ ID NO: 586716 - protein, 8 aa, Mycobacterium
SSTESGLG

SEQ ID NO: 586717 - protein, 6 aa, Mycobacterium
SSTESR

SEQ ID NO: 586718 - protein, 7 aa, Mycobacterium
SSTETET

SEQ ID NO: 586719 - protein, 7 aa, Mycobacterium
SSTFQPP

SEQ ID NO: 586720 - protein, 13 aa, Mycobacterium
SSTGAASDAHREP

SEQ ID NO: 586721 - protein, 7 aa, Mycobacterium
SSTGALA

SEQ ID NO: 586722 - protein, 15 aa, Mycobacterium
SSTGDAGERTLIPPD

SEQ ID NO: 586723 - protein, 18 aa, Mycobacterium
SSTGEYVTTYTDDGRIAG

SEQ ID NO: 586724 - protein, 11 aa, Mycobacterium
SSTGGQPPAAA

SEQ ID NO: 586725 - protein, 8 aa, Mycobacterium
SSTGPRQL

SEQ ID NO: 586726 - protein, 9 aa, Mycobacterium
SSTGRDESY

SEQ ID NO: 586727 - protein, 10 aa, Mycobacterium
SSTGRPSLPA

SEQ ID NO: 586728 - protein, 7 aa, Mycobacterium
SSTGTLA

SEQ ID NO: 586729 - protein, 6 aa, Mycobacterium
SSTGVP

SEQ ID NO: 586730 - protein, 8 aa, Mycobacterium
SSTGYGRR

SEQ ID NO: 586731 - protein, 5 aa, Mycobacterium
SSTHD

SEQ ID NO: 586732 - protein, 6 aa, Mycobacterium
SSTHER

SEQ ID NO: 586733 - protein, 4 aa, Mycobacterium
SSTI

SEQ ID NO: 586734 - protein, 15 aa, Mycobacterium
SSTISSANAAAAAPI

SEQ ID NO: 586735 - protein, 4 aa, Mycobacterium
SSTL

SEQ ID NO: 586736 - protein, 12 aa, Mycobacterium
SSTLSAEPSEAS

SEQ ID NO: 586737 - protein, 7 aa, Mycobacterium
SSTMVGG

SEQ ID NO: 586738 - protein, 23 aa, Mycobacterium
SSTNDSVTVRATDPRTSQVEEST

SEQ ID NO: 586739 - protein, 6 aa, Mycobacterium
SSTNDY

SEQ ID NO: 586740 - protein, 10 aa, Mycobacterium
SSTNPTNPYT

SEQ ID NO: 586741 - protein, 4 aa, Mycobacterium
SSTP

SEQ ID NO: 586742 - protein, 6 aa, Mycobacterium
SSTPAE

SEQ ID NO: 586743 - protein, 11 aa, Mycobacterium
SSTPAPLPAVS

SEQ ID NO: 586744 - protein, 17 aa, Mycobacterium
SSTPARTSGQTATVSTG

SEQ ID NO: 586745 - protein, 11 aa, Mycobacterium
SSTPEARPDGT

SEQ ID NO: 586746 - protein, 6 aa, Mycobacterium
SSTPEG

SEQ ID NO: 586747 - protein, 8 aa, Mycobacterium
SSTPERLE

SEQ ID NO: 586748 - protein, 5 aa, Mycobacterium
SSTPM

SEQ ID NO: 586749 - protein, 14 aa, Mycobacterium
SSTPPGEHASSLLD

SEQ ID NO: 586750 - protein, 13 aa, Mycobacterium
SSTPPLEPDDPLN

SEQ ID NO: 586751 - protein, 7 aa, Mycobacterium
SSTPQRT

SEQ ID NO: 586752 - protein, 6 aa, Mycobacterium
SSTPRY

SEQ ID NO: 586753 - protein, 9 aa, Mycobacterium
SSTPSCGDS

SEQ ID NO: 586754 - protein, 25 aa, Mycobacterium
SSTPSTLQSLASPSAATASTTPISD

SEQ ID NO: 586755 - protein, 13 aa, Mycobacterium
SSTPVSEWTPGAY

SEQ ID NO: 586756 - protein, 4 aa, Mycobacterium
SSTQ

SEQ ID NO: 586757 - protein, 9 aa, Mycobacterium
SSTQDTSSR

SEQ ID NO: 586758 - protein, 11 aa, Mycobacterium
SSTQGWERNPE

SEQ ID NO: 586759 - protein, 11 aa, Mycobacterium
SSTQGWRDNPE

SEQ ID NO: 586760 - protein, 11 aa, Mycobacterium
SSTQGWRDNPQ

SEQ ID NO: 586761 - protein, 9 aa, Mycobacterium
SSTQPPVEA

SEQ ID NO: 586762 - protein, 13 aa, Mycobacterium
SSTRNYTGRMGST

SEQ ID NO: 586763 - protein, 6 aa, Mycobacterium
SSTRQL

SEQ ID NO: 586764 - protein, 8 aa, Mycobacterium
SSTRSPDV

SEQ ID NO: 586765 - protein, 8 aa, Mycobacterium
SSTSAADI

SEQ ID NO: 586766 - protein, 8 aa, Mycobacterium
SSTSAEQL

SEQ ID NO: 586767 - protein, 7 aa, Mycobacterium
SSTSFGG

SEQ ID NO: 586768 - protein, 16 aa, Mycobacterium
SSTSGVRRSDKTRGVR

SEQ ID NO: 586769 - protein, 13 aa, Mycobacterium
SSTSIGAEDPEFE

SEQ ID NO: 586770 - protein, 31 aa, Mycobacterium
SSTSQAASTAATTIDTQPPRTEQAPPAADGT

SEQ ID NO: 586771 - protein, 7 aa, Mycobacterium
SSTSRVR

SEQ ID NO: 586772 - protein, 6 aa, Mycobacterium
SSTSST

SEQ ID NO: 586773 - protein, 16 aa, Mycobacterium
SSTSWRPRNPTPRYPA

SEQ ID NO: 586774 - protein, 6 aa, Mycobacterium
SSTTLA

SEQ ID NO: 586775 - protein, 7 aa, Mycobacterium
SSTTQAI

SEQ ID NO: 586776 - protein, 10 aa, Mycobacterium
SSTTQPGDRK

SEQ ID NO: 586777 - protein, 5 aa, Mycobacterium
SSTTT

SEQ ID NO: 586778 - protein, 7 aa, Mycobacterium
SSTTWPK

SEQ ID NO: 586779 - protein, 7 aa, Mycobacterium
SSTTWPN

SEQ ID NO: 586780 - protein, 6 aa, Mycobacterium
SSTWEG

SEQ ID NO: 586781 - protein, 18 aa, Mycobacterium
SSTYAPAPQRFEAGTPMT

SEQ ID NO: 586782 - protein, 6 aa, Mycobacterium
SSTYRG

SEQ ID NO: 586783 - protein, 13 aa, Mycobacterium
SSTYSSAASAARE

SEQ ID NO: 586784 - protein, 7 aa, Mycobacterium
SSTYTYD

SEQ ID NO: 586785 - protein, 5 aa, Mycobacterium
SSTYV

SEQ ID NO: 586786 - protein, 5 aa, Mycobacterium
SSVAE

SEQ ID NO: 586787 - protein, 12 aa, Mycobacterium
SSVAETEITEQL

SEQ ID NO: 586788 - protein, 5 aa, Mycobacterium
SSVAG

SEQ ID NO: 586789 - protein, 14 aa, Mycobacterium
SSVAGYSDSPTAEA

SEQ ID NO: 586790 - protein, 14 aa, Mycobacterium
SSVAGYSESASAEA

SEQ ID NO: 586791 - protein, 7 aa, Mycobacterium
SSVAKGT

SEQ ID NO: 586792 - protein, 8 aa, Mycobacterium
SSVAPEEL

SEQ ID NO: 586793 - protein, 8 aa, Mycobacterium
SSVAPRYE

SEQ ID NO: 586794 - protein, 6 aa, Mycobacterium
SSVASG

SEQ ID NO: 586795 - protein, 10 aa, Mycobacterium
SSVATPEQLE

SEQ ID NO: 586796 - protein, 15 aa, Mycobacterium
SSVDGGAGGAGGDAG

SEQ ID NO: 586797 - protein, 17 aa, Mycobacterium
SSVDGRSAAADGSSQWI

SEQ ID NO: 586798 - protein, 16 aa, Mycobacterium
SSVDGRSAAADGTSQW

SEQ ID NO: 586799 - protein, 14 aa, Mycobacterium
SSVDGSPTRPARAG

SEQ ID NO: 586800 - protein, 11 aa, Mycobacterium
SSVDKGLAKDD

SEQ ID NO: 586801 - protein, 8 aa, Mycobacterium
SSVDPDHA

SEQ ID NO: 586802 - protein, 19 aa, Mycobacterium
SSVDPHDFEPSPSDAAKFE

SEQ ID NO: 586803 - protein, 6 aa, Mycobacterium
SSVEER

SEQ ID NO: 586804 - protein, 12 aa, Mycobacterium
SSVEQKPYTRRP

SEQ ID NO: 586805 - protein, 14 aa, Mycobacterium
SSVERRGKNAEDDA

SEQ ID NO: 586806 - protein, 13 aa, Mycobacterium
SSVERRGKNAEQD

SEQ ID NO: 586807 - protein, 10 aa, Mycobacterium
SSVERTPAGR

SEQ ID NO: 586808 - protein, 8 aa, Mycobacterium
SSVESGPR

SEQ ID NO: 586809 - protein, 12 aa, Mycobacterium
SSVESGTEIDSR

SEQ ID NO: 586810 - protein, 4 aa, Mycobacterium
SSVG

SEQ ID NO: 586811 - protein, 24 aa, Mycobacterium
SSVGDTAVDPSPARLKDGSNPYVE

SEQ ID NO: 586812 - protein, 10 aa, Mycobacterium
SSVGEPPACG

SEQ ID NO: 586813 - protein, 8 aa, Mycobacterium
SSVGQSDA

SEQ ID NO: 586814 - protein, 6 aa, Mycobacterium
SSVGSA

SEQ ID NO: 586815 - protein, 40 aa, Mycobacterium
SSVGSDSNVGSGNLGSHNFGNGNTGSSNIGSGNIGDTNRG

SEQ ID NO: 586816 - protein, 6 aa, Mycobacterium
SSVGTR

SEQ ID NO: 586817 - protein, 6 aa, Mycobacterium
SSVGTT

SEQ ID NO: 586818 - protein, 11 aa, Mycobacterium
SSVGVSGERDA

SEQ ID NO: 586819 - protein, 6 aa, Mycobacterium
SSVHRH

SEQ ID NO: 586820 - protein, 26 aa, Mycobacterium
SSVIGDQQARVDAAHESVESAQGALD

SEQ ID NO: 586821 - protein, 6 aa, Mycobacterium
SSVKSS

SEQ ID NO: 586822 - protein, 7 aa, Mycobacterium
SSVLGSG

SEQ ID NO: 586823 - protein, 10 aa, Mycobacterium
SSVLTTPTIN

SEQ ID NO: 586824 - protein, 4 aa, Mycobacterium
SSVN

SEQ ID NO: 586825 - protein, 21 aa, Mycobacterium
SSVNQDGASSGLTVPNGGAQQ

SEQ ID NO: 586826 - protein, 6 aa, Mycobacterium
SSVNRS

SEQ ID NO: 586827 - protein, 4 aa, Mycobacterium
SSVP

SEQ ID NO: 586828 - protein, 9 aa, Mycobacterium
SSVPDEVGA

SEQ ID NO: 586829 - protein, 5 aa, Mycobacterium
SSVPF

SEQ ID NO: 586830 - protein, 7 aa, Mycobacterium
SSVPPGR

SEQ ID NO: 586831 - protein, 12 aa, Mycobacterium
SSVPSGGQARRV

SEQ ID NO: 586832 - protein, 24 aa, Mycobacterium
SSVPVESSAMPEQEPEVPASNPVV

SEQ ID NO: 586833 - protein, 5 aa, Mycobacterium
SSVQE

SEQ ID NO: 586834 - protein, 12 aa, Mycobacterium
SSVQHTDEDDAG

SEQ ID NO: 586835 - protein, 4 aa, Mycobacterium
SSVR

SEQ ID NO: 586836 - protein, 8 aa, Mycobacterium
SSVRGAEL

SEQ ID NO: 586837 - protein, 7 aa, Mycobacterium
SSVRGDE

SEQ ID NO: 586838 - protein, 15 aa, Mycobacterium
SSVRRALDTGKTAGE

SEQ ID NO: 586839 - protein, 18 aa, Mycobacterium
SSVSAADLAQGGATPRIA

SEQ ID NO: 586840 - protein, 17 aa, Mycobacterium
SSVSAVTGKLSGGNQQK

SEQ ID NO: 586841 - protein, 10 aa, Mycobacterium
SSVSGVEPER

SEQ ID NO: 586842 - protein, 16 aa, Mycobacterium
SSVSKPRSKPEPDPAE

SEQ ID NO: 586843 - protein, 17 aa, Mycobacterium
SSVSPAEATDVEAAPIQ

SEQ ID NO: 586844 - protein, 13 aa, Mycobacterium
SSVTDPATGRTSA

SEQ ID NO: 586845 - protein, 8 aa, Mycobacterium
SSVTEPQV

SEQ ID NO: 586846 - protein, 16 aa, Mycobacterium
SSVTFDGDEQARSRPI

SEQ ID NO: 586847 - protein, 11 aa, Mycobacterium
SSVTGGQRPFG

SEQ ID NO: 586848 - protein, 7 aa, Mycobacterium
SSVTGRA

SEQ ID NO: 586849 - protein, 8 aa, Mycobacterium
SSVTKDAA

SEQ ID NO: 586850 - protein, 10 aa, Mycobacterium
SSVTKDAATD

SEQ ID NO: 586851 - protein, 8 aa, Mycobacterium
SSVTPSLS

SEQ ID NO: 586852 - protein, 6 aa, Mycobacterium
SSVTQD

SEQ ID NO: 586853 - protein, 10 aa, Mycobacterium
SSVTSRASDI

SEQ ID NO: 586854 - protein, 7 aa, Mycobacterium
SSVTSSL

SEQ ID NO: 586855 - protein, 4 aa, Mycobacterium
SSVV

SEQ ID NO: 586856 - protein, 18 aa, Mycobacterium
SSVVETERPEPPTAKTSW

SEQ ID NO: 586857 - protein, 6 aa, Mycobacterium
SSWAGK

SEQ ID NO: 586858 - protein, 5 aa, Mycobacterium
SSWDD

SEQ ID NO: 586859 - protein, 5 aa, Mycobacterium
SSWDG

SEQ ID NO: 586860 - protein, 6 aa, Mycobacterium
SSWEDY

SEQ ID NO: 586861 - protein, 6 aa, Mycobacterium
SSWGPT

SEQ ID NO: 586862 - protein, 13 aa, Mycobacterium
SSWPPDGRPPGPK

SEQ ID NO: 586863 - protein, 15 aa, Mycobacterium
SSWPPDGRSPAGAVI

SEQ ID NO: 586864 - protein, 5 aa, Mycobacterium
SSWPT

SEQ ID NO: 586865 - protein, 4 aa, Mycobacterium
SSWT

SEQ ID NO: 586866 - protein, 8 aa, Mycobacterium
SSWTGGAS

SEQ ID NO: 586867 - protein, 11 aa, Mycobacterium
SSWTTDAPYRE

SEQ ID NO: 586868 - protein, 7 aa, Mycobacterium
SSYAPEE

SEQ ID NO: 586869 - protein, 7 aa, Mycobacterium
SSYAPMG

SEQ ID NO: 586870 - protein, 6 aa, Mycobacterium
SSYCSG

SEQ ID NO: 586871 - protein, 4 aa, Mycobacterium
SSYD

SEQ ID NO: 586872 - protein, 9 aa, Mycobacterium
SSYDPGRHN

SEQ ID NO: 586873 - protein, 6 aa, Mycobacterium
SSYERG

SEQ ID NO: 586874 - protein, 4 aa, Mycobacterium
SSYG

SEQ ID NO: 586875 - protein, 14 aa, Mycobacterium
SSYGTGSGKDAITS

SEQ ID NO: 586876 - protein, 14 aa, Mycobacterium
SSYGTGVGKDAITS

SEQ ID NO: 586877 - protein, 11 aa, Mycobacterium
SSYHNPDQLPA

SEQ ID NO: 586878 - protein, 19 aa, Mycobacterium
SSYPSPGSAAAVSKAHTNL

SEQ ID NO: 586879 - protein, 4 aa, Mycobacterium
SSYQ

SEQ ID NO: 586880 - protein, 7 aa, Mycobacterium
SSYQEAA

SEQ ID NO: 586881 - protein, 8 aa, Mycobacterium
SSYQRGAP

SEQ ID NO: 586882 - protein, 6 aa, Mycobacterium
SSYRAG

SEQ ID NO: 586883 - protein, 7 aa, Mycobacterium
SSYRGSK

SEQ ID NO: 586884 - protein, 10 aa, Mycobacterium
SSYRPTPDAN

SEQ ID NO: 586885 - protein, 9 aa, Mycobacterium
SSYSDKPGT

SEQ ID NO: 586886 - protein, 11 aa, Mycobacterium
SSYSDKPGTIV

SEQ ID NO: 586887 - protein, 9 aa, Mycobacterium
SSYSDKTGT

SEQ ID NO: 586888 - protein, 9 aa, Mycobacterium
SSYSDRPGT

SEQ ID NO: 586889 - protein, 7 aa, Mycobacterium
SSYSGTE

SEQ ID NO: 586890 - protein, 5 aa, Mycobacterium
SSYSL

SEQ ID NO: 586891 - protein, 9 aa, Mycobacterium
SSYTAEEIT

SEQ ID NO: 586892 - protein, 11 aa, Mycobacterium
SSYTDKPGTIV

SEQ ID NO: 586893 - protein, 5 aa, Mycobacterium
SSYTN

SEQ ID NO: 586894 - protein, 5 aa, Mycobacterium
SSYTP

SEQ ID NO: 586895 - protein, 13 aa, Mycobacterium
SSYTPQPDTHGRS

SEQ ID NO: 586896 - protein, 11 aa, Mycobacterium
SSYTRGTPAQF

SEQ ID NO: 586897 - protein, 5 aa, Mycobacterium
SSYTT

SEQ ID NO: 586898 - protein, 6 aa, Mycobacterium
SSYVTG

SEQ ID NO: 586899 - protein, 4 aa, Mycobacterium
SSYY

SEQ ID NO: 586900 - protein, 14 aa, Mycobacterium
STAAAAGKSAAAFS

SEQ ID NO: 586901 - protein, 10 aa, Mycobacterium
STAAAASTTN

SEQ ID NO: 586902 - protein, 8 aa, Mycobacterium
STAAASYG

SEQ ID NO: 586903 - protein, 7 aa, Mycobacterium
STAADEP

SEQ ID NO: 586904 - protein, 8 aa, Mycobacterium
STAADSNA

SEQ ID NO: 586905 - protein, 6 aa, Mycobacterium
STAADV

SEQ ID NO: 586906 - protein, 13 aa, Mycobacterium
STAAGRRDRADEV

SEQ ID NO: 586907 - protein, 11 aa, Mycobacterium
STAAGSAEATV

SEQ ID NO: 586908 - protein, 7 aa, Mycobacterium
STAAGSG

SEQ ID NO: 586909 - protein, 12 aa, Mycobacterium
STAALPGLRGSE

SEQ ID NO: 586910 - protein, 9 aa, Mycobacterium
STAALSSAR

SEQ ID NO: 586911 - protein, 12 aa, Mycobacterium
STAANAAPGLPT

SEQ ID NO: 586912 - protein, 10 aa, Mycobacterium
STAAPAAQAT

SEQ ID NO: 586913 - protein, 9 aa, Mycobacterium
STAAPGARF

SEQ ID NO: 586914 - protein, 6 aa, Mycobacterium
STAAQP

SEQ ID NO: 586915 - protein, 12 aa, Mycobacterium
STAAQQAGGGRA

SEQ ID NO: 586916 - protein, 8 aa, Mycobacterium
STAAQRAE

SEQ ID NO: 586917 - protein, 9 aa, Mycobacterium
STAARASAP

SEQ ID NO: 586918 - protein, 6 aa, Mycobacterium
STAARL

SEQ ID NO: 586919 - protein, 36 aa, Mycobacterium
STAARQAGITRDTPDPKGANYGRDANGDLDGTAEET

SEQ ID NO: 586920 - protein, 24 aa, Mycobacterium
STAASAEAAASTSAEDVRTGMSSE

SEQ ID NO: 586921 - protein, 15 aa, Mycobacterium
STAASNMAASLKVST

SEQ ID NO: 586922 - protein, 5 aa, Mycobacterium
STAAT

SEQ ID NO: 586923 - protein, 6 aa, Mycobacterium
STAATG

SEQ ID NO: 586924 - protein, 14 aa, Mycobacterium
STAATTLSGDSAAL

SEQ ID NO: 586925 - protein, 6 aa, Mycobacterium
STAATV

SEQ ID NO: 586926 - protein, 10 aa, Mycobacterium
STAAYNGSPA

SEQ ID NO: 586927 - protein, 10 aa, Mycobacterium
STAAYNGTPA

SEQ ID NO: 586928 - protein, 8 aa, Mycobacterium
STAAYQTG

SEQ ID NO: 586929 - protein, 12 aa, Mycobacterium
STADAPRGQRFA

SEQ ID NO: 586930 - protein, 10 aa, Mycobacterium
STADDTTKTV

SEQ ID NO: 586931 - protein, 10 aa, Mycobacterium
STADFSGTTL

SEQ ID NO: 586932 - protein, 9 aa, Mycobacterium
STADGGDEL

SEQ ID NO: 586933 - protein, 11 aa, Mycobacterium
STADGRADAAA

SEQ ID NO: 586934 - protein, 6 aa, Mycobacterium
STADLP

SEQ ID NO: 586935 - protein, 6 aa, Mycobacterium
STADPT

SEQ ID NO: 586936 - protein, 6 aa, Mycobacterium
STADQR

SEQ ID NO: 586937 - protein, 5 aa, Mycobacterium
STADS

SEQ ID NO: 586938 - protein, 8 aa, Mycobacterium
STADTASR

SEQ ID NO: 586939 - protein, 10 aa, Mycobacterium
STADTRSNWD

SEQ ID NO: 586940 - protein, 7 aa, Mycobacterium
STADTVA

SEQ ID NO: 586941 - protein, 24 aa, Mycobacterium
STADTVGPVAPGQTVTAAPGSTIT

SEQ ID NO: 586942 - protein, 5 aa, Mycobacterium
STADV

SEQ ID NO: 586943 - protein, 6 aa, Mycobacterium
STADVQ

SEQ ID NO: 586944 - protein, 15 aa, Mycobacterium
STADYSGASAAVGSM

SEQ ID NO: 586945 - protein, 11 aa, Mycobacterium
STAEAADIDET

SEQ ID NO: 586946 - protein, 9 aa, Mycobacterium
STAEAHREQ

SEQ ID NO: 586947 - protein, 7 aa, Mycobacterium
STAEDGA

SEQ ID NO: 586948 - protein, 10 aa, Mycobacterium
STAEDPGGRM

SEQ ID NO: 586949 - protein, 18 aa, Mycobacterium
STAEEEVYTGPLESAQTL

SEQ ID NO: 586950 - protein, 11 aa, Mycobacterium
STAEGKDDIGI

SEQ ID NO: 586951 - protein, 6 aa, Mycobacterium
STAEGY

SEQ ID NO: 586952 - protein, 6 aa, Mycobacterium
STAEHG

SEQ ID NO: 586953 - protein, 9 aa, Mycobacterium
STAEPSIPM

SEQ ID NO: 586954 - protein, 8 aa, Mycobacterium
STAEQGAE

SEQ ID NO: 586955 - protein, 7 aa, Mycobacterium
STAEQLG

SEQ ID NO: 586956 - protein, 6 aa, Mycobacterium
STAESR

SEQ ID NO: 586957 - protein, 5 aa, Mycobacterium
STAEV

SEQ ID NO: 586958 - protein, 9 aa, Mycobacterium
STAFPASAE

SEQ ID NO: 586959 - protein, 4 aa, Mycobacterium
STAG

SEQ ID NO: 586960 - protein, 22 aa, Mycobacterium
STAGAAGDLGAGSDVSGAPGIR

SEQ ID NO: 586961 - protein, 15 aa, Mycobacterium
STAGADPQTAPPIEG

SEQ ID NO: 586962 - protein, 6 aa, Mycobacterium
STAGDE

SEQ ID NO: 586963 - protein, 10 aa, Mycobacterium
STAGDERTRV

SEQ ID NO: 586964 - protein, 9 aa, Mycobacterium
STAGDGATA

SEQ ID NO: 586965 - protein, 11 aa, Mycobacterium
STAGDGESAIA

SEQ ID NO: 586966 - protein, 8 aa, Mycobacterium
STAGDTAS

SEQ ID NO: 586967 - protein, 9 aa, Mycobacterium
STAGEHAAA

SEQ ID NO: 586968 - protein, 14 aa, Mycobacterium
STAGFAEGHPLPLG

SEQ ID NO: 586969 - protein, 19 aa, Mycobacterium
STAGLKGFGGSQGGGLGYA

SEQ ID NO: 586970 - protein, 6 aa, Mycobacterium
STAGNE

SEQ ID NO: 586971 - protein, 6 aa, Mycobacterium
STAGNI

SEQ ID NO: 586972 - protein, 7 aa, Mycobacterium
STAGNSI

SEQ ID NO: 586973 - protein, 6 aa, Mycobacterium
STAGNV

SEQ ID NO: 586974 - protein, 7 aa, Mycobacterium
STAGNVG

SEQ ID NO: 586975 - protein, 6 aa, Mycobacterium
STAGQP

SEQ ID NO: 586976 - protein, 12 aa, Mycobacterium
STAGQPGQNSIE

SEQ ID NO: 586977 - protein, 19 aa, Mycobacterium
STAGRGWPEDEPVQAGGQL

SEQ ID NO: 586978 - protein, 14 aa, Mycobacterium
STAGRSLATGNAPQ

SEQ ID NO: 586979 - protein, 5 aa, Mycobacterium
STAGT

SEQ ID NO: 586980 - protein, 7 aa, Mycobacterium
STAGTGY

SEQ ID NO: 586981 - protein, 16 aa, Mycobacterium
STAGYHPFPGQAGYAA

SEQ ID NO: 586982 - protein, 17 aa, Mycobacterium
STAGYQPFPGQAGYAAT

SEQ ID NO: 586983 - protein, 9 aa, Mycobacterium
STAHAAGRN

SEQ ID NO: 586984 - protein, 8 aa, Mycobacterium
STAHDGNE

SEQ ID NO: 586985 - protein, 7 aa, Mycobacterium
STAHRHD

SEQ ID NO: 586986 - protein, 5 aa, Mycobacterium
STAHT

SEQ ID NO: 586987 - protein, 10 aa, Mycobacterium
STAHTGAQGM

SEQ ID NO: 586988 - protein, 10 aa, Mycobacterium
STAKKIDGKY

SEQ ID NO: 586989 - protein, 11 aa, Mycobacterium
STAKSRDGWDS

SEQ ID NO: 586990 - protein, 14 aa, Mycobacterium
STALASDARKNLGS

SEQ ID NO: 586991 - protein, 10 aa, Mycobacterium
STALASPHPD

SEQ ID NO: 586992 - protein, 14 aa, Mycobacterium
STALATADRLGKQG

SEQ ID NO: 586993 - protein, 15 aa, Mycobacterium
STALGTALEKGSEPI

SEQ ID NO: 586994 - protein, 7 aa, Mycobacterium
STALPAN

SEQ ID NO: 586995 - protein, 5 aa, Mycobacterium
STALR

SEQ ID NO: 586996 - protein, 7 aa, Mycobacterium
STALSGG

SEQ ID NO: 586997 - protein, 5 aa, Mycobacterium
STALT

SEQ ID NO: 586998 - protein, 6 aa, Mycobacterium
STALYP

SEQ ID NO: 586999 - protein, 4 aa, Mycobacterium
STAM

SEQ ID NO: 587000 - protein, 4 aa, Mycobacterium
STAN

SEQ ID NO: 587001 - protein, 10 aa, Mycobacterium
STANDPAEAL

SEQ ID NO: 587002 - protein, 5 aa, Mycobacterium
STAPA

SEQ ID NO: 587003 - protein, 10 aa, Mycobacterium
STAPAGSAYD

SEQ ID NO: 587004 - protein, 15 aa, Mycobacterium
STAPASAASGGGLGS

SEQ ID NO: 587005 - protein, 7 aa, Mycobacterium
STAPDAS

SEQ ID NO: 587006 - protein, 5 aa, Mycobacterium
STAPE

SEQ ID NO: 587007 - protein, 7 aa, Mycobacterium
STAPFSD

SEQ ID NO: 587008 - protein, 5 aa, Mycobacterium
STAPG

SEQ ID NO: 587009 - protein, 21 aa, Mycobacterium
STAPGDPVTGVSNGADGLTGR

SEQ ID NO: 587010 - protein, 7 aa, Mycobacterium
STAPGNW

SEQ ID NO: 587011 - protein, 8 aa, Mycobacterium
STAPGVAT

SEQ ID NO: 587012 - protein, 13 aa, Mycobacterium
STAPHTVPPAEGG

SEQ ID NO: 587013 - protein, 14 aa, Mycobacterium
STAPNGKESSADVT

SEQ ID NO: 587014 - protein, 11 aa, Mycobacterium
STAPPKRSTAD

SEQ ID NO: 587015 - protein, 10 aa, Mycobacterium
STAPPLPGRP

SEQ ID NO: 587016 - protein, 8 aa, Mycobacterium
STAPQGAA

SEQ ID NO: 587017 - protein, 4 aa, Mycobacterium
STAQ

SEQ ID NO: 587018 - protein, 7 aa, Mycobacterium
STAQTTT

SEQ ID NO: 587019 - protein, 14 aa, Mycobacterium
STAQVEGGDLLVVV

SEQ ID NO: 587020 - protein, 5 aa, Mycobacterium
STARE

SEQ ID NO: 587021 - protein, 6 aa, Mycobacterium
STARQW

SEQ ID NO: 587022 - protein, 8 aa, Mycobacterium
STARREGP

SEQ ID NO: 587023 - protein, 10 aa, Mycobacterium
STARTEDQRE

SEQ ID NO: 587024 - protein, 4 aa, Mycobacterium
STAS

SEQ ID NO: 587025 - protein, 7 aa, Mycobacterium
STASADH

SEQ ID NO: 587026 - protein, 18 aa, Mycobacterium
STASAETRSEVDRALLAL

SEQ ID NO: 587027 - protein, 30 aa, Mycobacterium
STASGDPVAAVTGGSDGLSGSVTSVAGAAE

SEQ ID NO: 587028 - protein, 15 aa, Mycobacterium
STASGLAADADSVAY

SEQ ID NO: 587029 - protein, 13 aa, Mycobacterium
STASGMAVPADSA

SEQ ID NO: 587030 - protein, 8 aa, Mycobacterium
STASGTSI

SEQ ID NO: 587031 - protein, 6 aa, Mycobacterium
STASLD

SEQ ID NO: 587032 - protein, 7 aa, Mycobacterium
STASQAM

SEQ ID NO: 587033 - protein, 7 aa, Mycobacterium
STASRSV

SEQ ID NO: 587034 - protein, 15 aa, Mycobacterium
STASRSVTLSGRPVN

SEQ ID NO: 587035 - protein, 15 aa, Mycobacterium
STASSPGSWNAVGAR

SEQ ID NO: 587036 - protein, 7 aa, Mycobacterium
STASSQL

SEQ ID NO: 587037 - protein, 5 aa, Mycobacterium
STATA

SEQ ID NO: 587038 - protein, 7 aa, Mycobacterium
STATAEF

SEQ ID NO: 587039 - protein, 5 aa, Mycobacterium
STATE

SEQ ID NO: 587040 - protein, 7 aa, Mycobacterium
STATELA

SEQ ID NO: 587041 - protein, 9 aa, Mycobacterium
STATGNRTG

SEQ ID NO: 587042 - protein, 7 aa, Mycobacterium
STATGRK

SEQ ID NO: 587043 - protein, 7 aa, Mycobacterium
STATGRQ

SEQ ID NO: 587044 - protein, 8 aa, Mycobacterium
STATGRQL

SEQ ID NO: 587045 - protein, 8 aa, Mycobacterium
STATGRTL

SEQ ID NO: 587046 - protein, 11 aa, Mycobacterium
STATNEAGLSG

SEQ ID NO: 587047 - protein, 19 aa, Mycobacterium
STATPAPGHVKKMAGWVAR

SEQ ID NO: 587048 - protein, 9 aa, Mycobacterium
STATQASLA

SEQ ID NO: 587049 - protein, 9 aa, Mycobacterium
STATSTRTV

SEQ ID NO: 587050 - protein, 9 aa, Mycobacterium
STATSTSKF

SEQ ID NO: 587051 - protein, 9 aa, Mycobacterium
STATVAPPV

SEQ ID NO: 587052 - protein, 6 aa, Mycobacterium
STATYV

SEQ ID NO: 587053 - protein, 4 aa, Mycobacterium
STAV

SEQ ID NO: 587054 - protein, 21 aa, Mycobacterium
STAVDRGDRPTEDVVINSITI

SEQ ID NO: 587055 - protein, 6 aa, Mycobacterium
STAVED

SEQ ID NO: 587056 - protein, 5 aa, Mycobacterium
STAVG

SEQ ID NO: 587057 - protein, 16 aa, Mycobacterium
STAVGRSASAKEVSAV

SEQ ID NO: 587058 - protein, 8 aa, Mycobacterium
STAVPDLD

SEQ ID NO: 587059 - protein, 9 aa, Mycobacterium
STAVRPSYG

SEQ ID NO: 587060 - protein, 8 aa, Mycobacterium
STAVSGLE

SEQ ID NO: 587061 - protein, 8 aa, Mycobacterium
STAVTGTA

SEQ ID NO: 587062 - protein, 12 aa, Mycobacterium
STAYAENAQGEV

SEQ ID NO: 587063 - protein, 11 aa, Mycobacterium
STAYGSSGKVY

SEQ ID NO: 587064 - protein, 7 aa, Mycobacterium
STCDKQT

SEQ ID NO: 587065 - protein, 7 aa, Mycobacterium
STCTEAR

SEQ ID NO: 587066 - protein, 14 aa, Mycobacterium
STDADDVAGALAGA

SEQ ID NO: 587067 - protein, 17 aa, Mycobacterium
STDADGAPEQSTPDEVG

SEQ ID NO: 587068 - protein, 8 aa, Mycobacterium
STDADGGA

SEQ ID NO: 587069 - protein, 9 aa, Mycobacterium
STDADGGPA

SEQ ID NO: 587070 - protein, 26 aa, Mycobacterium
STDADKKSDSVTKDSSDLNTAAPTGA

SEQ ID NO: 587071 - protein, 5 aa, Mycobacterium
STDAF

SEQ ID NO: 587072 - protein, 7 aa, Mycobacterium
STDAGRS

SEQ ID NO: 587073 - protein, 6 aa, Mycobacterium
STDANG

SEQ ID NO: 587074 - protein, 19 aa, Mycobacterium
STDAPLALPGGDAAPSDVD

SEQ ID NO: 587075 - protein, 18 aa, Mycobacterium
STDAPLALPTAPPTDVDT

SEQ ID NO: 587076 - protein, 6 aa, Mycobacterium
STDAPT

SEQ ID NO: 587077 - protein, 9 aa, Mycobacterium
STDASGRYT

SEQ ID NO: 587078 - protein, 10 aa, Mycobacterium
STDASGRYTK

SEQ ID NO: 587079 - protein, 14 aa, Mycobacterium
STDATSDDADPAAR

SEQ ID NO: 587080 - protein, 8 aa, Mycobacterium
STDAYEDL

SEQ ID NO: 587081 - protein, 12 aa, Mycobacterium
STDCRQRAAESR

SEQ ID NO: 587082 - protein, 10 aa, Mycobacterium
STDCRRRAAH

SEQ ID NO: 587083 - protein, 11 aa, Mycobacterium
STDCRRRAEEH

SEQ ID NO: 587084 - protein, 4 aa, Mycobacterium
STDD

SEQ ID NO: 587085 - protein, 10 aa, Mycobacterium
STDDAPAGTR

SEQ ID NO: 587086 - protein, 10 aa, Mycobacterium
STDDEEEGEA

SEQ ID NO: 587087 - protein, 11 aa, Mycobacterium
STDDEGVPAEI

SEQ ID NO: 587088 - protein, 10 aa, Mycobacterium
STDDEGVPEE

SEQ ID NO: 587089 - protein, 10 aa, Mycobacterium
STDDGSGTTI

SEQ ID NO: 587090 - protein, 17 aa, Mycobacterium
STDDPEVAGQPDPAAKL

SEQ ID NO: 587091 - protein, 8 aa, Mycobacterium
STDDPHEG

SEQ ID NO: 587092 - protein, 7 aa, Mycobacterium
STDDPLR

SEQ ID NO: 587093 - protein, 9 aa, Mycobacterium
STDEASRRR

SEQ ID NO: 587094 - protein, 14 aa, Mycobacterium
STDEEARRAEREEY

SEQ ID NO: 587095 - protein, 16 aa, Mycobacterium
STDEEGTEIMTFAFQP

SEQ ID NO: 587096 - protein, 8 aa, Mycobacterium
STDEGGNV

SEQ ID NO: 587097 - protein, 5 aa, Mycobacterium
STDEL

SEQ ID NO: 587098 - protein, 26 aa, Mycobacterium
STDEQADSRNGLEAQRSAIDAEAARR

SEQ ID NO: 587099 - protein, 8 aa, Mycobacterium
STDESDQA

SEQ ID NO: 587100 - protein, 7 aa, Mycobacterium
STDESPV

SEQ ID NO: 587101 - protein, 11 aa, Mycobacterium
STDESVRPSTT

SEQ ID NO: 587102 - protein, 5 aa, Mycobacterium
STDFG

SEQ ID NO: 587103 - protein, 4 aa, Mycobacterium
STDG

SEQ ID NO: 587104 - protein, 10 aa, Mycobacterium
STDGAVTDGL

SEQ ID NO: 587105 - protein, 5 aa, Mycobacterium
STDGD

SEQ ID NO: 587106 - protein, 11 aa, Mycobacterium
STDGDTKRGRA

SEQ ID NO: 587107 - protein, 15 aa, Mycobacterium
STDGELPGAAEYARE

SEQ ID NO: 587108 - protein, 6 aa, Mycobacterium
STDGNR

SEQ ID NO: 587109 - protein, 5 aa, Mycobacterium
STDGP

SEQ ID NO: 587110 - protein, 12 aa, Mycobacterium
STDGSWDAKSAW

SEQ ID NO: 587111 - protein, 12 aa, Mycobacterium
STDGTRSNWDPQ

SEQ ID NO: 587112 - protein, 8 aa, Mycobacterium
STDGVSRI

SEQ ID NO: 587113 - protein, 11 aa, Mycobacterium
STDGYAEATGC

SEQ ID NO: 587114 - protein, 7 aa, Mycobacterium
STDHTGE

SEQ ID NO: 587115 - protein, 14 aa, Mycobacterium
STDKPGEVADDGSV

SEQ ID NO: 587116 - protein, 10 aa, Mycobacterium
STDLSPARSF

SEQ ID NO: 587117 - protein, 6 aa, Mycobacterium
STDNER

SEQ ID NO: 587118 - protein, 6 aa, Mycobacterium
STDNND

SEQ ID NO: 587119 - protein, 6 aa, Mycobacterium
STDPAR

SEQ ID NO: 587120 - protein, 9 aa, Mycobacterium
STDPDDDEI

SEQ ID NO: 587121 - protein, 8 aa, Mycobacterium
STDPDENP

SEQ ID NO: 587122 - protein, 7 aa, Mycobacterium
STDPDQL

SEQ ID NO: 587123 - protein, 7 aa, Mycobacterium
STDPDTL

SEQ ID NO: 587124 - protein, 6 aa, Mycobacterium
STDPEC

SEQ ID NO: 587125 - protein, 5 aa, Mycobacterium
STDPH

SEQ ID NO: 587126 - protein, 6 aa, Mycobacterium
STDPLD

SEQ ID NO: 587127 - protein, 17 aa, Mycobacterium
STDPPAGSKQRLTELGP

SEQ ID NO: 587128 - protein, 15 aa, Mycobacterium
STDPRALHSRSRDIS

SEQ ID NO: 587129 - protein, 6 aa, Mycobacterium
STDPRL

SEQ ID NO: 587130 - protein, 8 aa, Mycobacterium
STDPRRVA

SEQ ID NO: 587131 - protein, 8 aa, Mycobacterium
STDPRSRV

SEQ ID NO: 587132 - protein, 6 aa, Mycobacterium
STDPRW

SEQ ID NO: 587133 - protein, 23 aa, Mycobacterium
STDPVYTPNSMGGPEVDPKRASE

SEQ ID NO: 587134 - protein, 5 aa, Mycobacterium
STDQL

SEQ ID NO: 587135 - protein, 5 aa, Mycobacterium
STDQM

SEQ ID NO: 587136 - protein, 7 aa, Mycobacterium
STDQMTD

SEQ ID NO: 587137 - protein, 4 aa, Mycobacterium
STDR

SEQ ID NO: 587138 - protein, 7 aa, Mycobacterium
STDRAEA

SEQ ID NO: 587139 - protein, 11 aa, Mycobacterium
STDRANAAALD

SEQ ID NO: 587140 - protein, 10 aa, Mycobacterium
STDRANADAL

SEQ ID NO: 587141 - protein, 13 aa, Mycobacterium
STDRDAKATIDQM

SEQ ID NO: 587142 - protein, 8 aa, Mycobacterium
STDRGDDI

SEQ ID NO: 587143 - protein, 5 aa, Mycobacterium
STDRR

SEQ ID NO: 587144 - protein, 10 aa, Mycobacterium
STDRSGPQTP

SEQ ID NO: 587145 - protein, 5 aa, Mycobacterium
STDRV

SEQ ID NO: 587146 - protein, 7 aa, Mycobacterium
STDSEGL

SEQ ID NO: 587147 - protein, 25 aa, Mycobacterium
STDSNEVSNAVTPDTSDVKTNARVG

SEQ ID NO: 587148 - protein, 11 aa, Mycobacterium
STDSTAAGVPG

SEQ ID NO: 587149 - protein, 8 aa, Mycobacterium
STDTAKQA

SEQ ID NO: 587150 - protein, 9 aa, Mycobacterium
STDTNANLQ

SEQ ID NO: 587151 - protein, 15 aa, Mycobacterium
STDTRPEELKTQGVR

SEQ ID NO: 587152 - protein, 8 aa, Mycobacterium
STDTRPQE

SEQ ID NO: 587153 - protein, 5 aa, Mycobacterium
STDTV

SEQ ID NO: 587154 - protein, 9 aa, Mycobacterium
STDVAGEEH

SEQ ID NO: 587155 - protein, 5 aa, Mycobacterium
STDVD

SEQ ID NO: 587156 - protein, 14 aa, Mycobacterium
STDVEPVRTGLPTT

SEQ ID NO: 587157 - protein, 17 aa, Mycobacterium
STDVSGAPEQSTPDEVN

SEQ ID NO: 587158 - protein, 5 aa, Mycobacterium
STDYG

SEQ ID NO: 587159 - protein, 10 aa, Mycobacterium
STDYQKPDQL

SEQ ID NO: 587160 - protein, 4 aa, Mycobacterium
STEA

SEQ ID NO: 587161 - protein, 17 aa, Mycobacterium
STEAAPSPADASAAKVY

SEQ ID NO: 587162 - protein, 8 aa, Mycobacterium
STEADDDV

SEQ ID NO: 587163 - protein, 5 aa, Mycobacterium
STEAE

SEQ ID NO: 587164 - protein, 6 aa, Mycobacterium
STEAEA

SEQ ID NO: 587165 - protein, 11 aa, Mycobacterium
STEAEALAAES

SEQ ID NO: 587166 - protein, 25 aa, Mycobacterium
STEAGKRMGSRSSAPRNLATTAHRN

SEQ ID NO: 587167 - protein, 9 aa, Mycobacterium
STEAGPDPE

SEQ ID NO: 587168 - protein, 13 aa, Mycobacterium
STEAKVGRDAGEL

SEQ ID NO: 587169 - protein, 8 aa, Mycobacterium
STEAPPVQ

SEQ ID NO: 587170 - protein, 5 aa, Mycobacterium
STEAT

SEQ ID NO: 587171 - protein, 6 aa, Mycobacterium
STEATS

SEQ ID NO: 587172 - protein, 18 aa, Mycobacterium
STEDAQDPDASRSWQKRR

SEQ ID NO: 587173 - protein, 15 aa, Mycobacterium
STEDAQDPEASRSWQ

SEQ ID NO: 587174 - protein, 5 aa, Mycobacterium
STEDD

SEQ ID NO: 587175 - protein, 6 aa, Mycobacterium
STEDGR

SEQ ID NO: 587176 - protein, 5 aa, Mycobacterium
STEDL

SEQ ID NO: 587177 - protein, 13 aa, Mycobacterium
STEDVTDLTGEHA

SEQ ID NO: 587178 - protein, 11 aa, Mycobacterium
STEEGQGVPKT

SEQ ID NO: 587179 - protein, 11 aa, Mycobacterium
STEEGQGVPRT

SEQ ID NO: 587180 - protein, 16 aa, Mycobacterium
STEEKGEIARAAGASD

SEQ ID NO: 587181 - protein, 7 aa, Mycobacterium
STEEQDT

SEQ ID NO: 587182 - protein, 7 aa, Mycobacterium
STEEQER

SEQ ID NO: 587183 - protein, 11 aa, Mycobacterium
STEEQLEYGTP

SEQ ID NO: 587184 - protein, 6 aa, Mycobacterium
STEERL

SEQ ID NO: 587185 - protein, 17 aa, Mycobacterium
STEFGRKTRIDQSSCNK

SEQ ID NO: 587186 - protein, 8 aa, Mycobacterium
STEGDGEA

SEQ ID NO: 587187 - protein, 6 aa, Mycobacterium
STEGEV

SEQ ID NO: 587188 - protein, 5 aa, Mycobacterium
STEGL

SEQ ID NO: 587189 - protein, 9 aa, Mycobacterium
STEGMTSSD

SEQ ID NO: 587190 - protein, 6 aa, Mycobacterium
STEGQL

SEQ ID NO: 587191 - protein, 18 aa, Mycobacterium
STEGSVNSRDARGGTAPI

SEQ ID NO: 587192 - protein, 4 aa, Mycobacterium
STEH

SEQ ID NO: 587193 - protein, 6 aa, Mycobacterium
STEHQP

SEQ ID NO: 587194 - protein, 9 aa, Mycobacterium
STEHQQPTF

SEQ ID NO: 587195 - protein, 9 aa, Mycobacterium
STEKLSTMG

SEQ ID NO: 587196 - protein, 32 aa, Mycobacterium
STEKNRNRSLTQVTASGEYDEEAADLTDEKLR

SEQ ID NO: 587197 - protein, 29 aa, Mycobacterium
STEKNRSRSLSQVTDSSEYDEEAAGLTDA

SEQ ID NO: 587198 - protein, 5 aa, Mycobacterium
STELA

SEQ ID NO: 587199 - protein, 11 aa, Mycobacterium
STELADATDRE

SEQ ID NO: 587200 - protein, 15 aa, Mycobacterium
STELEGTARFKSPNP

SEQ ID NO: 587201 - protein, 4 aa, Mycobacterium
STEN

SEQ ID NO: 587202 - protein, 5 aa, Mycobacterium
STEPA

SEQ ID NO: 587203 - protein, 22 aa, Mycobacterium
STEPADTAAPVGPPATQQQPSP

SEQ ID NO: 587204 - protein, 11 aa, Mycobacterium
STEPAEPSRGD

SEQ ID NO: 587205 - protein, 9 aa, Mycobacterium
STEPAEYDQ

SEQ ID NO: 587206 - protein, 5 aa, Mycobacterium
STEPF

SEQ ID NO: 587207 - protein, 10 aa, Mycobacterium
STEPGEYNED

SEQ ID NO: 587208 - protein, 19 aa, Mycobacterium
STEPGGQPGAGREARVSPD

SEQ ID NO: 587209 - protein, 8 aa, Mycobacterium
STEPIAGA

SEQ ID NO: 587210 - protein, 7 aa, Mycobacterium
STEPPAE

SEQ ID NO: 587211 - protein, 7 aa, Mycobacterium
STEPPGE

SEQ ID NO: 587212 - protein, 9 aa, Mycobacterium
STEPVPTGD

SEQ ID NO: 587213 - protein, 10 aa, Mycobacterium
STEPVSGADT

SEQ ID NO: 587214 - protein, 9 aa, Mycobacterium
STEPVTGAD

SEQ ID NO: 587215 - protein, 7 aa, Mycobacterium
STEQHGP

SEQ ID NO: 587216 - protein, 17 aa, Mycobacterium
STEQQERARQKADAAYR

SEQ ID NO: 587217 - protein, 17 aa, Mycobacterium
STEQSVTGGRETFGEPK

SEQ ID NO: 587218 - protein, 7 aa, Mycobacterium
STEQVTS

SEQ ID NO: 587219 - protein, 8 aa, Mycobacterium
STERAAEL

SEQ ID NO: 587220 - protein, 9 aa, Mycobacterium
STERAASLG

SEQ ID NO: 587221 - protein, 10 aa, Mycobacterium
STERAKAIRR

SEQ ID NO: 587222 - protein, 10 aa, Mycobacterium
STERARDLRQ

SEQ ID NO: 587223 - protein, 6 aa, Mycobacterium
STERGD

SEQ ID NO: 587224 - protein, 7 aa, Mycobacterium
STERHPI

SEQ ID NO: 587225 - protein, 7 aa, Mycobacterium
STERLGP

SEQ ID NO: 587226 - protein, 16 aa, Mycobacterium
STERPRLAAEKRDLDT

SEQ ID NO: 587227 - protein, 7 aa, Mycobacterium
STERQQV

SEQ ID NO: 587228 - protein, 17 aa, Mycobacterium
STESDAASELRQRVRTV

SEQ ID NO: 587229 - protein, 5 aa, Mycobacterium
STESL

SEQ ID NO: 587230 - protein, 17 aa, Mycobacterium
STESLRRAAEDAVKAGV

SEQ ID NO: 587231 - protein, 25 aa, Mycobacterium
STESPADADGAGRRRAVDNGLTERQ

SEQ ID NO: 587232 - protein, 8 aa, Mycobacterium
STESRREP

SEQ ID NO: 587233 - protein, 10 aa, Mycobacterium
STESRSGIDN

SEQ ID NO: 587234 - protein, 29 aa, Mycobacterium
STETAGLTAAQAPESPAPRDFGTTSRRPL

SEQ ID NO: 587235 - protein, 19 aa, Mycobacterium
STETAPPKPGEEGRQRTPE

SEQ ID NO: 587236 - protein, 6 aa, Mycobacterium
STETGH

SEQ ID NO: 587237 - protein, 25 aa, Mycobacterium
STETGIQTKQSPYCGPSRKASGRPR

SEQ ID NO: 587238 - protein, 8 aa, Mycobacterium
STETGPIT

SEQ ID NO: 587239 - protein, 5 aa, Mycobacterium
STETL

SEQ ID NO: 587240 - protein, 4 aa, Mycobacterium
STEV

SEQ ID NO: 587241 - protein, 6 aa, Mycobacterium
STEVAA

SEQ ID NO: 587242 - protein, 6 aa, Mycobacterium
STEVGT

SEQ ID NO: 587243 - protein, 7 aa, Mycobacterium
STEVIGG

SEQ ID NO: 587244 - protein, 6 aa, Mycobacterium
STEVPV

SEQ ID NO: 587245 - protein, 4 aa, Mycobacterium
STEW

SEQ ID NO: 587246 - protein, 4 aa, Mycobacterium
STEY

SEQ ID NO: 587247 - protein, 12 aa, Mycobacterium
STFAESARRTNR

SEQ ID NO: 587248 - protein, 11 aa, Mycobacterium
STFAPSDEQRA

SEQ ID NO: 587249 - protein, 5 aa, Mycobacterium
STFDD

SEQ ID NO: 587250 - protein, 14 aa, Mycobacterium
STFEAAEQAARECG

SEQ ID NO: 587251 - protein, 6 aa, Mycobacterium
STFEGF

SEQ ID NO: 587252 - protein, 6 aa, Mycobacterium
STFGGN

SEQ ID NO: 587253 - protein, 12 aa, Mycobacterium
STFGKPPVVNPG

SEQ ID NO: 587254 - protein, 8 aa, Mycobacterium
STFGQPPI

SEQ ID NO: 587255 - protein, 14 aa, Mycobacterium
STFGSSSGGAVANS

SEQ ID NO: 587256 - protein, 4 aa, Mycobacterium
STFK

SEQ ID NO: 587257 - protein, 7 aa, Mycobacterium
STFKSQK

SEQ ID NO: 587258 - protein, 9 aa, Mycobacterium
STFTEEQRA

SEQ ID NO: 587259 - protein, 4 aa, Mycobacterium
STGA

SEQ ID NO: 587260 - protein, 8 aa, Mycobacterium
STGAAAED

SEQ ID NO: 587261 - protein, 8 aa, Mycobacterium
STGAARVT

SEQ ID NO: 587262 - protein, 13 aa, Mycobacterium
STGADAAAALSGA

SEQ ID NO: 587263 - protein, 13 aa, Mycobacterium
STGADVAASLSGA

SEQ ID NO: 587264 - protein, 7 aa, Mycobacterium
STGAEGS

SEQ ID NO: 587265 - protein, 27 aa, Mycobacterium
STGAEKQPESVTKDTSDVNTMAPGGSL

SEQ ID NO: 587266 - protein, 12 aa, Mycobacterium
STGAEPETAEQA

SEQ ID NO: 587267 - protein, 6 aa, Mycobacterium
STGAGA

SEQ ID NO: 587268 - protein, 7 aa, Mycobacterium
STGAGAA

SEQ ID NO: 587269 - protein, 6 aa, Mycobacterium
STGAGE

SEQ ID NO: 587270 - protein, 16 aa, Mycobacterium
STGAGSAPDPQFRPAE

SEQ ID NO: 587271 - protein, 8 aa, Mycobacterium
STGALDPA

SEQ ID NO: 587272 - protein, 8 aa, Mycobacterium
STGANRTV

SEQ ID NO: 587273 - protein, 17 aa, Mycobacterium
STGAPDPRLLPDTTQAV

SEQ ID NO: 587274 - protein, 6 aa, Mycobacterium
STGAQD

SEQ ID NO: 587275 - protein, 12 aa, Mycobacterium
STGARSGKTRQT

SEQ ID NO: 587276 - protein, 13 aa, Mycobacterium
STGASGSGADVDK

SEQ ID NO: 587277 - protein, 18 aa, Mycobacterium
STGASGTGADVDKVRKAT

SEQ ID NO: 587278 - protein, 17 aa, Mycobacterium
STGASGTGADVEKVREA

SEQ ID NO: 587279 - protein, 5 aa, Mycobacterium
STGAT

SEQ ID NO: 587280 - protein, 11 aa, Mycobacterium
STGATPAVPGA

SEQ ID NO: 587281 - protein, 11 aa, Mycobacterium
STGATPPAVPG

SEQ ID NO: 587282 - protein, 10 aa, Mycobacterium
STGATPSTVP

SEQ ID NO: 587283 - protein, 5 aa, Mycobacterium
STGAV

SEQ ID NO: 587284 - protein, 12 aa, Mycobacterium
STGAVPDGVPGA

SEQ ID NO: 587285 - protein, 7 aa, Mycobacterium
STGCTRS

SEQ ID NO: 587286 - protein, 4 aa, Mycobacterium
STGD

SEQ ID NO: 587287 - protein, 5 aa, Mycobacterium
STGDA

SEQ ID NO: 587288 - protein, 7 aa, Mycobacterium
STGDGHL

SEQ ID NO: 587289 - protein, 6 aa, Mycobacterium
STGDGL

SEQ ID NO: 587290 - protein, 8 aa, Mycobacterium
STGDPVGA

SEQ ID NO: 587291 - protein, 18 aa, Mycobacterium
STGDSGSGADVDKVRTAT

SEQ ID NO: 587292 - protein, 15 aa, Mycobacterium
STGDSVTTYGEPWNM

SEQ ID NO: 587293 - protein, 5 aa, Mycobacterium
STGDY

SEQ ID NO: 587294 - protein, 8 aa, Mycobacterium
STGEAEER

SEQ ID NO: 587295 - protein, 6 aa, Mycobacterium
STGEEF

SEQ ID NO: 587296 - protein, 7 aa, Mycobacterium
STGEEFD

SEQ ID NO: 587297 - protein, 8 aa, Mycobacterium
STGEEFPV

SEQ ID NO: 587298 - protein, 5 aa, Mycobacterium
STGEG

SEQ ID NO: 587299 - protein, 12 aa, Mycobacterium
STGEICPPTTQF

SEQ ID NO: 587300 - protein, 6 aa, Mycobacterium
STGENL

SEQ ID NO: 587301 - protein, 15 aa, Mycobacterium
STGEQLPISSSRQKL

SEQ ID NO: 587302 - protein, 8 aa, Mycobacterium
STGERNGE

SEQ ID NO: 587303 - protein, 7 aa, Mycobacterium
STGESEA

SEQ ID NO: 587304 - protein, 8 aa, Mycobacterium
STGESVNV

SEQ ID NO: 587305 - protein, 6 aa, Mycobacterium
STGFGR

SEQ ID NO: 587306 - protein, 13 aa, Mycobacterium
STGGADPQTAPPL

SEQ ID NO: 587307 - protein, 16 aa, Mycobacterium
STGGATGSGSTGSSAL

SEQ ID NO: 587308 - protein, 16 aa, Mycobacterium
STGGATGSGSTGSSAM

SEQ ID NO: 587309 - protein, 11 aa, Mycobacterium
STGGDFTPGNE

SEQ ID NO: 587310 - protein, 10 aa, Mycobacterium
STGGDTDNGI

SEQ ID NO: 587311 - protein, 6 aa, Mycobacterium
STGGEI

SEQ ID NO: 587312 - protein, 13 aa, Mycobacterium
STGGGGGGGNGGL

SEQ ID NO: 587313 - protein, 8 aa, Mycobacterium
STGGGGTL

SEQ ID NO: 587314 - protein, 6 aa, Mycobacterium
STGGGR

SEQ ID NO: 587315 - protein, 16 aa, Mycobacterium
STGGLTEPARTDTERA

SEQ ID NO: 587316 - protein, 6 aa, Mycobacterium
STGGNV

SEQ ID NO: 587317 - protein, 8 aa, Mycobacterium
STGGPSAD

SEQ ID NO: 587318 - protein, 6 aa, Mycobacterium
STGGPV

SEQ ID NO: 587319 - protein, 5 aa, Mycobacterium
STGGR

SEQ ID NO: 587320 - protein, 6 aa, Mycobacterium
STGGRD

SEQ ID NO: 587321 - protein, 7 aa, Mycobacterium
STGGRFA

SEQ ID NO: 587322 - protein, 9 aa, Mycobacterium
STGGSPLSS

SEQ ID NO: 587323 - protein, 7 aa, Mycobacterium
STGGSTE

SEQ ID NO: 587324 - protein, 8 aa, Mycobacterium
STGGSTEI

SEQ ID NO: 587325 - protein, 14 aa, Mycobacterium
STGGTASEPPPVGD

SEQ ID NO: 587326 - protein, 12 aa, Mycobacterium
STGGVGPDGRPM

SEQ ID NO: 587327 - protein, 12 aa, Mycobacterium
STGGVPTSVPGA

SEQ ID NO: 587328 - protein, 14 aa, Mycobacterium
STGGWDADGKPVHG

SEQ ID NO: 587329 - protein, 13 aa, Mycobacterium
STGGWDADGNPVH

SEQ ID NO: 587330 - protein, 14 aa, Mycobacterium
STGGWDDDGKPVHG

SEQ ID NO: 587331 - protein, 13 aa, Mycobacterium
STGGWDDEGKPVH

SEQ ID NO: 587332 - protein, 12 aa, Mycobacterium
STGGWDENGHPV

SEQ ID NO: 587333 - protein, 13 aa, Mycobacterium
STGGWDPAGNPVH

SEQ ID NO: 587334 - protein, 4 aa, Mycobacterium
STGH

SEQ ID NO: 587335 - protein, 10 aa, Mycobacterium
STGHDGAPLR

SEQ ID NO: 587336 - protein, 8 aa, Mycobacterium
STGHQSLD

SEQ ID NO: 587337 - protein, 7 aa, Mycobacterium
STGHSYG

SEQ ID NO: 587338 - protein, 4 aa, Mycobacterium
STGI

SEQ ID NO: 587339 - protein, 6 aa, Mycobacterium
STGICP

SEQ ID NO: 587340 - protein, 7 aa, Mycobacterium
STGIGRG

SEQ ID NO: 587341 - protein, 10 aa, Mycobacterium
STGISRATAT

SEQ ID NO: 587342 - protein, 11 aa, Mycobacterium
STGKADAAERL

SEQ ID NO: 587343 - protein, 11 aa, Mycobacterium
STGKADRADEL

SEQ ID NO: 587344 - protein, 9 aa, Mycobacterium
STGKATHAS

SEQ ID NO: 587345 - protein, 9 aa, Mycobacterium
STGKESAAG

SEQ ID NO: 587346 - protein, 8 aa, Mycobacterium
STGKPQAA

SEQ ID NO: 587347 - protein, 9 aa, Mycobacterium
STGKPQAAE

SEQ ID NO: 587348 - protein, 8 aa, Mycobacterium
STGKSQAH

SEQ ID NO: 587349 - protein, 5 aa, Mycobacterium
STGLG

SEQ ID NO: 587350 - protein, 9 aa, Mycobacterium
STGLPAGTE

SEQ ID NO: 587351 - protein, 13 aa, Mycobacterium
STGLQSVSAGAAQ

SEQ ID NO: 587352 - protein, 6 aa, Mycobacterium
STGLTS

SEQ ID NO: 587353 - protein, 19 aa, Mycobacterium
STGLTSRSGNAGDTAADAE

SEQ ID NO: 587354 - protein, 4 aa, Mycobacterium
STGN

SEQ ID NO: 587355 - protein, 11 aa, Mycobacterium
STGNDRDNRAA

SEQ ID NO: 587356 - protein, 6 aa, Mycobacterium
STGNGN

SEQ ID NO: 587357 - protein, 17 aa, Mycobacterium
STGNISADDRDATPPRA

SEQ ID NO: 587358 - protein, 17 aa, Mycobacterium
STGNISAEDRTADPPRA

SEQ ID NO: 587359 - protein, 9 aa, Mycobacterium
STGNNTNPA

SEQ ID NO: 587360 - protein, 9 aa, Mycobacterium
STGNPHSAA

SEQ ID NO: 587361 - protein, 5 aa, Mycobacterium
STGNT

SEQ ID NO: 587362 - protein, 17 aa, Mycobacterium
STGNTSASAAAYAAKAG

SEQ ID NO: 587363 - protein, 15 aa, Mycobacterium
STGNTSASAAAYAAR

SEQ ID NO: 587364 - protein, 9 aa, Mycobacterium
STGPDHDKE

SEQ ID NO: 587365 - protein, 9 aa, Mycobacterium
STGPGPSAL

SEQ ID NO: 587366 - protein, 8 aa, Mycobacterium
STGPLEEV

SEQ ID NO: 587367 - protein, 6 aa, Mycobacterium
STGPMT

SEQ ID NO: 587368 - protein, 11 aa, Mycobacterium
STGPTTPARVS

SEQ ID NO: 587369 - protein, 8 aa, Mycobacterium
STGQALPT

SEQ ID NO: 587370 - protein, 9 aa, Mycobacterium
STGQEPPTW

SEQ ID NO: 587371 - protein, 10 aa, Mycobacterium
STGQSPAKAE

SEQ ID NO: 587372 - protein, 7 aa, Mycobacterium
STGQTVP

SEQ ID NO: 587373 - protein, 6 aa, Mycobacterium
STGRAG

SEQ ID NO: 587374 - protein, 11 aa, Mycobacterium
STGRDGASGVR

SEQ ID NO: 587375 - protein, 11 aa, Mycobacterium
STGRDVETGVT

SEQ ID NO: 587376 - protein, 5 aa, Mycobacterium
STGRG

SEQ ID NO: 587377 - protein, 13 aa, Mycobacterium
STGRNCRPTNDQL

SEQ ID NO: 587378 - protein, 6 aa, Mycobacterium
STGRPP

SEQ ID NO: 587379 - protein, 5 aa, Mycobacterium
STGRR

SEQ ID NO: 587380 - protein, 6 aa, Mycobacterium
STGRRL

SEQ ID NO: 587381 - protein, 7 aa, Mycobacterium
STGRSYG

SEQ ID NO: 587382 - protein, 30 aa, Mycobacterium
STGRTITPPSGAPHPGQPAWNTQRGSSMPV

SEQ ID NO: 587383 - protein, 6 aa, Mycobacterium
STGRVQ

SEQ ID NO: 587384 - protein, 4 aa, Mycobacterium
STGS

SEQ ID NO: 587385 - protein, 5 aa, Mycobacterium
STGSE

SEQ ID NO: 587386 - protein, 6 aa, Mycobacterium
STGSEL

SEQ ID NO: 587387 - protein, 7 aa, Mycobacterium
STGSGPM

SEQ ID NO: 587388 - protein, 14 aa, Mycobacterium
STGSGTAPDPQFRP

SEQ ID NO: 587389 - protein, 8 aa, Mycobacterium
STGSLRPG

SEQ ID NO: 587390 - protein, 5 aa, Mycobacterium
STGSP

SEQ ID NO: 587391 - protein, 16 aa, Mycobacterium
STGSRIREVGTTNRTH

SEQ ID NO: 587392 - protein, 6 aa, Mycobacterium
STGSRL

SEQ ID NO: 587393 - protein, 11 aa, Mycobacterium
STGSSGSGADV

SEQ ID NO: 587394 - protein, 10 aa, Mycobacterium
STGSTAKNIA

SEQ ID NO: 587395 - protein, 13 aa, Mycobacterium
STGSTAKNIAEKG

SEQ ID NO: 587396 - protein, 13 aa, Mycobacterium
STGSTAKTIAEKG

SEQ ID NO: 587397 - protein, 13 aa, Mycobacterium
STGSTAKTIASKG

SEQ ID NO: 587398 - protein, 14 aa, Mycobacterium
STGSTAKTIASKGI

SEQ ID NO: 587399 - protein, 7 aa, Mycobacterium
STGSVDE

SEQ ID NO: 587400 - protein, 8 aa, Mycobacterium
STGTAPLS

SEQ ID NO: 587401 - protein, 12 aa, Mycobacterium
STGTASSAGPTI

SEQ ID NO: 587402 - protein, 10 aa, Mycobacterium
STGTGDSGFG

SEQ ID NO: 587403 - protein, 11 aa, Mycobacterium
STGTLQDYGPD

SEQ ID NO: 587404 - protein, 35 aa, Mycobacterium
STGTPDSAESEPAARSSKSSEPSKPSEPETGEAPA

SEQ ID NO: 587405 - protein, 6 aa, Mycobacterium
STGTPH

SEQ ID NO: 587406 - protein, 7 aa, Mycobacterium
STGTQNW

SEQ ID NO: 587407 - protein, 6 aa, Mycobacterium
STGTRE

SEQ ID NO: 587408 - protein, 18 aa, Mycobacterium
STGTSGTGADVDKVRQAT

SEQ ID NO: 587409 - protein, 12 aa, Mycobacterium
STGTSGTGADVE

SEQ ID NO: 587410 - protein, 12 aa, Mycobacterium
STGTSGVPSVAR

SEQ ID NO: 587411 - protein, 4 aa, Mycobacterium
STGV

SEQ ID NO: 587412 - protein, 5 aa, Mycobacterium
STGVG

SEQ ID NO: 587413 - protein, 6 aa, Mycobacterium
STGVGI

SEQ ID NO: 587414 - protein, 6 aa, Mycobacterium
STGVPG

SEQ ID NO: 587415 - protein, 15 aa, Mycobacterium
STGVRRRYSQPAGAV

SEQ ID NO: 587416 - protein, 17 aa, Mycobacterium
STGVTANRNWPSAPAAG

SEQ ID NO: 587417 - protein, 8 aa, Mycobacterium
STGVTTER

SEQ ID NO: 587418 - protein, 18 aa, Mycobacterium
STGWGSATISAGTEPGDT

SEQ ID NO: 587419 - protein, 7 aa, Mycobacterium
STHAEGT

SEQ ID NO: 587420 - protein, 12 aa, Mycobacterium
STHAVGDGEPPP

SEQ ID NO: 587421 - protein, 16 aa, Mycobacterium
STHDAEQAAAAARDDE

SEQ ID NO: 587422 - protein, 8 aa, Mycobacterium
STHDRDQV

SEQ ID NO: 587423 - protein, 12 aa, Mycobacterium
STHDTKRGEDVR

SEQ ID NO: 587424 - protein, 6 aa, Mycobacterium
STHEAN

SEQ ID NO: 587425 - protein, 13 aa, Mycobacterium
STHNGATQNVGWG

SEQ ID NO: 587426 - protein, 7 aa, Mycobacterium
STHPGTF

SEQ ID NO: 587427 - protein, 7 aa, Mycobacterium
STHPSDD

SEQ ID NO: 587428 - protein, 6 aa, Mycobacterium
STHQGK

SEQ ID NO: 587429 - protein, 17 aa, Mycobacterium
STHQQRADRNFADAGGN

SEQ ID NO: 587430 - protein, 13 aa, Mycobacterium
STHRDDSQSANQI

SEQ ID NO: 587431 - protein, 11 aa, Mycobacterium
STHRRSVDPTV

SEQ ID NO: 587432 - protein, 4 aa, Mycobacterium
STHS

SEQ ID NO: 587433 - protein, 5 aa, Mycobacterium
STHSA

SEQ ID NO: 587434 - protein, 11 aa, Mycobacterium
STHSEEEPTTL

SEQ ID NO: 587435 - protein, 27 aa, Mycobacterium
STHSGQRTSSLTYNKPTLKNDSFVIGL

SEQ ID NO: 587436 - protein, 9 aa, Mycobacterium
STHSPEQAA

SEQ ID NO: 587437 - protein, 21 aa, Mycobacterium
STHTRSDRESVKGRVGGRTQE

SEQ ID NO: 587438 - protein, 15 aa, Mycobacterium
STHTTTTDTGGGIGE

SEQ ID NO: 587439 - protein, 5 aa, Mycobacterium
STHVE

SEQ ID NO: 587440 - protein, 18 aa, Mycobacterium
STIATDTDGISPSGQSWA

SEQ ID NO: 587441 - protein, 8 aa, Mycobacterium
STIGDRTL

SEQ ID NO: 587442 - protein, 6 aa, Mycobacterium
STIGGQ

SEQ ID NO: 587443 - protein, 5 aa, Mycobacterium
STIGT

SEQ ID NO: 587444 - protein, 5 aa, Mycobacterium
STIPA

SEQ ID NO: 587445 - protein, 4 aa, Mycobacterium
STIQ

SEQ ID NO: 587446 - protein, 6 aa, Mycobacterium
STIQPE

SEQ ID NO: 587447 - protein, 10 aa, Mycobacterium
STIRGGRRVS

SEQ ID NO: 587448 - protein, 6 aa, Mycobacterium
STIRSS

SEQ ID NO: 587449 - protein, 5 aa, Mycobacterium
STISD

SEQ ID NO: 587450 - protein, 11 aa, Mycobacterium
STISGSGNTGV

SEQ ID NO: 587451 - protein, 17 aa, Mycobacterium
STISSTDAEPGTASSPE

SEQ ID NO: 587452 - protein, 15 aa, Mycobacterium
STITAANAAAAAPTT

SEQ ID NO: 587453 - protein, 5 aa, Mycobacterium
STITG

SEQ ID NO: 587454 - protein, 11 aa, Mycobacterium
STITSSKGSRC

SEQ ID NO: 587455 - protein, 5 aa, Mycobacterium
STITT

SEQ ID NO: 587456 - protein, 6 aa, Mycobacterium
STITTK

SEQ ID NO: 587457 - protein, 28 aa, Mycobacterium
STKAVREGDSWTLSGSKNPVLAGGSADT

SEQ ID NO: 587458 - protein, 6 aa, Mycobacterium
STKDLK

SEQ ID NO: 587459 - protein, 5 aa, Mycobacterium
STKDV

SEQ ID NO: 587460 - protein, 6 aa, Mycobacterium
STKEAQ

SEQ ID NO: 587461 - protein, 6 aa, Mycobacterium
STKEGF

SEQ ID NO: 587462 - protein, 10 aa, Mycobacterium
STKELGVDPA

SEQ ID NO: 587463 - protein, 10 aa, Mycobacterium
STKGESPGRW

SEQ ID NO: 587464 - protein, 14 aa, Mycobacterium
STKGLTVKPDPSMG

SEQ ID NO: 587465 - protein, 14 aa, Mycobacterium
STKLDGQKAPGSVQ

SEQ ID NO: 587466 - protein, 8 aa, Mycobacterium
STKPGITA

SEQ ID NO: 587467 - protein, 7 aa, Mycobacterium
STKPQAV

SEQ ID NO: 587468 - protein, 7 aa, Mycobacterium
STKPQNN

SEQ ID NO: 587469 - protein, 4 aa, Mycobacterium
STKR

SEQ ID NO: 587470 - protein, 9 aa, Mycobacterium
STKRAARQI

SEQ ID NO: 587471 - protein, 4 aa, Mycobacterium
STKS

SEQ ID NO: 587472 - protein, 4 aa, Mycobacterium
STKT

SEQ ID NO: 587473 - protein, 10 aa, Mycobacterium
STKTAAGNEL

SEQ ID NO: 587474 - protein, 6 aa, Mycobacterium
STKTHG

SEQ ID NO: 587475 - protein, 5 aa, Mycobacterium
STKVQ

SEQ ID NO: 587476 - protein, 8 aa, Mycobacterium
STKVQEPA

SEQ ID NO: 587477 - protein, 8 aa, Mycobacterium
STKYAGYV

SEQ ID NO: 587478 - protein, 8 aa, Mycobacterium
STLADGAA

SEQ ID NO: 587479 - protein, 13 aa, Mycobacterium
STLAERGARPTCN

SEQ ID NO: 587480 - protein, 10 aa, Mycobacterium
STLAGAPALS

SEQ ID NO: 587481 - protein, 11 aa, Mycobacterium
STLAGAPSLSP

SEQ ID NO: 587482 - protein, 11 aa, Mycobacterium
STLAGSDDCPA

SEQ ID NO: 587483 - protein, 13 aa, Mycobacterium
STLARAAEQEARD

SEQ ID NO: 587484 - protein, 10 aa, Mycobacterium
STLATPGGLA

SEQ ID NO: 587485 - protein, 7 aa, Mycobacterium
STLATQR

SEQ ID NO: 587486 - protein, 9 aa, Mycobacterium
STLDNLSNG

SEQ ID NO: 587487 - protein, 7 aa, Mycobacterium
STLDSPV

SEQ ID NO: 587488 - protein, 10 aa, Mycobacterium
STLDSTRQAY

SEQ ID NO: 587489 - protein, 5 aa, Mycobacterium
STLDT

SEQ ID NO: 587490 - protein, 6 aa, Mycobacterium
STLEGH

SEQ ID NO: 587491 - protein, 10 aa, Mycobacterium
STLENDEDGE

SEQ ID NO: 587492 - protein, 11 aa, Mycobacterium
STLEPSSGHGV

SEQ ID NO: 587493 - protein, 14 aa, Mycobacterium
STLGAANSAALART

SEQ ID NO: 587494 - protein, 6 aa, Mycobacterium
STLGAK

SEQ ID NO: 587495 - protein, 12 aa, Mycobacterium
STLGEKEDAVSD

SEQ ID NO: 587496 - protein, 7 aa, Mycobacterium
STLGPGA

SEQ ID NO: 587497 - protein, 8 aa, Mycobacterium
STLGSKAN

SEQ ID NO: 587498 - protein, 6 aa, Mycobacterium
STLGSN

SEQ ID NO: 587499 - protein, 6 aa, Mycobacterium
STLPDA

SEQ ID NO: 587500 - protein, 8 aa, Mycobacterium
STLPGRRR

SEQ ID NO: 587501 - protein, 7 aa, Mycobacterium
STLPQGV

SEQ ID NO: 587502 - protein, 8 aa, Mycobacterium
STLPRDGD

SEQ ID NO: 587503 - protein, 13 aa, Mycobacterium
STLPTDVSRDPGR

SEQ ID NO: 587504 - protein, 5 aa, Mycobacterium
STLRD

SEQ ID NO: 587505 - protein, 11 aa, Mycobacterium
STLRGRGQAMS

SEQ ID NO: 587506 - protein, 10 aa, Mycobacterium
STLRSQAKDA

SEQ ID NO: 587507 - protein, 7 aa, Mycobacterium
STLRSTG

SEQ ID NO: 587508 - protein, 17 aa, Mycobacterium
STLSAQNAAAAAPTTGV

SEQ ID NO: 587509 - protein, 6 aa, Mycobacterium
STLSEG

SEQ ID NO: 587510 - protein, 19 aa, Mycobacterium
STLSGAAASVGTQRPAGRR

SEQ ID NO: 587511 - protein, 10 aa, Mycobacterium
STLSGGQRRR

SEQ ID NO: 587512 - protein, 8 aa, Mycobacterium
STLSRDDG

SEQ ID NO: 587513 - protein, 17 aa, Mycobacterium
STLSSQNAAAAAPTTGV

SEQ ID NO: 587514 - protein, 4 aa, Mycobacterium
STLT

SEQ ID NO: 587515 - protein, 6 aa, Mycobacterium
STLTAD

SEQ ID NO: 587516 - protein, 13 aa, Mycobacterium
STLTGRHLAEYVS

SEQ ID NO: 587517 - protein, 9 aa, Mycobacterium
STLTPEDEA

SEQ ID NO: 587518 - protein, 5 aa, Mycobacterium
STLYP

SEQ ID NO: 587519 - protein, 7 aa, Mycobacterium
STMDTTR

SEQ ID NO: 587520 - protein, 7 aa, Mycobacterium
STMPASN

SEQ ID NO: 587521 - protein, 8 aa, Mycobacterium
STMPSQRF

SEQ ID NO: 587522 - protein, 7 aa, Mycobacterium
STMPTRE

SEQ ID NO: 587523 - protein, 5 aa, Mycobacterium
STMSE

SEQ ID NO: 587524 - protein, 4 aa, Mycobacterium
STMT

SEQ ID NO: 587525 - protein, 5 aa, Mycobacterium
STMTG

SEQ ID NO: 587526 - protein, 5 aa, Mycobacterium
STNAF

SEQ ID NO: 587527 - protein, 5 aa, Mycobacterium
STNAK

SEQ ID NO: 587528 - protein, 15 aa, Mycobacterium
STNARTNDTRQYDEA

SEQ ID NO: 587529 - protein, 6 aa, Mycobacterium
STNDNQ

SEQ ID NO: 587530 - protein, 8 aa, Mycobacterium
STNEAEQA

SEQ ID NO: 587531 - protein, 8 aa, Mycobacterium
STNELPED

SEQ ID NO: 587532 - protein, 10 aa, Mycobacterium
STNERLRGEA

SEQ ID NO: 587533 - protein, 6 aa, Mycobacterium
STNLAD

SEQ ID NO: 587534 - protein, 9 aa, Mycobacterium
STNPAPYVP

SEQ ID NO: 587535 - protein, 11 aa, Mycobacterium
STNPPAGAGNV

SEQ ID NO: 587536 - protein, 11 aa, Mycobacterium
STNPYATGPAR

SEQ ID NO: 587537 - protein, 13 aa, Mycobacterium
STNRQEDRWEDPD

SEQ ID NO: 587538 - protein, 6 aa, Mycobacterium
STNTGY

SEQ ID NO: 587539 - protein, 32 aa, Mycobacterium
STNTTQHAAATTGGVDPPLPPGTSANIAPGGA

SEQ ID NO: 587540 - protein, 19 aa, Mycobacterium
STNVEPAGGAVSTPAGQWG

SEQ ID NO: 587541 - protein, 7 aa, Mycobacterium
STNVPSD

SEQ ID NO: 587542 - protein, 11 aa, Mycobacterium
STNWEGEARDA

SEQ ID NO: 587543 - protein, 5 aa, Mycobacterium
STNYS

SEQ ID NO: 587544 - protein, 4 aa, Mycobacterium
STPA

SEQ ID NO: 587545 - protein, 10 aa, Mycobacterium
STPAAKAALP

SEQ ID NO: 587546 - protein, 14 aa, Mycobacterium
STPAARAVAKASQR

SEQ ID NO: 587547 - protein, 12 aa, Mycobacterium
STPADPTAPRTK

SEQ ID NO: 587548 - protein, 10 aa, Mycobacterium
STPADRPSSR

SEQ ID NO: 587549 - protein, 7 aa, Mycobacterium
STPAELR

SEQ ID NO: 587550 - protein, 7 aa, Mycobacterium
STPAFPT

SEQ ID NO: 587551 - protein, 11 aa, Mycobacterium
STPAHRSQASG

SEQ ID NO: 587552 - protein, 9 aa, Mycobacterium
STPAKWSDP

SEQ ID NO: 587553 - protein, 7 aa, Mycobacterium
STPALTS

SEQ ID NO: 587554 - protein, 5 aa, Mycobacterium
STPAN

SEQ ID NO: 587555 - protein, 11 aa, Mycobacterium
STPAPDPSRVG

SEQ ID NO: 587556 - protein, 7 aa, Mycobacterium
STPAPGW

SEQ ID NO: 587557 - protein, 10 aa, Mycobacterium
STPAPTPAAG

SEQ ID NO: 587558 - protein, 7 aa, Mycobacterium
STPAPVR

SEQ ID NO: 587559 - protein, 9 aa, Mycobacterium
STPASKPLT

SEQ ID NO: 587560 - protein, 5 aa, Mycobacterium
STPAT

SEQ ID NO: 587561 - protein, 21 aa, Mycobacterium
STPATGDSIAPEQPAVLGGEP

SEQ ID NO: 587562 - protein, 6 aa, Mycobacterium
STPAVP

SEQ ID NO: 587563 - protein, 13 aa, Mycobacterium
STPAYADKTNATA

SEQ ID NO: 587564 - protein, 12 aa, Mycobacterium
STPCGRGGIGAT

SEQ ID NO: 587565 - protein, 8 aa, Mycobacterium
STPDAADV

SEQ ID NO: 587566 - protein, 8 aa, Mycobacterium
STPDANKD

SEQ ID NO: 587567 - protein, 8 aa, Mycobacterium
STPDAPSI

SEQ ID NO: 587568 - protein, 7 aa, Mycobacterium
STPDATA

SEQ ID NO: 587569 - protein, 5 aa, Mycobacterium
STPDD

SEQ ID NO: 587570 - protein, 6 aa, Mycobacterium
STPDEH

SEQ ID NO: 587571 - protein, 13 aa, Mycobacterium
STPDEVARQAADN

SEQ ID NO: 587572 - protein, 8 aa, Mycobacterium
STPDGPLA

SEQ ID NO: 587573 - protein, 8 aa, Mycobacterium
STPDGSEM

SEQ ID NO: 587574 - protein, 6 aa, Mycobacterium
STPDHS

SEQ ID NO: 587575 - protein, 6 aa, Mycobacterium
STPDPE

SEQ ID NO: 587576 - protein, 8 aa, Mycobacterium
STPDTDEE

SEQ ID NO: 587577 - protein, 10 aa, Mycobacterium
STPDTRSNWD

SEQ ID NO: 587578 - protein, 14 aa, Mycobacterium
STPEAFEGRDADRF

SEQ ID NO: 587579 - protein, 6 aa, Mycobacterium
STPEAT

SEQ ID NO: 587580 - protein, 5 aa, Mycobacterium
STPEE

SEQ ID NO: 587581 - protein, 11 aa, Mycobacterium
STPEEEAAQTD

SEQ ID NO: 587582 - protein, 8 aa, Mycobacterium
STPEEGRQ

SEQ ID NO: 587583 - protein, 6 aa, Mycobacterium
STPEEV

SEQ ID NO: 587584 - protein, 5 aa, Mycobacterium
STPEF

SEQ ID NO: 587585 - protein, 15 aa, Mycobacterium
STPEGNAAAYYPETN

SEQ ID NO: 587586 - protein, 5 aa, Mycobacterium
STPEH

SEQ ID NO: 587587 - protein, 10 aa, Mycobacterium
STPERPTEIP

SEQ ID NO: 587588 - protein, 16 aa, Mycobacterium
STPESLAATKAMGKSF

SEQ ID NO: 587589 - protein, 12 aa, Mycobacterium
STPESLAATRAM

SEQ ID NO: 587590 - protein, 15 aa, Mycobacterium
STPEVAGPLPLEGPP

SEQ ID NO: 587591 - protein, 74 aa, Mycobacterium
STPEVDEKLSAKAAEELEEEPEEPEEDEGAAGEDDEASADSADEDDEDEAAEDEADEDEEDEEDSVEEDRAAGD

SEQ ID NO: 587592 - protein, 4 aa, Mycobacterium
STPF

SEQ ID NO: 587593 - protein, 5 aa, Mycobacterium
STPFA

SEQ ID NO: 587594 - protein, 5 aa, Mycobacterium
STPGA

SEQ ID NO: 587595 - protein, 16 aa, Mycobacterium
STPGAAEAYTSMAGPT

SEQ ID NO: 587596 - protein, 14 aa, Mycobacterium
STPGAEPAADGGYG

SEQ ID NO: 587597 - protein, 6 aa, Mycobacterium
STPGEG

SEQ ID NO: 587598 - protein, 10 aa, Mycobacterium
STPGGTMADP

SEQ ID NO: 587599 - protein, 13 aa, Mycobacterium
STPGIAVDEAAPA

SEQ ID NO: 587600 - protein, 7 aa, Mycobacterium
STPGLGQ

SEQ ID NO: 587601 - protein, 7 aa, Mycobacterium
STPGLTV

SEQ ID NO: 587602 - protein, 5 aa, Mycobacterium
STPGM

SEQ ID NO: 587603 - protein, 9 aa, Mycobacterium
STPGRETLQ

SEQ ID NO: 587604 - protein, 18 aa, Mycobacterium
STPGRRESAGGQAATAAK

SEQ ID NO: 587605 - protein, 7 aa, Mycobacterium
STPGRSL

SEQ ID NO: 587606 - protein, 6 aa, Mycobacterium
STPGSS

SEQ ID NO: 587607 - protein, 6 aa, Mycobacterium
STPGVT

SEQ ID NO: 587608 - protein, 9 aa, Mycobacterium
STPHGRSEA

SEQ ID NO: 587609 - protein, 6 aa, Mycobacterium
STPHHA

SEQ ID NO: 587610 - protein, 21 aa, Mycobacterium
STPHPEGHDGGFELSPDSSYR

SEQ ID NO: 587611 - protein, 22 aa, Mycobacterium
STPHSVKPAVTKAQSSTAQSRG

SEQ ID NO: 587612 - protein, 5 aa, Mycobacterium
STPID

SEQ ID NO: 587613 - protein, 5 aa, Mycobacterium
STPIR

SEQ ID NO: 587614 - protein, 5 aa, Mycobacterium
STPIT

SEQ ID NO: 587615 - protein, 6 aa, Mycobacterium
STPITI

SEQ ID NO: 587616 - protein, 5 aa, Mycobacterium
STPKA

SEQ ID NO: 587617 - protein, 7 aa, Mycobacterium
STPKADL

SEQ ID NO: 587618 - protein, 8 aa, Mycobacterium
STPKKLTY

SEQ ID NO: 587619 - protein, 5 aa, Mycobacterium
STPLA

SEQ ID NO: 587620 - protein, 19 aa, Mycobacterium
STPLAAKGGAPPTGSAVPG

SEQ ID NO: 587621 - protein, 5 aa, Mycobacterium
STPLD

SEQ ID NO: 587622 - protein, 7 aa, Mycobacterium
STPLDER

SEQ ID NO: 587623 - protein, 7 aa, Mycobacterium
STPLDEV

SEQ ID NO: 587624 - protein, 7 aa, Mycobacterium
STPLDRT

SEQ ID NO: 587625 - protein, 7 aa, Mycobacterium
STPLPTA

SEQ ID NO: 587626 - protein, 10 aa, Mycobacterium
STPLRATAAE

SEQ ID NO: 587627 - protein, 17 aa, Mycobacterium
STPLTPAAPIVSRLVAR

SEQ ID NO: 587628 - protein, 16 aa, Mycobacterium
STPMDRPSGITRRTSE

SEQ ID NO: 587629 - protein, 8 aa, Mycobacterium
STPNAHPR

SEQ ID NO: 587630 - protein, 18 aa, Mycobacterium
STPPAGSYTNGAANGGDI

SEQ ID NO: 587631 - protein, 9 aa, Mycobacterium
STPPISTDP

SEQ ID NO: 587632 - protein, 23 aa, Mycobacterium
STPPQTAPPLPGVAQSGPPNHQI

SEQ ID NO: 587633 - protein, 6 aa, Mycobacterium
STPQLD

SEQ ID NO: 587634 - protein, 4 aa, Mycobacterium
STPR

SEQ ID NO: 587635 - protein, 5 aa, Mycobacterium
STPRG

SEQ ID NO: 587636 - protein, 15 aa, Mycobacterium
STPRGNAAAYYPETN

SEQ ID NO: 587637 - protein, 6 aa, Mycobacterium
STPRRW

SEQ ID NO: 587638 - protein, 5 aa, Mycobacterium
STPRT

SEQ ID NO: 587639 - protein, 6 aa, Mycobacterium
STPRTL

SEQ ID NO: 587640 - protein, 8 aa, Mycobacterium
STPSESER

SEQ ID NO: 587641 - protein, 13 aa, Mycobacterium
STPSGDLRGDIDG

SEQ ID NO: 587642 - protein, 10 aa, Mycobacterium
STPSGQGPWP

SEQ ID NO: 587643 - protein, 8 aa, Mycobacterium
STPSGSEM

SEQ ID NO: 587644 - protein, 5 aa, Mycobacterium
STPSL

SEQ ID NO: 587645 - protein, 9 aa, Mycobacterium
STPSRAGRL

SEQ ID NO: 587646 - protein, 7 aa, Mycobacterium
STPSRVG

SEQ ID NO: 587647 - protein, 6 aa, Mycobacterium
STPTAL

SEQ ID NO: 587648 - protein, 22 aa, Mycobacterium
STPTALRKRAASRSGSAESGAA

SEQ ID NO: 587649 - protein, 8 aa, Mycobacterium
STPTEEDD

SEQ ID NO: 587650 - protein, 10 aa, Mycobacterium
STPTGSGPWP

SEQ ID NO: 587651 - protein, 8 aa, Mycobacterium
STPTGSTA

SEQ ID NO: 587652 - protein, 9 aa, Mycobacterium
STPTHTAQA

SEQ ID NO: 587653 - protein, 7 aa, Mycobacterium
STPTQVG

SEQ ID NO: 587654 - protein, 7 aa, Mycobacterium
STPTRSA

SEQ ID NO: 587655 - protein, 10 aa, Mycobacterium
STPTRSAADI

SEQ ID NO: 587656 - protein, 4 aa, Mycobacterium
STPV

SEQ ID NO: 587657 - protein, 17 aa, Mycobacterium
STPWPEQWPKPSRVEQG

SEQ ID NO: 587658 - protein, 8 aa, Mycobacterium
STPYGAGG

SEQ ID NO: 587659 - protein, 12 aa, Mycobacterium
STPYNRRTATRD

SEQ ID NO: 587660 - protein, 7 aa, Mycobacterium
STPYPAR

SEQ ID NO: 587661 - protein, 4 aa, Mycobacterium
STQA

SEQ ID NO: 587662 - protein, 6 aa, Mycobacterium
STQAFQ

SEQ ID NO: 587663 - protein, 7 aa, Mycobacterium
STQAPAL

SEQ ID NO: 587664 - protein, 6 aa, Mycobacterium
STQGQP

SEQ ID NO: 587665 - protein, 7 aa, Mycobacterium
STQGQPV

SEQ ID NO: 587666 - protein, 5 aa, Mycobacterium
STQGS

SEQ ID NO: 587667 - protein, 4 aa, Mycobacterium
STQH

SEQ ID NO: 587668 - protein, 12 aa, Mycobacterium
STQLRNEGNRGG

SEQ ID NO: 587669 - protein, 6 aa, Mycobacterium
STQNSY

SEQ ID NO: 587670 - protein, 4 aa, Mycobacterium
STQP

SEQ ID NO: 587671 - protein, 5 aa, Mycobacterium
STQPA

SEQ ID NO: 587672 - protein, 11 aa, Mycobacterium
STQPCPPPSTV

SEQ ID NO: 587673 - protein, 7 aa, Mycobacterium
STQPPVA

SEQ ID NO: 587674 - protein, 14 aa, Mycobacterium
STQPPVPDRPEYHD

SEQ ID NO: 587675 - protein, 8 aa, Mycobacterium
STQPQLTD

SEQ ID NO: 587676 - protein, 9 aa, Mycobacterium
STQPTAEGF

SEQ ID NO: 587677 - protein, 8 aa, Mycobacterium
STQQGAGY

SEQ ID NO: 587678 - protein, 8 aa, Mycobacterium
STQQGRLR

SEQ ID NO: 587679 - protein, 6 aa, Mycobacterium
STQQLA

SEQ ID NO: 587680 - protein, 4 aa, Mycobacterium
STQR

SEQ ID NO: 587681 - protein, 11 aa, Mycobacterium
STQRAAALGDD

SEQ ID NO: 587682 - protein, 8 aa, Mycobacterium
STQRAATV

SEQ ID NO: 587683 - protein, 13 aa, Mycobacterium
STQRQRWDGRTNC

SEQ ID NO: 587684 - protein, 5 aa, Mycobacterium
STQRV

SEQ ID NO: 587685 - protein, 7 aa, Mycobacterium
STQSDDL

SEQ ID NO: 587686 - protein, 13 aa, Mycobacterium
STQSGWNPRDHNV

SEQ ID NO: 587687 - protein, 20 aa, Mycobacterium
STQSIAPAQKRKPLRRSEID

SEQ ID NO: 587688 - protein, 8 aa, Mycobacterium
STQTAEGD

SEQ ID NO: 587689 - protein, 8 aa, Mycobacterium
STQTDVPD

SEQ ID NO: 587690 - protein, 5 aa, Mycobacterium
STQTQ

SEQ ID NO: 587691 - protein, 17 aa, Mycobacterium
STQTSFTQTSQRRESSR

SEQ ID NO: 587692 - protein, 7 aa, Mycobacterium
STQTSLD

SEQ ID NO: 587693 - protein, 4 aa, Mycobacterium
STQV

SEQ ID NO: 587694 - protein, 7 aa, Mycobacterium
STQVGSG

SEQ ID NO: 587695 - protein, 16 aa, Mycobacterium
STQVNPEGSPEQQAAA

SEQ ID NO: 587696 - protein, 6 aa, Mycobacterium
STQYGT

SEQ ID NO: 587697 - protein, 32 aa, Mycobacterium
STRAAALSEKEQTHHDRSDNRRDHRNRPTARH

SEQ ID NO: 587698 - protein, 10 aa, Mycobacterium
STRAAYPDGR

SEQ ID NO: 587699 - protein, 5 aa, Mycobacterium
STRAC

SEQ ID NO: 587700 - protein, 21 aa, Mycobacterium
STRADGNRALDAGDHEGALSA

SEQ ID NO: 587701 - protein, 7 aa, Mycobacterium
STRADHR

SEQ ID NO: 587702 - protein, 13 aa, Mycobacterium
STRAGGQGRPARI

SEQ ID NO: 587703 - protein, 8 aa, Mycobacterium
STRAGRSV

SEQ ID NO: 587704 - protein, 5 aa, Mycobacterium
STRAR

SEQ ID NO: 587705 - protein, 18 aa, Mycobacterium
STRATPEGRERVNVAIRR

SEQ ID NO: 587706 - protein, 9 aa, Mycobacterium
STRCTRSEI

SEQ ID NO: 587707 - protein, 4 aa, Mycobacterium
STRD

SEQ ID NO: 587708 - protein, 10 aa, Mycobacterium
STRDAVGNAG

SEQ ID NO: 587709 - protein, 11 aa, Mycobacterium
STRDDGRPGWR

SEQ ID NO: 587710 - protein, 11 aa, Mycobacterium
STRDDRVHPGH

SEQ ID NO: 587711 - protein, 12 aa, Mycobacterium
STRDDRVHPGHA

SEQ ID NO: 587712 - protein, 21 aa, Mycobacterium
STRDDTVADPDALRRAVWEGL

SEQ ID NO: 587713 - protein, 5 aa, Mycobacterium
STRDE

SEQ ID NO: 587714 - protein, 5 aa, Mycobacterium
STRDP

SEQ ID NO: 587715 - protein, 12 aa, Mycobacterium
STREEKGKYTDF

SEQ ID NO: 587716 - protein, 6 aa, Mycobacterium
STREQA

SEQ ID NO: 587717 - protein, 6 aa, Mycobacterium
STREQQ

SEQ ID NO: 587718 - protein, 6 aa, Mycobacterium
STRESF

SEQ ID NO: 587719 - protein, 6 aa, Mycobacterium
STREVR

SEQ ID NO: 587720 - protein, 4 aa, Mycobacterium
STRF

SEQ ID NO: 587721 - protein, 7 aa, Mycobacterium
STRFEGD

SEQ ID NO: 587722 - protein, 8 aa, Mycobacterium
STRFGDRT

SEQ ID NO: 587723 - protein, 7 aa, Mycobacterium
STRFGSG

SEQ ID NO: 587724 - protein, 12 aa, Mycobacterium
STRGAELGEGTD

SEQ ID NO: 587725 - protein, 11 aa, Mycobacterium
STRGAQLPGRD

SEQ ID NO: 587726 - protein, 10 aa, Mycobacterium
STRGDPNNVD

SEQ ID NO: 587727 - protein, 7 aa, Mycobacterium
STRGESQ

SEQ ID NO: 587728 - protein, 4 aa, Mycobacterium
STRH

SEQ ID NO: 587729 - protein, 4 aa, Mycobacterium
STRI

SEQ ID NO: 587730 - protein, 10 aa, Mycobacterium
STRKDHREHA

SEQ ID NO: 587731 - protein, 6 aa, Mycobacterium
STRKTL

SEQ ID NO: 587732 - protein, 10 aa, Mycobacterium
STRLAGQSAP

SEQ ID NO: 587733 - protein, 6 aa, Mycobacterium
STRMPA

SEQ ID NO: 587734 - protein, 4 aa, Mycobacterium
STRN

SEQ ID NO: 587735 - protein, 8 aa, Mycobacterium
STRNAGPL

SEQ ID NO: 587736 - protein, 18 aa, Mycobacterium
STRNDDPQGASRPFDKDR

SEQ ID NO: 587737 - protein, 14 aa, Mycobacterium
STRNFKGRMGSPDA

SEQ ID NO: 587738 - protein, 13 aa, Mycobacterium
STRNFTGRMGSTE

SEQ ID NO: 587739 - protein, 10 aa, Mycobacterium
STRNGKGKFT

SEQ ID NO: 587740 - protein, 9 aa, Mycobacterium
STRNPDPPL

SEQ ID NO: 587741 - protein, 7 aa, Mycobacterium
STRPDGV

SEQ ID NO: 587742 - protein, 11 aa, Mycobacterium
STRPGEDELSR

SEQ ID NO: 587743 - protein, 9 aa, Mycobacterium
STRPGSRAE

SEQ ID NO: 587744 - protein, 6 aa, Mycobacterium
STRPNH

SEQ ID NO: 587745 - protein, 5 aa, Mycobacterium
STRPP

SEQ ID NO: 587746 - protein, 7 aa, Mycobacterium
STRPRPE

SEQ ID NO: 587747 - protein, 7 aa, Mycobacterium
STRPRRD

SEQ ID NO: 587748 - protein, 9 aa, Mycobacterium
STRPTKVDN

SEQ ID NO: 587749 - protein, 7 aa, Mycobacterium
STRQAIA

SEQ ID NO: 587750 - protein, 10 aa, Mycobacterium
STRQDHRSQA

SEQ ID NO: 587751 - protein, 9 aa, Mycobacterium
STRQGGTIR

SEQ ID NO: 587752 - protein, 16 aa, Mycobacterium
STRQHSDASAPTLSSE

SEQ ID NO: 587753 - protein, 15 aa, Mycobacterium
STRQHSEEGAPTLSA

SEQ ID NO: 587754 - protein, 25 aa, Mycobacterium
STRQPRLQSSAQNRWKPQHNTSAPE

SEQ ID NO: 587755 - protein, 20 aa, Mycobacterium
STRQVEPGAPARGALASTDR

SEQ ID NO: 587756 - protein, 10 aa, Mycobacterium
STRRAEQLRD

SEQ ID NO: 587757 - protein, 5 aa, Mycobacterium
STRRG

SEQ ID NO: 587758 - protein, 8 aa, Mycobacterium
STRRPDGT

SEQ ID NO: 587759 - protein, 4 aa, Mycobacterium
STRS

SEQ ID NO: 587760 - protein, 6 aa, Mycobacterium
STRSAA

SEQ ID NO: 587761 - protein, 14 aa, Mycobacterium
STRSALGSSLNNAG

SEQ ID NO: 587762 - protein, 7 aa, Mycobacterium
STRSDGV

SEQ ID NO: 587763 - protein, 5 aa, Mycobacterium
STRSE

SEQ ID NO: 587764 - protein, 6 aa, Mycobacterium
STRSTQ

SEQ ID NO: 587765 - protein, 7 aa, Mycobacterium
STRTDAT

SEQ ID NO: 587766 - protein, 15 aa, Mycobacterium
STRTDDDKDDVGNRV

SEQ ID NO: 587767 - protein, 16 aa, Mycobacterium
STRTDENKDDVGNKVS

SEQ ID NO: 587768 - protein, 17 aa, Mycobacterium
STRTDETKSDVGNQISS

SEQ ID NO: 587769 - protein, 15 aa, Mycobacterium
STRTDQTKEDVGNQI

SEQ ID NO: 587770 - protein, 7 aa, Mycobacterium
STRTEGR

SEQ ID NO: 587771 - protein, 7 aa, Mycobacterium
STRTGQY

SEQ ID NO: 587772 - protein, 8 aa, Mycobacterium
STRTPAGR

SEQ ID NO: 587773 - protein, 7 aa, Mycobacterium
STRTPMP

SEQ ID NO: 587774 - protein, 7 aa, Mycobacterium
STRTSPR

SEQ ID NO: 587775 - protein, 9 aa, Mycobacterium
STRTTAGDD

SEQ ID NO: 587776 - protein, 8 aa, Mycobacterium
STRTTRSV

SEQ ID NO: 587777 - protein, 22 aa, Mycobacterium
STRTVSGRTVPYESLSGGAKEQ

SEQ ID NO: 587778 - protein, 13 aa, Mycobacterium
STRVRSVSPDTCD

SEQ ID NO: 587779 - protein, 7 aa, Mycobacterium
STRYGGT

SEQ ID NO: 587780 - protein, 14 aa, Mycobacterium
STRYRDDNGKPQIA

SEQ ID NO: 587781 - protein, 6 aa, Mycobacterium
STRYSA

SEQ ID NO: 587782 - protein, 9 aa, Mycobacterium
STSAAHPTA

SEQ ID NO: 587783 - protein, 12 aa, Mycobacterium
STSADELRRTAG

SEQ ID NO: 587784 - protein, 11 aa, Mycobacterium
STSADGLRQTA

SEQ ID NO: 587785 - protein, 10 aa, Mycobacterium
STSAEELRRT

SEQ ID NO: 587786 - protein, 6 aa, Mycobacterium
STSAGK

SEQ ID NO: 587787 - protein, 11 aa, Mycobacterium
STSAPPGPKTS

SEQ ID NO: 587788 - protein, 6 aa, Mycobacterium
STSDDL

SEQ ID NO: 587789 - protein, 9 aa, Mycobacterium
STSDKGHYA

SEQ ID NO: 587790 - protein, 10 aa, Mycobacterium
STSDPDEGDA

SEQ ID NO: 587791 - protein, 10 aa, Mycobacterium
STSDPDEGEA

SEQ ID NO: 587792 - protein, 6 aa, Mycobacterium
STSDPE

SEQ ID NO: 587793 - protein, 8 aa, Mycobacterium
STSEASRV

SEQ ID NO: 587794 - protein, 9 aa, Mycobacterium
STSEKPAGR

SEQ ID NO: 587795 - protein, 10 aa, Mycobacterium
STSEPADDVA

SEQ ID NO: 587796 - protein, 6 aa, Mycobacterium
STSERG

SEQ ID NO: 587797 - protein, 7 aa, Mycobacterium
STSEVAD

SEQ ID NO: 587798 - protein, 31 aa, Mycobacterium
STSFSSASGGAGGTGAPGGTGGGGGGGPLAS

SEQ ID NO: 587799 - protein, 9 aa, Mycobacterium
STSGAATRQ

SEQ ID NO: 587800 - protein, 14 aa, Mycobacterium
STSGALRSDKVRGV

SEQ ID NO: 587801 - protein, 10 aa, Mycobacterium
STSGDDIAAS

SEQ ID NO: 587802 - protein, 23 aa, Mycobacterium
STSGDDIAESRSNVIERGRTQVR

SEQ ID NO: 587803 - protein, 8 aa, Mycobacterium
STSGDDRA

SEQ ID NO: 587804 - protein, 10 aa, Mycobacterium
STSGDERTRV

SEQ ID NO: 587805 - protein, 9 aa, Mycobacterium
STSGGSPNL

SEQ ID NO: 587806 - protein, 6 aa, Mycobacterium
STSGIP

SEQ ID NO: 587807 - protein, 10 aa, Mycobacterium
STSGKANRQF

SEQ ID NO: 587808 - protein, 10 aa, Mycobacterium
STSGLSSTDL

SEQ ID NO: 587809 - protein, 6 aa, Mycobacterium
STSGLY

SEQ ID NO: 587810 - protein, 8 aa, Mycobacterium
STSGNSED

SEQ ID NO: 587811 - protein, 11 aa, Mycobacterium
STSGPADESSG

SEQ ID NO: 587812 - protein, 6 aa, Mycobacterium
STSGSE

SEQ ID NO: 587813 - protein, 9 aa, Mycobacterium
STSGTGADV

SEQ ID NO: 587814 - protein, 9 aa, Mycobacterium
STSGTSRNV

SEQ ID NO: 587815 - protein, 12 aa, Mycobacterium
STSGTTGTPKGA

SEQ ID NO: 587816 - protein, 9 aa, Mycobacterium
STSGVEPER

SEQ ID NO: 587817 - protein, 9 aa, Mycobacterium
STSGYYAGR

SEQ ID NO: 587818 - protein, 5 aa, Mycobacterium
STSIQ

SEQ ID NO: 587819 - protein, 6 aa, Mycobacterium
STSMAS

SEQ ID NO: 587820 - protein, 12 aa, Mycobacterium
STSMSSRGRRRS

SEQ ID NO: 587821 - protein, 5 aa, Mycobacterium
STSNF

SEQ ID NO: 587822 - protein, 7 aa, Mycobacterium
STSNPFR

SEQ ID NO: 587823 - protein, 8 aa, Mycobacterium
STSNRGQS

SEQ ID NO: 587824 - protein, 8 aa, Mycobacterium
STSPEETA

SEQ ID NO: 587825 - protein, 8 aa, Mycobacterium
STSPGARA

SEQ ID NO: 587826 - protein, 13 aa, Mycobacterium
STSPLSGADVDQA

SEQ ID NO: 587827 - protein, 9 aa, Mycobacterium
STSPPALST

SEQ ID NO: 587828 - protein, 14 aa, Mycobacterium
STSPPRTEAASEDA

SEQ ID NO: 587829 - protein, 12 aa, Mycobacterium
STSPRRSRGRHR

SEQ ID NO: 587830 - protein, 8 aa, Mycobacterium
STSPSFST

SEQ ID NO: 587831 - protein, 9 aa, Mycobacterium
STSPVSRDF

SEQ ID NO: 587832 - protein, 9 aa, Mycobacterium
STSRPDGTR

SEQ ID NO: 587833 - protein, 19 aa, Mycobacterium
STSRPGSSMGAKPITRPYA

SEQ ID NO: 587834 - protein, 9 aa, Mycobacterium
STSRSDEVY

SEQ ID NO: 587835 - protein, 9 aa, Mycobacterium
STSRTEAHR

SEQ ID NO: 587836 - protein, 9 aa, Mycobacterium
STSRTPTGD

SEQ ID NO: 587837 - protein, 7 aa, Mycobacterium
STSRYAQ

SEQ ID NO: 587838 - protein, 10 aa, Mycobacterium
STSSAAAEQL

SEQ ID NO: 587839 - protein, 13 aa, Mycobacterium
STSSAINPRPHRE

SEQ ID NO: 587840 - protein, 12 aa, Mycobacterium
STSSARSAAERE

SEQ ID NO: 587841 - protein, 12 aa, Mycobacterium
STSSARSASERE

SEQ ID NO: 587842 - protein, 8 aa, Mycobacterium
STSSAYGS

SEQ ID NO: 587843 - protein, 14 aa, Mycobacterium
STSSEAVVSQDPAR

SEQ ID NO: 587844 - protein, 6 aa, Mycobacterium
STSSEH

SEQ ID NO: 587845 - protein, 11 aa, Mycobacterium
STSSESAELGE

SEQ ID NO: 587846 - protein, 10 aa, Mycobacterium
STSSFHPGRG

SEQ ID NO: 587847 - protein, 10 aa, Mycobacterium
STSSNERGMS

SEQ ID NO: 587848 - protein, 9 aa, Mycobacterium
STSSPSSGF

SEQ ID NO: 587849 - protein, 9 aa, Mycobacterium
STSSRQLDA

SEQ ID NO: 587850 - protein, 5 aa, Mycobacterium
STSST

SEQ ID NO: 587851 - protein, 12 aa, Mycobacterium
STSSTGYRPRSV

SEQ ID NO: 587852 - protein, 7 aa, Mycobacterium
STSSTSL

SEQ ID NO: 587853 - protein, 9 aa, Mycobacterium
STSTADGDD

SEQ ID NO: 587854 - protein, 12 aa, Mycobacterium
STSTERARSIGA

SEQ ID NO: 587855 - protein, 5 aa, Mycobacterium
STSTT

SEQ ID NO: 587856 - protein, 13 aa, Mycobacterium
STSVADAHRKAHE

SEQ ID NO: 587857 - protein, 16 aa, Mycobacterium
STSVAEAAERPVVVVR

SEQ ID NO: 587858 - protein, 6 aa, Mycobacterium
STSVDG

SEQ ID NO: 587859 - protein, 5 aa, Mycobacterium
STSVP

SEQ ID NO: 587860 - protein, 5 aa, Mycobacterium
STSVT

SEQ ID NO: 587861 - protein, 7 aa, Mycobacterium
STSWNQA

SEQ ID NO: 587862 - protein, 9 aa, Mycobacterium
STSYQSSDV

SEQ ID NO: 587863 - protein, 4 aa, Mycobacterium
STTA

SEQ ID NO: 587864 - protein, 10 aa, Mycobacterium
STTAANDGAE

SEQ ID NO: 587865 - protein, 9 aa, Mycobacterium
STTAANDSH

SEQ ID NO: 587866 - protein, 9 aa, Mycobacterium
STTAANEAR

SEQ ID NO: 587867 - protein, 21 aa, Mycobacterium
STTAAQAGQTAAQARAAAAAY

SEQ ID NO: 587868 - protein, 6 aa, Mycobacterium
STTADT

SEQ ID NO: 587869 - protein, 12 aa, Mycobacterium
STTAPESLGGGG

SEQ ID NO: 587870 - protein, 7 aa, Mycobacterium
STTAQED

SEQ ID NO: 587871 - protein, 13 aa, Mycobacterium
STTAQSVRPDDSS

SEQ ID NO: 587872 - protein, 6 aa, Mycobacterium
STTARM

SEQ ID NO: 587873 - protein, 14 aa, Mycobacterium
STTARRAGSGGHPC

SEQ ID NO: 587874 - protein, 20 aa, Mycobacterium
STTATARRPAPNTLSGNTTG

SEQ ID NO: 587875 - protein, 22 aa, Mycobacterium
STTATDSNDRPTEPVVIESITI

SEQ ID NO: 587876 - protein, 9 aa, Mycobacterium
STTATLDRL

SEQ ID NO: 587877 - protein, 5 aa, Mycobacterium
STTAY

SEQ ID NO: 587878 - protein, 4 aa, Mycobacterium
STTC

SEQ ID NO: 587879 - protein, 16 aa, Mycobacterium
STTDAAPSPADASATK

SEQ ID NO: 587880 - protein, 5 aa, Mycobacterium
STTDI

SEQ ID NO: 587881 - protein, 6 aa, Mycobacterium
STTDIE

SEQ ID NO: 587882 - protein, 14 aa, Mycobacterium
STTDLGPVAARPSE

SEQ ID NO: 587883 - protein, 10 aa, Mycobacterium
STTDPDEGEA

SEQ ID NO: 587884 - protein, 9 aa, Mycobacterium
STTDPSSGF

SEQ ID NO: 587885 - protein, 8 aa, Mycobacterium
STTDPVRQ

SEQ ID NO: 587886 - protein, 18 aa, Mycobacterium
STTDTGDRDDLKPGVAER

SEQ ID NO: 587887 - protein, 8 aa, Mycobacterium
STTEDTPS

SEQ ID NO: 587888 - protein, 8 aa, Mycobacterium
STTEEGGP

SEQ ID NO: 587889 - protein, 7 aa, Mycobacterium
STTEEQK

SEQ ID NO: 587890 - protein, 6 aa, Mycobacterium
STTEMR

SEQ ID NO: 587891 - protein, 20 aa, Mycobacterium
STTENRRNPFGQNGIGLRGA

SEQ ID NO: 587892 - protein, 19 aa, Mycobacterium
STTEPGTGNPGGEGSTLDR

SEQ ID NO: 587893 - protein, 16 aa, Mycobacterium
STTESGPVAASRPGRG

SEQ ID NO: 587894 - protein, 4 aa, Mycobacterium
STTG

SEQ ID NO: 587895 - protein, 13 aa, Mycobacterium
STTGAGPAAMAPG

SEQ ID NO: 587896 - protein, 13 aa, Mycobacterium
STTGDGEPPDNGA

SEQ ID NO: 587897 - protein, 7 aa, Mycobacterium
STTGDVA

SEQ ID NO: 587898 - protein, 8 aa, Mycobacterium
STTGDVSD

SEQ ID NO: 587899 - protein, 6 aa, Mycobacterium
STTGNQ

SEQ ID NO: 587900 - protein, 5 aa, Mycobacterium
STTGV

SEQ ID NO: 587901 - protein, 17 aa, Mycobacterium
STTGVAGPGGGSPDKPV

SEQ ID NO: 587902 - protein, 19 aa, Mycobacterium
STTHAQLSPAEQLSTGVSP

SEQ ID NO: 587903 - protein, 20 aa, Mycobacterium
STTHAQLSPQEQLSTGVSPG

SEQ ID NO: 587904 - protein, 12 aa, Mycobacterium
STTHKTLGGPRG

SEQ ID NO: 587905 - protein, 10 aa, Mycobacterium
STTHPTTEQT

SEQ ID NO: 587906 - protein, 19 aa, Mycobacterium
STTHQQLSPEEQLASGVTP

SEQ ID NO: 587907 - protein, 7 aa, Mycobacterium
STTISGA

SEQ ID NO: 587908 - protein, 9 aa, Mycobacterium
STTITPDPG

SEQ ID NO: 587909 - protein, 10 aa, Mycobacterium
STTIYGGTSE

SEQ ID NO: 587910 - protein, 5 aa, Mycobacterium
STTKH

SEQ ID NO: 587911 - protein, 19 aa, Mycobacterium
STTKITEAVPAGLPDVTQG

SEQ ID NO: 587912 - protein, 5 aa, Mycobacterium
STTKR

SEQ ID NO: 587913 - protein, 19 aa, Mycobacterium
STTLPGGADTAGYGASSTV

SEQ ID NO: 587914 - protein, 11 aa, Mycobacterium
STTMDPAPPPM

SEQ ID NO: 587915 - protein, 11 aa, Mycobacterium
STTMDPAPPSM

SEQ ID NO: 587916 - protein, 4 aa, Mycobacterium
STTN

SEQ ID NO: 587917 - protein, 9 aa, Mycobacterium
STTNPSSGL

SEQ ID NO: 587918 - protein, 4 aa, Mycobacterium
STTP

SEQ ID NO: 587919 - protein, 5 aa, Mycobacterium
STTPA

SEQ ID NO: 587920 - protein, 7 aa, Mycobacterium
STTPAGV

SEQ ID NO: 587921 - protein, 10 aa, Mycobacterium
STTPANGGAQ

SEQ ID NO: 587922 - protein, 6 aa, Mycobacterium
STTPDQ

SEQ ID NO: 587923 - protein, 10 aa, Mycobacterium
STTPEEETQR

SEQ ID NO: 587924 - protein, 6 aa, Mycobacterium
STTPHH

SEQ ID NO: 587925 - protein, 15 aa, Mycobacterium
STTPPPNAGGAPWPT

SEQ ID NO: 587926 - protein, 9 aa, Mycobacterium
STTPQAALP

SEQ ID NO: 587927 - protein, 11 aa, Mycobacterium
STTPQAALPAA

SEQ ID NO: 587928 - protein, 9 aa, Mycobacterium
STTPSCGDS

SEQ ID NO: 587929 - protein, 13 aa, Mycobacterium
STTPVPHEDPRSE

SEQ ID NO: 587930 - protein, 6 aa, Mycobacterium
STTQDH

SEQ ID NO: 587931 - protein, 7 aa, Mycobacterium
STTQKAG

SEQ ID NO: 587932 - protein, 31 aa, Mycobacterium
STTQTRTLSDHSGTRQGEPARQKGSGTKLPA

SEQ ID NO: 587933 - protein, 6 aa, Mycobacterium
STTRDT

SEQ ID NO: 587934 - protein, 12 aa, Mycobacterium
STTRGGQAAPNA

SEQ ID NO: 587935 - protein, 13 aa, Mycobacterium
STTRGSLSGTLAT

SEQ ID NO: 587936 - protein, 14 aa, Mycobacterium
STTRHRAKNAERAA

SEQ ID NO: 587937 - protein, 15 aa, Mycobacterium
STTSAQGEPDIADSK

SEQ ID NO: 587938 - protein, 17 aa, Mycobacterium
STTSFERNDFSGSKNDP

SEQ ID NO: 587939 - protein, 19 aa, Mycobacterium
STTSIDTQYEPRRRGDQVS

SEQ ID NO: 587940 - protein, 16 aa, Mycobacterium
STTSLERDDFSGSRND

SEQ ID NO: 587941 - protein, 14 aa, Mycobacterium
STTSLPETPRGERN

SEQ ID NO: 587942 - protein, 17 aa, Mycobacterium
STTSTPDDHKAYYPGAT

SEQ ID NO: 587943 - protein, 17 aa, Mycobacterium
STTTAGEPGQNSVAETD

SEQ ID NO: 587944 - protein, 12 aa, Mycobacterium
STTTELERRPRV

SEQ ID NO: 587945 - protein, 8 aa, Mycobacterium
STTTGAPM

SEQ ID NO: 587946 - protein, 12 aa, Mycobacterium
STTTGPGIPVDP

SEQ ID NO: 587947 - protein, 20 aa, Mycobacterium
STTTGPGIQVDPGVTRNFLE

SEQ ID NO: 587948 - protein, 8 aa, Mycobacterium
STTTPSSG

SEQ ID NO: 587949 - protein, 8 aa, Mycobacterium
STTTPTID

SEQ ID NO: 587950 - protein, 12 aa, Mycobacterium
STTTSAQPSGAR

SEQ ID NO: 587951 - protein, 10 aa, Mycobacterium
STTTTSGPAL

SEQ ID NO: 587952 - protein, 16 aa, Mycobacterium
STTVAESALAPVAVVR

SEQ ID NO: 587953 - protein, 6 aa, Mycobacterium
STTVEQ

SEQ ID NO: 587954 - protein, 8 aa, Mycobacterium
STTYNTPY

SEQ ID NO: 587955 - protein, 4 aa, Mycobacterium
STVA

SEQ ID NO: 587956 - protein, 5 aa, Mycobacterium
STVAH

SEQ ID NO: 587957 - protein, 10 aa, Mycobacterium
STVATPNNEG

SEQ ID NO: 587958 - protein, 6 aa, Mycobacterium
STVDGK

SEQ ID NO: 587959 - protein, 7 aa, Mycobacterium
STVDPAG

SEQ ID NO: 587960 - protein, 9 aa, Mycobacterium
STVDPDDPT

SEQ ID NO: 587961 - protein, 11 aa, Mycobacterium
STVDPGDRQRI

SEQ ID NO: 587962 - protein, 16 aa, Mycobacterium
STVDPVSEADPAGGVQ

SEQ ID NO: 587963 - protein, 9 aa, Mycobacterium
STVEAEPQA

SEQ ID NO: 587964 - protein, 6 aa, Mycobacterium
STVENE

SEQ ID NO: 587965 - protein, 11 aa, Mycobacterium
STVEVSGGDVE

SEQ ID NO: 587966 - protein, 11 aa, Mycobacterium
STVGAGDSSLA

SEQ ID NO: 587967 - protein, 10 aa, Mycobacterium
STVGGRLKGS

SEQ ID NO: 587968 - protein, 6 aa, Mycobacterium
STVGGY

SEQ ID NO: 587969 - protein, 9 aa, Mycobacterium
STVGSDTIA

SEQ ID NO: 587970 - protein, 13 aa, Mycobacterium
STVGSGMTGKSSG

SEQ ID NO: 587971 - protein, 8 aa, Mycobacterium
STVGTDGV

SEQ ID NO: 587972 - protein, 23 aa, Mycobacterium
STVHNEPTLTEEAYAKNAKRGRH

SEQ ID NO: 587973 - protein, 6 aa, Mycobacterium
STVNRA

SEQ ID NO: 587974 - protein, 5 aa, Mycobacterium
STVNS

SEQ ID NO: 587975 - protein, 50 aa, Mycobacterium
STVPAVATSSAGSTGVQSAEAAGSTDATDTTGTDQPSITTGTANPTCPTG

SEQ ID NO: 587976 - protein, 8 aa, Mycobacterium
STVPDYTG

SEQ ID NO: 587977 - protein, 9 aa, Mycobacterium
STVPGPEGE

SEQ ID NO: 587978 - protein, 10 aa, Mycobacterium
STVPGPEGEF

SEQ ID NO: 587979 - protein, 8 aa, Mycobacterium
STVPPGKL

SEQ ID NO: 587980 - protein, 6 aa, Mycobacterium
STVPPQ

SEQ ID NO: 587981 - protein, 6 aa, Mycobacterium
STVPQE

SEQ ID NO: 587982 - protein, 6 aa, Mycobacterium
STVPRD

SEQ ID NO: 587983 - protein, 9 aa, Mycobacterium
STVPTRGRS

SEQ ID NO: 587984 - protein, 9 aa, Mycobacterium
STVQGITGG

SEQ ID NO: 587985 - protein, 5 aa, Mycobacterium
STVQP

SEQ ID NO: 587986 - protein, 9 aa, Mycobacterium
STVRRRAEE

SEQ ID NO: 587987 - protein, 8 aa, Mycobacterium
STVRTGSI

SEQ ID NO: 587988 - protein, 5 aa, Mycobacterium
STVSG

SEQ ID NO: 587989 - protein, 9 aa, Mycobacterium
STVSGELSA

SEQ ID NO: 587990 - protein, 14 aa, Mycobacterium
STVSGRLGASNDRM

SEQ ID NO: 587991 - protein, 14 aa, Mycobacterium
STVSGRLGTSNDRM

SEQ ID NO: 587992 - protein, 5 aa, Mycobacterium
STVSR

SEQ ID NO: 587993 - protein, 7 aa, Mycobacterium
STVSTAE

SEQ ID NO: 587994 - protein, 8 aa, Mycobacterium
STVTDQAG

SEQ ID NO: 587995 - protein, 7 aa, Mycobacterium
STVTELE

SEQ ID NO: 587996 - protein, 6 aa, Mycobacterium
STVTES

SEQ ID NO: 587997 - protein, 6 aa, Mycobacterium
STVTGA

SEQ ID NO: 587998 - protein, 8 aa, Mycobacterium
STVTGGTQ

SEQ ID NO: 587999 - protein, 15 aa, Mycobacterium
STVTNADGVTEAPRS

SEQ ID NO: 588000 - protein, 13 aa, Mycobacterium
STWAGGAFDGPPV

SEQ ID NO: 588001 - protein, 5 aa, Mycobacterium
STWAP

SEQ ID NO: 588002 - protein, 8 aa, Mycobacterium
STWATNPA

SEQ ID NO: 588003 - protein, 4 aa, Mycobacterium
STWD

SEQ ID NO: 588004 - protein, 6 aa, Mycobacterium
STWDRR

SEQ ID NO: 588005 - protein, 12 aa, Mycobacterium
STWEPPEADENT

SEQ ID NO: 588006 - protein, 12 aa, Mycobacterium
STWGGQAPPEDM

SEQ ID NO: 588007 - protein, 11 aa, Mycobacterium
STWPDDNPQLI

SEQ ID NO: 588008 - protein, 18 aa, Mycobacterium
STYAAPPQRFEAGTPMTS

SEQ ID NO: 588009 - protein, 10 aa, Mycobacterium
STYAPAPQRF

SEQ ID NO: 588010 - protein, 6 aa, Mycobacterium
STYARD

SEQ ID NO: 588011 - protein, 8 aa, Mycobacterium
STYATPPR

SEQ ID NO: 588012 - protein, 11 aa, Mycobacterium
STYESAATQTA

SEQ ID NO: 588013 - protein, 11 aa, Mycobacterium
STYESAGTQTA

SEQ ID NO: 588014 - protein, 6 aa, Mycobacterium
STYGKM

SEQ ID NO: 588015 - protein, 5 aa, Mycobacterium
STYGP

SEQ ID NO: 588016 - protein, 10 aa, Mycobacterium
STYGRGQGSC

SEQ ID NO: 588017 - protein, 6 aa, Mycobacterium
STYKRA

SEQ ID NO: 588018 - protein, 5 aa, Mycobacterium
STYPA

SEQ ID NO: 588019 - protein, 16 aa, Mycobacterium
STYRPGETLRGRLGIE

SEQ ID NO: 588020 - protein, 4 aa, Mycobacterium
STYV

SEQ ID NO: 588021 - protein, 7 aa, Mycobacterium
STYVDPG

SEQ ID NO: 588022 - protein, 9 aa, Mycobacterium
STYVPGRTQ

SEQ ID NO: 588023 - protein, 12 aa, Mycobacterium
SVAAEPASAATD

SEQ ID NO: 588024 - protein, 9 aa, Mycobacterium
SVAAERPGL

SEQ ID NO: 588025 - protein, 6 aa, Mycobacterium
SVAAES

SEQ ID NO: 588026 - protein, 11 aa, Mycobacterium
SVAAGDSDRIN

SEQ ID NO: 588027 - protein, 12 aa, Mycobacterium
SVAAGGEDAYTA

SEQ ID NO: 588028 - protein, 7 aa, Mycobacterium
SVAAGKA

SEQ ID NO: 588029 - protein, 11 aa, Mycobacterium
SVAANGTPEQV

SEQ ID NO: 588030 - protein, 8 aa, Mycobacterium
SVAARKAG

SEQ ID NO: 588031 - protein, 13 aa, Mycobacterium
SVAASAGPAGQFA

SEQ ID NO: 588032 - protein, 4 aa, Mycobacterium
SVAD

SEQ ID NO: 588033 - protein, 7 aa, Mycobacterium
SVADAER

SEQ ID NO: 588034 - protein, 7 aa, Mycobacterium
SVADAHR

SEQ ID NO: 588035 - protein, 22 aa, Mycobacterium
SVADDNDGENAVAPWNAGTTDN

SEQ ID NO: 588036 - protein, 9 aa, Mycobacterium
SVADDPTVV

SEQ ID NO: 588037 - protein, 18 aa, Mycobacterium
SVADDSDGRGEHPSPSRL

SEQ ID NO: 588038 - protein, 8 aa, Mycobacterium
SVADDSGL

SEQ ID NO: 588039 - protein, 11 aa, Mycobacterium
SVADDTPDALD

SEQ ID NO: 588040 - protein, 7 aa, Mycobacterium
SVADNGD

SEQ ID NO: 588041 - protein, 4 aa, Mycobacterium
SVAE

SEQ ID NO: 588042 - protein, 8 aa, Mycobacterium
SVAEGRKR

SEQ ID NO: 588043 - protein, 6 aa, Mycobacterium
SVAEGT

SEQ ID NO: 588044 - protein, 7 aa, Mycobacterium
SVAEGTV

SEQ ID NO: 588045 - protein, 10 aa, Mycobacterium
SVAEPEGAEN

SEQ ID NO: 588046 - protein, 5 aa, Mycobacterium
SVAER

SEQ ID NO: 588047 - protein, 11 aa, Mycobacterium
SVAESPAGEVS

SEQ ID NO: 588048 - protein, 5 aa, Mycobacterium
SVAET

SEQ ID NO: 588049 - protein, 7 aa, Mycobacterium
SVAETVR

SEQ ID NO: 588050 - protein, 12 aa, Mycobacterium
SVAGGGDPEPPH

SEQ ID NO: 588051 - protein, 13 aa, Mycobacterium
SVAGGKPAWTDGE

SEQ ID NO: 588052 - protein, 8 aa, Mycobacterium
SVAGGPRG

SEQ ID NO: 588053 - protein, 11 aa, Mycobacterium
SVAGRAPGHAG

SEQ ID NO: 588054 - protein, 6 aa, Mycobacterium
SVAGRE

SEQ ID NO: 588055 - protein, 8 aa, Mycobacterium
SVAGSPKD

SEQ ID NO: 588056 - protein, 17 aa, Mycobacterium
SVAGTALDTEDLNPQTG

SEQ ID NO: 588057 - protein, 5 aa, Mycobacterium
SVAKT

SEQ ID NO: 588058 - protein, 6 aa, Mycobacterium
SVAKTD

SEQ ID NO: 588059 - protein, 7 aa, Mycobacterium
SVANADR

SEQ ID NO: 588060 - protein, 5 aa, Mycobacterium
SVANR

SEQ ID NO: 588061 - protein, 11 aa, Mycobacterium
SVANTGQVSSR

SEQ ID NO: 588062 - protein, 7 aa, Mycobacterium
SVAPAAA

SEQ ID NO: 588063 - protein, 8 aa, Mycobacterium
SVAPDGDI

SEQ ID NO: 588064 - protein, 10 aa, Mycobacterium
SVAPEASATS

SEQ ID NO: 588065 - protein, 15 aa, Mycobacterium
SVAPGFAPTDAQDAA

SEQ ID NO: 588066 - protein, 7 aa, Mycobacterium
SVAPPGG

SEQ ID NO: 588067 - protein, 13 aa, Mycobacterium
SVAPRDKAQARRD

SEQ ID NO: 588068 - protein, 6 aa, Mycobacterium
SVAPSL

SEQ ID NO: 588069 - protein, 5 aa, Mycobacterium
SVAPT

SEQ ID NO: 588070 - protein, 5 aa, Mycobacterium
SVAPV

SEQ ID NO: 588071 - protein, 4 aa, Mycobacterium
SVAQ

SEQ ID NO: 588072 - protein, 21 aa, Mycobacterium
SVAQGVEDTMPPTLYVSAQRR

SEQ ID NO: 588073 - protein, 6 aa, Mycobacterium
SVAQPN

SEQ ID NO: 588074 - protein, 16 aa, Mycobacterium
SVAQTGTGALTSSSLT

SEQ ID NO: 588075 - protein, 11 aa, Mycobacterium
SVARGGGRASY

SEQ ID NO: 588076 - protein, 12 aa, Mycobacterium
SVARGGGRASYR

SEQ ID NO: 588077 - protein, 9 aa, Mycobacterium
SVARGRDYY

SEQ ID NO: 588078 - protein, 6 aa, Mycobacterium
SVARGV

SEQ ID NO: 588079 - protein, 8 aa, Mycobacterium
SVARPGTV

SEQ ID NO: 588080 - protein, 7 aa, Mycobacterium
SVARPTR

SEQ ID NO: 588081 - protein, 6 aa, Mycobacterium
SVASAD

SEQ ID NO: 588082 - protein, 10 aa, Mycobacterium
SVASAKSNAY

SEQ ID NO: 588083 - protein, 5 aa, Mycobacterium
SVASD

SEQ ID NO: 588084 - protein, 19 aa, Mycobacterium
SVASEVPAAEKADRNNPDH

SEQ ID NO: 588085 - protein, 15 aa, Mycobacterium
SVASGYRNDPERTAE

SEQ ID NO: 588086 - protein, 13 aa, Mycobacterium
SVASRDAWGGTAP

SEQ ID NO: 588087 - protein, 9 aa, Mycobacterium
SVASTPSAV

SEQ ID NO: 588088 - protein, 7 aa, Mycobacterium
SVATAER

SEQ ID NO: 588089 - protein, 9 aa, Mycobacterium
SVATDDGAI

SEQ ID NO: 588090 - protein, 8 aa, Mycobacterium
SVATDDGS

SEQ ID NO: 588091 - protein, 9 aa, Mycobacterium
SVATEDGAA

SEQ ID NO: 588092 - protein, 9 aa, Mycobacterium
SVATEEGAA

SEQ ID NO: 588093 - protein, 7 aa, Mycobacterium
SVATGDT

SEQ ID NO: 588094 - protein, 7 aa, Mycobacterium
SVATPEH

SEQ ID NO: 588095 - protein, 5 aa, Mycobacterium
SVATR

SEQ ID NO: 588096 - protein, 9 aa, Mycobacterium
SVATREGAE

SEQ ID NO: 588097 - protein, 5 aa, Mycobacterium
SVATT

SEQ ID NO: 588098 - protein, 5 aa, Mycobacterium
SVDAA

SEQ ID NO: 588099 - protein, 8 aa, Mycobacterium
SVDADAKS

SEQ ID NO: 588100 - protein, 6 aa, Mycobacterium
SVDADE

SEQ ID NO: 588101 - protein, 6 aa, Mycobacterium
SVDADV

SEQ ID NO: 588102 - protein, 6 aa, Mycobacterium
SVDAEE

SEQ ID NO: 588103 - protein, 6 aa, Mycobacterium
SVDAGR

SEQ ID NO: 588104 - protein, 8 aa, Mycobacterium
SVDAPGGA

SEQ ID NO: 588105 - protein, 11 aa, Mycobacterium
SVDAPRAGATG

SEQ ID NO: 588106 - protein, 10 aa, Mycobacterium
SVDDAAKAVT

SEQ ID NO: 588107 - protein, 6 aa, Mycobacterium
SVDDAT

SEQ ID NO: 588108 - protein, 8 aa, Mycobacterium
SVDDGKST

SEQ ID NO: 588109 - protein, 9 aa, Mycobacterium
SVDDGKSTL

SEQ ID NO: 588110 - protein, 9 aa, Mycobacterium
SVDDPEPKY

SEQ ID NO: 588111 - protein, 7 aa, Mycobacterium
SVDDPGI

SEQ ID NO: 588112 - protein, 11 aa, Mycobacterium
SVDDQGKRDVS

SEQ ID NO: 588113 - protein, 9 aa, Mycobacterium
SVDDRRPGF

SEQ ID NO: 588114 - protein, 12 aa, Mycobacterium
SVDDSPYGGGPG

SEQ ID NO: 588115 - protein, 12 aa, Mycobacterium
SVDEAEERARGD

SEQ ID NO: 588116 - protein, 11 aa, Mycobacterium
SVDECKDKDMT

SEQ ID NO: 588117 - protein, 7 aa, Mycobacterium
SVDENHT

SEQ ID NO: 588118 - protein, 5 aa, Mycobacterium
SVDET

SEQ ID NO: 588119 - protein, 9 aa, Mycobacterium
SVDGAPLAG

SEQ ID NO: 588120 - protein, 8 aa, Mycobacterium
SVDGDPLN

SEQ ID NO: 588121 - protein, 7 aa, Mycobacterium
SVDGESK

SEQ ID NO: 588122 - protein, 16 aa, Mycobacterium
SVDGNTVRAQVDGESL

SEQ ID NO: 588123 - protein, 15 aa, Mycobacterium
SVDGRSAAADGSSQW

SEQ ID NO: 588124 - protein, 15 aa, Mycobacterium
SVDGRSAANDGTSQW

SEQ ID NO: 588125 - protein, 5 aa, Mycobacterium
SVDHH

SEQ ID NO: 588126 - protein, 4 aa, Mycobacterium
SVDP

SEQ ID NO: 588127 - protein, 5 aa, Mycobacterium
SVDPA

SEQ ID NO: 588128 - protein, 15 aa, Mycobacterium
SVDPAAVRRTRTAVR

SEQ ID NO: 588129 - protein, 7 aa, Mycobacterium
SVDPDEE

SEQ ID NO: 588130 - protein, 7 aa, Mycobacterium
SVDPDHA

SEQ ID NO: 588131 - protein, 9 aa, Mycobacterium
SVDPDSKSV

SEQ ID NO: 588132 - protein, 8 aa, Mycobacterium
SVDPDTKS

SEQ ID NO: 588133 - protein, 8 aa, Mycobacterium
SVDPESRS

SEQ ID NO: 588134 - protein, 15 aa, Mycobacterium
SVDPFNGKSLRASAG

SEQ ID NO: 588135 - protein, 7 aa, Mycobacterium
SVDPGGK

SEQ ID NO: 588136 - protein, 20 aa, Mycobacterium
SVDPMSPPAAPRDQERSWQR

SEQ ID NO: 588137 - protein, 13 aa, Mycobacterium
SVDPNKSIDDPIG

SEQ ID NO: 588138 - protein, 11 aa, Mycobacterium
SVDPNKSIHDP

SEQ ID NO: 588139 - protein, 16 aa, Mycobacterium
SVDPSAAERRRSGPVE

SEQ ID NO: 588140 - protein, 8 aa, Mycobacterium
SVDPSRPL

SEQ ID NO: 588141 - protein, 6 aa, Mycobacterium
SVDQPE

SEQ ID NO: 588142 - protein, 12 aa, Mycobacterium
SVDQTDEQFNTT

SEQ ID NO: 588143 - protein, 7 aa, Mycobacterium
SVDRDDA

SEQ ID NO: 588144 - protein, 5 aa, Mycobacterium
SVDRI

SEQ ID NO: 588145 - protein, 6 aa, Mycobacterium
SVDRNA

SEQ ID NO: 588146 - protein, 12 aa, Mycobacterium
SVDRPSTGDPVL

SEQ ID NO: 588147 - protein, 17 aa, Mycobacterium
SVDRQRHRRGAGIGGAG

SEQ ID NO: 588148 - protein, 8 aa, Mycobacterium
SVDRTPGF

SEQ ID NO: 588149 - protein, 4 aa, Mycobacterium
SVDS

SEQ ID NO: 588150 - protein, 6 aa, Mycobacterium
SVDSEL

SEQ ID NO: 588151 - protein, 5 aa, Mycobacterium
SVDSK

SEQ ID NO: 588152 - protein, 6 aa, Mycobacterium
SVDSPR

SEQ ID NO: 588153 - protein, 13 aa, Mycobacterium
SVDSQSNVRTLPE

SEQ ID NO: 588154 - protein, 7 aa, Mycobacterium
SVDSSGK

SEQ ID NO: 588155 - protein, 13 aa, Mycobacterium
SVDSSGRTEYSHS

SEQ ID NO: 588156 - protein, 5 aa, Mycobacterium
SVDST

SEQ ID NO: 588157 - protein, 4 aa, Mycobacterium
SVDT

SEQ ID NO: 588158 - protein, 6 aa, Mycobacterium
SVDTAG

SEQ ID NO: 588159 - protein, 8 aa, Mycobacterium
SVDTAGTV

SEQ ID NO: 588160 - protein, 5 aa, Mycobacterium
SVDTD

SEQ ID NO: 588161 - protein, 7 aa, Mycobacterium
SVDTDKL

SEQ ID NO: 588162 - protein, 4 aa, Mycobacterium
SVEE

SEQ ID NO: 588163 - protein, 14 aa, Mycobacterium
SVEEAAATAARAGV

SEQ ID NO: 588164 - protein, 5 aa, Mycobacterium
SVEES

SEQ ID NO: 588165 - protein, 4 aa, Mycobacterium
SVEG

SEQ ID NO: 588166 - protein, 9 aa, Mycobacterium
SVEGAQPGD

SEQ ID NO: 588167 - protein, 19 aa, Mycobacterium
SVEGKAKMSQNQPERNRTG

SEQ ID NO: 588168 - protein, 11 aa, Mycobacterium
SVEGQAKPLPD

SEQ ID NO: 588169 - protein, 15 aa, Mycobacterium
SVEGRDRTRALLREL

SEQ ID NO: 588170 - protein, 9 aa, Mycobacterium
SVEGSADPA

SEQ ID NO: 588171 - protein, 9 aa, Mycobacterium
SVEGTQTPH

SEQ ID NO: 588172 - protein, 7 aa, Mycobacterium
SVEGVEA

SEQ ID NO: 588173 - protein, 7 aa, Mycobacterium
SVEIPNE

SEQ ID NO: 588174 - protein, 8 aa, Mycobacterium
SVEKDTDL

SEQ ID NO: 588175 - protein, 6 aa, Mycobacterium
SVELDS

SEQ ID NO: 588176 - protein, 10 aa, Mycobacterium
SVEMDDAEHN

SEQ ID NO: 588177 - protein, 8 aa, Mycobacterium
SVENDTDL

SEQ ID NO: 588178 - protein, 9 aa, Mycobacterium
SVENDTDLY

SEQ ID NO: 588179 - protein, 4 aa, Mycobacterium
SVEP

SEQ ID NO: 588180 - protein, 28 aa, Mycobacterium
SVEPAGTASAAPAPAPLAPSGAARPDDI

SEQ ID NO: 588181 - protein, 7 aa, Mycobacterium
SVEPGAE

SEQ ID NO: 588182 - protein, 10 aa, Mycobacterium
SVEPPGGESF

SEQ ID NO: 588183 - protein, 6 aa, Mycobacterium
SVEPSG

SEQ ID NO: 588184 - protein, 8 aa, Mycobacterium
SVEPSREY

SEQ ID NO: 588185 - protein, 11 aa, Mycobacterium
SVEPTEGTAMN

SEQ ID NO: 588186 - protein, 10 aa, Mycobacterium
SVEQEPAPED

SEQ ID NO: 588187 - protein, 7 aa, Mycobacterium
SVEQGDS

SEQ ID NO: 588188 - protein, 6 aa, Mycobacterium
SVEQLD

SEQ ID NO: 588189 - protein, 8 aa, Mycobacterium
SVERAHGA

SEQ ID NO: 588190 - protein, 6 aa, Mycobacterium
SVERDA

SEQ ID NO: 588191 - protein, 12 aa, Mycobacterium
SVERPSTGDPVL

SEQ ID NO: 588192 - protein, 5 aa, Mycobacterium
SVERS

SEQ ID NO: 588193 - protein, 4 aa, Mycobacterium
SVES

SEQ ID NO: 588194 - protein, 7 aa, Mycobacterium
SVESGQI

SEQ ID NO: 588195 - protein, 6 aa, Mycobacterium
SVESGR

SEQ ID NO: 588196 - protein, 11 aa, Mycobacterium
SVESPAGPATG

SEQ ID NO: 588197 - protein, 7 aa, Mycobacterium
SVESTEA

SEQ ID NO: 588198 - protein, 11 aa, Mycobacterium
SVETGGPEGLA

SEQ ID NO: 588199 - protein, 8 aa, Mycobacterium
SVETGRKH

SEQ ID NO: 588200 - protein, 10 aa, Mycobacterium
SVETGRKKAI

SEQ ID NO: 588201 - protein, 13 aa, Mycobacterium
SVETNGKGCAGGV

SEQ ID NO: 588202 - protein, 11 aa, Mycobacterium
SVETSRANLRS

SEQ ID NO: 588203 - protein, 16 aa, Mycobacterium
SVETTQGRQTALPRTT

SEQ ID NO: 588204 - protein, 4 aa, Mycobacterium
SVEV

SEQ ID NO: 588205 - protein, 6 aa, Mycobacterium
SVFAGP

SEQ ID NO: 588206 - protein, 5 aa, Mycobacterium
SVGAD

SEQ ID NO: 588207 - protein, 23 aa, Mycobacterium
SVGAEVTGLDPGRLGPGDPTGQA

SEQ ID NO: 588208 - protein, 15 aa, Mycobacterium
SVGAPPDNFTPRGQD

SEQ ID NO: 588209 - protein, 7 aa, Mycobacterium
SVGASAS

SEQ ID NO: 588210 - protein, 9 aa, Mycobacterium
SVGATATAV

SEQ ID NO: 588211 - protein, 12 aa, Mycobacterium
SVGATATSVAAS

SEQ ID NO: 588212 - protein, 13 aa, Mycobacterium
SVGDEDSYSLATS

SEQ ID NO: 588213 - protein, 12 aa, Mycobacterium
SVGDEDSYTLAS

SEQ ID NO: 588214 - protein, 7 aa, Mycobacterium
SVGDGAG

SEQ ID NO: 588215 - protein, 7 aa, Mycobacterium
SVGDGAT

SEQ ID NO: 588216 - protein, 8 aa, Mycobacterium
SVGDPNAG

SEQ ID NO: 588217 - protein, 9 aa, Mycobacterium
SVGDPTDEV

SEQ ID NO: 588218 - protein, 11 aa, Mycobacterium
SVGDQGKRDVS

SEQ ID NO: 588219 - protein, 18 aa, Mycobacterium
SVGDRAELAARPGREGDL

SEQ ID NO: 588220 - protein, 5 aa, Mycobacterium
SVGEI

SEQ ID NO: 588221 - protein, 7 aa, Mycobacterium
SVGEKLD

SEQ ID NO: 588222 - protein, 12 aa, Mycobacterium
SVGEPARRAAAK

SEQ ID NO: 588223 - protein, 18 aa, Mycobacterium
SVGEPGAAQAVGQSLGRN

SEQ ID NO: 588224 - protein, 11 aa, Mycobacterium
SVGFPTPTRHT

SEQ ID NO: 588225 - protein, 8 aa, Mycobacterium
SVGGAAVE

SEQ ID NO: 588226 - protein, 16 aa, Mycobacterium
SVGGGVPELGEPERTR

SEQ ID NO: 588227 - protein, 16 aa, Mycobacterium
SVGGHKSDNQAVGDDV

SEQ ID NO: 588228 - protein, 7 aa, Mycobacterium
SVGGQGF

SEQ ID NO: 588229 - protein, 6 aa, Mycobacterium
SVGGRA

SEQ ID NO: 588230 - protein, 12 aa, Mycobacterium
SVGGRKAYPNTG

SEQ ID NO: 588231 - protein, 8 aa, Mycobacterium
SVGGTPRF

SEQ ID NO: 588232 - protein, 6 aa, Mycobacterium
SVGKGT

SEQ ID NO: 588233 - protein, 8 aa, Mycobacterium
SVGKTTTV

SEQ ID NO: 588234 - protein, 14 aa, Mycobacterium
SVGLGSSARERNAA

SEQ ID NO: 588235 - protein, 13 aa, Mycobacterium
SVGLGTDKTRDLA

SEQ ID NO: 588236 - protein, 7 aa, Mycobacterium
SVGNAER

SEQ ID NO: 588237 - protein, 6 aa, Mycobacterium
SVGNDT

SEQ ID NO: 588238 - protein, 7 aa, Mycobacterium
SVGNGYP

SEQ ID NO: 588239 - protein, 7 aa, Mycobacterium
SVGNRPA

SEQ ID NO: 588240 - protein, 4 aa, Mycobacterium
SVGP

SEQ ID NO: 588241 - protein, 15 aa, Mycobacterium
SVGPADEGATIFRSA

SEQ ID NO: 588242 - protein, 9 aa, Mycobacterium
SVGPASGAA

SEQ ID NO: 588243 - protein, 11 aa, Mycobacterium
SVGPDATADAV

SEQ ID NO: 588244 - protein, 5 aa, Mycobacterium
SVGPG

SEQ ID NO: 588245 - protein, 9 aa, Mycobacterium
SVGPGSTNM

SEQ ID NO: 588246 - protein, 10 aa, Mycobacterium
SVGPNGKIKA

SEQ ID NO: 588247 - protein, 8 aa, Mycobacterium
SVGPQGVS

SEQ ID NO: 588248 - protein, 10 aa, Mycobacterium
SVGPSETVDA

SEQ ID NO: 588249 - protein, 20 aa, Mycobacterium
SVGPTRRTRAPRKRGDDTRA

SEQ ID NO: 588250 - protein, 24 aa, Mycobacterium
SVGPYAAQRGLSDASPAALAADPE

SEQ ID NO: 588251 - protein, 11 aa, Mycobacterium
SVGQAERLGGI

SEQ ID NO: 588252 - protein, 10 aa, Mycobacterium
SVGQGNPDAG

SEQ ID NO: 588253 - protein, 6 aa, Mycobacterium
SVGQVD

SEQ ID NO: 588254 - protein, 7 aa, Mycobacterium
SVGRGFR

SEQ ID NO: 588255 - protein, 6 aa, Mycobacterium
SVGRGR

SEQ ID NO: 588256 - protein, 20 aa, Mycobacterium
SVGRGRHQLRTGAGTHDYVQ

SEQ ID NO: 588257 - protein, 7 aa, Mycobacterium
SVGRPAE

SEQ ID NO: 588258 - protein, 9 aa, Mycobacterium
SVGRPAELG

SEQ ID NO: 588259 - protein, 6 aa, Mycobacterium
SVGRPV

SEQ ID NO: 588260 - protein, 9 aa, Mycobacterium
SVGRSGVAT

SEQ ID NO: 588261 - protein, 7 aa, Mycobacterium
SVGRSYG

SEQ ID NO: 588262 - protein, 5 aa, Mycobacterium
SVGRT

SEQ ID NO: 588263 - protein, 4 aa, Mycobacterium
SVGS

SEQ ID NO: 588264 - protein, 10 aa, Mycobacterium
SVGSEGRRRA

SEQ ID NO: 588265 - protein, 54 aa, Mycobacterium
SVGSGGAGLGGGSGGGAGLGGGGTVPASSLGPPPVPTSSPPTTPAGAKAPIMPA

SEQ ID NO: 588266 - protein, 5 aa, Mycobacterium
SVGSH

SEQ ID NO: 588267 - protein, 8 aa, Mycobacterium
SVGSQGIA

SEQ ID NO: 588268 - protein, 9 aa, Mycobacterium
SVGSQGYAN

SEQ ID NO: 588269 - protein, 9 aa, Mycobacterium
SVGSTATGV

SEQ ID NO: 588270 - protein, 4 aa, Mycobacterium
SVGT

SEQ ID NO: 588271 - protein, 5 aa, Mycobacterium
SVGTA

SEQ ID NO: 588272 - protein, 12 aa, Mycobacterium
SVGTAPERVGQN

SEQ ID NO: 588273 - protein, 15 aa, Mycobacterium
SVGTVEEAAAWVALL

SEQ ID NO: 588274 - protein, 5 aa, Mycobacterium
SVGVA

SEQ ID NO: 588275 - protein, 9 aa, Mycobacterium
SVHEGERRE

SEQ ID NO: 588276 - protein, 9 aa, Mycobacterium
SVHEGGAAI

SEQ ID NO: 588277 - protein, 13 aa, Mycobacterium
SVHGPGATEVRAS

SEQ ID NO: 588278 - protein, 14 aa, Mycobacterium
SVHGQTDRPGRNQL

SEQ ID NO: 588279 - protein, 5 aa, Mycobacterium
SVHNS

SEQ ID NO: 588280 - protein, 6 aa, Mycobacterium
SVHPAD

SEQ ID NO: 588281 - protein, 17 aa, Mycobacterium
SVHPGGHAHGPQRGAYE

SEQ ID NO: 588282 - protein, 5 aa, Mycobacterium
SVHPT

SEQ ID NO: 588283 - protein, 4 aa, Mycobacterium
SVHS

SEQ ID NO: 588284 - protein, 6 aa, Mycobacterium
SVHSQT

SEQ ID NO: 588285 - protein, 5 aa, Mycobacterium
SVIAS

SEQ ID NO: 588286 - protein, 11 aa, Mycobacterium
SVIGGANAEGI

SEQ ID NO: 588287 - protein, 11 aa, Mycobacterium
SVIGGANAKGI

SEQ ID NO: 588288 - protein, 12 aa, Mycobacterium
SVIGTSSPRRAA

SEQ ID NO: 588289 - protein, 11 aa, Mycobacterium
SVIGTSSPRRV

SEQ ID NO: 588290 - protein, 13 aa, Mycobacterium
SVIPEEAAGRLAE

SEQ ID NO: 588291 - protein, 11 aa, Mycobacterium
SVIPGGVNSPV

SEQ ID NO: 588292 - protein, 10 aa, Mycobacterium
SVIPPGDQSV

SEQ ID NO: 588293 - protein, 51 aa, Mycobacterium
SVKARSGGGNGKAAEKKAPAKKSAAKKTAAKKALAKKTAAKKAPAKKAASK

SEQ ID NO: 588294 - protein, 12 aa, Mycobacterium
SVKDGVHEAGGY

SEQ ID NO: 588295 - protein, 10 aa, Mycobacterium
SVKERKGSVH

SEQ ID NO: 588296 - protein, 10 aa, Mycobacterium
SVKGADKGAY

SEQ ID NO: 588297 - protein, 8 aa, Mycobacterium
SVKGPDAV

SEQ ID NO: 588298 - protein, 9 aa, Mycobacterium
SVKGPKGAL

SEQ ID NO: 588299 - protein, 9 aa, Mycobacterium
SVKGPKGSL

SEQ ID NO: 588300 - protein, 9 aa, Mycobacterium
SVKGPKGTL

SEQ ID NO: 588301 - protein, 9 aa, Mycobacterium
SVKNGPALA

SEQ ID NO: 588302 - protein, 16 aa, Mycobacterium
SVKNGRSARYHAGQPA

SEQ ID NO: 588303 - protein, 6 aa, Mycobacterium
SVKPEE

SEQ ID NO: 588304 - protein, 5 aa, Mycobacterium
SVKPG

SEQ ID NO: 588305 - protein, 11 aa, Mycobacterium
SVKRNQPAAAI

SEQ ID NO: 588306 - protein, 6 aa, Mycobacterium
SVKSPG

SEQ ID NO: 588307 - protein, 5 aa, Mycobacterium
SVLAS

SEQ ID NO: 588308 - protein, 6 aa, Mycobacterium
SVLGDE

SEQ ID NO: 588309 - protein, 10 aa, Mycobacterium
SVLPGPGPLG

SEQ ID NO: 588310 - protein, 9 aa, Mycobacterium
SVLRGSGRE

SEQ ID NO: 588311 - protein, 10 aa, Mycobacterium
SVLSGSPREI

SEQ ID NO: 588312 - protein, 9 aa, Mycobacterium
SVLSNDSTR

SEQ ID NO: 588313 - protein, 11 aa, Mycobacterium
SVLTDDARKAE

SEQ ID NO: 588314 - protein, 11 aa, Mycobacterium
SVLTDEARQAE

SEQ ID NO: 588315 - protein, 7 aa, Mycobacterium
SVNAAPG

SEQ ID NO: 588316 - protein, 16 aa, Mycobacterium
SVNARNARGGTAPTQV

SEQ ID NO: 588317 - protein, 4 aa, Mycobacterium
SVND

SEQ ID NO: 588318 - protein, 5 aa, Mycobacterium
SVNGA

SEQ ID NO: 588319 - protein, 12 aa, Mycobacterium
SVNGEGPGAGLD

SEQ ID NO: 588320 - protein, 9 aa, Mycobacterium
SVNGHEGSA

SEQ ID NO: 588321 - protein, 13 aa, Mycobacterium
SVNGKRPAHYRTA

SEQ ID NO: 588322 - protein, 8 aa, Mycobacterium
SVNGRRPA

SEQ ID NO: 588323 - protein, 14 aa, Mycobacterium
SVNNRPHELMVVPV

SEQ ID NO: 588324 - protein, 13 aa, Mycobacterium
SVNPDAAGAARRA

SEQ ID NO: 588325 - protein, 7 aa, Mycobacterium
SVNPERI

SEQ ID NO: 588326 - protein, 6 aa, Mycobacterium
SVNQVG

SEQ ID NO: 588327 - protein, 5 aa, Mycobacterium
SVNRS

SEQ ID NO: 588328 - protein, 7 aa, Mycobacterium
SVNRSAK

SEQ ID NO: 588329 - protein, 11 aa, Mycobacterium
SVNSDTTARYD

SEQ ID NO: 588330 - protein, 9 aa, Mycobacterium
SVNSHEGSA

SEQ ID NO: 588331 - protein, 8 aa, Mycobacterium
SVNSHSSV

SEQ ID NO: 588332 - protein, 20 aa, Mycobacterium
SVNTAGSDNGATASADGSCN

SEQ ID NO: 588333 - protein, 26 aa, Mycobacterium
SVNTANRPGKRKRTRTGYGQRKATKR

SEQ ID NO: 588334 - protein, 27 aa, Mycobacterium
SVNTANRQGKRKRTRTGFGKRKSTKRA

SEQ ID NO: 588335 - protein, 26 aa, Mycobacterium
SVNTANRQGKRKRTRTGFGQRKSTKR

SEQ ID NO: 588336 - protein, 8 aa, Mycobacterium
SVNTDNAE

SEQ ID NO: 588337 - protein, 47 aa, Mycobacterium
SVNTGFGSSIDQPGSVSGFNNTGTDVSGFNNTGPATSGFQNTNTGLG

SEQ ID NO: 588338 - protein, 26 aa, Mycobacterium
SVNTGFGSSIDQPGTVSGFGNTGTNM

SEQ ID NO: 588339 - protein, 36 aa, Mycobacterium
SVNTGIGSPDTQPGSVSGFGNTGTALSGFNNSGSFT

SEQ ID NO: 588340 - protein, 13 aa, Mycobacterium
SVNTGSKGRDEAI

SEQ ID NO: 588341 - protein, 5 aa, Mycobacterium
SVNTS

SEQ ID NO: 588342 - protein, 38 aa, Mycobacterium
SVPAAEPPAYVPPAPAPEPAYVPPAPEPAYVPPPPPAF

SEQ ID NO: 588343 - protein, 5 aa, Mycobacterium
SVPAG

SEQ ID NO: 588344 - protein, 7 aa, Mycobacterium
SVPAGTV

SEQ ID NO: 588345 - protein, 5 aa, Mycobacterium
SVPAP

SEQ ID NO: 588346 - protein, 13 aa, Mycobacterium
SVPAPPRGAIDKV

SEQ ID NO: 588347 - protein, 5 aa, Mycobacterium
SVPAQ

SEQ ID NO: 588348 - protein, 8 aa, Mycobacterium
SVPARSAG

SEQ ID NO: 588349 - protein, 6 aa, Mycobacterium
SVPAST

SEQ ID NO: 588350 - protein, 5 aa, Mycobacterium
SVPCS

SEQ ID NO: 588351 - protein, 4 aa, Mycobacterium
SVPD

SEQ ID NO: 588352 - protein, 20 aa, Mycobacterium
SVPDAAAAQNAADHTALPLS

SEQ ID NO: 588353 - protein, 6 aa, Mycobacterium
SVPDAE

SEQ ID NO: 588354 - protein, 8 aa, Mycobacterium
SVPDAPAP

SEQ ID NO: 588355 - protein, 7 aa, Mycobacterium
SVPDETD

SEQ ID NO: 588356 - protein, 8 aa, Mycobacterium
SVPDGPGL

SEQ ID NO: 588357 - protein, 7 aa, Mycobacterium
SVPDGSR

SEQ ID NO: 588358 - protein, 6 aa, Mycobacterium
SVPDRD

SEQ ID NO: 588359 - protein, 12 aa, Mycobacterium
SVPDRRPSAEEV

SEQ ID NO: 588360 - protein, 7 aa, Mycobacterium
SVPDSVA

SEQ ID NO: 588361 - protein, 7 aa, Mycobacterium
SVPDSVG

SEQ ID NO: 588362 - protein, 6 aa, Mycobacterium
SVPDYA

SEQ ID NO: 588363 - protein, 7 aa, Mycobacterium
SVPDYQG

SEQ ID NO: 588364 - protein, 4 aa, Mycobacterium
SVPE

SEQ ID NO: 588365 - protein, 7 aa, Mycobacterium
SVPEGTS

SEQ ID NO: 588366 - protein, 15 aa, Mycobacterium
SVPENPTGDFDAAAE

SEQ ID NO: 588367 - protein, 6 aa, Mycobacterium
SVPEQA

SEQ ID NO: 588368 - protein, 8 aa, Mycobacterium
SVPEQSRA

SEQ ID NO: 588369 - protein, 8 aa, Mycobacterium
SVPESTEE

SEQ ID NO: 588370 - protein, 13 aa, Mycobacterium
SVPFGKGEMPAKG

SEQ ID NO: 588371 - protein, 4 aa, Mycobacterium
SVPG

SEQ ID NO: 588372 - protein, 8 aa, Mycobacterium
SVPGAGSA

SEQ ID NO: 588373 - protein, 6 aa, Mycobacterium
SVPGAR

SEQ ID NO: 588374 - protein, 9 aa, Mycobacterium
SVPGARNDG

SEQ ID NO: 588375 - protein, 7 aa, Mycobacterium
SVPGDRA

SEQ ID NO: 588376 - protein, 7 aa, Mycobacterium
SVPGGQA

SEQ ID NO: 588377 - protein, 12 aa, Mycobacterium
SVPGGTTADPAT

SEQ ID NO: 588378 - protein, 18 aa, Mycobacterium
SVPGKLKQGGETKETGTT

SEQ ID NO: 588379 - protein, 16 aa, Mycobacterium
SVPGPIPTSGTAKSVQ

SEQ ID NO: 588380 - protein, 9 aa, Mycobacterium
SVPGQRDHS

SEQ ID NO: 588381 - protein, 7 aa, Mycobacterium
SVPGSTI

SEQ ID NO: 588382 - protein, 11 aa, Mycobacterium
SVPGTDRLSES

SEQ ID NO: 588383 - protein, 5 aa, Mycobacterium
SVPGV

SEQ ID NO: 588384 - protein, 6 aa, Mycobacterium
SVPGVS

SEQ ID NO: 588385 - protein, 4 aa, Mycobacterium
SVPH

SEQ ID NO: 588386 - protein, 7 aa, Mycobacterium
SVPIPDP

SEQ ID NO: 588387 - protein, 9 aa, Mycobacterium
SVPLGSTDM

SEQ ID NO: 588388 - protein, 13 aa, Mycobacterium
SVPPADDESQPDV

SEQ ID NO: 588389 - protein, 9 aa, Mycobacterium
SVPPATPAP

SEQ ID NO: 588390 - protein, 7 aa, Mycobacterium
SVPPAVD

SEQ ID NO: 588391 - protein, 7 aa, Mycobacterium
SVPPEVT

SEQ ID NO: 588392 - protein, 5 aa, Mycobacterium
SVPPF

SEQ ID NO: 588393 - protein, 6 aa, Mycobacterium
SVPPGK

SEQ ID NO: 588394 - protein, 6 aa, Mycobacterium
SVPPGW

SEQ ID NO: 588395 - protein, 24 aa, Mycobacterium
SVPPGWDPLPSAAGAKVATVSARG

SEQ ID NO: 588396 - protein, 6 aa, Mycobacterium
SVPPPL

SEQ ID NO: 588397 - protein, 13 aa, Mycobacterium
SVPPPPIPDLPEP

SEQ ID NO: 588398 - protein, 6 aa, Mycobacterium
SVPPRS

SEQ ID NO: 588399 - protein, 6 aa, Mycobacterium
SVPPSL

SEQ ID NO: 588400 - protein, 6 aa, Mycobacterium
SVPPSV

SEQ ID NO: 588401 - protein, 20 aa, Mycobacterium
SVPPSWAASAPEAATAPAAM

SEQ ID NO: 588402 - protein, 6 aa, Mycobacterium
SVPPTL

SEQ ID NO: 588403 - protein, 15 aa, Mycobacterium
SVPPTPRSTRPPTQA

SEQ ID NO: 588404 - protein, 4 aa, Mycobacterium
SVPQ

SEQ ID NO: 588405 - protein, 12 aa, Mycobacterium
SVPRPQRRQRTT

SEQ ID NO: 588406 - protein, 12 aa, Mycobacterium
SVPRTREPKVQQ

SEQ ID NO: 588407 - protein, 7 aa, Mycobacterium
SVPRVPG

SEQ ID NO: 588408 - protein, 6 aa, Mycobacterium
SVPSAP

SEQ ID NO: 588409 - protein, 5 aa, Mycobacterium
SVPSD

SEQ ID NO: 588410 - protein, 7 aa, Mycobacterium
SVPSDVD

SEQ ID NO: 588411 - protein, 21 aa, Mycobacterium
SVPSELDGAGRNADEDGPVSV

SEQ ID NO: 588412 - protein, 10 aa, Mycobacterium
SVPSGRPARL

SEQ ID NO: 588413 - protein, 5 aa, Mycobacterium
SVPSP

SEQ ID NO: 588414 - protein, 24 aa, Mycobacterium
SVPSQQSADQDEMREKMKDSTDRW

SEQ ID NO: 588415 - protein, 6 aa, Mycobacterium
SVPSSA

SEQ ID NO: 588416 - protein, 6 aa, Mycobacterium
SVPSSI

SEQ ID NO: 588417 - protein, 17 aa, Mycobacterium
SVPSVPETPAPQNLTSG

SEQ ID NO: 588418 - protein, 8 aa, Mycobacterium
SVPTGEPL

SEQ ID NO: 588419 - protein, 6 aa, Mycobacterium
SVPTGN

SEQ ID NO: 588420 - protein, 6 aa, Mycobacterium
SVQAAK

SEQ ID NO: 588421 - protein, 5 aa, Mycobacterium
SVQAS

SEQ ID NO: 588422 - protein, 4 aa, Mycobacterium
SVQD

SEQ ID NO: 588423 - protein, 4 aa, Mycobacterium
SVQE

SEQ ID NO: 588424 - protein, 7 aa, Mycobacterium
SVQGKTV

SEQ ID NO: 588425 - protein, 6 aa, Mycobacterium
SVQGRD

SEQ ID NO: 588426 - protein, 9 aa, Mycobacterium
SVQGRGGKG

SEQ ID NO: 588427 - protein, 5 aa, Mycobacterium
SVQNT

SEQ ID NO: 588428 - protein, 17 aa, Mycobacterium
SVQPASEITPTLTSGAM

SEQ ID NO: 588429 - protein, 6 aa, Mycobacterium
SVQPGQ

SEQ ID NO: 588430 - protein, 5 aa, Mycobacterium
SVQPR

SEQ ID NO: 588431 - protein, 6 aa, Mycobacterium
SVQQAA

SEQ ID NO: 588432 - protein, 5 aa, Mycobacterium
SVQQS

SEQ ID NO: 588433 - protein, 6 aa, Mycobacterium
SVQRTS

SEQ ID NO: 588434 - protein, 6 aa, Mycobacterium
SVQSDR

SEQ ID NO: 588435 - protein, 12 aa, Mycobacterium
SVQSTAARKPIE

SEQ ID NO: 588436 - protein, 5 aa, Mycobacterium
SVQTE

SEQ ID NO: 588437 - protein, 6 aa, Mycobacterium
SVQTRS

SEQ ID NO: 588438 - protein, 8 aa, Mycobacterium
SVQTSNDA

SEQ ID NO: 588439 - protein, 6 aa, Mycobacterium
SVRAEA

SEQ ID NO: 588440 - protein, 5 aa, Mycobacterium
SVRAG

SEQ ID NO: 588441 - protein, 6 aa, Mycobacterium
SVRDPD

SEQ ID NO: 588442 - protein, 8 aa, Mycobacterium
SVRDPETK

SEQ ID NO: 588443 - protein, 9 aa, Mycobacterium
SVRDTGLGE

SEQ ID NO: 588444 - protein, 5 aa, Mycobacterium
SVREA

SEQ ID NO: 588445 - protein, 10 aa, Mycobacterium
SVREAPDPEL

SEQ ID NO: 588446 - protein, 11 aa, Mycobacterium
SVREGEAGGIT

SEQ ID NO: 588447 - protein, 15 aa, Mycobacterium
SVREGLEGGAPPTAT

SEQ ID NO: 588448 - protein, 12 aa, Mycobacterium
SVRETADPEPMR

SEQ ID NO: 588449 - protein, 14 aa, Mycobacterium
SVRETDDPEAIQRG

SEQ ID NO: 588450 - protein, 11 aa, Mycobacterium
SVRETDEDYTV

SEQ ID NO: 588451 - protein, 4 aa, Mycobacterium
SVRG

SEQ ID NO: 588452 - protein, 6 aa, Mycobacterium
SVRGDG

SEQ ID NO: 588453 - protein, 16 aa, Mycobacterium
SVRGGAATTLPGTVGE

SEQ ID NO: 588454 - protein, 14 aa, Mycobacterium
SVRGKSDRPGRNQT

SEQ ID NO: 588455 - protein, 13 aa, Mycobacterium
SVRGKSSRPGRNQ

SEQ ID NO: 588456 - protein, 10 aa, Mycobacterium
SVRGKVGDSL

SEQ ID NO: 588457 - protein, 11 aa, Mycobacterium
SVRGPSDDATV

SEQ ID NO: 588458 - protein, 7 aa, Mycobacterium
SVRGSRE

SEQ ID NO: 588459 - protein, 7 aa, Mycobacterium
SVRGTGG

SEQ ID NO: 588460 - protein, 8 aa, Mycobacterium
SVRGTGGL

SEQ ID NO: 588461 - protein, 6 aa, Mycobacterium
SVRGVA

SEQ ID NO: 588462 - protein, 9 aa, Mycobacterium
SVRKQQLSQ

SEQ ID NO: 588463 - protein, 7 aa, Mycobacterium
SVRKSGT

SEQ ID NO: 588464 - protein, 5 aa, Mycobacterium
SVRKT

SEQ ID NO: 588465 - protein, 5 aa, Mycobacterium
SVRLD

SEQ ID NO: 588466 - protein, 8 aa, Mycobacterium
SVRNAPGF

SEQ ID NO: 588467 - protein, 8 aa, Mycobacterium
SVRNEAQA

SEQ ID NO: 588468 - protein, 10 aa, Mycobacterium
SVRNTGDSQP

SEQ ID NO: 588469 - protein, 12 aa, Mycobacterium
SVRPAGADEVST

SEQ ID NO: 588470 - protein, 7 aa, Mycobacterium
SVRPAGE

SEQ ID NO: 588471 - protein, 11 aa, Mycobacterium
SVRPAGSAPAY

SEQ ID NO: 588472 - protein, 4 aa, Mycobacterium
SVRR

SEQ ID NO: 588473 - protein, 13 aa, Mycobacterium
SVRRASDELKGRY

SEQ ID NO: 588474 - protein, 9 aa, Mycobacterium
SVRRATDAL

SEQ ID NO: 588475 - protein, 5 aa, Mycobacterium
SVRRE

SEQ ID NO: 588476 - protein, 6 aa, Mycobacterium
SVRRTG

SEQ ID NO: 588477 - protein, 9 aa, Mycobacterium
SVRSAADAL

SEQ ID NO: 588478 - protein, 10 aa, Mycobacterium
SVRSDKPITE

SEQ ID NO: 588479 - protein, 7 aa, Mycobacterium
SVRSQGH

SEQ ID NO: 588480 - protein, 12 aa, Mycobacterium
SVRTAADELKGA

SEQ ID NO: 588481 - protein, 6 aa, Mycobacterium
SVRTGT

SEQ ID NO: 588482 - protein, 4 aa, Mycobacterium
SVSA

SEQ ID NO: 588483 - protein, 8 aa, Mycobacterium
SVSAAGSL

SEQ ID NO: 588484 - protein, 10 aa, Mycobacterium
SVSAAHGEQV

SEQ ID NO: 588485 - protein, 10 aa, Mycobacterium
SVSAERTPAA

SEQ ID NO: 588486 - protein, 10 aa, Mycobacterium
SVSAGGGPRR

SEQ ID NO: 588487 - protein, 10 aa, Mycobacterium
SVSAPVRDRH

SEQ ID NO: 588488 - protein, 8 aa, Mycobacterium
SVSDADRI

SEQ ID NO: 588489 - protein, 10 aa, Mycobacterium
SVSDDDETTR

SEQ ID NO: 588490 - protein, 10 aa, Mycobacterium
SVSDGDETTR

SEQ ID NO: 588491 - protein, 9 aa, Mycobacterium
SVSDNGRQE

SEQ ID NO: 588492 - protein, 16 aa, Mycobacterium
SVSDTARQAGFGSPET

SEQ ID NO: 588493 - protein, 10 aa, Mycobacterium
SVSDTDGRPV

SEQ ID NO: 588494 - protein, 10 aa, Mycobacterium
SVSEEARRRS

SEQ ID NO: 588495 - protein, 11 aa, Mycobacterium
SVSEEKKTALG

SEQ ID NO: 588496 - protein, 8 aa, Mycobacterium
SVSEEYRQ

SEQ ID NO: 588497 - protein, 15 aa, Mycobacterium
SVSESDVERLREALL

SEQ ID NO: 588498 - protein, 4 aa, Mycobacterium
SVSG

SEQ ID NO: 588499 - protein, 11 aa, Mycobacterium
SVSGAGGIRGP

SEQ ID NO: 588500 - protein, 10 aa, Mycobacterium
SVSGARQQYA

SEQ ID NO: 588501 - protein, 15 aa, Mycobacterium
SVSGDPYAAPAAETP

SEQ ID NO: 588502 - protein, 9 aa, Mycobacterium
SVSGGAPLG

SEQ ID NO: 588503 - protein, 9 aa, Mycobacterium
SVSGGHVGR

SEQ ID NO: 588504 - protein, 21 aa, Mycobacterium
SVSGPAAPQGIRRLQRYRRLS

SEQ ID NO: 588505 - protein, 16 aa, Mycobacterium
SVSGPAGAGGHGGDAG

SEQ ID NO: 588506 - protein, 9 aa, Mycobacterium
SVSGPAPEH

SEQ ID NO: 588507 - protein, 17 aa, Mycobacterium
SVSGPISGRDLFGAADA

SEQ ID NO: 588508 - protein, 8 aa, Mycobacterium
SVSGPSAH

SEQ ID NO: 588509 - protein, 6 aa, Mycobacterium
SVSGRE

SEQ ID NO: 588510 - protein, 8 aa, Mycobacterium
SVSGRGDL

SEQ ID NO: 588511 - protein, 6 aa, Mycobacterium
SVSGSQ

SEQ ID NO: 588512 - protein, 6 aa, Mycobacterium
SVSGYG

SEQ ID NO: 588513 - protein, 9 aa, Mycobacterium
SVSKDTISR

SEQ ID NO: 588514 - protein, 15 aa, Mycobacterium
SVSKGPGINDNGTGV

SEQ ID NO: 588515 - protein, 11 aa, Mycobacterium
SVSNGEKRWDA

SEQ ID NO: 588516 - protein, 5 aa, Mycobacterium
SVSNV

SEQ ID NO: 588517 - protein, 4 aa, Mycobacterium
SVSP

SEQ ID NO: 588518 - protein, 5 aa, Mycobacterium
SVSPA

SEQ ID NO: 588519 - protein, 9 aa, Mycobacterium
SVSPAATAG

SEQ ID NO: 588520 - protein, 6 aa, Mycobacterium
SVSPAI

SEQ ID NO: 588521 - protein, 8 aa, Mycobacterium
SVSPARGE

SEQ ID NO: 588522 - protein, 9 aa, Mycobacterium
SVSPDDGLD

SEQ ID NO: 588523 - protein, 24 aa, Mycobacterium
SVSPGAAADGIRRRPKDRKAQIAR

SEQ ID NO: 588524 - protein, 13 aa, Mycobacterium
SVSPGPTRTPTTL

SEQ ID NO: 588525 - protein, 6 aa, Mycobacterium
SVSPRA

SEQ ID NO: 588526 - protein, 5 aa, Mycobacterium
SVSPS

SEQ ID NO: 588527 - protein, 7 aa, Mycobacterium
SVSPTTV

SEQ ID NO: 588528 - protein, 15 aa, Mycobacterium
SVSQKGRDLSANPAA

SEQ ID NO: 588529 - protein, 4 aa, Mycobacterium
SVSR

SEQ ID NO: 588530 - protein, 6 aa, Mycobacterium
SVSRAG

SEQ ID NO: 588531 - protein, 9 aa, Mycobacterium
SVSRDERRI

SEQ ID NO: 588532 - protein, 11 aa, Mycobacterium
SVSRDGPSRAY

SEQ ID NO: 588533 - protein, 11 aa, Mycobacterium
SVSRGATARAV

SEQ ID NO: 588534 - protein, 12 aa, Mycobacterium
SVSRGPRGIGAA

SEQ ID NO: 588535 - protein, 14 aa, Mycobacterium
SVSRPNGAWSSSSV

SEQ ID NO: 588536 - protein, 10 aa, Mycobacterium
SVSRRPANPE

SEQ ID NO: 588537 - protein, 13 aa, Mycobacterium
SVSRSGGGGTFMQ

SEQ ID NO: 588538 - protein, 11 aa, Mycobacterium
SVSRSGPSRAY

SEQ ID NO: 588539 - protein, 4 aa, Mycobacterium
SVSS

SEQ ID NO: 588540 - protein, 9 aa, Mycobacterium
SVSSADRPI

SEQ ID NO: 588541 - protein, 16 aa, Mycobacterium
SVSSDKVRRTQHTPDI

SEQ ID NO: 588542 - protein, 14 aa, Mycobacterium
SVSSEVDSPAAQRY

SEQ ID NO: 588543 - protein, 7 aa, Mycobacterium
SVSSGEA

SEQ ID NO: 588544 - protein, 9 aa, Mycobacterium
SVSSGEWPV

SEQ ID NO: 588545 - protein, 6 aa, Mycobacterium
SVSSNT

SEQ ID NO: 588546 - protein, 6 aa, Mycobacterium
SVSSPS

SEQ ID NO: 588547 - protein, 7 aa, Mycobacterium
SVSTSTL

SEQ ID NO: 588548 - protein, 8 aa, Mycobacterium
SVSTTVTP

SEQ ID NO: 588549 - protein, 8 aa, Mycobacterium
SVSTYTST

SEQ ID NO: 588550 - protein, 12 aa, Mycobacterium
SVTAADASRDYW

SEQ ID NO: 588551 - protein, 10 aa, Mycobacterium
SVTAAEGDAL

SEQ ID NO: 588552 - protein, 8 aa, Mycobacterium
SVTAEQVS

SEQ ID NO: 588553 - protein, 7 aa, Mycobacterium
SVTAEYR

SEQ ID NO: 588554 - protein, 8 aa, Mycobacterium
SVTAGSVP

SEQ ID NO: 588555 - protein, 9 aa, Mycobacterium
SVTAPVAAA

SEQ ID NO: 588556 - protein, 30 aa, Mycobacterium
SVTAPVAAPAASAAASAGTAPAAPAAPAAV

SEQ ID NO: 588557 - protein, 5 aa, Mycobacterium
SVTAS

SEQ ID NO: 588558 - protein, 6 aa, Mycobacterium
SVTASR

SEQ ID NO: 588559 - protein, 13 aa, Mycobacterium
SVTATPRTSPAPQ

SEQ ID NO: 588560 - protein, 5 aa, Mycobacterium
SVTDA

SEQ ID NO: 588561 - protein, 7 aa, Mycobacterium
SVTDAYR

SEQ ID NO: 588562 - protein, 10 aa, Mycobacterium
SVTDDGQPLL

SEQ ID NO: 588563 - protein, 7 aa, Mycobacterium
SVTDEAG

SEQ ID NO: 588564 - protein, 7 aa, Mycobacterium
SVTDEDI

SEQ ID NO: 588565 - protein, 5 aa, Mycobacterium
SVTDG

SEQ ID NO: 588566 - protein, 12 aa, Mycobacterium
SVTDKSSADGEG

SEQ ID NO: 588567 - protein, 7 aa, Mycobacterium
SVTDNRA

SEQ ID NO: 588568 - protein, 4 aa, Mycobacterium
SVTE

SEQ ID NO: 588569 - protein, 7 aa, Mycobacterium
SVTEAGV

SEQ ID NO: 588570 - protein, 8 aa, Mycobacterium
SVTEEYRQ

SEQ ID NO: 588571 - protein, 9 aa, Mycobacterium
SVTENNPYQ

SEQ ID NO: 588572 - protein, 11 aa, Mycobacterium
SVTERRSHSGL

SEQ ID NO: 588573 - protein, 14 aa, Mycobacterium
SVTERTPDRGNPDH

SEQ ID NO: 588574 - protein, 7 aa, Mycobacterium
SVTEVRP

SEQ ID NO: 588575 - protein, 11 aa, Mycobacterium
SVTGAAAAEAA

SEQ ID NO: 588576 - protein, 17 aa, Mycobacterium
SVTGDAKGGPPKTPGYH

SEQ ID NO: 588577 - protein, 16 aa, Mycobacterium
SVTGDPKGAPKTPGYH

SEQ ID NO: 588578 - protein, 7 aa, Mycobacterium
SVTGEGQ

SEQ ID NO: 588579 - protein, 8 aa, Mycobacterium
SVTGEGQV

SEQ ID NO: 588580 - protein, 7 aa, Mycobacterium
SVTGEQW

SEQ ID NO: 588581 - protein, 5 aa, Mycobacterium
SVTGG

SEQ ID NO: 588582 - protein, 7 aa, Mycobacterium
SVTGGAG

SEQ ID NO: 588583 - protein, 6 aa, Mycobacterium
SVTGGN

SEQ ID NO: 588584 - protein, 12 aa, Mycobacterium
SVTGGSRPYGGT

SEQ ID NO: 588585 - protein, 10 aa, Mycobacterium
SVTGKRAQGD

SEQ ID NO: 588586 - protein, 7 aa, Mycobacterium
SVTGPFP

SEQ ID NO: 588587 - protein, 8 aa, Mycobacterium
SVTGPIPG

SEQ ID NO: 588588 - protein, 11 aa, Mycobacterium
SVTGSERAGAA

SEQ ID NO: 588589 - protein, 8 aa, Mycobacterium
SVTGSPAD

SEQ ID NO: 588590 - protein, 14 aa, Mycobacterium
SVTGTADRPPTPVG

SEQ ID NO: 588591 - protein, 6 aa, Mycobacterium
SVTGTG

SEQ ID NO: 588592 - protein, 12 aa, Mycobacterium
SVTGTTAAEAAG

SEQ ID NO: 588593 - protein, 5 aa, Mycobacterium
SVTKG

SEQ ID NO: 588594 - protein, 9 aa, Mycobacterium
SVTKSRTAR

SEQ ID NO: 588595 - protein, 12 aa, Mycobacterium
SVTKTVERGLDT

SEQ ID NO: 588596 - protein, 9 aa, Mycobacterium
SVTLDDEQR

SEQ ID NO: 588597 - protein, 9 aa, Mycobacterium
SVTLDGEQR

SEQ ID NO: 588598 - protein, 10 aa, Mycobacterium
SVTLDGEQRY

SEQ ID NO: 588599 - protein, 13 aa, Mycobacterium
SVTPAPRRTAGPC

SEQ ID NO: 588600 - protein, 6 aa, Mycobacterium
SVTPAR

SEQ ID NO: 588601 - protein, 6 aa, Mycobacterium
SVTPAT

SEQ ID NO: 588602 - protein, 11 aa, Mycobacterium
SVTPDPRGGSC

SEQ ID NO: 588603 - protein, 10 aa, Mycobacterium
SVTPDSNADQ

SEQ ID NO: 588604 - protein, 7 aa, Mycobacterium
SVTPGDA

SEQ ID NO: 588605 - protein, 8 aa, Mycobacterium
SVTPNPGA

SEQ ID NO: 588606 - protein, 9 aa, Mycobacterium
SVTPPLPAA

SEQ ID NO: 588607 - protein, 9 aa, Mycobacterium
SVTPPTDST

SEQ ID NO: 588608 - protein, 10 aa, Mycobacterium
SVTPSPEAAY

SEQ ID NO: 588609 - protein, 10 aa, Mycobacterium
SVTPSSDDAE

SEQ ID NO: 588610 - protein, 11 aa, Mycobacterium
SVTQDTNLDTV

SEQ ID NO: 588611 - protein, 12 aa, Mycobacterium
SVTQGMDTGETM

SEQ ID NO: 588612 - protein, 11 aa, Mycobacterium
SVTQGMETGET

SEQ ID NO: 588613 - protein, 6 aa, Mycobacterium
SVTQHG

SEQ ID NO: 588614 - protein, 6 aa, Mycobacterium
SVTRDS

SEQ ID NO: 588615 - protein, 6 aa, Mycobacterium
SVTRGY

SEQ ID NO: 588616 - protein, 12 aa, Mycobacterium
SVTRNSAVRRIS

SEQ ID NO: 588617 - protein, 5 aa, Mycobacterium
SVTRR

SEQ ID NO: 588618 - protein, 5 aa, Mycobacterium
SVTSA

SEQ ID NO: 588619 - protein, 11 aa, Mycobacterium
SVTSDGRSRAY

SEQ ID NO: 588620 - protein, 5 aa, Mycobacterium
SVTSP

SEQ ID NO: 588621 - protein, 11 aa, Mycobacterium
SVTSPGGTTAA

SEQ ID NO: 588622 - protein, 8 aa, Mycobacterium
SVTSPGRL

SEQ ID NO: 588623 - protein, 13 aa, Mycobacterium
SVTSRAAGALPQG

SEQ ID NO: 588624 - protein, 9 aa, Mycobacterium
SVTSTLGVG

SEQ ID NO: 588625 - protein, 5 aa, Mycobacterium
SVTTA

SEQ ID NO: 588626 - protein, 9 aa, Mycobacterium
SVTTGPIAG

SEQ ID NO: 588627 - protein, 13 aa, Mycobacterium
SVTTGPIAGSSKV

SEQ ID NO: 588628 - protein, 5 aa, Mycobacterium
SVTTP

SEQ ID NO: 588629 - protein, 9 aa, Mycobacterium
SVTTPEPPW

SEQ ID NO: 588630 - protein, 9 aa, Mycobacterium
SVTTRHDEQ

SEQ ID NO: 588631 - protein, 8 aa, Mycobacterium
SVTTSNDR

SEQ ID NO: 588632 - protein, 10 aa, Mycobacterium
SVTTSTGDTV

SEQ ID NO: 588633 - protein, 11 aa, Mycobacterium
SVTTTGGRTVR

SEQ ID NO: 588634 - protein, 14 aa, Mycobacterium
SVTTTQSTAGNIDE

SEQ ID NO: 588635 - protein, 7 aa, Mycobacterium
SVTTTRV

SEQ ID NO: 588636 - protein, 8 aa, Mycobacterium
SVTVPGGV

SEQ ID NO: 588637 - protein, 7 aa, Mycobacterium
SVTVTRD

SEQ ID NO: 588638 - protein, 4 aa, Mycobacterium
SVVD

SEQ ID NO: 588639 - protein, 9 aa, Mycobacterium
SVVDPSDVE

SEQ ID NO: 588640 - protein, 8 aa, Mycobacterium
SVVERTAG

SEQ ID NO: 588641 - protein, 24 aa, Mycobacterium
SVVPEEAAAEFTSAEVADTAAALD

SEQ ID NO: 588642 - protein, 7 aa, Mycobacterium
SVVPEGQ

SEQ ID NO: 588643 - protein, 10 aa, Mycobacterium
SVVPNDGGRV

SEQ ID NO: 588644 - protein, 6 aa, Mycobacterium
SVVRTP

SEQ ID NO: 588645 - protein, 13 aa, Mycobacterium
SVVSDDDLHQTAR

SEQ ID NO: 588646 - protein, 4 aa, Mycobacterium
SVVT

SEQ ID NO: 588647 - protein, 21 aa, Mycobacterium
SVWSSGTQTDTPVAPAAESVE

SEQ ID NO: 588648 - protein, 4 aa, Mycobacterium
SVYD

SEQ ID NO: 588649 - protein, 6 aa, Mycobacterium
SVYGDA

SEQ ID NO: 588650 - protein, 5 aa, Mycobacterium
SVYGG

SEQ ID NO: 588651 - protein, 10 aa, Mycobacterium
SWAAPATRTV

SEQ ID NO: 588652 - protein, 9 aa, Mycobacterium
SWADDPDGL

SEQ ID NO: 588653 - protein, 13 aa, Mycobacterium
SWAGAAGALNGTV

SEQ ID NO: 588654 - protein, 13 aa, Mycobacterium
SWAGDPPPGALRG

SEQ ID NO: 588655 - protein, 7 aa, Mycobacterium
SWAGGQR

SEQ ID NO: 588656 - protein, 5 aa, Mycobacterium
SWDDY

SEQ ID NO: 588657 - protein, 4 aa, Mycobacterium
SWDE

SEQ ID NO: 588658 - protein, 9 aa, Mycobacterium
SWDGAMSTR

SEQ ID NO: 588659 - protein, 11 aa, Mycobacterium
SWDNGKPVRET

SEQ ID NO: 588660 - protein, 6 aa, Mycobacterium
SWEQTS

SEQ ID NO: 588661 - protein, 11 aa, Mycobacterium
SWESEPDDDYD

SEQ ID NO: 588662 - protein, 7 aa, Mycobacterium
SWEYTGD

SEQ ID NO: 588663 - protein, 10 aa, Mycobacterium
SWGAARPRRS

SEQ ID NO: 588664 - protein, 12 aa, Mycobacterium
SWGASGERGAVS

SEQ ID NO: 588665 - protein, 5 aa, Mycobacterium
SWGGN

SEQ ID NO: 588666 - protein, 4 aa, Mycobacterium
SWGI

SEQ ID NO: 588667 - protein, 14 aa, Mycobacterium
SWGIGNQSNYAAAK

SEQ ID NO: 588668 - protein, 11 aa, Mycobacterium
SWGPGHSVGAT

SEQ ID NO: 588669 - protein, 10 aa, Mycobacterium
SWGPSPSTVA

SEQ ID NO: 588670 - protein, 16 aa, Mycobacterium
SWGSADKGAVNVADGE

SEQ ID NO: 588671 - protein, 12 aa, Mycobacterium
SWGSEATPVADA

SEQ ID NO: 588672 - protein, 9 aa, Mycobacterium
SWKAPDDVP

SEQ ID NO: 588673 - protein, 5 aa, Mycobacterium
SWNDP

SEQ ID NO: 588674 - protein, 6 aa, Mycobacterium
SWNQTS

SEQ ID NO: 588675 - protein, 8 aa, Mycobacterium
SWPADESA

SEQ ID NO: 588676 - protein, 11 aa, Mycobacterium
SWPAPDRESLG

SEQ ID NO: 588677 - protein, 12 aa, Mycobacterium
SWPDEPGEPVTE

SEQ ID NO: 588678 - protein, 8 aa, Mycobacterium
SWPDGESR

SEQ ID NO: 588679 - protein, 10 aa, Mycobacterium
SWPDGTEGTA

SEQ ID NO: 588680 - protein, 12 aa, Mycobacterium
SWPDRGKRTGGG

SEQ ID NO: 588681 - protein, 11 aa, Mycobacterium
SWPGSRPREAA

SEQ ID NO: 588682 - protein, 10 aa, Mycobacterium
SWPGTTARQA

SEQ ID NO: 588683 - protein, 6 aa, Mycobacterium
SWPPQR

SEQ ID NO: 588684 - protein, 10 aa, Mycobacterium
SWPPSQAPHR

SEQ ID NO: 588685 - protein, 16 aa, Mycobacterium
SWPTPDRGSAGKATRK

SEQ ID NO: 588686 - protein, 5 aa, Mycobacterium
SWQGA

SEQ ID NO: 588687 - protein, 8 aa, Mycobacterium
SWQGPAAA

SEQ ID NO: 588688 - protein, 9 aa, Mycobacterium
SWQGPAATA

SEQ ID NO: 588689 - protein, 8 aa, Mycobacterium
SWQGPSAA

SEQ ID NO: 588690 - protein, 5 aa, Mycobacterium
SWQGW

SEQ ID NO: 588691 - protein, 5 aa, Mycobacterium
SWQTS

SEQ ID NO: 588692 - protein, 9 aa, Mycobacterium
SWRGPASAA

SEQ ID NO: 588693 - protein, 6 aa, Mycobacterium
SWRGQP

SEQ ID NO: 588694 - protein, 12 aa, Mycobacterium
SWRNDTTGACGT

SEQ ID NO: 588695 - protein, 11 aa, Mycobacterium
SWRTAQRAHAP

SEQ ID NO: 588696 - protein, 5 aa, Mycobacterium
SWRTT

SEQ ID NO: 588697 - protein, 6 aa, Mycobacterium
SWSDET

SEQ ID NO: 588698 - protein, 4 aa, Mycobacterium
SWSG

SEQ ID NO: 588699 - protein, 5 aa, Mycobacterium
SWSGG

SEQ ID NO: 588700 - protein, 5 aa, Mycobacterium
SWSPE

SEQ ID NO: 588701 - protein, 8 aa, Mycobacterium
SWSPQGKP

SEQ ID NO: 588702 - protein, 4 aa, Mycobacterium
SWSQ

SEQ ID NO: 588703 - protein, 8 aa, Mycobacterium
SWSRNGEG

SEQ ID NO: 588704 - protein, 19 aa, Mycobacterium
SWSTGSSIMPQKKNPDIAE

SEQ ID NO: 588705 - protein, 45 aa, Mycobacterium
SWTAPSTGPVTALSGSGLTTIPGTEVPDHGLPGVPGMPAGTLKRA

SEQ ID NO: 588706 - protein, 7 aa, Mycobacterium
SWTEPKG

SEQ ID NO: 588707 - protein, 7 aa, Mycobacterium
SWTEPQG

SEQ ID NO: 588708 - protein, 7 aa, Mycobacterium
SWTGPSS

SEQ ID NO: 588709 - protein, 5 aa, Mycobacterium
SWTGR

SEQ ID NO: 588710 - protein, 11 aa, Mycobacterium
SWTSGAASSVD

SEQ ID NO: 588711 - protein, 10 aa, Mycobacterium
SYAAAAPTTA

SEQ ID NO: 588712 - protein, 12 aa, Mycobacterium
SYAAAQRARRQR

SEQ ID NO: 588713 - protein, 4 aa, Mycobacterium
SYAD

SEQ ID NO: 588714 - protein, 5 aa, Mycobacterium
SYADG

SEQ ID NO: 588715 - protein, 9 aa, Mycobacterium
SYADSRDSG

SEQ ID NO: 588716 - protein, 16 aa, Mycobacterium
SYADTRIKDTKPFNPK

SEQ ID NO: 588717 - protein, 10 aa, Mycobacterium
SYAGAGATIG

SEQ ID NO: 588718 - protein, 11 aa, Mycobacterium
SYAGAGATIGP

SEQ ID NO: 588719 - protein, 12 aa, Mycobacterium
SYAGGGGGDPHL

SEQ ID NO: 588720 - protein, 8 aa, Mycobacterium
SYAGPDKV

SEQ ID NO: 588721 - protein, 10 aa, Mycobacterium
SYAGPDREVR

SEQ ID NO: 588722 - protein, 7 aa, Mycobacterium
SYAGPTA

SEQ ID NO: 588723 - protein, 12 aa, Mycobacterium
SYAGQDAKTGQT

SEQ ID NO: 588724 - protein, 7 aa, Mycobacterium
SYAGRGE

SEQ ID NO: 588725 - protein, 8 aa, Mycobacterium
SYAGRGSV

SEQ ID NO: 588726 - protein, 20 aa, Mycobacterium
SYAGSSAAAGQLTPFTEPPQ

SEQ ID NO: 588727 - protein, 8 aa, Mycobacterium
SYAPDLSD

SEQ ID NO: 588728 - protein, 11 aa, Mycobacterium
SYAPERAHRPE

SEQ ID NO: 588729 - protein, 12 aa, Mycobacterium
SYAPERSHRPDT

SEQ ID NO: 588730 - protein, 10 aa, Mycobacterium
SYAPGDGYID

SEQ ID NO: 588731 - protein, 20 aa, Mycobacterium
SYAPKPVALPDGSVKASTKF

SEQ ID NO: 588732 - protein, 7 aa, Mycobacterium
SYAPMGA

SEQ ID NO: 588733 - protein, 12 aa, Mycobacterium
SYAPQRARRPDT

SEQ ID NO: 588734 - protein, 5 aa, Mycobacterium
SYAPR

SEQ ID NO: 588735 - protein, 5 aa, Mycobacterium
SYAPT

SEQ ID NO: 588736 - protein, 4 aa, Mycobacterium
SYAQ

SEQ ID NO: 588737 - protein, 5 aa, Mycobacterium
SYAQA

SEQ ID NO: 588738 - protein, 12 aa, Mycobacterium
SYASRPAEAAAD

SEQ ID NO: 588739 - protein, 6 aa, Mycobacterium
SYATDR

SEQ ID NO: 588740 - protein, 7 aa, Mycobacterium
SYATHNE

SEQ ID NO: 588741 - protein, 17 aa, Mycobacterium
SYATSKSCRREIESAPD

SEQ ID NO: 588742 - protein, 4 aa, Mycobacterium
SYDA

SEQ ID NO: 588743 - protein, 7 aa, Mycobacterium
SYDAASQ

SEQ ID NO: 588744 - protein, 8 aa, Mycobacterium
SYDAEGQL

SEQ ID NO: 588745 - protein, 9 aa, Mycobacterium
SYDAESRNK

SEQ ID NO: 588746 - protein, 10 aa, Mycobacterium
SYDAESRNKV

SEQ ID NO: 588747 - protein, 15 aa, Mycobacterium
SYDPAASHTPVQSDP

SEQ ID NO: 588748 - protein, 5 aa, Mycobacterium
SYDPE

SEQ ID NO: 588749 - protein, 10 aa, Mycobacterium
SYDPESRNKV

SEQ ID NO: 588750 - protein, 6 aa, Mycobacterium
SYDPGL

SEQ ID NO: 588751 - protein, 5 aa, Mycobacterium
SYDQR

SEQ ID NO: 588752 - protein, 7 aa, Mycobacterium
SYDQVSR

SEQ ID NO: 588753 - protein, 12 aa, Mycobacterium
SYDQVSRNPTVE

SEQ ID NO: 588754 - protein, 15 aa, Mycobacterium
SYDRDQLAPAWLWLR

SEQ ID NO: 588755 - protein, 9 aa, Mycobacterium
SYDRQRGGW

SEQ ID NO: 588756 - protein, 10 aa, Mycobacterium
SYDSDSYADD

SEQ ID NO: 588757 - protein, 9 aa, Mycobacterium
SYDTETRNK

SEQ ID NO: 588758 - protein, 11 aa, Mycobacterium
SYEAGAQQALA

SEQ ID NO: 588759 - protein, 10 aa, Mycobacterium
SYEAGPAAAL

SEQ ID NO: 588760 - protein, 12 aa, Mycobacterium
SYEAGPAAALAS

SEQ ID NO: 588761 - protein, 10 aa, Mycobacterium
SYEAGPTAAL

SEQ ID NO: 588762 - protein, 6 aa, Mycobacterium
SYEKSD

SEQ ID NO: 588763 - protein, 13 aa, Mycobacterium
SYEPAHADPDAAY

SEQ ID NO: 588764 - protein, 10 aa, Mycobacterium
SYEQQRQRAD

SEQ ID NO: 588765 - protein, 7 aa, Mycobacterium
SYERGAP

SEQ ID NO: 588766 - protein, 10 aa, Mycobacterium
SYESGPSAAL

SEQ ID NO: 588767 - protein, 6 aa, Mycobacterium
SYESSP

SEQ ID NO: 588768 - protein, 12 aa, Mycobacterium
SYETDRDHDLAP

SEQ ID NO: 588769 - protein, 13 aa, Mycobacterium
SYETDRNHDLAPR

SEQ ID NO: 588770 - protein, 10 aa, Mycobacterium
SYETEKAGEY

SEQ ID NO: 588771 - protein, 6 aa, Mycobacterium
SYETPF

SEQ ID NO: 588772 - protein, 7 aa, Mycobacterium
SYETSFD

SEQ ID NO: 588773 - protein, 4 aa, Mycobacterium
SYGA

SEQ ID NO: 588774 - protein, 7 aa, Mycobacterium
SYGADIA

SEQ ID NO: 588775 - protein, 5 aa, Mycobacterium
SYGAP

SEQ ID NO: 588776 - protein, 7 aa, Mycobacterium
SYGAQRA

SEQ ID NO: 588777 - protein, 23 aa, Mycobacterium
SYGASESGTTATRIDDGTPRTTP

SEQ ID NO: 588778 - protein, 7 aa, Mycobacterium
SYGDANP

SEQ ID NO: 588779 - protein, 5 aa, Mycobacterium
SYGDG

SEQ ID NO: 588780 - protein, 6 aa, Mycobacterium
SYGDGE

SEQ ID NO: 588781 - protein, 17 aa, Mycobacterium
SYGDRGDAFAAAVRAAV

SEQ ID NO: 588782 - protein, 9 aa, Mycobacterium
SYGDTYTEQ

SEQ ID NO: 588783 - protein, 5 aa, Mycobacterium
SYGGA

SEQ ID NO: 588784 - protein, 6 aa, Mycobacterium
SYGGEQ

SEQ ID NO: 588785 - protein, 7 aa, Mycobacterium
SYGGEQA

SEQ ID NO: 588786 - protein, 5 aa, Mycobacterium
SYGGY

SEQ ID NO: 588787 - protein, 6 aa, Mycobacterium
SYGISG

SEQ ID NO: 588788 - protein, 7 aa, Mycobacterium
SYGISGT

SEQ ID NO: 588789 - protein, 8 aa, Mycobacterium
SYGKNGAD

SEQ ID NO: 588790 - protein, 7 aa, Mycobacterium
SYGLSGT

SEQ ID NO: 588791 - protein, 6 aa, Mycobacterium
SYGMSG

SEQ ID NO: 588792 - protein, 5 aa, Mycobacterium
SYGNC

SEQ ID NO: 588793 - protein, 7 aa, Mycobacterium
SYGPDTQ

SEQ ID NO: 588794 - protein, 8 aa, Mycobacterium
SYGPKRAQ

SEQ ID NO: 588795 - protein, 7 aa, Mycobacterium
SYGPRRA

SEQ ID NO: 588796 - protein, 7 aa, Mycobacterium
SYGPTEA

SEQ ID NO: 588797 - protein, 5 aa, Mycobacterium
SYGQV

SEQ ID NO: 588798 - protein, 12 aa, Mycobacterium
SYGRSPPEGGHS

SEQ ID NO: 588799 - protein, 5 aa, Mycobacterium
SYGSA

SEQ ID NO: 588800 - protein, 12 aa, Mycobacterium
SYGSKETGGLQG

SEQ ID NO: 588801 - protein, 4 aa, Mycobacterium
SYGT

SEQ ID NO: 588802 - protein, 10 aa, Mycobacterium
SYGTDPETGL

SEQ ID NO: 588803 - protein, 9 aa, Mycobacterium
SYGTNPETG

SEQ ID NO: 588804 - protein, 5 aa, Mycobacterium
SYGVP

SEQ ID NO: 588805 - protein, 10 aa, Mycobacterium
SYGYGAEADR

SEQ ID NO: 588806 - protein, 6 aa, Mycobacterium
SYGYGR

SEQ ID NO: 588807 - protein, 12 aa, Mycobacterium
SYGYGRDRVSTG

SEQ ID NO: 588808 - protein, 11 aa, Mycobacterium
SYHKQAADTGA

SEQ ID NO: 588809 - protein, 8 aa, Mycobacterium
SYHPGGAA

SEQ ID NO: 588810 - protein, 18 aa, Mycobacterium
SYHPNSGYPHSGRRPMNS

SEQ ID NO: 588811 - protein, 13 aa, Mycobacterium
SYKKQMKAAAKAA

SEQ ID NO: 588812 - protein, 6 aa, Mycobacterium
SYKRPR

SEQ ID NO: 588813 - protein, 6 aa, Mycobacterium
SYKRPS

SEQ ID NO: 588814 - protein, 20 aa, Mycobacterium
SYLDPDAAAAGAAAVAAQGA

SEQ ID NO: 588815 - protein, 7 aa, Mycobacterium
SYLGPAG

SEQ ID NO: 588816 - protein, 12 aa, Mycobacterium
SYLPSPLTRGPW

SEQ ID NO: 588817 - protein, 11 aa, Mycobacterium
SYLPTAKNTQV

SEQ ID NO: 588818 - protein, 4 aa, Mycobacterium
SYLR

SEQ ID NO: 588819 - protein, 4 aa, Mycobacterium
SYLT

SEQ ID NO: 588820 - protein, 5 aa, Mycobacterium
SYLTP

SEQ ID NO: 588821 - protein, 8 aa, Mycobacterium
SYNEETKE

SEQ ID NO: 588822 - protein, 5 aa, Mycobacterium
SYNGT

SEQ ID NO: 588823 - protein, 9 aa, Mycobacterium
SYNKDVSRQ

SEQ ID NO: 588824 - protein, 10 aa, Mycobacterium
SYNPNSKTSA

SEQ ID NO: 588825 - protein, 5 aa, Mycobacterium
SYNPW

SEQ ID NO: 588826 - protein, 8 aa, Mycobacterium
SYNPYSSE

SEQ ID NO: 588827 - protein, 11 aa, Mycobacterium
SYNRPKLPGIP

SEQ ID NO: 588828 - protein, 4 aa, Mycobacterium
SYPA

SEQ ID NO: 588829 - protein, 4 aa, Mycobacterium
SYPD

SEQ ID NO: 588830 - protein, 6 aa, Mycobacterium
SYPDGA

SEQ ID NO: 588831 - protein, 9 aa, Mycobacterium
SYPDGATAV

SEQ ID NO: 588832 - protein, 8 aa, Mycobacterium
SYPDGHTA

SEQ ID NO: 588833 - protein, 13 aa, Mycobacterium
SYPDGQSLPTPSA

SEQ ID NO: 588834 - protein, 7 aa, Mycobacterium
SYPEAQA

SEQ ID NO: 588835 - protein, 7 aa, Mycobacterium
SYPGGFA

SEQ ID NO: 588836 - protein, 6 aa, Mycobacterium
SYPGGV

SEQ ID NO: 588837 - protein, 10 aa, Mycobacterium
SYPGSDANAV

SEQ ID NO: 588838 - protein, 10 aa, Mycobacterium
SYPKPVRPQG

SEQ ID NO: 588839 - protein, 8 aa, Mycobacterium
SYPNGAAA

SEQ ID NO: 588840 - protein, 10 aa, Mycobacterium
SYPNTTQRST

SEQ ID NO: 588841 - protein, 18 aa, Mycobacterium
SYPPAAEIDESVEPRATP

SEQ ID NO: 588842 - protein, 9 aa, Mycobacterium
SYPPESAGR

SEQ ID NO: 588843 - protein, 13 aa, Mycobacterium
SYPPGSRSAPHHH

SEQ ID NO: 588844 - protein, 6 aa, Mycobacterium
SYPPMG

SEQ ID NO: 588845 - protein, 20 aa, Mycobacterium
SYPPPLPASEATPGQRSTPE

SEQ ID NO: 588846 - protein, 19 aa, Mycobacterium
SYPPSLPASGTTARRSTPE

SEQ ID NO: 588847 - protein, 9 aa, Mycobacterium
SYPQLAEGP

SEQ ID NO: 588848 - protein, 19 aa, Mycobacterium
SYPREGSSHGRVRWLSRRC

SEQ ID NO: 588849 - protein, 5 aa, Mycobacterium
SYPSC

SEQ ID NO: 588850 - protein, 5 aa, Mycobacterium
SYPSI

SEQ ID NO: 588851 - protein, 18 aa, Mycobacterium
SYPSPQPTGAAADPRATP

SEQ ID NO: 588852 - protein, 6 aa, Mycobacterium
SYPSPT

SEQ ID NO: 588853 - protein, 18 aa, Mycobacterium
SYPSSTPPGEGTGHRATP

SEQ ID NO: 588854 - protein, 5 aa, Mycobacterium
SYPST

SEQ ID NO: 588855 - protein, 8 aa, Mycobacterium
SYPSTLAT

SEQ ID NO: 588856 - protein, 8 aa, Mycobacterium
SYPTFTPV

SEQ ID NO: 588857 - protein, 6 aa, Mycobacterium
SYPTPY

SEQ ID NO: 588858 - protein, 13 aa, Mycobacterium
SYPTTDSLTVDFD

SEQ ID NO: 588859 - protein, 15 aa, Mycobacterium
SYPVPKGGDRGERTG

SEQ ID NO: 588860 - protein, 12 aa, Mycobacterium
SYQDERKPHVTE

SEQ ID NO: 588861 - protein, 7 aa, Mycobacterium
SYQETAA

SEQ ID NO: 588862 - protein, 6 aa, Mycobacterium
SYQPGV

SEQ ID NO: 588863 - protein, 13 aa, Mycobacterium
SYQRPKPVRKPHP

SEQ ID NO: 588864 - protein, 6 aa, Mycobacterium
SYQRQR

SEQ ID NO: 588865 - protein, 16 aa, Mycobacterium
SYQRQRRVAEENDGDL

SEQ ID NO: 588866 - protein, 4 aa, Mycobacterium
SYQT

SEQ ID NO: 588867 - protein, 18 aa, Mycobacterium
SYQTGGTRHWPRAQAVHI

SEQ ID NO: 588868 - protein, 8 aa, Mycobacterium
SYQTLSAQ

SEQ ID NO: 588869 - protein, 7 aa, Mycobacterium
SYRAENT

SEQ ID NO: 588870 - protein, 19 aa, Mycobacterium
SYRATENAETIGDSVREPL

SEQ ID NO: 588871 - protein, 6 aa, Mycobacterium
SYRDDP

SEQ ID NO: 588872 - protein, 4 aa, Mycobacterium
SYRG

SEQ ID NO: 588873 - protein, 5 aa, Mycobacterium
SYRGA

SEQ ID NO: 588874 - protein, 17 aa, Mycobacterium
SYRGEAPEQLAARPPWS

SEQ ID NO: 588875 - protein, 7 aa, Mycobacterium
SYRGISG

SEQ ID NO: 588876 - protein, 17 aa, Mycobacterium
SYRGPHSDQSGGAETRP

SEQ ID NO: 588877 - protein, 5 aa, Mycobacterium
SYRGS

SEQ ID NO: 588878 - protein, 13 aa, Mycobacterium
SYRITGSRGTSAY

SEQ ID NO: 588879 - protein, 9 aa, Mycobacterium
SYRNPGPTM

SEQ ID NO: 588880 - protein, 9 aa, Mycobacterium
SYRNPRYTY

SEQ ID NO: 588881 - protein, 5 aa, Mycobacterium
SYRPA

SEQ ID NO: 588882 - protein, 14 aa, Mycobacterium
SYRPDPAEPTQAAA

SEQ ID NO: 588883 - protein, 14 aa, Mycobacterium
SYRPDPNEPTQTAA

SEQ ID NO: 588884 - protein, 6 aa, Mycobacterium
SYRPTA

SEQ ID NO: 588885 - protein, 15 aa, Mycobacterium
SYRQDPNSTFMTTPI

SEQ ID NO: 588886 - protein, 6 aa, Mycobacterium
SYRRRT

SEQ ID NO: 588887 - protein, 8 aa, Mycobacterium
SYRRSSPL

SEQ ID NO: 588888 - protein, 6 aa, Mycobacterium
SYRSAG

SEQ ID NO: 588889 - protein, 7 aa, Mycobacterium
SYRTDAP

SEQ ID NO: 588890 - protein, 8 aa, Mycobacterium
SYRTDEPE

SEQ ID NO: 588891 - protein, 8 aa, Mycobacterium
SYRTDTPE

SEQ ID NO: 588892 - protein, 7 aa, Mycobacterium
SYRTQQM

SEQ ID NO: 588893 - protein, 11 aa, Mycobacterium
SYSAAEANRTV

SEQ ID NO: 588894 - protein, 12 aa, Mycobacterium
SYSAAKTAEAAE

SEQ ID NO: 588895 - protein, 8 aa, Mycobacterium
SYSANNRE

SEQ ID NO: 588896 - protein, 8 aa, Mycobacterium
SYSASKGA

SEQ ID NO: 588897 - protein, 8 aa, Mycobacterium
SYSDDEAA

SEQ ID NO: 588898 - protein, 7 aa, Mycobacterium
SYSEDGD

SEQ ID NO: 588899 - protein, 13 aa, Mycobacterium
SYSEEGRTTLTTA

SEQ ID NO: 588900 - protein, 8 aa, Mycobacterium
SYSENPGT

SEQ ID NO: 588901 - protein, 8 aa, Mycobacterium
SYSESNRH

SEQ ID NO: 588902 - protein, 17 aa, Mycobacterium
SYSGADFPAGRQRLDAS

SEQ ID NO: 588903 - protein, 17 aa, Mycobacterium
SYSGADFPAGRQTLDAS

SEQ ID NO: 588904 - protein, 5 aa, Mycobacterium
SYSGG

SEQ ID NO: 588905 - protein, 5 aa, Mycobacterium
SYSMG

SEQ ID NO: 588906 - protein, 8 aa, Mycobacterium
SYSMGGTN

SEQ ID NO: 588907 - protein, 8 aa, Mycobacterium
SYSMGKAD

SEQ ID NO: 588908 - protein, 4 aa, Mycobacterium
SYSP

SEQ ID NO: 588909 - protein, 10 aa, Mycobacterium
SYSPAEATVY

SEQ ID NO: 588910 - protein, 5 aa, Mycobacterium
SYSPT

SEQ ID NO: 588911 - protein, 10 aa, Mycobacterium
SYSSAGSRGE

SEQ ID NO: 588912 - protein, 6 aa, Mycobacterium
SYSSPL

SEQ ID NO: 588913 - protein, 7 aa, Mycobacterium
SYSTDAP

SEQ ID NO: 588914 - protein, 7 aa, Mycobacterium
SYSTGTA

SEQ ID NO: 588915 - protein, 10 aa, Mycobacterium
SYSTISEATD

SEQ ID NO: 588916 - protein, 4 aa, Mycobacterium
SYTA

SEQ ID NO: 588917 - protein, 6 aa, Mycobacterium
SYTADR

SEQ ID NO: 588918 - protein, 10 aa, Mycobacterium
SYTASLGGKN

SEQ ID NO: 588919 - protein, 8 aa, Mycobacterium
SYTDGDKP

SEQ ID NO: 588920 - protein, 8 aa, Mycobacterium
SYTDPQGA

SEQ ID NO: 588921 - protein, 6 aa, Mycobacterium
SYTDRA

SEQ ID NO: 588922 - protein, 6 aa, Mycobacterium
SYTDRD

SEQ ID NO: 588923 - protein, 9 aa, Mycobacterium
SYTDRPGTL

SEQ ID NO: 588924 - protein, 5 aa, Mycobacterium
SYTDV

SEQ ID NO: 588925 - protein, 11 aa, Mycobacterium
SYTDVDEAAAE

SEQ ID NO: 588926 - protein, 13 aa, Mycobacterium
SYTEAAKAQGLSA

SEQ ID NO: 588927 - protein, 12 aa, Mycobacterium
SYTEDPTVNWNT

SEQ ID NO: 588928 - protein, 5 aa, Mycobacterium
SYTEG

SEQ ID NO: 588929 - protein, 14 aa, Mycobacterium
SYTEGAQSQGRTPG

SEQ ID NO: 588930 - protein, 14 aa, Mycobacterium
SYTEGAQTVGRTPG

SEQ ID NO: 588931 - protein, 6 aa, Mycobacterium
SYTEGR

SEQ ID NO: 588932 - protein, 16 aa, Mycobacterium
SYTEGRLERIDARQAG

SEQ ID NO: 588933 - protein, 16 aa, Mycobacterium
SYTEGRLERVDARQSA

SEQ ID NO: 588934 - protein, 10 aa, Mycobacterium
SYTENASTKV

SEQ ID NO: 588935 - protein, 6 aa, Mycobacterium
SYTESR

SEQ ID NO: 588936 - protein, 21 aa, Mycobacterium
SYTGADPTRDEHSAHGLEPGP

SEQ ID NO: 588937 - protein, 15 aa, Mycobacterium
SYTGATEAAEREQLE

SEQ ID NO: 588938 - protein, 12 aa, Mycobacterium
SYTGEREQFGRP

SEQ ID NO: 588939 - protein, 10 aa, Mycobacterium
SYTGGDTTGN

SEQ ID NO: 588940 - protein, 5 aa, Mycobacterium
SYTGR

SEQ ID NO: 588941 - protein, 4 aa, Mycobacterium
SYTP

SEQ ID NO: 588942 - protein, 12 aa, Mycobacterium
SYTPNPADGGRT

SEQ ID NO: 588943 - protein, 9 aa, Mycobacterium
SYTSVGPSR

SEQ ID NO: 588944 - protein, 4 aa, Mycobacterium
SYTT

SEQ ID NO: 588945 - protein, 12 aa, Mycobacterium
SYTTAASVQPGD

SEQ ID NO: 588946 - protein, 17 aa, Mycobacterium
SYTTGSDQGGNGSQGWT

SEQ ID NO: 588947 - protein, 10 aa, Mycobacterium
SYTTSDGEVA

SEQ ID NO: 588948 - protein, 8 aa, Mycobacterium
SYVEDSAL

SEQ ID NO: 588949 - protein, 6 aa, Mycobacterium
SYVPGA

SEQ ID NO: 588950 - protein, 15 aa, Mycobacterium
SYVPGTVSTSSRESL

SEQ ID NO: 588951 - protein, 11 aa, Mycobacterium
SYVSRTPGQGS

SEQ ID NO: 588952 - protein, 4 aa, Mycobacterium
SYVT

SEQ ID NO: 588953 - protein, 8 aa, Mycobacterium
SYYPQGAE

SEQ ID NO: 588954 - protein, 13 aa, Mycobacterium
SYYSVTSSAGDTV

SEQ ID NO: 588955 - protein, 12 aa, Mycobacterium
TAAAAGASDPLR

SEQ ID NO: 588956 - protein, 16 aa, Mycobacterium
TAAAAGATDTSAAGPA

SEQ ID NO: 588957 - protein, 11 aa, Mycobacterium
TAAAAGSGLDT

SEQ ID NO: 588958 - protein, 6 aa, Mycobacterium
TAAAAK

SEQ ID NO: 588959 - protein, 9 aa, Mycobacterium
TAAAASDQR

SEQ ID NO: 588960 - protein, 43 aa, Mycobacterium
TAAAASPHTGPPAAPQPAAPPVAATSPPATAPPLAAAAAMPGG

SEQ ID NO: 588961 - protein, 19 aa, Mycobacterium
TAAAATETTPPPETARAAA

SEQ ID NO: 588962 - protein, 10 aa, Mycobacterium
TAAADGNPTM

SEQ ID NO: 588963 - protein, 6 aa, Mycobacterium
TAAADL

SEQ ID NO: 588964 - protein, 6 aa, Mycobacterium
TAAADR

SEQ ID NO: 588965 - protein, 5 aa, Mycobacterium
TAAAE

SEQ ID NO: 588966 - protein, 7 aa, Mycobacterium
TAAAEAG

SEQ ID NO: 588967 - protein, 6 aa, Mycobacterium
TAAAEG

SEQ ID NO: 588968 - protein, 7 aa, Mycobacterium
TAAAEHK

SEQ ID NO: 588969 - protein, 9 aa, Mycobacterium
TAAAELAPA

SEQ ID NO: 588970 - protein, 20 aa, Mycobacterium
TAAAENSRTWPTDTTVADRA

SEQ ID NO: 588971 - protein, 9 aa, Mycobacterium
TAAAESTGA

SEQ ID NO: 588972 - protein, 6 aa, Mycobacterium
TAAAGD

SEQ ID NO: 588973 - protein, 8 aa, Mycobacterium
TAAAGGPI

SEQ ID NO: 588974 - protein, 33 aa, Mycobacterium
TAAAGPGVTEGPPDHANGAPLGGAPRPVAPATS

SEQ ID NO: 588975 - protein, 9 aa, Mycobacterium
TAAAGPPVD

SEQ ID NO: 588976 - protein, 10 aa, Mycobacterium
TAAAGSASPL

SEQ ID NO: 588977 - protein, 8 aa, Mycobacterium
TAAAGSPA

SEQ ID NO: 588978 - protein, 6 aa, Mycobacterium
TAAAKK

SEQ ID NO: 588979 - protein, 8 aa, Mycobacterium
TAAAKQFQ

SEQ ID NO: 588980 - protein, 13 aa, Mycobacterium
TAAALSGPDGHIR

SEQ ID NO: 588981 - protein, 16 aa, Mycobacterium
TAAANRDASVYDRPDR

SEQ ID NO: 588982 - protein, 16 aa, Mycobacterium
TAAAPGDSHAWHDRHR

SEQ ID NO: 588983 - protein, 10 aa, Mycobacterium
TAAAPPDTDG

SEQ ID NO: 588984 - protein, 11 aa, Mycobacterium
TAAAPTDAGTA

SEQ ID NO: 588985 - protein, 8 aa, Mycobacterium
TAAAPTTT

SEQ ID NO: 588986 - protein, 11 aa, Mycobacterium
TAAAQAQGHLG

SEQ ID NO: 588987 - protein, 6 aa, Mycobacterium
TAAAQE

SEQ ID NO: 588988 - protein, 10 aa, Mycobacterium
TAAAQRAGAI

SEQ ID NO: 588989 - protein, 6 aa, Mycobacterium
TAAARA

SEQ ID NO: 588990 - protein, 18 aa, Mycobacterium
TAAARAALTDTGADTAAV

SEQ ID NO: 588991 - protein, 7 aa, Mycobacterium
TAAARAH

SEQ ID NO: 588992 - protein, 6 aa, Mycobacterium
TAAARR

SEQ ID NO: 588993 - protein, 9 aa, Mycobacterium
TAAARSAAL

SEQ ID NO: 588994 - protein, 6 aa, Mycobacterium
TAAARY

SEQ ID NO: 588995 - protein, 9 aa, Mycobacterium
TAAASDKAA

SEQ ID NO: 588996 - protein, 9 aa, Mycobacterium
TAAASSDLL

SEQ ID NO: 588997 - protein, 6 aa, Mycobacterium
TAAATT

SEQ ID NO: 588998 - protein, 7 aa, Mycobacterium
TAAATTA

SEQ ID NO: 588999 - protein, 18 aa, Mycobacterium
TAAAVSAEVGKAASLGPL

SEQ ID NO: 589000 - protein, 15 aa, Mycobacterium
TAAAYGPDTREQITT

SEQ ID NO: 589001 - protein, 6 aa, Mycobacterium
TAACER

SEQ ID NO: 589002 - protein, 10 aa, Mycobacterium
TAADAAGAGF

SEQ ID NO: 589003 - protein, 10 aa, Mycobacterium
TAADAATAGF

SEQ ID NO: 589004 - protein, 8 aa, Mycobacterium
TAADADEN

SEQ ID NO: 589005 - protein, 14 aa, Mycobacterium
TAADADSDDMSDAI

SEQ ID NO: 589006 - protein, 6 aa, Mycobacterium
TAADAE

SEQ ID NO: 589007 - protein, 10 aa, Mycobacterium
TAADATQETI

SEQ ID NO: 589008 - protein, 10 aa, Mycobacterium
TAADDDQLGE

SEQ ID NO: 589009 - protein, 8 aa, Mycobacterium
TAADDDVV

SEQ ID NO: 589010 - protein, 8 aa, Mycobacterium
TAADDGAR

SEQ ID NO: 589011 - protein, 7 aa, Mycobacterium
TAADDRA

SEQ ID NO: 589012 - protein, 7 aa, Mycobacterium
TAADDVR

SEQ ID NO: 589013 - protein, 18 aa, Mycobacterium
TAADDVSPEQLDPLGSAS

SEQ ID NO: 589014 - protein, 8 aa, Mycobacterium
TAADETPK

SEQ ID NO: 589015 - protein, 5 aa, Mycobacterium
TAADF

SEQ ID NO: 589016 - protein, 7 aa, Mycobacterium
TAADGAS

SEQ ID NO: 589017 - protein, 8 aa, Mycobacterium
TAADGEAL

SEQ ID NO: 589018 - protein, 7 aa, Mycobacterium
TAADGPA

SEQ ID NO: 589019 - protein, 5 aa, Mycobacterium
TAADL

SEQ ID NO: 589020 - protein, 17 aa, Mycobacterium
TAADLGEADKNSENAAL

SEQ ID NO: 589021 - protein, 18 aa, Mycobacterium
TAADLGRGYETEENSALK

SEQ ID NO: 589022 - protein, 16 aa, Mycobacterium
TAADLTPDVAAQENAA

SEQ ID NO: 589023 - protein, 15 aa, Mycobacterium
TAADNSVDATASRDF

SEQ ID NO: 589024 - protein, 8 aa, Mycobacterium
TAADQSAE

SEQ ID NO: 589025 - protein, 7 aa, Mycobacterium
TAADRER

SEQ ID NO: 589026 - protein, 8 aa, Mycobacterium
TAADRERS

SEQ ID NO: 589027 - protein, 9 aa, Mycobacterium
TAADSASIS

SEQ ID NO: 589028 - protein, 7 aa, Mycobacterium
TAADSGK

SEQ ID NO: 589029 - protein, 11 aa, Mycobacterium
TAADTATLELP

SEQ ID NO: 589030 - protein, 6 aa, Mycobacterium
TAADYG

SEQ ID NO: 589031 - protein, 5 aa, Mycobacterium
TAAEA

SEQ ID NO: 589032 - protein, 8 aa, Mycobacterium
TAAEAGAD

SEQ ID NO: 589033 - protein, 10 aa, Mycobacterium
TAAEAGSINQ

SEQ ID NO: 589034 - protein, 10 aa, Mycobacterium
TAAEEDLRTR

SEQ ID NO: 589035 - protein, 16 aa, Mycobacterium
TAAEGDELHASPPEGR

SEQ ID NO: 589036 - protein, 9 aa, Mycobacterium
TAAEGEVAA

SEQ ID NO: 589037 - protein, 22 aa, Mycobacterium
TAAEIGAADGDAVTVSSSRGSI

SEQ ID NO: 589038 - protein, 22 aa, Mycobacterium
TAAEIGATEGDAVTVSTPRGSI

SEQ ID NO: 589039 - protein, 16 aa, Mycobacterium
TAAEKYSEKSKTLQDA

SEQ ID NO: 589040 - protein, 13 aa, Mycobacterium
TAAENMPAARRRA

SEQ ID NO: 589041 - protein, 5 aa, Mycobacterium
TAAEP

SEQ ID NO: 589042 - protein, 20 aa, Mycobacterium
TAAEPAAPDAATAAPETTDA

SEQ ID NO: 589043 - protein, 9 aa, Mycobacterium
TAAEPADQR

SEQ ID NO: 589044 - protein, 8 aa, Mycobacterium
TAAEPATV

SEQ ID NO: 589045 - protein, 6 aa, Mycobacterium
TAAEPD

SEQ ID NO: 589046 - protein, 6 aa, Mycobacterium
TAAEPG

SEQ ID NO: 589047 - protein, 9 aa, Mycobacterium
TAAEPIDVD

SEQ ID NO: 589048 - protein, 7 aa, Mycobacterium
TAAEPRG

SEQ ID NO: 589049 - protein, 6 aa, Mycobacterium
TAAEPT

SEQ ID NO: 589050 - protein, 8 aa, Mycobacterium
TAAEQMAG

SEQ ID NO: 589051 - protein, 10 aa, Mycobacterium
TAAEQRHRER

SEQ ID NO: 589052 - protein, 12 aa, Mycobacterium
TAAERDARQQRL

SEQ ID NO: 589053 - protein, 25 aa, Mycobacterium
TAAEREQYRDHHERNDALQARSHTD

SEQ ID NO: 589054 - protein, 7 aa, Mycobacterium
TAAERER

SEQ ID NO: 589055 - protein, 17 aa, Mycobacterium
TAAERGPVVGTTTTRGH

SEQ ID NO: 589056 - protein, 6 aa, Mycobacterium
TAAERH

SEQ ID NO: 589057 - protein, 12 aa, Mycobacterium
TAAESNSAQDRL

SEQ ID NO: 589058 - protein, 7 aa, Mycobacterium
TAAESRN

SEQ ID NO: 589059 - protein, 7 aa, Mycobacterium
TAAETEL

SEQ ID NO: 589060 - protein, 10 aa, Mycobacterium
TAAETGPAPM

SEQ ID NO: 589061 - protein, 6 aa, Mycobacterium
TAAEVG

SEQ ID NO: 589062 - protein, 10 aa, Mycobacterium
TAAGAAEATV

SEQ ID NO: 589063 - protein, 8 aa, Mycobacterium
TAAGADLE

SEQ ID NO: 589064 - protein, 9 aa, Mycobacterium
TAAGADPET

SEQ ID NO: 589065 - protein, 7 aa, Mycobacterium
TAAGAGV

SEQ ID NO: 589066 - protein, 10 aa, Mycobacterium
TAAGALDPAE

SEQ ID NO: 589067 - protein, 21 aa, Mycobacterium
TAAGAQARRDRLDEVAGSEYV

SEQ ID NO: 589068 - protein, 6 aa, Mycobacterium
TAAGAR

SEQ ID NO: 589069 - protein, 7 aa, Mycobacterium
TAAGATA

SEQ ID NO: 589070 - protein, 18 aa, Mycobacterium
TAAGATAASRVGSARAAR

SEQ ID NO: 589071 - protein, 9 aa, Mycobacterium
TAAGATEVD

SEQ ID NO: 589072 - protein, 10 aa, Mycobacterium
TAAGATRANS

SEQ ID NO: 589073 - protein, 11 aa, Mycobacterium
TAAGATRENSL

SEQ ID NO: 589074 - protein, 6 aa, Mycobacterium
TAAGEA

SEQ ID NO: 589075 - protein, 7 aa, Mycobacterium
TAAGEKA

SEQ ID NO: 589076 - protein, 7 aa, Mycobacterium
TAAGELP

SEQ ID NO: 589077 - protein, 9 aa, Mycobacterium
TAAGEQRGQ

SEQ ID NO: 589078 - protein, 5 aa, Mycobacterium
TAAGF

SEQ ID NO: 589079 - protein, 13 aa, Mycobacterium
TAAGFDPDRPLTD

SEQ ID NO: 589080 - protein, 17 aa, Mycobacterium
TAAGGEAVANGSDVSNW

SEQ ID NO: 589081 - protein, 19 aa, Mycobacterium
TAAGGEAVTNGDDVADWSG

SEQ ID NO: 589082 - protein, 18 aa, Mycobacterium
TAAGGEAVTNGSDVSDWN

SEQ ID NO: 589083 - protein, 13 aa, Mycobacterium
TAAGGEAVVNGSN

SEQ ID NO: 589084 - protein, 14 aa, Mycobacterium
TAAGGEPDAHVEME

SEQ ID NO: 589085 - protein, 16 aa, Mycobacterium
TAAGGEPDVHLDADIG

SEQ ID NO: 589086 - protein, 16 aa, Mycobacterium
TAAGGEPDVHMDADID

SEQ ID NO: 589087 - protein, 12 aa, Mycobacterium
TAAGGESASPVD

SEQ ID NO: 589088 - protein, 21 aa, Mycobacterium
TAAGGGRLRTRGKTVGVADPR

SEQ ID NO: 589089 - protein, 15 aa, Mycobacterium
TAAGGGRMRRNGKGF

SEQ ID NO: 589090 - protein, 18 aa, Mycobacterium
TAAGGKAVANTDNISTWA

SEQ ID NO: 589091 - protein, 7 aa, Mycobacterium
TAAGGLT

SEQ ID NO: 589092 - protein, 6 aa, Mycobacterium
TAAGGN

SEQ ID NO: 589093 - protein, 19 aa, Mycobacterium
TAAGGNRENSLDLPPEAEE

SEQ ID NO: 589094 - protein, 7 aa, Mycobacterium
TAAGGQA

SEQ ID NO: 589095 - protein, 6 aa, Mycobacterium
TAAGGR

SEQ ID NO: 589096 - protein, 11 aa, Mycobacterium
TAAGGRVNTPL

SEQ ID NO: 589097 - protein, 7 aa, Mycobacterium
TAAGGTA

SEQ ID NO: 589098 - protein, 12 aa, Mycobacterium
TAAGHPERPDRY

SEQ ID NO: 589099 - protein, 6 aa, Mycobacterium
TAAGHR

SEQ ID NO: 589100 - protein, 5 aa, Mycobacterium
TAAGI

SEQ ID NO: 589101 - protein, 6 aa, Mycobacterium
TAAGIG

SEQ ID NO: 589102 - protein, 5 aa, Mycobacterium
TAAGL

SEQ ID NO: 589103 - protein, 5 aa, Mycobacterium
TAAGM

SEQ ID NO: 589104 - protein, 12 aa, Mycobacterium
TAAGNGGGATPA

SEQ ID NO: 589105 - protein, 9 aa, Mycobacterium
TAAGPTTAL

SEQ ID NO: 589106 - protein, 9 aa, Mycobacterium
TAAGQDPQT

SEQ ID NO: 589107 - protein, 8 aa, Mycobacterium
TAAGQQVP

SEQ ID NO: 589108 - protein, 6 aa, Mycobacterium
TAAGQR

SEQ ID NO: 589109 - protein, 13 aa, Mycobacterium
TAAGRAALANDRR

SEQ ID NO: 589110 - protein, 7 aa, Mycobacterium
TAAGRAE

SEQ ID NO: 589111 - protein, 18 aa, Mycobacterium
TAAGRARTSAPGPPDRLR

SEQ ID NO: 589112 - protein, 14 aa, Mycobacterium
TAAGRATATAQRAR

SEQ ID NO: 589113 - protein, 9 aa, Mycobacterium
TAAGRDPQT

SEQ ID NO: 589114 - protein, 6 aa, Mycobacterium
TAAGRG

SEQ ID NO: 589115 - protein, 10 aa, Mycobacterium
TAAGRRAARA

SEQ ID NO: 589116 - protein, 16 aa, Mycobacterium
TAAGRSEPRAGRDPVN

SEQ ID NO: 589117 - protein, 40 aa, Mycobacterium
TAAGSAAVTAGAARAAVADQPPAVAARPARSASAAAGAGA

SEQ ID NO: 589118 - protein, 8 aa, Mycobacterium
TAAGSAMG

SEQ ID NO: 589119 - protein, 9 aa, Mycobacterium
TAAGSGCAA

SEQ ID NO: 589120 - protein, 10 aa, Mycobacterium
TAAGSGNSNV

SEQ ID NO: 589121 - protein, 10 aa, Mycobacterium
TAAGSPSTAM

SEQ ID NO: 589122 - protein, 6 aa, Mycobacterium
TAAGSR

SEQ ID NO: 589123 - protein, 21 aa, Mycobacterium
TAAGSSYAGAEAANAAPLQQT

SEQ ID NO: 589124 - protein, 11 aa, Mycobacterium
TAAGTADMRRH

SEQ ID NO: 589125 - protein, 30 aa, Mycobacterium
TAAGTIYSGSRSPSAVRSPPGSTVPVPDSV

SEQ ID NO: 589126 - protein, 7 aa, Mycobacterium
TAAGVGK

SEQ ID NO: 589127 - protein, 8 aa, Mycobacterium
TAAGVGNA

SEQ ID NO: 589128 - protein, 10 aa, Mycobacterium
TAAGVPSETV

SEQ ID NO: 589129 - protein, 8 aa, Mycobacterium
TAAGVSPR

SEQ ID NO: 589130 - protein, 6 aa, Mycobacterium
TAAGVT

SEQ ID NO: 589131 - protein, 4 aa, Mycobacterium
TAAH

SEQ ID NO: 589132 - protein, 6 aa, Mycobacterium
TAAHAS

SEQ ID NO: 589133 - protein, 6 aa, Mycobacterium
TAAHGA

SEQ ID NO: 589134 - protein, 10 aa, Mycobacterium
TAAHGSAHGE

SEQ ID NO: 589135 - protein, 7 aa, Mycobacterium
TAAHGTV

SEQ ID NO: 589136 - protein, 11 aa, Mycobacterium
TAAHPSRRRAA

SEQ ID NO: 589137 - protein, 8 aa, Mycobacterium
TAAHRGGR

SEQ ID NO: 589138 - protein, 5 aa, Mycobacterium
TAAHY

SEQ ID NO: 589139 - protein, 9 aa, Mycobacterium
TAAISSSHG

SEQ ID NO: 589140 - protein, 6 aa, Mycobacterium
TAAKAE

SEQ ID NO: 589141 - protein, 15 aa, Mycobacterium
TAAKAYASAEAASAA

SEQ ID NO: 589142 - protein, 8 aa, Mycobacterium
TAAKDDEV

SEQ ID NO: 589143 - protein, 11 aa, Mycobacterium
TAAKDPARAEL

SEQ ID NO: 589144 - protein, 9 aa, Mycobacterium
TAAKGRLGD

SEQ ID NO: 589145 - protein, 9 aa, Mycobacterium
TAAKPGKRI

SEQ ID NO: 589146 - protein, 9 aa, Mycobacterium
TAAKTKSEK

SEQ ID NO: 589147 - protein, 15 aa, Mycobacterium
TAALGGSERARERHV

SEQ ID NO: 589148 - protein, 13 aa, Mycobacterium
TAALGTDGHPRDG

SEQ ID NO: 589149 - protein, 7 aa, Mycobacterium
TAALPGV

SEQ ID NO: 589150 - protein, 19 aa, Mycobacterium
TAALPPPPTPPPPMTPSEI

SEQ ID NO: 589151 - protein, 12 aa, Mycobacterium
TAANAAAAIPTS

SEQ ID NO: 589152 - protein, 12 aa, Mycobacterium
TAANAAAAVPTT

SEQ ID NO: 589153 - protein, 10 aa, Mycobacterium
TAANELGPQG

SEQ ID NO: 589154 - protein, 7 aa, Mycobacterium
TAANPVD

SEQ ID NO: 589155 - protein, 10 aa, Mycobacterium
TAANQDGRSE

SEQ ID NO: 589156 - protein, 16 aa, Mycobacterium
TAANSDLKRLPTEDEV

SEQ ID NO: 589157 - protein, 19 aa, Mycobacterium
TAANSPTVVSSGNPFNTGN

SEQ ID NO: 589158 - protein, 13 aa, Mycobacterium
TAAPAAASDPLST

SEQ ID NO: 589159 - protein, 8 aa, Mycobacterium
TAAPAAEP

SEQ ID NO: 589160 - protein, 9 aa, Mycobacterium
TAAPAGTGR

SEQ ID NO: 589161 - protein, 7 aa, Mycobacterium
TAAPATA

SEQ ID NO: 589162 - protein, 8 aa, Mycobacterium
TAAPAYAE

SEQ ID NO: 589163 - protein, 11 aa, Mycobacterium
TAAPDEIDSTA

SEQ ID NO: 589164 - protein, 7 aa, Mycobacterium
TAAPDQL

SEQ ID NO: 589165 - protein, 10 aa, Mycobacterium
TAAPDRPGSV

SEQ ID NO: 589166 - protein, 5 aa, Mycobacterium
TAAPE

SEQ ID NO: 589167 - protein, 7 aa, Mycobacterium
TAAPEEI

SEQ ID NO: 589168 - protein, 10 aa, Mycobacterium
TAAPESVGGA

SEQ ID NO: 589169 - protein, 28 aa, Mycobacterium
TAAPGELKGIGSGMAAKSAAAARPTTSV

SEQ ID NO: 589170 - protein, 7 aa, Mycobacterium
TAAPGIT

SEQ ID NO: 589171 - protein, 11 aa, Mycobacterium
TAAPGNGAPLG

SEQ ID NO: 589172 - protein, 13 aa, Mycobacterium
TAAPGPVSDYTGQ

SEQ ID NO: 589173 - protein, 11 aa, Mycobacterium
TAAPGRDDADT

SEQ ID NO: 589174 - protein, 11 aa, Mycobacterium
TAAPLPTADPD

SEQ ID NO: 589175 - protein, 7 aa, Mycobacterium
TAAPLSP

SEQ ID NO: 589176 - protein, 5 aa, Mycobacterium
TAAPM

SEQ ID NO: 589177 - protein, 8 aa, Mycobacterium
TAAPMGGM

SEQ ID NO: 589178 - protein, 14 aa, Mycobacterium
TAAPNVHGDDVSDT

SEQ ID NO: 589179 - protein, 7 aa, Mycobacterium
TAAPPFG

SEQ ID NO: 589180 - protein, 9 aa, Mycobacterium
TAAPPLTPH

SEQ ID NO: 589181 - protein, 9 aa, Mycobacterium
TAAPPPDFP

SEQ ID NO: 589182 - protein, 8 aa, Mycobacterium
TAAPRIPA

SEQ ID NO: 589183 - protein, 6 aa, Mycobacterium
TAAPRR

SEQ ID NO: 589184 - protein, 6 aa, Mycobacterium
TAAPSN

SEQ ID NO: 589185 - protein, 8 aa, Mycobacterium
TAAPSRRM

SEQ ID NO: 589186 - protein, 8 aa, Mycobacterium
TAAPTAQY

SEQ ID NO: 589187 - protein, 5 aa, Mycobacterium
TAAPY

SEQ ID NO: 589188 - protein, 5 aa, Mycobacterium
TAAQA

SEQ ID NO: 589189 - protein, 11 aa, Mycobacterium
TAAQAAAAAPT

SEQ ID NO: 589190 - protein, 9 aa, Mycobacterium
TAAQAADAA

SEQ ID NO: 589191 - protein, 11 aa, Mycobacterium
TAAQAAGDAGL

SEQ ID NO: 589192 - protein, 8 aa, Mycobacterium
TAAQAAQA

SEQ ID NO: 589193 - protein, 19 aa, Mycobacterium
TAAQAEESAVQAAAAAAAY

SEQ ID NO: 589194 - protein, 16 aa, Mycobacterium
TAAQAELASAQARAAV

SEQ ID NO: 589195 - protein, 19 aa, Mycobacterium
TAAQAELTADQVRTAATAY

SEQ ID NO: 589196 - protein, 14 aa, Mycobacterium
TAAQAEQAAAQARA

SEQ ID NO: 589197 - protein, 18 aa, Mycobacterium
TAAQAEQAASRARAAAAA

SEQ ID NO: 589198 - protein, 18 aa, Mycobacterium
TAAQAEQAGGQAVAAATA

SEQ ID NO: 589199 - protein, 14 aa, Mycobacterium
TAAQAEQIAGQART

SEQ ID NO: 589200 - protein, 14 aa, Mycobacterium
TAAQAEQSAAQARA

SEQ ID NO: 589201 - protein, 14 aa, Mycobacterium
TAAQAEQSATQARA

SEQ ID NO: 589202 - protein, 18 aa, Mycobacterium
TAAQAKESADQSRAAAAA

SEQ ID NO: 589203 - protein, 19 aa, Mycobacterium
TAAQAQKRALQASAQASSY

SEQ ID NO: 589204 - protein, 12 aa, Mycobacterium
TAAQAQQTAGQL

SEQ ID NO: 589205 - protein, 19 aa, Mycobacterium
TAAQAQQTASQLGSAAAAY

SEQ ID NO: 589206 - protein, 18 aa, Mycobacterium
TAAQATQAADQATAAAGA

SEQ ID NO: 589207 - protein, 10 aa, Mycobacterium
TAAQDAPAMG

SEQ ID NO: 589208 - protein, 5 aa, Mycobacterium
TAAQH

SEQ ID NO: 589209 - protein, 11 aa, Mycobacterium
TAAQHAAASGE

SEQ ID NO: 589210 - protein, 8 aa, Mycobacterium
TAAQHPDR

SEQ ID NO: 589211 - protein, 9 aa, Mycobacterium
TAAQQQRAE

SEQ ID NO: 589212 - protein, 11 aa, Mycobacterium
TAAQRRAERRE

SEQ ID NO: 589213 - protein, 11 aa, Mycobacterium
TAAQRYSGTAD

SEQ ID NO: 589214 - protein, 7 aa, Mycobacterium
TAAQSDL

SEQ ID NO: 589215 - protein, 11 aa, Mycobacterium
TAAQSGPGRGI

SEQ ID NO: 589216 - protein, 8 aa, Mycobacterium
TAAQTELT

SEQ ID NO: 589217 - protein, 7 aa, Mycobacterium
TAAQTER

SEQ ID NO: 589218 - protein, 5 aa, Mycobacterium
TAAQY

SEQ ID NO: 589219 - protein, 10 aa, Mycobacterium
TAARARGGRT

SEQ ID NO: 589220 - protein, 8 aa, Mycobacterium
TAARASHD

SEQ ID NO: 589221 - protein, 8 aa, Mycobacterium
TAARDGGY

SEQ ID NO: 589222 - protein, 7 aa, Mycobacterium
TAARDRL

SEQ ID NO: 589223 - protein, 33 aa, Mycobacterium
TAARGGEASAARARASSEALHRRTGRTAGNGSL

SEQ ID NO: 589224 - protein, 11 aa, Mycobacterium
TAARMGPDASR

SEQ ID NO: 589225 - protein, 6 aa, Mycobacterium
TAARPS

SEQ ID NO: 589226 - protein, 10 aa, Mycobacterium
TAARRAREHR

SEQ ID NO: 589227 - protein, 6 aa, Mycobacterium
TAARRP

SEQ ID NO: 589228 - protein, 21 aa, Mycobacterium
TAARSADRRRRELQGSRDQLS

SEQ ID NO: 589229 - protein, 22 aa, Mycobacterium
TAARSAIDTTNDAKAAAARAEA

SEQ ID NO: 589230 - protein, 7 aa, Mycobacterium
TAARSDK

SEQ ID NO: 589231 - protein, 13 aa, Mycobacterium
TAARSGRTPTRGA

SEQ ID NO: 589232 - protein, 6 aa, Mycobacterium
TAARSI

SEQ ID NO: 589233 - protein, 7 aa, Mycobacterium
TAARTAR

SEQ ID NO: 589234 - protein, 21 aa, Mycobacterium
TAARTSRGQVRNKRALRTSAG

SEQ ID NO: 589235 - protein, 4 aa, Mycobacterium
TAAS

SEQ ID NO: 589236 - protein, 9 aa, Mycobacterium
TAASAAKAC

SEQ ID NO: 589237 - protein, 10 aa, Mycobacterium
TAASAAKACA

SEQ ID NO: 589238 - protein, 7 aa, Mycobacterium
TAASAAV

SEQ ID NO: 589239 - protein, 6 aa, Mycobacterium
TAASAG

SEQ ID NO: 589240 - protein, 7 aa, Mycobacterium
TAASAGL

SEQ ID NO: 589241 - protein, 22 aa, Mycobacterium
TAASAKKAAGAAERSKPVRTRE

SEQ ID NO: 589242 - protein, 9 aa, Mycobacterium
TAASAPSPG

SEQ ID NO: 589243 - protein, 10 aa, Mycobacterium
TAASATKTCA

SEQ ID NO: 589244 - protein, 8 aa, Mycobacterium
TAASATKV

SEQ ID NO: 589245 - protein, 11 aa, Mycobacterium
TAASDAGRDPM

SEQ ID NO: 589246 - protein, 7 aa, Mycobacterium
TAASESV

SEQ ID NO: 589247 - protein, 7 aa, Mycobacterium
TAASETV

SEQ ID NO: 589248 - protein, 5 aa, Mycobacterium
TAASG

SEQ ID NO: 589249 - protein, 13 aa, Mycobacterium
TAASGELEAVADV

SEQ ID NO: 589250 - protein, 8 aa, Mycobacterium
TAASGPTT

SEQ ID NO: 589251 - protein, 9 aa, Mycobacterium
TAASGRPGG

SEQ ID NO: 589252 - protein, 9 aa, Mycobacterium
TAASKTPKD

SEQ ID NO: 589253 - protein, 30 aa, Mycobacterium
TAASMKRRSTALRARGRNARRPRCLVRRAA

SEQ ID NO: 589254 - protein, 9 aa, Mycobacterium
TAASNDEVD

SEQ ID NO: 589255 - protein, 13 aa, Mycobacterium
TAASNHRVSLWPH

SEQ ID NO: 589256 - protein, 13 aa, Mycobacterium
TAASPAALPGPSG

SEQ ID NO: 589257 - protein, 10 aa, Mycobacterium
TAASPEEMRA

SEQ ID NO: 589258 - protein, 11 aa, Mycobacterium
TAASSLHPQGG

SEQ ID NO: 589259 - protein, 5 aa, Mycobacterium
TAAST

SEQ ID NO: 589260 - protein, 6 aa, Mycobacterium
TAASTG

SEQ ID NO: 589261 - protein, 5 aa, Mycobacterium
TAATA

SEQ ID NO: 589262 - protein, 7 aa, Mycobacterium
TAATAAD

SEQ ID NO: 589263 - protein, 7 aa, Mycobacterium
TAATADL

SEQ ID NO: 589264 - protein, 8 aa, Mycobacterium
TAATAREN

SEQ ID NO: 589265 - protein, 5 aa, Mycobacterium
TAATD

SEQ ID NO: 589266 - protein, 10 aa, Mycobacterium
TAATDGDLAP

SEQ ID NO: 589267 - protein, 9 aa, Mycobacterium
TAATDGNLD

SEQ ID NO: 589268 - protein, 7 aa, Mycobacterium
TAATDGS

SEQ ID NO: 589269 - protein, 8 aa, Mycobacterium
TAATDPRR

SEQ ID NO: 589270 - protein, 11 aa, Mycobacterium
TAATEAHTGPL

SEQ ID NO: 589271 - protein, 10 aa, Mycobacterium
TAATEGDLGP

SEQ ID NO: 589272 - protein, 16 aa, Mycobacterium
TAATEPPAPGENPAAG

SEQ ID NO: 589273 - protein, 11 aa, Mycobacterium
TAATGGDLGPV

SEQ ID NO: 589274 - protein, 9 aa, Mycobacterium
TAATGLAER

SEQ ID NO: 589275 - protein, 13 aa, Mycobacterium
TAATGRAVTGGGT

SEQ ID NO: 589276 - protein, 9 aa, Mycobacterium
TAATGSDGA

SEQ ID NO: 589277 - protein, 8 aa, Mycobacterium
TAATGSGH

SEQ ID NO: 589278 - protein, 7 aa, Mycobacterium
TAATGSR

SEQ ID NO: 589279 - protein, 16 aa, Mycobacterium
TAATLGGAHRSATEAV

SEQ ID NO: 589280 - protein, 10 aa, Mycobacterium
TAATPGQSAD

SEQ ID NO: 589281 - protein, 12 aa, Mycobacterium
TAATPLGQQPLS

SEQ ID NO: 589282 - protein, 8 aa, Mycobacterium
TAATPQGL

SEQ ID NO: 589283 - protein, 59 aa, Mycobacterium
TAATPRVPAGEKPPADAPSGAMPVAPTQTQSAATPSRTAEPQVPPPMPPPPATAPQWPQ

SEQ ID NO: 589284 - protein, 8 aa, Mycobacterium
TAATPTLT

SEQ ID NO: 589285 - protein, 11 aa, Mycobacterium
TAATRLGAPSV

SEQ ID NO: 589286 - protein, 7 aa, Mycobacterium
TAATRSL

SEQ ID NO: 589287 - protein, 6 aa, Mycobacterium
TAATTA

SEQ ID NO: 589288 - protein, 9 aa, Mycobacterium
TAATTGDLA

SEQ ID NO: 589289 - protein, 6 aa, Mycobacterium
TAATTN

SEQ ID NO: 589290 - protein, 8 aa, Mycobacterium
TAATTSRQ

SEQ ID NO: 589291 - protein, 7 aa, Mycobacterium
TAATVGE

SEQ ID NO: 589292 - protein, 7 aa, Mycobacterium
TAATYGA

SEQ ID NO: 589293 - protein, 7 aa, Mycobacterium
TAATYGS

SEQ ID NO: 589294 - protein, 10 aa, Mycobacterium
TAAVGGDAPI

SEQ ID NO: 589295 - protein, 8 aa, Mycobacterium
TAAVGGDV

SEQ ID NO: 589296 - protein, 6 aa, Mycobacterium
TAAYGM

SEQ ID NO: 589297 - protein, 8 aa, Mycobacterium
TAAYRQGE

SEQ ID NO: 589298 - protein, 8 aa, Mycobacterium
TACAPTRS

SEQ ID NO: 589299 - protein, 6 aa, Mycobacterium
TACGPP

SEQ ID NO: 589300 - protein, 7 aa, Mycobacterium
TACGPPG

SEQ ID NO: 589301 - protein, 8 aa, Mycobacterium
TACGPPGL

SEQ ID NO: 589302 - protein, 64 aa, Mycobacterium
TACQTDSTVATRSTVTAQPPQPDGSATGAPVTAATGDRAGSAGPAGATATEQPSASTATATGAT

SEQ ID NO: 589303 - protein, 5 aa, Mycobacterium
TADAA

SEQ ID NO: 589304 - protein, 8 aa, Mycobacterium
TADAAGHD

SEQ ID NO: 589305 - protein, 11 aa, Mycobacterium
TADAALRRTTR

SEQ ID NO: 589306 - protein, 9 aa, Mycobacterium
TADAARAEL

SEQ ID NO: 589307 - protein, 12 aa, Mycobacterium
TADAATSDLTLP

SEQ ID NO: 589308 - protein, 11 aa, Mycobacterium
TADADAAAKGA

SEQ ID NO: 589309 - protein, 10 aa, Mycobacterium
TADADNVVPT

SEQ ID NO: 589310 - protein, 7 aa, Mycobacterium
TADADPL

SEQ ID NO: 589311 - protein, 8 aa, Mycobacterium
TADADRDA

SEQ ID NO: 589312 - protein, 8 aa, Mycobacterium
TADAEGSA

SEQ ID NO: 589313 - protein, 7 aa, Mycobacterium
TADAGAR

SEQ ID NO: 589314 - protein, 6 aa, Mycobacterium
TADAGD

SEQ ID NO: 589315 - protein, 10 aa, Mycobacterium
TADAGPARDS

SEQ ID NO: 589316 - protein, 8 aa, Mycobacterium
TADAHRRA

SEQ ID NO: 589317 - protein, 5 aa, Mycobacterium
TADAI

SEQ ID NO: 589318 - protein, 9 aa, Mycobacterium
TADAKNSAL

SEQ ID NO: 589319 - protein, 11 aa, Mycobacterium
TADAPPQPSAE

SEQ ID NO: 589320 - protein, 5 aa, Mycobacterium
TADAR

SEQ ID NO: 589321 - protein, 7 aa, Mycobacterium
TADARGA

SEQ ID NO: 589322 - protein, 7 aa, Mycobacterium
TADARSG

SEQ ID NO: 589323 - protein, 5 aa, Mycobacterium
TADAS

SEQ ID NO: 589324 - protein, 20 aa, Mycobacterium
TADAVSADRIARSPGDDDSV

SEQ ID NO: 589325 - protein, 8 aa, Mycobacterium
TADCTTAA

SEQ ID NO: 589326 - protein, 4 aa, Mycobacterium
TADD

SEQ ID NO: 589327 - protein, 11 aa, Mycobacterium
TADDAAGGNAV

SEQ ID NO: 589328 - protein, 6 aa, Mycobacterium
TADDAE

SEQ ID NO: 589329 - protein, 11 aa, Mycobacterium
TADDAPETASE

SEQ ID NO: 589330 - protein, 8 aa, Mycobacterium
TADDATHQ

SEQ ID NO: 589331 - protein, 10 aa, Mycobacterium
TADDATKTMT

SEQ ID NO: 589332 - protein, 7 aa, Mycobacterium
TADDDAA

SEQ ID NO: 589333 - protein, 5 aa, Mycobacterium
TADDE

SEQ ID NO: 589334 - protein, 17 aa, Mycobacterium
TADDESQLDGDSATRRA

SEQ ID NO: 589335 - protein, 5 aa, Mycobacterium
TADDG

SEQ ID NO: 589336 - protein, 10 aa, Mycobacterium
TADDGPDELS

SEQ ID NO: 589337 - protein, 8 aa, Mycobacterium
TADDGRSA

SEQ ID NO: 589338 - protein, 6 aa, Mycobacterium
TADDLA

SEQ ID NO: 589339 - protein, 16 aa, Mycobacterium
TADDLRSAAGAEQLEP

SEQ ID NO: 589340 - protein, 21 aa, Mycobacterium
TADDPDPEDQRELESRAAGLK

SEQ ID NO: 589341 - protein, 7 aa, Mycobacterium
TADDPEL

SEQ ID NO: 589342 - protein, 7 aa, Mycobacterium
TADDPKL

SEQ ID NO: 589343 - protein, 6 aa, Mycobacterium
TADDPV

SEQ ID NO: 589344 - protein, 5 aa, Mycobacterium
TADDQ

SEQ ID NO: 589345 - protein, 5 aa, Mycobacterium
TADDT

SEQ ID NO: 589346 - protein, 6 aa, Mycobacterium
TADDTV

SEQ ID NO: 589347 - protein, 6 aa, Mycobacterium
TADDVA

SEQ ID NO: 589348 - protein, 13 aa, Mycobacterium
TADDVATSAQSAA

SEQ ID NO: 589349 - protein, 8 aa, Mycobacterium
TADEAKEY

SEQ ID NO: 589350 - protein, 10 aa, Mycobacterium
TADEDPGAAR

SEQ ID NO: 589351 - protein, 5 aa, Mycobacterium
TADEG

SEQ ID NO: 589352 - protein, 6 aa, Mycobacterium
TADEGH

SEQ ID NO: 589353 - protein, 7 aa, Mycobacterium
TADEGRR

SEQ ID NO: 589354 - protein, 14 aa, Mycobacterium
TADEISAEGTSPDV

SEQ ID NO: 589355 - protein, 9 aa, Mycobacterium
TADENDGRA

SEQ ID NO: 589356 - protein, 6 aa, Mycobacterium
TADENR

SEQ ID NO: 589357 - protein, 9 aa, Mycobacterium
TADEPAHTA

SEQ ID NO: 589358 - protein, 7 aa, Mycobacterium
TADEPDT

SEQ ID NO: 589359 - protein, 11 aa, Mycobacterium
TADEPTDDERQ

SEQ ID NO: 589360 - protein, 7 aa, Mycobacterium
TADEQRA

SEQ ID NO: 589361 - protein, 8 aa, Mycobacterium
TADESDRR

SEQ ID NO: 589362 - protein, 19 aa, Mycobacterium
TADEVDADRQRQLESAAAG

SEQ ID NO: 589363 - protein, 4 aa, Mycobacterium
TADF

SEQ ID NO: 589364 - protein, 11 aa, Mycobacterium
TADFDGEARDA

SEQ ID NO: 589365 - protein, 7 aa, Mycobacterium
TADFTGS

SEQ ID NO: 589366 - protein, 10 aa, Mycobacterium
TADGADREYA

SEQ ID NO: 589367 - protein, 12 aa, Mycobacterium
TADGATAGTLQR

SEQ ID NO: 589368 - protein, 20 aa, Mycobacterium
TADGATRQYHTRTASAQEKA

SEQ ID NO: 589369 - protein, 15 aa, Mycobacterium
TADGCRGDYDQAGPA

SEQ ID NO: 589370 - protein, 6 aa, Mycobacterium
TADGDG

SEQ ID NO: 589371 - protein, 8 aa, Mycobacterium
TADGDLRP

SEQ ID NO: 589372 - protein, 8 aa, Mycobacterium
TADGEPWR

SEQ ID NO: 589373 - protein, 7 aa, Mycobacterium
TADGEQH

SEQ ID NO: 589374 - protein, 9 aa, Mycobacterium
TADGETHRA

SEQ ID NO: 589375 - protein, 7 aa, Mycobacterium
TADGFPS

SEQ ID NO: 589376 - protein, 8 aa, Mycobacterium
TADGGGQV

SEQ ID NO: 589377 - protein, 10 aa, Mycobacterium
TADGGTASDW

SEQ ID NO: 589378 - protein, 6 aa, Mycobacterium
TADGGV

SEQ ID NO: 589379 - protein, 9 aa, Mycobacterium
TADGKRYQA

SEQ ID NO: 589380 - protein, 5 aa, Mycobacterium
TADGL

SEQ ID NO: 589381 - protein, 10 aa, Mycobacterium
TADGLDADAV

SEQ ID NO: 589382 - protein, 14 aa, Mycobacterium
TADGLDDARRDDLE

SEQ ID NO: 589383 - protein, 12 aa, Mycobacterium
TADGLPDPAASK

SEQ ID NO: 589384 - protein, 8 aa, Mycobacterium
TADGPDAQ

SEQ ID NO: 589385 - protein, 11 aa, Mycobacterium
TADGPEPRSNG

SEQ ID NO: 589386 - protein, 9 aa, Mycobacterium
TADGPGEFH

SEQ ID NO: 589387 - protein, 8 aa, Mycobacterium
TADGPRTV

SEQ ID NO: 589388 - protein, 7 aa, Mycobacterium
TADGPTE

SEQ ID NO: 589389 - protein, 6 aa, Mycobacterium
TADGPV

SEQ ID NO: 589390 - protein, 8 aa, Mycobacterium
TADGQTRR

SEQ ID NO: 589391 - protein, 5 aa, Mycobacterium
TADGR

SEQ ID NO: 589392 - protein, 13 aa, Mycobacterium
TADGRDGYAVQPG

SEQ ID NO: 589393 - protein, 12 aa, Mycobacterium
TADGRDGYPVEA

SEQ ID NO: 589394 - protein, 13 aa, Mycobacterium
TADGRDGYPVEPD

SEQ ID NO: 589395 - protein, 13 aa, Mycobacterium
TADGRDGYRVEPG

SEQ ID NO: 589396 - protein, 7 aa, Mycobacterium
TADGRKL

SEQ ID NO: 589397 - protein, 22 aa, Mycobacterium
TADGRREYARAQEQISERAAPL

SEQ ID NO: 589398 - protein, 13 aa, Mycobacterium
TADGRSPESVQKR

SEQ ID NO: 589399 - protein, 11 aa, Mycobacterium
TADGRTEQVRQ

SEQ ID NO: 589400 - protein, 17 aa, Mycobacterium
TADGRTGVGWLEWNRNL

SEQ ID NO: 589401 - protein, 6 aa, Mycobacterium
TADGSM

SEQ ID NO: 589402 - protein, 7 aa, Mycobacterium
TADGSVK

SEQ ID NO: 589403 - protein, 7 aa, Mycobacterium
TADGSVR

SEQ ID NO: 589404 - protein, 8 aa, Mycobacterium
TADGTEHE

SEQ ID NO: 589405 - protein, 8 aa, Mycobacterium
TADGTERP

SEQ ID NO: 589406 - protein, 8 aa, Mycobacterium
TADGTVKP

SEQ ID NO: 589407 - protein, 7 aa, Mycobacterium
TADGVEG

SEQ ID NO: 589408 - protein, 8 aa, Mycobacterium
TADGWAPD

SEQ ID NO: 589409 - protein, 6 aa, Mycobacterium
TADGYA

SEQ ID NO: 589410 - protein, 4 aa, Mycobacterium
TADH

SEQ ID NO: 589411 - protein, 10 aa, Mycobacterium
TADHGFTASR

SEQ ID NO: 589412 - protein, 5 aa, Mycobacterium
TADIS

SEQ ID NO: 589413 - protein, 10 aa, Mycobacterium
TADKAPDATP

SEQ ID NO: 589414 - protein, 8 aa, Mycobacterium
TADLDDAR

SEQ ID NO: 589415 - protein, 13 aa, Mycobacterium
TADLGRTVTAADT

SEQ ID NO: 589416 - protein, 6 aa, Mycobacterium
TADLND

SEQ ID NO: 589417 - protein, 5 aa, Mycobacterium
TADLP

SEQ ID NO: 589418 - protein, 9 aa, Mycobacterium
TADLPARGL

SEQ ID NO: 589419 - protein, 13 aa, Mycobacterium
TADLPTAQSAASQ

SEQ ID NO: 589420 - protein, 7 aa, Mycobacterium
TADMKSG

SEQ ID NO: 589421 - protein, 9 aa, Mycobacterium
TADMTSSAA

SEQ ID NO: 589422 - protein, 5 aa, Mycobacterium
TADND

SEQ ID NO: 589423 - protein, 5 aa, Mycobacterium
TADNE

SEQ ID NO: 589424 - protein, 5 aa, Mycobacterium
TADNG

SEQ ID NO: 589425 - protein, 16 aa, Mycobacterium
TADNGALTDVVLHAIE

SEQ ID NO: 589426 - protein, 9 aa, Mycobacterium
TADNGATDI

SEQ ID NO: 589427 - protein, 9 aa, Mycobacterium
TADNGPDEL

SEQ ID NO: 589428 - protein, 9 aa, Mycobacterium
TADNGVGPV

SEQ ID NO: 589429 - protein, 6 aa, Mycobacterium
TADNVD

SEQ ID NO: 589430 - protein, 20 aa, Mycobacterium
TADPAEDAAALEDRVVAMLK

SEQ ID NO: 589431 - protein, 7 aa, Mycobacterium
TADPAEQ

SEQ ID NO: 589432 - protein, 17 aa, Mycobacterium
TADPAHHERPEYNVPTQ

SEQ ID NO: 589433 - protein, 16 aa, Mycobacterium
TADPAIDLPDTLMGVR

SEQ ID NO: 589434 - protein, 11 aa, Mycobacterium
TADPASDKPPY

SEQ ID NO: 589435 - protein, 10 aa, Mycobacterium
TADPASVEPL

SEQ ID NO: 589436 - protein, 12 aa, Mycobacterium
TADPDHHGFGIH

SEQ ID NO: 589437 - protein, 10 aa, Mycobacterium
TADPDTAIGP

SEQ ID NO: 589438 - protein, 8 aa, Mycobacterium
TADPEFQT

SEQ ID NO: 589439 - protein, 6 aa, Mycobacterium
TADPER

SEQ ID NO: 589440 - protein, 6 aa, Mycobacterium
TADPFG

SEQ ID NO: 589441 - protein, 8 aa, Mycobacterium
TADPGATM

SEQ ID NO: 589442 - protein, 8 aa, Mycobacterium
TADPGQAL

SEQ ID NO: 589443 - protein, 9 aa, Mycobacterium
TADPQAADL

SEQ ID NO: 589444 - protein, 10 aa, Mycobacterium
TADPQARRRG

SEQ ID NO: 589445 - protein, 7 aa, Mycobacterium
TADPRRA

SEQ ID NO: 589446 - protein, 8 aa, Mycobacterium
TADPSGNL

SEQ ID NO: 589447 - protein, 13 aa, Mycobacterium
TADPSLVKKSTDE

SEQ ID NO: 589448 - protein, 11 aa, Mycobacterium
TADPSSDKPAY

SEQ ID NO: 589449 - protein, 11 aa, Mycobacterium
TADPSSDKPGY

SEQ ID NO: 589450 - protein, 10 aa, Mycobacterium
TADPSTGARD

SEQ ID NO: 589451 - protein, 9 aa, Mycobacterium
TADPTGVAE

SEQ ID NO: 589452 - protein, 14 aa, Mycobacterium
TADPTRSPAGTESA

SEQ ID NO: 589453 - protein, 11 aa, Mycobacterium
TADPTSSKPAY

SEQ ID NO: 589454 - protein, 5 aa, Mycobacterium
TADPV

SEQ ID NO: 589455 - protein, 6 aa, Mycobacterium
TADPVE

SEQ ID NO: 589456 - protein, 8 aa, Mycobacterium
TADQKEGM

SEQ ID NO: 589457 - protein, 6 aa, Mycobacterium
TADQKQ

SEQ ID NO: 589458 - protein, 15 aa, Mycobacterium
TADQPQKAKDFTSDQ

SEQ ID NO: 589459 - protein, 8 aa, Mycobacterium
TADQREAS

SEQ ID NO: 589460 - protein, 6 aa, Mycobacterium
TADQRG

SEQ ID NO: 589461 - protein, 7 aa, Mycobacterium
TADQSEG

SEQ ID NO: 589462 - protein, 16 aa, Mycobacterium
TADQSVPYDGGPGKAV

SEQ ID NO: 589463 - protein, 9 aa, Mycobacterium
TADRAELEG

SEQ ID NO: 589464 - protein, 6 aa, Mycobacterium
TADRCG

SEQ ID NO: 589465 - protein, 6 aa, Mycobacterium
TADRER

SEQ ID NO: 589466 - protein, 7 aa, Mycobacterium
TADRETF

SEQ ID NO: 589467 - protein, 5 aa, Mycobacterium
TADRL

SEQ ID NO: 589468 - protein, 13 aa, Mycobacterium
TADRRDLAQDQQG

SEQ ID NO: 589469 - protein, 13 aa, Mycobacterium
TADRRDLAQNQQG

SEQ ID NO: 589470 - protein, 12 aa, Mycobacterium
TADRSDLDDIPA

SEQ ID NO: 589471 - protein, 9 aa, Mycobacterium
TADRVTPPE

SEQ ID NO: 589472 - protein, 6 aa, Mycobacterium
TADSDM

SEQ ID NO: 589473 - protein, 9 aa, Mycobacterium
TADSEREEI

SEQ ID NO: 589474 - protein, 8 aa, Mycobacterium
TADSGAAA

SEQ ID NO: 589475 - protein, 15 aa, Mycobacterium
TADSGDPAPNSGENI

SEQ ID NO: 589476 - protein, 9 aa, Mycobacterium
TADSGSAAN

SEQ ID NO: 589477 - protein, 10 aa, Mycobacterium
TADSGSSANW

SEQ ID NO: 589478 - protein, 9 aa, Mycobacterium
TADSGSSTT

SEQ ID NO: 589479 - protein, 8 aa, Mycobacterium
TADSGTVI

SEQ ID NO: 589480 - protein, 5 aa, Mycobacterium
TADSL

SEQ ID NO: 589481 - protein, 12 aa, Mycobacterium
TADSLTDDDRRD

SEQ ID NO: 589482 - protein, 15 aa, Mycobacterium
TADSPAGDFGGVAPE

SEQ ID NO: 589483 - protein, 17 aa, Mycobacterium
TADSPFTLTGPAAGTPF

SEQ ID NO: 589484 - protein, 7 aa, Mycobacterium
TADSPGV

SEQ ID NO: 589485 - protein, 8 aa, Mycobacterium
TADSPIDA

SEQ ID NO: 589486 - protein, 8 aa, Mycobacterium
TADSSQRL

SEQ ID NO: 589487 - protein, 6 aa, Mycobacterium
TADSSR

SEQ ID NO: 589488 - protein, 7 aa, Mycobacterium
TADTAAA

SEQ ID NO: 589489 - protein, 17 aa, Mycobacterium
TADTAEGSAEPVEPPPR

SEQ ID NO: 589490 - protein, 10 aa, Mycobacterium
TADTASRALG

SEQ ID NO: 589491 - protein, 10 aa, Mycobacterium
TADTDVAQKV

SEQ ID NO: 589492 - protein, 7 aa, Mycobacterium
TADTEIR

SEQ ID NO: 589493 - protein, 7 aa, Mycobacterium
TADTEVR

SEQ ID NO: 589494 - protein, 6 aa, Mycobacterium
TADTGV

SEQ ID NO: 589495 - protein, 8 aa, Mycobacterium
TADTLAPD

SEQ ID NO: 589496 - protein, 7 aa, Mycobacterium
TADTPFP

SEQ ID NO: 589497 - protein, 6 aa, Mycobacterium
TADTPL

SEQ ID NO: 589498 - protein, 9 aa, Mycobacterium
TADTTGRWR

SEQ ID NO: 589499 - protein, 14 aa, Mycobacterium
TADTVGGQDGVGPS

SEQ ID NO: 589500 - protein, 7 aa, Mycobacterium
TADTVTT

SEQ ID NO: 589501 - protein, 4 aa, Mycobacterium
TADV

SEQ ID NO: 589502 - protein, 6 aa, Mycobacterium
TADVAA

SEQ ID NO: 589503 - protein, 10 aa, Mycobacterium
TADVAASSLA

SEQ ID NO: 589504 - protein, 16 aa, Mycobacterium
TADVAEAARSTNPQAF

SEQ ID NO: 589505 - protein, 8 aa, Mycobacterium
TADVDAEQ

SEQ ID NO: 589506 - protein, 10 aa, Mycobacterium
TADVGTPNSS

SEQ ID NO: 589507 - protein, 10 aa, Mycobacterium
TADVNADDAF

SEQ ID NO: 589508 - protein, 8 aa, Mycobacterium
TADVPEPV

SEQ ID NO: 589509 - protein, 5 aa, Mycobacterium
TADVS

SEQ ID NO: 589510 - protein, 6 aa, Mycobacterium
TADVSA

SEQ ID NO: 589511 - protein, 10 aa, Mycobacterium
TADVSDRKDI

SEQ ID NO: 589512 - protein, 9 aa, Mycobacterium
TADVTLPAG

SEQ ID NO: 589513 - protein, 11 aa, Mycobacterium
TADYGTTANYA

SEQ ID NO: 589514 - protein, 9 aa, Mycobacterium
TADYPELDQ

SEQ ID NO: 589515 - protein, 9 aa, Mycobacterium
TADYPRRTA

SEQ ID NO: 589516 - protein, 4 aa, Mycobacterium
TAEA

SEQ ID NO: 589517 - protein, 8 aa, Mycobacterium
TAEAAAAA

SEQ ID NO: 589518 - protein, 13 aa, Mycobacterium
TAEAAAAAGARRV

SEQ ID NO: 589519 - protein, 11 aa, Mycobacterium
TAEAAADGALP

SEQ ID NO: 589520 - protein, 12 aa, Mycobacterium
TAEAADAAIAEA

SEQ ID NO: 589521 - protein, 17 aa, Mycobacterium
TAEAADDVARAAAASPR

SEQ ID NO: 589522 - protein, 9 aa, Mycobacterium
TAEAADRGH

SEQ ID NO: 589523 - protein, 11 aa, Mycobacterium
TAEAAEERGGV

SEQ ID NO: 589524 - protein, 9 aa, Mycobacterium
TAEAANASP

SEQ ID NO: 589525 - protein, 8 aa, Mycobacterium
TAEAAQAG

SEQ ID NO: 589526 - protein, 6 aa, Mycobacterium
TAEAAR

SEQ ID NO: 589527 - protein, 5 aa, Mycobacterium
TAEAE

SEQ ID NO: 589528 - protein, 6 aa, Mycobacterium
TAEAEA

SEQ ID NO: 589529 - protein, 22 aa, Mycobacterium
TAEAEAKALTGDRNEAESEELR

SEQ ID NO: 589530 - protein, 5 aa, Mycobacterium
TAEAG

SEQ ID NO: 589531 - protein, 24 aa, Mycobacterium
TAEAGQGGGAQGASGTSGAAAKGV

SEQ ID NO: 589532 - protein, 15 aa, Mycobacterium
TAEARDAFDQPNPFT

SEQ ID NO: 589533 - protein, 9 aa, Mycobacterium
TAEARQVDN

SEQ ID NO: 589534 - protein, 7 aa, Mycobacterium
TAEASGL

SEQ ID NO: 589535 - protein, 8 aa, Mycobacterium
TAEASGND

SEQ ID NO: 589536 - protein, 7 aa, Mycobacterium
TAEATDL

SEQ ID NO: 589537 - protein, 10 aa, Mycobacterium
TAEDAARAGL

SEQ ID NO: 589538 - protein, 11 aa, Mycobacterium
TAEDAGGDPAA

SEQ ID NO: 589539 - protein, 6 aa, Mycobacterium
TAEDAV

SEQ ID NO: 589540 - protein, 12 aa, Mycobacterium
TAEDDEEAARVK

SEQ ID NO: 589541 - protein, 11 aa, Mycobacterium
TAEDFSAGEPF

SEQ ID NO: 589542 - protein, 10 aa, Mycobacterium
TAEDLGGGDI

SEQ ID NO: 589543 - protein, 15 aa, Mycobacterium
TAEDLGKRSGVSQAS

SEQ ID NO: 589544 - protein, 7 aa, Mycobacterium
TAEDLRT

SEQ ID NO: 589545 - protein, 9 aa, Mycobacterium
TAEDMDRAG

SEQ ID NO: 589546 - protein, 8 aa, Mycobacterium
TAEDPERA

SEQ ID NO: 589547 - protein, 11 aa, Mycobacterium
TAEDQQRARRE

SEQ ID NO: 589548 - protein, 6 aa, Mycobacterium
TAEDRE

SEQ ID NO: 589549 - protein, 11 aa, Mycobacterium
TAEDTHGPRGL

SEQ ID NO: 589550 - protein, 5 aa, Mycobacterium
TAEDV

SEQ ID NO: 589551 - protein, 12 aa, Mycobacterium
TAEDYAGANRAE

SEQ ID NO: 589552 - protein, 9 aa, Mycobacterium
TAEEAERTG

SEQ ID NO: 589553 - protein, 8 aa, Mycobacterium
TAEEAKEY

SEQ ID NO: 589554 - protein, 6 aa, Mycobacterium
TAEEAT

SEQ ID NO: 589555 - protein, 12 aa, Mycobacterium
TAEEDGITSTAR

SEQ ID NO: 589556 - protein, 10 aa, Mycobacterium
TAEEDSSTRA

SEQ ID NO: 589557 - protein, 5 aa, Mycobacterium
TAEEG

SEQ ID NO: 589558 - protein, 14 aa, Mycobacterium
TAEEIAAEGTPADI

SEQ ID NO: 589559 - protein, 14 aa, Mycobacterium
TAEEIAAEGTPAEV

SEQ ID NO: 589560 - protein, 14 aa, Mycobacterium
TAEEIAAEGTPAGI

SEQ ID NO: 589561 - protein, 14 aa, Mycobacterium
TAEEITAEGTAPNV

SEQ ID NO: 589562 - protein, 9 aa, Mycobacterium
TAEENPDAL

SEQ ID NO: 589563 - protein, 27 aa, Mycobacterium
TAEERANALRGRADSLRRAAAAEREAR

SEQ ID NO: 589564 - protein, 27 aa, Mycobacterium
TAEERANAVRGRADSLRRAAAAEREAR

SEQ ID NO: 589565 - protein, 28 aa, Mycobacterium
TAEERANAVRGRADSLRRAAAAEREARV

SEQ ID NO: 589566 - protein, 6 aa, Mycobacterium
TAEERD

SEQ ID NO: 589567 - protein, 17 aa, Mycobacterium
TAEEREQRVAQWAASNS

SEQ ID NO: 589568 - protein, 17 aa, Mycobacterium
TAEETAAPEAEPRTADL

SEQ ID NO: 589569 - protein, 7 aa, Mycobacterium
TAEETRR

SEQ ID NO: 589570 - protein, 9 aa, Mycobacterium
TAEETSGVV

SEQ ID NO: 589571 - protein, 6 aa, Mycobacterium
TAEEVE

SEQ ID NO: 589572 - protein, 7 aa, Mycobacterium
TAEFGES

SEQ ID NO: 589573 - protein, 6 aa, Mycobacterium
TAEGAV

SEQ ID NO: 589574 - protein, 9 aa, Mycobacterium
TAEGDHIGP

SEQ ID NO: 589575 - protein, 8 aa, Mycobacterium
TAEGDVDA

SEQ ID NO: 589576 - protein, 11 aa, Mycobacterium
TAEGEGGPAVV

SEQ ID NO: 589577 - protein, 8 aa, Mycobacterium
TAEGFETQ

SEQ ID NO: 589578 - protein, 5 aa, Mycobacterium
TAEGG

SEQ ID NO: 589579 - protein, 7 aa, Mycobacterium
TAEGGAL

SEQ ID NO: 589580 - protein, 8 aa, Mycobacterium
TAEGGGQV

SEQ ID NO: 589581 - protein, 8 aa, Mycobacterium
TAEGGRRA

SEQ ID NO: 589582 - protein, 6 aa, Mycobacterium
TAEGKE

SEQ ID NO: 589583 - protein, 12 aa, Mycobacterium
TAEGKIQVARLA

SEQ ID NO: 589584 - protein, 11 aa, Mycobacterium
TAEGKPPAPGY

SEQ ID NO: 589585 - protein, 6 aa, Mycobacterium
TAEGLG

SEQ ID NO: 589586 - protein, 11 aa, Mycobacterium
TAEGMSKRETR

SEQ ID NO: 589587 - protein, 8 aa, Mycobacterium
TAEGNHMG

SEQ ID NO: 589588 - protein, 9 aa, Mycobacterium
TAEGNHMGP

SEQ ID NO: 589589 - protein, 9 aa, Mycobacterium
TAEGNRLGP

SEQ ID NO: 589590 - protein, 7 aa, Mycobacterium
TAEGPAL

SEQ ID NO: 589591 - protein, 7 aa, Mycobacterium
TAEGQQY

SEQ ID NO: 589592 - protein, 9 aa, Mycobacterium
TAEGRAAAL

SEQ ID NO: 589593 - protein, 7 aa, Mycobacterium
TAEGRTA

SEQ ID NO: 589594 - protein, 8 aa, Mycobacterium
TAEGWSTS

SEQ ID NO: 589595 - protein, 8 aa, Mycobacterium
TAEGWSTT

SEQ ID NO: 589596 - protein, 6 aa, Mycobacterium
TAEGYA

SEQ ID NO: 589597 - protein, 12 aa, Mycobacterium
TAEGYEVTATSN

SEQ ID NO: 589598 - protein, 4 aa, Mycobacterium
TAEI

SEQ ID NO: 589599 - protein, 10 aa, Mycobacterium
TAEIGSPRSW

SEQ ID NO: 589600 - protein, 4 aa, Mycobacterium
TAEK

SEQ ID NO: 589601 - protein, 11 aa, Mycobacterium
TAEKQPLPRRT

SEQ ID NO: 589602 - protein, 10 aa, Mycobacterium
TAEKSNTPVS

SEQ ID NO: 589603 - protein, 15 aa, Mycobacterium
TAELPDAGEHPPVSD

SEQ ID NO: 589604 - protein, 5 aa, Mycobacterium
TAELS

SEQ ID NO: 589605 - protein, 5 aa, Mycobacterium
TAELT

SEQ ID NO: 589606 - protein, 11 aa, Mycobacterium
TAELTEDSPGV

SEQ ID NO: 589607 - protein, 4 aa, Mycobacterium
TAEN

SEQ ID NO: 589608 - protein, 9 aa, Mycobacterium
TAENEKSVD

SEQ ID NO: 589609 - protein, 5 aa, Mycobacterium
TAENL

SEQ ID NO: 589610 - protein, 8 aa, Mycobacterium
TAENPARA

SEQ ID NO: 589611 - protein, 11 aa, Mycobacterium
TAEPADPVPVA

SEQ ID NO: 589612 - protein, 9 aa, Mycobacterium
TAEPANVEP

SEQ ID NO: 589613 - protein, 8 aa, Mycobacterium
TAEPARTN

SEQ ID NO: 589614 - protein, 8 aa, Mycobacterium
TAEPDQAS

SEQ ID NO: 589615 - protein, 17 aa, Mycobacterium
TAEPDTPAGPTDATVAT

SEQ ID NO: 589616 - protein, 7 aa, Mycobacterium
TAEPEER

SEQ ID NO: 589617 - protein, 18 aa, Mycobacterium
TAEPETAALPDDEIAPQE

SEQ ID NO: 589618 - protein, 6 aa, Mycobacterium
TAEPEY

SEQ ID NO: 589619 - protein, 5 aa, Mycobacterium
TAEPF

SEQ ID NO: 589620 - protein, 5 aa, Mycobacterium
TAEPG

SEQ ID NO: 589621 - protein, 8 aa, Mycobacterium
TAEPGAAA

SEQ ID NO: 589622 - protein, 13 aa, Mycobacterium
TAEPGHGHEKIDP

SEQ ID NO: 589623 - protein, 7 aa, Mycobacterium
TAEPGHH

SEQ ID NO: 589624 - protein, 9 aa, Mycobacterium
TAEPGIGGT

SEQ ID NO: 589625 - protein, 5 aa, Mycobacterium
TAEPH

SEQ ID NO: 589626 - protein, 8 aa, Mycobacterium
TAEPHPKL

SEQ ID NO: 589627 - protein, 9 aa, Mycobacterium
TAEPHPKLP

SEQ ID NO: 589628 - protein, 11 aa, Mycobacterium
TAEPHPKLPGT

SEQ ID NO: 589629 - protein, 9 aa, Mycobacterium
TAEPHPRLP

SEQ ID NO: 589630 - protein, 12 aa, Mycobacterium
TAEPPAGTRARD

SEQ ID NO: 589631 - protein, 8 aa, Mycobacterium
TAEPQRAG

SEQ ID NO: 589632 - protein, 7 aa, Mycobacterium
TAEPRHA

SEQ ID NO: 589633 - protein, 7 aa, Mycobacterium
TAEPRRT

SEQ ID NO: 589634 - protein, 6 aa, Mycobacterium
TAEPSL

SEQ ID NO: 589635 - protein, 8 aa, Mycobacterium
TAEPTADV

SEQ ID NO: 589636 - protein, 6 aa, Mycobacterium
TAEPVS

SEQ ID NO: 589637 - protein, 6 aa, Mycobacterium
TAEQAG

SEQ ID NO: 589638 - protein, 10 aa, Mycobacterium
TAEQARNAGH

SEQ ID NO: 589639 - protein, 13 aa, Mycobacterium
TAEQARSEVASPP

SEQ ID NO: 589640 - protein, 7 aa, Mycobacterium
TAEQDDR

SEQ ID NO: 589641 - protein, 5 aa, Mycobacterium
TAEQE

SEQ ID NO: 589642 - protein, 6 aa, Mycobacterium
TAEQIT

SEQ ID NO: 589643 - protein, 9 aa, Mycobacterium
TAEQKARNV

SEQ ID NO: 589644 - protein, 6 aa, Mycobacterium
TAEQKQ

SEQ ID NO: 589645 - protein, 5 aa, Mycobacterium
TAEQL

SEQ ID NO: 589646 - protein, 12 aa, Mycobacterium
TAEQLRRSEYAG

SEQ ID NO: 589647 - protein, 12 aa, Mycobacterium
TAEQNASNDGKG

SEQ ID NO: 589648 - protein, 7 aa, Mycobacterium
TAEQQDR

SEQ ID NO: 589649 - protein, 6 aa, Mycobacterium
TAEQQL

SEQ ID NO: 589650 - protein, 6 aa, Mycobacterium
TAEQRG

SEQ ID NO: 589651 - protein, 8 aa, Mycobacterium
TAEQRSRL

SEQ ID NO: 589652 - protein, 5 aa, Mycobacterium
TAEQV

SEQ ID NO: 589653 - protein, 7 aa, Mycobacterium
TAERAEV

SEQ ID NO: 589654 - protein, 7 aa, Mycobacterium
TAEREDL

SEQ ID NO: 589655 - protein, 5 aa, Mycobacterium
TAERG

SEQ ID NO: 589656 - protein, 11 aa, Mycobacterium
TAERGDRRFGS

SEQ ID NO: 589657 - protein, 11 aa, Mycobacterium
TAERGKTELEA

SEQ ID NO: 589658 - protein, 5 aa, Mycobacterium
TAERH

SEQ ID NO: 589659 - protein, 9 aa, Mycobacterium
TAERKAADP

SEQ ID NO: 589660 - protein, 14 aa, Mycobacterium
TAERKAQQSSEQAR

SEQ ID NO: 589661 - protein, 13 aa, Mycobacterium
TAERMTELDAIRG

SEQ ID NO: 589662 - protein, 7 aa, Mycobacterium
TAERPDI

SEQ ID NO: 589663 - protein, 8 aa, Mycobacterium
TAERPWTA

SEQ ID NO: 589664 - protein, 9 aa, Mycobacterium
TAERQQRAT

SEQ ID NO: 589665 - protein, 6 aa, Mycobacterium
TAERRA

SEQ ID NO: 589666 - protein, 18 aa, Mycobacterium
TAERRGEQPWRNDPVGPL

SEQ ID NO: 589667 - protein, 9 aa, Mycobacterium
TAERRTPPA

SEQ ID NO: 589668 - protein, 5 aa, Mycobacterium
TAERV

SEQ ID NO: 589669 - protein, 4 aa, Mycobacterium
TAES

SEQ ID NO: 589670 - protein, 9 aa, Mycobacterium
TAESAEPAI

SEQ ID NO: 589671 - protein, 9 aa, Mycobacterium
TAESAGGPM

SEQ ID NO: 589672 - protein, 7 aa, Mycobacterium
TAESAKR

SEQ ID NO: 589673 - protein, 6 aa, Mycobacterium
TAESAL

SEQ ID NO: 589674 - protein, 11 aa, Mycobacterium
TAESAPGPAVI

SEQ ID NO: 589675 - protein, 5 aa, Mycobacterium
TAESC

SEQ ID NO: 589676 - protein, 9 aa, Mycobacterium
TAESDKEVR

SEQ ID NO: 589677 - protein, 17 aa, Mycobacterium
TAESESALAQSHSRLGG

SEQ ID NO: 589678 - protein, 12 aa, Mycobacterium
TAESGDPETHLD

SEQ ID NO: 589679 - protein, 11 aa, Mycobacterium
TAESGSAETYL

SEQ ID NO: 589680 - protein, 5 aa, Mycobacterium
TAESL

SEQ ID NO: 589681 - protein, 9 aa, Mycobacterium
TAESLRSDG

SEQ ID NO: 589682 - protein, 5 aa, Mycobacterium
TAESN

SEQ ID NO: 589683 - protein, 8 aa, Mycobacterium
TAESPVPP

SEQ ID NO: 589684 - protein, 7 aa, Mycobacterium
TAESQGI

SEQ ID NO: 589685 - protein, 9 aa, Mycobacterium
TAESRDALT

SEQ ID NO: 589686 - protein, 44 aa, Mycobacterium
TAESRQRRGYQPRTQPTKPPTPGPKCGTEAGAKEHNTRQEQTCD

SEQ ID NO: 589687 - protein, 9 aa, Mycobacterium
TAESRRARR

SEQ ID NO: 589688 - protein, 8 aa, Mycobacterium
TAESSALA

SEQ ID NO: 589689 - protein, 7 aa, Mycobacterium
TAESVNE

SEQ ID NO: 589690 - protein, 5 aa, Mycobacterium
TAETA

SEQ ID NO: 589691 - protein, 6 aa, Mycobacterium
TAETAA

SEQ ID NO: 589692 - protein, 17 aa, Mycobacterium
TAETAARGKEKADLADD

SEQ ID NO: 589693 - protein, 12 aa, Mycobacterium
TAETAERDAEKV

SEQ ID NO: 589694 - protein, 8 aa, Mycobacterium
TAETEGGT

SEQ ID NO: 589695 - protein, 5 aa, Mycobacterium
TAETG

SEQ ID NO: 589696 - protein, 9 aa, Mycobacterium
TAETGNGYW

SEQ ID NO: 589697 - protein, 9 aa, Mycobacterium
TAETLGTRA

SEQ ID NO: 589698 - protein, 5 aa, Mycobacterium
TAETP

SEQ ID NO: 589699 - protein, 12 aa, Mycobacterium
TAETPRDPSAER

SEQ ID NO: 589700 - protein, 5 aa, Mycobacterium
TAETR

SEQ ID NO: 589701 - protein, 12 aa, Mycobacterium
TAETRHDPYPTR

SEQ ID NO: 589702 - protein, 19 aa, Mycobacterium
TAETRRDSLADVPKFAAAR

SEQ ID NO: 589703 - protein, 5 aa, Mycobacterium
TAETT

SEQ ID NO: 589704 - protein, 27 aa, Mycobacterium
TAETTGPARTADTGRVATRESVPEADS

SEQ ID NO: 589705 - protein, 6 aa, Mycobacterium
TAETTI

SEQ ID NO: 589706 - protein, 12 aa, Mycobacterium
TAETTRLPSEDE

SEQ ID NO: 589707 - protein, 6 aa, Mycobacterium
TAETTV

SEQ ID NO: 589708 - protein, 6 aa, Mycobacterium
TAEVAP

SEQ ID NO: 589709 - protein, 6 aa, Mycobacterium
TAEVSA

SEQ ID NO: 589710 - protein, 9 aa, Mycobacterium
TAEVSQQAY

SEQ ID NO: 589711 - protein, 8 aa, Mycobacterium
TAEVTAQA

SEQ ID NO: 589712 - protein, 9 aa, Mycobacterium
TAEYGPRGV

SEQ ID NO: 589713 - protein, 12 aa, Mycobacterium
TAFDTTSWSTDT

SEQ ID NO: 589714 - protein, 7 aa, Mycobacterium
TAFGANE

SEQ ID NO: 589715 - protein, 14 aa, Mycobacterium
TAFGANENIDTVPT

SEQ ID NO: 589716 - protein, 14 aa, Mycobacterium
TAFGANENVDTVPT

SEQ ID NO: 589717 - protein, 9 aa, Mycobacterium
TAFGGKGRA

SEQ ID NO: 589718 - protein, 15 aa, Mycobacterium
TAFGTEGTVPPATHD

SEQ ID NO: 589719 - protein, 5 aa, Mycobacterium
TAFPG

SEQ ID NO: 589720 - protein, 7 aa, Mycobacterium
TAFPTTA

SEQ ID NO: 589721 - protein, 7 aa, Mycobacterium
TAFSAQR

SEQ ID NO: 589722 - protein, 12 aa, Mycobacterium
TAFSPPRPRSRH

SEQ ID NO: 589723 - protein, 6 aa, Mycobacterium
TAFTDG

SEQ ID NO: 589724 - protein, 7 aa, Mycobacterium
TAFTDGE

SEQ ID NO: 589725 - protein, 5 aa, Mycobacterium
TAFTG

SEQ ID NO: 589726 - protein, 9 aa, Mycobacterium
TAFTGAEGM

SEQ ID NO: 589727 - protein, 4 aa, Mycobacterium
TAGA

SEQ ID NO: 589728 - protein, 8 aa, Mycobacterium
TAGAAAAA

SEQ ID NO: 589729 - protein, 8 aa, Mycobacterium
TAGAAAAW

SEQ ID NO: 589730 - protein, 13 aa, Mycobacterium
TAGAARTLFGRDP

SEQ ID NO: 589731 - protein, 13 aa, Mycobacterium
TAGAARTLFGRNP

SEQ ID NO: 589732 - protein, 6 aa, Mycobacterium
TAGAAS

SEQ ID NO: 589733 - protein, 19 aa, Mycobacterium
TAGADAARNFGRAGEPDHG

SEQ ID NO: 589734 - protein, 9 aa, Mycobacterium
TAGAEAAGR

SEQ ID NO: 589735 - protein, 6 aa, Mycobacterium
TAGAER

SEQ ID NO: 589736 - protein, 7 aa, Mycobacterium
TAGAERA

SEQ ID NO: 589737 - protein, 9 aa, Mycobacterium
TAGAFDAEA

SEQ ID NO: 589738 - protein, 8 aa, Mycobacterium
TAGAGGDH

SEQ ID NO: 589739 - protein, 7 aa, Mycobacterium
TAGAGMG

SEQ ID NO: 589740 - protein, 7 aa, Mycobacterium
TAGAGRF

SEQ ID NO: 589741 - protein, 10 aa, Mycobacterium
TAGAINQGGQ

SEQ ID NO: 589742 - protein, 7 aa, Mycobacterium
TAGAKDA

SEQ ID NO: 589743 - protein, 5 aa, Mycobacterium
TAGAL

SEQ ID NO: 589744 - protein, 12 aa, Mycobacterium
TAGALRDAGVRR

SEQ ID NO: 589745 - protein, 10 aa, Mycobacterium
TAGANEKIHR

SEQ ID NO: 589746 - protein, 9 aa, Mycobacterium
TAGAPDHGT

SEQ ID NO: 589747 - protein, 7 aa, Mycobacterium
TAGAPVA

SEQ ID NO: 589748 - protein, 49 aa, Mycobacterium
TAGAQKAGADAGKAAGEGLNKGISKGAKDAGKSVGDELTKATKRTGDSI

SEQ ID NO: 589749 - protein, 10 aa, Mycobacterium
TAGARPDGTA

SEQ ID NO: 589750 - protein, 5 aa, Mycobacterium
TAGAS

SEQ ID NO: 589751 - protein, 8 aa, Mycobacterium
TAGASGMN

SEQ ID NO: 589752 - protein, 11 aa, Mycobacterium
TAGASSSGSGA

SEQ ID NO: 589753 - protein, 10 aa, Mycobacterium
TAGASTDRQA

SEQ ID NO: 589754 - protein, 27 aa, Mycobacterium
TAGATGTHAGGATSATGSSRATKGPVA

SEQ ID NO: 589755 - protein, 7 aa, Mycobacterium
TAGATHD

SEQ ID NO: 589756 - protein, 7 aa, Mycobacterium
TAGATPV

SEQ ID NO: 589757 - protein, 8 aa, Mycobacterium
TAGATPVQ

SEQ ID NO: 589758 - protein, 8 aa, Mycobacterium
TAGATTRQ

SEQ ID NO: 589759 - protein, 7 aa, Mycobacterium
TAGAVRP

SEQ ID NO: 589760 - protein, 13 aa, Mycobacterium
TAGAVTTGNTTGK

SEQ ID NO: 589761 - protein, 8 aa, Mycobacterium
TAGCRGAA

SEQ ID NO: 589762 - protein, 6 aa, Mycobacterium
TAGDAA

SEQ ID NO: 589763 - protein, 10 aa, Mycobacterium
TAGDAGGTGI

SEQ ID NO: 589764 - protein, 6 aa, Mycobacterium
TAGDAY

SEQ ID NO: 589765 - protein, 10 aa, Mycobacterium
TAGDDRTKVR

SEQ ID NO: 589766 - protein, 9 aa, Mycobacterium
TAGDECTRV

SEQ ID NO: 589767 - protein, 28 aa, Mycobacterium
TAGDGAEPIRPVGTDGGAGSAGPTGATG

SEQ ID NO: 589768 - protein, 18 aa, Mycobacterium
TAGDGASALAAARGQRPD

SEQ ID NO: 589769 - protein, 14 aa, Mycobacterium
TAGDIDADGPATPF

SEQ ID NO: 589770 - protein, 14 aa, Mycobacterium
TAGDPVGAKRAATE

SEQ ID NO: 589771 - protein, 11 aa, Mycobacterium
TAGDRSSAPIE

SEQ ID NO: 589772 - protein, 12 aa, Mycobacterium
TAGDRSSGPIES

SEQ ID NO: 589773 - protein, 14 aa, Mycobacterium
TAGDSARAKTLSEQ

SEQ ID NO: 589774 - protein, 14 aa, Mycobacterium
TAGDSARAKTLSER

SEQ ID NO: 589775 - protein, 13 aa, Mycobacterium
TAGDVDNHDRTGV

SEQ ID NO: 589776 - protein, 8 aa, Mycobacterium
TAGEAEPG

SEQ ID NO: 589777 - protein, 8 aa, Mycobacterium
TAGEATKH

SEQ ID NO: 589778 - protein, 5 aa, Mycobacterium
TAGEF

SEQ ID NO: 589779 - protein, 6 aa, Mycobacterium
TAGEGT

SEQ ID NO: 589780 - protein, 13 aa, Mycobacterium
TAGELGAPDDATS

SEQ ID NO: 589781 - protein, 13 aa, Mycobacterium
TAGELPLATKELH

SEQ ID NO: 589782 - protein, 6 aa, Mycobacterium
TAGEPL

SEQ ID NO: 589783 - protein, 9 aa, Mycobacterium
TAGESPSLE

SEQ ID NO: 589784 - protein, 6 aa, Mycobacterium
TAGESY

SEQ ID NO: 589785 - protein, 6 aa, Mycobacterium
TAGETF

SEQ ID NO: 589786 - protein, 13 aa, Mycobacterium
TAGETYTPPPDAT

SEQ ID NO: 589787 - protein, 8 aa, Mycobacterium
TAGEVSAA

SEQ ID NO: 589788 - protein, 5 aa, Mycobacterium
TAGEW

SEQ ID NO: 589789 - protein, 8 aa, Mycobacterium
TAGGAGHR

SEQ ID NO: 589790 - protein, 7 aa, Mycobacterium
TAGGAGS

SEQ ID NO: 589791 - protein, 6 aa, Mycobacterium
TAGGAT

SEQ ID NO: 589792 - protein, 12 aa, Mycobacterium
TAGGATAAPEEH

SEQ ID NO: 589793 - protein, 15 aa, Mycobacterium
TAGGATAAPEEHIPA

SEQ ID NO: 589794 - protein, 5 aa, Mycobacterium
TAGGE

SEQ ID NO: 589795 - protein, 9 aa, Mycobacterium
TAGGEDGVH

SEQ ID NO: 589796 - protein, 6 aa, Mycobacterium
TAGGEE

SEQ ID NO: 589797 - protein, 6 aa, Mycobacterium
TAGGEH

SEQ ID NO: 589798 - protein, 6 aa, Mycobacterium
TAGGFD

SEQ ID NO: 589799 - protein, 5 aa, Mycobacterium
TAGGG

SEQ ID NO: 589800 - protein, 19 aa, Mycobacterium
TAGGGIAERTVKKDGPHSL

SEQ ID NO: 589801 - protein, 19 aa, Mycobacterium
TAGGGIGERTVKKDGPHSL

SEQ ID NO: 589802 - protein, 19 aa, Mycobacterium
TAGGGVSARTLSKSGPHSL

SEQ ID NO: 589803 - protein, 5 aa, Mycobacterium
TAGGH

SEQ ID NO: 589804 - protein, 11 aa, Mycobacterium
TAGGKRTEAAV

SEQ ID NO: 589805 - protein, 13 aa, Mycobacterium
TAGGLEAAARAAR

SEQ ID NO: 589806 - protein, 5 aa, Mycobacterium
TAGGM

SEQ ID NO: 589807 - protein, 6 aa, Mycobacterium
TAGGQE

SEQ ID NO: 589808 - protein, 11 aa, Mycobacterium
TAGGQPGGKRR

SEQ ID NO: 589809 - protein, 13 aa, Mycobacterium
TAGGRKAAERQAD

SEQ ID NO: 589810 - protein, 10 aa, Mycobacterium
TAGGRPTEAA

SEQ ID NO: 589811 - protein, 8 aa, Mycobacterium
TAGGRRGI

SEQ ID NO: 589812 - protein, 7 aa, Mycobacterium
TAGGRVT

SEQ ID NO: 589813 - protein, 9 aa, Mycobacterium
TAGGSQADP

SEQ ID NO: 589814 - protein, 10 aa, Mycobacterium
TAGGSQADPA

SEQ ID NO: 589815 - protein, 13 aa, Mycobacterium
TAGGSSSGAGAAV

SEQ ID NO: 589816 - protein, 5 aa, Mycobacterium
TAGGT

SEQ ID NO: 589817 - protein, 18 aa, Mycobacterium
TAGGTSYAAADYAAATPL

SEQ ID NO: 589818 - protein, 10 aa, Mycobacterium
TAGGVGVTPA

SEQ ID NO: 589819 - protein, 14 aa, Mycobacterium
TAGHDDDFGRGDEA

SEQ ID NO: 589820 - protein, 11 aa, Mycobacterium
TAGHGGISGRY

SEQ ID NO: 589821 - protein, 9 aa, Mycobacterium
TAGHPGEPI

SEQ ID NO: 589822 - protein, 10 aa, Mycobacterium
TAGHPGEPIG

SEQ ID NO: 589823 - protein, 10 aa, Mycobacterium
TAGHPGQPLG

SEQ ID NO: 589824 - protein, 6 aa, Mycobacterium
TAGHTG

SEQ ID NO: 589825 - protein, 4 aa, Mycobacterium
TAGI

SEQ ID NO: 589826 - protein, 5 aa, Mycobacterium
TAGIA

SEQ ID NO: 589827 - protein, 7 aa, Mycobacterium
TAGIEER

SEQ ID NO: 589828 - protein, 6 aa, Mycobacterium
TAGIKG

SEQ ID NO: 589829 - protein, 8 aa, Mycobacterium
TAGISPET

SEQ ID NO: 589830 - protein, 6 aa, Mycobacterium
TAGITD

SEQ ID NO: 589831 - protein, 5 aa, Mycobacterium
TAGKG

SEQ ID NO: 589832 - protein, 11 aa, Mycobacterium
TAGKVTPEERT

SEQ ID NO: 589833 - protein, 5 aa, Mycobacterium
TAGLD

SEQ ID NO: 589834 - protein, 6 aa, Mycobacterium
TAGLDA

SEQ ID NO: 589835 - protein, 10 aa, Mycobacterium
TAGLDDEQRE

SEQ ID NO: 589836 - protein, 8 aa, Mycobacterium
TAGLDKPD

SEQ ID NO: 589837 - protein, 5 aa, Mycobacterium
TAGLG

SEQ ID NO: 589838 - protein, 7 aa, Mycobacterium
TAGLKGV

SEQ ID NO: 589839 - protein, 5 aa, Mycobacterium
TAGLP

SEQ ID NO: 589840 - protein, 8 aa, Mycobacterium
TAGLPAAA

SEQ ID NO: 589841 - protein, 6 aa, Mycobacterium
TAGLPR

SEQ ID NO: 589842 - protein, 10 aa, Mycobacterium
TAGLRGMDSP

SEQ ID NO: 589843 - protein, 5 aa, Mycobacterium
TAGLS

SEQ ID NO: 589844 - protein, 11 aa, Mycobacterium
TAGLSPDQARA

SEQ ID NO: 589845 - protein, 9 aa, Mycobacterium
TAGLSPKDI

SEQ ID NO: 589846 - protein, 5 aa, Mycobacterium
TAGMP

SEQ ID NO: 589847 - protein, 4 aa, Mycobacterium
TAGN

SEQ ID NO: 589848 - protein, 7 aa, Mycobacterium
TAGNAAT

SEQ ID NO: 589849 - protein, 6 aa, Mycobacterium
TAGNAE

SEQ ID NO: 589850 - protein, 8 aa, Mycobacterium
TAGNAERL

SEQ ID NO: 589851 - protein, 11 aa, Mycobacterium
TAGNAKAMADT

SEQ ID NO: 589852 - protein, 8 aa, Mycobacterium
TAGNGQPV

SEQ ID NO: 589853 - protein, 8 aa, Mycobacterium
TAGNPRKR

SEQ ID NO: 589854 - protein, 11 aa, Mycobacterium
TAGNSAGINDA

SEQ ID NO: 589855 - protein, 9 aa, Mycobacterium
TAGNSESYD

SEQ ID NO: 589856 - protein, 9 aa, Mycobacterium
TAGNSKAMA

SEQ ID NO: 589857 - protein, 9 aa, Mycobacterium
TAGNSQAMA

SEQ ID NO: 589858 - protein, 11 aa, Mycobacterium
TAGNSSGINDA

SEQ ID NO: 589859 - protein, 14 aa, Mycobacterium
TAGNSSGTNDAAAG

SEQ ID NO: 589860 - protein, 12 aa, Mycobacterium
TAGNSSPINDGA

SEQ ID NO: 589861 - protein, 6 aa, Mycobacterium
TAGNTA

SEQ ID NO: 589862 - protein, 10 aa, Mycobacterium
TAGNTGEAGG

SEQ ID NO: 589863 - protein, 7 aa, Mycobacterium
TAGPAAA

SEQ ID NO: 589864 - protein, 8 aa, Mycobacterium
TAGPADLP

SEQ ID NO: 589865 - protein, 15 aa, Mycobacterium
TAGPAEARAAALGIL

SEQ ID NO: 589866 - protein, 8 aa, Mycobacterium
TAGPAGPT

SEQ ID NO: 589867 - protein, 9 aa, Mycobacterium
TAGPAGTGI

SEQ ID NO: 589868 - protein, 12 aa, Mycobacterium
TAGPAPDAHRTT

SEQ ID NO: 589869 - protein, 6 aa, Mycobacterium
TAGPDD

SEQ ID NO: 589870 - protein, 6 aa, Mycobacterium
TAGPDG

SEQ ID NO: 589871 - protein, 7 aa, Mycobacterium
TAGPDGT

SEQ ID NO: 589872 - protein, 7 aa, Mycobacterium
TAGPDHD

SEQ ID NO: 589873 - protein, 6 aa, Mycobacterium
TAGPDP

SEQ ID NO: 589874 - protein, 15 aa, Mycobacterium
TAGPDRLSDRHRPPA

SEQ ID NO: 589875 - protein, 6 aa, Mycobacterium
TAGPED

SEQ ID NO: 589876 - protein, 15 aa, Mycobacterium
TAGPEVDPRPSVDPE

SEQ ID NO: 589877 - protein, 11 aa, Mycobacterium
TAGPFADPKRE

SEQ ID NO: 589878 - protein, 7 aa, Mycobacterium
TAGPGRF

SEQ ID NO: 589879 - protein, 9 aa, Mycobacterium
TAGPGRPPK

SEQ ID NO: 589880 - protein, 12 aa, Mycobacterium
TAGPHSLIEARS

SEQ ID NO: 589881 - protein, 7 aa, Mycobacterium
TAGPKEA

SEQ ID NO: 589882 - protein, 12 aa, Mycobacterium
TAGPKPLTPEQA

SEQ ID NO: 589883 - protein, 5 aa, Mycobacterium
TAGPL

SEQ ID NO: 589884 - protein, 6 aa, Mycobacterium
TAGPLG

SEQ ID NO: 589885 - protein, 5 aa, Mycobacterium
TAGPN

SEQ ID NO: 589886 - protein, 9 aa, Mycobacterium
TAGPPRPGY

SEQ ID NO: 589887 - protein, 12 aa, Mycobacterium
TAGPPRSSGTTL

SEQ ID NO: 589888 - protein, 6 aa, Mycobacterium
TAGPPV

SEQ ID NO: 589889 - protein, 5 aa, Mycobacterium
TAGPQ

SEQ ID NO: 589890 - protein, 8 aa, Mycobacterium
TAGPRVDP

SEQ ID NO: 589891 - protein, 25 aa, Mycobacterium
TAGPTAAAAGLDATDHAESARTRMQ

SEQ ID NO: 589892 - protein, 7 aa, Mycobacterium
TAGPTIS

SEQ ID NO: 589893 - protein, 5 aa, Mycobacterium
TAGPV

SEQ ID NO: 589894 - protein, 8 aa, Mycobacterium
TAGPVGTA

SEQ ID NO: 589895 - protein, 6 aa, Mycobacterium
TAGPVS

SEQ ID NO: 589896 - protein, 4 aa, Mycobacterium
TAGQ

SEQ ID NO: 589897 - protein, 5 aa, Mycobacterium
TAGQA

SEQ ID NO: 589898 - protein, 19 aa, Mycobacterium
TAGQAEHAAAQAAAAASAY

SEQ ID NO: 589899 - protein, 16 aa, Mycobacterium
TAGQARRSGTAGSVGT

SEQ ID NO: 589900 - protein, 5 aa, Mycobacterium
TAGQD

SEQ ID NO: 589901 - protein, 17 aa, Mycobacterium
TAGQDCASDGPHPEHTG

SEQ ID NO: 589902 - protein, 14 aa, Mycobacterium
TAGQGPAVTVTGAP

SEQ ID NO: 589903 - protein, 5 aa, Mycobacterium
TAGQI

SEQ ID NO: 589904 - protein, 7 aa, Mycobacterium
TAGQIGP

SEQ ID NO: 589905 - protein, 13 aa, Mycobacterium
TAGQPGLETEKSA

SEQ ID NO: 589906 - protein, 10 aa, Mycobacterium
TAGQPPTRER

SEQ ID NO: 589907 - protein, 5 aa, Mycobacterium
TAGQT

SEQ ID NO: 589908 - protein, 5 aa, Mycobacterium
TAGQV

SEQ ID NO: 589909 - protein, 4 aa, Mycobacterium
TAGR

SEQ ID NO: 589910 - protein, 5 aa, Mycobacterium
TAGRA

SEQ ID NO: 589911 - protein, 8 aa, Mycobacterium
TAGRGPDH

SEQ ID NO: 589912 - protein, 25 aa, Mycobacterium
TAGRKNSLADKSSGVKTRNGDPARG

SEQ ID NO: 589913 - protein, 26 aa, Mycobacterium
TAGRKSRFSGDDTKRPLDKRGRAQAK

SEQ ID NO: 589914 - protein, 14 aa, Mycobacterium
TAGRLTPTGDPDAL

SEQ ID NO: 589915 - protein, 12 aa, Mycobacterium
TAGRNTAKGTGP

SEQ ID NO: 589916 - protein, 7 aa, Mycobacterium
TAGRPTS

SEQ ID NO: 589917 - protein, 12 aa, Mycobacterium
TAGRQMPHLRLA

SEQ ID NO: 589918 - protein, 26 aa, Mycobacterium
TAGRRTEPHERPVNGTPVVDTDRGGK

SEQ ID NO: 589919 - protein, 7 aa, Mycobacterium
TAGRSAP

SEQ ID NO: 589920 - protein, 9 aa, Mycobacterium
TAGRTDTAR

SEQ ID NO: 589921 - protein, 13 aa, Mycobacterium
TAGRTGDFRPSQS

SEQ ID NO: 589922 - protein, 6 aa, Mycobacterium
TAGRTR

SEQ ID NO: 589923 - protein, 7 aa, Mycobacterium
TAGRTTL

SEQ ID NO: 589924 - protein, 11 aa, Mycobacterium
TAGRTTLTGEG

SEQ ID NO: 589925 - protein, 16 aa, Mycobacterium
TAGRVKPTTAAVSHDG

SEQ ID NO: 589926 - protein, 7 aa, Mycobacterium
TAGRYSS

SEQ ID NO: 589927 - protein, 7 aa, Mycobacterium
TAGSAAE

SEQ ID NO: 589928 - protein, 11 aa, Mycobacterium
TAGSAGPAYGA

SEQ ID NO: 589929 - protein, 13 aa, Mycobacterium
TAGSARQEAINLI

SEQ ID NO: 589930 - protein, 9 aa, Mycobacterium
TAGSDAKRE

SEQ ID NO: 589931 - protein, 7 aa, Mycobacterium
TAGSEEK

SEQ ID NO: 589932 - protein, 10 aa, Mycobacterium
TAGSEERRRA

SEQ ID NO: 589933 - protein, 8 aa, Mycobacterium
TAGSETTT

SEQ ID NO: 589934 - protein, 6 aa, Mycobacterium
TAGSGA

SEQ ID NO: 589935 - protein, 15 aa, Mycobacterium
TAGSGPAVTVTGPPE

SEQ ID NO: 589936 - protein, 6 aa, Mycobacterium
TAGSHS

SEQ ID NO: 589937 - protein, 5 aa, Mycobacterium
TAGSI

SEQ ID NO: 589938 - protein, 28 aa, Mycobacterium
TAGSKVSYSPGESGRRIDPRGSGLPRVD

SEQ ID NO: 589939 - protein, 12 aa, Mycobacterium
TAGSNDYSPLES

SEQ ID NO: 589940 - protein, 9 aa, Mycobacterium
TAGSNPAPH

SEQ ID NO: 589941 - protein, 15 aa, Mycobacterium
TAGSNSYSGAPVNST

SEQ ID NO: 589942 - protein, 11 aa, Mycobacterium
TAGSNVSPAEV

SEQ ID NO: 589943 - protein, 9 aa, Mycobacterium
TAGSPKRRE

SEQ ID NO: 589944 - protein, 8 aa, Mycobacterium
TAGSPLDS

SEQ ID NO: 589945 - protein, 9 aa, Mycobacterium
TAGSPMPTN

SEQ ID NO: 589946 - protein, 34 aa, Mycobacterium
TAGSPRAGRAARMPTRARTRAQNRANRIDTERRC

SEQ ID NO: 589947 - protein, 6 aa, Mycobacterium
TAGSRL

SEQ ID NO: 589948 - protein, 7 aa, Mycobacterium
TAGSSEK

SEQ ID NO: 589949 - protein, 5 aa, Mycobacterium
TAGSW

SEQ ID NO: 589950 - protein, 6 aa, Mycobacterium
TAGSWE

SEQ ID NO: 589951 - protein, 6 aa, Mycobacterium
TAGTAG

SEQ ID NO: 589952 - protein, 8 aa, Mycobacterium
TAGTAGAH

SEQ ID NO: 589953 - protein, 13 aa, Mycobacterium
TAGTAQVEVGTET

SEQ ID NO: 589954 - protein, 21 aa, Mycobacterium
TAGTEGGDVISDEADDTYDDL

SEQ ID NO: 589955 - protein, 16 aa, Mycobacterium
TAGTELTAAGATFRPS

SEQ ID NO: 589956 - protein, 126 aa, Mycobacterium
TAGTGGSGGQGGEGGAAADTGVPGAAGSTGGFGGTGGAGGAGGDAVAGATNGSGGAGGQGGAGAKGGQGYDDDGANNAGVGGNGGEGGTGGSGGAAGTGGDGGTAGAAGTGGTGGDGGKGGATTIS

SEQ ID NO: 589957 - protein, 8 aa, Mycobacterium
TAGTGRSH

SEQ ID NO: 589958 - protein, 19 aa, Mycobacterium
TAGTGRVRSDRLSKRTEFD

SEQ ID NO: 589959 - protein, 6 aa, Mycobacterium
TAGTIA

SEQ ID NO: 589960 - protein, 5 aa, Mycobacterium
TAGTL

SEQ ID NO: 589961 - protein, 7 aa, Mycobacterium
TAGTPEK

SEQ ID NO: 589962 - protein, 36 aa, Mycobacterium
TAGTPGTGGAGGVAPDAGVPAGAGGAGGTGGVPPRV

SEQ ID NO: 589963 - protein, 8 aa, Mycobacterium
TAGTPLTA

SEQ ID NO: 589964 - protein, 17 aa, Mycobacterium
TAGTPTDIRADTRADDY

SEQ ID NO: 589965 - protein, 7 aa, Mycobacterium
TAGTPTR

SEQ ID NO: 589966 - protein, 6 aa, Mycobacterium
TAGTQG

SEQ ID NO: 589967 - protein, 12 aa, Mycobacterium
TAGTSAAAAGAD

SEQ ID NO: 589968 - protein, 6 aa, Mycobacterium
TAGTSG

SEQ ID NO: 589969 - protein, 7 aa, Mycobacterium
TAGTTPN

SEQ ID NO: 589970 - protein, 8 aa, Mycobacterium
TAGTTVDP

SEQ ID NO: 589971 - protein, 41 aa, Mycobacterium
TAGTVTADPDPSEAATAVDAARRSAATARNWHGPGATGDGH

SEQ ID NO: 589972 - protein, 6 aa, Mycobacterium
TAGTYR

SEQ ID NO: 589973 - protein, 4 aa, Mycobacterium
TAGV

SEQ ID NO: 589974 - protein, 8 aa, Mycobacterium
TAGVDGAS

SEQ ID NO: 589975 - protein, 8 aa, Mycobacterium
TAGVDKPD

SEQ ID NO: 589976 - protein, 6 aa, Mycobacterium
TAGVEP

SEQ ID NO: 589977 - protein, 18 aa, Mycobacterium
TAGVEVGAKDAKMGQEGA

SEQ ID NO: 589978 - protein, 5 aa, Mycobacterium
TAGVG

SEQ ID NO: 589979 - protein, 15 aa, Mycobacterium
TAGVPDALGRERSGV

SEQ ID NO: 589980 - protein, 15 aa, Mycobacterium
TAGVPDALQRDRSGV

SEQ ID NO: 589981 - protein, 7 aa, Mycobacterium
TAGVQRT

SEQ ID NO: 589982 - protein, 15 aa, Mycobacterium
TAGVQTRNPKYASYI

SEQ ID NO: 589983 - protein, 5 aa, Mycobacterium
TAGVT

SEQ ID NO: 589984 - protein, 19 aa, Mycobacterium
TAGVTQADSGYLANEAASA

SEQ ID NO: 589985 - protein, 4 aa, Mycobacterium
TAGY

SEQ ID NO: 589986 - protein, 10 aa, Mycobacterium
TAHAAAAGDA

SEQ ID NO: 589987 - protein, 8 aa, Mycobacterium
TAHADPAD

SEQ ID NO: 589988 - protein, 9 aa, Mycobacterium
TAHAGDRIR

SEQ ID NO: 589989 - protein, 10 aa, Mycobacterium
TAHARHEAEV

SEQ ID NO: 589990 - protein, 4 aa, Mycobacterium
TAHE

SEQ ID NO: 589991 - protein, 6 aa, Mycobacterium
TAHEGA

SEQ ID NO: 589992 - protein, 5 aa, Mycobacterium
TAHGG

SEQ ID NO: 589993 - protein, 16 aa, Mycobacterium
TAHGPAPASPPPNNAK

SEQ ID NO: 589994 - protein, 10 aa, Mycobacterium
TAHGPTAGPE

SEQ ID NO: 589995 - protein, 5 aa, Mycobacterium
TAHGQ

SEQ ID NO: 589996 - protein, 6 aa, Mycobacterium
TAHGRR

SEQ ID NO: 589997 - protein, 7 aa, Mycobacterium
TAHGSDD

SEQ ID NO: 589998 - protein, 7 aa, Mycobacterium
TAHHPAA

SEQ ID NO: 589999 - protein, 5 aa, Mycobacterium
TAHHR

SEQ ID NO: 590000 - protein, 8 aa, Mycobacterium
TAHKAAPG

SEQ ID NO: 590001 - protein, 8 aa, Mycobacterium
TAHKSAPG

SEQ ID NO: 590002 - protein, 11 aa, Mycobacterium
TAHNSADEMRR

SEQ ID NO: 590003 - protein, 4 aa, Mycobacterium
TAHP

SEQ ID NO: 590004 - protein, 10 aa, Mycobacterium
TAHPGGPGRV

SEQ ID NO: 590005 - protein, 7 aa, Mycobacterium
TAHPNSL

SEQ ID NO: 590006 - protein, 11 aa, Mycobacterium
TAHPQPGNPAP

SEQ ID NO: 590007 - protein, 12 aa, Mycobacterium
TAHPRPASNPYP

SEQ ID NO: 590008 - protein, 10 aa, Mycobacterium
TAHPRPLSPP

SEQ ID NO: 590009 - protein, 10 aa, Mycobacterium
TAHPRPVNPP

SEQ ID NO: 590010 - protein, 12 aa, Mycobacterium
TAHPRPVSDPHP

SEQ ID NO: 590011 - protein, 5 aa, Mycobacterium
TAHPS

SEQ ID NO: 590012 - protein, 12 aa, Mycobacterium
TAHQPDKPAFTG

SEQ ID NO: 590013 - protein, 6 aa, Mycobacterium
TAHREG

SEQ ID NO: 590014 - protein, 20 aa, Mycobacterium
TAHRGPSPTPVRQPTVGSMG

SEQ ID NO: 590015 - protein, 12 aa, Mycobacterium
TAHRTPGSAISA

SEQ ID NO: 590016 - protein, 11 aa, Mycobacterium
TAHSARNQPVS

SEQ ID NO: 590017 - protein, 18 aa, Mycobacterium
TAHSPDALAAADAAPDDI

SEQ ID NO: 590018 - protein, 9 aa, Mycobacterium
TAHSQRLGG

SEQ ID NO: 590019 - protein, 8 aa, Mycobacterium
TAHSTAPA

SEQ ID NO: 590020 - protein, 7 aa, Mycobacterium
TAHTPAT

SEQ ID NO: 590021 - protein, 7 aa, Mycobacterium
TAHTPEE

SEQ ID NO: 590022 - protein, 8 aa, Mycobacterium
TAHTPGGE

SEQ ID NO: 590023 - protein, 4 aa, Mycobacterium
TAHV

SEQ ID NO: 590024 - protein, 5 aa, Mycobacterium
TAHYP

SEQ ID NO: 590025 - protein, 23 aa, Mycobacterium
TAIAEAEQAALSARPTIEMRGLL

SEQ ID NO: 590026 - protein, 33 aa, Mycobacterium
TAIAESKSGFLSPEGRSKAFSDTADGYARGEGG

SEQ ID NO: 590027 - protein, 5 aa, Mycobacterium
TAIDA

SEQ ID NO: 590028 - protein, 12 aa, Mycobacterium
TAIDDKGYRDST

SEQ ID NO: 590029 - protein, 6 aa, Mycobacterium
TAIDES

SEQ ID NO: 590030 - protein, 9 aa, Mycobacterium
TAIDSGAAA

SEQ ID NO: 590031 - protein, 4 aa, Mycobacterium
TAIE

SEQ ID NO: 590032 - protein, 10 aa, Mycobacterium
TAIETGPPAQ

SEQ ID NO: 590033 - protein, 11 aa, Mycobacterium
TAIGDEDPDFA

SEQ ID NO: 590034 - protein, 5 aa, Mycobacterium
TAIGQ

SEQ ID NO: 590035 - protein, 8 aa, Mycobacterium
TAIGRPAQ

SEQ ID NO: 590036 - protein, 38 aa, Mycobacterium
TAIGSSVSQSGLNSGFGNLGSGNSGFYNSDPNGSANSG

SEQ ID NO: 590037 - protein, 4 aa, Mycobacterium
TAIH

SEQ ID NO: 590038 - protein, 5 aa, Mycobacterium
TAINA

SEQ ID NO: 590039 - protein, 6 aa, Mycobacterium
TAIPDG

SEQ ID NO: 590040 - protein, 13 aa, Mycobacterium
TAIPDTGSTADGL

SEQ ID NO: 590041 - protein, 11 aa, Mycobacterium
TAIPGSGSLEA

SEQ ID NO: 590042 - protein, 8 aa, Mycobacterium
TAIPSVKA

SEQ ID NO: 590043 - protein, 12 aa, Mycobacterium
TAIQNAGAALDD

SEQ ID NO: 590044 - protein, 5 aa, Mycobacterium
TAIRD

SEQ ID NO: 590045 - protein, 9 aa, Mycobacterium
TAIRGEPPK

SEQ ID NO: 590046 - protein, 16 aa, Mycobacterium
TAISSNQRGAQSGGIV

SEQ ID NO: 590047 - protein, 16 aa, Mycobacterium
TAISTNQRGAQSGGIV

SEQ ID NO: 590048 - protein, 4 aa, Mycobacterium
TAIT

SEQ ID NO: 590049 - protein, 12 aa, Mycobacterium
TAITAGEAEQRA

SEQ ID NO: 590050 - protein, 16 aa, Mycobacterium
TAITPGLESPTIAPLA

SEQ ID NO: 590051 - protein, 21 aa, Mycobacterium
TAITPYGAGTQGSRSGPMTAG

SEQ ID NO: 590052 - protein, 7 aa, Mycobacterium
TAIYPPG

SEQ ID NO: 590053 - protein, 65 aa, Mycobacterium
TAKADKPGLDTDSKVTDATKDDPDVTTKATTAQPASVTEPDSAGKSTPSVTKPRPIRKAASDIGR

SEQ ID NO: 590054 - protein, 19 aa, Mycobacterium
TAKAELSARESAVAQAQRQ

SEQ ID NO: 590055 - protein, 7 aa, Mycobacterium
TAKAGKS

SEQ ID NO: 590056 - protein, 6 aa, Mycobacterium
TAKAGT

SEQ ID NO: 590057 - protein, 9 aa, Mycobacterium
TAKANRSRA

SEQ ID NO: 590058 - protein, 13 aa, Mycobacterium
TAKAVLKDPDRVS

SEQ ID NO: 590059 - protein, 14 aa, Mycobacterium
TAKDAKAASAHGAA

SEQ ID NO: 590060 - protein, 12 aa, Mycobacterium
TAKDAKKHSAHA

SEQ ID NO: 590061 - protein, 8 aa, Mycobacterium
TAKDARKH

SEQ ID NO: 590062 - protein, 9 aa, Mycobacterium
TAKDGSPKI

SEQ ID NO: 590063 - protein, 9 aa, Mycobacterium
TAKDRRGNP

SEQ ID NO: 590064 - protein, 6 aa, Mycobacterium
TAKDSR

SEQ ID NO: 590065 - protein, 10 aa, Mycobacterium
TAKDSRASAE

SEQ ID NO: 590066 - protein, 9 aa, Mycobacterium
TAKDSRVSA

SEQ ID NO: 590067 - protein, 8 aa, Mycobacterium
TAKDWPPS

SEQ ID NO: 590068 - protein, 7 aa, Mycobacterium
TAKEQNV

SEQ ID NO: 590069 - protein, 5 aa, Mycobacterium
TAKER

SEQ ID NO: 590070 - protein, 8 aa, Mycobacterium
TAKERGLP

SEQ ID NO: 590071 - protein, 15 aa, Mycobacterium
TAKGDVDLHRPVALA

SEQ ID NO: 590072 - protein, 18 aa, Mycobacterium
TAKGRRPSWNAAAPGAVA

SEQ ID NO: 590073 - protein, 7 aa, Mycobacterium
TAKGSGK

SEQ ID NO: 590074 - protein, 10 aa, Mycobacterium
TAKKSNTPVS

SEQ ID NO: 590075 - protein, 10 aa, Mycobacterium
TAKNRDGWDS

SEQ ID NO: 590076 - protein, 13 aa, Mycobacterium
TAKNRPGTGFVPI

SEQ ID NO: 590077 - protein, 9 aa, Mycobacterium
TAKNSGGNR

SEQ ID NO: 590078 - protein, 4 aa, Mycobacterium
TAKP

SEQ ID NO: 590079 - protein, 15 aa, Mycobacterium
TAKPADGADPRSGRW

SEQ ID NO: 590080 - protein, 8 aa, Mycobacterium
TAKPDDHE

SEQ ID NO: 590081 - protein, 8 aa, Mycobacterium
TAKPEATR

SEQ ID NO: 590082 - protein, 14 aa, Mycobacterium
TAKPGAFRRPNGQA

SEQ ID NO: 590083 - protein, 15 aa, Mycobacterium
TAKPGAFRRPNGQAF

SEQ ID NO: 590084 - protein, 5 aa, Mycobacterium
TAKPK

SEQ ID NO: 590085 - protein, 10 aa, Mycobacterium
TAKPKSRSQL

SEQ ID NO: 590086 - protein, 8 aa, Mycobacterium
TAKPYFGD

SEQ ID NO: 590087 - protein, 15 aa, Mycobacterium
TAKQAGVKRTEQDAL

SEQ ID NO: 590088 - protein, 12 aa, Mycobacterium
TAKQGSGEPNPD

SEQ ID NO: 590089 - protein, 5 aa, Mycobacterium
TAKQI

SEQ ID NO: 590090 - protein, 9 aa, Mycobacterium
TAKQNGKRC

SEQ ID NO: 590091 - protein, 27 aa, Mycobacterium
TAKQQKRARARADAAYRRRNYTPEATA

SEQ ID NO: 590092 - protein, 9 aa, Mycobacterium
TAKRAVEGV

SEQ ID NO: 590093 - protein, 17 aa, Mycobacterium
TAKRDLKAGEKLDGEGG

SEQ ID NO: 590094 - protein, 8 aa, Mycobacterium
TAKRLGAA

SEQ ID NO: 590095 - protein, 7 aa, Mycobacterium
TAKSARA

SEQ ID NO: 590096 - protein, 8 aa, Mycobacterium
TAKSGMSE

SEQ ID NO: 590097 - protein, 10 aa, Mycobacterium
TAKSRDGWDS

SEQ ID NO: 590098 - protein, 9 aa, Mycobacterium
TAKTEYCPG

SEQ ID NO: 590099 - protein, 9 aa, Mycobacterium
TAKTGTERS

SEQ ID NO: 590100 - protein, 8 aa, Mycobacterium
TAKTPEVA

SEQ ID NO: 590101 - protein, 10 aa, Mycobacterium
TAKTPSEYSG

SEQ ID NO: 590102 - protein, 20 aa, Mycobacterium
TAKWARDEARKTGLPHNEAR

SEQ ID NO: 590103 - protein, 19 aa, Mycobacterium
TAKYDDAQTQRDARERERS

SEQ ID NO: 590104 - protein, 11 aa, Mycobacterium
TALAAAKPEVA

SEQ ID NO: 590105 - protein, 16 aa, Mycobacterium
TALAEDAGTAITPAEG

SEQ ID NO: 590106 - protein, 5 aa, Mycobacterium
TALAT

SEQ ID NO: 590107 - protein, 11 aa, Mycobacterium
TALDEDTPGIN

SEQ ID NO: 590108 - protein, 11 aa, Mycobacterium
TALDGAPDATD

SEQ ID NO: 590109 - protein, 5 aa, Mycobacterium
TALDP

SEQ ID NO: 590110 - protein, 10 aa, Mycobacterium
TALDRTEREL

SEQ ID NO: 590111 - protein, 12 aa, Mycobacterium
TALDSGSSAPLH

SEQ ID NO: 590112 - protein, 4 aa, Mycobacterium
TALE

SEQ ID NO: 590113 - protein, 17 aa, Mycobacterium
TALGAEQKWGQAESRRL

SEQ ID NO: 590114 - protein, 6 aa, Mycobacterium
TALGAG

SEQ ID NO: 590115 - protein, 8 aa, Mycobacterium
TALGEASF

SEQ ID NO: 590116 - protein, 23 aa, Mycobacterium
TALGGALGSRARSLTRTRSVSET

SEQ ID NO: 590117 - protein, 9 aa, Mycobacterium
TALGGGPAL

SEQ ID NO: 590118 - protein, 8 aa, Mycobacterium
TALGGGTE

SEQ ID NO: 590119 - protein, 19 aa, Mycobacterium
TALGGQPPASRVPNLSGQY

SEQ ID NO: 590120 - protein, 6 aa, Mycobacterium
TALGGR

SEQ ID NO: 590121 - protein, 6 aa, Mycobacterium
TALGQD

SEQ ID NO: 590122 - protein, 10 aa, Mycobacterium
TALGRASAPV

SEQ ID NO: 590123 - protein, 10 aa, Mycobacterium
TALGRASSPV

SEQ ID NO: 590124 - protein, 6 aa, Mycobacterium
TALGRD

SEQ ID NO: 590125 - protein, 11 aa, Mycobacterium
TALGSGRGEDL

SEQ ID NO: 590126 - protein, 10 aa, Mycobacterium
TALGTGRGEQ

SEQ ID NO: 590127 - protein, 4 aa, Mycobacterium
TALH

SEQ ID NO: 590128 - protein, 5 aa, Mycobacterium
TALKG

SEQ ID NO: 590129 - protein, 10 aa, Mycobacterium
TALPAGTAKA

SEQ ID NO: 590130 - protein, 10 aa, Mycobacterium
TALPAGTTKA

SEQ ID NO: 590131 - protein, 11 aa, Mycobacterium
TALPEAPDATD

SEQ ID NO: 590132 - protein, 5 aa, Mycobacterium
TALPF

SEQ ID NO: 590133 - protein, 20 aa, Mycobacterium
TALPGARQPQPVTRQRADGL

SEQ ID NO: 590134 - protein, 6 aa, Mycobacterium
TALPPE

SEQ ID NO: 590135 - protein, 7 aa, Mycobacterium
TALPPPL

SEQ ID NO: 590136 - protein, 11 aa, Mycobacterium
TALPPPSDKTW

SEQ ID NO: 590137 - protein, 17 aa, Mycobacterium
TALPRYKDGTVGEQVER

SEQ ID NO: 590138 - protein, 7 aa, Mycobacterium
TALPSES

SEQ ID NO: 590139 - protein, 10 aa, Mycobacterium
TALPTGPDAA

SEQ ID NO: 590140 - protein, 5 aa, Mycobacterium
TALQE

SEQ ID NO: 590141 - protein, 10 aa, Mycobacterium
TALQESRDRV

SEQ ID NO: 590142 - protein, 8 aa, Mycobacterium
TALQPRPE

SEQ ID NO: 590143 - protein, 5 aa, Mycobacterium
TALQT

SEQ ID NO: 590144 - protein, 4 aa, Mycobacterium
TALR

SEQ ID NO: 590145 - protein, 8 aa, Mycobacterium
TALRATGT

SEQ ID NO: 590146 - protein, 6 aa, Mycobacterium
TALRDD

SEQ ID NO: 590147 - protein, 8 aa, Mycobacterium
TALRDGDS

SEQ ID NO: 590148 - protein, 8 aa, Mycobacterium
TALRGREA

SEQ ID NO: 590149 - protein, 8 aa, Mycobacterium
TALSDDAG

SEQ ID NO: 590150 - protein, 13 aa, Mycobacterium
TALSDSGWDAASP

SEQ ID NO: 590151 - protein, 9 aa, Mycobacterium
TALSEKPEL

SEQ ID NO: 590152 - protein, 13 aa, Mycobacterium
TALSGGGDHIDPG

SEQ ID NO: 590153 - protein, 8 aa, Mycobacterium
TALSGTAG

SEQ ID NO: 590154 - protein, 20 aa, Mycobacterium
TALSNTGLASTSRIAPDAAA

SEQ ID NO: 590155 - protein, 10 aa, Mycobacterium
TALSPDQARA

SEQ ID NO: 590156 - protein, 7 aa, Mycobacterium
TALSSSA

SEQ ID NO: 590157 - protein, 9 aa, Mycobacterium
TALSTTPQI

SEQ ID NO: 590158 - protein, 9 aa, Mycobacterium
TALSTTQPV

SEQ ID NO: 590159 - protein, 7 aa, Mycobacterium
TALSTTT

SEQ ID NO: 590160 - protein, 7 aa, Mycobacterium
TALTEGD

SEQ ID NO: 590161 - protein, 14 aa, Mycobacterium
TALTGTSTAAATTW

SEQ ID NO: 590162 - protein, 8 aa, Mycobacterium
TALTTPSG

SEQ ID NO: 590163 - protein, 4 aa, Mycobacterium
TAMA

SEQ ID NO: 590164 - protein, 4 aa, Mycobacterium
TAMD

SEQ ID NO: 590165 - protein, 24 aa, Mycobacterium
TAMDGYASSSAAASEVTPFAEPPQ

SEQ ID NO: 590166 - protein, 8 aa, Mycobacterium
TAMGGAQA

SEQ ID NO: 590167 - protein, 16 aa, Mycobacterium
TAMNNYAGQSAAATTL

SEQ ID NO: 590168 - protein, 8 aa, Mycobacterium
TAMPEGED

SEQ ID NO: 590169 - protein, 9 aa, Mycobacterium
TAMPEGEDL

SEQ ID NO: 590170 - protein, 8 aa, Mycobacterium
TAMPSPTG

SEQ ID NO: 590171 - protein, 7 aa, Mycobacterium
TAMPTAA

SEQ ID NO: 590172 - protein, 5 aa, Mycobacterium
TAMQA

SEQ ID NO: 590173 - protein, 8 aa, Mycobacterium
TAMRRARG

SEQ ID NO: 590174 - protein, 6 aa, Mycobacterium
TAMTTY

SEQ ID NO: 590175 - protein, 9 aa, Mycobacterium
TANAAAGGK

SEQ ID NO: 590176 - protein, 9 aa, Mycobacterium
TANAAEADE

SEQ ID NO: 590177 - protein, 9 aa, Mycobacterium
TANAAEARE

SEQ ID NO: 590178 - protein, 7 aa, Mycobacterium
TANAGGL

SEQ ID NO: 590179 - protein, 12 aa, Mycobacterium
TANAQAAGATTS

SEQ ID NO: 590180 - protein, 11 aa, Mycobacterium
TANARGSRELA

SEQ ID NO: 590181 - protein, 9 aa, Mycobacterium
TANATEARE

SEQ ID NO: 590182 - protein, 7 aa, Mycobacterium
TANDGVD

SEQ ID NO: 590183 - protein, 19 aa, Mycobacterium
TANDPEMQGELPEGSDTSV

SEQ ID NO: 590184 - protein, 16 aa, Mycobacterium
TANDPQFAAARPDPAI

SEQ ID NO: 590185 - protein, 9 aa, Mycobacterium
TANDPRRAT

SEQ ID NO: 590186 - protein, 4 aa, Mycobacterium
TANE

SEQ ID NO: 590187 - protein, 10 aa, Mycobacterium
TANEPTAEDI

SEQ ID NO: 590188 - protein, 5 aa, Mycobacterium
TANFG

SEQ ID NO: 590189 - protein, 5 aa, Mycobacterium
TANGA

SEQ ID NO: 590190 - protein, 13 aa, Mycobacterium
TANGKAHGLGDPT

SEQ ID NO: 590191 - protein, 14 aa, Mycobacterium
TANGKAHGVGDPSG

SEQ ID NO: 590192 - protein, 9 aa, Mycobacterium
TANGKIDQR

SEQ ID NO: 590193 - protein, 30 aa, Mycobacterium
TANGKLDEAALPDVDAGTVGSAPETATEST

SEQ ID NO: 590194 - protein, 34 aa, Mycobacterium
TANGKLDTRALPAPDHSHRSQGSDHYRAPTTPVE

SEQ ID NO: 590195 - protein, 5 aa, Mycobacterium
TANGP

SEQ ID NO: 590196 - protein, 6 aa, Mycobacterium
TANGPL

SEQ ID NO: 590197 - protein, 11 aa, Mycobacterium
TANGPLDTAEV

SEQ ID NO: 590198 - protein, 8 aa, Mycobacterium
TANGQPAA

SEQ ID NO: 590199 - protein, 9 aa, Mycobacterium
TANGRANTL

SEQ ID NO: 590200 - protein, 22 aa, Mycobacterium
TANGRVTPAESRRSQRQRRDAQ

SEQ ID NO: 590201 - protein, 5 aa, Mycobacterium
TANIT

SEQ ID NO: 590202 - protein, 6 aa, Mycobacterium
TANKPL

SEQ ID NO: 590203 - protein, 9 aa, Mycobacterium
TANLGGSSR

SEQ ID NO: 590204 - protein, 8 aa, Mycobacterium
TANNPDLD

SEQ ID NO: 590205 - protein, 11 aa, Mycobacterium
TANNPRELTAE

SEQ ID NO: 590206 - protein, 6 aa, Mycobacterium
TANPAG

SEQ ID NO: 590207 - protein, 10 aa, Mycobacterium
TANPASDEVR

SEQ ID NO: 590208 - protein, 16 aa, Mycobacterium
TANPLRDKRDKRLPRI

SEQ ID NO: 590209 - protein, 8 aa, Mycobacterium
TANPPRSV

SEQ ID NO: 590210 - protein, 9 aa, Mycobacterium
TANPQDAED

SEQ ID NO: 590211 - protein, 5 aa, Mycobacterium
TANPR

SEQ ID NO: 590212 - protein, 8 aa, Mycobacterium
TANPRPGQ

SEQ ID NO: 590213 - protein, 9 aa, Mycobacterium
TANQGMAAA

SEQ ID NO: 590214 - protein, 8 aa, Mycobacterium
TANREDSN

SEQ ID NO: 590215 - protein, 8 aa, Mycobacterium
TANRPTVH

SEQ ID NO: 590216 - protein, 14 aa, Mycobacterium
TANSAAATQTTAVT

SEQ ID NO: 590217 - protein, 8 aa, Mycobacterium
TANSAEVA

SEQ ID NO: 590218 - protein, 18 aa, Mycobacterium
TANSGAHSGSRATRRATQ

SEQ ID NO: 590219 - protein, 5 aa, Mycobacterium
TANSN

SEQ ID NO: 590220 - protein, 10 aa, Mycobacterium
TANTFSAEPV

SEQ ID NO: 590221 - protein, 11 aa, Mycobacterium
TANTGATSELT

SEQ ID NO: 590222 - protein, 18 aa, Mycobacterium
TANTGMTQQPLAQQASGD

SEQ ID NO: 590223 - protein, 5 aa, Mycobacterium
TANTP

SEQ ID NO: 590224 - protein, 8 aa, Mycobacterium
TANTPLAG

SEQ ID NO: 590225 - protein, 7 aa, Mycobacterium
TANTRSI

SEQ ID NO: 590226 - protein, 16 aa, Mycobacterium
TANTSNTSNTNAIPQT

SEQ ID NO: 590227 - protein, 7 aa, Mycobacterium
TANTTVT

SEQ ID NO: 590228 - protein, 9 aa, Mycobacterium
TANVEAAAD

SEQ ID NO: 590229 - protein, 5 aa, Mycobacterium
TANWG

SEQ ID NO: 590230 - protein, 9 aa, Mycobacterium
TAPAAEPLS

SEQ ID NO: 590231 - protein, 5 aa, Mycobacterium
TAPAD

SEQ ID NO: 590232 - protein, 10 aa, Mycobacterium
TAPADGSVNE

SEQ ID NO: 590233 - protein, 9 aa, Mycobacterium
TAPAEPGGC

SEQ ID NO: 590234 - protein, 9 aa, Mycobacterium
TAPAEPSSL

SEQ ID NO: 590235 - protein, 8 aa, Mycobacterium
TAPAESGW

SEQ ID NO: 590236 - protein, 6 aa, Mycobacterium
TAPAFS

SEQ ID NO: 590237 - protein, 8 aa, Mycobacterium
TAPAGDID

SEQ ID NO: 590238 - protein, 12 aa, Mycobacterium
TAPAGGDGRDTV

SEQ ID NO: 590239 - protein, 18 aa, Mycobacterium
TAPAGRGLTATQKRRRAI

SEQ ID NO: 590240 - protein, 19 aa, Mycobacterium
TAPAGRGLTPVQKRRRAIG

SEQ ID NO: 590241 - protein, 11 aa, Mycobacterium
TAPAGRSPKRN

SEQ ID NO: 590242 - protein, 16 aa, Mycobacterium
TAPAHNPASAAAVRAK

SEQ ID NO: 590243 - protein, 17 aa, Mycobacterium
TAPANNPASASAVQAQD

SEQ ID NO: 590244 - protein, 11 aa, Mycobacterium
TAPAPAPGDPQ

SEQ ID NO: 590245 - protein, 11 aa, Mycobacterium
TAPAPEPAEGE

SEQ ID NO: 590246 - protein, 7 aa, Mycobacterium
TAPAPFP

SEQ ID NO: 590247 - protein, 8 aa, Mycobacterium
TAPAPPEL

SEQ ID NO: 590248 - protein, 11 aa, Mycobacterium
TAPAPQGPWSP

SEQ ID NO: 590249 - protein, 14 aa, Mycobacterium
TAPAPQGPWSPPQP

SEQ ID NO: 590250 - protein, 12 aa, Mycobacterium
TAPAPSFSAPVS

SEQ ID NO: 590251 - protein, 32 aa, Mycobacterium
TAPAPSFSAPVSGAGRFGAPRAAPTRSGAGKR

SEQ ID NO: 590252 - protein, 12 aa, Mycobacterium
TAPAPTTDPGGL

SEQ ID NO: 590253 - protein, 23 aa, Mycobacterium
TAPAQEARASAGGLNISPKGYGP

SEQ ID NO: 590254 - protein, 6 aa, Mycobacterium
TAPAQL

SEQ ID NO: 590255 - protein, 15 aa, Mycobacterium
TAPARASTRPGRPPS

SEQ ID NO: 590256 - protein, 6 aa, Mycobacterium
TAPARV

SEQ ID NO: 590257 - protein, 5 aa, Mycobacterium
TAPAS

SEQ ID NO: 590258 - protein, 6 aa, Mycobacterium
TAPASE

SEQ ID NO: 590259 - protein, 25 aa, Mycobacterium
TAPASPSRSLADAAAARVAGSPTRG

SEQ ID NO: 590260 - protein, 13 aa, Mycobacterium
TAPASSSTQDSIN

SEQ ID NO: 590261 - protein, 7 aa, Mycobacterium
TAPATAG

SEQ ID NO: 590262 - protein, 8 aa, Mycobacterium
TAPATGAV

SEQ ID NO: 590263 - protein, 5 aa, Mycobacterium
TAPAV

SEQ ID NO: 590264 - protein, 7 aa, Mycobacterium
TAPAVRR

SEQ ID NO: 590265 - protein, 5 aa, Mycobacterium
TAPDA

SEQ ID NO: 590266 - protein, 12 aa, Mycobacterium
TAPDAAEAHDST

SEQ ID NO: 590267 - protein, 6 aa, Mycobacterium
TAPDAK

SEQ ID NO: 590268 - protein, 9 aa, Mycobacterium
TAPDAPKHK

SEQ ID NO: 590269 - protein, 8 aa, Mycobacterium
TAPDARCP

SEQ ID NO: 590270 - protein, 9 aa, Mycobacterium
TAPDASIAQ

SEQ ID NO: 590271 - protein, 8 aa, Mycobacterium
TAPDASVA

SEQ ID NO: 590272 - protein, 21 aa, Mycobacterium
TAPDDPVTGVSGGPGGLSGSV

SEQ ID NO: 590273 - protein, 10 aa, Mycobacterium
TAPDGASLPR

SEQ ID NO: 590274 - protein, 7 aa, Mycobacterium
TAPDGEV

SEQ ID NO: 590275 - protein, 7 aa, Mycobacterium
TAPDGGV

SEQ ID NO: 590276 - protein, 9 aa, Mycobacterium
TAPDGSVSA

SEQ ID NO: 590277 - protein, 9 aa, Mycobacterium
TAPDGTRQR

SEQ ID NO: 590278 - protein, 6 aa, Mycobacterium
TAPDGV

SEQ ID NO: 590279 - protein, 6 aa, Mycobacterium
TAPDPI

SEQ ID NO: 590280 - protein, 8 aa, Mycobacterium
TAPDPIPL

SEQ ID NO: 590281 - protein, 8 aa, Mycobacterium
TAPDPISG

SEQ ID NO: 590282 - protein, 5 aa, Mycobacterium
TAPDQ

SEQ ID NO: 590283 - protein, 6 aa, Mycobacterium
TAPDRA

SEQ ID NO: 590284 - protein, 20 aa, Mycobacterium
TAPDRHDPAGQTESQTTSNQ

SEQ ID NO: 590285 - protein, 13 aa, Mycobacterium
TAPDSAEPQPTPL

SEQ ID NO: 590286 - protein, 8 aa, Mycobacterium
TAPDSRAI

SEQ ID NO: 590287 - protein, 25 aa, Mycobacterium
TAPDVATARDRARDVATRLSMRDSR

SEQ ID NO: 590288 - protein, 4 aa, Mycobacterium
TAPE

SEQ ID NO: 590289 - protein, 8 aa, Mycobacterium
TAPEAAHP

SEQ ID NO: 590290 - protein, 15 aa, Mycobacterium
TAPEAESAARARQQA

SEQ ID NO: 590291 - protein, 7 aa, Mycobacterium
TAPEAND

SEQ ID NO: 590292 - protein, 7 aa, Mycobacterium
TAPEATR

SEQ ID NO: 590293 - protein, 9 aa, Mycobacterium
TAPEAYTGA

SEQ ID NO: 590294 - protein, 7 aa, Mycobacterium
TAPEDQW

SEQ ID NO: 590295 - protein, 11 aa, Mycobacterium
TAPEEAAPHAA

SEQ ID NO: 590296 - protein, 9 aa, Mycobacterium
TAPEFRKPT

SEQ ID NO: 590297 - protein, 14 aa, Mycobacterium
TAPEGAPSGGDPLD

SEQ ID NO: 590298 - protein, 7 aa, Mycobacterium
TAPEGAT

SEQ ID NO: 590299 - protein, 11 aa, Mycobacterium
TAPEHSRSTEY

SEQ ID NO: 590300 - protein, 7 aa, Mycobacterium
TAPELKA

SEQ ID NO: 590301 - protein, 6 aa, Mycobacterium
TAPELQ

SEQ ID NO: 590302 - protein, 5 aa, Mycobacterium
TAPEN

SEQ ID NO: 590303 - protein, 26 aa, Mycobacterium
TAPEPEDDVPAVDQEAVGARGEQEAA

SEQ ID NO: 590304 - protein, 9 aa, Mycobacterium
TAPEPESVA

SEQ ID NO: 590305 - protein, 10 aa, Mycobacterium
TAPEPTVGSP

SEQ ID NO: 590306 - protein, 10 aa, Mycobacterium
TAPEPYEPWP

SEQ ID NO: 590307 - protein, 9 aa, Mycobacterium
TAPEQDPGL

SEQ ID NO: 590308 - protein, 6 aa, Mycobacterium
TAPERL

SEQ ID NO: 590309 - protein, 13 aa, Mycobacterium
TAPERWGPRGPAP

SEQ ID NO: 590310 - protein, 7 aa, Mycobacterium
TAPESDT

SEQ ID NO: 590311 - protein, 7 aa, Mycobacterium
TAPESIP

SEQ ID NO: 590312 - protein, 7 aa, Mycobacterium
TAPETVT

SEQ ID NO: 590313 - protein, 25 aa, Mycobacterium
TAPEVAAARERAREAANRLTQRPPA

SEQ ID NO: 590314 - protein, 11 aa, Mycobacterium
TAPEYSRSTEY

SEQ ID NO: 590315 - protein, 5 aa, Mycobacterium
TAPFT

SEQ ID NO: 590316 - protein, 11 aa, Mycobacterium
TAPGAAPTPVA

SEQ ID NO: 590317 - protein, 24 aa, Mycobacterium
TAPGALRTGSRGCCSKEDASDARR

SEQ ID NO: 590318 - protein, 7 aa, Mycobacterium
TAPGAQS

SEQ ID NO: 590319 - protein, 7 aa, Mycobacterium
TAPGARG

SEQ ID NO: 590320 - protein, 9 aa, Mycobacterium
TAPGAVPGQ

SEQ ID NO: 590321 - protein, 6 aa, Mycobacterium
TAPGDF

SEQ ID NO: 590322 - protein, 7 aa, Mycobacterium
TAPGDPI

SEQ ID NO: 590323 - protein, 18 aa, Mycobacterium
TAPGDPVAGVSRGSAGLS

SEQ ID NO: 590324 - protein, 8 aa, Mycobacterium
TAPGDSIA

SEQ ID NO: 590325 - protein, 6 aa, Mycobacterium
TAPGEF

SEQ ID NO: 590326 - protein, 7 aa, Mycobacterium
TAPGEVT

SEQ ID NO: 590327 - protein, 16 aa, Mycobacterium
TAPGFGNATDSPSSGF

SEQ ID NO: 590328 - protein, 5 aa, Mycobacterium
TAPGG

SEQ ID NO: 590329 - protein, 19 aa, Mycobacterium
TAPGGAEPLTVPVPPWACL

SEQ ID NO: 590330 - protein, 7 aa, Mycobacterium
TAPGGAL

SEQ ID NO: 590331 - protein, 7 aa, Mycobacterium
TAPGGDA

SEQ ID NO: 590332 - protein, 9 aa, Mycobacterium
TAPGGEAAA

SEQ ID NO: 590333 - protein, 14 aa, Mycobacterium
TAPGGLVTGTGTVE

SEQ ID NO: 590334 - protein, 8 aa, Mycobacterium
TAPGGRTV

SEQ ID NO: 590335 - protein, 26 aa, Mycobacterium
TAPGGTAAPPRRISRGTPVPRDETEQ

SEQ ID NO: 590336 - protein, 26 aa, Mycobacterium
TAPGGTDAPPRRISRGTPAPADDTER

SEQ ID NO: 590337 - protein, 9 aa, Mycobacterium
TAPGGTIVG

SEQ ID NO: 590338 - protein, 8 aa, Mycobacterium
TAPGGTRL

SEQ ID NO: 590339 - protein, 8 aa, Mycobacterium
TAPGGVLS

SEQ ID NO: 590340 - protein, 7 aa, Mycobacterium
TAPGHEG

SEQ ID NO: 590341 - protein, 7 aa, Mycobacterium
TAPGIAG

SEQ ID NO: 590342 - protein, 15 aa, Mycobacterium
TAPGKSQIGGASNAG

SEQ ID NO: 590343 - protein, 5 aa, Mycobacterium
TAPGM

SEQ ID NO: 590344 - protein, 8 aa, Mycobacterium
TAPGMTSQ

SEQ ID NO: 590345 - protein, 13 aa, Mycobacterium
TAPGPRPLSPGFS

SEQ ID NO: 590346 - protein, 5 aa, Mycobacterium
TAPGQ

SEQ ID NO: 590347 - protein, 7 aa, Mycobacterium
TAPGQGR

SEQ ID NO: 590348 - protein, 10 aa, Mycobacterium
TAPGQRIPRT

SEQ ID NO: 590349 - protein, 6 aa, Mycobacterium
TAPGQS

SEQ ID NO: 590350 - protein, 6 aa, Mycobacterium
TAPGSA

SEQ ID NO: 590351 - protein, 9 aa, Mycobacterium
TAPGSADID

SEQ ID NO: 590352 - protein, 9 aa, Mycobacterium
TAPGSAKEV

SEQ ID NO: 590353 - protein, 9 aa, Mycobacterium
TAPGSLSQH

SEQ ID NO: 590354 - protein, 6 aa, Mycobacterium
TAPGSR

SEQ ID NO: 590355 - protein, 9 aa, Mycobacterium
TAPGSTLDA

SEQ ID NO: 590356 - protein, 6 aa, Mycobacterium
TAPGTA

SEQ ID NO: 590357 - protein, 9 aa, Mycobacterium
TAPGTNGVT

SEQ ID NO: 590358 - protein, 16 aa, Mycobacterium
TAPGTQQVDPEYAGDL

SEQ ID NO: 590359 - protein, 8 aa, Mycobacterium
TAPGTTAE

SEQ ID NO: 590360 - protein, 8 aa, Mycobacterium
TAPGTTTA

SEQ ID NO: 590361 - protein, 7 aa, Mycobacterium
TAPGWQA

SEQ ID NO: 590362 - protein, 6 aa, Mycobacterium
TAPGYL

SEQ ID NO: 590363 - protein, 13 aa, Mycobacterium
TAPHGPSTRTQAV

SEQ ID NO: 590364 - protein, 8 aa, Mycobacterium
TAPHPPME

SEQ ID NO: 590365 - protein, 15 aa, Mycobacterium
TAPHQSSRPDTPRRG

SEQ ID NO: 590366 - protein, 6 aa, Mycobacterium
TAPIDS

SEQ ID NO: 590367 - protein, 5 aa, Mycobacterium
TAPIG

SEQ ID NO: 590368 - protein, 5 aa, Mycobacterium
TAPIR

SEQ ID NO: 590369 - protein, 24 aa, Mycobacterium
TAPISDGASLSNSVTGIGSTAVSD

SEQ ID NO: 590370 - protein, 9 aa, Mycobacterium
TAPKAGAVG

SEQ ID NO: 590371 - protein, 8 aa, Mycobacterium
TAPKAGTV

SEQ ID NO: 590372 - protein, 8 aa, Mycobacterium
TAPKFPPS

SEQ ID NO: 590373 - protein, 5 aa, Mycobacterium
TAPKH

SEQ ID NO: 590374 - protein, 12 aa, Mycobacterium
TAPKKGCDHGQC

SEQ ID NO: 590375 - protein, 21 aa, Mycobacterium
TAPKPDSVDTFDSDPGNALSD

SEQ ID NO: 590376 - protein, 33 aa, Mycobacterium
TAPKPSFSAPVSGAGRFGAPRSAPTRSAGASKR

SEQ ID NO: 590377 - protein, 16 aa, Mycobacterium
TAPKPSVRQRLTAGLL

SEQ ID NO: 590378 - protein, 9 aa, Mycobacterium
TAPKQDGRN

SEQ ID NO: 590379 - protein, 6 aa, Mycobacterium
TAPKRG

SEQ ID NO: 590380 - protein, 7 aa, Mycobacterium
TAPKRRR

SEQ ID NO: 590381 - protein, 11 aa, Mycobacterium
TAPKSGAVPAA

SEQ ID NO: 590382 - protein, 9 aa, Mycobacterium
TAPKSNAVT

SEQ ID NO: 590383 - protein, 11 aa, Mycobacterium
TAPKSNSVTTA

SEQ ID NO: 590384 - protein, 12 aa, Mycobacterium
TAPKSRRFSPTA

SEQ ID NO: 590385 - protein, 7 aa, Mycobacterium
TAPLDDG

SEQ ID NO: 590386 - protein, 6 aa, Mycobacterium
TAPLGE

SEQ ID NO: 590387 - protein, 9 aa, Mycobacterium
TAPLGTPGA

SEQ ID NO: 590388 - protein, 7 aa, Mycobacterium
TAPLSPD

SEQ ID NO: 590389 - protein, 11 aa, Mycobacterium
TAPLSPDAAPD

SEQ ID NO: 590390 - protein, 14 aa, Mycobacterium
TAPLTADDADAFTE

SEQ ID NO: 590391 - protein, 7 aa, Mycobacterium
TAPLTQE

SEQ ID NO: 590392 - protein, 6 aa, Mycobacterium
TAPMTA

SEQ ID NO: 590393 - protein, 20 aa, Mycobacterium
TAPNAPAPEPATRIGGANPL

SEQ ID NO: 590394 - protein, 7 aa, Mycobacterium
TAPNDTL

SEQ ID NO: 590395 - protein, 8 aa, Mycobacterium
TAPNEPPT

SEQ ID NO: 590396 - protein, 10 aa, Mycobacterium
TAPNPQAAAA

SEQ ID NO: 590397 - protein, 6 aa, Mycobacterium
TAPNSR

SEQ ID NO: 590398 - protein, 6 aa, Mycobacterium
TAPNTA

SEQ ID NO: 590399 - protein, 5 aa, Mycobacterium
TAPPA

SEQ ID NO: 590400 - protein, 8 aa, Mycobacterium
TAPPAAAG

SEQ ID NO: 590401 - protein, 13 aa, Mycobacterium
TAPPAQQPAAGLK

SEQ ID NO: 590402 - protein, 6 aa, Mycobacterium
TAPPAR

SEQ ID NO: 590403 - protein, 55 aa, Mycobacterium
TAPPATAAPADSAATAAQAPTTPPRSAPAPKAPPEAPAAQAEPAERAAQPEPAPV

SEQ ID NO: 590404 - protein, 6 aa, Mycobacterium
TAPPDG

SEQ ID NO: 590405 - protein, 5 aa, Mycobacterium
TAPPE

SEQ ID NO: 590406 - protein, 6 aa, Mycobacterium
TAPPEL

SEQ ID NO: 590407 - protein, 13 aa, Mycobacterium
TAPPFGFSSTPDT

SEQ ID NO: 590408 - protein, 7 aa, Mycobacterium
TAPPGIT

SEQ ID NO: 590409 - protein, 7 aa, Mycobacterium
TAPPGPF

SEQ ID NO: 590410 - protein, 24 aa, Mycobacterium
TAPPGRGGPEPTPRRPVRDVLELR

SEQ ID NO: 590411 - protein, 5 aa, Mycobacterium
TAPPH

SEQ ID NO: 590412 - protein, 15 aa, Mycobacterium
TAPPHPRAPGATDKD

SEQ ID NO: 590413 - protein, 7 aa, Mycobacterium
TAPPNLG

SEQ ID NO: 590414 - protein, 18 aa, Mycobacterium
TAPPNTTAPDATGDQAAA

SEQ ID NO: 590415 - protein, 18 aa, Mycobacterium
TAPPNTTSPGGLAEQGLS

SEQ ID NO: 590416 - protein, 9 aa, Mycobacterium
TAPPPEGFG

SEQ ID NO: 590417 - protein, 11 aa, Mycobacterium
TAPPPEQPAAT

SEQ ID NO: 590418 - protein, 8 aa, Mycobacterium
TAPPPPGH

SEQ ID NO: 590419 - protein, 9 aa, Mycobacterium
TAPPPPPVT

SEQ ID NO: 590420 - protein, 24 aa, Mycobacterium
TAPPPSNSAEWSPGWRSSNTARTG

SEQ ID NO: 590421 - protein, 8 aa, Mycobacterium
TAPPQPRG

SEQ ID NO: 590422 - protein, 16 aa, Mycobacterium
TAPPRTADSDGLARQA

SEQ ID NO: 590423 - protein, 21 aa, Mycobacterium
TAPPSVPVKTGDGKPTVTKST

SEQ ID NO: 590424 - protein, 7 aa, Mycobacterium
TAPPVTT

SEQ ID NO: 590425 - protein, 7 aa, Mycobacterium
TAPQEVR

SEQ ID NO: 590426 - protein, 8 aa, Mycobacterium
TAPQGLTD

SEQ ID NO: 590427 - protein, 8 aa, Mycobacterium
TAPQPTGK

SEQ ID NO: 590428 - protein, 7 aa, Mycobacterium
TAPQTVT

SEQ ID NO: 590429 - protein, 8 aa, Mycobacterium
TAPRADED

SEQ ID NO: 590430 - protein, 5 aa, Mycobacterium
TAPRG

SEQ ID NO: 590431 - protein, 5 aa, Mycobacterium
TAPRI

SEQ ID NO: 590432 - protein, 11 aa, Mycobacterium
TAPRLPDGTPF

SEQ ID NO: 590433 - protein, 10 aa, Mycobacterium
TAPRPLPEGP

SEQ ID NO: 590434 - protein, 7 aa, Mycobacterium
TAPRRDD

SEQ ID NO: 590435 - protein, 7 aa, Mycobacterium
TAPRRRS

SEQ ID NO: 590436 - protein, 7 aa, Mycobacterium
TAPRSAY

SEQ ID NO: 590437 - protein, 16 aa, Mycobacterium
TAPRSSRLQHRPGTRL

SEQ ID NO: 590438 - protein, 20 aa, Mycobacterium
TAPRVTDPRMSPYPYAASKS

SEQ ID NO: 590439 - protein, 5 aa, Mycobacterium
TAPSA

SEQ ID NO: 590440 - protein, 6 aa, Mycobacterium
TAPSAG

SEQ ID NO: 590441 - protein, 6 aa, Mycobacterium
TAPSAQ

SEQ ID NO: 590442 - protein, 20 aa, Mycobacterium
TAPSGKPGMGSNRDGAAGAD

SEQ ID NO: 590443 - protein, 20 aa, Mycobacterium
TAPSGKQGMGNNRDGAAGAD

SEQ ID NO: 590444 - protein, 20 aa, Mycobacterium
TAPSGKQGMGSNRDGAAGAD

SEQ ID NO: 590445 - protein, 18 aa, Mycobacterium
TAPSGSDGHVNVSPKGMA

SEQ ID NO: 590446 - protein, 9 aa, Mycobacterium
TAPSGTRVK

SEQ ID NO: 590447 - protein, 5 aa, Mycobacterium
TAPSL

SEQ ID NO: 590448 - protein, 8 aa, Mycobacterium
TAPSLAGT

SEQ ID NO: 590449 - protein, 8 aa, Mycobacterium
TAPSLPEV

SEQ ID NO: 590450 - protein, 7 aa, Mycobacterium
TAPSPDL

SEQ ID NO: 590451 - protein, 6 aa, Mycobacterium
TAPSPL

SEQ ID NO: 590452 - protein, 13 aa, Mycobacterium
TAPSQSSYLGPTK

SEQ ID NO: 590453 - protein, 7 aa, Mycobacterium
TAPSRAE

SEQ ID NO: 590454 - protein, 6 aa, Mycobacterium
TAPSRE

SEQ ID NO: 590455 - protein, 7 aa, Mycobacterium
TAPSRLA

SEQ ID NO: 590456 - protein, 24 aa, Mycobacterium
TAPSSRATGPPTPRRPPSDILRFE

SEQ ID NO: 590457 - protein, 23 aa, Mycobacterium
TAPSSRSAIAADRGIEEEAASAN

SEQ ID NO: 590458 - protein, 5 aa, Mycobacterium
TAPST

SEQ ID NO: 590459 - protein, 6 aa, Mycobacterium
TAPSVA

SEQ ID NO: 590460 - protein, 13 aa, Mycobacterium
TAPSVSPSLTTSE

SEQ ID NO: 590461 - protein, 8 aa, Mycobacterium
TAPSWEQT

SEQ ID NO: 590462 - protein, 7 aa, Mycobacterium
TAPSWER

SEQ ID NO: 590463 - protein, 14 aa, Mycobacterium
TAPSWSEYQDGTAA

SEQ ID NO: 590464 - protein, 13 aa, Mycobacterium
TAPTAERERPAGD

SEQ ID NO: 590465 - protein, 13 aa, Mycobacterium
TAPTARDAANAAV

SEQ ID NO: 590466 - protein, 5 aa, Mycobacterium
TAPTD

SEQ ID NO: 590467 - protein, 6 aa, Mycobacterium
TAPTDG

SEQ ID NO: 590468 - protein, 6 aa, Mycobacterium
TAPTGH

SEQ ID NO: 590469 - protein, 12 aa, Mycobacterium
TAPTGRSVQMSD

SEQ ID NO: 590470 - protein, 12 aa, Mycobacterium
TAPTGRSVSMTP

SEQ ID NO: 590471 - protein, 5 aa, Mycobacterium
TAPTI

SEQ ID NO: 590472 - protein, 18 aa, Mycobacterium
TAPTKAHIPDTPGNFDPI

SEQ ID NO: 590473 - protein, 12 aa, Mycobacterium
TAPTKAHTPDVA

SEQ ID NO: 590474 - protein, 10 aa, Mycobacterium
TAPTPGPGEI

SEQ ID NO: 590475 - protein, 9 aa, Mycobacterium
TAPTPPEGV

SEQ ID NO: 590476 - protein, 9 aa, Mycobacterium
TAPTPPHGI

SEQ ID NO: 590477 - protein, 11 aa, Mycobacterium
TAPTPTSAATA

SEQ ID NO: 590478 - protein, 7 aa, Mycobacterium
TAPTRID

SEQ ID NO: 590479 - protein, 13 aa, Mycobacterium
TAPTSDDGGDARW

SEQ ID NO: 590480 - protein, 15 aa, Mycobacterium
TAPTSPKARALSSRP

SEQ ID NO: 590481 - protein, 9 aa, Mycobacterium
TAPTTASLS

SEQ ID NO: 590482 - protein, 12 aa, Mycobacterium
TAPTTATEPEIR

SEQ ID NO: 590483 - protein, 5 aa, Mycobacterium
TAPTV

SEQ ID NO: 590484 - protein, 6 aa, Mycobacterium
TAPVAA

SEQ ID NO: 590485 - protein, 10 aa, Mycobacterium
TAPVAPRPAR

SEQ ID NO: 590486 - protein, 18 aa, Mycobacterium
TAPVDGSSAPAGPSLGAA

SEQ ID NO: 590487 - protein, 11 aa, Mycobacterium
TAPVDPANRHA

SEQ ID NO: 590488 - protein, 14 aa, Mycobacterium
TAPVDYTDSIDPEQ

SEQ ID NO: 590489 - protein, 11 aa, Mycobacterium
TAPVGADGRSH

SEQ ID NO: 590490 - protein, 6 aa, Mycobacterium
TAPVGT

SEQ ID NO: 590491 - protein, 14 aa, Mycobacterium
TAPVNYEDSIDPEQ

SEQ ID NO: 590492 - protein, 7 aa, Mycobacterium
TAPVPAG

SEQ ID NO: 590493 - protein, 15 aa, Mycobacterium
TAPVPEKDKSRTWDI

SEQ ID NO: 590494 - protein, 9 aa, Mycobacterium
TAPVPPGAY

SEQ ID NO: 590495 - protein, 5 aa, Mycobacterium
TAPVS

SEQ ID NO: 590496 - protein, 15 aa, Mycobacterium
TAPVSVDPGATAGGA

SEQ ID NO: 590497 - protein, 17 aa, Mycobacterium
TAPWSEDAAKTEAAQKY

SEQ ID NO: 590498 - protein, 12 aa, Mycobacterium
TAQAATYRASDA

SEQ ID NO: 590499 - protein, 5 aa, Mycobacterium
TAQAE

SEQ ID NO: 590500 - protein, 8 aa, Mycobacterium
TAQAERAA

SEQ ID NO: 590501 - protein, 9 aa, Mycobacterium
TAQAERATS

SEQ ID NO: 590502 - protein, 14 aa, Mycobacterium
TAQAGEEIGAHAPG

SEQ ID NO: 590503 - protein, 6 aa, Mycobacterium
TAQAGG

SEQ ID NO: 590504 - protein, 15 aa, Mycobacterium
TAQAKIERGISGEIE

SEQ ID NO: 590505 - protein, 9 aa, Mycobacterium
TAQANSTFG

SEQ ID NO: 590506 - protein, 12 aa, Mycobacterium
TAQAQPGNPPPR

SEQ ID NO: 590507 - protein, 8 aa, Mycobacterium
TAQARRHR

SEQ ID NO: 590508 - protein, 9 aa, Mycobacterium
TAQASFDSA

SEQ ID NO: 590509 - protein, 8 aa, Mycobacterium
TAQASSSF

SEQ ID NO: 590510 - protein, 6 aa, Mycobacterium
TAQAVG

SEQ ID NO: 590511 - protein, 6 aa, Mycobacterium
TAQDGR

SEQ ID NO: 590512 - protein, 6 aa, Mycobacterium
TAQDKD

SEQ ID NO: 590513 - protein, 5 aa, Mycobacterium
TAQDL

SEQ ID NO: 590514 - protein, 9 aa, Mycobacterium
TAQDPDGRV

SEQ ID NO: 590515 - protein, 5 aa, Mycobacterium
TAQDT

SEQ ID NO: 590516 - protein, 5 aa, Mycobacterium
TAQDW

SEQ ID NO: 590517 - protein, 6 aa, Mycobacterium
TAQEKA

SEQ ID NO: 590518 - protein, 9 aa, Mycobacterium
TAQESNKAL

SEQ ID NO: 590519 - protein, 5 aa, Mycobacterium
TAQFG

SEQ ID NO: 590520 - protein, 7 aa, Mycobacterium
TAQGADA

SEQ ID NO: 590521 - protein, 10 aa, Mycobacterium
TAQGAQGSED

SEQ ID NO: 590522 - protein, 5 aa, Mycobacterium
TAQGG

SEQ ID NO: 590523 - protein, 13 aa, Mycobacterium
TAQGLAKAAGDGV

SEQ ID NO: 590524 - protein, 8 aa, Mycobacterium
TAQGRKAE

SEQ ID NO: 590525 - protein, 8 aa, Mycobacterium
TAQGRYGG

SEQ ID NO: 590526 - protein, 7 aa, Mycobacterium
TAQGTGV

SEQ ID NO: 590527 - protein, 7 aa, Mycobacterium
TAQGTTV

SEQ ID NO: 590528 - protein, 7 aa, Mycobacterium
TAQHGHR

SEQ ID NO: 590529 - protein, 5 aa, Mycobacterium
TAQIS

SEQ ID NO: 590530 - protein, 6 aa, Mycobacterium
TAQLDG

SEQ ID NO: 590531 - protein, 7 aa, Mycobacterium
TAQLDGS

SEQ ID NO: 590532 - protein, 15 aa, Mycobacterium
TAQLEGVANQNDDVD

SEQ ID NO: 590533 - protein, 12 aa, Mycobacterium
TAQLGGMRPRDP

SEQ ID NO: 590534 - protein, 9 aa, Mycobacterium
TAQMSRPAR

SEQ ID NO: 590535 - protein, 11 aa, Mycobacterium
TAQNSADQKHR

SEQ ID NO: 590536 - protein, 10 aa, Mycobacterium
TAQPEAGDGQ

SEQ ID NO: 590537 - protein, 8 aa, Mycobacterium
TAQPGTST

SEQ ID NO: 590538 - protein, 12 aa, Mycobacterium
TAQPHPKLPGTV

SEQ ID NO: 590539 - protein, 9 aa, Mycobacterium
TAQPKPTMD

SEQ ID NO: 590540 - protein, 22 aa, Mycobacterium
TAQPTSSTRRPDAARNAGECRG

SEQ ID NO: 590541 - protein, 6 aa, Mycobacterium
TAQPVE

SEQ ID NO: 590542 - protein, 7 aa, Mycobacterium
TAQQDDR

SEQ ID NO: 590543 - protein, 8 aa, Mycobacterium
TAQQDPAH

SEQ ID NO: 590544 - protein, 7 aa, Mycobacterium
TAQQHGQ

SEQ ID NO: 590545 - protein, 8 aa, Mycobacterium
TAQQHGQR

SEQ ID NO: 590546 - protein, 7 aa, Mycobacterium
TAQQNGR

SEQ ID NO: 590547 - protein, 7 aa, Mycobacterium
TAQQREA

SEQ ID NO: 590548 - protein, 8 aa, Mycobacterium
TAQQRTPP

SEQ ID NO: 590549 - protein, 13 aa, Mycobacterium
TAQQVTSAGGTGI

SEQ ID NO: 590550 - protein, 16 aa, Mycobacterium
TAQRAHAPEDVVEVLA

SEQ ID NO: 590551 - protein, 16 aa, Mycobacterium
TAQRAHAPQDVVEVLA

SEQ ID NO: 590552 - protein, 8 aa, Mycobacterium
TAQRDPTT

SEQ ID NO: 590553 - protein, 7 aa, Mycobacterium
TAQRDRA

SEQ ID NO: 590554 - protein, 6 aa, Mycobacterium
TAQREK

SEQ ID NO: 590555 - protein, 14 aa, Mycobacterium
TAQRESLRTRAGRA

SEQ ID NO: 590556 - protein, 7 aa, Mycobacterium
TAQRGAV

SEQ ID NO: 590557 - protein, 25 aa, Mycobacterium
TAQRGGRSDEHGTLPQNTHRRTAVG

SEQ ID NO: 590558 - protein, 8 aa, Mycobacterium
TAQRIQGD

SEQ ID NO: 590559 - protein, 7 aa, Mycobacterium
TAQRPDA

SEQ ID NO: 590560 - protein, 8 aa, Mycobacterium
TAQRPDAV

SEQ ID NO: 590561 - protein, 27 aa, Mycobacterium
TAQRPVAAGRSRPRPRRPVSDQVSDQR

SEQ ID NO: 590562 - protein, 9 aa, Mycobacterium
TAQRRTPPA

SEQ ID NO: 590563 - protein, 6 aa, Mycobacterium
TAQRSA

SEQ ID NO: 590564 - protein, 7 aa, Mycobacterium
TAQRSTL

SEQ ID NO: 590565 - protein, 32 aa, Mycobacterium
TAQRTKLTAAAKRRGDDAGAKRISAANKPTTA

SEQ ID NO: 590566 - protein, 7 aa, Mycobacterium
TAQRWST

SEQ ID NO: 590567 - protein, 20 aa, Mycobacterium
TAQRYAERESKTAAKVTGVY

SEQ ID NO: 590568 - protein, 5 aa, Mycobacterium
TAQSA

SEQ ID NO: 590569 - protein, 7 aa, Mycobacterium
TAQSAAT

SEQ ID NO: 590570 - protein, 9 aa, Mycobacterium
TAQSARDAG

SEQ ID NO: 590571 - protein, 9 aa, Mycobacterium
TAQSATPTG

SEQ ID NO: 590572 - protein, 6 aa, Mycobacterium
TAQSCS

SEQ ID NO: 590573 - protein, 12 aa, Mycobacterium
TAQSPDAADRGE

SEQ ID NO: 590574 - protein, 15 aa, Mycobacterium
TAQSSGQRGTTSGRC

SEQ ID NO: 590575 - protein, 9 aa, Mycobacterium
TAQSVSSMT

SEQ ID NO: 590576 - protein, 9 aa, Mycobacterium
TAQTARDFA

SEQ ID NO: 590577 - protein, 11 aa, Mycobacterium
TAQTELAAQPD

SEQ ID NO: 590578 - protein, 11 aa, Mycobacterium
TAQTLPPAELG

SEQ ID NO: 590579 - protein, 5 aa, Mycobacterium
TAQTM

SEQ ID NO: 590580 - protein, 8 aa, Mycobacterium
TAQTRTNG

SEQ ID NO: 590581 - protein, 4 aa, Mycobacterium
TAQV

SEQ ID NO: 590582 - protein, 7 aa, Mycobacterium
TAQVEGG

SEQ ID NO: 590583 - protein, 13 aa, Mycobacterium
TAQVEGGDLLVVI

SEQ ID NO: 590584 - protein, 13 aa, Mycobacterium
TAQVEGGDLLVVV

SEQ ID NO: 590585 - protein, 14 aa, Mycobacterium
TAQVSGSGEPEIPA

SEQ ID NO: 590586 - protein, 5 aa, Mycobacterium
TAQYP

SEQ ID NO: 590587 - protein, 9 aa, Mycobacterium
TARAAQELE

SEQ ID NO: 590588 - protein, 9 aa, Mycobacterium
TARAASAAA

SEQ ID NO: 590589 - protein, 9 aa, Mycobacterium
TARADTELH

SEQ ID NO: 590590 - protein, 11 aa, Mycobacterium
TARAEADGTYY

SEQ ID NO: 590591 - protein, 11 aa, Mycobacterium
TARAEDPGTYY

SEQ ID NO: 590592 - protein, 10 aa, Mycobacterium
TARAEEPGTF

SEQ ID NO: 590593 - protein, 10 aa, Mycobacterium
TARAEQRRAA

SEQ ID NO: 590594 - protein, 11 aa, Mycobacterium
TARAERDGTYY

SEQ ID NO: 590595 - protein, 6 aa, Mycobacterium
TARAEV

SEQ ID NO: 590596 - protein, 15 aa, Mycobacterium
TARAGKTAPTDMSGG

SEQ ID NO: 590597 - protein, 7 aa, Mycobacterium
TARANGW

SEQ ID NO: 590598 - protein, 7 aa, Mycobacterium
TARAPAD

SEQ ID NO: 590599 - protein, 15 aa, Mycobacterium
TARAPQGAPAEEEPV

SEQ ID NO: 590600 - protein, 12 aa, Mycobacterium
TARAPRPSADPR

SEQ ID NO: 590601 - protein, 5 aa, Mycobacterium
TARAQ

SEQ ID NO: 590602 - protein, 10 aa, Mycobacterium
TARAQAAAPS

SEQ ID NO: 590603 - protein, 14 aa, Mycobacterium
TARARVEAPVRGRR

SEQ ID NO: 590604 - protein, 9 aa, Mycobacterium
TARASSPWR

SEQ ID NO: 590605 - protein, 15 aa, Mycobacterium
TARATARAGPAGGRN

SEQ ID NO: 590606 - protein, 8 aa, Mycobacterium
TARDATRR

SEQ ID NO: 590607 - protein, 7 aa, Mycobacterium
TARDERL

SEQ ID NO: 590608 - protein, 8 aa, Mycobacterium
TARDGHRI

SEQ ID NO: 590609 - protein, 7 aa, Mycobacterium
TARDGRV

SEQ ID NO: 590610 - protein, 8 aa, Mycobacterium
TARDNTSR

SEQ ID NO: 590611 - protein, 31 aa, Mycobacterium
TARDNVATAQHDLETSQQAVKDANSAIAGAQ

SEQ ID NO: 590612 - protein, 7 aa, Mycobacterium
TARDREV

SEQ ID NO: 590613 - protein, 7 aa, Mycobacterium
TARDRTL

SEQ ID NO: 590614 - protein, 13 aa, Mycobacterium
TARDTARTRFHLE

SEQ ID NO: 590615 - protein, 8 aa, Mycobacterium
TARDTPKN

SEQ ID NO: 590616 - protein, 6 aa, Mycobacterium
TARDTY

SEQ ID NO: 590617 - protein, 14 aa, Mycobacterium
TARDYSDDDRRELE

SEQ ID NO: 590618 - protein, 4 aa, Mycobacterium
TARE

SEQ ID NO: 590619 - protein, 10 aa, Mycobacterium
TAREASDTIA

SEQ ID NO: 590620 - protein, 8 aa, Mycobacterium
TAREDPRG

SEQ ID NO: 590621 - protein, 9 aa, Mycobacterium
TAREDTELG

SEQ ID NO: 590622 - protein, 5 aa, Mycobacterium
TAREF

SEQ ID NO: 590623 - protein, 6 aa, Mycobacterium
TAREFA

SEQ ID NO: 590624 - protein, 13 aa, Mycobacterium
TAREGDPETAVDA

SEQ ID NO: 590625 - protein, 11 aa, Mycobacterium
TAREKAKELGA

SEQ ID NO: 590626 - protein, 7 aa, Mycobacterium
TARENDE

SEQ ID NO: 590627 - protein, 5 aa, Mycobacterium
TAREQ

SEQ ID NO: 590628 - protein, 17 aa, Mycobacterium
TARERLGEQVKTGRRKL

SEQ ID NO: 590629 - protein, 14 aa, Mycobacterium
TARESALAAQAGLA

SEQ ID NO: 590630 - protein, 5 aa, Mycobacterium
TARET

SEQ ID NO: 590631 - protein, 9 aa, Mycobacterium
TARETFNRR

SEQ ID NO: 590632 - protein, 7 aa, Mycobacterium
TARFGQP

SEQ ID NO: 590633 - protein, 5 aa, Mycobacterium
TARGA

SEQ ID NO: 590634 - protein, 12 aa, Mycobacterium
TARGAGFDTSPG

SEQ ID NO: 590635 - protein, 8 aa, Mycobacterium
TARGAGGN

SEQ ID NO: 590636 - protein, 6 aa, Mycobacterium
TARGAV

SEQ ID NO: 590637 - protein, 7 aa, Mycobacterium
TARGDEI

SEQ ID NO: 590638 - protein, 9 aa, Mycobacterium
TARGDGTNT

SEQ ID NO: 590639 - protein, 8 aa, Mycobacterium
TARGEGNG

SEQ ID NO: 590640 - protein, 19 aa, Mycobacterium
TARGEQDGYSRVFYAKRIT

SEQ ID NO: 590641 - protein, 12 aa, Mycobacterium
TARGEVNPTGGL

SEQ ID NO: 590642 - protein, 23 aa, Mycobacterium
TARGGAAHALPGDLSTAAGADAV

SEQ ID NO: 590643 - protein, 10 aa, Mycobacterium
TARGGDATAM

SEQ ID NO: 590644 - protein, 7 aa, Mycobacterium
TARGGEA

SEQ ID NO: 590645 - protein, 15 aa, Mycobacterium
TARGGNVIGGGDWSE

SEQ ID NO: 590646 - protein, 10 aa, Mycobacterium
TARGGSSKQA

SEQ ID NO: 590647 - protein, 7 aa, Mycobacterium
TARGPAT

SEQ ID NO: 590648 - protein, 5 aa, Mycobacterium
TARGQ

SEQ ID NO: 590649 - protein, 9 aa, Mycobacterium
TARGRRYGG

SEQ ID NO: 590650 - protein, 8 aa, Mycobacterium
TARGRTPT

SEQ ID NO: 590651 - protein, 12 aa, Mycobacterium
TARGSEPHSPAL

SEQ ID NO: 590652 - protein, 17 aa, Mycobacterium
TARGSGTGLSGAAIPRA

SEQ ID NO: 590653 - protein, 12 aa, Mycobacterium
TARGTLTGVYER

SEQ ID NO: 590654 - protein, 11 aa, Mycobacterium
TARGTSEEGFD

SEQ ID NO: 590655 - protein, 5 aa, Mycobacterium
TARGY

SEQ ID NO: 590656 - protein, 4 aa, Mycobacterium
TARH

SEQ ID NO: 590657 - protein, 12 aa, Mycobacterium
TARHAARSGRGE

SEQ ID NO: 590658 - protein, 23 aa, Mycobacterium
TARHASRRSAPQQVTHARALRPI

SEQ ID NO: 590659 - protein, 7 aa, Mycobacterium
TARHGTA

SEQ ID NO: 590660 - protein, 9 aa, Mycobacterium
TARHNGVPD

SEQ ID NO: 590661 - protein, 8 aa, Mycobacterium
TARHQGVP

SEQ ID NO: 590662 - protein, 7 aa, Mycobacterium
TARHRGV

SEQ ID NO: 590663 - protein, 4 aa, Mycobacterium
TARI

SEQ ID NO: 590664 - protein, 5 aa, Mycobacterium
TARKD

SEQ ID NO: 590665 - protein, 9 aa, Mycobacterium
TARKDDGYD

SEQ ID NO: 590666 - protein, 8 aa, Mycobacterium
TARKDGNT

SEQ ID NO: 590667 - protein, 9 aa, Mycobacterium
TARKKPPFG

SEQ ID NO: 590668 - protein, 8 aa, Mycobacterium
TARKPSGD

SEQ ID NO: 590669 - protein, 5 aa, Mycobacterium
TARKY

SEQ ID NO: 590670 - protein, 10 aa, Mycobacterium
TARKYGPAAR

SEQ ID NO: 590671 - protein, 4 aa, Mycobacterium
TARL

SEQ ID NO: 590672 - protein, 5 aa, Mycobacterium
TARLS

SEQ ID NO: 590673 - protein, 11 aa, Mycobacterium
TARMGSPSDPM

SEQ ID NO: 590674 - protein, 4 aa, Mycobacterium
TARN

SEQ ID NO: 590675 - protein, 9 aa, Mycobacterium
TARNDRKGT

SEQ ID NO: 590676 - protein, 8 aa, Mycobacterium
TARNGPLE

SEQ ID NO: 590677 - protein, 8 aa, Mycobacterium
TARNTPGF

SEQ ID NO: 590678 - protein, 7 aa, Mycobacterium
TARNTVR

SEQ ID NO: 590679 - protein, 8 aa, Mycobacterium
TARPAGDH

SEQ ID NO: 590680 - protein, 6 aa, Mycobacterium
TARPAS

SEQ ID NO: 590681 - protein, 11 aa, Mycobacterium
TARPATASDER

SEQ ID NO: 590682 - protein, 8 aa, Mycobacterium
TARPDQID

SEQ ID NO: 590683 - protein, 14 aa, Mycobacterium
TARPEPSKTAGGRW

SEQ ID NO: 590684 - protein, 5 aa, Mycobacterium
TARPG

SEQ ID NO: 590685 - protein, 13 aa, Mycobacterium
TARPGNSGGPIVA

SEQ ID NO: 590686 - protein, 6 aa, Mycobacterium
TARPGT

SEQ ID NO: 590687 - protein, 7 aa, Mycobacterium
TARPISE

SEQ ID NO: 590688 - protein, 11 aa, Mycobacterium
TARPPKPSAIR

SEQ ID NO: 590689 - protein, 8 aa, Mycobacterium
TARPPSSC

SEQ ID NO: 590690 - protein, 25 aa, Mycobacterium
TARPRPRVGSPQLKPPREPRGGPLE

SEQ ID NO: 590691 - protein, 9 aa, Mycobacterium
TARPSGTAW

SEQ ID NO: 590692 - protein, 7 aa, Mycobacterium
TARPYTH

SEQ ID NO: 590693 - protein, 15 aa, Mycobacterium
TARQDGRPESKGAPL

SEQ ID NO: 590694 - protein, 5 aa, Mycobacterium
TARQG

SEQ ID NO: 590695 - protein, 6 aa, Mycobacterium
TARQHD

SEQ ID NO: 590696 - protein, 14 aa, Mycobacterium
TARQNAQNDGKGKI

SEQ ID NO: 590697 - protein, 9 aa, Mycobacterium
TARQRGAGT

SEQ ID NO: 590698 - protein, 9 aa, Mycobacterium
TARQRSTLS

SEQ ID NO: 590699 - protein, 8 aa, Mycobacterium
TARQRTDA

SEQ ID NO: 590700 - protein, 13 aa, Mycobacterium
TARQSTVRSGRKA

SEQ ID NO: 590701 - protein, 7 aa, Mycobacterium
TARRAAP

SEQ ID NO: 590702 - protein, 9 aa, Mycobacterium
TARRAGADA

SEQ ID NO: 590703 - protein, 8 aa, Mycobacterium
TARRAQKI

SEQ ID NO: 590704 - protein, 23 aa, Mycobacterium
TARRAREGKIAPPPAWMTRQIGG

SEQ ID NO: 590705 - protein, 14 aa, Mycobacterium
TARRDDGAIVSSGG

SEQ ID NO: 590706 - protein, 7 aa, Mycobacterium
TARRDEA

SEQ ID NO: 590707 - protein, 5 aa, Mycobacterium
TARRE

SEQ ID NO: 590708 - protein, 10 aa, Mycobacterium
TARREHPTED

SEQ ID NO: 590709 - protein, 12 aa, Mycobacterium
TARRFSASTERT

SEQ ID NO: 590710 - protein, 6 aa, Mycobacterium
TARRGN

SEQ ID NO: 590711 - protein, 6 aa, Mycobacterium
TARRQL

SEQ ID NO: 590712 - protein, 31 aa, Mycobacterium
TARRRDAGEPASLAPPPRNRVSSGRSPRDRR

SEQ ID NO: 590713 - protein, 21 aa, Mycobacterium
TARRRGDRRRSFGSRLDPRAR

SEQ ID NO: 590714 - protein, 8 aa, Mycobacterium
TARRTPDA

SEQ ID NO: 590715 - protein, 6 aa, Mycobacterium
TARRYT

SEQ ID NO: 590716 - protein, 7 aa, Mycobacterium
TARSAEL

SEQ ID NO: 590717 - protein, 13 aa, Mycobacterium
TARSAMGGSYQQE

SEQ ID NO: 590718 - protein, 15 aa, Mycobacterium
TARSEGTEDDETGSS

SEQ ID NO: 590719 - protein, 5 aa, Mycobacterium
TARSG

SEQ ID NO: 590720 - protein, 7 aa, Mycobacterium
TARSGAI

SEQ ID NO: 590721 - protein, 5 aa, Mycobacterium
TARSH

SEQ ID NO: 590722 - protein, 9 aa, Mycobacterium
TARSINSGG

SEQ ID NO: 590723 - protein, 16 aa, Mycobacterium
TARSLRSNEDLEEAER

SEQ ID NO: 590724 - protein, 5 aa, Mycobacterium
TARSP

SEQ ID NO: 590725 - protein, 11 aa, Mycobacterium
TARSSDFAAAP

SEQ ID NO: 590726 - protein, 14 aa, Mycobacterium
TARSSRALLAEVSG

SEQ ID NO: 590727 - protein, 8 aa, Mycobacterium
TARSTEPV

SEQ ID NO: 590728 - protein, 6 aa, Mycobacterium
TARSTT

SEQ ID NO: 590729 - protein, 4 aa, Mycobacterium
TART

SEQ ID NO: 590730 - protein, 5 aa, Mycobacterium
TARTA

SEQ ID NO: 590731 - protein, 11 aa, Mycobacterium
TARTAALETTE

SEQ ID NO: 590732 - protein, 11 aa, Mycobacterium
TARTAEPPRDD

SEQ ID NO: 590733 - protein, 13 aa, Mycobacterium
TARTAMGGSYQQE

SEQ ID NO: 590734 - protein, 14 aa, Mycobacterium
TARTDVADPHPVRD

SEQ ID NO: 590735 - protein, 7 aa, Mycobacterium
TARTEAD

SEQ ID NO: 590736 - protein, 10 aa, Mycobacterium
TARTGENGEE

SEQ ID NO: 590737 - protein, 6 aa, Mycobacterium
TARTGQ

SEQ ID NO: 590738 - protein, 10 aa, Mycobacterium
TARTNPDKLR

SEQ ID NO: 590739 - protein, 10 aa, Mycobacterium
TARTNPDVTD

SEQ ID NO: 590740 - protein, 37 aa, Mycobacterium
TARTQTTASGVTAASGGYTAQEAASAAEMGAITGVTV

SEQ ID NO: 590741 - protein, 8 aa, Mycobacterium
TARTTGKT

SEQ ID NO: 590742 - protein, 9 aa, Mycobacterium
TARTTTDET

SEQ ID NO: 590743 - protein, 5 aa, Mycobacterium
TARTV

SEQ ID NO: 590744 - protein, 8 aa, Mycobacterium
TARVDGQP

SEQ ID NO: 590745 - protein, 6 aa, Mycobacterium
TARVTS

SEQ ID NO: 590746 - protein, 4 aa, Mycobacterium
TARY

SEQ ID NO: 590747 - protein, 6 aa, Mycobacterium
TARYDD

SEQ ID NO: 590748 - protein, 12 aa, Mycobacterium
TARYNEEAANLR

SEQ ID NO: 590749 - protein, 4 aa, Mycobacterium
TASA

SEQ ID NO: 590750 - protein, 15 aa, Mycobacterium
TASAAATHQRLGGPG

SEQ ID NO: 590751 - protein, 15 aa, Mycobacterium
TASAAEARAAALEVL

SEQ ID NO: 590752 - protein, 15 aa, Mycobacterium
TASAAGEDRIAERAK

SEQ ID NO: 590753 - protein, 9 aa, Mycobacterium
TASAAGTAT

SEQ ID NO: 590754 - protein, 18 aa, Mycobacterium
TASADAIPGAGFTPGNEN

SEQ ID NO: 590755 - protein, 8 aa, Mycobacterium
TASADPPV

SEQ ID NO: 590756 - protein, 10 aa, Mycobacterium
TASADPPVAR

SEQ ID NO: 590757 - protein, 9 aa, Mycobacterium
TASADRPTA

SEQ ID NO: 590758 - protein, 6 aa, Mycobacterium
TASAER

SEQ ID NO: 590759 - protein, 6 aa, Mycobacterium
TASAFR

SEQ ID NO: 590760 - protein, 6 aa, Mycobacterium
TASAGL

SEQ ID NO: 590761 - protein, 8 aa, Mycobacterium
TASAKGKE

SEQ ID NO: 590762 - protein, 6 aa, Mycobacterium
TASANL

SEQ ID NO: 590763 - protein, 8 aa, Mycobacterium
TASAPLTK

SEQ ID NO: 590764 - protein, 6 aa, Mycobacterium
TASAPN

SEQ ID NO: 590765 - protein, 7 aa, Mycobacterium
TASARDI

SEQ ID NO: 590766 - protein, 11 aa, Mycobacterium
TASARGANRPT

SEQ ID NO: 590767 - protein, 10 aa, Mycobacterium
TASARLPARR

SEQ ID NO: 590768 - protein, 6 aa, Mycobacterium
TASASE

SEQ ID NO: 590769 - protein, 8 aa, Mycobacterium
TASASTLD

SEQ ID NO: 590770 - protein, 12 aa, Mycobacterium
TASATAAAGPAE

SEQ ID NO: 590771 - protein, 11 aa, Mycobacterium
TASATAAATAA

SEQ ID NO: 590772 - protein, 10 aa, Mycobacterium
TASATATATA

SEQ ID NO: 590773 - protein, 11 aa, Mycobacterium
TASATGHEDHA

SEQ ID NO: 590774 - protein, 13 aa, Mycobacterium
TASDAAAELRQHV

SEQ ID NO: 590775 - protein, 16 aa, Mycobacterium
TASDAEQAAAQARSAV

SEQ ID NO: 590776 - protein, 5 aa, Mycobacterium
TASDD

SEQ ID NO: 590777 - protein, 8 aa, Mycobacterium
TASDDAAH

SEQ ID NO: 590778 - protein, 9 aa, Mycobacterium
TASDEAVAG

SEQ ID NO: 590779 - protein, 6 aa, Mycobacterium
TASDEL

SEQ ID NO: 590780 - protein, 18 aa, Mycobacterium
TASDGASAIASARAERPD

SEQ ID NO: 590781 - protein, 15 aa, Mycobacterium
TASDGDEEADQPGTP

SEQ ID NO: 590782 - protein, 7 aa, Mycobacterium
TASDRQR

SEQ ID NO: 590783 - protein, 10 aa, Mycobacterium
TASDSLDDAV

SEQ ID NO: 590784 - protein, 8 aa, Mycobacterium
TASDSRAI

SEQ ID NO: 590785 - protein, 11 aa, Mycobacterium
TASDYGTRSRS

SEQ ID NO: 590786 - protein, 11 aa, Mycobacterium
TASEEQKKTHI

SEQ ID NO: 590787 - protein, 7 aa, Mycobacterium
TASEQQA

SEQ ID NO: 590788 - protein, 5 aa, Mycobacterium
TASER

SEQ ID NO: 590789 - protein, 6 aa, Mycobacterium
TASESI

SEQ ID NO: 590790 - protein, 8 aa, Mycobacterium
TASESQHP

SEQ ID NO: 590791 - protein, 8 aa, Mycobacterium
TASETVTG

SEQ ID NO: 590792 - protein, 5 aa, Mycobacterium
TASFR

SEQ ID NO: 590793 - protein, 7 aa, Mycobacterium
TASFRNA

SEQ ID NO: 590794 - protein, 10 aa, Mycobacterium
TASGAPAGIS

SEQ ID NO: 590795 - protein, 13 aa, Mycobacterium
TASGASVALKTPG

SEQ ID NO: 590796 - protein, 16 aa, Mycobacterium
TASGAYAAAEAANANP

SEQ ID NO: 590797 - protein, 5 aa, Mycobacterium
TASGD

SEQ ID NO: 590798 - protein, 22 aa, Mycobacterium
TASGEGGYARELTDEERAQQQK

SEQ ID NO: 590799 - protein, 7 aa, Mycobacterium
TASGEGI

SEQ ID NO: 590800 - protein, 7 aa, Mycobacterium
TASGEPD

SEQ ID NO: 590801 - protein, 14 aa, Mycobacterium
TASGEPQAPTPPVK

SEQ ID NO: 590802 - protein, 11 aa, Mycobacterium
TASGFGSGGDR

SEQ ID NO: 590803 - protein, 5 aa, Mycobacterium
TASGG

SEQ ID NO: 590804 - protein, 10 aa, Mycobacterium
TASGGARSHA

SEQ ID NO: 590805 - protein, 20 aa, Mycobacterium
TASGGGWAHDAGQGANRLGS

SEQ ID NO: 590806 - protein, 19 aa, Mycobacterium
TASGGRASALAGPADDERV

SEQ ID NO: 590807 - protein, 8 aa, Mycobacterium
TASGGSYA

SEQ ID NO: 590808 - protein, 6 aa, Mycobacterium
TASGHG

SEQ ID NO: 590809 - protein, 9 aa, Mycobacterium
TASGHPDVT

SEQ ID NO: 590810 - protein, 9 aa, Mycobacterium
TASGIPDYP

SEQ ID NO: 590811 - protein, 8 aa, Mycobacterium
TASGKADL

SEQ ID NO: 590812 - protein, 8 aa, Mycobacterium
TASGLGGG

SEQ ID NO: 590813 - protein, 7 aa, Mycobacterium
TASGLRD

SEQ ID NO: 590814 - protein, 7 aa, Mycobacterium
TASGNAR

SEQ ID NO: 590815 - protein, 9 aa, Mycobacterium
TASGNTSIG

SEQ ID NO: 590816 - protein, 11 aa, Mycobacterium
TASGPDEQAAF

SEQ ID NO: 590817 - protein, 7 aa, Mycobacterium
TASGPGE

SEQ ID NO: 590818 - protein, 12 aa, Mycobacterium
TASGQGQAYDDP

SEQ ID NO: 590819 - protein, 6 aa, Mycobacterium
TASGRG

SEQ ID NO: 590820 - protein, 12 aa, Mycobacterium
TASGRVSAVTEP

SEQ ID NO: 590821 - protein, 9 aa, Mycobacterium
TASGSPVVT

SEQ ID NO: 590822 - protein, 19 aa, Mycobacterium
TASGSVEAAREVEQGDAAA

SEQ ID NO: 590823 - protein, 9 aa, Mycobacterium
TASHPSTGA

SEQ ID NO: 590824 - protein, 9 aa, Mycobacterium
TASHRSAQA

SEQ ID NO: 590825 - protein, 4 aa, Mycobacterium
TASI

SEQ ID NO: 590826 - protein, 5 aa, Mycobacterium
TASIP

SEQ ID NO: 590827 - protein, 5 aa, Mycobacterium
TASKA

SEQ ID NO: 590828 - protein, 9 aa, Mycobacterium
TASKAGVAG

SEQ ID NO: 590829 - protein, 6 aa, Mycobacterium
TASKGK

SEQ ID NO: 590830 - protein, 6 aa, Mycobacterium
TASKPL

SEQ ID NO: 590831 - protein, 6 aa, Mycobacterium
TASLNP

SEQ ID NO: 590832 - protein, 13 aa, Mycobacterium
TASLSTPSIRPAC

SEQ ID NO: 590833 - protein, 7 aa, Mycobacterium
TASMTEG

SEQ ID NO: 590834 - protein, 4 aa, Mycobacterium
TASN

SEQ ID NO: 590835 - protein, 18 aa, Mycobacterium
TASNADDGFADAVERFVL

SEQ ID NO: 590836 - protein, 17 aa, Mycobacterium
TASNGAAALDKAREVRP

SEQ ID NO: 590837 - protein, 18 aa, Mycobacterium
TASNGAQALDRAREARPD

SEQ ID NO: 590838 - protein, 10 aa, Mycobacterium
TASNGPAALD

SEQ ID NO: 590839 - protein, 7 aa, Mycobacterium
TASNKGK

SEQ ID NO: 590840 - protein, 8 aa, Mycobacterium
TASNLTTD

SEQ ID NO: 590841 - protein, 4 aa, Mycobacterium
TASP

SEQ ID NO: 590842 - protein, 7 aa, Mycobacterium
TASPALG

SEQ ID NO: 590843 - protein, 6 aa, Mycobacterium
TASPDE

SEQ ID NO: 590844 - protein, 8 aa, Mycobacterium
TASPDQHA

SEQ ID NO: 590845 - protein, 10 aa, Mycobacterium
TASPEDLGNI

SEQ ID NO: 590846 - protein, 5 aa, Mycobacterium
TASPG

SEQ ID NO: 590847 - protein, 8 aa, Mycobacterium
TASPGTAG

SEQ ID NO: 590848 - protein, 8 aa, Mycobacterium
TASPGVGT

SEQ ID NO: 590849 - protein, 33 aa, Mycobacterium
TASPIADPTNTPLARPEINPQAATMTADNPGAN

SEQ ID NO: 590850 - protein, 7 aa, Mycobacterium
TASPKTI

SEQ ID NO: 590851 - protein, 14 aa, Mycobacterium
TASPLPISRAGRRC

SEQ ID NO: 590852 - protein, 14 aa, Mycobacterium
TASPPRTAATAVSG

SEQ ID NO: 590853 - protein, 6 aa, Mycobacterium
TASPQT

SEQ ID NO: 590854 - protein, 18 aa, Mycobacterium
TASPRDSSPRADTILREN

SEQ ID NO: 590855 - protein, 9 aa, Mycobacterium
TASPREDLA

SEQ ID NO: 590856 - protein, 11 aa, Mycobacterium
TASPRKRDGYD

SEQ ID NO: 590857 - protein, 14 aa, Mycobacterium
TASPRSADRVRGYG

SEQ ID NO: 590858 - protein, 9 aa, Mycobacterium
TASPSAAVQ

SEQ ID NO: 590859 - protein, 8 aa, Mycobacterium
TASPSVQH

SEQ ID NO: 590860 - protein, 5 aa, Mycobacterium
TASPT

SEQ ID NO: 590861 - protein, 6 aa, Mycobacterium
TASPTD

SEQ ID NO: 590862 - protein, 6 aa, Mycobacterium
TASPVT

SEQ ID NO: 590863 - protein, 4 aa, Mycobacterium
TASQ

SEQ ID NO: 590864 - protein, 13 aa, Mycobacterium
TASQAGGAAPAQH

SEQ ID NO: 590865 - protein, 18 aa, Mycobacterium
TASQAQHAAGQARAAAQA

SEQ ID NO: 590866 - protein, 11 aa, Mycobacterium
TASQETRDRRW

SEQ ID NO: 590867 - protein, 6 aa, Mycobacterium
TASQEV

SEQ ID NO: 590868 - protein, 23 aa, Mycobacterium
TASQLRRDGLATTTKQMRASSPA

SEQ ID NO: 590869 - protein, 8 aa, Mycobacterium
TASQNGKR

SEQ ID NO: 590870 - protein, 5 aa, Mycobacterium
TASQR

SEQ ID NO: 590871 - protein, 8 aa, Mycobacterium
TASRASMR

SEQ ID NO: 590872 - protein, 10 aa, Mycobacterium
TASRATKTYR

SEQ ID NO: 590873 - protein, 5 aa, Mycobacterium
TASRD

SEQ ID NO: 590874 - protein, 10 aa, Mycobacterium
TASRDESRQW

SEQ ID NO: 590875 - protein, 6 aa, Mycobacterium
TASRDP

SEQ ID NO: 590876 - protein, 8 aa, Mycobacterium
TASREHAE

SEQ ID NO: 590877 - protein, 22 aa, Mycobacterium
TASRETALHSPAPGFAEADTTQ

SEQ ID NO: 590878 - protein, 15 aa, Mycobacterium
TASREVTRDGTPISL

SEQ ID NO: 590879 - protein, 7 aa, Mycobacterium
TASRGAP

SEQ ID NO: 590880 - protein, 7 aa, Mycobacterium
TASRGKW

SEQ ID NO: 590881 - protein, 8 aa, Mycobacterium
TASRGKWD

SEQ ID NO: 590882 - protein, 12 aa, Mycobacterium
TASRHRRRESRI

SEQ ID NO: 590883 - protein, 20 aa, Mycobacterium
TASRSVGTVDTGIEAHLKGY

SEQ ID NO: 590884 - protein, 5 aa, Mycobacterium
TASRT

SEQ ID NO: 590885 - protein, 12 aa, Mycobacterium
TASRTAVDTDGK

SEQ ID NO: 590886 - protein, 11 aa, Mycobacterium
TASRYRRRDSR

SEQ ID NO: 590887 - protein, 8 aa, Mycobacterium
TASSAKAW

SEQ ID NO: 590888 - protein, 14 aa, Mycobacterium
TASSARFRGDRGAL

SEQ ID NO: 590889 - protein, 5 aa, Mycobacterium
TASSD

SEQ ID NO: 590890 - protein, 7 aa, Mycobacterium
TASSDTV

SEQ ID NO: 590891 - protein, 8 aa, Mycobacterium
TASSKREL

SEQ ID NO: 590892 - protein, 8 aa, Mycobacterium
TASSPHGF

SEQ ID NO: 590893 - protein, 11 aa, Mycobacterium
TASSPTAESAR

SEQ ID NO: 590894 - protein, 16 aa, Mycobacterium
TASSRPLSAVGVRSRV

SEQ ID NO: 590895 - protein, 9 aa, Mycobacterium
TASSSGPTL

SEQ ID NO: 590896 - protein, 19 aa, Mycobacterium
TASSSSPTLTDHPEPPLSA

SEQ ID NO: 590897 - protein, 6 aa, Mycobacterium
TASSWP

SEQ ID NO: 590898 - protein, 4 aa, Mycobacterium
TAST

SEQ ID NO: 590899 - protein, 8 aa, Mycobacterium
TASTAESW

SEQ ID NO: 590900 - protein, 16 aa, Mycobacterium
TASTAGTAVPSSAAGN

SEQ ID NO: 590901 - protein, 10 aa, Mycobacterium
TASTDAPAAV

SEQ ID NO: 590902 - protein, 8 aa, Mycobacterium
TASTDGRF

SEQ ID NO: 590903 - protein, 6 aa, Mycobacterium
TASTDS

SEQ ID NO: 590904 - protein, 6 aa, Mycobacterium
TASTGI

SEQ ID NO: 590905 - protein, 19 aa, Mycobacterium
TASTGLDGLAATPDKTTTT

SEQ ID NO: 590906 - protein, 6 aa, Mycobacterium
TASTHA

SEQ ID NO: 590907 - protein, 8 aa, Mycobacterium
TASTLRKA

SEQ ID NO: 590908 - protein, 15 aa, Mycobacterium
TASTPEKAELSRQAG

SEQ ID NO: 590909 - protein, 8 aa, Mycobacterium
TASTRDVN

SEQ ID NO: 590910 - protein, 8 aa, Mycobacterium
TASTTSAI

SEQ ID NO: 590911 - protein, 13 aa, Mycobacterium
TASVASPRRIAER

SEQ ID NO: 590912 - protein, 10 aa, Mycobacterium
TASVDGEPVD

SEQ ID NO: 590913 - protein, 7 aa, Mycobacterium
TASVPAE

SEQ ID NO: 590914 - protein, 17 aa, Mycobacterium
TASWPNRTDSGGSRGLD

SEQ ID NO: 590915 - protein, 9 aa, Mycobacterium
TASYGPSAG

SEQ ID NO: 590916 - protein, 6 aa, Mycobacterium
TASYNE

SEQ ID NO: 590917 - protein, 4 aa, Mycobacterium
TATA

SEQ ID NO: 590918 - protein, 7 aa, Mycobacterium
TATAAAA

SEQ ID NO: 590919 - protein, 6 aa, Mycobacterium
TATAAG

SEQ ID NO: 590920 - protein, 10 aa, Mycobacterium
TATAAGARAR

SEQ ID NO: 590921 - protein, 9 aa, Mycobacterium
TATAAKEFG

SEQ ID NO: 590922 - protein, 13 aa, Mycobacterium
TATAASDAGGDLP

SEQ ID NO: 590923 - protein, 11 aa, Mycobacterium
TATADGPGRYP

SEQ ID NO: 590924 - protein, 8 aa, Mycobacterium
TATAEATR

SEQ ID NO: 590925 - protein, 10 aa, Mycobacterium
TATAEDGTPV

SEQ ID NO: 590926 - protein, 11 aa, Mycobacterium
TATAEDIKARD

SEQ ID NO: 590927 - protein, 6 aa, Mycobacterium
TATAGS

SEQ ID NO: 590928 - protein, 10 aa, Mycobacterium
TATAGSPRRY

SEQ ID NO: 590929 - protein, 9 aa, Mycobacterium
TATAGTDSL

SEQ ID NO: 590930 - protein, 9 aa, Mycobacterium
TATAGTPRR

SEQ ID NO: 590931 - protein, 8 aa, Mycobacterium
TATAIPEA

SEQ ID NO: 590932 - protein, 5 aa, Mycobacterium
TATAL

SEQ ID NO: 590933 - protein, 8 aa, Mycobacterium
TATALRED

SEQ ID NO: 590934 - protein, 9 aa, Mycobacterium
TATALREDT

SEQ ID NO: 590935 - protein, 13 aa, Mycobacterium
TATALREDTETLD

SEQ ID NO: 590936 - protein, 8 aa, Mycobacterium
TATANDRV

SEQ ID NO: 590937 - protein, 6 aa, Mycobacterium
TATAQI

SEQ ID NO: 590938 - protein, 17 aa, Mycobacterium
TATARDELAERSPERYA

SEQ ID NO: 590939 - protein, 7 aa, Mycobacterium
TATARRR

SEQ ID NO: 590940 - protein, 7 aa, Mycobacterium
TATASAV

SEQ ID NO: 590941 - protein, 26 aa, Mycobacterium
TATASDGGNGAQGGQGGADGGTGGVA

SEQ ID NO: 590942 - protein, 9 aa, Mycobacterium
TATASDKAA

SEQ ID NO: 590943 - protein, 6 aa, Mycobacterium
TATATE

SEQ ID NO: 590944 - protein, 8 aa, Mycobacterium
TATATGMR

SEQ ID NO: 590945 - protein, 5 aa, Mycobacterium
TATAW

SEQ ID NO: 590946 - protein, 16 aa, Mycobacterium
TATDADPVVAGKPGRA

SEQ ID NO: 590947 - protein, 7 aa, Mycobacterium
TATDDPD

SEQ ID NO: 590948 - protein, 10 aa, Mycobacterium
TATDDRGRGR

SEQ ID NO: 590949 - protein, 12 aa, Mycobacterium
TATDFAAEEARA

SEQ ID NO: 590950 - protein, 16 aa, Mycobacterium
TATDFADSEREAAANV

SEQ ID NO: 590951 - protein, 11 aa, Mycobacterium
TATDGIGAGMS

SEQ ID NO: 590952 - protein, 11 aa, Mycobacterium
TATDGKPVPPA

SEQ ID NO: 590953 - protein, 20 aa, Mycobacterium
TATDGPTPKNPTLPRPSRYT

SEQ ID NO: 590954 - protein, 6 aa, Mycobacterium
TATDGT

SEQ ID NO: 590955 - protein, 16 aa, Mycobacterium
TATDPATASVKPGQQA

SEQ ID NO: 590956 - protein, 8 aa, Mycobacterium
TATDPGVR

SEQ ID NO: 590957 - protein, 5 aa, Mycobacterium
TATDQ

SEQ ID NO: 590958 - protein, 9 aa, Mycobacterium
TATDTDGAF

SEQ ID NO: 590959 - protein, 7 aa, Mycobacterium
TATDVPD

SEQ ID NO: 590960 - protein, 12 aa, Mycobacterium
TATEADTAARVR

SEQ ID NO: 590961 - protein, 8 aa, Mycobacterium
TATEAKAQ

SEQ ID NO: 590962 - protein, 7 aa, Mycobacterium
TATEGDL

SEQ ID NO: 590963 - protein, 6 aa, Mycobacterium
TATEGL

SEQ ID NO: 590964 - protein, 10 aa, Mycobacterium
TATEGLDPQQ

SEQ ID NO: 590965 - protein, 6 aa, Mycobacterium
TATEKA

SEQ ID NO: 590966 - protein, 9 aa, Mycobacterium
TATEKEAAY

SEQ ID NO: 590967 - protein, 6 aa, Mycobacterium
TATELA

SEQ ID NO: 590968 - protein, 10 aa, Mycobacterium
TATELGPDGF

SEQ ID NO: 590969 - protein, 8 aa, Mycobacterium
TATELGPE

SEQ ID NO: 590970 - protein, 11 aa, Mycobacterium
TATEPGRSDRH

SEQ ID NO: 590971 - protein, 10 aa, Mycobacterium
TATEPNTKYV

SEQ ID NO: 590972 - protein, 6 aa, Mycobacterium
TATERS

SEQ ID NO: 590973 - protein, 8 aa, Mycobacterium
TATESDDV

SEQ ID NO: 590974 - protein, 19 aa, Mycobacterium
TATETASVHTAANPAATNG

SEQ ID NO: 590975 - protein, 23 aa, Mycobacterium
TATETATATDPNTQENDSHATAR

SEQ ID NO: 590976 - protein, 5 aa, Mycobacterium
TATFP

SEQ ID NO: 590977 - protein, 4 aa, Mycobacterium
TATG

SEQ ID NO: 590978 - protein, 9 aa, Mycobacterium
TATGAAAAY

SEQ ID NO: 590979 - protein, 7 aa, Mycobacterium
TATGAER

SEQ ID NO: 590980 - protein, 11 aa, Mycobacterium
TATGAGGQRWA

SEQ ID NO: 590981 - protein, 15 aa, Mycobacterium
TATGAPGRIDDETAG

SEQ ID NO: 590982 - protein, 17 aa, Mycobacterium
TATGAQPQVAGKPGPQL

SEQ ID NO: 590983 - protein, 11 aa, Mycobacterium
TATGARAAHSE

SEQ ID NO: 590984 - protein, 11 aa, Mycobacterium
TATGASGVSAA

SEQ ID NO: 590985 - protein, 5 aa, Mycobacterium
TATGE

SEQ ID NO: 590986 - protein, 9 aa, Mycobacterium
TATGETHTI

SEQ ID NO: 590987 - protein, 15 aa, Mycobacterium
TATGFASDHAAAQRI

SEQ ID NO: 590988 - protein, 13 aa, Mycobacterium
TATGGPGRGAERA

SEQ ID NO: 590989 - protein, 13 aa, Mycobacterium
TATGGQRITATTP

SEQ ID NO: 590990 - protein, 7 aa, Mycobacterium
TATGGVE

SEQ ID NO: 590991 - protein, 7 aa, Mycobacterium
TATGIAG

SEQ ID NO: 590992 - protein, 5 aa, Mycobacterium
TATGP

SEQ ID NO: 590993 - protein, 6 aa, Mycobacterium
TATGPA

SEQ ID NO: 590994 - protein, 9 aa, Mycobacterium
TATGPAEVE

SEQ ID NO: 590995 - protein, 19 aa, Mycobacterium
TATGPTPSALPDQPEDAFD

SEQ ID NO: 590996 - protein, 7 aa, Mycobacterium
TATGQAA

SEQ ID NO: 590997 - protein, 7 aa, Mycobacterium
TATGQDV

SEQ ID NO: 590998 - protein, 5 aa, Mycobacterium
TATGR

SEQ ID NO: 590999 - protein, 17 aa, Mycobacterium
TATGSADDVVAALRTAL

SEQ ID NO: 591000 - protein, 8 aa, Mycobacterium
TATGTDIG

SEQ ID NO: 591001 - protein, 6 aa, Mycobacterium
TATGTI

SEQ ID NO: 591002 - protein, 10 aa, Mycobacterium
TATGTSKGGC

SEQ ID NO: 591003 - protein, 6 aa, Mycobacterium
TATGVD

SEQ ID NO: 591004 - protein, 7 aa, Mycobacterium
TATGVTD

SEQ ID NO: 591005 - protein, 4 aa, Mycobacterium
TATH

SEQ ID NO: 591006 - protein, 14 aa, Mycobacterium
TATHGDPALRGDRG

SEQ ID NO: 591007 - protein, 5 aa, Mycobacterium
TATIP

SEQ ID NO: 591008 - protein, 21 aa, Mycobacterium
TATISSTPQQPDGGARSPKYR

SEQ ID NO: 591009 - protein, 4 aa, Mycobacterium
TATK

SEQ ID NO: 591010 - protein, 10 aa, Mycobacterium
TATKPDGGKV

SEQ ID NO: 591011 - protein, 10 aa, Mycobacterium
TATKQALAPV

SEQ ID NO: 591012 - protein, 18 aa, Mycobacterium
TATKQPRKRAAKKATKTT

SEQ ID NO: 591013 - protein, 8 aa, Mycobacterium
TATKYPDL

SEQ ID NO: 591014 - protein, 5 aa, Mycobacterium
TATLA

SEQ ID NO: 591015 - protein, 5 aa, Mycobacterium
TATLP

SEQ ID NO: 591016 - protein, 12 aa, Mycobacterium
TATLPGVRGSEE

SEQ ID NO: 591017 - protein, 14 aa, Mycobacterium
TATMKAAAERQHGQ

SEQ ID NO: 591018 - protein, 15 aa, Mycobacterium
TATMNGSPYSLPTNP

SEQ ID NO: 591019 - protein, 9 aa, Mycobacterium
TATNDAEGR

SEQ ID NO: 591020 - protein, 5 aa, Mycobacterium
TATNP

SEQ ID NO: 591021 - protein, 7 aa, Mycobacterium
TATNPTV

SEQ ID NO: 591022 - protein, 12 aa, Mycobacterium
TATNQDGRTENI

SEQ ID NO: 591023 - protein, 10 aa, Mycobacterium
TATNQDGRTV

SEQ ID NO: 591024 - protein, 8 aa, Mycobacterium
TATNSSGC

SEQ ID NO: 591025 - protein, 11 aa, Mycobacterium
TATNSVTGEPI

SEQ ID NO: 591026 - protein, 10 aa, Mycobacterium
TATNTTSGTW

SEQ ID NO: 591027 - protein, 12 aa, Mycobacterium
TATNTTSGTWGS

SEQ ID NO: 591028 - protein, 4 aa, Mycobacterium
TATP

SEQ ID NO: 591029 - protein, 7 aa, Mycobacterium
TATPAAM

SEQ ID NO: 591030 - protein, 22 aa, Mycobacterium
TATPADLRAAPDTAGRPAEGTE

SEQ ID NO: 591031 - protein, 8 aa, Mycobacterium
TATPAELT

SEQ ID NO: 591032 - protein, 5 aa, Mycobacterium
TATPD

SEQ ID NO: 591033 - protein, 10 aa, Mycobacterium
TATPDDPRRV

SEQ ID NO: 591034 - protein, 10 aa, Mycobacterium
TATPEAAGLS

SEQ ID NO: 591035 - protein, 21 aa, Mycobacterium
TATPEAFNKGQLDGPGPSAGP

SEQ ID NO: 591036 - protein, 7 aa, Mycobacterium
TATPEAY

SEQ ID NO: 591037 - protein, 22 aa, Mycobacterium
TATPEDLRAAPDTAGRPAGGTE

SEQ ID NO: 591038 - protein, 9 aa, Mycobacterium
TATPEQGAE

SEQ ID NO: 591039 - protein, 7 aa, Mycobacterium
TATPERL

SEQ ID NO: 591040 - protein, 21 aa, Mycobacterium
TATPETPDVPAEAPAAAPAAE

SEQ ID NO: 591041 - protein, 7 aa, Mycobacterium
TATPGKQ

SEQ ID NO: 591042 - protein, 8 aa, Mycobacterium
TATPGKQT

SEQ ID NO: 591043 - protein, 13 aa, Mycobacterium
TATPGPVSDYTGK

SEQ ID NO: 591044 - protein, 8 aa, Mycobacterium
TATPGQSV

SEQ ID NO: 591045 - protein, 16 aa, Mycobacterium
TATPGRTWNDPDADRE

SEQ ID NO: 591046 - protein, 7 aa, Mycobacterium
TATPLAD

SEQ ID NO: 591047 - protein, 9 aa, Mycobacterium
TATPNGQCS

SEQ ID NO: 591048 - protein, 7 aa, Mycobacterium
TATPPVA

SEQ ID NO: 591049 - protein, 5 aa, Mycobacterium
TATPS

SEQ ID NO: 591050 - protein, 8 aa, Mycobacterium
TATPSPFA

SEQ ID NO: 591051 - protein, 10 aa, Mycobacterium
TATPTGPDTY

SEQ ID NO: 591052 - protein, 7 aa, Mycobacterium
TATPTND

SEQ ID NO: 591053 - protein, 5 aa, Mycobacterium
TATPV

SEQ ID NO: 591054 - protein, 10 aa, Mycobacterium
TATQADLGGQ

SEQ ID NO: 591055 - protein, 19 aa, Mycobacterium
TATQAEQAATQAEAAAAAY

SEQ ID NO: 591056 - protein, 8 aa, Mycobacterium
TATQDTEL

SEQ ID NO: 591057 - protein, 19 aa, Mycobacterium
TATQKVQAAEDAWNTRDPH

SEQ ID NO: 591058 - protein, 5 aa, Mycobacterium
TATQL

SEQ ID NO: 591059 - protein, 5 aa, Mycobacterium
TATQP

SEQ ID NO: 591060 - protein, 6 aa, Mycobacterium
TATQPM

SEQ ID NO: 591061 - protein, 7 aa, Mycobacterium
TATQRPN

SEQ ID NO: 591062 - protein, 8 aa, Mycobacterium
TATQRPNA

SEQ ID NO: 591063 - protein, 5 aa, Mycobacterium
TATQY

SEQ ID NO: 591064 - protein, 5 aa, Mycobacterium
TATRA

SEQ ID NO: 591065 - protein, 12 aa, Mycobacterium
TATRAAAGLIRW

SEQ ID NO: 591066 - protein, 7 aa, Mycobacterium
TATRAEL

SEQ ID NO: 591067 - protein, 8 aa, Mycobacterium
TATRDGDN

SEQ ID NO: 591068 - protein, 9 aa, Mycobacterium
TATRDTDVG

SEQ ID NO: 591069 - protein, 10 aa, Mycobacterium
TATRENGETV

SEQ ID NO: 591070 - protein, 5 aa, Mycobacterium
TATRG

SEQ ID NO: 591071 - protein, 19 aa, Mycobacterium
TATRGGADQLLRPDHTEEI

SEQ ID NO: 591072 - protein, 8 aa, Mycobacterium
TATRGGQR

SEQ ID NO: 591073 - protein, 8 aa, Mycobacterium
TATRGSYA

SEQ ID NO: 591074 - protein, 19 aa, Mycobacterium
TATRKGVEDAGGTYEPHPA

SEQ ID NO: 591075 - protein, 20 aa, Mycobacterium
TATRKGVEDAGGTYEPHPAE

SEQ ID NO: 591076 - protein, 7 aa, Mycobacterium
TATRPRT

SEQ ID NO: 591077 - protein, 13 aa, Mycobacterium
TATRRDLADPETI

SEQ ID NO: 591078 - protein, 12 aa, Mycobacterium
TATRRDLQDPKT

SEQ ID NO: 591079 - protein, 9 aa, Mycobacterium
TATRRITEE

SEQ ID NO: 591080 - protein, 6 aa, Mycobacterium
TATRTL

SEQ ID NO: 591081 - protein, 13 aa, Mycobacterium
TATRTRATLTQTG

SEQ ID NO: 591082 - protein, 15 aa, Mycobacterium
TATRTRETLARTGVD

SEQ ID NO: 591083 - protein, 10 aa, Mycobacterium
TATRTRETLR

SEQ ID NO: 591084 - protein, 9 aa, Mycobacterium
TATRTRQTL

SEQ ID NO: 591085 - protein, 22 aa, Mycobacterium
TATRVSRPKKLSELSPRPDAPP

SEQ ID NO: 591086 - protein, 11 aa, Mycobacterium
TATSATVATEM

SEQ ID NO: 591087 - protein, 13 aa, Mycobacterium
TATSDGQVYSFAP

SEQ ID NO: 591088 - protein, 7 aa, Mycobacterium
TATSGDV

SEQ ID NO: 591089 - protein, 8 aa, Mycobacterium
TATSGSEP

SEQ ID NO: 591090 - protein, 6 aa, Mycobacterium
TATSGT

SEQ ID NO: 591091 - protein, 8 aa, Mycobacterium
TATSPAVG

SEQ ID NO: 591092 - protein, 11 aa, Mycobacterium
TATSSGARPAR

SEQ ID NO: 591093 - protein, 8 aa, Mycobacterium
TATSSGAT

SEQ ID NO: 591094 - protein, 7 aa, Mycobacterium
TATSSPQ

SEQ ID NO: 591095 - protein, 10 aa, Mycobacterium
TATSTDAVQN

SEQ ID NO: 591096 - protein, 7 aa, Mycobacterium
TATSTGL

SEQ ID NO: 591097 - protein, 7 aa, Mycobacterium
TATSVDD

SEQ ID NO: 591098 - protein, 14 aa, Mycobacterium
TATSVDDVGYAAIS

SEQ ID NO: 591099 - protein, 8 aa, Mycobacterium
TATSVPGS

SEQ ID NO: 591100 - protein, 7 aa, Mycobacterium
TATSVRA

SEQ ID NO: 591101 - protein, 4 aa, Mycobacterium
TATT

SEQ ID NO: 591102 - protein, 22 aa, Mycobacterium
TATTASDVSPLAGDGLAGGLGS

SEQ ID NO: 591103 - protein, 6 aa, Mycobacterium
TATTDA

SEQ ID NO: 591104 - protein, 9 aa, Mycobacterium
TATTDRDSV

SEQ ID NO: 591105 - protein, 7 aa, Mycobacterium
TATTDVE

SEQ ID NO: 591106 - protein, 8 aa, Mycobacterium
TATTEREP

SEQ ID NO: 591107 - protein, 5 aa, Mycobacterium
TATTG

SEQ ID NO: 591108 - protein, 8 aa, Mycobacterium
TATTGGKK

SEQ ID NO: 591109 - protein, 16 aa, Mycobacterium
TATTGIKGTPKNVDGV

SEQ ID NO: 591110 - protein, 5 aa, Mycobacterium
TATTL

SEQ ID NO: 591111 - protein, 6 aa, Mycobacterium
TATTLT

SEQ ID NO: 591112 - protein, 5 aa, Mycobacterium
TATTP

SEQ ID NO: 591113 - protein, 8 aa, Mycobacterium
TATTPDLG

SEQ ID NO: 591114 - protein, 9 aa, Mycobacterium
TATTPEVGS

SEQ ID NO: 591115 - protein, 9 aa, Mycobacterium
TATTPGTKA

SEQ ID NO: 591116 - protein, 7 aa, Mycobacterium
TATTPQV

SEQ ID NO: 591117 - protein, 18 aa, Mycobacterium
TATTPSSTPNPPAPADSA

SEQ ID NO: 591118 - protein, 7 aa, Mycobacterium
TATTSEP

SEQ ID NO: 591119 - protein, 13 aa, Mycobacterium
TATTSGDKKAQVC

SEQ ID NO: 591120 - protein, 6 aa, Mycobacterium
TATTTE

SEQ ID NO: 591121 - protein, 7 aa, Mycobacterium
TATTTGM

SEQ ID NO: 591122 - protein, 8 aa, Mycobacterium
TATTTGMR

SEQ ID NO: 591123 - protein, 6 aa, Mycobacterium
TATTTP

SEQ ID NO: 591124 - protein, 8 aa, Mycobacterium
TATTTTTE

SEQ ID NO: 591125 - protein, 4 aa, Mycobacterium
TATV

SEQ ID NO: 591126 - protein, 13 aa, Mycobacterium
TATVASPRRIAER

SEQ ID NO: 591127 - protein, 12 aa, Mycobacterium
TATVATKTGQIA

SEQ ID NO: 591128 - protein, 8 aa, Mycobacterium
TATVDQAK

SEQ ID NO: 591129 - protein, 8 aa, Mycobacterium
TATVDRRD

SEQ ID NO: 591130 - protein, 9 aa, Mycobacterium
TATVDRRDT

SEQ ID NO: 591131 - protein, 11 aa, Mycobacterium
TATVPDTARAR

SEQ ID NO: 591132 - protein, 11 aa, Mycobacterium
TATVTGTAQRP

SEQ ID NO: 591133 - protein, 5 aa, Mycobacterium
TATVV

SEQ ID NO: 591134 - protein, 12 aa, Mycobacterium
TATYPDGSIPDV

SEQ ID NO: 591135 - protein, 11 aa, Mycobacterium
TATYPDGSTPD

SEQ ID NO: 591136 - protein, 11 aa, Mycobacterium
TATYPDGSTPP

SEQ ID NO: 591137 - protein, 10 aa, Mycobacterium
TATYPDGSVP

SEQ ID NO: 591138 - protein, 4 aa, Mycobacterium
TAVA

SEQ ID NO: 591139 - protein, 6 aa, Mycobacterium
TAVAAG

SEQ ID NO: 591140 - protein, 9 aa, Mycobacterium
TAVAGNTSL

SEQ ID NO: 591141 - protein, 10 aa, Mycobacterium
TAVARRTGIE

SEQ ID NO: 591142 - protein, 12 aa, Mycobacterium
TAVATTDGESHE

SEQ ID NO: 591143 - protein, 18 aa, Mycobacterium
TAVDGAEALRSATETRPD

SEQ ID NO: 591144 - protein, 9 aa, Mycobacterium
TAVDGTPLP

SEQ ID NO: 591145 - protein, 14 aa, Mycobacterium
TAVDPDTTVGQAEY

SEQ ID NO: 591146 - protein, 11 aa, Mycobacterium
TAVDPSAERRE

SEQ ID NO: 591147 - protein, 11 aa, Mycobacterium
TAVDRGDVSGS

SEQ ID NO: 591148 - protein, 9 aa, Mycobacterium
TAVDSPADT

SEQ ID NO: 591149 - protein, 12 aa, Mycobacterium
TAVEEGATQDEL

SEQ ID NO: 591150 - protein, 26 aa, Mycobacterium
TAVEGAGHSENPGATPGLVGRSTGPQ

SEQ ID NO: 591151 - protein, 5 aa, Mycobacterium
TAVES

SEQ ID NO: 591152 - protein, 9 aa, Mycobacterium
TAVESAGET

SEQ ID NO: 591153 - protein, 9 aa, Mycobacterium
TAVGAGQAP

SEQ ID NO: 591154 - protein, 8 aa, Mycobacterium
TAVGGGTP

SEQ ID NO: 591155 - protein, 6 aa, Mycobacterium
TAVGPD

SEQ ID NO: 591156 - protein, 10 aa, Mycobacterium
TAVGPGPDGL

SEQ ID NO: 591157 - protein, 12 aa, Mycobacterium
TAVHDTQQIPQR

SEQ ID NO: 591158 - protein, 4 aa, Mycobacterium
TAVN

SEQ ID NO: 591159 - protein, 5 aa, Mycobacterium
TAVNG

SEQ ID NO: 591160 - protein, 7 aa, Mycobacterium
TAVPASP

SEQ ID NO: 591161 - protein, 5 aa, Mycobacterium
TAVPD

SEQ ID NO: 591162 - protein, 7 aa, Mycobacterium
TAVPDFP

SEQ ID NO: 591163 - protein, 10 aa, Mycobacterium
TAVPDTGSLA

SEQ ID NO: 591164 - protein, 11 aa, Mycobacterium
TAVPDTGSPVD

SEQ ID NO: 591165 - protein, 5 aa, Mycobacterium
TAVPG

SEQ ID NO: 591166 - protein, 7 aa, Mycobacterium
TAVPGLD

SEQ ID NO: 591167 - protein, 8 aa, Mycobacterium
TAVPGYDA

SEQ ID NO: 591168 - protein, 34 aa, Mycobacterium
TAVPPPEPARGAPEAPVDHGASNDGVDQDHEPGR

SEQ ID NO: 591169 - protein, 7 aa, Mycobacterium
TAVPTPL

SEQ ID NO: 591170 - protein, 7 aa, Mycobacterium
TAVPTPV

SEQ ID NO: 591171 - protein, 4 aa, Mycobacterium
TAVQ

SEQ ID NO: 591172 - protein, 15 aa, Mycobacterium
TAVQEATGHPDSPEE

SEQ ID NO: 591173 - protein, 6 aa, Mycobacterium
TAVQGT

SEQ ID NO: 591174 - protein, 15 aa, Mycobacterium
TAVQQATGHADSADE

SEQ ID NO: 591175 - protein, 15 aa, Mycobacterium
TAVQQATGHDDSPEE

SEQ ID NO: 591176 - protein, 15 aa, Mycobacterium
TAVQQATGHPDSPDE

SEQ ID NO: 591177 - protein, 15 aa, Mycobacterium
TAVQQATGQDDSAEE

SEQ ID NO: 591178 - protein, 15 aa, Mycobacterium
TAVQRATGHDDTPDE

SEQ ID NO: 591179 - protein, 9 aa, Mycobacterium
TAVQTTSPT

SEQ ID NO: 591180 - protein, 4 aa, Mycobacterium
TAVR

SEQ ID NO: 591181 - protein, 9 aa, Mycobacterium
TAVRDGDDY

SEQ ID NO: 591182 - protein, 8 aa, Mycobacterium
TAVRDGDS

SEQ ID NO: 591183 - protein, 8 aa, Mycobacterium
TAVRDGGD

SEQ ID NO: 591184 - protein, 10 aa, Mycobacterium
TAVRDKDGIS

SEQ ID NO: 591185 - protein, 8 aa, Mycobacterium
TAVRGEAP

SEQ ID NO: 591186 - protein, 9 aa, Mycobacterium
TAVRGEPPK

SEQ ID NO: 591187 - protein, 18 aa, Mycobacterium
TAVRGTLSSPADLTAEPT

SEQ ID NO: 591188 - protein, 6 aa, Mycobacterium
TAVRQG

SEQ ID NO: 591189 - protein, 7 aa, Mycobacterium
TAVRQGD

SEQ ID NO: 591190 - protein, 5 aa, Mycobacterium
TAVRR

SEQ ID NO: 591191 - protein, 10 aa, Mycobacterium
TAVRTPSGYR

SEQ ID NO: 591192 - protein, 29 aa, Mycobacterium
TAVSAKKLASRARARLGAADPERAREVGS

SEQ ID NO: 591193 - protein, 16 aa, Mycobacterium
TAVSANERGASSGGIV

SEQ ID NO: 591194 - protein, 15 aa, Mycobacterium
TAVSDPWAGVVIPLI

SEQ ID NO: 591195 - protein, 15 aa, Mycobacterium
TAVSQANAAALAPTT

SEQ ID NO: 591196 - protein, 5 aa, Mycobacterium
TAVSS

SEQ ID NO: 591197 - protein, 16 aa, Mycobacterium
TAVSTNQRGARSGGIV

SEQ ID NO: 591198 - protein, 5 aa, Mycobacterium
TAVSY

SEQ ID NO: 591199 - protein, 4 aa, Mycobacterium
TAVT

SEQ ID NO: 591200 - protein, 10 aa, Mycobacterium
TAVTGGAQDC

SEQ ID NO: 591201 - protein, 16 aa, Mycobacterium
TAVTPGLESPTIAPLA

SEQ ID NO: 591202 - protein, 7 aa, Mycobacterium
TAVTPSR

SEQ ID NO: 591203 - protein, 14 aa, Mycobacterium
TAVTQNPSPSGAGL

SEQ ID NO: 591204 - protein, 5 aa, Mycobacterium
TAWNP

SEQ ID NO: 591205 - protein, 16 aa, Mycobacterium
TAWPATEGGGGPRRAA

SEQ ID NO: 591206 - protein, 6 aa, Mycobacterium
TAWPDP

SEQ ID NO: 591207 - protein, 5 aa, Mycobacterium
TAWPG

SEQ ID NO: 591208 - protein, 6 aa, Mycobacterium
TAWPQS

SEQ ID NO: 591209 - protein, 8 aa, Mycobacterium
TAWPSGNP

SEQ ID NO: 591210 - protein, 14 aa, Mycobacterium
TAWQGGSVEDAQIR

SEQ ID NO: 591211 - protein, 22 aa, Mycobacterium
TAWSTRGPDDSSDESGAPPTEL

SEQ ID NO: 591212 - protein, 14 aa, Mycobacterium
TAYAASKAAANAFT

SEQ ID NO: 591213 - protein, 6 aa, Mycobacterium
TAYAPS

SEQ ID NO: 591214 - protein, 7 aa, Mycobacterium
TAYAPSD

SEQ ID NO: 591215 - protein, 16 aa, Mycobacterium
TAYASTDAASALAAAE

SEQ ID NO: 591216 - protein, 10 aa, Mycobacterium
TAYDPASGRV

SEQ ID NO: 591217 - protein, 13 aa, Mycobacterium
TAYDSAAADRTGL

SEQ ID NO: 591218 - protein, 13 aa, Mycobacterium
TAYDSAAAERTGL

SEQ ID NO: 591219 - protein, 4 aa, Mycobacterium
TAYE

SEQ ID NO: 591220 - protein, 16 aa, Mycobacterium
TAYGDKGAERDVGGYD

SEQ ID NO: 591221 - protein, 7 aa, Mycobacterium
TAYGGAD

SEQ ID NO: 591222 - protein, 8 aa, Mycobacterium
TAYGSAGK

SEQ ID NO: 591223 - protein, 9 aa, Mycobacterium
TAYGSGSPT

SEQ ID NO: 591224 - protein, 10 aa, Mycobacterium
TAYGTSDTVY

SEQ ID NO: 591225 - protein, 7 aa, Mycobacterium
TAYPPAA

SEQ ID NO: 591226 - protein, 11 aa, Mycobacterium
TAYSGAPADCG

SEQ ID NO: 591227 - protein, 9 aa, Mycobacterium
TAYSPDQLD

SEQ ID NO: 591228 - protein, 7 aa, Mycobacterium
TAYSTSK

SEQ ID NO: 591229 - protein, 7 aa, Mycobacterium
TAYTEER

SEQ ID NO: 591230 - protein, 5 aa, Mycobacterium
TAYTG

SEQ ID NO: 591231 - protein, 12 aa, Mycobacterium
TCAMGDSDESVV

SEQ ID NO: 591232 - protein, 14 aa, Mycobacterium
TCARADDDAAAAAA

SEQ ID NO: 591233 - protein, 10 aa, Mycobacterium
TCARGDADAA

SEQ ID NO: 591234 - protein, 12 aa, Mycobacterium
TCARGDEDADIA

SEQ ID NO: 591235 - protein, 8 aa, Mycobacterium
TCATGEPA

SEQ ID NO: 591236 - protein, 9 aa, Mycobacterium
TCDEQPAEA

SEQ ID NO: 591237 - protein, 5 aa, Mycobacterium
TCDSD

SEQ ID NO: 591238 - protein, 10 aa, Mycobacterium
TCEPGDGLGI

SEQ ID NO: 591239 - protein, 6 aa, Mycobacterium
TCESAR

SEQ ID NO: 591240 - protein, 7 aa, Mycobacterium
TCGDRVG

SEQ ID NO: 591241 - protein, 6 aa, Mycobacterium
TCGPGD

SEQ ID NO: 591242 - protein, 6 aa, Mycobacterium
TCGPSR

SEQ ID NO: 591243 - protein, 5 aa, Mycobacterium
TCGRE

SEQ ID NO: 591244 - protein, 4 aa, Mycobacterium
TCHH

SEQ ID NO: 591245 - protein, 7 aa, Mycobacterium
TCHNDNG

SEQ ID NO: 591246 - protein, 7 aa, Mycobacterium
TCKRDQR

SEQ ID NO: 591247 - protein, 14 aa, Mycobacterium
TCNDGVGKSACGGT

SEQ ID NO: 591248 - protein, 8 aa, Mycobacterium
TCNPSRGL

SEQ ID NO: 591249 - protein, 10 aa, Mycobacterium
TCPGPGATTV

SEQ ID NO: 591250 - protein, 7 aa, Mycobacterium
TCPKGRA

SEQ ID NO: 591251 - protein, 6 aa, Mycobacterium
TCPPET

SEQ ID NO: 591252 - protein, 12 aa, Mycobacterium
TCPTGTTGTTVG

SEQ ID NO: 591253 - protein, 16 aa, Mycobacterium
TCPTTRGHYPDGDPIE

SEQ ID NO: 591254 - protein, 13 aa, Mycobacterium
TCPVDAGSTPNLA

SEQ ID NO: 591255 - protein, 13 aa, Mycobacterium
TCPVNAGSTPNLA

SEQ ID NO: 591256 - protein, 11 aa, Mycobacterium
TCRAGDAEPVE

SEQ ID NO: 591257 - protein, 13 aa, Mycobacterium
TCRDTTASLEGTT

SEQ ID NO: 591258 - protein, 5 aa, Mycobacterium
TCRGR

SEQ ID NO: 591259 - protein, 19 aa, Mycobacterium
TCRTRGPDLAGPASSADAA

SEQ ID NO: 591260 - protein, 12 aa, Mycobacterium
TCSGGDGAVVYL

SEQ ID NO: 591261 - protein, 7 aa, Mycobacterium
TCSHDGP

SEQ ID NO: 591262 - protein, 8 aa, Mycobacterium
TCSPANTL

SEQ ID NO: 591263 - protein, 8 aa, Mycobacterium
TCSPENTL

SEQ ID NO: 591264 - protein, 6 aa, Mycobacterium
TCSPSV

SEQ ID NO: 591265 - protein, 9 aa, Mycobacterium
TCTECPDGT

SEQ ID NO: 591266 - protein, 6 aa, Mycobacterium
TCTPGG

SEQ ID NO: 591267 - protein, 8 aa, Mycobacterium
TCTPRNPL

SEQ ID NO: 591268 - protein, 20 aa, Mycobacterium
TCTPSGDNTNIGIGDPTAGV

SEQ ID NO: 591269 - protein, 4 aa, Mycobacterium
TDAA

SEQ ID NO: 591270 - protein, 14 aa, Mycobacterium
TDAAAAGVTDQETA

SEQ ID NO: 591271 - protein, 6 aa, Mycobacterium
TDAAAT

SEQ ID NO: 591272 - protein, 9 aa, Mycobacterium
TDAADTGDG

SEQ ID NO: 591273 - protein, 7 aa, Mycobacterium
TDAAERQ

SEQ ID NO: 591274 - protein, 8 aa, Mycobacterium
TDAAESRT

SEQ ID NO: 591275 - protein, 9 aa, Mycobacterium
TDAAETNGA

SEQ ID NO: 591276 - protein, 9 aa, Mycobacterium
TDAAGAQAA

SEQ ID NO: 591277 - protein, 7 aa, Mycobacterium
TDAAGER

SEQ ID NO: 591278 - protein, 8 aa, Mycobacterium
TDAAGQTL

SEQ ID NO: 591279 - protein, 8 aa, Mycobacterium
TDAAGRPE

SEQ ID NO: 591280 - protein, 7 aa, Mycobacterium
TDAAGSY

SEQ ID NO: 591281 - protein, 14 aa, Mycobacterium
TDAAIGDPDQLPGK

SEQ ID NO: 591282 - protein, 14 aa, Mycobacterium
TDAAIGDPQEEPGR

SEQ ID NO: 591283 - protein, 13 aa, Mycobacterium
TDAAIGDTDELAG

SEQ ID NO: 591284 - protein, 11 aa, Mycobacterium
TDAAKGAGYTV

SEQ ID NO: 591285 - protein, 9 aa, Mycobacterium
TDAAKGIDK

SEQ ID NO: 591286 - protein, 6 aa, Mycobacterium
TDAAPA

SEQ ID NO: 591287 - protein, 22 aa, Mycobacterium
TDAAQSAVSGLRPSLSTSTRAI

SEQ ID NO: 591288 - protein, 12 aa, Mycobacterium
TDAARDSDESYA

SEQ ID NO: 591289 - protein, 10 aa, Mycobacterium
TDAARDSEES

SEQ ID NO: 591290 - protein, 9 aa, Mycobacterium
TDAARRAPE

SEQ ID NO: 591291 - protein, 18 aa, Mycobacterium
TDAARYPTEFSGGQKQRI

SEQ ID NO: 591292 - protein, 8 aa, Mycobacterium
TDAASGYA

SEQ ID NO: 591293 - protein, 6 aa, Mycobacterium
TDAASL

SEQ ID NO: 591294 - protein, 10 aa, Mycobacterium
TDAATALTDA

SEQ ID NO: 591295 - protein, 8 aa, Mycobacterium
TDAATDPL

SEQ ID NO: 591296 - protein, 10 aa, Mycobacterium
TDAATPSVPS

SEQ ID NO: 591297 - protein, 6 aa, Mycobacterium
TDACTT

SEQ ID NO: 591298 - protein, 4 aa, Mycobacterium
TDAD

SEQ ID NO: 591299 - protein, 11 aa, Mycobacterium
TDADAARETAR

SEQ ID NO: 591300 - protein, 11 aa, Mycobacterium
TDADAETAAKA

SEQ ID NO: 591301 - protein, 9 aa, Mycobacterium
TDADAPAHR

SEQ ID NO: 591302 - protein, 9 aa, Mycobacterium
TDADAPGRL

SEQ ID NO: 591303 - protein, 7 aa, Mycobacterium
TDADDDV

SEQ ID NO: 591304 - protein, 7 aa, Mycobacterium
TDADDEV

SEQ ID NO: 591305 - protein, 6 aa, Mycobacterium
TDADDG

SEQ ID NO: 591306 - protein, 11 aa, Mycobacterium
TDADEARTLGR

SEQ ID NO: 591307 - protein, 7 aa, Mycobacterium
TDADEDV

SEQ ID NO: 591308 - protein, 9 aa, Mycobacterium
TDADERLTE

SEQ ID NO: 591309 - protein, 9 aa, Mycobacterium
TDADERVTE

SEQ ID NO: 591310 - protein, 8 aa, Mycobacterium
TDADESAA

SEQ ID NO: 591311 - protein, 10 aa, Mycobacterium
TDADGAVVGT

SEQ ID NO: 591312 - protein, 8 aa, Mycobacterium
TDADGNPL

SEQ ID NO: 591313 - protein, 12 aa, Mycobacterium
TDADGRLQERRA

SEQ ID NO: 591314 - protein, 14 aa, Mycobacterium
TDADGRRAAASEPS

SEQ ID NO: 591315 - protein, 7 aa, Mycobacterium
TDADGRV

SEQ ID NO: 591316 - protein, 16 aa, Mycobacterium
TDADGRVDVSPKGDPA

SEQ ID NO: 591317 - protein, 11 aa, Mycobacterium
TDADGSVSASA

SEQ ID NO: 591318 - protein, 11 aa, Mycobacterium
TDADGTEHHEP

SEQ ID NO: 591319 - protein, 9 aa, Mycobacterium
TDADGTLLS

SEQ ID NO: 591320 - protein, 5 aa, Mycobacterium
TDADL

SEQ ID NO: 591321 - protein, 13 aa, Mycobacterium
TDADLAKDPDLSI

SEQ ID NO: 591322 - protein, 6 aa, Mycobacterium
TDADLE

SEQ ID NO: 591323 - protein, 6 aa, Mycobacterium
TDADPV

SEQ ID NO: 591324 - protein, 18 aa, Mycobacterium
TDADQNGPPLASTARQRA

SEQ ID NO: 591325 - protein, 6 aa, Mycobacterium
TDADRD

SEQ ID NO: 591326 - protein, 5 aa, Mycobacterium
TDADS

SEQ ID NO: 591327 - protein, 6 aa, Mycobacterium
TDADSA

SEQ ID NO: 591328 - protein, 7 aa, Mycobacterium
TDADSRN

SEQ ID NO: 591329 - protein, 8 aa, Mycobacterium
TDADSRVD

SEQ ID NO: 591330 - protein, 6 aa, Mycobacterium
TDADSV

SEQ ID NO: 591331 - protein, 28 aa, Mycobacterium
TDADTHAVPKTAADRRPKTAQPGLVAST

SEQ ID NO: 591332 - protein, 9 aa, Mycobacterium
TDADTPSWR

SEQ ID NO: 591333 - protein, 10 aa, Mycobacterium
TDADTRSTAA

SEQ ID NO: 591334 - protein, 7 aa, Mycobacterium
TDADTTL

SEQ ID NO: 591335 - protein, 4 aa, Mycobacterium
TDAE

SEQ ID NO: 591336 - protein, 5 aa, Mycobacterium
TDAEA

SEQ ID NO: 591337 - protein, 8 aa, Mycobacterium
TDAEAAEV

SEQ ID NO: 591338 - protein, 19 aa, Mycobacterium
TDAEAEAAEAVERAEQLGG

SEQ ID NO: 591339 - protein, 6 aa, Mycobacterium
TDAEAI

SEQ ID NO: 591340 - protein, 8 aa, Mycobacterium
TDAEGQSA

SEQ ID NO: 591341 - protein, 11 aa, Mycobacterium
TDAEGRLQERR

SEQ ID NO: 591342 - protein, 17 aa, Mycobacterium
TDAEGRVDVSPKGDPPG

SEQ ID NO: 591343 - protein, 8 aa, Mycobacterium
TDAEKDEL

SEQ ID NO: 591344 - protein, 7 aa, Mycobacterium
TDAELSA

SEQ ID NO: 591345 - protein, 6 aa, Mycobacterium
TDAEPG

SEQ ID NO: 591346 - protein, 8 aa, Mycobacterium
TDAEPGRT

SEQ ID NO: 591347 - protein, 10 aa, Mycobacterium
TDAEQARAVG

SEQ ID NO: 591348 - protein, 6 aa, Mycobacterium
TDAEQT

SEQ ID NO: 591349 - protein, 5 aa, Mycobacterium
TDAER

SEQ ID NO: 591350 - protein, 7 aa, Mycobacterium
TDAERAV

SEQ ID NO: 591351 - protein, 17 aa, Mycobacterium
TDAERDQRRDETGRPPA

SEQ ID NO: 591352 - protein, 7 aa, Mycobacterium
TDAERPM

SEQ ID NO: 591353 - protein, 16 aa, Mycobacterium
TDAERRAAIETTPARK

SEQ ID NO: 591354 - protein, 9 aa, Mycobacterium
TDAGAGPPV

SEQ ID NO: 591355 - protein, 6 aa, Mycobacterium
TDAGDG

SEQ ID NO: 591356 - protein, 10 aa, Mycobacterium
TDAGDRLGKR

SEQ ID NO: 591357 - protein, 7 aa, Mycobacterium
TDAGDTI

SEQ ID NO: 591358 - protein, 11 aa, Mycobacterium
TDAGEPDESAL

SEQ ID NO: 591359 - protein, 9 aa, Mycobacterium
TDAGERYGT

SEQ ID NO: 591360 - protein, 5 aa, Mycobacterium
TDAGG

SEQ ID NO: 591361 - protein, 14 aa, Mycobacterium
TDAGGRRVSAHEPS

SEQ ID NO: 591362 - protein, 9 aa, Mycobacterium
TDAGGTIGH

SEQ ID NO: 591363 - protein, 9 aa, Mycobacterium
TDAGHVPAQ

SEQ ID NO: 591364 - protein, 8 aa, Mycobacterium
TDAGKDAL

SEQ ID NO: 591365 - protein, 7 aa, Mycobacterium
TDAGKRA

SEQ ID NO: 591366 - protein, 5 aa, Mycobacterium
TDAGL

SEQ ID NO: 591367 - protein, 10 aa, Mycobacterium
TDAGLPRGPE

SEQ ID NO: 591368 - protein, 6 aa, Mycobacterium
TDAGNR

SEQ ID NO: 591369 - protein, 11 aa, Mycobacterium
TDAGNSGVGDM

SEQ ID NO: 591370 - protein, 9 aa, Mycobacterium
TDAGPTARR

SEQ ID NO: 591371 - protein, 24 aa, Mycobacterium
TDAGQAADVADAGKPATDRGTRLT

SEQ ID NO: 591372 - protein, 7 aa, Mycobacterium
TDAGQTI

SEQ ID NO: 591373 - protein, 7 aa, Mycobacterium
TDAGRAT

SEQ ID NO: 591374 - protein, 9 aa, Mycobacterium
TDAGRDRLA

SEQ ID NO: 591375 - protein, 10 aa, Mycobacterium
TDAGRDSEES

SEQ ID NO: 591376 - protein, 6 aa, Mycobacterium
TDAGRE

SEQ ID NO: 591377 - protein, 9 aa, Mycobacterium
TDAGREQAQ

SEQ ID NO: 591378 - protein, 7 aa, Mycobacterium
TDAGRQI

SEQ ID NO: 591379 - protein, 5 aa, Mycobacterium
TDAGS

SEQ ID NO: 591380 - protein, 8 aa, Mycobacterium
TDAGSGRS

SEQ ID NO: 591381 - protein, 10 aa, Mycobacterium
TDAGTAPGLD

SEQ ID NO: 591382 - protein, 8 aa, Mycobacterium
TDAGTGEM

SEQ ID NO: 591383 - protein, 6 aa, Mycobacterium
TDAGTP

SEQ ID NO: 591384 - protein, 8 aa, Mycobacterium
TDAGVPWG

SEQ ID NO: 591385 - protein, 8 aa, Mycobacterium
TDAGYGSV

SEQ ID NO: 591386 - protein, 8 aa, Mycobacterium
TDAHAPGQ

SEQ ID NO: 591387 - protein, 22 aa, Mycobacterium
TDAHGAKLTQRRKLREQDHGLD

SEQ ID NO: 591388 - protein, 6 aa, Mycobacterium
TDAIGE

SEQ ID NO: 591389 - protein, 8 aa, Mycobacterium
TDAKDSSR

SEQ ID NO: 591390 - protein, 7 aa, Mycobacterium
TDAKGRH

SEQ ID NO: 591391 - protein, 7 aa, Mycobacterium
TDAKGRR

SEQ ID NO: 591392 - protein, 7 aa, Mycobacterium
TDAKNSA

SEQ ID NO: 591393 - protein, 4 aa, Mycobacterium
TDAL

SEQ ID NO: 591394 - protein, 6 aa, Mycobacterium
TDALPA

SEQ ID NO: 591395 - protein, 8 aa, Mycobacterium
TDALRRGG

SEQ ID NO: 591396 - protein, 4 aa, Mycobacterium
TDAM

SEQ ID NO: 591397 - protein, 17 aa, Mycobacterium
TDAMTEKVASVERYLED

SEQ ID NO: 591398 - protein, 8 aa, Mycobacterium
TDAMYPPD

SEQ ID NO: 591399 - protein, 10 aa, Mycobacterium
TDAPAEPIRS

SEQ ID NO: 591400 - protein, 14 aa, Mycobacterium
TDAPAIPHGDNAKE

SEQ ID NO: 591401 - protein, 12 aa, Mycobacterium
TDAPAIPHGQNA

SEQ ID NO: 591402 - protein, 15 aa, Mycobacterium
TDAPAIPHGQNAKEL

SEQ ID NO: 591403 - protein, 8 aa, Mycobacterium
TDAPAPRH

SEQ ID NO: 591404 - protein, 12 aa, Mycobacterium
TDAPAVPHGQNA

SEQ ID NO: 591405 - protein, 8 aa, Mycobacterium
TDAPDDTV

SEQ ID NO: 591406 - protein, 7 aa, Mycobacterium
TDAPDQV

SEQ ID NO: 591407 - protein, 9 aa, Mycobacterium
TDAPFGDAD

SEQ ID NO: 591408 - protein, 8 aa, Mycobacterium
TDAPFGHS

SEQ ID NO: 591409 - protein, 9 aa, Mycobacterium
TDAPGELST

SEQ ID NO: 591410 - protein, 7 aa, Mycobacterium
TDAPGLT

SEQ ID NO: 591411 - protein, 13 aa, Mycobacterium
TDAPGVSIEPQQS

SEQ ID NO: 591412 - protein, 5 aa, Mycobacterium
TDAPI

SEQ ID NO: 591413 - protein, 5 aa, Mycobacterium
TDAPL

SEQ ID NO: 591414 - protein, 19 aa, Mycobacterium
TDAPQRSTELSRSTAGSQG

SEQ ID NO: 591415 - protein, 11 aa, Mycobacterium
TDAPSAREIGR

SEQ ID NO: 591416 - protein, 10 aa, Mycobacterium
TDAPSTLTPA

SEQ ID NO: 591417 - protein, 5 aa, Mycobacterium
TDAPV

SEQ ID NO: 591418 - protein, 4 aa, Mycobacterium
TDAQ

SEQ ID NO: 591419 - protein, 8 aa, Mycobacterium
TDAQAAER

SEQ ID NO: 591420 - protein, 10 aa, Mycobacterium
TDAQESEEPQ

SEQ ID NO: 591421 - protein, 8 aa, Mycobacterium
TDAQETTI

SEQ ID NO: 591422 - protein, 8 aa, Mycobacterium
TDAQKSEW

SEQ ID NO: 591423 - protein, 7 aa, Mycobacterium
TDAQPEG

SEQ ID NO: 591424 - protein, 8 aa, Mycobacterium
TDAQQDGD

SEQ ID NO: 591425 - protein, 10 aa, Mycobacterium
TDAQRDTEES

SEQ ID NO: 591426 - protein, 11 aa, Mycobacterium
TDAQREKHGVA

SEQ ID NO: 591427 - protein, 9 aa, Mycobacterium
TDAQSVDEA

SEQ ID NO: 591428 - protein, 7 aa, Mycobacterium
TDARAET

SEQ ID NO: 591429 - protein, 6 aa, Mycobacterium
TDARAT

SEQ ID NO: 591430 - protein, 5 aa, Mycobacterium
TDARE

SEQ ID NO: 591431 - protein, 10 aa, Mycobacterium
TDARKRGATV

SEQ ID NO: 591432 - protein, 8 aa, Mycobacterium
TDARPDLA

SEQ ID NO: 591433 - protein, 8 aa, Mycobacterium
TDARPQQV

SEQ ID NO: 591434 - protein, 10 aa, Mycobacterium
TDARRRAAAR

SEQ ID NO: 591435 - protein, 9 aa, Mycobacterium
TDARSAPRE

SEQ ID NO: 591436 - protein, 8 aa, Mycobacterium
TDARSGTL

SEQ ID NO: 591437 - protein, 9 aa, Mycobacterium
TDARTGESF

SEQ ID NO: 591438 - protein, 9 aa, Mycobacterium
TDASAEDME

SEQ ID NO: 591439 - protein, 6 aa, Mycobacterium
TDASAV

SEQ ID NO: 591440 - protein, 8 aa, Mycobacterium
TDASDAHA

SEQ ID NO: 591441 - protein, 5 aa, Mycobacterium
TDASE

SEQ ID NO: 591442 - protein, 6 aa, Mycobacterium
TDASGR

SEQ ID NO: 591443 - protein, 7 aa, Mycobacterium
TDASGRY

SEQ ID NO: 591444 - protein, 6 aa, Mycobacterium
TDASMT

SEQ ID NO: 591445 - protein, 5 aa, Mycobacterium
TDASP

SEQ ID NO: 591446 - protein, 10 aa, Mycobacterium
TDASPDAPAL

SEQ ID NO: 591447 - protein, 8 aa, Mycobacterium
TDASRAAY

SEQ ID NO: 591448 - protein, 16 aa, Mycobacterium
TDASSCTVSGPAAEIG

SEQ ID NO: 591449 - protein, 14 aa, Mycobacterium
TDASTGKVKRINNN

SEQ ID NO: 591450 - protein, 4 aa, Mycobacterium
TDAT

SEQ ID NO: 591451 - protein, 11 aa, Mycobacterium
TDATAATDSRF

SEQ ID NO: 591452 - protein, 29 aa, Mycobacterium
TDATDYNGTGVGNLGGVDATDDPWHGRPA

SEQ ID NO: 591453 - protein, 11 aa, Mycobacterium
TDATESQRAIG

SEQ ID NO: 591454 - protein, 5 aa, Mycobacterium
TDATG

SEQ ID NO: 591455 - protein, 8 aa, Mycobacterium
TDATGGQV

SEQ ID NO: 591456 - protein, 14 aa, Mycobacterium
TDATPDLSEPPRGL

SEQ ID NO: 591457 - protein, 10 aa, Mycobacterium
TDATPSQREI

SEQ ID NO: 591458 - protein, 11 aa, Mycobacterium
TDATPSQRGIR

SEQ ID NO: 591459 - protein, 9 aa, Mycobacterium
TDATQAALS

SEQ ID NO: 591460 - protein, 12 aa, Mycobacterium
TDATQAREIGRQ

SEQ ID NO: 591461 - protein, 9 aa, Mycobacterium
TDATRAEEG

SEQ ID NO: 591462 - protein, 14 aa, Mycobacterium
TDATREAVADKPAA

SEQ ID NO: 591463 - protein, 8 aa, Mycobacterium
TDATRRGT

SEQ ID NO: 591464 - protein, 8 aa, Mycobacterium
TDATSEES

SEQ ID NO: 591465 - protein, 8 aa, Mycobacterium
TDATTRGQ

SEQ ID NO: 591466 - protein, 9 aa, Mycobacterium
TDATYEQTR

SEQ ID NO: 591467 - protein, 13 aa, Mycobacterium
TDAVASSRTSQQP

SEQ ID NO: 591468 - protein, 5 aa, Mycobacterium
TDAVH

SEQ ID NO: 591469 - protein, 8 aa, Mycobacterium
TDAVRTRS

SEQ ID NO: 591470 - protein, 6 aa, Mycobacterium
TDAWPA

SEQ ID NO: 591471 - protein, 4 aa, Mycobacterium
TDAY

SEQ ID NO: 591472 - protein, 6 aa, Mycobacterium
TDAYPK

SEQ ID NO: 591473 - protein, 8 aa, Mycobacterium
TDAYPQRL

SEQ ID NO: 591474 - protein, 11 aa, Mycobacterium
TDCAAGTRRVT

SEQ ID NO: 591475 - protein, 6 aa, Mycobacterium
TDCADP

SEQ ID NO: 591476 - protein, 5 aa, Mycobacterium
TDCAE

SEQ ID NO: 591477 - protein, 4 aa, Mycobacterium
TDCG

SEQ ID NO: 591478 - protein, 13 aa, Mycobacterium
TDCPAAGAPQQPS

SEQ ID NO: 591479 - protein, 14 aa, Mycobacterium
TDCTNAASLQQQSE

SEQ ID NO: 591480 - protein, 11 aa, Mycobacterium
TDDAADHPDTW

SEQ ID NO: 591481 - protein, 7 aa, Mycobacterium
TDDAAQA

SEQ ID NO: 591482 - protein, 8 aa, Mycobacterium
TDDAEARD

SEQ ID NO: 591483 - protein, 8 aa, Mycobacterium
TDDAESPH

SEQ ID NO: 591484 - protein, 7 aa, Mycobacterium
TDDAEVN

SEQ ID NO: 591485 - protein, 5 aa, Mycobacterium
TDDAG

SEQ ID NO: 591486 - protein, 9 aa, Mycobacterium
TDDAGKPHL

SEQ ID NO: 591487 - protein, 16 aa, Mycobacterium
TDDAGNPHLTGSKCPQ

SEQ ID NO: 591488 - protein, 8 aa, Mycobacterium
TDDAGSPR

SEQ ID NO: 591489 - protein, 13 aa, Mycobacterium
TDDALTAGERGPT

SEQ ID NO: 591490 - protein, 9 aa, Mycobacterium
TDDAQKRQA

SEQ ID NO: 591491 - protein, 8 aa, Mycobacterium
TDDASVDA

SEQ ID NO: 591492 - protein, 11 aa, Mycobacterium
TDDATIPRAAG

SEQ ID NO: 591493 - protein, 8 aa, Mycobacterium
TDDATTAM

SEQ ID NO: 591494 - protein, 10 aa, Mycobacterium
TDDAVPTSHQ

SEQ ID NO: 591495 - protein, 18 aa, Mycobacterium
TDDDAGVDAAARAFAELL

SEQ ID NO: 591496 - protein, 19 aa, Mycobacterium
TDDDAGVDAAARAFAQLLS

SEQ ID NO: 591497 - protein, 10 aa, Mycobacterium
TDDDAPGQLT

SEQ ID NO: 591498 - protein, 8 aa, Mycobacterium
TDDDAPRR

SEQ ID NO: 591499 - protein, 9 aa, Mycobacterium
TDDDAPRRI

SEQ ID NO: 591500 - protein, 8 aa, Mycobacterium
TDDDDAVR

SEQ ID NO: 591501 - protein, 7 aa, Mycobacterium
TDDDGAE

SEQ ID NO: 591502 - protein, 9 aa, Mycobacterium
TDDDGMGGN

SEQ ID NO: 591503 - protein, 10 aa, Mycobacterium
TDDDGQQRVS

SEQ ID NO: 591504 - protein, 20 aa, Mycobacterium
TDDDGRLRTPGVAPNTLTST

SEQ ID NO: 591505 - protein, 12 aa, Mycobacterium
TDDDGRTMSDQE

SEQ ID NO: 591506 - protein, 9 aa, Mycobacterium
TDDDNVRSA

SEQ ID NO: 591507 - protein, 9 aa, Mycobacterium
TDDDPRFNN

SEQ ID NO: 591508 - protein, 5 aa, Mycobacterium
TDDDQ

SEQ ID NO: 591509 - protein, 9 aa, Mycobacterium
TDDDRQKAV

SEQ ID NO: 591510 - protein, 7 aa, Mycobacterium
TDDDSIA

SEQ ID NO: 591511 - protein, 5 aa, Mycobacterium
TDDEA

SEQ ID NO: 591512 - protein, 6 aa, Mycobacterium
TDDEAA

SEQ ID NO: 591513 - protein, 6 aa, Mycobacterium
TDDEAK

SEQ ID NO: 591514 - protein, 7 aa, Mycobacterium
TDDEARQ

SEQ ID NO: 591515 - protein, 5 aa, Mycobacterium
TDDEG

SEQ ID NO: 591516 - protein, 16 aa, Mycobacterium
TDDEGAEIITFAFQPV

SEQ ID NO: 591517 - protein, 15 aa, Mycobacterium
TDDEGNEVVTFAFQP

SEQ ID NO: 591518 - protein, 5 aa, Mycobacterium
TDDEL

SEQ ID NO: 591519 - protein, 14 aa, Mycobacterium
TDDELKDKLRESKE

SEQ ID NO: 591520 - protein, 8 aa, Mycobacterium
TDDENLRT

SEQ ID NO: 591521 - protein, 25 aa, Mycobacterium
TDDEQAELRRTPAITGADYERGERP

SEQ ID NO: 591522 - protein, 6 aa, Mycobacterium
TDDERD

SEQ ID NO: 591523 - protein, 7 aa, Mycobacterium
TDDERDA

SEQ ID NO: 591524 - protein, 22 aa, Mycobacterium
TDDESVIDTGPDRLPPGWSDRT

SEQ ID NO: 591525 - protein, 6 aa, Mycobacterium
TDDEVA

SEQ ID NO: 591526 - protein, 5 aa, Mycobacterium
TDDFP

SEQ ID NO: 591527 - protein, 6 aa, Mycobacterium
TDDFPE

SEQ ID NO: 591528 - protein, 4 aa, Mycobacterium
TDDG

SEQ ID NO: 591529 - protein, 5 aa, Mycobacterium
TDDGA

SEQ ID NO: 591530 - protein, 18 aa, Mycobacterium
TDDGADGTPDDSLPPDDV

SEQ ID NO: 591531 - protein, 9 aa, Mycobacterium
TDDGDEFTA

SEQ ID NO: 591532 - protein, 11 aa, Mycobacterium
TDDGDQSTQME

SEQ ID NO: 591533 - protein, 5 aa, Mycobacterium
TDDGE

SEQ ID NO: 591534 - protein, 7 aa, Mycobacterium
TDDGGLS

SEQ ID NO: 591535 - protein, 9 aa, Mycobacterium
TDDGGPGSV

SEQ ID NO: 591536 - protein, 7 aa, Mycobacterium
TDDGHTV

SEQ ID NO: 591537 - protein, 6 aa, Mycobacterium
TDDGID

SEQ ID NO: 591538 - protein, 10 aa, Mycobacterium
TDDGLGPTGE

SEQ ID NO: 591539 - protein, 5 aa, Mycobacterium
TDDGQ

SEQ ID NO: 591540 - protein, 8 aa, Mycobacterium
TDDGRGET

SEQ ID NO: 591541 - protein, 8 aa, Mycobacterium
TDDGRGIA

SEQ ID NO: 591542 - protein, 9 aa, Mycobacterium
TDDGRPPAS

SEQ ID NO: 591543 - protein, 9 aa, Mycobacterium
TDDGRRKLE

SEQ ID NO: 591544 - protein, 7 aa, Mycobacterium
TDDGSGT

SEQ ID NO: 591545 - protein, 9 aa, Mycobacterium
TDDGSGTWG

SEQ ID NO: 591546 - protein, 9 aa, Mycobacterium
TDDGSWKTK

SEQ ID NO: 591547 - protein, 9 aa, Mycobacterium
TDDGTGAWS

SEQ ID NO: 591548 - protein, 24 aa, Mycobacterium
TDDGTGPDPVTEIEPSSIGKHTKP

SEQ ID NO: 591549 - protein, 24 aa, Mycobacterium
TDDGVPSPSQYDPERNRHRDPRGW

SEQ ID NO: 591550 - protein, 7 aa, Mycobacterium
TDDHPGY

SEQ ID NO: 591551 - protein, 7 aa, Mycobacterium
TDDHTVP

SEQ ID NO: 591552 - protein, 5 aa, Mycobacterium
TDDIA

SEQ ID NO: 591553 - protein, 7 aa, Mycobacterium
TDDIPEG

SEQ ID NO: 591554 - protein, 8 aa, Mycobacterium
TDDIPEHG

SEQ ID NO: 591555 - protein, 5 aa, Mycobacterium
TDDIT

SEQ ID NO: 591556 - protein, 6 aa, Mycobacterium
TDDKDL

SEQ ID NO: 591557 - protein, 7 aa, Mycobacterium
TDDKLKE

SEQ ID NO: 591558 - protein, 9 aa, Mycobacterium
TDDKLRDTL

SEQ ID NO: 591559 - protein, 4 aa, Mycobacterium
TDDL

SEQ ID NO: 591560 - protein, 11 aa, Mycobacterium
TDDLAKAQGIP

SEQ ID NO: 591561 - protein, 11 aa, Mycobacterium
TDDLTDARGAA

SEQ ID NO: 591562 - protein, 9 aa, Mycobacterium
TDDLTSEDT

SEQ ID NO: 591563 - protein, 6 aa, Mycobacterium
TDDNED

SEQ ID NO: 591564 - protein, 8 aa, Mycobacterium
TDDNTTAV

SEQ ID NO: 591565 - protein, 4 aa, Mycobacterium
TDDP

SEQ ID NO: 591566 - protein, 7 aa, Mycobacterium
TDDPAAL

SEQ ID NO: 591567 - protein, 7 aa, Mycobacterium
TDDPADL

SEQ ID NO: 591568 - protein, 10 aa, Mycobacterium
TDDPAEGAGF

SEQ ID NO: 591569 - protein, 8 aa, Mycobacterium
TDDPARMA

SEQ ID NO: 591570 - protein, 25 aa, Mycobacterium
TDDPDARFATGNALRGKASRGGGER

SEQ ID NO: 591571 - protein, 10 aa, Mycobacterium
TDDPDENRRL

SEQ ID NO: 591572 - protein, 10 aa, Mycobacterium
TDDPDNRFAP

SEQ ID NO: 591573 - protein, 9 aa, Mycobacterium
TDDPDPWNP

SEQ ID NO: 591574 - protein, 9 aa, Mycobacterium
TDDPEARFA

SEQ ID NO: 591575 - protein, 6 aa, Mycobacterium
TDDPEH

SEQ ID NO: 591576 - protein, 7 aa, Mycobacterium
TDDPEHH

SEQ ID NO: 591577 - protein, 6 aa, Mycobacterium
TDDPEL

SEQ ID NO: 591578 - protein, 6 aa, Mycobacterium
TDDPEY

SEQ ID NO: 591579 - protein, 9 aa, Mycobacterium
TDDPGALPD

SEQ ID NO: 591580 - protein, 25 aa, Mycobacterium
TDDPGARFAPGNTLRGRASRGGGER

SEQ ID NO: 591581 - protein, 10 aa, Mycobacterium
TDDPGTKQTA

SEQ ID NO: 591582 - protein, 8 aa, Mycobacterium
TDDPHAYR

SEQ ID NO: 591583 - protein, 11 aa, Mycobacterium
TDDPKTSEDNA

SEQ ID NO: 591584 - protein, 7 aa, Mycobacterium
TDDPLRR

SEQ ID NO: 591585 - protein, 22 aa, Mycobacterium
TDDPPERRHSRGIANAPARGGR

SEQ ID NO: 591586 - protein, 10 aa, Mycobacterium
TDDPQDLATT

SEQ ID NO: 591587 - protein, 7 aa, Mycobacterium
TDDPQVN

SEQ ID NO: 591588 - protein, 8 aa, Mycobacterium
TDDPREPR

SEQ ID NO: 591589 - protein, 9 aa, Mycobacterium
TDDPRLNPA

SEQ ID NO: 591590 - protein, 7 aa, Mycobacterium
TDDPRVN

SEQ ID NO: 591591 - protein, 14 aa, Mycobacterium
TDDPSNDVLPAPVD

SEQ ID NO: 591592 - protein, 9 aa, Mycobacterium
TDDPSSRRV

SEQ ID NO: 591593 - protein, 14 aa, Mycobacterium
TDDPTVTDGPYPTA

SEQ ID NO: 591594 - protein, 5 aa, Mycobacterium
TDDPV

SEQ ID NO: 591595 - protein, 14 aa, Mycobacterium
TDDPVGGARGVVVD

SEQ ID NO: 591596 - protein, 5 aa, Mycobacterium
TDDQA

SEQ ID NO: 591597 - protein, 12 aa, Mycobacterium
TDDQGARFYLGE

SEQ ID NO: 591598 - protein, 10 aa, Mycobacterium
TDDQGRKEGS

SEQ ID NO: 591599 - protein, 6 aa, Mycobacterium
TDDQRE

SEQ ID NO: 591600 - protein, 7 aa, Mycobacterium
TDDQRRR

SEQ ID NO: 591601 - protein, 9 aa, Mycobacterium
TDDQTEGMN

SEQ ID NO: 591602 - protein, 6 aa, Mycobacterium
TDDQWS

SEQ ID NO: 591603 - protein, 7 aa, Mycobacterium
TDDRARQ

SEQ ID NO: 591604 - protein, 8 aa, Mycobacterium
TDDRGDPV

SEQ ID NO: 591605 - protein, 7 aa, Mycobacterium
TDDRGDS

SEQ ID NO: 591606 - protein, 7 aa, Mycobacterium
TDDRGRR

SEQ ID NO: 591607 - protein, 7 aa, Mycobacterium
TDDRNRE

SEQ ID NO: 591608 - protein, 5 aa, Mycobacterium
TDDRQ

SEQ ID NO: 591609 - protein, 8 aa, Mycobacterium
TDDRQSLE

SEQ ID NO: 591610 - protein, 6 aa, Mycobacterium
TDDRRA

SEQ ID NO: 591611 - protein, 8 aa, Mycobacterium
TDDRRKAL

SEQ ID NO: 591612 - protein, 9 aa, Mycobacterium
TDDSDDLAR

SEQ ID NO: 591613 - protein, 5 aa, Mycobacterium
TDDSL

SEQ ID NO: 591614 - protein, 8 aa, Mycobacterium
TDDSVAVG

SEQ ID NO: 591615 - protein, 15 aa, Mycobacterium
TDDTDAGAAKAAELG

SEQ ID NO: 591616 - protein, 15 aa, Mycobacterium
TDDTGGYPAAAEPNT

SEQ ID NO: 591617 - protein, 6 aa, Mycobacterium
TDDTGT

SEQ ID NO: 591618 - protein, 6 aa, Mycobacterium
TDDTKL

SEQ ID NO: 591619 - protein, 6 aa, Mycobacterium
TDDVPD

SEQ ID NO: 591620 - protein, 10 aa, Mycobacterium
TDEAAAADAI

SEQ ID NO: 591621 - protein, 12 aa, Mycobacterium
TDEAAERRKKWS

SEQ ID NO: 591622 - protein, 12 aa, Mycobacterium
TDEAAERRRKWS

SEQ ID NO: 591623 - protein, 9 aa, Mycobacterium
TDEAEKYSK

SEQ ID NO: 591624 - protein, 5 aa, Mycobacterium
TDEAG

SEQ ID NO: 591625 - protein, 8 aa, Mycobacterium
TDEAGSRR

SEQ ID NO: 591626 - protein, 6 aa, Mycobacterium
TDEAHG

SEQ ID NO: 591627 - protein, 9 aa, Mycobacterium
TDEAQRPRP

SEQ ID NO: 591628 - protein, 7 aa, Mycobacterium
TDEAREA

SEQ ID NO: 591629 - protein, 8 aa, Mycobacterium
TDEAREAL

SEQ ID NO: 591630 - protein, 5 aa, Mycobacterium
TDEAS

SEQ ID NO: 591631 - protein, 5 aa, Mycobacterium
TDEDA

SEQ ID NO: 591632 - protein, 10 aa, Mycobacterium
TDEDAQRVRR

SEQ ID NO: 591633 - protein, 7 aa, Mycobacterium
TDEDDQA

SEQ ID NO: 591634 - protein, 10 aa, Mycobacterium
TDEDEQDYID

SEQ ID NO: 591635 - protein, 17 aa, Mycobacterium
TDEDGFRAEARQGREMG

SEQ ID NO: 591636 - protein, 7 aa, Mycobacterium
TDEDGRV

SEQ ID NO: 591637 - protein, 10 aa, Mycobacterium
TDEDTDDRRA

SEQ ID NO: 591638 - protein, 5 aa, Mycobacterium
TDEDV

SEQ ID NO: 591639 - protein, 4 aa, Mycobacterium
TDEE

SEQ ID NO: 591640 - protein, 7 aa, Mycobacterium
TDEEAYR

SEQ ID NO: 591641 - protein, 6 aa, Mycobacterium
TDEEDC

SEQ ID NO: 591642 - protein, 8 aa, Mycobacterium
TDEEFGEP

SEQ ID NO: 591643 - protein, 5 aa, Mycobacterium
TDEEL

SEQ ID NO: 591644 - protein, 14 aa, Mycobacterium
TDEELTERLRESKE

SEQ ID NO: 591645 - protein, 6 aa, Mycobacterium
TDEEQV

SEQ ID NO: 591646 - protein, 5 aa, Mycobacterium
TDEER

SEQ ID NO: 591647 - protein, 6 aa, Mycobacterium
TDEERA

SEQ ID NO: 591648 - protein, 6 aa, Mycobacterium
TDEERH

SEQ ID NO: 591649 - protein, 9 aa, Mycobacterium
TDEERQANT

SEQ ID NO: 591650 - protein, 4 aa, Mycobacterium
TDEF

SEQ ID NO: 591651 - protein, 15 aa, Mycobacterium
TDEFGGSLANRAKVA

SEQ ID NO: 591652 - protein, 10 aa, Mycobacterium
TDEFKSAQDL

SEQ ID NO: 591653 - protein, 6 aa, Mycobacterium
TDEFPE

SEQ ID NO: 591654 - protein, 11 aa, Mycobacterium
TDEGAAKPHRN

SEQ ID NO: 591655 - protein, 8 aa, Mycobacterium
TDEGADTH

SEQ ID NO: 591656 - protein, 7 aa, Mycobacterium
TDEGAQF

SEQ ID NO: 591657 - protein, 16 aa, Mycobacterium
TDEGGFRAEAQHGREM

SEQ ID NO: 591658 - protein, 5 aa, Mycobacterium
TDEGL

SEQ ID NO: 591659 - protein, 11 aa, Mycobacterium
TDEGNNYAGRD

SEQ ID NO: 591660 - protein, 6 aa, Mycobacterium
TDEGRA

SEQ ID NO: 591661 - protein, 7 aa, Mycobacterium
TDEGRAA

SEQ ID NO: 591662 - protein, 6 aa, Mycobacterium
TDEGTH

SEQ ID NO: 591663 - protein, 5 aa, Mycobacterium
TDEGV

SEQ ID NO: 591664 - protein, 5 aa, Mycobacterium
TDEHA

SEQ ID NO: 591665 - protein, 5 aa, Mycobacterium
TDEHG

SEQ ID NO: 591666 - protein, 9 aa, Mycobacterium
TDEHGRRAL

SEQ ID NO: 591667 - protein, 11 aa, Mycobacterium
TDEHKQLDGWG

SEQ ID NO: 591668 - protein, 13 aa, Mycobacterium
TDEHPRADTSVEA

SEQ ID NO: 591669 - protein, 13 aa, Mycobacterium
TDEHPRADTSVES

SEQ ID NO: 591670 - protein, 13 aa, Mycobacterium
TDEHPRADTTLES

SEQ ID NO: 591671 - protein, 13 aa, Mycobacterium
TDEHPRDTTPDAL

SEQ ID NO: 591672 - protein, 6 aa, Mycobacterium
TDEIGR

SEQ ID NO: 591673 - protein, 10 aa, Mycobacterium
TDEKNAEDHE

SEQ ID NO: 591674 - protein, 12 aa, Mycobacterium
TDENADPSAVAG

SEQ ID NO: 591675 - protein, 5 aa, Mycobacterium
TDEND

SEQ ID NO: 591676 - protein, 15 aa, Mycobacterium
TDENGAATPVNAGQG

SEQ ID NO: 591677 - protein, 8 aa, Mycobacterium
TDENGSNL

SEQ ID NO: 591678 - protein, 19 aa, Mycobacterium
TDEPAAAAAGTSRQGANSL

SEQ ID NO: 591679 - protein, 6 aa, Mycobacterium
TDEPAR

SEQ ID NO: 591680 - protein, 6 aa, Mycobacterium
TDEPDP

SEQ ID NO: 591681 - protein, 24 aa, Mycobacterium
TDEPDPDSQVYERSSAPPERTDVD

SEQ ID NO: 591682 - protein, 27 aa, Mycobacterium
TDEPDRRFTPGASLRAKRSRDGGTGRN

SEQ ID NO: 591683 - protein, 10 aa, Mycobacterium
TDEPGVTPGV

SEQ ID NO: 591684 - protein, 6 aa, Mycobacterium
TDEPVD

SEQ ID NO: 591685 - protein, 8 aa, Mycobacterium
TDEPVDAQ

SEQ ID NO: 591686 - protein, 5 aa, Mycobacterium
TDEQA

SEQ ID NO: 591687 - protein, 6 aa, Mycobacterium
TDEQAI

SEQ ID NO: 591688 - protein, 8 aa, Mycobacterium
TDEQARAD

SEQ ID NO: 591689 - protein, 12 aa, Mycobacterium
TDEQARSTPSVS

SEQ ID NO: 591690 - protein, 13 aa, Mycobacterium
TDEQFRNAQPDLS

SEQ ID NO: 591691 - protein, 8 aa, Mycobacterium
TDEQGNPR

SEQ ID NO: 591692 - protein, 6 aa, Mycobacterium
TDEQKA

SEQ ID NO: 591693 - protein, 6 aa, Mycobacterium
TDEQKK

SEQ ID NO: 591694 - protein, 7 aa, Mycobacterium
TDEQKKW

SEQ ID NO: 591695 - protein, 6 aa, Mycobacterium
TDEQKQ

SEQ ID NO: 591696 - protein, 7 aa, Mycobacterium
TDEQKQR

SEQ ID NO: 591697 - protein, 9 aa, Mycobacterium
TDEQLPPGA

SEQ ID NO: 591698 - protein, 7 aa, Mycobacterium
TDEQLRP

SEQ ID NO: 591699 - protein, 7 aa, Mycobacterium
TDEQQQE

SEQ ID NO: 591700 - protein, 11 aa, Mycobacterium
TDEQRARSARS

SEQ ID NO: 591701 - protein, 7 aa, Mycobacterium
TDEQRDG

SEQ ID NO: 591702 - protein, 7 aa, Mycobacterium
TDEQRDR

SEQ ID NO: 591703 - protein, 6 aa, Mycobacterium
TDEQRH

SEQ ID NO: 591704 - protein, 6 aa, Mycobacterium
TDEQRR

SEQ ID NO: 591705 - protein, 6 aa, Mycobacterium
TDEQRY

SEQ ID NO: 591706 - protein, 8 aa, Mycobacterium
TDEQTAQA

SEQ ID NO: 591707 - protein, 7 aa, Mycobacterium
TDERASE

SEQ ID NO: 591708 - protein, 9 aa, Mycobacterium
TDERGLGGR

SEQ ID NO: 591709 - protein, 10 aa, Mycobacterium
TDERGLGGRV

SEQ ID NO: 591710 - protein, 9 aa, Mycobacterium
TDERGTVPL

SEQ ID NO: 591711 - protein, 5 aa, Mycobacterium
TDERP

SEQ ID NO: 591712 - protein, 12 aa, Mycobacterium
TDERRGPRTGTE

SEQ ID NO: 591713 - protein, 6 aa, Mycobacterium
TDERSL

SEQ ID NO: 591714 - protein, 20 aa, Mycobacterium
TDERSREEHVTDPDRAREVG

SEQ ID NO: 591715 - protein, 6 aa, Mycobacterium
TDERTI

SEQ ID NO: 591716 - protein, 7 aa, Mycobacterium
TDERTIP

SEQ ID NO: 591717 - protein, 4 aa, Mycobacterium
TDES

SEQ ID NO: 591718 - protein, 9 aa, Mycobacterium
TDESGAKQV

SEQ ID NO: 591719 - protein, 11 aa, Mycobacterium
TDESGETHIPG

SEQ ID NO: 591720 - protein, 8 aa, Mycobacterium
TDESGRPH

SEQ ID NO: 591721 - protein, 24 aa, Mycobacterium
TDESGTYSGTAYPGSRPKSVAGTG

SEQ ID NO: 591722 - protein, 5 aa, Mycobacterium
TDESL

SEQ ID NO: 591723 - protein, 7 aa, Mycobacterium
TDESPFD

SEQ ID NO: 591724 - protein, 17 aa, Mycobacterium
TDESPFDPPLPRSEARG

SEQ ID NO: 591725 - protein, 9 aa, Mycobacterium
TDESPFNAP

SEQ ID NO: 591726 - protein, 7 aa, Mycobacterium
TDESPGF

SEQ ID NO: 591727 - protein, 8 aa, Mycobacterium
TDESPNEL

SEQ ID NO: 591728 - protein, 8 aa, Mycobacterium
TDESPTLN

SEQ ID NO: 591729 - protein, 23 aa, Mycobacterium
TDESRGVGQKRGGDESTGHASGR

SEQ ID NO: 591730 - protein, 8 aa, Mycobacterium
TDESTGRS

SEQ ID NO: 591731 - protein, 4 aa, Mycobacterium
TDET

SEQ ID NO: 591732 - protein, 7 aa, Mycobacterium
TDETAAD

SEQ ID NO: 591733 - protein, 8 aa, Mycobacterium
TDETGRYG

SEQ ID NO: 591734 - protein, 10 aa, Mycobacterium
TDETGSTNRL

SEQ ID NO: 591735 - protein, 14 aa, Mycobacterium
TDETLRDGTISDET

SEQ ID NO: 591736 - protein, 13 aa, Mycobacterium
TDETLRDGTISDG

SEQ ID NO: 591737 - protein, 13 aa, Mycobacterium
TDETQGMAGGQGQ

SEQ ID NO: 591738 - protein, 6 aa, Mycobacterium
TDETRA

SEQ ID NO: 591739 - protein, 6 aa, Mycobacterium
TDETTA

SEQ ID NO: 591740 - protein, 14 aa, Mycobacterium
TDETTALSGLPASA

SEQ ID NO: 591741 - protein, 7 aa, Mycobacterium
TDETTTQ

SEQ ID NO: 591742 - protein, 5 aa, Mycobacterium
TDETY

SEQ ID NO: 591743 - protein, 12 aa, Mycobacterium
TDEVGAKSVRNL

SEQ ID NO: 591744 - protein, 6 aa, Mycobacterium
TDEVGQ

SEQ ID NO: 591745 - protein, 7 aa, Mycobacterium
TDEVPEG

SEQ ID NO: 591746 - protein, 8 aa, Mycobacterium
TDEVQDRV

SEQ ID NO: 591747 - protein, 7 aa, Mycobacterium
TDFARPD

SEQ ID NO: 591748 - protein, 9 aa, Mycobacterium
TDFEGDPGQ

SEQ ID NO: 591749 - protein, 8 aa, Mycobacterium
TDFGEGPC

SEQ ID NO: 591750 - protein, 5 aa, Mycobacterium
TDFPD

SEQ ID NO: 591751 - protein, 10 aa, Mycobacterium
TDFPGGDSDE

SEQ ID NO: 591752 - protein, 11 aa, Mycobacterium
TDFPGGDSDEI

SEQ ID NO: 591753 - protein, 6 aa, Mycobacterium
TDFPPG

SEQ ID NO: 591754 - protein, 5 aa, Mycobacterium
TDFPS

SEQ ID NO: 591755 - protein, 4 aa, Mycobacterium
TDFS

SEQ ID NO: 591756 - protein, 10 aa, Mycobacterium
TDFSGVQTSP

SEQ ID NO: 591757 - protein, 5 aa, Mycobacterium
TDFTS

SEQ ID NO: 591758 - protein, 6 aa, Mycobacterium
TDGAAA

SEQ ID NO: 591759 - protein, 9 aa, Mycobacterium
TDGAAEDEL

SEQ ID NO: 591760 - protein, 12 aa, Mycobacterium
TDGAAGADEPFY

SEQ ID NO: 591761 - protein, 14 aa, Mycobacterium
TDGADSARGGVGQH

SEQ ID NO: 591762 - protein, 5 aa, Mycobacterium
TDGAE

SEQ ID NO: 591763 - protein, 13 aa, Mycobacterium
TDGAEETYGGPRS

SEQ ID NO: 591764 - protein, 17 aa, Mycobacterium
TDGAGFATDEGPRDTSL

SEQ ID NO: 591765 - protein, 12 aa, Mycobacterium
TDGAGKPGERTF

SEQ ID NO: 591766 - protein, 6 aa, Mycobacterium
TDGAGV

SEQ ID NO: 591767 - protein, 11 aa, Mycobacterium
TDGANVRRRPI

SEQ ID NO: 591768 - protein, 13 aa, Mycobacterium
TDGAQTRYRTPAR

SEQ ID NO: 591769 - protein, 6 aa, Mycobacterium
TDGAVG

SEQ ID NO: 591770 - protein, 4 aa, Mycobacterium
TDGD

SEQ ID NO: 591771 - protein, 6 aa, Mycobacterium
TDGDDI

SEQ ID NO: 591772 - protein, 9 aa, Mycobacterium
TDGDDTPWS

SEQ ID NO: 591773 - protein, 8 aa, Mycobacterium
TDGDEMAV

SEQ ID NO: 591774 - protein, 5 aa, Mycobacterium
TDGDG

SEQ ID NO: 591775 - protein, 10 aa, Mycobacterium
TDGDGAQATA

SEQ ID NO: 591776 - protein, 7 aa, Mycobacterium
TDGDGEA

SEQ ID NO: 591777 - protein, 9 aa, Mycobacterium
TDGDGGRQE

SEQ ID NO: 591778 - protein, 10 aa, Mycobacterium
TDGDGPKSRW

SEQ ID NO: 591779 - protein, 10 aa, Mycobacterium
TDGDGQERVS

SEQ ID NO: 591780 - protein, 14 aa, Mycobacterium
TDGDGYLYLRYLRD

SEQ ID NO: 591781 - protein, 6 aa, Mycobacterium
TDGDLA

SEQ ID NO: 591782 - protein, 10 aa, Mycobacterium
TDGDLTPSQT

SEQ ID NO: 591783 - protein, 5 aa, Mycobacterium
TDGDP

SEQ ID NO: 591784 - protein, 14 aa, Mycobacterium
TDGDPNNLTLPKSL

SEQ ID NO: 591785 - protein, 8 aa, Mycobacterium
TDGDRSWT

SEQ ID NO: 591786 - protein, 18 aa, Mycobacterium
TDGDSKAWYPGSEPFEYL

SEQ ID NO: 591787 - protein, 8 aa, Mycobacterium
TDGDTPGH

SEQ ID NO: 591788 - protein, 7 aa, Mycobacterium
TDGDVST

SEQ ID NO: 591789 - protein, 8 aa, Mycobacterium
TDGEKEFR

SEQ ID NO: 591790 - protein, 5 aa, Mycobacterium
TDGEP

SEQ ID NO: 591791 - protein, 7 aa, Mycobacterium
TDGEREF

SEQ ID NO: 591792 - protein, 8 aa, Mycobacterium
TDGESEFR

SEQ ID NO: 591793 - protein, 6 aa, Mycobacterium
TDGETL

SEQ ID NO: 591794 - protein, 22 aa, Mycobacterium
TDGETNASLRKGDDVATITDQR

SEQ ID NO: 591795 - protein, 24 aa, Mycobacterium
TDGETNASLRKGDEVASITDERAS

SEQ ID NO: 591796 - protein, 5 aa, Mycobacterium
TDGEV

SEQ ID NO: 591797 - protein, 6 aa, Mycobacterium
TDGEVT

SEQ ID NO: 591798 - protein, 7 aa, Mycobacterium
TDGEYRV

SEQ ID NO: 591799 - protein, 6 aa, Mycobacterium
TDGFDA

SEQ ID NO: 591800 - protein, 6 aa, Mycobacterium
TDGFSG

SEQ ID NO: 591801 - protein, 8 aa, Mycobacterium
TDGGDEFT

SEQ ID NO: 591802 - protein, 6 aa, Mycobacterium
TDGGDS

SEQ ID NO: 591803 - protein, 8 aa, Mycobacterium
TDGGESSL

SEQ ID NO: 591804 - protein, 6 aa, Mycobacterium
TDGGGA

SEQ ID NO: 591805 - protein, 13 aa, Mycobacterium
TDGGGLPGAARRP

SEQ ID NO: 591806 - protein, 8 aa, Mycobacterium
TDGGKEIT

SEQ ID NO: 591807 - protein, 9 aa, Mycobacterium
TDGGPEAAR

SEQ ID NO: 591808 - protein, 8 aa, Mycobacterium
TDGGPSAG

SEQ ID NO: 591809 - protein, 5 aa, Mycobacterium
TDGGR

SEQ ID NO: 591810 - protein, 6 aa, Mycobacterium
TDGGSV

SEQ ID NO: 591811 - protein, 6 aa, Mycobacterium
TDGGTE

SEQ ID NO: 591812 - protein, 9 aa, Mycobacterium
TDGGTETVT

SEQ ID NO: 591813 - protein, 8 aa, Mycobacterium
TDGGTYYT

SEQ ID NO: 591814 - protein, 9 aa, Mycobacterium
TDGHEPDAR

SEQ ID NO: 591815 - protein, 8 aa, Mycobacterium
TDGHEPNA

SEQ ID NO: 591816 - protein, 8 aa, Mycobacterium
TDGHGGVA

SEQ ID NO: 591817 - protein, 7 aa, Mycobacterium
TDGHTNE

SEQ ID NO: 591818 - protein, 5 aa, Mycobacterium
TDGIA

SEQ ID NO: 591819 - protein, 7 aa, Mycobacterium
TDGIATD

SEQ ID NO: 591820 - protein, 5 aa, Mycobacterium
TDGID

SEQ ID NO: 591821 - protein, 15 aa, Mycobacterium
TDGKGGPGDRTFRST

SEQ ID NO: 591822 - protein, 10 aa, Mycobacterium
TDGKSPAQIA

SEQ ID NO: 591823 - protein, 4 aa, Mycobacterium
TDGL

SEQ ID NO: 591824 - protein, 5 aa, Mycobacterium
TDGLD

SEQ ID NO: 591825 - protein, 5 aa, Mycobacterium
TDGLG

SEQ ID NO: 591826 - protein, 7 aa, Mycobacterium
TDGLGAD

SEQ ID NO: 591827 - protein, 5 aa, Mycobacterium
TDGLR

SEQ ID NO: 591828 - protein, 6 aa, Mycobacterium
TDGLSA

SEQ ID NO: 591829 - protein, 18 aa, Mycobacterium
TDGLSDPALTYRPTPDAN

SEQ ID NO: 591830 - protein, 12 aa, Mycobacterium
TDGLTAGAPSLV

SEQ ID NO: 591831 - protein, 18 aa, Mycobacterium
TDGLTEEVSSYRPTPEAN

SEQ ID NO: 591832 - protein, 5 aa, Mycobacterium
TDGMS

SEQ ID NO: 591833 - protein, 4 aa, Mycobacterium
TDGN

SEQ ID NO: 591834 - protein, 9 aa, Mycobacterium
TDGNGRTGR

SEQ ID NO: 591835 - protein, 5 aa, Mycobacterium
TDGNL

SEQ ID NO: 591836 - protein, 8 aa, Mycobacterium
TDGNPTGG

SEQ ID NO: 591837 - protein, 8 aa, Mycobacterium
TDGNTSLP

SEQ ID NO: 591838 - protein, 10 aa, Mycobacterium
TDGPARGESY

SEQ ID NO: 591839 - protein, 10 aa, Mycobacterium
TDGPCNPSRG

SEQ ID NO: 591840 - protein, 11 aa, Mycobacterium
TDGPPTPGDST

SEQ ID NO: 591841 - protein, 14 aa, Mycobacterium
TDGPPTTDDSTTVL

SEQ ID NO: 591842 - protein, 6 aa, Mycobacterium
TDGPSA

SEQ ID NO: 591843 - protein, 9 aa, Mycobacterium
TDGPSAQAA

SEQ ID NO: 591844 - protein, 10 aa, Mycobacterium
TDGPSRAADE

SEQ ID NO: 591845 - protein, 9 aa, Mycobacterium
TDGPTSHDG

SEQ ID NO: 591846 - protein, 13 aa, Mycobacterium
TDGPWESEQTHDS

SEQ ID NO: 591847 - protein, 13 aa, Mycobacterium
TDGPWESEQTHNS

SEQ ID NO: 591848 - protein, 5 aa, Mycobacterium
TDGQA

SEQ ID NO: 591849 - protein, 15 aa, Mycobacterium
TDGQGYGGGLPEGCP

SEQ ID NO: 591850 - protein, 15 aa, Mycobacterium
TDGQIGNNDSANDVR

SEQ ID NO: 591851 - protein, 10 aa, Mycobacterium
TDGQPGGSIY

SEQ ID NO: 591852 - protein, 13 aa, Mycobacterium
TDGQVKVSNVEFV

SEQ ID NO: 591853 - protein, 4 aa, Mycobacterium
TDGR

SEQ ID NO: 591854 - protein, 12 aa, Mycobacterium
TDGRAAGGHVDA

SEQ ID NO: 591855 - protein, 8 aa, Mycobacterium
TDGRDAEH

SEQ ID NO: 591856 - protein, 14 aa, Mycobacterium
TDGREQTPKSAEEI

SEQ ID NO: 591857 - protein, 5 aa, Mycobacterium
TDGRI

SEQ ID NO: 591858 - protein, 12 aa, Mycobacterium
TDGRLDRTRDPA

SEQ ID NO: 591859 - protein, 7 aa, Mycobacterium
TDGRLGG

SEQ ID NO: 591860 - protein, 6 aa, Mycobacterium
TDGRPL

SEQ ID NO: 591861 - protein, 12 aa, Mycobacterium
TDGRPLTPEQGR

SEQ ID NO: 591862 - protein, 11 aa, Mycobacterium
TDGRPVTQAPR

SEQ ID NO: 591863 - protein, 9 aa, Mycobacterium
TDGRQTAEQ

SEQ ID NO: 591864 - protein, 7 aa, Mycobacterium
TDGRRTE

SEQ ID NO: 591865 - protein, 16 aa, Mycobacterium
TDGRSGVGWMEWNRNQ

SEQ ID NO: 591866 - protein, 16 aa, Mycobacterium
TDGRVHNEDGNRLGEL

SEQ ID NO: 591867 - protein, 13 aa, Mycobacterium
TDGRVPLREYRHI

SEQ ID NO: 591868 - protein, 15 aa, Mycobacterium
TDGRYRTQAAEQAPG

SEQ ID NO: 591869 - protein, 15 aa, Mycobacterium
TDGRYRTQAAQQAPD

SEQ ID NO: 591870 - protein, 6 aa, Mycobacterium
TDGSAA

SEQ ID NO: 591871 - protein, 5 aa, Mycobacterium
TDGSD

SEQ ID NO: 591872 - protein, 11 aa, Mycobacterium
TDGSEALAGDF

SEQ ID NO: 591873 - protein, 8 aa, Mycobacterium
TDGSGGVG

SEQ ID NO: 591874 - protein, 7 aa, Mycobacterium
TDGSGRI

SEQ ID NO: 591875 - protein, 9 aa, Mycobacterium
TDGSPASEF

SEQ ID NO: 591876 - protein, 7 aa, Mycobacterium
TDGSPDL

SEQ ID NO: 591877 - protein, 8 aa, Mycobacterium
TDGSPLGT

SEQ ID NO: 591878 - protein, 7 aa, Mycobacterium
TDGSQVP

SEQ ID NO: 591879 - protein, 6 aa, Mycobacterium
TDGSRV

SEQ ID NO: 591880 - protein, 14 aa, Mycobacterium
TDGSTLAQASPPDM

SEQ ID NO: 591881 - protein, 7 aa, Mycobacterium
TDGTATV

SEQ ID NO: 591882 - protein, 8 aa, Mycobacterium
TDGTDDVG

SEQ ID NO: 591883 - protein, 8 aa, Mycobacterium
TDGTELTP

SEQ ID NO: 591884 - protein, 8 aa, Mycobacterium
TDGTGAER

SEQ ID NO: 591885 - protein, 12 aa, Mycobacterium
TDGTGPEVHGPG

SEQ ID NO: 591886 - protein, 5 aa, Mycobacterium
TDGTI

SEQ ID NO: 591887 - protein, 6 aa, Mycobacterium
TDGTIG

SEQ ID NO: 591888 - protein, 8 aa, Mycobacterium
TDGTPYKY

SEQ ID NO: 591889 - protein, 12 aa, Mycobacterium
TDGTRFQNNGTG

SEQ ID NO: 591890 - protein, 9 aa, Mycobacterium
TDGTRSPVD

SEQ ID NO: 591891 - protein, 7 aa, Mycobacterium
TDGTTAV

SEQ ID NO: 591892 - protein, 17 aa, Mycobacterium
TDGTVPNGGSVQYTGTN

SEQ ID NO: 591893 - protein, 8 aa, Mycobacterium
TDGTVRRV

SEQ ID NO: 591894 - protein, 4 aa, Mycobacterium
TDGV

SEQ ID NO: 591895 - protein, 7 aa, Mycobacterium
TDGVAPG

SEQ ID NO: 591896 - protein, 6 aa, Mycobacterium
TDGVPR

SEQ ID NO: 591897 - protein, 10 aa, Mycobacterium
TDGVPRSGAP

SEQ ID NO: 591898 - protein, 5 aa, Mycobacterium
TDGVT

SEQ ID NO: 591899 - protein, 9 aa, Mycobacterium
TDGVTSLPA

SEQ ID NO: 591900 - protein, 5 aa, Mycobacterium
TDGVV

SEQ ID NO: 591901 - protein, 4 aa, Mycobacterium
TDGY

SEQ ID NO: 591902 - protein, 9 aa, Mycobacterium
TDGYAASCD

SEQ ID NO: 591903 - protein, 10 aa, Mycobacterium
TDGYDPPKAV

SEQ ID NO: 591904 - protein, 9 aa, Mycobacterium
TDGYGSTEA

SEQ ID NO: 591905 - protein, 15 aa, Mycobacterium
TDGYSTYAGSKSPVE

SEQ ID NO: 591906 - protein, 12 aa, Mycobacterium
TDHADADTEEAA

SEQ ID NO: 591907 - protein, 6 aa, Mycobacterium
TDHAGA

SEQ ID NO: 591908 - protein, 7 aa, Mycobacterium
TDHAGAD

SEQ ID NO: 591909 - protein, 11 aa, Mycobacterium
TDHAVRGDERE

SEQ ID NO: 591910 - protein, 4 aa, Mycobacterium
TDHC

SEQ ID NO: 591911 - protein, 4 aa, Mycobacterium
TDHD

SEQ ID NO: 591912 - protein, 5 aa, Mycobacterium
TDHDY

SEQ ID NO: 591913 - protein, 5 aa, Mycobacterium
TDHGR

SEQ ID NO: 591914 - protein, 14 aa, Mycobacterium
TDHNSGQLRNKTGP

SEQ ID NO: 591915 - protein, 8 aa, Mycobacterium
TDHPADPS

SEQ ID NO: 591916 - protein, 13 aa, Mycobacterium
TDHPDADTEEAAS

SEQ ID NO: 591917 - protein, 12 aa, Mycobacterium
TDHPDAGTEEAA

SEQ ID NO: 591918 - protein, 6 aa, Mycobacterium
TDHPEQ

SEQ ID NO: 591919 - protein, 9 aa, Mycobacterium
TDHPKRLDR

SEQ ID NO: 591920 - protein, 13 aa, Mycobacterium
TDHPNADTEQAAS

SEQ ID NO: 591921 - protein, 6 aa, Mycobacterium
TDHPSA

SEQ ID NO: 591922 - protein, 6 aa, Mycobacterium
TDHPYR

SEQ ID NO: 591923 - protein, 6 aa, Mycobacterium
TDHQGY

SEQ ID NO: 591924 - protein, 7 aa, Mycobacterium
TDHQRAT

SEQ ID NO: 591925 - protein, 8 aa, Mycobacterium
TDHRDGAD

SEQ ID NO: 591926 - protein, 14 aa, Mycobacterium
TDHREGSKGTIEGP

SEQ ID NO: 591927 - protein, 5 aa, Mycobacterium
TDHRP

SEQ ID NO: 591928 - protein, 6 aa, Mycobacterium
TDHRPV

SEQ ID NO: 591929 - protein, 7 aa, Mycobacterium
TDHSGRE

SEQ ID NO: 591930 - protein, 12 aa, Mycobacterium
TDHTDADTEEAA

SEQ ID NO: 591931 - protein, 5 aa, Mycobacterium
TDHTG

SEQ ID NO: 591932 - protein, 9 aa, Mycobacterium
TDHTQGANG

SEQ ID NO: 591933 - protein, 4 aa, Mycobacterium
TDIA

SEQ ID NO: 591934 - protein, 6 aa, Mycobacterium
TDIAGA

SEQ ID NO: 591935 - protein, 11 aa, Mycobacterium
TDIAGANAARL

SEQ ID NO: 591936 - protein, 9 aa, Mycobacterium
TDIATPSEL

SEQ ID NO: 591937 - protein, 9 aa, Mycobacterium
TDIDADDGS

SEQ ID NO: 591938 - protein, 14 aa, Mycobacterium
TDIDDGGVVSPGGV

SEQ ID NO: 591939 - protein, 9 aa, Mycobacterium
TDIEGAHAA

SEQ ID NO: 591940 - protein, 11 aa, Mycobacterium
TDIEGANAAGL

SEQ ID NO: 591941 - protein, 5 aa, Mycobacterium
TDIEL

SEQ ID NO: 591942 - protein, 4 aa, Mycobacterium
TDIG

SEQ ID NO: 591943 - protein, 13 aa, Mycobacterium
TDIGRGRHTSTQS

SEQ ID NO: 591944 - protein, 8 aa, Mycobacterium
TDIPDRDL

SEQ ID NO: 591945 - protein, 11 aa, Mycobacterium
TDIPGTLESKS

SEQ ID NO: 591946 - protein, 12 aa, Mycobacterium
TDIPPATPDDLA

SEQ ID NO: 591947 - protein, 7 aa, Mycobacterium
TDIQTQR

SEQ ID NO: 591948 - protein, 6 aa, Mycobacterium
TDIRAG

SEQ ID NO: 591949 - protein, 5 aa, Mycobacterium
TDIRD

SEQ ID NO: 591950 - protein, 9 aa, Mycobacterium
TDIRDDEQV

SEQ ID NO: 591951 - protein, 6 aa, Mycobacterium
TDIRDP

SEQ ID NO: 591952 - protein, 14 aa, Mycobacterium
TDIRDPGAVAQEYP

SEQ ID NO: 591953 - protein, 9 aa, Mycobacterium
TDIRDPQKI

SEQ ID NO: 591954 - protein, 9 aa, Mycobacterium
TDIRDPQTI

SEQ ID NO: 591955 - protein, 6 aa, Mycobacterium
TDIREP

SEQ ID NO: 591956 - protein, 16 aa, Mycobacterium
TDISDQLDERESASNL

SEQ ID NO: 591957 - protein, 6 aa, Mycobacterium
TDISDT

SEQ ID NO: 591958 - protein, 9 aa, Mycobacterium
TDISTDHTG

SEQ ID NO: 591959 - protein, 7 aa, Mycobacterium
TDISVPK

SEQ ID NO: 591960 - protein, 9 aa, Mycobacterium
TDITDEASV

SEQ ID NO: 591961 - protein, 8 aa, Mycobacterium
TDKAALDG

SEQ ID NO: 591962 - protein, 7 aa, Mycobacterium
TDKDANW

SEQ ID NO: 591963 - protein, 7 aa, Mycobacterium
TDKEAIE

SEQ ID NO: 591964 - protein, 12 aa, Mycobacterium
TDKEPGEVVRET

SEQ ID NO: 591965 - protein, 8 aa, Mycobacterium
TDKGIPGA

SEQ ID NO: 591966 - protein, 6 aa, Mycobacterium
TDKGQA

SEQ ID NO: 591967 - protein, 13 aa, Mycobacterium
TDKGRAEATRAGE

SEQ ID NO: 591968 - protein, 11 aa, Mycobacterium
TDKGRAEAVRG

SEQ ID NO: 591969 - protein, 11 aa, Mycobacterium
TDKGRTEAVRS

SEQ ID NO: 591970 - protein, 6 aa, Mycobacterium
TDKGVD

SEQ ID NO: 591971 - protein, 8 aa, Mycobacterium
TDKPGALT

SEQ ID NO: 591972 - protein, 14 aa, Mycobacterium
TDKPRMGNQGTSVA

SEQ ID NO: 591973 - protein, 8 aa, Mycobacterium
TDKQRDRL

SEQ ID NO: 591974 - protein, 5 aa, Mycobacterium
TDKRA

SEQ ID NO: 591975 - protein, 20 aa, Mycobacterium
TDKRCGAAARPAHPPPHPSH

SEQ ID NO: 591976 - protein, 22 aa, Mycobacterium
TDKRKGYEERARAARGVVEGSQ

SEQ ID NO: 591977 - protein, 8 aa, Mycobacterium
TDKRTGES

SEQ ID NO: 591978 - protein, 10 aa, Mycobacterium
TDKSASDYFN

SEQ ID NO: 591979 - protein, 7 aa, Mycobacterium
TDKSQID

SEQ ID NO: 591980 - protein, 8 aa, Mycobacterium
TDKSQIDD

SEQ ID NO: 591981 - protein, 8 aa, Mycobacterium
TDKSQIDS

SEQ ID NO: 591982 - protein, 8 aa, Mycobacterium
TDKSQIEE

SEQ ID NO: 591983 - protein, 8 aa, Mycobacterium
TDKSRDGL

SEQ ID NO: 591984 - protein, 18 aa, Mycobacterium
TDKSTSPKGAAPQTTDEI

SEQ ID NO: 591985 - protein, 7 aa, Mycobacterium
TDKSYAA

SEQ ID NO: 591986 - protein, 8 aa, Mycobacterium
TDKSYTAT

SEQ ID NO: 591987 - protein, 13 aa, Mycobacterium
TDKVDTEIPSPAA

SEQ ID NO: 591988 - protein, 14 aa, Mycobacterium
TDKVDTEIPSPAAG

SEQ ID NO: 591989 - protein, 6 aa, Mycobacterium
TDKYGG

SEQ ID NO: 591990 - protein, 4 aa, Mycobacterium
TDLA

SEQ ID NO: 591991 - protein, 9 aa, Mycobacterium
TDLADPDSF

SEQ ID NO: 591992 - protein, 5 aa, Mycobacterium
TDLAG

SEQ ID NO: 591993 - protein, 6 aa, Mycobacterium
TDLAGL

SEQ ID NO: 591994 - protein, 7 aa, Mycobacterium
TDLAPSA

SEQ ID NO: 591995 - protein, 6 aa, Mycobacterium
TDLDGI

SEQ ID NO: 591996 - protein, 14 aa, Mycobacterium
TDLDPASKLEHPNA

SEQ ID NO: 591997 - protein, 21 aa, Mycobacterium
TDLDPGCPPVRPAPPTAPPVA

SEQ ID NO: 591998 - protein, 7 aa, Mycobacterium
TDLDPGG

SEQ ID NO: 591999 - protein, 7 aa, Mycobacterium
TDLDPSP

SEQ ID NO: 592000 - protein, 5 aa, Mycobacterium
TDLEA

SEQ ID NO: 592001 - protein, 12 aa, Mycobacterium
TDLERTNVHGSG

SEQ ID NO: 592002 - protein, 7 aa, Mycobacterium
TDLGAKA

SEQ ID NO: 592003 - protein, 16 aa, Mycobacterium
TDLGARRAAEVGGTTT

SEQ ID NO: 592004 - protein, 11 aa, Mycobacterium
TDLGPADGGPV

SEQ ID NO: 592005 - protein, 6 aa, Mycobacterium
TDLGRS

SEQ ID NO: 592006 - protein, 18 aa, Mycobacterium
TDLPAASVAGGSSGMTSW

SEQ ID NO: 592007 - protein, 6 aa, Mycobacterium
TDLPDD

SEQ ID NO: 592008 - protein, 5 aa, Mycobacterium
TDLPE

SEQ ID NO: 592009 - protein, 5 aa, Mycobacterium
TDLPG

SEQ ID NO: 592010 - protein, 9 aa, Mycobacterium
TDLPGGNHQ

SEQ ID NO: 592011 - protein, 6 aa, Mycobacterium
TDLPPE

SEQ ID NO: 592012 - protein, 8 aa, Mycobacterium
TDLPPRAR

SEQ ID NO: 592013 - protein, 7 aa, Mycobacterium
TDLPRAT

SEQ ID NO: 592014 - protein, 6 aa, Mycobacterium
TDLPRG

SEQ ID NO: 592015 - protein, 7 aa, Mycobacterium
TDLQSYQ

SEQ ID NO: 592016 - protein, 4 aa, Mycobacterium
TDLR

SEQ ID NO: 592017 - protein, 8 aa, Mycobacterium
TDLRDPDA

SEQ ID NO: 592018 - protein, 11 aa, Mycobacterium
TDLRDPDTLTG

SEQ ID NO: 592019 - protein, 6 aa, Mycobacterium
TDLRPA

SEQ ID NO: 592020 - protein, 5 aa, Mycobacterium
TDLRR

SEQ ID NO: 592021 - protein, 9 aa, Mycobacterium
TDLSELSDA

SEQ ID NO: 592022 - protein, 17 aa, Mycobacterium
TDLSNPPAGMAPGRAEN

SEQ ID NO: 592023 - protein, 7 aa, Mycobacterium
TDLSPND

SEQ ID NO: 592024 - protein, 8 aa, Mycobacterium
TDLSTQPW

SEQ ID NO: 592025 - protein, 7 aa, Mycobacterium
TDLTGEH

SEQ ID NO: 592026 - protein, 11 aa, Mycobacterium
TDLTKGMDPEY

SEQ ID NO: 592027 - protein, 6 aa, Mycobacterium
TDLTPD

SEQ ID NO: 592028 - protein, 16 aa, Mycobacterium
TDLTPNPRNPRDDLGD

SEQ ID NO: 592029 - protein, 18 aa, Mycobacterium
TDLTVSPGAGDDDASTVD

SEQ ID NO: 592030 - protein, 4 aa, Mycobacterium
TDLV

SEQ ID NO: 592031 - protein, 8 aa, Mycobacterium
TDMADPEL

SEQ ID NO: 592032 - protein, 6 aa, Mycobacterium
TDMARS

SEQ ID NO: 592033 - protein, 4 aa, Mycobacterium
TDMD

SEQ ID NO: 592034 - protein, 7 aa, Mycobacterium
TDMGEDE

SEQ ID NO: 592035 - protein, 8 aa, Mycobacterium
TDMHTGKG

SEQ ID NO: 592036 - protein, 4 aa, Mycobacterium
TDMP

SEQ ID NO: 592037 - protein, 7 aa, Mycobacterium
TDMPDGL

SEQ ID NO: 592038 - protein, 7 aa, Mycobacterium
TDMPTTC

SEQ ID NO: 592039 - protein, 8 aa, Mycobacterium
TDMREPDA

SEQ ID NO: 592040 - protein, 4 aa, Mycobacterium
TDMT

SEQ ID NO: 592041 - protein, 11 aa, Mycobacterium
TDMTPDNGDDM

SEQ ID NO: 592042 - protein, 8 aa, Mycobacterium
TDNADNDF

SEQ ID NO: 592043 - protein, 7 aa, Mycobacterium
TDNDAVD

SEQ ID NO: 592044 - protein, 7 aa, Mycobacterium
TDNDNDL

SEQ ID NO: 592045 - protein, 17 aa, Mycobacterium
TDNDNPAGASRPFDKNR

SEQ ID NO: 592046 - protein, 5 aa, Mycobacterium
TDNDP

SEQ ID NO: 592047 - protein, 7 aa, Mycobacterium
TDNDQID

SEQ ID NO: 592048 - protein, 7 aa, Mycobacterium
TDNDVAR

SEQ ID NO: 592049 - protein, 12 aa, Mycobacterium
TDNEETLSPSTN

SEQ ID NO: 592050 - protein, 9 aa, Mycobacterium
TDNEISERA

SEQ ID NO: 592051 - protein, 4 aa, Mycobacterium
TDNF

SEQ ID NO: 592052 - protein, 4 aa, Mycobacterium
TDNG

SEQ ID NO: 592053 - protein, 8 aa, Mycobacterium
TDNGETSL

SEQ ID NO: 592054 - protein, 27 aa, Mycobacterium
TDNGPHANTWPDGATTPFRSEKNTNWE

SEQ ID NO: 592055 - protein, 5 aa, Mycobacterium
TDNGV

SEQ ID NO: 592056 - protein, 20 aa, Mycobacterium
TDNHPKATYRSTAVRPEGDD

SEQ ID NO: 592057 - protein, 4 aa, Mycobacterium
TDNI

SEQ ID NO: 592058 - protein, 5 aa, Mycobacterium
TDNLT

SEQ ID NO: 592059 - protein, 7 aa, Mycobacterium
TDNNGGY

SEQ ID NO: 592060 - protein, 21 aa, Mycobacterium
TDNPAEAAKAHREKRAPKWDP

SEQ ID NO: 592061 - protein, 6 aa, Mycobacterium
TDNPDI

SEQ ID NO: 592062 - protein, 7 aa, Mycobacterium
TDNPDRD

SEQ ID NO: 592063 - protein, 11 aa, Mycobacterium
TDNPDSIEDKN

SEQ ID NO: 592064 - protein, 8 aa, Mycobacterium
TDNPDSPH

SEQ ID NO: 592065 - protein, 6 aa, Mycobacterium
TDNPED

SEQ ID NO: 592066 - protein, 9 aa, Mycobacterium
TDNPLPDPA

SEQ ID NO: 592067 - protein, 8 aa, Mycobacterium
TDNPQGIE

SEQ ID NO: 592068 - protein, 7 aa, Mycobacterium
TDNPQLR

SEQ ID NO: 592069 - protein, 6 aa, Mycobacterium
TDNPVR

SEQ ID NO: 592070 - protein, 4 aa, Mycobacterium
TDNQ

SEQ ID NO: 592071 - protein, 7 aa, Mycobacterium
TDNQGAD

SEQ ID NO: 592072 - protein, 5 aa, Mycobacterium
TDNQY

SEQ ID NO: 592073 - protein, 4 aa, Mycobacterium
TDNR

SEQ ID NO: 592074 - protein, 7 aa, Mycobacterium
TDNRASH

SEQ ID NO: 592075 - protein, 5 aa, Mycobacterium
TDNRK

SEQ ID NO: 592076 - protein, 5 aa, Mycobacterium
TDNRS

SEQ ID NO: 592077 - protein, 10 aa, Mycobacterium
TDNRTTTCPE

SEQ ID NO: 592078 - protein, 7 aa, Mycobacterium
TDNSAQV

SEQ ID NO: 592079 - protein, 19 aa, Mycobacterium
TDNSARNRLRSAEAEDRAA

SEQ ID NO: 592080 - protein, 6 aa, Mycobacterium
TDNSEL

SEQ ID NO: 592081 - protein, 9 aa, Mycobacterium
TDNTGSKHK

SEQ ID NO: 592082 - protein, 5 aa, Mycobacterium
TDNTK

SEQ ID NO: 592083 - protein, 6 aa, Mycobacterium
TDNTKL

SEQ ID NO: 592084 - protein, 8 aa, Mycobacterium
TDNTSPAV

SEQ ID NO: 592085 - protein, 9 aa, Mycobacterium
TDPAAGAAG

SEQ ID NO: 592086 - protein, 8 aa, Mycobacterium
TDPAALPE

SEQ ID NO: 592087 - protein, 9 aa, Mycobacterium
TDPAALQTQ

SEQ ID NO: 592088 - protein, 9 aa, Mycobacterium
TDPAANSGI

SEQ ID NO: 592089 - protein, 9 aa, Mycobacterium
TDPAAPKHR

SEQ ID NO: 592090 - protein, 6 aa, Mycobacterium
TDPAAR

SEQ ID NO: 592091 - protein, 7 aa, Mycobacterium
TDPAARA

SEQ ID NO: 592092 - protein, 8 aa, Mycobacterium
TDPAATSK

SEQ ID NO: 592093 - protein, 8 aa, Mycobacterium
TDPADLAD

SEQ ID NO: 592094 - protein, 7 aa, Mycobacterium
TDPADRV

SEQ ID NO: 592095 - protein, 15 aa, Mycobacterium
TDPADVAPLPAEGEA

SEQ ID NO: 592096 - protein, 8 aa, Mycobacterium
TDPADVPR

SEQ ID NO: 592097 - protein, 7 aa, Mycobacterium
TDPAEAL

SEQ ID NO: 592098 - protein, 7 aa, Mycobacterium
TDPAESD

SEQ ID NO: 592099 - protein, 6 aa, Mycobacterium
TDPAGA

SEQ ID NO: 592100 - protein, 7 aa, Mycobacterium
TDPAGAT

SEQ ID NO: 592101 - protein, 6 aa, Mycobacterium
TDPAGL

SEQ ID NO: 592102 - protein, 6 aa, Mycobacterium
TDPAGV

SEQ ID NO: 592103 - protein, 6 aa, Mycobacterium
TDPAHE

SEQ ID NO: 592104 - protein, 13 aa, Mycobacterium
TDPAHERYKEAAE

SEQ ID NO: 592105 - protein, 9 aa, Mycobacterium
TDPAHNPAR

SEQ ID NO: 592106 - protein, 11 aa, Mycobacterium
TDPAKEALADP

SEQ ID NO: 592107 - protein, 19 aa, Mycobacterium
TDPAKSAPLFGPGGTGTFS

SEQ ID NO: 592108 - protein, 14 aa, Mycobacterium
TDPAKSTPLFGPGG

SEQ ID NO: 592109 - protein, 14 aa, Mycobacterium
TDPALAGANPALTT

SEQ ID NO: 592110 - protein, 9 aa, Mycobacterium
TDPANPYGA

SEQ ID NO: 592111 - protein, 5 aa, Mycobacterium
TDPAP

SEQ ID NO: 592112 - protein, 9 aa, Mycobacterium
TDPAPPRET

SEQ ID NO: 592113 - protein, 9 aa, Mycobacterium
TDPAPVTEY

SEQ ID NO: 592114 - protein, 9 aa, Mycobacterium
TDPAQRARD

SEQ ID NO: 592115 - protein, 9 aa, Mycobacterium
TDPAQRDRA

SEQ ID NO: 592116 - protein, 10 aa, Mycobacterium
TDPAQSTPLF

SEQ ID NO: 592117 - protein, 5 aa, Mycobacterium
TDPAR

SEQ ID NO: 592118 - protein, 6 aa, Mycobacterium
TDPARA

SEQ ID NO: 592119 - protein, 7 aa, Mycobacterium
TDPARAA

SEQ ID NO: 592120 - protein, 11 aa, Mycobacterium
TDPARADDTEY

SEQ ID NO: 592121 - protein, 9 aa, Mycobacterium
TDPARSAPL

SEQ ID NO: 592122 - protein, 14 aa, Mycobacterium
TDPARTAPEQWPAA

SEQ ID NO: 592123 - protein, 6 aa, Mycobacterium
TDPASA

SEQ ID NO: 592124 - protein, 6 aa, Mycobacterium
TDPASF

SEQ ID NO: 592125 - protein, 8 aa, Mycobacterium
TDPASNVG

SEQ ID NO: 592126 - protein, 9 aa, Mycobacterium
TDPASSRHH

SEQ ID NO: 592127 - protein, 5 aa, Mycobacterium
TDPAT

SEQ ID NO: 592128 - protein, 8 aa, Mycobacterium
TDPATAEA

SEQ ID NO: 592129 - protein, 7 aa, Mycobacterium
TDPATGK

SEQ ID NO: 592130 - protein, 10 aa, Mycobacterium
TDPATGRRRG

SEQ ID NO: 592131 - protein, 6 aa, Mycobacterium
TDPATP

SEQ ID NO: 592132 - protein, 8 aa, Mycobacterium
TDPATPPL

SEQ ID NO: 592133 - protein, 7 aa, Mycobacterium
TDPATTA

SEQ ID NO: 592134 - protein, 8 aa, Mycobacterium
TDPAVPKH

SEQ ID NO: 592135 - protein, 6 aa, Mycobacterium
TDPDAA

SEQ ID NO: 592136 - protein, 14 aa, Mycobacterium
TDPDAAAPHVAESD

SEQ ID NO: 592137 - protein, 10 aa, Mycobacterium
TDPDAAARNP

SEQ ID NO: 592138 - protein, 9 aa, Mycobacterium
TDPDAAKHK

SEQ ID NO: 592139 - protein, 12 aa, Mycobacterium
TDPDADAPHVAE

SEQ ID NO: 592140 - protein, 8 aa, Mycobacterium
TDPDADLP

SEQ ID NO: 592141 - protein, 7 aa, Mycobacterium
TDPDADP

SEQ ID NO: 592142 - protein, 12 aa, Mycobacterium
TDPDAGAPHVAE

SEQ ID NO: 592143 - protein, 8 aa, Mycobacterium
TDPDAHVS

SEQ ID NO: 592144 - protein, 9 aa, Mycobacterium
TDPDALART

SEQ ID NO: 592145 - protein, 12 aa, Mycobacterium
TDPDANAPHVAE

SEQ ID NO: 592146 - protein, 10 aa, Mycobacterium
TDPDAPKRKG

SEQ ID NO: 592147 - protein, 10 aa, Mycobacterium
TDPDAQPAHK

SEQ ID NO: 592148 - protein, 9 aa, Mycobacterium
TDPDASAAA

SEQ ID NO: 592149 - protein, 11 aa, Mycobacterium
TDPDATPKHSG

SEQ ID NO: 592150 - protein, 8 aa, Mycobacterium
TDPDAVEQ

SEQ ID NO: 592151 - protein, 9 aa, Mycobacterium
TDPDDRAAR

SEQ ID NO: 592152 - protein, 10 aa, Mycobacterium
TDPDDRDARR

SEQ ID NO: 592153 - protein, 20 aa, Mycobacterium
TDPDDWDPPRFDESTEIPGE

SEQ ID NO: 592154 - protein, 5 aa, Mycobacterium
TDPDE

SEQ ID NO: 592155 - protein, 9 aa, Mycobacterium
TDPDFTPGR

SEQ ID NO: 592156 - protein, 5 aa, Mycobacterium
TDPDG

SEQ ID NO: 592157 - protein, 7 aa, Mycobacterium
TDPDGAR

SEQ ID NO: 592158 - protein, 9 aa, Mycobacterium
TDPDGGKAV

SEQ ID NO: 592159 - protein, 10 aa, Mycobacterium
TDPDGGSGEP

SEQ ID NO: 592160 - protein, 14 aa, Mycobacterium
TDPDGNEVSFVQEL

SEQ ID NO: 592161 - protein, 9 aa, Mycobacterium
TDPDGNYIT

SEQ ID NO: 592162 - protein, 6 aa, Mycobacterium
TDPDGR

SEQ ID NO: 592163 - protein, 10 aa, Mycobacterium
TDPDGSPTGL

SEQ ID NO: 592164 - protein, 9 aa, Mycobacterium
TDPDGSVRS

SEQ ID NO: 592165 - protein, 7 aa, Mycobacterium
TDPDHHH

SEQ ID NO: 592166 - protein, 8 aa, Mycobacterium
TDPDHYEA

SEQ ID NO: 592167 - protein, 10 aa, Mycobacterium
TDPDITASYR

SEQ ID NO: 592168 - protein, 6 aa, Mycobacterium
TDPDLG

SEQ ID NO: 592169 - protein, 9 aa, Mycobacterium
TDPDNPANW

SEQ ID NO: 592170 - protein, 7 aa, Mycobacterium
TDPDRHR

SEQ ID NO: 592171 - protein, 8 aa, Mycobacterium
TDPDRHRT

SEQ ID NO: 592172 - protein, 6 aa, Mycobacterium
TDPDSI

SEQ ID NO: 592173 - protein, 7 aa, Mycobacterium
TDPDSQQ

SEQ ID NO: 592174 - protein, 6 aa, Mycobacterium
TDPDSV

SEQ ID NO: 592175 - protein, 7 aa, Mycobacterium
TDPDSVP

SEQ ID NO: 592176 - protein, 12 aa, Mycobacterium
TDPDSVRAATEI

SEQ ID NO: 592177 - protein, 5 aa, Mycobacterium
TDPDT

SEQ ID NO: 592178 - protein, 10 aa, Mycobacterium
TDPDTAAATV

SEQ ID NO: 592179 - protein, 9 aa, Mycobacterium
TDPDTELSD

SEQ ID NO: 592180 - protein, 10 aa, Mycobacterium
TDPDTGTPRR

SEQ ID NO: 592181 - protein, 6 aa, Mycobacterium
TDPDVP

SEQ ID NO: 592182 - protein, 21 aa, Mycobacterium
TDPDWQGGDYHGSGRSPGKGL

SEQ ID NO: 592183 - protein, 4 aa, Mycobacterium
TDPE

SEQ ID NO: 592184 - protein, 6 aa, Mycobacterium
TDPEAF

SEQ ID NO: 592185 - protein, 9 aa, Mycobacterium
TDPEAPKHN

SEQ ID NO: 592186 - protein, 10 aa, Mycobacterium
TDPEAPKPKR

SEQ ID NO: 592187 - protein, 10 aa, Mycobacterium
TDPEAREKPF

SEQ ID NO: 592188 - protein, 6 aa, Mycobacterium
TDPEAV

SEQ ID NO: 592189 - protein, 5 aa, Mycobacterium
TDPEE

SEQ ID NO: 592190 - protein, 5 aa, Mycobacterium
TDPEF

SEQ ID NO: 592191 - protein, 5 aa, Mycobacterium
TDPEG

SEQ ID NO: 592192 - protein, 10 aa, Mycobacterium
TDPEGGEAAA

SEQ ID NO: 592193 - protein, 7 aa, Mycobacterium
TDPEGGL

SEQ ID NO: 592194 - protein, 7 aa, Mycobacterium
TDPEHRE

SEQ ID NO: 592195 - protein, 11 aa, Mycobacterium
TDPEHREFGDE

SEQ ID NO: 592196 - protein, 7 aa, Mycobacterium
TDPEKGA

SEQ ID NO: 592197 - protein, 9 aa, Mycobacterium
TDPEKGANG

SEQ ID NO: 592198 - protein, 10 aa, Mycobacterium
TDPEKKANGI

SEQ ID NO: 592199 - protein, 5 aa, Mycobacterium
TDPEL

SEQ ID NO: 592200 - protein, 6 aa, Mycobacterium
TDPELG

SEQ ID NO: 592201 - protein, 7 aa, Mycobacterium
TDPELSG

SEQ ID NO: 592202 - protein, 14 aa, Mycobacterium
TDPELTEAAARYAS

SEQ ID NO: 592203 - protein, 5 aa, Mycobacterium
TDPEQ

SEQ ID NO: 592204 - protein, 9 aa, Mycobacterium
TDPEQAQRV

SEQ ID NO: 592205 - protein, 11 aa, Mycobacterium
TDPEQARSVGR

SEQ ID NO: 592206 - protein, 9 aa, Mycobacterium
TDPEQPKHK

SEQ ID NO: 592207 - protein, 10 aa, Mycobacterium
TDPEQRDRDI

SEQ ID NO: 592208 - protein, 8 aa, Mycobacterium
TDPEQVGR

SEQ ID NO: 592209 - protein, 6 aa, Mycobacterium
TDPERV

SEQ ID NO: 592210 - protein, 7 aa, Mycobacterium
TDPERVP

SEQ ID NO: 592211 - protein, 16 aa, Mycobacterium
TDPERVRQALRRLRGA

SEQ ID NO: 592212 - protein, 7 aa, Mycobacterium
TDPESQK

SEQ ID NO: 592213 - protein, 7 aa, Mycobacterium
TDPESQR

SEQ ID NO: 592214 - protein, 6 aa, Mycobacterium
TDPESV

SEQ ID NO: 592215 - protein, 6 aa, Mycobacterium
TDPESY

SEQ ID NO: 592216 - protein, 18 aa, Mycobacterium
TDPETETAPNLTDEQRYV

SEQ ID NO: 592217 - protein, 6 aa, Mycobacterium
TDPETL

SEQ ID NO: 592218 - protein, 8 aa, Mycobacterium
TDPETLES

SEQ ID NO: 592219 - protein, 7 aa, Mycobacterium
TDPFPES

SEQ ID NO: 592220 - protein, 17 aa, Mycobacterium
TDPGAALTTGTDTGIAA

SEQ ID NO: 592221 - protein, 7 aa, Mycobacterium
TDPGAEF

SEQ ID NO: 592222 - protein, 9 aa, Mycobacterium
TDPGAGGRT

SEQ ID NO: 592223 - protein, 10 aa, Mycobacterium
TDPGAPKHKG

SEQ ID NO: 592224 - protein, 9 aa, Mycobacterium
TDPGAWPGL

SEQ ID NO: 592225 - protein, 6 aa, Mycobacterium
TDPGEL

SEQ ID NO: 592226 - protein, 7 aa, Mycobacterium
TDPGELP

SEQ ID NO: 592227 - protein, 9 aa, Mycobacterium
TDPGFTPGK

SEQ ID NO: 592228 - protein, 28 aa, Mycobacterium
TDPGGAHDEATAGVDRAARDGVARTDLD

SEQ ID NO: 592229 - protein, 7 aa, Mycobacterium
TDPGGEL

SEQ ID NO: 592230 - protein, 7 aa, Mycobacterium
TDPGGEV

SEQ ID NO: 592231 - protein, 7 aa, Mycobacterium
TDPGGTV

SEQ ID NO: 592232 - protein, 6 aa, Mycobacterium
TDPGGV

SEQ ID NO: 592233 - protein, 5 aa, Mycobacterium
TDPGH

SEQ ID NO: 592234 - protein, 11 aa, Mycobacterium
TDPGHRNARRH

SEQ ID NO: 592235 - protein, 9 aa, Mycobacterium
TDPGLGAAG

SEQ ID NO: 592236 - protein, 8 aa, Mycobacterium
TDPGLGDV

SEQ ID NO: 592237 - protein, 9 aa, Mycobacterium
TDPGLGEAG

SEQ ID NO: 592238 - protein, 10 aa, Mycobacterium
TDPGLGEAGE

SEQ ID NO: 592239 - protein, 9 aa, Mycobacterium
TDPGPERQS

SEQ ID NO: 592240 - protein, 10 aa, Mycobacterium
TDPGQTPRAG

SEQ ID NO: 592241 - protein, 6 aa, Mycobacterium
TDPGRF

SEQ ID NO: 592242 - protein, 6 aa, Mycobacterium
TDPGRL

SEQ ID NO: 592243 - protein, 8 aa, Mycobacterium
TDPGSPLH

SEQ ID NO: 592244 - protein, 10 aa, Mycobacterium
TDPGSRNGGD

SEQ ID NO: 592245 - protein, 15 aa, Mycobacterium
TDPGTAPAPQADPSV

SEQ ID NO: 592246 - protein, 6 aa, Mycobacterium
TDPGVP

SEQ ID NO: 592247 - protein, 9 aa, Mycobacterium
TDPGVTPEF

SEQ ID NO: 592248 - protein, 8 aa, Mycobacterium
TDPGWGQQ

SEQ ID NO: 592249 - protein, 8 aa, Mycobacterium
TDPHARKH

SEQ ID NO: 592250 - protein, 6 aa, Mycobacterium
TDPHRV

SEQ ID NO: 592251 - protein, 8 aa, Mycobacterium
TDPHSPPE

SEQ ID NO: 592252 - protein, 6 aa, Mycobacterium
TDPHSS

SEQ ID NO: 592253 - protein, 7 aa, Mycobacterium
TDPHSSL

SEQ ID NO: 592254 - protein, 12 aa, Mycobacterium
TDPIEADNRWTD

SEQ ID NO: 592255 - protein, 26 aa, Mycobacterium
TDPIEDAPATGSGAAFEQSQTDDVAR

SEQ ID NO: 592256 - protein, 6 aa, Mycobacterium
TDPIGQ

SEQ ID NO: 592257 - protein, 12 aa, Mycobacterium
TDPINYYYVARK

SEQ ID NO: 592258 - protein, 9 aa, Mycobacterium
TDPKAREEP

SEQ ID NO: 592259 - protein, 10 aa, Mycobacterium
TDPKATPRHT

SEQ ID NO: 592260 - protein, 6 aa, Mycobacterium
TDPKGM

SEQ ID NO: 592261 - protein, 7 aa, Mycobacterium
TDPKTIE

SEQ ID NO: 592262 - protein, 9 aa, Mycobacterium
TDPKYHSEH

SEQ ID NO: 592263 - protein, 7 aa, Mycobacterium
TDPLDSH

SEQ ID NO: 592264 - protein, 5 aa, Mycobacterium
TDPLG

SEQ ID NO: 592265 - protein, 12 aa, Mycobacterium
TDPLGKDHDGND

SEQ ID NO: 592266 - protein, 8 aa, Mycobacterium
TDPLPEGQ

SEQ ID NO: 592267 - protein, 42 aa, Mycobacterium
TDPLPGRIATGAGGYGGGGYGSGGSRAGGGSLGAPSKKRTKP

SEQ ID NO: 592268 - protein, 6 aa, Mycobacterium
TDPLSQ

SEQ ID NO: 592269 - protein, 10 aa, Mycobacterium
TDPMSRQTGQ

SEQ ID NO: 592270 - protein, 11 aa, Mycobacterium
TDPMSRQTGQT

SEQ ID NO: 592271 - protein, 18 aa, Mycobacterium
TDPNAPAARRLAGGNAAI

SEQ ID NO: 592272 - protein, 9 aa, Mycobacterium
TDPNAPKRH

SEQ ID NO: 592273 - protein, 9 aa, Mycobacterium
TDPNAPPAH

SEQ ID NO: 592274 - protein, 15 aa, Mycobacterium
TDPNAQTLTATTDPV

SEQ ID NO: 592275 - protein, 10 aa, Mycobacterium
TDPNASKHKG

SEQ ID NO: 592276 - protein, 10 aa, Mycobacterium
TDPNATPRHR

SEQ ID NO: 592277 - protein, 22 aa, Mycobacterium
TDPNDYAGPGTGYTLSEQRRAE

SEQ ID NO: 592278 - protein, 13 aa, Mycobacterium
TDPNDYRGPATGY

SEQ ID NO: 592279 - protein, 7 aa, Mycobacterium
TDPNFSE

SEQ ID NO: 592280 - protein, 9 aa, Mycobacterium
TDPNGTPGQ

SEQ ID NO: 592281 - protein, 8 aa, Mycobacterium
TDPNMPKH

SEQ ID NO: 592282 - protein, 5 aa, Mycobacterium
TDPNR

SEQ ID NO: 592283 - protein, 6 aa, Mycobacterium
TDPNRV

SEQ ID NO: 592284 - protein, 10 aa, Mycobacterium
TDPNTGRSSA

SEQ ID NO: 592285 - protein, 10 aa, Mycobacterium
TDPNTKPRHT

SEQ ID NO: 592286 - protein, 10 aa, Mycobacterium
TDPPDLSSLG

SEQ ID NO: 592287 - protein, 8 aa, Mycobacterium
TDPPEAVT

SEQ ID NO: 592288 - protein, 6 aa, Mycobacterium
TDPPER

SEQ ID NO: 592289 - protein, 10 aa, Mycobacterium
TDPPNLPAAQ

SEQ ID NO: 592290 - protein, 8 aa, Mycobacterium
TDPPPEVP

SEQ ID NO: 592291 - protein, 9 aa, Mycobacterium
TDPPPGKDR

SEQ ID NO: 592292 - protein, 5 aa, Mycobacterium
TDPPR

SEQ ID NO: 592293 - protein, 7 aa, Mycobacterium
TDPPSSP

SEQ ID NO: 592294 - protein, 9 aa, Mycobacterium
TDPPSTSVS

SEQ ID NO: 592295 - protein, 9 aa, Mycobacterium
TDPPTAELT

SEQ ID NO: 592296 - protein, 9 aa, Mycobacterium
TDPPTPQAY

SEQ ID NO: 592297 - protein, 6 aa, Mycobacterium
TDPPVA

SEQ ID NO: 592298 - protein, 4 aa, Mycobacterium
TDPQ

SEQ ID NO: 592299 - protein, 9 aa, Mycobacterium
TDPQAPKHQ

SEQ ID NO: 592300 - protein, 10 aa, Mycobacterium
TDPQAQPRHK

SEQ ID NO: 592301 - protein, 8 aa, Mycobacterium
TDPQARKH

SEQ ID NO: 592302 - protein, 6 aa, Mycobacterium
TDPQEL

SEQ ID NO: 592303 - protein, 9 aa, Mycobacterium
TDPQGAAAT

SEQ ID NO: 592304 - protein, 6 aa, Mycobacterium
TDPQGN

SEQ ID NO: 592305 - protein, 9 aa, Mycobacterium
TDPQGPKHK

SEQ ID NO: 592306 - protein, 8 aa, Mycobacterium
TDPQGRKH

SEQ ID NO: 592307 - protein, 7 aa, Mycobacterium
TDPQGYD

SEQ ID NO: 592308 - protein, 6 aa, Mycobacterium
TDPQLR

SEQ ID NO: 592309 - protein, 8 aa, Mycobacterium
TDPQQRGQ

SEQ ID NO: 592310 - protein, 10 aa, Mycobacterium
TDPQSPLTGL

SEQ ID NO: 592311 - protein, 18 aa, Mycobacterium
TDPQTAETLTGAPAPPMK

SEQ ID NO: 592312 - protein, 6 aa, Mycobacterium
TDPQTM

SEQ ID NO: 592313 - protein, 8 aa, Mycobacterium
TDPRAGNA

SEQ ID NO: 592314 - protein, 8 aa, Mycobacterium
TDPRDVGC

SEQ ID NO: 592315 - protein, 16 aa, Mycobacterium
TDPRELRETVEGQVNR

SEQ ID NO: 592316 - protein, 5 aa, Mycobacterium
TDPRI

SEQ ID NO: 592317 - protein, 9 aa, Mycobacterium
TDPRPLRPG

SEQ ID NO: 592318 - protein, 8 aa, Mycobacterium
TDPRQTPQ

SEQ ID NO: 592319 - protein, 8 aa, Mycobacterium
TDPRSGVR

SEQ ID NO: 592320 - protein, 12 aa, Mycobacterium
TDPRSPLSGLRP

SEQ ID NO: 592321 - protein, 7 aa, Mycobacterium
TDPRTGA

SEQ ID NO: 592322 - protein, 16 aa, Mycobacterium
TDPSAARTAVATAREA

SEQ ID NO: 592323 - protein, 6 aa, Mycobacterium
TDPSAD

SEQ ID NO: 592324 - protein, 13 aa, Mycobacterium
TDPSALADTAGYA

SEQ ID NO: 592325 - protein, 14 aa, Mycobacterium
TDPSALADTSGYAS

SEQ ID NO: 592326 - protein, 7 aa, Mycobacterium
TDPSAVE

SEQ ID NO: 592327 - protein, 6 aa, Mycobacterium
TDPSEA

SEQ ID NO: 592328 - protein, 15 aa, Mycobacterium
TDPSESLSHLASAGM

SEQ ID NO: 592329 - protein, 7 aa, Mycobacterium
TDPSGAT

SEQ ID NO: 592330 - protein, 6 aa, Mycobacterium
TDPSGG

SEQ ID NO: 592331 - protein, 6 aa, Mycobacterium
TDPSIA

SEQ ID NO: 592332 - protein, 16 aa, Mycobacterium
TDPSIPDDAPADPGPL

SEQ ID NO: 592333 - protein, 7 aa, Mycobacterium
TDPSNYP

SEQ ID NO: 592334 - protein, 7 aa, Mycobacterium
TDPSPEA

SEQ ID NO: 592335 - protein, 8 aa, Mycobacterium
TDPSPEAA

SEQ ID NO: 592336 - protein, 8 aa, Mycobacterium
TDPSQGAA

SEQ ID NO: 592337 - protein, 11 aa, Mycobacterium
TDPSQRPKDAE

SEQ ID NO: 592338 - protein, 5 aa, Mycobacterium
TDPSR

SEQ ID NO: 592339 - protein, 15 aa, Mycobacterium
TDPSRPTAGSLGSVR

SEQ ID NO: 592340 - protein, 6 aa, Mycobacterium
TDPSSD

SEQ ID NO: 592341 - protein, 8 aa, Mycobacterium
TDPSSVDL

SEQ ID NO: 592342 - protein, 9 aa, Mycobacterium
TDPSTEVAA

SEQ ID NO: 592343 - protein, 5 aa, Mycobacterium
TDPSV

SEQ ID NO: 592344 - protein, 5 aa, Mycobacterium
TDPSW

SEQ ID NO: 592345 - protein, 12 aa, Mycobacterium
TDPTAATTINSA

SEQ ID NO: 592346 - protein, 6 aa, Mycobacterium
TDPTAN

SEQ ID NO: 592347 - protein, 9 aa, Mycobacterium
TDPTAPKHK

SEQ ID NO: 592348 - protein, 18 aa, Mycobacterium
TDPTAPPGSGKPEPLGDD

SEQ ID NO: 592349 - protein, 8 aa, Mycobacterium
TDPTAPVH

SEQ ID NO: 592350 - protein, 10 aa, Mycobacterium
TDPTARQGLE

SEQ ID NO: 592351 - protein, 6 aa, Mycobacterium
TDPTAV

SEQ ID NO: 592352 - protein, 12 aa, Mycobacterium
TDPTAYGLPAPN

SEQ ID NO: 592353 - protein, 8 aa, Mycobacterium
TDPTETTN

SEQ ID NO: 592354 - protein, 9 aa, Mycobacterium
TDPTGGPAE

SEQ ID NO: 592355 - protein, 8 aa, Mycobacterium
TDPTGLGE

SEQ ID NO: 592356 - protein, 10 aa, Mycobacterium
TDPTGPDAGH

SEQ ID NO: 592357 - protein, 7 aa, Mycobacterium
TDPTHPV

SEQ ID NO: 592358 - protein, 5 aa, Mycobacterium
TDPTN

SEQ ID NO: 592359 - protein, 6 aa, Mycobacterium
TDPTNG

SEQ ID NO: 592360 - protein, 8 aa, Mycobacterium
TDPTNGTR

SEQ ID NO: 592361 - protein, 6 aa, Mycobacterium
TDPTNL

SEQ ID NO: 592362 - protein, 6 aa, Mycobacterium
TDPTPL

SEQ ID NO: 592363 - protein, 7 aa, Mycobacterium
TDPTPVN

SEQ ID NO: 592364 - protein, 17 aa, Mycobacterium
TDPTQRTRDIEQNAEYE

SEQ ID NO: 592365 - protein, 5 aa, Mycobacterium
TDPTR

SEQ ID NO: 592366 - protein, 6 aa, Mycobacterium
TDPTRA

SEQ ID NO: 592367 - protein, 7 aa, Mycobacterium
TDPTTAL

SEQ ID NO: 592368 - protein, 6 aa, Mycobacterium
TDPTVE

SEQ ID NO: 592369 - protein, 7 aa, Mycobacterium
TDPTVKK

SEQ ID NO: 592370 - protein, 6 aa, Mycobacterium
TDPTVP

SEQ ID NO: 592371 - protein, 5 aa, Mycobacterium
TDPVP

SEQ ID NO: 592372 - protein, 9 aa, Mycobacterium
TDPVSPDDY

SEQ ID NO: 592373 - protein, 5 aa, Mycobacterium
TDPVT

SEQ ID NO: 592374 - protein, 13 aa, Mycobacterium
TDPVTPEITQWVR

SEQ ID NO: 592375 - protein, 6 aa, Mycobacterium
TDPYEP

SEQ ID NO: 592376 - protein, 10 aa, Mycobacterium
TDPYGNTSTQ

SEQ ID NO: 592377 - protein, 8 aa, Mycobacterium
TDQADART

SEQ ID NO: 592378 - protein, 8 aa, Mycobacterium
TDQAETAI

SEQ ID NO: 592379 - protein, 6 aa, Mycobacterium
TDQAHS

SEQ ID NO: 592380 - protein, 8 aa, Mycobacterium
TDQDDRVS

SEQ ID NO: 592381 - protein, 8 aa, Mycobacterium
TDQDGRTT

SEQ ID NO: 592382 - protein, 23 aa, Mycobacterium
TDQDQRLAAGRRQKRIDATPGPM

SEQ ID NO: 592383 - protein, 6 aa, Mycobacterium
TDQDRQ

SEQ ID NO: 592384 - protein, 4 aa, Mycobacterium
TDQE

SEQ ID NO: 592385 - protein, 9 aa, Mycobacterium
TDQEAGSRG

SEQ ID NO: 592386 - protein, 6 aa, Mycobacterium
TDQGNY

SEQ ID NO: 592387 - protein, 7 aa, Mycobacterium
TDQGRRP

SEQ ID NO: 592388 - protein, 6 aa, Mycobacterium
TDQHDG

SEQ ID NO: 592389 - protein, 25 aa, Mycobacterium
TDQHNSSPSVAKAASNAPAAPHPPR

SEQ ID NO: 592390 - protein, 6 aa, Mycobacterium
TDQKGR

SEQ ID NO: 592391 - protein, 5 aa, Mycobacterium
TDQLT

SEQ ID NO: 592392 - protein, 7 aa, Mycobacterium
TDQNGEV

SEQ ID NO: 592393 - protein, 8 aa, Mycobacterium
TDQNGEVL

SEQ ID NO: 592394 - protein, 6 aa, Mycobacterium
TDQNSE

SEQ ID NO: 592395 - protein, 20 aa, Mycobacterium
TDQPCVGEDAASGAAEATVG

SEQ ID NO: 592396 - protein, 8 aa, Mycobacterium
TDQPGASE

SEQ ID NO: 592397 - protein, 6 aa, Mycobacterium
TDQPIA

SEQ ID NO: 592398 - protein, 8 aa, Mycobacterium
TDQPQAVD

SEQ ID NO: 592399 - protein, 8 aa, Mycobacterium
TDQPRSEH

SEQ ID NO: 592400 - protein, 6 aa, Mycobacterium
TDQPSL

SEQ ID NO: 592401 - protein, 9 aa, Mycobacterium
TDQQARRRR

SEQ ID NO: 592402 - protein, 6 aa, Mycobacterium
TDQRGG

SEQ ID NO: 592403 - protein, 4 aa, Mycobacterium
TDQS

SEQ ID NO: 592404 - protein, 8 aa, Mycobacterium
TDQSTRDA

SEQ ID NO: 592405 - protein, 4 aa, Mycobacterium
TDQT

SEQ ID NO: 592406 - protein, 6 aa, Mycobacterium
TDQTGV

SEQ ID NO: 592407 - protein, 12 aa, Mycobacterium
TDQVEQWSKASG

SEQ ID NO: 592408 - protein, 14 aa, Mycobacterium
TDQVPDDLREQTKS

SEQ ID NO: 592409 - protein, 16 aa, Mycobacterium
TDQVRTRSEVELSFQS

SEQ ID NO: 592410 - protein, 14 aa, Mycobacterium
TDQYGQDEGNQLGE

SEQ ID NO: 592411 - protein, 8 aa, Mycobacterium
TDRAADDV

SEQ ID NO: 592412 - protein, 13 aa, Mycobacterium
TDRAFTQREPETT

SEQ ID NO: 592413 - protein, 14 aa, Mycobacterium
TDRAGAEILDQQVD

SEQ ID NO: 592414 - protein, 9 aa, Mycobacterium
TDRAGAEQA

SEQ ID NO: 592415 - protein, 16 aa, Mycobacterium
TDRAGRDRTPSVPGHE

SEQ ID NO: 592416 - protein, 10 aa, Mycobacterium
TDRAGSSAYV

SEQ ID NO: 592417 - protein, 6 aa, Mycobacterium
TDRAHP

SEQ ID NO: 592418 - protein, 11 aa, Mycobacterium
TDRAKAVTRGI

SEQ ID NO: 592419 - protein, 6 aa, Mycobacterium
TDRAPI

SEQ ID NO: 592420 - protein, 12 aa, Mycobacterium
TDRAQQATTYRN

SEQ ID NO: 592421 - protein, 7 aa, Mycobacterium
TDRARPR

SEQ ID NO: 592422 - protein, 13 aa, Mycobacterium
TDRASAQAAMNAA

SEQ ID NO: 592423 - protein, 6 aa, Mycobacterium
TDRAYP

SEQ ID NO: 592424 - protein, 4 aa, Mycobacterium
TDRD

SEQ ID NO: 592425 - protein, 9 aa, Mycobacterium
TDRDAADAL

SEQ ID NO: 592426 - protein, 9 aa, Mycobacterium
TDRDAARAH

SEQ ID NO: 592427 - protein, 7 aa, Mycobacterium
TDRDEFG

SEQ ID NO: 592428 - protein, 11 aa, Mycobacterium
TDRDGDPAADA

SEQ ID NO: 592429 - protein, 8 aa, Mycobacterium
TDRDGKEV

SEQ ID NO: 592430 - protein, 7 aa, Mycobacterium
TDRDKLS

SEQ ID NO: 592431 - protein, 7 aa, Mycobacterium
TDRDPRE

SEQ ID NO: 592432 - protein, 10 aa, Mycobacterium
TDRDQLPERA

SEQ ID NO: 592433 - protein, 10 aa, Mycobacterium
TDRDSADALR

SEQ ID NO: 592434 - protein, 6 aa, Mycobacterium
TDRDTA

SEQ ID NO: 592435 - protein, 6 aa, Mycobacterium
TDRDVS

SEQ ID NO: 592436 - protein, 26 aa, Mycobacterium
TDREAGVGLPDGERAPKSSLTTRCGQ

SEQ ID NO: 592437 - protein, 8 aa, Mycobacterium
TDREAPAA

SEQ ID NO: 592438 - protein, 10 aa, Mycobacterium
TDREGEPVAG

SEQ ID NO: 592439 - protein, 6 aa, Mycobacterium
TDREGL

SEQ ID NO: 592440 - protein, 6 aa, Mycobacterium
TDRESL

SEQ ID NO: 592441 - protein, 7 aa, Mycobacterium
TDREYRL

SEQ ID NO: 592442 - protein, 4 aa, Mycobacterium
TDRG

SEQ ID NO: 592443 - protein, 10 aa, Mycobacterium
TDRGARADDA

SEQ ID NO: 592444 - protein, 11 aa, Mycobacterium
TDRGEERSAHT

SEQ ID NO: 592445 - protein, 12 aa, Mycobacterium
TDRGEKLPAAQR

SEQ ID NO: 592446 - protein, 8 aa, Mycobacterium
TDRGETRP

SEQ ID NO: 592447 - protein, 7 aa, Mycobacterium
TDRGGER

SEQ ID NO: 592448 - protein, 6 aa, Mycobacterium
TDRGGL

SEQ ID NO: 592449 - protein, 5 aa, Mycobacterium
TDRGL

SEQ ID NO: 592450 - protein, 15 aa, Mycobacterium
TDRGNVARGADFDTS

SEQ ID NO: 592451 - protein, 17 aa, Mycobacterium
TDRGNVARGDDFETSAP

SEQ ID NO: 592452 - protein, 15 aa, Mycobacterium
TDRGNVKRDDNFQTS

SEQ ID NO: 592453 - protein, 7 aa, Mycobacterium
TDRGQRI

SEQ ID NO: 592454 - protein, 20 aa, Mycobacterium
TDRGRAASADWPAGAGVRSA

SEQ ID NO: 592455 - protein, 6 aa, Mycobacterium
TDRGRP

SEQ ID NO: 592456 - protein, 8 aa, Mycobacterium
TDRGSLTV

SEQ ID NO: 592457 - protein, 6 aa, Mycobacterium
TDRGVE

SEQ ID NO: 592458 - protein, 7 aa, Mycobacterium
TDRGVEG

SEQ ID NO: 592459 - protein, 8 aa, Mycobacterium
TDRGVHEG

SEQ ID NO: 592460 - protein, 5 aa, Mycobacterium
TDRHP

SEQ ID NO: 592461 - protein, 11 aa, Mycobacterium
TDRKSGTPSSY

SEQ ID NO: 592462 - protein, 7 aa, Mycobacterium
TDRKTSE

SEQ ID NO: 592463 - protein, 10 aa, Mycobacterium
TDRNAGAENA

SEQ ID NO: 592464 - protein, 7 aa, Mycobacterium
TDRNDTV

SEQ ID NO: 592465 - protein, 10 aa, Mycobacterium
TDRNGAPEAA

SEQ ID NO: 592466 - protein, 6 aa, Mycobacterium
TDRNGQ

SEQ ID NO: 592467 - protein, 15 aa, Mycobacterium
TDRPAGRSRPAGAPP

SEQ ID NO: 592468 - protein, 5 aa, Mycobacterium
TDRPC

SEQ ID NO: 592469 - protein, 13 aa, Mycobacterium
TDRPDADSEQAAS

SEQ ID NO: 592470 - protein, 7 aa, Mycobacterium
TDRPDND

SEQ ID NO: 592471 - protein, 11 aa, Mycobacterium
TDRPGSSDYVS

SEQ ID NO: 592472 - protein, 9 aa, Mycobacterium
TDRPGSSGY

SEQ ID NO: 592473 - protein, 20 aa, Mycobacterium
TDRPLGAGLPDGPAGPPRAF

SEQ ID NO: 592474 - protein, 13 aa, Mycobacterium
TDRPLSDDTLSDA

SEQ ID NO: 592475 - protein, 8 aa, Mycobacterium
TDRPPNHH

SEQ ID NO: 592476 - protein, 7 aa, Mycobacterium
TDRPQVG

SEQ ID NO: 592477 - protein, 7 aa, Mycobacterium
TDRPTQV

SEQ ID NO: 592478 - protein, 5 aa, Mycobacterium
TDRPV

SEQ ID NO: 592479 - protein, 6 aa, Mycobacterium
TDRPVG

SEQ ID NO: 592480 - protein, 7 aa, Mycobacterium
TDRPYPA

SEQ ID NO: 592481 - protein, 15 aa, Mycobacterium
TDRPYPPATVGNGGT

SEQ ID NO: 592482 - protein, 15 aa, Mycobacterium
TDRPYPPVADQRGSS

SEQ ID NO: 592483 - protein, 8 aa, Mycobacterium
TDRPYPSV

SEQ ID NO: 592484 - protein, 9 aa, Mycobacterium
TDRQAVDDG

SEQ ID NO: 592485 - protein, 6 aa, Mycobacterium
TDRQGA

SEQ ID NO: 592486 - protein, 8 aa, Mycobacterium
TDRQGDPV

SEQ ID NO: 592487 - protein, 5 aa, Mycobacterium
TDRQP

SEQ ID NO: 592488 - protein, 11 aa, Mycobacterium
TDRQRDTENWT

SEQ ID NO: 592489 - protein, 11 aa, Mycobacterium
TDRQSGTPSSY

SEQ ID NO: 592490 - protein, 4 aa, Mycobacterium
TDRR

SEQ ID NO: 592491 - protein, 5 aa, Mycobacterium
TDRRA

SEQ ID NO: 592492 - protein, 7 aa, Mycobacterium
TDRRAER

SEQ ID NO: 592493 - protein, 11 aa, Mycobacterium
TDRRPFGAPRG

SEQ ID NO: 592494 - protein, 9 aa, Mycobacterium
TDRRPFRAP

SEQ ID NO: 592495 - protein, 12 aa, Mycobacterium
TDRRQPQRSDLR

SEQ ID NO: 592496 - protein, 7 aa, Mycobacterium
TDRRSGY

SEQ ID NO: 592497 - protein, 9 aa, Mycobacterium
TDRRTGQSF

SEQ ID NO: 592498 - protein, 11 aa, Mycobacterium
TDRRTRARREP

SEQ ID NO: 592499 - protein, 40 aa, Mycobacterium
TDRRTTNRRPTPLPRSSEGYARRAPTTRRAPSTSSAIRRA

SEQ ID NO: 592500 - protein, 7 aa, Mycobacterium
TDRSNGM

SEQ ID NO: 592501 - protein, 7 aa, Mycobacterium
TDRSQVD

SEQ ID NO: 592502 - protein, 8 aa, Mycobacterium
TDRSTLTD

SEQ ID NO: 592503 - protein, 10 aa, Mycobacterium
TDRTDEKAEK

SEQ ID NO: 592504 - protein, 5 aa, Mycobacterium
TDRTP

SEQ ID NO: 592505 - protein, 22 aa, Mycobacterium
TDRTPPGYQVASSNETDPSPAD

SEQ ID NO: 592506 - protein, 18 aa, Mycobacterium
TDRTRQTYHEERMAKAAQ

SEQ ID NO: 592507 - protein, 9 aa, Mycobacterium
TDRTVSTRA

SEQ ID NO: 592508 - protein, 12 aa, Mycobacterium
TDRYRRDSDGSW

SEQ ID NO: 592509 - protein, 6 aa, Mycobacterium
TDSAAS

SEQ ID NO: 592510 - protein, 13 aa, Mycobacterium
TDSADGKPNPASS

SEQ ID NO: 592511 - protein, 8 aa, Mycobacterium
TDSADSPH

SEQ ID NO: 592512 - protein, 8 aa, Mycobacterium
TDSAEGSY

SEQ ID NO: 592513 - protein, 5 aa, Mycobacterium
TDSAF

SEQ ID NO: 592514 - protein, 5 aa, Mycobacterium
TDSAG

SEQ ID NO: 592515 - protein, 9 aa, Mycobacterium
TDSAGGVAQ

SEQ ID NO: 592516 - protein, 8 aa, Mycobacterium
TDSALNGA

SEQ ID NO: 592517 - protein, 9 aa, Mycobacterium
TDSANASGV

SEQ ID NO: 592518 - protein, 13 aa, Mycobacterium
TDSANGEPNPASS

SEQ ID NO: 592519 - protein, 13 aa, Mycobacterium
TDSANGQPNPASS

SEQ ID NO: 592520 - protein, 7 aa, Mycobacterium
TDSAPGI

SEQ ID NO: 592521 - protein, 9 aa, Mycobacterium
TDSARTTYR

SEQ ID NO: 592522 - protein, 9 aa, Mycobacterium
TDSATSAQV

SEQ ID NO: 592523 - protein, 10 aa, Mycobacterium
TDSDAPEGTP

SEQ ID NO: 592524 - protein, 10 aa, Mycobacterium
TDSDAPKHKG

SEQ ID NO: 592525 - protein, 8 aa, Mycobacterium
TDSDASGR

SEQ ID NO: 592526 - protein, 7 aa, Mycobacterium
TDSDAVD

SEQ ID NO: 592527 - protein, 9 aa, Mycobacterium
TDSDDGTPI

SEQ ID NO: 592528 - protein, 10 aa, Mycobacterium
TDSDDPAQRL

SEQ ID NO: 592529 - protein, 7 aa, Mycobacterium
TDSDDPL

SEQ ID NO: 592530 - protein, 14 aa, Mycobacterium
TDSDGDGLADGASS

SEQ ID NO: 592531 - protein, 14 aa, Mycobacterium
TDSDGDGTADGASA

SEQ ID NO: 592532 - protein, 10 aa, Mycobacterium
TDSDGIDATN

SEQ ID NO: 592533 - protein, 17 aa, Mycobacterium
TDSDGNTGVGEVPGGEA

SEQ ID NO: 592534 - protein, 9 aa, Mycobacterium
TDSDGSDMR

SEQ ID NO: 592535 - protein, 9 aa, Mycobacterium
TDSDGVETA

SEQ ID NO: 592536 - protein, 48 aa, Mycobacterium
TDSDPEPEPEIEEPVESTAAASGSVEAAPAPAAAPAAPSGGPRPDDLG

SEQ ID NO: 592537 - protein, 15 aa, Mycobacterium
TDSDPVAFDTGPANA

SEQ ID NO: 592538 - protein, 8 aa, Mycobacterium
TDSDTRER

SEQ ID NO: 592539 - protein, 9 aa, Mycobacterium
TDSDTYHGA

SEQ ID NO: 592540 - protein, 12 aa, Mycobacterium
TDSDVEKPGSDK

SEQ ID NO: 592541 - protein, 6 aa, Mycobacterium
TDSDVT

SEQ ID NO: 592542 - protein, 7 aa, Mycobacterium
TDSEDDW

SEQ ID NO: 592543 - protein, 9 aa, Mycobacterium
TDSEDPRPG

SEQ ID NO: 592544 - protein, 7 aa, Mycobacterium
TDSEFSE

SEQ ID NO: 592545 - protein, 10 aa, Mycobacterium
TDSEITKRAR

SEQ ID NO: 592546 - protein, 9 aa, Mycobacterium
TDSEQAARV

SEQ ID NO: 592547 - protein, 5 aa, Mycobacterium
TDSER

SEQ ID NO: 592548 - protein, 9 aa, Mycobacterium
TDSESISRI

SEQ ID NO: 592549 - protein, 6 aa, Mycobacterium
TDSFSS

SEQ ID NO: 592550 - protein, 6 aa, Mycobacterium
TDSFTR

SEQ ID NO: 592551 - protein, 4 aa, Mycobacterium
TDSG

SEQ ID NO: 592552 - protein, 14 aa, Mycobacterium
TDSGASADNDPAAI

SEQ ID NO: 592553 - protein, 12 aa, Mycobacterium
TDSGASAGNNPF

SEQ ID NO: 592554 - protein, 59 aa, Mycobacterium
TDSGATNSGFGNTGSGNSGFNNDGNDNSGFQNTGTSSEGFGNVGNNQTGFQNTGGTNTG

SEQ ID NO: 592555 - protein, 8 aa, Mycobacterium
TDSGEERT

SEQ ID NO: 592556 - protein, 7 aa, Mycobacterium
TDSGEGE

SEQ ID NO: 592557 - protein, 11 aa, Mycobacterium
TDSGLAKSFDG

SEQ ID NO: 592558 - protein, 14 aa, Mycobacterium
TDSGLRGALCSQRP

SEQ ID NO: 592559 - protein, 15 aa, Mycobacterium
TDSGLRGRGGAGFPA

SEQ ID NO: 592560 - protein, 22 aa, Mycobacterium
TDSGPQRLVGSSGAPETQAAET

SEQ ID NO: 592561 - protein, 6 aa, Mycobacterium
TDSGPS

SEQ ID NO: 592562 - protein, 7 aa, Mycobacterium
TDSGRRA

SEQ ID NO: 592563 - protein, 14 aa, Mycobacterium
TDSGRRNPAVTAQA

SEQ ID NO: 592564 - protein, 7 aa, Mycobacterium
TDSHTPM

SEQ ID NO: 592565 - protein, 6 aa, Mycobacterium
TDSKLP

SEQ ID NO: 592566 - protein, 6 aa, Mycobacterium
TDSKRR

SEQ ID NO: 592567 - protein, 6 aa, Mycobacterium
TDSLEE

SEQ ID NO: 592568 - protein, 15 aa, Mycobacterium
TDSNASALPPEDGVR

SEQ ID NO: 592569 - protein, 7 aa, Mycobacterium
TDSNDSR

SEQ ID NO: 592570 - protein, 15 aa, Mycobacterium
TDSNVQAAPPRDGIR

SEQ ID NO: 592571 - protein, 4 aa, Mycobacterium
TDSP

SEQ ID NO: 592572 - protein, 6 aa, Mycobacterium
TDSPAD

SEQ ID NO: 592573 - protein, 14 aa, Mycobacterium
TDSPAGKSNSSFQS

SEQ ID NO: 592574 - protein, 9 aa, Mycobacterium
TDSPAGQAA

SEQ ID NO: 592575 - protein, 15 aa, Mycobacterium
TDSPAGYAGVDGDAQ

SEQ ID NO: 592576 - protein, 10 aa, Mycobacterium
TDSPAPAPYV

SEQ ID NO: 592577 - protein, 13 aa, Mycobacterium
TDSPAVEATSTRC

SEQ ID NO: 592578 - protein, 8 aa, Mycobacterium
TDSPDPPL

SEQ ID NO: 592579 - protein, 6 aa, Mycobacterium
TDSPGL

SEQ ID NO: 592580 - protein, 5 aa, Mycobacterium
TDSPV

SEQ ID NO: 592581 - protein, 13 aa, Mycobacterium
TDSPVQLSTPTDA

SEQ ID NO: 592582 - protein, 13 aa, Mycobacterium
TDSPYDADPVPTV

SEQ ID NO: 592583 - protein, 6 aa, Mycobacterium
TDSPYH

SEQ ID NO: 592584 - protein, 10 aa, Mycobacterium
TDSQNDDTQL

SEQ ID NO: 592585 - protein, 6 aa, Mycobacterium
TDSQRA

SEQ ID NO: 592586 - protein, 6 aa, Mycobacterium
TDSRAR

SEQ ID NO: 592587 - protein, 7 aa, Mycobacterium
TDSRDDV

SEQ ID NO: 592588 - protein, 8 aa, Mycobacterium
TDSRGSYV

SEQ ID NO: 592589 - protein, 9 aa, Mycobacterium
TDSRGSYVP

SEQ ID NO: 592590 - protein, 8 aa, Mycobacterium
TDSRGTYV

SEQ ID NO: 592591 - protein, 21 aa, Mycobacterium
TDSRQGSVGSPRADDAVADDA

SEQ ID NO: 592592 - protein, 12 aa, Mycobacterium
TDSSAPSSGATE

SEQ ID NO: 592593 - protein, 7 aa, Mycobacterium
TDSSGAS

SEQ ID NO: 592594 - protein, 8 aa, Mycobacterium
TDSSNPGL

SEQ ID NO: 592595 - protein, 9 aa, Mycobacterium
TDSSSATAT

SEQ ID NO: 592596 - protein, 10 aa, Mycobacterium
TDSSSGVELG

SEQ ID NO: 592597 - protein, 9 aa, Mycobacterium
TDSSSNTAT

SEQ ID NO: 592598 - protein, 24 aa, Mycobacterium
TDSTAISGHGGAGNGGNGGKGADG

SEQ ID NO: 592599 - protein, 14 aa, Mycobacterium
TDSTDSAARSKADD

SEQ ID NO: 592600 - protein, 11 aa, Mycobacterium
TDSTEARAIGR

SEQ ID NO: 592601 - protein, 7 aa, Mycobacterium
TDSTGAS

SEQ ID NO: 592602 - protein, 6 aa, Mycobacterium
TDSTID

SEQ ID NO: 592603 - protein, 5 aa, Mycobacterium
TDSTL

SEQ ID NO: 592604 - protein, 6 aa, Mycobacterium
TDSTRA

SEQ ID NO: 592605 - protein, 8 aa, Mycobacterium
TDSTSVEH

SEQ ID NO: 592606 - protein, 8 aa, Mycobacterium
TDSTTVEK

SEQ ID NO: 592607 - protein, 4 aa, Mycobacterium
TDSV

SEQ ID NO: 592608 - protein, 6 aa, Mycobacterium
TDSVNN

SEQ ID NO: 592609 - protein, 7 aa, Mycobacterium
TDSVTPI

SEQ ID NO: 592610 - protein, 5 aa, Mycobacterium
TDSYR

SEQ ID NO: 592611 - protein, 6 aa, Mycobacterium
TDSYRY

SEQ ID NO: 592612 - protein, 5 aa, Mycobacterium
TDTAA

SEQ ID NO: 592613 - protein, 6 aa, Mycobacterium
TDTAAA

SEQ ID NO: 592614 - protein, 7 aa, Mycobacterium
TDTAAGY

SEQ ID NO: 592615 - protein, 16 aa, Mycobacterium
TDTADGPQWSLQAGQN

SEQ ID NO: 592616 - protein, 10 aa, Mycobacterium
TDTADGPQWT

SEQ ID NO: 592617 - protein, 8 aa, Mycobacterium
TDTADSPH

SEQ ID NO: 592618 - protein, 5 aa, Mycobacterium
TDTAE

SEQ ID NO: 592619 - protein, 8 aa, Mycobacterium
TDTAGDDV

SEQ ID NO: 592620 - protein, 5 aa, Mycobacterium
TDTAI

SEQ ID NO: 592621 - protein, 6 aa, Mycobacterium
TDTALP

SEQ ID NO: 592622 - protein, 5 aa, Mycobacterium
TDTAP

SEQ ID NO: 592623 - protein, 8 aa, Mycobacterium
TDTAPAQD

SEQ ID NO: 592624 - protein, 5 aa, Mycobacterium
TDTAQ

SEQ ID NO: 592625 - protein, 6 aa, Mycobacterium
TDTARA

SEQ ID NO: 592626 - protein, 16 aa, Mycobacterium
TDTAREELKERSPERY

SEQ ID NO: 592627 - protein, 17 aa, Mycobacterium
TDTARKELQERSPERYD

SEQ ID NO: 592628 - protein, 8 aa, Mycobacterium
TDTARNAV

SEQ ID NO: 592629 - protein, 7 aa, Mycobacterium
TDTASAY

SEQ ID NO: 592630 - protein, 9 aa, Mycobacterium
TDTASEYAK

SEQ ID NO: 592631 - protein, 8 aa, Mycobacterium
TDTASQYA

SEQ ID NO: 592632 - protein, 14 aa, Mycobacterium
TDTATGLRNGAAQL

SEQ ID NO: 592633 - protein, 12 aa, Mycobacterium
TDTDAAAAALAG

SEQ ID NO: 592634 - protein, 7 aa, Mycobacterium
TDTDADA

SEQ ID NO: 592635 - protein, 16 aa, Mycobacterium
TDTDAPARQPRIGTRT

SEQ ID NO: 592636 - protein, 6 aa, Mycobacterium
TDTDAV

SEQ ID NO: 592637 - protein, 8 aa, Mycobacterium
TDTDDPAQ

SEQ ID NO: 592638 - protein, 18 aa, Mycobacterium
TDTDERVTESVARAADSG

SEQ ID NO: 592639 - protein, 8 aa, Mycobacterium
TDTDGSVS

SEQ ID NO: 592640 - protein, 12 aa, Mycobacterium
TDTDQGDDSGAA

SEQ ID NO: 592641 - protein, 7 aa, Mycobacterium
TDTDSEA

SEQ ID NO: 592642 - protein, 14 aa, Mycobacterium
TDTDTDAPSAATPR

SEQ ID NO: 592643 - protein, 5 aa, Mycobacterium
TDTEA

SEQ ID NO: 592644 - protein, 7 aa, Mycobacterium
TDTEAVP

SEQ ID NO: 592645 - protein, 7 aa, Mycobacterium
TDTEQLA

SEQ ID NO: 592646 - protein, 5 aa, Mycobacterium
TDTER

SEQ ID NO: 592647 - protein, 9 aa, Mycobacterium
TDTERPLTG

SEQ ID NO: 592648 - protein, 7 aa, Mycobacterium
TDTETFE

SEQ ID NO: 592649 - protein, 6 aa, Mycobacterium
TDTGEV

SEQ ID NO: 592650 - protein, 5 aa, Mycobacterium
TDTGG

SEQ ID NO: 592651 - protein, 7 aa, Mycobacterium
TDTGGAI

SEQ ID NO: 592652 - protein, 12 aa, Mycobacterium
TDTGIETEAGRT

SEQ ID NO: 592653 - protein, 7 aa, Mycobacterium
TDTGKRA

SEQ ID NO: 592654 - protein, 6 aa, Mycobacterium
TDTGNP

SEQ ID NO: 592655 - protein, 6 aa, Mycobacterium
TDTGQV

SEQ ID NO: 592656 - protein, 6 aa, Mycobacterium
TDTGRE

SEQ ID NO: 592657 - protein, 14 aa, Mycobacterium
TDTGRRNPAVTAQA

SEQ ID NO: 592658 - protein, 6 aa, Mycobacterium
TDTGSG

SEQ ID NO: 592659 - protein, 20 aa, Mycobacterium
TDTGSWKAPQPASHHRRGRG

SEQ ID NO: 592660 - protein, 28 aa, Mycobacterium
TDTGTHQDAVGQPVSGGSVARDAAEERS

SEQ ID NO: 592661 - protein, 10 aa, Mycobacterium
TDTGVPRPGL

SEQ ID NO: 592662 - protein, 8 aa, Mycobacterium
TDTHGRPC

SEQ ID NO: 592663 - protein, 8 aa, Mycobacterium
TDTKGKKE

SEQ ID NO: 592664 - protein, 8 aa, Mycobacterium
TDTKGKKN

SEQ ID NO: 592665 - protein, 9 aa, Mycobacterium
TDTKTSPPL

SEQ ID NO: 592666 - protein, 5 aa, Mycobacterium
TDTLE

SEQ ID NO: 592667 - protein, 6 aa, Mycobacterium
TDTLEE

SEQ ID NO: 592668 - protein, 5 aa, Mycobacterium
TDTLR

SEQ ID NO: 592669 - protein, 6 aa, Mycobacterium
TDTNAR

SEQ ID NO: 592670 - protein, 26 aa, Mycobacterium
TDTNGLAASPAPADAGEAREETDAEL

SEQ ID NO: 592671 - protein, 6 aa, Mycobacterium
TDTNNG

SEQ ID NO: 592672 - protein, 7 aa, Mycobacterium
TDTNPRA

SEQ ID NO: 592673 - protein, 4 aa, Mycobacterium
TDTP

SEQ ID NO: 592674 - protein, 6 aa, Mycobacterium
TDTPAA

SEQ ID NO: 592675 - protein, 10 aa, Mycobacterium
TDTPAKKLSE

SEQ ID NO: 592676 - protein, 14 aa, Mycobacterium
TDTPAPSPHIDDDQ

SEQ ID NO: 592677 - protein, 7 aa, Mycobacterium
TDTPART

SEQ ID NO: 592678 - protein, 53 aa, Mycobacterium
TDTPDPDTENCTEKPEITDEHRDKAKEMAKAYSDDLQTTTLPGSSGTVSGTSV

SEQ ID NO: 592679 - protein, 15 aa, Mycobacterium
TDTPFSNAANGYPDA

SEQ ID NO: 592680 - protein, 7 aa, Mycobacterium
TDTPGFT

SEQ ID NO: 592681 - protein, 8 aa, Mycobacterium
TDTPGFTA

SEQ ID NO: 592682 - protein, 10 aa, Mycobacterium
TDTPGFTANT

SEQ ID NO: 592683 - protein, 16 aa, Mycobacterium
TDTPGRLVSGPGEAER

SEQ ID NO: 592684 - protein, 8 aa, Mycobacterium
TDTPGVSI

SEQ ID NO: 592685 - protein, 7 aa, Mycobacterium
TDTPGVT

SEQ ID NO: 592686 - protein, 10 aa, Mycobacterium
TDTPHPRLPG

SEQ ID NO: 592687 - protein, 8 aa, Mycobacterium
TDTPPDTL

SEQ ID NO: 592688 - protein, 8 aa, Mycobacterium
TDTPPETL

SEQ ID NO: 592689 - protein, 8 aa, Mycobacterium
TDTPPETV

SEQ ID NO: 592690 - protein, 11 aa, Mycobacterium
TDTPPTPPATL

SEQ ID NO: 592691 - protein, 7 aa, Mycobacterium
TDTPQQI

SEQ ID NO: 592692 - protein, 5 aa, Mycobacterium
TDTPR

SEQ ID NO: 592693 - protein, 7 aa, Mycobacterium
TDTPRYR

SEQ ID NO: 592694 - protein, 8 aa, Mycobacterium
TDTPSPFA

SEQ ID NO: 592695 - protein, 8 aa, Mycobacterium
TDTPTENL

SEQ ID NO: 592696 - protein, 15 aa, Mycobacterium
TDTPTGYTGVDGDAQ

SEQ ID NO: 592697 - protein, 7 aa, Mycobacterium
TDTQARA

SEQ ID NO: 592698 - protein, 17 aa, Mycobacterium
TDTQQRDFKRMLDKLGS

SEQ ID NO: 592699 - protein, 9 aa, Mycobacterium
TDTQRPRRT

SEQ ID NO: 592700 - protein, 7 aa, Mycobacterium
TDTQRQQ

SEQ ID NO: 592701 - protein, 17 aa, Mycobacterium
TDTRESLANSGKNPDLE

SEQ ID NO: 592702 - protein, 17 aa, Mycobacterium
TDTRESLANSGKNPEVE

SEQ ID NO: 592703 - protein, 9 aa, Mycobacterium
TDTRGNPIA

SEQ ID NO: 592704 - protein, 6 aa, Mycobacterium
TDTRPG

SEQ ID NO: 592705 - protein, 6 aa, Mycobacterium
TDTRRG

SEQ ID NO: 592706 - protein, 8 aa, Mycobacterium
TDTSAPAL

SEQ ID NO: 592707 - protein, 10 aa, Mycobacterium
TDTSDPATIT

SEQ ID NO: 592708 - protein, 17 aa, Mycobacterium
TDTSGITPAESNDSDAE

SEQ ID NO: 592709 - protein, 6 aa, Mycobacterium
TDTSGR

SEQ ID NO: 592710 - protein, 29 aa, Mycobacterium
TDTSGSHGAAAAADGSTHSHADHDEDERI

SEQ ID NO: 592711 - protein, 12 aa, Mycobacterium
TDTSLANRESGG

SEQ ID NO: 592712 - protein, 8 aa, Mycobacterium
TDTSRGLL

SEQ ID NO: 592713 - protein, 6 aa, Mycobacterium
TDTSTA

SEQ ID NO: 592714 - protein, 13 aa, Mycobacterium
TDTSTAALESTHT

SEQ ID NO: 592715 - protein, 8 aa, Mycobacterium
TDTTDPAK

SEQ ID NO: 592716 - protein, 9 aa, Mycobacterium
TDTTPALSP

SEQ ID NO: 592717 - protein, 10 aa, Mycobacterium
TDTTQPPARR

SEQ ID NO: 592718 - protein, 7 aa, Mycobacterium
TDTTRHQ

SEQ ID NO: 592719 - protein, 12 aa, Mycobacterium
TDTTRHQPTGVS

SEQ ID NO: 592720 - protein, 9 aa, Mycobacterium
TDTTRNQLS

SEQ ID NO: 592721 - protein, 8 aa, Mycobacterium
TDTTRTQL

SEQ ID NO: 592722 - protein, 8 aa, Mycobacterium
TDTTSEEW

SEQ ID NO: 592723 - protein, 7 aa, Mycobacterium
TDTTSHT

SEQ ID NO: 592724 - protein, 6 aa, Mycobacterium
TDTTTQ

SEQ ID NO: 592725 - protein, 6 aa, Mycobacterium
TDTTTR

SEQ ID NO: 592726 - protein, 6 aa, Mycobacterium
TDTTTV

SEQ ID NO: 592727 - protein, 6 aa, Mycobacterium
TDTTTY

SEQ ID NO: 592728 - protein, 4 aa, Mycobacterium
TDTV

SEQ ID NO: 592729 - protein, 6 aa, Mycobacterium
TDTVEQ

SEQ ID NO: 592730 - protein, 8 aa, Mycobacterium
TDTVGNER

SEQ ID NO: 592731 - protein, 26 aa, Mycobacterium
TDTVGSGLTAGATRTTCATTPAGATL

SEQ ID NO: 592732 - protein, 14 aa, Mycobacterium
TDTVNGIPSRPSAL

SEQ ID NO: 592733 - protein, 14 aa, Mycobacterium
TDTVPAADNLPSRL

SEQ ID NO: 592734 - protein, 9 aa, Mycobacterium
TDTVPGDRR

SEQ ID NO: 592735 - protein, 16 aa, Mycobacterium
TDTVSDESLGSVARPD

SEQ ID NO: 592736 - protein, 9 aa, Mycobacterium
TDTVTADAA

SEQ ID NO: 592737 - protein, 4 aa, Mycobacterium
TDTW

SEQ ID NO: 592738 - protein, 7 aa, Mycobacterium
TDVAAGK

SEQ ID NO: 592739 - protein, 9 aa, Mycobacterium
TDVAAPSEL

SEQ ID NO: 592740 - protein, 13 aa, Mycobacterium
TDVAGSDALPEPT

SEQ ID NO: 592741 - protein, 10 aa, Mycobacterium
TDVAQNRDQM

SEQ ID NO: 592742 - protein, 9 aa, Mycobacterium
TDVARPAEL

SEQ ID NO: 592743 - protein, 9 aa, Mycobacterium
TDVATPTEL

SEQ ID NO: 592744 - protein, 7 aa, Mycobacterium
TDVDGPT

SEQ ID NO: 592745 - protein, 7 aa, Mycobacterium
TDVEGAD

SEQ ID NO: 592746 - protein, 11 aa, Mycobacterium
TDVEPGGHGLE

SEQ ID NO: 592747 - protein, 8 aa, Mycobacterium
TDVGETEA

SEQ ID NO: 592748 - protein, 7 aa, Mycobacterium
TDVGGGD

SEQ ID NO: 592749 - protein, 12 aa, Mycobacterium
TDVGKRNPQWTG

SEQ ID NO: 592750 - protein, 12 aa, Mycobacterium
TDVGPRNPDLPG

SEQ ID NO: 592751 - protein, 9 aa, Mycobacterium
TDVGPTAGY

SEQ ID NO: 592752 - protein, 12 aa, Mycobacterium
TDVGRAPASVHP

SEQ ID NO: 592753 - protein, 9 aa, Mycobacterium
TDVGSRAGQ

SEQ ID NO: 592754 - protein, 9 aa, Mycobacterium
TDVKGVSDS

SEQ ID NO: 592755 - protein, 5 aa, Mycobacterium
TDVNG

SEQ ID NO: 592756 - protein, 8 aa, Mycobacterium
TDVNGADR

SEQ ID NO: 592757 - protein, 9 aa, Mycobacterium
TDVNGAERH

SEQ ID NO: 592758 - protein, 9 aa, Mycobacterium
TDVNGDDRH

SEQ ID NO: 592759 - protein, 9 aa, Mycobacterium
TDVNGDGRH

SEQ ID NO: 592760 - protein, 12 aa, Mycobacterium
TDVPAGDIGVGQ

SEQ ID NO: 592761 - protein, 12 aa, Mycobacterium
TDVPAGDIGVGT

SEQ ID NO: 592762 - protein, 12 aa, Mycobacterium
TDVPAPSASIDG

SEQ ID NO: 592763 - protein, 7 aa, Mycobacterium
TDVPDGQ

SEQ ID NO: 592764 - protein, 7 aa, Mycobacterium
TDVPGSG

SEQ ID NO: 592765 - protein, 14 aa, Mycobacterium
TDVPGSNVDKNKHY

SEQ ID NO: 592766 - protein, 8 aa, Mycobacterium
TDVPGSSR

SEQ ID NO: 592767 - protein, 8 aa, Mycobacterium
TDVPGTGA

SEQ ID NO: 592768 - protein, 8 aa, Mycobacterium
TDVPPPVA

SEQ ID NO: 592769 - protein, 7 aa, Mycobacterium
TDVPTSA

SEQ ID NO: 592770 - protein, 14 aa, Mycobacterium
TDVPYEPAVGQDDL

SEQ ID NO: 592771 - protein, 26 aa, Mycobacterium
TDVQARRAELKQSGMKPRDFVERDEN

SEQ ID NO: 592772 - protein, 17 aa, Mycobacterium
TDVRADAAAAAQEPSAN

SEQ ID NO: 592773 - protein, 7 aa, Mycobacterium
TDVRDPD

SEQ ID NO: 592774 - protein, 7 aa, Mycobacterium
TDVSAGD

SEQ ID NO: 592775 - protein, 10 aa, Mycobacterium
TDVSAPSSAT

SEQ ID NO: 592776 - protein, 8 aa, Mycobacterium
TDVSDRAQ

SEQ ID NO: 592777 - protein, 16 aa, Mycobacterium
TDVSGGRQRWRATKPG

SEQ ID NO: 592778 - protein, 11 aa, Mycobacterium
TDVSPRAGDHC

SEQ ID NO: 592779 - protein, 8 aa, Mycobacterium
TDVTAAEQ

SEQ ID NO: 592780 - protein, 6 aa, Mycobacterium
TDVTDP

SEQ ID NO: 592781 - protein, 8 aa, Mycobacterium
TDVTDPAS

SEQ ID NO: 592782 - protein, 8 aa, Mycobacterium
TDVTNASR

SEQ ID NO: 592783 - protein, 6 aa, Mycobacterium
TDVTRG

SEQ ID NO: 592784 - protein, 14 aa, Mycobacterium
TDVTRYQNANETKL

SEQ ID NO: 592785 - protein, 9 aa, Mycobacterium
TDVTTPTEL

SEQ ID NO: 592786 - protein, 14 aa, Mycobacterium
TDWAGSSAKHATPI

SEQ ID NO: 592787 - protein, 16 aa, Mycobacterium
TDWATPDSAMARQRAG

SEQ ID NO: 592788 - protein, 8 aa, Mycobacterium
TDWGPTSG

SEQ ID NO: 592789 - protein, 4 aa, Mycobacterium
TDWP

SEQ ID NO: 592790 - protein, 4 aa, Mycobacterium
TDWR

SEQ ID NO: 592791 - protein, 8 aa, Mycobacterium
TDWTGGSV

SEQ ID NO: 592792 - protein, 11 aa, Mycobacterium
TDWTKRAVPDR

SEQ ID NO: 592793 - protein, 6 aa, Mycobacterium
TDYADG

SEQ ID NO: 592794 - protein, 4 aa, Mycobacterium
TDYD

SEQ ID NO: 592795 - protein, 11 aa, Mycobacterium
TDYDERPTAGE

SEQ ID NO: 592796 - protein, 7 aa, Mycobacterium
TDYEQTA

SEQ ID NO: 592797 - protein, 6 aa, Mycobacterium
TDYERE

SEQ ID NO: 592798 - protein, 8 aa, Mycobacterium
TDYPAAAQ

SEQ ID NO: 592799 - protein, 8 aa, Mycobacterium
TDYPEASQ

SEQ ID NO: 592800 - protein, 8 aa, Mycobacterium
TDYPSAAE

SEQ ID NO: 592801 - protein, 9 aa, Mycobacterium
TDYQNQSES

SEQ ID NO: 592802 - protein, 9 aa, Mycobacterium
TDYQNRSES

SEQ ID NO: 592803 - protein, 12 aa, Mycobacterium
TDYRATSDRDTF

SEQ ID NO: 592804 - protein, 11 aa, Mycobacterium
TDYRNNTRRPA

SEQ ID NO: 592805 - protein, 5 aa, Mycobacterium
TDYRR

SEQ ID NO: 592806 - protein, 6 aa, Mycobacterium
TDYSSV

SEQ ID NO: 592807 - protein, 16 aa, Mycobacterium
TDYTGTGNSLNARNPH

SEQ ID NO: 592808 - protein, 9 aa, Mycobacterium
TDYTRSNWN

SEQ ID NO: 592809 - protein, 9 aa, Mycobacterium
TEAADDRYG

SEQ ID NO: 592810 - protein, 17 aa, Mycobacterium
TEAADNVAGHTQQGKDP

SEQ ID NO: 592811 - protein, 5 aa, Mycobacterium
TEAAE

SEQ ID NO: 592812 - protein, 15 aa, Mycobacterium
TEAAEAAAALTADGP

SEQ ID NO: 592813 - protein, 6 aa, Mycobacterium
TEAAEE

SEQ ID NO: 592814 - protein, 12 aa, Mycobacterium
TEAALRAVKNGG

SEQ ID NO: 592815 - protein, 8 aa, Mycobacterium
TEAAPLRP

SEQ ID NO: 592816 - protein, 7 aa, Mycobacterium
TEAAQSA

SEQ ID NO: 592817 - protein, 10 aa, Mycobacterium
TEAAQSPGVR

SEQ ID NO: 592818 - protein, 7 aa, Mycobacterium
TEAAQTE

SEQ ID NO: 592819 - protein, 7 aa, Mycobacterium
TEAARRI

SEQ ID NO: 592820 - protein, 13 aa, Mycobacterium
TEAARRQLEETDD

SEQ ID NO: 592821 - protein, 13 aa, Mycobacterium
TEAARRQLEETED

SEQ ID NO: 592822 - protein, 25 aa, Mycobacterium
TEAARRVKDAADLGPRHGLTGEPLP

SEQ ID NO: 592823 - protein, 9 aa, Mycobacterium
TEAASDDSL

SEQ ID NO: 592824 - protein, 12 aa, Mycobacterium
TEAASVEKDTDL

SEQ ID NO: 592825 - protein, 10 aa, Mycobacterium
TEAATDPDVA

SEQ ID NO: 592826 - protein, 4 aa, Mycobacterium
TEAC

SEQ ID NO: 592827 - protein, 20 aa, Mycobacterium
TEADAPAPDPVDGVGGGTGW

SEQ ID NO: 592828 - protein, 19 aa, Mycobacterium
TEADAPAPEPAGGVGGASG

SEQ ID NO: 592829 - protein, 8 aa, Mycobacterium
TEADAWRD

SEQ ID NO: 592830 - protein, 15 aa, Mycobacterium
TEADDTWSKALGSLF

SEQ ID NO: 592831 - protein, 6 aa, Mycobacterium
TEADDV

SEQ ID NO: 592832 - protein, 9 aa, Mycobacterium
TEADGTPGQ

SEQ ID NO: 592833 - protein, 13 aa, Mycobacterium
TEADNDKQTPNAK

SEQ ID NO: 592834 - protein, 8 aa, Mycobacterium
TEADPEFP

SEQ ID NO: 592835 - protein, 14 aa, Mycobacterium
TEADVREGQDFPVS

SEQ ID NO: 592836 - protein, 11 aa, Mycobacterium
TEAEAKALREE

SEQ ID NO: 592837 - protein, 7 aa, Mycobacterium
TEAEALA

SEQ ID NO: 592838 - protein, 6 aa, Mycobacterium
TEAEAR

SEQ ID NO: 592839 - protein, 9 aa, Mycobacterium
TEAEARQQF

SEQ ID NO: 592840 - protein, 5 aa, Mycobacterium
TEAEE

SEQ ID NO: 592841 - protein, 8 aa, Mycobacterium
TEAEGRPE

SEQ ID NO: 592842 - protein, 7 aa, Mycobacterium
TEAEGSK

SEQ ID NO: 592843 - protein, 7 aa, Mycobacterium
TEAEKEQ

SEQ ID NO: 592844 - protein, 16 aa, Mycobacterium
TEAEPAAAAAARAKID

SEQ ID NO: 592845 - protein, 8 aa, Mycobacterium
TEAEQEAS

SEQ ID NO: 592846 - protein, 5 aa, Mycobacterium
TEAER

SEQ ID NO: 592847 - protein, 16 aa, Mycobacterium
TEAERASGALERSEEH

SEQ ID NO: 592848 - protein, 10 aa, Mycobacterium
TEAERDEREE

SEQ ID NO: 592849 - protein, 8 aa, Mycobacterium
TEAESREL

SEQ ID NO: 592850 - protein, 6 aa, Mycobacterium
TEAETI

SEQ ID NO: 592851 - protein, 6 aa, Mycobacterium
TEAETV

SEQ ID NO: 592852 - protein, 5 aa, Mycobacterium
TEAEV

SEQ ID NO: 592853 - protein, 6 aa, Mycobacterium
TEAEVG

SEQ ID NO: 592854 - protein, 5 aa, Mycobacterium
TEAFG

SEQ ID NO: 592855 - protein, 31 aa, Mycobacterium
TEAGAAAVAAATSKIDSAAAELSGALKPGPF

SEQ ID NO: 592856 - protein, 11 aa, Mycobacterium
TEAGAADPYAL

SEQ ID NO: 592857 - protein, 6 aa, Mycobacterium
TEAGAD

SEQ ID NO: 592858 - protein, 6 aa, Mycobacterium
TEAGAG

SEQ ID NO: 592859 - protein, 6 aa, Mycobacterium
TEAGAR

SEQ ID NO: 592860 - protein, 6 aa, Mycobacterium
TEAGEQ

SEQ ID NO: 592861 - protein, 11 aa, Mycobacterium
TEAGETKIGGR

SEQ ID NO: 592862 - protein, 7 aa, Mycobacterium
TEAGGMA

SEQ ID NO: 592863 - protein, 11 aa, Mycobacterium
TEAGGRDDDHG

SEQ ID NO: 592864 - protein, 16 aa, Mycobacterium
TEAGGWRADNTDVDGV

SEQ ID NO: 592865 - protein, 7 aa, Mycobacterium
TEAGHQV

SEQ ID NO: 592866 - protein, 5 aa, Mycobacterium
TEAGI

SEQ ID NO: 592867 - protein, 6 aa, Mycobacterium
TEAGKS

SEQ ID NO: 592868 - protein, 12 aa, Mycobacterium
TEAGLSEKTLPR

SEQ ID NO: 592869 - protein, 18 aa, Mycobacterium
TEAGNGEPARIADGEPDT

SEQ ID NO: 592870 - protein, 5 aa, Mycobacterium
TEAGP

SEQ ID NO: 592871 - protein, 11 aa, Mycobacterium
TEAGPGEPGAV

SEQ ID NO: 592872 - protein, 11 aa, Mycobacterium
TEAGPGEPGTV

SEQ ID NO: 592873 - protein, 6 aa, Mycobacterium
TEAGQR

SEQ ID NO: 592874 - protein, 9 aa, Mycobacterium
TEAGREQAK

SEQ ID NO: 592875 - protein, 6 aa, Mycobacterium
TEAGRH

SEQ ID NO: 592876 - protein, 7 aa, Mycobacterium
TEAGRHS

SEQ ID NO: 592877 - protein, 8 aa, Mycobacterium
TEAGRTAS

SEQ ID NO: 592878 - protein, 9 aa, Mycobacterium
TEAGRTASI

SEQ ID NO: 592879 - protein, 5 aa, Mycobacterium
TEAGT

SEQ ID NO: 592880 - protein, 9 aa, Mycobacterium
TEAGTASRE

SEQ ID NO: 592881 - protein, 5 aa, Mycobacterium
TEAGV

SEQ ID NO: 592882 - protein, 5 aa, Mycobacterium
TEAHG

SEQ ID NO: 592883 - protein, 10 aa, Mycobacterium
TEAIGESQIT

SEQ ID NO: 592884 - protein, 4 aa, Mycobacterium
TEAK

SEQ ID NO: 592885 - protein, 13 aa, Mycobacterium
TEAKTGRTRRFDD

SEQ ID NO: 592886 - protein, 7 aa, Mycobacterium
TEALPGA

SEQ ID NO: 592887 - protein, 8 aa, Mycobacterium
TEALPGPE

SEQ ID NO: 592888 - protein, 9 aa, Mycobacterium
TEALPGPLT

SEQ ID NO: 592889 - protein, 5 aa, Mycobacterium
TEALR

SEQ ID NO: 592890 - protein, 6 aa, Mycobacterium
TEALSE

SEQ ID NO: 592891 - protein, 11 aa, Mycobacterium
TEALTGPSDDG

SEQ ID NO: 592892 - protein, 4 aa, Mycobacterium
TEAM

SEQ ID NO: 592893 - protein, 7 aa, Mycobacterium
TEAMSAE

SEQ ID NO: 592894 - protein, 5 aa, Mycobacterium
TEANG

SEQ ID NO: 592895 - protein, 9 aa, Mycobacterium
TEAPAERLD

SEQ ID NO: 592896 - protein, 7 aa, Mycobacterium
TEAPAEV

SEQ ID NO: 592897 - protein, 33 aa, Mycobacterium
TEAPASSFSAPVGNAGRYGTPRPSPTRPAAGKR

SEQ ID NO: 592898 - protein, 5 aa, Mycobacterium
TEAPD

SEQ ID NO: 592899 - protein, 9 aa, Mycobacterium
TEAPDGTRW

SEQ ID NO: 592900 - protein, 7 aa, Mycobacterium
TEAPDRV

SEQ ID NO: 592901 - protein, 13 aa, Mycobacterium
TEAPDTGGLEPGH

SEQ ID NO: 592902 - protein, 12 aa, Mycobacterium
TEAPDTTTGPAI

SEQ ID NO: 592903 - protein, 22 aa, Mycobacterium
TEAPEQRDSEELSDEVASTGAH

SEQ ID NO: 592904 - protein, 7 aa, Mycobacterium
TEAPEQV

SEQ ID NO: 592905 - protein, 11 aa, Mycobacterium
TEAPGAYHAKD

SEQ ID NO: 592906 - protein, 7 aa, Mycobacterium
TEAPPFD

SEQ ID NO: 592907 - protein, 9 aa, Mycobacterium
TEAPSFPES

SEQ ID NO: 592908 - protein, 5 aa, Mycobacterium
TEAPV

SEQ ID NO: 592909 - protein, 11 aa, Mycobacterium
TEAQAEAEPSL

SEQ ID NO: 592910 - protein, 6 aa, Mycobacterium
TEAQAR

SEQ ID NO: 592911 - protein, 5 aa, Mycobacterium
TEAQK

SEQ ID NO: 592912 - protein, 6 aa, Mycobacterium
TEAQKR

SEQ ID NO: 592913 - protein, 6 aa, Mycobacterium
TEAQLE

SEQ ID NO: 592914 - protein, 14 aa, Mycobacterium
TEAQRDRLGATNGW

SEQ ID NO: 592915 - protein, 16 aa, Mycobacterium
TEAQRRELKRLLAHAV

SEQ ID NO: 592916 - protein, 8 aa, Mycobacterium
TEAQRTTE

SEQ ID NO: 592917 - protein, 6 aa, Mycobacterium
TEAQSQ

SEQ ID NO: 592918 - protein, 8 aa, Mycobacterium
TEAQTNKL

SEQ ID NO: 592919 - protein, 4 aa, Mycobacterium
TEAR

SEQ ID NO: 592920 - protein, 8 aa, Mycobacterium
TEARDAGD

SEQ ID NO: 592921 - protein, 9 aa, Mycobacterium
TEARELTGT

SEQ ID NO: 592922 - protein, 9 aa, Mycobacterium
TEARGGPLG

SEQ ID NO: 592923 - protein, 5 aa, Mycobacterium
TEARL

SEQ ID NO: 592924 - protein, 8 aa, Mycobacterium
TEARRPDS

SEQ ID NO: 592925 - protein, 17 aa, Mycobacterium
TEARTEQMAHRAELAAL

SEQ ID NO: 592926 - protein, 4 aa, Mycobacterium
TEAS

SEQ ID NO: 592927 - protein, 6 aa, Mycobacterium
TEASAR

SEQ ID NO: 592928 - protein, 10 aa, Mycobacterium
TEASGAEGSG

SEQ ID NO: 592929 - protein, 12 aa, Mycobacterium
TEASGAEGSGPR

SEQ ID NO: 592930 - protein, 6 aa, Mycobacterium
TEASHA

SEQ ID NO: 592931 - protein, 10 aa, Mycobacterium
TEASKIPPRT

SEQ ID NO: 592932 - protein, 11 aa, Mycobacterium
TEASLTPAHDA

SEQ ID NO: 592933 - protein, 10 aa, Mycobacterium
TEASPTADPQ

SEQ ID NO: 592934 - protein, 8 aa, Mycobacterium
TEASSTRE

SEQ ID NO: 592935 - protein, 8 aa, Mycobacterium
TEASTAKV

SEQ ID NO: 592936 - protein, 4 aa, Mycobacterium
TEAT

SEQ ID NO: 592937 - protein, 5 aa, Mycobacterium
TEATA

SEQ ID NO: 592938 - protein, 7 aa, Mycobacterium
TEATATK

SEQ ID NO: 592939 - protein, 5 aa, Mycobacterium
TEATE

SEQ ID NO: 592940 - protein, 15 aa, Mycobacterium
TEATEARTVDAPTSH

SEQ ID NO: 592941 - protein, 12 aa, Mycobacterium
TEATEPAPADSS

SEQ ID NO: 592942 - protein, 11 aa, Mycobacterium
TEATGAPTAAH

SEQ ID NO: 592943 - protein, 13 aa, Mycobacterium
TEATGRNARPVAT

SEQ ID NO: 592944 - protein, 15 aa, Mycobacterium
TEATISPDVDKAGEH

SEQ ID NO: 592945 - protein, 12 aa, Mycobacterium
TEATNTVHDDAR

SEQ ID NO: 592946 - protein, 10 aa, Mycobacterium
TEATRRDESH

SEQ ID NO: 592947 - protein, 5 aa, Mycobacterium
TEATT

SEQ ID NO: 592948 - protein, 8 aa, Mycobacterium
TEATTVPL

SEQ ID NO: 592949 - protein, 14 aa, Mycobacterium
TEAVPSSNRISAGA

SEQ ID NO: 592950 - protein, 7 aa, Mycobacterium
TEAVTGS

SEQ ID NO: 592951 - protein, 6 aa, Mycobacterium
TEAYPQ

SEQ ID NO: 592952 - protein, 7 aa, Mycobacterium
TEAYTNA

SEQ ID NO: 592953 - protein, 6 aa, Mycobacterium
TECADR

SEQ ID NO: 592954 - protein, 12 aa, Mycobacterium
TECGRPRGRAPS

SEQ ID NO: 592955 - protein, 6 aa, Mycobacterium
TECNRG

SEQ ID NO: 592956 - protein, 9 aa, Mycobacterium
TECQSPGNV

SEQ ID NO: 592957 - protein, 10 aa, Mycobacterium
TEDAARPDAV

SEQ ID NO: 592958 - protein, 7 aa, Mycobacterium
TEDAATA

SEQ ID NO: 592959 - protein, 9 aa, Mycobacterium
TEDADPAAL

SEQ ID NO: 592960 - protein, 13 aa, Mycobacterium
TEDAEGDEPSGED

SEQ ID NO: 592961 - protein, 21 aa, Mycobacterium
TEDAKEGPRAFAEKRPPRWRA

SEQ ID NO: 592962 - protein, 6 aa, Mycobacterium
TEDAPN

SEQ ID NO: 592963 - protein, 7 aa, Mycobacterium
TEDAPND

SEQ ID NO: 592964 - protein, 8 aa, Mycobacterium
TEDAQEGP

SEQ ID NO: 592965 - protein, 12 aa, Mycobacterium
TEDARAKFGVAS

SEQ ID NO: 592966 - protein, 6 aa, Mycobacterium
TEDARS

SEQ ID NO: 592967 - protein, 6 aa, Mycobacterium
TEDARV

SEQ ID NO: 592968 - protein, 5 aa, Mycobacterium
TEDAS

SEQ ID NO: 592969 - protein, 9 aa, Mycobacterium
TEDATQAEV

SEQ ID NO: 592970 - protein, 4 aa, Mycobacterium
TEDD

SEQ ID NO: 592971 - protein, 11 aa, Mycobacterium
TEDDDAVPEEL

SEQ ID NO: 592972 - protein, 6 aa, Mycobacterium
TEDDEA

SEQ ID NO: 592973 - protein, 6 aa, Mycobacterium
TEDDED

SEQ ID NO: 592974 - protein, 7 aa, Mycobacterium
TEDDEPI

SEQ ID NO: 592975 - protein, 5 aa, Mycobacterium
TEDDH

SEQ ID NO: 592976 - protein, 9 aa, Mycobacterium
TEDDLEETA

SEQ ID NO: 592977 - protein, 9 aa, Mycobacterium
TEDDLNETA

SEQ ID NO: 592978 - protein, 7 aa, Mycobacterium
TEDDLTE

SEQ ID NO: 592979 - protein, 8 aa, Mycobacterium
TEDDPAQA

SEQ ID NO: 592980 - protein, 8 aa, Mycobacterium
TEDDPEAI

SEQ ID NO: 592981 - protein, 7 aa, Mycobacterium
TEDDPEF

SEQ ID NO: 592982 - protein, 6 aa, Mycobacterium
TEDDPW

SEQ ID NO: 592983 - protein, 11 aa, Mycobacterium
TEDDSDGAGQC

SEQ ID NO: 592984 - protein, 8 aa, Mycobacterium
TEDDSRES

SEQ ID NO: 592985 - protein, 4 aa, Mycobacterium
TEDE

SEQ ID NO: 592986 - protein, 15 aa, Mycobacterium
TEDEAPNAKGGVDKR

SEQ ID NO: 592987 - protein, 6 aa, Mycobacterium
TEDEAR

SEQ ID NO: 592988 - protein, 11 aa, Mycobacterium
TEDEDGNRFSD

SEQ ID NO: 592989 - protein, 5 aa, Mycobacterium
TEDEL

SEQ ID NO: 592990 - protein, 6 aa, Mycobacterium
TEDELA

SEQ ID NO: 592991 - protein, 5 aa, Mycobacterium
TEDER

SEQ ID NO: 592992 - protein, 8 aa, Mycobacterium
TEDERSYA

SEQ ID NO: 592993 - protein, 8 aa, Mycobacterium
TEDEVTPQ

SEQ ID NO: 592994 - protein, 11 aa, Mycobacterium
TEDGDDGLPAR

SEQ ID NO: 592995 - protein, 6 aa, Mycobacterium
TEDGEL

SEQ ID NO: 592996 - protein, 8 aa, Mycobacterium
TEDGGEDL

SEQ ID NO: 592997 - protein, 9 aa, Mycobacterium
TEDGIDAAR

SEQ ID NO: 592998 - protein, 8 aa, Mycobacterium
TEDGIPQT

SEQ ID NO: 592999 - protein, 6 aa, Mycobacterium
TEDGIS

SEQ ID NO: 593000 - protein, 8 aa, Mycobacterium
TEDGKPVN

SEQ ID NO: 593001 - protein, 9 aa, Mycobacterium
TEDGKPVNH

SEQ ID NO: 593002 - protein, 8 aa, Mycobacterium
TEDGQLRD

SEQ ID NO: 593003 - protein, 11 aa, Mycobacterium
TEDGQRQIGTV

SEQ ID NO: 593004 - protein, 5 aa, Mycobacterium
TEDGR

SEQ ID NO: 593005 - protein, 6 aa, Mycobacterium
TEDGRR

SEQ ID NO: 593006 - protein, 11 aa, Mycobacterium
TEDGSPENKGP

SEQ ID NO: 593007 - protein, 10 aa, Mycobacterium
TEDGSPQGAR

SEQ ID NO: 593008 - protein, 8 aa, Mycobacterium
TEDGTVTT

SEQ ID NO: 593009 - protein, 9 aa, Mycobacterium
TEDGVDAAR

SEQ ID NO: 593010 - protein, 4 aa, Mycobacterium
TEDI

SEQ ID NO: 593011 - protein, 9 aa, Mycobacterium
TEDIASAAG

SEQ ID NO: 593012 - protein, 4 aa, Mycobacterium
TEDL

SEQ ID NO: 593013 - protein, 18 aa, Mycobacterium
TEDLGENPTSEPELRERA

SEQ ID NO: 593014 - protein, 21 aa, Mycobacterium
TEDMGAAGDGSGGPAGNLDDE

SEQ ID NO: 593015 - protein, 9 aa, Mycobacterium
TEDNIYQTE

SEQ ID NO: 593016 - protein, 5 aa, Mycobacterium
TEDNV

SEQ ID NO: 593017 - protein, 11 aa, Mycobacterium
TEDPAAAAAEL

SEQ ID NO: 593018 - protein, 15 aa, Mycobacterium
TEDPANGFRPDTGRI

SEQ ID NO: 593019 - protein, 7 aa, Mycobacterium
TEDPDVQ

SEQ ID NO: 593020 - protein, 9 aa, Mycobacterium
TEDPEPRGH

SEQ ID NO: 593021 - protein, 6 aa, Mycobacterium
TEDPLE

SEQ ID NO: 593022 - protein, 9 aa, Mycobacterium
TEDPPPDIA

SEQ ID NO: 593023 - protein, 9 aa, Mycobacterium
TEDPSAGVD

SEQ ID NO: 593024 - protein, 11 aa, Mycobacterium
TEDPSEGVDGQ

SEQ ID NO: 593025 - protein, 10 aa, Mycobacterium
TEDPSPGVDG

SEQ ID NO: 593026 - protein, 11 aa, Mycobacterium
TEDPSPGVDGQ

SEQ ID NO: 593027 - protein, 9 aa, Mycobacterium
TEDPSSGVD

SEQ ID NO: 593028 - protein, 5 aa, Mycobacterium
TEDPT

SEQ ID NO: 593029 - protein, 11 aa, Mycobacterium
TEDPTLNWSTP

SEQ ID NO: 593030 - protein, 14 aa, Mycobacterium
TEDPTNGFRPDTGR

SEQ ID NO: 593031 - protein, 7 aa, Mycobacterium
TEDPTRA

SEQ ID NO: 593032 - protein, 7 aa, Mycobacterium
TEDPTRQ

SEQ ID NO: 593033 - protein, 11 aa, Mycobacterium
TEDPTVNWSTP

SEQ ID NO: 593034 - protein, 5 aa, Mycobacterium
TEDPV

SEQ ID NO: 593035 - protein, 4 aa, Mycobacterium
TEDQ

SEQ ID NO: 593036 - protein, 5 aa, Mycobacterium
TEDQA

SEQ ID NO: 593037 - protein, 7 aa, Mycobacterium
TEDQKAR

SEQ ID NO: 593038 - protein, 5 aa, Mycobacterium
TEDQT

SEQ ID NO: 593039 - protein, 8 aa, Mycobacterium
TEDRADKG

SEQ ID NO: 593040 - protein, 5 aa, Mycobacterium
TEDRE

SEQ ID NO: 593041 - protein, 10 aa, Mycobacterium
TEDRGDGPRY

SEQ ID NO: 593042 - protein, 8 aa, Mycobacterium
TEDRGSED

SEQ ID NO: 593043 - protein, 7 aa, Mycobacterium
TEDRKIG

SEQ ID NO: 593044 - protein, 8 aa, Mycobacterium
TEDRPTQV

SEQ ID NO: 593045 - protein, 9 aa, Mycobacterium
TEDSADLSA

SEQ ID NO: 593046 - protein, 5 aa, Mycobacterium
TEDSR

SEQ ID NO: 593047 - protein, 6 aa, Mycobacterium
TEDSRI

SEQ ID NO: 593048 - protein, 11 aa, Mycobacterium
TEDSTAARAEL

SEQ ID NO: 593049 - protein, 8 aa, Mycobacterium
TEDSTDLA

SEQ ID NO: 593050 - protein, 10 aa, Mycobacterium
TEDSTDLTSA

SEQ ID NO: 593051 - protein, 8 aa, Mycobacterium
TEDSTDQR

SEQ ID NO: 593052 - protein, 10 aa, Mycobacterium
TEDSVARSQL

SEQ ID NO: 593053 - protein, 4 aa, Mycobacterium
TEDT

SEQ ID NO: 593054 - protein, 10 aa, Mycobacterium
TEDTGELTPT

SEQ ID NO: 593055 - protein, 13 aa, Mycobacterium
TEDTGPGAGLTPR

SEQ ID NO: 593056 - protein, 12 aa, Mycobacterium
TEDVRGDYGQSL

SEQ ID NO: 593057 - protein, 13 aa, Mycobacterium
TEDVSDLTGDHAE

SEQ ID NO: 593058 - protein, 11 aa, Mycobacterium
TEDVSDLTGEH

SEQ ID NO: 593059 - protein, 4 aa, Mycobacterium
TEDY

SEQ ID NO: 593060 - protein, 8 aa, Mycobacterium
TEDYQQAY

SEQ ID NO: 593061 - protein, 6 aa, Mycobacterium
TEDYVH

SEQ ID NO: 593062 - protein, 12 aa, Mycobacterium
TEEAAALRGKWS

SEQ ID NO: 593063 - protein, 10 aa, Mycobacterium
TEEAKSRNVN

SEQ ID NO: 593064 - protein, 10 aa, Mycobacterium
TEEAKTGKLK

SEQ ID NO: 593065 - protein, 5 aa, Mycobacterium
TEEAN

SEQ ID NO: 593066 - protein, 8 aa, Mycobacterium
TEEANSLR

SEQ ID NO: 593067 - protein, 10 aa, Mycobacterium
TEEASAGTDI

SEQ ID NO: 593068 - protein, 5 aa, Mycobacterium
TEEDA

SEQ ID NO: 593069 - protein, 6 aa, Mycobacterium
TEEDDD

SEQ ID NO: 593070 - protein, 17 aa, Mycobacterium
TEEDDRASRLRAGEATS

SEQ ID NO: 593071 - protein, 5 aa, Mycobacterium
TEEEA

SEQ ID NO: 593072 - protein, 11 aa, Mycobacterium
TEEEADRALQA

SEQ ID NO: 593073 - protein, 12 aa, Mycobacterium
TEEEADRALSAG

SEQ ID NO: 593074 - protein, 11 aa, Mycobacterium
TEEEADRALTA

SEQ ID NO: 593075 - protein, 5 aa, Mycobacterium
TEEEV

SEQ ID NO: 593076 - protein, 14 aa, Mycobacterium
TEEEYDSASAVNAK

SEQ ID NO: 593077 - protein, 5 aa, Mycobacterium
TEEFE

SEQ ID NO: 593078 - protein, 9 aa, Mycobacterium
TEEFTRGAY

SEQ ID NO: 593079 - protein, 11 aa, Mycobacterium
TEEGADKPHRN

SEQ ID NO: 593080 - protein, 7 aa, Mycobacterium
TEEGEAV

SEQ ID NO: 593081 - protein, 9 aa, Mycobacterium
TEEGFPQGA

SEQ ID NO: 593082 - protein, 14 aa, Mycobacterium
TEEGKTKAEGIGEV

SEQ ID NO: 593083 - protein, 9 aa, Mycobacterium
TEEGQSYSL

SEQ ID NO: 593084 - protein, 7 aa, Mycobacterium
TEEGRRL

SEQ ID NO: 593085 - protein, 10 aa, Mycobacterium
TEEGSGTTTI

SEQ ID NO: 593086 - protein, 12 aa, Mycobacterium
TEEHTRVPAPED

SEQ ID NO: 593087 - protein, 5 aa, Mycobacterium
TEEIE

SEQ ID NO: 593088 - protein, 13 aa, Mycobacterium
TEEIGAPPSLAAG

SEQ ID NO: 593089 - protein, 14 aa, Mycobacterium
TEEKAAIATAAGAT

SEQ ID NO: 593090 - protein, 14 aa, Mycobacterium
TEEKADVARAAGAT

SEQ ID NO: 593091 - protein, 14 aa, Mycobacterium
TEEKADVATAAGAT

SEQ ID NO: 593092 - protein, 5 aa, Mycobacterium
TEELE

SEQ ID NO: 593093 - protein, 7 aa, Mycobacterium
TEELEAE

SEQ ID NO: 593094 - protein, 5 aa, Mycobacterium
TEELG

SEQ ID NO: 593095 - protein, 7 aa, Mycobacterium
TEELGPN

SEQ ID NO: 593096 - protein, 21 aa, Mycobacterium
TEEMGAAGDGSGGPAGNLDDE

SEQ ID NO: 593097 - protein, 4 aa, Mycobacterium
TEEN

SEQ ID NO: 593098 - protein, 6 aa, Mycobacterium
TEENRG

SEQ ID NO: 593099 - protein, 5 aa, Mycobacterium
TEEPA

SEQ ID NO: 593100 - protein, 7 aa, Mycobacterium
TEEPDRL

SEQ ID NO: 593101 - protein, 59 aa, Mycobacterium
TEEPVKRTATKTPAKKAPAKRAAKSAAAKAGGKAPAKKAPAKRAAKGTAAKPEDGVTDD

SEQ ID NO: 593102 - protein, 4 aa, Mycobacterium
TEEQ

SEQ ID NO: 593103 - protein, 15 aa, Mycobacterium
TEEQAASGAGLDAQR

SEQ ID NO: 593104 - protein, 11 aa, Mycobacterium
TEEQARAEGYD

SEQ ID NO: 593105 - protein, 11 aa, Mycobacterium
TEEQARDEGYD

SEQ ID NO: 593106 - protein, 10 aa, Mycobacterium
TEEQAREEGH

SEQ ID NO: 593107 - protein, 8 aa, Mycobacterium
TEEQAVQA

SEQ ID NO: 593108 - protein, 7 aa, Mycobacterium
TEEQKAR

SEQ ID NO: 593109 - protein, 7 aa, Mycobacterium
TEEQKQR

SEQ ID NO: 593110 - protein, 6 aa, Mycobacterium
TEEQKR

SEQ ID NO: 593111 - protein, 9 aa, Mycobacterium
TEEQKRTYL

SEQ ID NO: 593112 - protein, 6 aa, Mycobacterium
TEEQKT

SEQ ID NO: 593113 - protein, 7 aa, Mycobacterium
TEEQKTA

SEQ ID NO: 593114 - protein, 8 aa, Mycobacterium
TEEQQRKH

SEQ ID NO: 593115 - protein, 6 aa, Mycobacterium
TEEQRD

SEQ ID NO: 593116 - protein, 6 aa, Mycobacterium
TEEQRR

SEQ ID NO: 593117 - protein, 8 aa, Mycobacterium
TEEQRRDW

SEQ ID NO: 593118 - protein, 11 aa, Mycobacterium
TEEQRTTGYTG

SEQ ID NO: 593119 - protein, 10 aa, Mycobacterium
TEEQRVPDNL

SEQ ID NO: 593120 - protein, 10 aa, Mycobacterium
TEEQVGRATE

SEQ ID NO: 593121 - protein, 7 aa, Mycobacterium
TEERFPN

SEQ ID NO: 593122 - protein, 5 aa, Mycobacterium
TEERG

SEQ ID NO: 593123 - protein, 5 aa, Mycobacterium
TEERV

SEQ ID NO: 593124 - protein, 13 aa, Mycobacterium
TEESEHAGAVDER

SEQ ID NO: 593125 - protein, 9 aa, Mycobacterium
TEESGRGEG

SEQ ID NO: 593126 - protein, 23 aa, Mycobacterium
TEESNAVGQKQGESESTGHASGR

SEQ ID NO: 593127 - protein, 17 aa, Mycobacterium
TEESPGRSTAASTLAAE

SEQ ID NO: 593128 - protein, 8 aa, Mycobacterium
TEETARKA

SEQ ID NO: 593129 - protein, 5 aa, Mycobacterium
TEETC

SEQ ID NO: 593130 - protein, 13 aa, Mycobacterium
TEETGASISIEDD

SEQ ID NO: 593131 - protein, 10 aa, Mycobacterium
TEETKTLAAE

SEQ ID NO: 593132 - protein, 12 aa, Mycobacterium
TEETTEPSAVAG

SEQ ID NO: 593133 - protein, 5 aa, Mycobacterium
TEEVD

SEQ ID NO: 593134 - protein, 6 aa, Mycobacterium
TEEVEI

SEQ ID NO: 593135 - protein, 15 aa, Mycobacterium
TEEVSGKQAKDLTDE

SEQ ID NO: 593136 - protein, 15 aa, Mycobacterium
TEEVSGKQAKELTDD

SEQ ID NO: 593137 - protein, 11 aa, Mycobacterium
TEEYPEKPGPV

SEQ ID NO: 593138 - protein, 14 aa, Mycobacterium
TEEYPEKPGPVAPR

SEQ ID NO: 593139 - protein, 19 aa, Mycobacterium
TEFAGREADDSAARKVRER

SEQ ID NO: 593140 - protein, 18 aa, Mycobacterium
TEFGPAPQTTNAAAEPMQ

SEQ ID NO: 593141 - protein, 13 aa, Mycobacterium
TEFGPEQLRAGAD

SEQ ID NO: 593142 - protein, 14 aa, Mycobacterium
TEFGRDTADISDRQ

SEQ ID NO: 593143 - protein, 6 aa, Mycobacterium
TEFGRR

SEQ ID NO: 593144 - protein, 9 aa, Mycobacterium
TEFGSGGRY

SEQ ID NO: 593145 - protein, 4 aa, Mycobacterium
TEFP

SEQ ID NO: 593146 - protein, 7 aa, Mycobacterium
TEFPRGR

SEQ ID NO: 593147 - protein, 7 aa, Mycobacterium
TEFPTTT

SEQ ID NO: 593148 - protein, 11 aa, Mycobacterium
TEFRPGPRADH

SEQ ID NO: 593149 - protein, 4 aa, Mycobacterium
TEFS

SEQ ID NO: 593150 - protein, 4 aa, Mycobacterium
TEGA

SEQ ID NO: 593151 - protein, 6 aa, Mycobacterium
TEGAAA

SEQ ID NO: 593152 - protein, 7 aa, Mycobacterium
TEGADGI

SEQ ID NO: 593153 - protein, 8 aa, Mycobacterium
TEGADPGH

SEQ ID NO: 593154 - protein, 11 aa, Mycobacterium
TEGAGAESAQL

SEQ ID NO: 593155 - protein, 14 aa, Mycobacterium
TEGALPPPRKKSRR

SEQ ID NO: 593156 - protein, 16 aa, Mycobacterium
TEGARGGLHNDDEDRR

SEQ ID NO: 593157 - protein, 13 aa, Mycobacterium
TEGARGYSPDSGH

SEQ ID NO: 593158 - protein, 11 aa, Mycobacterium
TEGASAFQSGI

SEQ ID NO: 593159 - protein, 9 aa, Mycobacterium
TEGDAAAAS

SEQ ID NO: 593160 - protein, 10 aa, Mycobacterium
TEGDEPSGED

SEQ ID NO: 593161 - protein, 13 aa, Mycobacterium
TEGDHEREHEEQD

SEQ ID NO: 593162 - protein, 11 aa, Mycobacterium
TEGDRNQGPIA

SEQ ID NO: 593163 - protein, 12 aa, Mycobacterium
TEGDRRADEPIA

SEQ ID NO: 593164 - protein, 4 aa, Mycobacterium
TEGE

SEQ ID NO: 593165 - protein, 5 aa, Mycobacterium
TEGEC

SEQ ID NO: 593166 - protein, 10 aa, Mycobacterium
TEGEFGGGPR

SEQ ID NO: 593167 - protein, 15 aa, Mycobacterium
TEGEGGDDTSESGAP

SEQ ID NO: 593168 - protein, 5 aa, Mycobacterium
TEGEL

SEQ ID NO: 593169 - protein, 6 aa, Mycobacterium
TEGERQ

SEQ ID NO: 593170 - protein, 11 aa, Mycobacterium
TEGESQEPAMA

SEQ ID NO: 593171 - protein, 10 aa, Mycobacterium
TEGEWRDSAS

SEQ ID NO: 593172 - protein, 4 aa, Mycobacterium
TEGF

SEQ ID NO: 593173 - protein, 11 aa, Mycobacterium
TEGGAAHSDEL

SEQ ID NO: 593174 - protein, 6 aa, Mycobacterium
TEGGAL

SEQ ID NO: 593175 - protein, 7 aa, Mycobacterium
TEGGEEL

SEQ ID NO: 593176 - protein, 7 aa, Mycobacterium
TEGGEPR

SEQ ID NO: 593177 - protein, 5 aa, Mycobacterium
TEGGF

SEQ ID NO: 593178 - protein, 11 aa, Mycobacterium
TEGGSDGGATR

SEQ ID NO: 593179 - protein, 5 aa, Mycobacterium
TEGGT

SEQ ID NO: 593180 - protein, 6 aa, Mycobacterium
TEGHEA

SEQ ID NO: 593181 - protein, 8 aa, Mycobacterium
TEGHQNDA

SEQ ID NO: 593182 - protein, 9 aa, Mycobacterium
TEGHQNDAR

SEQ ID NO: 593183 - protein, 6 aa, Mycobacterium
TEGIPD

SEQ ID NO: 593184 - protein, 9 aa, Mycobacterium
TEGITNRKQ

SEQ ID NO: 593185 - protein, 6 aa, Mycobacterium
TEGKKA

SEQ ID NO: 593186 - protein, 5 aa, Mycobacterium
TEGLA

SEQ ID NO: 593187 - protein, 7 aa, Mycobacterium
TEGLPEA

SEQ ID NO: 593188 - protein, 5 aa, Mycobacterium
TEGLQ

SEQ ID NO: 593189 - protein, 6 aa, Mycobacterium
TEGMEQ

SEQ ID NO: 593190 - protein, 5 aa, Mycobacterium
TEGMH

SEQ ID NO: 593191 - protein, 6 aa, Mycobacterium
TEGMHE

SEQ ID NO: 593192 - protein, 4 aa, Mycobacterium
TEGN

SEQ ID NO: 593193 - protein, 5 aa, Mycobacterium
TEGNQ

SEQ ID NO: 593194 - protein, 9 aa, Mycobacterium
TEGNRSIEN

SEQ ID NO: 593195 - protein, 4 aa, Mycobacterium
TEGP

SEQ ID NO: 593196 - protein, 8 aa, Mycobacterium
TEGPDPVD

SEQ ID NO: 593197 - protein, 13 aa, Mycobacterium
TEGPKSPTQAHPG

SEQ ID NO: 593198 - protein, 5 aa, Mycobacterium
TEGPV

SEQ ID NO: 593199 - protein, 8 aa, Mycobacterium
TEGPVGVG

SEQ ID NO: 593200 - protein, 6 aa, Mycobacterium
TEGQTV

SEQ ID NO: 593201 - protein, 17 aa, Mycobacterium
TEGQVAVGGASDAESLT

SEQ ID NO: 593202 - protein, 6 aa, Mycobacterium
TEGRGV

SEQ ID NO: 593203 - protein, 8 aa, Mycobacterium
TEGRPEEF

SEQ ID NO: 593204 - protein, 8 aa, Mycobacterium
TEGRPPAE

SEQ ID NO: 593205 - protein, 7 aa, Mycobacterium
TEGSQAV

SEQ ID NO: 593206 - protein, 5 aa, Mycobacterium
TEGSV

SEQ ID NO: 593207 - protein, 18 aa, Mycobacterium
TEGSVPQQLRTAAESAGI

SEQ ID NO: 593208 - protein, 4 aa, Mycobacterium
TEGT

SEQ ID NO: 593209 - protein, 8 aa, Mycobacterium
TEGTDKPL

SEQ ID NO: 593210 - protein, 7 aa, Mycobacterium
TEGTDLQ

SEQ ID NO: 593211 - protein, 6 aa, Mycobacterium
TEGTGW

SEQ ID NO: 593212 - protein, 9 aa, Mycobacterium
TEGTPSHSD

SEQ ID NO: 593213 - protein, 5 aa, Mycobacterium
TEGVA

SEQ ID NO: 593214 - protein, 5 aa, Mycobacterium
TEGVG

SEQ ID NO: 593215 - protein, 12 aa, Mycobacterium
TEGVRGELADTG

SEQ ID NO: 593216 - protein, 11 aa, Mycobacterium
TEGVRGTGPAM

SEQ ID NO: 593217 - protein, 12 aa, Mycobacterium
TEGVRRTGGNTV

SEQ ID NO: 593218 - protein, 5 aa, Mycobacterium
TEGVS

SEQ ID NO: 593219 - protein, 8 aa, Mycobacterium
TEGVSGPL

SEQ ID NO: 593220 - protein, 5 aa, Mycobacterium
TEGYM

SEQ ID NO: 593221 - protein, 14 aa, Mycobacterium
TEGYPEKPGPVAPR

SEQ ID NO: 593222 - protein, 13 aa, Mycobacterium
TEGYPSRPGGAQA

SEQ ID NO: 593223 - protein, 8 aa, Mycobacterium
TEHAAAMG

SEQ ID NO: 593224 - protein, 7 aa, Mycobacterium
TEHADRD

SEQ ID NO: 593225 - protein, 7 aa, Mycobacterium
TEHAPEL

SEQ ID NO: 593226 - protein, 11 aa, Mycobacterium
TEHDAVAPDPL

SEQ ID NO: 593227 - protein, 6 aa, Mycobacterium
TEHDDP

SEQ ID NO: 593228 - protein, 12 aa, Mycobacterium
TEHDETTAEAAR

SEQ ID NO: 593229 - protein, 8 aa, Mycobacterium
TEHDRTAT

SEQ ID NO: 593230 - protein, 9 aa, Mycobacterium
TEHDTRNAQ

SEQ ID NO: 593231 - protein, 4 aa, Mycobacterium
TEHG

SEQ ID NO: 593232 - protein, 5 aa, Mycobacterium
TEHGG

SEQ ID NO: 593233 - protein, 11 aa, Mycobacterium
TEHGGGQRKVP

SEQ ID NO: 593234 - protein, 10 aa, Mycobacterium
TEHGGTGDVG

SEQ ID NO: 593235 - protein, 14 aa, Mycobacterium
TEHGVPKSAGTPAD

SEQ ID NO: 593236 - protein, 4 aa, Mycobacterium
TEHL

SEQ ID NO: 593237 - protein, 10 aa, Mycobacterium
TEHPDGTERL

SEQ ID NO: 593238 - protein, 6 aa, Mycobacterium
TEHPEA

SEQ ID NO: 593239 - protein, 7 aa, Mycobacterium
TEHPQEA

SEQ ID NO: 593240 - protein, 7 aa, Mycobacterium
TEHPSND

SEQ ID NO: 593241 - protein, 5 aa, Mycobacterium
TEHRP

SEQ ID NO: 593242 - protein, 9 aa, Mycobacterium
TEHTPDGEG

SEQ ID NO: 593243 - protein, 5 aa, Mycobacterium
TEHVD

SEQ ID NO: 593244 - protein, 13 aa, Mycobacterium
TEHVPDPDAFSDE

SEQ ID NO: 593245 - protein, 17 aa, Mycobacterium
TEIADGDSVTILPAVAG

SEQ ID NO: 593246 - protein, 4 aa, Mycobacterium
TEID

SEQ ID NO: 593247 - protein, 5 aa, Mycobacterium
TEIDE

SEQ ID NO: 593248 - protein, 9 aa, Mycobacterium
TEIESETGR

SEQ ID NO: 593249 - protein, 4 aa, Mycobacterium
TEIG

SEQ ID NO: 593250 - protein, 5 aa, Mycobacterium
TEIGI

SEQ ID NO: 593251 - protein, 32 aa, Mycobacterium
TEIGPDDPGSADELDDDPRIDDGHFYEDVLED

SEQ ID NO: 593252 - protein, 15 aa, Mycobacterium
TEIPATVDPPWSDPA

SEQ ID NO: 593253 - protein, 5 aa, Mycobacterium
TEIPD

SEQ ID NO: 593254 - protein, 5 aa, Mycobacterium
TEIPG

SEQ ID NO: 593255 - protein, 7 aa, Mycobacterium
TEIPQAG

SEQ ID NO: 593256 - protein, 16 aa, Mycobacterium
TEIPTRSKELINDLLQ

SEQ ID NO: 593257 - protein, 4 aa, Mycobacterium
TEIR

SEQ ID NO: 593258 - protein, 8 aa, Mycobacterium
TEIRSGPD

SEQ ID NO: 593259 - protein, 5 aa, Mycobacterium
TEISG

SEQ ID NO: 593260 - protein, 9 aa, Mycobacterium
TEISGAPGA

SEQ ID NO: 593261 - protein, 13 aa, Mycobacterium
TEISPDGATTSVL

SEQ ID NO: 593262 - protein, 4 aa, Mycobacterium
TEIT

SEQ ID NO: 593263 - protein, 10 aa, Mycobacterium
TEITRERGPA

SEQ ID NO: 593264 - protein, 10 aa, Mycobacterium
TEKAARRGLA

SEQ ID NO: 593265 - protein, 11 aa, Mycobacterium
TEKADGTGTIE

SEQ ID NO: 593266 - protein, 9 aa, Mycobacterium
TEKDPEKRL

SEQ ID NO: 593267 - protein, 8 aa, Mycobacterium
TEKEDEPD

SEQ ID NO: 593268 - protein, 16 aa, Mycobacterium
TEKEEAERKNKTRGGA

SEQ ID NO: 593269 - protein, 9 aa, Mycobacterium
TEKEEESEI

SEQ ID NO: 593270 - protein, 12 aa, Mycobacterium
TEKEGVYGVGPK

SEQ ID NO: 593271 - protein, 6 aa, Mycobacterium
TEKGAI

SEQ ID NO: 593272 - protein, 12 aa, Mycobacterium
TEKGEKLPAAQR

SEQ ID NO: 593273 - protein, 11 aa, Mycobacterium
TEKGQAEAVRS

SEQ ID NO: 593274 - protein, 13 aa, Mycobacterium
TEKGRSEAQRGGE

SEQ ID NO: 593275 - protein, 10 aa, Mycobacterium
TEKGSKRHAG

SEQ ID NO: 593276 - protein, 7 aa, Mycobacterium
TEKIGAG

SEQ ID NO: 593277 - protein, 9 aa, Mycobacterium
TEKNDHPAV

SEQ ID NO: 593278 - protein, 10 aa, Mycobacterium
TEKPARETAN

SEQ ID NO: 593279 - protein, 7 aa, Mycobacterium
TEKPKHT

SEQ ID NO: 593280 - protein, 8 aa, Mycobacterium
TEKPPRKP

SEQ ID NO: 593281 - protein, 9 aa, Mycobacterium
TEKPTKGIR

SEQ ID NO: 593282 - protein, 8 aa, Mycobacterium
TEKQAASW

SEQ ID NO: 593283 - protein, 12 aa, Mycobacterium
TEKQAASWDDLP

SEQ ID NO: 593284 - protein, 9 aa, Mycobacterium
TEKQAASWE

SEQ ID NO: 593285 - protein, 8 aa, Mycobacterium
TEKQAATW

SEQ ID NO: 593286 - protein, 26 aa, Mycobacterium
TEKQGGSDVRAGTTEATPNGDGTYSL

SEQ ID NO: 593287 - protein, 25 aa, Mycobacterium
TEKQGGSDVRAGTTEATPNSDGTYR

SEQ ID NO: 593288 - protein, 26 aa, Mycobacterium
TEKQGGSDVRAGTTQATPNGDGSYSL

SEQ ID NO: 593289 - protein, 26 aa, Mycobacterium
TEKQGGSDVRAGTTQATPNGDGSYTL

SEQ ID NO: 593290 - protein, 11 aa, Mycobacterium
TEKRRKALTDL

SEQ ID NO: 593291 - protein, 7 aa, Mycobacterium
TEKRTGF

SEQ ID NO: 593292 - protein, 7 aa, Mycobacterium
TEKSPGF

SEQ ID NO: 593293 - protein, 6 aa, Mycobacterium
TEKTVR

SEQ ID NO: 593294 - protein, 11 aa, Mycobacterium
TEKYGDDRRTR

SEQ ID NO: 593295 - protein, 4 aa, Mycobacterium
TELA

SEQ ID NO: 593296 - protein, 13 aa, Mycobacterium
TELAAGSADLTPL

SEQ ID NO: 593297 - protein, 5 aa, Mycobacterium
TELAE

SEQ ID NO: 593298 - protein, 12 aa, Mycobacterium
TELDESAAPPEL

SEQ ID NO: 593299 - protein, 11 aa, Mycobacterium
TELDGAGTAAL

SEQ ID NO: 593300 - protein, 16 aa, Mycobacterium
TELDGGPSWHEGPPTN

SEQ ID NO: 593301 - protein, 5 aa, Mycobacterium
TELDK

SEQ ID NO: 593302 - protein, 6 aa, Mycobacterium
TELDPD

SEQ ID NO: 593303 - protein, 7 aa, Mycobacterium
TELDPGQ

SEQ ID NO: 593304 - protein, 9 aa, Mycobacterium
TELEARGHD

SEQ ID NO: 593305 - protein, 8 aa, Mycobacterium
TELGASDR

SEQ ID NO: 593306 - protein, 9 aa, Mycobacterium
TELGDDAEG

SEQ ID NO: 593307 - protein, 7 aa, Mycobacterium
TELGDQG

SEQ ID NO: 593308 - protein, 7 aa, Mycobacterium
TELGEQG

SEQ ID NO: 593309 - protein, 22 aa, Mycobacterium
TELGEQRAAEISANGGGATSVQ

SEQ ID NO: 593310 - protein, 12 aa, Mycobacterium
TELGEQRATEIS

SEQ ID NO: 593311 - protein, 7 aa, Mycobacterium
TELGGKS

SEQ ID NO: 593312 - protein, 7 aa, Mycobacterium
TELGGQN

SEQ ID NO: 593313 - protein, 7 aa, Mycobacterium
TELGGYP

SEQ ID NO: 593314 - protein, 6 aa, Mycobacterium
TELGIT

SEQ ID NO: 593315 - protein, 8 aa, Mycobacterium
TELGPGGV

SEQ ID NO: 593316 - protein, 8 aa, Mycobacterium
TELGPKGI

SEQ ID NO: 593317 - protein, 12 aa, Mycobacterium
TELGRAPGPDGR

SEQ ID NO: 593318 - protein, 4 aa, Mycobacterium
TELP

SEQ ID NO: 593319 - protein, 6 aa, Mycobacterium
TELPDQ

SEQ ID NO: 593320 - protein, 12 aa, Mycobacterium
TELPDTGSLPDD

SEQ ID NO: 593321 - protein, 16 aa, Mycobacterium
TELPEDAGAGKELPGG

SEQ ID NO: 593322 - protein, 8 aa, Mycobacterium
TELPLPAR

SEQ ID NO: 593323 - protein, 9 aa, Mycobacterium
TELPPADGY

SEQ ID NO: 593324 - protein, 5 aa, Mycobacterium
TELPS

SEQ ID NO: 593325 - protein, 6 aa, Mycobacterium
TELPTS

SEQ ID NO: 593326 - protein, 18 aa, Mycobacterium
TELRDGKFGTPTAPSSPT

SEQ ID NO: 593327 - protein, 18 aa, Mycobacterium
TELRDGNLGTSGQAPSST

SEQ ID NO: 593328 - protein, 16 aa, Mycobacterium
TELREGNFGTPVQADS

SEQ ID NO: 593329 - protein, 38 aa, Mycobacterium
TELRPGAQGSTTELTTGGYDKLPTSVQEALNDKSPGFS

SEQ ID NO: 593330 - protein, 14 aa, Mycobacterium
TELRPRDPAPGSDA

SEQ ID NO: 593331 - protein, 16 aa, Mycobacterium
TELRRKRKRGLAPEPV

SEQ ID NO: 593332 - protein, 16 aa, Mycobacterium
TELRRKRKRGLVSEPA

SEQ ID NO: 593333 - protein, 4 aa, Mycobacterium
TELS

SEQ ID NO: 593334 - protein, 17 aa, Mycobacterium
TELSEGDRLEVVTAVQG

SEQ ID NO: 593335 - protein, 8 aa, Mycobacterium
TELSESES

SEQ ID NO: 593336 - protein, 17 aa, Mycobacterium
TELSGPPTSAARAARSL

SEQ ID NO: 593337 - protein, 12 aa, Mycobacterium
TELSSAAADYSS

SEQ ID NO: 593338 - protein, 12 aa, Mycobacterium
TELSSAANAFGS

SEQ ID NO: 593339 - protein, 6 aa, Mycobacterium
TELSTE

SEQ ID NO: 593340 - protein, 12 aa, Mycobacterium
TELTEAQQARDA

SEQ ID NO: 593341 - protein, 7 aa, Mycobacterium
TELTERP

SEQ ID NO: 593342 - protein, 8 aa, Mycobacterium
TELTGAGA

SEQ ID NO: 593343 - protein, 10 aa, Mycobacterium
TELVGSPDEA

SEQ ID NO: 593344 - protein, 5 aa, Mycobacterium
TEMAP

SEQ ID NO: 593345 - protein, 4 aa, Mycobacterium
TEMP

SEQ ID NO: 593346 - protein, 14 aa, Mycobacterium
TEMRTKELGPSTQA

SEQ ID NO: 593347 - protein, 6 aa, Mycobacterium
TEMSPP

SEQ ID NO: 593348 - protein, 4 aa, Mycobacterium
TENA

SEQ ID NO: 593349 - protein, 6 aa, Mycobacterium
TENADE

SEQ ID NO: 593350 - protein, 6 aa, Mycobacterium
TENAEV

SEQ ID NO: 593351 - protein, 4 aa, Mycobacterium
TEND

SEQ ID NO: 593352 - protein, 5 aa, Mycobacterium
TENDG

SEQ ID NO: 593353 - protein, 17 aa, Mycobacterium
TENDGTTTKLNERGATL

SEQ ID NO: 593354 - protein, 7 aa, Mycobacterium
TENGEGR

SEQ ID NO: 593355 - protein, 16 aa, Mycobacterium
TENGNDTQTIYGEPKD

SEQ ID NO: 593356 - protein, 16 aa, Mycobacterium
TENGSAPTNGAPLGYP

SEQ ID NO: 593357 - protein, 12 aa, Mycobacterium
TENGWDQRETAG

SEQ ID NO: 593358 - protein, 8 aa, Mycobacterium
TENHGADV

SEQ ID NO: 593359 - protein, 5 aa, Mycobacterium
TENHV

SEQ ID NO: 593360 - protein, 5 aa, Mycobacterium
TENLT

SEQ ID NO: 593361 - protein, 8 aa, Mycobacterium
TENNDEDW

SEQ ID NO: 593362 - protein, 5 aa, Mycobacterium
TENPD

SEQ ID NO: 593363 - protein, 7 aa, Mycobacterium
TENPDVQ

SEQ ID NO: 593364 - protein, 6 aa, Mycobacterium
TENPMH

SEQ ID NO: 593365 - protein, 8 aa, Mycobacterium
TENPNPAV

SEQ ID NO: 593366 - protein, 10 aa, Mycobacterium
TENPQDLATT

SEQ ID NO: 593367 - protein, 10 aa, Mycobacterium
TENPRDLATT

SEQ ID NO: 593368 - protein, 5 aa, Mycobacterium
TENQA

SEQ ID NO: 593369 - protein, 7 aa, Mycobacterium
TENQALD

SEQ ID NO: 593370 - protein, 6 aa, Mycobacterium
TENRDE

SEQ ID NO: 593371 - protein, 5 aa, Mycobacterium
TENRE

SEQ ID NO: 593372 - protein, 6 aa, Mycobacterium
TENSDL

SEQ ID NO: 593373 - protein, 10 aa, Mycobacterium
TENSNRERTT

SEQ ID NO: 593374 - protein, 8 aa, Mycobacterium
TENSPTSL

SEQ ID NO: 593375 - protein, 7 aa, Mycobacterium
TENSRLA

SEQ ID NO: 593376 - protein, 5 aa, Mycobacterium
TENST

SEQ ID NO: 593377 - protein, 8 aa, Mycobacterium
TENSVRGG

SEQ ID NO: 593378 - protein, 5 aa, Mycobacterium
TENTT

SEQ ID NO: 593379 - protein, 12 aa, Mycobacterium
TENVGDRYATAV

SEQ ID NO: 593380 - protein, 4 aa, Mycobacterium
TEPA

SEQ ID NO: 593381 - protein, 8 aa, Mycobacterium
TEPAAEPV

SEQ ID NO: 593382 - protein, 5 aa, Mycobacterium
TEPAD

SEQ ID NO: 593383 - protein, 7 aa, Mycobacterium
TEPADDI

SEQ ID NO: 593384 - protein, 6 aa, Mycobacterium
TEPADR

SEQ ID NO: 593385 - protein, 5 aa, Mycobacterium
TEPAG

SEQ ID NO: 593386 - protein, 8 aa, Mycobacterium
TEPAGGSD

SEQ ID NO: 593387 - protein, 8 aa, Mycobacterium
TEPAGWPD

SEQ ID NO: 593388 - protein, 6 aa, Mycobacterium
TEPAHA

SEQ ID NO: 593389 - protein, 10 aa, Mycobacterium
TEPAKLKPGY

SEQ ID NO: 593390 - protein, 8 aa, Mycobacterium
TEPAPPTL

SEQ ID NO: 593391 - protein, 5 aa, Mycobacterium
TEPAV

SEQ ID NO: 593392 - protein, 8 aa, Mycobacterium
TEPAYAAR

SEQ ID NO: 593393 - protein, 7 aa, Mycobacterium
TEPCTDS

SEQ ID NO: 593394 - protein, 5 aa, Mycobacterium
TEPDA

SEQ ID NO: 593395 - protein, 13 aa, Mycobacterium
TEPDAAAPHVTEA

SEQ ID NO: 593396 - protein, 10 aa, Mycobacterium
TEPDADRRTP

SEQ ID NO: 593397 - protein, 7 aa, Mycobacterium
TEPDAEP

SEQ ID NO: 593398 - protein, 10 aa, Mycobacterium
TEPDAGSDVA

SEQ ID NO: 593399 - protein, 23 aa, Mycobacterium
TEPDAGSNSHNVQTTARKSGSGW

SEQ ID NO: 593400 - protein, 16 aa, Mycobacterium
TEPDAPPPDAVAGAGG

SEQ ID NO: 593401 - protein, 19 aa, Mycobacterium
TEPDAPPPDPVDAPTGAST

SEQ ID NO: 593402 - protein, 20 aa, Mycobacterium
TEPDAPPPDPVDGPGGGTGL

SEQ ID NO: 593403 - protein, 5 aa, Mycobacterium
TEPDD

SEQ ID NO: 593404 - protein, 7 aa, Mycobacterium
TEPDEGT

SEQ ID NO: 593405 - protein, 20 aa, Mycobacterium
TEPDGAGSDPSQLKTSATFD

SEQ ID NO: 593406 - protein, 8 aa, Mycobacterium
TEPDGGAL

SEQ ID NO: 593407 - protein, 10 aa, Mycobacterium
TEPDQIGPGL

SEQ ID NO: 593408 - protein, 9 aa, Mycobacterium
TEPDSRRIR

SEQ ID NO: 593409 - protein, 7 aa, Mycobacterium
TEPDSVK

SEQ ID NO: 593410 - protein, 7 aa, Mycobacterium
TEPDTGF

SEQ ID NO: 593411 - protein, 7 aa, Mycobacterium
TEPDTPQ

SEQ ID NO: 593412 - protein, 9 aa, Mycobacterium
TEPDVAQQD

SEQ ID NO: 593413 - protein, 5 aa, Mycobacterium
TEPEA

SEQ ID NO: 593414 - protein, 15 aa, Mycobacterium
TEPEASIETEPEASI

SEQ ID NO: 593415 - protein, 14 aa, Mycobacterium
TEPEDGPGTQPAGF

SEQ ID NO: 593416 - protein, 9 aa, Mycobacterium
TEPEGGSDI

SEQ ID NO: 593417 - protein, 10 aa, Mycobacterium
TEPEGGSDIA

SEQ ID NO: 593418 - protein, 10 aa, Mycobacterium
TEPEGGSDVA

SEQ ID NO: 593419 - protein, 5 aa, Mycobacterium
TEPEL

SEQ ID NO: 593420 - protein, 6 aa, Mycobacterium
TEPELP

SEQ ID NO: 593421 - protein, 6 aa, Mycobacterium
TEPELQ

SEQ ID NO: 593422 - protein, 7 aa, Mycobacterium
TEPEPAR

SEQ ID NO: 593423 - protein, 6 aa, Mycobacterium
TEPEQM

SEQ ID NO: 593424 - protein, 6 aa, Mycobacterium
TEPERA

SEQ ID NO: 593425 - protein, 6 aa, Mycobacterium
TEPERY

SEQ ID NO: 593426 - protein, 9 aa, Mycobacterium
TEPERYAKR

SEQ ID NO: 593427 - protein, 6 aa, Mycobacterium
TEPEYQ

SEQ ID NO: 593428 - protein, 4 aa, Mycobacterium
TEPF

SEQ ID NO: 593429 - protein, 6 aa, Mycobacterium
TEPFAS

SEQ ID NO: 593430 - protein, 14 aa, Mycobacterium
TEPFPGGATHASNT

SEQ ID NO: 593431 - protein, 9 aa, Mycobacterium
TEPFPGGVT

SEQ ID NO: 593432 - protein, 12 aa, Mycobacterium
TEPGAAATEDGV

SEQ ID NO: 593433 - protein, 19 aa, Mycobacterium
TEPGAGSDAGATRTTARLD

SEQ ID NO: 593434 - protein, 19 aa, Mycobacterium
TEPGAGSDAGATRTTARLE

SEQ ID NO: 593435 - protein, 19 aa, Mycobacterium
TEPGAGSDAGSTRTTARIE

SEQ ID NO: 593436 - protein, 19 aa, Mycobacterium
TEPGAGSDAGSTRTTARLD

SEQ ID NO: 593437 - protein, 9 aa, Mycobacterium
TEPGAGSDL

SEQ ID NO: 593438 - protein, 11 aa, Mycobacterium
TEPGAGSDLAG

SEQ ID NO: 593439 - protein, 12 aa, Mycobacterium
TEPGAGSDLAGI

SEQ ID NO: 593440 - protein, 20 aa, Mycobacterium
TEPGAGSDLSGIRTSAVDKG

SEQ ID NO: 593441 - protein, 15 aa, Mycobacterium
TEPGAGSNPSGLRTK

SEQ ID NO: 593442 - protein, 14 aa, Mycobacterium
TEPGAGSSPAGLRT

SEQ ID NO: 593443 - protein, 9 aa, Mycobacterium
TEPGASRHR

SEQ ID NO: 593444 - protein, 7 aa, Mycobacterium
TEPGEAL

SEQ ID NO: 593445 - protein, 13 aa, Mycobacterium
TEPGESPGSVRPS

SEQ ID NO: 593446 - protein, 15 aa, Mycobacterium
TEPGEWDGVAGNPPY

SEQ ID NO: 593447 - protein, 10 aa, Mycobacterium
TEPGGGSDLQ

SEQ ID NO: 593448 - protein, 11 aa, Mycobacterium
TEPGGGSDLQN

SEQ ID NO: 593449 - protein, 13 aa, Mycobacterium
TEPGGGSDLQSMS

SEQ ID NO: 593450 - protein, 21 aa, Mycobacterium
TEPGGGSDLQSMTTTAVSDGD

SEQ ID NO: 593451 - protein, 22 aa, Mycobacterium
TEPGGGSDVGHLTTSAKRDGDH

SEQ ID NO: 593452 - protein, 13 aa, Mycobacterium
TEPGGGTDIPGSI

SEQ ID NO: 593453 - protein, 10 aa, Mycobacterium
TEPGLARSGG

SEQ ID NO: 593454 - protein, 6 aa, Mycobacterium
TEPGLS

SEQ ID NO: 593455 - protein, 6 aa, Mycobacterium
TEPGQS

SEQ ID NO: 593456 - protein, 6 aa, Mycobacterium
TEPGRL

SEQ ID NO: 593457 - protein, 10 aa, Mycobacterium
TEPGSPDETA

SEQ ID NO: 593458 - protein, 10 aa, Mycobacterium
TEPGSSRHKG

SEQ ID NO: 593459 - protein, 5 aa, Mycobacterium
TEPGT

SEQ ID NO: 593460 - protein, 10 aa, Mycobacterium
TEPGTGSDLA

SEQ ID NO: 593461 - protein, 12 aa, Mycobacterium
TEPGTGSDLAGV

SEQ ID NO: 593462 - protein, 10 aa, Mycobacterium
TEPGTGSDLQ

SEQ ID NO: 593463 - protein, 11 aa, Mycobacterium
TEPGTGSDLQG

SEQ ID NO: 593464 - protein, 12 aa, Mycobacterium
TEPGTGSDLQSI

SEQ ID NO: 593465 - protein, 6 aa, Mycobacterium
TEPHAD

SEQ ID NO: 593466 - protein, 11 aa, Mycobacterium
TEPHAGADPTL

SEQ ID NO: 593467 - protein, 12 aa, Mycobacterium
TEPHGGSDAFHP

SEQ ID NO: 593468 - protein, 5 aa, Mycobacterium
TEPHI

SEQ ID NO: 593469 - protein, 6 aa, Mycobacterium
TEPHIT

SEQ ID NO: 593470 - protein, 8 aa, Mycobacterium
TEPHPTRE

SEQ ID NO: 593471 - protein, 5 aa, Mycobacterium
TEPHQ

SEQ ID NO: 593472 - protein, 12 aa, Mycobacterium
TEPHSLDNERPA

SEQ ID NO: 593473 - protein, 5 aa, Mycobacterium
TEPIT

SEQ ID NO: 593474 - protein, 4 aa, Mycobacterium
TEPK

SEQ ID NO: 593475 - protein, 5 aa, Mycobacterium
TEPKA

SEQ ID NO: 593476 - protein, 6 aa, Mycobacterium
TEPLAP

SEQ ID NO: 593477 - protein, 8 aa, Mycobacterium
TEPLDDGR

SEQ ID NO: 593478 - protein, 6 aa, Mycobacterium
TEPLQP

SEQ ID NO: 593479 - protein, 15 aa, Mycobacterium
TEPLRGNRRGEQGPV

SEQ ID NO: 593480 - protein, 5 aa, Mycobacterium
TEPLS

SEQ ID NO: 593481 - protein, 7 aa, Mycobacterium
TEPLSPV

SEQ ID NO: 593482 - protein, 13 aa, Mycobacterium
TEPLTSPAGKRQF

SEQ ID NO: 593483 - protein, 9 aa, Mycobacterium
TEPMTASKE

SEQ ID NO: 593484 - protein, 6 aa, Mycobacterium
TEPNGA

SEQ ID NO: 593485 - protein, 6 aa, Mycobacterium
TEPNGH

SEQ ID NO: 593486 - protein, 30 aa, Mycobacterium
TEPPAGGPSPASAPVNGSPPQPATNGSTPC

SEQ ID NO: 593487 - protein, 14 aa, Mycobacterium
TEPPAPSSTRRSAA

SEQ ID NO: 593488 - protein, 9 aa, Mycobacterium
TEPPDDLRD

SEQ ID NO: 593489 - protein, 8 aa, Mycobacterium
TEPPDTSE

SEQ ID NO: 593490 - protein, 6 aa, Mycobacterium
TEPPEK

SEQ ID NO: 593491 - protein, 6 aa, Mycobacterium
TEPPGI

SEQ ID NO: 593492 - protein, 8 aa, Mycobacterium
TEPPKPGL

SEQ ID NO: 593493 - protein, 16 aa, Mycobacterium
TEPPLPQSDSSYSPLA

SEQ ID NO: 593494 - protein, 8 aa, Mycobacterium
TEPPPDLR

SEQ ID NO: 593495 - protein, 6 aa, Mycobacterium
TEPPPM

SEQ ID NO: 593496 - protein, 12 aa, Mycobacterium
TEPPPPEPDTVR

SEQ ID NO: 593497 - protein, 15 aa, Mycobacterium
TEPPPTLPPSPGWPD

SEQ ID NO: 593498 - protein, 12 aa, Mycobacterium
TEPPQKSPAGGL

SEQ ID NO: 593499 - protein, 8 aa, Mycobacterium
TEPPRGGH

SEQ ID NO: 593500 - protein, 33 aa, Mycobacterium
TEPPRTTNAHGQSAQAAAVNEAVGTAAGQARAA

SEQ ID NO: 593501 - protein, 9 aa, Mycobacterium
TEPPSSQVP

SEQ ID NO: 593502 - protein, 6 aa, Mycobacterium
TEPPVE

SEQ ID NO: 593503 - protein, 4 aa, Mycobacterium
TEPQ

SEQ ID NO: 593504 - protein, 10 aa, Mycobacterium
TEPQGGSDPG

SEQ ID NO: 593505 - protein, 12 aa, Mycobacterium
TEPQGGSDPGQF

SEQ ID NO: 593506 - protein, 12 aa, Mycobacterium
TEPQGGSDPGSF

SEQ ID NO: 593507 - protein, 11 aa, Mycobacterium
TEPQGGSDPSL

SEQ ID NO: 593508 - protein, 6 aa, Mycobacterium
TEPQLR

SEQ ID NO: 593509 - protein, 6 aa, Mycobacterium
TEPQRY

SEQ ID NO: 593510 - protein, 5 aa, Mycobacterium
TEPQT

SEQ ID NO: 593511 - protein, 7 aa, Mycobacterium
TEPQTTV

SEQ ID NO: 593512 - protein, 16 aa, Mycobacterium
TEPRAKTRNLRRDPRA

SEQ ID NO: 593513 - protein, 8 aa, Mycobacterium
TEPRPGYG

SEQ ID NO: 593514 - protein, 6 aa, Mycobacterium
TEPRPR

SEQ ID NO: 593515 - protein, 9 aa, Mycobacterium
TEPRPVSAG

SEQ ID NO: 593516 - protein, 5 aa, Mycobacterium
TEPRQ

SEQ ID NO: 593517 - protein, 6 aa, Mycobacterium
TEPRQS

SEQ ID NO: 593518 - protein, 18 aa, Mycobacterium
TEPRTDPKSEAAEQRTPW

SEQ ID NO: 593519 - protein, 5 aa, Mycobacterium
TEPRW

SEQ ID NO: 593520 - protein, 7 aa, Mycobacterium
TEPSDYA

SEQ ID NO: 593521 - protein, 9 aa, Mycobacterium
TEPSGGSDL

SEQ ID NO: 593522 - protein, 8 aa, Mycobacterium
TEPSSGDR

SEQ ID NO: 593523 - protein, 8 aa, Mycobacterium
TEPSTGEL

SEQ ID NO: 593524 - protein, 9 aa, Mycobacterium
TEPSTPIAD

SEQ ID NO: 593525 - protein, 6 aa, Mycobacterium
TEPSTS

SEQ ID NO: 593526 - protein, 9 aa, Mycobacterium
TEPSVSGSN

SEQ ID NO: 593527 - protein, 6 aa, Mycobacterium
TEPTGT

SEQ ID NO: 593528 - protein, 5 aa, Mycobacterium
TEPTS

SEQ ID NO: 593529 - protein, 7 aa, Mycobacterium
TEPTSGG

SEQ ID NO: 593530 - protein, 9 aa, Mycobacterium
TEPTSGTAR

SEQ ID NO: 593531 - protein, 10 aa, Mycobacterium
TEPTSVPPVS

SEQ ID NO: 593532 - protein, 7 aa, Mycobacterium
TEPTTPW

SEQ ID NO: 593533 - protein, 4 aa, Mycobacterium
TEPV

SEQ ID NO: 593534 - protein, 12 aa, Mycobacterium
TEPVADPTLAPG

SEQ ID NO: 593535 - protein, 9 aa, Mycobacterium
TEPVAEPPL

SEQ ID NO: 593536 - protein, 12 aa, Mycobacterium
TEPVGELGKDHR

SEQ ID NO: 593537 - protein, 6 aa, Mycobacterium
TEPVPE

SEQ ID NO: 593538 - protein, 8 aa, Mycobacterium
TEPVPEPA

SEQ ID NO: 593539 - protein, 8 aa, Mycobacterium
TEPVRGQR

SEQ ID NO: 593540 - protein, 10 aa, Mycobacterium
TEPVRGTVSA

SEQ ID NO: 593541 - protein, 12 aa, Mycobacterium
TEPVRSSSGLTT

SEQ ID NO: 593542 - protein, 6 aa, Mycobacterium
TEPWRG

SEQ ID NO: 593543 - protein, 6 aa, Mycobacterium
TEPYDQ

SEQ ID NO: 593544 - protein, 7 aa, Mycobacterium
TEQAAPF

SEQ ID NO: 593545 - protein, 7 aa, Mycobacterium
TEQAEPF

SEQ ID NO: 593546 - protein, 7 aa, Mycobacterium
TEQAQPF

SEQ ID NO: 593547 - protein, 8 aa, Mycobacterium
TEQARDAL

SEQ ID NO: 593548 - protein, 9 aa, Mycobacterium
TEQASQSDH

SEQ ID NO: 593549 - protein, 19 aa, Mycobacterium
TEQDGRYRIGGKSGSGEPA

SEQ ID NO: 593550 - protein, 11 aa, Mycobacterium
TEQEADRALKA

SEQ ID NO: 593551 - protein, 12 aa, Mycobacterium
TEQEADRALKAG

SEQ ID NO: 593552 - protein, 6 aa, Mycobacterium
TEQEIN

SEQ ID NO: 593553 - protein, 26 aa, Mycobacterium
TEQFPRPAPRPPYTALSSGQSAAAGL

SEQ ID NO: 593554 - protein, 5 aa, Mycobacterium
TEQGA

SEQ ID NO: 593555 - protein, 6 aa, Mycobacterium
TEQGER

SEQ ID NO: 593556 - protein, 6 aa, Mycobacterium
TEQGGM

SEQ ID NO: 593557 - protein, 9 aa, Mycobacterium
TEQGKTGWA

SEQ ID NO: 593558 - protein, 5 aa, Mycobacterium
TEQGN

SEQ ID NO: 593559 - protein, 18 aa, Mycobacterium
TEQGPRREDGRPGRPGEV

SEQ ID NO: 593560 - protein, 8 aa, Mycobacterium
TEQGRRID

SEQ ID NO: 593561 - protein, 10 aa, Mycobacterium
TEQGSEPRLA

SEQ ID NO: 593562 - protein, 7 aa, Mycobacterium
TEQHGPH

SEQ ID NO: 593563 - protein, 8 aa, Mycobacterium
TEQLAGPD

SEQ ID NO: 593564 - protein, 7 aa, Mycobacterium
TEQPAAH

SEQ ID NO: 593565 - protein, 6 aa, Mycobacterium
TEQPAT

SEQ ID NO: 593566 - protein, 5 aa, Mycobacterium
TEQPE

SEQ ID NO: 593567 - protein, 7 aa, Mycobacterium
TEQPEPD

SEQ ID NO: 593568 - protein, 5 aa, Mycobacterium
TEQPI

SEQ ID NO: 593569 - protein, 5 aa, Mycobacterium
TEQPR

SEQ ID NO: 593570 - protein, 10 aa, Mycobacterium
TEQQAARHAE

SEQ ID NO: 593571 - protein, 10 aa, Mycobacterium
TEQQAKDEGY

SEQ ID NO: 593572 - protein, 10 aa, Mycobacterium
TEQQARDEGY

SEQ ID NO: 593573 - protein, 10 aa, Mycobacterium
TEQQNQKVRR

SEQ ID NO: 593574 - protein, 8 aa, Mycobacterium
TEQRANKA

SEQ ID NO: 593575 - protein, 6 aa, Mycobacterium
TEQRHK

SEQ ID NO: 593576 - protein, 30 aa, Mycobacterium
TEQRNDADKFTRAEQDSYAAESHQKAARAW

SEQ ID NO: 593577 - protein, 29 aa, Mycobacterium
TEQRNDVDGFTRRQQDEYSAASHQKAAAA

SEQ ID NO: 593578 - protein, 5 aa, Mycobacterium
TEQRR

SEQ ID NO: 593579 - protein, 4 aa, Mycobacterium
TEQS

SEQ ID NO: 593580 - protein, 9 aa, Mycobacterium
TEQSESLGP

SEQ ID NO: 593581 - protein, 11 aa, Mycobacterium
TEQSESLGPKS

SEQ ID NO: 593582 - protein, 11 aa, Mycobacterium
TEQSESLGPQS

SEQ ID NO: 593583 - protein, 7 aa, Mycobacterium
TEQSIRS

SEQ ID NO: 593584 - protein, 9 aa, Mycobacterium
TEQSPAAAR

SEQ ID NO: 593585 - protein, 4 aa, Mycobacterium
TEQT

SEQ ID NO: 593586 - protein, 6 aa, Mycobacterium
TEQTLA

SEQ ID NO: 593587 - protein, 10 aa, Mycobacterium
TEQTRSDLDE

SEQ ID NO: 593588 - protein, 8 aa, Mycobacterium
TEQTVKPG

SEQ ID NO: 593589 - protein, 15 aa, Mycobacterium
TEQVAGQATDGTVED

SEQ ID NO: 593590 - protein, 13 aa, Mycobacterium
TEQVRREKSLPYT

SEQ ID NO: 593591 - protein, 16 aa, Mycobacterium
TEQYPEKKQPTAPRYH

SEQ ID NO: 593592 - protein, 4 aa, Mycobacterium
TERA

SEQ ID NO: 593593 - protein, 9 aa, Mycobacterium
TERAAAERR

SEQ ID NO: 593594 - protein, 7 aa, Mycobacterium
TERAAAV

SEQ ID NO: 593595 - protein, 6 aa, Mycobacterium
TERADD

SEQ ID NO: 593596 - protein, 6 aa, Mycobacterium
TERADS

SEQ ID NO: 593597 - protein, 10 aa, Mycobacterium
TERAEDFSSN

SEQ ID NO: 593598 - protein, 18 aa, Mycobacterium
TERAGRKVPVPIGMPRMR

SEQ ID NO: 593599 - protein, 5 aa, Mycobacterium
TERAP

SEQ ID NO: 593600 - protein, 9 aa, Mycobacterium
TERAPREMN

SEQ ID NO: 593601 - protein, 9 aa, Mycobacterium
TERAPRPGH

SEQ ID NO: 593602 - protein, 8 aa, Mycobacterium
TERARAEA

SEQ ID NO: 593603 - protein, 11 aa, Mycobacterium
TERARRHGSDI

SEQ ID NO: 593604 - protein, 9 aa, Mycobacterium
TERARVAQR

SEQ ID NO: 593605 - protein, 9 aa, Mycobacterium
TERASTRSV

SEQ ID NO: 593606 - protein, 4 aa, Mycobacterium
TERD

SEQ ID NO: 593607 - protein, 14 aa, Mycobacterium
TERDDACGGRVDTG

SEQ ID NO: 593608 - protein, 5 aa, Mycobacterium
TERDG

SEQ ID NO: 593609 - protein, 6 aa, Mycobacterium
TERDGA

SEQ ID NO: 593610 - protein, 7 aa, Mycobacterium
TERDGEY

SEQ ID NO: 593611 - protein, 6 aa, Mycobacterium
TERDGI

SEQ ID NO: 593612 - protein, 6 aa, Mycobacterium
TERDGQ

SEQ ID NO: 593613 - protein, 6 aa, Mycobacterium
TERDGV

SEQ ID NO: 593614 - protein, 7 aa, Mycobacterium
TERDGVE

SEQ ID NO: 593615 - protein, 8 aa, Mycobacterium
TERDGVPR

SEQ ID NO: 593616 - protein, 14 aa, Mycobacterium
TERDPEAPDDRDAH

SEQ ID NO: 593617 - protein, 16 aa, Mycobacterium
TERDPGPKALAAGRAW

SEQ ID NO: 593618 - protein, 8 aa, Mycobacterium
TERDPQLP

SEQ ID NO: 593619 - protein, 8 aa, Mycobacterium
TERDRSAS

SEQ ID NO: 593620 - protein, 12 aa, Mycobacterium
TERDSDYAGSLP

SEQ ID NO: 593621 - protein, 9 aa, Mycobacterium
TERDSVGGN

SEQ ID NO: 593622 - protein, 11 aa, Mycobacterium
TERDVSGDGWH

SEQ ID NO: 593623 - protein, 6 aa, Mycobacterium
TEREAR

SEQ ID NO: 593624 - protein, 5 aa, Mycobacterium
TERES

SEQ ID NO: 593625 - protein, 5 aa, Mycobacterium
TERGA

SEQ ID NO: 593626 - protein, 12 aa, Mycobacterium
TERGAAASPPRV

SEQ ID NO: 593627 - protein, 25 aa, Mycobacterium
TERGATRADDRISEAGMEDRKREGY

SEQ ID NO: 593628 - protein, 25 aa, Mycobacterium
TERGATRADDRISESGMEDRKRQGY

SEQ ID NO: 593629 - protein, 6 aa, Mycobacterium
TERGAV

SEQ ID NO: 593630 - protein, 8 aa, Mycobacterium
TERGDDGV

SEQ ID NO: 593631 - protein, 12 aa, Mycobacterium
TERGDKLPAAQR

SEQ ID NO: 593632 - protein, 7 aa, Mycobacterium
TERGERV

SEQ ID NO: 593633 - protein, 5 aa, Mycobacterium
TERGG

SEQ ID NO: 593634 - protein, 7 aa, Mycobacterium
TERGISR

SEQ ID NO: 593635 - protein, 10 aa, Mycobacterium
TERGNTASTT

SEQ ID NO: 593636 - protein, 15 aa, Mycobacterium
TERGNVARGADFETS

SEQ ID NO: 593637 - protein, 12 aa, Mycobacterium
TERGRRGYTDRV

SEQ ID NO: 593638 - protein, 5 aa, Mycobacterium
TERGY

SEQ ID NO: 593639 - protein, 4 aa, Mycobacterium
TERI

SEQ ID NO: 593640 - protein, 8 aa, Mycobacterium
TERKSSED

SEQ ID NO: 593641 - protein, 4 aa, Mycobacterium
TERM

SEQ ID NO: 593642 - protein, 5 aa, Mycobacterium
TERNE

SEQ ID NO: 593643 - protein, 7 aa, Mycobacterium
TERNEVG

SEQ ID NO: 593644 - protein, 6 aa, Mycobacterium
TERNKS

SEQ ID NO: 593645 - protein, 7 aa, Mycobacterium
TERNNAH

SEQ ID NO: 593646 - protein, 7 aa, Mycobacterium
TERNPQL

SEQ ID NO: 593647 - protein, 14 aa, Mycobacterium
TERPADDPHPEHTG

SEQ ID NO: 593648 - protein, 8 aa, Mycobacterium
TERPADEL

SEQ ID NO: 593649 - protein, 9 aa, Mycobacterium
TERPAEDSF

SEQ ID NO: 593650 - protein, 9 aa, Mycobacterium
TERPDADGV

SEQ ID NO: 593651 - protein, 10 aa, Mycobacterium
TERPDGSCEA

SEQ ID NO: 593652 - protein, 12 aa, Mycobacterium
TERPDGSSETQV

SEQ ID NO: 593653 - protein, 8 aa, Mycobacterium
TERPDTGS

SEQ ID NO: 593654 - protein, 5 aa, Mycobacterium
TERPE

SEQ ID NO: 593655 - protein, 7 aa, Mycobacterium
TERPEED

SEQ ID NO: 593656 - protein, 16 aa, Mycobacterium
TERPFTGEYTDTKTQG

SEQ ID NO: 593657 - protein, 6 aa, Mycobacterium
TERPGP

SEQ ID NO: 593658 - protein, 16 aa, Mycobacterium
TERPGSAIGAHGGIQD

SEQ ID NO: 593659 - protein, 6 aa, Mycobacterium
TERPNW

SEQ ID NO: 593660 - protein, 8 aa, Mycobacterium
TERPPRKP

SEQ ID NO: 593661 - protein, 6 aa, Mycobacterium
TERPPV

SEQ ID NO: 593662 - protein, 7 aa, Mycobacterium
TERPRGV

SEQ ID NO: 593663 - protein, 8 aa, Mycobacterium
TERPTRGT

SEQ ID NO: 593664 - protein, 6 aa, Mycobacterium
TERQAD

SEQ ID NO: 593665 - protein, 5 aa, Mycobacterium
TERQS

SEQ ID NO: 593666 - protein, 6 aa, Mycobacterium
TERQYR

SEQ ID NO: 593667 - protein, 6 aa, Mycobacterium
TERRAR

SEQ ID NO: 593668 - protein, 10 aa, Mycobacterium
TERRERPGDD

SEQ ID NO: 593669 - protein, 6 aa, Mycobacterium
TERRGE

SEQ ID NO: 593670 - protein, 10 aa, Mycobacterium
TERRGQEGND

SEQ ID NO: 593671 - protein, 7 aa, Mycobacterium
TERRGSL

SEQ ID NO: 593672 - protein, 26 aa, Mycobacterium
TERRHNREARRAASVTAADPDHDPPP

SEQ ID NO: 593673 - protein, 7 aa, Mycobacterium
TERRNAR

SEQ ID NO: 593674 - protein, 25 aa, Mycobacterium
TERRPAAPREAAPPTTARPAGMPPW

SEQ ID NO: 593675 - protein, 7 aa, Mycobacterium
TERRPEE

SEQ ID NO: 593676 - protein, 17 aa, Mycobacterium
TERRSAARAEGAEAPDV

SEQ ID NO: 593677 - protein, 9 aa, Mycobacterium
TERSAAAEA

SEQ ID NO: 593678 - protein, 11 aa, Mycobacterium
TERSAGPDRPA

SEQ ID NO: 593679 - protein, 13 aa, Mycobacterium
TERSAVAGHEAGQ

SEQ ID NO: 593680 - protein, 6 aa, Mycobacterium
TERSEL

SEQ ID NO: 593681 - protein, 11 aa, Mycobacterium
TERSELPGHEV

SEQ ID NO: 593682 - protein, 10 aa, Mycobacterium
TERSGAAAGA

SEQ ID NO: 593683 - protein, 10 aa, Mycobacterium
TERSGLPKGT

SEQ ID NO: 593684 - protein, 16 aa, Mycobacterium
TERSGRDRTPSVPGHE

SEQ ID NO: 593685 - protein, 6 aa, Mycobacterium
TERSKT

SEQ ID NO: 593686 - protein, 5 aa, Mycobacterium
TERSL

SEQ ID NO: 593687 - protein, 6 aa, Mycobacterium
TERSRR

SEQ ID NO: 593688 - protein, 4 aa, Mycobacterium
TERT

SEQ ID NO: 593689 - protein, 24 aa, Mycobacterium
TERTADVASDAAEAIAASRAGSQV

SEQ ID NO: 593690 - protein, 5 aa, Mycobacterium
TERTC

SEQ ID NO: 593691 - protein, 5 aa, Mycobacterium
TERTE

SEQ ID NO: 593692 - protein, 10 aa, Mycobacterium
TERTEDGFGQ

SEQ ID NO: 593693 - protein, 8 aa, Mycobacterium
TERTGDRR

SEQ ID NO: 593694 - protein, 19 aa, Mycobacterium
TERTGEYHTRAGGQRSTME

SEQ ID NO: 593695 - protein, 21 aa, Mycobacterium
TERTGGSDLGALETTATRAGD

SEQ ID NO: 593696 - protein, 19 aa, Mycobacterium
TERTGGSDLGALETTATRC

SEQ ID NO: 593697 - protein, 20 aa, Mycobacterium
TERTGGSDLGALETTATRHG

SEQ ID NO: 593698 - protein, 6 aa, Mycobacterium
TERTGI

SEQ ID NO: 593699 - protein, 16 aa, Mycobacterium
TERTLSGGTPGVVDDP

SEQ ID NO: 593700 - protein, 4 aa, Mycobacterium
TERV

SEQ ID NO: 593701 - protein, 7 aa, Mycobacterium
TERVRPE

SEQ ID NO: 593702 - protein, 19 aa, Mycobacterium
TERWPSGIKDGAEFVIPTM

SEQ ID NO: 593703 - protein, 13 aa, Mycobacterium
TERYDDGRPRRAK

SEQ ID NO: 593704 - protein, 5 aa, Mycobacterium
TERYG

SEQ ID NO: 593705 - protein, 8 aa, Mycobacterium
TESAADRF

SEQ ID NO: 593706 - protein, 10 aa, Mycobacterium
TESAAETEEV

SEQ ID NO: 593707 - protein, 7 aa, Mycobacterium
TESAAQV

SEQ ID NO: 593708 - protein, 12 aa, Mycobacterium
TESAAVDEAERR

SEQ ID NO: 593709 - protein, 12 aa, Mycobacterium
TESADRVGARPG

SEQ ID NO: 593710 - protein, 9 aa, Mycobacterium
TESAELSGQ

SEQ ID NO: 593711 - protein, 7 aa, Mycobacterium
TESAETV

SEQ ID NO: 593712 - protein, 7 aa, Mycobacterium
TESAPDL

SEQ ID NO: 593713 - protein, 8 aa, Mycobacterium
TESARPDA

SEQ ID NO: 593714 - protein, 9 aa, Mycobacterium
TESASDPLG

SEQ ID NO: 593715 - protein, 5 aa, Mycobacterium
TESAT

SEQ ID NO: 593716 - protein, 10 aa, Mycobacterium
TESAVTPSGC

SEQ ID NO: 593717 - protein, 4 aa, Mycobacterium
TESD

SEQ ID NO: 593718 - protein, 19 aa, Mycobacterium
TESDAAAPIPGGIPSPDER

SEQ ID NO: 593719 - protein, 7 aa, Mycobacterium
TESDARK

SEQ ID NO: 593720 - protein, 10 aa, Mycobacterium
TESDHREAEC

SEQ ID NO: 593721 - protein, 10 aa, Mycobacterium
TESDNRASEQ

SEQ ID NO: 593722 - protein, 5 aa, Mycobacterium
TESDT

SEQ ID NO: 593723 - protein, 23 aa, Mycobacterium
TESDTPAVPRTAADRRPAAVASK

SEQ ID NO: 593724 - protein, 13 aa, Mycobacterium
TESEDLDAQSPAA

SEQ ID NO: 593725 - protein, 5 aa, Mycobacterium
TESEF

SEQ ID NO: 593726 - protein, 9 aa, Mycobacterium
TESEHRGSA

SEQ ID NO: 593727 - protein, 7 aa, Mycobacterium
TESERAR

SEQ ID NO: 593728 - protein, 10 aa, Mycobacterium
TESESDTDEF

SEQ ID NO: 593729 - protein, 4 aa, Mycobacterium
TESG

SEQ ID NO: 593730 - protein, 5 aa, Mycobacterium
TESGD

SEQ ID NO: 593731 - protein, 7 aa, Mycobacterium
TESGERG

SEQ ID NO: 593732 - protein, 5 aa, Mycobacterium
TESGG

SEQ ID NO: 593733 - protein, 6 aa, Mycobacterium
TESGKT

SEQ ID NO: 593734 - protein, 8 aa, Mycobacterium
TESGPNGV

SEQ ID NO: 593735 - protein, 5 aa, Mycobacterium
TESGR

SEQ ID NO: 593736 - protein, 9 aa, Mycobacterium
TESGTPVWS

SEQ ID NO: 593737 - protein, 4 aa, Mycobacterium
TESH

SEQ ID NO: 593738 - protein, 5 aa, Mycobacterium
TESLD

SEQ ID NO: 593739 - protein, 8 aa, Mycobacterium
TESNDKNA

SEQ ID NO: 593740 - protein, 6 aa, Mycobacterium
TESNKE

SEQ ID NO: 593741 - protein, 7 aa, Mycobacterium
TESPGFG

SEQ ID NO: 593742 - protein, 5 aa, Mycobacterium
TESPN

SEQ ID NO: 593743 - protein, 19 aa, Mycobacterium
TESPSASVTTGAANGQRTV

SEQ ID NO: 593744 - protein, 25 aa, Mycobacterium
TESPTTAADSDHGAVQADSDAPTYR

SEQ ID NO: 593745 - protein, 14 aa, Mycobacterium
TESQATEKTENTAA

SEQ ID NO: 593746 - protein, 6 aa, Mycobacterium
TESRCP

SEQ ID NO: 593747 - protein, 17 aa, Mycobacterium
TESREDVEKRGGKPTEG

SEQ ID NO: 593748 - protein, 17 aa, Mycobacterium
TESRPDATRIPPAPRGP

SEQ ID NO: 593749 - protein, 11 aa, Mycobacterium
TESRREHPTED

SEQ ID NO: 593750 - protein, 8 aa, Mycobacterium
TESRRREA

SEQ ID NO: 593751 - protein, 7 aa, Mycobacterium
TESRRRY

SEQ ID NO: 593752 - protein, 6 aa, Mycobacterium
TESRSA

SEQ ID NO: 593753 - protein, 11 aa, Mycobacterium
TESSGDESVAS

SEQ ID NO: 593754 - protein, 6 aa, Mycobacterium
TESSGT

SEQ ID NO: 593755 - protein, 10 aa, Mycobacterium
TESSPDADSC

SEQ ID NO: 593756 - protein, 8 aa, Mycobacterium
TESSRSIP

SEQ ID NO: 593757 - protein, 6 aa, Mycobacterium
TESSWD

SEQ ID NO: 593758 - protein, 7 aa, Mycobacterium
TESSYRA

SEQ ID NO: 593759 - protein, 11 aa, Mycobacterium
TESTDGPLAGR

SEQ ID NO: 593760 - protein, 7 aa, Mycobacterium
TESTERP

SEQ ID NO: 593761 - protein, 15 aa, Mycobacterium
TESTGSVTQLDGDEH

SEQ ID NO: 593762 - protein, 7 aa, Mycobacterium
TESTPAG

SEQ ID NO: 593763 - protein, 6 aa, Mycobacterium
TESTVA

SEQ ID NO: 593764 - protein, 10 aa, Mycobacterium
TESTVRQTDY

SEQ ID NO: 593765 - protein, 6 aa, Mycobacterium
TESTWG

SEQ ID NO: 593766 - protein, 8 aa, Mycobacterium
TESVGQQR

SEQ ID NO: 593767 - protein, 4 aa, Mycobacterium
TESY

SEQ ID NO: 593768 - protein, 6 aa, Mycobacterium
TESYEK

SEQ ID NO: 593769 - protein, 4 aa, Mycobacterium
TETA

SEQ ID NO: 593770 - protein, 5 aa, Mycobacterium
TETAA

SEQ ID NO: 593771 - protein, 5 aa, Mycobacterium
TETAD

SEQ ID NO: 593772 - protein, 8 aa, Mycobacterium
TETADDHR

SEQ ID NO: 593773 - protein, 6 aa, Mycobacterium
TETAGE

SEQ ID NO: 593774 - protein, 6 aa, Mycobacterium
TETAGG

SEQ ID NO: 593775 - protein, 7 aa, Mycobacterium
TETAGGF

SEQ ID NO: 593776 - protein, 11 aa, Mycobacterium
TETAKTGAPRL

SEQ ID NO: 593777 - protein, 5 aa, Mycobacterium
TETAL

SEQ ID NO: 593778 - protein, 11 aa, Mycobacterium
TETANLPAEHR

SEQ ID NO: 593779 - protein, 7 aa, Mycobacterium
TETAPEL

SEQ ID NO: 593780 - protein, 7 aa, Mycobacterium
TETAQRL

SEQ ID NO: 593781 - protein, 8 aa, Mycobacterium
TETASARL

SEQ ID NO: 593782 - protein, 11 aa, Mycobacterium
TETASQDGRFE

SEQ ID NO: 593783 - protein, 11 aa, Mycobacterium
TETATKVGGTA

SEQ ID NO: 593784 - protein, 12 aa, Mycobacterium
TETATLAREHNN

SEQ ID NO: 593785 - protein, 15 aa, Mycobacterium
TETATPAKRERHETV

SEQ ID NO: 593786 - protein, 4 aa, Mycobacterium
TETD

SEQ ID NO: 593787 - protein, 8 aa, Mycobacterium
TETDDPHQ

SEQ ID NO: 593788 - protein, 9 aa, Mycobacterium
TETDYSPTT

SEQ ID NO: 593789 - protein, 11 aa, Mycobacterium
TETEGGSSRKQ

SEQ ID NO: 593790 - protein, 15 aa, Mycobacterium
TETEIEPVGPENPYG

SEQ ID NO: 593791 - protein, 6 aa, Mycobacterium
TETELK

SEQ ID NO: 593792 - protein, 6 aa, Mycobacterium
TETENI

SEQ ID NO: 593793 - protein, 8 aa, Mycobacterium
TETEPDAV

SEQ ID NO: 593794 - protein, 8 aa, Mycobacterium
TETGARRE

SEQ ID NO: 593795 - protein, 11 aa, Mycobacterium
TETGEPAGIGG

SEQ ID NO: 593796 - protein, 5 aa, Mycobacterium
TETGF

SEQ ID NO: 593797 - protein, 5 aa, Mycobacterium
TETGG

SEQ ID NO: 593798 - protein, 9 aa, Mycobacterium
TETGGATSH

SEQ ID NO: 593799 - protein, 7 aa, Mycobacterium
TETGGPH

SEQ ID NO: 593800 - protein, 7 aa, Mycobacterium
TETGGRS

SEQ ID NO: 593801 - protein, 17 aa, Mycobacterium
TETGKGASRRARREGKV

SEQ ID NO: 593802 - protein, 9 aa, Mycobacterium
TETGNPDRR

SEQ ID NO: 593803 - protein, 7 aa, Mycobacterium
TETGNSA

SEQ ID NO: 593804 - protein, 6 aa, Mycobacterium
TETGPV

SEQ ID NO: 593805 - protein, 7 aa, Mycobacterium
TETGQAV

SEQ ID NO: 593806 - protein, 5 aa, Mycobacterium
TETGR

SEQ ID NO: 593807 - protein, 11 aa, Mycobacterium
TETGRAQAELA

SEQ ID NO: 593808 - protein, 5 aa, Mycobacterium
TETGS

SEQ ID NO: 593809 - protein, 7 aa, Mycobacterium
TETGSRL

SEQ ID NO: 593810 - protein, 8 aa, Mycobacterium
TETGSSLA

SEQ ID NO: 593811 - protein, 7 aa, Mycobacterium
TETGSSM

SEQ ID NO: 593812 - protein, 7 aa, Mycobacterium
TETGSSV

SEQ ID NO: 593813 - protein, 13 aa, Mycobacterium
TETGTNRIPDGAQ

SEQ ID NO: 593814 - protein, 4 aa, Mycobacterium
TETH

SEQ ID NO: 593815 - protein, 12 aa, Mycobacterium
TETHERVPAPES

SEQ ID NO: 593816 - protein, 8 aa, Mycobacterium
TETHNGCP

SEQ ID NO: 593817 - protein, 6 aa, Mycobacterium
TETHSG

SEQ ID NO: 593818 - protein, 4 aa, Mycobacterium
TETI

SEQ ID NO: 593819 - protein, 12 aa, Mycobacterium
TETIEDGAGRIQ

SEQ ID NO: 593820 - protein, 13 aa, Mycobacterium
TETISAPRSGTMG

SEQ ID NO: 593821 - protein, 9 aa, Mycobacterium
TETLPNGLS

SEQ ID NO: 593822 - protein, 4 aa, Mycobacterium
TETN

SEQ ID NO: 593823 - protein, 5 aa, Mycobacterium
TETNE

SEQ ID NO: 593824 - protein, 14 aa, Mycobacterium
TETNTPLPMVELRL

SEQ ID NO: 593825 - protein, 9 aa, Mycobacterium
TETPAGPVA

SEQ ID NO: 593826 - protein, 12 aa, Mycobacterium
TETPDAGGEAGD

SEQ ID NO: 593827 - protein, 17 aa, Mycobacterium
TETPEDLKQRGAKKTDG

SEQ ID NO: 593828 - protein, 9 aa, Mycobacterium
TETPGVQRR

SEQ ID NO: 593829 - protein, 10 aa, Mycobacterium
TETPNGPVAT

SEQ ID NO: 593830 - protein, 14 aa, Mycobacterium
TETPNSGQREQLRR

SEQ ID NO: 593831 - protein, 8 aa, Mycobacterium
TETPQPVP

SEQ ID NO: 593832 - protein, 9 aa, Mycobacterium
TETPSGPVA

SEQ ID NO: 593833 - protein, 10 aa, Mycobacterium
TETPSGPVAT

SEQ ID NO: 593834 - protein, 5 aa, Mycobacterium
TETPV

SEQ ID NO: 593835 - protein, 4 aa, Mycobacterium
TETQ

SEQ ID NO: 593836 - protein, 6 aa, Mycobacterium
TETQAG

SEQ ID NO: 593837 - protein, 7 aa, Mycobacterium
TETQQRE

SEQ ID NO: 593838 - protein, 8 aa, Mycobacterium
TETQRAEG

SEQ ID NO: 593839 - protein, 7 aa, Mycobacterium
TETRDEV

SEQ ID NO: 593840 - protein, 10 aa, Mycobacterium
TETRRRGATR

SEQ ID NO: 593841 - protein, 9 aa, Mycobacterium
TETRSEDEV

SEQ ID NO: 593842 - protein, 4 aa, Mycobacterium
TETS

SEQ ID NO: 593843 - protein, 7 aa, Mycobacterium
TETSDGT

SEQ ID NO: 593844 - protein, 11 aa, Mycobacterium
TETSEHPGGYA

SEQ ID NO: 593845 - protein, 6 aa, Mycobacterium
TETSLD

SEQ ID NO: 593846 - protein, 8 aa, Mycobacterium
TETSPLAT

SEQ ID NO: 593847 - protein, 12 aa, Mycobacterium
TETSPLGTDPGL

SEQ ID NO: 593848 - protein, 7 aa, Mycobacterium
TETSSTT

SEQ ID NO: 593849 - protein, 11 aa, Mycobacterium
TETTDHPGGYA

SEQ ID NO: 593850 - protein, 12 aa, Mycobacterium
TETTESPETRER

SEQ ID NO: 593851 - protein, 11 aa, Mycobacterium
TETTGHPGGYA

SEQ ID NO: 593852 - protein, 10 aa, Mycobacterium
TETTGRRGGI

SEQ ID NO: 593853 - protein, 11 aa, Mycobacterium
TETTGTRGGIH

SEQ ID NO: 593854 - protein, 18 aa, Mycobacterium
TETTHQAASRRVRTHDPR

SEQ ID NO: 593855 - protein, 5 aa, Mycobacterium
TETTR

SEQ ID NO: 593856 - protein, 6 aa, Mycobacterium
TETTTC

SEQ ID NO: 593857 - protein, 5 aa, Mycobacterium
TETTV

SEQ ID NO: 593858 - protein, 5 aa, Mycobacterium
TETVD

SEQ ID NO: 593859 - protein, 11 aa, Mycobacterium
TETVSESGETV

SEQ ID NO: 593860 - protein, 5 aa, Mycobacterium
TETWD

SEQ ID NO: 593861 - protein, 42 aa, Mycobacterium
TETYAGQARSPGTAGPAPQPPQPDGGAWRPAEADFSAEADRI

SEQ ID NO: 593862 - protein, 4 aa, Mycobacterium
TEVA

SEQ ID NO: 593863 - protein, 15 aa, Mycobacterium
TEVAEPDRAAEAGRF

SEQ ID NO: 593864 - protein, 5 aa, Mycobacterium
TEVAG

SEQ ID NO: 593865 - protein, 13 aa, Mycobacterium
TEVASSITSLGGR

SEQ ID NO: 593866 - protein, 9 aa, Mycobacterium
TEVDAGHSR

SEQ ID NO: 593867 - protein, 10 aa, Mycobacterium
TEVDVGANDM

SEQ ID NO: 593868 - protein, 11 aa, Mycobacterium
TEVEARARAAE

SEQ ID NO: 593869 - protein, 12 aa, Mycobacterium
TEVEGYPPAAEI

SEQ ID NO: 593870 - protein, 6 aa, Mycobacterium
TEVEPG

SEQ ID NO: 593871 - protein, 9 aa, Mycobacterium
TEVERDQYA

SEQ ID NO: 593872 - protein, 13 aa, Mycobacterium
TEVGRPEAHHEEA

SEQ ID NO: 593873 - protein, 6 aa, Mycobacterium
TEVGSR

SEQ ID NO: 593874 - protein, 4 aa, Mycobacterium
TEVH

SEQ ID NO: 593875 - protein, 14 aa, Mycobacterium
TEVKERGAQPISDD

SEQ ID NO: 593876 - protein, 12 aa, Mycobacterium
TEVNPAAPLPDT

SEQ ID NO: 593877 - protein, 14 aa, Mycobacterium
TEVPAAGRRRMETA

SEQ ID NO: 593878 - protein, 5 aa, Mycobacterium
TEVPP

SEQ ID NO: 593879 - protein, 6 aa, Mycobacterium
TEVPSR

SEQ ID NO: 593880 - protein, 5 aa, Mycobacterium
TEVPT

SEQ ID NO: 593881 - protein, 15 aa, Mycobacterium
TEVQSRSDAEPVMEE

SEQ ID NO: 593882 - protein, 11 aa, Mycobacterium
TEVRAEGSADV

SEQ ID NO: 593883 - protein, 8 aa, Mycobacterium
TEVRASAE

SEQ ID NO: 593884 - protein, 7 aa, Mycobacterium
TEVRDSS

SEQ ID NO: 593885 - protein, 9 aa, Mycobacterium
TEVRGEGRA

SEQ ID NO: 593886 - protein, 10 aa, Mycobacterium
TEVSAPSAAT

SEQ ID NO: 593887 - protein, 10 aa, Mycobacterium
TEVSDQERPH

SEQ ID NO: 593888 - protein, 11 aa, Mycobacterium
TEVSGAARPSA

SEQ ID NO: 593889 - protein, 15 aa, Mycobacterium
TEVSGSGAVADNSVT

SEQ ID NO: 593890 - protein, 7 aa, Mycobacterium
TEVSPYQ

SEQ ID NO: 593891 - protein, 10 aa, Mycobacterium
TEVTDTGRPI

SEQ ID NO: 593892 - protein, 5 aa, Mycobacterium
TEVTP

SEQ ID NO: 593893 - protein, 5 aa, Mycobacterium
TEVTS

SEQ ID NO: 593894 - protein, 7 aa, Mycobacterium
TEVTSRP

SEQ ID NO: 593895 - protein, 10 aa, Mycobacterium
TEVTTAEGAP

SEQ ID NO: 593896 - protein, 12 aa, Mycobacterium
TEWGGAGTKDAL

SEQ ID NO: 593897 - protein, 6 aa, Mycobacterium
TEWPPA

SEQ ID NO: 593898 - protein, 4 aa, Mycobacterium
TEYA

SEQ ID NO: 593899 - protein, 8 aa, Mycobacterium
TEYAPAGA

SEQ ID NO: 593900 - protein, 4 aa, Mycobacterium
TEYD

SEQ ID NO: 593901 - protein, 6 aa, Mycobacterium
TEYDED

SEQ ID NO: 593902 - protein, 13 aa, Mycobacterium
TEYEPDRAARERD

SEQ ID NO: 593903 - protein, 8 aa, Mycobacterium
TEYGGHGR

SEQ ID NO: 593904 - protein, 7 aa, Mycobacterium
TEYGGKG

SEQ ID NO: 593905 - protein, 22 aa, Mycobacterium
TEYGGNRHSGPRNWPDGQRSPG

SEQ ID NO: 593906 - protein, 10 aa, Mycobacterium
TEYGGTVTTG

SEQ ID NO: 593907 - protein, 23 aa, Mycobacterium
TEYGSGVGRSKKEAEQKAAAAAY

SEQ ID NO: 593908 - protein, 22 aa, Mycobacterium
TEYGSGVGRSKKEAEQKAAAAT

SEQ ID NO: 593909 - protein, 15 aa, Mycobacterium
TEYISSGAHKPTPTI

SEQ ID NO: 593910 - protein, 5 aa, Mycobacterium
TEYPE

SEQ ID NO: 593911 - protein, 8 aa, Mycobacterium
TEYPEGME

SEQ ID NO: 593912 - protein, 6 aa, Mycobacterium
TEYPKP

SEQ ID NO: 593913 - protein, 10 aa, Mycobacterium
TEYPRNPDWA

SEQ ID NO: 593914 - protein, 8 aa, Mycobacterium
TEYRPDGT

SEQ ID NO: 593915 - protein, 5 aa, Mycobacterium
TEYSG

SEQ ID NO: 593916 - protein, 20 aa, Mycobacterium
TEYSSGASRVQGPITKAGNA

SEQ ID NO: 593917 - protein, 6 aa, Mycobacterium
TEYSYT

SEQ ID NO: 593918 - protein, 6 aa, Mycobacterium
TEYTDA

SEQ ID NO: 593919 - protein, 17 aa, Mycobacterium
TFAAPRNPDFSASPVQP

SEQ ID NO: 593920 - protein, 4 aa, Mycobacterium
TFAE

SEQ ID NO: 593921 - protein, 5 aa, Mycobacterium
TFAEH

SEQ ID NO: 593922 - protein, 6 aa, Mycobacterium
TFAEHA

SEQ ID NO: 593923 - protein, 12 aa, Mycobacterium
TFAEQRKRAQRV

SEQ ID NO: 593924 - protein, 14 aa, Mycobacterium
TFAERDDLSGSRND

SEQ ID NO: 593925 - protein, 11 aa, Mycobacterium
TFAGGSPGAFQ

SEQ ID NO: 593926 - protein, 5 aa, Mycobacterium
TFAGN

SEQ ID NO: 593927 - protein, 17 aa, Mycobacterium
TFAPAPQRFEAGTPMTS

SEQ ID NO: 593928 - protein, 6 aa, Mycobacterium
TFAPGA

SEQ ID NO: 593929 - protein, 8 aa, Mycobacterium
TFAPPAGD

SEQ ID NO: 593930 - protein, 11 aa, Mycobacterium
TFAQDGVGGLR

SEQ ID NO: 593931 - protein, 13 aa, Mycobacterium
TFAQDGVGGLRGG

SEQ ID NO: 593932 - protein, 10 aa, Mycobacterium
TFAQDGVGQL

SEQ ID NO: 593933 - protein, 6 aa, Mycobacterium
TFAQTG

SEQ ID NO: 593934 - protein, 14 aa, Mycobacterium
TFDAENSRKKLPSV

SEQ ID NO: 593935 - protein, 6 aa, Mycobacterium
TFDDGD

SEQ ID NO: 593936 - protein, 4 aa, Mycobacterium
TFDG

SEQ ID NO: 593937 - protein, 7 aa, Mycobacterium
TFDGGGH

SEQ ID NO: 593938 - protein, 13 aa, Mycobacterium
TFDGPYGNTGTNS

SEQ ID NO: 593939 - protein, 17 aa, Mycobacterium
TFDPDPDASGKTYSRRG

SEQ ID NO: 593940 - protein, 6 aa, Mycobacterium
TFDPGT

SEQ ID NO: 593941 - protein, 9 aa, Mycobacterium
TFDPPEHTA

SEQ ID NO: 593942 - protein, 7 aa, Mycobacterium
TFDPSTS

SEQ ID NO: 593943 - protein, 6 aa, Mycobacterium
TFDTAR

SEQ ID NO: 593944 - protein, 8 aa, Mycobacterium
TFDTGARS

SEQ ID NO: 593945 - protein, 7 aa, Mycobacterium
TFDTGDA

SEQ ID NO: 593946 - protein, 7 aa, Mycobacterium
TFDTGDP

SEQ ID NO: 593947 - protein, 10 aa, Mycobacterium
TFEARTPDTL

SEQ ID NO: 593948 - protein, 11 aa, Mycobacterium
TFEGFGEKDPL

SEQ ID NO: 593949 - protein, 15 aa, Mycobacterium
TFEPAGATMSGPNQL

SEQ ID NO: 593950 - protein, 6 aa, Mycobacterium
TFEPGG

SEQ ID NO: 593951 - protein, 5 aa, Mycobacterium
TFERQ

SEQ ID NO: 593952 - protein, 13 aa, Mycobacterium
TFERTGKTVHADA

SEQ ID NO: 593953 - protein, 12 aa, Mycobacterium
TFESEQDAGTKY

SEQ ID NO: 593954 - protein, 11 aa, Mycobacterium
TFGADGTYETW

SEQ ID NO: 593955 - protein, 6 aa, Mycobacterium
TFGAEG

SEQ ID NO: 593956 - protein, 9 aa, Mycobacterium
TFGAPDDNI

SEQ ID NO: 593957 - protein, 8 aa, Mycobacterium
TFGASEAA

SEQ ID NO: 593958 - protein, 6 aa, Mycobacterium
TFGDDE

SEQ ID NO: 593959 - protein, 11 aa, Mycobacterium
TFGDPVDPRGI

SEQ ID NO: 593960 - protein, 12 aa, Mycobacterium
TFGESAGTQDFR

SEQ ID NO: 593961 - protein, 12 aa, Mycobacterium
TFGGANRAAGVA

SEQ ID NO: 593962 - protein, 9 aa, Mycobacterium
TFGGDPGNV

SEQ ID NO: 593963 - protein, 5 aa, Mycobacterium
TFGGF

SEQ ID NO: 593964 - protein, 7 aa, Mycobacterium
TFGGGGH

SEQ ID NO: 593965 - protein, 5 aa, Mycobacterium
TFGGK

SEQ ID NO: 593966 - protein, 6 aa, Mycobacterium
TFGGSG

SEQ ID NO: 593967 - protein, 4 aa, Mycobacterium
TFGI

SEQ ID NO: 593968 - protein, 10 aa, Mycobacterium
TFGNPRERAQ

SEQ ID NO: 593969 - protein, 4 aa, Mycobacterium
TFGP

SEQ ID NO: 593970 - protein, 7 aa, Mycobacterium
TFGPEDG

SEQ ID NO: 593971 - protein, 19 aa, Mycobacterium
TFGPLGAKSMSESPYNPVA

SEQ ID NO: 593972 - protein, 7 aa, Mycobacterium
TFGPQSL

SEQ ID NO: 593973 - protein, 10 aa, Mycobacterium
TFGPREPSPW

SEQ ID NO: 593974 - protein, 8 aa, Mycobacterium
TFGPTEPL

SEQ ID NO: 593975 - protein, 6 aa, Mycobacterium
TFGPTG

SEQ ID NO: 593976 - protein, 7 aa, Mycobacterium
TFGPTTE

SEQ ID NO: 593977 - protein, 19 aa, Mycobacterium
TFGQSEPEVDTRDDARTRN

SEQ ID NO: 593978 - protein, 9 aa, Mycobacterium
TFGQTGPDY

SEQ ID NO: 593979 - protein, 11 aa, Mycobacterium
TFGSAPEAADG

SEQ ID NO: 593980 - protein, 5 aa, Mycobacterium
TFGSG

SEQ ID NO: 593981 - protein, 9 aa, Mycobacterium
TFGSGSGAV

SEQ ID NO: 593982 - protein, 11 aa, Mycobacterium
TFGSRQEEAQR

SEQ ID NO: 593983 - protein, 6 aa, Mycobacterium
TFGTAA

SEQ ID NO: 593984 - protein, 22 aa, Mycobacterium
TFKQNPPPAPVDPKDMTAEEAR

SEQ ID NO: 593985 - protein, 9 aa, Mycobacterium
TFKSGSAEI

SEQ ID NO: 593986 - protein, 17 aa, Mycobacterium
TFNAPTEYQYPHMERED

SEQ ID NO: 593987 - protein, 5 aa, Mycobacterium
TFNEP

SEQ ID NO: 593988 - protein, 10 aa, Mycobacterium
TFPASAPDRQ

SEQ ID NO: 593989 - protein, 5 aa, Mycobacterium
TFPDA

SEQ ID NO: 593990 - protein, 15 aa, Mycobacterium
TFPDGTKLVTVHQPI

SEQ ID NO: 593991 - protein, 10 aa, Mycobacterium
TFPDGTVPDV

SEQ ID NO: 593992 - protein, 5 aa, Mycobacterium
TFPDV

SEQ ID NO: 593993 - protein, 6 aa, Mycobacterium
TFPEAA

SEQ ID NO: 593994 - protein, 12 aa, Mycobacterium
TFPETPHDHKPH

SEQ ID NO: 593995 - protein, 4 aa, Mycobacterium
TFPG

SEQ ID NO: 593996 - protein, 7 aa, Mycobacterium
TFPGEPP

SEQ ID NO: 593997 - protein, 9 aa, Mycobacterium
TFPGPGADR

SEQ ID NO: 593998 - protein, 12 aa, Mycobacterium
TFPGSGSQRPTR

SEQ ID NO: 593999 - protein, 6 aa, Mycobacterium
TFPNGG

SEQ ID NO: 594000 - protein, 5 aa, Mycobacterium
TFPNV

SEQ ID NO: 594001 - protein, 4 aa, Mycobacterium
TFPQ

SEQ ID NO: 594002 - protein, 10 aa, Mycobacterium
TFPSGEGSDL

SEQ ID NO: 594003 - protein, 10 aa, Mycobacterium
TFPSGQGSDL

SEQ ID NO: 594004 - protein, 10 aa, Mycobacterium
TFPSINPATG

SEQ ID NO: 594005 - protein, 4 aa, Mycobacterium
TFPT

SEQ ID NO: 594006 - protein, 6 aa, Mycobacterium
TFPTEP

SEQ ID NO: 594007 - protein, 19 aa, Mycobacterium
TFPTTHDPERRTEVPRDES

SEQ ID NO: 594008 - protein, 11 aa, Mycobacterium
TFQASSEKHPD

SEQ ID NO: 594009 - protein, 5 aa, Mycobacterium
TFQEN

SEQ ID NO: 594010 - protein, 8 aa, Mycobacterium
TFQGTEPD

SEQ ID NO: 594011 - protein, 4 aa, Mycobacterium
TFQQ

SEQ ID NO: 594012 - protein, 5 aa, Mycobacterium
TFQQR

SEQ ID NO: 594013 - protein, 10 aa, Mycobacterium
TFRGTGQGGA

SEQ ID NO: 594014 - protein, 21 aa, Mycobacterium
TFRSERYPEYKANRSATPDEF

SEQ ID NO: 594015 - protein, 11 aa, Mycobacterium
TFRTPRPRHEP

SEQ ID NO: 594016 - protein, 10 aa, Mycobacterium
TFSANGTTPA

SEQ ID NO: 594017 - protein, 13 aa, Mycobacterium
TFSDDVRRKGDRL

SEQ ID NO: 594018 - protein, 6 aa, Mycobacterium
TFSDPT

SEQ ID NO: 594019 - protein, 7 aa, Mycobacterium
TFSDSGA

SEQ ID NO: 594020 - protein, 6 aa, Mycobacterium
TFSDTG

SEQ ID NO: 594021 - protein, 9 aa, Mycobacterium
TFSGEPADV

SEQ ID NO: 594022 - protein, 9 aa, Mycobacterium
TFSGGGMPD

SEQ ID NO: 594023 - protein, 11 aa, Mycobacterium
TFSGGSPGAFQ

SEQ ID NO: 594024 - protein, 21 aa, Mycobacterium
TFSGKAKGHGRHVKQSGGHGQ

SEQ ID NO: 594025 - protein, 7 aa, Mycobacterium
TFSGPNM

SEQ ID NO: 594026 - protein, 13 aa, Mycobacterium
TFSPGPSPYGPPP

SEQ ID NO: 594027 - protein, 7 aa, Mycobacterium
TFSRGDT

SEQ ID NO: 594028 - protein, 41 aa, Mycobacterium
TFSSSGHSHTPTKLAGDESRHITRQNPSSMPVHPRRQRLFP

SEQ ID NO: 594029 - protein, 13 aa, Mycobacterium
TFSSTSIDGGGYP

SEQ ID NO: 594030 - protein, 6 aa, Mycobacterium
TFTAPA

SEQ ID NO: 594031 - protein, 7 aa, Mycobacterium
TFTGAGT

SEQ ID NO: 594032 - protein, 9 aa, Mycobacterium
TFTGGGMPD

SEQ ID NO: 594033 - protein, 12 aa, Mycobacterium
TFTGGSPGAFQG

SEQ ID NO: 594034 - protein, 12 aa, Mycobacterium
TFTGGTPGAFQG

SEQ ID NO: 594035 - protein, 6 aa, Mycobacterium
TFTGKK

SEQ ID NO: 594036 - protein, 4 aa, Mycobacterium
TFTP

SEQ ID NO: 594037 - protein, 11 aa, Mycobacterium
TFTPATDEEVD

SEQ ID NO: 594038 - protein, 11 aa, Mycobacterium
TFTPATDQEVD

SEQ ID NO: 594039 - protein, 10 aa, Mycobacterium
TFTPATREEV

SEQ ID NO: 594040 - protein, 10 aa, Mycobacterium
TFTPGDHTDS

SEQ ID NO: 594041 - protein, 12 aa, Mycobacterium
TFTPGPRLGPGL

SEQ ID NO: 594042 - protein, 6 aa, Mycobacterium
TFTPPA

SEQ ID NO: 594043 - protein, 5 aa, Mycobacterium
TFTPT

SEQ ID NO: 594044 - protein, 5 aa, Mycobacterium
TFTRP

SEQ ID NO: 594045 - protein, 11 aa, Mycobacterium
TFTTADGEVTG

SEQ ID NO: 594046 - protein, 7 aa, Mycobacterium
TFTTPTD

SEQ ID NO: 594047 - protein, 19 aa, Mycobacterium
TFYSPGKEGYIDYPSLSAG

SEQ ID NO: 594048 - protein, 6 aa, Mycobacterium
TGAAAE

SEQ ID NO: 594049 - protein, 9 aa, Mycobacterium
TGAAAGPNR

SEQ ID NO: 594050 - protein, 6 aa, Mycobacterium
TGAAAP

SEQ ID NO: 594051 - protein, 27 aa, Mycobacterium
TGAAAPAGATGGTGTTVAAAAAVASSD

SEQ ID NO: 594052 - protein, 6 aa, Mycobacterium
TGAAAR

SEQ ID NO: 594053 - protein, 6 aa, Mycobacterium
TGAADA

SEQ ID NO: 594054 - protein, 11 aa, Mycobacterium
TGAADFTPGDE

SEQ ID NO: 594055 - protein, 9 aa, Mycobacterium
TGAADGYAR

SEQ ID NO: 594056 - protein, 14 aa, Mycobacterium
TGAADGYARMTGTP

SEQ ID NO: 594057 - protein, 9 aa, Mycobacterium
TGAAEGPHV

SEQ ID NO: 594058 - protein, 8 aa, Mycobacterium
TGAAEGRV

SEQ ID NO: 594059 - protein, 36 aa, Mycobacterium
TGAAELADPVRAGGAVSENATDTPRRRRRDVTTTAP

SEQ ID NO: 594060 - protein, 7 aa, Mycobacterium
TGAAGDE

SEQ ID NO: 594061 - protein, 9 aa, Mycobacterium
TGAAGGREA

SEQ ID NO: 594062 - protein, 6 aa, Mycobacterium
TGAAGL

SEQ ID NO: 594063 - protein, 13 aa, Mycobacterium
TGAAGSAGISTGA

SEQ ID NO: 594064 - protein, 5 aa, Mycobacterium
TGAAI

SEQ ID NO: 594065 - protein, 8 aa, Mycobacterium
TGAAKLGD

SEQ ID NO: 594066 - protein, 8 aa, Mycobacterium
TGAAKPGD

SEQ ID NO: 594067 - protein, 7 aa, Mycobacterium
TGAAKRS

SEQ ID NO: 594068 - protein, 6 aa, Mycobacterium
TGAALG

SEQ ID NO: 594069 - protein, 10 aa, Mycobacterium
TGAANRDPAL

SEQ ID NO: 594070 - protein, 9 aa, Mycobacterium
TGAAPGAAL

SEQ ID NO: 594071 - protein, 14 aa, Mycobacterium
TGAAPGSVDIGDRG

SEQ ID NO: 594072 - protein, 13 aa, Mycobacterium
TGAAPLDKRRLRV

SEQ ID NO: 594073 - protein, 7 aa, Mycobacterium
TGAAPLS

SEQ ID NO: 594074 - protein, 11 aa, Mycobacterium
TGAAPSAAGPR

SEQ ID NO: 594075 - protein, 14 aa, Mycobacterium
TGAAPSGAGPRVKR

SEQ ID NO: 594076 - protein, 8 aa, Mycobacterium
TGAARPGT

SEQ ID NO: 594077 - protein, 11 aa, Mycobacterium
TGAASDDDALT

SEQ ID NO: 594078 - protein, 9 aa, Mycobacterium
TGAASEDDA

SEQ ID NO: 594079 - protein, 8 aa, Mycobacterium
TGAATADY

SEQ ID NO: 594080 - protein, 13 aa, Mycobacterium
TGAATAPAYRRRG

SEQ ID NO: 594081 - protein, 8 aa, Mycobacterium
TGAATSGV

SEQ ID NO: 594082 - protein, 9 aa, Mycobacterium
TGAAVDRNR

SEQ ID NO: 594083 - protein, 7 aa, Mycobacterium
TGAAVER

SEQ ID NO: 594084 - protein, 5 aa, Mycobacterium
TGADD

SEQ ID NO: 594085 - protein, 7 aa, Mycobacterium
TGADDDV

SEQ ID NO: 594086 - protein, 8 aa, Mycobacterium
TGADDEAA

SEQ ID NO: 594087 - protein, 8 aa, Mycobacterium
TGADDPEF

SEQ ID NO: 594088 - protein, 10 aa, Mycobacterium
TGADEAGEYV

SEQ ID NO: 594089 - protein, 9 aa, Mycobacterium
TGADEPGKH

SEQ ID NO: 594090 - protein, 8 aa, Mycobacterium
TGADEPGR

SEQ ID NO: 594091 - protein, 8 aa, Mycobacterium
TGADERGA

SEQ ID NO: 594092 - protein, 5 aa, Mycobacterium
TGADG

SEQ ID NO: 594093 - protein, 7 aa, Mycobacterium
TGADGAT

SEQ ID NO: 594094 - protein, 6 aa, Mycobacterium
TGADGE

SEQ ID NO: 594095 - protein, 9 aa, Mycobacterium
TGADGPRGI

SEQ ID NO: 594096 - protein, 10 aa, Mycobacterium
TGADGRPSQV

SEQ ID NO: 594097 - protein, 8 aa, Mycobacterium
TGADGRVR

SEQ ID NO: 594098 - protein, 5 aa, Mycobacterium
TGADI

SEQ ID NO: 594099 - protein, 5 aa, Mycobacterium
TGADL

SEQ ID NO: 594100 - protein, 10 aa, Mycobacterium
TGADLAAARA

SEQ ID NO: 594101 - protein, 24 aa, Mycobacterium
TGADLDGPVPDSAFPEHTETHQTA

SEQ ID NO: 594102 - protein, 9 aa, Mycobacterium
TGADLSAAR

SEQ ID NO: 594103 - protein, 10 aa, Mycobacterium
TGADLSAARD

SEQ ID NO: 594104 - protein, 13 aa, Mycobacterium
TGADLSAAREAAY

SEQ ID NO: 594105 - protein, 5 aa, Mycobacterium
TGADN

SEQ ID NO: 594106 - protein, 10 aa, Mycobacterium
TGADPARMNP

SEQ ID NO: 594107 - protein, 11 aa, Mycobacterium
TGADPARVNPL

SEQ ID NO: 594108 - protein, 15 aa, Mycobacterium
TGADPDGQTTRPAEE

SEQ ID NO: 594109 - protein, 10 aa, Mycobacterium
TGADPGRLNP

SEQ ID NO: 594110 - protein, 10 aa, Mycobacterium
TGADPRRLNP

SEQ ID NO: 594111 - protein, 5 aa, Mycobacterium
TGADR

SEQ ID NO: 594112 - protein, 7 aa, Mycobacterium
TGADREN

SEQ ID NO: 594113 - protein, 7 aa, Mycobacterium
TGADSVT

SEQ ID NO: 594114 - protein, 10 aa, Mycobacterium
TGADTDPAVN

SEQ ID NO: 594115 - protein, 9 aa, Mycobacterium
TGADTDPTV

SEQ ID NO: 594116 - protein, 11 aa, Mycobacterium
TGADTKSAAIA

SEQ ID NO: 594117 - protein, 6 aa, Mycobacterium
TGADYA

SEQ ID NO: 594118 - protein, 5 aa, Mycobacterium
TGAEA

SEQ ID NO: 594119 - protein, 11 aa, Mycobacterium
TGAEAANASPL

SEQ ID NO: 594120 - protein, 6 aa, Mycobacterium
TGAEAE

SEQ ID NO: 594121 - protein, 8 aa, Mycobacterium
TGAEAVEN

SEQ ID NO: 594122 - protein, 13 aa, Mycobacterium
TGAEDSGGSGASW

SEQ ID NO: 594123 - protein, 5 aa, Mycobacterium
TGAEE

SEQ ID NO: 594124 - protein, 6 aa, Mycobacterium
TGAEEA

SEQ ID NO: 594125 - protein, 7 aa, Mycobacterium
TGAEELD

SEQ ID NO: 594126 - protein, 13 aa, Mycobacterium
TGAEESGGSGAGW

SEQ ID NO: 594127 - protein, 7 aa, Mycobacterium
TGAEGMN

SEQ ID NO: 594128 - protein, 8 aa, Mycobacterium
TGAEGPRG

SEQ ID NO: 594129 - protein, 5 aa, Mycobacterium
TGAEI

SEQ ID NO: 594130 - protein, 9 aa, Mycobacterium
TGAELPAGE

SEQ ID NO: 594131 - protein, 11 aa, Mycobacterium
TGAENSPATYG

SEQ ID NO: 594132 - protein, 8 aa, Mycobacterium
TGAEPGEH

SEQ ID NO: 594133 - protein, 8 aa, Mycobacterium
TGAERDEI

SEQ ID NO: 594134 - protein, 9 aa, Mycobacterium
TGAERVNPA

SEQ ID NO: 594135 - protein, 9 aa, Mycobacterium
TGAESNEAA

SEQ ID NO: 594136 - protein, 12 aa, Mycobacterium
TGAESTIDSHPA

SEQ ID NO: 594137 - protein, 5 aa, Mycobacterium
TGAET

SEQ ID NO: 594138 - protein, 7 aa, Mycobacterium
TGAETRA

SEQ ID NO: 594139 - protein, 7 aa, Mycobacterium
TGAFGSA

SEQ ID NO: 594140 - protein, 6 aa, Mycobacterium
TGAGAE

SEQ ID NO: 594141 - protein, 10 aa, Mycobacterium
TGAGASATEY

SEQ ID NO: 594142 - protein, 21 aa, Mycobacterium
TGAGASKPTNSQPIESPPAIG

SEQ ID NO: 594143 - protein, 18 aa, Mycobacterium
TGAGAYAAAEAANSSPLQ

SEQ ID NO: 594144 - protein, 13 aa, Mycobacterium
TGAGDKAFVSGGD

SEQ ID NO: 594145 - protein, 6 aa, Mycobacterium
TGAGDR

SEQ ID NO: 594146 - protein, 5 aa, Mycobacterium
TGAGE

SEQ ID NO: 594147 - protein, 11 aa, Mycobacterium
TGAGEALTGPE

SEQ ID NO: 594148 - protein, 28 aa, Mycobacterium
TGAGEGSAIADSEFKAAGAQLADTAEQV

SEQ ID NO: 594149 - protein, 9 aa, Mycobacterium
TGAGGGDGG

SEQ ID NO: 594150 - protein, 16 aa, Mycobacterium
TGAGGNSGYANNGSGL

SEQ ID NO: 594151 - protein, 86 aa, Mycobacterium
TGAGGQGGAGGTGGQLSGNGGSGGTGGEGDYVGGADSGGAGGTGGNAGLTGDGGNGGNGGSGGTPGSPGGGGTGGALIGQDGLDGS

SEQ ID NO: 594152 - protein, 18 aa, Mycobacterium
TGAGKASVSGAPGTCPVA

SEQ ID NO: 594153 - protein, 8 aa, Mycobacterium
TGAGKGIG

SEQ ID NO: 594154 - protein, 8 aa, Mycobacterium
TGAGKTFT

SEQ ID NO: 594155 - protein, 7 aa, Mycobacterium
TGAGKTN

SEQ ID NO: 594156 - protein, 10 aa, Mycobacterium
TGAGKTYTAV

SEQ ID NO: 594157 - protein, 17 aa, Mycobacterium
TGAGNAYAAAEAANASP

SEQ ID NO: 594158 - protein, 6 aa, Mycobacterium
TGAGNV

SEQ ID NO: 594159 - protein, 18 aa, Mycobacterium
TGAGPEDWPTYGADGRRT

SEQ ID NO: 594160 - protein, 8 aa, Mycobacterium
TGAGPGGM

SEQ ID NO: 594161 - protein, 14 aa, Mycobacterium
TGAGPGSDVNGPKQ

SEQ ID NO: 594162 - protein, 11 aa, Mycobacterium
TGAGPQSAKEL

SEQ ID NO: 594163 - protein, 8 aa, Mycobacterium
TGAGQIDD

SEQ ID NO: 594164 - protein, 8 aa, Mycobacterium
TGAGRAPA

SEQ ID NO: 594165 - protein, 14 aa, Mycobacterium
TGAGRGEPTPGRGR

SEQ ID NO: 594166 - protein, 8 aa, Mycobacterium
TGAGRGFG

SEQ ID NO: 594167 - protein, 8 aa, Mycobacterium
TGAGRGLG

SEQ ID NO: 594168 - protein, 7 aa, Mycobacterium
TGAGRQL

SEQ ID NO: 594169 - protein, 18 aa, Mycobacterium
TGAGSAPDPQLQPGELTK

SEQ ID NO: 594170 - protein, 15 aa, Mycobacterium
TGAGSAPEPDFQPAE

SEQ ID NO: 594171 - protein, 11 aa, Mycobacterium
TGAGSARGIGR

SEQ ID NO: 594172 - protein, 9 aa, Mycobacterium
TGAGSGIGQ

SEQ ID NO: 594173 - protein, 7 aa, Mycobacterium
TGAGSSG

SEQ ID NO: 594174 - protein, 6 aa, Mycobacterium
TGAGTL

SEQ ID NO: 594175 - protein, 12 aa, Mycobacterium
TGAGTLGVSSPR

SEQ ID NO: 594176 - protein, 7 aa, Mycobacterium
TGAGTRL

SEQ ID NO: 594177 - protein, 16 aa, Mycobacterium
TGAGYATTTPRVRGPL

SEQ ID NO: 594178 - protein, 15 aa, Mycobacterium
TGAHDAAQLGTAQPT

SEQ ID NO: 594179 - protein, 6 aa, Mycobacterium
TGAHTQ

SEQ ID NO: 594180 - protein, 6 aa, Mycobacterium
TGAHYP

SEQ ID NO: 594181 - protein, 4 aa, Mycobacterium
TGAI

SEQ ID NO: 594182 - protein, 8 aa, Mycobacterium
TGAITGPA

SEQ ID NO: 594183 - protein, 17 aa, Mycobacterium
TGAITNGNSSGFGNTGV

SEQ ID NO: 594184 - protein, 4 aa, Mycobacterium
TGAK

SEQ ID NO: 594185 - protein, 5 aa, Mycobacterium
TGAKD

SEQ ID NO: 594186 - protein, 10 aa, Mycobacterium
TGAKESWQTH

SEQ ID NO: 594187 - protein, 11 aa, Mycobacterium
TGAKKGCNEGA

SEQ ID NO: 594188 - protein, 8 aa, Mycobacterium
TGAKLPGE

SEQ ID NO: 594189 - protein, 9 aa, Mycobacterium
TGAKLSAAA

SEQ ID NO: 594190 - protein, 8 aa, Mycobacterium
TGAKPVGK

SEQ ID NO: 594191 - protein, 10 aa, Mycobacterium
TGAKSGEPRT

SEQ ID NO: 594192 - protein, 10 aa, Mycobacterium
TGAKSGERRE

SEQ ID NO: 594193 - protein, 9 aa, Mycobacterium
TGAKSGKKR

SEQ ID NO: 594194 - protein, 11 aa, Mycobacterium
TGAKSGKTRLS

SEQ ID NO: 594195 - protein, 10 aa, Mycobacterium
TGAKSGQQRL

SEQ ID NO: 594196 - protein, 10 aa, Mycobacterium
TGAKSGRPRL

SEQ ID NO: 594197 - protein, 16 aa, Mycobacterium
TGAKVDRANTYGQRAH

SEQ ID NO: 594198 - protein, 4 aa, Mycobacterium
TGAL

SEQ ID NO: 594199 - protein, 9 aa, Mycobacterium
TGALAGTGA

SEQ ID NO: 594200 - protein, 10 aa, Mycobacterium
TGALANPDAA

SEQ ID NO: 594201 - protein, 6 aa, Mycobacterium
TGALGS

SEQ ID NO: 594202 - protein, 9 aa, Mycobacterium
TGALGSEDL

SEQ ID NO: 594203 - protein, 9 aa, Mycobacterium
TGALNEKMK

SEQ ID NO: 594204 - protein, 10 aa, Mycobacterium
TGALNTGDYN

SEQ ID NO: 594205 - protein, 5 aa, Mycobacterium
TGALP

SEQ ID NO: 594206 - protein, 7 aa, Mycobacterium
TGALPEV

SEQ ID NO: 594207 - protein, 6 aa, Mycobacterium
TGALPG

SEQ ID NO: 594208 - protein, 15 aa, Mycobacterium
TGAMAAESTAAAQAA

SEQ ID NO: 594209 - protein, 7 aa, Mycobacterium
TGAMPGE

SEQ ID NO: 594210 - protein, 4 aa, Mycobacterium
TGAN

SEQ ID NO: 594211 - protein, 6 aa, Mycobacterium
TGANGV

SEQ ID NO: 594212 - protein, 11 aa, Mycobacterium
TGANPLDESDR

SEQ ID NO: 594213 - protein, 7 aa, Mycobacterium
TGANRGL

SEQ ID NO: 594214 - protein, 13 aa, Mycobacterium
TGANSAIPHHRPT

SEQ ID NO: 594215 - protein, 9 aa, Mycobacterium
TGANSGIGL

SEQ ID NO: 594216 - protein, 7 aa, Mycobacterium
TGANSGL

SEQ ID NO: 594217 - protein, 5 aa, Mycobacterium
TGANT

SEQ ID NO: 594218 - protein, 4 aa, Mycobacterium
TGAP

SEQ ID NO: 594219 - protein, 7 aa, Mycobacterium
TGAPAAL

SEQ ID NO: 594220 - protein, 10 aa, Mycobacterium
TGAPADPDTL

SEQ ID NO: 594221 - protein, 8 aa, Mycobacterium
TGAPADRP

SEQ ID NO: 594222 - protein, 8 aa, Mycobacterium
TGAPAPTL

SEQ ID NO: 594223 - protein, 6 aa, Mycobacterium
TGAPAV

SEQ ID NO: 594224 - protein, 5 aa, Mycobacterium
TGAPD

SEQ ID NO: 594225 - protein, 10 aa, Mycobacterium
TGAPDAIPAV

SEQ ID NO: 594226 - protein, 8 aa, Mycobacterium
TGAPDPGD

SEQ ID NO: 594227 - protein, 29 aa, Mycobacterium
TGAPEAAVAAPPAATGGAAPQAPAPDPVE

SEQ ID NO: 594228 - protein, 14 aa, Mycobacterium
TGAPENSPASVSAR

SEQ ID NO: 594229 - protein, 6 aa, Mycobacterium
TGAPEQ

SEQ ID NO: 594230 - protein, 8 aa, Mycobacterium
TGAPFGGR

SEQ ID NO: 594231 - protein, 38 aa, Mycobacterium
TGAPFSAARTNPRPDHSAGRTAYRQDRRGQRPQRHGMA

SEQ ID NO: 594232 - protein, 10 aa, Mycobacterium
TGAPGTPGVP

SEQ ID NO: 594233 - protein, 16 aa, Mycobacterium
TGAPIEVTPPDSGSVE

SEQ ID NO: 594234 - protein, 9 aa, Mycobacterium
TGAPKVDDI

SEQ ID NO: 594235 - protein, 13 aa, Mycobacterium
TGAPLPTEPWTQP

SEQ ID NO: 594236 - protein, 11 aa, Mycobacterium
TGAPNHRQPQA

SEQ ID NO: 594237 - protein, 9 aa, Mycobacterium
TGAPNRDVA

SEQ ID NO: 594238 - protein, 10 aa, Mycobacterium
TGAPPNTTVT

SEQ ID NO: 594239 - protein, 7 aa, Mycobacterium
TGAPPRA

SEQ ID NO: 594240 - protein, 9 aa, Mycobacterium
TGAPPRPAI

SEQ ID NO: 594241 - protein, 7 aa, Mycobacterium
TGAPPRR

SEQ ID NO: 594242 - protein, 6 aa, Mycobacterium
TGAPQR

SEQ ID NO: 594243 - protein, 10 aa, Mycobacterium
TGAPRATAAS

SEQ ID NO: 594244 - protein, 8 aa, Mycobacterium
TGAPTGPT

SEQ ID NO: 594245 - protein, 10 aa, Mycobacterium
TGAPVPPHEI

SEQ ID NO: 594246 - protein, 8 aa, Mycobacterium
TGAPVRAA

SEQ ID NO: 594247 - protein, 4 aa, Mycobacterium
TGAQ

SEQ ID NO: 594248 - protein, 19 aa, Mycobacterium
TGAQAEAAGAQAKVAAGAY

SEQ ID NO: 594249 - protein, 14 aa, Mycobacterium
TGAQAEEAATQARA

SEQ ID NO: 594250 - protein, 19 aa, Mycobacterium
TGAQAEQAAAQAAAAAAAY

SEQ ID NO: 594251 - protein, 7 aa, Mycobacterium
TGAQARA

SEQ ID NO: 594252 - protein, 6 aa, Mycobacterium
TGAQGM

SEQ ID NO: 594253 - protein, 5 aa, Mycobacterium
TGAQI

SEQ ID NO: 594254 - protein, 13 aa, Mycobacterium
TGAQIPVDKGYLK

SEQ ID NO: 594255 - protein, 5 aa, Mycobacterium
TGAQR

SEQ ID NO: 594256 - protein, 9 aa, Mycobacterium
TGAQRETTV

SEQ ID NO: 594257 - protein, 9 aa, Mycobacterium
TGAQSDRAL

SEQ ID NO: 594258 - protein, 5 aa, Mycobacterium
TGAQT

SEQ ID NO: 594259 - protein, 8 aa, Mycobacterium
TGAQTTLG

SEQ ID NO: 594260 - protein, 5 aa, Mycobacterium
TGARA

SEQ ID NO: 594261 - protein, 8 aa, Mycobacterium
TGARDPGL

SEQ ID NO: 594262 - protein, 6 aa, Mycobacterium
TGARGL

SEQ ID NO: 594263 - protein, 13 aa, Mycobacterium
TGARISPVEGAAD

SEQ ID NO: 594264 - protein, 9 aa, Mycobacterium
TGARKLEKQ

SEQ ID NO: 594265 - protein, 5 aa, Mycobacterium
TGARL

SEQ ID NO: 594266 - protein, 8 aa, Mycobacterium
TGARPKGY

SEQ ID NO: 594267 - protein, 11 aa, Mycobacterium
TGARSANAGPV

SEQ ID NO: 594268 - protein, 10 aa, Mycobacterium
TGARSGAQRV

SEQ ID NO: 594269 - protein, 5 aa, Mycobacterium
TGART

SEQ ID NO: 594270 - protein, 14 aa, Mycobacterium
TGARTGGDVGDRAN

SEQ ID NO: 594271 - protein, 6 aa, Mycobacterium
TGARTT

SEQ ID NO: 594272 - protein, 5 aa, Mycobacterium
TGARV

SEQ ID NO: 594273 - protein, 5 aa, Mycobacterium
TGASA

SEQ ID NO: 594274 - protein, 6 aa, Mycobacterium
TGASAA

SEQ ID NO: 594275 - protein, 10 aa, Mycobacterium
TGASASVASG

SEQ ID NO: 594276 - protein, 9 aa, Mycobacterium
TGASDDAIE

SEQ ID NO: 594277 - protein, 7 aa, Mycobacterium
TGASDGI

SEQ ID NO: 594278 - protein, 8 aa, Mycobacterium
TGASDGIG

SEQ ID NO: 594279 - protein, 6 aa, Mycobacterium
TGASDR

SEQ ID NO: 594280 - protein, 9 aa, Mycobacterium
TGASEGGFN

SEQ ID NO: 594281 - protein, 10 aa, Mycobacterium
TGASEGGFNG

SEQ ID NO: 594282 - protein, 10 aa, Mycobacterium
TGASERNAKA

SEQ ID NO: 594283 - protein, 5 aa, Mycobacterium
TGASG

SEQ ID NO: 594284 - protein, 27 aa, Mycobacterium
TGASGAGGSAGTGGAGGNPGAGGDGGS

SEQ ID NO: 594285 - protein, 9 aa, Mycobacterium
TGASGGVGS

SEQ ID NO: 594286 - protein, 6 aa, Mycobacterium
TGASGL

SEQ ID NO: 594287 - protein, 10 aa, Mycobacterium
TGASGSGKTT

SEQ ID NO: 594288 - protein, 11 aa, Mycobacterium
TGASPGEAPLN

SEQ ID NO: 594289 - protein, 8 aa, Mycobacterium
TGASQGIG

SEQ ID NO: 594290 - protein, 8 aa, Mycobacterium
TGASQNIG

SEQ ID NO: 594291 - protein, 6 aa, Mycobacterium
TGASSA

SEQ ID NO: 594292 - protein, 9 aa, Mycobacterium
TGASSGIGE

SEQ ID NO: 594293 - protein, 10 aa, Mycobacterium
TGASSGIGKK

SEQ ID NO: 594294 - protein, 8 aa, Mycobacterium
TGASSGLG

SEQ ID NO: 594295 - protein, 14 aa, Mycobacterium
TGASSYASAEAASQ

SEQ ID NO: 594296 - protein, 6 aa, Mycobacterium
TGASTA

SEQ ID NO: 594297 - protein, 17 aa, Mycobacterium
TGASTGPTIATGSAGAL

SEQ ID NO: 594298 - protein, 47 aa, Mycobacterium
TGASTGPTITTGSTDPSDAVGESRGLRQPTGTTVAPGPANTTHTATA

SEQ ID NO: 594299 - protein, 8 aa, Mycobacterium
TGASVDEA

SEQ ID NO: 594300 - protein, 5 aa, Mycobacterium
TGATD

SEQ ID NO: 594301 - protein, 10 aa, Mycobacterium
TGATDAGNHA

SEQ ID NO: 594302 - protein, 6 aa, Mycobacterium
TGATDY

SEQ ID NO: 594303 - protein, 6 aa, Mycobacterium
TGATEG

SEQ ID NO: 594304 - protein, 16 aa, Mycobacterium
TGATELRDPYEPAMPS

SEQ ID NO: 594305 - protein, 5 aa, Mycobacterium
TGATG

SEQ ID NO: 594306 - protein, 7 aa, Mycobacterium
TGATGGL

SEQ ID NO: 594307 - protein, 13 aa, Mycobacterium
TGATGPDEQLPAS

SEQ ID NO: 594308 - protein, 9 aa, Mycobacterium
TGATGRKGR

SEQ ID NO: 594309 - protein, 7 aa, Mycobacterium
TGATGVQ

SEQ ID NO: 594310 - protein, 8 aa, Mycobacterium
TGATHSQS

SEQ ID NO: 594311 - protein, 8 aa, Mycobacterium
TGATHSQT

SEQ ID NO: 594312 - protein, 11 aa, Mycobacterium
TGATNHRQPRA

SEQ ID NO: 594313 - protein, 7 aa, Mycobacterium
TGATPIG

SEQ ID NO: 594314 - protein, 11 aa, Mycobacterium
TGATPPGGESF

SEQ ID NO: 594315 - protein, 6 aa, Mycobacterium
TGATPV

SEQ ID NO: 594316 - protein, 6 aa, Mycobacterium
TGATQP

SEQ ID NO: 594317 - protein, 10 aa, Mycobacterium
TGATRNTLEP

SEQ ID NO: 594318 - protein, 10 aa, Mycobacterium
TGATSMREQE

SEQ ID NO: 594319 - protein, 12 aa, Mycobacterium
TGATSSVQGSGW

SEQ ID NO: 594320 - protein, 8 aa, Mycobacterium
TGATSVPT

SEQ ID NO: 594321 - protein, 6 aa, Mycobacterium
TGATTQ

SEQ ID NO: 594322 - protein, 5 aa, Mycobacterium
TGATV

SEQ ID NO: 594323 - protein, 6 aa, Mycobacterium
TGATVE

SEQ ID NO: 594324 - protein, 11 aa, Mycobacterium
TGATVRATTDE

SEQ ID NO: 594325 - protein, 7 aa, Mycobacterium
TGATVTE

SEQ ID NO: 594326 - protein, 6 aa, Mycobacterium
TGAVAT

SEQ ID NO: 594327 - protein, 9 aa, Mycobacterium
TGAVDGPAF

SEQ ID NO: 594328 - protein, 5 aa, Mycobacterium
TGAVG

SEQ ID NO: 594329 - protein, 651 aa, Mycobacterium
TGAVGAPGVAGATGATGVTSGVVGGNGEDAVGYGATGAAGAAGAAGAAGAAGAVGSAGAAGEAGETGTWGNAGLPGKAGDAGGAGAVGAAGAAGTVGTAGATGGTGTGANGGAGGVGGVGGTGAAGAAGGAGGLGETGTTGGAGGVGGQGTAGGTGGVGGIGGAGSTGAVGGVGGKGIQGGQGLQGGKGGDGGAGGKGGDADSMGSAGATGGKGGNGGNGGRGGLFGKGGNAGNGADGGTGGAGGAGGTGGTGGAGGTGGTGGTGGIGGAGSTGGTGGTGGTGGTGGTGGTGGTGGTGGTGGTGGKGGTGGTGGAGGTGGDGGTGGTGGTGGTGGTGGTGGTGGAGDGTGGTGGTGGTGGQGGQGGQGGTGGTGGQGGLGGGGGTGGQGGTGGTGGQGGTGGTGGTGGTGGTGGAGGDGGLGGLGGFGGSGGTGGQGGLGGPGGSTGGAGGAGGQAGTAGKGGLFGGSGSAGKAGATGAAGASGGKGAQGATGAQGATGAQGATGATGAAGKAGATGAAGAAGAAGSAGTTGAQGSAGTNGANGANGSQGAAGKAGATGTTGATGAAGEDGDAGSGGSGINGGAGGAGGAGGEGGEGGDGGKGGAGAEGGAGGGGGAGGSGAGGAGGAGGSGGSGGSGGSGGSGGAAGDSD

SEQ ID NO: 594330 - protein, 10 aa, Mycobacterium
TGAVNGGTSQ

SEQ ID NO: 594331 - protein, 5 aa, Mycobacterium
TGAVP

SEQ ID NO: 594332 - protein, 13 aa, Mycobacterium
TGAVQHHGQPGQL

SEQ ID NO: 594333 - protein, 12 aa, Mycobacterium
TGAVSESQLDDR

SEQ ID NO: 594334 - protein, 8 aa, Mycobacterium
TGAVTRDD

SEQ ID NO: 594335 - protein, 9 aa, Mycobacterium
TGAYEDADP

SEQ ID NO: 594336 - protein, 8 aa, Mycobacterium
TGAYGASK

SEQ ID NO: 594337 - protein, 20 aa, Mycobacterium
TGAYGGSLADAENALEGQLW

SEQ ID NO: 594338 - protein, 9 aa, Mycobacterium
TGCDRDAAR

SEQ ID NO: 594339 - protein, 6 aa, Mycobacterium
TGCEYG

SEQ ID NO: 594340 - protein, 7 aa, Mycobacterium
TGCGERE

SEQ ID NO: 594341 - protein, 39 aa, Mycobacterium
TGCGGSDKPPPPSAAESGPSASPTDSGAVTGPPPGQPTD

SEQ ID NO: 594342 - protein, 6 aa, Mycobacterium
TGCGQW

SEQ ID NO: 594343 - protein, 45 aa, Mycobacterium
TGCGSGDSTVAKTPQARTSETPSITAPATPLPAAQPGNAPPADPC

SEQ ID NO: 594344 - protein, 4 aa, Mycobacterium
TGCP

SEQ ID NO: 594345 - protein, 11 aa, Mycobacterium
TGCPGGRSLTA

SEQ ID NO: 594346 - protein, 8 aa, Mycobacterium
TGCPSGEV

SEQ ID NO: 594347 - protein, 10 aa, Mycobacterium
TGCRAPQTPL

SEQ ID NO: 594348 - protein, 7 aa, Mycobacterium
TGCRPTK

SEQ ID NO: 594349 - protein, 9 aa, Mycobacterium
TGCRSGEHG

SEQ ID NO: 594350 - protein, 10 aa, Mycobacterium
TGDAAGQYDD

SEQ ID NO: 594351 - protein, 9 aa, Mycobacterium
TGDAAGTPH

SEQ ID NO: 594352 - protein, 6 aa, Mycobacterium
TGDAAN

SEQ ID NO: 594353 - protein, 5 aa, Mycobacterium
TGDAD

SEQ ID NO: 594354 - protein, 10 aa, Mycobacterium
TGDADTPNHQ

SEQ ID NO: 594355 - protein, 5 aa, Mycobacterium
TGDAE

SEQ ID NO: 594356 - protein, 23 aa, Mycobacterium
TGDAESVPAAPWQQAGRGRPAKR

SEQ ID NO: 594357 - protein, 9 aa, Mycobacterium
TGDAGEIEG

SEQ ID NO: 594358 - protein, 10 aa, Mycobacterium
TGDAGTPNHQ

SEQ ID NO: 594359 - protein, 8 aa, Mycobacterium
TGDAGVAD

SEQ ID NO: 594360 - protein, 7 aa, Mycobacterium
TGDAKQI

SEQ ID NO: 594361 - protein, 11 aa, Mycobacterium
TGDANGRAPTA

SEQ ID NO: 594362 - protein, 15 aa, Mycobacterium
TGDAPLTAADYSRPR

SEQ ID NO: 594363 - protein, 13 aa, Mycobacterium
TGDASDTGLPATS

SEQ ID NO: 594364 - protein, 10 aa, Mycobacterium
TGDASQAEDV

SEQ ID NO: 594365 - protein, 10 aa, Mycobacterium
TGDASQSEDV

SEQ ID NO: 594366 - protein, 9 aa, Mycobacterium
TGDATADGS

SEQ ID NO: 594367 - protein, 7 aa, Mycobacterium
TGDATEA

SEQ ID NO: 594368 - protein, 13 aa, Mycobacterium
TGDATSGIASRRR

SEQ ID NO: 594369 - protein, 9 aa, Mycobacterium
TGDAVPGTA

SEQ ID NO: 594370 - protein, 10 aa, Mycobacterium
TGDCDRDDLR

SEQ ID NO: 594371 - protein, 12 aa, Mycobacterium
TGDDAWDGKTGD

SEQ ID NO: 594372 - protein, 13 aa, Mycobacterium
TGDDEQSGERPGA

SEQ ID NO: 594373 - protein, 6 aa, Mycobacterium
TGDDER

SEQ ID NO: 594374 - protein, 11 aa, Mycobacterium
TGDDERQAAEK

SEQ ID NO: 594375 - protein, 9 aa, Mycobacterium
TGDDETPGA

SEQ ID NO: 594376 - protein, 5 aa, Mycobacterium
TGDDG

SEQ ID NO: 594377 - protein, 14 aa, Mycobacterium
TGDDGGKDGHHRAA

SEQ ID NO: 594378 - protein, 9 aa, Mycobacterium
TGDDGGPIR

SEQ ID NO: 594379 - protein, 14 aa, Mycobacterium
TGDDGLAANAKTGT

SEQ ID NO: 594380 - protein, 10 aa, Mycobacterium
TGDDGQERVS

SEQ ID NO: 594381 - protein, 9 aa, Mycobacterium
TGDDISQQT

SEQ ID NO: 594382 - protein, 9 aa, Mycobacterium
TGDDKSAAH

SEQ ID NO: 594383 - protein, 9 aa, Mycobacterium
TGDDLNRAP

SEQ ID NO: 594384 - protein, 18 aa, Mycobacterium
TGDDNAAMRQSVAITATR

SEQ ID NO: 594385 - protein, 6 aa, Mycobacterium
TGDDPL

SEQ ID NO: 594386 - protein, 12 aa, Mycobacterium
TGDDQPPQPSPG

SEQ ID NO: 594387 - protein, 6 aa, Mycobacterium
TGDDRD

SEQ ID NO: 594388 - protein, 6 aa, Mycobacterium
TGDDSR

SEQ ID NO: 594389 - protein, 5 aa, Mycobacterium
TGDDV

SEQ ID NO: 594390 - protein, 8 aa, Mycobacterium
TGDEATGA

SEQ ID NO: 594391 - protein, 13 aa, Mycobacterium
TGDEDEGQSDVEG

SEQ ID NO: 594392 - protein, 8 aa, Mycobacterium
TGDEDPVP

SEQ ID NO: 594393 - protein, 16 aa, Mycobacterium
TGDEDRPGAGVAEGES

SEQ ID NO: 594394 - protein, 6 aa, Mycobacterium
TGDEES

SEQ ID NO: 594395 - protein, 6 aa, Mycobacterium
TGDEIK

SEQ ID NO: 594396 - protein, 8 aa, Mycobacterium
TGDENPVP

SEQ ID NO: 594397 - protein, 16 aa, Mycobacterium
TGDENSIAALRAARRG

SEQ ID NO: 594398 - protein, 10 aa, Mycobacterium
TGDEPAAQAR

SEQ ID NO: 594399 - protein, 10 aa, Mycobacterium
TGDEQPGTAA

SEQ ID NO: 594400 - protein, 5 aa, Mycobacterium
TGDER

SEQ ID NO: 594401 - protein, 6 aa, Mycobacterium
TGDERV

SEQ ID NO: 594402 - protein, 9 aa, Mycobacterium
TGDETMTGG

SEQ ID NO: 594403 - protein, 4 aa, Mycobacterium
TGDF

SEQ ID NO: 594404 - protein, 5 aa, Mycobacterium
TGDFK

SEQ ID NO: 594405 - protein, 20 aa, Mycobacterium
TGDFNPGDTNTGSYNTGNIN

SEQ ID NO: 594406 - protein, 25 aa, Mycobacterium
TGDFNTGSFNPGDYNTGGFNPGNYN

SEQ ID NO: 594407 - protein, 32 aa, Mycobacterium
TGDGAVPYPDPDRVAPLPDEQAATVKDRTATQ

SEQ ID NO: 594408 - protein, 9 aa, Mycobacterium
TGDGEPVGA

SEQ ID NO: 594409 - protein, 8 aa, Mycobacterium
TGDGGVDA

SEQ ID NO: 594410 - protein, 9 aa, Mycobacterium
TGDGHSDYG

SEQ ID NO: 594411 - protein, 5 aa, Mycobacterium
TGDGL

SEQ ID NO: 594412 - protein, 7 aa, Mycobacterium
TGDGPAM

SEQ ID NO: 594413 - protein, 7 aa, Mycobacterium
TGDGPTA

SEQ ID NO: 594414 - protein, 6 aa, Mycobacterium
TGDGQV

SEQ ID NO: 594415 - protein, 5 aa, Mycobacterium
TGDGR

SEQ ID NO: 594416 - protein, 16 aa, Mycobacterium
TGDGRSVATREGVPGA

SEQ ID NO: 594417 - protein, 6 aa, Mycobacterium
TGDGSI

SEQ ID NO: 594418 - protein, 5 aa, Mycobacterium
TGDGT

SEQ ID NO: 594419 - protein, 6 aa, Mycobacterium
TGDGTP

SEQ ID NO: 594420 - protein, 6 aa, Mycobacterium
TGDGVP

SEQ ID NO: 594421 - protein, 7 aa, Mycobacterium
TGDGVPY

SEQ ID NO: 594422 - protein, 6 aa, Mycobacterium
TGDGYR

SEQ ID NO: 594423 - protein, 7 aa, Mycobacterium
TGDHESH

SEQ ID NO: 594424 - protein, 15 aa, Mycobacterium
TGDHGPDSPMARSTK

SEQ ID NO: 594425 - protein, 6 aa, Mycobacterium
TGDHGV

SEQ ID NO: 594426 - protein, 6 aa, Mycobacterium
TGDIAP

SEQ ID NO: 594427 - protein, 4 aa, Mycobacterium
TGDL

SEQ ID NO: 594428 - protein, 17 aa, Mycobacterium
TGDLPDLAAPKEEEADV

SEQ ID NO: 594429 - protein, 14 aa, Mycobacterium
TGDLRSADEARAAV

SEQ ID NO: 594430 - protein, 14 aa, Mycobacterium
TGDNAPPISPAPIS

SEQ ID NO: 594431 - protein, 115 aa, Mycobacterium
TGDNGGDGTAGGKGGDGGAGGAAGANGGTGGGGGIGGGGGVGGDGGNGGSGNTGTSSAPAGGTGGIGGTGADGGAGGNGGAAGGAGGTGGQGGTGGGAGKGGTGGAGGAAVTPGL

SEQ ID NO: 594432 - protein, 10 aa, Mycobacterium
TGDNNSGFGN

SEQ ID NO: 594433 - protein, 8 aa, Mycobacterium
TGDNQQGF

SEQ ID NO: 594434 - protein, 18 aa, Mycobacterium
TGDNQRGFGSLNSGSGNI

SEQ ID NO: 594435 - protein, 7 aa, Mycobacterium
TGDNSAT

SEQ ID NO: 594436 - protein, 9 aa, Mycobacterium
TGDNSLSRK

SEQ ID NO: 594437 - protein, 5 aa, Mycobacterium
TGDPA

SEQ ID NO: 594438 - protein, 6 aa, Mycobacterium
TGDPAA

SEQ ID NO: 594439 - protein, 8 aa, Mycobacterium
TGDPAARL

SEQ ID NO: 594440 - protein, 10 aa, Mycobacterium
TGDPADPETL

SEQ ID NO: 594441 - protein, 7 aa, Mycobacterium
TGDPAEP

SEQ ID NO: 594442 - protein, 9 aa, Mycobacterium
TGDPARAED

SEQ ID NO: 594443 - protein, 15 aa, Mycobacterium
TGDPASVDAVRHAFA

SEQ ID NO: 594444 - protein, 5 aa, Mycobacterium
TGDPC

SEQ ID NO: 594445 - protein, 5 aa, Mycobacterium
TGDPD

SEQ ID NO: 594446 - protein, 23 aa, Mycobacterium
TGDPDGPPTLPGYSSADNSTGMS

SEQ ID NO: 594447 - protein, 6 aa, Mycobacterium
TGDPDV

SEQ ID NO: 594448 - protein, 8 aa, Mycobacterium
TGDPEPLR

SEQ ID NO: 594449 - protein, 8 aa, Mycobacterium
TGDPGDRD

SEQ ID NO: 594450 - protein, 7 aa, Mycobacterium
TGDPGRI

SEQ ID NO: 594451 - protein, 6 aa, Mycobacterium
TGDPID

SEQ ID NO: 594452 - protein, 10 aa, Mycobacterium
TGDPIVPPPR

SEQ ID NO: 594453 - protein, 7 aa, Mycobacterium
TGDPKQQ

SEQ ID NO: 594454 - protein, 10 aa, Mycobacterium
TGDPKSLTGR

SEQ ID NO: 594455 - protein, 7 aa, Mycobacterium
TGDPLPD

SEQ ID NO: 594456 - protein, 14 aa, Mycobacterium
TGDPPETPEAKEHA

SEQ ID NO: 594457 - protein, 15 aa, Mycobacterium
TGDPPEVKTMVNKEN

SEQ ID NO: 594458 - protein, 6 aa, Mycobacterium
TGDPQR

SEQ ID NO: 594459 - protein, 9 aa, Mycobacterium
TGDPRTAPV

SEQ ID NO: 594460 - protein, 5 aa, Mycobacterium
TGDPS

SEQ ID NO: 594461 - protein, 6 aa, Mycobacterium
TGDPSH

SEQ ID NO: 594462 - protein, 6 aa, Mycobacterium
TGDPSN

SEQ ID NO: 594463 - protein, 8 aa, Mycobacterium
TGDPSTSV

SEQ ID NO: 594464 - protein, 9 aa, Mycobacterium
TGDPSVQGP

SEQ ID NO: 594465 - protein, 6 aa, Mycobacterium
TGDPTF

SEQ ID NO: 594466 - protein, 20 aa, Mycobacterium
TGDPTSLAEAAESLRARGAT

SEQ ID NO: 594467 - protein, 6 aa, Mycobacterium
TGDPTV

SEQ ID NO: 594468 - protein, 7 aa, Mycobacterium
TGDPTVA

SEQ ID NO: 594469 - protein, 7 aa, Mycobacterium
TGDPVDA

SEQ ID NO: 594470 - protein, 12 aa, Mycobacterium
TGDQAGSAVPTA

SEQ ID NO: 594471 - protein, 6 aa, Mycobacterium
TGDQLR

SEQ ID NO: 594472 - protein, 6 aa, Mycobacterium
TGDQQR

SEQ ID NO: 594473 - protein, 9 aa, Mycobacterium
TGDQSQDAV

SEQ ID NO: 594474 - protein, 4 aa, Mycobacterium
TGDR

SEQ ID NO: 594475 - protein, 5 aa, Mycobacterium
TGDRE

SEQ ID NO: 594476 - protein, 10 aa, Mycobacterium
TGDREELSPM

SEQ ID NO: 594477 - protein, 6 aa, Mycobacterium
TGDRIT

SEQ ID NO: 594478 - protein, 16 aa, Mycobacterium
TGDRPTSEHLAAADAE

SEQ ID NO: 594479 - protein, 10 aa, Mycobacterium
TGDRRPRINS

SEQ ID NO: 594480 - protein, 9 aa, Mycobacterium
TGDRRVGGS

SEQ ID NO: 594481 - protein, 8 aa, Mycobacterium
TGDRSGRN

SEQ ID NO: 594482 - protein, 8 aa, Mycobacterium
TGDRYGSD

SEQ ID NO: 594483 - protein, 6 aa, Mycobacterium
TGDSAV

SEQ ID NO: 594484 - protein, 10 aa, Mycobacterium
TGDSDARAAK

SEQ ID NO: 594485 - protein, 6 aa, Mycobacterium
TGDSDI

SEQ ID NO: 594486 - protein, 5 aa, Mycobacterium
TGDSE

SEQ ID NO: 594487 - protein, 6 aa, Mycobacterium
TGDSEV

SEQ ID NO: 594488 - protein, 7 aa, Mycobacterium
TGDSGEK

SEQ ID NO: 594489 - protein, 31 aa, Mycobacterium
TGDSHPTSSPAPKVTTLGKTAPKAPAGGSLT

SEQ ID NO: 594490 - protein, 5 aa, Mycobacterium
TGDSL

SEQ ID NO: 594491 - protein, 6 aa, Mycobacterium
TGDSLT

SEQ ID NO: 594492 - protein, 11 aa, Mycobacterium
TGDSNRRAPTA

SEQ ID NO: 594493 - protein, 6 aa, Mycobacterium
TGDSPL

SEQ ID NO: 594494 - protein, 9 aa, Mycobacterium
TGDSPLASN

SEQ ID NO: 594495 - protein, 11 aa, Mycobacterium
TGDSQPGTSAL

SEQ ID NO: 594496 - protein, 5 aa, Mycobacterium
TGDSV

SEQ ID NO: 594497 - protein, 8 aa, Mycobacterium
TGDTAAAE

SEQ ID NO: 594498 - protein, 10 aa, Mycobacterium
TGDTARSHED

SEQ ID NO: 594499 - protein, 15 aa, Mycobacterium
TGDTASPAGPAGTTV

SEQ ID NO: 594500 - protein, 9 aa, Mycobacterium
TGDTATGSW

SEQ ID NO: 594501 - protein, 9 aa, Mycobacterium
TGDTDGDTA

SEQ ID NO: 594502 - protein, 12 aa, Mycobacterium
TGDTEHVPDGAT

SEQ ID NO: 594503 - protein, 17 aa, Mycobacterium
TGDTERVTRAVHHQAAR

SEQ ID NO: 594504 - protein, 5 aa, Mycobacterium
TGDTF

SEQ ID NO: 594505 - protein, 14 aa, Mycobacterium
TGDTKVVDSGHGDG

SEQ ID NO: 594506 - protein, 5 aa, Mycobacterium
TGDTP

SEQ ID NO: 594507 - protein, 6 aa, Mycobacterium
TGDTSA

SEQ ID NO: 594508 - protein, 10 aa, Mycobacterium
TGDTSQSEDV

SEQ ID NO: 594509 - protein, 8 aa, Mycobacterium
TGDTTKVA

SEQ ID NO: 594510 - protein, 6 aa, Mycobacterium
TGDTTV

SEQ ID NO: 594511 - protein, 5 aa, Mycobacterium
TGDVG

SEQ ID NO: 594512 - protein, 8 aa, Mycobacterium
TGDVQGGI

SEQ ID NO: 594513 - protein, 9 aa, Mycobacterium
TGDVSPLPD

SEQ ID NO: 594514 - protein, 10 aa, Mycobacterium
TGDWPDPPAQ

SEQ ID NO: 594515 - protein, 5 aa, Mycobacterium
TGDYD

SEQ ID NO: 594516 - protein, 15 aa, Mycobacterium
TGDYGPDSPMARSTK

SEQ ID NO: 594517 - protein, 8 aa, Mycobacterium
TGDYGTYT

SEQ ID NO: 594518 - protein, 7 aa, Mycobacterium
TGDYNTG

SEQ ID NO: 594519 - protein, 6 aa, Mycobacterium
TGEAAG

SEQ ID NO: 594520 - protein, 10 aa, Mycobacterium
TGEAAGGPDF

SEQ ID NO: 594521 - protein, 6 aa, Mycobacterium
TGEAAK

SEQ ID NO: 594522 - protein, 5 aa, Mycobacterium
TGEAE

SEQ ID NO: 594523 - protein, 9 aa, Mycobacterium
TGEAEPHDA

SEQ ID NO: 594524 - protein, 13 aa, Mycobacterium
TGEAETDRQREKE

SEQ ID NO: 594525 - protein, 12 aa, Mycobacterium
TGEAGAQHYSDE

SEQ ID NO: 594526 - protein, 13 aa, Mycobacterium
TGEAGTARQEEKE

SEQ ID NO: 594527 - protein, 7 aa, Mycobacterium
TGEAHRR

SEQ ID NO: 594528 - protein, 7 aa, Mycobacterium
TGEAKEP

SEQ ID NO: 594529 - protein, 5 aa, Mycobacterium
TGEAN

SEQ ID NO: 594530 - protein, 8 aa, Mycobacterium
TGEARDGD

SEQ ID NO: 594531 - protein, 7 aa, Mycobacterium
TGEAREP

SEQ ID NO: 594532 - protein, 6 aa, Mycobacterium
TGEAVE

SEQ ID NO: 594533 - protein, 7 aa, Mycobacterium
TGECPED

SEQ ID NO: 594534 - protein, 14 aa, Mycobacterium
TGEDADDESLGGAD

SEQ ID NO: 594535 - protein, 15 aa, Mycobacterium
TGEDAPQREGPAADA

SEQ ID NO: 594536 - protein, 7 aa, Mycobacterium
TGEDELE

SEQ ID NO: 594537 - protein, 10 aa, Mycobacterium
TGEDGERFSL

SEQ ID NO: 594538 - protein, 10 aa, Mycobacterium
TGEDLAQGPR

SEQ ID NO: 594539 - protein, 8 aa, Mycobacterium
TGEDPGTD

SEQ ID NO: 594540 - protein, 5 aa, Mycobacterium
TGEDR

SEQ ID NO: 594541 - protein, 5 aa, Mycobacterium
TGEEA

SEQ ID NO: 594542 - protein, 26 aa, Mycobacterium
TGEEFSGPAIAPGQHPNRRTMTPETY

SEQ ID NO: 594543 - protein, 15 aa, Mycobacterium
TGEEGARRKAANQPV

SEQ ID NO: 594544 - protein, 10 aa, Mycobacterium
TGEEQPGTAA

SEQ ID NO: 594545 - protein, 13 aa, Mycobacterium
TGEESDDEALGGA

SEQ ID NO: 594546 - protein, 14 aa, Mycobacterium
TGEESDDESLGGAE

SEQ ID NO: 594547 - protein, 5 aa, Mycobacterium
TGEET

SEQ ID NO: 594548 - protein, 12 aa, Mycobacterium
TGEETDVDSHPT

SEQ ID NO: 594549 - protein, 12 aa, Mycobacterium
TGEETEVDSHPS

SEQ ID NO: 594550 - protein, 5 aa, Mycobacterium
TGEEY

SEQ ID NO: 594551 - protein, 6 aa, Mycobacterium
TGEEYQ

SEQ ID NO: 594552 - protein, 7 aa, Mycobacterium
TGEFGGT

SEQ ID NO: 594553 - protein, 9 aa, Mycobacterium
TGEFTAPEA

SEQ ID NO: 594554 - protein, 7 aa, Mycobacterium
TGEGERI

SEQ ID NO: 594555 - protein, 5 aa, Mycobacterium
TGEGF

SEQ ID NO: 594556 - protein, 10 aa, Mycobacterium
TGEGGNSAHE

SEQ ID NO: 594557 - protein, 5 aa, Mycobacterium
TGEGH

SEQ ID NO: 594558 - protein, 5 aa, Mycobacterium
TGEGI

SEQ ID NO: 594559 - protein, 12 aa, Mycobacterium
TGEGKSRPAFAT

SEQ ID NO: 594560 - protein, 10 aa, Mycobacterium
TGEGKTLSGA

SEQ ID NO: 594561 - protein, 10 aa, Mycobacterium
TGEGKTLTGA

SEQ ID NO: 594562 - protein, 7 aa, Mycobacterium
TGEGLQD

SEQ ID NO: 594563 - protein, 9 aa, Mycobacterium
TGEGPTRDK

SEQ ID NO: 594564 - protein, 15 aa, Mycobacterium
TGEGRDGKGRTSDGR

SEQ ID NO: 594565 - protein, 20 aa, Mycobacterium
TGEGRKDAATARMSGRARDG

SEQ ID NO: 594566 - protein, 20 aa, Mycobacterium
TGEGRKDASTARMSGRARDG

SEQ ID NO: 594567 - protein, 20 aa, Mycobacterium
TGEGRKDGETARMSGRARDG

SEQ ID NO: 594568 - protein, 20 aa, Mycobacterium
TGEGRKDSRTSRMSGRARDG

SEQ ID NO: 594569 - protein, 10 aa, Mycobacterium
TGEGRKDTLT

SEQ ID NO: 594570 - protein, 10 aa, Mycobacterium
TGEGRKVAET

SEQ ID NO: 594571 - protein, 7 aa, Mycobacterium
TGEGRSV

SEQ ID NO: 594572 - protein, 7 aa, Mycobacterium
TGEGSKG

SEQ ID NO: 594573 - protein, 7 aa, Mycobacterium
TGEGSQG

SEQ ID NO: 594574 - protein, 8 aa, Mycobacterium
TGEGSTTV

SEQ ID NO: 594575 - protein, 10 aa, Mycobacterium
TGEGTDPALR

SEQ ID NO: 594576 - protein, 10 aa, Mycobacterium
TGEGTTGLGK

SEQ ID NO: 594577 - protein, 5 aa, Mycobacterium
TGEGV

SEQ ID NO: 594578 - protein, 4 aa, Mycobacterium
TGEH

SEQ ID NO: 594579 - protein, 15 aa, Mycobacterium
TGEHAASRCESGPHR

SEQ ID NO: 594580 - protein, 12 aa, Mycobacterium
TGEHAGKDAQVT

SEQ ID NO: 594581 - protein, 11 aa, Mycobacterium
TGEHAGTATDF

SEQ ID NO: 594582 - protein, 8 aa, Mycobacterium
TGEHDYDR

SEQ ID NO: 594583 - protein, 5 aa, Mycobacterium
TGEHS

SEQ ID NO: 594584 - protein, 4 aa, Mycobacterium
TGEI

SEQ ID NO: 594585 - protein, 6 aa, Mycobacterium
TGEIGE

SEQ ID NO: 594586 - protein, 7 aa, Mycobacterium
TGEIGER

SEQ ID NO: 594587 - protein, 4 aa, Mycobacterium
TGEK

SEQ ID NO: 594588 - protein, 13 aa, Mycobacterium
TGEKGRSPQRVST

SEQ ID NO: 594589 - protein, 13 aa, Mycobacterium
TGEKGYASNKEAP

SEQ ID NO: 594590 - protein, 5 aa, Mycobacterium
TGEKM

SEQ ID NO: 594591 - protein, 12 aa, Mycobacterium
TGELDSSDIEEG

SEQ ID NO: 594592 - protein, 13 aa, Mycobacterium
TGELNDRKAPTEL

SEQ ID NO: 594593 - protein, 12 aa, Mycobacterium
TGELPKAGKTMG

SEQ ID NO: 594594 - protein, 15 aa, Mycobacterium
TGELSDRKARNDAKM

SEQ ID NO: 594595 - protein, 6 aa, Mycobacterium
TGEMPG

SEQ ID NO: 594596 - protein, 11 aa, Mycobacterium
TGENDADLETG

SEQ ID NO: 594597 - protein, 17 aa, Mycobacterium
TGENGAPVRRPVSTETS

SEQ ID NO: 594598 - protein, 7 aa, Mycobacterium
TGENHSG

SEQ ID NO: 594599 - protein, 13 aa, Mycobacterium
TGENKPSDWPGPA

SEQ ID NO: 594600 - protein, 5 aa, Mycobacterium
TGENL

SEQ ID NO: 594601 - protein, 11 aa, Mycobacterium
TGENPGRGIGE

SEQ ID NO: 594602 - protein, 9 aa, Mycobacterium
TGENRPDLD

SEQ ID NO: 594603 - protein, 11 aa, Mycobacterium
TGENSEAAHAK

SEQ ID NO: 594604 - protein, 10 aa, Mycobacterium
TGEPADPKTL

SEQ ID NO: 594605 - protein, 7 aa, Mycobacterium
TGEPAEL

SEQ ID NO: 594606 - protein, 9 aa, Mycobacterium
TGEPAGISG

SEQ ID NO: 594607 - protein, 8 aa, Mycobacterium
TGEPAPHA

SEQ ID NO: 594608 - protein, 9 aa, Mycobacterium
TGEPAPSAA

SEQ ID NO: 594609 - protein, 10 aa, Mycobacterium
TGEPATPATL

SEQ ID NO: 594610 - protein, 9 aa, Mycobacterium
TGEPCPPGR

SEQ ID NO: 594611 - protein, 7 aa, Mycobacterium
TGEPHEP

SEQ ID NO: 594612 - protein, 7 aa, Mycobacterium
TGEPHNP

SEQ ID NO: 594613 - protein, 8 aa, Mycobacterium
TGEPIPPA

SEQ ID NO: 594614 - protein, 5 aa, Mycobacterium
TGEPL

SEQ ID NO: 594615 - protein, 6 aa, Mycobacterium
TGEPLD

SEQ ID NO: 594616 - protein, 10 aa, Mycobacterium
TGEPPHGAEA

SEQ ID NO: 594617 - protein, 14 aa, Mycobacterium
TGEPPRGPEGRRQA

SEQ ID NO: 594618 - protein, 6 aa, Mycobacterium
TGEPQQ

SEQ ID NO: 594619 - protein, 9 aa, Mycobacterium
TGEPRSGTT

SEQ ID NO: 594620 - protein, 6 aa, Mycobacterium
TGEPRV

SEQ ID NO: 594621 - protein, 8 aa, Mycobacterium
TGEPRVSD

SEQ ID NO: 594622 - protein, 9 aa, Mycobacterium
TGEPSQSID

SEQ ID NO: 594623 - protein, 9 aa, Mycobacterium
TGEPSRDGV

SEQ ID NO: 594624 - protein, 22 aa, Mycobacterium
TGEPTENDGSPNRGYKVRPKGG

SEQ ID NO: 594625 - protein, 7 aa, Mycobacterium
TGEPVAT

SEQ ID NO: 594626 - protein, 100 aa, Mycobacterium
TGEPVKRTATKSPAKAGAKRPTKTANGAAPAKRAAKTTGQADDATTGDAPKKTRPSARGTKAARGTKAPGEGATDPDANLDTADDLDADPDIDVDSSDDL

SEQ ID NO: 594627 - protein, 5 aa, Mycobacterium
TGEPW

SEQ ID NO: 594628 - protein, 22 aa, Mycobacterium
TGEPYEEDGSPNRGYKVRPKGG

SEQ ID NO: 594629 - protein, 7 aa, Mycobacterium
TGEPYEP

SEQ ID NO: 594630 - protein, 8 aa, Mycobacterium
TGEQAANT

SEQ ID NO: 594631 - protein, 5 aa, Mycobacterium
TGEQG

SEQ ID NO: 594632 - protein, 10 aa, Mycobacterium
TGEQGQQGHP

SEQ ID NO: 594633 - protein, 6 aa, Mycobacterium
TGEQGV

SEQ ID NO: 594634 - protein, 9 aa, Mycobacterium
TGEQRALGG

SEQ ID NO: 594635 - protein, 16 aa, Mycobacterium
TGEQRALGGREIPSGN

SEQ ID NO: 594636 - protein, 5 aa, Mycobacterium
TGEQT

SEQ ID NO: 594637 - protein, 15 aa, Mycobacterium
TGEQVTDTDPGQCPV

SEQ ID NO: 594638 - protein, 5 aa, Mycobacterium
TGERA

SEQ ID NO: 594639 - protein, 9 aa, Mycobacterium
TGERAPDAV

SEQ ID NO: 594640 - protein, 11 aa, Mycobacterium
TGEREGNEPYG

SEQ ID NO: 594641 - protein, 9 aa, Mycobacterium
TGERGGKVA

SEQ ID NO: 594642 - protein, 9 aa, Mycobacterium
TGERGSYQC

SEQ ID NO: 594643 - protein, 15 aa, Mycobacterium
TGERPANEALVEVRD

SEQ ID NO: 594644 - protein, 16 aa, Mycobacterium
TGERPAQDDLEKAVDY

SEQ ID NO: 594645 - protein, 15 aa, Mycobacterium
TGERPDSQQLATADA

SEQ ID NO: 594646 - protein, 15 aa, Mycobacterium
TGERPTNEALVEVRD

SEQ ID NO: 594647 - protein, 15 aa, Mycobacterium
TGERPTSEALVEVRD

SEQ ID NO: 594648 - protein, 6 aa, Mycobacterium
TGERRD

SEQ ID NO: 594649 - protein, 13 aa, Mycobacterium
TGERRDTQSPQPS

SEQ ID NO: 594650 - protein, 5 aa, Mycobacterium
TGERS

SEQ ID NO: 594651 - protein, 9 aa, Mycobacterium
TGERSARPG

SEQ ID NO: 594652 - protein, 9 aa, Mycobacterium
TGERTKEGF

SEQ ID NO: 594653 - protein, 11 aa, Mycobacterium
TGERVGPGEVG

SEQ ID NO: 594654 - protein, 5 aa, Mycobacterium
TGESA

SEQ ID NO: 594655 - protein, 9 aa, Mycobacterium
TGESAGDVD

SEQ ID NO: 594656 - protein, 5 aa, Mycobacterium
TGESD

SEQ ID NO: 594657 - protein, 5 aa, Mycobacterium
TGESG

SEQ ID NO: 594658 - protein, 5 aa, Mycobacterium
TGESH

SEQ ID NO: 594659 - protein, 5 aa, Mycobacterium
TGESL

SEQ ID NO: 594660 - protein, 8 aa, Mycobacterium
TGESLAGG

SEQ ID NO: 594661 - protein, 10 aa, Mycobacterium
TGESLAGGFG

SEQ ID NO: 594662 - protein, 11 aa, Mycobacterium
TGESLGSEPAL

SEQ ID NO: 594663 - protein, 7 aa, Mycobacterium
TGESSPY

SEQ ID NO: 594664 - protein, 4 aa, Mycobacterium
TGET

SEQ ID NO: 594665 - protein, 10 aa, Mycobacterium
TGETGTGRTI

SEQ ID NO: 594666 - protein, 14 aa, Mycobacterium
TGETPHDPRTAREQ

SEQ ID NO: 594667 - protein, 9 aa, Mycobacterium
TGETRGSFS

SEQ ID NO: 594668 - protein, 10 aa, Mycobacterium
TGETRTTLPG

SEQ ID NO: 594669 - protein, 7 aa, Mycobacterium
TGETSTG

SEQ ID NO: 594670 - protein, 9 aa, Mycobacterium
TGETVTDPE

SEQ ID NO: 594671 - protein, 5 aa, Mycobacterium
TGEVA

SEQ ID NO: 594672 - protein, 24 aa, Mycobacterium
TGEVNPDELNDAHDGATGSTGAMS

SEQ ID NO: 594673 - protein, 5 aa, Mycobacterium
TGEVP

SEQ ID NO: 594674 - protein, 13 aa, Mycobacterium
TGEVSDDESLGGA

SEQ ID NO: 594675 - protein, 13 aa, Mycobacterium
TGEVTDPDNVPET

SEQ ID NO: 594676 - protein, 15 aa, Mycobacterium
TGEVTPPSGKYDKNE

SEQ ID NO: 594677 - protein, 7 aa, Mycobacterium
TGEYGTY

SEQ ID NO: 594678 - protein, 6 aa, Mycobacterium
TGEYLE

SEQ ID NO: 594679 - protein, 7 aa, Mycobacterium
TGFAPGD

SEQ ID NO: 594680 - protein, 5 aa, Mycobacterium
TGFAR

SEQ ID NO: 594681 - protein, 4 aa, Mycobacterium
TGFE

SEQ ID NO: 594682 - protein, 4 aa, Mycobacterium
TGFG

SEQ ID NO: 594683 - protein, 19 aa, Mycobacterium
TGFGETGPYAHKGGQDAIA

SEQ ID NO: 594684 - protein, 14 aa, Mycobacterium
TGFGGSAQPARAAG

SEQ ID NO: 594685 - protein, 15 aa, Mycobacterium
TGFGGSAQPARAAGV

SEQ ID NO: 594686 - protein, 7 aa, Mycobacterium
TGFGNTG

SEQ ID NO: 594687 - protein, 8 aa, Mycobacterium
TGFGNTGS

SEQ ID NO: 594688 - protein, 6 aa, Mycobacterium
TGFGPK

SEQ ID NO: 594689 - protein, 7 aa, Mycobacterium
TGFGRTG

SEQ ID NO: 594690 - protein, 8 aa, Mycobacterium
TGFGSATN

SEQ ID NO: 594691 - protein, 8 aa, Mycobacterium
TGFGSDGA

SEQ ID NO: 594692 - protein, 16 aa, Mycobacterium
TGFGSGSVAAGTQAGD

SEQ ID NO: 594693 - protein, 9 aa, Mycobacterium
TGFGSSTNI

SEQ ID NO: 594694 - protein, 13 aa, Mycobacterium
TGFHPAGGASTRA

SEQ ID NO: 594695 - protein, 11 aa, Mycobacterium
TGFHPAGGASV

SEQ ID NO: 594696 - protein, 10 aa, Mycobacterium
TGFHPAGGAT

SEQ ID NO: 594697 - protein, 11 aa, Mycobacterium
TGFHPAGGATV

SEQ ID NO: 594698 - protein, 10 aa, Mycobacterium
TGFHPGGGAT

SEQ ID NO: 594699 - protein, 13 aa, Mycobacterium
TGFHPSGGASPRA

SEQ ID NO: 594700 - protein, 11 aa, Mycobacterium
TGFHPSGGASV

SEQ ID NO: 594701 - protein, 12 aa, Mycobacterium
TGFHPTGGASAR

SEQ ID NO: 594702 - protein, 5 aa, Mycobacterium
TGFNP

SEQ ID NO: 594703 - protein, 5 aa, Mycobacterium
TGFRD

SEQ ID NO: 594704 - protein, 8 aa, Mycobacterium
TGFRPGQA

SEQ ID NO: 594705 - protein, 6 aa, Mycobacterium
TGFSNR

SEQ ID NO: 594706 - protein, 20 aa, Mycobacterium
TGFSRTPGRVRGGAPRLGEH

SEQ ID NO: 594707 - protein, 5 aa, Mycobacterium
TGFSS

SEQ ID NO: 594708 - protein, 11 aa, Mycobacterium
TGFTAGPGGIT

SEQ ID NO: 594709 - protein, 12 aa, Mycobacterium
TGFTDPVSGAHG

SEQ ID NO: 594710 - protein, 7 aa, Mycobacterium
TGFTEKE

SEQ ID NO: 594711 - protein, 7 aa, Mycobacterium
TGFTPGK

SEQ ID NO: 594712 - protein, 5 aa, Mycobacterium
TGFTQ

SEQ ID NO: 594713 - protein, 6 aa, Mycobacterium
TGFTQE

SEQ ID NO: 594714 - protein, 9 aa, Mycobacterium
TGFTSSDDA

SEQ ID NO: 594715 - protein, 5 aa, Mycobacterium
TGFTT

SEQ ID NO: 594716 - protein, 4 aa, Mycobacterium
TGGA

SEQ ID NO: 594717 - protein, 5 aa, Mycobacterium
TGGAA

SEQ ID NO: 594718 - protein, 19 aa, Mycobacterium
TGGAAAYDQDGRRAGAGHV

SEQ ID NO: 594719 - protein, 6 aa, Mycobacterium
TGGAAN

SEQ ID NO: 594720 - protein, 14 aa, Mycobacterium
TGGAANAANGALGA

SEQ ID NO: 594721 - protein, 9 aa, Mycobacterium
TGGAATNLK

SEQ ID NO: 594722 - protein, 11 aa, Mycobacterium
TGGAATNPKYQ

SEQ ID NO: 594723 - protein, 11 aa, Mycobacterium
TGGAATNQRHQ

SEQ ID NO: 594724 - protein, 5 aa, Mycobacterium
TGGAD

SEQ ID NO: 594725 - protein, 10 aa, Mycobacterium
TGGAEPQPVG

SEQ ID NO: 594726 - protein, 16 aa, Mycobacterium
TGGAGAAVSDAEQGTQ

SEQ ID NO: 594727 - protein, 40 aa, Mycobacterium
TGGAGGAGGEGGAAGGDPADIAYGQTGGVGGNGGSGGNGG

SEQ ID NO: 594728 - protein, 40 aa, Mycobacterium
TGGAGGAGGEGGAAGGDPAGIAYGSTGGVGGNGGSGGNGG

SEQ ID NO: 594729 - protein, 40 aa, Mycobacterium
TGGAGGAGGEGGAAGGGPAGIAYGQTGGVGGNGGNGGNGG

SEQ ID NO: 594730 - protein, 27 aa, Mycobacterium
TGGAGGAGGFGAGTGGIGGQGGLLFGN

SEQ ID NO: 594731 - protein, 25 aa, Mycobacterium
TGGAGGAGGHAFDGDGGAGGAGGNA

SEQ ID NO: 594732 - protein, 13 aa, Mycobacterium
TGGAGGAGGTASS

SEQ ID NO: 594733 - protein, 25 aa, Mycobacterium
TGGAGGAGGYSSTNVDGGTGGMGGA

SEQ ID NO: 594734 - protein, 28 aa, Mycobacterium
TGGAGGAGGYTTSGTGGAGGAGGTGGLL

SEQ ID NO: 594735 - protein, 9 aa, Mycobacterium
TGGAGGIGA

SEQ ID NO: 594736 - protein, 25 aa, Mycobacterium
TGGAGGSGAESLGVGDSGGAGGMGG

SEQ ID NO: 594737 - protein, 35 aa, Mycobacterium
TGGAGGSGGAGGVSGMNPGNHGGLGGNGGAGGAAG

SEQ ID NO: 594738 - protein, 11 aa, Mycobacterium
TGGAGGTGGFG

SEQ ID NO: 594739 - protein, 7 aa, Mycobacterium
TGGAGLT

SEQ ID NO: 594740 - protein, 7 aa, Mycobacterium
TGGAGQP

SEQ ID NO: 594741 - protein, 9 aa, Mycobacterium
TGGAGSRGI

SEQ ID NO: 594742 - protein, 11 aa, Mycobacterium
TGGAPDAPVRA

SEQ ID NO: 594743 - protein, 6 aa, Mycobacterium
TGGAPI

SEQ ID NO: 594744 - protein, 7 aa, Mycobacterium
TGGAPNL

SEQ ID NO: 594745 - protein, 10 aa, Mycobacterium
TGGAQPRTRP

SEQ ID NO: 594746 - protein, 12 aa, Mycobacterium
TGGARASIAEAR

SEQ ID NO: 594747 - protein, 8 aa, Mycobacterium
TGGARGIG

SEQ ID NO: 594748 - protein, 9 aa, Mycobacterium
TGGARGMGR

SEQ ID NO: 594749 - protein, 5 aa, Mycobacterium
TGGAS

SEQ ID NO: 594750 - protein, 8 aa, Mycobacterium
TGGASGIG

SEQ ID NO: 594751 - protein, 10 aa, Mycobacterium
TGGASGIGRA

SEQ ID NO: 594752 - protein, 10 aa, Mycobacterium
TGGASGIGRG

SEQ ID NO: 594753 - protein, 9 aa, Mycobacterium
TGGASGVEG

SEQ ID NO: 594754 - protein, 9 aa, Mycobacterium
TGGASNPGM

SEQ ID NO: 594755 - protein, 5 aa, Mycobacterium
TGGAT

SEQ ID NO: 594756 - protein, 8 aa, Mycobacterium
TGGATGLG

SEQ ID NO: 594757 - protein, 9 aa, Mycobacterium
TGGATPANL

SEQ ID NO: 594758 - protein, 10 aa, Mycobacterium
TGGATPRTRP

SEQ ID NO: 594759 - protein, 23 aa, Mycobacterium
TGGATRNRYGQDLEPGSPGSLQM

SEQ ID NO: 594760 - protein, 6 aa, Mycobacterium
TGGCPE

SEQ ID NO: 594761 - protein, 6 aa, Mycobacterium
TGGDDA

SEQ ID NO: 594762 - protein, 8 aa, Mycobacterium
TGGDDVGG

SEQ ID NO: 594763 - protein, 5 aa, Mycobacterium
TGGDE

SEQ ID NO: 594764 - protein, 5 aa, Mycobacterium
TGGDG

SEQ ID NO: 594765 - protein, 70 aa, Mycobacterium
TGGDGGSGGSGGDGGLGGNGGHGGAGGKGGNADQHADDGAPGIGGGGGDAGAGGTAGSGGAGGGAGTGGA

SEQ ID NO: 594766 - protein, 7 aa, Mycobacterium
TGGDGKD

SEQ ID NO: 594767 - protein, 9 aa, Mycobacterium
TGGDGPRGI

SEQ ID NO: 594768 - protein, 7 aa, Mycobacterium
TGGDGTD

SEQ ID NO: 594769 - protein, 14 aa, Mycobacterium
TGGDGVPDGDHDPL

SEQ ID NO: 594770 - protein, 9 aa, Mycobacterium
TGGDKPDGI

SEQ ID NO: 594771 - protein, 5 aa, Mycobacterium
TGGDS

SEQ ID NO: 594772 - protein, 9 aa, Mycobacterium
TGGDSEITD

SEQ ID NO: 594773 - protein, 9 aa, Mycobacterium
TGGDSGIGR

SEQ ID NO: 594774 - protein, 10 aa, Mycobacterium
TGGDTADPTV

SEQ ID NO: 594775 - protein, 17 aa, Mycobacterium
TGGDTGDSDANGDKPGF

SEQ ID NO: 594776 - protein, 7 aa, Mycobacterium
TGGDTVT

SEQ ID NO: 594777 - protein, 5 aa, Mycobacterium
TGGDV

SEQ ID NO: 594778 - protein, 13 aa, Mycobacterium
TGGEKRVTATGST

SEQ ID NO: 594779 - protein, 5 aa, Mycobacterium
TGGEN

SEQ ID NO: 594780 - protein, 11 aa, Mycobacterium
TGGEPADEQRQ

SEQ ID NO: 594781 - protein, 6 aa, Mycobacterium
TGGEPI

SEQ ID NO: 594782 - protein, 9 aa, Mycobacterium
TGGEQGASL

SEQ ID NO: 594783 - protein, 6 aa, Mycobacterium
TGGERK

SEQ ID NO: 594784 - protein, 8 aa, Mycobacterium
TGGERPPF

SEQ ID NO: 594785 - protein, 5 aa, Mycobacterium
TGGES

SEQ ID NO: 594786 - protein, 11 aa, Mycobacterium
TGGESDLPPRR

SEQ ID NO: 594787 - protein, 11 aa, Mycobacterium
TGGESVASPQT

SEQ ID NO: 594788 - protein, 4 aa, Mycobacterium
TGGF

SEQ ID NO: 594789 - protein, 7 aa, Mycobacterium
TGGFATT

SEQ ID NO: 594790 - protein, 6 aa, Mycobacterium
TGGFRA

SEQ ID NO: 594791 - protein, 5 aa, Mycobacterium
TGGFT

SEQ ID NO: 594792 - protein, 9 aa, Mycobacterium
TGGGAAGTA

SEQ ID NO: 594793 - protein, 11 aa, Mycobacterium
TGGGAGIGRGI

SEQ ID NO: 594794 - protein, 8 aa, Mycobacterium
TGGGAVEE

SEQ ID NO: 594795 - protein, 6 aa, Mycobacterium
TGGGDL

SEQ ID NO: 594796 - protein, 24 aa, Mycobacterium
TGGGEQKPSRARGAMNSDPPTRAI

SEQ ID NO: 594797 - protein, 15 aa, Mycobacterium
TGGGERAVSGPAPTR

SEQ ID NO: 594798 - protein, 15 aa, Mycobacterium
TGGGERTVSGPADTR

SEQ ID NO: 594799 - protein, 7 aa, Mycobacterium
TGGGEVL

SEQ ID NO: 594800 - protein, 7 aa, Mycobacterium
TGGGGAG

SEQ ID NO: 594801 - protein, 54 aa, Mycobacterium
TGGGGGAGGVSATTGNGGNGGNAGLIGDGGAGGAGAIPGAGGAGGRIFGALGLP

SEQ ID NO: 594802 - protein, 30 aa, Mycobacterium
TGGGGGEGGATSPSSSTGSGGDGGIGGTSG

SEQ ID NO: 594803 - protein, 11 aa, Mycobacterium
TGGGGGIGAAT

SEQ ID NO: 594804 - protein, 9 aa, Mycobacterium
TGGGGGIGR

SEQ ID NO: 594805 - protein, 10 aa, Mycobacterium
TGGGGLTPSD

SEQ ID NO: 594806 - protein, 13 aa, Mycobacterium
TGGGGPAERAAAA

SEQ ID NO: 594807 - protein, 119 aa, Mycobacterium
TGGGHGGLGGAGVTAGGDGGAGGDGGPLIGRGGDGGAGGLSNSVDAVGGAGGAGGDGSRLVGSGGAGGTGGTSLAGDGGAGGAGGTAGLLGSGGSGGSGGTSGFLGTGSGGAGGDGGNA

SEQ ID NO: 594808 - protein, 5 aa, Mycobacterium
TGGGI

SEQ ID NO: 594809 - protein, 8 aa, Mycobacterium
TGGGIPEN

SEQ ID NO: 594810 - protein, 10 aa, Mycobacterium
TGGGNTRGVE

SEQ ID NO: 594811 - protein, 22 aa, Mycobacterium
TGGGPGAMEAANRGASESGGYS

SEQ ID NO: 594812 - protein, 11 aa, Mycobacterium
TGGGPSGQAGA

SEQ ID NO: 594813 - protein, 10 aa, Mycobacterium
TGGGQVATSQ

SEQ ID NO: 594814 - protein, 5 aa, Mycobacterium
TGGGR

SEQ ID NO: 594815 - protein, 8 aa, Mycobacterium
TGGGRGIG

SEQ ID NO: 594816 - protein, 8 aa, Mycobacterium
TGGGRGLG

SEQ ID NO: 594817 - protein, 10 aa, Mycobacterium
TGGGRPEGLD

SEQ ID NO: 594818 - protein, 15 aa, Mycobacterium
TGGGRTAPDGHGPLK

SEQ ID NO: 594819 - protein, 9 aa, Mycobacterium
TGGGSGGVC

SEQ ID NO: 594820 - protein, 8 aa, Mycobacterium
TGGGSGIG

SEQ ID NO: 594821 - protein, 8 aa, Mycobacterium
TGGGSQTL

SEQ ID NO: 594822 - protein, 10 aa, Mycobacterium
TGGGTGIGRA

SEQ ID NO: 594823 - protein, 7 aa, Mycobacterium
TGGGTRV

SEQ ID NO: 594824 - protein, 8 aa, Mycobacterium
TGGGTRVG

SEQ ID NO: 594825 - protein, 8 aa, Mycobacterium
TGGGTTAR

SEQ ID NO: 594826 - protein, 8 aa, Mycobacterium
TGGGVPEN

SEQ ID NO: 594827 - protein, 5 aa, Mycobacterium
TGGHE

SEQ ID NO: 594828 - protein, 6 aa, Mycobacterium
TGGHEL

SEQ ID NO: 594829 - protein, 38 aa, Mycobacterium
TGGHGGSGGAGGVGALGGAGESGGAGGAAGDGGAGGRG

SEQ ID NO: 594830 - protein, 14 aa, Mycobacterium
TGGHHEGPTDPPGV

SEQ ID NO: 594831 - protein, 5 aa, Mycobacterium
TGGHL

SEQ ID NO: 594832 - protein, 9 aa, Mycobacterium
TGGHRGRTK

SEQ ID NO: 594833 - protein, 8 aa, Mycobacterium
TGGHRPGV

SEQ ID NO: 594834 - protein, 8 aa, Mycobacterium
TGGHTPGH

SEQ ID NO: 594835 - protein, 12 aa, Mycobacterium
TGGIAASTAVAP

SEQ ID NO: 594836 - protein, 8 aa, Mycobacterium
TGGIEDPH

SEQ ID NO: 594837 - protein, 9 aa, Mycobacterium
TGGIGTGKT

SEQ ID NO: 594838 - protein, 10 aa, Mycobacterium
TGGKISYSGN

SEQ ID NO: 594839 - protein, 12 aa, Mycobacterium
TGGKNFEGPGRG

SEQ ID NO: 594840 - protein, 9 aa, Mycobacterium
TGGKPMDRK

SEQ ID NO: 594841 - protein, 10 aa, Mycobacterium
TGGKQKSYDA

SEQ ID NO: 594842 - protein, 11 aa, Mycobacterium
TGGKQSPEDLD

SEQ ID NO: 594843 - protein, 8 aa, Mycobacterium
TGGKQYKV

SEQ ID NO: 594844 - protein, 6 aa, Mycobacterium
TGGKRL

SEQ ID NO: 594845 - protein, 5 aa, Mycobacterium
TGGKV

SEQ ID NO: 594846 - protein, 11 aa, Mycobacterium
TGGLATDDFGT

SEQ ID NO: 594847 - protein, 11 aa, Mycobacterium
TGGLEQPKLPE

SEQ ID NO: 594848 - protein, 5 aa, Mycobacterium
TGGLG

SEQ ID NO: 594849 - protein, 17 aa, Mycobacterium
TGGLPAAEADPPSDHCD

SEQ ID NO: 594850 - protein, 11 aa, Mycobacterium
TGGLPKGDALA

SEQ ID NO: 594851 - protein, 8 aa, Mycobacterium
TGGLPPER

SEQ ID NO: 594852 - protein, 5 aa, Mycobacterium
TGGLS

SEQ ID NO: 594853 - protein, 5 aa, Mycobacterium
TGGLT

SEQ ID NO: 594854 - protein, 7 aa, Mycobacterium
TGGLTDA

SEQ ID NO: 594855 - protein, 6 aa, Mycobacterium
TGGMRE

SEQ ID NO: 594856 - protein, 6 aa, Mycobacterium
TGGMTA

SEQ ID NO: 594857 - protein, 17 aa, Mycobacterium
TGGMWSGAGSPRGNCDT

SEQ ID NO: 594858 - protein, 8 aa, Mycobacterium
TGGNATTV

SEQ ID NO: 594859 - protein, 11 aa, Mycobacterium
TGGNDEAGGDD

SEQ ID NO: 594860 - protein, 73 aa, Mycobacterium
TGGNGGAGGIGGSGGAGDIGGAGGNGGAGGVASSSGISTSHGGDGGDGGDGGDGGDAGAGGVGGVGGKGGNGG

SEQ ID NO: 594861 - protein, 29 aa, Mycobacterium
TGGNGGAGVPPASGGSGGRGGLIGSAGQN

SEQ ID NO: 594862 - protein, 10 aa, Mycobacterium
TGGNGGHSGR

SEQ ID NO: 594863 - protein, 11 aa, Mycobacterium
TGGNGGNGASG

SEQ ID NO: 594864 - protein, 34 aa, Mycobacterium
TGGNGGNGGAGTAKGTPGTGGTGGLIGVDGLSGA

SEQ ID NO: 594865 - protein, 24 aa, Mycobacterium
TGGNGGNGGVGAGTGTRGAGGSGG

SEQ ID NO: 594866 - protein, 14 aa, Mycobacterium
TGGNGGQGGTGGTL

SEQ ID NO: 594867 - protein, 8 aa, Mycobacterium
TGGNKTEL

SEQ ID NO: 594868 - protein, 7 aa, Mycobacterium
TGGNLGY

SEQ ID NO: 594869 - protein, 8 aa, Mycobacterium
TGGNQGLG

SEQ ID NO: 594870 - protein, 12 aa, Mycobacterium
TGGPADSALPTA

SEQ ID NO: 594871 - protein, 7 aa, Mycobacterium
TGGPAGA

SEQ ID NO: 594872 - protein, 6 aa, Mycobacterium
TGGPAL

SEQ ID NO: 594873 - protein, 19 aa, Mycobacterium
TGGPDDETRSAARAESELA

SEQ ID NO: 594874 - protein, 13 aa, Mycobacterium
TGGPDDPRWSPAE

SEQ ID NO: 594875 - protein, 5 aa, Mycobacterium
TGGPE

SEQ ID NO: 594876 - protein, 8 aa, Mycobacterium
TGGPEYGG

SEQ ID NO: 594877 - protein, 6 aa, Mycobacterium
TGGPFP

SEQ ID NO: 594878 - protein, 11 aa, Mycobacterium
TGGPGEEATGR

SEQ ID NO: 594879 - protein, 7 aa, Mycobacterium
TGGPGFN

SEQ ID NO: 594880 - protein, 9 aa, Mycobacterium
TGGPGPRGI

SEQ ID NO: 594881 - protein, 11 aa, Mycobacterium
TGGPGTGKTTT

SEQ ID NO: 594882 - protein, 18 aa, Mycobacterium
TGGPGVSIEPERGIDQTR

SEQ ID NO: 594883 - protein, 6 aa, Mycobacterium
TGGPIP

SEQ ID NO: 594884 - protein, 8 aa, Mycobacterium
TGGPLGGP

SEQ ID NO: 594885 - protein, 9 aa, Mycobacterium
TGGPPQPPP

SEQ ID NO: 594886 - protein, 10 aa, Mycobacterium
TGGPRQLDSA

SEQ ID NO: 594887 - protein, 5 aa, Mycobacterium
TGGPS

SEQ ID NO: 594888 - protein, 5 aa, Mycobacterium
TGGPW

SEQ ID NO: 594889 - protein, 14 aa, Mycobacterium
TGGPWEGASSGTMA

SEQ ID NO: 594890 - protein, 11 aa, Mycobacterium
TGGQAGQSSRI

SEQ ID NO: 594891 - protein, 10 aa, Mycobacterium
TGGQDLTRGQ

SEQ ID NO: 594892 - protein, 12 aa, Mycobacterium
TGGQGGAGGNAG

SEQ ID NO: 594893 - protein, 6 aa, Mycobacterium
TGGQPL

SEQ ID NO: 594894 - protein, 5 aa, Mycobacterium
TGGQS

SEQ ID NO: 594895 - protein, 6 aa, Mycobacterium
TGGQYG

SEQ ID NO: 594896 - protein, 4 aa, Mycobacterium
TGGR

SEQ ID NO: 594897 - protein, 8 aa, Mycobacterium
TGGRARRT

SEQ ID NO: 594898 - protein, 6 aa, Mycobacterium
TGGREH

SEQ ID NO: 594899 - protein, 11 aa, Mycobacterium
TGGRGADAAFD

SEQ ID NO: 594900 - protein, 5 aa, Mycobacterium
TGGRH

SEQ ID NO: 594901 - protein, 16 aa, Mycobacterium
TGGRISPTDAPGFGLE

SEQ ID NO: 594902 - protein, 8 aa, Mycobacterium
TGGRLGQR

SEQ ID NO: 594903 - protein, 14 aa, Mycobacterium
TGGRPAGERLTEHP

SEQ ID NO: 594904 - protein, 11 aa, Mycobacterium
TGGRPLTSGQL

SEQ ID NO: 594905 - protein, 15 aa, Mycobacterium
TGGRPRRLPVPGPRP

SEQ ID NO: 594906 - protein, 8 aa, Mycobacterium
TGGRPVSQ

SEQ ID NO: 594907 - protein, 6 aa, Mycobacterium
TGGRQR

SEQ ID NO: 594908 - protein, 6 aa, Mycobacterium
TGGRRG

SEQ ID NO: 594909 - protein, 6 aa, Mycobacterium
TGGRRR

SEQ ID NO: 594910 - protein, 8 aa, Mycobacterium
TGGRRYRG

SEQ ID NO: 594911 - protein, 8 aa, Mycobacterium
TGGRSARV

SEQ ID NO: 594912 - protein, 5 aa, Mycobacterium
TGGRT

SEQ ID NO: 594913 - protein, 11 aa, Mycobacterium
TGGSAKDLVGT

SEQ ID NO: 594914 - protein, 10 aa, Mycobacterium
TGGSDPAGVA

SEQ ID NO: 594915 - protein, 25 aa, Mycobacterium
TGGSGGAGGGSNAFTAGDGGAGGAG

SEQ ID NO: 594916 - protein, 10 aa, Mycobacterium
TGGSGGAGGV

SEQ ID NO: 594917 - protein, 12 aa, Mycobacterium
TGGSGGDGGLAP

SEQ ID NO: 594918 - protein, 19 aa, Mycobacterium
TGGSGRMYKTTSNALTLTG

SEQ ID NO: 594919 - protein, 9 aa, Mycobacterium
TGGSGRRAR

SEQ ID NO: 594920 - protein, 6 aa, Mycobacterium
TGGSGV

SEQ ID NO: 594921 - protein, 5 aa, Mycobacterium
TGGSL

SEQ ID NO: 594922 - protein, 10 aa, Mycobacterium
TGGSNLARGQ

SEQ ID NO: 594923 - protein, 8 aa, Mycobacterium
TGGSRGIG

SEQ ID NO: 594924 - protein, 11 aa, Mycobacterium
TGGSRVASPQT

SEQ ID NO: 594925 - protein, 5 aa, Mycobacterium
TGGSS

SEQ ID NO: 594926 - protein, 8 aa, Mycobacterium
TGGSSIET

SEQ ID NO: 594927 - protein, 9 aa, Mycobacterium
TGGSTGIGK

SEQ ID NO: 594928 - protein, 5 aa, Mycobacterium
TGGSY

SEQ ID NO: 594929 - protein, 4 aa, Mycobacterium
TGGT

SEQ ID NO: 594930 - protein, 9 aa, Mycobacterium
TGGTASGPL

SEQ ID NO: 594931 - protein, 8 aa, Mycobacterium
TGGTDAGK

SEQ ID NO: 594932 - protein, 9 aa, Mycobacterium
TGGTEMPDG

SEQ ID NO: 594933 - protein, 10 aa, Mycobacterium
TGGTEPGRSI

SEQ ID NO: 594934 - protein, 9 aa, Mycobacterium
TGGTESDNL

SEQ ID NO: 594935 - protein, 12 aa, Mycobacterium
TGGTGGAGGAGI

SEQ ID NO: 594936 - protein, 27 aa, Mycobacterium
TGGTGGAGGWAAAGATGGIGGQGGAGG

SEQ ID NO: 594937 - protein, 13 aa, Mycobacterium
TGGTGGDGGAGGL

SEQ ID NO: 594938 - protein, 26 aa, Mycobacterium
TGGTGGTGGFGDGPLGGQGGDGGNAG

SEQ ID NO: 594939 - protein, 17 aa, Mycobacterium
TGGTGLSPTDSTPEQTA

SEQ ID NO: 594940 - protein, 6 aa, Mycobacterium
TGGTGV

SEQ ID NO: 594941 - protein, 6 aa, Mycobacterium
TGGTGW

SEQ ID NO: 594942 - protein, 5 aa, Mycobacterium
TGGTI

SEQ ID NO: 594943 - protein, 10 aa, Mycobacterium
TGGTKGAGAA

SEQ ID NO: 594944 - protein, 9 aa, Mycobacterium
TGGTKGIGR

SEQ ID NO: 594945 - protein, 5 aa, Mycobacterium
TGGTL

SEQ ID NO: 594946 - protein, 7 aa, Mycobacterium
TGGTLGA

SEQ ID NO: 594947 - protein, 7 aa, Mycobacterium
TGGTLSA

SEQ ID NO: 594948 - protein, 8 aa, Mycobacterium
TGGTPAAR

SEQ ID NO: 594949 - protein, 12 aa, Mycobacterium
TGGTPLDDPPEM

SEQ ID NO: 594950 - protein, 6 aa, Mycobacterium
TGGTPR

SEQ ID NO: 594951 - protein, 9 aa, Mycobacterium
TGGTPSVYA

SEQ ID NO: 594952 - protein, 5 aa, Mycobacterium
TGGTQ

SEQ ID NO: 594953 - protein, 7 aa, Mycobacterium
TGGTRGI

SEQ ID NO: 594954 - protein, 8 aa, Mycobacterium
TGGTRGIG

SEQ ID NO: 594955 - protein, 16 aa, Mycobacterium
TGGTRYDSERQQWDSG

SEQ ID NO: 594956 - protein, 9 aa, Mycobacterium
TGGTSGIGH

SEQ ID NO: 594957 - protein, 10 aa, Mycobacterium
TGGTSGIGHA

SEQ ID NO: 594958 - protein, 7 aa, Mycobacterium
TGGTVAK

SEQ ID NO: 594959 - protein, 11 aa, Mycobacterium
TGGTVPVPAPK

SEQ ID NO: 594960 - protein, 9 aa, Mycobacterium
TGGTYDGPV

SEQ ID NO: 594961 - protein, 9 aa, Mycobacterium
TGGVDSETQ

SEQ ID NO: 594962 - protein, 5 aa, Mycobacterium
TGGVG

SEQ ID NO: 594963 - protein, 9 aa, Mycobacterium
TGGVGDRSL

SEQ ID NO: 594964 - protein, 5 aa, Mycobacterium
TGGVY

SEQ ID NO: 594965 - protein, 11 aa, Mycobacterium
TGGWEPDAKGL

SEQ ID NO: 594966 - protein, 8 aa, Mycobacterium
TGGWNGDQ

SEQ ID NO: 594967 - protein, 5 aa, Mycobacterium
TGGYG

SEQ ID NO: 594968 - protein, 8 aa, Mycobacterium
TGGYPPRE

SEQ ID NO: 594969 - protein, 8 aa, Mycobacterium
TGGYTREE

SEQ ID NO: 594970 - protein, 16 aa, Mycobacterium
TGHAPFRTGTAADKPR

SEQ ID NO: 594971 - protein, 5 aa, Mycobacterium
TGHAR

SEQ ID NO: 594972 - protein, 19 aa, Mycobacterium
TGHDGGAGTLHANNPGEVP

SEQ ID NO: 594973 - protein, 20 aa, Mycobacterium
TGHDGGAGTVHANAPAEVPA

SEQ ID NO: 594974 - protein, 128 aa, Mycobacterium
TGHDGGHGTGGAGGNGGAGGSAGNGGNGAKGVSGVNNGAGGNGGDGGTPGIGGTGGAGGDSGGGSHGATGSDGATPHSGGNGGKGGDGADATGFGQTGGNGGRGGNGGLVGNGGDGGTGGAGGTGLGG

SEQ ID NO: 594975 - protein, 15 aa, Mycobacterium
TGHDPQVAGKPQPTL

SEQ ID NO: 594976 - protein, 7 aa, Mycobacterium
TGHDPRL

SEQ ID NO: 594977 - protein, 5 aa, Mycobacterium
TGHEG

SEQ ID NO: 594978 - protein, 8 aa, Mycobacterium
TGHEGAEA

SEQ ID NO: 594979 - protein, 20 aa, Mycobacterium
TGHEGGAGTVHANSPGEVPA

SEQ ID NO: 594980 - protein, 7 aa, Mycobacterium
TGHEGRD

SEQ ID NO: 594981 - protein, 12 aa, Mycobacterium
TGHEKRGQHLHS

SEQ ID NO: 594982 - protein, 5 aa, Mycobacterium
TGHEP

SEQ ID NO: 594983 - protein, 11 aa, Mycobacterium
TGHEPAGDEMK

SEQ ID NO: 594984 - protein, 6 aa, Mycobacterium
TGHEPV

SEQ ID NO: 594985 - protein, 15 aa, Mycobacterium
TGHESAWARRGPAVR

SEQ ID NO: 594986 - protein, 12 aa, Mycobacterium
TGHETGSDSATA

SEQ ID NO: 594987 - protein, 6 aa, Mycobacterium
TGHGAA

SEQ ID NO: 594988 - protein, 8 aa, Mycobacterium
TGHGDSTL

SEQ ID NO: 594989 - protein, 10 aa, Mycobacterium
TGHGDSTTIG

SEQ ID NO: 594990 - protein, 11 aa, Mycobacterium
TGHGDSTTVGD

SEQ ID NO: 594991 - protein, 8 aa, Mycobacterium
TGHGESLS

SEQ ID NO: 594992 - protein, 5 aa, Mycobacterium
TGHGP

SEQ ID NO: 594993 - protein, 12 aa, Mycobacterium
TGHGPDGPVSFT

SEQ ID NO: 594994 - protein, 8 aa, Mycobacterium
TGHGPYGP

SEQ ID NO: 594995 - protein, 9 aa, Mycobacterium
TGHGPYGPL

SEQ ID NO: 594996 - protein, 13 aa, Mycobacterium
TGHGRKTDEADAV

SEQ ID NO: 594997 - protein, 20 aa, Mycobacterium
TGHGSDVQSLETTATYDADT

SEQ ID NO: 594998 - protein, 6 aa, Mycobacterium
TGHGTT

SEQ ID NO: 594999 - protein, 5 aa, Mycobacterium
TGHHA

SEQ ID NO: 595000 - protein, 10 aa, Mycobacterium
TGHHDGTPRS

SEQ ID NO: 595001 - protein, 12 aa, Mycobacterium
TGHHGDALLIGV

SEQ ID NO: 595002 - protein, 13 aa, Mycobacterium
TGHHPPRDTSGKI

SEQ ID NO: 595003 - protein, 4 aa, Mycobacterium
TGHI

SEQ ID NO: 595004 - protein, 6 aa, Mycobacterium
TGHLDA

SEQ ID NO: 595005 - protein, 6 aa, Mycobacterium
TGHNPH

SEQ ID NO: 595006 - protein, 5 aa, Mycobacterium
TGHPA

SEQ ID NO: 595007 - protein, 6 aa, Mycobacterium
TGHPAQ

SEQ ID NO: 595008 - protein, 7 aa, Mycobacterium
TGHPPAA

SEQ ID NO: 595009 - protein, 12 aa, Mycobacterium
TGHPQGGGSEAY

SEQ ID NO: 595010 - protein, 12 aa, Mycobacterium
TGHPQGGGSETY

SEQ ID NO: 595011 - protein, 12 aa, Mycobacterium
TGHPSGTAKDVE

SEQ ID NO: 595012 - protein, 12 aa, Mycobacterium
TGHPTSSRRGPQ

SEQ ID NO: 595013 - protein, 10 aa, Mycobacterium
TGHPVSPSTV

SEQ ID NO: 595014 - protein, 6 aa, Mycobacterium
TGHQTT

SEQ ID NO: 595015 - protein, 6 aa, Mycobacterium
TGHRAD

SEQ ID NO: 595016 - protein, 10 aa, Mycobacterium
TGHSDEQTTA

SEQ ID NO: 595017 - protein, 6 aa, Mycobacterium
TGHTAQ

SEQ ID NO: 595018 - protein, 12 aa, Mycobacterium
TGHTGNKPVTES

SEQ ID NO: 595019 - protein, 19 aa, Mycobacterium
TGHTGNKPVTESLHPASPD

SEQ ID NO: 595020 - protein, 14 aa, Mycobacterium
TGHTPKGWMCQQAN

SEQ ID NO: 595021 - protein, 6 aa, Mycobacterium
TGHTRQ

SEQ ID NO: 595022 - protein, 6 aa, Mycobacterium
TGHTTF

SEQ ID NO: 595023 - protein, 10 aa, Mycobacterium
TGHVASAKNA

SEQ ID NO: 595024 - protein, 10 aa, Mycobacterium
TGHYDGKGRV

SEQ ID NO: 595025 - protein, 4 aa, Mycobacterium
TGIA

SEQ ID NO: 595026 - protein, 11 aa, Mycobacterium
TGIAGHDGRQV

SEQ ID NO: 595027 - protein, 13 aa, Mycobacterium
TGIAGQDGRQVVE

SEQ ID NO: 595028 - protein, 11 aa, Mycobacterium
TGIAGSPRRVG

SEQ ID NO: 595029 - protein, 9 aa, Mycobacterium
TGIAPSYQQ

SEQ ID NO: 595030 - protein, 13 aa, Mycobacterium
TGIARQDAGRPWR

SEQ ID NO: 595031 - protein, 5 aa, Mycobacterium
TGIAT

SEQ ID NO: 595032 - protein, 9 aa, Mycobacterium
TGIATSGAH

SEQ ID NO: 595033 - protein, 4 aa, Mycobacterium
TGID

SEQ ID NO: 595034 - protein, 6 aa, Mycobacterium
TGIDES

SEQ ID NO: 595035 - protein, 7 aa, Mycobacterium
TGIDPER

SEQ ID NO: 595036 - protein, 14 aa, Mycobacterium
TGIDPGNLDGITTE

SEQ ID NO: 595037 - protein, 6 aa, Mycobacterium
TGIDPK

SEQ ID NO: 595038 - protein, 14 aa, Mycobacterium
TGIDPTTLRGSPTG

SEQ ID NO: 595039 - protein, 18 aa, Mycobacterium
TGIDTDLASNNDTTLVDA

SEQ ID NO: 595040 - protein, 4 aa, Mycobacterium
TGIE

SEQ ID NO: 595041 - protein, 6 aa, Mycobacterium
TGIEEL

SEQ ID NO: 595042 - protein, 5 aa, Mycobacterium
TGIEP

SEQ ID NO: 595043 - protein, 14 aa, Mycobacterium
TGIEPDKNTPAQWR

SEQ ID NO: 595044 - protein, 9 aa, Mycobacterium
TGIEPSTAV

SEQ ID NO: 595045 - protein, 18 aa, Mycobacterium
TGIEPTPYVGGNSPRTAL

SEQ ID NO: 595046 - protein, 13 aa, Mycobacterium
TGIEPTVEVHGSA

SEQ ID NO: 595047 - protein, 6 aa, Mycobacterium
TGIGED

SEQ ID NO: 595048 - protein, 12 aa, Mycobacterium
TGIGGSITRQDV

SEQ ID NO: 595049 - protein, 30 aa, Mycobacterium
TGIGNPGNYNSGAHNVGSTNTGGANQGDYN

SEQ ID NO: 595050 - protein, 34 aa, Mycobacterium
TGIGNTGNYNSGGFNAGSTNTGSFNPGDYNTGGL

SEQ ID NO: 595051 - protein, 51 aa, Mycobacterium
TGIGNTGNYNSGSFNAGSTNTGGFNAGSHNTGYLNPGNYNTGAANTGDVDT

SEQ ID NO: 595052 - protein, 5 aa, Mycobacterium
TGIGP

SEQ ID NO: 595053 - protein, 6 aa, Mycobacterium
TGIGPG

SEQ ID NO: 595054 - protein, 5 aa, Mycobacterium
TGIGQ

SEQ ID NO: 595055 - protein, 5 aa, Mycobacterium
TGIGR

SEQ ID NO: 595056 - protein, 7 aa, Mycobacterium
TGIGSGG

SEQ ID NO: 595057 - protein, 5 aa, Mycobacterium
TGIKP

SEQ ID NO: 595058 - protein, 4 aa, Mycobacterium
TGIP

SEQ ID NO: 595059 - protein, 6 aa, Mycobacterium
TGIPAA

SEQ ID NO: 595060 - protein, 7 aa, Mycobacterium
TGIPDPD

SEQ ID NO: 595061 - protein, 7 aa, Mycobacterium
TGIPEER

SEQ ID NO: 595062 - protein, 5 aa, Mycobacterium
TGIPP

SEQ ID NO: 595063 - protein, 8 aa, Mycobacterium
TGIPSEDI

SEQ ID NO: 595064 - protein, 23 aa, Mycobacterium
TGIPSSELQQTATQVAEASGPMQ

SEQ ID NO: 595065 - protein, 10 aa, Mycobacterium
TGIQRAKRTR

SEQ ID NO: 595066 - protein, 14 aa, Mycobacterium
TGIRPRGARPPGGL

SEQ ID NO: 595067 - protein, 8 aa, Mycobacterium
TGISKSEV

SEQ ID NO: 595068 - protein, 9 aa, Mycobacterium
TGITTSDAH

SEQ ID NO: 595069 - protein, 4 aa, Mycobacterium
TGKA

SEQ ID NO: 595070 - protein, 8 aa, Mycobacterium
TGKAGAKR

SEQ ID NO: 595071 - protein, 14 aa, Mycobacterium
TGKAHGAALGDDEV

SEQ ID NO: 595072 - protein, 14 aa, Mycobacterium
TGKAHGAALGDEEV

SEQ ID NO: 595073 - protein, 28 aa, Mycobacterium
TGKAPAAYIGDNTRPDAVRTRTLSEETN

SEQ ID NO: 595074 - protein, 28 aa, Mycobacterium
TGKAPAAYIGDNTRPDSVRTRTLSEETT

SEQ ID NO: 595075 - protein, 9 aa, Mycobacterium
TGKAPPEAR

SEQ ID NO: 595076 - protein, 10 aa, Mycobacterium
TGKAPPEARA

SEQ ID NO: 595077 - protein, 7 aa, Mycobacterium
TGKAQIG

SEQ ID NO: 595078 - protein, 8 aa, Mycobacterium
TGKARDQL

SEQ ID NO: 595079 - protein, 8 aa, Mycobacterium
TGKARPGY

SEQ ID NO: 595080 - protein, 6 aa, Mycobacterium
TGKAST

SEQ ID NO: 595081 - protein, 7 aa, Mycobacterium
TGKATGW

SEQ ID NO: 595082 - protein, 13 aa, Mycobacterium
TGKDLAAARESAY

SEQ ID NO: 595083 - protein, 28 aa, Mycobacterium
TGKDPAAYIGDNTRPDAVRTRTLSEETT

SEQ ID NO: 595084 - protein, 9 aa, Mycobacterium
TGKDPNTVP

SEQ ID NO: 595085 - protein, 6 aa, Mycobacterium
TGKEVN

SEQ ID NO: 595086 - protein, 14 aa, Mycobacterium
TGKFPGAKTPESYL

SEQ ID NO: 595087 - protein, 21 aa, Mycobacterium
TGKFTGAGGNLEETVTRNNLE

SEQ ID NO: 595088 - protein, 21 aa, Mycobacterium
TGKFTGSGGNLEQTVTRNNLE

SEQ ID NO: 595089 - protein, 11 aa, Mycobacterium
TGKGATKRTAV

SEQ ID NO: 595090 - protein, 11 aa, Mycobacterium
TGKGGPAQGVA

SEQ ID NO: 595091 - protein, 5 aa, Mycobacterium
TGKGI

SEQ ID NO: 595092 - protein, 10 aa, Mycobacterium
TGKGSGEVTS

SEQ ID NO: 595093 - protein, 8 aa, Mycobacterium
TGKGSRKH

SEQ ID NO: 595094 - protein, 4 aa, Mycobacterium
TGKI

SEQ ID NO: 595095 - protein, 17 aa, Mycobacterium
TGKIDTGVGRGSKAGAR

SEQ ID NO: 595096 - protein, 14 aa, Mycobacterium
TGKKTTRLRTTPNP

SEQ ID NO: 595097 - protein, 8 aa, Mycobacterium
TGKLPKLS

SEQ ID NO: 595098 - protein, 8 aa, Mycobacterium
TGKLSTAD

SEQ ID NO: 595099 - protein, 4 aa, Mycobacterium
TGKN

SEQ ID NO: 595100 - protein, 16 aa, Mycobacterium
TGKPAALDRDEPRRVA

SEQ ID NO: 595101 - protein, 15 aa, Mycobacterium
TGKPADLDRDEPRRV

SEQ ID NO: 595102 - protein, 16 aa, Mycobacterium
TGKPADVIRKDTDRDK

SEQ ID NO: 595103 - protein, 16 aa, Mycobacterium
TGKPAELDRDEPRRVA

SEQ ID NO: 595104 - protein, 17 aa, Mycobacterium
TGKPAGPPRSNRRGKVS

SEQ ID NO: 595105 - protein, 6 aa, Mycobacterium
TGKPAH

SEQ ID NO: 595106 - protein, 15 aa, Mycobacterium
TGKPAPLDRDEPRRV

SEQ ID NO: 595107 - protein, 6 aa, Mycobacterium
TGKPAR

SEQ ID NO: 595108 - protein, 15 aa, Mycobacterium
TGKPATLDRDEPRRV

SEQ ID NO: 595109 - protein, 8 aa, Mycobacterium
TGKPDRQI

SEQ ID NO: 595110 - protein, 5 aa, Mycobacterium
TGKPE

SEQ ID NO: 595111 - protein, 10 aa, Mycobacterium
TGKPGVGKSR

SEQ ID NO: 595112 - protein, 9 aa, Mycobacterium
TGKPKPEAY

SEQ ID NO: 595113 - protein, 8 aa, Mycobacterium
TGKPLRPD

SEQ ID NO: 595114 - protein, 5 aa, Mycobacterium
TGKPN

SEQ ID NO: 595115 - protein, 8 aa, Mycobacterium
TGKPNARY

SEQ ID NO: 595116 - protein, 5 aa, Mycobacterium
TGKPP

SEQ ID NO: 595117 - protein, 10 aa, Mycobacterium
TGKPTPAGYA

SEQ ID NO: 595118 - protein, 14 aa, Mycobacterium
TGKPTPAGYAAAGG

SEQ ID NO: 595119 - protein, 6 aa, Mycobacterium
TGKPYD

SEQ ID NO: 595120 - protein, 9 aa, Mycobacterium
TGKQPEALR

SEQ ID NO: 595121 - protein, 4 aa, Mycobacterium
TGKR

SEQ ID NO: 595122 - protein, 8 aa, Mycobacterium
TGKRARPA

SEQ ID NO: 595123 - protein, 13 aa, Mycobacterium
TGKRESKSRPGEG

SEQ ID NO: 595124 - protein, 15 aa, Mycobacterium
TGKRGEYAPPPPKQY

SEQ ID NO: 595125 - protein, 6 aa, Mycobacterium
TGKRNR

SEQ ID NO: 595126 - protein, 4 aa, Mycobacterium
TGKS

SEQ ID NO: 595127 - protein, 8 aa, Mycobacterium
TGKSAGDS

SEQ ID NO: 595128 - protein, 10 aa, Mycobacterium
TGKSAVDAAQ

SEQ ID NO: 595129 - protein, 5 aa, Mycobacterium
TGKSD

SEQ ID NO: 595130 - protein, 19 aa, Mycobacterium
TGKSDQPYGVPSPRLGGAL

SEQ ID NO: 595131 - protein, 18 aa, Mycobacterium
TGKSDQPYGVQSPRFDGA

SEQ ID NO: 595132 - protein, 5 aa, Mycobacterium
TGKSG

SEQ ID NO: 595133 - protein, 9 aa, Mycobacterium
TGKSGTVAL

SEQ ID NO: 595134 - protein, 23 aa, Mycobacterium
TGKSGTVALKPRPDINPDGPTTL

SEQ ID NO: 595135 - protein, 15 aa, Mycobacterium
TGKSPATKDDAQQHA

SEQ ID NO: 595136 - protein, 14 aa, Mycobacterium
TGKSPVSKDDAQAH

SEQ ID NO: 595137 - protein, 15 aa, Mycobacterium
TGKSPVSKDDAQQHA

SEQ ID NO: 595138 - protein, 15 aa, Mycobacterium
TGKSPVTKDDAQNHA

SEQ ID NO: 595139 - protein, 20 aa, Mycobacterium
TGKSSSASRAIDTESSLGQY

SEQ ID NO: 595140 - protein, 8 aa, Mycobacterium
TGKSWGDA

SEQ ID NO: 595141 - protein, 6 aa, Mycobacterium
TGKTSS

SEQ ID NO: 595142 - protein, 17 aa, Mycobacterium
TGKTYAEGNADAAARYG

SEQ ID NO: 595143 - protein, 9 aa, Mycobacterium
TGKVTDDPL

SEQ ID NO: 595144 - protein, 7 aa, Mycobacterium
TGLADEN

SEQ ID NO: 595145 - protein, 8 aa, Mycobacterium
TGLAGEND

SEQ ID NO: 595146 - protein, 10 aa, Mycobacterium
TGLAGGDPHA

SEQ ID NO: 595147 - protein, 9 aa, Mycobacterium
TGLASGNSY

SEQ ID NO: 595148 - protein, 11 aa, Mycobacterium
TGLASGNSYHE

SEQ ID NO: 595149 - protein, 12 aa, Mycobacterium
TGLATDDPRGLT

SEQ ID NO: 595150 - protein, 8 aa, Mycobacterium
TGLDDAAA

SEQ ID NO: 595151 - protein, 16 aa, Mycobacterium
TGLDDEAASTEEPGSI

SEQ ID NO: 595152 - protein, 9 aa, Mycobacterium
TGLDELPQA

SEQ ID NO: 595153 - protein, 5 aa, Mycobacterium
TGLDI

SEQ ID NO: 595154 - protein, 12 aa, Mycobacterium
TGLDPARDATVT

SEQ ID NO: 595155 - protein, 10 aa, Mycobacterium
TGLDPDDEKA

SEQ ID NO: 595156 - protein, 11 aa, Mycobacterium
TGLDPNTTTAG

SEQ ID NO: 595157 - protein, 5 aa, Mycobacterium
TGLDQ

SEQ ID NO: 595158 - protein, 5 aa, Mycobacterium
TGLEE

SEQ ID NO: 595159 - protein, 8 aa, Mycobacterium
TGLERPRS

SEQ ID NO: 595160 - protein, 5 aa, Mycobacterium
TGLET

SEQ ID NO: 595161 - protein, 6 aa, Mycobacterium
TGLETS

SEQ ID NO: 595162 - protein, 4 aa, Mycobacterium
TGLG

SEQ ID NO: 595163 - protein, 8 aa, Mycobacterium
TGLGADPD

SEQ ID NO: 595164 - protein, 7 aa, Mycobacterium
TGLGDKI

SEQ ID NO: 595165 - protein, 8 aa, Mycobacterium
TGLGEGDV

SEQ ID NO: 595166 - protein, 5 aa, Mycobacterium
TGLGG

SEQ ID NO: 595167 - protein, 6 aa, Mycobacterium
TGLGGA

SEQ ID NO: 595168 - protein, 8 aa, Mycobacterium
TGLGGGEK

SEQ ID NO: 595169 - protein, 7 aa, Mycobacterium
TGLGGNS

SEQ ID NO: 595170 - protein, 9 aa, Mycobacterium
TGLGNSGQW

SEQ ID NO: 595171 - protein, 16 aa, Mycobacterium
TGLGNTGDWNVGGGNM

SEQ ID NO: 595172 - protein, 11 aa, Mycobacterium
TGLGPAPVSGS

SEQ ID NO: 595173 - protein, 11 aa, Mycobacterium
TGLGPKTATVA

SEQ ID NO: 595174 - protein, 7 aa, Mycobacterium
TGLGSSE

SEQ ID NO: 595175 - protein, 13 aa, Mycobacterium
TGLGTLDDGSTHL

SEQ ID NO: 595176 - protein, 9 aa, Mycobacterium
TGLKGDAAR

SEQ ID NO: 595177 - protein, 9 aa, Mycobacterium
TGLKGEAAR

SEQ ID NO: 595178 - protein, 28 aa, Mycobacterium
TGLKPARVTGRNVPSDAKAPYDPARADA

SEQ ID NO: 595179 - protein, 10 aa, Mycobacterium
TGLKPKGPSD

SEQ ID NO: 595180 - protein, 7 aa, Mycobacterium
TGLKPTW

SEQ ID NO: 595181 - protein, 5 aa, Mycobacterium
TGLMG

SEQ ID NO: 595182 - protein, 6 aa, Mycobacterium
TGLNNR

SEQ ID NO: 595183 - protein, 12 aa, Mycobacterium
TGLNRNGVPAGY

SEQ ID NO: 595184 - protein, 13 aa, Mycobacterium
TGLNRNGVPPEHY

SEQ ID NO: 595185 - protein, 5 aa, Mycobacterium
TGLPA

SEQ ID NO: 595186 - protein, 6 aa, Mycobacterium
TGLPAA

SEQ ID NO: 595187 - protein, 7 aa, Mycobacterium
TGLPAGE

SEQ ID NO: 595188 - protein, 10 aa, Mycobacterium
TGLPAGPDAA

SEQ ID NO: 595189 - protein, 21 aa, Mycobacterium
TGLPASGTVTDQSLDPEARRA

SEQ ID NO: 595190 - protein, 6 aa, Mycobacterium
TGLPDN

SEQ ID NO: 595191 - protein, 8 aa, Mycobacterium
TGLPDPGP

SEQ ID NO: 595192 - protein, 9 aa, Mycobacterium
TGLPEATTA

SEQ ID NO: 595193 - protein, 5 aa, Mycobacterium
TGLPF

SEQ ID NO: 595194 - protein, 13 aa, Mycobacterium
TGLPGDWQLSTAE

SEQ ID NO: 595195 - protein, 6 aa, Mycobacterium
TGLPKG

SEQ ID NO: 595196 - protein, 7 aa, Mycobacterium
TGLPPEA

SEQ ID NO: 595197 - protein, 17 aa, Mycobacterium
TGLPRGSRTVDSAGCDD

SEQ ID NO: 595198 - protein, 6 aa, Mycobacterium
TGLPRS

SEQ ID NO: 595199 - protein, 21 aa, Mycobacterium
TGLPRSATPVTHRRQPPGRRE

SEQ ID NO: 595200 - protein, 8 aa, Mycobacterium
TGLPRSSA

SEQ ID NO: 595201 - protein, 7 aa, Mycobacterium
TGLPSDD

SEQ ID NO: 595202 - protein, 13 aa, Mycobacterium
TGLPSKTGAPADD

SEQ ID NO: 595203 - protein, 24 aa, Mycobacterium
TGLPSRPGVVTDRGTQLQRAREGV

SEQ ID NO: 595204 - protein, 12 aa, Mycobacterium
TGLPSVADDSGL

SEQ ID NO: 595205 - protein, 10 aa, Mycobacterium
TGLPTEKGRL

SEQ ID NO: 595206 - protein, 8 aa, Mycobacterium
TGLPTGDI

SEQ ID NO: 595207 - protein, 11 aa, Mycobacterium
TGLPVPDRGRL

SEQ ID NO: 595208 - protein, 6 aa, Mycobacterium
TGLREH

SEQ ID NO: 595209 - protein, 13 aa, Mycobacterium
TGLRRRYTQPAGA

SEQ ID NO: 595210 - protein, 14 aa, Mycobacterium
TGLRTAENALPRRG

SEQ ID NO: 595211 - protein, 14 aa, Mycobacterium
TGLRTAQNALPRRG

SEQ ID NO: 595212 - protein, 8 aa, Mycobacterium
TGLRYTPQ

SEQ ID NO: 595213 - protein, 4 aa, Mycobacterium
TGLS

SEQ ID NO: 595214 - protein, 10 aa, Mycobacterium
TGLSADETID

SEQ ID NO: 595215 - protein, 8 aa, Mycobacterium
TGLSDAEG

SEQ ID NO: 595216 - protein, 10 aa, Mycobacterium
TGLSDLGRAQ

SEQ ID NO: 595217 - protein, 6 aa, Mycobacterium
TGLSEL

SEQ ID NO: 595218 - protein, 10 aa, Mycobacterium
TGLSGKAQIG

SEQ ID NO: 595219 - protein, 6 aa, Mycobacterium
TGLSNY

SEQ ID NO: 595220 - protein, 16 aa, Mycobacterium
TGLSPPLTGDDAADWR

SEQ ID NO: 595221 - protein, 9 aa, Mycobacterium
TGLSRDTEL

SEQ ID NO: 595222 - protein, 14 aa, Mycobacterium
TGLSRNGVGAADYP

SEQ ID NO: 595223 - protein, 9 aa, Mycobacterium
TGLSSESKT

SEQ ID NO: 595224 - protein, 9 aa, Mycobacterium
TGLSTMTGG

SEQ ID NO: 595225 - protein, 7 aa, Mycobacterium
TGLTDDT

SEQ ID NO: 595226 - protein, 6 aa, Mycobacterium
TGLTED

SEQ ID NO: 595227 - protein, 14 aa, Mycobacterium
TGLTGGDEARRQPI

SEQ ID NO: 595228 - protein, 6 aa, Mycobacterium
TGLTPR

SEQ ID NO: 595229 - protein, 6 aa, Mycobacterium
TGLTQA

SEQ ID NO: 595230 - protein, 20 aa, Mycobacterium
TGLVDKSNASALVGQSTFAA

SEQ ID NO: 595231 - protein, 10 aa, Mycobacterium
TGLVDPEDTE

SEQ ID NO: 595232 - protein, 10 aa, Mycobacterium
TGLVQPDDTE

SEQ ID NO: 595233 - protein, 22 aa, Mycobacterium
TGLYGPSSVQRAVEEAAREAGY

SEQ ID NO: 595234 - protein, 11 aa, Mycobacterium
TGMAGDDNDVD

SEQ ID NO: 595235 - protein, 9 aa, Mycobacterium
TGMATEAEE

SEQ ID NO: 595236 - protein, 6 aa, Mycobacterium
TGMEPD

SEQ ID NO: 595237 - protein, 14 aa, Mycobacterium
TGMGAAAAKSAAEL

SEQ ID NO: 595238 - protein, 5 aa, Mycobacterium
TGMGG

SEQ ID NO: 595239 - protein, 4 aa, Mycobacterium
TGMI

SEQ ID NO: 595240 - protein, 20 aa, Mycobacterium
TGMIGDPRDVGERTLNTADT

SEQ ID NO: 595241 - protein, 17 aa, Mycobacterium
TGMRTPDPGKVEATAEP

SEQ ID NO: 595242 - protein, 11 aa, Mycobacterium
TGMSGARTGPV

SEQ ID NO: 595243 - protein, 7 aa, Mycobacterium
TGMTDEE

SEQ ID NO: 595244 - protein, 30 aa, Mycobacterium
TGMTGAGGAGGHGGNGAIAGNGGAGANGDM

SEQ ID NO: 595245 - protein, 5 aa, Mycobacterium
TGMTK

SEQ ID NO: 595246 - protein, 6 aa, Mycobacterium
TGMTPA

SEQ ID NO: 595247 - protein, 4 aa, Mycobacterium
TGNA

SEQ ID NO: 595248 - protein, 5 aa, Mycobacterium
TGNAH

SEQ ID NO: 595249 - protein, 7 aa, Mycobacterium
TGNAPAR

SEQ ID NO: 595250 - protein, 10 aa, Mycobacterium
TGNAQPRTRP

SEQ ID NO: 595251 - protein, 12 aa, Mycobacterium
TGNAQQTTHEPY

SEQ ID NO: 595252 - protein, 8 aa, Mycobacterium
TGNCGNRQ

SEQ ID NO: 595253 - protein, 7 aa, Mycobacterium
TGNDART

SEQ ID NO: 595254 - protein, 18 aa, Mycobacterium
TGNDGGASESDPAPTVQS

SEQ ID NO: 595255 - protein, 9 aa, Mycobacterium
TGNDLDATA

SEQ ID NO: 595256 - protein, 13 aa, Mycobacterium
TGNDPTSTAPNAQ

SEQ ID NO: 595257 - protein, 10 aa, Mycobacterium
TGNDQRSHLS

SEQ ID NO: 595258 - protein, 6 aa, Mycobacterium
TGNDTL

SEQ ID NO: 595259 - protein, 7 aa, Mycobacterium
TGNDTNT

SEQ ID NO: 595260 - protein, 8 aa, Mycobacterium
TGNDYAED

SEQ ID NO: 595261 - protein, 56 aa, Mycobacterium
TGNESLTAEGQLEQSQAHERKEANATEAVAEAQANRAQDRAAEARVEGAQQRVAAN

SEQ ID NO: 595262 - protein, 5 aa, Mycobacterium
TGNFG

SEQ ID NO: 595263 - protein, 7 aa, Mycobacterium
TGNGDLA

SEQ ID NO: 595264 - protein, 6 aa, Mycobacterium
TGNGED

SEQ ID NO: 595265 - protein, 16 aa, Mycobacterium
TGNGEGQQTDDNQGVD

SEQ ID NO: 595266 - protein, 8 aa, Mycobacterium
TGNGEQIN

SEQ ID NO: 595267 - protein, 25 aa, Mycobacterium
TGNGLHGPRRAQHRAHPAQHSGQVQ

SEQ ID NO: 595268 - protein, 17 aa, Mycobacterium
TGNGNNLSGYSNPQVDS

SEQ ID NO: 595269 - protein, 6 aa, Mycobacterium
TGNGYH

SEQ ID NO: 595270 - protein, 6 aa, Mycobacterium
TGNGYY

SEQ ID NO: 595271 - protein, 11 aa, Mycobacterium
TGNHDGQLPPI

SEQ ID NO: 595272 - protein, 5 aa, Mycobacterium
TGNHT

SEQ ID NO: 595273 - protein, 12 aa, Mycobacterium
TGNIYEKDGASW

SEQ ID NO: 595274 - protein, 14 aa, Mycobacterium
TGNKSRAVAAARQA

SEQ ID NO: 595275 - protein, 8 aa, Mycobacterium
TGNKTEPF

SEQ ID NO: 595276 - protein, 4 aa, Mycobacterium
TGNN

SEQ ID NO: 595277 - protein, 8 aa, Mycobacterium
TGNNIGDA

SEQ ID NO: 595278 - protein, 6 aa, Mycobacterium
TGNNLT

SEQ ID NO: 595279 - protein, 5 aa, Mycobacterium
TGNNR

SEQ ID NO: 595280 - protein, 13 aa, Mycobacterium
TGNNTYAETDSET

SEQ ID NO: 595281 - protein, 14 aa, Mycobacterium
TGNNTYKAVQRSAG

SEQ ID NO: 595282 - protein, 26 aa, Mycobacterium
TGNPAGTALTTGPADTLGAVGESRGL

SEQ ID NO: 595283 - protein, 8 aa, Mycobacterium
TGNPANTN

SEQ ID NO: 595284 - protein, 9 aa, Mycobacterium
TGNPASEVA

SEQ ID NO: 595285 - protein, 5 aa, Mycobacterium
TGNPI

SEQ ID NO: 595286 - protein, 5 aa, Mycobacterium
TGNPL

SEQ ID NO: 595287 - protein, 8 aa, Mycobacterium
TGNPRQRT

SEQ ID NO: 595288 - protein, 6 aa, Mycobacterium
TGNQEQ

SEQ ID NO: 595289 - protein, 13 aa, Mycobacterium
TGNQIRASGNTNV

SEQ ID NO: 595290 - protein, 4 aa, Mycobacterium
TGNR

SEQ ID NO: 595291 - protein, 5 aa, Mycobacterium
TGNSE

SEQ ID NO: 595292 - protein, 15 aa, Mycobacterium
TGNSFGADGTEGSHG

SEQ ID NO: 595293 - protein, 5 aa, Mycobacterium
TGNYL

SEQ ID NO: 595294 - protein, 10 aa, Mycobacterium
TGNYNGKTAR

SEQ ID NO: 595295 - protein, 9 aa, Mycobacterium
TGNYSTGFA

SEQ ID NO: 595296 - protein, 7 aa, Mycobacterium
TGPAAVS

SEQ ID NO: 595297 - protein, 6 aa, Mycobacterium
TGPADA

SEQ ID NO: 595298 - protein, 15 aa, Mycobacterium
TGPADQLTVTDDRGR

SEQ ID NO: 595299 - protein, 5 aa, Mycobacterium
TGPAE

SEQ ID NO: 595300 - protein, 6 aa, Mycobacterium
TGPAEA

SEQ ID NO: 595301 - protein, 11 aa, Mycobacterium
TGPAELPPDQV

SEQ ID NO: 595302 - protein, 6 aa, Mycobacterium
TGPAEM

SEQ ID NO: 595303 - protein, 20 aa, Mycobacterium
TGPAGALTVTDGRGRPLSAG

SEQ ID NO: 595304 - protein, 12 aa, Mycobacterium
TGPAGEDERQVV

SEQ ID NO: 595305 - protein, 7 aa, Mycobacterium
TGPAGER

SEQ ID NO: 595306 - protein, 12 aa, Mycobacterium
TGPAGSWSEDGV

SEQ ID NO: 595307 - protein, 12 aa, Mycobacterium
TGPAMQTYKGTI

SEQ ID NO: 595308 - protein, 7 aa, Mycobacterium
TGPANGR

SEQ ID NO: 595309 - protein, 9 aa, Mycobacterium
TGPAPDARP

SEQ ID NO: 595310 - protein, 9 aa, Mycobacterium
TGPAPVGYD

SEQ ID NO: 595311 - protein, 9 aa, Mycobacterium
TGPAQRAAP

SEQ ID NO: 595312 - protein, 6 aa, Mycobacterium
TGPARA

SEQ ID NO: 595313 - protein, 19 aa, Mycobacterium
TGPARQVSRPALSPSRAAD

SEQ ID NO: 595314 - protein, 6 aa, Mycobacterium
TGPASG

SEQ ID NO: 595315 - protein, 7 aa, Mycobacterium
TGPASLA

SEQ ID NO: 595316 - protein, 12 aa, Mycobacterium
TGPASPSWRKGP

SEQ ID NO: 595317 - protein, 14 aa, Mycobacterium
TGPASVPDGHGGTL

SEQ ID NO: 595318 - protein, 19 aa, Mycobacterium
TGPAVEAHAGQQAKPVATG

SEQ ID NO: 595319 - protein, 5 aa, Mycobacterium
TGPAW

SEQ ID NO: 595320 - protein, 5 aa, Mycobacterium
TGPCH

SEQ ID NO: 595321 - protein, 4 aa, Mycobacterium
TGPD

SEQ ID NO: 595322 - protein, 5 aa, Mycobacterium
TGPDA

SEQ ID NO: 595323 - protein, 11 aa, Mycobacterium
TGPDAAHPSKV

SEQ ID NO: 595324 - protein, 7 aa, Mycobacterium
TGPDADT

SEQ ID NO: 595325 - protein, 9 aa, Mycobacterium
TGPDAGDHQ

SEQ ID NO: 595326 - protein, 8 aa, Mycobacterium
TGPDATGA

SEQ ID NO: 595327 - protein, 16 aa, Mycobacterium
TGPDATTARTVTAPTS

SEQ ID NO: 595328 - protein, 9 aa, Mycobacterium
TGPDCATTV

SEQ ID NO: 595329 - protein, 5 aa, Mycobacterium
TGPDD

SEQ ID NO: 595330 - protein, 9 aa, Mycobacterium
TGPDEDISR

SEQ ID NO: 595331 - protein, 5 aa, Mycobacterium
TGPDF

SEQ ID NO: 595332 - protein, 7 aa, Mycobacterium
TGPDFPT

SEQ ID NO: 595333 - protein, 5 aa, Mycobacterium
TGPDG

SEQ ID NO: 595334 - protein, 6 aa, Mycobacterium
TGPDGA

SEQ ID NO: 595335 - protein, 12 aa, Mycobacterium
TGPDGAPVSPRD

SEQ ID NO: 595336 - protein, 6 aa, Mycobacterium
TGPDGD

SEQ ID NO: 595337 - protein, 8 aa, Mycobacterium
TGPDGERY

SEQ ID NO: 595338 - protein, 16 aa, Mycobacterium
TGPDGFQRSQADHTYG

SEQ ID NO: 595339 - protein, 10 aa, Mycobacterium
TGPDGPNKTL

SEQ ID NO: 595340 - protein, 7 aa, Mycobacterium
TGPDGRP

SEQ ID NO: 595341 - protein, 6 aa, Mycobacterium
TGPDGS

SEQ ID NO: 595342 - protein, 13 aa, Mycobacterium
TGPDGSPISPQDR

SEQ ID NO: 595343 - protein, 11 aa, Mycobacterium
TGPDGVPIDPA

SEQ ID NO: 595344 - protein, 13 aa, Mycobacterium
TGPDGWRDRQLPD

SEQ ID NO: 595345 - protein, 7 aa, Mycobacterium
TGPDGYD

SEQ ID NO: 595346 - protein, 7 aa, Mycobacterium
TGPDKHR

SEQ ID NO: 595347 - protein, 30 aa, Mycobacterium
TGPDLSSALSARPPEKSAGDASDATVGGTT

SEQ ID NO: 595348 - protein, 12 aa, Mycobacterium
TGPDPDAPAHGP

SEQ ID NO: 595349 - protein, 5 aa, Mycobacterium
TGPDR

SEQ ID NO: 595350 - protein, 6 aa, Mycobacterium
TGPDRF

SEQ ID NO: 595351 - protein, 10 aa, Mycobacterium
TGPDSPNKTL

SEQ ID NO: 595352 - protein, 5 aa, Mycobacterium
TGPDV

SEQ ID NO: 595353 - protein, 6 aa, Mycobacterium
TGPEAL

SEQ ID NO: 595354 - protein, 7 aa, Mycobacterium
TGPEALK

SEQ ID NO: 595355 - protein, 10 aa, Mycobacterium
TGPEGPNKTL

SEQ ID NO: 595356 - protein, 6 aa, Mycobacterium
TGPEHG

SEQ ID NO: 595357 - protein, 7 aa, Mycobacterium
TGPEKIA

SEQ ID NO: 595358 - protein, 7 aa, Mycobacterium
TGPENKL

SEQ ID NO: 595359 - protein, 9 aa, Mycobacterium
TGPEPAERY

SEQ ID NO: 595360 - protein, 9 aa, Mycobacterium
TGPEPGTTT

SEQ ID NO: 595361 - protein, 6 aa, Mycobacterium
TGPEQA

SEQ ID NO: 595362 - protein, 7 aa, Mycobacterium
TGPEREG

SEQ ID NO: 595363 - protein, 6 aa, Mycobacterium
TGPESV

SEQ ID NO: 595364 - protein, 9 aa, Mycobacterium
TGPEVRETR

SEQ ID NO: 595365 - protein, 6 aa, Mycobacterium
TGPEVT

SEQ ID NO: 595366 - protein, 9 aa, Mycobacterium
TGPFATPDA

SEQ ID NO: 595367 - protein, 15 aa, Mycobacterium
TGPFGDQYGKNPGGL

SEQ ID NO: 595368 - protein, 16 aa, Mycobacterium
TGPFGDQYGKNPGGLT

SEQ ID NO: 595369 - protein, 6 aa, Mycobacterium
TGPFGV

SEQ ID NO: 595370 - protein, 5 aa, Mycobacterium
TGPFT

SEQ ID NO: 595371 - protein, 4 aa, Mycobacterium
TGPG

SEQ ID NO: 595372 - protein, 7 aa, Mycobacterium
TGPGADA

SEQ ID NO: 595373 - protein, 8 aa, Mycobacterium
TGPGAGSL

SEQ ID NO: 595374 - protein, 21 aa, Mycobacterium
TGPGALADDNGTELPGMPGNS

SEQ ID NO: 595375 - protein, 14 aa, Mycobacterium
TGPGAQLLRSRCSG

SEQ ID NO: 595376 - protein, 8 aa, Mycobacterium
TGPGAVSP

SEQ ID NO: 595377 - protein, 8 aa, Mycobacterium
TGPGDRSG

SEQ ID NO: 595378 - protein, 10 aa, Mycobacterium
TGPGDSGGSF

SEQ ID NO: 595379 - protein, 7 aa, Mycobacterium
TGPGEGA

SEQ ID NO: 595380 - protein, 10 aa, Mycobacterium
TGPGEGNTAY

SEQ ID NO: 595381 - protein, 6 aa, Mycobacterium
TGPGES

SEQ ID NO: 595382 - protein, 9 aa, Mycobacterium
TGPGEYGEG

SEQ ID NO: 595383 - protein, 11 aa, Mycobacterium
TGPGGTALGSE

SEQ ID NO: 595384 - protein, 11 aa, Mycobacterium
TGPGGTAVASE

SEQ ID NO: 595385 - protein, 8 aa, Mycobacterium
TGPGIPED

SEQ ID NO: 595386 - protein, 10 aa, Mycobacterium
TGPGNDAAGL

SEQ ID NO: 595387 - protein, 8 aa, Mycobacterium
TGPGPLTE

SEQ ID NO: 595388 - protein, 7 aa, Mycobacterium
TGPGPVV

SEQ ID NO: 595389 - protein, 9 aa, Mycobacterium
TGPGQAERS

SEQ ID NO: 595390 - protein, 15 aa, Mycobacterium
TGPGQAERSILPGNP

SEQ ID NO: 595391 - protein, 10 aa, Mycobacterium
TGPGQARRAG

SEQ ID NO: 595392 - protein, 6 aa, Mycobacterium
TGPGQF

SEQ ID NO: 595393 - protein, 8 aa, Mycobacterium
TGPGQLKT

SEQ ID NO: 595394 - protein, 12 aa, Mycobacterium
TGPGQSSPHAFG

SEQ ID NO: 595395 - protein, 6 aa, Mycobacterium
TGPGTF

SEQ ID NO: 595396 - protein, 9 aa, Mycobacterium
TGPGTPSGK

SEQ ID NO: 595397 - protein, 9 aa, Mycobacterium
TGPGTTGLG

SEQ ID NO: 595398 - protein, 7 aa, Mycobacterium
TGPGVDT

SEQ ID NO: 595399 - protein, 8 aa, Mycobacterium
TGPGVEAR

SEQ ID NO: 595400 - protein, 8 aa, Mycobacterium
TGPGVPEE

SEQ ID NO: 595401 - protein, 9 aa, Mycobacterium
TGPGVTDTP

SEQ ID NO: 595402 - protein, 12 aa, Mycobacterium
TGPGVTVLRSRL

SEQ ID NO: 595403 - protein, 5 aa, Mycobacterium
TGPGY

SEQ ID NO: 595404 - protein, 6 aa, Mycobacterium
TGPGYQ

SEQ ID NO: 595405 - protein, 12 aa, Mycobacterium
TGPGYRNDEARA

SEQ ID NO: 595406 - protein, 10 aa, Mycobacterium
TGPHGGGKSS

SEQ ID NO: 595407 - protein, 8 aa, Mycobacterium
TGPHLGPG

SEQ ID NO: 595408 - protein, 10 aa, Mycobacterium
TGPHRVGPAP

SEQ ID NO: 595409 - protein, 6 aa, Mycobacterium
TGPHSI

SEQ ID NO: 595410 - protein, 6 aa, Mycobacterium
TGPIGQ

SEQ ID NO: 595411 - protein, 11 aa, Mycobacterium
TGPIGQNPSGL

SEQ ID NO: 595412 - protein, 5 aa, Mycobacterium
TGPIT

SEQ ID NO: 595413 - protein, 8 aa, Mycobacterium
TGPKDHAA

SEQ ID NO: 595414 - protein, 8 aa, Mycobacterium
TGPKDHAE

SEQ ID NO: 595415 - protein, 9 aa, Mycobacterium
TGPKDHAGS

SEQ ID NO: 595416 - protein, 9 aa, Mycobacterium
TGPKDHASS

SEQ ID NO: 595417 - protein, 9 aa, Mycobacterium
TGPLDPDRL

SEQ ID NO: 595418 - protein, 23 aa, Mycobacterium
TGPLGTATATALANPGFSPPRAF

SEQ ID NO: 595419 - protein, 5 aa, Mycobacterium
TGPLN

SEQ ID NO: 595420 - protein, 6 aa, Mycobacterium
TGPLPA

SEQ ID NO: 595421 - protein, 27 aa, Mycobacterium
TGPLQPTPGVASPGAGASPLGGGGMSS

SEQ ID NO: 595422 - protein, 13 aa, Mycobacterium
TGPLRPSETGRPI

SEQ ID NO: 595423 - protein, 7 aa, Mycobacterium
TGPLSAG

SEQ ID NO: 595424 - protein, 5 aa, Mycobacterium
TGPLT

SEQ ID NO: 595425 - protein, 7 aa, Mycobacterium
TGPLTSR

SEQ ID NO: 595426 - protein, 15 aa, Mycobacterium
TGPNGWTDRQLPDGT

SEQ ID NO: 595427 - protein, 12 aa, Mycobacterium
TGPNTEDTPTIA

SEQ ID NO: 595428 - protein, 4 aa, Mycobacterium
TGPP

SEQ ID NO: 595429 - protein, 7 aa, Mycobacterium
TGPPDEV

SEQ ID NO: 595430 - protein, 13 aa, Mycobacterium
TGPPGAGKSTTIT

SEQ ID NO: 595431 - protein, 12 aa, Mycobacterium
TGPPGAGKSTTV

SEQ ID NO: 595432 - protein, 18 aa, Mycobacterium
TGPPPGGGLADGQALPAA

SEQ ID NO: 595433 - protein, 29 aa, Mycobacterium
TGPPPPTTHPPNRSASPSAPNNPTVPTTC

SEQ ID NO: 595434 - protein, 9 aa, Mycobacterium
TGPPTITND

SEQ ID NO: 595435 - protein, 6 aa, Mycobacterium
TGPPVG

SEQ ID NO: 595436 - protein, 7 aa, Mycobacterium
TGPQAAR

SEQ ID NO: 595437 - protein, 6 aa, Mycobacterium
TGPQAF

SEQ ID NO: 595438 - protein, 21 aa, Mycobacterium
TGPQGTLERSAARALNDQRRT

SEQ ID NO: 595439 - protein, 6 aa, Mycobacterium
TGPQLS

SEQ ID NO: 595440 - protein, 7 aa, Mycobacterium
TGPQSFT

SEQ ID NO: 595441 - protein, 8 aa, Mycobacterium
TGPQSGSI

SEQ ID NO: 595442 - protein, 4 aa, Mycobacterium
TGPR

SEQ ID NO: 595443 - protein, 7 aa, Mycobacterium
TGPRAAD

SEQ ID NO: 595444 - protein, 6 aa, Mycobacterium
TGPRAK

SEQ ID NO: 595445 - protein, 5 aa, Mycobacterium
TGPRG

SEQ ID NO: 595446 - protein, 6 aa, Mycobacterium
TGPRIG

SEQ ID NO: 595447 - protein, 6 aa, Mycobacterium
TGPRPG

SEQ ID NO: 595448 - protein, 9 aa, Mycobacterium
TGPRQPEAK

SEQ ID NO: 595449 - protein, 6 aa, Mycobacterium
TGPRQY

SEQ ID NO: 595450 - protein, 14 aa, Mycobacterium
TGPRTTRERAIEDR

SEQ ID NO: 595451 - protein, 18 aa, Mycobacterium
TGPRWPDVSGNSQATGTR

SEQ ID NO: 595452 - protein, 28 aa, Mycobacterium
TGPRWPDVSGNSQATGTRAVTSGAPSAA

SEQ ID NO: 595453 - protein, 28 aa, Mycobacterium
TGPRWPDVSGNSQATGTRAVTSGSPDPA

SEQ ID NO: 595454 - protein, 28 aa, Mycobacterium
TGPRWPDVSGNSQATGTRAVTTGTPNPA

SEQ ID NO: 595455 - protein, 9 aa, Mycobacterium
TGPSAGLGT

SEQ ID NO: 595456 - protein, 9 aa, Mycobacterium
TGPSDDPFG

SEQ ID NO: 595457 - protein, 5 aa, Mycobacterium
TGPSG

SEQ ID NO: 595458 - protein, 6 aa, Mycobacterium
TGPSMS

SEQ ID NO: 595459 - protein, 9 aa, Mycobacterium
TGPSPTTVT

SEQ ID NO: 595460 - protein, 22 aa, Mycobacterium
TGPSTSPARTAHGGDGSDPDAG

SEQ ID NO: 595461 - protein, 4 aa, Mycobacterium
TGPT

SEQ ID NO: 595462 - protein, 25 aa, Mycobacterium
TGPTADPNRRVTTANAPGAEVGPGQ

SEQ ID NO: 595463 - protein, 8 aa, Mycobacterium
TGPTAGYG

SEQ ID NO: 595464 - protein, 12 aa, Mycobacterium
TGPTAPSWRKGP

SEQ ID NO: 595465 - protein, 6 aa, Mycobacterium
TGPTPR

SEQ ID NO: 595466 - protein, 8 aa, Mycobacterium
TGPTPRVN

SEQ ID NO: 595467 - protein, 11 aa, Mycobacterium
TGPTRTVGSDR

SEQ ID NO: 595468 - protein, 10 aa, Mycobacterium
TGPTTTHSTN

SEQ ID NO: 595469 - protein, 5 aa, Mycobacterium
TGPTY

SEQ ID NO: 595470 - protein, 4 aa, Mycobacterium
TGPV

SEQ ID NO: 595471 - protein, 9 aa, Mycobacterium
TGPVADPAP

SEQ ID NO: 595472 - protein, 12 aa, Mycobacterium
TGPVAIPGPAGQ

SEQ ID NO: 595473 - protein, 9 aa, Mycobacterium
TGPVEPPAR

SEQ ID NO: 595474 - protein, 10 aa, Mycobacterium
TGPVKRAGGI

SEQ ID NO: 595475 - protein, 5 aa, Mycobacterium
TGPVP

SEQ ID NO: 595476 - protein, 12 aa, Mycobacterium
TGPVPEGDADWA

SEQ ID NO: 595477 - protein, 16 aa, Mycobacterium
TGPVPGARVVPAPVTP

SEQ ID NO: 595478 - protein, 16 aa, Mycobacterium
TGPVPGARVVPTPGIA

SEQ ID NO: 595479 - protein, 9 aa, Mycobacterium
TGPVREGDT

SEQ ID NO: 595480 - protein, 8 aa, Mycobacterium
TGPVRPRR

SEQ ID NO: 595481 - protein, 10 aa, Mycobacterium
TGPVTRPTPT

SEQ ID NO: 595482 - protein, 7 aa, Mycobacterium
TGPWTGP

SEQ ID NO: 595483 - protein, 9 aa, Mycobacterium
TGPWTGPSS

SEQ ID NO: 595484 - protein, 5 aa, Mycobacterium
TGPYA

SEQ ID NO: 595485 - protein, 6 aa, Mycobacterium
TGPYGS

SEQ ID NO: 595486 - protein, 7 aa, Mycobacterium
TGPYSDE

SEQ ID NO: 595487 - protein, 7 aa, Mycobacterium
TGPYTDD

SEQ ID NO: 595488 - protein, 10 aa, Mycobacterium
TGQAAAAHAE

SEQ ID NO: 595489 - protein, 7 aa, Mycobacterium
TGQAERL

SEQ ID NO: 595490 - protein, 141 aa, Mycobacterium
TGQANGASASSTSSQDSDRSEPTVTAKAAAGEEAPAEGRSDSGETQRRERRKSSREAGTSAAESGDQAAAGEDAATTDEDAKGRPGQGGARTDERGDKTDERGDKTDEREDSGGEQQGSGGQQARGDEDGEGRQGRRGRRF

SEQ ID NO: 595491 - protein, 5 aa, Mycobacterium
TGQAP

SEQ ID NO: 595492 - protein, 15 aa, Mycobacterium
TGQAPLEPVSYGVFR

SEQ ID NO: 595493 - protein, 7 aa, Mycobacterium
TGQARDS

SEQ ID NO: 595494 - protein, 7 aa, Mycobacterium
TGQARED

SEQ ID NO: 595495 - protein, 13 aa, Mycobacterium
TGQASPMQLGGTS

SEQ ID NO: 595496 - protein, 7 aa, Mycobacterium
TGQATVA

SEQ ID NO: 595497 - protein, 6 aa, Mycobacterium
TGQATW

SEQ ID NO: 595498 - protein, 12 aa, Mycobacterium
TGQAWQADRERA

SEQ ID NO: 595499 - protein, 8 aa, Mycobacterium
TGQCSPEE

SEQ ID NO: 595500 - protein, 4 aa, Mycobacterium
TGQD

SEQ ID NO: 595501 - protein, 5 aa, Mycobacterium
TGQDA

SEQ ID NO: 595502 - protein, 9 aa, Mycobacterium
TGQDPSVSR

SEQ ID NO: 595503 - protein, 10 aa, Mycobacterium
TGQDSAVNDA

SEQ ID NO: 595504 - protein, 11 aa, Mycobacterium
TGQDTRRGTFT

SEQ ID NO: 595505 - protein, 6 aa, Mycobacterium
TGQEAH

SEQ ID NO: 595506 - protein, 12 aa, Mycobacterium
TGQEESRKDGIE

SEQ ID NO: 595507 - protein, 6 aa, Mycobacterium
TGQEFE

SEQ ID NO: 595508 - protein, 6 aa, Mycobacterium
TGQEKI

SEQ ID NO: 595509 - protein, 5 aa, Mycobacterium
TGQEN

SEQ ID NO: 595510 - protein, 6 aa, Mycobacterium
TGQESA

SEQ ID NO: 595511 - protein, 11 aa, Mycobacterium
TGQETSSERET

SEQ ID NO: 595512 - protein, 6 aa, Mycobacterium
TGQFGT

SEQ ID NO: 595513 - protein, 8 aa, Mycobacterium
TGQGAAAL

SEQ ID NO: 595514 - protein, 22 aa, Mycobacterium
TGQGAGEVAQTSGAAGEQQVSA

SEQ ID NO: 595515 - protein, 11 aa, Mycobacterium
TGQGAGEYPTI

SEQ ID NO: 595516 - protein, 5 aa, Mycobacterium
TGQGC

SEQ ID NO: 595517 - protein, 8 aa, Mycobacterium
TGQGEGLA

SEQ ID NO: 595518 - protein, 8 aa, Mycobacterium
TGQGPDTS

SEQ ID NO: 595519 - protein, 8 aa, Mycobacterium
TGQGPTSF

SEQ ID NO: 595520 - protein, 10 aa, Mycobacterium
TGQGSALSAG

SEQ ID NO: 595521 - protein, 6 aa, Mycobacterium
TGQGVE

SEQ ID NO: 595522 - protein, 7 aa, Mycobacterium
TGQHHGP

SEQ ID NO: 595523 - protein, 19 aa, Mycobacterium
TGQHRAPDPIRGNRTQGRV

SEQ ID NO: 595524 - protein, 8 aa, Mycobacterium
TGQIDPET

SEQ ID NO: 595525 - protein, 9 aa, Mycobacterium
TGQKTDDAG

SEQ ID NO: 595526 - protein, 11 aa, Mycobacterium
TGQLSAAGWSD

SEQ ID NO: 595527 - protein, 7 aa, Mycobacterium
TGQLSGS

SEQ ID NO: 595528 - protein, 5 aa, Mycobacterium
TGQMA

SEQ ID NO: 595529 - protein, 8 aa, Mycobacterium
TGQNGGAG

SEQ ID NO: 595530 - protein, 8 aa, Mycobacterium
TGQNNARM

SEQ ID NO: 595531 - protein, 19 aa, Mycobacterium
TGQNPASAGPLAKEFMTEL

SEQ ID NO: 595532 - protein, 20 aa, Mycobacterium
TGQNPGSAKATAKKIVSVLG

SEQ ID NO: 595533 - protein, 5 aa, Mycobacterium
TGQPA

SEQ ID NO: 595534 - protein, 12 aa, Mycobacterium
TGQPAGDDFASP

SEQ ID NO: 595535 - protein, 14 aa, Mycobacterium
TGQPAGTATPTAAQ

SEQ ID NO: 595536 - protein, 13 aa, Mycobacterium
TGQPSDLDPDLAT

SEQ ID NO: 595537 - protein, 7 aa, Mycobacterium
TGQPSPH

SEQ ID NO: 595538 - protein, 13 aa, Mycobacterium
TGQPWSYDEPRYR

SEQ ID NO: 595539 - protein, 6 aa, Mycobacterium
TGQQAK

SEQ ID NO: 595540 - protein, 10 aa, Mycobacterium
TGQQDAERNG

SEQ ID NO: 595541 - protein, 12 aa, Mycobacterium
TGQQFSTTPTTM

SEQ ID NO: 595542 - protein, 8 aa, Mycobacterium
TGQQNKQR

SEQ ID NO: 595543 - protein, 11 aa, Mycobacterium
TGQQPAVDDGK

SEQ ID NO: 595544 - protein, 5 aa, Mycobacterium
TGQQV

SEQ ID NO: 595545 - protein, 6 aa, Mycobacterium
TGQQVE

SEQ ID NO: 595546 - protein, 6 aa, Mycobacterium
TGQRAH

SEQ ID NO: 595547 - protein, 27 aa, Mycobacterium
TGQRAPAATGTALTASAASSSGSARAT

SEQ ID NO: 595548 - protein, 22 aa, Mycobacterium
TGQREPGPAPSFDEYPDEVAEA

SEQ ID NO: 595549 - protein, 5 aa, Mycobacterium
TGQRF

SEQ ID NO: 595550 - protein, 5 aa, Mycobacterium
TGQRG

SEQ ID NO: 595551 - protein, 7 aa, Mycobacterium
TGQRNAI

SEQ ID NO: 595552 - protein, 21 aa, Mycobacterium
TGQRRRSVGAQRALGRAGSAM

SEQ ID NO: 595553 - protein, 8 aa, Mycobacterium
TGQSGAQI

SEQ ID NO: 595554 - protein, 8 aa, Mycobacterium
TGQSGYGG

SEQ ID NO: 595555 - protein, 6 aa, Mycobacterium
TGQSLD

SEQ ID NO: 595556 - protein, 9 aa, Mycobacterium
TGQSLLPGQ

SEQ ID NO: 595557 - protein, 6 aa, Mycobacterium
TGQSMQ

SEQ ID NO: 595558 - protein, 10 aa, Mycobacterium
TGQSPANMDE

SEQ ID NO: 595559 - protein, 13 aa, Mycobacterium
TGQSPTPKPVDAD

SEQ ID NO: 595560 - protein, 11 aa, Mycobacterium
TGQSVADPTRR

SEQ ID NO: 595561 - protein, 6 aa, Mycobacterium
TGQSVS

SEQ ID NO: 595562 - protein, 5 aa, Mycobacterium
TGQTK

SEQ ID NO: 595563 - protein, 6 aa, Mycobacterium
TGQTKY

SEQ ID NO: 595564 - protein, 7 aa, Mycobacterium
TGQTLES

SEQ ID NO: 595565 - protein, 6 aa, Mycobacterium
TGQTLR

SEQ ID NO: 595566 - protein, 7 aa, Mycobacterium
TGQTPLD

SEQ ID NO: 595567 - protein, 11 aa, Mycobacterium
TGQTSGVVPPG

SEQ ID NO: 595568 - protein, 6 aa, Mycobacterium
TGQTSL

SEQ ID NO: 595569 - protein, 11 aa, Mycobacterium
TGQTWPPKPAQ

SEQ ID NO: 595570 - protein, 4 aa, Mycobacterium
TGQV

SEQ ID NO: 595571 - protein, 9 aa, Mycobacterium
TGQVDTGGG

SEQ ID NO: 595572 - protein, 9 aa, Mycobacterium
TGRAADAGA

SEQ ID NO: 595573 - protein, 11 aa, Mycobacterium
TGRADVDSDEL

SEQ ID NO: 595574 - protein, 8 aa, Mycobacterium
TGRAEVRT

SEQ ID NO: 595575 - protein, 7 aa, Mycobacterium
TGRAGDI

SEQ ID NO: 595576 - protein, 7 aa, Mycobacterium
TGRAGEE

SEQ ID NO: 595577 - protein, 11 aa, Mycobacterium
TGRAGSNTAAD

SEQ ID NO: 595578 - protein, 11 aa, Mycobacterium
TGRAGTGKQTW

SEQ ID NO: 595579 - protein, 10 aa, Mycobacterium
TGRANAKTLP

SEQ ID NO: 595580 - protein, 8 aa, Mycobacterium
TGRANPSR

SEQ ID NO: 595581 - protein, 14 aa, Mycobacterium
TGRAPEGWVCQQAG

SEQ ID NO: 595582 - protein, 13 aa, Mycobacterium
TGRAPLKETVTFV

SEQ ID NO: 595583 - protein, 6 aa, Mycobacterium
TGRAPM

SEQ ID NO: 595584 - protein, 8 aa, Mycobacterium
TGRARPAN

SEQ ID NO: 595585 - protein, 13 aa, Mycobacterium
TGRAVSSTTFDSQ

SEQ ID NO: 595586 - protein, 10 aa, Mycobacterium
TGRCPSGVAT

SEQ ID NO: 595587 - protein, 11 aa, Mycobacterium
TGRCPSGVATQ

SEQ ID NO: 595588 - protein, 10 aa, Mycobacterium
TGRDAAVPTP

SEQ ID NO: 595589 - protein, 7 aa, Mycobacterium
TGRDDAG

SEQ ID NO: 595590 - protein, 47 aa, Mycobacterium
TGRDDMKREGQAQQDKADAQRDAAKKEAEAEAARGSAEASEQRQEAN

SEQ ID NO: 595591 - protein, 47 aa, Mycobacterium
TGRDDVKREGQAQQDKADAQRDAAKKEAEAEAARRGADVAEERQKAN

SEQ ID NO: 595592 - protein, 9 aa, Mycobacterium
TGRDEDRDV

SEQ ID NO: 595593 - protein, 7 aa, Mycobacterium
TGRDERR

SEQ ID NO: 595594 - protein, 7 aa, Mycobacterium
TGRDGAQ

SEQ ID NO: 595595 - protein, 12 aa, Mycobacterium
TGRDGLDSSPAN

SEQ ID NO: 595596 - protein, 18 aa, Mycobacterium
TGRDGLPLSPANLSAGER

SEQ ID NO: 595597 - protein, 5 aa, Mycobacterium
TGRDH

SEQ ID NO: 595598 - protein, 10 aa, Mycobacterium
TGRDNRPQTV

SEQ ID NO: 595599 - protein, 9 aa, Mycobacterium
TGRDPAVPR

SEQ ID NO: 595600 - protein, 9 aa, Mycobacterium
TGRDPDTGA

SEQ ID NO: 595601 - protein, 9 aa, Mycobacterium
TGRDPGDDV

SEQ ID NO: 595602 - protein, 11 aa, Mycobacterium
TGRDPGDSAGF

SEQ ID NO: 595603 - protein, 7 aa, Mycobacterium
TGRDPLQ

SEQ ID NO: 595604 - protein, 10 aa, Mycobacterium
TGRDPTSPRD

SEQ ID NO: 595605 - protein, 9 aa, Mycobacterium
TGRDPTVPR

SEQ ID NO: 595606 - protein, 7 aa, Mycobacterium
TGRDQDR

SEQ ID NO: 595607 - protein, 9 aa, Mycobacterium
TGRDRADAA

SEQ ID NO: 595608 - protein, 11 aa, Mycobacterium
TGRDRDDVEEA

SEQ ID NO: 595609 - protein, 8 aa, Mycobacterium
TGRDSAAC

SEQ ID NO: 595610 - protein, 9 aa, Mycobacterium
TGRDTDPEF

SEQ ID NO: 595611 - protein, 5 aa, Mycobacterium
TGRDV

SEQ ID NO: 595612 - protein, 10 aa, Mycobacterium
TGRDVARPRD

SEQ ID NO: 595613 - protein, 4 aa, Mycobacterium
TGRE

SEQ ID NO: 595614 - protein, 10 aa, Mycobacterium
TGREADDLTA

SEQ ID NO: 595615 - protein, 10 aa, Mycobacterium
TGREADDVTA

SEQ ID NO: 595616 - protein, 9 aa, Mycobacterium
TGREADELT

SEQ ID NO: 595617 - protein, 7 aa, Mycobacterium
TGRELTD

SEQ ID NO: 595618 - protein, 5 aa, Mycobacterium
TGRER

SEQ ID NO: 595619 - protein, 11 aa, Mycobacterium
TGREVRDTKVG

SEQ ID NO: 595620 - protein, 16 aa, Mycobacterium
TGRFAPSSDPTHGNTL

SEQ ID NO: 595621 - protein, 4 aa, Mycobacterium
TGRG

SEQ ID NO: 595622 - protein, 12 aa, Mycobacterium
TGRGADPIDWRL

SEQ ID NO: 595623 - protein, 8 aa, Mycobacterium
TGRGDDVG

SEQ ID NO: 595624 - protein, 14 aa, Mycobacterium
TGRGDVRRGQPPAA

SEQ ID NO: 595625 - protein, 7 aa, Mycobacterium
TGRGDYR

SEQ ID NO: 595626 - protein, 7 aa, Mycobacterium
TGRGEEL

SEQ ID NO: 595627 - protein, 14 aa, Mycobacterium
TGRGETRKVGHRDR

SEQ ID NO: 595628 - protein, 6 aa, Mycobacterium
TGRGGL

SEQ ID NO: 595629 - protein, 8 aa, Mycobacterium
TGRGGTGA

SEQ ID NO: 595630 - protein, 6 aa, Mycobacterium
TGRGGW

SEQ ID NO: 595631 - protein, 8 aa, Mycobacterium
TGRGNPDG

SEQ ID NO: 595632 - protein, 12 aa, Mycobacterium
TGRGPDGPVSFT

SEQ ID NO: 595633 - protein, 6 aa, Mycobacterium
TGRGQP

SEQ ID NO: 595634 - protein, 9 aa, Mycobacterium
TGRGTAAER

SEQ ID NO: 595635 - protein, 7 aa, Mycobacterium
TGRGTEQ

SEQ ID NO: 595636 - protein, 9 aa, Mycobacterium
TGRGTESES

SEQ ID NO: 595637 - protein, 10 aa, Mycobacterium
TGRGTIDGRP

SEQ ID NO: 595638 - protein, 16 aa, Mycobacterium
TGRGVDAGDQQLTPQE

SEQ ID NO: 595639 - protein, 6 aa, Mycobacterium
TGRGVE

SEQ ID NO: 595640 - protein, 6 aa, Mycobacterium
TGRGVG

SEQ ID NO: 595641 - protein, 5 aa, Mycobacterium
TGRHY

SEQ ID NO: 595642 - protein, 4 aa, Mycobacterium
TGRI

SEQ ID NO: 595643 - protein, 10 aa, Mycobacterium
TGRIGTPDDI

SEQ ID NO: 595644 - protein, 4 aa, Mycobacterium
TGRK

SEQ ID NO: 595645 - protein, 14 aa, Mycobacterium
TGRKSGKPRRTAVG

SEQ ID NO: 595646 - protein, 9 aa, Mycobacterium
TGRKTGQQR

SEQ ID NO: 595647 - protein, 4 aa, Mycobacterium
TGRL

SEQ ID NO: 595648 - protein, 10 aa, Mycobacterium
TGRLNDAARN

SEQ ID NO: 595649 - protein, 8 aa, Mycobacterium
TGRLPSPA

SEQ ID NO: 595650 - protein, 8 aa, Mycobacterium
TGRLPTPA

SEQ ID NO: 595651 - protein, 8 aa, Mycobacterium
TGRLTGGQ

SEQ ID NO: 595652 - protein, 8 aa, Mycobacterium
TGRNADKL

SEQ ID NO: 595653 - protein, 12 aa, Mycobacterium
TGRNCRPTNDQL

SEQ ID NO: 595654 - protein, 10 aa, Mycobacterium
TGRNGAGKTT

SEQ ID NO: 595655 - protein, 12 aa, Mycobacterium
TGRNGLDSSPAN

SEQ ID NO: 595656 - protein, 6 aa, Mycobacterium
TGRNKV

SEQ ID NO: 595657 - protein, 5 aa, Mycobacterium
TGRNM

SEQ ID NO: 595658 - protein, 6 aa, Mycobacterium
TGRNMA

SEQ ID NO: 595659 - protein, 7 aa, Mycobacterium
TGRNQHG

SEQ ID NO: 595660 - protein, 9 aa, Mycobacterium
TGRNQRGDV

SEQ ID NO: 595661 - protein, 11 aa, Mycobacterium
TGRNVADPRRR

SEQ ID NO: 595662 - protein, 11 aa, Mycobacterium
TGRPADAEYGS

SEQ ID NO: 595663 - protein, 11 aa, Mycobacterium
TGRPAGPGYGS

SEQ ID NO: 595664 - protein, 7 aa, Mycobacterium
TGRPAGT

SEQ ID NO: 595665 - protein, 9 aa, Mycobacterium
TGRPAHAPV

SEQ ID NO: 595666 - protein, 11 aa, Mycobacterium
TGRPAKPTAAS

SEQ ID NO: 595667 - protein, 7 aa, Mycobacterium
TGRPDLR

SEQ ID NO: 595668 - protein, 9 aa, Mycobacterium
TGRPEWTGV

SEQ ID NO: 595669 - protein, 6 aa, Mycobacterium
TGRPFS

SEQ ID NO: 595670 - protein, 6 aa, Mycobacterium
TGRPGD

SEQ ID NO: 595671 - protein, 8 aa, Mycobacterium
TGRPGRNL

SEQ ID NO: 595672 - protein, 6 aa, Mycobacterium
TGRPGV

SEQ ID NO: 595673 - protein, 7 aa, Mycobacterium
TGRPIGA

SEQ ID NO: 595674 - protein, 5 aa, Mycobacterium
TGRPK

SEQ ID NO: 595675 - protein, 5 aa, Mycobacterium
TGRPL

SEQ ID NO: 595676 - protein, 5 aa, Mycobacterium
TGRPN

SEQ ID NO: 595677 - protein, 7 aa, Mycobacterium
TGRPPQV

SEQ ID NO: 595678 - protein, 11 aa, Mycobacterium
TGRPPRAIPDP

SEQ ID NO: 595679 - protein, 6 aa, Mycobacterium
TGRPQR

SEQ ID NO: 595680 - protein, 8 aa, Mycobacterium
TGRPQRIG

SEQ ID NO: 595681 - protein, 7 aa, Mycobacterium
TGRPQRL

SEQ ID NO: 595682 - protein, 8 aa, Mycobacterium
TGRPRPAN

SEQ ID NO: 595683 - protein, 8 aa, Mycobacterium
TGRPSPAH

SEQ ID NO: 595684 - protein, 5 aa, Mycobacterium
TGRPT

SEQ ID NO: 595685 - protein, 8 aa, Mycobacterium
TGRPTGEW

SEQ ID NO: 595686 - protein, 9 aa, Mycobacterium
TGRPTGEWA

SEQ ID NO: 595687 - protein, 11 aa, Mycobacterium
TGRPTPTPHPE

SEQ ID NO: 595688 - protein, 5 aa, Mycobacterium
TGRPV

SEQ ID NO: 595689 - protein, 7 aa, Mycobacterium
TGRPVQR

SEQ ID NO: 595690 - protein, 16 aa, Mycobacterium
TGRPYYAPDGAAHDPY

SEQ ID NO: 595691 - protein, 11 aa, Mycobacterium
TGRQAAEKDGF

SEQ ID NO: 595692 - protein, 8 aa, Mycobacterium
TGRQAESA

SEQ ID NO: 595693 - protein, 5 aa, Mycobacterium
TGRQI

SEQ ID NO: 595694 - protein, 14 aa, Mycobacterium
TGRQRSTGEADPVD

SEQ ID NO: 595695 - protein, 10 aa, Mycobacterium
TGRQSRPATH

SEQ ID NO: 595696 - protein, 5 aa, Mycobacterium
TGRQT

SEQ ID NO: 595697 - protein, 12 aa, Mycobacterium
TGRQVQRETPLP

SEQ ID NO: 595698 - protein, 11 aa, Mycobacterium
TGRRARRGRGA

SEQ ID NO: 595699 - protein, 11 aa, Mycobacterium
TGRRDGDDAEL

SEQ ID NO: 595700 - protein, 25 aa, Mycobacterium
TGRREAAEEAADRLAAQAGASGTDW

SEQ ID NO: 595701 - protein, 10 aa, Mycobacterium
TGRRLSGTVT

SEQ ID NO: 595702 - protein, 7 aa, Mycobacterium
TGRRPGE

SEQ ID NO: 595703 - protein, 7 aa, Mycobacterium
TGRRPGW

SEQ ID NO: 595704 - protein, 6 aa, Mycobacterium
TGRRPH

SEQ ID NO: 595705 - protein, 10 aa, Mycobacterium
TGRRPNTDGL

SEQ ID NO: 595706 - protein, 16 aa, Mycobacterium
TGRRPTHTNDQAPLPK

SEQ ID NO: 595707 - protein, 6 aa, Mycobacterium
TGRRPV

SEQ ID NO: 595708 - protein, 6 aa, Mycobacterium
TGRRRD

SEQ ID NO: 595709 - protein, 13 aa, Mycobacterium
TGRRRGPDGNHHP

SEQ ID NO: 595710 - protein, 6 aa, Mycobacterium
TGRRRP

SEQ ID NO: 595711 - protein, 12 aa, Mycobacterium
TGRRSAINGRRG

SEQ ID NO: 595712 - protein, 8 aa, Mycobacterium
TGRRSGQI

SEQ ID NO: 595713 - protein, 9 aa, Mycobacterium
TGRRSGRPF

SEQ ID NO: 595714 - protein, 12 aa, Mycobacterium
TGRRTWPPQPSQ

SEQ ID NO: 595715 - protein, 10 aa, Mycobacterium
TGRSAAAPVP

SEQ ID NO: 595716 - protein, 10 aa, Mycobacterium
TGRSAAVPSP

SEQ ID NO: 595717 - protein, 9 aa, Mycobacterium
TGRSAGTAV

SEQ ID NO: 595718 - protein, 10 aa, Mycobacterium
TGRSAGTAVP

SEQ ID NO: 595719 - protein, 10 aa, Mycobacterium
TGRSATVPTP

SEQ ID NO: 595720 - protein, 8 aa, Mycobacterium
TGRSDNKA

SEQ ID NO: 595721 - protein, 9 aa, Mycobacterium
TGRSDYPNQ

SEQ ID NO: 595722 - protein, 5 aa, Mycobacterium
TGRSG

SEQ ID NO: 595723 - protein, 21 aa, Mycobacterium
TGRSGGLPAADDAPLTPNAGT

SEQ ID NO: 595724 - protein, 6 aa, Mycobacterium
TGRSGL

SEQ ID NO: 595725 - protein, 7 aa, Mycobacterium
TGRSGPH

SEQ ID NO: 595726 - protein, 22 aa, Mycobacterium
TGRSGSATLKPRPDINPDGPTT

SEQ ID NO: 595727 - protein, 6 aa, Mycobacterium
TGRSIE

SEQ ID NO: 595728 - protein, 6 aa, Mycobacterium
TGRSIG

SEQ ID NO: 595729 - protein, 14 aa, Mycobacterium
TGRSNAPEPALDPE

SEQ ID NO: 595730 - protein, 12 aa, Mycobacterium
TGRSPSEFRLSP

SEQ ID NO: 595731 - protein, 12 aa, Mycobacterium
TGRSPSEYRRSQ

SEQ ID NO: 595732 - protein, 7 aa, Mycobacterium
TGRSQRA

SEQ ID NO: 595733 - protein, 9 aa, Mycobacterium
TGRSRESIP

SEQ ID NO: 595734 - protein, 5 aa, Mycobacterium
TGRSV

SEQ ID NO: 595735 - protein, 6 aa, Mycobacterium
TGRSVR

SEQ ID NO: 595736 - protein, 6 aa, Mycobacterium
TGRTEL

SEQ ID NO: 595737 - protein, 10 aa, Mycobacterium
TGRTFGSGPH

SEQ ID NO: 595738 - protein, 13 aa, Mycobacterium
TGRTGPGAGRTSK

SEQ ID NO: 595739 - protein, 27 aa, Mycobacterium
TGRTKKELAAAEGISPSAVSQRASRDG

SEQ ID NO: 595740 - protein, 5 aa, Mycobacterium
TGRTL

SEQ ID NO: 595741 - protein, 14 aa, Mycobacterium
TGRTPDALRAVDPL

SEQ ID NO: 595742 - protein, 8 aa, Mycobacterium
TGRTPRTQ

SEQ ID NO: 595743 - protein, 10 aa, Mycobacterium
TGRTPTSGDL

SEQ ID NO: 595744 - protein, 5 aa, Mycobacterium
TGRTR

SEQ ID NO: 595745 - protein, 10 aa, Mycobacterium
TGRTRADVDE

SEQ ID NO: 595746 - protein, 7 aa, Mycobacterium
TGRTRRR

SEQ ID NO: 595747 - protein, 7 aa, Mycobacterium
TGRTRVP

SEQ ID NO: 595748 - protein, 8 aa, Mycobacterium
TGRTSTPV

SEQ ID NO: 595749 - protein, 9 aa, Mycobacterium
TGRTTETKQ

SEQ ID NO: 595750 - protein, 7 aa, Mycobacterium
TGRVEGR

SEQ ID NO: 595751 - protein, 8 aa, Mycobacterium
TGRVEGRS

SEQ ID NO: 595752 - protein, 9 aa, Mycobacterium
TGRVKRPQV

SEQ ID NO: 595753 - protein, 19 aa, Mycobacterium
TGRVPARSAAQGACGDGRG

SEQ ID NO: 595754 - protein, 13 aa, Mycobacterium
TGRWARKDKRSFT

SEQ ID NO: 595755 - protein, 8 aa, Mycobacterium
TGRYPDRN

SEQ ID NO: 595756 - protein, 12 aa, Mycobacterium
TGRYPGEDQDPA

SEQ ID NO: 595757 - protein, 7 aa, Mycobacterium
TGRYPSP

SEQ ID NO: 595758 - protein, 9 aa, Mycobacterium
TGRYSELDA

SEQ ID NO: 595759 - protein, 12 aa, Mycobacterium
TGSADEGATFTP

SEQ ID NO: 595760 - protein, 6 aa, Mycobacterium
TGSADV

SEQ ID NO: 595761 - protein, 5 aa, Mycobacterium
TGSAE

SEQ ID NO: 595762 - protein, 10 aa, Mycobacterium
TGSAETRGPR

SEQ ID NO: 595763 - protein, 16 aa, Mycobacterium
TGSAGAALQSEPRTPM

SEQ ID NO: 595764 - protein, 20 aa, Mycobacterium
TGSAGAPDDGGLNRTDDLDR

SEQ ID NO: 595765 - protein, 9 aa, Mycobacterium
TGSAGGPTF

SEQ ID NO: 595766 - protein, 10 aa, Mycobacterium
TGSAGPDGRL

SEQ ID NO: 595767 - protein, 11 aa, Mycobacterium
TGSAITQQSVA

SEQ ID NO: 595768 - protein, 15 aa, Mycobacterium
TGSAKSDRTGTGTRS

SEQ ID NO: 595769 - protein, 5 aa, Mycobacterium
TGSAP

SEQ ID NO: 595770 - protein, 8 aa, Mycobacterium
TGSAPAAR

SEQ ID NO: 595771 - protein, 6 aa, Mycobacterium
TGSAPE

SEQ ID NO: 595772 - protein, 8 aa, Mycobacterium
TGSAPISA

SEQ ID NO: 595773 - protein, 9 aa, Mycobacterium
TGSAPQTRS

SEQ ID NO: 595774 - protein, 9 aa, Mycobacterium
TGSAPQTRT

SEQ ID NO: 595775 - protein, 18 aa, Mycobacterium
TGSAPRGWYGGRDSPHTR

SEQ ID NO: 595776 - protein, 10 aa, Mycobacterium
TGSAPRNIPA

SEQ ID NO: 595777 - protein, 9 aa, Mycobacterium
TGSAPRTRT

SEQ ID NO: 595778 - protein, 6 aa, Mycobacterium
TGSARI

SEQ ID NO: 595779 - protein, 19 aa, Mycobacterium
TGSASGGVEVGTEVGGEIP

SEQ ID NO: 595780 - protein, 10 aa, Mycobacterium
TGSASGVEDR

SEQ ID NO: 595781 - protein, 9 aa, Mycobacterium
TGSASSIAA

SEQ ID NO: 595782 - protein, 8 aa, Mycobacterium
TGSATAGQ

SEQ ID NO: 595783 - protein, 5 aa, Mycobacterium
TGSDA

SEQ ID NO: 595784 - protein, 10 aa, Mycobacterium
TGSDAKERGL

SEQ ID NO: 595785 - protein, 13 aa, Mycobacterium
TGSDAPELDASVA

SEQ ID NO: 595786 - protein, 6 aa, Mycobacterium
TGSDAQ

SEQ ID NO: 595787 - protein, 9 aa, Mycobacterium
TGSDDGTQD

SEQ ID NO: 595788 - protein, 9 aa, Mycobacterium
TGSDEDINR

SEQ ID NO: 595789 - protein, 9 aa, Mycobacterium
TGSDEGEEV

SEQ ID NO: 595790 - protein, 7 aa, Mycobacterium
TGSDGEA

SEQ ID NO: 595791 - protein, 9 aa, Mycobacterium
TGSDGPGPT

SEQ ID NO: 595792 - protein, 9 aa, Mycobacterium
TGSDGPKGI

SEQ ID NO: 595793 - protein, 10 aa, Mycobacterium
TGSDHDEVAY

SEQ ID NO: 595794 - protein, 12 aa, Mycobacterium
TGSDLVAVIDRL

SEQ ID NO: 595795 - protein, 31 aa, Mycobacterium
TGSDMYPDGTRTSVHPGPLGDDLEGSSRPGH

SEQ ID NO: 595796 - protein, 8 aa, Mycobacterium
TGSDPALA

SEQ ID NO: 595797 - protein, 17 aa, Mycobacterium
TGSDPLGRGKAAQSARS

SEQ ID NO: 595798 - protein, 7 aa, Mycobacterium
TGSDPRI

SEQ ID NO: 595799 - protein, 9 aa, Mycobacterium
TGSDRPPPD

SEQ ID NO: 595800 - protein, 6 aa, Mycobacterium
TGSDRQ

SEQ ID NO: 595801 - protein, 21 aa, Mycobacterium
TGSDSASAASIAEGRPDLAGP

SEQ ID NO: 595802 - protein, 8 aa, Mycobacterium
TGSDSGDA

SEQ ID NO: 595803 - protein, 7 aa, Mycobacterium
TGSDSGL

SEQ ID NO: 595804 - protein, 9 aa, Mycobacterium
TGSDSTPGL

SEQ ID NO: 595805 - protein, 21 aa, Mycobacterium
TGSDTASAESIARGRPDLAGP

SEQ ID NO: 595806 - protein, 5 aa, Mycobacterium
TGSDV

SEQ ID NO: 595807 - protein, 10 aa, Mycobacterium
TGSDVTRFTN

SEQ ID NO: 595808 - protein, 6 aa, Mycobacterium
TGSEAT

SEQ ID NO: 595809 - protein, 7 aa, Mycobacterium
TGSEATV

SEQ ID NO: 595810 - protein, 6 aa, Mycobacterium
TGSEDP

SEQ ID NO: 595811 - protein, 13 aa, Mycobacterium
TGSEESGGSGAGW

SEQ ID NO: 595812 - protein, 15 aa, Mycobacterium
TGSEESGGSGAGWRE

SEQ ID NO: 595813 - protein, 5 aa, Mycobacterium
TGSEF

SEQ ID NO: 595814 - protein, 17 aa, Mycobacterium
TGSELVPPGTPLRPGQI

SEQ ID NO: 595815 - protein, 13 aa, Mycobacterium
TGSEMHHTDENTL

SEQ ID NO: 595816 - protein, 6 aa, Mycobacterium
TGSEPV

SEQ ID NO: 595817 - protein, 8 aa, Mycobacterium
TGSEQDRL

SEQ ID NO: 595818 - protein, 11 aa, Mycobacterium
TGSERGGSGNY

SEQ ID NO: 595819 - protein, 5 aa, Mycobacterium
TGSES

SEQ ID NO: 595820 - protein, 9 aa, Mycobacterium
TGSESQKKR

SEQ ID NO: 595821 - protein, 9 aa, Mycobacterium
TGSFDGDGV

SEQ ID NO: 595822 - protein, 6 aa, Mycobacterium
TGSFGD

SEQ ID NO: 595823 - protein, 7 aa, Mycobacterium
TGSFTTP

SEQ ID NO: 595824 - protein, 4 aa, Mycobacterium
TGSG

SEQ ID NO: 595825 - protein, 9 aa, Mycobacterium
TGSGADVGA

SEQ ID NO: 595826 - protein, 9 aa, Mycobacterium
TGSGAPTAS

SEQ ID NO: 595827 - protein, 9 aa, Mycobacterium
TGSGAQGRY

SEQ ID NO: 595828 - protein, 14 aa, Mycobacterium
TGSGATESDESVAP

SEQ ID NO: 595829 - protein, 6 aa, Mycobacterium
TGSGDP

SEQ ID NO: 595830 - protein, 5 aa, Mycobacterium
TGSGF

SEQ ID NO: 595831 - protein, 7 aa, Mycobacterium
TGSGGIG

SEQ ID NO: 595832 - protein, 11 aa, Mycobacterium
TGSGGKPSDGI

SEQ ID NO: 595833 - protein, 8 aa, Mycobacterium
TGSGGKSL

SEQ ID NO: 595834 - protein, 6 aa, Mycobacterium
TGSGGL

SEQ ID NO: 595835 - protein, 14 aa, Mycobacterium
TGSGGSRPSGGWER

SEQ ID NO: 595836 - protein, 5 aa, Mycobacterium
TGSGH

SEQ ID NO: 595837 - protein, 7 aa, Mycobacterium
TGSGHHH

SEQ ID NO: 595838 - protein, 5 aa, Mycobacterium
TGSGI

SEQ ID NO: 595839 - protein, 6 aa, Mycobacterium
TGSGIR

SEQ ID NO: 595840 - protein, 5 aa, Mycobacterium
TGSGK

SEQ ID NO: 595841 - protein, 8 aa, Mycobacterium
TGSGKTRT

SEQ ID NO: 595842 - protein, 6 aa, Mycobacterium
TGSGKV

SEQ ID NO: 595843 - protein, 21 aa, Mycobacterium
TGSGLPAAPGAQHDVAGTGSM

SEQ ID NO: 595844 - protein, 7 aa, Mycobacterium
TGSGLQP

SEQ ID NO: 595845 - protein, 49 aa, Mycobacterium
TGSGNDGFGNSGTGTNGIANSGTFSSGIANSGTNSSGGFNTGDDQSGFF

SEQ ID NO: 595846 - protein, 12 aa, Mycobacterium
TGSGPLAPPALT

SEQ ID NO: 595847 - protein, 6 aa, Mycobacterium
TGSGPM

SEQ ID NO: 595848 - protein, 7 aa, Mycobacterium
TGSGPVA

SEQ ID NO: 595849 - protein, 14 aa, Mycobacterium
TGSGTLAPGMPTDG

SEQ ID NO: 595850 - protein, 11 aa, Mycobacterium
TGSGTSSNMNA

SEQ ID NO: 595851 - protein, 5 aa, Mycobacterium
TGSGV

SEQ ID NO: 595852 - protein, 9 aa, Mycobacterium
TGSGVAPGL

SEQ ID NO: 595853 - protein, 8 aa, Mycobacterium
TGSGYSSV

SEQ ID NO: 595854 - protein, 8 aa, Mycobacterium
TGSHSGIQ

SEQ ID NO: 595855 - protein, 4 aa, Mycobacterium
TGSI

SEQ ID NO: 595856 - protein, 17 aa, Mycobacterium
TGSIDARDHDLEPAGTY

SEQ ID NO: 595857 - protein, 4 aa, Mycobacterium
TGSK

SEQ ID NO: 595858 - protein, 13 aa, Mycobacterium
TGSLEASARRHGA

SEQ ID NO: 595859 - protein, 7 aa, Mycobacterium
TGSLGAA

SEQ ID NO: 595860 - protein, 8 aa, Mycobacterium
TGSLGRAA

SEQ ID NO: 595861 - protein, 5 aa, Mycobacterium
TGSLH

SEQ ID NO: 595862 - protein, 14 aa, Mycobacterium
TGSLNGGCNPRNDI

SEQ ID NO: 595863 - protein, 17 aa, Mycobacterium
TGSLNKAQSVANEDGGY

SEQ ID NO: 595864 - protein, 7 aa, Mycobacterium
TGSLRDG

SEQ ID NO: 595865 - protein, 11 aa, Mycobacterium
TGSLSTPSSWG

SEQ ID NO: 595866 - protein, 4 aa, Mycobacterium
TGSN

SEQ ID NO: 595867 - protein, 19 aa, Mycobacterium
TGSNDPQKFDPDASRETLD

SEQ ID NO: 595868 - protein, 10 aa, Mycobacterium
TGSNGAGKST

SEQ ID NO: 595869 - protein, 6 aa, Mycobacterium
TGSNNA

SEQ ID NO: 595870 - protein, 7 aa, Mycobacterium
TGSNSLG

SEQ ID NO: 595871 - protein, 8 aa, Mycobacterium
TGSPAALA

SEQ ID NO: 595872 - protein, 10 aa, Mycobacterium
TGSPAEVART

SEQ ID NO: 595873 - protein, 25 aa, Mycobacterium
TGSPAPAEAGTPEGGPVAAPSGPSV

SEQ ID NO: 595874 - protein, 10 aa, Mycobacterium
TGSPAQIADQ

SEQ ID NO: 595875 - protein, 6 aa, Mycobacterium
TGSPDI

SEQ ID NO: 595876 - protein, 7 aa, Mycobacterium
TGSPDIT

SEQ ID NO: 595877 - protein, 6 aa, Mycobacterium
TGSPEV

SEQ ID NO: 595878 - protein, 5 aa, Mycobacterium
TGSPF

SEQ ID NO: 595879 - protein, 8 aa, Mycobacterium
TGSPGCAR

SEQ ID NO: 595880 - protein, 15 aa, Mycobacterium
TGSPGGDDMGATADA

SEQ ID NO: 595881 - protein, 10 aa, Mycobacterium
TGSPGYQPTE

SEQ ID NO: 595882 - protein, 8 aa, Mycobacterium
TGSPIGPL

SEQ ID NO: 595883 - protein, 10 aa, Mycobacterium
TGSPLAGTTW

SEQ ID NO: 595884 - protein, 9 aa, Mycobacterium
TGSPLGQPI

SEQ ID NO: 595885 - protein, 22 aa, Mycobacterium
TGSPNELDGSPNRGYKVRPKGG

SEQ ID NO: 595886 - protein, 9 aa, Mycobacterium
TGSPRHTAT

SEQ ID NO: 595887 - protein, 10 aa, Mycobacterium
TGSPRTAEDI

SEQ ID NO: 595888 - protein, 10 aa, Mycobacterium
TGSPRTAQSV

SEQ ID NO: 595889 - protein, 30 aa, Mycobacterium
TGSPSPSAEAGEHGAGHGGGSGQASGETLT

SEQ ID NO: 595890 - protein, 15 aa, Mycobacterium
TGSPVRHDDPAQAAR

SEQ ID NO: 595891 - protein, 7 aa, Mycobacterium
TGSPYGL

SEQ ID NO: 595892 - protein, 4 aa, Mycobacterium
TGSQ

SEQ ID NO: 595893 - protein, 5 aa, Mycobacterium
TGSQI

SEQ ID NO: 595894 - protein, 11 aa, Mycobacterium
TGSRAANAGPV

SEQ ID NO: 595895 - protein, 7 aa, Mycobacterium
TGSRAGG

SEQ ID NO: 595896 - protein, 7 aa, Mycobacterium
TGSREQH

SEQ ID NO: 595897 - protein, 18 aa, Mycobacterium
TGSRHPEQRERQAAGSAA

SEQ ID NO: 595898 - protein, 18 aa, Mycobacterium
TGSRHPEQVERQRDGNTA

SEQ ID NO: 595899 - protein, 13 aa, Mycobacterium
TGSRKERNLRRDP

SEQ ID NO: 595900 - protein, 8 aa, Mycobacterium
TGSRPEVD

SEQ ID NO: 595901 - protein, 15 aa, Mycobacterium
TGSRPRPRTADGGYM

SEQ ID NO: 595902 - protein, 8 aa, Mycobacterium
TGSRRQRT

SEQ ID NO: 595903 - protein, 13 aa, Mycobacterium
TGSRSGGGSHNGS

SEQ ID NO: 595904 - protein, 14 aa, Mycobacterium
TGSRTAGDPTVPGI

SEQ ID NO: 595905 - protein, 7 aa, Mycobacterium
TGSRTTA

SEQ ID NO: 595906 - protein, 8 aa, Mycobacterium
TGSRTTAA

SEQ ID NO: 595907 - protein, 6 aa, Mycobacterium
TGSRVR

SEQ ID NO: 595908 - protein, 6 aa, Mycobacterium
TGSRYA

SEQ ID NO: 595909 - protein, 9 aa, Mycobacterium
TGSSATGRR

SEQ ID NO: 595910 - protein, 10 aa, Mycobacterium
TGSSAVGKEI

SEQ ID NO: 595911 - protein, 11 aa, Mycobacterium
TGSSDGTQDTI

SEQ ID NO: 595912 - protein, 7 aa, Mycobacterium
TGSSERP

SEQ ID NO: 595913 - protein, 5 aa, Mycobacterium
TGSSG

SEQ ID NO: 595914 - protein, 8 aa, Mycobacterium
TGSSGFRR

SEQ ID NO: 595915 - protein, 7 aa, Mycobacterium
TGSSGGM

SEQ ID NO: 595916 - protein, 7 aa, Mycobacterium
TGSSGLV

SEQ ID NO: 595917 - protein, 6 aa, Mycobacterium
TGSSGT

SEQ ID NO: 595918 - protein, 7 aa, Mycobacterium
TGSSIAD

SEQ ID NO: 595919 - protein, 8 aa, Mycobacterium
TGSSISPP

SEQ ID NO: 595920 - protein, 8 aa, Mycobacterium
TGSSLASL

SEQ ID NO: 595921 - protein, 7 aa, Mycobacterium
TGSSNLE

SEQ ID NO: 595922 - protein, 6 aa, Mycobacterium
TGSSPL

SEQ ID NO: 595923 - protein, 7 aa, Mycobacterium
TGSSPLP

SEQ ID NO: 595924 - protein, 7 aa, Mycobacterium
TGSSRGI

SEQ ID NO: 595925 - protein, 8 aa, Mycobacterium
TGSSRGIG

SEQ ID NO: 595926 - protein, 6 aa, Mycobacterium
TGSSSM

SEQ ID NO: 595927 - protein, 8 aa, Mycobacterium
TGSSTIGR

SEQ ID NO: 595928 - protein, 12 aa, Mycobacterium
TGSSTLDASTLS

SEQ ID NO: 595929 - protein, 8 aa, Mycobacterium
TGSSTVGR

SEQ ID NO: 595930 - protein, 7 aa, Mycobacterium
TGSTAAQ

SEQ ID NO: 595931 - protein, 9 aa, Mycobacterium
TGSTARWDG

SEQ ID NO: 595932 - protein, 7 aa, Mycobacterium
TGSTAVG

SEQ ID NO: 595933 - protein, 8 aa, Mycobacterium
TGSTAVGR

SEQ ID NO: 595934 - protein, 9 aa, Mycobacterium
TGSTEVGKQ

SEQ ID NO: 595935 - protein, 9 aa, Mycobacterium
TGSTEYPPS

SEQ ID NO: 595936 - protein, 6 aa, Mycobacterium
TGSTGI

SEQ ID NO: 595937 - protein, 6 aa, Mycobacterium
TGSTGV

SEQ ID NO: 595938 - protein, 8 aa, Mycobacterium
TGSTGVGR

SEQ ID NO: 595939 - protein, 8 aa, Mycobacterium
TGSTGVGS

SEQ ID NO: 595940 - protein, 6 aa, Mycobacterium
TGSTHI

SEQ ID NO: 595941 - protein, 11 aa, Mycobacterium
TGSTKVGRGIA

SEQ ID NO: 595942 - protein, 7 aa, Mycobacterium
TGSTLGT

SEQ ID NO: 595943 - protein, 9 aa, Mycobacterium
TGSTNTGRA

SEQ ID NO: 595944 - protein, 10 aa, Mycobacterium
TGSTPDATIA

SEQ ID NO: 595945 - protein, 9 aa, Mycobacterium
TGSTPSQRY

SEQ ID NO: 595946 - protein, 7 aa, Mycobacterium
TGSTRAG

SEQ ID NO: 595947 - protein, 12 aa, Mycobacterium
TGSTRLKAGTAE

SEQ ID NO: 595948 - protein, 8 aa, Mycobacterium
TGSTRQRT

SEQ ID NO: 595949 - protein, 7 aa, Mycobacterium
TGSTRRG

SEQ ID NO: 595950 - protein, 8 aa, Mycobacterium
TGSTTPVQ

SEQ ID NO: 595951 - protein, 8 aa, Mycobacterium
TGSVAGGT

SEQ ID NO: 595952 - protein, 12 aa, Mycobacterium
TGSVAGSDAERV

SEQ ID NO: 595953 - protein, 11 aa, Mycobacterium
TGSVGGDKKEI

SEQ ID NO: 595954 - protein, 9 aa, Mycobacterium
TGSVPAAGG

SEQ ID NO: 595955 - protein, 8 aa, Mycobacterium
TGSVPPTV

SEQ ID NO: 595956 - protein, 14 aa, Mycobacterium
TGSVTAQEGCPSHT

SEQ ID NO: 595957 - protein, 23 aa, Mycobacterium
TGSVTPAAGLTTLGGDDFDGEPR

SEQ ID NO: 595958 - protein, 11 aa, Mycobacterium
TGSWARRDRRT

SEQ ID NO: 595959 - protein, 10 aa, Mycobacterium
TGSWGGAASM

SEQ ID NO: 595960 - protein, 5 aa, Mycobacterium
TGSYD

SEQ ID NO: 595961 - protein, 6 aa, Mycobacterium
TGSYDQ

SEQ ID NO: 595962 - protein, 6 aa, Mycobacterium
TGSYEQ

SEQ ID NO: 595963 - protein, 35 aa, Mycobacterium
TGSYGCSGPIPAAPNGANLVSGGPGVPGFASSPAP

SEQ ID NO: 595964 - protein, 6 aa, Mycobacterium
TGSYSI

SEQ ID NO: 595965 - protein, 4 aa, Mycobacterium
TGTA

SEQ ID NO: 595966 - protein, 11 aa, Mycobacterium
TGTAAEAADFT

SEQ ID NO: 595967 - protein, 6 aa, Mycobacterium
TGTAAG

SEQ ID NO: 595968 - protein, 9 aa, Mycobacterium
TGTAAGKRV

SEQ ID NO: 595969 - protein, 16 aa, Mycobacterium
TGTAAGKRVQALGGAK

SEQ ID NO: 595970 - protein, 8 aa, Mycobacterium
TGTAANGQ

SEQ ID NO: 595971 - protein, 6 aa, Mycobacterium
TGTAAR

SEQ ID NO: 595972 - protein, 22 aa, Mycobacterium
TGTAATKPTANQPIQSPQEVGA

SEQ ID NO: 595973 - protein, 5 aa, Mycobacterium
TGTAD

SEQ ID NO: 595974 - protein, 11 aa, Mycobacterium
TGTADDDPWSP

SEQ ID NO: 595975 - protein, 9 aa, Mycobacterium
TGTADDGVT

SEQ ID NO: 595976 - protein, 12 aa, Mycobacterium
TGTADEDPWSPD

SEQ ID NO: 595977 - protein, 8 aa, Mycobacterium
TGTADGEW

SEQ ID NO: 595978 - protein, 9 aa, Mycobacterium
TGTADGEWR

SEQ ID NO: 595979 - protein, 12 aa, Mycobacterium
TGTADTDPWSPE

SEQ ID NO: 595980 - protein, 12 aa, Mycobacterium
TGTAEGSHTPIG

SEQ ID NO: 595981 - protein, 29 aa, Mycobacterium
TGTAELSDPVRAGGTVSENATDTPRRRRR

SEQ ID NO: 595982 - protein, 9 aa, Mycobacterium
TGTAGQDKA

SEQ ID NO: 595983 - protein, 7 aa, Mycobacterium
TGTAGRP

SEQ ID NO: 595984 - protein, 8 aa, Mycobacterium
TGTAGTSQ

SEQ ID NO: 595985 - protein, 16 aa, Mycobacterium
TGTAHATGTAGPAEAT

SEQ ID NO: 595986 - protein, 8 aa, Mycobacterium
TGTAKPGD

SEQ ID NO: 595987 - protein, 15 aa, Mycobacterium
TGTAKSDRTGTGTRS

SEQ ID NO: 595988 - protein, 5 aa, Mycobacterium
TGTAL

SEQ ID NO: 595989 - protein, 10 aa, Mycobacterium
TGTALAASDS

SEQ ID NO: 595990 - protein, 12 aa, Mycobacterium
TGTALTAAEAER

SEQ ID NO: 595991 - protein, 10 aa, Mycobacterium
TGTANATTTF

SEQ ID NO: 595992 - protein, 10 aa, Mycobacterium
TGTAPGAKVH

SEQ ID NO: 595993 - protein, 7 aa, Mycobacterium
TGTAQRA

SEQ ID NO: 595994 - protein, 5 aa, Mycobacterium
TGTAR

SEQ ID NO: 595995 - protein, 9 aa, Mycobacterium
TGTASGKSV

SEQ ID NO: 595996 - protein, 8 aa, Mycobacterium
TGTASGVI

SEQ ID NO: 595997 - protein, 7 aa, Mycobacterium
TGTASRQ

SEQ ID NO: 595998 - protein, 14 aa, Mycobacterium
TGTAVRDPETGEDL

SEQ ID NO: 595999 - protein, 4 aa, Mycobacterium
TGTD

SEQ ID NO: 596000 - protein, 16 aa, Mycobacterium
TGTDAPELDDLITRQT

SEQ ID NO: 596001 - protein, 9 aa, Mycobacterium
TGTDEARRL

SEQ ID NO: 596002 - protein, 6 aa, Mycobacterium
TGTDEM

SEQ ID NO: 596003 - protein, 10 aa, Mycobacterium
TGTDERGRGR

SEQ ID NO: 596004 - protein, 8 aa, Mycobacterium
TGTDEVRT

SEQ ID NO: 596005 - protein, 13 aa, Mycobacterium
TGTDLQAARADAY

SEQ ID NO: 596006 - protein, 13 aa, Mycobacterium
TGTDPASAYHGSR

SEQ ID NO: 596007 - protein, 5 aa, Mycobacterium
TGTDR

SEQ ID NO: 596008 - protein, 17 aa, Mycobacterium
TGTDSIESVEHSDGATS

SEQ ID NO: 596009 - protein, 9 aa, Mycobacterium
TGTDTGAVA

SEQ ID NO: 596010 - protein, 13 aa, Mycobacterium
TGTDTPELDTAVA

SEQ ID NO: 596011 - protein, 5 aa, Mycobacterium
TGTDV

SEQ ID NO: 596012 - protein, 5 aa, Mycobacterium
TGTEA

SEQ ID NO: 596013 - protein, 7 aa, Mycobacterium
TGTEAGA

SEQ ID NO: 596014 - protein, 7 aa, Mycobacterium
TGTEALT

SEQ ID NO: 596015 - protein, 10 aa, Mycobacterium
TGTEAYPSRT

SEQ ID NO: 596016 - protein, 11 aa, Mycobacterium
TGTEAYPSRTD

SEQ ID NO: 596017 - protein, 6 aa, Mycobacterium
TGTEEA

SEQ ID NO: 596018 - protein, 7 aa, Mycobacterium
TGTEEAE

SEQ ID NO: 596019 - protein, 6 aa, Mycobacterium
TGTEEV

SEQ ID NO: 596020 - protein, 5 aa, Mycobacterium
TGTEF

SEQ ID NO: 596021 - protein, 12 aa, Mycobacterium
TGTEPGDPTKAG

SEQ ID NO: 596022 - protein, 7 aa, Mycobacterium
TGTEPYT

SEQ ID NO: 596023 - protein, 6 aa, Mycobacterium
TGTEQI

SEQ ID NO: 596024 - protein, 5 aa, Mycobacterium
TGTER

SEQ ID NO: 596025 - protein, 6 aa, Mycobacterium
TGTERG

SEQ ID NO: 596026 - protein, 11 aa, Mycobacterium
TGTESGPQGEV

SEQ ID NO: 596027 - protein, 10 aa, Mycobacterium
TGTESNAAVP

SEQ ID NO: 596028 - protein, 7 aa, Mycobacterium
TGTESTP

SEQ ID NO: 596029 - protein, 5 aa, Mycobacterium
TGTFP

SEQ ID NO: 596030 - protein, 4 aa, Mycobacterium
TGTG

SEQ ID NO: 596031 - protein, 25 aa, Mycobacterium
TGTGAAAPTTLSPGLGTAGLTSPGL

SEQ ID NO: 596032 - protein, 7 aa, Mycobacterium
TGTGAAD

SEQ ID NO: 596033 - protein, 7 aa, Mycobacterium
TGTGARS

SEQ ID NO: 596034 - protein, 12 aa, Mycobacterium
TGTGEGDADPLT

SEQ ID NO: 596035 - protein, 6 aa, Mycobacterium
TGTGEV

SEQ ID NO: 596036 - protein, 29 aa, Mycobacterium
TGTGGAGGSGGYSSTADGGVGGAGGAGGL

SEQ ID NO: 596037 - protein, 8 aa, Mycobacterium
TGTGIAPA

SEQ ID NO: 596038 - protein, 6 aa, Mycobacterium
TGTGKT

SEQ ID NO: 596039 - protein, 7 aa, Mycobacterium
TGTGKTA

SEQ ID NO: 596040 - protein, 7 aa, Mycobacterium
TGTGKTV

SEQ ID NO: 596041 - protein, 7 aa, Mycobacterium
TGTGNSF

SEQ ID NO: 596042 - protein, 7 aa, Mycobacterium
TGTGPAV

SEQ ID NO: 596043 - protein, 5 aa, Mycobacterium
TGTGQ

SEQ ID NO: 596044 - protein, 6 aa, Mycobacterium
TGTGQF

SEQ ID NO: 596045 - protein, 11 aa, Mycobacterium
TGTGRGGVAPR

SEQ ID NO: 596046 - protein, 11 aa, Mycobacterium
TGTGRGGVTPR

SEQ ID NO: 596047 - protein, 6 aa, Mycobacterium
TGTGRR

SEQ ID NO: 596048 - protein, 9 aa, Mycobacterium
TGTGRRLGK

SEQ ID NO: 596049 - protein, 11 aa, Mycobacterium
TGTGRTADVSR

SEQ ID NO: 596050 - protein, 12 aa, Mycobacterium
TGTGSDLSDDIT

SEQ ID NO: 596051 - protein, 9 aa, Mycobacterium
TGTGSGKTE

SEQ ID NO: 596052 - protein, 5 aa, Mycobacterium
TGTGT

SEQ ID NO: 596053 - protein, 9 aa, Mycobacterium
TGTGTARVK

SEQ ID NO: 596054 - protein, 7 aa, Mycobacterium
TGTGTAV

SEQ ID NO: 596055 - protein, 10 aa, Mycobacterium
TGTGVGGRIR

SEQ ID NO: 596056 - protein, 14 aa, Mycobacterium
TGTGWKDTPAIKSR

SEQ ID NO: 596057 - protein, 12 aa, Mycobacterium
TGTGYGGPAFGG

SEQ ID NO: 596058 - protein, 6 aa, Mycobacterium
TGTHGS

SEQ ID NO: 596059 - protein, 10 aa, Mycobacterium
TGTHPRTRTE

SEQ ID NO: 596060 - protein, 5 aa, Mycobacterium
TGTHR

SEQ ID NO: 596061 - protein, 6 aa, Mycobacterium
TGTHRQ

SEQ ID NO: 596062 - protein, 4 aa, Mycobacterium
TGTI

SEQ ID NO: 596063 - protein, 6 aa, Mycobacterium
TGTISD

SEQ ID NO: 596064 - protein, 9 aa, Mycobacterium
TGTISDGTR

SEQ ID NO: 596065 - protein, 9 aa, Mycobacterium
TGTKSVPTV

SEQ ID NO: 596066 - protein, 11 aa, Mycobacterium
TGTLAGVPAQK

SEQ ID NO: 596067 - protein, 7 aa, Mycobacterium
TGTLPGG

SEQ ID NO: 596068 - protein, 5 aa, Mycobacterium
TGTLS

SEQ ID NO: 596069 - protein, 11 aa, Mycobacterium
TGTLSETNVAT

SEQ ID NO: 596070 - protein, 7 aa, Mycobacterium
TGTLSQN

SEQ ID NO: 596071 - protein, 15 aa, Mycobacterium
TGTLTAASTPIHRGR

SEQ ID NO: 596072 - protein, 6 aa, Mycobacterium
TGTLTD

SEQ ID NO: 596073 - protein, 6 aa, Mycobacterium
TGTNCT

SEQ ID NO: 596074 - protein, 5 aa, Mycobacterium
TGTNG

SEQ ID NO: 596075 - protein, 12 aa, Mycobacterium
TGTNGKSTTTRM

SEQ ID NO: 596076 - protein, 9 aa, Mycobacterium
TGTNGKTTC

SEQ ID NO: 596077 - protein, 6 aa, Mycobacterium
TGTNHS

SEQ ID NO: 596078 - protein, 9 aa, Mycobacterium
TGTNPKAKR

SEQ ID NO: 596079 - protein, 9 aa, Mycobacterium
TGTPAAAEN

SEQ ID NO: 596080 - protein, 9 aa, Mycobacterium
TGTPAAATT

SEQ ID NO: 596081 - protein, 23 aa, Mycobacterium
TGTPADAPPPPAPAPPATGTAPV

SEQ ID NO: 596082 - protein, 7 aa, Mycobacterium
TGTPAED

SEQ ID NO: 596083 - protein, 7 aa, Mycobacterium
TGTPANV

SEQ ID NO: 596084 - protein, 13 aa, Mycobacterium
TGTPCGRRGSPLA

SEQ ID NO: 596085 - protein, 5 aa, Mycobacterium
TGTPD

SEQ ID NO: 596086 - protein, 7 aa, Mycobacterium
TGTPDPF

SEQ ID NO: 596087 - protein, 17 aa, Mycobacterium
TGTPEPASEEKEEQCAS

SEQ ID NO: 596088 - protein, 9 aa, Mycobacterium
TGTPESRHR

SEQ ID NO: 596089 - protein, 5 aa, Mycobacterium
TGTPF

SEQ ID NO: 596090 - protein, 8 aa, Mycobacterium
TGTPGSGV

SEQ ID NO: 596091 - protein, 13 aa, Mycobacterium
TGTPGVGKSTTIE

SEQ ID NO: 596092 - protein, 8 aa, Mycobacterium
TGTPHAAT

SEQ ID NO: 596093 - protein, 14 aa, Mycobacterium
TGTPKSDRTGTGTR

SEQ ID NO: 596094 - protein, 6 aa, Mycobacterium
TGTPLT

SEQ ID NO: 596095 - protein, 6 aa, Mycobacterium
TGTPME

SEQ ID NO: 596096 - protein, 7 aa, Mycobacterium
TGTPNPS

SEQ ID NO: 596097 - protein, 10 aa, Mycobacterium
TGTPQGSAAQ

SEQ ID NO: 596098 - protein, 9 aa, Mycobacterium
TGTPTTDRH

SEQ ID NO: 596099 - protein, 8 aa, Mycobacterium
TGTQQGFN

SEQ ID NO: 596100 - protein, 4 aa, Mycobacterium
TGTR

SEQ ID NO: 596101 - protein, 8 aa, Mycobacterium
TGTRAHSA

SEQ ID NO: 596102 - protein, 11 aa, Mycobacterium
TGTRDDGLPDY

SEQ ID NO: 596103 - protein, 11 aa, Mycobacterium
TGTREHDPWSP

SEQ ID NO: 596104 - protein, 5 aa, Mycobacterium
TGTRG

SEQ ID NO: 596105 - protein, 9 aa, Mycobacterium
TGTRGMTAT

SEQ ID NO: 596106 - protein, 7 aa, Mycobacterium
TGTRGSG

SEQ ID NO: 596107 - protein, 6 aa, Mycobacterium
TGTRGT

SEQ ID NO: 596108 - protein, 7 aa, Mycobacterium
TGTRIPA

SEQ ID NO: 596109 - protein, 11 aa, Mycobacterium
TGTRNPQPDSD

SEQ ID NO: 596110 - protein, 5 aa, Mycobacterium
TGTRP

SEQ ID NO: 596111 - protein, 14 aa, Mycobacterium
TGTRRRYDTAAERY

SEQ ID NO: 596112 - protein, 5 aa, Mycobacterium
TGTRT

SEQ ID NO: 596113 - protein, 8 aa, Mycobacterium
TGTRTTAA

SEQ ID NO: 596114 - protein, 4 aa, Mycobacterium
TGTS

SEQ ID NO: 596115 - protein, 12 aa, Mycobacterium
TGTSAGTDRGAR

SEQ ID NO: 596116 - protein, 14 aa, Mycobacterium
TGTSENTLSGDVDT

SEQ ID NO: 596117 - protein, 7 aa, Mycobacterium
TGTSGGV

SEQ ID NO: 596118 - protein, 10 aa, Mycobacterium
TGTSPSQRYQ

SEQ ID NO: 596119 - protein, 17 aa, Mycobacterium
TGTSPVAGKYHGKAEYR

SEQ ID NO: 596120 - protein, 8 aa, Mycobacterium
TGTSRGVG

SEQ ID NO: 596121 - protein, 7 aa, Mycobacterium
TGTSSGI

SEQ ID NO: 596122 - protein, 8 aa, Mycobacterium
TGTSSGIS

SEQ ID NO: 596123 - protein, 20 aa, Mycobacterium
TGTSTDTLQTEIPERWLEKS

SEQ ID NO: 596124 - protein, 5 aa, Mycobacterium
TGTTA

SEQ ID NO: 596125 - protein, 17 aa, Mycobacterium
TGTTAANNCHGPTHLSQ

SEQ ID NO: 596126 - protein, 13 aa, Mycobacterium
TGTTAGSGAWYPT

SEQ ID NO: 596127 - protein, 7 aa, Mycobacterium
TGTTAPT

SEQ ID NO: 596128 - protein, 9 aa, Mycobacterium
TGTTFSEVP

SEQ ID NO: 596129 - protein, 5 aa, Mycobacterium
TGTTL

SEQ ID NO: 596130 - protein, 16 aa, Mycobacterium
TGTTMSASEATNPSTW

SEQ ID NO: 596131 - protein, 20 aa, Mycobacterium
TGTTPARHQRSVAPRARLVA

SEQ ID NO: 596132 - protein, 9 aa, Mycobacterium
TGTTPLPLP

SEQ ID NO: 596133 - protein, 11 aa, Mycobacterium
TGTTPPGGESF

SEQ ID NO: 596134 - protein, 6 aa, Mycobacterium
TGTTPR

SEQ ID NO: 596135 - protein, 15 aa, Mycobacterium
TGTTPVHTTLITQGR

SEQ ID NO: 596136 - protein, 7 aa, Mycobacterium
TGTTRTS

SEQ ID NO: 596137 - protein, 21 aa, Mycobacterium
TGTTTDSLQTELPERWLAAAG

SEQ ID NO: 596138 - protein, 8 aa, Mycobacterium
TGTTVSPP

SEQ ID NO: 596139 - protein, 5 aa, Mycobacterium
TGTVA

SEQ ID NO: 596140 - protein, 8 aa, Mycobacterium
TGTVAGGT

SEQ ID NO: 596141 - protein, 8 aa, Mycobacterium
TGTVEGGR

SEQ ID NO: 596142 - protein, 10 aa, Mycobacterium
TGTVGDKKEI

SEQ ID NO: 596143 - protein, 6 aa, Mycobacterium
TGTVQQ

SEQ ID NO: 596144 - protein, 12 aa, Mycobacterium
TGTVQQTTHEPY

SEQ ID NO: 596145 - protein, 13 aa, Mycobacterium
TGTVTAASDWGGI

SEQ ID NO: 596146 - protein, 24 aa, Mycobacterium
TGTVTEKPGGGKDYGPGPARPPQT

SEQ ID NO: 596147 - protein, 15 aa, Mycobacterium
TGTVTGAGSTKLSGG

SEQ ID NO: 596148 - protein, 17 aa, Mycobacterium
TGTVTSERRDDRPQEFP

SEQ ID NO: 596149 - protein, 4 aa, Mycobacterium
TGTW

SEQ ID NO: 596150 - protein, 27 aa, Mycobacterium
TGTWNSDAGYDSGYEADDNQDYAETEQ

SEQ ID NO: 596151 - protein, 23 aa, Mycobacterium
TGTWSDTGSYDFDGDQDFAETEQ

SEQ ID NO: 596152 - protein, 20 aa, Mycobacterium
TGTWSTEGAYDDQDYAETEQ

SEQ ID NO: 596153 - protein, 20 aa, Mycobacterium
TGTWSTEGSYDDQDYAETEQ

SEQ ID NO: 596154 - protein, 16 aa, Mycobacterium
TGVAGPWASRAKPGDK

SEQ ID NO: 596155 - protein, 6 aa, Mycobacterium
TGVART

SEQ ID NO: 596156 - protein, 11 aa, Mycobacterium
TGVASSPIKGT

SEQ ID NO: 596157 - protein, 4 aa, Mycobacterium
TGVD

SEQ ID NO: 596158 - protein, 5 aa, Mycobacterium
TGVDA

SEQ ID NO: 596159 - protein, 12 aa, Mycobacterium
TGVDGGPSVGTV

SEQ ID NO: 596160 - protein, 5 aa, Mycobacterium
TGVDN

SEQ ID NO: 596161 - protein, 6 aa, Mycobacterium
TGVDPA

SEQ ID NO: 596162 - protein, 8 aa, Mycobacterium
TGVDPAEV

SEQ ID NO: 596163 - protein, 8 aa, Mycobacterium
TGVDPAQV

SEQ ID NO: 596164 - protein, 12 aa, Mycobacterium
TGVDPDRGGGQI

SEQ ID NO: 596165 - protein, 18 aa, Mycobacterium
TGVDRGDQAHRRQRIPTQ

SEQ ID NO: 596166 - protein, 8 aa, Mycobacterium
TGVDSAQV

SEQ ID NO: 596167 - protein, 13 aa, Mycobacterium
TGVEGVEAEAARA

SEQ ID NO: 596168 - protein, 11 aa, Mycobacterium
TGVEPTDNPLK

SEQ ID NO: 596169 - protein, 7 aa, Mycobacterium
TGVEQGG

SEQ ID NO: 596170 - protein, 9 aa, Mycobacterium
TGVETSTRE

SEQ ID NO: 596171 - protein, 6 aa, Mycobacterium
TGVGAG

SEQ ID NO: 596172 - protein, 53 aa, Mycobacterium
TGVGDPENGRRFGEGADHMSAAGRTLDSAYPTSDWDSAASDAYLSQNNGQVTR

SEQ ID NO: 596173 - protein, 15 aa, Mycobacterium
TGVGDYGTHAGPLDV

SEQ ID NO: 596174 - protein, 6 aa, Mycobacterium
TGVGKS

SEQ ID NO: 596175 - protein, 33 aa, Mycobacterium
TGVGNAGNYNSGGFNAGHTNTGSFNSGDYNTGY

SEQ ID NO: 596176 - protein, 43 aa, Mycobacterium
TGVGNAGNYNSGGFNTGSTNTGSFNPGDYNTGGLNQGDYNTGY

SEQ ID NO: 596177 - protein, 34 aa, Mycobacterium
TGVGNAGNYNSGGFNTGSTNTGSFNSGDHNTGYL

SEQ ID NO: 596178 - protein, 33 aa, Mycobacterium
TGVGNAGNYNSGGFNTGSTNTGSFNSGDYNTGY

SEQ ID NO: 596179 - protein, 33 aa, Mycobacterium
TGVGNAGNYNSGGLNAGHTNTGSFNSGDYNTGY

SEQ ID NO: 596180 - protein, 12 aa, Mycobacterium
TGVGPDPAGTQN

SEQ ID NO: 596181 - protein, 17 aa, Mycobacterium
TGVGRAADARRTEQLRS

SEQ ID NO: 596182 - protein, 16 aa, Mycobacterium
TGVGRDEPAAECGTEV

SEQ ID NO: 596183 - protein, 9 aa, Mycobacterium
TGVGRPKAL

SEQ ID NO: 596184 - protein, 6 aa, Mycobacterium
TGVGRT

SEQ ID NO: 596185 - protein, 9 aa, Mycobacterium
TGVGSSTIG

SEQ ID NO: 596186 - protein, 6 aa, Mycobacterium
TGVGSY

SEQ ID NO: 596187 - protein, 10 aa, Mycobacterium
TGVKNPAYPD

SEQ ID NO: 596188 - protein, 10 aa, Mycobacterium
TGVKNPDYDD

SEQ ID NO: 596189 - protein, 10 aa, Mycobacterium
TGVKNPDYSD

SEQ ID NO: 596190 - protein, 5 aa, Mycobacterium
TGVPA

SEQ ID NO: 596191 - protein, 8 aa, Mycobacterium
TGVPAEEL

SEQ ID NO: 596192 - protein, 7 aa, Mycobacterium
TGVPAGT

SEQ ID NO: 596193 - protein, 11 aa, Mycobacterium
TGVPGAGWPSH

SEQ ID NO: 596194 - protein, 15 aa, Mycobacterium
TGVPGTGWPAYGEPE

SEQ ID NO: 596195 - protein, 7 aa, Mycobacterium
TGVPRPG

SEQ ID NO: 596196 - protein, 5 aa, Mycobacterium
TGVPT

SEQ ID NO: 596197 - protein, 11 aa, Mycobacterium
TGVQGDAADLE

SEQ ID NO: 596198 - protein, 11 aa, Mycobacterium
TGVQPGPEHTT

SEQ ID NO: 596199 - protein, 4 aa, Mycobacterium
TGVR

SEQ ID NO: 596200 - protein, 7 aa, Mycobacterium
TGVRATP

SEQ ID NO: 596201 - protein, 6 aa, Mycobacterium
TGVRGE

SEQ ID NO: 596202 - protein, 10 aa, Mycobacterium
TGVRSSAREV

SEQ ID NO: 596203 - protein, 11 aa, Mycobacterium
TGVSEEGNRDR

SEQ ID NO: 596204 - protein, 6 aa, Mycobacterium
TGVSGM

SEQ ID NO: 596205 - protein, 10 aa, Mycobacterium
TGVSGSGKST

SEQ ID NO: 596206 - protein, 11 aa, Mycobacterium
TGVSGSGKSTM

SEQ ID NO: 596207 - protein, 33 aa, Mycobacterium
TGVSNAGNYNSGGFNAGHTNTGSFNSGDYNTGY

SEQ ID NO: 596208 - protein, 12 aa, Mycobacterium
TGVSPDRIDDSA

SEQ ID NO: 596209 - protein, 6 aa, Mycobacterium
TGVSPE

SEQ ID NO: 596210 - protein, 7 aa, Mycobacterium
TGVSRGG

SEQ ID NO: 596211 - protein, 16 aa, Mycobacterium
TGVSSEPEVTERDDEV

SEQ ID NO: 596212 - protein, 11 aa, Mycobacterium
TGVSTLGGTTV

SEQ ID NO: 596213 - protein, 5 aa, Mycobacterium
TGVTA

SEQ ID NO: 596214 - protein, 10 aa, Mycobacterium
TGVTDDPQAA

SEQ ID NO: 596215 - protein, 5 aa, Mycobacterium
TGVTE

SEQ ID NO: 596216 - protein, 8 aa, Mycobacterium
TGVTEPTP

SEQ ID NO: 596217 - protein, 5 aa, Mycobacterium
TGVTG

SEQ ID NO: 596218 - protein, 8 aa, Mycobacterium
TGVTGSTA

SEQ ID NO: 596219 - protein, 6 aa, Mycobacterium
TGVTNT

SEQ ID NO: 596220 - protein, 6 aa, Mycobacterium
TGVTPM

SEQ ID NO: 596221 - protein, 11 aa, Mycobacterium
TGVTSEDGGAK

SEQ ID NO: 596222 - protein, 8 aa, Mycobacterium
TGVTTPAP

SEQ ID NO: 596223 - protein, 4 aa, Mycobacterium
TGVV

SEQ ID NO: 596224 - protein, 5 aa, Mycobacterium
TGVVG

SEQ ID NO: 596225 - protein, 6 aa, Mycobacterium
TGVVPG

SEQ ID NO: 596226 - protein, 11 aa, Mycobacterium
TGWANTGDLNT

SEQ ID NO: 596227 - protein, 11 aa, Mycobacterium
TGWANTGDVDT

SEQ ID NO: 596228 - protein, 10 aa, Mycobacterium
TGWGAGAPSV

SEQ ID NO: 596229 - protein, 17 aa, Mycobacterium
TGWGSATVSAGTEPGDT

SEQ ID NO: 596230 - protein, 6 aa, Mycobacterium
TGWNPA

SEQ ID NO: 596231 - protein, 4 aa, Mycobacterium
TGWR

SEQ ID NO: 596232 - protein, 5 aa, Mycobacterium
TGWSE

SEQ ID NO: 596233 - protein, 9 aa, Mycobacterium
TGWSEADVQ

SEQ ID NO: 596234 - protein, 5 aa, Mycobacterium
TGWSG

SEQ ID NO: 596235 - protein, 6 aa, Mycobacterium
TGWSPA

SEQ ID NO: 596236 - protein, 6 aa, Mycobacterium
TGWSTD

SEQ ID NO: 596237 - protein, 5 aa, Mycobacterium
TGWTE

SEQ ID NO: 596238 - protein, 6 aa, Mycobacterium
TGWTEA

SEQ ID NO: 596239 - protein, 13 aa, Mycobacterium
TGWTENRSVPDKT

SEQ ID NO: 596240 - protein, 6 aa, Mycobacterium
TGYAAD

SEQ ID NO: 596241 - protein, 10 aa, Mycobacterium
TGYAGDTGDL

SEQ ID NO: 596242 - protein, 30 aa, Mycobacterium
TGYAKRTKSDLYRSQKRGGKGVQGAGLKQD

SEQ ID NO: 596243 - protein, 5 aa, Mycobacterium
TGYDA

SEQ ID NO: 596244 - protein, 5 aa, Mycobacterium
TGYDE

SEQ ID NO: 596245 - protein, 12 aa, Mycobacterium
TGYEESQGRCQP

SEQ ID NO: 596246 - protein, 6 aa, Mycobacterium
TGYEGA

SEQ ID NO: 596247 - protein, 7 aa, Mycobacterium
TGYEGDW

SEQ ID NO: 596248 - protein, 6 aa, Mycobacterium
TGYEPE

SEQ ID NO: 596249 - protein, 7 aa, Mycobacterium
TGYGPVG

SEQ ID NO: 596250 - protein, 16 aa, Mycobacterium
TGYGSAANRAGVRGGD

SEQ ID NO: 596251 - protein, 16 aa, Mycobacterium
TGYGSAARRAGVRGGD

SEQ ID NO: 596252 - protein, 14 aa, Mycobacterium
TGYGSAARRAQVRG

SEQ ID NO: 596253 - protein, 15 aa, Mycobacterium
TGYGSAVRTGEVRAG

SEQ ID NO: 596254 - protein, 16 aa, Mycobacterium
TGYGSAVRTGEVRAGD

SEQ ID NO: 596255 - protein, 15 aa, Mycobacterium
TGYGSVANRSNMRAG

SEQ ID NO: 596256 - protein, 6 aa, Mycobacterium
TGYHGR

SEQ ID NO: 596257 - protein, 4 aa, Mycobacterium
TGYP

SEQ ID NO: 596258 - protein, 14 aa, Mycobacterium
TGYPDRAAGRPAAR

SEQ ID NO: 596259 - protein, 11 aa, Mycobacterium
TGYPPGSEGRF

SEQ ID NO: 596260 - protein, 13 aa, Mycobacterium
TGYPQRKRDYDAR

SEQ ID NO: 596261 - protein, 29 aa, Mycobacterium
TGYPRSDDADDATPRPGRRPHPNPAPGQG

SEQ ID NO: 596262 - protein, 7 aa, Mycobacterium
TGYPTFP

SEQ ID NO: 596263 - protein, 15 aa, Mycobacterium
TGYQAGAAAAAAGLN

SEQ ID NO: 596264 - protein, 4 aa, Mycobacterium
TGYR

SEQ ID NO: 596265 - protein, 5 aa, Mycobacterium
TGYRD

SEQ ID NO: 596266 - protein, 5 aa, Mycobacterium
TGYRR

SEQ ID NO: 596267 - protein, 16 aa, Mycobacterium
TGYRRELESSSDPQEL

SEQ ID NO: 596268 - protein, 16 aa, Mycobacterium
TGYRRELESSTDPQDL

SEQ ID NO: 596269 - protein, 16 aa, Mycobacterium
TGYRRELESSTDPQEL

SEQ ID NO: 596270 - protein, 5 aa, Mycobacterium
TGYRT

SEQ ID NO: 596271 - protein, 11 aa, Mycobacterium
TGYSAEHGGEY

SEQ ID NO: 596272 - protein, 5 aa, Mycobacterium
TGYSD

SEQ ID NO: 596273 - protein, 6 aa, Mycobacterium
TGYSDD

SEQ ID NO: 596274 - protein, 14 aa, Mycobacterium
TGYSFEGSTRTAEQ

SEQ ID NO: 596275 - protein, 9 aa, Mycobacterium
TGYSRKDSY

SEQ ID NO: 596276 - protein, 4 aa, Mycobacterium
TGYT

SEQ ID NO: 596277 - protein, 6 aa, Mycobacterium
TGYTGE

SEQ ID NO: 596278 - protein, 8 aa, Mycobacterium
TGYTGEDG

SEQ ID NO: 596279 - protein, 13 aa, Mycobacterium
TGYTRVPADPLPS

SEQ ID NO: 596280 - protein, 5 aa, Mycobacterium
TGYTS

SEQ ID NO: 596281 - protein, 5 aa, Mycobacterium
TGYTT

SEQ ID NO: 596282 - protein, 4 aa, Mycobacterium
TGYY

SEQ ID NO: 596283 - protein, 5 aa, Mycobacterium
THAAG

SEQ ID NO: 596284 - protein, 9 aa, Mycobacterium
THAATGEFN

SEQ ID NO: 596285 - protein, 4 aa, Mycobacterium
THAD

SEQ ID NO: 596286 - protein, 5 aa, Mycobacterium
THAET

SEQ ID NO: 596287 - protein, 7 aa, Mycobacterium
THAGPGG

SEQ ID NO: 596288 - protein, 8 aa, Mycobacterium
THAGPNSG

SEQ ID NO: 596289 - protein, 7 aa, Mycobacterium
THAGTAL

SEQ ID NO: 596290 - protein, 9 aa, Mycobacterium
THAKSSVSG

SEQ ID NO: 596291 - protein, 8 aa, Mycobacterium
THANTSWD

SEQ ID NO: 596292 - protein, 4 aa, Mycobacterium
THAP

SEQ ID NO: 596293 - protein, 5 aa, Mycobacterium
THAPA

SEQ ID NO: 596294 - protein, 8 aa, Mycobacterium
THAPAGTG

SEQ ID NO: 596295 - protein, 5 aa, Mycobacterium
THAPE

SEQ ID NO: 596296 - protein, 20 aa, Mycobacterium
THAPGGKGANQAVAAARAGA

SEQ ID NO: 596297 - protein, 8 aa, Mycobacterium
THARRDGD

SEQ ID NO: 596298 - protein, 8 aa, Mycobacterium
THASSAEE

SEQ ID NO: 596299 - protein, 9 aa, Mycobacterium
THDAPPVAD

SEQ ID NO: 596300 - protein, 8 aa, Mycobacterium
THDDSASI

SEQ ID NO: 596301 - protein, 9 aa, Mycobacterium
THDDSASVT

SEQ ID NO: 596302 - protein, 9 aa, Mycobacterium
THDDSSSVT

SEQ ID NO: 596303 - protein, 7 aa, Mycobacterium
THDGDAL

SEQ ID NO: 596304 - protein, 7 aa, Mycobacterium
THDGDVS

SEQ ID NO: 596305 - protein, 10 aa, Mycobacterium
THDGGTQLRA

SEQ ID NO: 596306 - protein, 17 aa, Mycobacterium
THDGRSGVGWLEWNRNQ

SEQ ID NO: 596307 - protein, 5 aa, Mycobacterium
THDGT

SEQ ID NO: 596308 - protein, 10 aa, Mycobacterium
THDGTARQHA

SEQ ID NO: 596309 - protein, 6 aa, Mycobacterium
THDGTC

SEQ ID NO: 596310 - protein, 4 aa, Mycobacterium
THDH

SEQ ID NO: 596311 - protein, 5 aa, Mycobacterium
THDHQ

SEQ ID NO: 596312 - protein, 4 aa, Mycobacterium
THDN

SEQ ID NO: 596313 - protein, 9 aa, Mycobacterium
THDNAQHRD

SEQ ID NO: 596314 - protein, 9 aa, Mycobacterium
THDNPQHRA

SEQ ID NO: 596315 - protein, 6 aa, Mycobacterium
THDPDG

SEQ ID NO: 596316 - protein, 10 aa, Mycobacterium
THDPTVADEA

SEQ ID NO: 596317 - protein, 11 aa, Mycobacterium
THDPTVADEAS

SEQ ID NO: 596318 - protein, 7 aa, Mycobacterium
THDQDAK

SEQ ID NO: 596319 - protein, 7 aa, Mycobacterium
THDQPCR

SEQ ID NO: 596320 - protein, 7 aa, Mycobacterium
THDQTPH

SEQ ID NO: 596321 - protein, 4 aa, Mycobacterium
THDR

SEQ ID NO: 596322 - protein, 20 aa, Mycobacterium
THDRSDRESVKGRIGGRTQE

SEQ ID NO: 596323 - protein, 20 aa, Mycobacterium
THDRSDRESVKGRVGGRTQE

SEQ ID NO: 596324 - protein, 4 aa, Mycobacterium
THDS

SEQ ID NO: 596325 - protein, 4 aa, Mycobacterium
THDT

SEQ ID NO: 596326 - protein, 10 aa, Mycobacterium
THDTKRGEDV

SEQ ID NO: 596327 - protein, 5 aa, Mycobacterium
THEAA

SEQ ID NO: 596328 - protein, 5 aa, Mycobacterium
THEAE

SEQ ID NO: 596329 - protein, 7 aa, Mycobacterium
THEARTG

SEQ ID NO: 596330 - protein, 9 aa, Mycobacterium
THEEGERLR

SEQ ID NO: 596331 - protein, 9 aa, Mycobacterium
THEEGERVR

SEQ ID NO: 596332 - protein, 9 aa, Mycobacterium
THEEIKRGS

SEQ ID NO: 596333 - protein, 14 aa, Mycobacterium
THEHADHRSYAGTV

SEQ ID NO: 596334 - protein, 9 aa, Mycobacterium
THEHQDGSR

SEQ ID NO: 596335 - protein, 4 aa, Mycobacterium
THEP

SEQ ID NO: 596336 - protein, 6 aa, Mycobacterium
THEPRS

SEQ ID NO: 596337 - protein, 4 aa, Mycobacterium
THEQ

SEQ ID NO: 596338 - protein, 33 aa, Mycobacterium
THERQRNRNARTTPPPDHTTRTGPAPPDDEPPP

SEQ ID NO: 596339 - protein, 29 aa, Mycobacterium
THERRGRRARGCAARRSHRANSRSRRGRK

SEQ ID NO: 596340 - protein, 18 aa, Mycobacterium
THESPGDLQLSPTGRRYK

SEQ ID NO: 596341 - protein, 5 aa, Mycobacterium
THEST

SEQ ID NO: 596342 - protein, 7 aa, Mycobacterium
THETESV

SEQ ID NO: 596343 - protein, 6 aa, Mycobacterium
THGAEA

SEQ ID NO: 596344 - protein, 14 aa, Mycobacterium
THGAENGKTRWPNE

SEQ ID NO: 596345 - protein, 13 aa, Mycobacterium
THGAPDVAGAAAR

SEQ ID NO: 596346 - protein, 19 aa, Mycobacterium
THGAPTDRNAHPHQDATGK

SEQ ID NO: 596347 - protein, 6 aa, Mycobacterium
THGARA

SEQ ID NO: 596348 - protein, 11 aa, Mycobacterium
THGARGRNQDE

SEQ ID NO: 596349 - protein, 10 aa, Mycobacterium
THGASSEAAR

SEQ ID NO: 596350 - protein, 16 aa, Mycobacterium
THGCGDPDTNRQYPCG

SEQ ID NO: 596351 - protein, 4 aa, Mycobacterium
THGD

SEQ ID NO: 596352 - protein, 5 aa, Mycobacterium
THGDF

SEQ ID NO: 596353 - protein, 11 aa, Mycobacterium
THGDPRQTETV

SEQ ID NO: 596354 - protein, 7 aa, Mycobacterium
THGDRSV

SEQ ID NO: 596355 - protein, 8 aa, Mycobacterium
THGDSPTG

SEQ ID NO: 596356 - protein, 10 aa, Mycobacterium
THGDTAGDFP

SEQ ID NO: 596357 - protein, 6 aa, Mycobacterium
THGEGD

SEQ ID NO: 596358 - protein, 6 aa, Mycobacterium
THGENL

SEQ ID NO: 596359 - protein, 21 aa, Mycobacterium
THGGPASGGRLVGKDGSPLDL

SEQ ID NO: 596360 - protein, 8 aa, Mycobacterium
THGGQKDS

SEQ ID NO: 596361 - protein, 6 aa, Mycobacterium
THGGQL

SEQ ID NO: 596362 - protein, 10 aa, Mycobacterium
THGGRRGTGL

SEQ ID NO: 596363 - protein, 4 aa, Mycobacterium
THGH

SEQ ID NO: 596364 - protein, 5 aa, Mycobacterium
THGHD

SEQ ID NO: 596365 - protein, 4 aa, Mycobacterium
THGI

SEQ ID NO: 596366 - protein, 12 aa, Mycobacterium
THGINPPRSRGS

SEQ ID NO: 596367 - protein, 5 aa, Mycobacterium
THGKP

SEQ ID NO: 596368 - protein, 8 aa, Mycobacterium
THGKTSTT

SEQ ID NO: 596369 - protein, 9 aa, Mycobacterium
THGKTSTTS

SEQ ID NO: 596370 - protein, 10 aa, Mycobacterium
THGPAGTTAS

SEQ ID NO: 596371 - protein, 8 aa, Mycobacterium
THGPERGS

SEQ ID NO: 596372 - protein, 9 aa, Mycobacterium
THGPGGEFN

SEQ ID NO: 596373 - protein, 19 aa, Mycobacterium
THGPGSPEGEAASAKLPKL

SEQ ID NO: 596374 - protein, 8 aa, Mycobacterium
THGPQGSL

SEQ ID NO: 596375 - protein, 11 aa, Mycobacterium
THGPRTTGGHE

SEQ ID NO: 596376 - protein, 4 aa, Mycobacterium
THGR

SEQ ID NO: 596377 - protein, 7 aa, Mycobacterium
THGRGTD

SEQ ID NO: 596378 - protein, 19 aa, Mycobacterium
THGRPTDRNAHPHRDSSGK

SEQ ID NO: 596379 - protein, 4 aa, Mycobacterium
THGS

SEQ ID NO: 596380 - protein, 5 aa, Mycobacterium
THGSM

SEQ ID NO: 596381 - protein, 5 aa, Mycobacterium
THGSP

SEQ ID NO: 596382 - protein, 11 aa, Mycobacterium
THGTGTPLGDP

SEQ ID NO: 596383 - protein, 7 aa, Mycobacterium
THGTGTV

SEQ ID NO: 596384 - protein, 6 aa, Mycobacterium
THGTLQ

SEQ ID NO: 596385 - protein, 5 aa, Mycobacterium
THGTP

SEQ ID NO: 596386 - protein, 15 aa, Mycobacterium
THGTPPRGTARARPQ

SEQ ID NO: 596387 - protein, 8 aa, Mycobacterium
THGTPPRV

SEQ ID NO: 596388 - protein, 14 aa, Mycobacterium
THGTSSSIGAGATV

SEQ ID NO: 596389 - protein, 9 aa, Mycobacterium
THGWESNPE

SEQ ID NO: 596390 - protein, 6 aa, Mycobacterium
THGYDT

SEQ ID NO: 596391 - protein, 7 aa, Mycobacterium
THGYDTT

SEQ ID NO: 596392 - protein, 8 aa, Mycobacterium
THGYDTTD

SEQ ID NO: 596393 - protein, 13 aa, Mycobacterium
THGYSAQKENYAK

SEQ ID NO: 596394 - protein, 5 aa, Mycobacterium
THHDE

SEQ ID NO: 596395 - protein, 41 aa, Mycobacterium
THHGGRGGAAAKQSAAPDQLGSGGAAVEGGAGEIPGDPTLQ

SEQ ID NO: 596396 - protein, 41 aa, Mycobacterium
THHGGRGGADDKQRAAPDQLGSGGPAVEGGAGPIPADPTLQ

SEQ ID NO: 596397 - protein, 12 aa, Mycobacterium
THIPESDRAVDA

SEQ ID NO: 596398 - protein, 6 aa, Mycobacterium
THKDAR

SEQ ID NO: 596399 - protein, 5 aa, Mycobacterium
THKPV

SEQ ID NO: 596400 - protein, 8 aa, Mycobacterium
THKRTGVP

SEQ ID NO: 596401 - protein, 8 aa, Mycobacterium
THLPEGSA

SEQ ID NO: 596402 - protein, 6 aa, Mycobacterium
THLPQR

SEQ ID NO: 596403 - protein, 10 aa, Mycobacterium
THNATSPEEL

SEQ ID NO: 596404 - protein, 18 aa, Mycobacterium
THNGPAPGKGAPPAGNGM

SEQ ID NO: 596405 - protein, 7 aa, Mycobacterium
THNPTGA

SEQ ID NO: 596406 - protein, 4 aa, Mycobacterium
THPA

SEQ ID NO: 596407 - protein, 6 aa, Mycobacterium
THPAER

SEQ ID NO: 596408 - protein, 11 aa, Mycobacterium
THPAPDRDALG

SEQ ID NO: 596409 - protein, 9 aa, Mycobacterium
THPAPKVSA

SEQ ID NO: 596410 - protein, 5 aa, Mycobacterium
THPAQ

SEQ ID NO: 596411 - protein, 5 aa, Mycobacterium
THPAS

SEQ ID NO: 596412 - protein, 5 aa, Mycobacterium
THPAV

SEQ ID NO: 596413 - protein, 20 aa, Mycobacterium
THPCNTGKPEFANGPRGGRL

SEQ ID NO: 596414 - protein, 5 aa, Mycobacterium
THPDE

SEQ ID NO: 596415 - protein, 6 aa, Mycobacterium
THPDGR

SEQ ID NO: 596416 - protein, 8 aa, Mycobacterium
THPDGRPH

SEQ ID NO: 596417 - protein, 9 aa, Mycobacterium
THPDGRQPA

SEQ ID NO: 596418 - protein, 7 aa, Mycobacterium
THPDGSV

SEQ ID NO: 596419 - protein, 7 aa, Mycobacterium
THPDGTS

SEQ ID NO: 596420 - protein, 5 aa, Mycobacterium
THPDR

SEQ ID NO: 596421 - protein, 6 aa, Mycobacterium
THPDRF

SEQ ID NO: 596422 - protein, 10 aa, Mycobacterium
THPDRPDAPN

SEQ ID NO: 596423 - protein, 11 aa, Mycobacterium
THPDRPDAPNM

SEQ ID NO: 596424 - protein, 13 aa, Mycobacterium
THPDTGAPAGTGA

SEQ ID NO: 596425 - protein, 7 aa, Mycobacterium
THPEATI

SEQ ID NO: 596426 - protein, 7 aa, Mycobacterium
THPEDRA

SEQ ID NO: 596427 - protein, 5 aa, Mycobacterium
THPEE

SEQ ID NO: 596428 - protein, 6 aa, Mycobacterium
THPESS

SEQ ID NO: 596429 - protein, 8 aa, Mycobacterium
THPFGQAP

SEQ ID NO: 596430 - protein, 15 aa, Mycobacterium
THPGHTWTKVPSLLW

SEQ ID NO: 596431 - protein, 6 aa, Mycobacterium
THPGLR

SEQ ID NO: 596432 - protein, 5 aa, Mycobacterium
THPGN

SEQ ID NO: 596433 - protein, 5 aa, Mycobacterium
THPGV

SEQ ID NO: 596434 - protein, 5 aa, Mycobacterium
THPHD

SEQ ID NO: 596435 - protein, 5 aa, Mycobacterium
THPLT

SEQ ID NO: 596436 - protein, 5 aa, Mycobacterium
THPNA

SEQ ID NO: 596437 - protein, 19 aa, Mycobacterium
THPNNPGTRRQADLSSRLT

SEQ ID NO: 596438 - protein, 15 aa, Mycobacterium
THPNVNASYNEESKE

SEQ ID NO: 596439 - protein, 11 aa, Mycobacterium
THPNYPDRHEP

SEQ ID NO: 596440 - protein, 11 aa, Mycobacterium
THPNYPERHEP

SEQ ID NO: 596441 - protein, 14 aa, Mycobacterium
THPNYPERHEPGHP

SEQ ID NO: 596442 - protein, 12 aa, Mycobacterium
THPNYPERHEPS

SEQ ID NO: 596443 - protein, 6 aa, Mycobacterium
THPPAA

SEQ ID NO: 596444 - protein, 24 aa, Mycobacterium
THPPEAAENPGAANGKAEPAPHTA

SEQ ID NO: 596445 - protein, 13 aa, Mycobacterium
THPPFTTAEAAGR

SEQ ID NO: 596446 - protein, 18 aa, Mycobacterium
THPPGTTDKFGPELTDRT

SEQ ID NO: 596447 - protein, 9 aa, Mycobacterium
THPPNRHET

SEQ ID NO: 596448 - protein, 4 aa, Mycobacterium
THPQ

SEQ ID NO: 596449 - protein, 5 aa, Mycobacterium
THPQG

SEQ ID NO: 596450 - protein, 5 aa, Mycobacterium
THPRE

SEQ ID NO: 596451 - protein, 5 aa, Mycobacterium
THPSA

SEQ ID NO: 596452 - protein, 6 aa, Mycobacterium
THPSDD

SEQ ID NO: 596453 - protein, 10 aa, Mycobacterium
THQDLGNSTA

SEQ ID NO: 596454 - protein, 8 aa, Mycobacterium
THQEPGLG

SEQ ID NO: 596455 - protein, 4 aa, Mycobacterium
THQG

SEQ ID NO: 596456 - protein, 5 aa, Mycobacterium
THQGA

SEQ ID NO: 596457 - protein, 6 aa, Mycobacterium
THQGTA

SEQ ID NO: 596458 - protein, 9 aa, Mycobacterium
THQPPGDRV

SEQ ID NO: 596459 - protein, 11 aa, Mycobacterium
THQRGEGHAVG

SEQ ID NO: 596460 - protein, 6 aa, Mycobacterium
THQRGP

SEQ ID NO: 596461 - protein, 8 aa, Mycobacterium
THQRRTRR

SEQ ID NO: 596462 - protein, 9 aa, Mycobacterium
THQSGGGED

SEQ ID NO: 596463 - protein, 6 aa, Mycobacterium
THQSTE

SEQ ID NO: 596464 - protein, 4 aa, Mycobacterium
THQT

SEQ ID NO: 596465 - protein, 8 aa, Mycobacterium
THQTGTEQ

SEQ ID NO: 596466 - protein, 8 aa, Mycobacterium
THRASELA

SEQ ID NO: 596467 - protein, 5 aa, Mycobacterium
THRAT

SEQ ID NO: 596468 - protein, 4 aa, Mycobacterium
THRD

SEQ ID NO: 596469 - protein, 11 aa, Mycobacterium
THRDDETSTTT

SEQ ID NO: 596470 - protein, 16 aa, Mycobacterium
THRDGDVTTAALGGGY

SEQ ID NO: 596471 - protein, 13 aa, Mycobacterium
THRDQAISALTAL

SEQ ID NO: 596472 - protein, 9 aa, Mycobacterium
THRDSTGNH

SEQ ID NO: 596473 - protein, 9 aa, Mycobacterium
THRDSTGTH

SEQ ID NO: 596474 - protein, 5 aa, Mycobacterium
THRDT

SEQ ID NO: 596475 - protein, 9 aa, Mycobacterium
THREASEAH

SEQ ID NO: 596476 - protein, 6 aa, Mycobacterium
THRECP

SEQ ID NO: 596477 - protein, 5 aa, Mycobacterium
THREE

SEQ ID NO: 596478 - protein, 6 aa, Mycobacterium
THRETP

SEQ ID NO: 596479 - protein, 10 aa, Mycobacterium
THRGEGTVDP

SEQ ID NO: 596480 - protein, 9 aa, Mycobacterium
THRGPDGAQ

SEQ ID NO: 596481 - protein, 22 aa, Mycobacterium
THRGPGSSTCPSDAARAVGGSG

SEQ ID NO: 596482 - protein, 10 aa, Mycobacterium
THRHSSGSPF

SEQ ID NO: 596483 - protein, 8 aa, Mycobacterium
THRKQHGT

SEQ ID NO: 596484 - protein, 18 aa, Mycobacterium
THRNPDRQLPSEGTTRGA

SEQ ID NO: 596485 - protein, 5 aa, Mycobacterium
THRPD

SEQ ID NO: 596486 - protein, 14 aa, Mycobacterium
THRPGAGDRNGETL

SEQ ID NO: 596487 - protein, 12 aa, Mycobacterium
THRPSWKPRTLP

SEQ ID NO: 596488 - protein, 6 aa, Mycobacterium
THRRRG

SEQ ID NO: 596489 - protein, 4 aa, Mycobacterium
THRS

SEQ ID NO: 596490 - protein, 9 aa, Mycobacterium
THRSSAGTA

SEQ ID NO: 596491 - protein, 5 aa, Mycobacterium
THRTD

SEQ ID NO: 596492 - protein, 7 aa, Mycobacterium
THSANAS

SEQ ID NO: 596493 - protein, 9 aa, Mycobacterium
THSDGSGVH

SEQ ID NO: 596494 - protein, 15 aa, Mycobacterium
THSDPGPDGPVTSEY

SEQ ID NO: 596495 - protein, 7 aa, Mycobacterium
THSEPHW

SEQ ID NO: 596496 - protein, 4 aa, Mycobacterium
THSG

SEQ ID NO: 596497 - protein, 6 aa, Mycobacterium
THSGSY

SEQ ID NO: 596498 - protein, 9 aa, Mycobacterium
THSKHSGTD

SEQ ID NO: 596499 - protein, 9 aa, Mycobacterium
THSPDRPPA

SEQ ID NO: 596500 - protein, 10 aa, Mycobacterium
THSPDRPPDL

SEQ ID NO: 596501 - protein, 9 aa, Mycobacterium
THSPDRPPR

SEQ ID NO: 596502 - protein, 18 aa, Mycobacterium
THSPGRAPAAVAEAKAAG

SEQ ID NO: 596503 - protein, 6 aa, Mycobacterium
THSRAT

SEQ ID NO: 596504 - protein, 13 aa, Mycobacterium
THSRESATKAISY

SEQ ID NO: 596505 - protein, 7 aa, Mycobacterium
THSRHQR

SEQ ID NO: 596506 - protein, 7 aa, Mycobacterium
THSRSSV

SEQ ID NO: 596507 - protein, 7 aa, Mycobacterium
THSTEAD

SEQ ID NO: 596508 - protein, 5 aa, Mycobacterium
THSTP

SEQ ID NO: 596509 - protein, 12 aa, Mycobacterium
THSTPAASTDDI

SEQ ID NO: 596510 - protein, 6 aa, Mycobacterium
THTAAP

SEQ ID NO: 596511 - protein, 5 aa, Mycobacterium
THTAP

SEQ ID NO: 596512 - protein, 12 aa, Mycobacterium
THTDDPDKAQRL

SEQ ID NO: 596513 - protein, 6 aa, Mycobacterium
THTDGS

SEQ ID NO: 596514 - protein, 16 aa, Mycobacterium
THTDRPKRVRKPGEPL

SEQ ID NO: 596515 - protein, 6 aa, Mycobacterium
THTGER

SEQ ID NO: 596516 - protein, 9 aa, Mycobacterium
THTGGGVAT

SEQ ID NO: 596517 - protein, 8 aa, Mycobacterium
THTGQKRA

SEQ ID NO: 596518 - protein, 5 aa, Mycobacterium
THTPR

SEQ ID NO: 596519 - protein, 10 aa, Mycobacterium
THTPSPNTVR

SEQ ID NO: 596520 - protein, 5 aa, Mycobacterium
THTQQ

SEQ ID NO: 596521 - protein, 8 aa, Mycobacterium
THTQSGSV

SEQ ID NO: 596522 - protein, 5 aa, Mycobacterium
THTRA

SEQ ID NO: 596523 - protein, 6 aa, Mycobacterium
THTRRG

SEQ ID NO: 596524 - protein, 8 aa, Mycobacterium
THTTANPV

SEQ ID NO: 596525 - protein, 6 aa, Mycobacterium
THTTKV

SEQ ID NO: 596526 - protein, 16 aa, Mycobacterium
THTTRGPQTPHPAEPH

SEQ ID NO: 596527 - protein, 5 aa, Mycobacterium
THTVT

SEQ ID NO: 596528 - protein, 10 aa, Mycobacterium
THVESSAQIG

SEQ ID NO: 596529 - protein, 6 aa, Mycobacterium
THVGPG

SEQ ID NO: 596530 - protein, 6 aa, Mycobacterium
THVPDA

SEQ ID NO: 596531 - protein, 6 aa, Mycobacterium
THVPEN

SEQ ID NO: 596532 - protein, 4 aa, Mycobacterium
THVR

SEQ ID NO: 596533 - protein, 8 aa, Mycobacterium
THVTEKER

SEQ ID NO: 596534 - protein, 16 aa, Mycobacterium
THVTETAQREIEGPMD

SEQ ID NO: 596535 - protein, 5 aa, Mycobacterium
THYAQ

SEQ ID NO: 596536 - protein, 7 aa, Mycobacterium
THYEKSG

SEQ ID NO: 596537 - protein, 11 aa, Mycobacterium
TIAAADPPQHT

SEQ ID NO: 596538 - protein, 5 aa, Mycobacterium
TIAAG

SEQ ID NO: 596539 - protein, 4 aa, Mycobacterium
TIAD

SEQ ID NO: 596540 - protein, 12 aa, Mycobacterium
TIADASGVPTEI

SEQ ID NO: 596541 - protein, 7 aa, Mycobacterium
TIADGAD

SEQ ID NO: 596542 - protein, 12 aa, Mycobacterium
TIAEGDVDRARR

SEQ ID NO: 596543 - protein, 12 aa, Mycobacterium
TIAEGNVDRARR

SEQ ID NO: 596544 - protein, 6 aa, Mycobacterium
TIAGAD

SEQ ID NO: 596545 - protein, 9 aa, Mycobacterium
TIAGARGAT

SEQ ID NO: 596546 - protein, 12 aa, Mycobacterium
TIAGETESFTGT

SEQ ID NO: 596547 - protein, 9 aa, Mycobacterium
TIAGGTSEI

SEQ ID NO: 596548 - protein, 8 aa, Mycobacterium
TIAGPAGP

SEQ ID NO: 596549 - protein, 8 aa, Mycobacterium
TIAGPGGH

SEQ ID NO: 596550 - protein, 19 aa, Mycobacterium
TIAGQPDRLTAGRETRFAE

SEQ ID NO: 596551 - protein, 60 aa, Mycobacterium
TIAGRPVAAPGAGPVEPTFPTPRPTASPPGPTASPAPGLPTTPANPTAPAGAIPLPPDEN

SEQ ID NO: 596552 - protein, 8 aa, Mycobacterium
TIAGTYDG

SEQ ID NO: 596553 - protein, 5 aa, Mycobacterium
TIAPE

SEQ ID NO: 596554 - protein, 12 aa, Mycobacterium
TIAPNGDVRPPI

SEQ ID NO: 596555 - protein, 9 aa, Mycobacterium
TIAPRDARH

SEQ ID NO: 596556 - protein, 11 aa, Mycobacterium
TIAPTDATEAT

SEQ ID NO: 596557 - protein, 12 aa, Mycobacterium
TIAQNGAAMTGS

SEQ ID NO: 596558 - protein, 7 aa, Mycobacterium
TIARPNQ

SEQ ID NO: 596559 - protein, 8 aa, Mycobacterium
TIARSAGP

SEQ ID NO: 596560 - protein, 15 aa, Mycobacterium
TIARSEGKARRIVDH

SEQ ID NO: 596561 - protein, 8 aa, Mycobacterium
TIARTKSD

SEQ ID NO: 596562 - protein, 13 aa, Mycobacterium
TIARTKSGTVATR

SEQ ID NO: 596563 - protein, 5 aa, Mycobacterium
TIASA

SEQ ID NO: 596564 - protein, 10 aa, Mycobacterium
TIASGAYQDS

SEQ ID NO: 596565 - protein, 6 aa, Mycobacterium
TIASGG

SEQ ID NO: 596566 - protein, 4 aa, Mycobacterium
TIAT

SEQ ID NO: 596567 - protein, 5 aa, Mycobacterium
TIATA

SEQ ID NO: 596568 - protein, 7 aa, Mycobacterium
TIATDEL

SEQ ID NO: 596569 - protein, 20 aa, Mycobacterium
TIATDGMDANYTQEAKDRWS

SEQ ID NO: 596570 - protein, 5 aa, Mycobacterium
TIATG

SEQ ID NO: 596571 - protein, 9 aa, Mycobacterium
TIDAARARG

SEQ ID NO: 596572 - protein, 8 aa, Mycobacterium
TIDADTAA

SEQ ID NO: 596573 - protein, 5 aa, Mycobacterium
TIDAE

SEQ ID NO: 596574 - protein, 9 aa, Mycobacterium
TIDAEGKTR

SEQ ID NO: 596575 - protein, 8 aa, Mycobacterium
TIDAGTAR

SEQ ID NO: 596576 - protein, 17 aa, Mycobacterium
TIDAGTASEWGLVDATR

SEQ ID NO: 596577 - protein, 4 aa, Mycobacterium
TIDD

SEQ ID NO: 596578 - protein, 8 aa, Mycobacterium
TIDDETTE

SEQ ID NO: 596579 - protein, 18 aa, Mycobacterium
TIDEPGSPYAPGIERASQ

SEQ ID NO: 596580 - protein, 11 aa, Mycobacterium
TIDESADAATL

SEQ ID NO: 596581 - protein, 5 aa, Mycobacterium
TIDET

SEQ ID NO: 596582 - protein, 5 aa, Mycobacterium
TIDGR

SEQ ID NO: 596583 - protein, 13 aa, Mycobacterium
TIDGSQFSGIGGA

SEQ ID NO: 596584 - protein, 5 aa, Mycobacterium
TIDKA

SEQ ID NO: 596585 - protein, 5 aa, Mycobacterium
TIDNA

SEQ ID NO: 596586 - protein, 5 aa, Mycobacterium
TIDPD

SEQ ID NO: 596587 - protein, 9 aa, Mycobacterium
TIDPEPDGL

SEQ ID NO: 596588 - protein, 5 aa, Mycobacterium
TIDPG

SEQ ID NO: 596589 - protein, 6 aa, Mycobacterium
TIDPTT

SEQ ID NO: 596590 - protein, 7 aa, Mycobacterium
TIDRESA

SEQ ID NO: 596591 - protein, 7 aa, Mycobacterium
TIDRPDH

SEQ ID NO: 596592 - protein, 4 aa, Mycobacterium
TIEA

SEQ ID NO: 596593 - protein, 13 aa, Mycobacterium
TIEADSAESRGTT

SEQ ID NO: 596594 - protein, 5 aa, Mycobacterium
TIEDE

SEQ ID NO: 596595 - protein, 6 aa, Mycobacterium
TIEDPI

SEQ ID NO: 596596 - protein, 7 aa, Mycobacterium
TIEESGV

SEQ ID NO: 596597 - protein, 6 aa, Mycobacterium
TIEGAG

SEQ ID NO: 596598 - protein, 9 aa, Mycobacterium
TIEGPAGPI

SEQ ID NO: 596599 - protein, 5 aa, Mycobacterium
TIEHD

SEQ ID NO: 596600 - protein, 15 aa, Mycobacterium
TIEKRDWSGHPGAAL

SEQ ID NO: 596601 - protein, 5 aa, Mycobacterium
TIEPG

SEQ ID NO: 596602 - protein, 6 aa, Mycobacterium
TIEPGA

SEQ ID NO: 596603 - protein, 6 aa, Mycobacterium
TIEPGG

SEQ ID NO: 596604 - protein, 4 aa, Mycobacterium
TIER

SEQ ID NO: 596605 - protein, 9 aa, Mycobacterium
TIESNSVNE

SEQ ID NO: 596606 - protein, 13 aa, Mycobacterium
TIESPHPSPLSAS

SEQ ID NO: 596607 - protein, 11 aa, Mycobacterium
TIETEGEGEFT

SEQ ID NO: 596608 - protein, 4 aa, Mycobacterium
TIGA

SEQ ID NO: 596609 - protein, 8 aa, Mycobacterium
TIGAAGVS

SEQ ID NO: 596610 - protein, 13 aa, Mycobacterium
TIGADGALHSSSG

SEQ ID NO: 596611 - protein, 5 aa, Mycobacterium
TIGAS

SEQ ID NO: 596612 - protein, 11 aa, Mycobacterium
TIGDEGDSQLG

SEQ ID NO: 596613 - protein, 15 aa, Mycobacterium
TIGDGWSGPGARAAL

SEQ ID NO: 596614 - protein, 8 aa, Mycobacterium
TIGDTAGV

SEQ ID NO: 596615 - protein, 12 aa, Mycobacterium
TIGEEDHSEIDS

SEQ ID NO: 596616 - protein, 11 aa, Mycobacterium
TIGEQKQTNYA

SEQ ID NO: 596617 - protein, 12 aa, Mycobacterium
TIGGAESAGGAR

SEQ ID NO: 596618 - protein, 8 aa, Mycobacterium
TIGGEAPE

SEQ ID NO: 596619 - protein, 12 aa, Mycobacterium
TIGGGARSGELT

SEQ ID NO: 596620 - protein, 5 aa, Mycobacterium
TIGGK

SEQ ID NO: 596621 - protein, 6 aa, Mycobacterium
TIGGNA

SEQ ID NO: 596622 - protein, 8 aa, Mycobacterium
TIGGTNNK

SEQ ID NO: 596623 - protein, 5 aa, Mycobacterium
TIGGY

SEQ ID NO: 596624 - protein, 10 aa, Mycobacterium
TIGKDGEFAS

SEQ ID NO: 596625 - protein, 11 aa, Mycobacterium
TIGKDGEYASA

SEQ ID NO: 596626 - protein, 12 aa, Mycobacterium
TIGNRGNSTGPH

SEQ ID NO: 596627 - protein, 9 aa, Mycobacterium
TIGPNGQPH

SEQ ID NO: 596628 - protein, 8 aa, Mycobacterium
TIGPSDTD

SEQ ID NO: 596629 - protein, 10 aa, Mycobacterium
TIGPSNLGGA

SEQ ID NO: 596630 - protein, 4 aa, Mycobacterium
TIGQ

SEQ ID NO: 596631 - protein, 5 aa, Mycobacterium
TIGQD

SEQ ID NO: 596632 - protein, 7 aa, Mycobacterium
TIGRDGS

SEQ ID NO: 596633 - protein, 10 aa, Mycobacterium
TIGRGSSEDT

SEQ ID NO: 596634 - protein, 6 aa, Mycobacterium
TIGRPD

SEQ ID NO: 596635 - protein, 10 aa, Mycobacterium
TIGRSSTEDT

SEQ ID NO: 596636 - protein, 8 aa, Mycobacterium
TIGSAQDR

SEQ ID NO: 596637 - protein, 11 aa, Mycobacterium
TIGSTDARTPL

SEQ ID NO: 596638 - protein, 20 aa, Mycobacterium
TIGTDDGAIDLGTQRTVVRY

SEQ ID NO: 596639 - protein, 10 aa, Mycobacterium
TIGTTTPGRV

SEQ ID NO: 596640 - protein, 10 aa, Mycobacterium
TIGTTTPRRV

SEQ ID NO: 596641 - protein, 11 aa, Mycobacterium
TIKASRDPKAR

SEQ ID NO: 596642 - protein, 4 aa, Mycobacterium
TILD

SEQ ID NO: 596643 - protein, 8 aa, Mycobacterium
TINADPEV

SEQ ID NO: 596644 - protein, 8 aa, Mycobacterium
TINDTRSR

SEQ ID NO: 596645 - protein, 5 aa, Mycobacterium
TINEE

SEQ ID NO: 596646 - protein, 13 aa, Mycobacterium
TINGGQFSGIGGA

SEQ ID NO: 596647 - protein, 6 aa, Mycobacterium
TINPGQ

SEQ ID NO: 596648 - protein, 6 aa, Mycobacterium
TINSGG

SEQ ID NO: 596649 - protein, 9 aa, Mycobacterium
TINSSNVTD

SEQ ID NO: 596650 - protein, 4 aa, Mycobacterium
TIPA

SEQ ID NO: 596651 - protein, 12 aa, Mycobacterium
TIPADASYEPKW

SEQ ID NO: 596652 - protein, 5 aa, Mycobacterium
TIPAG

SEQ ID NO: 596653 - protein, 6 aa, Mycobacterium
TIPAGR

SEQ ID NO: 596654 - protein, 14 aa, Mycobacterium
TIPANEGADLSPAG

SEQ ID NO: 596655 - protein, 9 aa, Mycobacterium
TIPAPPNLG

SEQ ID NO: 596656 - protein, 6 aa, Mycobacterium
TIPATP

SEQ ID NO: 596657 - protein, 6 aa, Mycobacterium
TIPATS

SEQ ID NO: 596658 - protein, 5 aa, Mycobacterium
TIPCG

SEQ ID NO: 596659 - protein, 4 aa, Mycobacterium
TIPE

SEQ ID NO: 596660 - protein, 16 aa, Mycobacterium
TIPEPAPIDDDDRDQY

SEQ ID NO: 596661 - protein, 5 aa, Mycobacterium
TIPGK

SEQ ID NO: 596662 - protein, 14 aa, Mycobacterium
TIPGQLSARTSSNL

SEQ ID NO: 596663 - protein, 29 aa, Mycobacterium
TIPGTEVAEQGAPGVPGMPVGTGKRATSV

SEQ ID NO: 596664 - protein, 11 aa, Mycobacterium
TIPGVAQAKDG

SEQ ID NO: 596665 - protein, 6 aa, Mycobacterium
TIPNDR

SEQ ID NO: 596666 - protein, 18 aa, Mycobacterium
TIPPEQAYGPAGGGHRLS

SEQ ID NO: 596667 - protein, 10 aa, Mycobacterium
TIPPGTQPAS

SEQ ID NO: 596668 - protein, 13 aa, Mycobacterium
TIPPGTQPGSVTT

SEQ ID NO: 596669 - protein, 10 aa, Mycobacterium
TIPPGTQPNS

SEQ ID NO: 596670 - protein, 12 aa, Mycobacterium
TIPPPGTAVANP

SEQ ID NO: 596671 - protein, 16 aa, Mycobacterium
TIPPPGTAVPEPIDPA

SEQ ID NO: 596672 - protein, 12 aa, Mycobacterium
TIPRTSSGKIGH

SEQ ID NO: 596673 - protein, 4 aa, Mycobacterium
TIPS

SEQ ID NO: 596674 - protein, 5 aa, Mycobacterium
TIPSN

SEQ ID NO: 596675 - protein, 9 aa, Mycobacterium
TIPSRGPAA

SEQ ID NO: 596676 - protein, 13 aa, Mycobacterium
TIPSSLSSSFQTG

SEQ ID NO: 596677 - protein, 13 aa, Mycobacterium
TIPTDGGTGAAGG

SEQ ID NO: 596678 - protein, 9 aa, Mycobacterium
TIPTENEPW

SEQ ID NO: 596679 - protein, 14 aa, Mycobacterium
TIPTGPDNAKPPPA

SEQ ID NO: 596680 - protein, 12 aa, Mycobacterium
TIPVDRGAGAGA

SEQ ID NO: 596681 - protein, 10 aa, Mycobacterium
TIQDGAAVNT

SEQ ID NO: 596682 - protein, 31 aa, Mycobacterium
TIQGDTAITPYGAGTQGSRSAPMTAGAVNEA

SEQ ID NO: 596683 - protein, 31 aa, Mycobacterium
TIQGDTAVTPYGAGTQGSRSAPMTAGAVNEA

SEQ ID NO: 596684 - protein, 32 aa, Mycobacterium
TIQGDTAVTPYGAGTQGSRSAPMTAGAVNEAG

SEQ ID NO: 596685 - protein, 5 aa, Mycobacterium
TIQPS

SEQ ID NO: 596686 - protein, 5 aa, Mycobacterium
TIRAH

SEQ ID NO: 596687 - protein, 6 aa, Mycobacterium
TIRDAG

SEQ ID NO: 596688 - protein, 14 aa, Mycobacterium
TIRDPASSPERRAA

SEQ ID NO: 596689 - protein, 6 aa, Mycobacterium
TIRGEE

SEQ ID NO: 596690 - protein, 5 aa, Mycobacterium
TIRPA

SEQ ID NO: 596691 - protein, 5 aa, Mycobacterium
TIRPG

SEQ ID NO: 596692 - protein, 7 aa, Mycobacterium
TIRPGSP

SEQ ID NO: 596693 - protein, 10 aa, Mycobacterium
TIRPLDGEEA

SEQ ID NO: 596694 - protein, 8 aa, Mycobacterium
TIRRPPRC

SEQ ID NO: 596695 - protein, 12 aa, Mycobacterium
TIRSGKGQKKLR

SEQ ID NO: 596696 - protein, 7 aa, Mycobacterium
TIRTASR

SEQ ID NO: 596697 - protein, 8 aa, Mycobacterium
TIRTASRD

SEQ ID NO: 596698 - protein, 6 aa, Mycobacterium
TIRTGD

SEQ ID NO: 596699 - protein, 10 aa, Mycobacterium
TISDAAGVTV

SEQ ID NO: 596700 - protein, 10 aa, Mycobacterium
TISDDASMDS

SEQ ID NO: 596701 - protein, 6 aa, Mycobacterium
TISDPT

SEQ ID NO: 596702 - protein, 13 aa, Mycobacterium
TISDTGTETPPGA

SEQ ID NO: 596703 - protein, 20 aa, Mycobacterium
TISEAGQTMAQTEAGVTGMF

SEQ ID NO: 596704 - protein, 4 aa, Mycobacterium
TISG

SEQ ID NO: 596705 - protein, 9 aa, Mycobacterium
TISGEPADV

SEQ ID NO: 596706 - protein, 9 aa, Mycobacterium
TISGGLSSA

SEQ ID NO: 596707 - protein, 7 aa, Mycobacterium
TISGSEL

SEQ ID NO: 596708 - protein, 13 aa, Mycobacterium
TISGTEPDDAPEV

SEQ ID NO: 596709 - protein, 15 aa, Mycobacterium
TISGTGSGSSARAAV

SEQ ID NO: 596710 - protein, 10 aa, Mycobacterium
TISNRAGVAR

SEQ ID NO: 596711 - protein, 7 aa, Mycobacterium
TISPEET

SEQ ID NO: 596712 - protein, 10 aa, Mycobacterium
TISPKGGEIV

SEQ ID NO: 596713 - protein, 15 aa, Mycobacterium
TISRDGGEVWSTNAK

SEQ ID NO: 596714 - protein, 13 aa, Mycobacterium
TISRGPKATGELR

SEQ ID NO: 596715 - protein, 12 aa, Mycobacterium
TISRRQASRPGH

SEQ ID NO: 596716 - protein, 6 aa, Mycobacterium
TISSAA

SEQ ID NO: 596717 - protein, 9 aa, Mycobacterium
TISSGEPGA

SEQ ID NO: 596718 - protein, 9 aa, Mycobacterium
TISSNEPGA

SEQ ID NO: 596719 - protein, 8 aa, Mycobacterium
TISSPGAL

SEQ ID NO: 596720 - protein, 9 aa, Mycobacterium
TISTGDDGA

SEQ ID NO: 596721 - protein, 18 aa, Mycobacterium
TISTPERQKELDKQDSRF

SEQ ID NO: 596722 - protein, 12 aa, Mycobacterium
TITAGTKALSSE

SEQ ID NO: 596723 - protein, 14 aa, Mycobacterium
TITARRAPSVTTRS

SEQ ID NO: 596724 - protein, 7 aa, Mycobacterium
TITDNPD

SEQ ID NO: 596725 - protein, 9 aa, Mycobacterium
TITDPDAAK

SEQ ID NO: 596726 - protein, 5 aa, Mycobacterium
TITDR

SEQ ID NO: 596727 - protein, 10 aa, Mycobacterium
TITDRKEVGD

SEQ ID NO: 596728 - protein, 12 aa, Mycobacterium
TITEATGRRPRG

SEQ ID NO: 596729 - protein, 11 aa, Mycobacterium
TITEDEAATLA

SEQ ID NO: 596730 - protein, 21 aa, Mycobacterium
TITGAAPARSVYEPAPRSPAL

SEQ ID NO: 596731 - protein, 8 aa, Mycobacterium
TITGEHGV

SEQ ID NO: 596732 - protein, 19 aa, Mycobacterium
TITGGADPAAAAAKAGQQG

SEQ ID NO: 596733 - protein, 7 aa, Mycobacterium
TITGGTM

SEQ ID NO: 596734 - protein, 8 aa, Mycobacterium
TITGGTPR

SEQ ID NO: 596735 - protein, 9 aa, Mycobacterium
TITGGTQQF

SEQ ID NO: 596736 - protein, 9 aa, Mycobacterium
TITGQAPAR

SEQ ID NO: 596737 - protein, 18 aa, Mycobacterium
TITGRDADRGAAAAAELG

SEQ ID NO: 596738 - protein, 7 aa, Mycobacterium
TITGSGT

SEQ ID NO: 596739 - protein, 4 aa, Mycobacterium
TITN

SEQ ID NO: 596740 - protein, 9 aa, Mycobacterium
TITPDGPAS

SEQ ID NO: 596741 - protein, 10 aa, Mycobacterium
TITPDGPESP

SEQ ID NO: 596742 - protein, 7 aa, Mycobacterium
TITPETS

SEQ ID NO: 596743 - protein, 13 aa, Mycobacterium
TITPGLESPTIAP

SEQ ID NO: 596744 - protein, 6 aa, Mycobacterium
TITPGS

SEQ ID NO: 596745 - protein, 21 aa, Mycobacterium
TITPSPTSTTAGTHGAGIGPI

SEQ ID NO: 596746 - protein, 7 aa, Mycobacterium
TITQGTD

SEQ ID NO: 596747 - protein, 16 aa, Mycobacterium
TITRDGSTERLTNARP

SEQ ID NO: 596748 - protein, 6 aa, Mycobacterium
TITSPG

SEQ ID NO: 596749 - protein, 8 aa, Mycobacterium
TITSRGPH

SEQ ID NO: 596750 - protein, 11 aa, Mycobacterium
TITTGSEFADR

SEQ ID NO: 596751 - protein, 15 aa, Mycobacterium
TITTTYRPRPKARFA

SEQ ID NO: 596752 - protein, 8 aa, Mycobacterium
TIYGGSSE

SEQ ID NO: 596753 - protein, 14 aa, Mycobacterium
TKAAADAGRPPPRI

SEQ ID NO: 596754 - protein, 11 aa, Mycobacterium
TKAAADDLSDD

SEQ ID NO: 596755 - protein, 28 aa, Mycobacterium
TKAAAKPAKEADDDSLPEPSEKDKASGD

SEQ ID NO: 596756 - protein, 13 aa, Mycobacterium
TKAAEQRAAQGGG

SEQ ID NO: 596757 - protein, 8 aa, Mycobacterium
TKADGEAV

SEQ ID NO: 596758 - protein, 14 aa, Mycobacterium
TKADPEKVNPSGGA

SEQ ID NO: 596759 - protein, 6 aa, Mycobacterium
TKADTV

SEQ ID NO: 596760 - protein, 7 aa, Mycobacterium
TKADTVD

SEQ ID NO: 596761 - protein, 11 aa, Mycobacterium
TKAEVQPNPSG

SEQ ID NO: 596762 - protein, 4 aa, Mycobacterium
TKAG

SEQ ID NO: 596763 - protein, 107 aa, Mycobacterium
TKAGGDVTKNLEGATGDLPEIKAPPAGGTPVGLPSGKPLEAPVEATPGPHTAAPGAPHEPPGPVGEAPASEPTTGPHEPTPGGGPREPMPPTAASPVAAAPAAAGER

SEQ ID NO: 596764 - protein, 7 aa, Mycobacterium
TKAGGRV

SEQ ID NO: 596765 - protein, 10 aa, Mycobacterium
TKAGGTAIAS

SEQ ID NO: 596766 - protein, 7 aa, Mycobacterium
TKAGPQA

SEQ ID NO: 596767 - protein, 5 aa, Mycobacterium
TKAIP

SEQ ID NO: 596768 - protein, 7 aa, Mycobacterium
TKAKELG

SEQ ID NO: 596769 - protein, 6 aa, Mycobacterium
TKAKER

SEQ ID NO: 596770 - protein, 8 aa, Mycobacterium
TKAKSAIR

SEQ ID NO: 596771 - protein, 7 aa, Mycobacterium
TKAKTQL

SEQ ID NO: 596772 - protein, 14 aa, Mycobacterium
TKAKVRDTRKTLPG

SEQ ID NO: 596773 - protein, 4 aa, Mycobacterium
TKAL

SEQ ID NO: 596774 - protein, 7 aa, Mycobacterium
TKALAGH

SEQ ID NO: 596775 - protein, 8 aa, Mycobacterium
TKALSGHS

SEQ ID NO: 596776 - protein, 10 aa, Mycobacterium
TKANAAGIES

SEQ ID NO: 596777 - protein, 8 aa, Mycobacterium
TKANRTLQ

SEQ ID NO: 596778 - protein, 8 aa, Mycobacterium
TKAPADND

SEQ ID NO: 596779 - protein, 9 aa, Mycobacterium
TKAPADSSL

SEQ ID NO: 596780 - protein, 9 aa, Mycobacterium
TKAPDNKGN

SEQ ID NO: 596781 - protein, 7 aa, Mycobacterium
TKAPGDL

SEQ ID NO: 596782 - protein, 8 aa, Mycobacterium
TKAPIATE

SEQ ID NO: 596783 - protein, 13 aa, Mycobacterium
TKAPTKAEAQRGV

SEQ ID NO: 596784 - protein, 5 aa, Mycobacterium
TKARA

SEQ ID NO: 596785 - protein, 9 aa, Mycobacterium
TKAREEVNE

SEQ ID NO: 596786 - protein, 6 aa, Mycobacterium
TKARPV

SEQ ID NO: 596787 - protein, 8 aa, Mycobacterium
TKARSTIA

SEQ ID NO: 596788 - protein, 6 aa, Mycobacterium
TKARTQ

SEQ ID NO: 596789 - protein, 13 aa, Mycobacterium
TKASESRGLDTPD

SEQ ID NO: 596790 - protein, 8 aa, Mycobacterium
TKASGIEG

SEQ ID NO: 596791 - protein, 10 aa, Mycobacterium
TKASGTPTAL

SEQ ID NO: 596792 - protein, 9 aa, Mycobacterium
TKASKVART

SEQ ID NO: 596793 - protein, 22 aa, Mycobacterium
TKASNSSVNAGSKRTPASMTIA

SEQ ID NO: 596794 - protein, 39 aa, Mycobacterium
TKASRPATLPASTSHQSTSEMASGSNRGNGEHRTNPLIA

SEQ ID NO: 596795 - protein, 9 aa, Mycobacterium
TKATGARIT

SEQ ID NO: 596796 - protein, 8 aa, Mycobacterium
TKATGIDE

SEQ ID NO: 596797 - protein, 18 aa, Mycobacterium
TKATGLDDFGTDDDNYRE

SEQ ID NO: 596798 - protein, 8 aa, Mycobacterium
TKATGVTV

SEQ ID NO: 596799 - protein, 9 aa, Mycobacterium
TKATRVDGG

SEQ ID NO: 596800 - protein, 9 aa, Mycobacterium
TKATTIDIP

SEQ ID NO: 596801 - protein, 8 aa, Mycobacterium
TKCSDDKF

SEQ ID NO: 596802 - protein, 8 aa, Mycobacterium
TKCSDEQF

SEQ ID NO: 596803 - protein, 8 aa, Mycobacterium
TKCSDGQF

SEQ ID NO: 596804 - protein, 7 aa, Mycobacterium
TKCSDKQ

SEQ ID NO: 596805 - protein, 8 aa, Mycobacterium
TKCSDSQF

SEQ ID NO: 596806 - protein, 8 aa, Mycobacterium
TKDAEAAA

SEQ ID NO: 596807 - protein, 7 aa, Mycobacterium
TKDAINA

SEQ ID NO: 596808 - protein, 9 aa, Mycobacterium
TKDDGIGGN

SEQ ID NO: 596809 - protein, 7 aa, Mycobacterium
TKDDRET

SEQ ID NO: 596810 - protein, 12 aa, Mycobacterium
TKDDSVDKTTPV

SEQ ID NO: 596811 - protein, 10 aa, Mycobacterium
TKDDTRGNAL

SEQ ID NO: 596812 - protein, 7 aa, Mycobacterium
TKDEADQ

SEQ ID NO: 596813 - protein, 8 aa, Mycobacterium
TKDEAKFV

SEQ ID NO: 596814 - protein, 8 aa, Mycobacterium
TKDEQDAV

SEQ ID NO: 596815 - protein, 6 aa, Mycobacterium
TKDEQT

SEQ ID NO: 596816 - protein, 14 aa, Mycobacterium
TKDERRKNAAELED

SEQ ID NO: 596817 - protein, 7 aa, Mycobacterium
TKDEVRQ

SEQ ID NO: 596818 - protein, 5 aa, Mycobacterium
TKDGA

SEQ ID NO: 596819 - protein, 5 aa, Mycobacterium
TKDGD

SEQ ID NO: 596820 - protein, 10 aa, Mycobacterium
TKDGGKNSHA

SEQ ID NO: 596821 - protein, 15 aa, Mycobacterium
TKDGHGQPYTNPEAA

SEQ ID NO: 596822 - protein, 10 aa, Mycobacterium
TKDGRAKPAA

SEQ ID NO: 596823 - protein, 9 aa, Mycobacterium
TKDGRISQR

SEQ ID NO: 596824 - protein, 10 aa, Mycobacterium
TKDGRISQRN

SEQ ID NO: 596825 - protein, 8 aa, Mycobacterium
TKDGSPAL

SEQ ID NO: 596826 - protein, 9 aa, Mycobacterium
TKDGTLAGP

SEQ ID NO: 596827 - protein, 10 aa, Mycobacterium
TKDGTLNGPN

SEQ ID NO: 596828 - protein, 13 aa, Mycobacterium
TKDHAAQADSDIA

SEQ ID NO: 596829 - protein, 9 aa, Mycobacterium
TKDKAAAKK

SEQ ID NO: 596830 - protein, 22 aa, Mycobacterium
TKDLDSELTYDPGSLSRPPGSF

SEQ ID NO: 596831 - protein, 6 aa, Mycobacterium
TKDLEP

SEQ ID NO: 596832 - protein, 9 aa, Mycobacterium
TKDPEKYVG

SEQ ID NO: 596833 - protein, 8 aa, Mycobacterium
TKDPLERP

SEQ ID NO: 596834 - protein, 10 aa, Mycobacterium
TKDPLGSVDE

SEQ ID NO: 596835 - protein, 8 aa, Mycobacterium
TKDPWRPD

SEQ ID NO: 596836 - protein, 10 aa, Mycobacterium
TKDRKQFGES

SEQ ID NO: 596837 - protein, 10 aa, Mycobacterium
TKDRKQFGTS

SEQ ID NO: 596838 - protein, 8 aa, Mycobacterium
TKDRNGQV

SEQ ID NO: 596839 - protein, 11 aa, Mycobacterium
TKDRRKDRESY

SEQ ID NO: 596840 - protein, 5 aa, Mycobacterium
TKDSA

SEQ ID NO: 596841 - protein, 8 aa, Mycobacterium
TKDSINAA

SEQ ID NO: 596842 - protein, 5 aa, Mycobacterium
TKDSP

SEQ ID NO: 596843 - protein, 8 aa, Mycobacterium
TKDTEVQG

SEQ ID NO: 596844 - protein, 8 aa, Mycobacterium
TKDTGVTV

SEQ ID NO: 596845 - protein, 10 aa, Mycobacterium
TKDTYPEQNL

SEQ ID NO: 596846 - protein, 4 aa, Mycobacterium
TKEA

SEQ ID NO: 596847 - protein, 21 aa, Mycobacterium
TKEAADDAKAKLEAAGASVTV

SEQ ID NO: 596848 - protein, 13 aa, Mycobacterium
TKEDGSKTVRNDY

SEQ ID NO: 596849 - protein, 6 aa, Mycobacterium
TKEEQI

SEQ ID NO: 596850 - protein, 9 aa, Mycobacterium
TKEETRKRW

SEQ ID NO: 596851 - protein, 6 aa, Mycobacterium
TKEFEE

SEQ ID NO: 596852 - protein, 9 aa, Mycobacterium
TKEGGRRGR

SEQ ID NO: 596853 - protein, 12 aa, Mycobacterium
TKEHAESRHAET

SEQ ID NO: 596854 - protein, 15 aa, Mycobacterium
TKEHTESRHAETRAS

SEQ ID NO: 596855 - protein, 14 aa, Mycobacterium
TKELPRGLARAGGV

SEQ ID NO: 596856 - protein, 9 aa, Mycobacterium
TKENAEQVK

SEQ ID NO: 596857 - protein, 10 aa, Mycobacterium
TKENRAEAEQ

SEQ ID NO: 596858 - protein, 10 aa, Mycobacterium
TKEPGSQGEP

SEQ ID NO: 596859 - protein, 8 aa, Mycobacterium
TKEPIGSK

SEQ ID NO: 596860 - protein, 8 aa, Mycobacterium
TKEREAFG

SEQ ID NO: 596861 - protein, 14 aa, Mycobacterium
TKERKAFGKPIGSF

SEQ ID NO: 596862 - protein, 8 aa, Mycobacterium
TKERKQFG

SEQ ID NO: 596863 - protein, 6 aa, Mycobacterium
TKESDE

SEQ ID NO: 596864 - protein, 9 aa, Mycobacterium
TKESDSDEI

SEQ ID NO: 596865 - protein, 7 aa, Mycobacterium
TKESGMR

SEQ ID NO: 596866 - protein, 5 aa, Mycobacterium
TKESL

SEQ ID NO: 596867 - protein, 8 aa, Mycobacterium
TKESRRQI

SEQ ID NO: 596868 - protein, 9 aa, Mycobacterium
TKESTDGDF

SEQ ID NO: 596869 - protein, 26 aa, Mycobacterium
TKEVPVNDAEQKSRIVSQDPAAGAHL

SEQ ID NO: 596870 - protein, 9 aa, Mycobacterium
TKFKPGDHA

SEQ ID NO: 596871 - protein, 17 aa, Mycobacterium
TKGAGNRAGDGFDGAVQ

SEQ ID NO: 596872 - protein, 9 aa, Mycobacterium
TKGAKGEWT

SEQ ID NO: 596873 - protein, 6 aa, Mycobacterium
TKGATH

SEQ ID NO: 596874 - protein, 5 aa, Mycobacterium
TKGAV

SEQ ID NO: 596875 - protein, 4 aa, Mycobacterium
TKGD

SEQ ID NO: 596876 - protein, 9 aa, Mycobacterium
TKGDDDDDY

SEQ ID NO: 596877 - protein, 10 aa, Mycobacterium
TKGDPERYRE

SEQ ID NO: 596878 - protein, 5 aa, Mycobacterium
TKGDV

SEQ ID NO: 596879 - protein, 6 aa, Mycobacterium
TKGDVE

SEQ ID NO: 596880 - protein, 8 aa, Mycobacterium
TKGEQDTL

SEQ ID NO: 596881 - protein, 8 aa, Mycobacterium
TKGESDEA

SEQ ID NO: 596882 - protein, 5 aa, Mycobacterium
TKGFE

SEQ ID NO: 596883 - protein, 9 aa, Mycobacterium
TKGGASEVR

SEQ ID NO: 596884 - protein, 8 aa, Mycobacterium
TKGGEQAP

SEQ ID NO: 596885 - protein, 11 aa, Mycobacterium
TKGGGENDYER

SEQ ID NO: 596886 - protein, 8 aa, Mycobacterium
TKGGGPND

SEQ ID NO: 596887 - protein, 8 aa, Mycobacterium
TKGGKTLE

SEQ ID NO: 596888 - protein, 7 aa, Mycobacterium
TKGHRRR

SEQ ID NO: 596889 - protein, 11 aa, Mycobacterium
TKGLTTHPTRE

SEQ ID NO: 596890 - protein, 7 aa, Mycobacterium
TKGPGLQ

SEQ ID NO: 596891 - protein, 8 aa, Mycobacterium
TKGPPPSI

SEQ ID NO: 596892 - protein, 13 aa, Mycobacterium
TKGPQGKRLGKTS

SEQ ID NO: 596893 - protein, 13 aa, Mycobacterium
TKGPQGTRLGKTS

SEQ ID NO: 596894 - protein, 11 aa, Mycobacterium
TKGQSAEVAGA

SEQ ID NO: 596895 - protein, 8 aa, Mycobacterium
TKGQWTEP

SEQ ID NO: 596896 - protein, 5 aa, Mycobacterium
TKGRP

SEQ ID NO: 596897 - protein, 7 aa, Mycobacterium
TKGRYPR

SEQ ID NO: 596898 - protein, 12 aa, Mycobacterium
TKGTAFTEDERR

SEQ ID NO: 596899 - protein, 7 aa, Mycobacterium
TKGTEAW

SEQ ID NO: 596900 - protein, 9 aa, Mycobacterium
TKGTGGAAV

SEQ ID NO: 596901 - protein, 14 aa, Mycobacterium
TKGTRYTELSSEQR

SEQ ID NO: 596902 - protein, 7 aa, Mycobacterium
TKGVTEK

SEQ ID NO: 596903 - protein, 7 aa, Mycobacterium
TKHEYGN

SEQ ID NO: 596904 - protein, 4 aa, Mycobacterium
TKHP

SEQ ID NO: 596905 - protein, 8 aa, Mycobacterium
TKHPDGAR

SEQ ID NO: 596906 - protein, 8 aa, Mycobacterium
TKHPEANV

SEQ ID NO: 596907 - protein, 9 aa, Mycobacterium
TKHPGSGGL

SEQ ID NO: 596908 - protein, 9 aa, Mycobacterium
TKHPGTGGL

SEQ ID NO: 596909 - protein, 10 aa, Mycobacterium
TKHPGTGGLV

SEQ ID NO: 596910 - protein, 10 aa, Mycobacterium
TKHPGTGGRV

SEQ ID NO: 596911 - protein, 31 aa, Mycobacterium
TKHSGRHDATQSAHSADDVTASTGGRHQPID

SEQ ID NO: 596912 - protein, 4 aa, Mycobacterium
TKIH

SEQ ID NO: 596913 - protein, 8 aa, Mycobacterium
TKIKGTQA

SEQ ID NO: 596914 - protein, 6 aa, Mycobacterium
TKIRPD

SEQ ID NO: 596915 - protein, 7 aa, Mycobacterium
TKKETPS

SEQ ID NO: 596916 - protein, 13 aa, Mycobacterium
TKKFSEDTETKLT

SEQ ID NO: 596917 - protein, 9 aa, Mycobacterium
TKKGKPLAK

SEQ ID NO: 596918 - protein, 7 aa, Mycobacterium
TKKGSLE

SEQ ID NO: 596919 - protein, 8 aa, Mycobacterium
TKKKESEI

SEQ ID NO: 596920 - protein, 10 aa, Mycobacterium
TKKLSEEAEE

SEQ ID NO: 596921 - protein, 12 aa, Mycobacterium
TKKLSESTEEKL

SEQ ID NO: 596922 - protein, 4 aa, Mycobacterium
TKKP

SEQ ID NO: 596923 - protein, 5 aa, Mycobacterium
TKKPD

SEQ ID NO: 596924 - protein, 5 aa, Mycobacterium
TKKPP

SEQ ID NO: 596925 - protein, 6 aa, Mycobacterium
TKKPPR

SEQ ID NO: 596926 - protein, 7 aa, Mycobacterium
TKKSEVS

SEQ ID NO: 596927 - protein, 4 aa, Mycobacterium
TKKV

SEQ ID NO: 596928 - protein, 4 aa, Mycobacterium
TKLA

SEQ ID NO: 596929 - protein, 9 aa, Mycobacterium
TKLADQVAD

SEQ ID NO: 596930 - protein, 9 aa, Mycobacterium
TKLADQVAE

SEQ ID NO: 596931 - protein, 7 aa, Mycobacterium
TKLDGYT

SEQ ID NO: 596932 - protein, 5 aa, Mycobacterium
TKLEG

SEQ ID NO: 596933 - protein, 6 aa, Mycobacterium
TKLEGL

SEQ ID NO: 596934 - protein, 4 aa, Mycobacterium
TKLG

SEQ ID NO: 596935 - protein, 5 aa, Mycobacterium
TKLGA

SEQ ID NO: 596936 - protein, 4 aa, Mycobacterium
TKLP

SEQ ID NO: 596937 - protein, 5 aa, Mycobacterium
TKLPD

SEQ ID NO: 596938 - protein, 11 aa, Mycobacterium
TKLPEGISEHE

SEQ ID NO: 596939 - protein, 7 aa, Mycobacterium
TKLPNGR

SEQ ID NO: 596940 - protein, 6 aa, Mycobacterium
TKLQTL

SEQ ID NO: 596941 - protein, 11 aa, Mycobacterium
TKLRDSPVAGR

SEQ ID NO: 596942 - protein, 11 aa, Mycobacterium
TKLRGSPVAGR

SEQ ID NO: 596943 - protein, 8 aa, Mycobacterium
TKLSDEPK

SEQ ID NO: 596944 - protein, 10 aa, Mycobacterium
TKLSGQRVDS

SEQ ID NO: 596945 - protein, 6 aa, Mycobacterium
TKLSGR

SEQ ID NO: 596946 - protein, 14 aa, Mycobacterium
TKLSGTKGDISDKS

SEQ ID NO: 596947 - protein, 5 aa, Mycobacterium
TKLSP

SEQ ID NO: 596948 - protein, 10 aa, Mycobacterium
TKMSPAPTAP

SEQ ID NO: 596949 - protein, 10 aa, Mycobacterium
TKMSPAPTQP

SEQ ID NO: 596950 - protein, 11 aa, Mycobacterium
TKMTPAPSKPV

SEQ ID NO: 596951 - protein, 10 aa, Mycobacterium
TKMTPAPTEP

SEQ ID NO: 596952 - protein, 10 aa, Mycobacterium
TKMTPAPTKP

SEQ ID NO: 596953 - protein, 4 aa, Mycobacterium
TKNA

SEQ ID NO: 596954 - protein, 10 aa, Mycobacterium
TKNDQLQSDY

SEQ ID NO: 596955 - protein, 5 aa, Mycobacterium
TKNGI

SEQ ID NO: 596956 - protein, 9 aa, Mycobacterium
TKNIERTAD

SEQ ID NO: 596957 - protein, 14 aa, Mycobacterium
TKNLPEQKAVEEAQ

SEQ ID NO: 596958 - protein, 4 aa, Mycobacterium
TKNP

SEQ ID NO: 596959 - protein, 6 aa, Mycobacterium
TKNPVL

SEQ ID NO: 596960 - protein, 7 aa, Mycobacterium
TKNRACS

SEQ ID NO: 596961 - protein, 8 aa, Mycobacterium
TKNRATIG

SEQ ID NO: 596962 - protein, 16 aa, Mycobacterium
TKNSISPRDALASAGK

SEQ ID NO: 596963 - protein, 8 aa, Mycobacterium
TKNTGVTV

SEQ ID NO: 596964 - protein, 9 aa, Mycobacterium
TKNTPAQAV

SEQ ID NO: 596965 - protein, 5 aa, Mycobacterium
TKNTR

SEQ ID NO: 596966 - protein, 8 aa, Mycobacterium
TKNVDSGA

SEQ ID NO: 596967 - protein, 4 aa, Mycobacterium
TKNY

SEQ ID NO: 596968 - protein, 5 aa, Mycobacterium
TKNYG

SEQ ID NO: 596969 - protein, 13 aa, Mycobacterium
TKNYRGAYTLLEF

SEQ ID NO: 596970 - protein, 10 aa, Mycobacterium
TKPADSITKT

SEQ ID NO: 596971 - protein, 7 aa, Mycobacterium
TKPADSV

SEQ ID NO: 596972 - protein, 8 aa, Mycobacterium
TKPAERAD

SEQ ID NO: 596973 - protein, 7 aa, Mycobacterium
TKPAESV

SEQ ID NO: 596974 - protein, 8 aa, Mycobacterium
TKPAKKAL

SEQ ID NO: 596975 - protein, 14 aa, Mycobacterium
TKPANRAHDEARSR

SEQ ID NO: 596976 - protein, 13 aa, Mycobacterium
TKPARRRKRNIAP

SEQ ID NO: 596977 - protein, 8 aa, Mycobacterium
TKPDAIDP

SEQ ID NO: 596978 - protein, 13 aa, Mycobacterium
TKPDEDFAPRAAP

SEQ ID NO: 596979 - protein, 9 aa, Mycobacterium
TKPDKGDRA

SEQ ID NO: 596980 - protein, 14 aa, Mycobacterium
TKPDLTPATDADLD

SEQ ID NO: 596981 - protein, 19 aa, Mycobacterium
TKPDLTPVTDADRGAEETL

SEQ ID NO: 596982 - protein, 16 aa, Mycobacterium
TKPDLTPVTDADTSVE

SEQ ID NO: 596983 - protein, 10 aa, Mycobacterium
TKPDPDGDVE

SEQ ID NO: 596984 - protein, 174 aa, Mycobacterium
TKPDPKSAALEKTGTAAQTGESLKETTGESVQEEGKTAETGAATGTKEALDRKESAEGKASANDKATAVAEKTKAGDKATTESREPVTTATEAAKESTKDSVKDAAVPGVAADSDAASGNLTKGTLAAKETGNQQQSATDGKPSPSSAPADKPDKPVKPKVPAASTTEHGSISA

SEQ ID NO: 596985 - protein, 7 aa, Mycobacterium
TKPDPRH

SEQ ID NO: 596986 - protein, 7 aa, Mycobacterium
TKPDVGR

SEQ ID NO: 596987 - protein, 6 aa, Mycobacterium
TKPEAI

SEQ ID NO: 596988 - protein, 11 aa, Mycobacterium
TKPEDDEAADS

SEQ ID NO: 596989 - protein, 6 aa, Mycobacterium
TKPERL

SEQ ID NO: 596990 - protein, 8 aa, Mycobacterium
TKPESVGQ

SEQ ID NO: 596991 - protein, 39 aa, Mycobacterium
TKPEVTDENDDAAVPSSEARPSQAAAASSIGADPAPENI

SEQ ID NO: 596992 - protein, 8 aa, Mycobacterium
TKPFPTKL

SEQ ID NO: 596993 - protein, 5 aa, Mycobacterium
TKPGA

SEQ ID NO: 596994 - protein, 5 aa, Mycobacterium
TKPGC

SEQ ID NO: 596995 - protein, 11 aa, Mycobacterium
TKPGDDPELRT

SEQ ID NO: 596996 - protein, 17 aa, Mycobacterium
TKPGDDPELRTESFEQA

SEQ ID NO: 596997 - protein, 6 aa, Mycobacterium
TKPGGS

SEQ ID NO: 596998 - protein, 6 aa, Mycobacterium
TKPGKL

SEQ ID NO: 596999 - protein, 7 aa, Mycobacterium
TKPGLTT

SEQ ID NO: 597000 - protein, 6 aa, Mycobacterium
TKPGQA

SEQ ID NO: 597001 - protein, 8 aa, Mycobacterium
TKPIPTGD

SEQ ID NO: 597002 - protein, 7 aa, Mycobacterium
TKPKPYT

SEQ ID NO: 597003 - protein, 16 aa, Mycobacterium
TKPLADAKASTETASG

SEQ ID NO: 597004 - protein, 9 aa, Mycobacterium
TKPPAEQAE

SEQ ID NO: 597005 - protein, 11 aa, Mycobacterium
TKPPAEQPAAG

SEQ ID NO: 597006 - protein, 19 aa, Mycobacterium
TKPPERAEAQLARQASQFR

SEQ ID NO: 597007 - protein, 9 aa, Mycobacterium
TKPPQRPAY

SEQ ID NO: 597008 - protein, 17 aa, Mycobacterium
TKPPRALAETSIPAGGI

SEQ ID NO: 597009 - protein, 8 aa, Mycobacterium
TKPQAAAD

SEQ ID NO: 597010 - protein, 18 aa, Mycobacterium
TKPQAPARVPGDRQRGPV

SEQ ID NO: 597011 - protein, 4 aa, Mycobacterium
TKPR

SEQ ID NO: 597012 - protein, 8 aa, Mycobacterium
TKPRGALG

SEQ ID NO: 597013 - protein, 21 aa, Mycobacterium
TKPRQPKVSPEPPRDPVSARD

SEQ ID NO: 597014 - protein, 8 aa, Mycobacterium
TKPSEDPF

SEQ ID NO: 597015 - protein, 9 aa, Mycobacterium
TKPSGALGR

SEQ ID NO: 597016 - protein, 11 aa, Mycobacterium
TKPSGKEAEGI

SEQ ID NO: 597017 - protein, 13 aa, Mycobacterium
TKPSIAGRKVGAR

SEQ ID NO: 597018 - protein, 33 aa, Mycobacterium
TKPSPTPVAKPAEPQEISGAQRRAAEKELAAAE

SEQ ID NO: 597019 - protein, 6 aa, Mycobacterium
TKPSRE

SEQ ID NO: 597020 - protein, 7 aa, Mycobacterium
TKPSVTA

SEQ ID NO: 597021 - protein, 10 aa, Mycobacterium
TKPTPADAAD

SEQ ID NO: 597022 - protein, 9 aa, Mycobacterium
TKPVGPGAD

SEQ ID NO: 597023 - protein, 6 aa, Mycobacterium
TKPYSA

SEQ ID NO: 597024 - protein, 9 aa, Mycobacterium
TKPYTSGGA

SEQ ID NO: 597025 - protein, 8 aa, Mycobacterium
TKQAAQKR

SEQ ID NO: 597026 - protein, 8 aa, Mycobacterium
TKQAINEA

SEQ ID NO: 597027 - protein, 8 aa, Mycobacterium
TKQAPGDR

SEQ ID NO: 597028 - protein, 7 aa, Mycobacterium
TKQCPPS

SEQ ID NO: 597029 - protein, 6 aa, Mycobacterium
TKQETR

SEQ ID NO: 597030 - protein, 8 aa, Mycobacterium
TKQGGAPS

SEQ ID NO: 597031 - protein, 8 aa, Mycobacterium
TKQGMTEP

SEQ ID NO: 597032 - protein, 12 aa, Mycobacterium
TKQGPKPKPITE

SEQ ID NO: 597033 - protein, 13 aa, Mycobacterium
TKQIRGAYTLLEL

SEQ ID NO: 597034 - protein, 26 aa, Mycobacterium
TKQMTKSAKGTIDQPGRNVAAKSGLN

SEQ ID NO: 597035 - protein, 6 aa, Mycobacterium
TKQRTS

SEQ ID NO: 597036 - protein, 10 aa, Mycobacterium
TKQTGAAQRA

SEQ ID NO: 597037 - protein, 8 aa, Mycobacterium
TKRAPGRE

SEQ ID NO: 597038 - protein, 10 aa, Mycobacterium
TKRDGAELSP

SEQ ID NO: 597039 - protein, 10 aa, Mycobacterium
TKRDGGALSD

SEQ ID NO: 597040 - protein, 9 aa, Mycobacterium
TKRDGGRLS

SEQ ID NO: 597041 - protein, 8 aa, Mycobacterium
TKRDRKRL

SEQ ID NO: 597042 - protein, 14 aa, Mycobacterium
TKRDVTPDPGDALR

SEQ ID NO: 597043 - protein, 7 aa, Mycobacterium
TKREELR

SEQ ID NO: 597044 - protein, 5 aa, Mycobacterium
TKRGA

SEQ ID NO: 597045 - protein, 10 aa, Mycobacterium
TKRGARKSYT

SEQ ID NO: 597046 - protein, 11 aa, Mycobacterium
TKRGGASDDEI

SEQ ID NO: 597047 - protein, 9 aa, Mycobacterium
TKRGGGAAL

SEQ ID NO: 597048 - protein, 9 aa, Mycobacterium
TKRGHSAAE

SEQ ID NO: 597049 - protein, 9 aa, Mycobacterium
TKRGPHGRP

SEQ ID NO: 597050 - protein, 10 aa, Mycobacterium
TKRGSRKAYT

SEQ ID NO: 597051 - protein, 14 aa, Mycobacterium
TKRGSVGRANPGAQ

SEQ ID NO: 597052 - protein, 9 aa, Mycobacterium
TKRGYPDDV

SEQ ID NO: 597053 - protein, 10 aa, Mycobacterium
TKRGYPDDVS

SEQ ID NO: 597054 - protein, 11 aa, Mycobacterium
TKRLRDADEQV

SEQ ID NO: 597055 - protein, 8 aa, Mycobacterium
TKRMPNGR

SEQ ID NO: 597056 - protein, 10 aa, Mycobacterium
TKRPAAQRGA

SEQ ID NO: 597057 - protein, 7 aa, Mycobacterium
TKRPYES

SEQ ID NO: 597058 - protein, 19 aa, Mycobacterium
TKRQARSPRGHRGRTGVYD

SEQ ID NO: 597059 - protein, 6 aa, Mycobacterium
TKRQGA

SEQ ID NO: 597060 - protein, 8 aa, Mycobacterium
TKRQKYRN

SEQ ID NO: 597061 - protein, 10 aa, Mycobacterium
TKRRADRGTD

SEQ ID NO: 597062 - protein, 19 aa, Mycobacterium
TKRRARSPRGHRGRTGVYD

SEQ ID NO: 597063 - protein, 17 aa, Mycobacterium
TKRRSGREQLASGDVTA

SEQ ID NO: 597064 - protein, 10 aa, Mycobacterium
TKRTADSASR

SEQ ID NO: 597065 - protein, 22 aa, Mycobacterium
TKRTSPRPAMKHSATSSEAHAR

SEQ ID NO: 597066 - protein, 7 aa, Mycobacterium
TKRTTLP

SEQ ID NO: 597067 - protein, 8 aa, Mycobacterium
TKRVEGRS

SEQ ID NO: 597068 - protein, 14 aa, Mycobacterium
TKRYEEQRARAEDL

SEQ ID NO: 597069 - protein, 4 aa, Mycobacterium
TKSA

SEQ ID NO: 597070 - protein, 33 aa, Mycobacterium
TKSAAAGAADGASKEKGPKHTPSTPKPRGRRKT

SEQ ID NO: 597071 - protein, 8 aa, Mycobacterium
TKSAAGDV

SEQ ID NO: 597072 - protein, 10 aa, Mycobacterium
TKSAGRGGGT

SEQ ID NO: 597073 - protein, 11 aa, Mycobacterium
TKSAKSDTSGR

SEQ ID NO: 597074 - protein, 9 aa, Mycobacterium
TKSASGGEL

SEQ ID NO: 597075 - protein, 4 aa, Mycobacterium
TKSD

SEQ ID NO: 597076 - protein, 13 aa, Mycobacterium
TKSDAMRYLTNVP

SEQ ID NO: 597077 - protein, 9 aa, Mycobacterium
TKSDGTRYG

SEQ ID NO: 597078 - protein, 10 aa, Mycobacterium
TKSDQTPWYE

SEQ ID NO: 597079 - protein, 6 aa, Mycobacterium
TKSDSV

SEQ ID NO: 597080 - protein, 5 aa, Mycobacterium
TKSDY

SEQ ID NO: 597081 - protein, 4 aa, Mycobacterium
TKSE

SEQ ID NO: 597082 - protein, 10 aa, Mycobacterium
TKSELPQAVP

SEQ ID NO: 597083 - protein, 13 aa, Mycobacterium
TKSEPRTAATAVS

SEQ ID NO: 597084 - protein, 4 aa, Mycobacterium
TKSG

SEQ ID NO: 597085 - protein, 11 aa, Mycobacterium
TKSGALSANGA

SEQ ID NO: 597086 - protein, 6 aa, Mycobacterium
TKSGDT

SEQ ID NO: 597087 - protein, 6 aa, Mycobacterium
TKSGEE

SEQ ID NO: 597088 - protein, 7 aa, Mycobacterium
TKSGETQ

SEQ ID NO: 597089 - protein, 8 aa, Mycobacterium
TKSGPNER

SEQ ID NO: 597090 - protein, 9 aa, Mycobacterium
TKSLDAEEG

SEQ ID NO: 597091 - protein, 6 aa, Mycobacterium
TKSLGD

SEQ ID NO: 597092 - protein, 8 aa, Mycobacterium
TKSLTDDQ

SEQ ID NO: 597093 - protein, 7 aa, Mycobacterium
TKSPAGA

SEQ ID NO: 597094 - protein, 19 aa, Mycobacterium
TKSPAGAHQWKPKDGGWAN

SEQ ID NO: 597095 - protein, 19 aa, Mycobacterium
TKSPAGANQWKPKDNGWAN

SEQ ID NO: 597096 - protein, 8 aa, Mycobacterium
TKSPAGAW

SEQ ID NO: 597097 - protein, 7 aa, Mycobacterium
TKSPGDA

SEQ ID NO: 597098 - protein, 10 aa, Mycobacterium
TKSPKPGSPV

SEQ ID NO: 597099 - protein, 14 aa, Mycobacterium
TKSQTSIEANTVDA

SEQ ID NO: 597100 - protein, 4 aa, Mycobacterium
TKSR

SEQ ID NO: 597101 - protein, 6 aa, Mycobacterium
TKSRDV

SEQ ID NO: 597102 - protein, 8 aa, Mycobacterium
TKSRHYST

SEQ ID NO: 597103 - protein, 9 aa, Mycobacterium
TKSRHYSTT

SEQ ID NO: 597104 - protein, 6 aa, Mycobacterium
TKSRQA

SEQ ID NO: 597105 - protein, 6 aa, Mycobacterium
TKSRRG

SEQ ID NO: 597106 - protein, 16 aa, Mycobacterium
TKSSINPRDALASAGK

SEQ ID NO: 597107 - protein, 16 aa, Mycobacterium
TKSSQTCDASAGDETI

SEQ ID NO: 597108 - protein, 6 aa, Mycobacterium
TKSTAV

SEQ ID NO: 597109 - protein, 7 aa, Mycobacterium
TKSTGRW

SEQ ID NO: 597110 - protein, 8 aa, Mycobacterium
TKSTGVTV

SEQ ID NO: 597111 - protein, 12 aa, Mycobacterium
TKTADDAGEAGD

SEQ ID NO: 597112 - protein, 7 aa, Mycobacterium
TKTADDV

SEQ ID NO: 597113 - protein, 13 aa, Mycobacterium
TKTARAPQLQGAA

SEQ ID NO: 597114 - protein, 13 aa, Mycobacterium
TKTARAQQLQQAA

SEQ ID NO: 597115 - protein, 5 aa, Mycobacterium
TKTDD

SEQ ID NO: 597116 - protein, 6 aa, Mycobacterium
TKTDDF

SEQ ID NO: 597117 - protein, 7 aa, Mycobacterium
TKTDNNP

SEQ ID NO: 597118 - protein, 7 aa, Mycobacterium
TKTDVDA

SEQ ID NO: 597119 - protein, 4 aa, Mycobacterium
TKTG

SEQ ID NO: 597120 - protein, 11 aa, Mycobacterium
TKTGDAVTPSV

SEQ ID NO: 597121 - protein, 11 aa, Mycobacterium
TKTGIDADGLG

SEQ ID NO: 597122 - protein, 11 aa, Mycobacterium
TKTGRTPQLQA

SEQ ID NO: 597123 - protein, 7 aa, Mycobacterium
TKTHGKN

SEQ ID NO: 597124 - protein, 8 aa, Mycobacterium
TKTKDEAL

SEQ ID NO: 597125 - protein, 11 aa, Mycobacterium
TKTKGSNRKVP

SEQ ID NO: 597126 - protein, 9 aa, Mycobacterium
TKTKPEAQA

SEQ ID NO: 597127 - protein, 4 aa, Mycobacterium
TKTL

SEQ ID NO: 597128 - protein, 6 aa, Mycobacterium
TKTLQG

SEQ ID NO: 597129 - protein, 4 aa, Mycobacterium
TKTP

SEQ ID NO: 597130 - protein, 11 aa, Mycobacterium
TKTPEGTGTIE

SEQ ID NO: 597131 - protein, 12 aa, Mycobacterium
TKTPGPVSDYTG

SEQ ID NO: 597132 - protein, 6 aa, Mycobacterium
TKTPPE

SEQ ID NO: 597133 - protein, 9 aa, Mycobacterium
TKTPRAEAL

SEQ ID NO: 597134 - protein, 12 aa, Mycobacterium
TKTPTANGSDEY

SEQ ID NO: 597135 - protein, 5 aa, Mycobacterium
TKTPV

SEQ ID NO: 597136 - protein, 4 aa, Mycobacterium
TKTQ

SEQ ID NO: 597137 - protein, 4 aa, Mycobacterium
TKTR

SEQ ID NO: 597138 - protein, 7 aa, Mycobacterium
TKTRDEA

SEQ ID NO: 597139 - protein, 14 aa, Mycobacterium
TKTRRGAEQPTAAA

SEQ ID NO: 597140 - protein, 13 aa, Mycobacterium
TKTSFGANAVDAD

SEQ ID NO: 597141 - protein, 36 aa, Mycobacterium
TKTSVRSASELGPGRDHRRGPVTTSTEFPTSGRTEI

SEQ ID NO: 597142 - protein, 17 aa, Mycobacterium
TKTTDEVYEQYLAEAVK

SEQ ID NO: 597143 - protein, 12 aa, Mycobacterium
TKTTGVKASTDL

SEQ ID NO: 597144 - protein, 17 aa, Mycobacterium
TKTTSRGVQTIGGAARG

SEQ ID NO: 597145 - protein, 17 aa, Mycobacterium
TKTTSRGVQTIGGAKRG

SEQ ID NO: 597146 - protein, 14 aa, Mycobacterium
TKTTTRGAALLEFA

SEQ ID NO: 597147 - protein, 5 aa, Mycobacterium
TKTVP

SEQ ID NO: 597148 - protein, 6 aa, Mycobacterium
TKTVPD

SEQ ID NO: 597149 - protein, 5 aa, Mycobacterium
TKTVT

SEQ ID NO: 597150 - protein, 4 aa, Mycobacterium
TKTY

SEQ ID NO: 597151 - protein, 6 aa, Mycobacterium
TKTYGA

SEQ ID NO: 597152 - protein, 13 aa, Mycobacterium
TKTYRESGGSPGW

SEQ ID NO: 597153 - protein, 9 aa, Mycobacterium
TKVATPDGQ

SEQ ID NO: 597154 - protein, 7 aa, Mycobacterium
TKVEGVD

SEQ ID NO: 597155 - protein, 5 aa, Mycobacterium
TKVGE

SEQ ID NO: 597156 - protein, 16 aa, Mycobacterium
TKVGEEIAKELLSAKV

SEQ ID NO: 597157 - protein, 20 aa, Mycobacterium
TKVGEEIAKESLSATAGGAQ

SEQ ID NO: 597158 - protein, 20 aa, Mycobacterium
TKVGEEIAKESLSATAPGAQ

SEQ ID NO: 597159 - protein, 20 aa, Mycobacterium
TKVGEEIAKESLTATAGGAQ

SEQ ID NO: 597160 - protein, 21 aa, Mycobacterium
TKVGEEIAKKSAEASLASGAQ

SEQ ID NO: 597161 - protein, 22 aa, Mycobacterium
TKVGEEIARKSKDVTLSATGGT

SEQ ID NO: 597162 - protein, 4 aa, Mycobacterium
TKVP

SEQ ID NO: 597163 - protein, 12 aa, Mycobacterium
TKVPPNAGAQGS

SEQ ID NO: 597164 - protein, 7 aa, Mycobacterium
TKVPSMA

SEQ ID NO: 597165 - protein, 20 aa, Mycobacterium
TKVPTFGPRSSPISAPTTRP

SEQ ID NO: 597166 - protein, 8 aa, Mycobacterium
TKVSSSEI

SEQ ID NO: 597167 - protein, 16 aa, Mycobacterium
TKVTEPQDAPADYAES

SEQ ID NO: 597168 - protein, 9 aa, Mycobacterium
TKVTTPDGI

SEQ ID NO: 597169 - protein, 19 aa, Mycobacterium
TKVTTSDGQTVKARDLSGA

SEQ ID NO: 597170 - protein, 10 aa, Mycobacterium
TKVVGKGGAD

SEQ ID NO: 597171 - protein, 6 aa, Mycobacterium
TKWDPQ

SEQ ID NO: 597172 - protein, 5 aa, Mycobacterium
TKYGA

SEQ ID NO: 597173 - protein, 4 aa, Mycobacterium
TKYV

SEQ ID NO: 597174 - protein, 4 aa, Mycobacterium
TLAA

SEQ ID NO: 597175 - protein, 6 aa, Mycobacterium
TLAAAG

SEQ ID NO: 597176 - protein, 17 aa, Mycobacterium
TLAARQRNAYLAKLKAA

SEQ ID NO: 597177 - protein, 12 aa, Mycobacterium
TLAATAERLRRP

SEQ ID NO: 597178 - protein, 4 aa, Mycobacterium
TLAE

SEQ ID NO: 597179 - protein, 11 aa, Mycobacterium
TLAEDGLTREG

SEQ ID NO: 597180 - protein, 7 aa, Mycobacterium
TLAEGGF

SEQ ID NO: 597181 - protein, 14 aa, Mycobacterium
TLAENGVTPAAERR

SEQ ID NO: 597182 - protein, 6 aa, Mycobacterium
TLAERN

SEQ ID NO: 597183 - protein, 8 aa, Mycobacterium
TLAESGTQ

SEQ ID NO: 597184 - protein, 10 aa, Mycobacterium
TLAGDDTEPA

SEQ ID NO: 597185 - protein, 6 aa, Mycobacterium
TLAGGK

SEQ ID NO: 597186 - protein, 13 aa, Mycobacterium
TLAGNTAKYGAGE

SEQ ID NO: 597187 - protein, 8 aa, Mycobacterium
TLAGRERA

SEQ ID NO: 597188 - protein, 8 aa, Mycobacterium
TLAGRERG

SEQ ID NO: 597189 - protein, 18 aa, Mycobacterium
TLAGRSEEDGESGFSDGI

SEQ ID NO: 597190 - protein, 13 aa, Mycobacterium
TLAGSVGSGAGTA

SEQ ID NO: 597191 - protein, 6 aa, Mycobacterium
TLAGTP

SEQ ID NO: 597192 - protein, 9 aa, Mycobacterium
TLAHTGQAD

SEQ ID NO: 597193 - protein, 11 aa, Mycobacterium
TLAKEGSMTPG

SEQ ID NO: 597194 - protein, 7 aa, Mycobacterium
TLANATG

SEQ ID NO: 597195 - protein, 7 aa, Mycobacterium
TLANATS

SEQ ID NO: 597196 - protein, 6 aa, Mycobacterium
TLANSR

SEQ ID NO: 597197 - protein, 10 aa, Mycobacterium
TLAPAAAQQC

SEQ ID NO: 597198 - protein, 11 aa, Mycobacterium
TLAPAAAQQCT

SEQ ID NO: 597199 - protein, 8 aa, Mycobacterium
TLAPAAEA

SEQ ID NO: 597200 - protein, 13 aa, Mycobacterium
TLAPADGGGEFGA

SEQ ID NO: 597201 - protein, 9 aa, Mycobacterium
TLAPAEESV

SEQ ID NO: 597202 - protein, 7 aa, Mycobacterium
TLAPAGQ

SEQ ID NO: 597203 - protein, 5 aa, Mycobacterium
TLAPD

SEQ ID NO: 597204 - protein, 12 aa, Mycobacterium
TLAPDRPADAGT

SEQ ID NO: 597205 - protein, 12 aa, Mycobacterium
TLAPGEKLRDPE

SEQ ID NO: 597206 - protein, 11 aa, Mycobacterium
TLAPGERLRDD

SEQ ID NO: 597207 - protein, 6 aa, Mycobacterium
TLAPGG

SEQ ID NO: 597208 - protein, 6 aa, Mycobacterium
TLAPGH

SEQ ID NO: 597209 - protein, 8 aa, Mycobacterium
TLAPGSSM

SEQ ID NO: 597210 - protein, 11 aa, Mycobacterium
TLAPHGGESRI

SEQ ID NO: 597211 - protein, 30 aa, Mycobacterium
TLAPPQAEQPTQSIDTSDDDTPTGQIPPVR

SEQ ID NO: 597212 - protein, 6 aa, Mycobacterium
TLAPQS

SEQ ID NO: 597213 - protein, 6 aa, Mycobacterium
TLAPRE

SEQ ID NO: 597214 - protein, 6 aa, Mycobacterium
TLAPST

SEQ ID NO: 597215 - protein, 9 aa, Mycobacterium
TLAPSTATM

SEQ ID NO: 597216 - protein, 8 aa, Mycobacterium
TLAPTAAE

SEQ ID NO: 597217 - protein, 10 aa, Mycobacterium
TLAPTAAQRC

SEQ ID NO: 597218 - protein, 18 aa, Mycobacterium
TLAPTDDEERQKAIDRGH

SEQ ID NO: 597219 - protein, 17 aa, Mycobacterium
TLAPTDDEERQRAIDRG

SEQ ID NO: 597220 - protein, 8 aa, Mycobacterium
TLAPTGYS

SEQ ID NO: 597221 - protein, 7 aa, Mycobacterium
TLAQANA

SEQ ID NO: 597222 - protein, 10 aa, Mycobacterium
TLAQASPPDM

SEQ ID NO: 597223 - protein, 4 aa, Mycobacterium
TLAS

SEQ ID NO: 597224 - protein, 7 aa, Mycobacterium
TLASDPL

SEQ ID NO: 597225 - protein, 9 aa, Mycobacterium
TLASGGTWC

SEQ ID NO: 597226 - protein, 6 aa, Mycobacterium
TLASGS

SEQ ID NO: 597227 - protein, 7 aa, Mycobacterium
TLASGSK

SEQ ID NO: 597228 - protein, 10 aa, Mycobacterium
TLASRSAPQL

SEQ ID NO: 597229 - protein, 7 aa, Mycobacterium
TLASSAR

SEQ ID NO: 597230 - protein, 10 aa, Mycobacterium
TLATAAGTAR

SEQ ID NO: 597231 - protein, 11 aa, Mycobacterium
TLATNAAPAEL

SEQ ID NO: 597232 - protein, 33 aa, Mycobacterium
TLATPADQVTPDKAVPRARTASRADLAATSGPH

SEQ ID NO: 597233 - protein, 7 aa, Mycobacterium
TLATPHG

SEQ ID NO: 597234 - protein, 10 aa, Mycobacterium
TLATSSKDAI

SEQ ID NO: 597235 - protein, 11 aa, Mycobacterium
TLATTSKDAID

SEQ ID NO: 597236 - protein, 9 aa, Mycobacterium
TLDAQAGHP

SEQ ID NO: 597237 - protein, 6 aa, Mycobacterium
TLDDDE

SEQ ID NO: 597238 - protein, 9 aa, Mycobacterium
TLDDGADHL

SEQ ID NO: 597239 - protein, 5 aa, Mycobacterium
TLDDN

SEQ ID NO: 597240 - protein, 13 aa, Mycobacterium
TLDDSRERRLRTG

SEQ ID NO: 597241 - protein, 26 aa, Mycobacterium
TLDENAGFRQPGHAEFEDRDATDPLE

SEQ ID NO: 597242 - protein, 9 aa, Mycobacterium
TLDENTKAA

SEQ ID NO: 597243 - protein, 5 aa, Mycobacterium
TLDEQ

SEQ ID NO: 597244 - protein, 8 aa, Mycobacterium
TLDETRQE

SEQ ID NO: 597245 - protein, 9 aa, Mycobacterium
TLDETSAHA

SEQ ID NO: 597246 - protein, 5 aa, Mycobacterium
TLDGA

SEQ ID NO: 597247 - protein, 7 aa, Mycobacterium
TLDGARA

SEQ ID NO: 597248 - protein, 9 aa, Mycobacterium
TLDGARRRS

SEQ ID NO: 597249 - protein, 8 aa, Mycobacterium
TLDGPPLT

SEQ ID NO: 597250 - protein, 9 aa, Mycobacterium
TLDGRTQEL

SEQ ID NO: 597251 - protein, 6 aa, Mycobacterium
TLDGSD

SEQ ID NO: 597252 - protein, 8 aa, Mycobacterium
TLDGSTYH

SEQ ID NO: 597253 - protein, 10 aa, Mycobacterium
TLDKQGATPR

SEQ ID NO: 597254 - protein, 6 aa, Mycobacterium
TLDNGS

SEQ ID NO: 597255 - protein, 12 aa, Mycobacterium
TLDPAQGSPFDS

SEQ ID NO: 597256 - protein, 9 aa, Mycobacterium
TLDPEDEAA

SEQ ID NO: 597257 - protein, 8 aa, Mycobacterium
TLDPETTR

SEQ ID NO: 597258 - protein, 8 aa, Mycobacterium
TLDPGKLP

SEQ ID NO: 597259 - protein, 7 aa, Mycobacterium
TLDPNGE

SEQ ID NO: 597260 - protein, 9 aa, Mycobacterium
TLDPPTHTD

SEQ ID NO: 597261 - protein, 7 aa, Mycobacterium
TLDPRTV

SEQ ID NO: 597262 - protein, 5 aa, Mycobacterium
TLDPS

SEQ ID NO: 597263 - protein, 9 aa, Mycobacterium
TLDPTADDV

SEQ ID NO: 597264 - protein, 8 aa, Mycobacterium
TLDQAEQQ

SEQ ID NO: 597265 - protein, 4 aa, Mycobacterium
TLDR

SEQ ID NO: 597266 - protein, 5 aa, Mycobacterium
TLDRD

SEQ ID NO: 597267 - protein, 14 aa, Mycobacterium
TLDREGTPAPNGVG

SEQ ID NO: 597268 - protein, 11 aa, Mycobacterium
TLDRRARRGRA

SEQ ID NO: 597269 - protein, 7 aa, Mycobacterium
TLDRSNL

SEQ ID NO: 597270 - protein, 5 aa, Mycobacterium
TLDSD

SEQ ID NO: 597271 - protein, 5 aa, Mycobacterium
TLDSG

SEQ ID NO: 597272 - protein, 7 aa, Mycobacterium
TLDTDDA

SEQ ID NO: 597273 - protein, 9 aa, Mycobacterium
TLDTGDSAY

SEQ ID NO: 597274 - protein, 8 aa, Mycobacterium
TLDTNGRS

SEQ ID NO: 597275 - protein, 18 aa, Mycobacterium
TLDTNTDPTITPRNDRQT

SEQ ID NO: 597276 - protein, 14 aa, Mycobacterium
TLDTPNAPTWPGRD

SEQ ID NO: 597277 - protein, 6 aa, Mycobacterium
TLDTPP

SEQ ID NO: 597278 - protein, 7 aa, Mycobacterium
TLDTSNP

SEQ ID NO: 597279 - protein, 6 aa, Mycobacterium
TLDTSS

SEQ ID NO: 597280 - protein, 7 aa, Mycobacterium
TLDTSST

SEQ ID NO: 597281 - protein, 8 aa, Mycobacterium
TLDTTGAR

SEQ ID NO: 597282 - protein, 4 aa, Mycobacterium
TLEA

SEQ ID NO: 597283 - protein, 4 aa, Mycobacterium
TLED

SEQ ID NO: 597284 - protein, 11 aa, Mycobacterium
TLEDLDDEQRE

SEQ ID NO: 597285 - protein, 9 aa, Mycobacterium
TLEDPGGVR

SEQ ID NO: 597286 - protein, 5 aa, Mycobacterium
TLEEN

SEQ ID NO: 597287 - protein, 9 aa, Mycobacterium
TLEENQKQI

SEQ ID NO: 597288 - protein, 9 aa, Mycobacterium
TLEERGKTA

SEQ ID NO: 597289 - protein, 12 aa, Mycobacterium
TLEERKARLGAA

SEQ ID NO: 597290 - protein, 9 aa, Mycobacterium
TLEGAGDQI

SEQ ID NO: 597291 - protein, 6 aa, Mycobacterium
TLEGPA

SEQ ID NO: 597292 - protein, 6 aa, Mycobacterium
TLEGPT

SEQ ID NO: 597293 - protein, 5 aa, Mycobacterium
TLEGR

SEQ ID NO: 597294 - protein, 4 aa, Mycobacterium
TLEP

SEQ ID NO: 597295 - protein, 15 aa, Mycobacterium
TLEPGPAGELPPGLD

SEQ ID NO: 597296 - protein, 5 aa, Mycobacterium
TLEPT

SEQ ID NO: 597297 - protein, 9 aa, Mycobacterium
TLEPTKRPA

SEQ ID NO: 597298 - protein, 5 aa, Mycobacterium
TLEQQ

SEQ ID NO: 597299 - protein, 4 aa, Mycobacterium
TLES

SEQ ID NO: 597300 - protein, 22 aa, Mycobacterium
TLESREAKHEPRSLGEQRQEWR

SEQ ID NO: 597301 - protein, 15 aa, Mycobacterium
TLESSTRSNRGPGYP

SEQ ID NO: 597302 - protein, 13 aa, Mycobacterium
TLESTDGADPASV

SEQ ID NO: 597303 - protein, 6 aa, Mycobacterium
TLETEI

SEQ ID NO: 597304 - protein, 17 aa, Mycobacterium
TLETREATYYSRSRREQ

SEQ ID NO: 597305 - protein, 6 aa, Mycobacterium
TLEVGD

SEQ ID NO: 597306 - protein, 9 aa, Mycobacterium
TLGADPGDI

SEQ ID NO: 597307 - protein, 12 aa, Mycobacterium
TLGADSAQPAAD

SEQ ID NO: 597308 - protein, 14 aa, Mycobacterium
TLGADSGDAQSGSI

SEQ ID NO: 597309 - protein, 5 aa, Mycobacterium
TLGAE

SEQ ID NO: 597310 - protein, 13 aa, Mycobacterium
TLGAELGGAGGLR

SEQ ID NO: 597311 - protein, 9 aa, Mycobacterium
TLGAGDSAY

SEQ ID NO: 597312 - protein, 12 aa, Mycobacterium
TLGAPGQANYAA

SEQ ID NO: 597313 - protein, 12 aa, Mycobacterium
TLGATDGSEAEL

SEQ ID NO: 597314 - protein, 4 aa, Mycobacterium
TLGD

SEQ ID NO: 597315 - protein, 10 aa, Mycobacterium
TLGDAESTLS

SEQ ID NO: 597316 - protein, 8 aa, Mycobacterium
TLGDEHPS

SEQ ID NO: 597317 - protein, 5 aa, Mycobacterium
TLGDG

SEQ ID NO: 597318 - protein, 12 aa, Mycobacterium
TLGDGASSRAAG

SEQ ID NO: 597319 - protein, 9 aa, Mycobacterium
TLGDPTRDL

SEQ ID NO: 597320 - protein, 13 aa, Mycobacterium
TLGDRASASAHDA

SEQ ID NO: 597321 - protein, 11 aa, Mycobacterium
TLGDSKAFGGV

SEQ ID NO: 597322 - protein, 15 aa, Mycobacterium
TLGEAAKANTDGSEV

SEQ ID NO: 597323 - protein, 16 aa, Mycobacterium
TLGEASATAAAPTTAL

SEQ ID NO: 597324 - protein, 15 aa, Mycobacterium
TLGEASPALADPDRP

SEQ ID NO: 597325 - protein, 5 aa, Mycobacterium
TLGEN

SEQ ID NO: 597326 - protein, 8 aa, Mycobacterium
TLGEPAQS

SEQ ID NO: 597327 - protein, 8 aa, Mycobacterium
TLGEPDAR

SEQ ID NO: 597328 - protein, 6 aa, Mycobacterium
TLGERT

SEQ ID NO: 597329 - protein, 4 aa, Mycobacterium
TLGG

SEQ ID NO: 597330 - protein, 8 aa, Mycobacterium
TLGGDDRA

SEQ ID NO: 597331 - protein, 8 aa, Mycobacterium
TLGGGPTI

SEQ ID NO: 597332 - protein, 12 aa, Mycobacterium
TLGGPDAHHKKS

SEQ ID NO: 597333 - protein, 8 aa, Mycobacterium
TLGGPRSG

SEQ ID NO: 597334 - protein, 9 aa, Mycobacterium
TLGGTASGD

SEQ ID NO: 597335 - protein, 7 aa, Mycobacterium
TLGGTTT

SEQ ID NO: 597336 - protein, 11 aa, Mycobacterium
TLGGTYARKQT

SEQ ID NO: 597337 - protein, 11 aa, Mycobacterium
TLGHTEAASGI

SEQ ID NO: 597338 - protein, 5 aa, Mycobacterium
TLGIS

SEQ ID NO: 597339 - protein, 9 aa, Mycobacterium
TLGISDDSL

SEQ ID NO: 597340 - protein, 9 aa, Mycobacterium
TLGKSTAAV

SEQ ID NO: 597341 - protein, 14 aa, Mycobacterium
TLGNAPALPGPGAQ

SEQ ID NO: 597342 - protein, 11 aa, Mycobacterium
TLGNEGPMTPG

SEQ ID NO: 597343 - protein, 5 aa, Mycobacterium
TLGPA

SEQ ID NO: 597344 - protein, 17 aa, Mycobacterium
TLGPDESRADYAQSPWR

SEQ ID NO: 597345 - protein, 10 aa, Mycobacterium
TLGPDGKKAF

SEQ ID NO: 597346 - protein, 6 aa, Mycobacterium
TLGPDP

SEQ ID NO: 597347 - protein, 9 aa, Mycobacterium
TLGPEAEDD

SEQ ID NO: 597348 - protein, 5 aa, Mycobacterium
TLGPG

SEQ ID NO: 597349 - protein, 6 aa, Mycobacterium
TLGPGA

SEQ ID NO: 597350 - protein, 9 aa, Mycobacterium
TLGPGDSAY

SEQ ID NO: 597351 - protein, 6 aa, Mycobacterium
TLGPID

SEQ ID NO: 597352 - protein, 6 aa, Mycobacterium
TLGPKG

SEQ ID NO: 597353 - protein, 7 aa, Mycobacterium
TLGPKGR

SEQ ID NO: 597354 - protein, 9 aa, Mycobacterium
TLGPKGRNA

SEQ ID NO: 597355 - protein, 7 aa, Mycobacterium
TLGPKGS

SEQ ID NO: 597356 - protein, 7 aa, Mycobacterium
TLGPQQT

SEQ ID NO: 597357 - protein, 8 aa, Mycobacterium
TLGPSAAA

SEQ ID NO: 597358 - protein, 5 aa, Mycobacterium
TLGPV

SEQ ID NO: 597359 - protein, 5 aa, Mycobacterium
TLGQD

SEQ ID NO: 597360 - protein, 9 aa, Mycobacterium
TLGRDDGGL

SEQ ID NO: 597361 - protein, 7 aa, Mycobacterium
TLGRHNG

SEQ ID NO: 597362 - protein, 5 aa, Mycobacterium
TLGSE

SEQ ID NO: 597363 - protein, 15 aa, Mycobacterium
TLGSLAGGALGGPAA

SEQ ID NO: 597364 - protein, 11 aa, Mycobacterium
TLGTDPRADPR

SEQ ID NO: 597365 - protein, 9 aa, Mycobacterium
TLGTGDSAY

SEQ ID NO: 597366 - protein, 8 aa, Mycobacterium
TLGTTTEN

SEQ ID NO: 597367 - protein, 5 aa, Mycobacterium
TLGVP

SEQ ID NO: 597368 - protein, 16 aa, Mycobacterium
TLHDSGNDMAAAEAAN

SEQ ID NO: 597369 - protein, 6 aa, Mycobacterium
TLHGQA

SEQ ID NO: 597370 - protein, 14 aa, Mycobacterium
TLHPGSRLGSEREM

SEQ ID NO: 597371 - protein, 9 aa, Mycobacterium
TLHPPGAGV

SEQ ID NO: 597372 - protein, 4 aa, Mycobacterium
TLIP

SEQ ID NO: 597373 - protein, 8 aa, Mycobacterium
TLKGEHGD

SEQ ID NO: 597374 - protein, 7 aa, Mycobacterium
TLKGTSV

SEQ ID NO: 597375 - protein, 6 aa, Mycobacterium
TLKNRP

SEQ ID NO: 597376 - protein, 7 aa, Mycobacterium
TLKPEDR

SEQ ID NO: 597377 - protein, 12 aa, Mycobacterium
TLKRGEKTIEIN

SEQ ID NO: 597378 - protein, 8 aa, Mycobacterium
TLKSAGAS

SEQ ID NO: 597379 - protein, 7 aa, Mycobacterium
TLKSAKA

SEQ ID NO: 597380 - protein, 8 aa, Mycobacterium
TLKSPGAS

SEQ ID NO: 597381 - protein, 8 aa, Mycobacterium
TLNAGKST

SEQ ID NO: 597382 - protein, 9 aa, Mycobacterium
TLNDDEREV

SEQ ID NO: 597383 - protein, 14 aa, Mycobacterium
TLNDGEGTGVAPTD

SEQ ID NO: 597384 - protein, 5 aa, Mycobacterium
TLNET

SEQ ID NO: 597385 - protein, 14 aa, Mycobacterium
TLNGAPGSGRLPGN

SEQ ID NO: 597386 - protein, 6 aa, Mycobacterium
TLNGES

SEQ ID NO: 597387 - protein, 9 aa, Mycobacterium
TLNGETKAA

SEQ ID NO: 597388 - protein, 5 aa, Mycobacterium
TLNGR

SEQ ID NO: 597389 - protein, 5 aa, Mycobacterium
TLNPD

SEQ ID NO: 597390 - protein, 7 aa, Mycobacterium
TLNPGTA

SEQ ID NO: 597391 - protein, 9 aa, Mycobacterium
TLNPRPSQV

SEQ ID NO: 597392 - protein, 13 aa, Mycobacterium
TLNRDPEGAPYRT

SEQ ID NO: 597393 - protein, 8 aa, Mycobacterium
TLNRNDGV

SEQ ID NO: 597394 - protein, 7 aa, Mycobacterium
TLNRSSL

SEQ ID NO: 597395 - protein, 16 aa, Mycobacterium
TLNTGEPGCPAKPGVS

SEQ ID NO: 597396 - protein, 9 aa, Mycobacterium
TLPAGPDAA

SEQ ID NO: 597397 - protein, 11 aa, Mycobacterium
TLPAPTGLPDA

SEQ ID NO: 597398 - protein, 4 aa, Mycobacterium
TLPD

SEQ ID NO: 597399 - protein, 6 aa, Mycobacterium
TLPDDS

SEQ ID NO: 597400 - protein, 8 aa, Mycobacterium
TLPDEARA

SEQ ID NO: 597401 - protein, 6 aa, Mycobacterium
TLPDES

SEQ ID NO: 597402 - protein, 5 aa, Mycobacterium
TLPDG

SEQ ID NO: 597403 - protein, 7 aa, Mycobacterium
TLPDGRT

SEQ ID NO: 597404 - protein, 6 aa, Mycobacterium
TLPDGS

SEQ ID NO: 597405 - protein, 7 aa, Mycobacterium
TLPDGST

SEQ ID NO: 597406 - protein, 23 aa, Mycobacterium
TLPDGSTVSTDDGPRAGTTYEKV

SEQ ID NO: 597407 - protein, 16 aa, Mycobacterium
TLPDGTSVASGERGGV

SEQ ID NO: 597408 - protein, 21 aa, Mycobacterium
TLPDGTTVSTDDGPRAGTTYE

SEQ ID NO: 597409 - protein, 8 aa, Mycobacterium
TLPDNEAA

SEQ ID NO: 597410 - protein, 7 aa, Mycobacterium
TLPDPQQ

SEQ ID NO: 597411 - protein, 12 aa, Mycobacterium
TLPDPSDPEYGE

SEQ ID NO: 597412 - protein, 8 aa, Mycobacterium
TLPDTKAG

SEQ ID NO: 597413 - protein, 11 aa, Mycobacterium
TLPDTTESPAA

SEQ ID NO: 597414 - protein, 6 aa, Mycobacterium
TLPDVP

SEQ ID NO: 597415 - protein, 6 aa, Mycobacterium
TLPEAA

SEQ ID NO: 597416 - protein, 23 aa, Mycobacterium
TLPEDDDHPYRTGPWRPQTTEWD

SEQ ID NO: 597417 - protein, 23 aa, Mycobacterium
TLPEDDDHPYRTGPWRPQTTEWN

SEQ ID NO: 597418 - protein, 8 aa, Mycobacterium
TLPEDDPG

SEQ ID NO: 597419 - protein, 12 aa, Mycobacterium
TLPEDDTHPYRT

SEQ ID NO: 597420 - protein, 7 aa, Mycobacterium
TLPEGTD

SEQ ID NO: 597421 - protein, 5 aa, Mycobacterium
TLPER

SEQ ID NO: 597422 - protein, 8 aa, Mycobacterium
TLPGAAGP

SEQ ID NO: 597423 - protein, 7 aa, Mycobacterium
TLPGADD

SEQ ID NO: 597424 - protein, 16 aa, Mycobacterium
TLPGDGAEDAAARDTA

SEQ ID NO: 597425 - protein, 16 aa, Mycobacterium
TLPGDSADDAQARDTA

SEQ ID NO: 597426 - protein, 16 aa, Mycobacterium
TLPGDSPEDAMARDTA

SEQ ID NO: 597427 - protein, 9 aa, Mycobacterium
TLPGEDVTD

SEQ ID NO: 597428 - protein, 17 aa, Mycobacterium
TLPGETPEDIAARDTAR

SEQ ID NO: 597429 - protein, 6 aa, Mycobacterium
TLPGGA

SEQ ID NO: 597430 - protein, 9 aa, Mycobacterium
TLPGGSGME

SEQ ID NO: 597431 - protein, 10 aa, Mycobacterium
TLPGGTPRPV

SEQ ID NO: 597432 - protein, 7 aa, Mycobacterium
TLPGGYT

SEQ ID NO: 597433 - protein, 9 aa, Mycobacterium
TLPGLPPLS

SEQ ID NO: 597434 - protein, 9 aa, Mycobacterium
TLPGPGLPR

SEQ ID NO: 597435 - protein, 6 aa, Mycobacterium
TLPGPP

SEQ ID NO: 597436 - protein, 8 aa, Mycobacterium
TLPGPPVR

SEQ ID NO: 597437 - protein, 8 aa, Mycobacterium
TLPGPVAG

SEQ ID NO: 597438 - protein, 9 aa, Mycobacterium
TLPGRPGGN

SEQ ID NO: 597439 - protein, 9 aa, Mycobacterium
TLPGSRNGG

SEQ ID NO: 597440 - protein, 13 aa, Mycobacterium
TLPGSSGSSRSER

SEQ ID NO: 597441 - protein, 9 aa, Mycobacterium
TLPKPQVDN

SEQ ID NO: 597442 - protein, 11 aa, Mycobacterium
TLPKSGSEAPW

SEQ ID NO: 597443 - protein, 5 aa, Mycobacterium
TLPKT

SEQ ID NO: 597444 - protein, 4 aa, Mycobacterium
TLPN

SEQ ID NO: 597445 - protein, 8 aa, Mycobacterium
TLPNAEKR

SEQ ID NO: 597446 - protein, 7 aa, Mycobacterium
TLPNAGH

SEQ ID NO: 597447 - protein, 5 aa, Mycobacterium
TLPND

SEQ ID NO: 597448 - protein, 12 aa, Mycobacterium
TLPNDRVPTSKD

SEQ ID NO: 597449 - protein, 15 aa, Mycobacterium
TLPNGETVTAANPQL

SEQ ID NO: 597450 - protein, 6 aa, Mycobacterium
TLPNGT

SEQ ID NO: 597451 - protein, 12 aa, Mycobacterium
TLPNPATDQPRY

SEQ ID NO: 597452 - protein, 6 aa, Mycobacterium
TLPNTN

SEQ ID NO: 597453 - protein, 4 aa, Mycobacterium
TLPP

SEQ ID NO: 597454 - protein, 7 aa, Mycobacterium
TLPPADA

SEQ ID NO: 597455 - protein, 9 aa, Mycobacterium
TLPPAEEAR

SEQ ID NO: 597456 - protein, 6 aa, Mycobacterium
TLPPAV

SEQ ID NO: 597457 - protein, 19 aa, Mycobacterium
TLPPEADEYRTQAREAAEA

SEQ ID NO: 597458 - protein, 8 aa, Mycobacterium
TLPPEEYQ

SEQ ID NO: 597459 - protein, 6 aa, Mycobacterium
TLPPER

SEQ ID NO: 597460 - protein, 14 aa, Mycobacterium
TLPPGAELTPTGRV

SEQ ID NO: 597461 - protein, 7 aa, Mycobacterium
TLPPPGA

SEQ ID NO: 597462 - protein, 6 aa, Mycobacterium
TLPPRQ

SEQ ID NO: 597463 - protein, 6 aa, Mycobacterium
TLPPSQ

SEQ ID NO: 597464 - protein, 5 aa, Mycobacterium
TLPPT

SEQ ID NO: 597465 - protein, 7 aa, Mycobacterium
TLPQNSP

SEQ ID NO: 597466 - protein, 7 aa, Mycobacterium
TLPQRGR

SEQ ID NO: 597467 - protein, 22 aa, Mycobacterium
TLPQSSLSAAPAALAADGQGSL

SEQ ID NO: 597468 - protein, 11 aa, Mycobacterium
TLPQVTDASGT

SEQ ID NO: 597469 - protein, 25 aa, Mycobacterium
TLPRAPRAGDTGGGAVTSTDGDTFY

SEQ ID NO: 597470 - protein, 9 aa, Mycobacterium
TLPREAPWE

SEQ ID NO: 597471 - protein, 4 aa, Mycobacterium
TLPS

SEQ ID NO: 597472 - protein, 5 aa, Mycobacterium
TLPSA

SEQ ID NO: 597473 - protein, 5 aa, Mycobacterium
TLPSD

SEQ ID NO: 597474 - protein, 6 aa, Mycobacterium
TLPSEL

SEQ ID NO: 597475 - protein, 8 aa, Mycobacterium
TLPSGAPV

SEQ ID NO: 597476 - protein, 7 aa, Mycobacterium
TLPSGKP

SEQ ID NO: 597477 - protein, 5 aa, Mycobacterium
TLPSP

SEQ ID NO: 597478 - protein, 7 aa, Mycobacterium
TLPSPSQ

SEQ ID NO: 597479 - protein, 6 aa, Mycobacterium
TLPSTG

SEQ ID NO: 597480 - protein, 12 aa, Mycobacterium
TLPSTYAKPREL

SEQ ID NO: 597481 - protein, 8 aa, Mycobacterium
TLPSTYAR

SEQ ID NO: 597482 - protein, 11 aa, Mycobacterium
TLPSTYARPRE

SEQ ID NO: 597483 - protein, 12 aa, Mycobacterium
TLPSTYASPREL

SEQ ID NO: 597484 - protein, 6 aa, Mycobacterium
TLPTDD

SEQ ID NO: 597485 - protein, 9 aa, Mycobacterium
TLPTPDDES

SEQ ID NO: 597486 - protein, 11 aa, Mycobacterium
TLPTRGAARYT

SEQ ID NO: 597487 - protein, 13 aa, Mycobacterium
TLPTRQGSRTGFN

SEQ ID NO: 597488 - protein, 7 aa, Mycobacterium
TLPTTEP

SEQ ID NO: 597489 - protein, 17 aa, Mycobacterium
TLPYGTEAAADDGSAEY

SEQ ID NO: 597490 - protein, 5 aa, Mycobacterium
TLPYT

SEQ ID NO: 597491 - protein, 4 aa, Mycobacterium
TLQA

SEQ ID NO: 597492 - protein, 8 aa, Mycobacterium
TLQEAGHD

SEQ ID NO: 597493 - protein, 4 aa, Mycobacterium
TLQG

SEQ ID NO: 597494 - protein, 7 aa, Mycobacterium
TLQGPAT

SEQ ID NO: 597495 - protein, 8 aa, Mycobacterium
TLQGPSGA

SEQ ID NO: 597496 - protein, 5 aa, Mycobacterium
TLQHT

SEQ ID NO: 597497 - protein, 17 aa, Mycobacterium
TLQPGAPHRYPPNDARG

SEQ ID NO: 597498 - protein, 6 aa, Mycobacterium
TLQPGD

SEQ ID NO: 597499 - protein, 10 aa, Mycobacterium
TLQPGEGPVV

SEQ ID NO: 597500 - protein, 7 aa, Mycobacterium
TLQPGGL

SEQ ID NO: 597501 - protein, 6 aa, Mycobacterium
TLQPGQ

SEQ ID NO: 597502 - protein, 7 aa, Mycobacterium
TLQPGTA

SEQ ID NO: 597503 - protein, 20 aa, Mycobacterium
TLQRGQAALTGPVARGDAAA

SEQ ID NO: 597504 - protein, 4 aa, Mycobacterium
TLQS

SEQ ID NO: 597505 - protein, 11 aa, Mycobacterium
TLQSEADETLA

SEQ ID NO: 597506 - protein, 6 aa, Mycobacterium
TLQSGA

SEQ ID NO: 597507 - protein, 7 aa, Mycobacterium
TLQSGPE

SEQ ID NO: 597508 - protein, 11 aa, Mycobacterium
TLQSGRPARIS

SEQ ID NO: 597509 - protein, 16 aa, Mycobacterium
TLQSGTTVNFEVSDVG

SEQ ID NO: 597510 - protein, 5 aa, Mycobacterium
TLQTG

SEQ ID NO: 597511 - protein, 10 aa, Mycobacterium
TLQTGDGEQV

SEQ ID NO: 597512 - protein, 14 aa, Mycobacterium
TLQTPASGWGGRAP

SEQ ID NO: 597513 - protein, 8 aa, Mycobacterium
TLRDNQSR

SEQ ID NO: 597514 - protein, 5 aa, Mycobacterium
TLRDP

SEQ ID NO: 597515 - protein, 7 aa, Mycobacterium
TLRDPDR

SEQ ID NO: 597516 - protein, 13 aa, Mycobacterium
TLRDSRERRLRTG

SEQ ID NO: 597517 - protein, 8 aa, Mycobacterium
TLREGKAS

SEQ ID NO: 597518 - protein, 11 aa, Mycobacterium
TLREHGAEPTA

SEQ ID NO: 597519 - protein, 5 aa, Mycobacterium
TLRGA

SEQ ID NO: 597520 - protein, 19 aa, Mycobacterium
TLRGEADRAERDGDLAKAA

SEQ ID NO: 597521 - protein, 6 aa, Mycobacterium
TLRGGR

SEQ ID NO: 597522 - protein, 10 aa, Mycobacterium
TLRGGRGEDV

SEQ ID NO: 597523 - protein, 9 aa, Mycobacterium
TLRNGQQAA

SEQ ID NO: 597524 - protein, 11 aa, Mycobacterium
TLRPDDLPPGD

SEQ ID NO: 597525 - protein, 9 aa, Mycobacterium
TLRPEGTAG

SEQ ID NO: 597526 - protein, 6 aa, Mycobacterium
TLRPET

SEQ ID NO: 597527 - protein, 10 aa, Mycobacterium
TLRPGDDAGV

SEQ ID NO: 597528 - protein, 8 aa, Mycobacterium
TLRPGTRT

SEQ ID NO: 597529 - protein, 11 aa, Mycobacterium
TLRPTASPDQV

SEQ ID NO: 597530 - protein, 23 aa, Mycobacterium
TLRPTASRTDAAAAYESMTSGEL

SEQ ID NO: 597531 - protein, 8 aa, Mycobacterium
TLRQDSPG

SEQ ID NO: 597532 - protein, 9 aa, Mycobacterium
TLRQDSPGA

SEQ ID NO: 597533 - protein, 12 aa, Mycobacterium
TLRQDSPGAQLR

SEQ ID NO: 597534 - protein, 7 aa, Mycobacterium
TLRQGDR

SEQ ID NO: 597535 - protein, 9 aa, Mycobacterium
TLRRDGYDG

SEQ ID NO: 597536 - protein, 12 aa, Mycobacterium
TLRRHGAQPKAG

SEQ ID NO: 597537 - protein, 15 aa, Mycobacterium
TLRRKRTELTDHPEK

SEQ ID NO: 597538 - protein, 5 aa, Mycobacterium
TLRRS

SEQ ID NO: 597539 - protein, 5 aa, Mycobacterium
TLRSA

SEQ ID NO: 597540 - protein, 22 aa, Mycobacterium
TLRSARSGQGKTLREVSDSARV

SEQ ID NO: 597541 - protein, 10 aa, Mycobacterium
TLRSDTPVSL

SEQ ID NO: 597542 - protein, 5 aa, Mycobacterium
TLRSR

SEQ ID NO: 597543 - protein, 11 aa, Mycobacterium
TLRSSLDDGGW

SEQ ID NO: 597544 - protein, 12 aa, Mycobacterium
TLRTDSPVSTRG

SEQ ID NO: 597545 - protein, 10 aa, Mycobacterium
TLRTNSPGAV

SEQ ID NO: 597546 - protein, 9 aa, Mycobacterium
TLRTPATTA

SEQ ID NO: 597547 - protein, 7 aa, Mycobacterium
TLSAPGA

SEQ ID NO: 597548 - protein, 5 aa, Mycobacterium
TLSAR

SEQ ID NO: 597549 - protein, 7 aa, Mycobacterium
TLSASAE

SEQ ID NO: 597550 - protein, 6 aa, Mycobacterium
TLSDAG

SEQ ID NO: 597551 - protein, 6 aa, Mycobacterium
TLSDAV

SEQ ID NO: 597552 - protein, 8 aa, Mycobacterium
TLSDDEDA

SEQ ID NO: 597553 - protein, 16 aa, Mycobacterium
TLSDSEAEKPGSDDDQ

SEQ ID NO: 597554 - protein, 5 aa, Mycobacterium
TLSEA

SEQ ID NO: 597555 - protein, 15 aa, Mycobacterium
TLSEAAKSASSGSDV

SEQ ID NO: 597556 - protein, 9 aa, Mycobacterium
TLSEAETEL

SEQ ID NO: 597557 - protein, 6 aa, Mycobacterium
TLSEDP

SEQ ID NO: 597558 - protein, 7 aa, Mycobacterium
TLSEETT

SEQ ID NO: 597559 - protein, 5 aa, Mycobacterium
TLSEG

SEQ ID NO: 597560 - protein, 5 aa, Mycobacterium
TLSER

SEQ ID NO: 597561 - protein, 7 aa, Mycobacterium
TLSERAD

SEQ ID NO: 597562 - protein, 10 aa, Mycobacterium
TLSESDGTTT

SEQ ID NO: 597563 - protein, 12 aa, Mycobacterium
TLSETERTNYNE

SEQ ID NO: 597564 - protein, 8 aa, Mycobacterium
TLSGAGPA

SEQ ID NO: 597565 - protein, 7 aa, Mycobacterium
TLSGAPK

SEQ ID NO: 597566 - protein, 7 aa, Mycobacterium
TLSGERS

SEQ ID NO: 597567 - protein, 15 aa, Mycobacterium
TLSGGAESFTGKDGL

SEQ ID NO: 597568 - protein, 6 aa, Mycobacterium
TLSGGE

SEQ ID NO: 597569 - protein, 8 aa, Mycobacterium
TLSGGQQK

SEQ ID NO: 597570 - protein, 19 aa, Mycobacterium
TLSGGYTAHPKRDPDTGEL

SEQ ID NO: 597571 - protein, 6 aa, Mycobacterium
TLSGPQ

SEQ ID NO: 597572 - protein, 7 aa, Mycobacterium
TLSGPQL

SEQ ID NO: 597573 - protein, 8 aa, Mycobacterium
TLSGSPMK

SEQ ID NO: 597574 - protein, 16 aa, Mycobacterium
TLSGSRLASRSITPAT

SEQ ID NO: 597575 - protein, 19 aa, Mycobacterium
TLSGSSDPGAELAMIDAIL

SEQ ID NO: 597576 - protein, 14 aa, Mycobacterium
TLSGSSLASQSISP

SEQ ID NO: 597577 - protein, 17 aa, Mycobacterium
TLSGSTLATQSITPDTL

SEQ ID NO: 597578 - protein, 10 aa, Mycobacterium
TLSGTDTSDL

SEQ ID NO: 597579 - protein, 21 aa, Mycobacterium
TLSGTGTEPGAGPDAATLAPR

SEQ ID NO: 597580 - protein, 9 aa, Mycobacterium
TLSKDGPFP

SEQ ID NO: 597581 - protein, 10 aa, Mycobacterium
TLSKNGPFPL

SEQ ID NO: 597582 - protein, 9 aa, Mycobacterium
TLSKPEDSF

SEQ ID NO: 597583 - protein, 5 aa, Mycobacterium
TLSKR

SEQ ID NO: 597584 - protein, 6 aa, Mycobacterium
TLSNDG

SEQ ID NO: 597585 - protein, 17 aa, Mycobacterium
TLSNGSGGVIKCSRLLV

SEQ ID NO: 597586 - protein, 7 aa, Mycobacterium
TLSNHPS

SEQ ID NO: 597587 - protein, 4 aa, Mycobacterium
TLSP

SEQ ID NO: 597588 - protein, 10 aa, Mycobacterium
TLSPADALAG

SEQ ID NO: 597589 - protein, 7 aa, Mycobacterium
TLSPAEA

SEQ ID NO: 597590 - protein, 10 aa, Mycobacterium
TLSPASRRSL

SEQ ID NO: 597591 - protein, 8 aa, Mycobacterium
TLSPDDQR

SEQ ID NO: 597592 - protein, 11 aa, Mycobacterium
TLSPDDSVSDA

SEQ ID NO: 597593 - protein, 20 aa, Mycobacterium
TLSPEAESHPQFSGPQAGPL

SEQ ID NO: 597594 - protein, 11 aa, Mycobacterium
TLSPEDSVSDA

SEQ ID NO: 597595 - protein, 18 aa, Mycobacterium
TLSPEEGSAEGGAVEPSL

SEQ ID NO: 597596 - protein, 7 aa, Mycobacterium
TLSPGGV

SEQ ID NO: 597597 - protein, 8 aa, Mycobacterium
TLSPMASG

SEQ ID NO: 597598 - protein, 5 aa, Mycobacterium
TLSPN

SEQ ID NO: 597599 - protein, 10 aa, Mycobacterium
TLSPPSVAKY

SEQ ID NO: 597600 - protein, 6 aa, Mycobacterium
TLSPSE

SEQ ID NO: 597601 - protein, 8 aa, Mycobacterium
TLSPTDAL

SEQ ID NO: 597602 - protein, 4 aa, Mycobacterium
TLSQ

SEQ ID NO: 597603 - protein, 13 aa, Mycobacterium
TLSQDRRLRRPAT

SEQ ID NO: 597604 - protein, 10 aa, Mycobacterium
TLSQGERGRT

SEQ ID NO: 597605 - protein, 9 aa, Mycobacterium
TLSRPEDSF

SEQ ID NO: 597606 - protein, 11 aa, Mycobacterium
TLSRPGDSFED

SEQ ID NO: 597607 - protein, 12 aa, Mycobacterium
TLSRPGDSFEDV

SEQ ID NO: 597608 - protein, 11 aa, Mycobacterium
TLSRPQEGLTA

SEQ ID NO: 597609 - protein, 10 aa, Mycobacterium
TLSRPRSAKD

SEQ ID NO: 597610 - protein, 10 aa, Mycobacterium
TLSRTGKPAA

SEQ ID NO: 597611 - protein, 8 aa, Mycobacterium
TLSRTSRP

SEQ ID NO: 597612 - protein, 9 aa, Mycobacterium
TLSSDSNVR

SEQ ID NO: 597613 - protein, 7 aa, Mycobacterium
TLSSKAE

SEQ ID NO: 597614 - protein, 5 aa, Mycobacterium
TLSSQ

SEQ ID NO: 597615 - protein, 6 aa, Mycobacterium
TLSSSS

SEQ ID NO: 597616 - protein, 25 aa, Mycobacterium
TLSTANTAAVAATTGVVPSAADEVS

SEQ ID NO: 597617 - protein, 9 aa, Mycobacterium
TLSTASDGR

SEQ ID NO: 597618 - protein, 5 aa, Mycobacterium
TLSTG

SEQ ID NO: 597619 - protein, 6 aa, Mycobacterium
TLSTSS

SEQ ID NO: 597620 - protein, 15 aa, Mycobacterium
TLSTTELERTVLAEK

SEQ ID NO: 597621 - protein, 4 aa, Mycobacterium
TLSY

SEQ ID NO: 597622 - protein, 4 aa, Mycobacterium
TLTA

SEQ ID NO: 597623 - protein, 10 aa, Mycobacterium
TLTADDVQSA

SEQ ID NO: 597624 - protein, 6 aa, Mycobacterium
TLTADE

SEQ ID NO: 597625 - protein, 13 aa, Mycobacterium
TLTAPRSAPSADV

SEQ ID NO: 597626 - protein, 10 aa, Mycobacterium
TLTASSRRAL

SEQ ID NO: 597627 - protein, 9 aa, Mycobacterium
TLTATRQGD

SEQ ID NO: 597628 - protein, 5 aa, Mycobacterium
TLTDA

SEQ ID NO: 597629 - protein, 5 aa, Mycobacterium
TLTDE

SEQ ID NO: 597630 - protein, 12 aa, Mycobacterium
TLTDEPESKSAD

SEQ ID NO: 597631 - protein, 18 aa, Mycobacterium
TLTDGAGPVNSKTAGQLQ

SEQ ID NO: 597632 - protein, 12 aa, Mycobacterium
TLTDGGDAANQA

SEQ ID NO: 597633 - protein, 18 aa, Mycobacterium
TLTDGGEDQQFQSGGTGG

SEQ ID NO: 597634 - protein, 9 aa, Mycobacterium
TLTDSAEGI

SEQ ID NO: 597635 - protein, 8 aa, Mycobacterium
TLTEERKA

SEQ ID NO: 597636 - protein, 6 aa, Mycobacterium
TLTERQ

SEQ ID NO: 597637 - protein, 4 aa, Mycobacterium
TLTG

SEQ ID NO: 597638 - protein, 6 aa, Mycobacterium
TLTGGQ

SEQ ID NO: 597639 - protein, 7 aa, Mycobacterium
TLTGGQL

SEQ ID NO: 597640 - protein, 7 aa, Mycobacterium
TLTGGQM

SEQ ID NO: 597641 - protein, 19 aa, Mycobacterium
TLTGGYTAHPHRDPGTGEL

SEQ ID NO: 597642 - protein, 10 aa, Mycobacterium
TLTGHAKGGA

SEQ ID NO: 597643 - protein, 11 aa, Mycobacterium
TLTGHSKGGAA

SEQ ID NO: 597644 - protein, 18 aa, Mycobacterium
TLTGHTPTRSVYEPAPRP

SEQ ID NO: 597645 - protein, 15 aa, Mycobacterium
TLTGIGAEPTATRRT

SEQ ID NO: 597646 - protein, 7 aa, Mycobacterium
TLTGPAN

SEQ ID NO: 597647 - protein, 7 aa, Mycobacterium
TLTGPEH

SEQ ID NO: 597648 - protein, 7 aa, Mycobacterium
TLTGPHR

SEQ ID NO: 597649 - protein, 11 aa, Mycobacterium
TLTGRDGRTAH

SEQ ID NO: 597650 - protein, 8 aa, Mycobacterium
TLTGSDPV

SEQ ID NO: 597651 - protein, 13 aa, Mycobacterium
TLTGSEPAGQSVG

SEQ ID NO: 597652 - protein, 11 aa, Mycobacterium
TLTGSEPPVIG

SEQ ID NO: 597653 - protein, 10 aa, Mycobacterium
TLTKPGPHDL

SEQ ID NO: 597654 - protein, 11 aa, Mycobacterium
TLTLSSKAKSL

SEQ ID NO: 597655 - protein, 14 aa, Mycobacterium
TLTNNRLTGPTGLS

SEQ ID NO: 597656 - protein, 11 aa, Mycobacterium
TLTNPDAASDV

SEQ ID NO: 597657 - protein, 11 aa, Mycobacterium
TLTPADVRGTY

SEQ ID NO: 597658 - protein, 10 aa, Mycobacterium
TLTPAGRALE

SEQ ID NO: 597659 - protein, 7 aa, Mycobacterium
TLTPDDD

SEQ ID NO: 597660 - protein, 9 aa, Mycobacterium
TLTPDDDAA

SEQ ID NO: 597661 - protein, 7 aa, Mycobacterium
TLTPDHV

SEQ ID NO: 597662 - protein, 6 aa, Mycobacterium
TLTPDI

SEQ ID NO: 597663 - protein, 9 aa, Mycobacterium
TLTPDQAAG

SEQ ID NO: 597664 - protein, 20 aa, Mycobacterium
TLTPDRGAEPELGPQPDARW

SEQ ID NO: 597665 - protein, 8 aa, Mycobacterium
TLTPEQAA

SEQ ID NO: 597666 - protein, 8 aa, Mycobacterium
TLTPGVAD

SEQ ID NO: 597667 - protein, 6 aa, Mycobacterium
TLTPGY

SEQ ID NO: 597668 - protein, 9 aa, Mycobacterium
TLTPQESVR

SEQ ID NO: 597669 - protein, 14 aa, Mycobacterium
TLTPQQTSADRITA

SEQ ID NO: 597670 - protein, 9 aa, Mycobacterium
TLTPQRATD

SEQ ID NO: 597671 - protein, 12 aa, Mycobacterium
TLTPRPQPADGV

SEQ ID NO: 597672 - protein, 7 aa, Mycobacterium
TLTPSQA

SEQ ID NO: 597673 - protein, 6 aa, Mycobacterium
TLTPSR

SEQ ID NO: 597674 - protein, 7 aa, Mycobacterium
TLTPSRL

SEQ ID NO: 597675 - protein, 12 aa, Mycobacterium
TLTPTADTLESA

SEQ ID NO: 597676 - protein, 7 aa, Mycobacterium
TLTQTAE

SEQ ID NO: 597677 - protein, 4 aa, Mycobacterium
TLTR

SEQ ID NO: 597678 - protein, 8 aa, Mycobacterium
TLTRRDQG

SEQ ID NO: 597679 - protein, 9 aa, Mycobacterium
TLTRRDQGR

SEQ ID NO: 597680 - protein, 6 aa, Mycobacterium
TLTSAR

SEQ ID NO: 597681 - protein, 9 aa, Mycobacterium
TLTSGGNIS

SEQ ID NO: 597682 - protein, 6 aa, Mycobacterium
TLTSID

SEQ ID NO: 597683 - protein, 6 aa, Mycobacterium
TLTSMD

SEQ ID NO: 597684 - protein, 6 aa, Mycobacterium
TLTSSR

SEQ ID NO: 597685 - protein, 6 aa, Mycobacterium
TLTSST

SEQ ID NO: 597686 - protein, 21 aa, Mycobacterium
TLTSSTTDTSDIVTYAGQVKV

SEQ ID NO: 597687 - protein, 11 aa, Mycobacterium
TLTSTPSARGL

SEQ ID NO: 597688 - protein, 5 aa, Mycobacterium
TLTSV

SEQ ID NO: 597689 - protein, 6 aa, Mycobacterium
TLTSVD

SEQ ID NO: 597690 - protein, 7 aa, Mycobacterium
TLTSVDD

SEQ ID NO: 597691 - protein, 6 aa, Mycobacterium
TLTSVS

SEQ ID NO: 597692 - protein, 7 aa, Mycobacterium
TLTTGTG

SEQ ID NO: 597693 - protein, 5 aa, Mycobacterium
TLTVG

SEQ ID NO: 597694 - protein, 7 aa, Mycobacterium
TLVDTDD

SEQ ID NO: 597695 - protein, 14 aa, Mycobacterium
TLVGPSGRMGLGPR

SEQ ID NO: 597696 - protein, 4 aa, Mycobacterium
TLVQ

SEQ ID NO: 597697 - protein, 7 aa, Mycobacterium
TLYDAGT

SEQ ID NO: 597698 - protein, 9 aa, Mycobacterium
TMAGKAGTF

SEQ ID NO: 597699 - protein, 8 aa, Mycobacterium
TMAGRSGA

SEQ ID NO: 597700 - protein, 5 aa, Mycobacterium
TMAGV

SEQ ID NO: 597701 - protein, 14 aa, Mycobacterium
TMDAGADKAAELAN

SEQ ID NO: 597702 - protein, 8 aa, Mycobacterium
TMDPDPKY

SEQ ID NO: 597703 - protein, 17 aa, Mycobacterium
TMDPDPKYQGSLSQTRD

SEQ ID NO: 597704 - protein, 10 aa, Mycobacterium
TMDPEDSWQQ

SEQ ID NO: 597705 - protein, 8 aa, Mycobacterium
TMDPPAAT

SEQ ID NO: 597706 - protein, 5 aa, Mycobacterium
TMDPT

SEQ ID NO: 597707 - protein, 14 aa, Mycobacterium
TMDSGADKAAELAN

SEQ ID NO: 597708 - protein, 6 aa, Mycobacterium
TMEGPE

SEQ ID NO: 597709 - protein, 17 aa, Mycobacterium
TMEPDPKYQGSLSQTRD

SEQ ID NO: 597710 - protein, 7 aa, Mycobacterium
TMETNPQ

SEQ ID NO: 597711 - protein, 16 aa, Mycobacterium
TMGDTGPANPVTDDEL

SEQ ID NO: 597712 - protein, 14 aa, Mycobacterium
TMGGDSPNAQSGSI

SEQ ID NO: 597713 - protein, 4 aa, Mycobacterium
TMGN

SEQ ID NO: 597714 - protein, 11 aa, Mycobacterium
TMGNRGYSTGP

SEQ ID NO: 597715 - protein, 16 aa, Mycobacterium
TMGPEPQDSLLYAKIL

SEQ ID NO: 597716 - protein, 9 aa, Mycobacterium
TMGPGTPYA

SEQ ID NO: 597717 - protein, 8 aa, Mycobacterium
TMGSRPDR

SEQ ID NO: 597718 - protein, 4 aa, Mycobacterium
TMGY

SEQ ID NO: 597719 - protein, 15 aa, Mycobacterium
TMKDGEGEGVAPTDA

SEQ ID NO: 597720 - protein, 15 aa, Mycobacterium
TMNDGDGAGIPPTDA

SEQ ID NO: 597721 - protein, 14 aa, Mycobacterium
TMNDGEGSGVAPTD

SEQ ID NO: 597722 - protein, 4 aa, Mycobacterium
TMNG

SEQ ID NO: 597723 - protein, 5 aa, Mycobacterium
TMNGT

SEQ ID NO: 597724 - protein, 4 aa, Mycobacterium
TMNP

SEQ ID NO: 597725 - protein, 9 aa, Mycobacterium
TMNPDKRAT

SEQ ID NO: 597726 - protein, 4 aa, Mycobacterium
TMPA

SEQ ID NO: 597727 - protein, 10 aa, Mycobacterium
TMPAPDGTRT

SEQ ID NO: 597728 - protein, 10 aa, Mycobacterium
TMPAPGGTRT

SEQ ID NO: 597729 - protein, 4 aa, Mycobacterium
TMPD

SEQ ID NO: 597730 - protein, 12 aa, Mycobacterium
TMPDQKRTLDEL

SEQ ID NO: 597731 - protein, 4 aa, Mycobacterium
TMPE

SEQ ID NO: 597732 - protein, 9 aa, Mycobacterium
TMPEAARAR

SEQ ID NO: 597733 - protein, 7 aa, Mycobacterium
TMPEANR

SEQ ID NO: 597734 - protein, 5 aa, Mycobacterium
TMPEK

SEQ ID NO: 597735 - protein, 5 aa, Mycobacterium
TMPEP

SEQ ID NO: 597736 - protein, 5 aa, Mycobacterium
TMPGR

SEQ ID NO: 597737 - protein, 15 aa, Mycobacterium
TMPKDRPETESTLAA

SEQ ID NO: 597738 - protein, 9 aa, Mycobacterium
TMPKPQRNY

SEQ ID NO: 597739 - protein, 10 aa, Mycobacterium
TMPPDSVESF

SEQ ID NO: 597740 - protein, 25 aa, Mycobacterium
TMPPDSVESFGENTPLGRAGQPSEL

SEQ ID NO: 597741 - protein, 12 aa, Mycobacterium
TMPPTIRKDLRS

SEQ ID NO: 597742 - protein, 4 aa, Mycobacterium
TMPR

SEQ ID NO: 597743 - protein, 4 aa, Mycobacterium
TMQP

SEQ ID NO: 597744 - protein, 7 aa, Mycobacterium
TMQPQGH

SEQ ID NO: 597745 - protein, 5 aa, Mycobacterium
TMRDT

SEQ ID NO: 597746 - protein, 5 aa, Mycobacterium
TMREQ

SEQ ID NO: 597747 - protein, 10 aa, Mycobacterium
TMRKQAAASF

SEQ ID NO: 597748 - protein, 5 aa, Mycobacterium
TMRPG

SEQ ID NO: 597749 - protein, 8 aa, Mycobacterium
TMRPRGVY

SEQ ID NO: 597750 - protein, 11 aa, Mycobacterium
TMSENGSDERL

SEQ ID NO: 597751 - protein, 7 aa, Mycobacterium
TMSKQAR

SEQ ID NO: 597752 - protein, 11 aa, Mycobacterium
TMSLDGRSGGV

SEQ ID NO: 597753 - protein, 5 aa, Mycobacterium
TMSPE

SEQ ID NO: 597754 - protein, 6 aa, Mycobacterium
TMSSGA

SEQ ID NO: 597755 - protein, 4 aa, Mycobacterium
TMST

SEQ ID NO: 597756 - protein, 5 aa, Mycobacterium
TMSTE

SEQ ID NO: 597757 - protein, 14 aa, Mycobacterium
TMSTSEADGVAGGV

SEQ ID NO: 597758 - protein, 14 aa, Mycobacterium
TMSTSEVDGVTGGV

SEQ ID NO: 597759 - protein, 15 aa, Mycobacterium
TMSTTDADGVTGGVT

SEQ ID NO: 597760 - protein, 14 aa, Mycobacterium
TMSTTEADGVAGGV

SEQ ID NO: 597761 - protein, 15 aa, Mycobacterium
TMSTTESDGVAGGVT

SEQ ID NO: 597762 - protein, 16 aa, Mycobacterium
TMTAQETPSAAASRYQ

SEQ ID NO: 597763 - protein, 16 aa, Mycobacterium
TMTDGEGAGVAPTDAL

SEQ ID NO: 597764 - protein, 18 aa, Mycobacterium
TMTEEETEFSPDSRIPSP

SEQ ID NO: 597765 - protein, 5 aa, Mycobacterium
TMTGT

SEQ ID NO: 597766 - protein, 5 aa, Mycobacterium
TMTPE

SEQ ID NO: 597767 - protein, 6 aa, Mycobacterium
TMTPEQ

SEQ ID NO: 597768 - protein, 4 aa, Mycobacterium
TMTT

SEQ ID NO: 597769 - protein, 14 aa, Mycobacterium
TMTTNGESTSRTTT

SEQ ID NO: 597770 - protein, 12 aa, Mycobacterium
TMTTSGPRFSSG

SEQ ID NO: 597771 - protein, 5 aa, Mycobacterium
TMYPP

SEQ ID NO: 597772 - protein, 7 aa, Mycobacterium
TNAAAGS

SEQ ID NO: 597773 - protein, 8 aa, Mycobacterium
TNAAREMA

SEQ ID NO: 597774 - protein, 7 aa, Mycobacterium
TNADEGR

SEQ ID NO: 597775 - protein, 8 aa, Mycobacterium
TNADGATG

SEQ ID NO: 597776 - protein, 15 aa, Mycobacterium
TNADRLGLPDNKPMQ

SEQ ID NO: 597777 - protein, 6 aa, Mycobacterium
TNADRP

SEQ ID NO: 597778 - protein, 7 aa, Mycobacterium
TNADRPV

SEQ ID NO: 597779 - protein, 8 aa, Mycobacterium
TNAEAAQR

SEQ ID NO: 597780 - protein, 10 aa, Mycobacterium
TNAEAATTLG

SEQ ID NO: 597781 - protein, 9 aa, Mycobacterium
TNAEDTQKN

SEQ ID NO: 597782 - protein, 8 aa, Mycobacterium
TNAEGVAR

SEQ ID NO: 597783 - protein, 7 aa, Mycobacterium
TNAEHDE

SEQ ID NO: 597784 - protein, 17 aa, Mycobacterium
TNAEHPGVGPSESEVGP

SEQ ID NO: 597785 - protein, 7 aa, Mycobacterium
TNAEVSG

SEQ ID NO: 597786 - protein, 10 aa, Mycobacterium
TNAGHREAHD

SEQ ID NO: 597787 - protein, 8 aa, Mycobacterium
TNAGRAGA

SEQ ID NO: 597788 - protein, 4 aa, Mycobacterium
TNAI

SEQ ID NO: 597789 - protein, 9 aa, Mycobacterium
TNALTTDSG

SEQ ID NO: 597790 - protein, 8 aa, Mycobacterium
TNALTTEA

SEQ ID NO: 597791 - protein, 4 aa, Mycobacterium
TNAN

SEQ ID NO: 597792 - protein, 7 aa, Mycobacterium
TNAPADT

SEQ ID NO: 597793 - protein, 13 aa, Mycobacterium
TNAPDKTAERFTP

SEQ ID NO: 597794 - protein, 5 aa, Mycobacterium
TNAPE

SEQ ID NO: 597795 - protein, 7 aa, Mycobacterium
TNAPGIS

SEQ ID NO: 597796 - protein, 11 aa, Mycobacterium
TNAPGNGAPIG

SEQ ID NO: 597797 - protein, 5 aa, Mycobacterium
TNAPN

SEQ ID NO: 597798 - protein, 9 aa, Mycobacterium
TNAPPTERN

SEQ ID NO: 597799 - protein, 5 aa, Mycobacterium
TNAPT

SEQ ID NO: 597800 - protein, 9 aa, Mycobacterium
TNAQAAAAV

SEQ ID NO: 597801 - protein, 8 aa, Mycobacterium
TNAQKSGD

SEQ ID NO: 597802 - protein, 7 aa, Mycobacterium
TNAQRTL

SEQ ID NO: 597803 - protein, 4 aa, Mycobacterium
TNAR

SEQ ID NO: 597804 - protein, 5 aa, Mycobacterium
TNARA

SEQ ID NO: 597805 - protein, 7 aa, Mycobacterium
TNARAKM

SEQ ID NO: 597806 - protein, 12 aa, Mycobacterium
TNARSDPSQESA

SEQ ID NO: 597807 - protein, 4 aa, Mycobacterium
TNAS

SEQ ID NO: 597808 - protein, 7 aa, Mycobacterium
TNASGGC

SEQ ID NO: 597809 - protein, 9 aa, Mycobacterium
TNASGGSSI

SEQ ID NO: 597810 - protein, 17 aa, Mycobacterium
TNASGKVVSGRLNQDRT

SEQ ID NO: 597811 - protein, 11 aa, Mycobacterium
TNASGPGSPIA

SEQ ID NO: 597812 - protein, 7 aa, Mycobacterium
TNATEPG

SEQ ID NO: 597813 - protein, 15 aa, Mycobacterium
TNATETDANGNLPET

SEQ ID NO: 597814 - protein, 8 aa, Mycobacterium
TNATSEAV

SEQ ID NO: 597815 - protein, 9 aa, Mycobacterium
TNATTTETL

SEQ ID NO: 597816 - protein, 18 aa, Mycobacterium
TNATYGQAERAIGQGATV

SEQ ID NO: 597817 - protein, 4 aa, Mycobacterium
TNAV

SEQ ID NO: 597818 - protein, 6 aa, Mycobacterium
TNAVAP

SEQ ID NO: 597819 - protein, 11 aa, Mycobacterium
TNAVEKASDIV

SEQ ID NO: 597820 - protein, 6 aa, Mycobacterium
TNAVNG

SEQ ID NO: 597821 - protein, 8 aa, Mycobacterium
TNAVSPTT

SEQ ID NO: 597822 - protein, 7 aa, Mycobacterium
TNDAERR

SEQ ID NO: 597823 - protein, 8 aa, Mycobacterium
TNDAETLD

SEQ ID NO: 597824 - protein, 7 aa, Mycobacterium
TNDAGEL

SEQ ID NO: 597825 - protein, 5 aa, Mycobacterium
TNDDG

SEQ ID NO: 597826 - protein, 16 aa, Mycobacterium
TNDDGGPSEETFHSSS

SEQ ID NO: 597827 - protein, 5 aa, Mycobacterium
TNDDP

SEQ ID NO: 597828 - protein, 10 aa, Mycobacterium
TNDEAGVDAA

SEQ ID NO: 597829 - protein, 9 aa, Mycobacterium
TNDEEDAVG

SEQ ID NO: 597830 - protein, 6 aa, Mycobacterium
TNDEEL

SEQ ID NO: 597831 - protein, 7 aa, Mycobacterium
TNDEQKK

SEQ ID NO: 597832 - protein, 5 aa, Mycobacterium
TNDGR

SEQ ID NO: 597833 - protein, 7 aa, Mycobacterium
TNDHHEA

SEQ ID NO: 597834 - protein, 7 aa, Mycobacterium
TNDKAVG

SEQ ID NO: 597835 - protein, 4 aa, Mycobacterium
TNDP

SEQ ID NO: 597836 - protein, 7 aa, Mycobacterium
TNDPDEI

SEQ ID NO: 597837 - protein, 7 aa, Mycobacterium
TNDPGSV

SEQ ID NO: 597838 - protein, 10 aa, Mycobacterium
TNDPTLDAGP

SEQ ID NO: 597839 - protein, 8 aa, Mycobacterium
TNDPVTPE

SEQ ID NO: 597840 - protein, 4 aa, Mycobacterium
TNDR

SEQ ID NO: 597841 - protein, 7 aa, Mycobacterium
TNDRPVD

SEQ ID NO: 597842 - protein, 9 aa, Mycobacterium
TNDTAGNAI

SEQ ID NO: 597843 - protein, 18 aa, Mycobacterium
TNDTAPQWPRAQSVDNDA

SEQ ID NO: 597844 - protein, 7 aa, Mycobacterium
TNDTDTL

SEQ ID NO: 597845 - protein, 4 aa, Mycobacterium
TNDY

SEQ ID NO: 597846 - protein, 4 aa, Mycobacterium
TNEA

SEQ ID NO: 597847 - protein, 5 aa, Mycobacterium
TNEAV

SEQ ID NO: 597848 - protein, 6 aa, Mycobacterium
TNEAVE

SEQ ID NO: 597849 - protein, 7 aa, Mycobacterium
TNEDGDI

SEQ ID NO: 597850 - protein, 7 aa, Mycobacterium
TNEDHPG

SEQ ID NO: 597851 - protein, 14 aa, Mycobacterium
TNEDQPETSADPRV

SEQ ID NO: 597852 - protein, 14 aa, Mycobacterium
TNEDQPETSDDPRV

SEQ ID NO: 597853 - protein, 14 aa, Mycobacterium
TNEDQPQTSGDPRV

SEQ ID NO: 597854 - protein, 8 aa, Mycobacterium
TNEEQSEK

SEQ ID NO: 597855 - protein, 4 aa, Mycobacterium
TNEL

SEQ ID NO: 597856 - protein, 11 aa, Mycobacterium
TNENPHEPSAG

SEQ ID NO: 597857 - protein, 10 aa, Mycobacterium
TNENPHPPSR

SEQ ID NO: 597858 - protein, 7 aa, Mycobacterium
TNENSRA

SEQ ID NO: 597859 - protein, 10 aa, Mycobacterium
TNEPGRDPIS

SEQ ID NO: 597860 - protein, 5 aa, Mycobacterium
TNEPK

SEQ ID NO: 597861 - protein, 5 aa, Mycobacterium
TNEQA

SEQ ID NO: 597862 - protein, 4 aa, Mycobacterium
TNER

SEQ ID NO: 597863 - protein, 7 aa, Mycobacterium
TNESRCT

SEQ ID NO: 597864 - protein, 7 aa, Mycobacterium
TNESSRA

SEQ ID NO: 597865 - protein, 13 aa, Mycobacterium
TNETCSSLTEWVT

SEQ ID NO: 597866 - protein, 7 aa, Mycobacterium
TNEWKDG

SEQ ID NO: 597867 - protein, 4 aa, Mycobacterium
TNEY

SEQ ID NO: 597868 - protein, 15 aa, Mycobacterium
TNEYPLARPEDLAET

SEQ ID NO: 597869 - protein, 5 aa, Mycobacterium
TNFST

SEQ ID NO: 597870 - protein, 18 aa, Mycobacterium
TNGAAAADIDSGSAESVM

SEQ ID NO: 597871 - protein, 10 aa, Mycobacterium
TNGAEKPRGL

SEQ ID NO: 597872 - protein, 22 aa, Mycobacterium
TNGAPGGGAEPELEQLSGGSQN

SEQ ID NO: 597873 - protein, 16 aa, Mycobacterium
TNGARRARSALWAASS

SEQ ID NO: 597874 - protein, 7 aa, Mycobacterium
TNGATLG

SEQ ID NO: 597875 - protein, 7 aa, Mycobacterium
TNGDADD

SEQ ID NO: 597876 - protein, 6 aa, Mycobacterium
TNGDEN

SEQ ID NO: 597877 - protein, 5 aa, Mycobacterium
TNGEL

SEQ ID NO: 597878 - protein, 19 aa, Mycobacterium
TNGGAVAGIDSESATTSVT

SEQ ID NO: 597879 - protein, 6 aa, Mycobacterium
TNGGGA

SEQ ID NO: 597880 - protein, 12 aa, Mycobacterium
TNGGGANPGAAA

SEQ ID NO: 597881 - protein, 8 aa, Mycobacterium
TNGGPDDF

SEQ ID NO: 597882 - protein, 9 aa, Mycobacterium
TNGGPVQGI

SEQ ID NO: 597883 - protein, 9 aa, Mycobacterium
TNGGQAANI

SEQ ID NO: 597884 - protein, 7 aa, Mycobacterium
TNGGSRS

SEQ ID NO: 597885 - protein, 6 aa, Mycobacterium
TNGHSE

SEQ ID NO: 597886 - protein, 9 aa, Mycobacterium
TNGIGVGAT

SEQ ID NO: 597887 - protein, 10 aa, Mycobacterium
TNGIGVGSSD

SEQ ID NO: 597888 - protein, 6 aa, Mycobacterium
TNGKLG

SEQ ID NO: 597889 - protein, 9 aa, Mycobacterium
TNGKTTTTS

SEQ ID NO: 597890 - protein, 15 aa, Mycobacterium
TNGLKGTANTAHYTA

SEQ ID NO: 597891 - protein, 7 aa, Mycobacterium
TNGPLKE

SEQ ID NO: 597892 - protein, 18 aa, Mycobacterium
TNGPSLPARGADGRPTVL

SEQ ID NO: 597893 - protein, 13 aa, Mycobacterium
TNGPWESTQTHDS

SEQ ID NO: 597894 - protein, 4 aa, Mycobacterium
TNGQ

SEQ ID NO: 597895 - protein, 6 aa, Mycobacterium
TNGQNT

SEQ ID NO: 597896 - protein, 9 aa, Mycobacterium
TNGQPAGEM

SEQ ID NO: 597897 - protein, 10 aa, Mycobacterium
TNGSEAQKAA

SEQ ID NO: 597898 - protein, 6 aa, Mycobacterium
TNGSGL

SEQ ID NO: 597899 - protein, 14 aa, Mycobacterium
TNGSKTRKYDDAAT

SEQ ID NO: 597900 - protein, 10 aa, Mycobacterium
TNGSLTGYGG

SEQ ID NO: 597901 - protein, 10 aa, Mycobacterium
TNGSQIPREA

SEQ ID NO: 597902 - protein, 43 aa, Mycobacterium
TNGTATPDTQVAPAYRQSVSASVSASSATSRVRESQRQQSLTT

SEQ ID NO: 597903 - protein, 10 aa, Mycobacterium
TNGTPEQQKA

SEQ ID NO: 597904 - protein, 7 aa, Mycobacterium
TNGTQVR

SEQ ID NO: 597905 - protein, 4 aa, Mycobacterium
TNGV

SEQ ID NO: 597906 - protein, 7 aa, Mycobacterium
TNGVDPL

SEQ ID NO: 597907 - protein, 5 aa, Mycobacterium
TNGVG

SEQ ID NO: 597908 - protein, 6 aa, Mycobacterium
TNGVGL

SEQ ID NO: 597909 - protein, 10 aa, Mycobacterium
TNGVPPRDTS

SEQ ID NO: 597910 - protein, 6 aa, Mycobacterium
TNGVTP

SEQ ID NO: 597911 - protein, 7 aa, Mycobacterium
TNGVTRE

SEQ ID NO: 597912 - protein, 5 aa, Mycobacterium
TNGYP

SEQ ID NO: 597913 - protein, 8 aa, Mycobacterium
TNHDPRRN

SEQ ID NO: 597914 - protein, 6 aa, Mycobacterium
TNHGPA

SEQ ID NO: 597915 - protein, 5 aa, Mycobacterium
TNHKS

SEQ ID NO: 597916 - protein, 10 aa, Mycobacterium
TNHPAGDADA

SEQ ID NO: 597917 - protein, 7 aa, Mycobacterium
TNHPAGV

SEQ ID NO: 597918 - protein, 13 aa, Mycobacterium
TNHPASAGFPEHH

SEQ ID NO: 597919 - protein, 12 aa, Mycobacterium
TNHPGHGAELGQ

SEQ ID NO: 597920 - protein, 12 aa, Mycobacterium
TNHPHPSGKPVS

SEQ ID NO: 597921 - protein, 12 aa, Mycobacterium
TNHPHPSGRPVS

SEQ ID NO: 597922 - protein, 13 aa, Mycobacterium
TNHPITTTTLTEE

SEQ ID NO: 597923 - protein, 9 aa, Mycobacterium
TNHQGAPVA

SEQ ID NO: 597924 - protein, 5 aa, Mycobacterium
TNHRG

SEQ ID NO: 597925 - protein, 11 aa, Mycobacterium
TNHRGHGTELA

SEQ ID NO: 597926 - protein, 11 aa, Mycobacterium
TNHRGQITAPG

SEQ ID NO: 597927 - protein, 8 aa, Mycobacterium
TNHRGRRP

SEQ ID NO: 597928 - protein, 7 aa, Mycobacterium
TNHRNGG

SEQ ID NO: 597929 - protein, 7 aa, Mycobacterium
TNHRNPG

SEQ ID NO: 597930 - protein, 5 aa, Mycobacterium
TNIAG

SEQ ID NO: 597931 - protein, 8 aa, Mycobacterium
TNIENGDA

SEQ ID NO: 597932 - protein, 11 aa, Mycobacterium
TNIGHAGAAAG

SEQ ID NO: 597933 - protein, 13 aa, Mycobacterium
TNIGHAGGAAGVT

SEQ ID NO: 597934 - protein, 4 aa, Mycobacterium
TNIN

SEQ ID NO: 597935 - protein, 6 aa, Mycobacterium
TNISAA

SEQ ID NO: 597936 - protein, 15 aa, Mycobacterium
TNKAEVEIPSPYAGK

SEQ ID NO: 597937 - protein, 8 aa, Mycobacterium
TNKAKDVA

SEQ ID NO: 597938 - protein, 10 aa, Mycobacterium
TNKDGSPTGG

SEQ ID NO: 597939 - protein, 6 aa, Mycobacterium
TNKERP

SEQ ID NO: 597940 - protein, 7 aa, Mycobacterium
TNKGSHI

SEQ ID NO: 597941 - protein, 8 aa, Mycobacterium
TNKHPNET

SEQ ID NO: 597942 - protein, 8 aa, Mycobacterium
TNKKVTKD

SEQ ID NO: 597943 - protein, 9 aa, Mycobacterium
TNKPPAPGL

SEQ ID NO: 597944 - protein, 6 aa, Mycobacterium
TNKQRP

SEQ ID NO: 597945 - protein, 7 aa, Mycobacterium
TNKQRPV

SEQ ID NO: 597946 - protein, 5 aa, Mycobacterium
TNKRG

SEQ ID NO: 597947 - protein, 29 aa, Mycobacterium
TNKRRKALESMSDDDWNAATTTPAGPDTY

SEQ ID NO: 597948 - protein, 8 aa, Mycobacterium
TNKYPNES

SEQ ID NO: 597949 - protein, 6 aa, Mycobacterium
TNLAGR

SEQ ID NO: 597950 - protein, 8 aa, Mycobacterium
TNLAQNSG

SEQ ID NO: 597951 - protein, 10 aa, Mycobacterium
TNLDPLTTPS

SEQ ID NO: 597952 - protein, 15 aa, Mycobacterium
TNLGGPRTQSRTSTE

SEQ ID NO: 597953 - protein, 4 aa, Mycobacterium
TNLP

SEQ ID NO: 597954 - protein, 6 aa, Mycobacterium
TNLPGG

SEQ ID NO: 597955 - protein, 20 aa, Mycobacterium
TNLPRHTGGTLELQELGCRA

SEQ ID NO: 597956 - protein, 5 aa, Mycobacterium
TNLQA

SEQ ID NO: 597957 - protein, 12 aa, Mycobacterium
TNLQGASGRKLG

SEQ ID NO: 597958 - protein, 8 aa, Mycobacterium
TNLSDGDA

SEQ ID NO: 597959 - protein, 8 aa, Mycobacterium
TNLSTGVG

SEQ ID NO: 597960 - protein, 5 aa, Mycobacterium
TNMGP

SEQ ID NO: 597961 - protein, 7 aa, Mycobacterium
TNMPGAE

SEQ ID NO: 597962 - protein, 10 aa, Mycobacterium
TNNDDPAGAC

SEQ ID NO: 597963 - protein, 16 aa, Mycobacterium
TNNDDPAGACRPFDKD

SEQ ID NO: 597964 - protein, 10 aa, Mycobacterium
TNNDDPEGAC

SEQ ID NO: 597965 - protein, 6 aa, Mycobacterium
TNNDND

SEQ ID NO: 597966 - protein, 4 aa, Mycobacterium
TNNF

SEQ ID NO: 597967 - protein, 8 aa, Mycobacterium
TNNHPRVT

SEQ ID NO: 597968 - protein, 5 aa, Mycobacterium
TNNLP

SEQ ID NO: 597969 - protein, 21 aa, Mycobacterium
TNNPAEAARAHQEKRPPAWDS

SEQ ID NO: 597970 - protein, 21 aa, Mycobacterium
TNNPVEAAKAHQEKRAPRWDP

SEQ ID NO: 597971 - protein, 7 aa, Mycobacterium
TNNPVVP

SEQ ID NO: 597972 - protein, 8 aa, Mycobacterium
TNNQPRVA

SEQ ID NO: 597973 - protein, 11 aa, Mycobacterium
TNNRFPDDSYR

SEQ ID NO: 597974 - protein, 6 aa, Mycobacterium
TNNRPD

SEQ ID NO: 597975 - protein, 11 aa, Mycobacterium
TNNRWPDGSYR

SEQ ID NO: 597976 - protein, 6 aa, Mycobacterium
TNNSGW

SEQ ID NO: 597977 - protein, 7 aa, Mycobacterium
TNPAAVT

SEQ ID NO: 597978 - protein, 7 aa, Mycobacterium
TNPAGTD

SEQ ID NO: 597979 - protein, 6 aa, Mycobacterium
TNPATD

SEQ ID NO: 597980 - protein, 7 aa, Mycobacterium
TNPATGD

SEQ ID NO: 597981 - protein, 7 aa, Mycobacterium
TNPATRD

SEQ ID NO: 597982 - protein, 11 aa, Mycobacterium
TNPDAASHQQQ

SEQ ID NO: 597983 - protein, 10 aa, Mycobacterium
TNPDAKKHRG

SEQ ID NO: 597984 - protein, 8 aa, Mycobacterium
TNPDDKSH

SEQ ID NO: 597985 - protein, 10 aa, Mycobacterium
TNPDGPSHRQ

SEQ ID NO: 597986 - protein, 7 aa, Mycobacterium
TNPDGSL

SEQ ID NO: 597987 - protein, 9 aa, Mycobacterium
TNPDGSPTE

SEQ ID NO: 597988 - protein, 10 aa, Mycobacterium
TNPDGSPTKL

SEQ ID NO: 597989 - protein, 6 aa, Mycobacterium
TNPDGT

SEQ ID NO: 597990 - protein, 10 aa, Mycobacterium
TNPDKPKHKG

SEQ ID NO: 597991 - protein, 18 aa, Mycobacterium
TNPDPQSPECTGTAEMSG

SEQ ID NO: 597992 - protein, 8 aa, Mycobacterium
TNPDSRRN

SEQ ID NO: 597993 - protein, 9 aa, Mycobacterium
TNPDVPKHK

SEQ ID NO: 597994 - protein, 11 aa, Mycobacterium
TNPEAASHQQQ

SEQ ID NO: 597995 - protein, 7 aa, Mycobacterium
TNPEPLD

SEQ ID NO: 597996 - protein, 8 aa, Mycobacterium
TNPESRRK

SEQ ID NO: 597997 - protein, 4 aa, Mycobacterium
TNPG

SEQ ID NO: 597998 - protein, 9 aa, Mycobacterium
TNPGARQSN

SEQ ID NO: 597999 - protein, 6 aa, Mycobacterium
TNPGDR

SEQ ID NO: 598000 - protein, 10 aa, Mycobacterium
TNPGKYGLTA

SEQ ID NO: 598001 - protein, 7 aa, Mycobacterium
TNPGQGV

SEQ ID NO: 598002 - protein, 16 aa, Mycobacterium
TNPGQLDEAKSALPET

SEQ ID NO: 598003 - protein, 7 aa, Mycobacterium
TNPGTLG

SEQ ID NO: 598004 - protein, 13 aa, Mycobacterium
TNPHPQKREMDGG

SEQ ID NO: 598005 - protein, 5 aa, Mycobacterium
TNPHT

SEQ ID NO: 598006 - protein, 5 aa, Mycobacterium
TNPIE

SEQ ID NO: 598007 - protein, 6 aa, Mycobacterium
TNPING

SEQ ID NO: 598008 - protein, 10 aa, Mycobacterium
TNPKGEYIPR

SEQ ID NO: 598009 - protein, 5 aa, Mycobacterium
TNPKI

SEQ ID NO: 598010 - protein, 5 aa, Mycobacterium
TNPKP

SEQ ID NO: 598011 - protein, 9 aa, Mycobacterium
TNPKRPGAE

SEQ ID NO: 598012 - protein, 6 aa, Mycobacterium
TNPKVQ

SEQ ID NO: 598013 - protein, 5 aa, Mycobacterium
TNPLA

SEQ ID NO: 598014 - protein, 27 aa, Mycobacterium
TNPMSAPAHPVPGADDGGDARSSRPGH

SEQ ID NO: 598015 - protein, 4 aa, Mycobacterium
TNPN

SEQ ID NO: 598016 - protein, 38 aa, Mycobacterium
TNPNHGAADEAGGWDSQGQPVNGGPKGADGSTGNNVSQ

SEQ ID NO: 598017 - protein, 82 aa, Mycobacterium
TNPNHGAADPDGDTPASDEVTGAPDDDPPAITPAPDTDPGENSPRDAQTPDQPALPEQQPDDGDAFDPGSVDGPGDEPNVDE

SEQ ID NO: 598018 - protein, 13 aa, Mycobacterium
TNPNHGAADPGGF

SEQ ID NO: 598019 - protein, 36 aa, Mycobacterium
TNPNHGAADPVGTWGPDGRPINGGPAGADGSTGNNL

SEQ ID NO: 598020 - protein, 44 aa, Mycobacterium
TNPNHGAGDQPDAVDPPTGDAPDTGDAPPADDSDGVDDGSGEDT

SEQ ID NO: 598021 - protein, 32 aa, Mycobacterium
TNPNHGGGDDTGVPGDADSSNPSGTGQDSPSG

SEQ ID NO: 598022 - protein, 5 aa, Mycobacterium
TNPPE

SEQ ID NO: 598023 - protein, 13 aa, Mycobacterium
TNPPKRPAGTEGN

SEQ ID NO: 598024 - protein, 7 aa, Mycobacterium
TNPPLDS

SEQ ID NO: 598025 - protein, 14 aa, Mycobacterium
TNPPNQDAGGGGEI

SEQ ID NO: 598026 - protein, 9 aa, Mycobacterium
TNPPPAHSE

SEQ ID NO: 598027 - protein, 7 aa, Mycobacterium
TNPPRMM

SEQ ID NO: 598028 - protein, 5 aa, Mycobacterium
TNPQD

SEQ ID NO: 598029 - protein, 6 aa, Mycobacterium
TNPQGF

SEQ ID NO: 598030 - protein, 8 aa, Mycobacterium
TNPQGSVS

SEQ ID NO: 598031 - protein, 5 aa, Mycobacterium
TNPQI

SEQ ID NO: 598032 - protein, 6 aa, Mycobacterium
TNPQQR

SEQ ID NO: 598033 - protein, 7 aa, Mycobacterium
TNPQRAQ

SEQ ID NO: 598034 - protein, 4 aa, Mycobacterium
TNPR

SEQ ID NO: 598035 - protein, 8 aa, Mycobacterium
TNPRAKMS

SEQ ID NO: 598036 - protein, 18 aa, Mycobacterium
TNPRPVDEAGLCALFRTA

SEQ ID NO: 598037 - protein, 8 aa, Mycobacterium
TNPRRPLD

SEQ ID NO: 598038 - protein, 6 aa, Mycobacterium
TNPRRV

SEQ ID NO: 598039 - protein, 6 aa, Mycobacterium
TNPSDD

SEQ ID NO: 598040 - protein, 9 aa, Mycobacterium
TNPSDWPEG

SEQ ID NO: 598041 - protein, 9 aa, Mycobacterium
TNPSGADPT

SEQ ID NO: 598042 - protein, 9 aa, Mycobacterium
TNPSGSTLR

SEQ ID NO: 598043 - protein, 7 aa, Mycobacterium
TNPSGTI

SEQ ID NO: 598044 - protein, 13 aa, Mycobacterium
TNPSLGTDPAVDG

SEQ ID NO: 598045 - protein, 6 aa, Mycobacterium
TNPSSH

SEQ ID NO: 598046 - protein, 5 aa, Mycobacterium
TNPTA

SEQ ID NO: 598047 - protein, 6 aa, Mycobacterium
TNPTDR

SEQ ID NO: 598048 - protein, 6 aa, Mycobacterium
TNPTLN

SEQ ID NO: 598049 - protein, 7 aa, Mycobacterium
TNPTPTD

SEQ ID NO: 598050 - protein, 12 aa, Mycobacterium
TNPTTDGQTPDR

SEQ ID NO: 598051 - protein, 5 aa, Mycobacterium
TNPTV

SEQ ID NO: 598052 - protein, 10 aa, Mycobacterium
TNPVSGHGAA

SEQ ID NO: 598053 - protein, 6 aa, Mycobacterium
TNPYVE

SEQ ID NO: 598054 - protein, 5 aa, Mycobacterium
TNQAD

SEQ ID NO: 598055 - protein, 13 aa, Mycobacterium
TNQANPAEADTRD

SEQ ID NO: 598056 - protein, 6 aa, Mycobacterium
TNQGAK

SEQ ID NO: 598057 - protein, 6 aa, Mycobacterium
TNQGNT

SEQ ID NO: 598058 - protein, 9 aa, Mycobacterium
TNQNDDPVA

SEQ ID NO: 598059 - protein, 5 aa, Mycobacterium
TNQNE

SEQ ID NO: 598060 - protein, 4 aa, Mycobacterium
TNQP

SEQ ID NO: 598061 - protein, 12 aa, Mycobacterium
TNQPAPEPAGER

SEQ ID NO: 598062 - protein, 8 aa, Mycobacterium
TNQRGGEV

SEQ ID NO: 598063 - protein, 12 aa, Mycobacterium
TNQRRPSMSSMP

SEQ ID NO: 598064 - protein, 13 aa, Mycobacterium
TNQRTDGYGGSVA

SEQ ID NO: 598065 - protein, 6 aa, Mycobacterium
TNQTGT

SEQ ID NO: 598066 - protein, 5 aa, Mycobacterium
TNQTL

SEQ ID NO: 598067 - protein, 8 aa, Mycobacterium
TNRAEAAS

SEQ ID NO: 598068 - protein, 6 aa, Mycobacterium
TNRAPG

SEQ ID NO: 598069 - protein, 8 aa, Mycobacterium
TNRAQKGV

SEQ ID NO: 598070 - protein, 13 aa, Mycobacterium
TNRASSVGSATAA

SEQ ID NO: 598071 - protein, 7 aa, Mycobacterium
TNRDPAQ

SEQ ID NO: 598072 - protein, 5 aa, Mycobacterium
TNRDT

SEQ ID NO: 598073 - protein, 7 aa, Mycobacterium
TNRDTMD

SEQ ID NO: 598074 - protein, 4 aa, Mycobacterium
TNRE

SEQ ID NO: 598075 - protein, 6 aa, Mycobacterium
TNRECA

SEQ ID NO: 598076 - protein, 4 aa, Mycobacterium
TNRG

SEQ ID NO: 598077 - protein, 14 aa, Mycobacterium
TNRHYGTPTPISDE

SEQ ID NO: 598078 - protein, 14 aa, Mycobacterium
TNRKQLSDTISEHR

SEQ ID NO: 598079 - protein, 13 aa, Mycobacterium
TNRLRGDAEPIPA

SEQ ID NO: 598080 - protein, 7 aa, Mycobacterium
TNRMNPG

SEQ ID NO: 598081 - protein, 6 aa, Mycobacterium
TNRNSP

SEQ ID NO: 598082 - protein, 12 aa, Mycobacterium
TNRPAPEPAGER

SEQ ID NO: 598083 - protein, 6 aa, Mycobacterium
TNRPEL

SEQ ID NO: 598084 - protein, 10 aa, Mycobacterium
TNRPPSDPLR

SEQ ID NO: 598085 - protein, 9 aa, Mycobacterium
TNRPRGSQL

SEQ ID NO: 598086 - protein, 6 aa, Mycobacterium
TNRQRA

SEQ ID NO: 598087 - protein, 9 aa, Mycobacterium
TNRRGADRC

SEQ ID NO: 598088 - protein, 7 aa, Mycobacterium
TNRRNPG

SEQ ID NO: 598089 - protein, 8 aa, Mycobacterium
TNRRNPGA

SEQ ID NO: 598090 - protein, 7 aa, Mycobacterium
TNRSDRV

SEQ ID NO: 598091 - protein, 9 aa, Mycobacterium
TNRSDRYGK

SEQ ID NO: 598092 - protein, 23 aa, Mycobacterium
TNRSENLRSPRPNPPERRRVLTG

SEQ ID NO: 598093 - protein, 5 aa, Mycobacterium
TNRSG

SEQ ID NO: 598094 - protein, 7 aa, Mycobacterium
TNRTNQH

SEQ ID NO: 598095 - protein, 18 aa, Mycobacterium
TNRTPDGSYNDLSDPSMG

SEQ ID NO: 598096 - protein, 7 aa, Mycobacterium
TNRTWST

SEQ ID NO: 598097 - protein, 4 aa, Mycobacterium
TNRV

SEQ ID NO: 598098 - protein, 8 aa, Mycobacterium
TNRVGEGH

SEQ ID NO: 598099 - protein, 21 aa, Mycobacterium
TNRVGEGHVAQKDPHARPGMS

SEQ ID NO: 598100 - protein, 22 aa, Mycobacterium
TNRVGEGHVARDDPSGRPGMSA

SEQ ID NO: 598101 - protein, 5 aa, Mycobacterium
TNRYE

SEQ ID NO: 598102 - protein, 7 aa, Mycobacterium
TNRYGTR

SEQ ID NO: 598103 - protein, 11 aa, Mycobacterium
TNSAGPGSPIA

SEQ ID NO: 598104 - protein, 6 aa, Mycobacterium
TNSAQV

SEQ ID NO: 598105 - protein, 6 aa, Mycobacterium
TNSDGR

SEQ ID NO: 598106 - protein, 5 aa, Mycobacterium
TNSDH

SEQ ID NO: 598107 - protein, 6 aa, Mycobacterium
TNSDHA

SEQ ID NO: 598108 - protein, 11 aa, Mycobacterium
TNSDNDLTDHP

SEQ ID NO: 598109 - protein, 9 aa, Mycobacterium
TNSDPDEAD

SEQ ID NO: 598110 - protein, 17 aa, Mycobacterium
TNSEHPGVSPSESEVGP

SEQ ID NO: 598111 - protein, 8 aa, Mycobacterium
TNSEQEDM

SEQ ID NO: 598112 - protein, 17 aa, Mycobacterium
TNSEVPGVGPSESEIAP

SEQ ID NO: 598113 - protein, 6 aa, Mycobacterium
TNSGCK

SEQ ID NO: 598114 - protein, 8 aa, Mycobacterium
TNSGDDTV

SEQ ID NO: 598115 - protein, 7 aa, Mycobacterium
TNSGGPV

SEQ ID NO: 598116 - protein, 7 aa, Mycobacterium
TNSGGTD

SEQ ID NO: 598117 - protein, 7 aa, Mycobacterium
TNSGQLD

SEQ ID NO: 598118 - protein, 10 aa, Mycobacterium
TNSGQSCNAP

SEQ ID NO: 598119 - protein, 7 aa, Mycobacterium
TNSGTDI

SEQ ID NO: 598120 - protein, 8 aa, Mycobacterium
TNSGVTPT

SEQ ID NO: 598121 - protein, 4 aa, Mycobacterium
TNSP

SEQ ID NO: 598122 - protein, 14 aa, Mycobacterium
TNSPARPAGPLTQD

SEQ ID NO: 598123 - protein, 7 aa, Mycobacterium
TNSPDFD

SEQ ID NO: 598124 - protein, 12 aa, Mycobacterium
TNSPIKDGEHAN

SEQ ID NO: 598125 - protein, 13 aa, Mycobacterium
TNSPKAAKGLESI

SEQ ID NO: 598126 - protein, 5 aa, Mycobacterium
TNSPR

SEQ ID NO: 598127 - protein, 10 aa, Mycobacterium
TNSPRSALAE

SEQ ID NO: 598128 - protein, 8 aa, Mycobacterium
TNSPTGVA

SEQ ID NO: 598129 - protein, 8 aa, Mycobacterium
TNSPTGYA

SEQ ID NO: 598130 - protein, 5 aa, Mycobacterium
TNSPV

SEQ ID NO: 598131 - protein, 5 aa, Mycobacterium
TNSQW

SEQ ID NO: 598132 - protein, 7 aa, Mycobacterium
TNSRDHR

SEQ ID NO: 598133 - protein, 6 aa, Mycobacterium
TNSRTG

SEQ ID NO: 598134 - protein, 11 aa, Mycobacterium
TNSSSYPSSQM

SEQ ID NO: 598135 - protein, 4 aa, Mycobacterium
TNST

SEQ ID NO: 598136 - protein, 11 aa, Mycobacterium
TNSTDLTDGHK

SEQ ID NO: 598137 - protein, 9 aa, Mycobacterium
TNTAPNATM

SEQ ID NO: 598138 - protein, 11 aa, Mycobacterium
TNTATTPRQTL

SEQ ID NO: 598139 - protein, 9 aa, Mycobacterium
TNTDDMGGN

SEQ ID NO: 598140 - protein, 10 aa, Mycobacterium
TNTDGAPTTV

SEQ ID NO: 598141 - protein, 8 aa, Mycobacterium
TNTDPKGI

SEQ ID NO: 598142 - protein, 6 aa, Mycobacterium
TNTDPV

SEQ ID NO: 598143 - protein, 9 aa, Mycobacterium
TNTEAKKHR

SEQ ID NO: 598144 - protein, 10 aa, Mycobacterium
TNTEAKKHRG

SEQ ID NO: 598145 - protein, 10 aa, Mycobacterium
TNTEGAPTTV

SEQ ID NO: 598146 - protein, 7 aa, Mycobacterium
TNTENGA

SEQ ID NO: 598147 - protein, 8 aa, Mycobacterium
TNTEVKKH

SEQ ID NO: 598148 - protein, 4 aa, Mycobacterium
TNTF

SEQ ID NO: 598149 - protein, 10 aa, Mycobacterium
TNTGAGFTSG

SEQ ID NO: 598150 - protein, 9 aa, Mycobacterium
TNTGGGAFT

SEQ ID NO: 598151 - protein, 10 aa, Mycobacterium
TNTGKFSPET

SEQ ID NO: 598152 - protein, 6 aa, Mycobacterium
TNTGRP

SEQ ID NO: 598153 - protein, 10 aa, Mycobacterium
TNTGRRAGEE

SEQ ID NO: 598154 - protein, 9 aa, Mycobacterium
TNTGTAPVT

SEQ ID NO: 598155 - protein, 9 aa, Mycobacterium
TNTGTTPLT

SEQ ID NO: 598156 - protein, 6 aa, Mycobacterium
TNTGWT

SEQ ID NO: 598157 - protein, 5 aa, Mycobacterium
TNTLD

SEQ ID NO: 598158 - protein, 4 aa, Mycobacterium
TNTP

SEQ ID NO: 598159 - protein, 10 aa, Mycobacterium
TNTPAQPGQT

SEQ ID NO: 598160 - protein, 16 aa, Mycobacterium
TNTPEFGAKGVTEPEY

SEQ ID NO: 598161 - protein, 14 aa, Mycobacterium
TNTPEFGSKGITEP

SEQ ID NO: 598162 - protein, 7 aa, Mycobacterium
TNTPEWG

SEQ ID NO: 598163 - protein, 6 aa, Mycobacterium
TNTPIT

SEQ ID NO: 598164 - protein, 14 aa, Mycobacterium
TNTPTLIPTTGAES

SEQ ID NO: 598165 - protein, 6 aa, Mycobacterium
TNTRQQ

SEQ ID NO: 598166 - protein, 6 aa, Mycobacterium
TNTSMG

SEQ ID NO: 598167 - protein, 7 aa, Mycobacterium
TNTSSLS

SEQ ID NO: 598168 - protein, 6 aa, Mycobacterium
TNTSTI

SEQ ID NO: 598169 - protein, 4 aa, Mycobacterium
TNTT

SEQ ID NO: 598170 - protein, 8 aa, Mycobacterium
TNTTASDA

SEQ ID NO: 598171 - protein, 6 aa, Mycobacterium
TNTTPD

SEQ ID NO: 598172 - protein, 8 aa, Mycobacterium
TNTTTKTR

SEQ ID NO: 598173 - protein, 6 aa, Mycobacterium
TNTTTL

SEQ ID NO: 598174 - protein, 4 aa, Mycobacterium
TNTV

SEQ ID NO: 598175 - protein, 10 aa, Mycobacterium
TNTVAGQGAV

SEQ ID NO: 598176 - protein, 18 aa, Mycobacterium
TNTVNYSSDLPLAQGVEF

SEQ ID NO: 598177 - protein, 18 aa, Mycobacterium
TNTVNYSSELPLAQGVHF

SEQ ID NO: 598178 - protein, 4 aa, Mycobacterium
TNVA

SEQ ID NO: 598179 - protein, 7 aa, Mycobacterium
TNVAAGP

SEQ ID NO: 598180 - protein, 13 aa, Mycobacterium
TNVARNATVAEGY

SEQ ID NO: 598181 - protein, 5 aa, Mycobacterium
TNVAS

SEQ ID NO: 598182 - protein, 7 aa, Mycobacterium
TNVDTGD

SEQ ID NO: 598183 - protein, 7 aa, Mycobacterium
TNVESTE

SEQ ID NO: 598184 - protein, 7 aa, Mycobacterium
TNVGGSS

SEQ ID NO: 598185 - protein, 11 aa, Mycobacterium
TNVNPEADPAV

SEQ ID NO: 598186 - protein, 8 aa, Mycobacterium
TNVNQRAE

SEQ ID NO: 598187 - protein, 10 aa, Mycobacterium
TNVPEDAKAS

SEQ ID NO: 598188 - protein, 9 aa, Mycobacterium
TNVPGPRQP

SEQ ID NO: 598189 - protein, 9 aa, Mycobacterium
TNVPGPRRP

SEQ ID NO: 598190 - protein, 8 aa, Mycobacterium
TNVPGSLG

SEQ ID NO: 598191 - protein, 8 aa, Mycobacterium
TNVPPQRR

SEQ ID NO: 598192 - protein, 5 aa, Mycobacterium
TNVTG

SEQ ID NO: 598193 - protein, 7 aa, Mycobacterium
TNYDDPE

SEQ ID NO: 598194 - protein, 5 aa, Mycobacterium
TNYNT

SEQ ID NO: 598195 - protein, 6 aa, Mycobacterium
TNYSTV

SEQ ID NO: 598196 - protein, 5 aa, Mycobacterium
TPAAA

SEQ ID NO: 598197 - protein, 16 aa, Mycobacterium
TPAAAAASPPPDPAPT

SEQ ID NO: 598198 - protein, 9 aa, Mycobacterium
TPAAADRAA

SEQ ID NO: 598199 - protein, 17 aa, Mycobacterium
TPAAAPDWELPPDGHTG

SEQ ID NO: 598200 - protein, 10 aa, Mycobacterium
TPAAAQQAEW

SEQ ID NO: 598201 - protein, 13 aa, Mycobacterium
TPAAASPWEAGAG

SEQ ID NO: 598202 - protein, 8 aa, Mycobacterium
TPAAASTP

SEQ ID NO: 598203 - protein, 8 aa, Mycobacterium
TPAACGRT

SEQ ID NO: 598204 - protein, 8 aa, Mycobacterium
TPAADETL

SEQ ID NO: 598205 - protein, 9 aa, Mycobacterium
TPAADGSGT

SEQ ID NO: 598206 - protein, 6 aa, Mycobacterium
TPAAEL

SEQ ID NO: 598207 - protein, 9 aa, Mycobacterium
TPAAEPEPV

SEQ ID NO: 598208 - protein, 12 aa, Mycobacterium
TPAAGAAGRAPG

SEQ ID NO: 598209 - protein, 11 aa, Mycobacterium
TPAAGEERAPH

SEQ ID NO: 598210 - protein, 7 aa, Mycobacterium
TPAAKTT

SEQ ID NO: 598211 - protein, 10 aa, Mycobacterium
TPAALTAQAE

SEQ ID NO: 598212 - protein, 9 aa, Mycobacterium
TPAAPARAK

SEQ ID NO: 598213 - protein, 40 aa, Mycobacterium
TPAAPEPDPPPVPEPQPEPEPGPGKHRSPETDEPPVATTT

SEQ ID NO: 598214 - protein, 9 aa, Mycobacterium
TPAAPEVSF

SEQ ID NO: 598215 - protein, 18 aa, Mycobacterium
TPAAPSGITGPAEDLTEQ

SEQ ID NO: 598216 - protein, 11 aa, Mycobacterium
TPAAPSVSFGD

SEQ ID NO: 598217 - protein, 5 aa, Mycobacterium
TPAAQ

SEQ ID NO: 598218 - protein, 8 aa, Mycobacterium
TPAAQSLR

SEQ ID NO: 598219 - protein, 12 aa, Mycobacterium
TPAARAVARASQ

SEQ ID NO: 598220 - protein, 10 aa, Mycobacterium
TPAARNSAGF

SEQ ID NO: 598221 - protein, 5 aa, Mycobacterium
TPAAV

SEQ ID NO: 598222 - protein, 5 aa, Mycobacterium
TPAAW

SEQ ID NO: 598223 - protein, 10 aa, Mycobacterium
TPADADAYHR

SEQ ID NO: 598224 - protein, 10 aa, Mycobacterium
TPADAQQAEW

SEQ ID NO: 598225 - protein, 7 aa, Mycobacterium
TPADARR

SEQ ID NO: 598226 - protein, 6 aa, Mycobacterium
TPADAS

SEQ ID NO: 598227 - protein, 7 aa, Mycobacterium
TPADATN

SEQ ID NO: 598228 - protein, 11 aa, Mycobacterium
TPADEKNLDRW

SEQ ID NO: 598229 - protein, 5 aa, Mycobacterium
TPADF

SEQ ID NO: 598230 - protein, 12 aa, Mycobacterium
TPADFQQNPITR

SEQ ID NO: 598231 - protein, 9 aa, Mycobacterium
TPADGSQPI

SEQ ID NO: 598232 - protein, 12 aa, Mycobacterium
TPADHDRSAGTS

SEQ ID NO: 598233 - protein, 9 aa, Mycobacterium
TPADHGFGP

SEQ ID NO: 598234 - protein, 18 aa, Mycobacterium
TPADLDETAEQVREAGGR

SEQ ID NO: 598235 - protein, 8 aa, Mycobacterium
TPADLTST

SEQ ID NO: 598236 - protein, 16 aa, Mycobacterium
TPADPAVEAESAATEE

SEQ ID NO: 598237 - protein, 10 aa, Mycobacterium
TPADPLGPDS

SEQ ID NO: 598238 - protein, 8 aa, Mycobacterium
TPADRGSR

SEQ ID NO: 598239 - protein, 27 aa, Mycobacterium
TPADVTTTNGNSLTIDSDGAPAPVFTL

SEQ ID NO: 598240 - protein, 12 aa, Mycobacterium
TPADYQRAEDAG

SEQ ID NO: 598241 - protein, 6 aa, Mycobacterium
TPAEAC

SEQ ID NO: 598242 - protein, 8 aa, Mycobacterium
TPAEARRH

SEQ ID NO: 598243 - protein, 9 aa, Mycobacterium
TPAEDTERA

SEQ ID NO: 598244 - protein, 5 aa, Mycobacterium
TPAEE

SEQ ID NO: 598245 - protein, 10 aa, Mycobacterium
TPAEEGGGGK

SEQ ID NO: 598246 - protein, 9 aa, Mycobacterium
TPAEETGGG

SEQ ID NO: 598247 - protein, 7 aa, Mycobacterium
TPAEGEA

SEQ ID NO: 598248 - protein, 10 aa, Mycobacterium
TPAEGGPETV

SEQ ID NO: 598249 - protein, 8 aa, Mycobacterium
TPAEHDEY

SEQ ID NO: 598250 - protein, 5 aa, Mycobacterium
TPAEL

SEQ ID NO: 598251 - protein, 8 aa, Mycobacterium
TPAELDTD

SEQ ID NO: 598252 - protein, 14 aa, Mycobacterium
TPAELGAGGATPDG

SEQ ID NO: 598253 - protein, 9 aa, Mycobacterium
TPAELGGVN

SEQ ID NO: 598254 - protein, 6 aa, Mycobacterium
TPAEQR

SEQ ID NO: 598255 - protein, 5 aa, Mycobacterium
TPAER

SEQ ID NO: 598256 - protein, 13 aa, Mycobacterium
TPAEREDTGSPAA

SEQ ID NO: 598257 - protein, 8 aa, Mycobacterium
TPAERETL

SEQ ID NO: 598258 - protein, 30 aa, Mycobacterium
TPAERFGGRTPTSSLSTSTNTLTDRSGDDW

SEQ ID NO: 598259 - protein, 8 aa, Mycobacterium
TPAERQRR

SEQ ID NO: 598260 - protein, 6 aa, Mycobacterium
TPAERS

SEQ ID NO: 598261 - protein, 8 aa, Mycobacterium
TPAFDGEA

SEQ ID NO: 598262 - protein, 6 aa, Mycobacterium
TPAGDG

SEQ ID NO: 598263 - protein, 9 aa, Mycobacterium
TPAGDGIYD

SEQ ID NO: 598264 - protein, 14 aa, Mycobacterium
TPAGDVADRTIPAG

SEQ ID NO: 598265 - protein, 19 aa, Mycobacterium
TPAGEVKSRPLGQPGDLGK

SEQ ID NO: 598266 - protein, 6 aa, Mycobacterium
TPAGGR

SEQ ID NO: 598267 - protein, 22 aa, Mycobacterium
TPAGKPNPGQPSWNTQRASSMP

SEQ ID NO: 598268 - protein, 10 aa, Mycobacterium
TPAGKVEGSI

SEQ ID NO: 598269 - protein, 8 aa, Mycobacterium
TPAGPAAL

SEQ ID NO: 598270 - protein, 17 aa, Mycobacterium
TPAGPADPSVSQTLKGG

SEQ ID NO: 598271 - protein, 7 aa, Mycobacterium
TPAGPDS

SEQ ID NO: 598272 - protein, 5 aa, Mycobacterium
TPAGQ

SEQ ID NO: 598273 - protein, 7 aa, Mycobacterium
TPAGQTP

SEQ ID NO: 598274 - protein, 5 aa, Mycobacterium
TPAGR

SEQ ID NO: 598275 - protein, 6 aa, Mycobacterium
TPAGRA

SEQ ID NO: 598276 - protein, 10 aa, Mycobacterium
TPAGRGRYDD

SEQ ID NO: 598277 - protein, 16 aa, Mycobacterium
TPAGRKRAESDRRARE

SEQ ID NO: 598278 - protein, 7 aa, Mycobacterium
TPAGRWG

SEQ ID NO: 598279 - protein, 7 aa, Mycobacterium
TPAGTPR

SEQ ID NO: 598280 - protein, 20 aa, Mycobacterium
TPAGTSGPDGNHEYAQSPWR

SEQ ID NO: 598281 - protein, 8 aa, Mycobacterium
TPAHDPND

SEQ ID NO: 598282 - protein, 7 aa, Mycobacterium
TPAHHDG

SEQ ID NO: 598283 - protein, 7 aa, Mycobacterium
TPAHTAE

SEQ ID NO: 598284 - protein, 8 aa, Mycobacterium
TPAITNPG

SEQ ID NO: 598285 - protein, 5 aa, Mycobacterium
TPAKT

SEQ ID NO: 598286 - protein, 4 aa, Mycobacterium
TPAL

SEQ ID NO: 598287 - protein, 8 aa, Mycobacterium
TPALASRG

SEQ ID NO: 598288 - protein, 9 aa, Mycobacterium
TPALGATGA

SEQ ID NO: 598289 - protein, 13 aa, Mycobacterium
TPALGQPRRTKHH

SEQ ID NO: 598290 - protein, 13 aa, Mycobacterium
TPALTSRGFGADE

SEQ ID NO: 598291 - protein, 5 aa, Mycobacterium
TPAMQ

SEQ ID NO: 598292 - protein, 10 aa, Mycobacterium
TPANAYPTTD

SEQ ID NO: 598293 - protein, 8 aa, Mycobacterium
TPANPADI

SEQ ID NO: 598294 - protein, 10 aa, Mycobacterium
TPANPADLPQ

SEQ ID NO: 598295 - protein, 9 aa, Mycobacterium
TPANPANLP

SEQ ID NO: 598296 - protein, 7 aa, Mycobacterium
TPANPLG

SEQ ID NO: 598297 - protein, 9 aa, Mycobacterium
TPAPDAHDV

SEQ ID NO: 598298 - protein, 6 aa, Mycobacterium
TPAPDD

SEQ ID NO: 598299 - protein, 5 aa, Mycobacterium
TPAPE

SEQ ID NO: 598300 - protein, 11 aa, Mycobacterium
TPAPEPGPGQV

SEQ ID NO: 598301 - protein, 5 aa, Mycobacterium
TPAPG

SEQ ID NO: 598302 - protein, 23 aa, Mycobacterium
TPAPGRDGSNNEDGSKRASQDVR

SEQ ID NO: 598303 - protein, 21 aa, Mycobacterium
TPAPGRDGSTGPGDSERASQH

SEQ ID NO: 598304 - protein, 6 aa, Mycobacterium
TPAPGT

SEQ ID NO: 598305 - protein, 7 aa, Mycobacterium
TPAPIPA

SEQ ID NO: 598306 - protein, 10 aa, Mycobacterium
TPAPPARPIE

SEQ ID NO: 598307 - protein, 5 aa, Mycobacterium
TPAPS

SEQ ID NO: 598308 - protein, 17 aa, Mycobacterium
TPAPSPRQHLTSTGGAS

SEQ ID NO: 598309 - protein, 17 aa, Mycobacterium
TPAPSPRRDTTSIKGAS

SEQ ID NO: 598310 - protein, 13 aa, Mycobacterium
TPAPSSLTGPVTA

SEQ ID NO: 598311 - protein, 6 aa, Mycobacterium
TPAPTW

SEQ ID NO: 598312 - protein, 6 aa, Mycobacterium
TPAQAV

SEQ ID NO: 598313 - protein, 12 aa, Mycobacterium
TPAQKDREYQRN

SEQ ID NO: 598314 - protein, 8 aa, Mycobacterium
TPAQLPES

SEQ ID NO: 598315 - protein, 5 aa, Mycobacterium
TPAQN

SEQ ID NO: 598316 - protein, 6 aa, Mycobacterium
TPAQRT

SEQ ID NO: 598317 - protein, 7 aa, Mycobacterium
TPAQSAA

SEQ ID NO: 598318 - protein, 6 aa, Mycobacterium
TPAQTE

SEQ ID NO: 598319 - protein, 6 aa, Mycobacterium
TPARAD

SEQ ID NO: 598320 - protein, 9 aa, Mycobacterium
TPARATRLN

SEQ ID NO: 598321 - protein, 8 aa, Mycobacterium
TPARDDRT

SEQ ID NO: 598322 - protein, 8 aa, Mycobacterium
TPAREITD

SEQ ID NO: 598323 - protein, 12 aa, Mycobacterium
TPARHRARAASA

SEQ ID NO: 598324 - protein, 11 aa, Mycobacterium
TPARKADLEPA

SEQ ID NO: 598325 - protein, 19 aa, Mycobacterium
TPARKVRATPTRRRRASSP

SEQ ID NO: 598326 - protein, 14 aa, Mycobacterium
TPARLREDTSCSSL

SEQ ID NO: 598327 - protein, 8 aa, Mycobacterium
TPARRAAS

SEQ ID NO: 598328 - protein, 7 aa, Mycobacterium
TPARRRA

SEQ ID NO: 598329 - protein, 9 aa, Mycobacterium
TPARRRARA

SEQ ID NO: 598330 - protein, 11 aa, Mycobacterium
TPARRRARGAY

SEQ ID NO: 598331 - protein, 14 aa, Mycobacterium
TPARSDGGTRRYSA

SEQ ID NO: 598332 - protein, 8 aa, Mycobacterium
TPARSGEF

SEQ ID NO: 598333 - protein, 8 aa, Mycobacterium
TPARSRAN

SEQ ID NO: 598334 - protein, 5 aa, Mycobacterium
TPART

SEQ ID NO: 598335 - protein, 7 aa, Mycobacterium
TPARTRH

SEQ ID NO: 598336 - protein, 6 aa, Mycobacterium
TPARVA

SEQ ID NO: 598337 - protein, 5 aa, Mycobacterium
TPARY

SEQ ID NO: 598338 - protein, 5 aa, Mycobacterium
TPASA

SEQ ID NO: 598339 - protein, 16 aa, Mycobacterium
TPASARDGSDGSERAI

SEQ ID NO: 598340 - protein, 8 aa, Mycobacterium
TPASGDVA

SEQ ID NO: 598341 - protein, 9 aa, Mycobacterium
TPASGLGRT

SEQ ID NO: 598342 - protein, 10 aa, Mycobacterium
TPASGNWPER

SEQ ID NO: 598343 - protein, 8 aa, Mycobacterium
TPASGPKY

SEQ ID NO: 598344 - protein, 9 aa, Mycobacterium
TPASRHEAA

SEQ ID NO: 598345 - protein, 10 aa, Mycobacterium
TPASRHEAAC

SEQ ID NO: 598346 - protein, 5 aa, Mycobacterium
TPAST

SEQ ID NO: 598347 - protein, 12 aa, Mycobacterium
TPASTPDAPKLE

SEQ ID NO: 598348 - protein, 15 aa, Mycobacterium
TPASYNGTIEPGNSV

SEQ ID NO: 598349 - protein, 8 aa, Mycobacterium
TPATAPAW

SEQ ID NO: 598350 - protein, 12 aa, Mycobacterium
TPATATSTEDDV

SEQ ID NO: 598351 - protein, 8 aa, Mycobacterium
TPATDAAG

SEQ ID NO: 598352 - protein, 8 aa, Mycobacterium
TPATDLGA

SEQ ID NO: 598353 - protein, 5 aa, Mycobacterium
TPATE

SEQ ID NO: 598354 - protein, 9 aa, Mycobacterium
TPATEGADG

SEQ ID NO: 598355 - protein, 8 aa, Mycobacterium
TPATERRT

SEQ ID NO: 598356 - protein, 7 aa, Mycobacterium
TPATGLG

SEQ ID NO: 598357 - protein, 11 aa, Mycobacterium
TPATKADIGEH

SEQ ID NO: 598358 - protein, 22 aa, Mycobacterium
TPATLDAADPASTRAAFAGSGP

SEQ ID NO: 598359 - protein, 8 aa, Mycobacterium
TPATPAAP

SEQ ID NO: 598360 - protein, 17 aa, Mycobacterium
TPATPQRMTHALKSLGL

SEQ ID NO: 598361 - protein, 7 aa, Mycobacterium
TPATRHE

SEQ ID NO: 598362 - protein, 5 aa, Mycobacterium
TPATS

SEQ ID NO: 598363 - protein, 8 aa, Mycobacterium
TPATSTAD

SEQ ID NO: 598364 - protein, 8 aa, Mycobacterium
TPATTDLA

SEQ ID NO: 598365 - protein, 9 aa, Mycobacterium
TPATTDLGT

SEQ ID NO: 598366 - protein, 8 aa, Mycobacterium
TPATTDQA

SEQ ID NO: 598367 - protein, 10 aa, Mycobacterium
TPATTDQATA

SEQ ID NO: 598368 - protein, 7 aa, Mycobacterium
TPATTDV

SEQ ID NO: 598369 - protein, 8 aa, Mycobacterium
TPATTPTA

SEQ ID NO: 598370 - protein, 8 aa, Mycobacterium
TPATTTET

SEQ ID NO: 598371 - protein, 17 aa, Mycobacterium
TPATTVGGDMPTRRRRV

SEQ ID NO: 598372 - protein, 20 aa, Mycobacterium
TPATVANARDAPISAVPPSY

SEQ ID NO: 598373 - protein, 9 aa, Mycobacterium
TPAVEPADV

SEQ ID NO: 598374 - protein, 13 aa, Mycobacterium
TPAVGGVPTNAAS

SEQ ID NO: 598375 - protein, 6 aa, Mycobacterium
TPAVPE

SEQ ID NO: 598376 - protein, 5 aa, Mycobacterium
TPAVS

SEQ ID NO: 598377 - protein, 8 aa, Mycobacterium
TPAWGGSA

SEQ ID NO: 598378 - protein, 10 aa, Mycobacterium
TPAWRPGTRH

SEQ ID NO: 598379 - protein, 4 aa, Mycobacterium
TPAY

SEQ ID NO: 598380 - protein, 5 aa, Mycobacterium
TPAYR

SEQ ID NO: 598381 - protein, 4 aa, Mycobacterium
TPCQ

SEQ ID NO: 598382 - protein, 13 aa, Mycobacterium
TPCRRPRSPVMSR

SEQ ID NO: 598383 - protein, 6 aa, Mycobacterium
TPCTRA

SEQ ID NO: 598384 - protein, 7 aa, Mycobacterium
TPDAAEV

SEQ ID NO: 598385 - protein, 10 aa, Mycobacterium
TPDAAPERTH

SEQ ID NO: 598386 - protein, 26 aa, Mycobacterium
TPDADAAAAARDRQKRLTKPPGSLGR

SEQ ID NO: 598387 - protein, 18 aa, Mycobacterium
TPDADGRRPIDDEATKYR

SEQ ID NO: 598388 - protein, 9 aa, Mycobacterium
TPDAEAAAL

SEQ ID NO: 598389 - protein, 8 aa, Mycobacterium
TPDAEDER

SEQ ID NO: 598390 - protein, 9 aa, Mycobacterium
TPDAEPPFE

SEQ ID NO: 598391 - protein, 11 aa, Mycobacterium
TPDAFTGDEIT

SEQ ID NO: 598392 - protein, 9 aa, Mycobacterium
TPDAGDPPY

SEQ ID NO: 598393 - protein, 11 aa, Mycobacterium
TPDAGTATLAG

SEQ ID NO: 598394 - protein, 7 aa, Mycobacterium
TPDALAG

SEQ ID NO: 598395 - protein, 7 aa, Mycobacterium
TPDAPGI

SEQ ID NO: 598396 - protein, 7 aa, Mycobacterium
TPDAPPL

SEQ ID NO: 598397 - protein, 8 aa, Mycobacterium
TPDAPSYE

SEQ ID NO: 598398 - protein, 10 aa, Mycobacterium
TPDAPTNDQA

SEQ ID NO: 598399 - protein, 10 aa, Mycobacterium
TPDASDSASF

SEQ ID NO: 598400 - protein, 9 aa, Mycobacterium
TPDASRRIK

SEQ ID NO: 598401 - protein, 5 aa, Mycobacterium
TPDAY

SEQ ID NO: 598402 - protein, 6 aa, Mycobacterium
TPDAYP

SEQ ID NO: 598403 - protein, 18 aa, Mycobacterium
TPDCESGKAYVQWGLNTP

SEQ ID NO: 598404 - protein, 4 aa, Mycobacterium
TPDD

SEQ ID NO: 598405 - protein, 7 aa, Mycobacterium
TPDDARA

SEQ ID NO: 598406 - protein, 10 aa, Mycobacterium
TPDDARQAEW

SEQ ID NO: 598407 - protein, 6 aa, Mycobacterium
TPDDEL

SEQ ID NO: 598408 - protein, 6 aa, Mycobacterium
TPDDEQ

SEQ ID NO: 598409 - protein, 5 aa, Mycobacterium
TPDDG

SEQ ID NO: 598410 - protein, 9 aa, Mycobacterium
TPDDGTGVQ

SEQ ID NO: 598411 - protein, 8 aa, Mycobacterium
TPDDHKAL

SEQ ID NO: 598412 - protein, 5 aa, Mycobacterium
TPDDP

SEQ ID NO: 598413 - protein, 7 aa, Mycobacterium
TPDDPGA

SEQ ID NO: 598414 - protein, 9 aa, Mycobacterium
TPDDQQAEV

SEQ ID NO: 598415 - protein, 9 aa, Mycobacterium
TPDDQQALS

SEQ ID NO: 598416 - protein, 12 aa, Mycobacterium
TPDDRKTAKGVI

SEQ ID NO: 598417 - protein, 10 aa, Mycobacterium
TPDDRVPPKP

SEQ ID NO: 598418 - protein, 8 aa, Mycobacterium
TPDDSERL

SEQ ID NO: 598419 - protein, 15 aa, Mycobacterium
TPDDTPLSSNDAAEL

SEQ ID NO: 598420 - protein, 5 aa, Mycobacterium
TPDEA

SEQ ID NO: 598421 - protein, 8 aa, Mycobacterium
TPDEAADL

SEQ ID NO: 598422 - protein, 7 aa, Mycobacterium
TPDEAKR

SEQ ID NO: 598423 - protein, 9 aa, Mycobacterium
TPDEARDAV

SEQ ID NO: 598424 - protein, 5 aa, Mycobacterium
TPDEG

SEQ ID NO: 598425 - protein, 6 aa, Mycobacterium
TPDEGE

SEQ ID NO: 598426 - protein, 5 aa, Mycobacterium
TPDEP

SEQ ID NO: 598427 - protein, 8 aa, Mycobacterium
TPDEPGFA

SEQ ID NO: 598428 - protein, 11 aa, Mycobacterium
TPDEQHRAIGP

SEQ ID NO: 598429 - protein, 6 aa, Mycobacterium
TPDERR

SEQ ID NO: 598430 - protein, 9 aa, Mycobacterium
TPDERRTAK

SEQ ID NO: 598431 - protein, 8 aa, Mycobacterium
TPDEYSKK

SEQ ID NO: 598432 - protein, 7 aa, Mycobacterium
TPDEYSR

SEQ ID NO: 598433 - protein, 15 aa, Mycobacterium
TPDFASSTTETVSAT

SEQ ID NO: 598434 - protein, 9 aa, Mycobacterium
TPDGAGKDV

SEQ ID NO: 598435 - protein, 15 aa, Mycobacterium
TPDGAPIEPTTADDP

SEQ ID NO: 598436 - protein, 8 aa, Mycobacterium
TPDGDGPW

SEQ ID NO: 598437 - protein, 6 aa, Mycobacterium
TPDGEV

SEQ ID NO: 598438 - protein, 15 aa, Mycobacterium
TPDGHATNPPARYTE

SEQ ID NO: 598439 - protein, 15 aa, Mycobacterium
TPDGHATNPPPRYTE

SEQ ID NO: 598440 - protein, 6 aa, Mycobacterium
TPDGHG

SEQ ID NO: 598441 - protein, 11 aa, Mycobacterium
TPDGKNRGTVS

SEQ ID NO: 598442 - protein, 12 aa, Mycobacterium
TPDGPEATGRGE

SEQ ID NO: 598443 - protein, 7 aa, Mycobacterium
TPDGQRT

SEQ ID NO: 598444 - protein, 5 aa, Mycobacterium
TPDGR

SEQ ID NO: 598445 - protein, 11 aa, Mycobacterium
TPDGTGGDGLD

SEQ ID NO: 598446 - protein, 20 aa, Mycobacterium
TPDGTIEEQAQRVLDLLESR

SEQ ID NO: 598447 - protein, 4 aa, Mycobacterium
TPDH

SEQ ID NO: 598448 - protein, 5 aa, Mycobacterium
TPDHG

SEQ ID NO: 598449 - protein, 7 aa, Mycobacterium
TPDHPAP

SEQ ID NO: 598450 - protein, 8 aa, Mycobacterium
TPDHTPDH

SEQ ID NO: 598451 - protein, 8 aa, Mycobacterium
TPDKIASD

SEQ ID NO: 598452 - protein, 8 aa, Mycobacterium
TPDKQADA

SEQ ID NO: 598453 - protein, 4 aa, Mycobacterium
TPDL

SEQ ID NO: 598454 - protein, 10 aa, Mycobacterium
TPDLNPQTGP

SEQ ID NO: 598455 - protein, 6 aa, Mycobacterium
TPDLRE

SEQ ID NO: 598456 - protein, 4 aa, Mycobacterium
TPDM

SEQ ID NO: 598457 - protein, 6 aa, Mycobacterium
TPDMGI

SEQ ID NO: 598458 - protein, 4 aa, Mycobacterium
TPDN

SEQ ID NO: 598459 - protein, 9 aa, Mycobacterium
TPDNAAERP

SEQ ID NO: 598460 - protein, 7 aa, Mycobacterium
TPDNAFP

SEQ ID NO: 598461 - protein, 8 aa, Mycobacterium
TPDNPDAQ

SEQ ID NO: 598462 - protein, 6 aa, Mycobacterium
TPDNYY

SEQ ID NO: 598463 - protein, 7 aa, Mycobacterium
TPDPAPL

SEQ ID NO: 598464 - protein, 7 aa, Mycobacterium
TPDPAQA

SEQ ID NO: 598465 - protein, 14 aa, Mycobacterium
TPDPCSAGASTQAE

SEQ ID NO: 598466 - protein, 7 aa, Mycobacterium
TPDPDGG

SEQ ID NO: 598467 - protein, 5 aa, Mycobacterium
TPDPE

SEQ ID NO: 598468 - protein, 11 aa, Mycobacterium
TPDPPASTRGI

SEQ ID NO: 598469 - protein, 10 aa, Mycobacterium
TPDPPSADAH

SEQ ID NO: 598470 - protein, 10 aa, Mycobacterium
TPDPSAATLS

SEQ ID NO: 598471 - protein, 4 aa, Mycobacterium
TPDQ

SEQ ID NO: 598472 - protein, 9 aa, Mycobacterium
TPDQAVTTA

SEQ ID NO: 598473 - protein, 5 aa, Mycobacterium
TPDQD

SEQ ID NO: 598474 - protein, 7 aa, Mycobacterium
TPDQDPD

SEQ ID NO: 598475 - protein, 5 aa, Mycobacterium
TPDQL

SEQ ID NO: 598476 - protein, 15 aa, Mycobacterium
TPDQLAGKTPLNAEQ

SEQ ID NO: 598477 - protein, 25 aa, Mycobacterium
TPDQRAALADPGPMPPAPPVPPAAN

SEQ ID NO: 598478 - protein, 26 aa, Mycobacterium
TPDQRAALADPGPVPPAPPAPPAANP

SEQ ID NO: 598479 - protein, 8 aa, Mycobacterium
TPDQRRAA

SEQ ID NO: 598480 - protein, 10 aa, Mycobacterium
TPDRAPRDTL

SEQ ID NO: 598481 - protein, 9 aa, Mycobacterium
TPDRIDADA

SEQ ID NO: 598482 - protein, 8 aa, Mycobacterium
TPDRLERA

SEQ ID NO: 598483 - protein, 6 aa, Mycobacterium
TPDRMA

SEQ ID NO: 598484 - protein, 9 aa, Mycobacterium
TPDRPSNEP

SEQ ID NO: 598485 - protein, 7 aa, Mycobacterium
TPDRSSH

SEQ ID NO: 598486 - protein, 4 aa, Mycobacterium
TPDS

SEQ ID NO: 598487 - protein, 5 aa, Mycobacterium
TPDSA

SEQ ID NO: 598488 - protein, 16 aa, Mycobacterium
TPDSAENQENESWPAA

SEQ ID NO: 598489 - protein, 9 aa, Mycobacterium
TPDSAGDRL

SEQ ID NO: 598490 - protein, 11 aa, Mycobacterium
TPDSATSPDVV

SEQ ID NO: 598491 - protein, 7 aa, Mycobacterium
TPDSDAR

SEQ ID NO: 598492 - protein, 15 aa, Mycobacterium
TPDSGAAADNDPAAI

SEQ ID NO: 598493 - protein, 9 aa, Mycobacterium
TPDSGKAHR

SEQ ID NO: 598494 - protein, 8 aa, Mycobacterium
TPDSGNAH

SEQ ID NO: 598495 - protein, 7 aa, Mycobacterium
TPDSGPL

SEQ ID NO: 598496 - protein, 5 aa, Mycobacterium
TPDSR

SEQ ID NO: 598497 - protein, 12 aa, Mycobacterium
TPDSRPRGSAPA

SEQ ID NO: 598498 - protein, 6 aa, Mycobacterium
TPDSSL

SEQ ID NO: 598499 - protein, 6 aa, Mycobacterium
TPDSSR

SEQ ID NO: 598500 - protein, 5 aa, Mycobacterium
TPDTA

SEQ ID NO: 598501 - protein, 6 aa, Mycobacterium
TPDTAA

SEQ ID NO: 598502 - protein, 6 aa, Mycobacterium
TPDTDD

SEQ ID NO: 598503 - protein, 6 aa, Mycobacterium
TPDTDV

SEQ ID NO: 598504 - protein, 12 aa, Mycobacterium
TPDTPPNSPYPT

SEQ ID NO: 598505 - protein, 7 aa, Mycobacterium
TPDTTAA

SEQ ID NO: 598506 - protein, 4 aa, Mycobacterium
TPDV

SEQ ID NO: 598507 - protein, 7 aa, Mycobacterium
TPDVAPR

SEQ ID NO: 598508 - protein, 6 aa, Mycobacterium
TPDVGD

SEQ ID NO: 598509 - protein, 20 aa, Mycobacterium
TPDVRAPHAEGNFPTPSGKC

SEQ ID NO: 598510 - protein, 7 aa, Mycobacterium
TPDYGDP

SEQ ID NO: 598511 - protein, 6 aa, Mycobacterium
TPDYGG

SEQ ID NO: 598512 - protein, 5 aa, Mycobacterium
TPDYR

SEQ ID NO: 598513 - protein, 9 aa, Mycobacterium
TPEAAEPTL

SEQ ID NO: 598514 - protein, 9 aa, Mycobacterium
TPEAIGGPA

SEQ ID NO: 598515 - protein, 5 aa, Mycobacterium
TPEAL

SEQ ID NO: 598516 - protein, 6 aa, Mycobacterium
TPEARA

SEQ ID NO: 598517 - protein, 8 aa, Mycobacterium
TPEARATV

SEQ ID NO: 598518 - protein, 6 aa, Mycobacterium
TPEARR

SEQ ID NO: 598519 - protein, 10 aa, Mycobacterium
TPEATAEADG

SEQ ID NO: 598520 - protein, 18 aa, Mycobacterium
TPEAVAAAKGDAAALKTT

SEQ ID NO: 598521 - protein, 15 aa, Mycobacterium
TPEAVTATQQELAAD

SEQ ID NO: 598522 - protein, 5 aa, Mycobacterium
TPEDA

SEQ ID NO: 598523 - protein, 7 aa, Mycobacterium
TPEDAQS

SEQ ID NO: 598524 - protein, 7 aa, Mycobacterium
TPEDDEW

SEQ ID NO: 598525 - protein, 7 aa, Mycobacterium
TPEDPDR

SEQ ID NO: 598526 - protein, 6 aa, Mycobacterium
TPEDTR

SEQ ID NO: 598527 - protein, 8 aa, Mycobacterium
TPEEARKK

SEQ ID NO: 598528 - protein, 5 aa, Mycobacterium
TPEEC

SEQ ID NO: 598529 - protein, 6 aa, Mycobacterium
TPEECA

SEQ ID NO: 598530 - protein, 6 aa, Mycobacterium
TPEEGL

SEQ ID NO: 598531 - protein, 6 aa, Mycobacterium
TPEEHN

SEQ ID NO: 598532 - protein, 9 aa, Mycobacterium
TPEELGGAL

SEQ ID NO: 598533 - protein, 5 aa, Mycobacterium
TPEEN

SEQ ID NO: 598534 - protein, 13 aa, Mycobacterium
TPEENAAVGITLP

SEQ ID NO: 598535 - protein, 6 aa, Mycobacterium
TPEEQA

SEQ ID NO: 598536 - protein, 5 aa, Mycobacterium
TPEER

SEQ ID NO: 598537 - protein, 9 aa, Mycobacterium
TPEERADPK

SEQ ID NO: 598538 - protein, 10 aa, Mycobacterium
TPEERADPKI

SEQ ID NO: 598539 - protein, 12 aa, Mycobacterium
TPEEREDAAAGQ

SEQ ID NO: 598540 - protein, 12 aa, Mycobacterium
TPEEVAREAADN

SEQ ID NO: 598541 - protein, 6 aa, Mycobacterium
TPEEVE

SEQ ID NO: 598542 - protein, 13 aa, Mycobacterium
TPEFADRQRRTLS

SEQ ID NO: 598543 - protein, 13 aa, Mycobacterium
TPEFGAKGITEPD

SEQ ID NO: 598544 - protein, 14 aa, Mycobacterium
TPEFGAKGITESDY

SEQ ID NO: 598545 - protein, 14 aa, Mycobacterium
TPEFGAKGVTEPDY

SEQ ID NO: 598546 - protein, 8 aa, Mycobacterium
TPEFTTPP

SEQ ID NO: 598547 - protein, 12 aa, Mycobacterium
TPEGARSTGAGH

SEQ ID NO: 598548 - protein, 5 aa, Mycobacterium
TPEGD

SEQ ID NO: 598549 - protein, 6 aa, Mycobacterium
TPEGEE

SEQ ID NO: 598550 - protein, 12 aa, Mycobacterium
TPEGEPKPAVGA

SEQ ID NO: 598551 - protein, 6 aa, Mycobacterium
TPEGET

SEQ ID NO: 598552 - protein, 28 aa, Mycobacterium
TPEGGGHASGRLAPNVTPTVAAAESATV

SEQ ID NO: 598553 - protein, 7 aa, Mycobacterium
TPEGKEA

SEQ ID NO: 598554 - protein, 11 aa, Mycobacterium
TPEGKERLAGN

SEQ ID NO: 598555 - protein, 6 aa, Mycobacterium
TPEGPN

SEQ ID NO: 598556 - protein, 13 aa, Mycobacterium
TPEGPVGSDAVKG

SEQ ID NO: 598557 - protein, 7 aa, Mycobacterium
TPEGSHA

SEQ ID NO: 598558 - protein, 6 aa, Mycobacterium
TPEGTA

SEQ ID NO: 598559 - protein, 7 aa, Mycobacterium
TPEGTFD

SEQ ID NO: 598560 - protein, 12 aa, Mycobacterium
TPEGVARRLREL

SEQ ID NO: 598561 - protein, 10 aa, Mycobacterium
TPEHDARARE

SEQ ID NO: 598562 - protein, 5 aa, Mycobacterium
TPEHE

SEQ ID NO: 598563 - protein, 7 aa, Mycobacterium
TPEHTAA

SEQ ID NO: 598564 - protein, 8 aa, Mycobacterium
TPEHTAQA

SEQ ID NO: 598565 - protein, 7 aa, Mycobacterium
TPEHTEH

SEQ ID NO: 598566 - protein, 9 aa, Mycobacterium
TPEHTGTAR

SEQ ID NO: 598567 - protein, 8 aa, Mycobacterium
TPEHTRQA

SEQ ID NO: 598568 - protein, 8 aa, Mycobacterium
TPEHTRSA

SEQ ID NO: 598569 - protein, 4 aa, Mycobacterium
TPEI

SEQ ID NO: 598570 - protein, 5 aa, Mycobacterium
TPEIA

SEQ ID NO: 598571 - protein, 5 aa, Mycobacterium
TPEIT

SEQ ID NO: 598572 - protein, 7 aa, Mycobacterium
TPEKAAE

SEQ ID NO: 598573 - protein, 8 aa, Mycobacterium
TPEKAAEL

SEQ ID NO: 598574 - protein, 9 aa, Mycobacterium
TPEKAAEYG

SEQ ID NO: 598575 - protein, 9 aa, Mycobacterium
TPEKADEYG

SEQ ID NO: 598576 - protein, 5 aa, Mycobacterium
TPEKL

SEQ ID NO: 598577 - protein, 5 aa, Mycobacterium
TPEKQ

SEQ ID NO: 598578 - protein, 12 aa, Mycobacterium
TPEKVGRDAGDL

SEQ ID NO: 598579 - protein, 4 aa, Mycobacterium
TPEL

SEQ ID NO: 598580 - protein, 5 aa, Mycobacterium
TPELL

SEQ ID NO: 598581 - protein, 6 aa, Mycobacterium
TPEMTA

SEQ ID NO: 598582 - protein, 10 aa, Mycobacterium
TPEPDESTIR

SEQ ID NO: 598583 - protein, 11 aa, Mycobacterium
TPEPEAPESRA

SEQ ID NO: 598584 - protein, 14 aa, Mycobacterium
TPEPFGGAAPEETG

SEQ ID NO: 598585 - protein, 5 aa, Mycobacterium
TPEPG

SEQ ID NO: 598586 - protein, 17 aa, Mycobacterium
TPEPGADEFPPHPPSVT

SEQ ID NO: 598587 - protein, 7 aa, Mycobacterium
TPEPGAW

SEQ ID NO: 598588 - protein, 10 aa, Mycobacterium
TPEPHERNGY

SEQ ID NO: 598589 - protein, 11 aa, Mycobacterium
TPEPPADGEDV

SEQ ID NO: 598590 - protein, 16 aa, Mycobacterium
TPEPPDDIEPIGPGHP

SEQ ID NO: 598591 - protein, 11 aa, Mycobacterium
TPEPRAPQQET

SEQ ID NO: 598592 - protein, 20 aa, Mycobacterium
TPEPRPPAVGVQESPAAGMP

SEQ ID NO: 598593 - protein, 12 aa, Mycobacterium
TPEPRPPQQETV

SEQ ID NO: 598594 - protein, 13 aa, Mycobacterium
TPEPRPPQQETVG

SEQ ID NO: 598595 - protein, 9 aa, Mycobacterium
TPEPVAGPG

SEQ ID NO: 598596 - protein, 9 aa, Mycobacterium
TPEPVEDSI

SEQ ID NO: 598597 - protein, 5 aa, Mycobacterium
TPEQA

SEQ ID NO: 598598 - protein, 8 aa, Mycobacterium
TPEQAAAA

SEQ ID NO: 598599 - protein, 28 aa, Mycobacterium
TPEQAAHKDIEKRTTRPRPVTEEPEEMT

SEQ ID NO: 598600 - protein, 14 aa, Mycobacterium
TPEQADEIAAGTDG

SEQ ID NO: 598601 - protein, 6 aa, Mycobacterium
TPEQAK

SEQ ID NO: 598602 - protein, 16 aa, Mycobacterium
TPEQAKSAQEDLARRM

SEQ ID NO: 598603 - protein, 8 aa, Mycobacterium
TPEQAREV

SEQ ID NO: 598604 - protein, 5 aa, Mycobacterium
TPEQE

SEQ ID NO: 598605 - protein, 5 aa, Mycobacterium
TPEQH

SEQ ID NO: 598606 - protein, 6 aa, Mycobacterium
TPEQIA

SEQ ID NO: 598607 - protein, 8 aa, Mycobacterium
TPEQLATP

SEQ ID NO: 598608 - protein, 12 aa, Mycobacterium
TPEQPDDADNPL

SEQ ID NO: 598609 - protein, 13 aa, Mycobacterium
TPEQQAAAYSAPG

SEQ ID NO: 598610 - protein, 7 aa, Mycobacterium
TPEQQQL

SEQ ID NO: 598611 - protein, 6 aa, Mycobacterium
TPEQQR

SEQ ID NO: 598612 - protein, 5 aa, Mycobacterium
TPEQR

SEQ ID NO: 598613 - protein, 6 aa, Mycobacterium
TPEQRD

SEQ ID NO: 598614 - protein, 7 aa, Mycobacterium
TPEQRER

SEQ ID NO: 598615 - protein, 11 aa, Mycobacterium
TPEQTVAEQDK

SEQ ID NO: 598616 - protein, 5 aa, Mycobacterium
TPEQY

SEQ ID NO: 598617 - protein, 8 aa, Mycobacterium
TPEQYKED

SEQ ID NO: 598618 - protein, 8 aa, Mycobacterium
TPERADAY

SEQ ID NO: 598619 - protein, 8 aa, Mycobacterium
TPERAKDL

SEQ ID NO: 598620 - protein, 10 aa, Mycobacterium
TPERAKDLKN

SEQ ID NO: 598621 - protein, 8 aa, Mycobacterium
TPERARDL

SEQ ID NO: 598622 - protein, 10 aa, Mycobacterium
TPERDAARAH

SEQ ID NO: 598623 - protein, 6 aa, Mycobacterium
TPERFG

SEQ ID NO: 598624 - protein, 13 aa, Mycobacterium
TPERLSGKQIPVA

SEQ ID NO: 598625 - protein, 6 aa, Mycobacterium
TPERME

SEQ ID NO: 598626 - protein, 11 aa, Mycobacterium
TPERPDDADNT

SEQ ID NO: 598627 - protein, 11 aa, Mycobacterium
TPERPDDAENT

SEQ ID NO: 598628 - protein, 9 aa, Mycobacterium
TPERPDLEG

SEQ ID NO: 598629 - protein, 20 aa, Mycobacterium
TPERREALASNQGEYGSGNV

SEQ ID NO: 598630 - protein, 5 aa, Mycobacterium
TPERT

SEQ ID NO: 598631 - protein, 10 aa, Mycobacterium
TPESAGWAES

SEQ ID NO: 598632 - protein, 6 aa, Mycobacterium
TPESFS

SEQ ID NO: 598633 - protein, 8 aa, Mycobacterium
TPESFSPE

SEQ ID NO: 598634 - protein, 8 aa, Mycobacterium
TPESLAEA

SEQ ID NO: 598635 - protein, 10 aa, Mycobacterium
TPESNGEDNR

SEQ ID NO: 598636 - protein, 11 aa, Mycobacterium
TPESPEGPVSS

SEQ ID NO: 598637 - protein, 5 aa, Mycobacterium
TPESV

SEQ ID NO: 598638 - protein, 8 aa, Mycobacterium
TPESVAEA

SEQ ID NO: 598639 - protein, 12 aa, Mycobacterium
TPESVAERLRDL

SEQ ID NO: 598640 - protein, 4 aa, Mycobacterium
TPET

SEQ ID NO: 598641 - protein, 5 aa, Mycobacterium
TPETA

SEQ ID NO: 598642 - protein, 10 aa, Mycobacterium
TPETADEVER

SEQ ID NO: 598643 - protein, 11 aa, Mycobacterium
TPETAPTPASV

SEQ ID NO: 598644 - protein, 5 aa, Mycobacterium
TPETI

SEQ ID NO: 598645 - protein, 6 aa, Mycobacterium
TPETIG

SEQ ID NO: 598646 - protein, 12 aa, Mycobacterium
TPETLSGAGLSD

SEQ ID NO: 598647 - protein, 10 aa, Mycobacterium
TPETNGEANR

SEQ ID NO: 598648 - protein, 10 aa, Mycobacterium
TPETSGPGNL

SEQ ID NO: 598649 - protein, 12 aa, Mycobacterium
TPETVAERLREL

SEQ ID NO: 598650 - protein, 5 aa, Mycobacterium
TPEVA

SEQ ID NO: 598651 - protein, 5 aa, Mycobacterium
TPEVE

SEQ ID NO: 598652 - protein, 19 aa, Mycobacterium
TPEVSAYRRSPRAPAPGSS

SEQ ID NO: 598653 - protein, 5 aa, Mycobacterium
TPEYL

SEQ ID NO: 598654 - protein, 7 aa, Mycobacterium
TPEYPLD

SEQ ID NO: 598655 - protein, 8 aa, Mycobacterium
TPEYPLDQ

SEQ ID NO: 598656 - protein, 8 aa, Mycobacterium
TPEYPLGQ

SEQ ID NO: 598657 - protein, 28 aa, Mycobacterium
TPEYPLGQADRALSDLSSGRIAGAAVLL

SEQ ID NO: 598658 - protein, 9 aa, Mycobacterium
TPEYPTATS

SEQ ID NO: 598659 - protein, 20 aa, Mycobacterium
TPEYRPAPTLDEHADAPAHS

SEQ ID NO: 598660 - protein, 5 aa, Mycobacterium
TPFAG

SEQ ID NO: 598661 - protein, 5 aa, Mycobacterium
TPFAS

SEQ ID NO: 598662 - protein, 4 aa, Mycobacterium
TPFD

SEQ ID NO: 598663 - protein, 10 aa, Mycobacterium
TPFDAPADSE

SEQ ID NO: 598664 - protein, 13 aa, Mycobacterium
TPFDESPEITNAG

SEQ ID NO: 598665 - protein, 18 aa, Mycobacterium
TPFDTEEEAVAAANDTEY

SEQ ID NO: 598666 - protein, 6 aa, Mycobacterium
TPFGAA

SEQ ID NO: 598667 - protein, 11 aa, Mycobacterium
TPFGAEGETLG

SEQ ID NO: 598668 - protein, 21 aa, Mycobacterium
TPFGGPDPTKGFQSPIQPKPG

SEQ ID NO: 598669 - protein, 6 aa, Mycobacterium
TPFGPD

SEQ ID NO: 598670 - protein, 4 aa, Mycobacterium
TPFN

SEQ ID NO: 598671 - protein, 5 aa, Mycobacterium
TPFND

SEQ ID NO: 598672 - protein, 4 aa, Mycobacterium
TPFP

SEQ ID NO: 598673 - protein, 5 aa, Mycobacterium
TPFPP

SEQ ID NO: 598674 - protein, 6 aa, Mycobacterium
TPFTER

SEQ ID NO: 598675 - protein, 7 aa, Mycobacterium
TPFTGDS

SEQ ID NO: 598676 - protein, 34 aa, Mycobacterium
TPGAADIATDAVKPAAKSANGKPKRIGPEQLTGA

SEQ ID NO: 598677 - protein, 6 aa, Mycobacterium
TPGAAQ

SEQ ID NO: 598678 - protein, 19 aa, Mycobacterium
TPGAATALAAPAITTSAVT

SEQ ID NO: 598679 - protein, 5 aa, Mycobacterium
TPGAD

SEQ ID NO: 598680 - protein, 12 aa, Mycobacterium
TPGAEPRAAGGY

SEQ ID NO: 598681 - protein, 13 aa, Mycobacterium
TPGAEPRASGGYG

SEQ ID NO: 598682 - protein, 12 aa, Mycobacterium
TPGAEPVAAGGY

SEQ ID NO: 598683 - protein, 19 aa, Mycobacterium
TPGAKADEDAAVSDRDELN

SEQ ID NO: 598684 - protein, 5 aa, Mycobacterium
TPGAL

SEQ ID NO: 598685 - protein, 6 aa, Mycobacterium
TPGAPE

SEQ ID NO: 598686 - protein, 24 aa, Mycobacterium
TPGAPKPPANRRNRSSDDAGARGK

SEQ ID NO: 598687 - protein, 20 aa, Mycobacterium
TPGARDEQADTITNWIAKRW

SEQ ID NO: 598688 - protein, 6 aa, Mycobacterium
TPGARV

SEQ ID NO: 598689 - protein, 21 aa, Mycobacterium
TPGASASATQSELDDATAALS

SEQ ID NO: 598690 - protein, 24 aa, Mycobacterium
TPGATTYLNPAGQSWAATAGSGDV

SEQ ID NO: 598691 - protein, 11 aa, Mycobacterium
TPGDASTLGKQ

SEQ ID NO: 598692 - protein, 9 aa, Mycobacterium
TPGDCHKEG

SEQ ID NO: 598693 - protein, 6 aa, Mycobacterium
TPGDGQ

SEQ ID NO: 598694 - protein, 8 aa, Mycobacterium
TPGDHDKR

SEQ ID NO: 598695 - protein, 11 aa, Mycobacterium
TPGDKAAARAE

SEQ ID NO: 598696 - protein, 7 aa, Mycobacterium
TPGDPKL

SEQ ID NO: 598697 - protein, 6 aa, Mycobacterium
TPGDSE

SEQ ID NO: 598698 - protein, 9 aa, Mycobacterium
TPGDSRADA

SEQ ID NO: 598699 - protein, 5 aa, Mycobacterium
TPGDT

SEQ ID NO: 598700 - protein, 7 aa, Mycobacterium
TPGDTRA

SEQ ID NO: 598701 - protein, 8 aa, Mycobacterium
TPGDTRAD

SEQ ID NO: 598702 - protein, 9 aa, Mycobacterium
TPGDTRADA

SEQ ID NO: 598703 - protein, 5 aa, Mycobacterium
TPGDV

SEQ ID NO: 598704 - protein, 6 aa, Mycobacterium
TPGEAR

SEQ ID NO: 598705 - protein, 27 aa, Mycobacterium
TPGEEPTALPDPQIPAKASASRADASA

SEQ ID NO: 598706 - protein, 7 aa, Mycobacterium
TPGEFGS

SEQ ID NO: 598707 - protein, 8 aa, Mycobacterium
TPGEGSPV

SEQ ID NO: 598708 - protein, 6 aa, Mycobacterium
TPGEHV

SEQ ID NO: 598709 - protein, 6 aa, Mycobacterium
TPGELH

SEQ ID NO: 598710 - protein, 5 aa, Mycobacterium
TPGEM

SEQ ID NO: 598711 - protein, 6 aa, Mycobacterium
TPGEPV

SEQ ID NO: 598712 - protein, 6 aa, Mycobacterium
TPGEQG

SEQ ID NO: 598713 - protein, 9 aa, Mycobacterium
TPGEQQPDH

SEQ ID NO: 598714 - protein, 5 aa, Mycobacterium
TPGER

SEQ ID NO: 598715 - protein, 8 aa, Mycobacterium
TPGERPYP

SEQ ID NO: 598716 - protein, 7 aa, Mycobacterium
TPGERTG

SEQ ID NO: 598717 - protein, 5 aa, Mycobacterium
TPGET

SEQ ID NO: 598718 - protein, 8 aa, Mycobacterium
TPGFGDTT

SEQ ID NO: 598719 - protein, 4 aa, Mycobacterium
TPGG

SEQ ID NO: 598720 - protein, 6 aa, Mycobacterium
TPGGAD

SEQ ID NO: 598721 - protein, 11 aa, Mycobacterium
TPGGAQPSRLG

SEQ ID NO: 598722 - protein, 11 aa, Mycobacterium
TPGGDGPADAV

SEQ ID NO: 598723 - protein, 5 aa, Mycobacterium
TPGGF

SEQ ID NO: 598724 - protein, 6 aa, Mycobacterium
TPGGLD

SEQ ID NO: 598725 - protein, 7 aa, Mycobacterium
TPGGLES

SEQ ID NO: 598726 - protein, 8 aa, Mycobacterium
TPGGLRTP

SEQ ID NO: 598727 - protein, 5 aa, Mycobacterium
TPGGN

SEQ ID NO: 598728 - protein, 22 aa, Mycobacterium
TPGGNWSSYPAHKHDENTEVET

SEQ ID NO: 598729 - protein, 9 aa, Mycobacterium
TPGGQQPAH

SEQ ID NO: 598730 - protein, 7 aa, Mycobacterium
TPGGRRQ

SEQ ID NO: 598731 - protein, 7 aa, Mycobacterium
TPGGTFD

SEQ ID NO: 598732 - protein, 8 aa, Mycobacterium
TPGGTHEE

SEQ ID NO: 598733 - protein, 10 aa, Mycobacterium
TPGGTPDTRL

SEQ ID NO: 598734 - protein, 11 aa, Mycobacterium
TPGHADFGGEV

SEQ ID NO: 598735 - protein, 10 aa, Mycobacterium
TPGHADFSED

SEQ ID NO: 598736 - protein, 8 aa, Mycobacterium
TPGHEHDT

SEQ ID NO: 598737 - protein, 7 aa, Mycobacterium
TPGHEQY

SEQ ID NO: 598738 - protein, 7 aa, Mycobacterium
TPGHERY

SEQ ID NO: 598739 - protein, 8 aa, Mycobacterium
TPGHSDDS

SEQ ID NO: 598740 - protein, 8 aa, Mycobacterium
TPGHSPGS

SEQ ID NO: 598741 - protein, 7 aa, Mycobacterium
TPGHTGG

SEQ ID NO: 598742 - protein, 6 aa, Mycobacterium
TPGHTR

SEQ ID NO: 598743 - protein, 11 aa, Mycobacterium
TPGIGRREPAC

SEQ ID NO: 598744 - protein, 8 aa, Mycobacterium
TPGIPERR

SEQ ID NO: 598745 - protein, 5 aa, Mycobacterium
TPGIR

SEQ ID NO: 598746 - protein, 8 aa, Mycobacterium
TPGKPNID

SEQ ID NO: 598747 - protein, 8 aa, Mycobacterium
TPGKPNVD

SEQ ID NO: 598748 - protein, 7 aa, Mycobacterium
TPGKRIR

SEQ ID NO: 598749 - protein, 16 aa, Mycobacterium
TPGKVRGPAPELGADT

SEQ ID NO: 598750 - protein, 4 aa, Mycobacterium
TPGL

SEQ ID NO: 598751 - protein, 12 aa, Mycobacterium
TPGLEADAARQG

SEQ ID NO: 598752 - protein, 12 aa, Mycobacterium
TPGLEADAERQG

SEQ ID NO: 598753 - protein, 11 aa, Mycobacterium
TPGLESPTLAP

SEQ ID NO: 598754 - protein, 6 aa, Mycobacterium
TPGLPG

SEQ ID NO: 598755 - protein, 18 aa, Mycobacterium
TPGLQAQRQQLRAELDRS

SEQ ID NO: 598756 - protein, 13 aa, Mycobacterium
TPGLTSPRPDHYD

SEQ ID NO: 598757 - protein, 8 aa, Mycobacterium
TPGMPTDG

SEQ ID NO: 598758 - protein, 15 aa, Mycobacterium
TPGNATGPSRIGAYQ

SEQ ID NO: 598759 - protein, 7 aa, Mycobacterium
TPGNGQV

SEQ ID NO: 598760 - protein, 9 aa, Mycobacterium
TPGNPREVT

SEQ ID NO: 598761 - protein, 13 aa, Mycobacterium
TPGNSSPLSDGSA

SEQ ID NO: 598762 - protein, 4 aa, Mycobacterium
TPGP

SEQ ID NO: 598763 - protein, 19 aa, Mycobacterium
TPGPAPADTEESAGGGLIG

SEQ ID NO: 598764 - protein, 19 aa, Mycobacterium
TPGPEGVQVNGTRTNYPSL

SEQ ID NO: 598765 - protein, 5 aa, Mycobacterium
TPGPF

SEQ ID NO: 598766 - protein, 7 aa, Mycobacterium
TPGPGAV

SEQ ID NO: 598767 - protein, 8 aa, Mycobacterium
TPGPGTPL

SEQ ID NO: 598768 - protein, 10 aa, Mycobacterium
TPGPPDVASR

SEQ ID NO: 598769 - protein, 9 aa, Mycobacterium
TPGPPIPTT

SEQ ID NO: 598770 - protein, 8 aa, Mycobacterium
TPGPPIRT

SEQ ID NO: 598771 - protein, 6 aa, Mycobacterium
TPGPPV

SEQ ID NO: 598772 - protein, 8 aa, Mycobacterium
TPGPPVPT

SEQ ID NO: 598773 - protein, 9 aa, Mycobacterium
TPGPPVPTR

SEQ ID NO: 598774 - protein, 7 aa, Mycobacterium
TPGPSTY

SEQ ID NO: 598775 - protein, 18 aa, Mycobacterium
TPGPTGHHRSAPPTLGQH

SEQ ID NO: 598776 - protein, 8 aa, Mycobacterium
TPGPTHDK

SEQ ID NO: 598777 - protein, 13 aa, Mycobacterium
TPGPVGPDGLTER

SEQ ID NO: 598778 - protein, 19 aa, Mycobacterium
TPGPVPDAEELKIAKGREL

SEQ ID NO: 598779 - protein, 6 aa, Mycobacterium
TPGQPM

SEQ ID NO: 598780 - protein, 7 aa, Mycobacterium
TPGQQDR

SEQ ID NO: 598781 - protein, 7 aa, Mycobacterium
TPGQTSV

SEQ ID NO: 598782 - protein, 18 aa, Mycobacterium
TPGRARKPGSAPTPPPVP

SEQ ID NO: 598783 - protein, 6 aa, Mycobacterium
TPGRDL

SEQ ID NO: 598784 - protein, 5 aa, Mycobacterium
TPGRG

SEQ ID NO: 598785 - protein, 14 aa, Mycobacterium
TPGRGDATQEQTDV

SEQ ID NO: 598786 - protein, 15 aa, Mycobacterium
TPGRIAGPAPELGAH

SEQ ID NO: 598787 - protein, 17 aa, Mycobacterium
TPGRKESGSASAESARL

SEQ ID NO: 598788 - protein, 7 aa, Mycobacterium
TPGRPLG

SEQ ID NO: 598789 - protein, 5 aa, Mycobacterium
TPGRR

SEQ ID NO: 598790 - protein, 5 aa, Mycobacterium
TPGRT

SEQ ID NO: 598791 - protein, 5 aa, Mycobacterium
TPGRV

SEQ ID NO: 598792 - protein, 14 aa, Mycobacterium
TPGRVAGPAPELGA

SEQ ID NO: 598793 - protein, 17 aa, Mycobacterium
TPGRVSGPAPQLGADTS

SEQ ID NO: 598794 - protein, 6 aa, Mycobacterium
TPGSAE

SEQ ID NO: 598795 - protein, 8 aa, Mycobacterium
TPGSDGST

SEQ ID NO: 598796 - protein, 6 aa, Mycobacterium
TPGSEL

SEQ ID NO: 598797 - protein, 17 aa, Mycobacterium
TPGSGHEAFSGNNTQHT

SEQ ID NO: 598798 - protein, 7 aa, Mycobacterium
TPGSGKT

SEQ ID NO: 598799 - protein, 5 aa, Mycobacterium
TPGSI

SEQ ID NO: 598800 - protein, 6 aa, Mycobacterium
TPGSLA

SEQ ID NO: 598801 - protein, 11 aa, Mycobacterium
TPGSPKDVRAR

SEQ ID NO: 598802 - protein, 8 aa, Mycobacterium
TPGSRDAA

SEQ ID NO: 598803 - protein, 10 aa, Mycobacterium
TPGSRTARED

SEQ ID NO: 598804 - protein, 5 aa, Mycobacterium
TPGSV

SEQ ID NO: 598805 - protein, 12 aa, Mycobacterium
TPGTAAGPPRIG

SEQ ID NO: 598806 - protein, 16 aa, Mycobacterium
TPGTAGKAGLTGLTGP

SEQ ID NO: 598807 - protein, 12 aa, Mycobacterium
TPGTATGPSRIG

SEQ ID NO: 598808 - protein, 5 aa, Mycobacterium
TPGTF

SEQ ID NO: 598809 - protein, 12 aa, Mycobacterium
TPGTGGVRTDQH

SEQ ID NO: 598810 - protein, 15 aa, Mycobacterium
TPGTKRDQMPVTTHN

SEQ ID NO: 598811 - protein, 9 aa, Mycobacterium
TPGTPGAEE

SEQ ID NO: 598812 - protein, 9 aa, Mycobacterium
TPGTPWGPP

SEQ ID NO: 598813 - protein, 6 aa, Mycobacterium
TPGVAP

SEQ ID NO: 598814 - protein, 5 aa, Mycobacterium
TPGVD

SEQ ID NO: 598815 - protein, 16 aa, Mycobacterium
TPGVEPAERAQRPAVA

SEQ ID NO: 598816 - protein, 8 aa, Mycobacterium
TPGVNTED

SEQ ID NO: 598817 - protein, 11 aa, Mycobacterium
TPGVTASPLET

SEQ ID NO: 598818 - protein, 5 aa, Mycobacterium
TPGVY

SEQ ID NO: 598819 - protein, 14 aa, Mycobacterium
TPGYNAGYQALDDM

SEQ ID NO: 598820 - protein, 14 aa, Mycobacterium
TPGYNAGYQVLDDA

SEQ ID NO: 598821 - protein, 15 aa, Mycobacterium
TPHAEKDPDGEYETV

SEQ ID NO: 598822 - protein, 18 aa, Mycobacterium
TPHALSGPRVGVSQAADR

SEQ ID NO: 598823 - protein, 8 aa, Mycobacterium
TPHDDAPA

SEQ ID NO: 598824 - protein, 20 aa, Mycobacterium
TPHEGSGDNCERPYEQTDGK

SEQ ID NO: 598825 - protein, 6 aa, Mycobacterium
TPHEPI

SEQ ID NO: 598826 - protein, 16 aa, Mycobacterium
TPHESDMSSGDEAELE

SEQ ID NO: 598827 - protein, 7 aa, Mycobacterium
TPHETRP

SEQ ID NO: 598828 - protein, 5 aa, Mycobacterium
TPHEV

SEQ ID NO: 598829 - protein, 8 aa, Mycobacterium
TPHGNDYG

SEQ ID NO: 598830 - protein, 18 aa, Mycobacterium
TPHGSGATAVGSADAAPR

SEQ ID NO: 598831 - protein, 4 aa, Mycobacterium
TPHK

SEQ ID NO: 598832 - protein, 4 aa, Mycobacterium
TPHP

SEQ ID NO: 598833 - protein, 15 aa, Mycobacterium
TPHPASAAPISGGTG

SEQ ID NO: 598834 - protein, 6 aa, Mycobacterium
TPHPDG

SEQ ID NO: 598835 - protein, 13 aa, Mycobacterium
TPHPEDDDWGQAG

SEQ ID NO: 598836 - protein, 6 aa, Mycobacterium
TPHPGD

SEQ ID NO: 598837 - protein, 8 aa, Mycobacterium
TPHPHGDP

SEQ ID NO: 598838 - protein, 7 aa, Mycobacterium
TPHPVDG

SEQ ID NO: 598839 - protein, 4 aa, Mycobacterium
TPHR

SEQ ID NO: 598840 - protein, 6 aa, Mycobacterium
TPHRGA

SEQ ID NO: 598841 - protein, 5 aa, Mycobacterium
TPHRP

SEQ ID NO: 598842 - protein, 10 aa, Mycobacterium
TPHRPEGRGK

SEQ ID NO: 598843 - protein, 6 aa, Mycobacterium
TPHRRV

SEQ ID NO: 598844 - protein, 5 aa, Mycobacterium
TPHRT

SEQ ID NO: 598845 - protein, 9 aa, Mycobacterium
TPHSGDDTA

SEQ ID NO: 598846 - protein, 14 aa, Mycobacterium
TPHSMKSADARSAR

SEQ ID NO: 598847 - protein, 17 aa, Mycobacterium
TPHSMKSADTKSACAPH

SEQ ID NO: 598848 - protein, 22 aa, Mycobacterium
TPHSMKSPDTSRSKGARAARSR

SEQ ID NO: 598849 - protein, 9 aa, Mycobacterium
TPHSRPRGT

SEQ ID NO: 598850 - protein, 5 aa, Mycobacterium
TPHTA

SEQ ID NO: 598851 - protein, 5 aa, Mycobacterium
TPHTP

SEQ ID NO: 598852 - protein, 20 aa, Mycobacterium
TPHVSGTTLSAQARYAAGTR

SEQ ID NO: 598853 - protein, 4 aa, Mycobacterium
TPIA

SEQ ID NO: 598854 - protein, 9 aa, Mycobacterium
TPIAGRPTN

SEQ ID NO: 598855 - protein, 8 aa, Mycobacterium
TPIARDQG

SEQ ID NO: 598856 - protein, 11 aa, Mycobacterium
TPIASGAGDAA

SEQ ID NO: 598857 - protein, 5 aa, Mycobacterium
TPIAT

SEQ ID NO: 598858 - protein, 5 aa, Mycobacterium
TPIDT

SEQ ID NO: 598859 - protein, 10 aa, Mycobacterium
TPIDTTKPAE

SEQ ID NO: 598860 - protein, 5 aa, Mycobacterium
TPIEE

SEQ ID NO: 598861 - protein, 21 aa, Mycobacterium
TPIEEPANEPNQAKPEENAEL

SEQ ID NO: 598862 - protein, 8 aa, Mycobacterium
TPIERPAD

SEQ ID NO: 598863 - protein, 11 aa, Mycobacterium
TPIERPEDAED

SEQ ID NO: 598864 - protein, 17 aa, Mycobacterium
TPIESVDTTGINTTDAH

SEQ ID NO: 598865 - protein, 20 aa, Mycobacterium
TPIETDKNTERVTYWCPTCQ

SEQ ID NO: 598866 - protein, 6 aa, Mycobacterium
TPIGET

SEQ ID NO: 598867 - protein, 11 aa, Mycobacterium
TPIGKGKANGA

SEQ ID NO: 598868 - protein, 12 aa, Mycobacterium
TPIGKGKASGAL

SEQ ID NO: 598869 - protein, 12 aa, Mycobacterium
TPIGKGKGNGAL

SEQ ID NO: 598870 - protein, 12 aa, Mycobacterium
TPIGKGKPGGAL

SEQ ID NO: 598871 - protein, 14 aa, Mycobacterium
TPIGLGPDGRPRTA

SEQ ID NO: 598872 - protein, 5 aa, Mycobacterium
TPIGQ

SEQ ID NO: 598873 - protein, 13 aa, Mycobacterium
TPIGRARKGSLTS

SEQ ID NO: 598874 - protein, 8 aa, Mycobacterium
TPIGTAAD

SEQ ID NO: 598875 - protein, 7 aa, Mycobacterium
TPIINPG

SEQ ID NO: 598876 - protein, 6 aa, Mycobacterium
TPIPAS

SEQ ID NO: 598877 - protein, 41 aa, Mycobacterium
TPIPEASEADVAEQQIPVGDADDESWSDAATVNADRGWQAD

SEQ ID NO: 598878 - protein, 7 aa, Mycobacterium
TPIPEPD

SEQ ID NO: 598879 - protein, 8 aa, Mycobacterium
TPIPGESD

SEQ ID NO: 598880 - protein, 8 aa, Mycobacterium
TPIPPEPD

SEQ ID NO: 598881 - protein, 11 aa, Mycobacterium
TPIPPETGEVD

SEQ ID NO: 598882 - protein, 8 aa, Mycobacterium
TPIPPHSQ

SEQ ID NO: 598883 - protein, 12 aa, Mycobacterium
TPIPPPPPGVST

SEQ ID NO: 598884 - protein, 8 aa, Mycobacterium
TPIPPSQD

SEQ ID NO: 598885 - protein, 11 aa, Mycobacterium
TPIPSSSGALG

SEQ ID NO: 598886 - protein, 4 aa, Mycobacterium
TPIR

SEQ ID NO: 598887 - protein, 4 aa, Mycobacterium
TPIT

SEQ ID NO: 598888 - protein, 6 aa, Mycobacterium
TPITAT

SEQ ID NO: 598889 - protein, 5 aa, Mycobacterium
TPITG

SEQ ID NO: 598890 - protein, 8 aa, Mycobacterium
TPITGASG

SEQ ID NO: 598891 - protein, 5 aa, Mycobacterium
TPITT

SEQ ID NO: 598892 - protein, 5 aa, Mycobacterium
TPKAL

SEQ ID NO: 598893 - protein, 5 aa, Mycobacterium
TPKAT

SEQ ID NO: 598894 - protein, 8 aa, Mycobacterium
TPKDEVDH

SEQ ID NO: 598895 - protein, 13 aa, Mycobacterium
TPKDGGQIVVHRR

SEQ ID NO: 598896 - protein, 14 aa, Mycobacterium
TPKDTRSTQADLTT

SEQ ID NO: 598897 - protein, 61 aa, Mycobacterium
TPKEAAAPNTEPEAGSALEKTTPTARATADTQVGAQADAPADPPWSPNPLRPDDPDPTDFP

SEQ ID NO: 598898 - protein, 9 aa, Mycobacterium
TPKETTKDG

SEQ ID NO: 598899 - protein, 6 aa, Mycobacterium
TPKGLP

SEQ ID NO: 598900 - protein, 9 aa, Mycobacterium
TPKKVDGGV

SEQ ID NO: 598901 - protein, 9 aa, Mycobacterium
TPKKVDSGV

SEQ ID NO: 598902 - protein, 5 aa, Mycobacterium
TPKLA

SEQ ID NO: 598903 - protein, 12 aa, Mycobacterium
TPKLDGRAAAAE

SEQ ID NO: 598904 - protein, 27 aa, Mycobacterium
TPKNPPALSYQPANCPDAKPSPPASYC

SEQ ID NO: 598905 - protein, 4 aa, Mycobacterium
TPKP

SEQ ID NO: 598906 - protein, 5 aa, Mycobacterium
TPKPE

SEQ ID NO: 598907 - protein, 18 aa, Mycobacterium
TPKPGLVDTHGNASHPDM

SEQ ID NO: 598908 - protein, 8 aa, Mycobacterium
TPKPHTRP

SEQ ID NO: 598909 - protein, 8 aa, Mycobacterium
TPKPRTPR

SEQ ID NO: 598910 - protein, 11 aa, Mycobacterium
TPKQPVCPPNT

SEQ ID NO: 598911 - protein, 5 aa, Mycobacterium
TPKQR

SEQ ID NO: 598912 - protein, 5 aa, Mycobacterium
TPKRH

SEQ ID NO: 598913 - protein, 5 aa, Mycobacterium
TPKRI

SEQ ID NO: 598914 - protein, 5 aa, Mycobacterium
TPKRL

SEQ ID NO: 598915 - protein, 35 aa, Mycobacterium
TPKRPKPASSHDAGPAAGNKDTDNADKPAARADDA

SEQ ID NO: 598916 - protein, 11 aa, Mycobacterium
TPKSAADLPAA

SEQ ID NO: 598917 - protein, 11 aa, Mycobacterium
TPKSKRSRRTV

SEQ ID NO: 598918 - protein, 4 aa, Mycobacterium
TPKT

SEQ ID NO: 598919 - protein, 5 aa, Mycobacterium
TPKTE

SEQ ID NO: 598920 - protein, 21 aa, Mycobacterium
TPKTPAAADPDAIRRKGRGIA

SEQ ID NO: 598921 - protein, 8 aa, Mycobacterium
TPKVGIGT

SEQ ID NO: 598922 - protein, 5 aa, Mycobacterium
TPKYP

SEQ ID NO: 598923 - protein, 11 aa, Mycobacterium
TPLAAAGADES

SEQ ID NO: 598924 - protein, 11 aa, Mycobacterium
TPLAEKGARLA

SEQ ID NO: 598925 - protein, 14 aa, Mycobacterium
TPLAPAKEGDADIR

SEQ ID NO: 598926 - protein, 14 aa, Mycobacterium
TPLAPEKEGDADIR

SEQ ID NO: 598927 - protein, 8 aa, Mycobacterium
TPLDAPAL

SEQ ID NO: 598928 - protein, 5 aa, Mycobacterium
TPLDG

SEQ ID NO: 598929 - protein, 5 aa, Mycobacterium
TPLDL

SEQ ID NO: 598930 - protein, 6 aa, Mycobacterium
TPLDPA

SEQ ID NO: 598931 - protein, 7 aa, Mycobacterium
TPLDPGR

SEQ ID NO: 598932 - protein, 14 aa, Mycobacterium
TPLDPIPASRFPPA

SEQ ID NO: 598933 - protein, 9 aa, Mycobacterium
TPLDSTNTL

SEQ ID NO: 598934 - protein, 4 aa, Mycobacterium
TPLE

SEQ ID NO: 598935 - protein, 12 aa, Mycobacterium
TPLEDTGYRAPA

SEQ ID NO: 598936 - protein, 5 aa, Mycobacterium
TPLEL

SEQ ID NO: 598937 - protein, 11 aa, Mycobacterium
TPLESGPGGFR

SEQ ID NO: 598938 - protein, 13 aa, Mycobacterium
TPLETPRANPPSY

SEQ ID NO: 598939 - protein, 5 aa, Mycobacterium
TPLGA

SEQ ID NO: 598940 - protein, 6 aa, Mycobacterium
TPLGAT

SEQ ID NO: 598941 - protein, 6 aa, Mycobacterium
TPLGPL

SEQ ID NO: 598942 - protein, 12 aa, Mycobacterium
TPLGPLSRSRAL

SEQ ID NO: 598943 - protein, 12 aa, Mycobacterium
TPLGPPAGWPQS

SEQ ID NO: 598944 - protein, 14 aa, Mycobacterium
TPLGPTSEWPQSLQ

SEQ ID NO: 598945 - protein, 10 aa, Mycobacterium
TPLGQRPPGM

SEQ ID NO: 598946 - protein, 12 aa, Mycobacterium
TPLGRNSEPDEQ

SEQ ID NO: 598947 - protein, 12 aa, Mycobacterium
TPLGSPTPDPKP

SEQ ID NO: 598948 - protein, 21 aa, Mycobacterium
TPLLSGGNGARGMTEEGESAV

SEQ ID NO: 598949 - protein, 5 aa, Mycobacterium
TPLNG

SEQ ID NO: 598950 - protein, 4 aa, Mycobacterium
TPLP

SEQ ID NO: 598951 - protein, 5 aa, Mycobacterium
TPLPA

SEQ ID NO: 598952 - protein, 5 aa, Mycobacterium
TPLPE

SEQ ID NO: 598953 - protein, 5 aa, Mycobacterium
TPLPG

SEQ ID NO: 598954 - protein, 10 aa, Mycobacterium
TPLPGEPGGQ

SEQ ID NO: 598955 - protein, 7 aa, Mycobacterium
TPLPGGR

SEQ ID NO: 598956 - protein, 33 aa, Mycobacterium
TPLPKSVAQQGDTSDTDFEDFGKGGEEGTGPAP

SEQ ID NO: 598957 - protein, 5 aa, Mycobacterium
TPLPL

SEQ ID NO: 598958 - protein, 8 aa, Mycobacterium
TPLPPKGQ

SEQ ID NO: 598959 - protein, 12 aa, Mycobacterium
TPLPPSDYGVDP

SEQ ID NO: 598960 - protein, 8 aa, Mycobacterium
TPLPPTGQ

SEQ ID NO: 598961 - protein, 6 aa, Mycobacterium
TPLPTP

SEQ ID NO: 598962 - protein, 9 aa, Mycobacterium
TPLPTPAGW

SEQ ID NO: 598963 - protein, 10 aa, Mycobacterium
TPLPTPSGWT

SEQ ID NO: 598964 - protein, 9 aa, Mycobacterium
TPLPTPTGW

SEQ ID NO: 598965 - protein, 6 aa, Mycobacterium
TPLRQP

SEQ ID NO: 598966 - protein, 5 aa, Mycobacterium
TPLRS

SEQ ID NO: 598967 - protein, 6 aa, Mycobacterium
TPLRSE

SEQ ID NO: 598968 - protein, 8 aa, Mycobacterium
TPLRSGDQ

SEQ ID NO: 598969 - protein, 5 aa, Mycobacterium
TPLRT

SEQ ID NO: 598970 - protein, 9 aa, Mycobacterium
TPLSEEQRR

SEQ ID NO: 598971 - protein, 6 aa, Mycobacterium
TPLSEG

SEQ ID NO: 598972 - protein, 9 aa, Mycobacterium
TPLSTDPAE

SEQ ID NO: 598973 - protein, 13 aa, Mycobacterium
TPLTADGDVDTAS

SEQ ID NO: 598974 - protein, 5 aa, Mycobacterium
TPLTE

SEQ ID NO: 598975 - protein, 6 aa, Mycobacterium
TPLTED

SEQ ID NO: 598976 - protein, 16 aa, Mycobacterium
TPLTGQGSQDGTPRSV

SEQ ID NO: 598977 - protein, 16 aa, Mycobacterium
TPLTPAAPIVSRLVAR

SEQ ID NO: 598978 - protein, 8 aa, Mycobacterium
TPLTPGPG

SEQ ID NO: 598979 - protein, 9 aa, Mycobacterium
TPLTPGSPV

SEQ ID NO: 598980 - protein, 8 aa, Mycobacterium
TPLTSPAE

SEQ ID NO: 598981 - protein, 4 aa, Mycobacterium
TPLY

SEQ ID NO: 598982 - protein, 5 aa, Mycobacterium
TPMAE

SEQ ID NO: 598983 - protein, 6 aa, Mycobacterium
TPMDEA

SEQ ID NO: 598984 - protein, 6 aa, Mycobacterium
TPMDQA

SEQ ID NO: 598985 - protein, 4 aa, Mycobacterium
TPMG

SEQ ID NO: 598986 - protein, 8 aa, Mycobacterium
TPMGPDDP

SEQ ID NO: 598987 - protein, 10 aa, Mycobacterium
TPMHDPSSYD

SEQ ID NO: 598988 - protein, 4 aa, Mycobacterium
TPMP

SEQ ID NO: 598989 - protein, 8 aa, Mycobacterium
TPMPGAAT

SEQ ID NO: 598990 - protein, 12 aa, Mycobacterium
TPMPGSAAASVN

SEQ ID NO: 598991 - protein, 8 aa, Mycobacterium
TPMPPKGQ

SEQ ID NO: 598992 - protein, 5 aa, Mycobacterium
TPNAA

SEQ ID NO: 598993 - protein, 11 aa, Mycobacterium
TPNAAEPGTAG

SEQ ID NO: 598994 - protein, 5 aa, Mycobacterium
TPNAQ

SEQ ID NO: 598995 - protein, 28 aa, Mycobacterium
TPNATSGGAVTAAAAGAAGAASGSETVS

SEQ ID NO: 598996 - protein, 4 aa, Mycobacterium
TPND

SEQ ID NO: 598997 - protein, 9 aa, Mycobacterium
TPNDLPPGD

SEQ ID NO: 598998 - protein, 5 aa, Mycobacterium
TPNDR

SEQ ID NO: 598999 - protein, 18 aa, Mycobacterium
TPNFSNGYSGRIDPLPYL

SEQ ID NO: 599000 - protein, 11 aa, Mycobacterium
TPNGANAIPSE

SEQ ID NO: 599001 - protein, 8 aa, Mycobacterium
TPNGDYAA

SEQ ID NO: 599002 - protein, 5 aa, Mycobacterium
TPNGL

SEQ ID NO: 599003 - protein, 7 aa, Mycobacterium
TPNGNDY

SEQ ID NO: 599004 - protein, 7 aa, Mycobacterium
TPNGPGE

SEQ ID NO: 599005 - protein, 16 aa, Mycobacterium
TPNGRVGYGPVTPDQV

SEQ ID NO: 599006 - protein, 14 aa, Mycobacterium
TPNGVREPQQAGDL

SEQ ID NO: 599007 - protein, 14 aa, Mycobacterium
TPNITQSGVTPGIN

SEQ ID NO: 599008 - protein, 5 aa, Mycobacterium
TPNKI

SEQ ID NO: 599009 - protein, 7 aa, Mycobacterium
TPNKPDY

SEQ ID NO: 599010 - protein, 11 aa, Mycobacterium
TPNKSSSRRIE

SEQ ID NO: 599011 - protein, 4 aa, Mycobacterium
TPNL

SEQ ID NO: 599012 - protein, 5 aa, Mycobacterium
TPNLG

SEQ ID NO: 599013 - protein, 7 aa, Mycobacterium
TPNLSST

SEQ ID NO: 599014 - protein, 9 aa, Mycobacterium
TPNMQTRRR

SEQ ID NO: 599015 - protein, 4 aa, Mycobacterium
TPNP

SEQ ID NO: 599016 - protein, 6 aa, Mycobacterium
TPNPAA

SEQ ID NO: 599017 - protein, 9 aa, Mycobacterium
TPNPDPAAV

SEQ ID NO: 599018 - protein, 30 aa, Mycobacterium
TPNPESVADGEFSSEAECASESAAAQRSAE

SEQ ID NO: 599019 - protein, 10 aa, Mycobacterium
TPNPKDHEIT

SEQ ID NO: 599020 - protein, 11 aa, Mycobacterium
TPNPKSGGSRL

SEQ ID NO: 599021 - protein, 6 aa, Mycobacterium
TPNPLA

SEQ ID NO: 599022 - protein, 4 aa, Mycobacterium
TPNR

SEQ ID NO: 599023 - protein, 9 aa, Mycobacterium
TPNREEYSD

SEQ ID NO: 599024 - protein, 6 aa, Mycobacterium
TPNRLT

SEQ ID NO: 599025 - protein, 13 aa, Mycobacterium
TPNRRSQQKSDRR

SEQ ID NO: 599026 - protein, 4 aa, Mycobacterium
TPNS

SEQ ID NO: 599027 - protein, 7 aa, Mycobacterium
TPNSDPS

SEQ ID NO: 599028 - protein, 9 aa, Mycobacterium
TPNSTVGTP

SEQ ID NO: 599029 - protein, 5 aa, Mycobacterium
TPNTG

SEQ ID NO: 599030 - protein, 6 aa, Mycobacterium
TPNTPD

SEQ ID NO: 599031 - protein, 4 aa, Mycobacterium
TPNV

SEQ ID NO: 599032 - protein, 12 aa, Mycobacterium
TPPAAAPDDDTV

SEQ ID NO: 599033 - protein, 7 aa, Mycobacterium
TPPAANA

SEQ ID NO: 599034 - protein, 8 aa, Mycobacterium
TPPAAPAI

SEQ ID NO: 599035 - protein, 7 aa, Mycobacterium
TPPAAPN

SEQ ID NO: 599036 - protein, 9 aa, Mycobacterium
TPPADAPRD

SEQ ID NO: 599037 - protein, 7 aa, Mycobacterium
TPPAELG

SEQ ID NO: 599038 - protein, 7 aa, Mycobacterium
TPPAELS

SEQ ID NO: 599039 - protein, 12 aa, Mycobacterium
TPPAELVESGGT

SEQ ID NO: 599040 - protein, 6 aa, Mycobacterium
TPPAEP

SEQ ID NO: 599041 - protein, 15 aa, Mycobacterium
TPPAGAGGLGQVGLF

SEQ ID NO: 599042 - protein, 12 aa, Mycobacterium
TPPAGANQPGLF

SEQ ID NO: 599043 - protein, 7 aa, Mycobacterium
TPPAGGQ

SEQ ID NO: 599044 - protein, 8 aa, Mycobacterium
TPPAGRGG

SEQ ID NO: 599045 - protein, 19 aa, Mycobacterium
TPPAGVGPWPGEPPDDPRY

SEQ ID NO: 599046 - protein, 8 aa, Mycobacterium
TPPAGWRD

SEQ ID NO: 599047 - protein, 34 aa, Mycobacterium
TPPAHERPHHPAGKRAAKAARQAQGRHKKTDDTE

SEQ ID NO: 599048 - protein, 8 aa, Mycobacterium
TPPAHSST

SEQ ID NO: 599049 - protein, 7 aa, Mycobacterium
TPPAITP

SEQ ID NO: 599050 - protein, 6 aa, Mycobacterium
TPPAKQ

SEQ ID NO: 599051 - protein, 21 aa, Mycobacterium
TPPALPAAGPEDTYANAGQFS

SEQ ID NO: 599052 - protein, 10 aa, Mycobacterium
TPPANREQEN

SEQ ID NO: 599053 - protein, 5 aa, Mycobacterium
TPPAP

SEQ ID NO: 599054 - protein, 8 aa, Mycobacterium
TPPAPGIP

SEQ ID NO: 599055 - protein, 30 aa, Mycobacterium
TPPAPGVPGGAAAVPAGAVTPPAPGVPGAP

SEQ ID NO: 599056 - protein, 9 aa, Mycobacterium
TPPAPPGTH

SEQ ID NO: 599057 - protein, 16 aa, Mycobacterium
TPPATVRGVPQKPLDG

SEQ ID NO: 599058 - protein, 7 aa, Mycobacterium
TPPAVTP

SEQ ID NO: 599059 - protein, 4 aa, Mycobacterium
TPPD

SEQ ID NO: 599060 - protein, 5 aa, Mycobacterium
TPPDD

SEQ ID NO: 599061 - protein, 8 aa, Mycobacterium
TPPDDAPA

SEQ ID NO: 599062 - protein, 8 aa, Mycobacterium
TPPDDPGW

SEQ ID NO: 599063 - protein, 9 aa, Mycobacterium
TPPDPDPRM

SEQ ID NO: 599064 - protein, 17 aa, Mycobacterium
TPPDSCDATAESTWEPA

SEQ ID NO: 599065 - protein, 15 aa, Mycobacterium
TPPDSGVPLAPASGR

SEQ ID NO: 599066 - protein, 8 aa, Mycobacterium
TPPDTPWP

SEQ ID NO: 599067 - protein, 16 aa, Mycobacterium
TPPDTVKGITQKPLDG

SEQ ID NO: 599068 - protein, 8 aa, Mycobacterium
TPPDTVRG

SEQ ID NO: 599069 - protein, 15 aa, Mycobacterium
TPPDYPAYSENDWTG

SEQ ID NO: 599070 - protein, 9 aa, Mycobacterium
TPPDYPPYA

SEQ ID NO: 599071 - protein, 9 aa, Mycobacterium
TPPDYRPYA

SEQ ID NO: 599072 - protein, 10 aa, Mycobacterium
TPPEAADAAQ

SEQ ID NO: 599073 - protein, 31 aa, Mycobacterium
TPPELTPPAYGGQVSTPTDWTGTAAERAGTV

SEQ ID NO: 599074 - protein, 15 aa, Mycobacterium
TPPENRTQIAKATSA

SEQ ID NO: 599075 - protein, 9 aa, Mycobacterium
TPPEPAGKP

SEQ ID NO: 599076 - protein, 8 aa, Mycobacterium
TPPEPDAR

SEQ ID NO: 599077 - protein, 8 aa, Mycobacterium
TPPEPKQI

SEQ ID NO: 599078 - protein, 7 aa, Mycobacterium
TPPEQGP

SEQ ID NO: 599079 - protein, 7 aa, Mycobacterium
TPPERIR

SEQ ID NO: 599080 - protein, 7 aa, Mycobacterium
TPPESGP

SEQ ID NO: 599081 - protein, 8 aa, Mycobacterium
TPPEVPDL

SEQ ID NO: 599082 - protein, 15 aa, Mycobacterium
TPPFGGPLAASKAAI

SEQ ID NO: 599083 - protein, 6 aa, Mycobacterium
TPPGAA

SEQ ID NO: 599084 - protein, 7 aa, Mycobacterium
TPPGDIG

SEQ ID NO: 599085 - protein, 5 aa, Mycobacterium
TPPGE

SEQ ID NO: 599086 - protein, 6 aa, Mycobacterium
TPPGEI

SEQ ID NO: 599087 - protein, 12 aa, Mycobacterium
TPPGGPFGPRPG

SEQ ID NO: 599088 - protein, 20 aa, Mycobacterium
TPPGGTPPFQRGGMGDHSAG

SEQ ID NO: 599089 - protein, 22 aa, Mycobacterium
TPPGTVGAVDGRGGAPGTRETD

SEQ ID NO: 599090 - protein, 22 aa, Mycobacterium
TPPGTVGAVDSRGGAPGSRETD

SEQ ID NO: 599091 - protein, 4 aa, Mycobacterium
TPPH

SEQ ID NO: 599092 - protein, 5 aa, Mycobacterium
TPPHD

SEQ ID NO: 599093 - protein, 10 aa, Mycobacterium
TPPHTELGPG

SEQ ID NO: 599094 - protein, 5 aa, Mycobacterium
TPPIA

SEQ ID NO: 599095 - protein, 15 aa, Mycobacterium
TPPIDDAPPPTPRRP

SEQ ID NO: 599096 - protein, 6 aa, Mycobacterium
TPPIGP

SEQ ID NO: 599097 - protein, 7 aa, Mycobacterium
TPPIPDT

SEQ ID NO: 599098 - protein, 7 aa, Mycobacterium
TPPKPLE

SEQ ID NO: 599099 - protein, 7 aa, Mycobacterium
TPPLARP

SEQ ID NO: 599100 - protein, 13 aa, Mycobacterium
TPPLDPTSRGQTA

SEQ ID NO: 599101 - protein, 17 aa, Mycobacterium
TPPLGGHHAEAQMEWID

SEQ ID NO: 599102 - protein, 8 aa, Mycobacterium
TPPLGNHP

SEQ ID NO: 599103 - protein, 5 aa, Mycobacterium
TPPLN

SEQ ID NO: 599104 - protein, 7 aa, Mycobacterium
TPPLPAQ

SEQ ID NO: 599105 - protein, 5 aa, Mycobacterium
TPPLR

SEQ ID NO: 599106 - protein, 5 aa, Mycobacterium
TPPLT

SEQ ID NO: 599107 - protein, 6 aa, Mycobacterium
TPPMEL

SEQ ID NO: 599108 - protein, 7 aa, Mycobacterium
TPPMPGR

SEQ ID NO: 599109 - protein, 38 aa, Mycobacterium
TPPPAATPDTTEAARAAATLATGPTVKPAALGGAAGAA

SEQ ID NO: 599110 - protein, 39 aa, Mycobacterium
TPPPAATPDTTEAARAAATLATGPTVKPAALGGGAGAAI

SEQ ID NO: 599111 - protein, 6 aa, Mycobacterium
TPPPAE

SEQ ID NO: 599112 - protein, 13 aa, Mycobacterium
TPPPARNREDSIS

SEQ ID NO: 599113 - protein, 22 aa, Mycobacterium
TPPPDTGWSPVNAGSTTFSASK

SEQ ID NO: 599114 - protein, 8 aa, Mycobacterium
TPPPGGGA

SEQ ID NO: 599115 - protein, 8 aa, Mycobacterium
TPPPLPEV

SEQ ID NO: 599116 - protein, 14 aa, Mycobacterium
TPPPNPLDTGSAGD

SEQ ID NO: 599117 - protein, 5 aa, Mycobacterium
TPPPP

SEQ ID NO: 599118 - protein, 7 aa, Mycobacterium
TPPPQAL

SEQ ID NO: 599119 - protein, 13 aa, Mycobacterium
TPPPQLLGQTGLF

SEQ ID NO: 599120 - protein, 7 aa, Mycobacterium
TPPPQPE

SEQ ID NO: 599121 - protein, 18 aa, Mycobacterium
TPPPRPAAPTTDPGDTPT

SEQ ID NO: 599122 - protein, 6 aa, Mycobacterium
TPPPTW

SEQ ID NO: 599123 - protein, 8 aa, Mycobacterium
TPPQGTGP

SEQ ID NO: 599124 - protein, 5 aa, Mycobacterium
TPPQL

SEQ ID NO: 599125 - protein, 14 aa, Mycobacterium
TPPQLVPRSTAGLP

SEQ ID NO: 599126 - protein, 6 aa, Mycobacterium
TPPQPE

SEQ ID NO: 599127 - protein, 6 aa, Mycobacterium
TPPQTG

SEQ ID NO: 599128 - protein, 8 aa, Mycobacterium
TPPQTVKG

SEQ ID NO: 599129 - protein, 9 aa, Mycobacterium
TPPRARKPQ

SEQ ID NO: 599130 - protein, 10 aa, Mycobacterium
TPPRARKPQR

SEQ ID NO: 599131 - protein, 5 aa, Mycobacterium
TPPRQ

SEQ ID NO: 599132 - protein, 9 aa, Mycobacterium
TPPRSRQED

SEQ ID NO: 599133 - protein, 10 aa, Mycobacterium
TPPSARRKPI

SEQ ID NO: 599134 - protein, 10 aa, Mycobacterium
TPPSGEHGAH

SEQ ID NO: 599135 - protein, 6 aa, Mycobacterium
TPPSHT

SEQ ID NO: 599136 - protein, 7 aa, Mycobacterium
TPPSPSD

SEQ ID NO: 599137 - protein, 8 aa, Mycobacterium
TPPSPTAG

SEQ ID NO: 599138 - protein, 20 aa, Mycobacterium
TPPSQRCGDAGADAARPARY

SEQ ID NO: 599139 - protein, 6 aa, Mycobacterium
TPPSRE

SEQ ID NO: 599140 - protein, 8 aa, Mycobacterium
TPPSVASG

SEQ ID NO: 599141 - protein, 13 aa, Mycobacterium
TPPTAPPGTPGEW

SEQ ID NO: 599142 - protein, 6 aa, Mycobacterium
TPPTEA

SEQ ID NO: 599143 - protein, 13 aa, Mycobacterium
TPPTELGPADWEP

SEQ ID NO: 599144 - protein, 7 aa, Mycobacterium
TPPTGRV

SEQ ID NO: 599145 - protein, 7 aa, Mycobacterium
TPPTHVE

SEQ ID NO: 599146 - protein, 7 aa, Mycobacterium
TPPTPEV

SEQ ID NO: 599147 - protein, 12 aa, Mycobacterium
TPPTPPEGTPGE

SEQ ID NO: 599148 - protein, 13 aa, Mycobacterium
TPPTPPPGTPGEY

SEQ ID NO: 599149 - protein, 6 aa, Mycobacterium
TPPTRD

SEQ ID NO: 599150 - protein, 8 aa, Mycobacterium
TPPTVTPD

SEQ ID NO: 599151 - protein, 6 aa, Mycobacterium
TPPVAR

SEQ ID NO: 599152 - protein, 24 aa, Mycobacterium
TPPVDAPPPAAPAPMTTGGATSVA

SEQ ID NO: 599153 - protein, 6 aa, Mycobacterium
TPPVGF

SEQ ID NO: 599154 - protein, 6 aa, Mycobacterium
TPPVGG

SEQ ID NO: 599155 - protein, 17 aa, Mycobacterium
TPPVGGHHAEAQMAWID

SEQ ID NO: 599156 - protein, 6 aa, Mycobacterium
TPPVKP

SEQ ID NO: 599157 - protein, 17 aa, Mycobacterium
TPPVQSAPMSASGLSAD

SEQ ID NO: 599158 - protein, 14 aa, Mycobacterium
TPPVTSAVGSARTA

SEQ ID NO: 599159 - protein, 4 aa, Mycobacterium
TPPY

SEQ ID NO: 599160 - protein, 10 aa, Mycobacterium
TPQAAKNGTD

SEQ ID NO: 599161 - protein, 9 aa, Mycobacterium
TPQAEGGAF

SEQ ID NO: 599162 - protein, 28 aa, Mycobacterium
TPQAGANLTRASENYSKALAKADAAGVP

SEQ ID NO: 599163 - protein, 10 aa, Mycobacterium
TPQAGDGAKK

SEQ ID NO: 599164 - protein, 5 aa, Mycobacterium
TPQAL

SEQ ID NO: 599165 - protein, 20 aa, Mycobacterium
TPQAPAATPGQVRNAAGGYT

SEQ ID NO: 599166 - protein, 11 aa, Mycobacterium
TPQARTNGSVT

SEQ ID NO: 599167 - protein, 4 aa, Mycobacterium
TPQD

SEQ ID NO: 599168 - protein, 5 aa, Mycobacterium
TPQDF

SEQ ID NO: 599169 - protein, 11 aa, Mycobacterium
TPQDGRGSRYT

SEQ ID NO: 599170 - protein, 7 aa, Mycobacterium
TPQDPGQ

SEQ ID NO: 599171 - protein, 14 aa, Mycobacterium
TPQDSPFNARGARN

SEQ ID NO: 599172 - protein, 4 aa, Mycobacterium
TPQE

SEQ ID NO: 599173 - protein, 16 aa, Mycobacterium
TPQEGRSLGVDPQTGH

SEQ ID NO: 599174 - protein, 6 aa, Mycobacterium
TPQERA

SEQ ID NO: 599175 - protein, 8 aa, Mycobacterium
TPQERINR

SEQ ID NO: 599176 - protein, 9 aa, Mycobacterium
TPQEVTADS

SEQ ID NO: 599177 - protein, 4 aa, Mycobacterium
TPQF

SEQ ID NO: 599178 - protein, 12 aa, Mycobacterium
TPQGAADPDDAS

SEQ ID NO: 599179 - protein, 16 aa, Mycobacterium
TPQGAEAIARLIAREA

SEQ ID NO: 599180 - protein, 13 aa, Mycobacterium
TPQGASKAQVAGA

SEQ ID NO: 599181 - protein, 23 aa, Mycobacterium
TPQGDTLATVGKGAEVAVTGDPG

SEQ ID NO: 599182 - protein, 8 aa, Mycobacterium
TPQGKRTL

SEQ ID NO: 599183 - protein, 5 aa, Mycobacterium
TPQGR

SEQ ID NO: 599184 - protein, 4 aa, Mycobacterium
TPQH

SEQ ID NO: 599185 - protein, 22 aa, Mycobacterium
TPQHQGDHHAPAGHRGQQTGLV

SEQ ID NO: 599186 - protein, 15 aa, Mycobacterium
TPQHRSQVPPEESTQ

SEQ ID NO: 599187 - protein, 7 aa, Mycobacterium
TPQHTAQ

SEQ ID NO: 599188 - protein, 4 aa, Mycobacterium
TPQI

SEQ ID NO: 599189 - protein, 10 aa, Mycobacterium
TPQKADGSID

SEQ ID NO: 599190 - protein, 9 aa, Mycobacterium
TPQKKGDYG

SEQ ID NO: 599191 - protein, 9 aa, Mycobacterium
TPQKQRSED

SEQ ID NO: 599192 - protein, 8 aa, Mycobacterium
TPQKQTTT

SEQ ID NO: 599193 - protein, 10 aa, Mycobacterium
TPQKRGEYGA

SEQ ID NO: 599194 - protein, 6 aa, Mycobacterium
TPQLDT

SEQ ID NO: 599195 - protein, 5 aa, Mycobacterium
TPQLT

SEQ ID NO: 599196 - protein, 9 aa, Mycobacterium
TPQLTAPAA

SEQ ID NO: 599197 - protein, 8 aa, Mycobacterium
TPQPAMPG

SEQ ID NO: 599198 - protein, 9 aa, Mycobacterium
TPQPAMPGQ

SEQ ID NO: 599199 - protein, 10 aa, Mycobacterium
TPQPATPQAV

SEQ ID NO: 599200 - protein, 14 aa, Mycobacterium
TPQPMPAPKAGAQM

SEQ ID NO: 599201 - protein, 10 aa, Mycobacterium
TPQPNGQATV

SEQ ID NO: 599202 - protein, 7 aa, Mycobacterium
TPQPQLE

SEQ ID NO: 599203 - protein, 10 aa, Mycobacterium
TPQPSPGPGE

SEQ ID NO: 599204 - protein, 5 aa, Mycobacterium
TPQQA

SEQ ID NO: 599205 - protein, 22 aa, Mycobacterium
TPQQAAAEVAERAGAIATQTRQ

SEQ ID NO: 599206 - protein, 7 aa, Mycobacterium
TPQQAKE

SEQ ID NO: 599207 - protein, 5 aa, Mycobacterium
TPQQE

SEQ ID NO: 599208 - protein, 11 aa, Mycobacterium
TPQQPAPGRDL

SEQ ID NO: 599209 - protein, 14 aa, Mycobacterium
TPQQPARPTPQPAR

SEQ ID NO: 599210 - protein, 12 aa, Mycobacterium
TPQQPGAGPDLR

SEQ ID NO: 599211 - protein, 5 aa, Mycobacterium
TPQQR

SEQ ID NO: 599212 - protein, 7 aa, Mycobacterium
TPQQREH

SEQ ID NO: 599213 - protein, 8 aa, Mycobacterium
TPQQRKEG

SEQ ID NO: 599214 - protein, 4 aa, Mycobacterium
TPQR

SEQ ID NO: 599215 - protein, 6 aa, Mycobacterium
TPQRLA

SEQ ID NO: 599216 - protein, 9 aa, Mycobacterium
TPQRPDGSI

SEQ ID NO: 599217 - protein, 7 aa, Mycobacterium
TPQRSTQ

SEQ ID NO: 599218 - protein, 9 aa, Mycobacterium
TPQRTDRTV

SEQ ID NO: 599219 - protein, 8 aa, Mycobacterium
TPQSDGAA

SEQ ID NO: 599220 - protein, 9 aa, Mycobacterium
TPQSEAGKR

SEQ ID NO: 599221 - protein, 11 aa, Mycobacterium
TPQSEPGYEDE

SEQ ID NO: 599222 - protein, 5 aa, Mycobacterium
TPQSM

SEQ ID NO: 599223 - protein, 9 aa, Mycobacterium
TPQSRRELA

SEQ ID NO: 599224 - protein, 6 aa, Mycobacterium
TPQTAK

SEQ ID NO: 599225 - protein, 5 aa, Mycobacterium
TPQTH

SEQ ID NO: 599226 - protein, 6 aa, Mycobacterium
TPQTHT

SEQ ID NO: 599227 - protein, 6 aa, Mycobacterium
TPQTRE

SEQ ID NO: 599228 - protein, 4 aa, Mycobacterium
TPQV

SEQ ID NO: 599229 - protein, 8 aa, Mycobacterium
TPQVETDS

SEQ ID NO: 599230 - protein, 5 aa, Mycobacterium
TPQVS

SEQ ID NO: 599231 - protein, 4 aa, Mycobacterium
TPQY

SEQ ID NO: 599232 - protein, 6 aa, Mycobacterium
TPQYDE

SEQ ID NO: 599233 - protein, 5 aa, Mycobacterium
TPQYR

SEQ ID NO: 599234 - protein, 9 aa, Mycobacterium
TPRADRPAA

SEQ ID NO: 599235 - protein, 9 aa, Mycobacterium
TPRADTADW

SEQ ID NO: 599236 - protein, 7 aa, Mycobacterium
TPRAEEA

SEQ ID NO: 599237 - protein, 5 aa, Mycobacterium
TPRAG

SEQ ID NO: 599238 - protein, 9 aa, Mycobacterium
TPRAIQSQR

SEQ ID NO: 599239 - protein, 10 aa, Mycobacterium
TPRAIQSQRE

SEQ ID NO: 599240 - protein, 11 aa, Mycobacterium
TPRATAKMDQT

SEQ ID NO: 599241 - protein, 9 aa, Mycobacterium
TPRATGRLN

SEQ ID NO: 599242 - protein, 5 aa, Mycobacterium
TPRAV

SEQ ID NO: 599243 - protein, 11 aa, Mycobacterium
TPRAVQAQRDT

SEQ ID NO: 599244 - protein, 11 aa, Mycobacterium
TPRDAADERTS

SEQ ID NO: 599245 - protein, 9 aa, Mycobacterium
TPRDASEVR

SEQ ID NO: 599246 - protein, 5 aa, Mycobacterium
TPRDG

SEQ ID NO: 599247 - protein, 9 aa, Mycobacterium
TPRDGGGYG

SEQ ID NO: 599248 - protein, 13 aa, Mycobacterium
TPRDGVPDVSSSR

SEQ ID NO: 599249 - protein, 25 aa, Mycobacterium
TPRDQATAGALRAKAADVDTSIRPR

SEQ ID NO: 599250 - protein, 9 aa, Mycobacterium
TPRDQGGLG

SEQ ID NO: 599251 - protein, 10 aa, Mycobacterium
TPRDRGGYGM

SEQ ID NO: 599252 - protein, 7 aa, Mycobacterium
TPRDSAR

SEQ ID NO: 599253 - protein, 11 aa, Mycobacterium
TPRDSRKATDN

SEQ ID NO: 599254 - protein, 11 aa, Mycobacterium
TPRDSRNATDN

SEQ ID NO: 599255 - protein, 12 aa, Mycobacterium
TPRDSRSGSDNF

SEQ ID NO: 599256 - protein, 11 aa, Mycobacterium
TPRDSRTASDN

SEQ ID NO: 599257 - protein, 11 aa, Mycobacterium
TPRDTRRTSDN

SEQ ID NO: 599258 - protein, 5 aa, Mycobacterium
TPRDV

SEQ ID NO: 599259 - protein, 16 aa, Mycobacterium
TPREDLPAAAEYARDK

SEQ ID NO: 599260 - protein, 5 aa, Mycobacterium
TPREE

SEQ ID NO: 599261 - protein, 5 aa, Mycobacterium
TPREN

SEQ ID NO: 599262 - protein, 12 aa, Mycobacterium
TPREPGNDHRRA

SEQ ID NO: 599263 - protein, 5 aa, Mycobacterium
TPREQ

SEQ ID NO: 599264 - protein, 8 aa, Mycobacterium
TPRFAQRK

SEQ ID NO: 599265 - protein, 9 aa, Mycobacterium
TPRFSAEGQ

SEQ ID NO: 599266 - protein, 4 aa, Mycobacterium
TPRG

SEQ ID NO: 599267 - protein, 5 aa, Mycobacterium
TPRGG

SEQ ID NO: 599268 - protein, 13 aa, Mycobacterium
TPRGGDPQSGTGS

SEQ ID NO: 599269 - protein, 12 aa, Mycobacterium
TPRGKQKNGSLH

SEQ ID NO: 599270 - protein, 13 aa, Mycobacterium
TPRGKQKNGSLNE

SEQ ID NO: 599271 - protein, 11 aa, Mycobacterium
TPRGKQRGGAL

SEQ ID NO: 599272 - protein, 9 aa, Mycobacterium
TPRGLDPSH

SEQ ID NO: 599273 - protein, 8 aa, Mycobacterium
TPRGLEPS

SEQ ID NO: 599274 - protein, 10 aa, Mycobacterium
TPRGLNPDSL

SEQ ID NO: 599275 - protein, 6 aa, Mycobacterium
TPRGRG

SEQ ID NO: 599276 - protein, 10 aa, Mycobacterium
TPRGTAGSTY

SEQ ID NO: 599277 - protein, 4 aa, Mycobacterium
TPRH

SEQ ID NO: 599278 - protein, 5 aa, Mycobacterium
TPRHE

SEQ ID NO: 599279 - protein, 11 aa, Mycobacterium
TPRHGNTRVND

SEQ ID NO: 599280 - protein, 8 aa, Mycobacterium
TPRKHGYD

SEQ ID NO: 599281 - protein, 13 aa, Mycobacterium
TPRKSAARLPSAG

SEQ ID NO: 599282 - protein, 6 aa, Mycobacterium
TPRLNA

SEQ ID NO: 599283 - protein, 47 aa, Mycobacterium
TPRLPAEPREDAGRRHPRRRAPEPARHERQMPATGRDCGRRPARAGF

SEQ ID NO: 599284 - protein, 5 aa, Mycobacterium
TPRLV

SEQ ID NO: 599285 - protein, 5 aa, Mycobacterium
TPRNT

SEQ ID NO: 599286 - protein, 6 aa, Mycobacterium
TPRPAD

SEQ ID NO: 599287 - protein, 7 aa, Mycobacterium
TPRPADS

SEQ ID NO: 599288 - protein, 9 aa, Mycobacterium
TPRPAPKVA

SEQ ID NO: 599289 - protein, 5 aa, Mycobacterium
TPRPD

SEQ ID NO: 599290 - protein, 6 aa, Mycobacterium
TPRPDR

SEQ ID NO: 599291 - protein, 7 aa, Mycobacterium
TPRPDRT

SEQ ID NO: 599292 - protein, 8 aa, Mycobacterium
TPRPEPQR

SEQ ID NO: 599293 - protein, 5 aa, Mycobacterium
TPRPP

SEQ ID NO: 599294 - protein, 6 aa, Mycobacterium
TPRPTP

SEQ ID NO: 599295 - protein, 6 aa, Mycobacterium
TPRQHP

SEQ ID NO: 599296 - protein, 6 aa, Mycobacterium
TPRQPT

SEQ ID NO: 599297 - protein, 8 aa, Mycobacterium
TPRQRGTA

SEQ ID NO: 599298 - protein, 9 aa, Mycobacterium
TPRRAASPR

SEQ ID NO: 599299 - protein, 16 aa, Mycobacterium
TPRRDGTVPADSPSLR

SEQ ID NO: 599300 - protein, 9 aa, Mycobacterium
TPRRGTADS

SEQ ID NO: 599301 - protein, 5 aa, Mycobacterium
TPRRH

SEQ ID NO: 599302 - protein, 13 aa, Mycobacterium
TPRRNPEGRKPIS

SEQ ID NO: 599303 - protein, 9 aa, Mycobacterium
TPRRPPRAT

SEQ ID NO: 599304 - protein, 13 aa, Mycobacterium
TPRRRAPGSPSPL

SEQ ID NO: 599305 - protein, 10 aa, Mycobacterium
TPRSAPAHGA

SEQ ID NO: 599306 - protein, 6 aa, Mycobacterium
TPRSAT

SEQ ID NO: 599307 - protein, 8 aa, Mycobacterium
TPRSDSRQ

SEQ ID NO: 599308 - protein, 8 aa, Mycobacterium
TPRSGSSN

SEQ ID NO: 599309 - protein, 9 aa, Mycobacterium
TPRSRGGYQ

SEQ ID NO: 599310 - protein, 9 aa, Mycobacterium
TPRSSPRQR

SEQ ID NO: 599311 - protein, 7 aa, Mycobacterium
TPRSTEL

SEQ ID NO: 599312 - protein, 16 aa, Mycobacterium
TPRTDTHRSPPPDDDY

SEQ ID NO: 599313 - protein, 8 aa, Mycobacterium
TPRTGRTH

SEQ ID NO: 599314 - protein, 8 aa, Mycobacterium
TPRTPEGG

SEQ ID NO: 599315 - protein, 8 aa, Mycobacterium
TPRTPQSG

SEQ ID NO: 599316 - protein, 6 aa, Mycobacterium
TPRTQV

SEQ ID NO: 599317 - protein, 15 aa, Mycobacterium
TPRTRPPQPPAPDDD

SEQ ID NO: 599318 - protein, 5 aa, Mycobacterium
TPRTV

SEQ ID NO: 599319 - protein, 6 aa, Mycobacterium
TPSAAG

SEQ ID NO: 599320 - protein, 9 aa, Mycobacterium
TPSAAGKNI

SEQ ID NO: 599321 - protein, 12 aa, Mycobacterium
TPSADGGRADLG

SEQ ID NO: 599322 - protein, 9 aa, Mycobacterium
TPSADPADF

SEQ ID NO: 599323 - protein, 11 aa, Mycobacterium
TPSAGASVESD

SEQ ID NO: 599324 - protein, 5 aa, Mycobacterium
TPSAL

SEQ ID NO: 599325 - protein, 12 aa, Mycobacterium
TPSAPDTDEEAL

SEQ ID NO: 599326 - protein, 11 aa, Mycobacterium
TPSAPERHTEM

SEQ ID NO: 599327 - protein, 18 aa, Mycobacterium
TPSAPERHTQMTDAQKGT

SEQ ID NO: 599328 - protein, 10 aa, Mycobacterium
TPSAPGAGAA

SEQ ID NO: 599329 - protein, 11 aa, Mycobacterium
TPSAPRSGRRQ

SEQ ID NO: 599330 - protein, 12 aa, Mycobacterium
TPSAPSTAEPAD

SEQ ID NO: 599331 - protein, 22 aa, Mycobacterium
TPSASGPHRIDPGMGAPRASFA

SEQ ID NO: 599332 - protein, 8 aa, Mycobacterium
TPSASGTV

SEQ ID NO: 599333 - protein, 13 aa, Mycobacterium
TPSAYRDRFRTSY

SEQ ID NO: 599334 - protein, 6 aa, Mycobacterium
TPSDAD

SEQ ID NO: 599335 - protein, 8 aa, Mycobacterium
TPSDAPGC

SEQ ID NO: 599336 - protein, 8 aa, Mycobacterium
TPSDAQVR

SEQ ID NO: 599337 - protein, 7 aa, Mycobacterium
TPSDDDL

SEQ ID NO: 599338 - protein, 12 aa, Mycobacterium
TPSDESDASSWK

SEQ ID NO: 599339 - protein, 11 aa, Mycobacterium
TPSDGGTETVD

SEQ ID NO: 599340 - protein, 9 aa, Mycobacterium
TPSDGSEPM

SEQ ID NO: 599341 - protein, 8 aa, Mycobacterium
TPSDNAVA

SEQ ID NO: 599342 - protein, 12 aa, Mycobacterium
TPSDTQTKAAIS

SEQ ID NO: 599343 - protein, 5 aa, Mycobacterium
TPSDV

SEQ ID NO: 599344 - protein, 14 aa, Mycobacterium
TPSEDLAAATDKEL

SEQ ID NO: 599345 - protein, 10 aa, Mycobacterium
TPSEEAGRSV

SEQ ID NO: 599346 - protein, 8 aa, Mycobacterium
TPSEREPA

SEQ ID NO: 599347 - protein, 6 aa, Mycobacterium
TPSERQ

SEQ ID NO: 599348 - protein, 6 aa, Mycobacterium
TPSFAA

SEQ ID NO: 599349 - protein, 43 aa, Mycobacterium
TPSGAPGIDTPGPAVPVAPRGTVPDATAGSSAAATTGSWASPY

SEQ ID NO: 599350 - protein, 6 aa, Mycobacterium
TPSGAS

SEQ ID NO: 599351 - protein, 9 aa, Mycobacterium
TPSGDGRVK

SEQ ID NO: 599352 - protein, 7 aa, Mycobacterium
TPSGGAV

SEQ ID NO: 599353 - protein, 6 aa, Mycobacterium
TPSGGL

SEQ ID NO: 599354 - protein, 13 aa, Mycobacterium
TPSGGSSVDSATI

SEQ ID NO: 599355 - protein, 6 aa, Mycobacterium
TPSGKH

SEQ ID NO: 599356 - protein, 7 aa, Mycobacterium
TPSGLGR

SEQ ID NO: 599357 - protein, 8 aa, Mycobacterium
TPSGNVDD

SEQ ID NO: 599358 - protein, 8 aa, Mycobacterium
TPSGPGPK

SEQ ID NO: 599359 - protein, 8 aa, Mycobacterium
TPSGPVPE

SEQ ID NO: 599360 - protein, 14 aa, Mycobacterium
TPSGQAIPTDGGYR

SEQ ID NO: 599361 - protein, 5 aa, Mycobacterium
TPSGR

SEQ ID NO: 599362 - protein, 9 aa, Mycobacterium
TPSGRAGSA

SEQ ID NO: 599363 - protein, 6 aa, Mycobacterium
TPSGVE

SEQ ID NO: 599364 - protein, 6 aa, Mycobacterium
TPSGVS

SEQ ID NO: 599365 - protein, 10 aa, Mycobacterium
TPSGYQQAAG

SEQ ID NO: 599366 - protein, 4 aa, Mycobacterium
TPSH

SEQ ID NO: 599367 - protein, 16 aa, Mycobacterium
TPSHPDPDRPPLQGPG

SEQ ID NO: 599368 - protein, 16 aa, Mycobacterium
TPSHPDPTRPPLRGPG

SEQ ID NO: 599369 - protein, 9 aa, Mycobacterium
TPSHPQGEH

SEQ ID NO: 599370 - protein, 4 aa, Mycobacterium
TPSI

SEQ ID NO: 599371 - protein, 6 aa, Mycobacterium
TPSITG

SEQ ID NO: 599372 - protein, 4 aa, Mycobacterium
TPSK

SEQ ID NO: 599373 - protein, 12 aa, Mycobacterium
TPSKYGGEGAGT

SEQ ID NO: 599374 - protein, 7 aa, Mycobacterium
TPSLARK

SEQ ID NO: 599375 - protein, 5 aa, Mycobacterium
TPSLQ

SEQ ID NO: 599376 - protein, 26 aa, Mycobacterium
TPSLTKNSRVPTTDQPQKAKDYTSDQ

SEQ ID NO: 599377 - protein, 9 aa, Mycobacterium
TPSLVGPPH

SEQ ID NO: 599378 - protein, 8 aa, Mycobacterium
TPSNVYPT

SEQ ID NO: 599379 - protein, 4 aa, Mycobacterium
TPSP

SEQ ID NO: 599380 - protein, 9 aa, Mycobacterium
TPSPAGRTD

SEQ ID NO: 599381 - protein, 12 aa, Mycobacterium
TPSPASDTDTVT

SEQ ID NO: 599382 - protein, 14 aa, Mycobacterium
TPSPDLADATEAEV

SEQ ID NO: 599383 - protein, 17 aa, Mycobacterium
TPSPDPDNRRANSADTY

SEQ ID NO: 599384 - protein, 8 aa, Mycobacterium
TPSPDYDV

SEQ ID NO: 599385 - protein, 5 aa, Mycobacterium
TPSPG

SEQ ID NO: 599386 - protein, 20 aa, Mycobacterium
TPSPGSGAPAGGSDPSPVGP

SEQ ID NO: 599387 - protein, 39 aa, Mycobacterium
TPSPGTGGAGGDGGHGGSGSNGQAGGSGGQGGAGGNGGL

SEQ ID NO: 599388 - protein, 5 aa, Mycobacterium
TPSPH

SEQ ID NO: 599389 - protein, 6 aa, Mycobacterium
TPSPHI

SEQ ID NO: 599390 - protein, 15 aa, Mycobacterium
TPSPHRRGQESSGAL

SEQ ID NO: 599391 - protein, 8 aa, Mycobacterium
TPSPHTPD

SEQ ID NO: 599392 - protein, 5 aa, Mycobacterium
TPSPL

SEQ ID NO: 599393 - protein, 17 aa, Mycobacterium
TPSPPVPTMSTASSRMA

SEQ ID NO: 599394 - protein, 9 aa, Mycobacterium
TPSPSGRTD

SEQ ID NO: 599395 - protein, 7 aa, Mycobacterium
TPSPSMG

SEQ ID NO: 599396 - protein, 8 aa, Mycobacterium
TPSPVTSE

SEQ ID NO: 599397 - protein, 4 aa, Mycobacterium
TPSQ

SEQ ID NO: 599398 - protein, 8 aa, Mycobacterium
TPSQHAEL

SEQ ID NO: 599399 - protein, 6 aa, Mycobacterium
TPSQYA

SEQ ID NO: 599400 - protein, 6 aa, Mycobacterium
TPSRAR

SEQ ID NO: 599401 - protein, 5 aa, Mycobacterium
TPSRD

SEQ ID NO: 599402 - protein, 10 aa, Mycobacterium
TPSRDDRTVS

SEQ ID NO: 599403 - protein, 8 aa, Mycobacterium
TPSRERVE

SEQ ID NO: 599404 - protein, 5 aa, Mycobacterium
TPSRG

SEQ ID NO: 599405 - protein, 5 aa, Mycobacterium
TPSRN

SEQ ID NO: 599406 - protein, 6 aa, Mycobacterium
TPSRPA

SEQ ID NO: 599407 - protein, 8 aa, Mycobacterium
TPSRPDEV

SEQ ID NO: 599408 - protein, 45 aa, Mycobacterium
TPSRPSGDDPLRPAPPRLRSSRASGDDPLRPAPPRLRSSRASWRR

SEQ ID NO: 599409 - protein, 7 aa, Mycobacterium
TPSRSRA

SEQ ID NO: 599410 - protein, 5 aa, Mycobacterium
TPSRT

SEQ ID NO: 599411 - protein, 6 aa, Mycobacterium
TPSSAA

SEQ ID NO: 599412 - protein, 13 aa, Mycobacterium
TPSSADDIRRVGP

SEQ ID NO: 599413 - protein, 10 aa, Mycobacterium
TPSSGQTAAA

SEQ ID NO: 599414 - protein, 13 aa, Mycobacterium
TPSSIRDLGDPDV

SEQ ID NO: 599415 - protein, 8 aa, Mycobacterium
TPSSLPAP

SEQ ID NO: 599416 - protein, 6 aa, Mycobacterium
TPSSLQ

SEQ ID NO: 599417 - protein, 15 aa, Mycobacterium
TPSSRHEAACASGSV

SEQ ID NO: 599418 - protein, 7 aa, Mycobacterium
TPSSRLE

SEQ ID NO: 599419 - protein, 12 aa, Mycobacterium
TPSSTLDMDDPD

SEQ ID NO: 599420 - protein, 6 aa, Mycobacterium
TPSSVD

SEQ ID NO: 599421 - protein, 18 aa, Mycobacterium
TPSSVDQRVNTPTDPDWA

SEQ ID NO: 599422 - protein, 7 aa, Mycobacterium
TPSSVDV

SEQ ID NO: 599423 - protein, 11 aa, Mycobacterium
TPSSVEASRSL

SEQ ID NO: 599424 - protein, 17 aa, Mycobacterium
TPSSVGERNNTPTDPEW

SEQ ID NO: 599425 - protein, 14 aa, Mycobacterium
TPSSVGPRNNVPTD

SEQ ID NO: 599426 - protein, 5 aa, Mycobacterium
TPSTD

SEQ ID NO: 599427 - protein, 6 aa, Mycobacterium
TPSTEL

SEQ ID NO: 599428 - protein, 8 aa, Mycobacterium
TPSTITTA

SEQ ID NO: 599429 - protein, 5 aa, Mycobacterium
TPSTL

SEQ ID NO: 599430 - protein, 9 aa, Mycobacterium
TPSTRPGEP

SEQ ID NO: 599431 - protein, 8 aa, Mycobacterium
TPSTSADG

SEQ ID NO: 599432 - protein, 7 aa, Mycobacterium
TPSTSPY

SEQ ID NO: 599433 - protein, 6 aa, Mycobacterium
TPSTVD

SEQ ID NO: 599434 - protein, 17 aa, Mycobacterium
TPSTVDERNNAPTDPEW

SEQ ID NO: 599435 - protein, 18 aa, Mycobacterium
TPSTVDERNNAPTDPKWA

SEQ ID NO: 599436 - protein, 16 aa, Mycobacterium
TPSTVDERNNTPTDPE

SEQ ID NO: 599437 - protein, 8 aa, Mycobacterium
TPSVEAQS

SEQ ID NO: 599438 - protein, 6 aa, Mycobacterium
TPSVQA

SEQ ID NO: 599439 - protein, 19 aa, Mycobacterium
TPSVSKTLGETRPAAISAN

SEQ ID NO: 599440 - protein, 5 aa, Mycobacterium
TPSVY

SEQ ID NO: 599441 - protein, 4 aa, Mycobacterium
TPSW

SEQ ID NO: 599442 - protein, 5 aa, Mycobacterium
TPSWT

SEQ ID NO: 599443 - protein, 4 aa, Mycobacterium
TPSY

SEQ ID NO: 599444 - protein, 8 aa, Mycobacterium
TPSYNASK

SEQ ID NO: 599445 - protein, 11 aa, Mycobacterium
TPSYRSAVPQD

SEQ ID NO: 599446 - protein, 9 aa, Mycobacterium
TPTADAADL

SEQ ID NO: 599447 - protein, 9 aa, Mycobacterium
TPTADPADL

SEQ ID NO: 599448 - protein, 11 aa, Mycobacterium
TPTAGWSAGYA

SEQ ID NO: 599449 - protein, 17 aa, Mycobacterium
TPTAHARDRMRRRQASV

SEQ ID NO: 599450 - protein, 8 aa, Mycobacterium
TPTAKEVT

SEQ ID NO: 599451 - protein, 11 aa, Mycobacterium
TPTALDGRGSG

SEQ ID NO: 599452 - protein, 11 aa, Mycobacterium
TPTANGGEEAA

SEQ ID NO: 599453 - protein, 11 aa, Mycobacterium
TPTAPATPGLT

SEQ ID NO: 599454 - protein, 10 aa, Mycobacterium
TPTASAAHPA

SEQ ID NO: 599455 - protein, 11 aa, Mycobacterium
TPTASFAEQSR

SEQ ID NO: 599456 - protein, 21 aa, Mycobacterium
TPTASGPVRIDPGPGAPRSVA

SEQ ID NO: 599457 - protein, 9 aa, Mycobacterium
TPTATDGGV

SEQ ID NO: 599458 - protein, 5 aa, Mycobacterium
TPTAV

SEQ ID NO: 599459 - protein, 13 aa, Mycobacterium
TPTAVATDDGTDH

SEQ ID NO: 599460 - protein, 7 aa, Mycobacterium
TPTDASV

SEQ ID NO: 599461 - protein, 46 aa, Mycobacterium
TPTDEPEDAPDSFADSPAPASVPAGPADADEIDDDRDARVNAQESW

SEQ ID NO: 599462 - protein, 6 aa, Mycobacterium
TPTDNR

SEQ ID NO: 599463 - protein, 9 aa, Mycobacterium
TPTDPATAT

SEQ ID NO: 599464 - protein, 11 aa, Mycobacterium
TPTDSGLAPGL

SEQ ID NO: 599465 - protein, 7 aa, Mycobacterium
TPTDSRL

SEQ ID NO: 599466 - protein, 6 aa, Mycobacterium
TPTDTP

SEQ ID NO: 599467 - protein, 6 aa, Mycobacterium
TPTDTQ

SEQ ID NO: 599468 - protein, 6 aa, Mycobacterium
TPTDTR

SEQ ID NO: 599469 - protein, 4 aa, Mycobacterium
TPTE

SEQ ID NO: 599470 - protein, 6 aa, Mycobacterium
TPTEHA

SEQ ID NO: 599471 - protein, 6 aa, Mycobacterium
TPTEHG

SEQ ID NO: 599472 - protein, 17 aa, Mycobacterium
TPTEISYGSAPNTGTIP

SEQ ID NO: 599473 - protein, 6 aa, Mycobacterium
TPTELR

SEQ ID NO: 599474 - protein, 17 aa, Mycobacterium
TPTEPVPVGPDGSLPDD

SEQ ID NO: 599475 - protein, 11 aa, Mycobacterium
TPTERKSAKGL

SEQ ID NO: 599476 - protein, 10 aa, Mycobacterium
TPTERNSARG

SEQ ID NO: 599477 - protein, 8 aa, Mycobacterium
TPTERNTV

SEQ ID NO: 599478 - protein, 8 aa, Mycobacterium
TPTETHGR

SEQ ID NO: 599479 - protein, 6 aa, Mycobacterium
TPTFPE

SEQ ID NO: 599480 - protein, 4 aa, Mycobacterium
TPTG

SEQ ID NO: 599481 - protein, 5 aa, Mycobacterium
TPTGA

SEQ ID NO: 599482 - protein, 13 aa, Mycobacterium
TPTGAAPTVTGGI

SEQ ID NO: 599483 - protein, 6 aa, Mycobacterium
TPTGAR

SEQ ID NO: 599484 - protein, 9 aa, Mycobacterium
TPTGDPADL

SEQ ID NO: 599485 - protein, 9 aa, Mycobacterium
TPTGDTYSY

SEQ ID NO: 599486 - protein, 8 aa, Mycobacterium
TPTGDYGI

SEQ ID NO: 599487 - protein, 6 aa, Mycobacterium
TPTGEL

SEQ ID NO: 599488 - protein, 8 aa, Mycobacterium
TPTGETFD

SEQ ID NO: 599489 - protein, 10 aa, Mycobacterium
TPTGGSSTTY

SEQ ID NO: 599490 - protein, 12 aa, Mycobacterium
TPTGHAYSTKPL

SEQ ID NO: 599491 - protein, 8 aa, Mycobacterium
TPTGPPPA

SEQ ID NO: 599492 - protein, 11 aa, Mycobacterium
TPTGPSALANR

SEQ ID NO: 599493 - protein, 7 aa, Mycobacterium
TPTGPVD

SEQ ID NO: 599494 - protein, 9 aa, Mycobacterium
TPTGRPTGE

SEQ ID NO: 599495 - protein, 10 aa, Mycobacterium
TPTGRPTGEW

SEQ ID NO: 599496 - protein, 11 aa, Mycobacterium
TPTGRRAARDG

SEQ ID NO: 599497 - protein, 9 aa, Mycobacterium
TPTGSGKSL

SEQ ID NO: 599498 - protein, 9 aa, Mycobacterium
TPTGTETAD

SEQ ID NO: 599499 - protein, 11 aa, Mycobacterium
TPTGTQCTTKP

SEQ ID NO: 599500 - protein, 6 aa, Mycobacterium
TPTGTR

SEQ ID NO: 599501 - protein, 11 aa, Mycobacterium
TPTGTRSTPAE

SEQ ID NO: 599502 - protein, 17 aa, Mycobacterium
TPTGTTARSGRSGGRPA

SEQ ID NO: 599503 - protein, 18 aa, Mycobacterium
TPTGTTYRSTAPPRGPTI

SEQ ID NO: 599504 - protein, 6 aa, Mycobacterium
TPTGTV

SEQ ID NO: 599505 - protein, 5 aa, Mycobacterium
TPTGV

SEQ ID NO: 599506 - protein, 6 aa, Mycobacterium
TPTGVS

SEQ ID NO: 599507 - protein, 10 aa, Mycobacterium
TPTIAGSTAT

SEQ ID NO: 599508 - protein, 8 aa, Mycobacterium
TPTKDAAE

SEQ ID NO: 599509 - protein, 9 aa, Mycobacterium
TPTKDGSGL

SEQ ID NO: 599510 - protein, 17 aa, Mycobacterium
TPTKPVPVAADGSLPAE

SEQ ID NO: 599511 - protein, 5 aa, Mycobacterium
TPTKW

SEQ ID NO: 599512 - protein, 6 aa, Mycobacterium
TPTKWD

SEQ ID NO: 599513 - protein, 8 aa, Mycobacterium
TPTLAQST

SEQ ID NO: 599514 - protein, 8 aa, Mycobacterium
TPTLEQST

SEQ ID NO: 599515 - protein, 6 aa, Mycobacterium
TPTLNP

SEQ ID NO: 599516 - protein, 5 aa, Mycobacterium
TPTLP

SEQ ID NO: 599517 - protein, 18 aa, Mycobacterium
TPTLQGDATLGDLAERPR

SEQ ID NO: 599518 - protein, 18 aa, Mycobacterium
TPTLQGDSTLGDLAERPR

SEQ ID NO: 599519 - protein, 6 aa, Mycobacterium
TPTLRG

SEQ ID NO: 599520 - protein, 18 aa, Mycobacterium
TPTLRGDATLGDLADRPR

SEQ ID NO: 599521 - protein, 13 aa, Mycobacterium
TPTLTRSTPEGAR

SEQ ID NO: 599522 - protein, 6 aa, Mycobacterium
TPTNAA

SEQ ID NO: 599523 - protein, 5 aa, Mycobacterium
TPTNG

SEQ ID NO: 599524 - protein, 7 aa, Mycobacterium
TPTPAGL

SEQ ID NO: 599525 - protein, 7 aa, Mycobacterium
TPTPEDR

SEQ ID NO: 599526 - protein, 7 aa, Mycobacterium
TPTPGTV

SEQ ID NO: 599527 - protein, 7 aa, Mycobacterium
TPTPHQR

SEQ ID NO: 599528 - protein, 6 aa, Mycobacterium
TPTPIT

SEQ ID NO: 599529 - protein, 19 aa, Mycobacterium
TPTPNGENQPGGPTADHEN

SEQ ID NO: 599530 - protein, 11 aa, Mycobacterium
TPTPPPGTAAL

SEQ ID NO: 599531 - protein, 21 aa, Mycobacterium
TPTPQTDTHQAPGEIVPNTGS

SEQ ID NO: 599532 - protein, 5 aa, Mycobacterium
TPTPV

SEQ ID NO: 599533 - protein, 16 aa, Mycobacterium
TPTQAEEARAWVSAES

SEQ ID NO: 599534 - protein, 17 aa, Mycobacterium
TPTQPVPVGADGSLPAD

SEQ ID NO: 599535 - protein, 5 aa, Mycobacterium
TPTQT

SEQ ID NO: 599536 - protein, 15 aa, Mycobacterium
TPTRAPTPVGASAYN

SEQ ID NO: 599537 - protein, 12 aa, Mycobacterium
TPTRDKPSTIGR

SEQ ID NO: 599538 - protein, 12 aa, Mycobacterium
TPTRDKPSTLGR

SEQ ID NO: 599539 - protein, 17 aa, Mycobacterium
TPTREAQDAYNDELQDD

SEQ ID NO: 599540 - protein, 14 aa, Mycobacterium
TPTRLREDTGCTSL

SEQ ID NO: 599541 - protein, 6 aa, Mycobacterium
TPTRTA

SEQ ID NO: 599542 - protein, 5 aa, Mycobacterium
TPTRY

SEQ ID NO: 599543 - protein, 14 aa, Mycobacterium
TPTRYRERARYDSE

SEQ ID NO: 599544 - protein, 6 aa, Mycobacterium
TPTSAP

SEQ ID NO: 599545 - protein, 9 aa, Mycobacterium
TPTSDPADL

SEQ ID NO: 599546 - protein, 27 aa, Mycobacterium
TPTSEGTTFTNDATGRGMSVNVDGARA

SEQ ID NO: 599547 - protein, 5 aa, Mycobacterium
TPTSG

SEQ ID NO: 599548 - protein, 8 aa, Mycobacterium
TPTSGAPT

SEQ ID NO: 599549 - protein, 6 aa, Mycobacterium
TPTSGQ

SEQ ID NO: 599550 - protein, 6 aa, Mycobacterium
TPTSKR

SEQ ID NO: 599551 - protein, 15 aa, Mycobacterium
TPTSLSPAKPDDPSA

SEQ ID NO: 599552 - protein, 5 aa, Mycobacterium
TPTSQ

SEQ ID NO: 599553 - protein, 11 aa, Mycobacterium
TPTSSDAATRV

SEQ ID NO: 599554 - protein, 6 aa, Mycobacterium
TPTSTP

SEQ ID NO: 599555 - protein, 13 aa, Mycobacterium
TPTSTRKREENIS

SEQ ID NO: 599556 - protein, 11 aa, Mycobacterium
TPTSTRSTPAE

SEQ ID NO: 599557 - protein, 9 aa, Mycobacterium
TPTTAARKI

SEQ ID NO: 599558 - protein, 7 aa, Mycobacterium
TPTTDGR

SEQ ID NO: 599559 - protein, 8 aa, Mycobacterium
TPTTEAQV

SEQ ID NO: 599560 - protein, 17 aa, Mycobacterium
TPTTGAPRKAAARTPAE

SEQ ID NO: 599561 - protein, 6 aa, Mycobacterium
TPTTGI

SEQ ID NO: 599562 - protein, 8 aa, Mycobacterium
TPTTPEGG

SEQ ID NO: 599563 - protein, 9 aa, Mycobacterium
TPTTRTDQL

SEQ ID NO: 599564 - protein, 5 aa, Mycobacterium
TPTYD

SEQ ID NO: 599565 - protein, 10 aa, Mycobacterium
TPVAGRTEAE

SEQ ID NO: 599566 - protein, 11 aa, Mycobacterium
TPVAGRTESEL

SEQ ID NO: 599567 - protein, 5 aa, Mycobacterium
TPVAK

SEQ ID NO: 599568 - protein, 9 aa, Mycobacterium
TPVANPPPY

SEQ ID NO: 599569 - protein, 8 aa, Mycobacterium
TPVATPQQ

SEQ ID NO: 599570 - protein, 10 aa, Mycobacterium
TPVAVGGADT

SEQ ID NO: 599571 - protein, 11 aa, Mycobacterium
TPVDAKGRFDA

SEQ ID NO: 599572 - protein, 7 aa, Mycobacterium
TPVDEST

SEQ ID NO: 599573 - protein, 9 aa, Mycobacterium
TPVDESTSD

SEQ ID NO: 599574 - protein, 11 aa, Mycobacterium
TPVDIGAPKQR

SEQ ID NO: 599575 - protein, 18 aa, Mycobacterium
TPVDPEPEPVEEPAATGR

SEQ ID NO: 599576 - protein, 10 aa, Mycobacterium
TPVDPEPNTL

SEQ ID NO: 599577 - protein, 9 aa, Mycobacterium
TPVDQKAGE

SEQ ID NO: 599578 - protein, 12 aa, Mycobacterium
TPVDQMRYRCSL

SEQ ID NO: 599579 - protein, 11 aa, Mycobacterium
TPVDRDGNPEK

SEQ ID NO: 599580 - protein, 7 aa, Mycobacterium
TPVDTQR

SEQ ID NO: 599581 - protein, 9 aa, Mycobacterium
TPVENPPPY

SEQ ID NO: 599582 - protein, 29 aa, Mycobacterium
TPVEQPAARPRPVASQPKTATARGRSMPP

SEQ ID NO: 599583 - protein, 8 aa, Mycobacterium
TPVGAEGA

SEQ ID NO: 599584 - protein, 6 aa, Mycobacterium
TPVGDQ

SEQ ID NO: 599585 - protein, 18 aa, Mycobacterium
TPVGGSAFPAQGGGGFQG

SEQ ID NO: 599586 - protein, 12 aa, Mycobacterium
TPVGKGKAGGAL

SEQ ID NO: 599587 - protein, 12 aa, Mycobacterium
TPVGKGKANGAL

SEQ ID NO: 599588 - protein, 14 aa, Mycobacterium
TPVGKGKPGGSLSG

SEQ ID NO: 599589 - protein, 11 aa, Mycobacterium
TPVGKKNGSLA

SEQ ID NO: 599590 - protein, 9 aa, Mycobacterium
TPVGKRNGA

SEQ ID NO: 599591 - protein, 16 aa, Mycobacterium
TPVGKRNGGLSEQHAA

SEQ ID NO: 599592 - protein, 12 aa, Mycobacterium
TPVGKRNGGLSG

SEQ ID NO: 599593 - protein, 14 aa, Mycobacterium
TPVGNAASYYPETN

SEQ ID NO: 599594 - protein, 6 aa, Mycobacterium
TPVGPE

SEQ ID NO: 599595 - protein, 17 aa, Mycobacterium
TPVGREAETLTARSPLA

SEQ ID NO: 599596 - protein, 17 aa, Mycobacterium
TPVGREGETLTARSPLA

SEQ ID NO: 599597 - protein, 4 aa, Mycobacterium
TPVK

SEQ ID NO: 599598 - protein, 194 aa, Mycobacterium
TPVNPAPAPAPAPGPSTPVSPTPAPAPAPSPQPAPAGPSPSPSQPSMPSDPGTPSTPHTPSTEPAHVKPAAATEAPSVPSAQPTAPSGPSHGDDGSSSQPMAPAAAGGMPAAARGMSGGTAAPAASAGAGPSSGQSAASSAGSRAATGRAPLGPAGRAPAAATPRPASARIAPPARPAPPPEAPEKEKRESADD

SEQ ID NO: 599599 - protein, 10 aa, Mycobacterium
TPVNRTAAEA

SEQ ID NO: 599600 - protein, 4 aa, Mycobacterium
TPVP

SEQ ID NO: 599601 - protein, 31 aa, Mycobacterium
TPVPAPAPAAAASPVAPPAPPPTVVGPESAM

SEQ ID NO: 599602 - protein, 7 aa, Mycobacterium
TPVPASV

SEQ ID NO: 599603 - protein, 10 aa, Mycobacterium
TPVPGPADQV

SEQ ID NO: 599604 - protein, 10 aa, Mycobacterium
TPVPNPPPYW

SEQ ID NO: 599605 - protein, 12 aa, Mycobacterium
TPVPPDEDRMRG

SEQ ID NO: 599606 - protein, 9 aa, Mycobacterium
TPVPPGRTR

SEQ ID NO: 599607 - protein, 33 aa, Mycobacterium; identical to SEQ ID NO: 75618

SEQ ID NO: 599608 - protein, 20 aa, Mycobacterium
TPVPRRGGQHRKQPTSAAKG

SEQ ID NO: 599609 - protein, 8 aa, Mycobacterium
TPVPYGDG

SEQ ID NO: 599610 - protein, 7 aa, Mycobacterium
TPVQGPH

SEQ ID NO: 599611 - protein, 17 aa, Mycobacterium
TPVRDSKLTVDRGFVNN

SEQ ID NO: 599612 - protein, 11 aa, Mycobacterium
TPVSGSPRRAV

SEQ ID NO: 599613 - protein, 11 aa, Mycobacterium
TPVSPESPANV

SEQ ID NO: 599614 - protein, 16 aa, Mycobacterium
TPVSRGDEDGSRERKV

SEQ ID NO: 599615 - protein, 9 aa, Mycobacterium
TPVSSPPET

SEQ ID NO: 599616 - protein, 6 aa, Mycobacterium
TPVSTE

SEQ ID NO: 599617 - protein, 4 aa, Mycobacterium
TPVT

SEQ ID NO: 599618 - protein, 11 aa, Mycobacterium
TPVTADDPDYP

SEQ ID NO: 599619 - protein, 6 aa, Mycobacterium
TPVTAT

SEQ ID NO: 599620 - protein, 11 aa, Mycobacterium
TPVTESDPAWA

SEQ ID NO: 599621 - protein, 13 aa, Mycobacterium
TPVTNKHSASTAP

SEQ ID NO: 599622 - protein, 49 aa, Mycobacterium
TPVTPRPVPPVTPGKPVTPIPPVTPGKPAKPVTPVTPVKPKPEQPVTPV

SEQ ID NO: 599623 - protein, 14 aa, Mycobacterium
TPVTPVDSKGRFDA

SEQ ID NO: 599624 - protein, 21 aa, Mycobacterium
TPVTQQPTPGQCTDYRAACPS

SEQ ID NO: 599625 - protein, 5 aa, Mycobacterium
TPVTS

SEQ ID NO: 599626 - protein, 19 aa, Mycobacterium
TPVTSAPVEVTGSAEYRSR

SEQ ID NO: 599627 - protein, 9 aa, Mycobacterium
TPVTSPAET

SEQ ID NO: 599628 - protein, 17 aa, Mycobacterium
TPVTSSDTSFTPPTITG

SEQ ID NO: 599629 - protein, 24 aa, Mycobacterium
TPVTSSSQTSELPRSAEGSPDEHT

SEQ ID NO: 599630 - protein, 11 aa, Mycobacterium
TPWAPKMPSDY

SEQ ID NO: 599631 - protein, 6 aa, Mycobacterium
TPWKPQ

SEQ ID NO: 599632 - protein, 11 aa, Mycobacterium
TPWPAAGGQRI

SEQ ID NO: 599633 - protein, 12 aa, Mycobacterium
TPWPDEPGEPVT

SEQ ID NO: 599634 - protein, 14 aa, Mycobacterium
TPWPEQDDALPRRA

SEQ ID NO: 599635 - protein, 6 aa, Mycobacterium
TPWPET

SEQ ID NO: 599636 - protein, 24 aa, Mycobacterium
TPWPGNAAPVAPLTGSVEQEVGPA

SEQ ID NO: 599637 - protein, 13 aa, Mycobacterium
TPWPNGDDHAPKR

SEQ ID NO: 599638 - protein, 5 aa, Mycobacterium
TPWQH

SEQ ID NO: 599639 - protein, 8 aa, Mycobacterium
TPWSPRIP

SEQ ID NO: 599640 - protein, 14 aa, Mycobacterium
TPWTTNGDHPRRAA

SEQ ID NO: 599641 - protein, 4 aa, Mycobacterium
TPWY

SEQ ID NO: 599642 - protein, 17 aa, Mycobacterium
TPWYESATGPAGPVNCD

SEQ ID NO: 599643 - protein, 4 aa, Mycobacterium
TPYD

SEQ ID NO: 599644 - protein, 11 aa, Mycobacterium
TPYDREGRPEK

SEQ ID NO: 599645 - protein, 5 aa, Mycobacterium
TPYEP

SEQ ID NO: 599646 - protein, 6 aa, Mycobacterium
TPYEPV

SEQ ID NO: 599647 - protein, 5 aa, Mycobacterium
TPYGM

SEQ ID NO: 599648 - protein, 9 aa, Mycobacterium
TPYGMTPNP

SEQ ID NO: 599649 - protein, 5 aa, Mycobacterium
TPYIP

SEQ ID NO: 599650 - protein, 8 aa, Mycobacterium
TPYKSETV

SEQ ID NO: 599651 - protein, 6 aa, Mycobacterium
TPYNGR

SEQ ID NO: 599652 - protein, 7 aa, Mycobacterium
TPYPELD

SEQ ID NO: 599653 - protein, 7 aa, Mycobacterium
TPYPGTP

SEQ ID NO: 599654 - protein, 18 aa, Mycobacterium
TPYPPGADGAFPPVTGES

SEQ ID NO: 599655 - protein, 5 aa, Mycobacterium
TPYPS

SEQ ID NO: 599656 - protein, 9 aa, Mycobacterium
TPYPTPQSR

SEQ ID NO: 599657 - protein, 12 aa, Mycobacterium
TPYPYTKDGKRR

SEQ ID NO: 599658 - protein, 13 aa, Mycobacterium
TPYPYTKDGQRRW

SEQ ID NO: 599659 - protein, 14 aa, Mycobacterium
TPYPYTKDGQRRWP

SEQ ID NO: 599660 - protein, 6 aa, Mycobacterium
TPYQPG

SEQ ID NO: 599661 - protein, 16 aa, Mycobacterium
TPYRNPDGHKAISRTT

SEQ ID NO: 599662 - protein, 6 aa, Mycobacterium
TPYRPD

SEQ ID NO: 599663 - protein, 15 aa, Mycobacterium
TPYSAGRSAPSQTRT

SEQ ID NO: 599664 - protein, 5 aa, Mycobacterium
TPYSE

SEQ ID NO: 599665 - protein, 22 aa, Mycobacterium
TPYSMKSPDTSRSKSARAARSR

SEQ ID NO: 599666 - protein, 5 aa, Mycobacterium
TPYTA

SEQ ID NO: 599667 - protein, 6 aa, Mycobacterium
TPYTAD

SEQ ID NO: 599668 - protein, 4 aa, Mycobacterium
TPYY

SEQ ID NO: 599669 - protein, 5 aa, Mycobacterium
TPYYD

SEQ ID NO: 599670 - protein, 10 aa, Mycobacterium
TQAAADVDGV

SEQ ID NO: 599671 - protein, 9 aa, Mycobacterium
TQAAAHPTA

SEQ ID NO: 599672 - protein, 23 aa, Mycobacterium
TQAAGGADGDAAGGPQAGSADDV

SEQ ID NO: 599673 - protein, 16 aa, Mycobacterium
TQAAGPSLAAQRRAEL

SEQ ID NO: 599674 - protein, 7 aa, Mycobacterium
TQAAIDT

SEQ ID NO: 599675 - protein, 9 aa, Mycobacterium
TQAAPPPVT

SEQ ID NO: 599676 - protein, 10 aa, Mycobacterium
TQAARRSSRT

SEQ ID NO: 599677 - protein, 5 aa, Mycobacterium
TQAAT

SEQ ID NO: 599678 - protein, 6 aa, Mycobacterium
TQACER

SEQ ID NO: 599679 - protein, 9 aa, Mycobacterium
TQADELASS

SEQ ID NO: 599680 - protein, 9 aa, Mycobacterium
TQADPATVT

SEQ ID NO: 599681 - protein, 22 aa, Mycobacterium
TQADTQADTHADTHADGAKPAE

SEQ ID NO: 599682 - protein, 8 aa, Mycobacterium
TQADVDAG

SEQ ID NO: 599683 - protein, 15 aa, Mycobacterium
TQAEAAAKLGVSQPR

SEQ ID NO: 599684 - protein, 24 aa, Mycobacterium
TQAEASAAGAAQPGGGPSGSADDV

SEQ ID NO: 599685 - protein, 5 aa, Mycobacterium
TQAED

SEQ ID NO: 599686 - protein, 7 aa, Mycobacterium
TQAEGEG

SEQ ID NO: 599687 - protein, 8 aa, Mycobacterium
TQAEGEGH

SEQ ID NO: 599688 - protein, 7 aa, Mycobacterium
TQAEKEG

SEQ ID NO: 599689 - protein, 7 aa, Mycobacterium
TQAENEG

SEQ ID NO: 599690 - protein, 7 aa, Mycobacterium
TQAEQEG

SEQ ID NO: 599691 - protein, 10 aa, Mycobacterium
TQAESDDRSA

SEQ ID NO: 599692 - protein, 4 aa, Mycobacterium
TQAG

SEQ ID NO: 599693 - protein, 6 aa, Mycobacterium
TQAGAD

SEQ ID NO: 599694 - protein, 9 aa, Mycobacterium
TQAGENRVR

SEQ ID NO: 599695 - protein, 7 aa, Mycobacterium
TQAGEPS

SEQ ID NO: 599696 - protein, 5 aa, Mycobacterium
TQAGI

SEQ ID NO: 599697 - protein, 14 aa, Mycobacterium
TQAGRDDADLPLQA

SEQ ID NO: 599698 - protein, 5 aa, Mycobacterium
TQAGV

SEQ ID NO: 599699 - protein, 5 aa, Mycobacterium
TQAGW

SEQ ID NO: 599700 - protein, 7 aa, Mycobacterium
TQAHPLP

SEQ ID NO: 599701 - protein, 7 aa, Mycobacterium
TQAHQEA

SEQ ID NO: 599702 - protein, 9 aa, Mycobacterium
TQAKASKAT

SEQ ID NO: 599703 - protein, 6 aa, Mycobacterium
TQALAR

SEQ ID NO: 599704 - protein, 7 aa, Mycobacterium
TQALARQ

SEQ ID NO: 599705 - protein, 8 aa, Mycobacterium
TQANHGKP

SEQ ID NO: 599706 - protein, 9 aa, Mycobacterium
TQANRKRQV

SEQ ID NO: 599707 - protein, 4 aa, Mycobacterium
TQAP

SEQ ID NO: 599708 - protein, 8 aa, Mycobacterium
TQAPARSI

SEQ ID NO: 599709 - protein, 13 aa, Mycobacterium
TQAPDEIAGPAAT

SEQ ID NO: 599710 - protein, 7 aa, Mycobacterium
TQAPEVA

SEQ ID NO: 599711 - protein, 11 aa, Mycobacterium
TQAPGNGAPLG

SEQ ID NO: 599712 - protein, 6 aa, Mycobacterium
TQAPHA

SEQ ID NO: 599713 - protein, 6 aa, Mycobacterium
TQAPLG

SEQ ID NO: 599714 - protein, 10 aa, Mycobacterium
TQAPRDSEHG

SEQ ID NO: 599715 - protein, 10 aa, Mycobacterium
TQAPSGRNRQ

SEQ ID NO: 599716 - protein, 4 aa, Mycobacterium
TQAQ

SEQ ID NO: 599717 - protein, 6 aa, Mycobacterium
TQAQKL

SEQ ID NO: 599718 - protein, 11 aa, Mycobacterium
TQAQQAGRTQV

SEQ ID NO: 599719 - protein, 7 aa, Mycobacterium
TQAQTRL

SEQ ID NO: 599720 - protein, 9 aa, Mycobacterium
TQARSDAAE

SEQ ID NO: 599721 - protein, 10 aa, Mycobacterium
TQASPSANGV

SEQ ID NO: 599722 - protein, 12 aa, Mycobacterium
TQASSRGSAIDE

SEQ ID NO: 599723 - protein, 8 aa, Mycobacterium
TQATDMDP

SEQ ID NO: 599724 - protein, 7 aa, Mycobacterium
TQAYAGA

SEQ ID NO: 599725 - protein, 5 aa, Mycobacterium
TQAYE

SEQ ID NO: 599726 - protein, 6 aa, Mycobacterium
TQCPAG

SEQ ID NO: 599727 - protein, 4 aa, Mycobacterium
TQDA

SEQ ID NO: 599728 - protein, 8 aa, Mycobacterium
TQDAHRAG

SEQ ID NO: 599729 - protein, 10 aa, Mycobacterium
TQDAKEGPRA

SEQ ID NO: 599730 - protein, 12 aa, Mycobacterium
TQDAQSRHGRAE

SEQ ID NO: 599731 - protein, 5 aa, Mycobacterium
TQDAR

SEQ ID NO: 599732 - protein, 8 aa, Mycobacterium
TQDARSAQ

SEQ ID NO: 599733 - protein, 18 aa, Mycobacterium
TQDASGVTATFDDGDTIR

SEQ ID NO: 599734 - protein, 12 aa, Mycobacterium
TQDAVRAAKPGD

SEQ ID NO: 599735 - protein, 24 aa, Mycobacterium
TQDDARPDAVERRRASGARTARQN

SEQ ID NO: 599736 - protein, 6 aa, Mycobacterium
TQDDAT

SEQ ID NO: 599737 - protein, 6 aa, Mycobacterium
TQDDEG

SEQ ID NO: 599738 - protein, 11 aa, Mycobacterium
TQDDPATRRSE

SEQ ID NO: 599739 - protein, 17 aa, Mycobacterium
TQDGETQTATKQVRGGL

SEQ ID NO: 599740 - protein, 6 aa, Mycobacterium
TQDGGA

SEQ ID NO: 599741 - protein, 9 aa, Mycobacterium
TQDGKTQTA

SEQ ID NO: 599742 - protein, 6 aa, Mycobacterium
TQDGRQ

SEQ ID NO: 599743 - protein, 14 aa, Mycobacterium
TQDKADIATAAGAT

SEQ ID NO: 599744 - protein, 18 aa, Mycobacterium
TQDKTPVDRLQEDSDGVR

SEQ ID NO: 599745 - protein, 5 aa, Mycobacterium
TQDLA

SEQ ID NO: 599746 - protein, 4 aa, Mycobacterium
TQDP

SEQ ID NO: 599747 - protein, 5 aa, Mycobacterium
TQDPA

SEQ ID NO: 599748 - protein, 8 aa, Mycobacterium
TQDPASVR

SEQ ID NO: 599749 - protein, 14 aa, Mycobacterium
TQDPEEVDGPGATS

SEQ ID NO: 599750 - protein, 19 aa, Mycobacterium
TQDPETGDPLEQAAEAFYC

SEQ ID NO: 599751 - protein, 10 aa, Mycobacterium
TQDPPTDQIN

SEQ ID NO: 599752 - protein, 8 aa, Mycobacterium
TQDPREVA

SEQ ID NO: 599753 - protein, 9 aa, Mycobacterium
TQDPRHAPR

SEQ ID NO: 599754 - protein, 9 aa, Mycobacterium
TQDPSPTDL

SEQ ID NO: 599755 - protein, 5 aa, Mycobacterium
TQDQD

SEQ ID NO: 599756 - protein, 18 aa, Mycobacterium
TQDQNLQDGPHKDLRRAR

SEQ ID NO: 599757 - protein, 5 aa, Mycobacterium
TQDRL

SEQ ID NO: 599758 - protein, 10 aa, Mycobacterium
TQDRYTSRGR

SEQ ID NO: 599759 - protein, 8 aa, Mycobacterium
TQDSEANY

SEQ ID NO: 599760 - protein, 10 aa, Mycobacterium
TQDSGTSYGG

SEQ ID NO: 599761 - protein, 10 aa, Mycobacterium
TQDSPAPNGV

SEQ ID NO: 599762 - protein, 13 aa, Mycobacterium
TQDSSGFAGTSGL

SEQ ID NO: 599763 - protein, 6 aa, Mycobacterium
TQDTCS

SEQ ID NO: 599764 - protein, 10 aa, Mycobacterium
TQDTGPVGGE

SEQ ID NO: 599765 - protein, 6 aa, Mycobacterium
TQDVQS

SEQ ID NO: 599766 - protein, 4 aa, Mycobacterium
TQEA

SEQ ID NO: 599767 - protein, 11 aa, Mycobacterium
TQEALEDSRAT

SEQ ID NO: 599768 - protein, 7 aa, Mycobacterium
TQEFRTS

SEQ ID NO: 599769 - protein, 8 aa, Mycobacterium
TQEGESTR

SEQ ID NO: 599770 - protein, 6 aa, Mycobacterium
TQEHVT

SEQ ID NO: 599771 - protein, 5 aa, Mycobacterium
TQENT

SEQ ID NO: 599772 - protein, 8 aa, Mycobacterium
TQEPAAGQ

SEQ ID NO: 599773 - protein, 7 aa, Mycobacterium
TQEPADL

SEQ ID NO: 599774 - protein, 6 aa, Mycobacterium
TQEQKR

SEQ ID NO: 599775 - protein, 7 aa, Mycobacterium
TQERGTG

SEQ ID NO: 599776 - protein, 6 aa, Mycobacterium
TQERLP

SEQ ID NO: 599777 - protein, 4 aa, Mycobacterium
TQES

SEQ ID NO: 599778 - protein, 5 aa, Mycobacterium
TQESD

SEQ ID NO: 599779 - protein, 12 aa, Mycobacterium
TQESGTEPPFSG

SEQ ID NO: 599780 - protein, 9 aa, Mycobacterium
TQETEQSND

SEQ ID NO: 599781 - protein, 14 aa, Mycobacterium
TQETSPTRGIPSGV

SEQ ID NO: 599782 - protein, 14 aa, Mycobacterium
TQEWPRPDNARRAA

SEQ ID NO: 599783 - protein, 9 aa, Mycobacterium
TQFAGEAQQ

SEQ ID NO: 599784 - protein, 11 aa, Mycobacterium
TQFAGGEAGWR

SEQ ID NO: 599785 - protein, 13 aa, Mycobacterium
TQFDGYTSGSTKD

SEQ ID NO: 599786 - protein, 13 aa, Mycobacterium
TQFDGYTSGTTKD

SEQ ID NO: 599787 - protein, 13 aa, Mycobacterium
TQFEGYTSGTTKD

SEQ ID NO: 599788 - protein, 5 aa, Mycobacterium
TQFET

SEQ ID NO: 599789 - protein, 5 aa, Mycobacterium
TQFGG

SEQ ID NO: 599790 - protein, 6 aa, Mycobacterium
TQFKEG

SEQ ID NO: 599791 - protein, 9 aa, Mycobacterium
TQGAKEMTK

SEQ ID NO: 599792 - protein, 13 aa, Mycobacterium
TQGAQQATVGASY

SEQ ID NO: 599793 - protein, 11 aa, Mycobacterium
TQGASETRKLR

SEQ ID NO: 599794 - protein, 9 aa, Mycobacterium
TQGATALEA

SEQ ID NO: 599795 - protein, 7 aa, Mycobacterium
TQGCPRQ

SEQ ID NO: 599796 - protein, 4 aa, Mycobacterium
TQGD

SEQ ID NO: 599797 - protein, 6 aa, Mycobacterium
TQGDRT

SEQ ID NO: 599798 - protein, 7 aa, Mycobacterium
TQGDRTA

SEQ ID NO: 599799 - protein, 6 aa, Mycobacterium
TQGDTT

SEQ ID NO: 599800 - protein, 6 aa, Mycobacterium
TQGDVE

SEQ ID NO: 599801 - protein, 6 aa, Mycobacterium
TQGERT

SEQ ID NO: 599802 - protein, 5 aa, Mycobacterium
TQGET

SEQ ID NO: 599803 - protein, 14 aa, Mycobacterium
TQGFTAPVSQRHQK

SEQ ID NO: 599804 - protein, 9 aa, Mycobacterium
TQGGEESQC

SEQ ID NO: 599805 - protein, 7 aa, Mycobacterium
TQGGPER

SEQ ID NO: 599806 - protein, 14 aa, Mycobacterium
TQGGPGSENSPIGV

SEQ ID NO: 599807 - protein, 8 aa, Mycobacterium
TQGGTESQ

SEQ ID NO: 599808 - protein, 14 aa, Mycobacterium
TQGHPNQVGPGKRP

SEQ ID NO: 599809 - protein, 8 aa, Mycobacterium
TQGHQTDA

SEQ ID NO: 599810 - protein, 7 aa, Mycobacterium
TQGHTQS

SEQ ID NO: 599811 - protein, 4 aa, Mycobacterium
TQGL

SEQ ID NO: 599812 - protein, 10 aa, Mycobacterium
TQGMRNHAKT

SEQ ID NO: 599813 - protein, 11 aa, Mycobacterium
TQGMRNHAKTD

SEQ ID NO: 599814 - protein, 4 aa, Mycobacterium
TQGN

SEQ ID NO: 599815 - protein, 7 aa, Mycobacterium
TQGNPIR

SEQ ID NO: 599816 - protein, 6 aa, Mycobacterium
TQGNPL

SEQ ID NO: 599817 - protein, 5 aa, Mycobacterium
TQGNT

SEQ ID NO: 599818 - protein, 10 aa, Mycobacterium
TQGPAGPISE

SEQ ID NO: 599819 - protein, 8 aa, Mycobacterium
TQGPGAWP

SEQ ID NO: 599820 - protein, 14 aa, Mycobacterium
TQGPKGPQAVGVTA

SEQ ID NO: 599821 - protein, 8 aa, Mycobacterium
TQGPPTPV

SEQ ID NO: 599822 - protein, 6 aa, Mycobacterium
TQGPWG

SEQ ID NO: 599823 - protein, 4 aa, Mycobacterium
TQGQ

SEQ ID NO: 599824 - protein, 5 aa, Mycobacterium
TQGQP

SEQ ID NO: 599825 - protein, 4 aa, Mycobacterium
TQGR

SEQ ID NO: 599826 - protein, 6 aa, Mycobacterium
TQGRAG

SEQ ID NO: 599827 - protein, 7 aa, Mycobacterium
TQGRARR

SEQ ID NO: 599828 - protein, 5 aa, Mycobacterium
TQGRG

SEQ ID NO: 599829 - protein, 6 aa, Mycobacterium
TQGRLD

SEQ ID NO: 599830 - protein, 7 aa, Mycobacterium
TQGRLNR

SEQ ID NO: 599831 - protein, 5 aa, Mycobacterium
TQGRP

SEQ ID NO: 599832 - protein, 13 aa, Mycobacterium
TQGRPDTKAGSHE

SEQ ID NO: 599833 - protein, 5 aa, Mycobacterium
TQGRR

SEQ ID NO: 599834 - protein, 4 aa, Mycobacterium
TQGS

SEQ ID NO: 599835 - protein, 7 aa, Mycobacterium
TQGSKGA

SEQ ID NO: 599836 - protein, 5 aa, Mycobacterium
TQGSS

SEQ ID NO: 599837 - protein, 6 aa, Mycobacterium
TQGSSV

SEQ ID NO: 599838 - protein, 6 aa, Mycobacterium
TQGTDQ

SEQ ID NO: 599839 - protein, 7 aa, Mycobacterium
TQGTDQW

SEQ ID NO: 599840 - protein, 13 aa, Mycobacterium
TQGTGDPASDFAT

SEQ ID NO: 599841 - protein, 6 aa, Mycobacterium
TQGTYR

SEQ ID NO: 599842 - protein, 4 aa, Mycobacterium
TQGV

SEQ ID NO: 599843 - protein, 7 aa, Mycobacterium
TQGVGGC

SEQ ID NO: 599844 - protein, 17 aa, Mycobacterium
TQGVNPAPLAQGHKTSG

SEQ ID NO: 599845 - protein, 5 aa, Mycobacterium
TQGVR

SEQ ID NO: 599846 - protein, 6 aa, Mycobacterium
TQGWQP

SEQ ID NO: 599847 - protein, 11 aa, Mycobacterium
TQHAASNGDER

SEQ ID NO: 599848 - protein, 7 aa, Mycobacterium
TQHPDGT

SEQ ID NO: 599849 - protein, 13 aa, Mycobacterium
TQHPERASFPPQV

SEQ ID NO: 599850 - protein, 12 aa, Mycobacterium
TQHPLGEGFSGA

SEQ ID NO: 599851 - protein, 5 aa, Mycobacterium
TQHQR

SEQ ID NO: 599852 - protein, 5 aa, Mycobacterium
TQIDP

SEQ ID NO: 599853 - protein, 7 aa, Mycobacterium
TQIDPKG

SEQ ID NO: 599854 - protein, 6 aa, Mycobacterium
TQIDPN

SEQ ID NO: 599855 - protein, 6 aa, Mycobacterium
TQIDTS

SEQ ID NO: 599856 - protein, 6 aa, Mycobacterium
TQIEAG

SEQ ID NO: 599857 - protein, 11 aa, Mycobacterium
TQIEGDPKVTG

SEQ ID NO: 599858 - protein, 6 aa, Mycobacterium
TQIGEG

SEQ ID NO: 599859 - protein, 6 aa, Mycobacterium
TQIGPQ

SEQ ID NO: 599860 - protein, 12 aa, Mycobacterium
TQIGRNAGLPGG

SEQ ID NO: 599861 - protein, 8 aa, Mycobacterium
TQIGRNGG

SEQ ID NO: 599862 - protein, 9 aa, Mycobacterium
TQIGRNGGH

SEQ ID NO: 599863 - protein, 7 aa, Mycobacterium
TQIGRNR

SEQ ID NO: 599864 - protein, 4 aa, Mycobacterium
TQIP

SEQ ID NO: 599865 - protein, 16 aa, Mycobacterium
TQISYGGEEHIPGSGG

SEQ ID NO: 599866 - protein, 5 aa, Mycobacterium
TQITE

SEQ ID NO: 599867 - protein, 10 aa, Mycobacterium
TQKAEGKNTD

SEQ ID NO: 599868 - protein, 16 aa, Mycobacterium
TQKFTPAALQDETKPE

SEQ ID NO: 599869 - protein, 7 aa, Mycobacterium
TQKGLNI

SEQ ID NO: 599870 - protein, 12 aa, Mycobacterium
TQKLTEETEKAL

SEQ ID NO: 599871 - protein, 19 aa, Mycobacterium
TQKPADSADAVIDRVSAPV

SEQ ID NO: 599872 - protein, 8 aa, Mycobacterium
TQKSNQFN

SEQ ID NO: 599873 - protein, 4 aa, Mycobacterium
TQKT

SEQ ID NO: 599874 - protein, 11 aa, Mycobacterium
TQKTTRNLSDE

SEQ ID NO: 599875 - protein, 18 aa, Mycobacterium
TQKVQAAEDAWNTRDPQR

SEQ ID NO: 599876 - protein, 11 aa, Mycobacterium
TQLDGDPSRLR

SEQ ID NO: 599877 - protein, 7 aa, Mycobacterium
TQLDGDT

SEQ ID NO: 599878 - protein, 16 aa, Mycobacterium
TQLDSVSRSRQIRQRA

SEQ ID NO: 599879 - protein, 6 aa, Mycobacterium
TQLGGE

SEQ ID NO: 599880 - protein, 9 aa, Mycobacterium
TQLGPAAPP

SEQ ID NO: 599881 - protein, 8 aa, Mycobacterium
TQLGPQRP

SEQ ID NO: 599882 - protein, 8 aa, Mycobacterium
TQLGPQTP

SEQ ID NO: 599883 - protein, 10 aa, Mycobacterium
TQLNGVPRDA

SEQ ID NO: 599884 - protein, 14 aa, Mycobacterium
TQLPAGTTVSVWNL

SEQ ID NO: 599885 - protein, 5 aa, Mycobacterium
TQLPP

SEQ ID NO: 599886 - protein, 10 aa, Mycobacterium
TQLQEPTAAE

SEQ ID NO: 599887 - protein, 4 aa, Mycobacterium
TQLS

SEQ ID NO: 599888 - protein, 5 aa, Mycobacterium
TQLSG

SEQ ID NO: 599889 - protein, 9 aa, Mycobacterium
TQLSTAGNS

SEQ ID NO: 599890 - protein, 4 aa, Mycobacterium
TQLV

SEQ ID NO: 599891 - protein, 5 aa, Mycobacterium
TQMPA

SEQ ID NO: 599892 - protein, 9 aa, Mycobacterium
TQNATGPTV

SEQ ID NO: 599893 - protein, 15 aa, Mycobacterium
TQNDPDLAPPGKHAA

SEQ ID NO: 599894 - protein, 12 aa, Mycobacterium
TQNELDGKDARR

SEQ ID NO: 599895 - protein, 11 aa, Mycobacterium
TQNEVSGDDAR

SEQ ID NO: 599896 - protein, 36 aa, Mycobacterium
TQNGDQAPIPADDGSDVAGGGMKPTQKPPAEEDDET

SEQ ID NO: 599897 - protein, 14 aa, Mycobacterium
TQNGRGEMAANEHA

SEQ ID NO: 599898 - protein, 14 aa, Mycobacterium
TQNGTTPTPLKPGG

SEQ ID NO: 599899 - protein, 6 aa, Mycobacterium
TQNNRE

SEQ ID NO: 599900 - protein, 7 aa, Mycobacterium
TQNPASL

SEQ ID NO: 599901 - protein, 6 aa, Mycobacterium
TQNPEL

SEQ ID NO: 599902 - protein, 7 aa, Mycobacterium
TQNPHTR

SEQ ID NO: 599903 - protein, 6 aa, Mycobacterium
TQNPQL

SEQ ID NO: 599904 - protein, 14 aa, Mycobacterium
TQNVGESARRRGDE

SEQ ID NO: 599905 - protein, 4 aa, Mycobacterium
TQPA

SEQ ID NO: 599906 - protein, 8 aa, Mycobacterium
TQPAADNP

SEQ ID NO: 599907 - protein, 6 aa, Mycobacterium
TQPAAR

SEQ ID NO: 599908 - protein, 5 aa, Mycobacterium
TQPAG

SEQ ID NO: 599909 - protein, 9 aa, Mycobacterium
TQPAKLKEG

SEQ ID NO: 599910 - protein, 8 aa, Mycobacterium
TQPAKVDN

SEQ ID NO: 599911 - protein, 10 aa, Mycobacterium
TQPALPSTAA

SEQ ID NO: 599912 - protein, 27 aa, Mycobacterium
TQPAPAPRFSRTRPATPSAPALPGDHT

SEQ ID NO: 599913 - protein, 4 aa, Mycobacterium
TQPD

SEQ ID NO: 599914 - protein, 9 aa, Mycobacterium
TQPDGPSFS

SEQ ID NO: 599915 - protein, 10 aa, Mycobacterium
TQPDGPSFTI

SEQ ID NO: 599916 - protein, 6 aa, Mycobacterium
TQPDKA

SEQ ID NO: 599917 - protein, 7 aa, Mycobacterium
TQPDKPV

SEQ ID NO: 599918 - protein, 15 aa, Mycobacterium
TQPDLGLPAEGDPVT

SEQ ID NO: 599919 - protein, 6 aa, Mycobacterium
TQPDPR

SEQ ID NO: 599920 - protein, 6 aa, Mycobacterium
TQPDQR

SEQ ID NO: 599921 - protein, 6 aa, Mycobacterium
TQPDQV

SEQ ID NO: 599922 - protein, 7 aa, Mycobacterium
TQPDQVG

SEQ ID NO: 599923 - protein, 6 aa, Mycobacterium
TQPDQW

SEQ ID NO: 599924 - protein, 8 aa, Mycobacterium
TQPDRRVD

SEQ ID NO: 599925 - protein, 7 aa, Mycobacterium
TQPDSGG

SEQ ID NO: 599926 - protein, 9 aa, Mycobacterium
TQPDSSIPP

SEQ ID NO: 599927 - protein, 6 aa, Mycobacterium
TQPEDA

SEQ ID NO: 599928 - protein, 10 aa, Mycobacterium
TQPEGELDET

SEQ ID NO: 599929 - protein, 8 aa, Mycobacterium
TQPEHRQP

SEQ ID NO: 599930 - protein, 17 aa, Mycobacterium
TQPEPGGAVRSAELTPG

SEQ ID NO: 599931 - protein, 6 aa, Mycobacterium
TQPEQM

SEQ ID NO: 599932 - protein, 19 aa, Mycobacterium
TQPGAGGEGGGAAPRFITR

SEQ ID NO: 599933 - protein, 7 aa, Mycobacterium
TQPGALN

SEQ ID NO: 599934 - protein, 5 aa, Mycobacterium
TQPGD

SEQ ID NO: 599935 - protein, 6 aa, Mycobacterium
TQPGEG

SEQ ID NO: 599936 - protein, 11 aa, Mycobacterium
TQPGGGDEQTS

SEQ ID NO: 599937 - protein, 17 aa, Mycobacterium
TQPGKTYDVSSPDLPTV

SEQ ID NO: 599938 - protein, 7 aa, Mycobacterium
TQPGPVT

SEQ ID NO: 599939 - protein, 11 aa, Mycobacterium
TQPGTDDVTPA

SEQ ID NO: 599940 - protein, 9 aa, Mycobacterium
TQPHGPSFT

SEQ ID NO: 599941 - protein, 4 aa, Mycobacterium
TQPI

SEQ ID NO: 599942 - protein, 31 aa, Mycobacterium
TQPLAASAKPVKSAPPEPEPEPGSGSGRSMS

SEQ ID NO: 599943 - protein, 5 aa, Mycobacterium
TQPLE

SEQ ID NO: 599944 - protein, 12 aa, Mycobacterium
TQPLENPEAAAD

SEQ ID NO: 599945 - protein, 9 aa, Mycobacterium
TQPNPSGGV

SEQ ID NO: 599946 - protein, 8 aa, Mycobacterium
TQPPEQTA

SEQ ID NO: 599947 - protein, 8 aa, Mycobacterium
TQPPEYDQ

SEQ ID NO: 599948 - protein, 16 aa, Mycobacterium
TQPPGGEAATSLTSDT

SEQ ID NO: 599949 - protein, 14 aa, Mycobacterium
TQPPPLEDRKGDGH

SEQ ID NO: 599950 - protein, 36 aa, Mycobacterium
TQPPQTTNAGAQSAQAAAVGQATGTSAAGSAQRTLS

SEQ ID NO: 599951 - protein, 31 aa, Mycobacterium
TQPPTTTVPAGQTAQAAAVDQAAGASAPGNV

SEQ ID NO: 599952 - protein, 6 aa, Mycobacterium
TQPQAN

SEQ ID NO: 599953 - protein, 5 aa, Mycobacterium
TQPQH

SEQ ID NO: 599954 - protein, 6 aa, Mycobacterium
TQPRQS

SEQ ID NO: 599955 - protein, 8 aa, Mycobacterium
TQPRRDRA

SEQ ID NO: 599956 - protein, 5 aa, Mycobacterium
TQPSL

SEQ ID NO: 599957 - protein, 9 aa, Mycobacterium
TQPSPAANG

SEQ ID NO: 599958 - protein, 8 aa, Mycobacterium
TQPTGDKD

SEQ ID NO: 599959 - protein, 7 aa, Mycobacterium
TQPTGQV

SEQ ID NO: 599960 - protein, 25 aa, Mycobacterium
TQPTGSVEINGKRDGASAWSGVSTP

SEQ ID NO: 599961 - protein, 6 aa, Mycobacterium
TQPTIA

SEQ ID NO: 599962 - protein, 5 aa, Mycobacterium
TQPTP

SEQ ID NO: 599963 - protein, 7 aa, Mycobacterium
TQPTVAG

SEQ ID NO: 599964 - protein, 14 aa, Mycobacterium
TQPVGRSRRAKDAA

SEQ ID NO: 599965 - protein, 10 aa, Mycobacterium
TQPVPGSGGR

SEQ ID NO: 599966 - protein, 4 aa, Mycobacterium
TQPW

SEQ ID NO: 599967 - protein, 16 aa, Mycobacterium
TQPWPTGATHPANTKS

SEQ ID NO: 599968 - protein, 14 aa, Mycobacterium
TQPWPTGPTHPANT

SEQ ID NO: 599969 - protein, 8 aa, Mycobacterium
TQQETESL

SEQ ID NO: 599970 - protein, 4 aa, Mycobacterium
TQQG

SEQ ID NO: 599971 - protein, 5 aa, Mycobacterium
TQQGN

SEQ ID NO: 599972 - protein, 5 aa, Mycobacterium
TQQGT

SEQ ID NO: 599973 - protein, 5 aa, Mycobacterium
TQQGV

SEQ ID NO: 599974 - protein, 5 aa, Mycobacterium
TQQIE

SEQ ID NO: 599975 - protein, 12 aa, Mycobacterium
TQQLGAPSGYTC

SEQ ID NO: 599976 - protein, 21 aa, Mycobacterium
TQQNEAAESSKEECSTESSGD

SEQ ID NO: 599977 - protein, 18 aa, Mycobacterium
TQQNEAVREECSSPSEID

SEQ ID NO: 599978 - protein, 17 aa, Mycobacterium
TQQNESTDEECSTQSDT

SEQ ID NO: 599979 - protein, 11 aa, Mycobacterium
TQQNGTERPFT

SEQ ID NO: 599980 - protein, 5 aa, Mycobacterium
TQQNV

SEQ ID NO: 599981 - protein, 9 aa, Mycobacterium
TQQPGAMDP

SEQ ID NO: 599982 - protein, 6 aa, Mycobacterium
TQQPRR

SEQ ID NO: 599983 - protein, 4 aa, Mycobacterium
TQQQ

SEQ ID NO: 599984 - protein, 11 aa, Mycobacterium
TQQQEFKDAQG

SEQ ID NO: 599985 - protein, 11 aa, Mycobacterium
TQQRDGGRTIS

SEQ ID NO: 599986 - protein, 5 aa, Mycobacterium
TQQRF

SEQ ID NO: 599987 - protein, 9 aa, Mycobacterium
TQQSTAGDY

SEQ ID NO: 599988 - protein, 15 aa, Mycobacterium
TQQTATGAPGHTVCT

SEQ ID NO: 599989 - protein, 15 aa, Mycobacterium
TQQTYRELTSTSNCT

SEQ ID NO: 599990 - protein, 4 aa, Mycobacterium
TQQV

SEQ ID NO: 599991 - protein, 16 aa, Mycobacterium
TQQVSDTANTYAESYG

SEQ ID NO: 599992 - protein, 4 aa, Mycobacterium
TQRA

SEQ ID NO: 599993 - protein, 28 aa, Mycobacterium
TQRAPQAKVEYNPGNDPASAAAVAKSSE

SEQ ID NO: 599994 - protein, 17 aa, Mycobacterium
TQRAQPVRKPPAERVSP

SEQ ID NO: 599995 - protein, 7 aa, Mycobacterium
TQRARKV

SEQ ID NO: 599996 - protein, 6 aa, Mycobacterium
TQRDRA

SEQ ID NO: 599997 - protein, 5 aa, Mycobacterium
TQRGE

SEQ ID NO: 599998 - protein, 7 aa, Mycobacterium
TQRGGRQ

SEQ ID NO: 599999 - protein, 5 aa, Mycobacterium
TQRGS

SEQ ID NO: 600000 - protein, 6 aa, Mycobacterium
TQRGSP

SEQ ID NO: 600001 - protein, 6 aa, Mycobacterium
TQRGTM

SEQ ID NO: 600002 - protein, 11 aa, Mycobacterium
TQRGTSPEGLN

SEQ ID NO: 600003 - protein, 14 aa, Mycobacterium
TQRGTWRAGEQPSH

SEQ ID NO: 600004 - protein, 10 aa, Mycobacterium
TQRGYPADVS

SEQ ID NO: 600005 - protein, 13 aa, Mycobacterium
TQRNAGRRTAGID

SEQ ID NO: 600006 - protein, 8 aa, Mycobacterium
TQRNPTSE

SEQ ID NO: 600007 - protein, 5 aa, Mycobacterium
TQRPE

SEQ ID NO: 600008 - protein, 7 aa, Mycobacterium
TQRPIGA

SEQ ID NO: 600009 - protein, 5 aa, Mycobacterium
TQRPR

SEQ ID NO: 600010 - protein, 8 aa, Mycobacterium
TQRPSSES

SEQ ID NO: 600011 - protein, 5 aa, Mycobacterium
TQRPV

SEQ ID NO: 600012 - protein, 13 aa, Mycobacterium
TQRQQWSGRPGEV

SEQ ID NO: 600013 - protein, 5 aa, Mycobacterium
TQRRE

SEQ ID NO: 600014 - protein, 10 aa, Mycobacterium
TQRRGFGGYG

SEQ ID NO: 600015 - protein, 6 aa, Mycobacterium
TQRRRQ

SEQ ID NO: 600016 - protein, 27 aa, Mycobacterium
TQRRYRPGRRGRIGPSPQRGGGEHGLG

SEQ ID NO: 600017 - protein, 4 aa, Mycobacterium
TQRT

SEQ ID NO: 600018 - protein, 5 aa, Mycobacterium
TQRTI

SEQ ID NO: 600019 - protein, 8 aa, Mycobacterium
TQRTVSQS

SEQ ID NO: 600020 - protein, 11 aa, Mycobacterium
TQSADGATFDD

SEQ ID NO: 600021 - protein, 14 aa, Mycobacterium
TQSAEEIDGPGATS

SEQ ID NO: 600022 - protein, 8 aa, Mycobacterium
TQSAQAAR

SEQ ID NO: 600023 - protein, 5 aa, Mycobacterium
TQSAT

SEQ ID NO: 600024 - protein, 6 aa, Mycobacterium
TQSATA

SEQ ID NO: 600025 - protein, 9 aa, Mycobacterium
TQSAWSPAS

SEQ ID NO: 600026 - protein, 6 aa, Mycobacterium
TQSDSV

SEQ ID NO: 600027 - protein, 4 aa, Mycobacterium
TQSE

SEQ ID NO: 600028 - protein, 4 aa, Mycobacterium
TQSF

SEQ ID NO: 600029 - protein, 7 aa, Mycobacterium
TQSGASG

SEQ ID NO: 600030 - protein, 7 aa, Mycobacterium
TQSGELE

SEQ ID NO: 600031 - protein, 7 aa, Mycobacterium
TQSGGGD

SEQ ID NO: 600032 - protein, 6 aa, Mycobacterium
TQSGIP

SEQ ID NO: 600033 - protein, 7 aa, Mycobacterium
TQSGTQW

SEQ ID NO: 600034 - protein, 7 aa, Mycobacterium
TQSGTTL

SEQ ID NO: 600035 - protein, 5 aa, Mycobacterium
TQSGV

SEQ ID NO: 600036 - protein, 25 aa, Mycobacterium
TQSKASSTAPSPRHMTDTTSIKGAS

SEQ ID NO: 600037 - protein, 10 aa, Mycobacterium
TQSKEDHGLP

SEQ ID NO: 600038 - protein, 4 aa, Mycobacterium
TQSN

SEQ ID NO: 600039 - protein, 5 aa, Mycobacterium
TQSPR

SEQ ID NO: 600040 - protein, 12 aa, Mycobacterium
TQSPVSEAMQPR

SEQ ID NO: 600041 - protein, 4 aa, Mycobacterium
TQSQ

SEQ ID NO: 600042 - protein, 7 aa, Mycobacterium
TQSQHAA

SEQ ID NO: 600043 - protein, 5 aa, Mycobacterium
TQSQL

SEQ ID NO: 600044 - protein, 8 aa, Mycobacterium
TQSQTEGL

SEQ ID NO: 600045 - protein, 5 aa, Mycobacterium
TQSRK

SEQ ID NO: 600046 - protein, 16 aa, Mycobacterium
TQSRRRAAATGGESQI

SEQ ID NO: 600047 - protein, 17 aa, Mycobacterium
TQSRRRAAATGGESRIP

SEQ ID NO: 600048 - protein, 10 aa, Mycobacterium
TQSRTANRAD

SEQ ID NO: 600049 - protein, 10 aa, Mycobacterium
TQSRTANRSA

SEQ ID NO: 600050 - protein, 9 aa, Mycobacterium
TQSSGQDHA

SEQ ID NO: 600051 - protein, 6 aa, Mycobacterium
TQSSSI

SEQ ID NO: 600052 - protein, 6 aa, Mycobacterium
TQSTAA

SEQ ID NO: 600053 - protein, 8 aa, Mycobacterium
TQSTENGR

SEQ ID NO: 600054 - protein, 38 aa, Mycobacterium
TQSTGSGIPESALRPSRTADVSHRSANTQDQASEAEEK

SEQ ID NO: 600055 - protein, 7 aa, Mycobacterium
TQSVGDE

SEQ ID NO: 600056 - protein, 7 aa, Mycobacterium
TQSVNDE

SEQ ID NO: 600057 - protein, 5 aa, Mycobacterium
TQSVT

SEQ ID NO: 600058 - protein, 13 aa, Mycobacterium
TQTAARKSGGYEN

SEQ ID NO: 600059 - protein, 13 aa, Mycobacterium
TQTADGLFALAGE

SEQ ID NO: 600060 - protein, 31 aa, Mycobacterium
TQTANTAAGTVTKNLAGTANLAGTTTGATGP

SEQ ID NO: 600061 - protein, 11 aa, Mycobacterium
TQTARTNGERE

SEQ ID NO: 600062 - protein, 8 aa, Mycobacterium
TQTATGPT

SEQ ID NO: 600063 - protein, 8 aa, Mycobacterium
TQTATPVP

SEQ ID NO: 600064 - protein, 10 aa, Mycobacterium
TQTDGIGKRF

SEQ ID NO: 600065 - protein, 11 aa, Mycobacterium
TQTDGIGKRFD

SEQ ID NO: 600066 - protein, 13 aa, Mycobacterium
TQTDGIGKSHDDS

SEQ ID NO: 600067 - protein, 14 aa, Mycobacterium
TQTDGIGKTADDSR

SEQ ID NO: 600068 - protein, 13 aa, Mycobacterium
TQTDGLGKRYDDS

SEQ ID NO: 600069 - protein, 13 aa, Mycobacterium
TQTDGQVQPTTTA

SEQ ID NO: 600070 - protein, 14 aa, Mycobacterium
TQTDTQQTELAGDD

SEQ ID NO: 600071 - protein, 4 aa, Mycobacterium
TQTE

SEQ ID NO: 600072 - protein, 9 aa, Mycobacterium
TQTEEAAGR

SEQ ID NO: 600073 - protein, 9 aa, Mycobacterium
TQTEIGGRR

SEQ ID NO: 600074 - protein, 8 aa, Mycobacterium
TQTEVGAT

SEQ ID NO: 600075 - protein, 8 aa, Mycobacterium
TQTGNAEI

SEQ ID NO: 600076 - protein, 7 aa, Mycobacterium
TQTGPIT

SEQ ID NO: 600077 - protein, 7 aa, Mycobacterium
TQTGRAV

SEQ ID NO: 600078 - protein, 8 aa, Mycobacterium
TQTGTGPT

SEQ ID NO: 600079 - protein, 9 aa, Mycobacterium
TQTGTGPTV

SEQ ID NO: 600080 - protein, 9 aa, Mycobacterium
TQTGTRAHG

SEQ ID NO: 600081 - protein, 17 aa, Mycobacterium
TQTGTVAQSGRSGGRPA

SEQ ID NO: 600082 - protein, 11 aa, Mycobacterium
TQTHPGVPEEL

SEQ ID NO: 600083 - protein, 5 aa, Mycobacterium
TQTIR

SEQ ID NO: 600084 - protein, 8 aa, Mycobacterium
TQTIRPDE

SEQ ID NO: 600085 - protein, 15 aa, Mycobacterium
TQTKHSSPQRVAESR

SEQ ID NO: 600086 - protein, 4 aa, Mycobacterium
TQTL

SEQ ID NO: 600087 - protein, 7 aa, Mycobacterium
TQTLTRN

SEQ ID NO: 600088 - protein, 6 aa, Mycobacterium
TQTMDE

SEQ ID NO: 600089 - protein, 10 aa, Mycobacterium
TQTNGPADYP

SEQ ID NO: 600090 - protein, 6 aa, Mycobacterium
TQTNGT

SEQ ID NO: 600091 - protein, 7 aa, Mycobacterium
TQTNTTI

SEQ ID NO: 600092 - protein, 11 aa, Mycobacterium
TQTPDGVAERP

SEQ ID NO: 600093 - protein, 9 aa, Mycobacterium
TQTPEGEPV

SEQ ID NO: 600094 - protein, 6 aa, Mycobacterium
TQTPSA

SEQ ID NO: 600095 - protein, 6 aa, Mycobacterium
TQTPSE

SEQ ID NO: 600096 - protein, 8 aa, Mycobacterium
TQTPSEAG

SEQ ID NO: 600097 - protein, 6 aa, Mycobacterium
TQTPSS

SEQ ID NO: 600098 - protein, 16 aa, Mycobacterium
TQTPSSLGALSPDGVG

SEQ ID NO: 600099 - protein, 5 aa, Mycobacterium
TQTPV

SEQ ID NO: 600100 - protein, 12 aa, Mycobacterium
TQTPVPDGGPEV

SEQ ID NO: 600101 - protein, 5 aa, Mycobacterium
TQTQD

SEQ ID NO: 600102 - protein, 9 aa, Mycobacterium
TQTQQPCAA

SEQ ID NO: 600103 - protein, 4 aa, Mycobacterium
TQTR

SEQ ID NO: 600104 - protein, 15 aa, Mycobacterium
TQTRAALGKLERVLL

SEQ ID NO: 600105 - protein, 6 aa, Mycobacterium
TQTRAP

SEQ ID NO: 600106 - protein, 13 aa, Mycobacterium
TQTRDGRFALAGE

SEQ ID NO: 600107 - protein, 5 aa, Mycobacterium
TQTRL

SEQ ID NO: 600108 - protein, 7 aa, Mycobacterium
TQTRTAT

SEQ ID NO: 600109 - protein, 11 aa, Mycobacterium
TQTSADEQYAT

SEQ ID NO: 600110 - protein, 6 aa, Mycobacterium
TQTSTI

SEQ ID NO: 600111 - protein, 11 aa, Mycobacterium
TQTTDEPEARK

SEQ ID NO: 600112 - protein, 6 aa, Mycobacterium
TQTTDR

SEQ ID NO: 600113 - protein, 8 aa, Mycobacterium
TQTTKEQL

SEQ ID NO: 600114 - protein, 8 aa, Mycobacterium
TQTTVSAN

SEQ ID NO: 600115 - protein, 7 aa, Mycobacterium
TQTTYSS

SEQ ID NO: 600116 - protein, 4 aa, Mycobacterium
TQTY

SEQ ID NO: 600117 - protein, 20 aa, Mycobacterium
TQVAETETETAADEYAAPRE

SEQ ID NO: 600118 - protein, 5 aa, Mycobacterium
TQVAP

SEQ ID NO: 600119 - protein, 4 aa, Mycobacterium
TQVD

SEQ ID NO: 600120 - protein, 6 aa, Mycobacterium
TQVDPE

SEQ ID NO: 600121 - protein, 5 aa, Mycobacterium
TQVGD

SEQ ID NO: 600122 - protein, 30 aa, Mycobacterium
TQVGEGPTENPNADEPSSADPNEPPPETCA

SEQ ID NO: 600123 - protein, 6 aa, Mycobacterium
TQVGPD

SEQ ID NO: 600124 - protein, 12 aa, Mycobacterium
TQVGREATEPMR

SEQ ID NO: 600125 - protein, 5 aa, Mycobacterium
TQVNA

SEQ ID NO: 600126 - protein, 12 aa, Mycobacterium
TQVPGRGTTVVL

SEQ ID NO: 600127 - protein, 7 aa, Mycobacterium
TQVPQRP

SEQ ID NO: 600128 - protein, 5 aa, Mycobacterium
TQVRA

SEQ ID NO: 600129 - protein, 8 aa, Mycobacterium
TQVRPSQV

SEQ ID NO: 600130 - protein, 4 aa, Mycobacterium
TQVT

SEQ ID NO: 600131 - protein, 16 aa, Mycobacterium
TQVVGPREGDTPRTRL

SEQ ID NO: 600132 - protein, 16 aa, Mycobacterium
TQVVGPRHGDNPRTRL

SEQ ID NO: 600133 - protein, 9 aa, Mycobacterium
TQWRTAGDR

SEQ ID NO: 600134 - protein, 15 aa, Mycobacterium
TQYARDTADISDRQN

SEQ ID NO: 600135 - protein, 9 aa, Mycobacterium
TQYPDDATK

SEQ ID NO: 600136 - protein, 9 aa, Mycobacterium
TQYPDDETK

SEQ ID NO: 600137 - protein, 9 aa, Mycobacterium
TQYPDDPAK

SEQ ID NO: 600138 - protein, 7 aa, Mycobacterium
TQYRPDQ

SEQ ID NO: 600139 - protein, 5 aa, Mycobacterium
TQYSS

SEQ ID NO: 600140 - protein, 12 aa, Mycobacterium
TRAAAAGRDPYD

SEQ ID NO: 600141 - protein, 12 aa, Mycobacterium
TRAAAAPDRSRI

SEQ ID NO: 600142 - protein, 21 aa, Mycobacterium
TRAAADAQLAHTGSGLGPEEL

SEQ ID NO: 600143 - protein, 11 aa, Mycobacterium
TRAAAELDRAA

SEQ ID NO: 600144 - protein, 21 aa, Mycobacterium
TRAAAGDPRGAAEAAEHERAI

SEQ ID NO: 600145 - protein, 9 aa, Mycobacterium
TRAAAQPVV

SEQ ID NO: 600146 - protein, 6 aa, Mycobacterium
TRAADA

SEQ ID NO: 600147 - protein, 11 aa, Mycobacterium
TRAADDGRPLH

SEQ ID NO: 600148 - protein, 21 aa, Mycobacterium
TRAADDGRPLHSETGYVRSPA

SEQ ID NO: 600149 - protein, 7 aa, Mycobacterium
TRAADNS

SEQ ID NO: 600150 - protein, 9 aa, Mycobacterium
TRAADPAAM

SEQ ID NO: 600151 - protein, 9 aa, Mycobacterium
TRAADPPAM

SEQ ID NO: 600152 - protein, 13 aa, Mycobacterium
TRAADSDQDAASG

SEQ ID NO: 600153 - protein, 8 aa, Mycobacterium
TRAAEKQF

SEQ ID NO: 600154 - protein, 25 aa, Mycobacterium
TRAAGGVSSCASGASCASVAVSAGG

SEQ ID NO: 600155 - protein, 8 aa, Mycobacterium
TRAAGGVY

SEQ ID NO: 600156 - protein, 9 aa, Mycobacterium
TRAAGPNNL

SEQ ID NO: 600157 - protein, 10 aa, Mycobacterium
TRAAGSTDLR

SEQ ID NO: 600158 - protein, 19 aa, Mycobacterium
TRAAGTSAGTGTQATQSQL

SEQ ID NO: 600159 - protein, 9 aa, Mycobacterium
TRAAGWASA

SEQ ID NO: 600160 - protein, 10 aa, Mycobacterium
TRAARKGVTV

SEQ ID NO: 600161 - protein, 6 aa, Mycobacterium
TRAARR

SEQ ID NO: 600162 - protein, 9 aa, Mycobacterium
TRAATAYGE

SEQ ID NO: 600163 - protein, 9 aa, Mycobacterium
TRAATSYGE

SEQ ID NO: 600164 - protein, 8 aa, Mycobacterium
TRADDAQL

SEQ ID NO: 600165 - protein, 8 aa, Mycobacterium
TRADDRGR

SEQ ID NO: 600166 - protein, 5 aa, Mycobacterium
TRADE

SEQ ID NO: 600167 - protein, 10 aa, Mycobacterium
TRADEAGAGV

SEQ ID NO: 600168 - protein, 23 aa, Mycobacterium
TRADEHSKGGTSVSDAYDPTAAG

SEQ ID NO: 600169 - protein, 9 aa, Mycobacterium
TRADGERRA

SEQ ID NO: 600170 - protein, 13 aa, Mycobacterium
TRADGGDLAGRFG

SEQ ID NO: 600171 - protein, 9 aa, Mycobacterium
TRADHHEKA

SEQ ID NO: 600172 - protein, 9 aa, Mycobacterium
TRADHREQA

SEQ ID NO: 600173 - protein, 9 aa, Mycobacterium
TRADHRRQA

SEQ ID NO: 600174 - protein, 5 aa, Mycobacterium
TRAED

SEQ ID NO: 600175 - protein, 6 aa, Mycobacterium
TRAEEA

SEQ ID NO: 600176 - protein, 15 aa, Mycobacterium
TRAEKAGATVREPAQ

SEQ ID NO: 600177 - protein, 9 aa, Mycobacterium
TRAEPADAA

SEQ ID NO: 600178 - protein, 9 aa, Mycobacterium
TRAEPKDCG

SEQ ID NO: 600179 - protein, 10 aa, Mycobacterium
TRAEQRARQI

SEQ ID NO: 600180 - protein, 8 aa, Mycobacterium
TRAERDGD

SEQ ID NO: 600181 - protein, 8 aa, Mycobacterium
TRAERGGV

SEQ ID NO: 600182 - protein, 7 aa, Mycobacterium
TRAERRS

SEQ ID NO: 600183 - protein, 10 aa, Mycobacterium
TRAETDPQTA

SEQ ID NO: 600184 - protein, 8 aa, Mycobacterium
TRAFDDES

SEQ ID NO: 600185 - protein, 24 aa, Mycobacterium
TRAFGRGADDDRAAREDLVSNPKE

SEQ ID NO: 600186 - protein, 8 aa, Mycobacterium
TRAGAADF

SEQ ID NO: 600187 - protein, 24 aa, Mycobacterium
TRAGAGARHHGAARRRAPDEPGRR

SEQ ID NO: 600188 - protein, 8 aa, Mycobacterium
TRAGGATV

SEQ ID NO: 600189 - protein, 8 aa, Mycobacterium
TRAGMGQG

SEQ ID NO: 600190 - protein, 5 aa, Mycobacterium
TRAGR

SEQ ID NO: 600191 - protein, 7 aa, Mycobacterium
TRAGRDC

SEQ ID NO: 600192 - protein, 7 aa, Mycobacterium
TRAGSDR

SEQ ID NO: 600193 - protein, 11 aa, Mycobacterium
TRAGTADSEDA

SEQ ID NO: 600194 - protein, 7 aa, Mycobacterium
TRAGTPN

SEQ ID NO: 600195 - protein, 11 aa, Mycobacterium
TRAGTSGTDLR

SEQ ID NO: 600196 - protein, 52 aa, Mycobacterium
TRAGTTDDSPKPADPSAGQPSASTADPAPAVTDPAPAVAPDMADPGIADPGL

SEQ ID NO: 600197 - protein, 8 aa, Mycobacterium
TRAGVSRS

SEQ ID NO: 600198 - protein, 10 aa, Mycobacterium
TRAGVTPTAT

SEQ ID NO: 600199 - protein, 5 aa, Mycobacterium
TRAHN

SEQ ID NO: 600200 - protein, 8 aa, Mycobacterium
TRAHQTGA

SEQ ID NO: 600201 - protein, 7 aa, Mycobacterium
TRAIPRA

SEQ ID NO: 600202 - protein, 15 aa, Mycobacterium
TRAISGAEPGPEGNV

SEQ ID NO: 600203 - protein, 13 aa, Mycobacterium
TRAISSPDDGEEL

SEQ ID NO: 600204 - protein, 15 aa, Mycobacterium
TRAKGSGQREGGNAV

SEQ ID NO: 600205 - protein, 13 aa, Mycobacterium
TRAKNNGDGTYTI

SEQ ID NO: 600206 - protein, 10 aa, Mycobacterium
TRAKQETASA

SEQ ID NO: 600207 - protein, 4 aa, Mycobacterium
TRAL

SEQ ID NO: 600208 - protein, 11 aa, Mycobacterium
TRANAAAALAS

SEQ ID NO: 600209 - protein, 12 aa, Mycobacterium
TRANAAKALGAG

SEQ ID NO: 600210 - protein, 12 aa, Mycobacterium
TRANPVASADGP

SEQ ID NO: 600211 - protein, 5 aa, Mycobacterium
TRANT

SEQ ID NO: 600212 - protein, 5 aa, Mycobacterium
TRANY

SEQ ID NO: 600213 - protein, 8 aa, Mycobacterium
TRANYSEA

SEQ ID NO: 600214 - protein, 4 aa, Mycobacterium
TRAP

SEQ ID NO: 600215 - protein, 7 aa, Mycobacterium
TRAPDVA

SEQ ID NO: 600216 - protein, 7 aa, Mycobacterium
TRAPEIS

SEQ ID NO: 600217 - protein, 7 aa, Mycobacterium
TRAPQAV

SEQ ID NO: 600218 - protein, 14 aa, Mycobacterium
TRAPRARMTGSERR

SEQ ID NO: 600219 - protein, 10 aa, Mycobacterium
TRAPRPGEVD

SEQ ID NO: 600220 - protein, 11 aa, Mycobacterium
TRAPSPDPATG

SEQ ID NO: 600221 - protein, 5 aa, Mycobacterium
TRAPT

SEQ ID NO: 600222 - protein, 7 aa, Mycobacterium
TRAQAGV

SEQ ID NO: 600223 - protein, 5 aa, Mycobacterium
TRAQE

SEQ ID NO: 600224 - protein, 5 aa, Mycobacterium
TRAQR

SEQ ID NO: 600225 - protein, 17 aa, Mycobacterium
TRAQRAGNLRPDLTATD

SEQ ID NO: 600226 - protein, 11 aa, Mycobacterium
TRAQSGDTTAG

SEQ ID NO: 600227 - protein, 6 aa, Mycobacterium
TRAQSS

SEQ ID NO: 600228 - protein, 4 aa, Mycobacterium
TRAR

SEQ ID NO: 600229 - protein, 14 aa, Mycobacterium
TRARANGAAGDGFS

SEQ ID NO: 600230 - protein, 14 aa, Mycobacterium
TRARNNDDGTYTID

SEQ ID NO: 600231 - protein, 8 aa, Mycobacterium
TRARPGDR

SEQ ID NO: 600232 - protein, 20 aa, Mycobacterium
TRARRAGGSCEITSSGECGT

SEQ ID NO: 600233 - protein, 10 aa, Mycobacterium
TRARRDPGGD

SEQ ID NO: 600234 - protein, 14 aa, Mycobacterium
TRARRNDDGTYTID

SEQ ID NO: 600235 - protein, 6 aa, Mycobacterium
TRARSS

SEQ ID NO: 600236 - protein, 13 aa, Mycobacterium
TRARSTQMPDTES

SEQ ID NO: 600237 - protein, 6 aa, Mycobacterium
TRASAG

SEQ ID NO: 600238 - protein, 11 aa, Mycobacterium
TRASAGQYEDR

SEQ ID NO: 600239 - protein, 8 aa, Mycobacterium
TRASAGVY

SEQ ID NO: 600240 - protein, 15 aa, Mycobacterium
TRASARTRGKSDPID

SEQ ID NO: 600241 - protein, 10 aa, Mycobacterium
TRASDPPTMA

SEQ ID NO: 600242 - protein, 7 aa, Mycobacterium
TRASEEI

SEQ ID NO: 600243 - protein, 8 aa, Mycobacterium
TRASQTAE

SEQ ID NO: 600244 - protein, 23 aa, Mycobacterium
TRASRKSAQAAAVGYNRTKNQRT

SEQ ID NO: 600245 - protein, 8 aa, Mycobacterium
TRASRQTT

SEQ ID NO: 600246 - protein, 9 aa, Mycobacterium
TRASSGVYT

SEQ ID NO: 600247 - protein, 9 aa, Mycobacterium
TRASTETGV

SEQ ID NO: 600248 - protein, 5 aa, Mycobacterium
TRASY

SEQ ID NO: 600249 - protein, 9 aa, Mycobacterium
TRASYERRA

SEQ ID NO: 600250 - protein, 4 aa, Mycobacterium
TRAT

SEQ ID NO: 600251 - protein, 10 aa, Mycobacterium
TRATADELTG

SEQ ID NO: 600252 - protein, 6 aa, Mycobacterium
TRATAI

SEQ ID NO: 600253 - protein, 5 aa, Mycobacterium
TRATQ

SEQ ID NO: 600254 - protein, 17 aa, Mycobacterium
TRATRSRTVPRPTTSTE

SEQ ID NO: 600255 - protein, 9 aa, Mycobacterium
TRATSREGF

SEQ ID NO: 600256 - protein, 7 aa, Mycobacterium
TRATTGF

SEQ ID NO: 600257 - protein, 14 aa, Mycobacterium
TRATTVADDDDAEL

SEQ ID NO: 600258 - protein, 4 aa, Mycobacterium
TRAV

SEQ ID NO: 600259 - protein, 12 aa, Mycobacterium
TRAVADGAPLHA

SEQ ID NO: 600260 - protein, 9 aa, Mycobacterium
TRAVHGDPI

SEQ ID NO: 600261 - protein, 13 aa, Mycobacterium
TRAVPPERALNGP

SEQ ID NO: 600262 - protein, 7 aa, Mycobacterium
TRAVRDG

SEQ ID NO: 600263 - protein, 11 aa, Mycobacterium
TRCGQRDSATE

SEQ ID NO: 600264 - protein, 15 aa, Mycobacterium
TRDAAGRAAVDDGSV

SEQ ID NO: 600265 - protein, 6 aa, Mycobacterium
TRDADG

SEQ ID NO: 600266 - protein, 12 aa, Mycobacterium
TRDADGPAAGVD

SEQ ID NO: 600267 - protein, 13 aa, Mycobacterium
TRDADGPAAGVDE

SEQ ID NO: 600268 - protein, 10 aa, Mycobacterium
TRDADRAGKP

SEQ ID NO: 600269 - protein, 6 aa, Mycobacterium
TRDADS

SEQ ID NO: 600270 - protein, 12 aa, Mycobacterium
TRDAEGEANGIT

SEQ ID NO: 600271 - protein, 14 aa, Mycobacterium
TRDAEGRRQITPVG

SEQ ID NO: 600272 - protein, 8 aa, Mycobacterium
TRDAGKPV

SEQ ID NO: 600273 - protein, 9 aa, Mycobacterium
TRDAPRESF

SEQ ID NO: 600274 - protein, 10 aa, Mycobacterium
TRDAPSEQIP

SEQ ID NO: 600275 - protein, 10 aa, Mycobacterium
TRDAPTEPVP

SEQ ID NO: 600276 - protein, 7 aa, Mycobacterium
TRDARSD

SEQ ID NO: 600277 - protein, 6 aa, Mycobacterium
TRDASA

SEQ ID NO: 600278 - protein, 10 aa, Mycobacterium
TRDAVGSGKL

SEQ ID NO: 600279 - protein, 4 aa, Mycobacterium
TRDD

SEQ ID NO: 600280 - protein, 5 aa, Mycobacterium
TRDDA

SEQ ID NO: 600281 - protein, 19 aa, Mycobacterium
TRDDAPDAGPAWSPHLSWL

SEQ ID NO: 600282 - protein, 23 aa, Mycobacterium
TRDDDAPATPRRPLEEFFTGRSP

SEQ ID NO: 600283 - protein, 9 aa, Mycobacterium
TRDDEDSYT

SEQ ID NO: 600284 - protein, 5 aa, Mycobacterium
TRDDS

SEQ ID NO: 600285 - protein, 9 aa, Mycobacterium
TRDDTGRPF

SEQ ID NO: 600286 - protein, 6 aa, Mycobacterium
TRDDTT

SEQ ID NO: 600287 - protein, 4 aa, Mycobacterium
TRDE

SEQ ID NO: 600288 - protein, 16 aa, Mycobacterium
TRDEASSRMGETEFAQ

SEQ ID NO: 600289 - protein, 13 aa, Mycobacterium
TRDEDGPAAGVDE

SEQ ID NO: 600290 - protein, 6 aa, Mycobacterium
TRDELD

SEQ ID NO: 600291 - protein, 6 aa, Mycobacterium
TRDENS

SEQ ID NO: 600292 - protein, 11 aa, Mycobacterium
TRDEPHADAEK

SEQ ID NO: 600293 - protein, 9 aa, Mycobacterium
TRDEPPLPF

SEQ ID NO: 600294 - protein, 14 aa, Mycobacterium
TRDESQSGPQRHPI

SEQ ID NO: 600295 - protein, 8 aa, Mycobacterium
TRDFDDAD

SEQ ID NO: 600296 - protein, 22 aa, Mycobacterium
TRDFDEDAATHREPVLQRRTQK

SEQ ID NO: 600297 - protein, 5 aa, Mycobacterium
TRDGD

SEQ ID NO: 600298 - protein, 16 aa, Mycobacterium
TRDGDGAAESEPEAPR

SEQ ID NO: 600299 - protein, 9 aa, Mycobacterium
TRDGEETIS

SEQ ID NO: 600300 - protein, 15 aa, Mycobacterium
TRDGFGAAESEEDVP

SEQ ID NO: 600301 - protein, 16 aa, Mycobacterium
TRDGFSEAEADEPAPR

SEQ ID NO: 600302 - protein, 7 aa, Mycobacterium
TRDGGSF

SEQ ID NO: 600303 - protein, 8 aa, Mycobacterium
TRDGGSPV

SEQ ID NO: 600304 - protein, 8 aa, Mycobacterium
TRDGIRAD

SEQ ID NO: 600305 - protein, 7 aa, Mycobacterium
TRDGNSY

SEQ ID NO: 600306 - protein, 8 aa, Mycobacterium
TRDGQPEK

SEQ ID NO: 600307 - protein, 16 aa, Mycobacterium
TRDGRPITDHYRRRPQ

SEQ ID NO: 600308 - protein, 8 aa, Mycobacterium
TRDGRRYE

SEQ ID NO: 600309 - protein, 6 aa, Mycobacterium
TRDGRY

SEQ ID NO: 600310 - protein, 7 aa, Mycobacterium
TRDGSIT

SEQ ID NO: 600311 - protein, 6 aa, Mycobacterium
TRDGTP

SEQ ID NO: 600312 - protein, 18 aa, Mycobacterium
TRDGYDGQFGRASTADDV

SEQ ID NO: 600313 - protein, 5 aa, Mycobacterium
TRDHE

SEQ ID NO: 600314 - protein, 12 aa, Mycobacterium
TRDIGAAARKTV

SEQ ID NO: 600315 - protein, 6 aa, Mycobacterium
TRDITS

SEQ ID NO: 600316 - protein, 9 aa, Mycobacterium
TRDLDELSG

SEQ ID NO: 600317 - protein, 7 aa, Mycobacterium
TRDLPTL

SEQ ID NO: 600318 - protein, 5 aa, Mycobacterium
TRDLS

SEQ ID NO: 600319 - protein, 8 aa, Mycobacterium
TRDLSNEA

SEQ ID NO: 600320 - protein, 9 aa, Mycobacterium
TRDLSNEAT

SEQ ID NO: 600321 - protein, 8 aa, Mycobacterium
TRDLTDDQ

SEQ ID NO: 600322 - protein, 4 aa, Mycobacterium
TRDN

SEQ ID NO: 600323 - protein, 5 aa, Mycobacterium
TRDNG

SEQ ID NO: 600324 - protein, 6 aa, Mycobacterium
TRDNPG

SEQ ID NO: 600325 - protein, 5 aa, Mycobacterium
TRDNV

SEQ ID NO: 600326 - protein, 6 aa, Mycobacterium
TRDNYP

SEQ ID NO: 600327 - protein, 8 aa, Mycobacterium
TRDPDEHE

SEQ ID NO: 600328 - protein, 20 aa, Mycobacterium
TRDPDGTPHVAGTRPGRAGL

SEQ ID NO: 600329 - protein, 5 aa, Mycobacterium
TRDPE

SEQ ID NO: 600330 - protein, 8 aa, Mycobacterium
TRDPERHE

SEQ ID NO: 600331 - protein, 7 aa, Mycobacterium
TRDPLPD

SEQ ID NO: 600332 - protein, 9 aa, Mycobacterium
TRDPRNGRN

SEQ ID NO: 600333 - protein, 7 aa, Mycobacterium
TRDPVTC

SEQ ID NO: 600334 - protein, 8 aa, Mycobacterium
TRDPVTTD

SEQ ID NO: 600335 - protein, 9 aa, Mycobacterium
TRDQAERAV

SEQ ID NO: 600336 - protein, 6 aa, Mycobacterium
TRDQAY

SEQ ID NO: 600337 - protein, 5 aa, Mycobacterium
TRDQC

SEQ ID NO: 600338 - protein, 13 aa, Mycobacterium
TRDQGLRDTTAEA

SEQ ID NO: 600339 - protein, 14 aa, Mycobacterium
TRDQGLRDTTPEAL

SEQ ID NO: 600340 - protein, 8 aa, Mycobacterium
TRDQNQHG

SEQ ID NO: 600341 - protein, 6 aa, Mycobacterium
TRDQTG

SEQ ID NO: 600342 - protein, 12 aa, Mycobacterium
TRDRDTDPQGRA

SEQ ID NO: 600343 - protein, 12 aa, Mycobacterium
TRDRPGLGAGEA

SEQ ID NO: 600344 - protein, 13 aa, Mycobacterium
TRDRRKDAQEEHG

SEQ ID NO: 600345 - protein, 12 aa, Mycobacterium
TRDRRKEAQEAH

SEQ ID NO: 600346 - protein, 12 aa, Mycobacterium
TRDRRNEAQEAH

SEQ ID NO: 600347 - protein, 17 aa, Mycobacterium
TRDRSGATTAAKAALSA

SEQ ID NO: 600348 - protein, 4 aa, Mycobacterium
TRDS

SEQ ID NO: 600349 - protein, 6 aa, Mycobacterium
TRDSAV

SEQ ID NO: 600350 - protein, 5 aa, Mycobacterium
TRDSP

SEQ ID NO: 600351 - protein, 41 aa, Mycobacterium
TRDSRRRVNGKPVKRYEATGIEDGTRHTETFDTREAAQDKL

SEQ ID NO: 600352 - protein, 13 aa, Mycobacterium
TRDSYMSDTSTSS

SEQ ID NO: 600353 - protein, 4 aa, Mycobacterium
TRDT

SEQ ID NO: 600354 - protein, 15 aa, Mycobacterium
TRDTELAGTALPAGS

SEQ ID NO: 600355 - protein, 6 aa, Mycobacterium
TRDTES

SEQ ID NO: 600356 - protein, 7 aa, Mycobacterium
TRDTGYP

SEQ ID NO: 600357 - protein, 28 aa, Mycobacterium
TRDTPDPKGAKYGRDANGELDGTAEETG

SEQ ID NO: 600358 - protein, 24 aa, Mycobacterium
TRDTPDPKGSSYGRDAGGELDGTA

SEQ ID NO: 600359 - protein, 11 aa, Mycobacterium
TRDTRAEAEQR

SEQ ID NO: 600360 - protein, 7 aa, Mycobacterium
TRDTRYP

SEQ ID NO: 600361 - protein, 8 aa, Mycobacterium
TRDTSERF

SEQ ID NO: 600362 - protein, 5 aa, Mycobacterium
TRDTV

SEQ ID NO: 600363 - protein, 13 aa, Mycobacterium
TRDVEGLDTAGVE

SEQ ID NO: 600364 - protein, 4 aa, Mycobacterium
TRDW

SEQ ID NO: 600365 - protein, 4 aa, Mycobacterium
TRDY

SEQ ID NO: 600366 - protein, 7 aa, Mycobacterium
TRDYPSI

SEQ ID NO: 600367 - protein, 5 aa, Mycobacterium
TREAA

SEQ ID NO: 600368 - protein, 12 aa, Mycobacterium
TREAASKAPSLA

SEQ ID NO: 600369 - protein, 7 aa, Mycobacterium
TREAITR

SEQ ID NO: 600370 - protein, 9 aa, Mycobacterium
TREAQPEAV

SEQ ID NO: 600371 - protein, 32 aa, Mycobacterium
TREAVAARTDPWDPESGPDAAELAGERAAEAR

SEQ ID NO: 600372 - protein, 15 aa, Mycobacterium
TREAWDREAQGYIVS

SEQ ID NO: 600373 - protein, 4 aa, Mycobacterium
TRED

SEQ ID NO: 600374 - protein, 5 aa, Mycobacterium
TREDE

SEQ ID NO: 600375 - protein, 11 aa, Mycobacterium
TREDGEKESLD

SEQ ID NO: 600376 - protein, 10 aa, Mycobacterium
TREDNEEEGS

SEQ ID NO: 600377 - protein, 7 aa, Mycobacterium
TREDQDK

SEQ ID NO: 600378 - protein, 5 aa, Mycobacterium
TREDR

SEQ ID NO: 600379 - protein, 4 aa, Mycobacterium
TREE

SEQ ID NO: 600380 - protein, 10 aa, Mycobacterium
TREEALARSR

SEQ ID NO: 600381 - protein, 9 aa, Mycobacterium
TREEAQEQV

SEQ ID NO: 600382 - protein, 8 aa, Mycobacterium
TREEGNAM

SEQ ID NO: 600383 - protein, 12 aa, Mycobacterium
TREEKDSTRGRA

SEQ ID NO: 600384 - protein, 6 aa, Mycobacterium
TREEKE

SEQ ID NO: 600385 - protein, 9 aa, Mycobacterium
TREEKGAFT

SEQ ID NO: 600386 - protein, 5 aa, Mycobacterium
TREEL

SEQ ID NO: 600387 - protein, 4 aa, Mycobacterium
TREF

SEQ ID NO: 600388 - protein, 5 aa, Mycobacterium
TREFG

SEQ ID NO: 600389 - protein, 8 aa, Mycobacterium
TREGEQGR

SEQ ID NO: 600390 - protein, 8 aa, Mycobacterium
TREGRPEK

SEQ ID NO: 600391 - protein, 12 aa, Mycobacterium
TREGSSVRGGDL

SEQ ID NO: 600392 - protein, 12 aa, Mycobacterium
TREGTGDADGDW

SEQ ID NO: 600393 - protein, 8 aa, Mycobacterium
TREGYDKT

SEQ ID NO: 600394 - protein, 17 aa, Mycobacterium
TREINDGYANGYGNSKW

SEQ ID NO: 600395 - protein, 5 aa, Mycobacterium
TREIS

SEQ ID NO: 600396 - protein, 5 aa, Mycobacterium
TREKK

SEQ ID NO: 600397 - protein, 13 aa, Mycobacterium
TRELAERAAADRD

SEQ ID NO: 600398 - protein, 5 aa, Mycobacterium
TRELG

SEQ ID NO: 600399 - protein, 5 aa, Mycobacterium
TRELP

SEQ ID NO: 600400 - protein, 9 aa, Mycobacterium
TRELPKRRP

SEQ ID NO: 600401 - protein, 8 aa, Mycobacterium
TRELTSEP

SEQ ID NO: 600402 - protein, 6 aa, Mycobacterium
TRENPG

SEQ ID NO: 600403 - protein, 12 aa, Mycobacterium
TRENRADAERKQ

SEQ ID NO: 600404 - protein, 7 aa, Mycobacterium
TREPDSF

SEQ ID NO: 600405 - protein, 15 aa, Mycobacterium
TREPERVARGYSTDS

SEQ ID NO: 600406 - protein, 23 aa, Mycobacterium
TREPGDAKAIARRDKKGIPSARA

SEQ ID NO: 600407 - protein, 7 aa, Mycobacterium
TREPGGE

SEQ ID NO: 600408 - protein, 9 aa, Mycobacterium
TREPGNHLP

SEQ ID NO: 600409 - protein, 11 aa, Mycobacterium
TREPGPAKRHQ

SEQ ID NO: 600410 - protein, 7 aa, Mycobacterium
TREPLER

SEQ ID NO: 600411 - protein, 8 aa, Mycobacterium
TREPRREP

SEQ ID NO: 600412 - protein, 6 aa, Mycobacterium
TREPVA

SEQ ID NO: 600413 - protein, 22 aa, Mycobacterium
TREQAEDAVTNELADTAATITE

SEQ ID NO: 600414 - protein, 9 aa, Mycobacterium
TREQAERDV

SEQ ID NO: 600415 - protein, 6 aa, Mycobacterium
TREQAI

SEQ ID NO: 600416 - protein, 8 aa, Mycobacterium
TREQPRRL

SEQ ID NO: 600417 - protein, 6 aa, Mycobacterium
TREREA

SEQ ID NO: 600418 - protein, 5 aa, Mycobacterium
TRERG

SEQ ID NO: 600419 - protein, 10 aa, Mycobacterium
TRERGRPTTL

SEQ ID NO: 600420 - protein, 5 aa, Mycobacterium
TRERI

SEQ ID NO: 600421 - protein, 12 aa, Mycobacterium
TRERPGQSLAPN

SEQ ID NO: 600422 - protein, 22 aa, Mycobacterium
TRERQQEGKHGVSDDGEGLPVE

SEQ ID NO: 600423 - protein, 14 aa, Mycobacterium
TRESLQATAQLTQT

SEQ ID NO: 600424 - protein, 7 aa, Mycobacterium
TRESPKR

SEQ ID NO: 600425 - protein, 16 aa, Mycobacterium
TRESRPDTRNVPAGQA

SEQ ID NO: 600426 - protein, 5 aa, Mycobacterium
TRESV

SEQ ID NO: 600427 - protein, 7 aa, Mycobacterium
TRETRER

SEQ ID NO: 600428 - protein, 6 aa, Mycobacterium
TRETTA

SEQ ID NO: 600429 - protein, 11 aa, Mycobacterium
TRFADKNGSLR

SEQ ID NO: 600430 - protein, 8 aa, Mycobacterium
TRFGASTR

SEQ ID NO: 600431 - protein, 10 aa, Mycobacterium
TRFGEPDSIK

SEQ ID NO: 600432 - protein, 24 aa, Mycobacterium
TRFGPKTDDGRYTLRTESGEEFTS

SEQ ID NO: 600433 - protein, 19 aa, Mycobacterium
TRFGTEGDGRVAEADSEVA

SEQ ID NO: 600434 - protein, 11 aa, Mycobacterium
TRFKPDKAKEM

SEQ ID NO: 600435 - protein, 8 aa, Mycobacterium
TRFKPGKA

SEQ ID NO: 600436 - protein, 11 aa, Mycobacterium
TRFKPGKAKEI

SEQ ID NO: 600437 - protein, 11 aa, Mycobacterium
TRFNPTKAKEV

SEQ ID NO: 600438 - protein, 8 aa, Mycobacterium
TRFPEPDT

SEQ ID NO: 600439 - protein, 6 aa, Mycobacterium
TRFQPT

SEQ ID NO: 600440 - protein, 17 aa, Mycobacterium
TRFRTGEELEASAPARK

SEQ ID NO: 600441 - protein, 4 aa, Mycobacterium
TRFT

SEQ ID NO: 600442 - protein, 8 aa, Mycobacterium
TRGAAHRE

SEQ ID NO: 600443 - protein, 18 aa, Mycobacterium
TRGAAPESKAGQVHYPGT

SEQ ID NO: 600444 - protein, 6 aa, Mycobacterium
TRGAEM

SEQ ID NO: 600445 - protein, 8 aa, Mycobacterium
TRGAGAPW

SEQ ID NO: 600446 - protein, 8 aa, Mycobacterium
TRGAGASV

SEQ ID NO: 600447 - protein, 20 aa, Mycobacterium
TRGAGDKTISENGAHPEVIE

SEQ ID NO: 600448 - protein, 6 aa, Mycobacterium
TRGAGL

SEQ ID NO: 600449 - protein, 15 aa, Mycobacterium
TRGAGRSAAPQRTSG

SEQ ID NO: 600450 - protein, 9 aa, Mycobacterium
TRGAGSDVE

SEQ ID NO: 600451 - protein, 5 aa, Mycobacterium
TRGAI

SEQ ID NO: 600452 - protein, 5 aa, Mycobacterium
TRGAK

SEQ ID NO: 600453 - protein, 9 aa, Mycobacterium
TRGAKESLP

SEQ ID NO: 600454 - protein, 5 aa, Mycobacterium
TRGAL

SEQ ID NO: 600455 - protein, 9 aa, Mycobacterium
TRGANPALR

SEQ ID NO: 600456 - protein, 8 aa, Mycobacterium
TRGARPAL

SEQ ID NO: 600457 - protein, 6 aa, Mycobacterium
TRGATL

SEQ ID NO: 600458 - protein, 12 aa, Mycobacterium
TRGATRGGTEGQ

SEQ ID NO: 600459 - protein, 6 aa, Mycobacterium
TRGDAA

SEQ ID NO: 600460 - protein, 6 aa, Mycobacterium
TRGDAE

SEQ ID NO: 600461 - protein, 14 aa, Mycobacterium
TRGDAEALGLEEGD

SEQ ID NO: 600462 - protein, 8 aa, Mycobacterium
TRGDDGQP

SEQ ID NO: 600463 - protein, 9 aa, Mycobacterium
TRGDGDDGV

SEQ ID NO: 600464 - protein, 17 aa, Mycobacterium
TRGDGTTITASGLDDPQ

SEQ ID NO: 600465 - protein, 6 aa, Mycobacterium
TRGDGV

SEQ ID NO: 600466 - protein, 12 aa, Mycobacterium
TRGDLAADLRAV

SEQ ID NO: 600467 - protein, 8 aa, Mycobacterium
TRGDLGEP

SEQ ID NO: 600468 - protein, 9 aa, Mycobacterium
TRGDPNNVD

SEQ ID NO: 600469 - protein, 9 aa, Mycobacterium
TRGDVEPSV

SEQ ID NO: 600470 - protein, 9 aa, Mycobacterium
TRGEATDGL

SEQ ID NO: 600471 - protein, 6 aa, Mycobacterium
TRGELT

SEQ ID NO: 600472 - protein, 10 aa, Mycobacterium
TRGGAGQIRD

SEQ ID NO: 600473 - protein, 12 aa, Mycobacterium
TRGGGEGPRGAF

SEQ ID NO: 600474 - protein, 8 aa, Mycobacterium
TRGGGGGV

SEQ ID NO: 600475 - protein, 7 aa, Mycobacterium
TRGGGGV

SEQ ID NO: 600476 - protein, 7 aa, Mycobacterium
TRGGGNV

SEQ ID NO: 600477 - protein, 7 aa, Mycobacterium
TRGGHPA

SEQ ID NO: 600478 - protein, 11 aa, Mycobacterium
TRGGPDPSSRR

SEQ ID NO: 600479 - protein, 11 aa, Mycobacterium
TRGGPGESPRR

SEQ ID NO: 600480 - protein, 19 aa, Mycobacterium
TRGGPQENRLRAGTENVPG

SEQ ID NO: 600481 - protein, 10 aa, Mycobacterium
TRGGREGREV

SEQ ID NO: 600482 - protein, 23 aa, Mycobacterium
TRGGVGGAVTTDSAGATDTARRA

SEQ ID NO: 600483 - protein, 11 aa, Mycobacterium
TRGGYRSATFP

SEQ ID NO: 600484 - protein, 15 aa, Mycobacterium
TRGHGASPVPDGPYS

SEQ ID NO: 600485 - protein, 6 aa, Mycobacterium
TRGHGD

SEQ ID NO: 600486 - protein, 14 aa, Mycobacterium
TRGHGDSDRAPAAD

SEQ ID NO: 600487 - protein, 13 aa, Mycobacterium
TRGHGDSDWDPIG

SEQ ID NO: 600488 - protein, 15 aa, Mycobacterium
TRGHGQSPVPEGPYT

SEQ ID NO: 600489 - protein, 5 aa, Mycobacterium
TRGKI

SEQ ID NO: 600490 - protein, 10 aa, Mycobacterium
TRGKPSAAQL

SEQ ID NO: 600491 - protein, 11 aa, Mycobacterium
TRGKPSPEQLD

SEQ ID NO: 600492 - protein, 11 aa, Mycobacterium
TRGKPSSEQLD

SEQ ID NO: 600493 - protein, 10 aa, Mycobacterium
TRGKQAHAEW

SEQ ID NO: 600494 - protein, 10 aa, Mycobacterium
TRGKVGDSDL

SEQ ID NO: 600495 - protein, 4 aa, Mycobacterium
TRGL

SEQ ID NO: 600496 - protein, 12 aa, Mycobacterium
TRGLGAGAPGFS

SEQ ID NO: 600497 - protein, 8 aa, Mycobacterium
TRGLGGQL

SEQ ID NO: 600498 - protein, 11 aa, Mycobacterium
TRGLGRKNSYR

SEQ ID NO: 600499 - protein, 5 aa, Mycobacterium
TRGLR

SEQ ID NO: 600500 - protein, 5 aa, Mycobacterium
TRGLV

SEQ ID NO: 600501 - protein, 7 aa, Mycobacterium
TRGNERL

SEQ ID NO: 600502 - protein, 8 aa, Mycobacterium
TRGNQRLT

SEQ ID NO: 600503 - protein, 6 aa, Mycobacterium
TRGNTR

SEQ ID NO: 600504 - protein, 4 aa, Mycobacterium
TRGP

SEQ ID NO: 600505 - protein, 5 aa, Mycobacterium
TRGPD

SEQ ID NO: 600506 - protein, 6 aa, Mycobacterium
TRGPDK

SEQ ID NO: 600507 - protein, 17 aa, Mycobacterium
TRGPFPGHEASNRLNPM

SEQ ID NO: 600508 - protein, 6 aa, Mycobacterium
TRGPGL

SEQ ID NO: 600509 - protein, 5 aa, Mycobacterium
TRGPL

SEQ ID NO: 600510 - protein, 7 aa, Mycobacterium
TRGPRRA

SEQ ID NO: 600511 - protein, 6 aa, Mycobacterium
TRGPVG

SEQ ID NO: 600512 - protein, 11 aa, Mycobacterium
TRGQQDSRYPL

SEQ ID NO: 600513 - protein, 10 aa, Mycobacterium
TRGQYGSQGK

SEQ ID NO: 600514 - protein, 4 aa, Mycobacterium
TRGR

SEQ ID NO: 600515 - protein, 5 aa, Mycobacterium
TRGRA

SEQ ID NO: 600516 - protein, 7 aa, Mycobacterium
TRGRARR

SEQ ID NO: 600517 - protein, 9 aa, Mycobacterium
TRGREDATR

SEQ ID NO: 600518 - protein, 7 aa, Mycobacterium
TRGRESG

SEQ ID NO: 600519 - protein, 5 aa, Mycobacterium
TRGRG

SEQ ID NO: 600520 - protein, 9 aa, Mycobacterium
TRGRGVQRI

SEQ ID NO: 600521 - protein, 25 aa, Mycobacterium
TRGRHQGARHSGAARRRASDPGGRR

SEQ ID NO: 600522 - protein, 5 aa, Mycobacterium
TRGRL

SEQ ID NO: 600523 - protein, 14 aa, Mycobacterium
TRGRSAATIYLATR

SEQ ID NO: 600524 - protein, 9 aa, Mycobacterium
TRGRVADEQ

SEQ ID NO: 600525 - protein, 20 aa, Mycobacterium
TRGSDGGGGRPGVEAPTPRL

SEQ ID NO: 600526 - protein, 19 aa, Mycobacterium
TRGSERPATTEVGERIAAG

SEQ ID NO: 600527 - protein, 8 aa, Mycobacterium
TRGSGDPL

SEQ ID NO: 600528 - protein, 7 aa, Mycobacterium
TRGSGLD

SEQ ID NO: 600529 - protein, 11 aa, Mycobacterium
TRGSGPGPART

SEQ ID NO: 600530 - protein, 7 aa, Mycobacterium
TRGSHPA

SEQ ID NO: 600531 - protein, 5 aa, Mycobacterium
TRGSS

SEQ ID NO: 600532 - protein, 4 aa, Mycobacterium
TRGT

SEQ ID NO: 600533 - protein, 10 aa, Mycobacterium
TRGTEAQKAA

SEQ ID NO: 600534 - protein, 5 aa, Mycobacterium
TRGTG

SEQ ID NO: 600535 - protein, 26 aa, Mycobacterium
TRGTGPGPARTFREDDPALSRANPVD

SEQ ID NO: 600536 - protein, 5 aa, Mycobacterium
TRGTS

SEQ ID NO: 600537 - protein, 8 aa, Mycobacterium
TRGTSNRL

SEQ ID NO: 600538 - protein, 6 aa, Mycobacterium
TRGVGA

SEQ ID NO: 600539 - protein, 16 aa, Mycobacterium
TRGVGPGQRRTLTGQR

SEQ ID NO: 600540 - protein, 14 aa, Mycobacterium
TRGVTGESAPEFTA

SEQ ID NO: 600541 - protein, 4 aa, Mycobacterium
TRHA

SEQ ID NO: 600542 - protein, 10 aa, Mycobacterium
TRHDTADPGT

SEQ ID NO: 600543 - protein, 4 aa, Mycobacterium
TRHE

SEQ ID NO: 600544 - protein, 4 aa, Mycobacterium
TRHG

SEQ ID NO: 600545 - protein, 5 aa, Mycobacterium
TRHGA

SEQ ID NO: 600546 - protein, 5 aa, Mycobacterium
TRHGD

SEQ ID NO: 600547 - protein, 5 aa, Mycobacterium
TRHGG

SEQ ID NO: 600548 - protein, 6 aa, Mycobacterium
TRHGGA

SEQ ID NO: 600549 - protein, 12 aa, Mycobacterium
TRHGPADSRTYA

SEQ ID NO: 600550 - protein, 9 aa, Mycobacterium
TRHGPTDPA

SEQ ID NO: 600551 - protein, 9 aa, Mycobacterium
TRHGQDYAG

SEQ ID NO: 600552 - protein, 13 aa, Mycobacterium
TRHGRSLPARHAD

SEQ ID NO: 600553 - protein, 13 aa, Mycobacterium
TRHGRSRSRGATE

SEQ ID NO: 600554 - protein, 10 aa, Mycobacterium
TRHKGGGHKR

SEQ ID NO: 600555 - protein, 4 aa, Mycobacterium
TRHP

SEQ ID NO: 600556 - protein, 7 aa, Mycobacterium
TRHPDGT

SEQ ID NO: 600557 - protein, 6 aa, Mycobacterium
TRHPEQ

SEQ ID NO: 600558 - protein, 7 aa, Mycobacterium
TRHQQGN

SEQ ID NO: 600559 - protein, 13 aa, Mycobacterium
TRHRDGGRQSVQT

SEQ ID NO: 600560 - protein, 5 aa, Mycobacterium
TRHSP

SEQ ID NO: 600561 - protein, 14 aa, Mycobacterium
TRHTPASKKVASVA

SEQ ID NO: 600562 - protein, 7 aa, Mycobacterium
TRHTPAY

SEQ ID NO: 600563 - protein, 5 aa, Mycobacterium
TRIDE

SEQ ID NO: 600564 - protein, 5 aa, Mycobacterium
TRIGG

SEQ ID NO: 600565 - protein, 5 aa, Mycobacterium
TRIGR

SEQ ID NO: 600566 - protein, 10 aa, Mycobacterium
TRIGRSPDND

SEQ ID NO: 600567 - protein, 12 aa, Mycobacterium
TRIKSAVGKKDW

SEQ ID NO: 600568 - protein, 11 aa, Mycobacterium
TRIPQPKRNYG

SEQ ID NO: 600569 - protein, 4 aa, Mycobacterium
TRIT

SEQ ID NO: 600570 - protein, 8 aa, Mycobacterium
TRKAAGIA

SEQ ID NO: 600571 - protein, 10 aa, Mycobacterium
TRKAEARAIK

SEQ ID NO: 600572 - protein, 10 aa, Mycobacterium
TRKAGTEIRV

SEQ ID NO: 600573 - protein, 9 aa, Mycobacterium
TRKDHQEKA

SEQ ID NO: 600574 - protein, 6 aa, Mycobacterium
TRKEHN

SEQ ID NO: 600575 - protein, 6 aa, Mycobacterium
TRKEPQ

SEQ ID NO: 600576 - protein, 4 aa, Mycobacterium
TRKG

SEQ ID NO: 600577 - protein, 5 aa, Mycobacterium
TRKGE

SEQ ID NO: 600578 - protein, 17 aa, Mycobacterium
TRKGPLPRREDTSHRDV

SEQ ID NO: 600579 - protein, 16 aa, Mycobacterium
TRKGRYKDGLPSDDPV

SEQ ID NO: 600580 - protein, 8 aa, Mycobacterium
TRKGTYFS

SEQ ID NO: 600581 - protein, 18 aa, Mycobacterium
TRKGVEDAGGTYEPHPAE

SEQ ID NO: 600582 - protein, 4 aa, Mycobacterium
TRKL

SEQ ID NO: 600583 - protein, 9 aa, Mycobacterium
TRKLGRPLR

SEQ ID NO: 600584 - protein, 27 aa, Mycobacterium
TRKPAPGEDPRSGRWAGRNKTECGLHA

SEQ ID NO: 600585 - protein, 7 aa, Mycobacterium
TRKPESL

SEQ ID NO: 600586 - protein, 6 aa, Mycobacterium
TRKPNN

SEQ ID NO: 600587 - protein, 8 aa, Mycobacterium
TRKPNPHL

SEQ ID NO: 600588 - protein, 14 aa, Mycobacterium
TRKPPLQESPISSF

SEQ ID NO: 600589 - protein, 8 aa, Mycobacterium
TRKQEGRV

SEQ ID NO: 600590 - protein, 7 aa, Mycobacterium
TRKQGND

SEQ ID NO: 600591 - protein, 5 aa, Mycobacterium
TRKRR

SEQ ID NO: 600592 - protein, 8 aa, Mycobacterium
TRKRRYRR

SEQ ID NO: 600593 - protein, 20 aa, Mycobacterium
TRKSGTEVRVPRKTKLSRTV

SEQ ID NO: 600594 - protein, 6 aa, Mycobacterium
TRKSHD

SEQ ID NO: 600595 - protein, 9 aa, Mycobacterium
TRKVNAETR

SEQ ID NO: 600596 - protein, 13 aa, Mycobacterium
TRLAAEKREVDAA

SEQ ID NO: 600597 - protein, 12 aa, Mycobacterium
TRLAESGTSGPQ

SEQ ID NO: 600598 - protein, 6 aa, Mycobacterium
TRLDAD

SEQ ID NO: 600599 - protein, 17 aa, Mycobacterium
TRLDAGSHADGAPDNGA

SEQ ID NO: 600600 - protein, 7 aa, Mycobacterium
TRLDDRA

SEQ ID NO: 600601 - protein, 5 aa, Mycobacterium
TRLDG

SEQ ID NO: 600602 - protein, 13 aa, Mycobacterium
TRLDGGAAAAGFG

SEQ ID NO: 600603 - protein, 4 aa, Mycobacterium
TRLE

SEQ ID NO: 600604 - protein, 8 aa, Mycobacterium
TRLEPRDR

SEQ ID NO: 600605 - protein, 8 aa, Mycobacterium
TRLGEDGR

SEQ ID NO: 600606 - protein, 17 aa, Mycobacterium
TRLGLSGSRAVLDGFGS

SEQ ID NO: 600607 - protein, 15 aa, Mycobacterium
TRLGLSGTRAVLDEL

SEQ ID NO: 600608 - protein, 15 aa, Mycobacterium
TRLGLSGTRGVLDGL

SEQ ID NO: 600609 - protein, 6 aa, Mycobacterium
TRLGPQ

SEQ ID NO: 600610 - protein, 9 aa, Mycobacterium
TRLPDGRRV

SEQ ID NO: 600611 - protein, 5 aa, Mycobacterium
TRLPE

SEQ ID NO: 600612 - protein, 5 aa, Mycobacterium
TRLPG

SEQ ID NO: 600613 - protein, 13 aa, Mycobacterium
TRLPGDGPRSGEI

SEQ ID NO: 600614 - protein, 15 aa, Mycobacterium
TRLQGASGRFAPNPG

SEQ ID NO: 600615 - protein, 5 aa, Mycobacterium
TRLRP

SEQ ID NO: 600616 - protein, 28 aa, Mycobacterium
TRLRTEGRADQFKGNTKQAGAKVKDAFK

SEQ ID NO: 600617 - protein, 23 aa, Mycobacterium
TRLRTSASAPDIAGLVDTAILGD

SEQ ID NO: 600618 - protein, 7 aa, Mycobacterium
TRLSDPK

SEQ ID NO: 600619 - protein, 10 aa, Mycobacterium
TRLSEGPEYT

SEQ ID NO: 600620 - protein, 6 aa, Mycobacterium
TRLSGG

SEQ ID NO: 600621 - protein, 6 aa, Mycobacterium
TRLSGQ

SEQ ID NO: 600622 - protein, 12 aa, Mycobacterium
TRLSGQSGYTPK

SEQ ID NO: 600623 - protein, 10 aa, Mycobacterium
TRLSSGPDYE

SEQ ID NO: 600624 - protein, 5 aa, Mycobacterium
TRLST

SEQ ID NO: 600625 - protein, 10 aa, Mycobacterium
TRLSTGAEYE

SEQ ID NO: 600626 - protein, 6 aa, Mycobacterium
TRLTDT

SEQ ID NO: 600627 - protein, 4 aa, Mycobacterium
TRMA

SEQ ID NO: 600628 - protein, 5 aa, Mycobacterium
TRMAK

SEQ ID NO: 600629 - protein, 6 aa, Mycobacterium
TRMAKD

SEQ ID NO: 600630 - protein, 8 aa, Mycobacterium
TRMDPDLD

SEQ ID NO: 600631 - protein, 6 aa, Mycobacterium
TRMDPQ

SEQ ID NO: 600632 - protein, 10 aa, Mycobacterium
TRMENPDGKI

SEQ ID NO: 600633 - protein, 13 aa, Mycobacterium
TRNAADERSTDVQ

SEQ ID NO: 600634 - protein, 18 aa, Mycobacterium
TRNAAKTAYEQAGVGPSD

SEQ ID NO: 600635 - protein, 7 aa, Mycobacterium
TRNAATG

SEQ ID NO: 600636 - protein, 8 aa, Mycobacterium
TRNAGGAV

SEQ ID NO: 600637 - protein, 7 aa, Mycobacterium
TRNASTG

SEQ ID NO: 600638 - protein, 11 aa, Mycobacterium
TRNATDERSTD

SEQ ID NO: 600639 - protein, 9 aa, Mycobacterium
TRNAVDAGH

SEQ ID NO: 600640 - protein, 4 aa, Mycobacterium
TRND

SEQ ID NO: 600641 - protein, 6 aa, Mycobacterium
TRNDDR

SEQ ID NO: 600642 - protein, 17 aa, Mycobacterium
TRNDEPEKASRPFDKDR

SEQ ID NO: 600643 - protein, 15 aa, Mycobacterium
TRNDIDGGVGSRHYG

SEQ ID NO: 600644 - protein, 7 aa, Mycobacterium
TRNDSTI

SEQ ID NO: 600645 - protein, 17 aa, Mycobacterium
TRNEDPEGASRPFDKNR

SEQ ID NO: 600646 - protein, 9 aa, Mycobacterium
TRNEKGKFT

SEQ ID NO: 600647 - protein, 14 aa, Mycobacterium
TRNFRDRREAGRAL

SEQ ID NO: 600648 - protein, 6 aa, Mycobacterium
TRNGDD

SEQ ID NO: 600649 - protein, 5 aa, Mycobacterium
TRNGR

SEQ ID NO: 600650 - protein, 5 aa, Mycobacterium
TRNGT

SEQ ID NO: 600651 - protein, 16 aa, Mycobacterium
TRNHNQPRTATDPTAA

SEQ ID NO: 600652 - protein, 4 aa, Mycobacterium
TRNI

SEQ ID NO: 600653 - protein, 8 aa, Mycobacterium
TRNISNPQ

SEQ ID NO: 600654 - protein, 8 aa, Mycobacterium
TRNKAVGA

SEQ ID NO: 600655 - protein, 7 aa, Mycobacterium
TRNKEQR

SEQ ID NO: 600656 - protein, 4 aa, Mycobacterium
TRNL

SEQ ID NO: 600657 - protein, 7 aa, Mycobacterium
TRNPAQF

SEQ ID NO: 600658 - protein, 5 aa, Mycobacterium
TRNPN

SEQ ID NO: 600659 - protein, 7 aa, Mycobacterium
TRNPSTG

SEQ ID NO: 600660 - protein, 5 aa, Mycobacterium
TRNPW

SEQ ID NO: 600661 - protein, 22 aa, Mycobacterium
TRNPWDPRRTPGGSSGGSAAAV

SEQ ID NO: 600662 - protein, 22 aa, Mycobacterium
TRNPWNPARTPGGSSGGSAAAV

SEQ ID NO: 600663 - protein, 22 aa, Mycobacterium
TRNPWNPSRTPGGSSGGSAAAV

SEQ ID NO: 600664 - protein, 13 aa, Mycobacterium
TRNSKPRPAAGGA

SEQ ID NO: 600665 - protein, 7 aa, Mycobacterium
TRNSSTG

SEQ ID NO: 600666 - protein, 9 aa, Mycobacterium
TRNTDGRPF

SEQ ID NO: 600667 - protein, 11 aa, Mycobacterium
TRNTNPTTGFE

SEQ ID NO: 600668 - protein, 8 aa, Mycobacterium
TRNVPHTG

SEQ ID NO: 600669 - protein, 9 aa, Mycobacterium
TRNYPGTDE

SEQ ID NO: 600670 - protein, 11 aa, Mycobacterium
TRPAAEREYAT

SEQ ID NO: 600671 - protein, 9 aa, Mycobacterium
TRPADADGA

SEQ ID NO: 600672 - protein, 10 aa, Mycobacterium
TRPADDKGPG

SEQ ID NO: 600673 - protein, 9 aa, Mycobacterium
TRPADEQGA

SEQ ID NO: 600674 - protein, 10 aa, Mycobacterium
TRPADEQGPG

SEQ ID NO: 600675 - protein, 10 aa, Mycobacterium
TRPADSARGY

SEQ ID NO: 600676 - protein, 9 aa, Mycobacterium
TRPAERAAA

SEQ ID NO: 600677 - protein, 15 aa, Mycobacterium
TRPAETTNPAGEAMQ

SEQ ID NO: 600678 - protein, 5 aa, Mycobacterium
TRPAG

SEQ ID NO: 600679 - protein, 7 aa, Mycobacterium
TRPAGET

SEQ ID NO: 600680 - protein, 9 aa, Mycobacterium
TRPAGLPGL

SEQ ID NO: 600681 - protein, 5 aa, Mycobacterium
TRPAL

SEQ ID NO: 600682 - protein, 7 aa, Mycobacterium
TRPAPSG

SEQ ID NO: 600683 - protein, 8 aa, Mycobacterium
TRPAQAAN

SEQ ID NO: 600684 - protein, 5 aa, Mycobacterium
TRPAR

SEQ ID NO: 600685 - protein, 12 aa, Mycobacterium
TRPARNIGPGTG

SEQ ID NO: 600686 - protein, 12 aa, Mycobacterium
TRPARNIGPGTS

SEQ ID NO: 600687 - protein, 12 aa, Mycobacterium
TRPARNIGPGTT

SEQ ID NO: 600688 - protein, 10 aa, Mycobacterium
TRPASDKSPG

SEQ ID NO: 600689 - protein, 5 aa, Mycobacterium
TRPAT

SEQ ID NO: 600690 - protein, 31 aa, Mycobacterium
TRPDADGPAPTRKPPRRSPEATAHRTGSADA

SEQ ID NO: 600691 - protein, 12 aa, Mycobacterium
TRPDAGSAHVAG

SEQ ID NO: 600692 - protein, 21 aa, Mycobacterium
TRPDDPPELTEHTQGRPLSAA

SEQ ID NO: 600693 - protein, 11 aa, Mycobacterium
TRPDDTRDEDF

SEQ ID NO: 600694 - protein, 6 aa, Mycobacterium
TRPDGE

SEQ ID NO: 600695 - protein, 11 aa, Mycobacterium
TRPDGGSATVA

SEQ ID NO: 600696 - protein, 7 aa, Mycobacterium
TRPDGSE

SEQ ID NO: 600697 - protein, 9 aa, Mycobacterium
TRPDGSESI

SEQ ID NO: 600698 - protein, 15 aa, Mycobacterium
TRPDGTDTPDAAEFG

SEQ ID NO: 600699 - protein, 6 aa, Mycobacterium
TRPDSV

SEQ ID NO: 600700 - protein, 4 aa, Mycobacterium
TRPE

SEQ ID NO: 600701 - protein, 5 aa, Mycobacterium
TRPEA

SEQ ID NO: 600702 - protein, 13 aa, Mycobacterium
TRPEASVEDTAAR

SEQ ID NO: 600703 - protein, 7 aa, Mycobacterium
TRPEDPL

SEQ ID NO: 600704 - protein, 6 aa, Mycobacterium
TRPEDV

SEQ ID NO: 600705 - protein, 5 aa, Mycobacterium
TRPEF

SEQ ID NO: 600706 - protein, 12 aa, Mycobacterium
TRPENVADGGDI

SEQ ID NO: 600707 - protein, 7 aa, Mycobacterium
TRPEQPV

SEQ ID NO: 600708 - protein, 6 aa, Mycobacterium
TRPERT

SEQ ID NO: 600709 - protein, 5 aa, Mycobacterium
TRPEY

SEQ ID NO: 600710 - protein, 4 aa, Mycobacterium
TRPF

SEQ ID NO: 600711 - protein, 5 aa, Mycobacterium
TRPFH

SEQ ID NO: 600712 - protein, 6 aa, Mycobacterium
TRPFTD

SEQ ID NO: 600713 - protein, 21 aa, Mycobacterium
TRPGAQPPDATELANELRRVT

SEQ ID NO: 600714 - protein, 9 aa, Mycobacterium
TRPGATYDY

SEQ ID NO: 600715 - protein, 7 aa, Mycobacterium
TRPGDGP

SEQ ID NO: 600716 - protein, 9 aa, Mycobacterium
TRPGDPPEL

SEQ ID NO: 600717 - protein, 9 aa, Mycobacterium
TRPGGNKKR

SEQ ID NO: 600718 - protein, 6 aa, Mycobacterium
TRPGGT

SEQ ID NO: 600719 - protein, 10 aa, Mycobacterium
TRPGNPPLPV

SEQ ID NO: 600720 - protein, 6 aa, Mycobacterium
TRPGPD

SEQ ID NO: 600721 - protein, 7 aa, Mycobacterium
TRPGPQL

SEQ ID NO: 600722 - protein, 5 aa, Mycobacterium
TRPGQ

SEQ ID NO: 600723 - protein, 10 aa, Mycobacterium
TRPGQTAAGL

SEQ ID NO: 600724 - protein, 7 aa, Mycobacterium
TRPGRAR

SEQ ID NO: 600725 - protein, 9 aa, Mycobacterium
TRPGRRDER

SEQ ID NO: 600726 - protein, 11 aa, Mycobacterium
TRPGSVADGST

SEQ ID NO: 600727 - protein, 9 aa, Mycobacterium
TRPGTKPAI

SEQ ID NO: 600728 - protein, 5 aa, Mycobacterium
TRPGV

SEQ ID NO: 600729 - protein, 6 aa, Mycobacterium
TRPGWA

SEQ ID NO: 600730 - protein, 15 aa, Mycobacterium
TRPHLESSTGERQTY

SEQ ID NO: 600731 - protein, 6 aa, Mycobacterium
TRPHPV

SEQ ID NO: 600732 - protein, 16 aa, Mycobacterium
TRPIRNREASVTELHL

SEQ ID NO: 600733 - protein, 13 aa, Mycobacterium
TRPITGTNKLAAG

SEQ ID NO: 600734 - protein, 5 aa, Mycobacterium
TRPKE

SEQ ID NO: 600735 - protein, 4 aa, Mycobacterium
TRPL

SEQ ID NO: 600736 - protein, 17 aa, Mycobacterium
TRPLGPLDQTTARGQYA

SEQ ID NO: 600737 - protein, 5 aa, Mycobacterium
TRPLN

SEQ ID NO: 600738 - protein, 5 aa, Mycobacterium
TRPLQ

SEQ ID NO: 600739 - protein, 17 aa, Mycobacterium
TRPLRAAGTAPARPTAG

SEQ ID NO: 600740 - protein, 7 aa, Mycobacterium
TRPMGTS

SEQ ID NO: 600741 - protein, 14 aa, Mycobacterium
TRPNPDDPTGESTM

SEQ ID NO: 600742 - protein, 14 aa, Mycobacterium
TRPNPDDPTGQSTM

SEQ ID NO: 600743 - protein, 12 aa, Mycobacterium
TRPNPDDPTGRS

SEQ ID NO: 600744 - protein, 4 aa, Mycobacterium
TRPP

SEQ ID NO: 600745 - protein, 8 aa, Mycobacterium
TRPPADQL

SEQ ID NO: 600746 - protein, 30 aa, Mycobacterium
TRPPADTRVVPQDSTRGEDAGRGDHLASST

SEQ ID NO: 600747 - protein, 6 aa, Mycobacterium
TRPPDV

SEQ ID NO: 600748 - protein, 7 aa, Mycobacterium
TRPPEAP

SEQ ID NO: 600749 - protein, 8 aa, Mycobacterium
TRPPGERI

SEQ ID NO: 600750 - protein, 13 aa, Mycobacterium
TRPPIGGELAGQS

SEQ ID NO: 600751 - protein, 9 aa, Mycobacterium
TRPPQNAIS

SEQ ID NO: 600752 - protein, 12 aa, Mycobacterium
TRPPRDGDRPDA

SEQ ID NO: 600753 - protein, 6 aa, Mycobacterium
TRPPRG

SEQ ID NO: 600754 - protein, 11 aa, Mycobacterium
TRPPRPDDDQG

SEQ ID NO: 600755 - protein, 10 aa, Mycobacterium
TRPPSDPGLG

SEQ ID NO: 600756 - protein, 9 aa, Mycobacterium
TRPPSDTRA

SEQ ID NO: 600757 - protein, 13 aa, Mycobacterium
TRPPVGGELAGQS

SEQ ID NO: 600758 - protein, 4 aa, Mycobacterium
TRPQ

SEQ ID NO: 600759 - protein, 5 aa, Mycobacterium
TRPQA

SEQ ID NO: 600760 - protein, 6 aa, Mycobacterium
TRPQAA

SEQ ID NO: 600761 - protein, 8 aa, Mycobacterium
TRPQAAMA

SEQ ID NO: 600762 - protein, 6 aa, Mycobacterium
TRPQCS

SEQ ID NO: 600763 - protein, 6 aa, Mycobacterium
TRPQHP

SEQ ID NO: 600764 - protein, 8 aa, Mycobacterium
TRPQPSVA

SEQ ID NO: 600765 - protein, 6 aa, Mycobacterium
TRPQQQ

SEQ ID NO: 600766 - protein, 5 aa, Mycobacterium
TRPQT

SEQ ID NO: 600767 - protein, 6 aa, Mycobacterium
TRPRGD

SEQ ID NO: 600768 - protein, 9 aa, Mycobacterium
TRPRGGTPY

SEQ ID NO: 600769 - protein, 5 aa, Mycobacterium
TRPRL

SEQ ID NO: 600770 - protein, 16 aa, Mycobacterium
TRPRTAMARGPAGRPN

SEQ ID NO: 600771 - protein, 7 aa, Mycobacterium
TRPRTPC

SEQ ID NO: 600772 - protein, 8 aa, Mycobacterium
TRPRVDEG

SEQ ID NO: 600773 - protein, 5 aa, Mycobacterium
TRPRW

SEQ ID NO: 600774 - protein, 6 aa, Mycobacterium
TRPSAA

SEQ ID NO: 600775 - protein, 8 aa, Mycobacterium
TRPSAPVA

SEQ ID NO: 600776 - protein, 9 aa, Mycobacterium
TRPSASRPS

SEQ ID NO: 600777 - protein, 8 aa, Mycobacterium
TRPSGDER

SEQ ID NO: 600778 - protein, 7 aa, Mycobacterium
TRPSGTV

SEQ ID NO: 600779 - protein, 15 aa, Mycobacterium
TRPSLEDAYLHLIGR

SEQ ID NO: 600780 - protein, 18 aa, Mycobacterium
TRPSPKPNGGRKTTPAMA

SEQ ID NO: 600781 - protein, 29 aa, Mycobacterium
TRPSRPTPDPEPVPEPEPEPPSPEDEEEQ

SEQ ID NO: 600782 - protein, 6 aa, Mycobacterium
TRPSTL

SEQ ID NO: 600783 - protein, 9 aa, Mycobacterium
TRPSTTNEA

SEQ ID NO: 600784 - protein, 6 aa, Mycobacterium
TRPSYT

SEQ ID NO: 600785 - protein, 6 aa, Mycobacterium
TRPTAE

SEQ ID NO: 600786 - protein, 7 aa, Mycobacterium
TRPTAWS

SEQ ID NO: 600787 - protein, 5 aa, Mycobacterium
TRPTL

SEQ ID NO: 600788 - protein, 6 aa, Mycobacterium
TRPTLA

SEQ ID NO: 600789 - protein, 10 aa, Mycobacterium
TRPTPATPRR

SEQ ID NO: 600790 - protein, 8 aa, Mycobacterium
TRPTPDVD

SEQ ID NO: 600791 - protein, 7 aa, Mycobacterium
TRPTSGA

SEQ ID NO: 600792 - protein, 14 aa, Mycobacterium
TRPTTMTAHSNNPE

SEQ ID NO: 600793 - protein, 5 aa, Mycobacterium
TRPTV

SEQ ID NO: 600794 - protein, 6 aa, Mycobacterium
TRPTVA

SEQ ID NO: 600795 - protein, 7 aa, Mycobacterium
TRPTVAG

SEQ ID NO: 600796 - protein, 7 aa, Mycobacterium
TRPVEDA

SEQ ID NO: 600797 - protein, 7 aa, Mycobacterium
TRPVEDE

SEQ ID NO: 600798 - protein, 7 aa, Mycobacterium
TRPVEDQ

SEQ ID NO: 600799 - protein, 16 aa, Mycobacterium
TRPVRNREAPVAGPHL

SEQ ID NO: 600800 - protein, 16 aa, Mycobacterium
TRQADPSITVSPRPDD

SEQ ID NO: 600801 - protein, 9 aa, Mycobacterium
TRQADRYRD

SEQ ID NO: 600802 - protein, 9 aa, Mycobacterium
TRQAEKLTK

SEQ ID NO: 600803 - protein, 17 aa, Mycobacterium
TRQAPQLRTERRFDPAK

SEQ ID NO: 600804 - protein, 4 aa, Mycobacterium
TRQD

SEQ ID NO: 600805 - protein, 10 aa, Mycobacterium
TRQDNEEEGS

SEQ ID NO: 600806 - protein, 11 aa, Mycobacterium
TRQDNEEEGSL

SEQ ID NO: 600807 - protein, 4 aa, Mycobacterium
TRQE

SEQ ID NO: 600808 - protein, 8 aa, Mycobacterium
TRQGARRD

SEQ ID NO: 600809 - protein, 10 aa, Mycobacterium
TRQGDELQAA

SEQ ID NO: 600810 - protein, 6 aa, Mycobacterium
TRQGEE

SEQ ID NO: 600811 - protein, 27 aa, Mycobacterium
TRQGLEDEAALPPNFRAPKKAPSTAEI

SEQ ID NO: 600812 - protein, 14 aa, Mycobacterium
TRQGRRLDGETSRS

SEQ ID NO: 600813 - protein, 16 aa, Mycobacterium
TRQGSGNVVRDPQSLT

SEQ ID NO: 600814 - protein, 6 aa, Mycobacterium
TRQGVA

SEQ ID NO: 600815 - protein, 6 aa, Mycobacterium
TRQISS

SEQ ID NO: 600816 - protein, 13 aa, Mycobacterium
TRQKASRAAAQTA

SEQ ID NO: 600817 - protein, 4 aa, Mycobacterium
TRQL

SEQ ID NO: 600818 - protein, 4 aa, Mycobacterium
TRQP

SEQ ID NO: 600819 - protein, 5 aa, Mycobacterium
TRQPA

SEQ ID NO: 600820 - protein, 7 aa, Mycobacterium
TRQPDPL

SEQ ID NO: 600821 - protein, 11 aa, Mycobacterium
TRQPGPAGFPP

SEQ ID NO: 600822 - protein, 6 aa, Mycobacterium
TRQPTP

SEQ ID NO: 600823 - protein, 8 aa, Mycobacterium
TRQQAPSE

SEQ ID NO: 600824 - protein, 6 aa, Mycobacterium
TRQQAR

SEQ ID NO: 600825 - protein, 12 aa, Mycobacterium
TRQQGDGGAKTD

SEQ ID NO: 600826 - protein, 7 aa, Mycobacterium
TRQQQGR

SEQ ID NO: 600827 - protein, 8 aa, Mycobacterium
TRQRADGA

SEQ ID NO: 600828 - protein, 5 aa, Mycobacterium
TRQRD

SEQ ID NO: 600829 - protein, 9 aa, Mycobacterium
TRQRISHTE

SEQ ID NO: 600830 - protein, 8 aa, Mycobacterium
TRQRPSGV

SEQ ID NO: 600831 - protein, 10 aa, Mycobacterium
TRQRRLDKAT

SEQ ID NO: 600832 - protein, 4 aa, Mycobacterium
TRQS

SEQ ID NO: 600833 - protein, 6 aa, Mycobacterium
TRQSEA

SEQ ID NO: 600834 - protein, 7 aa, Mycobacterium
TRQSGID

SEQ ID NO: 600835 - protein, 15 aa, Mycobacterium
TRQSGQQHVQTRFKS

SEQ ID NO: 600836 - protein, 8 aa, Mycobacterium
TRQSPSLQ

SEQ ID NO: 600837 - protein, 4 aa, Mycobacterium
TRQT

SEQ ID NO: 600838 - protein, 6 aa, Mycobacterium
TRQTET

SEQ ID NO: 600839 - protein, 9 aa, Mycobacterium
TRQTGGVGE

SEQ ID NO: 600840 - protein, 6 aa, Mycobacterium
TRQTRV

SEQ ID NO: 600841 - protein, 6 aa, Mycobacterium
TRQVTG

SEQ ID NO: 600842 - protein, 9 aa, Mycobacterium
TRRAADDGA

SEQ ID NO: 600843 - protein, 13 aa, Mycobacterium
TRRAAGSGGGTSE

SEQ ID NO: 600844 - protein, 5 aa, Mycobacterium
TRRAD

SEQ ID NO: 600845 - protein, 9 aa, Mycobacterium
TRRAEARAI

SEQ ID NO: 600846 - protein, 15 aa, Mycobacterium
TRRAERARDPDAAQE

SEQ ID NO: 600847 - protein, 17 aa, Mycobacterium
TRRAGDGTRTLFDGRAN

SEQ ID NO: 600848 - protein, 6 aa, Mycobacterium
TRRALS

SEQ ID NO: 600849 - protein, 5 aa, Mycobacterium
TRRAP

SEQ ID NO: 600850 - protein, 6 aa, Mycobacterium
TRRAQL

SEQ ID NO: 600851 - protein, 5 aa, Mycobacterium
TRRAR

SEQ ID NO: 600852 - protein, 7 aa, Mycobacterium
TRRASGL

SEQ ID NO: 600853 - protein, 10 aa, Mycobacterium
TRRASQQRTS

SEQ ID NO: 600854 - protein, 39 aa, Mycobacterium
TRRCGPPTMAEPPGPTEWGGDGHGVGPWSGPPPDDPRYD

SEQ ID NO: 600855 - protein, 13 aa, Mycobacterium
TRRDDADLKLTQT

SEQ ID NO: 600856 - protein, 9 aa, Mycobacterium
TRRDDGGKI

SEQ ID NO: 600857 - protein, 6 aa, Mycobacterium
TRRDDL

SEQ ID NO: 600858 - protein, 6 aa, Mycobacterium
TRRDGT

SEQ ID NO: 600859 - protein, 7 aa, Mycobacterium
TRRDGTT

SEQ ID NO: 600860 - protein, 6 aa, Mycobacterium
TRRDLA

SEQ ID NO: 600861 - protein, 6 aa, Mycobacterium
TRREGR

SEQ ID NO: 600862 - protein, 7 aa, Mycobacterium
TRRESPQ

SEQ ID NO: 600863 - protein, 9 aa, Mycobacterium
TRRETPPGV

SEQ ID NO: 600864 - protein, 4 aa, Mycobacterium
TRRG

SEQ ID NO: 600865 - protein, 5 aa, Mycobacterium
TRRGC

SEQ ID NO: 600866 - protein, 5 aa, Mycobacterium
TRRGD

SEQ ID NO: 600867 - protein, 15 aa, Mycobacterium
TRRGEAGTRTLLTTP

SEQ ID NO: 600868 - protein, 12 aa, Mycobacterium
TRRGNRGDGDAI

SEQ ID NO: 600869 - protein, 5 aa, Mycobacterium
TRRGR

SEQ ID NO: 600870 - protein, 10 aa, Mycobacterium
TRRGRSGGSF

SEQ ID NO: 600871 - protein, 9 aa, Mycobacterium
TRRGTGLPG

SEQ ID NO: 600872 - protein, 19 aa, Mycobacterium
TRRHPTSNSLPSGHSASAA

SEQ ID NO: 600873 - protein, 8 aa, Mycobacterium
TRRKPASE

SEQ ID NO: 600874 - protein, 5 aa, Mycobacterium
TRRLG

SEQ ID NO: 600875 - protein, 9 aa, Mycobacterium
TRRLGPGEH

SEQ ID NO: 600876 - protein, 5 aa, Mycobacterium
TRRNE

SEQ ID NO: 600877 - protein, 6 aa, Mycobacterium
TRRPDG

SEQ ID NO: 600878 - protein, 8 aa, Mycobacterium
TRRPDGTE

SEQ ID NO: 600879 - protein, 9 aa, Mycobacterium
TRRPDPDGD

SEQ ID NO: 600880 - protein, 6 aa, Mycobacterium
TRRPEH

SEQ ID NO: 600881 - protein, 6 aa, Mycobacterium
TRRPEL

SEQ ID NO: 600882 - protein, 5 aa, Mycobacterium
TRRPP

SEQ ID NO: 600883 - protein, 9 aa, Mycobacterium
TRRPPSEEW

SEQ ID NO: 600884 - protein, 6 aa, Mycobacterium
TRRPRE

SEQ ID NO: 600885 - protein, 7 aa, Mycobacterium
TRRPRPA

SEQ ID NO: 600886 - protein, 9 aa, Mycobacterium
TRRPSPVTA

SEQ ID NO: 600887 - protein, 6 aa, Mycobacterium
TRRPTE

SEQ ID NO: 600888 - protein, 7 aa, Mycobacterium
TRRPVPI

SEQ ID NO: 600889 - protein, 14 aa, Mycobacterium
TRRQELQETGHPVA

SEQ ID NO: 600890 - protein, 4 aa, Mycobacterium
TRRR

SEQ ID NO: 600891 - protein, 23 aa, Mycobacterium
TRRRAPVGAPTGRRFPVSARPVL

SEQ ID NO: 600892 - protein, 7 aa, Mycobacterium
TRRRATQ

SEQ ID NO: 600893 - protein, 17 aa, Mycobacterium
TRRRDRISADEEERHRA

SEQ ID NO: 600894 - protein, 5 aa, Mycobacterium
TRRRE

SEQ ID NO: 600895 - protein, 14 aa, Mycobacterium
TRRRELEEHSSTEY

SEQ ID NO: 600896 - protein, 11 aa, Mycobacterium
TRRRNQRRQKH

SEQ ID NO: 600897 - protein, 13 aa, Mycobacterium
TRRRPPTASDAVS

SEQ ID NO: 600898 - protein, 15 aa, Mycobacterium
TRRRPVKREQAPETA

SEQ ID NO: 600899 - protein, 5 aa, Mycobacterium
TRRRR

SEQ ID NO: 600900 - protein, 14 aa, Mycobacterium
TRRRRDPAGDPGHD

SEQ ID NO: 600901 - protein, 11 aa, Mycobacterium
TRRRREAGHDS

SEQ ID NO: 600902 - protein, 10 aa, Mycobacterium
TRRRREPGHD

SEQ ID NO: 600903 - protein, 25 aa, Mycobacterium
TRRRRRPGRPPAPAPDGHARRSGSA

SEQ ID NO: 600904 - protein, 13 aa, Mycobacterium
TRRRSRAQNRAAR

SEQ ID NO: 600905 - protein, 4 aa, Mycobacterium
TRRS

SEQ ID NO: 600906 - protein, 5 aa, Mycobacterium
TRRSI

SEQ ID NO: 600907 - protein, 14 aa, Mycobacterium
TRRSTLSGGQQGTW

SEQ ID NO: 600908 - protein, 9 aa, Mycobacterium
TRRTGRPTA

SEQ ID NO: 600909 - protein, 7 aa, Mycobacterium
TRRTPAE

SEQ ID NO: 600910 - protein, 7 aa, Mycobacterium
TRRVDHP

SEQ ID NO: 600911 - protein, 10 aa, Mycobacterium
TRRVNSKRTV

SEQ ID NO: 600912 - protein, 8 aa, Mycobacterium
TRRVSGTA

SEQ ID NO: 600913 - protein, 7 aa, Mycobacterium
TRRVTGS

SEQ ID NO: 600914 - protein, 4 aa, Mycobacterium
TRRW

SEQ ID NO: 600915 - protein, 11 aa, Mycobacterium
TRRWESDPDRM

SEQ ID NO: 600916 - protein, 14 aa, Mycobacterium
TRRYEQERARAEDL

SEQ ID NO: 600917 - protein, 12 aa, Mycobacterium
TRRYGAQGLPED

SEQ ID NO: 600918 - protein, 10 aa, Mycobacterium
TRSAAEPEID

SEQ ID NO: 600919 - protein, 12 aa, Mycobacterium
TRSAAKAEPPVR

SEQ ID NO: 600920 - protein, 7 aa, Mycobacterium
TRSAAPP

SEQ ID NO: 600921 - protein, 5 aa, Mycobacterium
TRSAD

SEQ ID NO: 600922 - protein, 9 aa, Mycobacterium
TRSAEPLRQ

SEQ ID NO: 600923 - protein, 7 aa, Mycobacterium
TRSAQRT

SEQ ID NO: 600924 - protein, 12 aa, Mycobacterium
TRSARRVRPHDA

SEQ ID NO: 600925 - protein, 10 aa, Mycobacterium
TRSASAGRGL

SEQ ID NO: 600926 - protein, 13 aa, Mycobacterium
TRSASPGGVPGEN

SEQ ID NO: 600927 - protein, 9 aa, Mycobacterium
TRSASSADD

SEQ ID NO: 600928 - protein, 5 aa, Mycobacterium
TRSDA

SEQ ID NO: 600929 - protein, 12 aa, Mycobacterium
TRSDAARDGIPA

SEQ ID NO: 600930 - protein, 6 aa, Mycobacterium
TRSDDG

SEQ ID NO: 600931 - protein, 24 aa, Mycobacterium
TRSDGGDRQRGEAGRSGSPQDLEN

SEQ ID NO: 600932 - protein, 9 aa, Mycobacterium
TRSDGTPCT

SEQ ID NO: 600933 - protein, 5 aa, Mycobacterium
TRSDL

SEQ ID NO: 600934 - protein, 13 aa, Mycobacterium
TRSDLGASDVADD

SEQ ID NO: 600935 - protein, 13 aa, Mycobacterium
TRSDLNDPKTIES

SEQ ID NO: 600936 - protein, 7 aa, Mycobacterium
TRSDPDL

SEQ ID NO: 600937 - protein, 10 aa, Mycobacterium
TRSDRANLPP

SEQ ID NO: 600938 - protein, 10 aa, Mycobacterium
TRSDSGASPF

SEQ ID NO: 600939 - protein, 8 aa, Mycobacterium
TRSDVPPD

SEQ ID NO: 600940 - protein, 20 aa, Mycobacterium
TRSEPGTLQKGAATKKTGTT

SEQ ID NO: 600941 - protein, 5 aa, Mycobacterium
TRSES

SEQ ID NO: 600942 - protein, 7 aa, Mycobacterium
TRSFGTE

SEQ ID NO: 600943 - protein, 11 aa, Mycobacterium
TRSGAADRRAH

SEQ ID NO: 600944 - protein, 6 aa, Mycobacterium
TRSGAG

SEQ ID NO: 600945 - protein, 7 aa, Mycobacterium
TRSGAGD

SEQ ID NO: 600946 - protein, 10 aa, Mycobacterium
TRSGAPLPTL

SEQ ID NO: 600947 - protein, 9 aa, Mycobacterium
TRSGDGFGG

SEQ ID NO: 600948 - protein, 8 aa, Mycobacterium
TRSGDIDP

SEQ ID NO: 600949 - protein, 8 aa, Mycobacterium
TRSGGGDL

SEQ ID NO: 600950 - protein, 9 aa, Mycobacterium
TRSGGVARN

SEQ ID NO: 600951 - protein, 14 aa, Mycobacterium
TRSGKGGVAQVDTT

SEQ ID NO: 600952 - protein, 7 aa, Mycobacterium
TRSGMSA

SEQ ID NO: 600953 - protein, 9 aa, Mycobacterium
TRSGNRQIN

SEQ ID NO: 600954 - protein, 9 aa, Mycobacterium
TRSGPPPDR

SEQ ID NO: 600955 - protein, 11 aa, Mycobacterium
TRSGSSEWTTH

SEQ ID NO: 600956 - protein, 12 aa, Mycobacterium
TRSGSVADGSTV

SEQ ID NO: 600957 - protein, 5 aa, Mycobacterium
TRSGT

SEQ ID NO: 600958 - protein, 7 aa, Mycobacterium
TRSGTSR

SEQ ID NO: 600959 - protein, 8 aa, Mycobacterium
TRSGVGES

SEQ ID NO: 600960 - protein, 6 aa, Mycobacterium
TRSGWG

SEQ ID NO: 600961 - protein, 5 aa, Mycobacterium
TRSIG

SEQ ID NO: 600962 - protein, 4 aa, Mycobacterium
TRSK

SEQ ID NO: 600963 - protein, 7 aa, Mycobacterium
TRSKAGW

SEQ ID NO: 600964 - protein, 18 aa, Mycobacterium
TRSLADADQPLARRASVD

SEQ ID NO: 600965 - protein, 5 aa, Mycobacterium
TRSLD

SEQ ID NO: 600966 - protein, 13 aa, Mycobacterium
TRSMKESGAPITD

SEQ ID NO: 600967 - protein, 8 aa, Mycobacterium
TRSNGETV

SEQ ID NO: 600968 - protein, 10 aa, Mycobacterium
TRSPDAKDGV

SEQ ID NO: 600969 - protein, 15 aa, Mycobacterium
TRSPGGSSGGSAAAV

SEQ ID NO: 600970 - protein, 27 aa, Mycobacterium
TRSPYGAVSDSRRPEYISGGSSSGSAV

SEQ ID NO: 600971 - protein, 27 aa, Mycobacterium
TRSPYGPVRNAQRPEYISGGSSSGSAV

SEQ ID NO: 600972 - protein, 12 aa, Mycobacterium
TRSPYPAGGPIP

SEQ ID NO: 600973 - protein, 5 aa, Mycobacterium
TRSQL

SEQ ID NO: 600974 - protein, 74 aa, Mycobacterium
TRSQPAKKRTPRKAASKKIPTKTATKTAKKAQPKTTKKTQPKTKATRASSKVSDRPDADPPEPAEKPADSREGT

SEQ ID NO: 600975 - protein, 12 aa, Mycobacterium
TRSQQTPPPSRS

SEQ ID NO: 600976 - protein, 12 aa, Mycobacterium
TRSRDGGGSRYT

SEQ ID NO: 600977 - protein, 10 aa, Mycobacterium
TRSRGEHPDY

SEQ ID NO: 600978 - protein, 5 aa, Mycobacterium
TRSRP

SEQ ID NO: 600979 - protein, 7 aa, Mycobacterium
TRSRPGD

SEQ ID NO: 600980 - protein, 7 aa, Mycobacterium
TRSRSNR

SEQ ID NO: 600981 - protein, 5 aa, Mycobacterium
TRSRV

SEQ ID NO: 600982 - protein, 7 aa, Mycobacterium
TRSRVGL

SEQ ID NO: 600983 - protein, 4 aa, Mycobacterium
TRSS

SEQ ID NO: 600984 - protein, 5 aa, Mycobacterium
TRSSE

SEQ ID NO: 600985 - protein, 13 aa, Mycobacterium
TRSSGPDHASDGV

SEQ ID NO: 600986 - protein, 9 aa, Mycobacterium
TRSSGPGIA

SEQ ID NO: 600987 - protein, 26 aa, Mycobacterium
TRSSGPGPARTFPAGTAELTQANPVD

SEQ ID NO: 600988 - protein, 7 aa, Mycobacterium
TRSSPDE

SEQ ID NO: 600989 - protein, 8 aa, Mycobacterium
TRSSQDQC

SEQ ID NO: 600990 - protein, 10 aa, Mycobacterium
TRSSRSPDYA

SEQ ID NO: 600991 - protein, 8 aa, Mycobacterium
TRSSTKRL

SEQ ID NO: 600992 - protein, 8 aa, Mycobacterium
TRSTEQHQ

SEQ ID NO: 600993 - protein, 10 aa, Mycobacterium
TRSTNTPWYE

SEQ ID NO: 600994 - protein, 7 aa, Mycobacterium
TRSTQPE

SEQ ID NO: 600995 - protein, 13 aa, Mycobacterium
TRSTSRGQYPPPG

SEQ ID NO: 600996 - protein, 16 aa, Mycobacterium
TRSTTIGPAATGVASS

SEQ ID NO: 600997 - protein, 19 aa, Mycobacterium
TRSVGQQAATLKGEKRSGL

SEQ ID NO: 600998 - protein, 19 aa, Mycobacterium
TRSVQAYDGREVAPAAATE

SEQ ID NO: 600999 - protein, 5 aa, Mycobacterium
TRSVT

SEQ ID NO: 601000 - protein, 4 aa, Mycobacterium
TRSW

SEQ ID NO: 601001 - protein, 42 aa, Mycobacterium
TRTAAVSAAEAQAREAADARAAAHRQAEAADAAAREAAEAHA

SEQ ID NO: 601002 - protein, 10 aa, Mycobacterium
TRTADGSGSM

SEQ ID NO: 601003 - protein, 11 aa, Mycobacterium
TRTAEDAEDAL

SEQ ID NO: 601004 - protein, 11 aa, Mycobacterium
TRTAGDRPSAL

SEQ ID NO: 601005 - protein, 10 aa, Mycobacterium
TRTAPAGEGL

SEQ ID NO: 601006 - protein, 6 aa, Mycobacterium
TRTAPD

SEQ ID NO: 601007 - protein, 9 aa, Mycobacterium
TRTAPSGRV

SEQ ID NO: 601008 - protein, 15 aa, Mycobacterium
TRTAPSGRVLGPEER

SEQ ID NO: 601009 - protein, 6 aa, Mycobacterium
TRTART

SEQ ID NO: 601010 - protein, 7 aa, Mycobacterium
TRTATRD

SEQ ID NO: 601011 - protein, 4 aa, Mycobacterium
TRTD

SEQ ID NO: 601012 - protein, 5 aa, Mycobacterium
TRTDD

SEQ ID NO: 601013 - protein, 6 aa, Mycobacterium
TRTDDS

SEQ ID NO: 601014 - protein, 11 aa, Mycobacterium
TRTDEAPWPRN

SEQ ID NO: 601015 - protein, 9 aa, Mycobacterium
TRTDGAGRE

SEQ ID NO: 601016 - protein, 5 aa, Mycobacterium
TRTDI

SEQ ID NO: 601017 - protein, 6 aa, Mycobacterium
TRTDKI

SEQ ID NO: 601018 - protein, 10 aa, Mycobacterium
TRTDPDGTEA

SEQ ID NO: 601019 - protein, 10 aa, Mycobacterium
TRTDPPYAGD

SEQ ID NO: 601020 - protein, 5 aa, Mycobacterium
TRTDR

SEQ ID NO: 601021 - protein, 6 aa, Mycobacterium
TRTDRI

SEQ ID NO: 601022 - protein, 18 aa, Mycobacterium
TRTDRIASAAERDGRGDV

SEQ ID NO: 601023 - protein, 18 aa, Mycobacterium
TRTDRIASGLEGDGRGEV

SEQ ID NO: 601024 - protein, 14 aa, Mycobacterium
TRTDRPAKGHRGQC

SEQ ID NO: 601025 - protein, 10 aa, Mycobacterium
TRTDSPFPGL

SEQ ID NO: 601026 - protein, 6 aa, Mycobacterium
TRTDSV

SEQ ID NO: 601027 - protein, 7 aa, Mycobacterium
TRTDYTS

SEQ ID NO: 601028 - protein, 6 aa, Mycobacterium
TRTEGR

SEQ ID NO: 601029 - protein, 9 aa, Mycobacterium
TRTEKGKFT

SEQ ID NO: 601030 - protein, 4 aa, Mycobacterium
TRTF

SEQ ID NO: 601031 - protein, 6 aa, Mycobacterium
TRTGAR

SEQ ID NO: 601032 - protein, 5 aa, Mycobacterium
TRTGD

SEQ ID NO: 601033 - protein, 6 aa, Mycobacterium
TRTGDI

SEQ ID NO: 601034 - protein, 21 aa, Mycobacterium
TRTGESTREVPTSASCGPDST

SEQ ID NO: 601035 - protein, 6 aa, Mycobacterium
TRTGEW

SEQ ID NO: 601036 - protein, 10 aa, Mycobacterium
TRTGLGEGDI

SEQ ID NO: 601037 - protein, 6 aa, Mycobacterium
TRTGMP

SEQ ID NO: 601038 - protein, 7 aa, Mycobacterium
TRTGQEL

SEQ ID NO: 601039 - protein, 13 aa, Mycobacterium
TRTGQRFGTPAEA

SEQ ID NO: 601040 - protein, 5 aa, Mycobacterium
TRTGR

SEQ ID NO: 601041 - protein, 12 aa, Mycobacterium
TRTGRPAAGLPG

SEQ ID NO: 601042 - protein, 18 aa, Mycobacterium
TRTGRPSASLPLPRRETR

SEQ ID NO: 601043 - protein, 6 aa, Mycobacterium
TRTGRR

SEQ ID NO: 601044 - protein, 12 aa, Mycobacterium
TRTGSRPRLTDD

SEQ ID NO: 601045 - protein, 12 aa, Mycobacterium
TRTGTGPQPGQT

SEQ ID NO: 601046 - protein, 14 aa, Mycobacterium
TRTGTHRLSPVGSD

SEQ ID NO: 601047 - protein, 6 aa, Mycobacterium
TRTGTP

SEQ ID NO: 601048 - protein, 34 aa, Mycobacterium
TRTGTRDLHDGTTVTVDGARGEVASGVTEPAPQM

SEQ ID NO: 601049 - protein, 17 aa, Mycobacterium
TRTGTTARSGRSGGRPA

SEQ ID NO: 601050 - protein, 5 aa, Mycobacterium
TRTHH

SEQ ID NO: 601051 - protein, 4 aa, Mycobacterium
TRTL

SEQ ID NO: 601052 - protein, 17 aa, Mycobacterium
TRTLDGSVANGYGNSKW

SEQ ID NO: 601053 - protein, 6 aa, Mycobacterium
TRTLPQ

SEQ ID NO: 601054 - protein, 13 aa, Mycobacterium
TRTLTREELPPSA

SEQ ID NO: 601055 - protein, 9 aa, Mycobacterium
TRTNTDLAN

SEQ ID NO: 601056 - protein, 4 aa, Mycobacterium
TRTP

SEQ ID NO: 601057 - protein, 11 aa, Mycobacterium
TRTPAPSSDAR

SEQ ID NO: 601058 - protein, 10 aa, Mycobacterium
TRTPAQPPEV

SEQ ID NO: 601059 - protein, 13 aa, Mycobacterium
TRTPDGRFALAGE

SEQ ID NO: 601060 - protein, 6 aa, Mycobacterium
TRTPEA

SEQ ID NO: 601061 - protein, 6 aa, Mycobacterium
TRTPEF

SEQ ID NO: 601062 - protein, 7 aa, Mycobacterium
TRTPEQV

SEQ ID NO: 601063 - protein, 7 aa, Mycobacterium
TRTPGVM

SEQ ID NO: 601064 - protein, 11 aa, Mycobacterium
TRTPPPKHTAG

SEQ ID NO: 601065 - protein, 11 aa, Mycobacterium
TRTPTASKAAE

SEQ ID NO: 601066 - protein, 4 aa, Mycobacterium
TRTQ

SEQ ID NO: 601067 - protein, 10 aa, Mycobacterium
TRTQATAAAV

SEQ ID NO: 601068 - protein, 11 aa, Mycobacterium
TRTQQSREQAY

SEQ ID NO: 601069 - protein, 15 aa, Mycobacterium
TRTQQTAAPLAAASG

SEQ ID NO: 601070 - protein, 7 aa, Mycobacterium
TRTQRDK

SEQ ID NO: 601071 - protein, 8 aa, Mycobacterium
TRTQSGAF

SEQ ID NO: 601072 - protein, 6 aa, Mycobacterium
TRTRAG

SEQ ID NO: 601073 - protein, 8 aa, Mycobacterium
TRTRGTQE

SEQ ID NO: 601074 - protein, 12 aa, Mycobacterium
TRTRPDGTRQGS

SEQ ID NO: 601075 - protein, 15 aa, Mycobacterium
TRTRSDGGRVGGRSR

SEQ ID NO: 601076 - protein, 6 aa, Mycobacterium
TRTRTR

SEQ ID NO: 601077 - protein, 19 aa, Mycobacterium
TRTRTSRHALTQSAANDPD

SEQ ID NO: 601078 - protein, 4 aa, Mycobacterium
TRTS

SEQ ID NO: 601079 - protein, 7 aa, Mycobacterium
TRTTDRF

SEQ ID NO: 601080 - protein, 8 aa, Mycobacterium
TRTTELDE

SEQ ID NO: 601081 - protein, 8 aa, Mycobacterium
TRTTELNE

SEQ ID NO: 601082 - protein, 6 aa, Mycobacterium
TRTTHA

SEQ ID NO: 601083 - protein, 5 aa, Mycobacterium
TRTTR

SEQ ID NO: 601084 - protein, 7 aa, Mycobacterium
TRTTRAR

SEQ ID NO: 601085 - protein, 8 aa, Mycobacterium
TRTTRARV

SEQ ID NO: 601086 - protein, 9 aa, Mycobacterium
TRTTSAALS

SEQ ID NO: 601087 - protein, 9 aa, Mycobacterium
TRTVADPDS

SEQ ID NO: 601088 - protein, 4 aa, Mycobacterium
TRTW

SEQ ID NO: 601089 - protein, 6 aa, Mycobacterium
TRTYSA

SEQ ID NO: 601090 - protein, 4 aa, Mycobacterium
TRVA

SEQ ID NO: 601091 - protein, 5 aa, Mycobacterium
TRVAD

SEQ ID NO: 601092 - protein, 8 aa, Mycobacterium
TRVAGGPD

SEQ ID NO: 601093 - protein, 9 aa, Mycobacterium
TRVAPDAER

SEQ ID NO: 601094 - protein, 12 aa, Mycobacterium
TRVAPGSAREKV

SEQ ID NO: 601095 - protein, 16 aa, Mycobacterium
TRVDAEDWTPGDGDYL

SEQ ID NO: 601096 - protein, 21 aa, Mycobacterium
TRVDDSASPNASGDPRSANGE

SEQ ID NO: 601097 - protein, 7 aa, Mycobacterium
TRVDPDA

SEQ ID NO: 601098 - protein, 7 aa, Mycobacterium
TRVDPDT

SEQ ID NO: 601099 - protein, 17 aa, Mycobacterium
TRVEGAPSAAPGSQTLA

SEQ ID NO: 601100 - protein, 7 aa, Mycobacterium
TRVEQRT

SEQ ID NO: 601101 - protein, 5 aa, Mycobacterium
TRVER

SEQ ID NO: 601102 - protein, 4 aa, Mycobacterium
TRVG

SEQ ID NO: 601103 - protein, 8 aa, Mycobacterium
TRVGADAG

SEQ ID NO: 601104 - protein, 20 aa, Mycobacterium
TRVGEGHTVRDDPNARPGMS

SEQ ID NO: 601105 - protein, 9 aa, Mycobacterium
TRVGEYSKG

SEQ ID NO: 601106 - protein, 10 aa, Mycobacterium
TRVGGRQPAH

SEQ ID NO: 601107 - protein, 5 aa, Mycobacterium
TRVGL

SEQ ID NO: 601108 - protein, 9 aa, Mycobacterium
TRVGSGPFP

SEQ ID NO: 601109 - protein, 9 aa, Mycobacterium
TRVPGGSEV

SEQ ID NO: 601110 - protein, 8 aa, Mycobacterium
TRVPPQRR

SEQ ID NO: 601111 - protein, 7 aa, Mycobacterium
TRVQGAD

SEQ ID NO: 601112 - protein, 7 aa, Mycobacterium
TRVRRSD

SEQ ID NO: 601113 - protein, 12 aa, Mycobacterium
TRVSGQAPPGAA

SEQ ID NO: 601114 - protein, 6 aa, Mycobacterium
TRVSSS

SEQ ID NO: 601115 - protein, 13 aa, Mycobacterium
TRVSTGDADVDEA

SEQ ID NO: 601116 - protein, 8 aa, Mycobacterium
TRVTERDR

SEQ ID NO: 601117 - protein, 6 aa, Mycobacterium
TRVTND

SEQ ID NO: 601118 - protein, 5 aa, Mycobacterium
TRWSG

SEQ ID NO: 601119 - protein, 4 aa, Mycobacterium
TRYA

SEQ ID NO: 601120 - protein, 6 aa, Mycobacterium
TRYAAT

SEQ ID NO: 601121 - protein, 8 aa, Mycobacterium
TRYAPEGV

SEQ ID NO: 601122 - protein, 8 aa, Mycobacterium
TRYAPGGV

SEQ ID NO: 601123 - protein, 11 aa, Mycobacterium
TRYETAPDPDH

SEQ ID NO: 601124 - protein, 7 aa, Mycobacterium
TRYETGA

SEQ ID NO: 601125 - protein, 8 aa, Mycobacterium
TRYGDSPA

SEQ ID NO: 601126 - protein, 9 aa, Mycobacterium
TRYGGGEVG

SEQ ID NO: 601127 - protein, 10 aa, Mycobacterium
TRYGGGTTGL

SEQ ID NO: 601128 - protein, 8 aa, Mycobacterium
TRYGGQQA

SEQ ID NO: 601129 - protein, 12 aa, Mycobacterium
TRYGSVGPPLPY

SEQ ID NO: 601130 - protein, 4 aa, Mycobacterium
TRYP

SEQ ID NO: 601131 - protein, 14 aa, Mycobacterium
TRYPGTTLRESLRE

SEQ ID NO: 601132 - protein, 14 aa, Mycobacterium
TRYPNQLSGGQRQR

SEQ ID NO: 601133 - protein, 8 aa, Mycobacterium
TRYPPAGV

SEQ ID NO: 601134 - protein, 11 aa, Mycobacterium
TRYPPDGMSSE

SEQ ID NO: 601135 - protein, 5 aa, Mycobacterium
TRYQA

SEQ ID NO: 601136 - protein, 7 aa, Mycobacterium
TRYQPRG

SEQ ID NO: 601137 - protein, 22 aa, Mycobacterium
TRYRDENGKPQTAATLNGTLGT

SEQ ID NO: 601138 - protein, 4 aa, Mycobacterium
TRYS

SEQ ID NO: 601139 - protein, 6 aa, Mycobacterium
TRYSIG

SEQ ID NO: 601140 - protein, 7 aa, Mycobacterium
TSAAAAS

SEQ ID NO: 601141 - protein, 28 aa, Mycobacterium
TSAAATKLTPFASPQQATNPAGLPGQAA

SEQ ID NO: 601142 - protein, 9 aa, Mycobacterium
TSAAATVPQ

SEQ ID NO: 601143 - protein, 8 aa, Mycobacterium
TSAAATVQ

SEQ ID NO: 601144 - protein, 5 aa, Mycobacterium
TSAAE

SEQ ID NO: 601145 - protein, 8 aa, Mycobacterium
TSAAEAVP

SEQ ID NO: 601146 - protein, 7 aa, Mycobacterium
TSAAEEP

SEQ ID NO: 601147 - protein, 10 aa, Mycobacterium
TSAAEPEEAA

SEQ ID NO: 601148 - protein, 8 aa, Mycobacterium
TSAAEQAR

SEQ ID NO: 601149 - protein, 8 aa, Mycobacterium
TSAAGGLP

SEQ ID NO: 601150 - protein, 8 aa, Mycobacterium
TSAAGKSS

SEQ ID NO: 601151 - protein, 7 aa, Mycobacterium
TSAAGNT

SEQ ID NO: 601152 - protein, 6 aa, Mycobacterium
TSAAGP

SEQ ID NO: 601153 - protein, 8 aa, Mycobacterium
TSAAGQLK

SEQ ID NO: 601154 - protein, 8 aa, Mycobacterium
TSAAGRGG

SEQ ID NO: 601155 - protein, 6 aa, Mycobacterium
TSAAGV

SEQ ID NO: 601156 - protein, 22 aa, Mycobacterium
TSAALADPGQFAGYTGTAENPK

SEQ ID NO: 601157 - protein, 15 aa, Mycobacterium
TSAAPAADTRLDAAG

SEQ ID NO: 601158 - protein, 5 aa, Mycobacterium
TSAAQ

SEQ ID NO: 601159 - protein, 8 aa, Mycobacterium
TSAAQRAE

SEQ ID NO: 601160 - protein, 13 aa, Mycobacterium
TSAAQRAGTAGGD

SEQ ID NO: 601161 - protein, 10 aa, Mycobacterium
TSAARAVAKA

SEQ ID NO: 601162 - protein, 12 aa, Mycobacterium
TSAARERFDPDA

SEQ ID NO: 601163 - protein, 8 aa, Mycobacterium
TSAARGAV

SEQ ID NO: 601164 - protein, 10 aa, Mycobacterium
TSAASGVRDP

SEQ ID NO: 601165 - protein, 32 aa, Mycobacterium
TSAASTPAANVANAAATAATTTLPYSGPFSGA

SEQ ID NO: 601166 - protein, 10 aa, Mycobacterium
TSAASVGAPP

SEQ ID NO: 601167 - protein, 9 aa, Mycobacterium
TSAATTANG

SEQ ID NO: 601168 - protein, 6 aa, Mycobacterium
TSACAA

SEQ ID NO: 601169 - protein, 13 aa, Mycobacterium
TSACAPDEAPGGH

SEQ ID NO: 601170 - protein, 4 aa, Mycobacterium
TSAD

SEQ ID NO: 601171 - protein, 5 aa, Mycobacterium
TSADA

SEQ ID NO: 601172 - protein, 15 aa, Mycobacterium
TSADAAIAAKPKRNP

SEQ ID NO: 601173 - protein, 23 aa, Mycobacterium
TSADAEAKELTAARNEAEEEELK

SEQ ID NO: 601174 - protein, 11 aa, Mycobacterium
TSADALRQTAG

SEQ ID NO: 601175 - protein, 10 aa, Mycobacterium
TSADDGQAYG

SEQ ID NO: 601176 - protein, 6 aa, Mycobacterium
TSADEC

SEQ ID NO: 601177 - protein, 11 aa, Mycobacterium
TSADESAAQVT

SEQ ID NO: 601178 - protein, 9 aa, Mycobacterium
TSADFGTDT

SEQ ID NO: 601179 - protein, 17 aa, Mycobacterium
TSADGIAGSAEAELGQL

SEQ ID NO: 601180 - protein, 10 aa, Mycobacterium
TSADGLRQTA

SEQ ID NO: 601181 - protein, 7 aa, Mycobacterium
TSADPSV

SEQ ID NO: 601182 - protein, 17 aa, Mycobacterium
TSADRGAVRDVDNVVSD

SEQ ID NO: 601183 - protein, 7 aa, Mycobacterium
TSADSDD

SEQ ID NO: 601184 - protein, 8 aa, Mycobacterium
TSADSDDM

SEQ ID NO: 601185 - protein, 8 aa, Mycobacterium
TSADSGDG

SEQ ID NO: 601186 - protein, 6 aa, Mycobacterium
TSADTV

SEQ ID NO: 601187 - protein, 13 aa, Mycobacterium
TSADYAATAAEHE

SEQ ID NO: 601188 - protein, 9 aa, Mycobacterium
TSADYTGNT

SEQ ID NO: 601189 - protein, 9 aa, Mycobacterium
TSAEAAGME

SEQ ID NO: 601190 - protein, 15 aa, Mycobacterium
TSAEAEALAGSHPDG

SEQ ID NO: 601191 - protein, 12 aa, Mycobacterium
TSAEALRGSSRR

SEQ ID NO: 601192 - protein, 8 aa, Mycobacterium
TSAEDAAQ

SEQ ID NO: 601193 - protein, 10 aa, Mycobacterium
TSAEDGLARD

SEQ ID NO: 601194 - protein, 6 aa, Mycobacterium
TSAEGT

SEQ ID NO: 601195 - protein, 8 aa, Mycobacterium
TSAELGEE

SEQ ID NO: 601196 - protein, 12 aa, Mycobacterium
TSAELSRHSSEM

SEQ ID NO: 601197 - protein, 8 aa, Mycobacterium
TSAEPGNG

SEQ ID NO: 601198 - protein, 29 aa, Mycobacterium
TSAEPKSSTNSAGQVAAPGDSQPAATGCP

SEQ ID NO: 601199 - protein, 12 aa, Mycobacterium
TSAEQAVRDLTP

SEQ ID NO: 601200 - protein, 11 aa, Mycobacterium
TSAERAGRDPM

SEQ ID NO: 601201 - protein, 8 aa, Mycobacterium
TSAERDGD

SEQ ID NO: 601202 - protein, 6 aa, Mycobacterium
TSAFEQ

SEQ ID NO: 601203 - protein, 6 aa, Mycobacterium
TSAFTA

SEQ ID NO: 601204 - protein, 8 aa, Mycobacterium
TSAGAAAG

SEQ ID NO: 601205 - protein, 13 aa, Mycobacterium
TSAGAAARTPVAR

SEQ ID NO: 601206 - protein, 13 aa, Mycobacterium
TSAGADTSELALT

SEQ ID NO: 601207 - protein, 8 aa, Mycobacterium
TSAGASAG

SEQ ID NO: 601208 - protein, 7 aa, Mycobacterium
TSAGDPA

SEQ ID NO: 601209 - protein, 10 aa, Mycobacterium
TSAGDPNKYT

SEQ ID NO: 601210 - protein, 8 aa, Mycobacterium
TSAGDPSL

SEQ ID NO: 601211 - protein, 8 aa, Mycobacterium
TSAGERVE

SEQ ID NO: 601212 - protein, 8 aa, Mycobacterium
TSAGGAST

SEQ ID NO: 601213 - protein, 5 aa, Mycobacterium
TSAGI

SEQ ID NO: 601214 - protein, 5 aa, Mycobacterium
TSAGK

SEQ ID NO: 601215 - protein, 8 aa, Mycobacterium
TSAGKHHS

SEQ ID NO: 601216 - protein, 7 aa, Mycobacterium
TSAGNAE

SEQ ID NO: 601217 - protein, 8 aa, Mycobacterium
TSAGNGTH

SEQ ID NO: 601218 - protein, 8 aa, Mycobacterium
TSAGPDGM

SEQ ID NO: 601219 - protein, 8 aa, Mycobacterium
TSAGPEAV

SEQ ID NO: 601220 - protein, 6 aa, Mycobacterium
TSAGPH

SEQ ID NO: 601221 - protein, 7 aa, Mycobacterium
TSAGQQL

SEQ ID NO: 601222 - protein, 9 aa, Mycobacterium
TSAGRHPDS

SEQ ID NO: 601223 - protein, 8 aa, Mycobacterium
TSAGSDGL

SEQ ID NO: 601224 - protein, 7 aa, Mycobacterium
TSAGSET

SEQ ID NO: 601225 - protein, 7 aa, Mycobacterium
TSAGSTA

SEQ ID NO: 601226 - protein, 11 aa, Mycobacterium
TSAGTASPTAM

SEQ ID NO: 601227 - protein, 9 aa, Mycobacterium
TSAGTGDWH

SEQ ID NO: 601228 - protein, 7 aa, Mycobacterium
TSAGTGH

SEQ ID NO: 601229 - protein, 7 aa, Mycobacterium
TSAGTGN

SEQ ID NO: 601230 - protein, 17 aa, Mycobacterium
TSAGTGSWHAGDGADER

SEQ ID NO: 601231 - protein, 10 aa, Mycobacterium
TSAGTLTPEA

SEQ ID NO: 601232 - protein, 5 aa, Mycobacterium
TSAGV

SEQ ID NO: 601233 - protein, 7 aa, Mycobacterium
TSAGVSA

SEQ ID NO: 601234 - protein, 8 aa, Mycobacterium
TSAGVSAG

SEQ ID NO: 601235 - protein, 8 aa, Mycobacterium
TSAHGIKA

SEQ ID NO: 601236 - protein, 4 aa, Mycobacterium
TSAI

SEQ ID NO: 601237 - protein, 6 aa, Mycobacterium
TSAIPY

SEQ ID NO: 601238 - protein, 4 aa, Mycobacterium
TSAK

SEQ ID NO: 601239 - protein, 16 aa, Mycobacterium
TSAKGSTTEDPGPDLA

SEQ ID NO: 601240 - protein, 6 aa, Mycobacterium
TSAKPI

SEQ ID NO: 601241 - protein, 15 aa, Mycobacterium
TSALNPYTNPDGALA

SEQ ID NO: 601242 - protein, 15 aa, Mycobacterium
TSALNPYTNPEGALT

SEQ ID NO: 601243 - protein, 5 aa, Mycobacterium
TSALP

SEQ ID NO: 601244 - protein, 8 aa, Mycobacterium
TSANGQPA

SEQ ID NO: 601245 - protein, 12 aa, Mycobacterium
TSANLGRAEPGL

SEQ ID NO: 601246 - protein, 8 aa, Mycobacterium
TSANLQSL

SEQ ID NO: 601247 - protein, 14 aa, Mycobacterium
TSANLSAAAAQAGV

SEQ ID NO: 601248 - protein, 8 aa, Mycobacterium
TSANPDGD

SEQ ID NO: 601249 - protein, 8 aa, Mycobacterium
TSANSSRV

SEQ ID NO: 601250 - protein, 4 aa, Mycobacterium
TSAP

SEQ ID NO: 601251 - protein, 16 aa, Mycobacterium
TSAPAAAAEPGLGPPG

SEQ ID NO: 601252 - protein, 8 aa, Mycobacterium
TSAPAALD

SEQ ID NO: 601253 - protein, 8 aa, Mycobacterium
TSAPAGAA

SEQ ID NO: 601254 - protein, 15 aa, Mycobacterium
TSAPAMSGSREERRA

SEQ ID NO: 601255 - protein, 9 aa, Mycobacterium
TSAPASTRR

SEQ ID NO: 601256 - protein, 14 aa, Mycobacterium
TSAPASVVESPERV

SEQ ID NO: 601257 - protein, 7 aa, Mycobacterium
TSAPDDE

SEQ ID NO: 601258 - protein, 8 aa, Mycobacterium
TSAPDDEL

SEQ ID NO: 601259 - protein, 5 aa, Mycobacterium
TSAPE

SEQ ID NO: 601260 - protein, 7 aa, Mycobacterium
TSAPEDE

SEQ ID NO: 601261 - protein, 9 aa, Mycobacterium
TSAPEGEHA

SEQ ID NO: 601262 - protein, 7 aa, Mycobacterium
TSAPGHI

SEQ ID NO: 601263 - protein, 13 aa, Mycobacterium
TSAPLDEDPSPTV

SEQ ID NO: 601264 - protein, 6 aa, Mycobacterium
TSAPLG

SEQ ID NO: 601265 - protein, 10 aa, Mycobacterium
TSAPNRRPAV

SEQ ID NO: 601266 - protein, 14 aa, Mycobacterium
TSAPPESDAAPTVY

SEQ ID NO: 601267 - protein, 7 aa, Mycobacterium
TSAPRQK

SEQ ID NO: 601268 - protein, 6 aa, Mycobacterium
TSAPTG

SEQ ID NO: 601269 - protein, 5 aa, Mycobacterium
TSAPY

SEQ ID NO: 601270 - protein, 18 aa, Mycobacterium
TSAQAEQTATQAKAAAAA

SEQ ID NO: 601271 - protein, 10 aa, Mycobacterium
TSAQGGYSAT

SEQ ID NO: 601272 - protein, 5 aa, Mycobacterium
TSAQI

SEQ ID NO: 601273 - protein, 13 aa, Mycobacterium
TSAQQRTRDIDRA

SEQ ID NO: 601274 - protein, 5 aa, Mycobacterium
TSAQR

SEQ ID NO: 601275 - protein, 12 aa, Mycobacterium
TSAQRQCYTAQL

SEQ ID NO: 601276 - protein, 4 aa, Mycobacterium
TSAR

SEQ ID NO: 601277 - protein, 7 aa, Mycobacterium
TSARAEY

SEQ ID NO: 601278 - protein, 7 aa, Mycobacterium
TSARALA

SEQ ID NO: 601279 - protein, 8 aa, Mycobacterium
TSAREMGA

SEQ ID NO: 601280 - protein, 7 aa, Mycobacterium
TSARRDG

SEQ ID NO: 601281 - protein, 6 aa, Mycobacterium
TSARRV

SEQ ID NO: 601282 - protein, 5 aa, Mycobacterium
TSARS

SEQ ID NO: 601283 - protein, 12 aa, Mycobacterium
TSASAIQQTADT

SEQ ID NO: 601284 - protein, 6 aa, Mycobacterium
TSASAL

SEQ ID NO: 601285 - protein, 10 aa, Mycobacterium
TSASDLAGGY

SEQ ID NO: 601286 - protein, 9 aa, Mycobacterium
TSASDSDDI

SEQ ID NO: 601287 - protein, 14 aa, Mycobacterium
TSASGEATGGGPLT

SEQ ID NO: 601288 - protein, 10 aa, Mycobacterium
TSASISPDGT

SEQ ID NO: 601289 - protein, 5 aa, Mycobacterium
TSASM

SEQ ID NO: 601290 - protein, 8 aa, Mycobacterium
TSASSTVP

SEQ ID NO: 601291 - protein, 5 aa, Mycobacterium
TSASV

SEQ ID NO: 601292 - protein, 20 aa, Mycobacterium
TSASWTGAGSLASAANATAL

SEQ ID NO: 601293 - protein, 7 aa, Mycobacterium
TSATATT

SEQ ID NO: 601294 - protein, 7 aa, Mycobacterium
TSATGAP

SEQ ID NO: 601295 - protein, 9 aa, Mycobacterium
TSATGGSVE

SEQ ID NO: 601296 - protein, 5 aa, Mycobacterium
TSATM

SEQ ID NO: 601297 - protein, 6 aa, Mycobacterium
TSATPD

SEQ ID NO: 601298 - protein, 8 aa, Mycobacterium
TSATPDQL

SEQ ID NO: 601299 - protein, 10 aa, Mycobacterium
TSATSSGAKG

SEQ ID NO: 601300 - protein, 7 aa, Mycobacterium
TSATTAR

SEQ ID NO: 601301 - protein, 7 aa, Mycobacterium
TSATTAT

SEQ ID NO: 601302 - protein, 9 aa, Mycobacterium
TSATTPREA

SEQ ID NO: 601303 - protein, 5 aa, Mycobacterium
TSATV

SEQ ID NO: 601304 - protein, 11 aa, Mycobacterium
TSAVEESNRRR

SEQ ID NO: 601305 - protein, 8 aa, Mycobacterium
TSAVEGEY

SEQ ID NO: 601306 - protein, 6 aa, Mycobacterium
TSAVPD

SEQ ID NO: 601307 - protein, 7 aa, Mycobacterium
TSAVRDG

SEQ ID NO: 601308 - protein, 9 aa, Mycobacterium
TSAVRDGDD

SEQ ID NO: 601309 - protein, 5 aa, Mycobacterium
TSAVT

SEQ ID NO: 601310 - protein, 6 aa, Mycobacterium
TSAYDQ

SEQ ID NO: 601311 - protein, 13 aa, Mycobacterium
TSAYRKRADAPKR

SEQ ID NO: 601312 - protein, 7 aa, Mycobacterium
TSCAGDK

SEQ ID NO: 601313 - protein, 4 aa, Mycobacterium
TSDA

SEQ ID NO: 601314 - protein, 5 aa, Mycobacterium
TSDAA

SEQ ID NO: 601315 - protein, 12 aa, Mycobacterium
TSDAAASDQAPR

SEQ ID NO: 601316 - protein, 6 aa, Mycobacterium
TSDADA

SEQ ID NO: 601317 - protein, 9 aa, Mycobacterium
TSDADTAVP

SEQ ID NO: 601318 - protein, 5 aa, Mycobacterium
TSDAF

SEQ ID NO: 601319 - protein, 7 aa, Mycobacterium
TSDAGKS

SEQ ID NO: 601320 - protein, 6 aa, Mycobacterium
TSDAGL

SEQ ID NO: 601321 - protein, 6 aa, Mycobacterium
TSDAPG

SEQ ID NO: 601322 - protein, 6 aa, Mycobacterium
TSDAPL

SEQ ID NO: 601323 - protein, 6 aa, Mycobacterium
TSDASE

SEQ ID NO: 601324 - protein, 25 aa, Mycobacterium
TSDATGAPEQSGGPADGSNGVAGGC

SEQ ID NO: 601325 - protein, 9 aa, Mycobacterium
TSDATRLAG

SEQ ID NO: 601326 - protein, 10 aa, Mycobacterium
TSDAVGAGAI

SEQ ID NO: 601327 - protein, 4 aa, Mycobacterium
TSDD

SEQ ID NO: 601328 - protein, 10 aa, Mycobacterium
TSDDAELRGA

SEQ ID NO: 601329 - protein, 21 aa, Mycobacterium
TSDDAPETASERKFLGSTAGL

SEQ ID NO: 601330 - protein, 8 aa, Mycobacterium
TSDDDAGV

SEQ ID NO: 601331 - protein, 7 aa, Mycobacterium
TSDDDAN

SEQ ID NO: 601332 - protein, 8 aa, Mycobacterium
TSDDGTEI

SEQ ID NO: 601333 - protein, 8 aa, Mycobacterium
TSDDGTQV

SEQ ID NO: 601334 - protein, 7 aa, Mycobacterium
TSDDHAG

SEQ ID NO: 601335 - protein, 8 aa, Mycobacterium
TSDDHEGK

SEQ ID NO: 601336 - protein, 7 aa, Mycobacterium
TSDDHPG

SEQ ID NO: 601337 - protein, 6 aa, Mycobacterium
TSDEAT

SEQ ID NO: 601338 - protein, 8 aa, Mycobacterium
TSDEDAAA

SEQ ID NO: 601339 - protein, 7 aa, Mycobacterium
TSDEDAG

SEQ ID NO: 601340 - protein, 9 aa, Mycobacterium
TSDEDARRR

SEQ ID NO: 601341 - protein, 9 aa, Mycobacterium
TSDEGGYAG

SEQ ID NO: 601342 - protein, 20 aa, Mycobacterium
TSDEGKADLKDLGGVSSTTA

SEQ ID NO: 601343 - protein, 20 aa, Mycobacterium
TSDEGKADLKSLGGVSSTTA

SEQ ID NO: 601344 - protein, 25 aa, Mycobacterium
TSDEGRDETAAPGAANDSDGVAGGC

SEQ ID NO: 601345 - protein, 17 aa, Mycobacterium
TSDEGRKDDIAFLREHV

SEQ ID NO: 601346 - protein, 9 aa, Mycobacterium
TSDEQRCQE

SEQ ID NO: 601347 - protein, 6 aa, Mycobacterium
TSDEQV

SEQ ID NO: 601348 - protein, 5 aa, Mycobacterium
TSDER

SEQ ID NO: 601349 - protein, 9 aa, Mycobacterium
TSDESLAAW

SEQ ID NO: 601350 - protein, 6 aa, Mycobacterium
TSDFGP

SEQ ID NO: 601351 - protein, 4 aa, Mycobacterium
TSDG

SEQ ID NO: 601352 - protein, 6 aa, Mycobacterium
TSDGAA

SEQ ID NO: 601353 - protein, 7 aa, Mycobacterium
TSDGAAD

SEQ ID NO: 601354 - protein, 6 aa, Mycobacterium
TSDGAD

SEQ ID NO: 601355 - protein, 9 aa, Mycobacterium
TSDGDRMPW

SEQ ID NO: 601356 - protein, 9 aa, Mycobacterium
TSDGEEHTR

SEQ ID NO: 601357 - protein, 6 aa, Mycobacterium
TSDGFP

SEQ ID NO: 601358 - protein, 8 aa, Mycobacterium
TSDGGDLD

SEQ ID NO: 601359 - protein, 17 aa, Mycobacterium
TSDGGGKVSAARRPVYG

SEQ ID NO: 601360 - protein, 6 aa, Mycobacterium
TSDGGT

SEQ ID NO: 601361 - protein, 6 aa, Mycobacterium
TSDGLQ

SEQ ID NO: 601362 - protein, 7 aa, Mycobacterium
TSDGNHY

SEQ ID NO: 601363 - protein, 7 aa, Mycobacterium
TSDGRLS

SEQ ID NO: 601364 - protein, 5 aa, Mycobacterium
TSDGS

SEQ ID NO: 601365 - protein, 7 aa, Mycobacterium
TSDGSTL

SEQ ID NO: 601366 - protein, 8 aa, Mycobacterium
TSDGTPLS

SEQ ID NO: 601367 - protein, 6 aa, Mycobacterium
TSDGVA

SEQ ID NO: 601368 - protein, 8 aa, Mycobacterium
TSDGVNEA

SEQ ID NO: 601369 - protein, 8 aa, Mycobacterium
TSDGVPGC

SEQ ID NO: 601370 - protein, 5 aa, Mycobacterium
TSDGY

SEQ ID NO: 601371 - protein, 6 aa, Mycobacterium
TSDHEA

SEQ ID NO: 601372 - protein, 6 aa, Mycobacterium
TSDHRP

SEQ ID NO: 601373 - protein, 13 aa, Mycobacterium
TSDIAKTQATRYT

SEQ ID NO: 601374 - protein, 5 aa, Mycobacterium
TSDIG

SEQ ID NO: 601375 - protein, 8 aa, Mycobacterium
TSDKPDGM

SEQ ID NO: 601376 - protein, 8 aa, Mycobacterium
TSDKPNGM

SEQ ID NO: 601377 - protein, 19 aa, Mycobacterium
TSDLGEQPEPGAVNDAAGR

SEQ ID NO: 601378 - protein, 4 aa, Mycobacterium
TSDM

SEQ ID NO: 601379 - protein, 6 aa, Mycobacterium
TSDMDH

SEQ ID NO: 601380 - protein, 7 aa, Mycobacterium
TSDMGGA

SEQ ID NO: 601381 - protein, 7 aa, Mycobacterium
TSDMKAG

SEQ ID NO: 601382 - protein, 7 aa, Mycobacterium
TSDMKSG

SEQ ID NO: 601383 - protein, 8 aa, Mycobacterium
TSDPARRL

SEQ ID NO: 601384 - protein, 13 aa, Mycobacterium
TSDPDALARTDIS

SEQ ID NO: 601385 - protein, 9 aa, Mycobacterium
TSDPDDDEV

SEQ ID NO: 601386 - protein, 7 aa, Mycobacterium
TSDPDEL

SEQ ID NO: 601387 - protein, 11 aa, Mycobacterium
TSDPFGTPDEL

SEQ ID NO: 601388 - protein, 12 aa, Mycobacterium
TSDPFGTPDELR

SEQ ID NO: 601389 - protein, 8 aa, Mycobacterium
TSDPGAAQ

SEQ ID NO: 601390 - protein, 9 aa, Mycobacterium
TSDPHPEDG

SEQ ID NO: 601391 - protein, 7 aa, Mycobacterium
TSDPHPK

SEQ ID NO: 601392 - protein, 14 aa, Mycobacterium
TSDPNAIGSGPTVA

SEQ ID NO: 601393 - protein, 7 aa, Mycobacterium
TSDPQEL

SEQ ID NO: 601394 - protein, 10 aa, Mycobacterium
TSDPRAKHKV

SEQ ID NO: 601395 - protein, 9 aa, Mycobacterium
TSDPRPEDG

SEQ ID NO: 601396 - protein, 10 aa, Mycobacterium
TSDPSTGDAD

SEQ ID NO: 601397 - protein, 8 aa, Mycobacterium
TSDPVPED

SEQ ID NO: 601398 - protein, 8 aa, Mycobacterium
TSDPVRRK

SEQ ID NO: 601399 - protein, 9 aa, Mycobacterium
TSDQGKAEL

SEQ ID NO: 601400 - protein, 8 aa, Mycobacterium
TSDQKDTW

SEQ ID NO: 601401 - protein, 5 aa, Mycobacterium
TSDQR

SEQ ID NO: 601402 - protein, 4 aa, Mycobacterium
TSDR

SEQ ID NO: 601403 - protein, 5 aa, Mycobacterium
TSDRA

SEQ ID NO: 601404 - protein, 9 aa, Mycobacterium
TSDRAGLAR

SEQ ID NO: 601405 - protein, 17 aa, Mycobacterium
TSDRDLTAGAAPTPQSA

SEQ ID NO: 601406 - protein, 6 aa, Mycobacterium
TSDRIG

SEQ ID NO: 601407 - protein, 6 aa, Mycobacterium
TSDRPL

SEQ ID NO: 601408 - protein, 8 aa, Mycobacterium
TSDRPTQV

SEQ ID NO: 601409 - protein, 15 aa, Mycobacterium
TSDRQVRPVAPGSTA

SEQ ID NO: 601410 - protein, 8 aa, Mycobacterium
TSDRSDKL

SEQ ID NO: 601411 - protein, 7 aa, Mycobacterium
TSDRYPD

SEQ ID NO: 601412 - protein, 7 aa, Mycobacterium
TSDSGNE

SEQ ID NO: 601413 - protein, 6 aa, Mycobacterium
TSDSHP

SEQ ID NO: 601414 - protein, 16 aa, Mycobacterium
TSDSQPDPSAEQRPRR

SEQ ID NO: 601415 - protein, 14 aa, Mycobacterium
TSDSSDGKPNPASS

SEQ ID NO: 601416 - protein, 14 aa, Mycobacterium
TSDSVTNGQPLRTA

SEQ ID NO: 601417 - protein, 6 aa, Mycobacterium
TSDTAA

SEQ ID NO: 601418 - protein, 7 aa, Mycobacterium
TSDTPLL

SEQ ID NO: 601419 - protein, 6 aa, Mycobacterium
TSDTPV

SEQ ID NO: 601420 - protein, 10 aa, Mycobacterium
TSDTSREEVG

SEQ ID NO: 601421 - protein, 7 aa, Mycobacterium
TSDTTPV

SEQ ID NO: 601422 - protein, 7 aa, Mycobacterium
TSDTYSE

SEQ ID NO: 601423 - protein, 4 aa, Mycobacterium
TSDV

SEQ ID NO: 601424 - protein, 20 aa, Mycobacterium
TSDVGASGDGSGAPAADLDE

SEQ ID NO: 601425 - protein, 8 aa, Mycobacterium
TSDVGRQI

SEQ ID NO: 601426 - protein, 16 aa, Mycobacterium
TSDVGRQIEPSAFTED

SEQ ID NO: 601427 - protein, 9 aa, Mycobacterium
TSDVPTELE

SEQ ID NO: 601428 - protein, 7 aa, Mycobacterium
TSDYRNR

SEQ ID NO: 601429 - protein, 4 aa, Mycobacterium
TSEA

SEQ ID NO: 601430 - protein, 5 aa, Mycobacterium
TSEAA

SEQ ID NO: 601431 - protein, 10 aa, Mycobacterium
TSEAADKAQH

SEQ ID NO: 601432 - protein, 11 aa, Mycobacterium
TSEAADKAQRG

SEQ ID NO: 601433 - protein, 16 aa, Mycobacterium
TSEAAEAAARLRTAGA

SEQ ID NO: 601434 - protein, 8 aa, Mycobacterium
TSEAAERQ

SEQ ID NO: 601435 - protein, 8 aa, Mycobacterium
TSEADVED

SEQ ID NO: 601436 - protein, 9 aa, Mycobacterium
TSEADVKDR

SEQ ID NO: 601437 - protein, 12 aa, Mycobacterium
TSEAEKQAAAQS

SEQ ID NO: 601438 - protein, 8 aa, Mycobacterium
TSEANARQ

SEQ ID NO: 601439 - protein, 6 aa, Mycobacterium
TSEAPT

SEQ ID NO: 601440 - protein, 10 aa, Mycobacterium
TSEAYARAER

SEQ ID NO: 601441 - protein, 6 aa, Mycobacterium
TSEDAM

SEQ ID NO: 601442 - protein, 7 aa, Mycobacterium
TSEDAVD

SEQ ID NO: 601443 - protein, 13 aa, Mycobacterium
TSEDGETRTTRDV

SEQ ID NO: 601444 - protein, 6 aa, Mycobacterium
TSEDGI

SEQ ID NO: 601445 - protein, 19 aa, Mycobacterium
TSEDGYPNGQPAAGIEPGD

SEQ ID NO: 601446 - protein, 7 aa, Mycobacterium
TSEDIGR

SEQ ID NO: 601447 - protein, 4 aa, Mycobacterium
TSEE

SEQ ID NO: 601448 - protein, 8 aa, Mycobacterium
TSEEERAQ

SEQ ID NO: 601449 - protein, 6 aa, Mycobacterium
TSEEGL

SEQ ID NO: 601450 - protein, 12 aa, Mycobacterium
TSEELRKAAEGY

SEQ ID NO: 601451 - protein, 7 aa, Mycobacterium
TSEEQKQ

SEQ ID NO: 601452 - protein, 4 aa, Mycobacterium
TSEG

SEQ ID NO: 601453 - protein, 8 aa, Mycobacterium
TSEGETHR

SEQ ID NO: 601454 - protein, 15 aa, Mycobacterium
TSEGHRIGAADEQNF

SEQ ID NO: 601455 - protein, 9 aa, Mycobacterium
TSEGMADER

SEQ ID NO: 601456 - protein, 17 aa, Mycobacterium
TSEGQAVQAAESAARYE

SEQ ID NO: 601457 - protein, 9 aa, Mycobacterium
TSEGRPGCG

SEQ ID NO: 601458 - protein, 5 aa, Mycobacterium
TSEGV

SEQ ID NO: 601459 - protein, 5 aa, Mycobacterium
TSEGW

SEQ ID NO: 601460 - protein, 11 aa, Mycobacterium
TSEHSANGEEG

SEQ ID NO: 601461 - protein, 4 aa, Mycobacterium
TSEI

SEQ ID NO: 601462 - protein, 11 aa, Mycobacterium
TSEKASGARNR

SEQ ID NO: 601463 - protein, 5 aa, Mycobacterium
TSEKG

SEQ ID NO: 601464 - protein, 8 aa, Mycobacterium
TSELGGVS

SEQ ID NO: 601465 - protein, 13 aa, Mycobacterium
TSELRQSGPEDRW

SEQ ID NO: 601466 - protein, 13 aa, Mycobacterium
TSELRRKDVSGDC

SEQ ID NO: 601467 - protein, 7 aa, Mycobacterium
TSENSIV

SEQ ID NO: 601468 - protein, 9 aa, Mycobacterium
TSENTDPTA

SEQ ID NO: 601469 - protein, 4 aa, Mycobacterium
TSEP

SEQ ID NO: 601470 - protein, 12 aa, Mycobacterium
TSEPANRHGMGQ

SEQ ID NO: 601471 - protein, 7 aa, Mycobacterium
TSEPDER

SEQ ID NO: 601472 - protein, 5 aa, Mycobacterium
TSEPE

SEQ ID NO: 601473 - protein, 10 aa, Mycobacterium
TSEPFATPER

SEQ ID NO: 601474 - protein, 9 aa, Mycobacterium
TSEPISGGR

SEQ ID NO: 601475 - protein, 8 aa, Mycobacterium
TSEPLYGS

SEQ ID NO: 601476 - protein, 5 aa, Mycobacterium
TSEPN

SEQ ID NO: 601477 - protein, 7 aa, Mycobacterium
TSEPTTV

SEQ ID NO: 601478 - protein, 14 aa, Mycobacterium
TSEQLDDDQALPTA

SEQ ID NO: 601479 - protein, 9 aa, Mycobacterium
TSEQSRADV

SEQ ID NO: 601480 - protein, 10 aa, Mycobacterium
TSERKSPAHA

SEQ ID NO: 601481 - protein, 5 aa, Mycobacterium
TSESA

SEQ ID NO: 601482 - protein, 6 aa, Mycobacterium
TSESDC

SEQ ID NO: 601483 - protein, 6 aa, Mycobacterium
TSESDR

SEQ ID NO: 601484 - protein, 10 aa, Mycobacterium
TSESTEGGTR

SEQ ID NO: 601485 - protein, 15 aa, Mycobacterium
TSESVSDGQPLANDQ

SEQ ID NO: 601486 - protein, 7 aa, Mycobacterium
TSETAGA

SEQ ID NO: 601487 - protein, 8 aa, Mycobacterium
TSETARRI

SEQ ID NO: 601488 - protein, 6 aa, Mycobacterium
TSETLG

SEQ ID NO: 601489 - protein, 6 aa, Mycobacterium
TSETRG

SEQ ID NO: 601490 - protein, 19 aa, Mycobacterium
TSETTRSGARSRSAGTLST

SEQ ID NO: 601491 - protein, 5 aa, Mycobacterium
TSEVN

SEQ ID NO: 601492 - protein, 7 aa, Mycobacterium
TSEVPTG

SEQ ID NO: 601493 - protein, 6 aa, Mycobacterium
TSEVSG

SEQ ID NO: 601494 - protein, 7 aa, Mycobacterium
TSEVTSA

SEQ ID NO: 601495 - protein, 5 aa, Mycobacterium
TSEVY

SEQ ID NO: 601496 - protein, 16 aa, Mycobacterium
TSEVYGDPTVHPQAES

SEQ ID NO: 601497 - protein, 5 aa, Mycobacterium
TSEWP

SEQ ID NO: 601498 - protein, 5 aa, Mycobacterium
TSFPD

SEQ ID NO: 601499 - protein, 8 aa, Mycobacterium
TSFPDESI

SEQ ID NO: 601500 - protein, 12 aa, Mycobacterium
TSFPRPDTGTFR

SEQ ID NO: 601501 - protein, 5 aa, Mycobacterium
TSFRS

SEQ ID NO: 601502 - protein, 9 aa, Mycobacterium
TSFSNDDRS

SEQ ID NO: 601503 - protein, 7 aa, Mycobacterium
TSFSPGY

SEQ ID NO: 601504 - protein, 9 aa, Mycobacterium
TSFSSPIDG

SEQ ID NO: 601505 - protein, 8 aa, Mycobacterium
TSFSTPEF

SEQ ID NO: 601506 - protein, 8 aa, Mycobacterium
TSFTDGEQ

SEQ ID NO: 601507 - protein, 4 aa, Mycobacterium
TSGA

SEQ ID NO: 601508 - protein, 8 aa, Mycobacterium
TSGAATSE

SEQ ID NO: 601509 - protein, 9 aa, Mycobacterium
TSGADCPAE

SEQ ID NO: 601510 - protein, 7 aa, Mycobacterium
TSGADRA

SEQ ID NO: 601511 - protein, 11 aa, Mycobacterium
TSGAERDEDGS

SEQ ID NO: 601512 - protein, 6 aa, Mycobacterium
TSGALQ

SEQ ID NO: 601513 - protein, 9 aa, Mycobacterium
TSGALSPTL

SEQ ID NO: 601514 - protein, 6 aa, Mycobacterium
TSGANG

SEQ ID NO: 601515 - protein, 9 aa, Mycobacterium
TSGANVSPL

SEQ ID NO: 601516 - protein, 8 aa, Mycobacterium
TSGAQTSQ

SEQ ID NO: 601517 - protein, 11 aa, Mycobacterium
TSGARSGAERE

SEQ ID NO: 601518 - protein, 7 aa, Mycobacterium
TSGATAG

SEQ ID NO: 601519 - protein, 8 aa, Mycobacterium
TSGATGEP

SEQ ID NO: 601520 - protein, 10 aa, Mycobacterium
TSGATRPPVG

SEQ ID NO: 601521 - protein, 16 aa, Mycobacterium
TSGAVSTGTFNAGPDT

SEQ ID NO: 601522 - protein, 11 aa, Mycobacterium
TSGAWNPEGSE

SEQ ID NO: 601523 - protein, 8 aa, Mycobacterium
TSGDATAV

SEQ ID NO: 601524 - protein, 5 aa, Mycobacterium
TSGDG

SEQ ID NO: 601525 - protein, 5 aa, Mycobacterium
TSGDI

SEQ ID NO: 601526 - protein, 9 aa, Mycobacterium
TSGDIGEEQ

SEQ ID NO: 601527 - protein, 9 aa, Mycobacterium
TSGDPDGEE

SEQ ID NO: 601528 - protein, 8 aa, Mycobacterium
TSGDPGEL

SEQ ID NO: 601529 - protein, 9 aa, Mycobacterium
TSGDPRGAV

SEQ ID NO: 601530 - protein, 9 aa, Mycobacterium
TSGDPRSAV

SEQ ID NO: 601531 - protein, 14 aa, Mycobacterium
TSGDSARAKTLSER

SEQ ID NO: 601532 - protein, 7 aa, Mycobacterium
TSGDSDD

SEQ ID NO: 601533 - protein, 8 aa, Mycobacterium
TSGDSGDL

SEQ ID NO: 601534 - protein, 7 aa, Mycobacterium
TSGDSKM

SEQ ID NO: 601535 - protein, 21 aa, Mycobacterium
TSGDSRYGDDPVSSHAAAKLS

SEQ ID NO: 601536 - protein, 5 aa, Mycobacterium
TSGDV

SEQ ID NO: 601537 - protein, 4 aa, Mycobacterium
TSGE

SEQ ID NO: 601538 - protein, 10 aa, Mycobacterium
TSGEAGQARG

SEQ ID NO: 601539 - protein, 8 aa, Mycobacterium
TSGEAKPA

SEQ ID NO: 601540 - protein, 6 aa, Mycobacterium
TSGEAY

SEQ ID NO: 601541 - protein, 7 aa, Mycobacterium
TSGECMS

SEQ ID NO: 601542 - protein, 11 aa, Mycobacterium
TSGEEDAARRV

SEQ ID NO: 601543 - protein, 6 aa, Mycobacterium
TSGEEL

SEQ ID NO: 601544 - protein, 10 aa, Mycobacterium
TSGELSPVEA

SEQ ID NO: 601545 - protein, 10 aa, Mycobacterium
TSGEPGDGRG

SEQ ID NO: 601546 - protein, 10 aa, Mycobacterium
TSGEPGGARG

SEQ ID NO: 601547 - protein, 8 aa, Mycobacterium
TSGERAGL

SEQ ID NO: 601548 - protein, 8 aa, Mycobacterium
TSGERGQA

SEQ ID NO: 601549 - protein, 9 aa, Mycobacterium
TSGETGDVN

SEQ ID NO: 601550 - protein, 5 aa, Mycobacterium
TSGEV

SEQ ID NO: 601551 - protein, 12 aa, Mycobacterium
TSGGAGGTGGAG

SEQ ID NO: 601552 - protein, 8 aa, Mycobacterium
TSGGDEQR

SEQ ID NO: 601553 - protein, 9 aa, Mycobacterium
TSGGEFNRD

SEQ ID NO: 601554 - protein, 8 aa, Mycobacterium
TSGGEVGK

SEQ ID NO: 601555 - protein, 5 aa, Mycobacterium
TSGGF

SEQ ID NO: 601556 - protein, 6 aa, Mycobacterium
TSGGGA

SEQ ID NO: 601557 - protein, 15 aa, Mycobacterium
TSGGGEVHDTVTGPP

SEQ ID NO: 601558 - protein, 7 aa, Mycobacterium
TSGGGLR

SEQ ID NO: 601559 - protein, 7 aa, Mycobacterium
TSGGGLS

SEQ ID NO: 601560 - protein, 8 aa, Mycobacterium
TSGGGLSH

SEQ ID NO: 601561 - protein, 6 aa, Mycobacterium
TSGGGR

SEQ ID NO: 601562 - protein, 6 aa, Mycobacterium
TSGGGW

SEQ ID NO: 601563 - protein, 5 aa, Mycobacterium
TSGGI

SEQ ID NO: 601564 - protein, 30 aa, Mycobacterium
TSGGMPTIGGQVPADKPKDEPKPAPQDPSM

SEQ ID NO: 601565 - protein, 9 aa, Mycobacterium
TSGGPGDAT

SEQ ID NO: 601566 - protein, 8 aa, Mycobacterium
TSGGQVAR

SEQ ID NO: 601567 - protein, 17 aa, Mycobacterium
TSGGQVARYRPEAGETE

SEQ ID NO: 601568 - protein, 17 aa, Mycobacterium
TSGGQVARYRPGAGETD

SEQ ID NO: 601569 - protein, 7 aa, Mycobacterium
TSGGRID

SEQ ID NO: 601570 - protein, 14 aa, Mycobacterium
TSGGSQKAVNAEHR

SEQ ID NO: 601571 - protein, 9 aa, Mycobacterium
TSGGTSYIP

SEQ ID NO: 601572 - protein, 7 aa, Mycobacterium
TSGHEPL

SEQ ID NO: 601573 - protein, 7 aa, Mycobacterium
TSGHPRT

SEQ ID NO: 601574 - protein, 6 aa, Mycobacterium
TSGHVR

SEQ ID NO: 601575 - protein, 13 aa, Mycobacterium
TSGIDGGPGGAGY

SEQ ID NO: 601576 - protein, 5 aa, Mycobacterium
TSGIG

SEQ ID NO: 601577 - protein, 6 aa, Mycobacterium
TSGIGR

SEQ ID NO: 601578 - protein, 7 aa, Mycobacterium
TSGIGRS

SEQ ID NO: 601579 - protein, 9 aa, Mycobacterium
TSGIGSGYA

SEQ ID NO: 601580 - protein, 8 aa, Mycobacterium
TSGKLAPG

SEQ ID NO: 601581 - protein, 14 aa, Mycobacterium
TSGLARRAAPAVQP

SEQ ID NO: 601582 - protein, 6 aa, Mycobacterium
TSGLGA

SEQ ID NO: 601583 - protein, 7 aa, Mycobacterium
TSGLGDR

SEQ ID NO: 601584 - protein, 7 aa, Mycobacterium
TSGLGEG

SEQ ID NO: 601585 - protein, 15 aa, Mycobacterium
TSGLRGLPNTAHYTA

SEQ ID NO: 601586 - protein, 6 aa, Mycobacterium
TSGLSA

SEQ ID NO: 601587 - protein, 5 aa, Mycobacterium
TSGLT

SEQ ID NO: 601588 - protein, 14 aa, Mycobacterium
TSGLTGGSWQGPAA

SEQ ID NO: 601589 - protein, 13 aa, Mycobacterium
TSGLTGQAWQGAA

SEQ ID NO: 601590 - protein, 12 aa, Mycobacterium
TSGLTTPAPAEL

SEQ ID NO: 601591 - protein, 6 aa, Mycobacterium
TSGMSK

SEQ ID NO: 601592 - protein, 15 aa, Mycobacterium
TSGNQIVDSAGRPVQ

SEQ ID NO: 601593 - protein, 5 aa, Mycobacterium
TSGNT

SEQ ID NO: 601594 - protein, 8 aa, Mycobacterium
TSGPAGTD

SEQ ID NO: 601595 - protein, 6 aa, Mycobacterium
TSGPAL

SEQ ID NO: 601596 - protein, 17 aa, Mycobacterium
TSGPALQQNLVAVMEGN

SEQ ID NO: 601597 - protein, 6 aa, Mycobacterium
TSGPAN

SEQ ID NO: 601598 - protein, 8 aa, Mycobacterium
TSGPAPNL

SEQ ID NO: 601599 - protein, 6 aa, Mycobacterium
TSGPDI

SEQ ID NO: 601600 - protein, 6 aa, Mycobacterium
TSGPGF

SEQ ID NO: 601601 - protein, 30 aa, Mycobacterium
TSGPGFGHTRNPWSRGHTPGGSSGGSAAAV

SEQ ID NO: 601602 - protein, 30 aa, Mycobacterium
TSGPGFGHTRNPWSRRHSPGGSSGGSAAAV

SEQ ID NO: 601603 - protein, 30 aa, Mycobacterium
TSGPGFGHTRNPWSRRHTPGGSSGGSAAAV

SEQ ID NO: 601604 - protein, 7 aa, Mycobacterium
TSGPGGF

SEQ ID NO: 601605 - protein, 9 aa, Mycobacterium
TSGPGTTNL

SEQ ID NO: 601606 - protein, 7 aa, Mycobacterium
TSGPKDE

SEQ ID NO: 601607 - protein, 10 aa, Mycobacterium
TSGPKHEAAG

SEQ ID NO: 601608 - protein, 8 aa, Mycobacterium
TSGPPPHP

SEQ ID NO: 601609 - protein, 6 aa, Mycobacterium
TSGPQV

SEQ ID NO: 601610 - protein, 6 aa, Mycobacterium
TSGPRS

SEQ ID NO: 601611 - protein, 7 aa, Mycobacterium
TSGPSDE

SEQ ID NO: 601612 - protein, 6 aa, Mycobacterium
TSGPTN

SEQ ID NO: 601613 - protein, 5 aa, Mycobacterium
TSGPV

SEQ ID NO: 601614 - protein, 8 aa, Mycobacterium
TSGPVDDT

SEQ ID NO: 601615 - protein, 13 aa, Mycobacterium
TSGPWESEQTHDS

SEQ ID NO: 601616 - protein, 8 aa, Mycobacterium
TSGPYTDA

SEQ ID NO: 601617 - protein, 9 aa, Mycobacterium
TSGPYTDDT

SEQ ID NO: 601618 - protein, 9 aa, Mycobacterium
TSGPYTDPD

SEQ ID NO: 601619 - protein, 11 aa, Mycobacterium
TSGPYTDPDAT

SEQ ID NO: 601620 - protein, 9 aa, Mycobacterium
TSGPYTDPN

SEQ ID NO: 601621 - protein, 9 aa, Mycobacterium
TSGPYTDTD

SEQ ID NO: 601622 - protein, 9 aa, Mycobacterium
TSGPYTDTN

SEQ ID NO: 601623 - protein, 15 aa, Mycobacterium
TSGPYTETDTPARLA

SEQ ID NO: 601624 - protein, 4 aa, Mycobacterium
TSGQ

SEQ ID NO: 601625 - protein, 8 aa, Mycobacterium
TSGQPDPD

SEQ ID NO: 601626 - protein, 11 aa, Mycobacterium
TSGRADTTRQQ

SEQ ID NO: 601627 - protein, 10 aa, Mycobacterium
TSGRATLGTP

SEQ ID NO: 601628 - protein, 5 aa, Mycobacterium
TSGRD

SEQ ID NO: 601629 - protein, 7 aa, Mycobacterium
TSGRDRT

SEQ ID NO: 601630 - protein, 6 aa, Mycobacterium
TSGRQV

SEQ ID NO: 601631 - protein, 7 aa, Mycobacterium
TSGRTDI

SEQ ID NO: 601632 - protein, 9 aa, Mycobacterium
TSGRTDTNV

SEQ ID NO: 601633 - protein, 9 aa, Mycobacterium
TSGRTESGV

SEQ ID NO: 601634 - protein, 8 aa, Mycobacterium
TSGRTGVD

SEQ ID NO: 601635 - protein, 5 aa, Mycobacterium
TSGRV

SEQ ID NO: 601636 - protein, 10 aa, Mycobacterium
TSGRVKRPQL

SEQ ID NO: 601637 - protein, 8 aa, Mycobacterium
TSGSAARP

SEQ ID NO: 601638 - protein, 12 aa, Mycobacterium
TSGSARPAAGCP

SEQ ID NO: 601639 - protein, 7 aa, Mycobacterium
TSGSDRH

SEQ ID NO: 601640 - protein, 9 aa, Mycobacterium
TSGSGETSA

SEQ ID NO: 601641 - protein, 11 aa, Mycobacterium
TSGSHGDRHRG

SEQ ID NO: 601642 - protein, 6 aa, Mycobacterium
TSGSKG

SEQ ID NO: 601643 - protein, 9 aa, Mycobacterium
TSGSMGSAD

SEQ ID NO: 601644 - protein, 6 aa, Mycobacterium
TSGSQA

SEQ ID NO: 601645 - protein, 18 aa, Mycobacterium
TSGSRANITDSGAVEEPY

SEQ ID NO: 601646 - protein, 10 aa, Mycobacterium
TSGSSGPGGL

SEQ ID NO: 601647 - protein, 9 aa, Mycobacterium
TSGSSQGNQ

SEQ ID NO: 601648 - protein, 8 aa, Mycobacterium
TSGSTGIP

SEQ ID NO: 601649 - protein, 10 aa, Mycobacterium
TSGSTGQPKG

SEQ ID NO: 601650 - protein, 9 aa, Mycobacterium
TSGSTRAPA

SEQ ID NO: 601651 - protein, 9 aa, Mycobacterium
TSGSTREPA

SEQ ID NO: 601652 - protein, 10 aa, Mycobacterium
TSGSTRIPTG

SEQ ID NO: 601653 - protein, 8 aa, Mycobacterium
TSGSTRLP

SEQ ID NO: 601654 - protein, 9 aa, Mycobacterium
TSGSTRPPV

SEQ ID NO: 601655 - protein, 10 aa, Mycobacterium
TSGSTRQPAG

SEQ ID NO: 601656 - protein, 10 aa, Mycobacterium
TSGSTRRPTG

SEQ ID NO: 601657 - protein, 9 aa, Mycobacterium
TSGSTRTPA

SEQ ID NO: 601658 - protein, 11 aa, Mycobacterium
TSGSTRTPAGV

SEQ ID NO: 601659 - protein, 9 aa, Mycobacterium
TSGSTRVPA

SEQ ID NO: 601660 - protein, 10 aa, Mycobacterium
TSGSTSTPKG

SEQ ID NO: 601661 - protein, 4 aa, Mycobacterium
TSGT

SEQ ID NO: 601662 - protein, 13 aa, Mycobacterium
TSGTAARPLNGTP

SEQ ID NO: 601663 - protein, 14 aa, Mycobacterium
TSGTDTDTGTTLGV

SEQ ID NO: 601664 - protein, 8 aa, Mycobacterium
TSGTEDIG

SEQ ID NO: 601665 - protein, 8 aa, Mycobacterium
TSGTFSPT

SEQ ID NO: 601666 - protein, 16 aa, Mycobacterium
TSGTGSEVQMGNAEGR

SEQ ID NO: 601667 - protein, 5 aa, Mycobacterium
TSGTI

SEQ ID NO: 601668 - protein, 6 aa, Mycobacterium
TSGTIE

SEQ ID NO: 601669 - protein, 15 aa, Mycobacterium
TSGTITARGKKYELE

SEQ ID NO: 601670 - protein, 5 aa, Mycobacterium
TSGTN

SEQ ID NO: 601671 - protein, 5 aa, Mycobacterium
TSGTP

SEQ ID NO: 601672 - protein, 21 aa, Mycobacterium
TSGTPEDEIAKRREAGRKVIV

SEQ ID NO: 601673 - protein, 9 aa, Mycobacterium
TSGTPSPVL

SEQ ID NO: 601674 - protein, 6 aa, Mycobacterium
TSGTRI

SEQ ID NO: 601675 - protein, 8 aa, Mycobacterium
TSGTTGAP

SEQ ID NO: 601676 - protein, 12 aa, Mycobacterium
TSGTTGAPKGAL

SEQ ID NO: 601677 - protein, 12 aa, Mycobacterium
TSGTTGFPKGAT

SEQ ID NO: 601678 - protein, 13 aa, Mycobacterium
TSGTTGFPKGATL

SEQ ID NO: 601679 - protein, 11 aa, Mycobacterium
TSGTTGHPKGV

SEQ ID NO: 601680 - protein, 12 aa, Mycobacterium
TSGTTGKPKGAM

SEQ ID NO: 601681 - protein, 10 aa, Mycobacterium
TSGTTGNPKG

SEQ ID NO: 601682 - protein, 9 aa, Mycobacterium
TSGTTGQPK

SEQ ID NO: 601683 - protein, 8 aa, Mycobacterium
TSGTTGRP

SEQ ID NO: 601684 - protein, 9 aa, Mycobacterium
TSGTTGRPK

SEQ ID NO: 601685 - protein, 10 aa, Mycobacterium
TSGTTGRPKG

SEQ ID NO: 601686 - protein, 8 aa, Mycobacterium
TSGTTGVP

SEQ ID NO: 601687 - protein, 14 aa, Mycobacterium
TSGTTGYPKGATLS

SEQ ID NO: 601688 - protein, 6 aa, Mycobacterium
TSGTVA

SEQ ID NO: 601689 - protein, 7 aa, Mycobacterium
TSGTVDV

SEQ ID NO: 601690 - protein, 9 aa, Mycobacterium
TSGVDDSTQ

SEQ ID NO: 601691 - protein, 5 aa, Mycobacterium
TSGVG

SEQ ID NO: 601692 - protein, 7 aa, Mycobacterium
TSGVHER

SEQ ID NO: 601693 - protein, 9 aa, Mycobacterium
TSGVSDATQ

SEQ ID NO: 601694 - protein, 6 aa, Mycobacterium
TSGVST

SEQ ID NO: 601695 - protein, 8 aa, Mycobacterium
TSGWRGPA

SEQ ID NO: 601696 - protein, 8 aa, Mycobacterium
TSGYDAKT

SEQ ID NO: 601697 - protein, 8 aa, Mycobacterium
TSGYVDPG

SEQ ID NO: 601698 - protein, 7 aa, Mycobacterium
TSHDADS

SEQ ID NO: 601699 - protein, 7 aa, Mycobacterium
TSHEAGA

SEQ ID NO: 601700 - protein, 4 aa, Mycobacterium
TSHG

SEQ ID NO: 601701 - protein, 7 aa, Mycobacterium
TSHGADL

SEQ ID NO: 601702 - protein, 7 aa, Mycobacterium
TSHGDAS

SEQ ID NO: 601703 - protein, 9 aa, Mycobacterium
TSHGDFATS

SEQ ID NO: 601704 - protein, 13 aa, Mycobacterium
TSHGGREGKQGRL

SEQ ID NO: 601705 - protein, 7 aa, Mycobacterium
TSHPDST

SEQ ID NO: 601706 - protein, 7 aa, Mycobacterium
TSHPDTT

SEQ ID NO: 601707 - protein, 8 aa, Mycobacterium
TSHPESAQ

SEQ ID NO: 601708 - protein, 13 aa, Mycobacterium
TSHPPTEASRRDP

SEQ ID NO: 601709 - protein, 11 aa, Mycobacterium
TSHREAPSSEV

SEQ ID NO: 601710 - protein, 7 aa, Mycobacterium
TSHREQP

SEQ ID NO: 601711 - protein, 8 aa, Mycobacterium
TSHRETPR

SEQ ID NO: 601712 - protein, 11 aa, Mycobacterium
TSHRGHGTELA

SEQ ID NO: 601713 - protein, 9 aa, Mycobacterium
TSHRNVSEQ

SEQ ID NO: 601714 - protein, 8 aa, Mycobacterium
TSHRQAPV

SEQ ID NO: 601715 - protein, 8 aa, Mycobacterium
TSHRQGAA

SEQ ID NO: 601716 - protein, 8 aa, Mycobacterium
TSHRRASA

SEQ ID NO: 601717 - protein, 4 aa, Mycobacterium
TSHT

SEQ ID NO: 601718 - protein, 7 aa, Mycobacterium
TSHTNNA

SEQ ID NO: 601719 - protein, 8 aa, Mycobacterium
TSIAPEGI

SEQ ID NO: 601720 - protein, 4 aa, Mycobacterium
TSID

SEQ ID NO: 601721 - protein, 9 aa, Mycobacterium
TSIDDDPGL

SEQ ID NO: 601722 - protein, 9 aa, Mycobacterium
TSIDSGEAI

SEQ ID NO: 601723 - protein, 6 aa, Mycobacterium
TSIESP

SEQ ID NO: 601724 - protein, 7 aa, Mycobacterium
TSIESPA

SEQ ID NO: 601725 - protein, 4 aa, Mycobacterium
TSIG

SEQ ID NO: 601726 - protein, 16 aa, Mycobacterium
TSIGDNNTVSATNGLG

SEQ ID NO: 601727 - protein, 4 aa, Mycobacterium
TSIH

SEQ ID NO: 601728 - protein, 27 aa, Mycobacterium
TSIPDTQDIADQPPEADEPISTAPEHA

SEQ ID NO: 601729 - protein, 9 aa, Mycobacterium
TSIPEGGVD

SEQ ID NO: 601730 - protein, 8 aa, Mycobacterium
TSIPGAAD

SEQ ID NO: 601731 - protein, 6 aa, Mycobacterium
TSIPGN

SEQ ID NO: 601732 - protein, 7 aa, Mycobacterium
TSISGRE

SEQ ID NO: 601733 - protein, 6 aa, Mycobacterium
TSITAA

SEQ ID NO: 601734 - protein, 7 aa, Mycobacterium
TSITPAA

SEQ ID NO: 601735 - protein, 7 aa, Mycobacterium
TSITPAD

SEQ ID NO: 601736 - protein, 8 aa, Mycobacterium
TSITPKRD

SEQ ID NO: 601737 - protein, 15 aa, Mycobacterium
TSKAAPGATAPINKR

SEQ ID NO: 601738 - protein, 9 aa, Mycobacterium
TSKAEPTAR

SEQ ID NO: 601739 - protein, 9 aa, Mycobacterium
TSKAETTAQ

SEQ ID NO: 601740 - protein, 9 aa, Mycobacterium
TSKAGNTEV

SEQ ID NO: 601741 - protein, 13 aa, Mycobacterium
TSKAKTATAENIS

SEQ ID NO: 601742 - protein, 9 aa, Mycobacterium
TSKATGVDE

SEQ ID NO: 601743 - protein, 14 aa, Mycobacterium
TSKDFAAEETRAAR

SEQ ID NO: 601744 - protein, 12 aa, Mycobacterium
TSKDFADEETRA

SEQ ID NO: 601745 - protein, 7 aa, Mycobacterium
TSKDGAR

SEQ ID NO: 601746 - protein, 5 aa, Mycobacterium
TSKDR

SEQ ID NO: 601747 - protein, 8 aa, Mycobacterium
TSKEEVEE

SEQ ID NO: 601748 - protein, 8 aa, Mycobacterium
TSKFTPNP

SEQ ID NO: 601749 - protein, 10 aa, Mycobacterium
TSKGEKKQQG

SEQ ID NO: 601750 - protein, 6 aa, Mycobacterium
TSKGGT

SEQ ID NO: 601751 - protein, 7 aa, Mycobacterium
TSKGGTC

SEQ ID NO: 601752 - protein, 12 aa, Mycobacterium
TSKGHELRSRKL

SEQ ID NO: 601753 - protein, 5 aa, Mycobacterium
TSKGL

SEQ ID NO: 601754 - protein, 6 aa, Mycobacterium
TSKGRE

SEQ ID NO: 601755 - protein, 17 aa, Mycobacterium
TSKIKKSHGAAGENDAP

SEQ ID NO: 601756 - protein, 8 aa, Mycobacterium
TSKKRDDL

SEQ ID NO: 601757 - protein, 7 aa, Mycobacterium
TSKLDDE

SEQ ID NO: 601758 - protein, 10 aa, Mycobacterium
TSKLPAKPTL

SEQ ID NO: 601759 - protein, 9 aa, Mycobacterium
TSKNTQDRI

SEQ ID NO: 601760 - protein, 15 aa, Mycobacterium
TSKPIPGADPRSGRW

SEQ ID NO: 601761 - protein, 6 aa, Mycobacterium
TSKRER

SEQ ID NO: 601762 - protein, 6 aa, Mycobacterium
TSKRPN

SEQ ID NO: 601763 - protein, 10 aa, Mycobacterium
TSKRPQTTRH

SEQ ID NO: 601764 - protein, 9 aa, Mycobacterium
TSKSATAAE

SEQ ID NO: 601765 - protein, 10 aa, Mycobacterium
TSKSGTDKVA

SEQ ID NO: 601766 - protein, 10 aa, Mycobacterium
TSKSRRYSTT

SEQ ID NO: 601767 - protein, 10 aa, Mycobacterium
TSKSRSYSTT

SEQ ID NO: 601768 - protein, 5 aa, Mycobacterium
TSKTL

SEQ ID NO: 601769 - protein, 5 aa, Mycobacterium
TSKTS

SEQ ID NO: 601770 - protein, 4 aa, Mycobacterium
TSKV

SEQ ID NO: 601771 - protein, 11 aa, Mycobacterium
TSLADADPAGI

SEQ ID NO: 601772 - protein, 9 aa, Mycobacterium
TSLAEAEEA

SEQ ID NO: 601773 - protein, 5 aa, Mycobacterium
TSLAQ

SEQ ID NO: 601774 - protein, 15 aa, Mycobacterium
TSLDDTAAAGALPTA

SEQ ID NO: 601775 - protein, 18 aa, Mycobacterium
TSLDGSLGAAAPRGRTEH

SEQ ID NO: 601776 - protein, 5 aa, Mycobacterium
TSLEE

SEQ ID NO: 601777 - protein, 19 aa, Mycobacterium
TSLETPAPEVAAPTGGAGL

SEQ ID NO: 601778 - protein, 8 aa, Mycobacterium
TSLGAANA

SEQ ID NO: 601779 - protein, 6 aa, Mycobacterium
TSLGEA

SEQ ID NO: 601780 - protein, 10 aa, Mycobacterium
TSLGSQQDKN

SEQ ID NO: 601781 - protein, 13 aa, Mycobacterium
TSLGTPGGDQQDQ

SEQ ID NO: 601782 - protein, 4 aa, Mycobacterium
TSLK

SEQ ID NO: 601783 - protein, 12 aa, Mycobacterium
TSLKQARGAKLP

SEQ ID NO: 601784 - protein, 12 aa, Mycobacterium
TSLKQPKGNALP

SEQ ID NO: 601785 - protein, 15 aa, Mycobacterium
TSLNGTQAQADPDDK

SEQ ID NO: 601786 - protein, 15 aa, Mycobacterium
TSLNGTQAQEDPDGK

SEQ ID NO: 601787 - protein, 15 aa, Mycobacterium
TSLNNSQAQADPDGK

SEQ ID NO: 601788 - protein, 14 aa, Mycobacterium
TSLNSHQSHVDPDG

SEQ ID NO: 601789 - protein, 15 aa, Mycobacterium
TSLNSSQAQIDPDGN

SEQ ID NO: 601790 - protein, 12 aa, Mycobacterium
TSLPAGATRTAA

SEQ ID NO: 601791 - protein, 10 aa, Mycobacterium
TSLPAGTAKA

SEQ ID NO: 601792 - protein, 10 aa, Mycobacterium
TSLPAGTTRA

SEQ ID NO: 601793 - protein, 29 aa, Mycobacterium
TSLPGSSALSGSTALSDVAASSGSAISPG

SEQ ID NO: 601794 - protein, 13 aa, Mycobacterium
TSLPGTDEAAARS

SEQ ID NO: 601795 - protein, 9 aa, Mycobacterium
TSLRDGSHH

SEQ ID NO: 601796 - protein, 6 aa, Mycobacterium
TSLREG

SEQ ID NO: 601797 - protein, 5 aa, Mycobacterium
TSLSD

SEQ ID NO: 601798 - protein, 6 aa, Mycobacterium
TSLSDH

SEQ ID NO: 601799 - protein, 6 aa, Mycobacterium
TSLSEG

SEQ ID NO: 601800 - protein, 12 aa, Mycobacterium
TSLSGEGTGKVA

SEQ ID NO: 601801 - protein, 21 aa, Mycobacterium
TSLSGEPKPPPQKQPRLPPPA

SEQ ID NO: 601802 - protein, 10 aa, Mycobacterium
TSLSGSTALS

SEQ ID NO: 601803 - protein, 17 aa, Mycobacterium
TSLTAQNTAAAAPTTAI

SEQ ID NO: 601804 - protein, 5 aa, Mycobacterium
TSLTD

SEQ ID NO: 601805 - protein, 18 aa, Mycobacterium
TSLTDDEIGEYSGERKEI

SEQ ID NO: 601806 - protein, 20 aa, Mycobacterium
TSLTEDEIGEYSGEKKEIRP

SEQ ID NO: 601807 - protein, 12 aa, Mycobacterium
TSMAESPNGDDH

SEQ ID NO: 601808 - protein, 6 aa, Mycobacterium
TSMDQG

SEQ ID NO: 601809 - protein, 21 aa, Mycobacterium
TSMDQQNAGELKAVRPRSGTS

SEQ ID NO: 601810 - protein, 9 aa, Mycobacterium
TSMDSAAEL

SEQ ID NO: 601811 - protein, 14 aa, Mycobacterium
TSMEQTNGGPSDLD

SEQ ID NO: 601812 - protein, 4 aa, Mycobacterium
TSMG

SEQ ID NO: 601813 - protein, 6 aa, Mycobacterium
TSMGES

SEQ ID NO: 601814 - protein, 7 aa, Mycobacterium
TSMGHSK

SEQ ID NO: 601815 - protein, 6 aa, Mycobacterium
TSMPDP

SEQ ID NO: 601816 - protein, 7 aa, Mycobacterium
TSMPREA

SEQ ID NO: 601817 - protein, 4 aa, Mycobacterium
TSMS

SEQ ID NO: 601818 - protein, 6 aa, Mycobacterium
TSMSEA

SEQ ID NO: 601819 - protein, 5 aa, Mycobacterium
TSMTN

SEQ ID NO: 601820 - protein, 4 aa, Mycobacterium
TSNA

SEQ ID NO: 601821 - protein, 5 aa, Mycobacterium
TSNAH

SEQ ID NO: 601822 - protein, 6 aa, Mycobacterium
TSNAIQ

SEQ ID NO: 601823 - protein, 8 aa, Mycobacterium
TSNATGRE

SEQ ID NO: 601824 - protein, 4 aa, Mycobacterium
TSNC

SEQ ID NO: 601825 - protein, 8 aa, Mycobacterium
TSNDMEPK

SEQ ID NO: 601826 - protein, 18 aa, Mycobacterium
TSNGEVARYRPEAGESDV

SEQ ID NO: 601827 - protein, 27 aa, Mycobacterium
TSNGHLSPTPVGGRGPGDGAPGFDQQP

SEQ ID NO: 601828 - protein, 17 aa, Mycobacterium
TSNGNGHAHPDHDEDER

SEQ ID NO: 601829 - protein, 6 aa, Mycobacterium
TSNGPA

SEQ ID NO: 601830 - protein, 7 aa, Mycobacterium
TSNGPSV

SEQ ID NO: 601831 - protein, 8 aa, Mycobacterium
TSNHTEPV

SEQ ID NO: 601832 - protein, 4 aa, Mycobacterium
TSNK

SEQ ID NO: 601833 - protein, 7 aa, Mycobacterium
TSNLDDP

SEQ ID NO: 601834 - protein, 8 aa, Mycobacterium
TSNLDDPE

SEQ ID NO: 601835 - protein, 8 aa, Mycobacterium
TSNLGAHG

SEQ ID NO: 601836 - protein, 14 aa, Mycobacterium
TSNLQAAPAPEALR

SEQ ID NO: 601837 - protein, 17 aa, Mycobacterium
TSNLQAAPNGVRPSSVT

SEQ ID NO: 601838 - protein, 19 aa, Mycobacterium
TSNPEAPPVQRARAGEKTV

SEQ ID NO: 601839 - protein, 19 aa, Mycobacterium
TSNPEGASVQRADVAGRTV

SEQ ID NO: 601840 - protein, 18 aa, Mycobacterium
TSNPEGATIQRADADGRT

SEQ ID NO: 601841 - protein, 9 aa, Mycobacterium
TSNPEGATV

SEQ ID NO: 601842 - protein, 19 aa, Mycobacterium
TSNPEGATVQRADADGRTV

SEQ ID NO: 601843 - protein, 8 aa, Mycobacterium
TSNPEGVG

SEQ ID NO: 601844 - protein, 17 aa, Mycobacterium
TSNPSGNDRGGSSSTGV

SEQ ID NO: 601845 - protein, 8 aa, Mycobacterium
TSNPVDAT

SEQ ID NO: 601846 - protein, 8 aa, Mycobacterium
TSNQVDQF

SEQ ID NO: 601847 - protein, 6 aa, Mycobacterium
TSNQWS

SEQ ID NO: 601848 - protein, 10 aa, Mycobacterium
TSNRVGDTTR

SEQ ID NO: 601849 - protein, 8 aa, Mycobacterium
TSNSDAHE

SEQ ID NO: 601850 - protein, 10 aa, Mycobacterium
TSNSHSDTSL

SEQ ID NO: 601851 - protein, 28 aa, Mycobacterium
TSNTAHTLAGRSDGVDLDDRGREQAEGV

SEQ ID NO: 601852 - protein, 27 aa, Mycobacterium
TSNTAHTLAGRSEGVDLDDRGREQASE

SEQ ID NO: 601853 - protein, 6 aa, Mycobacterium
TSNTEP

SEQ ID NO: 601854 - protein, 15 aa, Mycobacterium
TSNTGDPATTKGEAE

SEQ ID NO: 601855 - protein, 12 aa, Mycobacterium
TSNTGDPATTMG

SEQ ID NO: 601856 - protein, 15 aa, Mycobacterium
TSNTGELETTKGEAE

SEQ ID NO: 601857 - protein, 4 aa, Mycobacterium
TSNV

SEQ ID NO: 601858 - protein, 5 aa, Mycobacterium
TSNYD

SEQ ID NO: 601859 - protein, 4 aa, Mycobacterium
TSPA

SEQ ID NO: 601860 - protein, 5 aa, Mycobacterium
TSPAA

SEQ ID NO: 601861 - protein, 8 aa, Mycobacterium
TSPAGRAG

SEQ ID NO: 601862 - protein, 8 aa, Mycobacterium
TSPAGSDW

SEQ ID NO: 601863 - protein, 5 aa, Mycobacterium
TSPAI

SEQ ID NO: 601864 - protein, 7 aa, Mycobacterium
TSPAIRQ

SEQ ID NO: 601865 - protein, 12 aa, Mycobacterium
TSPAKAPEASFA

SEQ ID NO: 601866 - protein, 7 aa, Mycobacterium
TSPANPE

SEQ ID NO: 601867 - protein, 8 aa, Mycobacterium
TSPAPATP

SEQ ID NO: 601868 - protein, 9 aa, Mycobacterium
TSPAPPTGT

SEQ ID NO: 601869 - protein, 20 aa, Mycobacterium
TSPAPVGPDGYRDTHESSWR

SEQ ID NO: 601870 - protein, 6 aa, Mycobacterium
TSPAQL

SEQ ID NO: 601871 - protein, 8 aa, Mycobacterium
TSPARSLR

SEQ ID NO: 601872 - protein, 26 aa, Mycobacterium
TSPARSTTPSANPAEEPTNSLPEELI

SEQ ID NO: 601873 - protein, 14 aa, Mycobacterium
TSPASAAASTMSST

SEQ ID NO: 601874 - protein, 8 aa, Mycobacterium
TSPATAAR

SEQ ID NO: 601875 - protein, 6 aa, Mycobacterium
TSPAVD

SEQ ID NO: 601876 - protein, 5 aa, Mycobacterium
TSPDA

SEQ ID NO: 601877 - protein, 10 aa, Mycobacterium
TSPDADDTAV

SEQ ID NO: 601878 - protein, 7 aa, Mycobacterium
TSPDDIP

SEQ ID NO: 601879 - protein, 6 aa, Mycobacterium
TSPDDW

SEQ ID NO: 601880 - protein, 15 aa, Mycobacterium
TSPDGAGFRSRRRPS

SEQ ID NO: 601881 - protein, 9 aa, Mycobacterium
TSPDGGSGH

SEQ ID NO: 601882 - protein, 14 aa, Mycobacterium
TSPDGQHRARELAG

SEQ ID NO: 601883 - protein, 10 aa, Mycobacterium
TSPDNATAQR

SEQ ID NO: 601884 - protein, 6 aa, Mycobacterium
TSPDPL

SEQ ID NO: 601885 - protein, 7 aa, Mycobacterium
TSPDRHQ

SEQ ID NO: 601886 - protein, 7 aa, Mycobacterium
TSPDRHT

SEQ ID NO: 601887 - protein, 20 aa, Mycobacterium
TSPDSDPRGTDTVGADDRVA

SEQ ID NO: 601888 - protein, 5 aa, Mycobacterium
TSPEA

SEQ ID NO: 601889 - protein, 8 aa, Mycobacterium
TSPEDVAG

SEQ ID NO: 601890 - protein, 7 aa, Mycobacterium
TSPEESA

SEQ ID NO: 601891 - protein, 8 aa, Mycobacterium
TSPEGAAK

SEQ ID NO: 601892 - protein, 7 aa, Mycobacterium
TSPELSA

SEQ ID NO: 601893 - protein, 6 aa, Mycobacterium
TSPEPR

SEQ ID NO: 601894 - protein, 14 aa, Mycobacterium
TSPEPRGVGSTRTA

SEQ ID NO: 601895 - protein, 10 aa, Mycobacterium
TSPEPRGVGT

SEQ ID NO: 601896 - protein, 11 aa, Mycobacterium
TSPEPRGVGTT

SEQ ID NO: 601897 - protein, 7 aa, Mycobacterium
TSPERHQ

SEQ ID NO: 601898 - protein, 6 aa, Mycobacterium
TSPERL

SEQ ID NO: 601899 - protein, 8 aa, Mycobacterium
TSPESASR

SEQ ID NO: 601900 - protein, 7 aa, Mycobacterium
TSPETGA

SEQ ID NO: 601901 - protein, 4 aa, Mycobacterium
TSPG

SEQ ID NO: 601902 - protein, 6 aa, Mycobacterium
TSPGDG

SEQ ID NO: 601903 - protein, 6 aa, Mycobacterium
TSPGDT

SEQ ID NO: 601904 - protein, 7 aa, Mycobacterium
TSPGGGN

SEQ ID NO: 601905 - protein, 7 aa, Mycobacterium
TSPGGLD

SEQ ID NO: 601906 - protein, 7 aa, Mycobacterium
TSPGHLH

SEQ ID NO: 601907 - protein, 6 aa, Mycobacterium
TSPGRL

SEQ ID NO: 601908 - protein, 9 aa, Mycobacterium
TSPGSDKSV

SEQ ID NO: 601909 - protein, 5 aa, Mycobacterium
TSPGY

SEQ ID NO: 601910 - protein, 8 aa, Mycobacterium
TSPHDKTL

SEQ ID NO: 601911 - protein, 32 aa, Mycobacterium
TSPHQTTNPAGLGAQSAAVANSTANVAADSGN

SEQ ID NO: 601912 - protein, 22 aa, Mycobacterium
TSPHSRNRTFGERLGKGGTMES

SEQ ID NO: 601913 - protein, 5 aa, Mycobacterium
TSPIA

SEQ ID NO: 601914 - protein, 6 aa, Mycobacterium
TSPIES

SEQ ID NO: 601915 - protein, 12 aa, Mycobacterium
TSPIGPPSIESH

SEQ ID NO: 601916 - protein, 4 aa, Mycobacterium
TSPK

SEQ ID NO: 601917 - protein, 9 aa, Mycobacterium
TSPKARPNM

SEQ ID NO: 601918 - protein, 9 aa, Mycobacterium
TSPKATKNM

SEQ ID NO: 601919 - protein, 11 aa, Mycobacterium
TSPKGKQKVSA

SEQ ID NO: 601920 - protein, 21 aa, Mycobacterium
TSPKLGKNKKRFGKRPLEPGD

SEQ ID NO: 601921 - protein, 8 aa, Mycobacterium
TSPKPEFE

SEQ ID NO: 601922 - protein, 19 aa, Mycobacterium
TSPKPESENTFDTDPGSAL

SEQ ID NO: 601923 - protein, 18 aa, Mycobacterium
TSPKPGHEDAIDTDPGNV

SEQ ID NO: 601924 - protein, 7 aa, Mycobacterium
TSPLDTQ

SEQ ID NO: 601925 - protein, 6 aa, Mycobacterium
TSPLEL

SEQ ID NO: 601926 - protein, 12 aa, Mycobacterium
TSPLGSGAPLLT

SEQ ID NO: 601927 - protein, 7 aa, Mycobacterium
TSPLQQS

SEQ ID NO: 601928 - protein, 5 aa, Mycobacterium
TSPMR

SEQ ID NO: 601929 - protein, 11 aa, Mycobacterium
TSPNGTGARRA

SEQ ID NO: 601930 - protein, 6 aa, Mycobacterium
TSPNPE

SEQ ID NO: 601931 - protein, 7 aa, Mycobacterium
TSPNPEL

SEQ ID NO: 601932 - protein, 8 aa, Mycobacterium
TSPNPELR

SEQ ID NO: 601933 - protein, 11 aa, Mycobacterium
TSPNSATEPDR

SEQ ID NO: 601934 - protein, 11 aa, Mycobacterium
TSPPAEDPATT

SEQ ID NO: 601935 - protein, 6 aa, Mycobacterium
TSPPAG

SEQ ID NO: 601936 - protein, 7 aa, Mycobacterium
TSPPDTA

SEQ ID NO: 601937 - protein, 9 aa, Mycobacterium
TSPPETVDD

SEQ ID NO: 601938 - protein, 16 aa, Mycobacterium
TSPPGTSYRSSGAVAA

SEQ ID NO: 601939 - protein, 5 aa, Mycobacterium
TSPPM

SEQ ID NO: 601940 - protein, 7 aa, Mycobacterium
TSPPNTH

SEQ ID NO: 601941 - protein, 11 aa, Mycobacterium
TSPPPAPAQAE

SEQ ID NO: 601942 - protein, 32 aa, Mycobacterium
TSPPPATNPGGLGAQAAAVSQAAASGAQPEFG

SEQ ID NO: 601943 - protein, 7 aa, Mycobacterium
TSPPPFR

SEQ ID NO: 601944 - protein, 12 aa, Mycobacterium
TSPPSPVEADPH

SEQ ID NO: 601945 - protein, 7 aa, Mycobacterium
TSPPTER

SEQ ID NO: 601946 - protein, 26 aa, Mycobacterium
TSPPYDVPRGPVPGPMGHDAGAWPSV

SEQ ID NO: 601947 - protein, 7 aa, Mycobacterium
TSPQDAA

SEQ ID NO: 601948 - protein, 9 aa, Mycobacterium
TSPQFRPRS

SEQ ID NO: 601949 - protein, 12 aa, Mycobacterium
TSPQPRGVGTTR

SEQ ID NO: 601950 - protein, 7 aa, Mycobacterium
TSPQTTV

SEQ ID NO: 601951 - protein, 6 aa, Mycobacterium
TSPRAA

SEQ ID NO: 601952 - protein, 14 aa, Mycobacterium
TSPRASTVYTVVVD

SEQ ID NO: 601953 - protein, 10 aa, Mycobacterium
TSPRDGEDQI

SEQ ID NO: 601954 - protein, 5 aa, Mycobacterium
TSPRG

SEQ ID NO: 601955 - protein, 12 aa, Mycobacterium
TSPRGLAGPLPT

SEQ ID NO: 601956 - protein, 15 aa, Mycobacterium
TSPRGRIVRGYVGGA

SEQ ID NO: 601957 - protein, 7 aa, Mycobacterium
TSPRGTT

SEQ ID NO: 601958 - protein, 5 aa, Mycobacterium
TSPRP

SEQ ID NO: 601959 - protein, 7 aa, Mycobacterium
TSPRPEG

SEQ ID NO: 601960 - protein, 6 aa, Mycobacterium
TSPSGN

SEQ ID NO: 601961 - protein, 35 aa, Mycobacterium
TSPSISQAPEPPAAPMPLKSGDPVTEPDRPPTGKG

SEQ ID NO: 601962 - protein, 11 aa, Mycobacterium
TSPSLSAAESA

SEQ ID NO: 601963 - protein, 7 aa, Mycobacterium
TSPSQRR

SEQ ID NO: 601964 - protein, 7 aa, Mycobacterium
TSPTASV

SEQ ID NO: 601965 - protein, 7 aa, Mycobacterium
TSPTLSD

SEQ ID NO: 601966 - protein, 11 aa, Mycobacterium
TSPTPDTTEDF

SEQ ID NO: 601967 - protein, 12 aa, Mycobacterium
TSPTPPDTPYPT

SEQ ID NO: 601968 - protein, 7 aa, Mycobacterium
TSPTTAD

SEQ ID NO: 601969 - protein, 7 aa, Mycobacterium
TSPTTAT

SEQ ID NO: 601970 - protein, 13 aa, Mycobacterium
TSPVAADSRGLGT

SEQ ID NO: 601971 - protein, 13 aa, Mycobacterium
TSPVAAESRGLGT

SEQ ID NO: 601972 - protein, 12 aa, Mycobacterium
TSPVDGDGESAA

SEQ ID NO: 601973 - protein, 19 aa, Mycobacterium
TSPVFPGNGGAGGSGGAAG

SEQ ID NO: 601974 - protein, 14 aa, Mycobacterium
TSPVGSAGGAYGGA

SEQ ID NO: 601975 - protein, 8 aa, Mycobacterium
TSPVGTFP

SEQ ID NO: 601976 - protein, 5 aa, Mycobacterium
TSPVH

SEQ ID NO: 601977 - protein, 5 aa, Mycobacterium
TSPVP

SEQ ID NO: 601978 - protein, 17 aa, Mycobacterium
TSPVPDTNPDGTANQEA

SEQ ID NO: 601979 - protein, 4 aa, Mycobacterium
TSPW

SEQ ID NO: 601980 - protein, 7 aa, Mycobacterium
TSPWPTA

SEQ ID NO: 601981 - protein, 4 aa, Mycobacterium
TSPY

SEQ ID NO: 601982 - protein, 5 aa, Mycobacterium
TSPYA

SEQ ID NO: 601983 - protein, 15 aa, Mycobacterium
TSPYADRRAAFGKER

SEQ ID NO: 601984 - protein, 11 aa, Mycobacterium
TSPYDERPGLE

SEQ ID NO: 601985 - protein, 12 aa, Mycobacterium
TSPYGAAARRAR

SEQ ID NO: 601986 - protein, 11 aa, Mycobacterium
TSPYPAPEGGH

SEQ ID NO: 601987 - protein, 8 aa, Mycobacterium
TSPYPDDL

SEQ ID NO: 601988 - protein, 13 aa, Mycobacterium
TSPYSRDKSRAES

SEQ ID NO: 601989 - protein, 21 aa, Mycobacterium
TSPYSRNRSFGERLGRGGTME

SEQ ID NO: 601990 - protein, 4 aa, Mycobacterium
TSQA

SEQ ID NO: 601991 - protein, 21 aa, Mycobacterium
TSQAAGTAASDQPAAETYEEF

SEQ ID NO: 601992 - protein, 9 aa, Mycobacterium
TSQADVDAG

SEQ ID NO: 601993 - protein, 9 aa, Mycobacterium
TSQAGGARG

SEQ ID NO: 601994 - protein, 10 aa, Mycobacterium
TSQAPNGPAE

SEQ ID NO: 601995 - protein, 8 aa, Mycobacterium
TSQAPQPR

SEQ ID NO: 601996 - protein, 7 aa, Mycobacterium
TSQAPVQ

SEQ ID NO: 601997 - protein, 9 aa, Mycobacterium
TSQDDVDAG

SEQ ID NO: 601998 - protein, 8 aa, Mycobacterium
TSQDMTQE

SEQ ID NO: 601999 - protein, 10 aa, Mycobacterium
TSQDPDERAA

SEQ ID NO: 602000 - protein, 10 aa, Mycobacterium
TSQDPPLHTR

SEQ ID NO: 602001 - protein, 6 aa, Mycobacterium
TSQETA

SEQ ID NO: 602002 - protein, 9 aa, Mycobacterium
TSQGDLGDG

SEQ ID NO: 602003 - protein, 8 aa, Mycobacterium
TSQGPTAT

SEQ ID NO: 602004 - protein, 5 aa, Mycobacterium
TSQGT

SEQ ID NO: 602005 - protein, 17 aa, Mycobacterium
TSQGTSTISGALRSRDT

SEQ ID NO: 602006 - protein, 7 aa, Mycobacterium
TSQKYTD

SEQ ID NO: 602007 - protein, 8 aa, Mycobacterium
TSQLGGKS

SEQ ID NO: 602008 - protein, 5 aa, Mycobacterium
TSQLT

SEQ ID NO: 602009 - protein, 15 aa, Mycobacterium
TSQNNGAVRSPKTAE

SEQ ID NO: 602010 - protein, 5 aa, Mycobacterium
TSQPE

SEQ ID NO: 602011 - protein, 12 aa, Mycobacterium
TSQPLGSKGRGA

SEQ ID NO: 602012 - protein, 27 aa, Mycobacterium
TSQPPPNSGEDPNREPVSEWTATWSPI

SEQ ID NO: 602013 - protein, 5 aa, Mycobacterium
TSQPV

SEQ ID NO: 602014 - protein, 4 aa, Mycobacterium
TSQQ

SEQ ID NO: 602015 - protein, 9 aa, Mycobacterium
TSQQHRDRA

SEQ ID NO: 602016 - protein, 16 aa, Mycobacterium
TSQQQEIDTMNKILAS

SEQ ID NO: 602017 - protein, 4 aa, Mycobacterium
TSQR

SEQ ID NO: 602018 - protein, 12 aa, Mycobacterium
TSQRGETTTRGT

SEQ ID NO: 602019 - protein, 6 aa, Mycobacterium
TSQSEM

SEQ ID NO: 602020 - protein, 9 aa, Mycobacterium
TSQSPVRQT

SEQ ID NO: 602021 - protein, 7 aa, Mycobacterium
TSQSRTR

SEQ ID NO: 602022 - protein, 7 aa, Mycobacterium
TSQTDLT

SEQ ID NO: 602023 - protein, 8 aa, Mycobacterium
TSQTPMSA

SEQ ID NO: 602024 - protein, 11 aa, Mycobacterium
TSQVPQHERNQ

SEQ ID NO: 602025 - protein, 6 aa, Mycobacterium
TSRAES

SEQ ID NO: 602026 - protein, 10 aa, Mycobacterium
TSRAFGRGPR

SEQ ID NO: 602027 - protein, 8 aa, Mycobacterium
TSRAGAES

SEQ ID NO: 602028 - protein, 9 aa, Mycobacterium
TSRAGDVGN

SEQ ID NO: 602029 - protein, 10 aa, Mycobacterium
TSRAKQQRMG

SEQ ID NO: 602030 - protein, 7 aa, Mycobacterium
TSRANAK

SEQ ID NO: 602031 - protein, 7 aa, Mycobacterium
TSRANNR

SEQ ID NO: 602032 - protein, 9 aa, Mycobacterium
TSRAPGLNA

SEQ ID NO: 602033 - protein, 11 aa, Mycobacterium
TSRAPSGGNVQ

SEQ ID NO: 602034 - protein, 5 aa, Mycobacterium
TSRAR

SEQ ID NO: 602035 - protein, 9 aa, Mycobacterium
TSRDELRER

SEQ ID NO: 602036 - protein, 7 aa, Mycobacterium
TSRDLTE

SEQ ID NO: 602037 - protein, 12 aa, Mycobacterium
TSRDPDDAADAL

SEQ ID NO: 602038 - protein, 18 aa, Mycobacterium
TSRDTIRSTGRTGKPARQ

SEQ ID NO: 602039 - protein, 4 aa, Mycobacterium
TSRE

SEQ ID NO: 602040 - protein, 5 aa, Mycobacterium
TSREE

SEQ ID NO: 602041 - protein, 5 aa, Mycobacterium
TSREL

SEQ ID NO: 602042 - protein, 7 aa, Mycobacterium
TSRGAVV

SEQ ID NO: 602043 - protein, 18 aa, Mycobacterium
TSRGESLKNLEAFEHLID

SEQ ID NO: 602044 - protein, 6 aa, Mycobacterium
TSRGGR

SEQ ID NO: 602045 - protein, 7 aa, Mycobacterium
TSRGKDR

SEQ ID NO: 602046 - protein, 10 aa, Mycobacterium
TSRGKRGRSR

SEQ ID NO: 602047 - protein, 7 aa, Mycobacterium
TSRGNVG

SEQ ID NO: 602048 - protein, 5 aa, Mycobacterium
TSRGP

SEQ ID NO: 602049 - protein, 14 aa, Mycobacterium
TSRGRGRPAELFRR

SEQ ID NO: 602050 - protein, 6 aa, Mycobacterium
TSRGRR

SEQ ID NO: 602051 - protein, 5 aa, Mycobacterium
TSRGS

SEQ ID NO: 602052 - protein, 11 aa, Mycobacterium
TSRGTNGVAAK

SEQ ID NO: 602053 - protein, 4 aa, Mycobacterium
TSRH

SEQ ID NO: 602054 - protein, 15 aa, Mycobacterium
TSRHSAATSTSGTSS

SEQ ID NO: 602055 - protein, 4 aa, Mycobacterium
TSRI

SEQ ID NO: 602056 - protein, 6 aa, Mycobacterium
TSRIDG

SEQ ID NO: 602057 - protein, 7 aa, Mycobacterium
TSRIDGS

SEQ ID NO: 602058 - protein, 18 aa, Mycobacterium
TSRIDGSPLAYNQPDPKL

SEQ ID NO: 602059 - protein, 11 aa, Mycobacterium
TSRIDGSPLRY

SEQ ID NO: 602060 - protein, 8 aa, Mycobacterium
TSRIERNE

SEQ ID NO: 602061 - protein, 5 aa, Mycobacterium
TSRIR

SEQ ID NO: 602062 - protein, 4 aa, Mycobacterium
TSRK

SEQ ID NO: 602063 - protein, 8 aa, Mycobacterium
TSRKDIPD

SEQ ID NO: 602064 - protein, 9 aa, Mycobacterium
TSRKKPPFG

SEQ ID NO: 602065 - protein, 8 aa, Mycobacterium
TSRKPVEI

SEQ ID NO: 602066 - protein, 9 aa, Mycobacterium
TSRKPVPIP

SEQ ID NO: 602067 - protein, 4 aa, Mycobacterium
TSRL

SEQ ID NO: 602068 - protein, 6 aa, Mycobacterium
TSRLDE

SEQ ID NO: 602069 - protein, 7 aa, Mycobacterium
TSRLDEE

SEQ ID NO: 602070 - protein, 9 aa, Mycobacterium
TSRLQAGAG

SEQ ID NO: 602071 - protein, 4 aa, Mycobacterium
TSRM

SEQ ID NO: 602072 - protein, 13 aa, Mycobacterium
TSRNGAGPAPDSA

SEQ ID NO: 602073 - protein, 11 aa, Mycobacterium
TSRNPDTITDR

SEQ ID NO: 602074 - protein, 4 aa, Mycobacterium
TSRP

SEQ ID NO: 602075 - protein, 11 aa, Mycobacterium
TSRPAAQARAA

SEQ ID NO: 602076 - protein, 15 aa, Mycobacterium
TSRPAFRSAKSALGD

SEQ ID NO: 602077 - protein, 5 aa, Mycobacterium
TSRPD

SEQ ID NO: 602078 - protein, 11 aa, Mycobacterium
TSRPEAQPIDG

SEQ ID NO: 602079 - protein, 7 aa, Mycobacterium
TSRPEVR

SEQ ID NO: 602080 - protein, 10 aa, Mycobacterium
TSRPGEKPTR

SEQ ID NO: 602081 - protein, 19 aa, Mycobacterium
TSRPGQAVSADGIEVRVAR

SEQ ID NO: 602082 - protein, 9 aa, Mycobacterium
TSRPGQPPE

SEQ ID NO: 602083 - protein, 10 aa, Mycobacterium
TSRPGTPHSC

SEQ ID NO: 602084 - protein, 17 aa, Mycobacterium
TSRPLARKGVPTSAPER

SEQ ID NO: 602085 - protein, 11 aa, Mycobacterium
TSRPQITEADV

SEQ ID NO: 602086 - protein, 10 aa, Mycobacterium
TSRPRAGTRV

SEQ ID NO: 602087 - protein, 9 aa, Mycobacterium
TSRPSPAGL

SEQ ID NO: 602088 - protein, 10 aa, Mycobacterium
TSRPSPGPGQ

SEQ ID NO: 602089 - protein, 5 aa, Mycobacterium
TSRPW

SEQ ID NO: 602090 - protein, 13 aa, Mycobacterium
TSRPYSRDELTSD

SEQ ID NO: 602091 - protein, 5 aa, Mycobacterium
TSRQG

SEQ ID NO: 602092 - protein, 7 aa, Mycobacterium
TSRQPLA

SEQ ID NO: 602093 - protein, 8 aa, Mycobacterium
TSRQPLGL

SEQ ID NO: 602094 - protein, 9 aa, Mycobacterium
TSRRDPERM

SEQ ID NO: 602095 - protein, 13 aa, Mycobacterium
TSRRELRAILMES

SEQ ID NO: 602096 - protein, 15 aa, Mycobacterium
TSRRTSGNQRRYARE

SEQ ID NO: 602097 - protein, 12 aa, Mycobacterium
TSRRVADRAGLK

SEQ ID NO: 602098 - protein, 6 aa, Mycobacterium
TSRSAV

SEQ ID NO: 602099 - protein, 11 aa, Mycobacterium
TSRSEAKRQTA

SEQ ID NO: 602100 - protein, 7 aa, Mycobacterium
TSRSPAD

SEQ ID NO: 602101 - protein, 9 aa, Mycobacterium
TSRSPDDLP

SEQ ID NO: 602102 - protein, 9 aa, Mycobacterium
TSRSPEDIP

SEQ ID NO: 602103 - protein, 18 aa, Mycobacterium
TSRSPRDLDAFCEAITER

SEQ ID NO: 602104 - protein, 19 aa, Mycobacterium
TSRSPSSMTATNIAPTAVN

SEQ ID NO: 602105 - protein, 15 aa, Mycobacterium
TSRSQLDGVLGHVTD

SEQ ID NO: 602106 - protein, 9 aa, Mycobacterium
TSRSQRHAY

SEQ ID NO: 602107 - protein, 14 aa, Mycobacterium
TSRSYGDDSAGAEL

SEQ ID NO: 602108 - protein, 13 aa, Mycobacterium
TSRTDGGRTLASP

SEQ ID NO: 602109 - protein, 7 aa, Mycobacterium
TSRTDTV

SEQ ID NO: 602110 - protein, 8 aa, Mycobacterium
TSRTGTLA

SEQ ID NO: 602111 - protein, 16 aa, Mycobacterium
TSRTLARESGRTNLDG

SEQ ID NO: 602112 - protein, 6 aa, Mycobacterium
TSRTNY

SEQ ID NO: 602113 - protein, 12 aa, Mycobacterium
TSRTPEDAEDAL

SEQ ID NO: 602114 - protein, 7 aa, Mycobacterium
TSRTPVR

SEQ ID NO: 602115 - protein, 17 aa, Mycobacterium
TSRTTPTRYRERARYDR

SEQ ID NO: 602116 - protein, 19 aa, Mycobacterium
TSRWPSGIKDGAEFVIPTM

SEQ ID NO: 602117 - protein, 4 aa, Mycobacterium
TSSA

SEQ ID NO: 602118 - protein, 5 aa, Mycobacterium
TSSAA

SEQ ID NO: 602119 - protein, 6 aa, Mycobacterium
TSSAAA

SEQ ID NO: 602120 - protein, 23 aa, Mycobacterium
TSSAAGLQGSVGQGNYAAAKAGI

SEQ ID NO: 602121 - protein, 7 aa, Mycobacterium
TSSAALG

SEQ ID NO: 602122 - protein, 11 aa, Mycobacterium
TSSAAPAQPAE

SEQ ID NO: 602123 - protein, 7 aa, Mycobacterium
TSSADGR

SEQ ID NO: 602124 - protein, 6 aa, Mycobacterium
TSSADQ

SEQ ID NO: 602125 - protein, 9 aa, Mycobacterium
TSSADRSPV

SEQ ID NO: 602126 - protein, 15 aa, Mycobacterium
TSSADVDTAKPKPDI

SEQ ID NO: 602127 - protein, 7 aa, Mycobacterium
TSSAEED

SEQ ID NO: 602128 - protein, 6 aa, Mycobacterium
TSSAEV

SEQ ID NO: 602129 - protein, 7 aa, Mycobacterium
TSSAGLP

SEQ ID NO: 602130 - protein, 10 aa, Mycobacterium
TSSAGTQQAM

SEQ ID NO: 602131 - protein, 9 aa, Mycobacterium
TSSAKLGDW

SEQ ID NO: 602132 - protein, 6 aa, Mycobacterium
TSSALR

SEQ ID NO: 602133 - protein, 5 aa, Mycobacterium
TSSAN

SEQ ID NO: 602134 - protein, 6 aa, Mycobacterium
TSSANL

SEQ ID NO: 602135 - protein, 7 aa, Mycobacterium
TSSAPIT

SEQ ID NO: 602136 - protein, 21 aa, Mycobacterium
TSSAPVQQTRRRRVTANSDDS

SEQ ID NO: 602137 - protein, 11 aa, Mycobacterium
TSSARSANERE

SEQ ID NO: 602138 - protein, 12 aa, Mycobacterium
TSSARSANERES

SEQ ID NO: 602139 - protein, 9 aa, Mycobacterium
TSSASAIRE

SEQ ID NO: 602140 - protein, 7 aa, Mycobacterium
TSSATYR

SEQ ID NO: 602141 - protein, 5 aa, Mycobacterium
TSSAV

SEQ ID NO: 602142 - protein, 5 aa, Mycobacterium
TSSCT

SEQ ID NO: 602143 - protein, 4 aa, Mycobacterium
TSSD

SEQ ID NO: 602144 - protein, 8 aa, Mycobacterium
TSSDDGHD

SEQ ID NO: 602145 - protein, 19 aa, Mycobacterium
TSSDEPVEAQPMNGEVPQR

SEQ ID NO: 602146 - protein, 8 aa, Mycobacterium
TSSDGLRS

SEQ ID NO: 602147 - protein, 9 aa, Mycobacterium
TSSDGTRRR

SEQ ID NO: 602148 - protein, 7 aa, Mycobacterium
TSSDNDF

SEQ ID NO: 602149 - protein, 9 aa, Mycobacterium
TSSDPELTN

SEQ ID NO: 602150 - protein, 9 aa, Mycobacterium
TSSDPELTS

SEQ ID NO: 602151 - protein, 9 aa, Mycobacterium
TSSDTTTDP

SEQ ID NO: 602152 - protein, 23 aa, Mycobacterium
TSSEAGLLGPEGQANYGAAKAGI

SEQ ID NO: 602153 - protein, 7 aa, Mycobacterium
TSSEPAL

SEQ ID NO: 602154 - protein, 6 aa, Mycobacterium
TSSFGQ

SEQ ID NO: 602155 - protein, 7 aa, Mycobacterium
TSSFTKA

SEQ ID NO: 602156 - protein, 4 aa, Mycobacterium
TSSG

SEQ ID NO: 602157 - protein, 10 aa, Mycobacterium
TSSGAAFDGQ

SEQ ID NO: 602158 - protein, 9 aa, Mycobacterium
TSSGAAGAR

SEQ ID NO: 602159 - protein, 22 aa, Mycobacterium
TSSGAGLQGSVGQANYSAAKAG

SEQ ID NO: 602160 - protein, 13 aa, Mycobacterium
TSSGAIPTNWPGP

SEQ ID NO: 602161 - protein, 14 aa, Mycobacterium
TSSGATDNAEVAGQ

SEQ ID NO: 602162 - protein, 5 aa, Mycobacterium
TSSGC

SEQ ID NO: 602163 - protein, 7 aa, Mycobacterium
TSSGDAV

SEQ ID NO: 602164 - protein, 6 aa, Mycobacterium
TSSGDI

SEQ ID NO: 602165 - protein, 6 aa, Mycobacterium
TSSGEH

SEQ ID NO: 602166 - protein, 8 aa, Mycobacterium
TSSGELDA

SEQ ID NO: 602167 - protein, 8 aa, Mycobacterium
TSSGERVE

SEQ ID NO: 602168 - protein, 18 aa, Mycobacterium
TSSGPGTRSPAPSSPIPR

SEQ ID NO: 602169 - protein, 6 aa, Mycobacterium
TSSGSS

SEQ ID NO: 602170 - protein, 13 aa, Mycobacterium
TSSGTATVSYIFP

SEQ ID NO: 602171 - protein, 10 aa, Mycobacterium
TSSGVDPAKL

SEQ ID NO: 602172 - protein, 9 aa, Mycobacterium
TSSHASALG

SEQ ID NO: 602173 - protein, 11 aa, Mycobacterium
TSSHRGELHRR

SEQ ID NO: 602174 - protein, 9 aa, Mycobacterium
TSSLGGGEV

SEQ ID NO: 602175 - protein, 20 aa, Mycobacterium
TSSNPTAGGASVGSGIGPTR

SEQ ID NO: 602176 - protein, 4 aa, Mycobacterium
TSSP

SEQ ID NO: 602177 - protein, 6 aa, Mycobacterium
TSSPAH

SEQ ID NO: 602178 - protein, 13 aa, Mycobacterium
TSSPESVAPHGQA

SEQ ID NO: 602179 - protein, 10 aa, Mycobacterium
TSSPGAGKTT

SEQ ID NO: 602180 - protein, 8 aa, Mycobacterium
TSSPGART

SEQ ID NO: 602181 - protein, 6 aa, Mycobacterium
TSSPGF

SEQ ID NO: 602182 - protein, 9 aa, Mycobacterium
TSSPGSATR

SEQ ID NO: 602183 - protein, 10 aa, Mycobacterium
TSSPGSGKTT

SEQ ID NO: 602184 - protein, 8 aa, Mycobacterium
TSSPIKGT

SEQ ID NO: 602185 - protein, 8 aa, Mycobacterium
TSSPRRAD

SEQ ID NO: 602186 - protein, 12 aa, Mycobacterium
TSSPSNHSLSIG

SEQ ID NO: 602187 - protein, 16 aa, Mycobacterium
TSSPVGGKSGPGSART

SEQ ID NO: 602188 - protein, 14 aa, Mycobacterium
TSSPVGTTGSARTV

SEQ ID NO: 602189 - protein, 18 aa, Mycobacterium
TSSQASDIVSKISASISN

SEQ ID NO: 602190 - protein, 10 aa, Mycobacterium
TSSQDKVGRD

SEQ ID NO: 602191 - protein, 13 aa, Mycobacterium
TSSQTAHGGQEST

SEQ ID NO: 602192 - protein, 7 aa, Mycobacterium
TSSRARD

SEQ ID NO: 602193 - protein, 15 aa, Mycobacterium
TSSRDVDTAKPEPGI

SEQ ID NO: 602194 - protein, 11 aa, Mycobacterium
TSSRNANSPHR

SEQ ID NO: 602195 - protein, 10 aa, Mycobacterium
TSSRSRNRSL

SEQ ID NO: 602196 - protein, 8 aa, Mycobacterium
TSSRYRGD

SEQ ID NO: 602197 - protein, 7 aa, Mycobacterium
TSSSAVS

SEQ ID NO: 602198 - protein, 6 aa, Mycobacterium
TSSSGS

SEQ ID NO: 602199 - protein, 6 aa, Mycobacterium
TSSSKM

SEQ ID NO: 602200 - protein, 15 aa, Mycobacterium
TSSSSLPQDISHGSP

SEQ ID NO: 602201 - protein, 20 aa, Mycobacterium
TSSSSRNRHVGEEIGKGKTI

SEQ ID NO: 602202 - protein, 7 aa, Mycobacterium
TSSSSRR

SEQ ID NO: 602203 - protein, 7 aa, Mycobacterium
TSSSTFR

SEQ ID NO: 602204 - protein, 16 aa, Mycobacterium
TSSSVVETERPEPPVT

SEQ ID NO: 602205 - protein, 7 aa, Mycobacterium
TSSTAAQ

SEQ ID NO: 602206 - protein, 33 aa, Mycobacterium
TSSTDPAARAAMTDPYTLSPDRSREPELGDQPD

SEQ ID NO: 602207 - protein, 7 aa, Mycobacterium
TSSTDRP

SEQ ID NO: 602208 - protein, 8 aa, Mycobacterium
TSSTEERV

SEQ ID NO: 602209 - protein, 7 aa, Mycobacterium
TSSTERP

SEQ ID NO: 602210 - protein, 9 aa, Mycobacterium
TSSTETPRR

SEQ ID NO: 602211 - protein, 15 aa, Mycobacterium
TSSTGLDPAVPRDAG

SEQ ID NO: 602212 - protein, 7 aa, Mycobacterium
TSSTKRP

SEQ ID NO: 602213 - protein, 7 aa, Mycobacterium
TSSTRGI

SEQ ID NO: 602214 - protein, 8 aa, Mycobacterium
TSSTRGID

SEQ ID NO: 602215 - protein, 10 aa, Mycobacterium
TSSTSTGGFL

SEQ ID NO: 602216 - protein, 7 aa, Mycobacterium
TSSTTRP

SEQ ID NO: 602217 - protein, 14 aa, Mycobacterium
TSSTYTAPTKLQIP

SEQ ID NO: 602218 - protein, 11 aa, Mycobacterium
TSSVTRDAATD

SEQ ID NO: 602219 - protein, 5 aa, Mycobacterium
TSSVY

SEQ ID NO: 602220 - protein, 5 aa, Mycobacterium
TSSYE

SEQ ID NO: 602221 - protein, 12 aa, Mycobacterium
TSSYYKNSTGEL

SEQ ID NO: 602222 - protein, 4 aa, Mycobacterium
TSTA

SEQ ID NO: 602223 - protein, 8 aa, Mycobacterium
TSTAAAAA

SEQ ID NO: 602224 - protein, 10 aa, Mycobacterium
TSTAAPDVPS

SEQ ID NO: 602225 - protein, 8 aa, Mycobacterium
TSTAASAD

SEQ ID NO: 602226 - protein, 5 aa, Mycobacterium
TSTAE

SEQ ID NO: 602227 - protein, 7 aa, Mycobacterium
TSTAGLT

SEQ ID NO: 602228 - protein, 9 aa, Mycobacterium
TSTAGQRRH

SEQ ID NO: 602229 - protein, 12 aa, Mycobacterium
TSTANLAAPANL

SEQ ID NO: 602230 - protein, 11 aa, Mycobacterium
TSTAPPGGESF

SEQ ID NO: 602231 - protein, 10 aa, Mycobacterium
TSTAPTLPDT

SEQ ID NO: 602232 - protein, 10 aa, Mycobacterium
TSTARAEAAR

SEQ ID NO: 602233 - protein, 13 aa, Mycobacterium
TSTDGRHSKWTHP

SEQ ID NO: 602234 - protein, 10 aa, Mycobacterium
TSTDGTPLQG

SEQ ID NO: 602235 - protein, 17 aa, Mycobacterium
TSTDIQASTHEPVTGLH

SEQ ID NO: 602236 - protein, 14 aa, Mycobacterium
TSTDVGELAPTDIS

SEQ ID NO: 602237 - protein, 7 aa, Mycobacterium
TSTEDVT

SEQ ID NO: 602238 - protein, 6 aa, Mycobacterium
TSTEGS

SEQ ID NO: 602239 - protein, 9 aa, Mycobacterium
TSTELQERD

SEQ ID NO: 602240 - protein, 9 aa, Mycobacterium
TSTEPNDIA

SEQ ID NO: 602241 - protein, 16 aa, Mycobacterium
TSTEYPPEAPISPHNE

SEQ ID NO: 602242 - protein, 4 aa, Mycobacterium
TSTG

SEQ ID NO: 602243 - protein, 7 aa, Mycobacterium
TSTGAEH

SEQ ID NO: 602244 - protein, 5 aa, Mycobacterium
TSTGD

SEQ ID NO: 602245 - protein, 8 aa, Mycobacterium
TSTGDQAE

SEQ ID NO: 602246 - protein, 7 aa, Mycobacterium
TSTGGFN

SEQ ID NO: 602247 - protein, 7 aa, Mycobacterium
TSTGGPV

SEQ ID NO: 602248 - protein, 5 aa, Mycobacterium
TSTGM

SEQ ID NO: 602249 - protein, 6 aa, Mycobacterium
TSTGNK

SEQ ID NO: 602250 - protein, 7 aa, Mycobacterium
TSTGNKD

SEQ ID NO: 602251 - protein, 11 aa, Mycobacterium
TSTGPDHDKEF

SEQ ID NO: 602252 - protein, 7 aa, Mycobacterium
TSTGSDI

SEQ ID NO: 602253 - protein, 14 aa, Mycobacterium
TSTGYGAAADGETA

SEQ ID NO: 602254 - protein, 7 aa, Mycobacterium
TSTHSRA

SEQ ID NO: 602255 - protein, 5 aa, Mycobacterium
TSTHV

SEQ ID NO: 602256 - protein, 4 aa, Mycobacterium
TSTI

SEQ ID NO: 602257 - protein, 8 aa, Mycobacterium
TSTIPAGE

SEQ ID NO: 602258 - protein, 11 aa, Mycobacterium
TSTIRNGRRVS

SEQ ID NO: 602259 - protein, 6 aa, Mycobacterium
TSTITT

SEQ ID NO: 602260 - protein, 11 aa, Mycobacterium
TSTKDKHEQAE

SEQ ID NO: 602261 - protein, 6 aa, Mycobacterium
TSTKDL

SEQ ID NO: 602262 - protein, 7 aa, Mycobacterium
TSTKDLK

SEQ ID NO: 602263 - protein, 7 aa, Mycobacterium
TSTKDLR

SEQ ID NO: 602264 - protein, 6 aa, Mycobacterium
TSTKDM

SEQ ID NO: 602265 - protein, 12 aa, Mycobacterium
TSTKGIADGTSI

SEQ ID NO: 602266 - protein, 8 aa, Mycobacterium
TSTLADRD

SEQ ID NO: 602267 - protein, 10 aa, Mycobacterium
TSTLAGSLNP

SEQ ID NO: 602268 - protein, 7 aa, Mycobacterium
TSTLGPI

SEQ ID NO: 602269 - protein, 5 aa, Mycobacterium
TSTLP

SEQ ID NO: 602270 - protein, 5 aa, Mycobacterium
TSTLR

SEQ ID NO: 602271 - protein, 11 aa, Mycobacterium
TSTLSTGGTGY

SEQ ID NO: 602272 - protein, 8 aa, Mycobacterium
TSTLTETF

SEQ ID NO: 602273 - protein, 6 aa, Mycobacterium
TSTNRC

SEQ ID NO: 602274 - protein, 12 aa, Mycobacterium
TSTNTAHGGQET

SEQ ID NO: 602275 - protein, 7 aa, Mycobacterium
TSTNTLA

SEQ ID NO: 602276 - protein, 6 aa, Mycobacterium
TSTNTV

SEQ ID NO: 602277 - protein, 4 aa, Mycobacterium
TSTP

SEQ ID NO: 602278 - protein, 9 aa, Mycobacterium
TSTPASAGR

SEQ ID NO: 602279 - protein, 11 aa, Mycobacterium
TSTPDMGAGPH

SEQ ID NO: 602280 - protein, 12 aa, Mycobacterium
TSTPDQPQPPTA

SEQ ID NO: 602281 - protein, 6 aa, Mycobacterium
TSTPEI

SEQ ID NO: 602282 - protein, 7 aa, Mycobacterium
TSTPEIA

SEQ ID NO: 602283 - protein, 8 aa, Mycobacterium
TSTPGFSA

SEQ ID NO: 602284 - protein, 6 aa, Mycobacterium
TSTPIS

SEQ ID NO: 602285 - protein, 5 aa, Mycobacterium
TSTPM

SEQ ID NO: 602286 - protein, 8 aa, Mycobacterium
TSTPPMTG

SEQ ID NO: 602287 - protein, 8 aa, Mycobacterium
TSTPPPRI

SEQ ID NO: 602288 - protein, 7 aa, Mycobacterium
TSTQARE

SEQ ID NO: 602289 - protein, 10 aa, Mycobacterium
TSTRDDGLPG

SEQ ID NO: 602290 - protein, 12 aa, Mycobacterium
TSTRDDGRPGWR

SEQ ID NO: 602291 - protein, 12 aa, Mycobacterium
TSTRDDGTAGWR

SEQ ID NO: 602292 - protein, 13 aa, Mycobacterium
TSTRDDRVHPGHA

SEQ ID NO: 602293 - protein, 10 aa, Mycobacterium
TSTRDTGHPR

SEQ ID NO: 602294 - protein, 5 aa, Mycobacterium
TSTRN

SEQ ID NO: 602295 - protein, 14 aa, Mycobacterium
TSTRPAERRHAPAV

SEQ ID NO: 602296 - protein, 10 aa, Mycobacterium
TSTRPQTTRH

SEQ ID NO: 602297 - protein, 5 aa, Mycobacterium
TSTRQ

SEQ ID NO: 602298 - protein, 10 aa, Mycobacterium
TSTRQSRKGL

SEQ ID NO: 602299 - protein, 14 aa, Mycobacterium
TSTRSHSRDRNDCT

SEQ ID NO: 602300 - protein, 14 aa, Mycobacterium
TSTRTLARGGPGAV

SEQ ID NO: 602301 - protein, 30 aa, Mycobacterium
TSTSPPLPTTSTSSAMATRTSKPAPAAPAI

SEQ ID NO: 602302 - protein, 6 aa, Mycobacterium
TSTSSR

SEQ ID NO: 602303 - protein, 7 aa, Mycobacterium
TSTTDEL

SEQ ID NO: 602304 - protein, 5 aa, Mycobacterium
TSTTG

SEQ ID NO: 602305 - protein, 6 aa, Mycobacterium
TSTTIG

SEQ ID NO: 602306 - protein, 5 aa, Mycobacterium
TSTTL

SEQ ID NO: 602307 - protein, 7 aa, Mycobacterium
TSTTPVG

SEQ ID NO: 602308 - protein, 5 aa, Mycobacterium
TSTTW

SEQ ID NO: 602309 - protein, 7 aa, Mycobacterium
TSTTWPK

SEQ ID NO: 602310 - protein, 6 aa, Mycobacterium
TSTVHH

SEQ ID NO: 602311 - protein, 8 aa, Mycobacterium
TSTWQGQA

SEQ ID NO: 602312 - protein, 5 aa, Mycobacterium
TSTYE

SEQ ID NO: 602313 - protein, 7 aa, Mycobacterium
TSTYGPE

SEQ ID NO: 602314 - protein, 9 aa, Mycobacterium
TSVAAASNT

SEQ ID NO: 602315 - protein, 6 aa, Mycobacterium
TSVADR

SEQ ID NO: 602316 - protein, 8 aa, Mycobacterium
TSVAPTGT

SEQ ID NO: 602317 - protein, 6 aa, Mycobacterium
TSVASG

SEQ ID NO: 602318 - protein, 12 aa, Mycobacterium
TSVASPRHRGPL

SEQ ID NO: 602319 - protein, 4 aa, Mycobacterium
TSVD

SEQ ID NO: 602320 - protein, 14 aa, Mycobacterium
TSVDAGRAAATSCA

SEQ ID NO: 602321 - protein, 6 aa, Mycobacterium
TSVDEV

SEQ ID NO: 602322 - protein, 5 aa, Mycobacterium
TSVDG

SEQ ID NO: 602323 - protein, 16 aa, Mycobacterium
TSVDGRSAAADGSSQW

SEQ ID NO: 602324 - protein, 6 aa, Mycobacterium
TSVDPT

SEQ ID NO: 602325 - protein, 4 aa, Mycobacterium
TSVE

SEQ ID NO: 602326 - protein, 6 aa, Mycobacterium
TSVENA

SEQ ID NO: 602327 - protein, 5 aa, Mycobacterium
TSVES

SEQ ID NO: 602328 - protein, 8 aa, Mycobacterium
TSVGERPI

SEQ ID NO: 602329 - protein, 7 aa, Mycobacterium
TSVGPDL

SEQ ID NO: 602330 - protein, 6 aa, Mycobacterium
TSVGST

SEQ ID NO: 602331 - protein, 14 aa, Mycobacterium
TSVNAQGRLSPYDT

SEQ ID NO: 602332 - protein, 15 aa, Mycobacterium
TSVNYQDPTWLTRLL

SEQ ID NO: 602333 - protein, 4 aa, Mycobacterium
TSVP

SEQ ID NO: 602334 - protein, 14 aa, Mycobacterium
TSVPHAASPAAPGK

SEQ ID NO: 602335 - protein, 16 aa, Mycobacterium
TSVPPHVGGASGCGPR

SEQ ID NO: 602336 - protein, 11 aa, Mycobacterium
TSVPPPGGESF

SEQ ID NO: 602337 - protein, 7 aa, Mycobacterium
TSVQESG

SEQ ID NO: 602338 - protein, 12 aa, Mycobacterium
TSVQSRPRPQAL

SEQ ID NO: 602339 - protein, 13 aa, Mycobacterium
TSVRRAREQVDRS

SEQ ID NO: 602340 - protein, 7 aa, Mycobacterium
TSVRRRE

SEQ ID NO: 602341 - protein, 8 aa, Mycobacterium
TSVSEGME

SEQ ID NO: 602342 - protein, 6 aa, Mycobacterium
TSVSQA

SEQ ID NO: 602343 - protein, 5 aa, Mycobacterium
TSVSR

SEQ ID NO: 602344 - protein, 5 aa, Mycobacterium
TSVST

SEQ ID NO: 602345 - protein, 14 aa, Mycobacterium
TSVTAAPAATLAGE

SEQ ID NO: 602346 - protein, 13 aa, Mycobacterium
TSVTAKTVYVDVT

SEQ ID NO: 602347 - protein, 6 aa, Mycobacterium
TSVTNT

SEQ ID NO: 602348 - protein, 6 aa, Mycobacterium
TSVTPT

SEQ ID NO: 602349 - protein, 16 aa, Mycobacterium
TSVVRDNDGKDAARLE

SEQ ID NO: 602350 - protein, 9 aa, Mycobacterium
TSWGASSIA

SEQ ID NO: 602351 - protein, 6 aa, Mycobacterium
TSWPLG

SEQ ID NO: 602352 - protein, 14 aa, Mycobacterium
TSWPTTAKMPEPYA

SEQ ID NO: 602353 - protein, 4 aa, Mycobacterium
TSWQ

SEQ ID NO: 602354 - protein, 9 aa, Mycobacterium
TSWQGAGGI

SEQ ID NO: 602355 - protein, 4 aa, Mycobacterium
TSWS

SEQ ID NO: 602356 - protein, 8 aa, Mycobacterium
TSWTTTDG

SEQ ID NO: 602357 - protein, 7 aa, Mycobacterium
TSYAAEA

SEQ ID NO: 602358 - protein, 12 aa, Mycobacterium
TSYAQRAQWANA

SEQ ID NO: 602359 - protein, 7 aa, Mycobacterium
TSYATHN

SEQ ID NO: 602360 - protein, 7 aa, Mycobacterium
TSYDDPE

SEQ ID NO: 602361 - protein, 17 aa, Mycobacterium
TSYDDPEYADIDPAASS

SEQ ID NO: 602362 - protein, 14 aa, Mycobacterium
TSYDEAEQADGRGV

SEQ ID NO: 602363 - protein, 7 aa, Mycobacterium
TSYEREH

SEQ ID NO: 602364 - protein, 11 aa, Mycobacterium
TSYESARQSEF

SEQ ID NO: 602365 - protein, 7 aa, Mycobacterium
TSYGEPL

SEQ ID NO: 602366 - protein, 9 aa, Mycobacterium
TSYGGERTV

SEQ ID NO: 602367 - protein, 13 aa, Mycobacterium
TSYGGSSVPARAA

SEQ ID NO: 602368 - protein, 10 aa, Mycobacterium
TSYGRDPHTP

SEQ ID NO: 602369 - protein, 5 aa, Mycobacterium
TSYLR

SEQ ID NO: 602370 - protein, 6 aa, Mycobacterium
TSYPAR

SEQ ID NO: 602371 - protein, 6 aa, Mycobacterium
TSYPQR

SEQ ID NO: 602372 - protein, 5 aa, Mycobacterium
TSYQP

SEQ ID NO: 602373 - protein, 5 aa, Mycobacterium
TSYRG

SEQ ID NO: 602374 - protein, 4 aa, Mycobacterium
TSYS

SEQ ID NO: 602375 - protein, 13 aa, Mycobacterium
TSYSPERAHRPDT

SEQ ID NO: 602376 - protein, 4 aa, Mycobacterium
TTAA

SEQ ID NO: 602377 - protein, 5 aa, Mycobacterium
TTAAA

SEQ ID NO: 602378 - protein, 10 aa, Mycobacterium
TTAAAETARR

SEQ ID NO: 602379 - protein, 7 aa, Mycobacterium
TTAAAQI

SEQ ID NO: 602380 - protein, 10 aa, Mycobacterium
TTAAATGTTA

SEQ ID NO: 602381 - protein, 10 aa, Mycobacterium
TTAAATPAEL

SEQ ID NO: 602382 - protein, 5 aa, Mycobacterium
TTAAD

SEQ ID NO: 602383 - protein, 16 aa, Mycobacterium
TTAADGPHKRRRASDL

SEQ ID NO: 602384 - protein, 7 aa, Mycobacterium
TTAAEAI

SEQ ID NO: 602385 - protein, 6 aa, Mycobacterium
TTAAGL

SEQ ID NO: 602386 - protein, 12 aa, Mycobacterium
TTAALRESRDAL

SEQ ID NO: 602387 - protein, 8 aa, Mycobacterium
TTAANADA

SEQ ID NO: 602388 - protein, 9 aa, Mycobacterium
TTAANGAPG

SEQ ID NO: 602389 - protein, 8 aa, Mycobacterium
TTAANRDP

SEQ ID NO: 602390 - protein, 9 aa, Mycobacterium
TTAAPAERQ

SEQ ID NO: 602391 - protein, 9 aa, Mycobacterium
TTAAPGDVP

SEQ ID NO: 602392 - protein, 15 aa, Mycobacterium
TTAAPNSTRWLLAKR

SEQ ID NO: 602393 - protein, 10 aa, Mycobacterium
TTAAPVDPAV

SEQ ID NO: 602394 - protein, 6 aa, Mycobacterium
TTAAQA

SEQ ID NO: 602395 - protein, 14 aa, Mycobacterium
TTAAQPRAPRRGVE

SEQ ID NO: 602396 - protein, 5 aa, Mycobacterium
TTAAS

SEQ ID NO: 602397 - protein, 25 aa, Mycobacterium
TTAASAAQGLGGDRRAKAPAWSGPV

SEQ ID NO: 602398 - protein, 19 aa, Mycobacterium
TTAASGQSLKAQAFRMLQT

SEQ ID NO: 602399 - protein, 6 aa, Mycobacterium
TTAATA

SEQ ID NO: 602400 - protein, 4 aa, Mycobacterium
TTAD

SEQ ID NO: 602401 - protein, 9 aa, Mycobacterium
TTADAAAAT

SEQ ID NO: 602402 - protein, 8 aa, Mycobacterium
TTADEHGN

SEQ ID NO: 602403 - protein, 18 aa, Mycobacterium
TTADERPLEPDRYNSQAL

SEQ ID NO: 602404 - protein, 17 aa, Mycobacterium
TTADGDYQTYKANDGAY

SEQ ID NO: 602405 - protein, 8 aa, Mycobacterium
TTADGPRR

SEQ ID NO: 602406 - protein, 9 aa, Mycobacterium
TTADGRGGV

SEQ ID NO: 602407 - protein, 9 aa, Mycobacterium
TTADGTGTT

SEQ ID NO: 602408 - protein, 9 aa, Mycobacterium
TTADNTPLP

SEQ ID NO: 602409 - protein, 8 aa, Mycobacterium
TTADPQVT

SEQ ID NO: 602410 - protein, 5 aa, Mycobacterium
TTADR

SEQ ID NO: 602411 - protein, 6 aa, Mycobacterium
TTADRD

SEQ ID NO: 602412 - protein, 6 aa, Mycobacterium
TTADRT

SEQ ID NO: 602413 - protein, 5 aa, Mycobacterium
TTADV

SEQ ID NO: 602414 - protein, 8 aa, Mycobacterium
TTAEAADN

SEQ ID NO: 602415 - protein, 8 aa, Mycobacterium
TTAEAKTK

SEQ ID NO: 602416 - protein, 18 aa, Mycobacterium
TTAELPPMAQPPPDPDRL

SEQ ID NO: 602417 - protein, 18 aa, Mycobacterium
TTAELPPMTTPPPGAGRE

SEQ ID NO: 602418 - protein, 11 aa, Mycobacterium
TTAEPSRYLGP

SEQ ID NO: 602419 - protein, 13 aa, Mycobacterium
TTAEPSRYLGPGK

SEQ ID NO: 602420 - protein, 8 aa, Mycobacterium
TTAEQREQ

SEQ ID NO: 602421 - protein, 12 aa, Mycobacterium
TTAEQTERSIAD

SEQ ID NO: 602422 - protein, 7 aa, Mycobacterium
TTAEREA

SEQ ID NO: 602423 - protein, 13 aa, Mycobacterium
TTAFDAGGSSAVR

SEQ ID NO: 602424 - protein, 10 aa, Mycobacterium
TTAGDGASAI

SEQ ID NO: 602425 - protein, 6 aa, Mycobacterium
TTAGDV

SEQ ID NO: 602426 - protein, 11 aa, Mycobacterium
TTAGEAKYAAK

SEQ ID NO: 602427 - protein, 13 aa, Mycobacterium
TTAGELAAALGCS

SEQ ID NO: 602428 - protein, 7 aa, Mycobacterium
TTAGERR

SEQ ID NO: 602429 - protein, 10 aa, Mycobacterium
TTAGGRTVRA

SEQ ID NO: 602430 - protein, 7 aa, Mycobacterium
TTAGGTM

SEQ ID NO: 602431 - protein, 5 aa, Mycobacterium
TTAGI

SEQ ID NO: 602432 - protein, 5 aa, Mycobacterium
TTAGK

SEQ ID NO: 602433 - protein, 5 aa, Mycobacterium
TTAGL

SEQ ID NO: 602434 - protein, 6 aa, Mycobacterium
TTAGLP

SEQ ID NO: 602435 - protein, 7 aa, Mycobacterium
TTAGPGT

SEQ ID NO: 602436 - protein, 11 aa, Mycobacterium
TTAGPGTEELT

SEQ ID NO: 602437 - protein, 6 aa, Mycobacterium
TTAGPV

SEQ ID NO: 602438 - protein, 6 aa, Mycobacterium
TTAGQA

SEQ ID NO: 602439 - protein, 6 aa, Mycobacterium
TTAGQD

SEQ ID NO: 602440 - protein, 11 aa, Mycobacterium
TTAGQSCGSTS

SEQ ID NO: 602441 - protein, 10 aa, Mycobacterium
TTAGSEAKRD

SEQ ID NO: 602442 - protein, 11 aa, Mycobacterium
TTAGSGSEATQ

SEQ ID NO: 602443 - protein, 10 aa, Mycobacterium
TTAGSTGNAI

SEQ ID NO: 602444 - protein, 32 aa, Mycobacterium
TTAGTAIGGTGSATTSTTRLSDPAEPVPGVET

SEQ ID NO: 602445 - protein, 10 aa, Mycobacterium
TTAGTGSETS

SEQ ID NO: 602446 - protein, 10 aa, Mycobacterium
TTAGTTGRRG

SEQ ID NO: 602447 - protein, 7 aa, Mycobacterium
TTAHAEA

SEQ ID NO: 602448 - protein, 10 aa, Mycobacterium
TTAHEGATHA

SEQ ID NO: 602449 - protein, 26 aa, Mycobacterium
TTAHKQGRVAGENAIGGNARYAGSLG

SEQ ID NO: 602450 - protein, 4 aa, Mycobacterium
TTAI

SEQ ID NO: 602451 - protein, 4 aa, Mycobacterium
TTAK

SEQ ID NO: 602452 - protein, 8 aa, Mycobacterium
TTAKHGRK

SEQ ID NO: 602453 - protein, 11 aa, Mycobacterium
TTAKSRDGWDS

SEQ ID NO: 602454 - protein, 6 aa, Mycobacterium
TTAKTG

SEQ ID NO: 602455 - protein, 10 aa, Mycobacterium
TTAKTGADRS

SEQ ID NO: 602456 - protein, 10 aa, Mycobacterium
TTAKTGGQRS

SEQ ID NO: 602457 - protein, 7 aa, Mycobacterium
TTALDDD

SEQ ID NO: 602458 - protein, 9 aa, Mycobacterium
TTALPGRSP

SEQ ID NO: 602459 - protein, 9 aa, Mycobacterium
TTALTTPSG

SEQ ID NO: 602460 - protein, 5 aa, Mycobacterium
TTAMP

SEQ ID NO: 602461 - protein, 8 aa, Mycobacterium
TTAPADMT

SEQ ID NO: 602462 - protein, 21 aa, Mycobacterium
TTAPAGDTFPTAAPKSLISGK

SEQ ID NO: 602463 - protein, 16 aa, Mycobacterium
TTAPAGDTFPTAAPRS

SEQ ID NO: 602464 - protein, 23 aa, Mycobacterium
TTAPAGDTFPTAAPRSAISGEPM

SEQ ID NO: 602465 - protein, 7 aa, Mycobacterium
TTAPDEK

SEQ ID NO: 602466 - protein, 12 aa, Mycobacterium
TTAPDEKVHPRG

SEQ ID NO: 602467 - protein, 5 aa, Mycobacterium
TTAPE

SEQ ID NO: 602468 - protein, 6 aa, Mycobacterium
TTAPGA

SEQ ID NO: 602469 - protein, 6 aa, Mycobacterium
TTAPGR

SEQ ID NO: 602470 - protein, 14 aa, Mycobacterium
TTAPQSEEDSGEAA

SEQ ID NO: 602471 - protein, 7 aa, Mycobacterium
TTAPRDY

SEQ ID NO: 602472 - protein, 15 aa, Mycobacterium
TTAPSDFVTSAGRKA

SEQ ID NO: 602473 - protein, 13 aa, Mycobacterium
TTAPTDSRSSEYC

SEQ ID NO: 602474 - protein, 9 aa, Mycobacterium
TTAPTPQTW

SEQ ID NO: 602475 - protein, 14 aa, Mycobacterium
TTAPTTNPASASAV

SEQ ID NO: 602476 - protein, 11 aa, Mycobacterium
TTAQDGASAIA

SEQ ID NO: 602477 - protein, 8 aa, Mycobacterium
TTAQGGSS

SEQ ID NO: 602478 - protein, 10 aa, Mycobacterium
TTAQGSAQAK

SEQ ID NO: 602479 - protein, 9 aa, Mycobacterium
TTAQPPPPV

SEQ ID NO: 602480 - protein, 6 aa, Mycobacterium
TTAQTY

SEQ ID NO: 602481 - protein, 4 aa, Mycobacterium
TTAR

SEQ ID NO: 602482 - protein, 9 aa, Mycobacterium
TTARAAGVN

SEQ ID NO: 602483 - protein, 10 aa, Mycobacterium
TTARAGNKGH

SEQ ID NO: 602484 - protein, 6 aa, Mycobacterium
TTARAK

SEQ ID NO: 602485 - protein, 5 aa, Mycobacterium
TTARG

SEQ ID NO: 602486 - protein, 6 aa, Mycobacterium
TTARGS

SEQ ID NO: 602487 - protein, 10 aa, Mycobacterium
TTARKKPPFG

SEQ ID NO: 602488 - protein, 11 aa, Mycobacterium
TTARKKPPFGI

SEQ ID NO: 602489 - protein, 5 aa, Mycobacterium
TTARM

SEQ ID NO: 602490 - protein, 10 aa, Mycobacterium
TTARPRADVS

SEQ ID NO: 602491 - protein, 8 aa, Mycobacterium
TTARPRRC

SEQ ID NO: 602492 - protein, 7 aa, Mycobacterium
TTARQGV

SEQ ID NO: 602493 - protein, 8 aa, Mycobacterium
TTARRDGD

SEQ ID NO: 602494 - protein, 9 aa, Mycobacterium
TTARRDGPD

SEQ ID NO: 602495 - protein, 5 aa, Mycobacterium
TTASG

SEQ ID NO: 602496 - protein, 7 aa, Mycobacterium
TTASGGP

SEQ ID NO: 602497 - protein, 10 aa, Mycobacterium
TTASKNPKDH

SEQ ID NO: 602498 - protein, 9 aa, Mycobacterium
TTASKQPKE

SEQ ID NO: 602499 - protein, 10 aa, Mycobacterium
TTASKSPKEH

SEQ ID NO: 602500 - protein, 7 aa, Mycobacterium
TTASLSD

SEQ ID NO: 602501 - protein, 7 aa, Mycobacterium
TTASPVR

SEQ ID NO: 602502 - protein, 11 aa, Mycobacterium
TTASRYATGSH

SEQ ID NO: 602503 - protein, 11 aa, Mycobacterium
TTASSDEDGRL

SEQ ID NO: 602504 - protein, 12 aa, Mycobacterium
TTASTDEITDTA

SEQ ID NO: 602505 - protein, 12 aa, Mycobacterium
TTASTEEITDTA

SEQ ID NO: 602506 - protein, 20 aa, Mycobacterium
TTASVPAGSVPPVSAAAAAA

SEQ ID NO: 602507 - protein, 7 aa, Mycobacterium
TTASYPA

SEQ ID NO: 602508 - protein, 4 aa, Mycobacterium
TTAT

SEQ ID NO: 602509 - protein, 6 aa, Mycobacterium
TTATAA

SEQ ID NO: 602510 - protein, 6 aa, Mycobacterium
TTATAE

SEQ ID NO: 602511 - protein, 14 aa, Mycobacterium
TTATAEEITDTSIT

SEQ ID NO: 602512 - protein, 8 aa, Mycobacterium
TTATANDR

SEQ ID NO: 602513 - protein, 13 aa, Mycobacterium
TTATATDSAERAR

SEQ ID NO: 602514 - protein, 21 aa, Mycobacterium
TTATDRSDRPVEPVVIESITI

SEQ ID NO: 602515 - protein, 6 aa, Mycobacterium
TTATEG

SEQ ID NO: 602516 - protein, 5 aa, Mycobacterium
TTATG

SEQ ID NO: 602517 - protein, 8 aa, Mycobacterium
TTATGDDR

SEQ ID NO: 602518 - protein, 8 aa, Mycobacterium
TTATGGAG

SEQ ID NO: 602519 - protein, 6 aa, Mycobacterium
TTATGR

SEQ ID NO: 602520 - protein, 10 aa, Mycobacterium
TTATGTGGFQ

SEQ ID NO: 602521 - protein, 16 aa, Mycobacterium
TTATNGPTVTSGTSMN

SEQ ID NO: 602522 - protein, 11 aa, Mycobacterium
TTATPFGQQPL

SEQ ID NO: 602523 - protein, 9 aa, Mycobacterium
TTATPGYDG

SEQ ID NO: 602524 - protein, 11 aa, Mycobacterium
TTATPMGQQPL

SEQ ID NO: 602525 - protein, 10 aa, Mycobacterium
TTATPMGQRP

SEQ ID NO: 602526 - protein, 6 aa, Mycobacterium
TTATPV

SEQ ID NO: 602527 - protein, 9 aa, Mycobacterium
TTATQTSAS

SEQ ID NO: 602528 - protein, 14 aa, Mycobacterium
TTATRAAKGQLQSM

SEQ ID NO: 602529 - protein, 7 aa, Mycobacterium
TTATRQG

SEQ ID NO: 602530 - protein, 10 aa, Mycobacterium
TTATRTPSGF

SEQ ID NO: 602531 - protein, 15 aa, Mycobacterium
TTAVEPPKTPEQGYT

SEQ ID NO: 602532 - protein, 8 aa, Mycobacterium
TTAVKDGD

SEQ ID NO: 602533 - protein, 6 aa, Mycobacterium
TTAVRD

SEQ ID NO: 602534 - protein, 8 aa, Mycobacterium
TTAVRDGD

SEQ ID NO: 602535 - protein, 9 aa, Mycobacterium
TTAVRDGDT

SEQ ID NO: 602536 - protein, 11 aa, Mycobacterium
TTAVRTPSGYR

SEQ ID NO: 602537 - protein, 6 aa, Mycobacterium
TTAYET

SEQ ID NO: 602538 - protein, 13 aa, Mycobacterium
TTAYQSTRASKRF

SEQ ID NO: 602539 - protein, 6 aa, Mycobacterium
TTCDST

SEQ ID NO: 602540 - protein, 6 aa, Mycobacterium
TTCDTE

SEQ ID NO: 602541 - protein, 6 aa, Mycobacterium
TTCGGT

SEQ ID NO: 602542 - protein, 12 aa, Mycobacterium
TTCSRPEDAGLG

SEQ ID NO: 602543 - protein, 4 aa, Mycobacterium
TTDA

SEQ ID NO: 602544 - protein, 5 aa, Mycobacterium
TTDAA

SEQ ID NO: 602545 - protein, 8 aa, Mycobacterium
TTDAAEGV

SEQ ID NO: 602546 - protein, 25 aa, Mycobacterium
TTDADAEKNEPAALRRRDGSSVYTR

SEQ ID NO: 602547 - protein, 6 aa, Mycobacterium
TTDADD

SEQ ID NO: 602548 - protein, 9 aa, Mycobacterium
TTDADSTVD

SEQ ID NO: 602549 - protein, 12 aa, Mycobacterium
TTDAEKARAVGR

SEQ ID NO: 602550 - protein, 11 aa, Mycobacterium
TTDAIGESQIT

SEQ ID NO: 602551 - protein, 8 aa, Mycobacterium
TTDANGAP

SEQ ID NO: 602552 - protein, 8 aa, Mycobacterium
TTDAPGER

SEQ ID NO: 602553 - protein, 6 aa, Mycobacterium
TTDAPV

SEQ ID NO: 602554 - protein, 9 aa, Mycobacterium
TTDARADLA

SEQ ID NO: 602555 - protein, 5 aa, Mycobacterium
TTDDA

SEQ ID NO: 602556 - protein, 12 aa, Mycobacterium
TTDDAGQTTENY

SEQ ID NO: 602557 - protein, 9 aa, Mycobacterium
TTDDERSSL

SEQ ID NO: 602558 - protein, 6 aa, Mycobacterium
TTDDGA

SEQ ID NO: 602559 - protein, 7 aa, Mycobacterium
TTDDGHV

SEQ ID NO: 602560 - protein, 9 aa, Mycobacterium
TTDDGRTGA

SEQ ID NO: 602561 - protein, 7 aa, Mycobacterium
TTDEDGS

SEQ ID NO: 602562 - protein, 5 aa, Mycobacterium
TTDEF

SEQ ID NO: 602563 - protein, 9 aa, Mycobacterium
TTDEGDEDY

SEQ ID NO: 602564 - protein, 9 aa, Mycobacterium
TTDEGQQRV

SEQ ID NO: 602565 - protein, 6 aa, Mycobacterium
TTDEGT

SEQ ID NO: 602566 - protein, 14 aa, Mycobacterium
TTDERSGAAKDYDV

SEQ ID NO: 602567 - protein, 4 aa, Mycobacterium
TTDF

SEQ ID NO: 602568 - protein, 6 aa, Mycobacterium
TTDFED

SEQ ID NO: 602569 - protein, 6 aa, Mycobacterium
TTDGAE

SEQ ID NO: 602570 - protein, 10 aa, Mycobacterium
TTDGDSVPTA

SEQ ID NO: 602571 - protein, 7 aa, Mycobacterium
TTDGFPS

SEQ ID NO: 602572 - protein, 7 aa, Mycobacterium
TTDGGET

SEQ ID NO: 602573 - protein, 5 aa, Mycobacterium
TTDGK

SEQ ID NO: 602574 - protein, 6 aa, Mycobacterium
TTDGQS

SEQ ID NO: 602575 - protein, 5 aa, Mycobacterium
TTDGR

SEQ ID NO: 602576 - protein, 7 aa, Mycobacterium
TTDGRWP

SEQ ID NO: 602577 - protein, 8 aa, Mycobacterium
TTDGSRAA

SEQ ID NO: 602578 - protein, 10 aa, Mycobacterium
TTDGSSRAAG

SEQ ID NO: 602579 - protein, 6 aa, Mycobacterium
TTDGTY

SEQ ID NO: 602580 - protein, 5 aa, Mycobacterium
TTDHL

SEQ ID NO: 602581 - protein, 6 aa, Mycobacterium
TTDLDA

SEQ ID NO: 602582 - protein, 7 aa, Mycobacterium
TTDLEEQ

SEQ ID NO: 602583 - protein, 5 aa, Mycobacterium
TTDLP

SEQ ID NO: 602584 - protein, 5 aa, Mycobacterium
TTDLT

SEQ ID NO: 602585 - protein, 11 aa, Mycobacterium
TTDNIGEQSIT

SEQ ID NO: 602586 - protein, 5 aa, Mycobacterium
TTDNP

SEQ ID NO: 602587 - protein, 11 aa, Mycobacterium
TTDNSIQSTGV

SEQ ID NO: 602588 - protein, 22 aa, Mycobacterium
TTDNSKRTEAPPITDAHREEAK

SEQ ID NO: 602589 - protein, 7 aa, Mycobacterium
TTDPAGH

SEQ ID NO: 602590 - protein, 10 aa, Mycobacterium
TTDPAPHQHE

SEQ ID NO: 602591 - protein, 9 aa, Mycobacterium
TTDPARTVS

SEQ ID NO: 602592 - protein, 10 aa, Mycobacterium
TTDPASLEEA

SEQ ID NO: 602593 - protein, 10 aa, Mycobacterium
TTDPASLTEA

SEQ ID NO: 602594 - protein, 6 aa, Mycobacterium
TTDPAV

SEQ ID NO: 602595 - protein, 10 aa, Mycobacterium
TTDPDNPAYV

SEQ ID NO: 602596 - protein, 11 aa, Mycobacterium
TTDPHTVSDEQ

SEQ ID NO: 602597 - protein, 10 aa, Mycobacterium
TTDPHTVTDK

SEQ ID NO: 602598 - protein, 5 aa, Mycobacterium
TTDPI

SEQ ID NO: 602599 - protein, 7 aa, Mycobacterium
TTDPLAP

SEQ ID NO: 602600 - protein, 6 aa, Mycobacterium
TTDPLE

SEQ ID NO: 602601 - protein, 10 aa, Mycobacterium
TTDPQDLATT

SEQ ID NO: 602602 - protein, 23 aa, Mycobacterium
TTDPQTGKRRVAKSTGDKSHPAN

SEQ ID NO: 602603 - protein, 8 aa, Mycobacterium
TTDPRGSR

SEQ ID NO: 602604 - protein, 10 aa, Mycobacterium
TTDPSPAAQV

SEQ ID NO: 602605 - protein, 9 aa, Mycobacterium
TTDPSPEAA

SEQ ID NO: 602606 - protein, 7 aa, Mycobacterium
TTDQAWA

SEQ ID NO: 602607 - protein, 15 aa, Mycobacterium
TTDQEVDDVLALLGQ

SEQ ID NO: 602608 - protein, 13 aa, Mycobacterium
TTDQHPWPQPSDL

SEQ ID NO: 602609 - protein, 6 aa, Mycobacterium
TTDQRA

SEQ ID NO: 602610 - protein, 10 aa, Mycobacterium
TTDQRQARQT

SEQ ID NO: 602611 - protein, 13 aa, Mycobacterium
TTDRAAKKPDGLD

SEQ ID NO: 602612 - protein, 9 aa, Mycobacterium
TTDRLTDAD

SEQ ID NO: 602613 - protein, 9 aa, Mycobacterium
TTDRPQGAQ

SEQ ID NO: 602614 - protein, 15 aa, Mycobacterium
TTDRTIRRTDEHQSV

SEQ ID NO: 602615 - protein, 9 aa, Mycobacterium
TTDRTQFGR

SEQ ID NO: 602616 - protein, 28 aa, Mycobacterium
TTDSGTDSGTGTTETEGQPRAVSEPVQG

SEQ ID NO: 602617 - protein, 15 aa, Mycobacterium
TTDSMARQQISRDAD

SEQ ID NO: 602618 - protein, 8 aa, Mycobacterium
TTDSMESG

SEQ ID NO: 602619 - protein, 9 aa, Mycobacterium
TTDSWDDAT

SEQ ID NO: 602620 - protein, 8 aa, Mycobacterium
TTDSWDSY

SEQ ID NO: 602621 - protein, 13 aa, Mycobacterium
TTDTAGAKPTATE

SEQ ID NO: 602622 - protein, 10 aa, Mycobacterium
TTDTEQQALD

SEQ ID NO: 602623 - protein, 5 aa, Mycobacterium
TTDTG

SEQ ID NO: 602624 - protein, 10 aa, Mycobacterium
TTDTHLTRGD

SEQ ID NO: 602625 - protein, 8 aa, Mycobacterium
TTDTRTTP

SEQ ID NO: 602626 - protein, 16 aa, Mycobacterium
TTDVDAAAAAGDPALR

SEQ ID NO: 602627 - protein, 16 aa, Mycobacterium
TTDVDAAAADGNPALR

SEQ ID NO: 602628 - protein, 11 aa, Mycobacterium
TTDWPDNGKAA

SEQ ID NO: 602629 - protein, 16 aa, Mycobacterium
TTDYTDDGSYDVAAGR

SEQ ID NO: 602630 - protein, 7 aa, Mycobacterium
TTEADDD

SEQ ID NO: 602631 - protein, 5 aa, Mycobacterium
TTEAF

SEQ ID NO: 602632 - protein, 12 aa, Mycobacterium
TTEAKVRGYQPG

SEQ ID NO: 602633 - protein, 10 aa, Mycobacterium
TTEANPESTW

SEQ ID NO: 602634 - protein, 9 aa, Mycobacterium
TTEANRRLT

SEQ ID NO: 602635 - protein, 10 aa, Mycobacterium
TTEDAERVRR

SEQ ID NO: 602636 - protein, 12 aa, Mycobacterium
TTEDLAEALATP

SEQ ID NO: 602637 - protein, 17 aa, Mycobacterium
TTEDPANGFRPDTGRVT

SEQ ID NO: 602638 - protein, 7 aa, Mycobacterium
TTEDPDP

SEQ ID NO: 602639 - protein, 7 aa, Mycobacterium
TTEDPKV

SEQ ID NO: 602640 - protein, 8 aa, Mycobacterium
TTEDPQLG

SEQ ID NO: 602641 - protein, 6 aa, Mycobacterium
TTEDSA

SEQ ID NO: 602642 - protein, 7 aa, Mycobacterium
TTEDSRD

SEQ ID NO: 602643 - protein, 8 aa, Mycobacterium
TTEDTELE

SEQ ID NO: 602644 - protein, 8 aa, Mycobacterium
TTEDTELQ

SEQ ID NO: 602645 - protein, 8 aa, Mycobacterium
TTEEERAQ

SEQ ID NO: 602646 - protein, 7 aa, Mycobacterium
TTEEERR

SEQ ID NO: 602647 - protein, 6 aa, Mycobacterium
TTEEFS

SEQ ID NO: 602648 - protein, 5 aa, Mycobacterium
TTEEP

SEQ ID NO: 602649 - protein, 8 aa, Mycobacterium
TTEEPGPE

SEQ ID NO: 602650 - protein, 20 aa, Mycobacterium
TTEEPGRAVPPEAPLKRPSL

SEQ ID NO: 602651 - protein, 7 aa, Mycobacterium
TTEEQKE

SEQ ID NO: 602652 - protein, 6 aa, Mycobacterium
TTEEQN

SEQ ID NO: 602653 - protein, 11 aa, Mycobacterium
TTEETAAWRDA

SEQ ID NO: 602654 - protein, 6 aa, Mycobacterium
TTEFEQ

SEQ ID NO: 602655 - protein, 6 aa, Mycobacterium
TTEGDW

SEQ ID NO: 602656 - protein, 5 aa, Mycobacterium
TTEGG

SEQ ID NO: 602657 - protein, 12 aa, Mycobacterium
TTEGHIQVARIA

SEQ ID NO: 602658 - protein, 5 aa, Mycobacterium
TTEGI

SEQ ID NO: 602659 - protein, 9 aa, Mycobacterium
TTEGKEVAG

SEQ ID NO: 602660 - protein, 25 aa, Mycobacterium
TTEGSVRGNLQRTRKRLAETLKDFR

SEQ ID NO: 602661 - protein, 4 aa, Mycobacterium
TTEH

SEQ ID NO: 602662 - protein, 6 aa, Mycobacterium
TTEHPP

SEQ ID NO: 602663 - protein, 6 aa, Mycobacterium
TTEHPS

SEQ ID NO: 602664 - protein, 15 aa, Mycobacterium
TTEIAPERLRPRLTR

SEQ ID NO: 602665 - protein, 5 aa, Mycobacterium
TTEID

SEQ ID NO: 602666 - protein, 7 aa, Mycobacterium
TTEKAQQ

SEQ ID NO: 602667 - protein, 10 aa, Mycobacterium
TTEKNQNRSL

SEQ ID NO: 602668 - protein, 9 aa, Mycobacterium
TTEKPETMP

SEQ ID NO: 602669 - protein, 9 aa, Mycobacterium
TTEKPQTMP

SEQ ID NO: 602670 - protein, 14 aa, Mycobacterium
TTELEGALKGRMAH

SEQ ID NO: 602671 - protein, 12 aa, Mycobacterium
TTELGNEHERRT

SEQ ID NO: 602672 - protein, 12 aa, Mycobacterium
TTELPGLGPTGD

SEQ ID NO: 602673 - protein, 10 aa, Mycobacterium
TTENIGEQKI

SEQ ID NO: 602674 - protein, 7 aa, Mycobacterium
TTENPAE

SEQ ID NO: 602675 - protein, 6 aa, Mycobacterium
TTENPS

SEQ ID NO: 602676 - protein, 7 aa, Mycobacterium
TTENSHD

SEQ ID NO: 602677 - protein, 9 aa, Mycobacterium
TTENSHDID

SEQ ID NO: 602678 - protein, 9 aa, Mycobacterium
TTENSHDVT

SEQ ID NO: 602679 - protein, 9 aa, Mycobacterium
TTENSHGIE

SEQ ID NO: 602680 - protein, 4 aa, Mycobacterium
TTEP

SEQ ID NO: 602681 - protein, 9 aa, Mycobacterium
TTEPDRTEE

SEQ ID NO: 602682 - protein, 6 aa, Mycobacterium
TTEPEA

SEQ ID NO: 602683 - protein, 9 aa, Mycobacterium
TTEPEPQLG

SEQ ID NO: 602684 - protein, 5 aa, Mycobacterium
TTEPG

SEQ ID NO: 602685 - protein, 7 aa, Mycobacterium
TTEPGVD

SEQ ID NO: 602686 - protein, 5 aa, Mycobacterium
TTEPI

SEQ ID NO: 602687 - protein, 7 aa, Mycobacterium
TTEPLGY

SEQ ID NO: 602688 - protein, 6 aa, Mycobacterium
TTEPPR

SEQ ID NO: 602689 - protein, 7 aa, Mycobacterium
TTEPQGA

SEQ ID NO: 602690 - protein, 7 aa, Mycobacterium
TTEPRPI

SEQ ID NO: 602691 - protein, 13 aa, Mycobacterium
TTEPVTLSSDTSQ

SEQ ID NO: 602692 - protein, 7 aa, Mycobacterium
TTEPVTP

SEQ ID NO: 602693 - protein, 6 aa, Mycobacterium
TTEPYL

SEQ ID NO: 602694 - protein, 6 aa, Mycobacterium
TTEQAI

SEQ ID NO: 602695 - protein, 6 aa, Mycobacterium
TTEQLG

SEQ ID NO: 602696 - protein, 8 aa, Mycobacterium
TTEQPPGS

SEQ ID NO: 602697 - protein, 7 aa, Mycobacterium
TTEQSNE

SEQ ID NO: 602698 - protein, 5 aa, Mycobacterium
TTEQV

SEQ ID NO: 602699 - protein, 4 aa, Mycobacterium
TTER

SEQ ID NO: 602700 - protein, 8 aa, Mycobacterium
TTERADHH

SEQ ID NO: 602701 - protein, 6 aa, Mycobacterium
TTERDG

SEQ ID NO: 602702 - protein, 6 aa, Mycobacterium
TTERES

SEQ ID NO: 602703 - protein, 7 aa, Mycobacterium
TTERGEV

SEQ ID NO: 602704 - protein, 10 aa, Mycobacterium
TTERKAFGKP

SEQ ID NO: 602705 - protein, 8 aa, Mycobacterium
TTERPGKG

SEQ ID NO: 602706 - protein, 22 aa, Mycobacterium
TTERPPAPQPAKVSGRTERARA

SEQ ID NO: 602707 - protein, 8 aa, Mycobacterium
TTERPRGR

SEQ ID NO: 602708 - protein, 11 aa, Mycobacterium
TTERQGLPGKA

SEQ ID NO: 602709 - protein, 8 aa, Mycobacterium
TTERTPVS

SEQ ID NO: 602710 - protein, 11 aa, Mycobacterium
TTESAVAEPRY

SEQ ID NO: 602711 - protein, 9 aa, Mycobacterium
TTESEAAVT

SEQ ID NO: 602712 - protein, 11 aa, Mycobacterium
TTESIGESQIT

SEQ ID NO: 602713 - protein, 17 aa, Mycobacterium
TTETERAALPDDEIAPE

SEQ ID NO: 602714 - protein, 13 aa, Mycobacterium
TTETSSGAGMADP

SEQ ID NO: 602715 - protein, 14 aa, Mycobacterium
TTETSSGAGMADPS

SEQ ID NO: 602716 - protein, 12 aa, Mycobacterium
TTETTDHPGGYA

SEQ ID NO: 602717 - protein, 13 aa, Mycobacterium
TTETTDHPGGYRG

SEQ ID NO: 602718 - protein, 5 aa, Mycobacterium
TTETV

SEQ ID NO: 602719 - protein, 16 aa, Mycobacterium
TTEVSSDFRKRPGQPL

SEQ ID NO: 602720 - protein, 4 aa, Mycobacterium
TTEW

SEQ ID NO: 602721 - protein, 12 aa, Mycobacterium
TTFAQGADRTRR

SEQ ID NO: 602722 - protein, 7 aa, Mycobacterium
TTFDPAR

SEQ ID NO: 602723 - protein, 9 aa, Mycobacterium
TTFDSGDPR

SEQ ID NO: 602724 - protein, 5 aa, Mycobacterium
TTFGP

SEQ ID NO: 602725 - protein, 7 aa, Mycobacterium
TTFGPDS

SEQ ID NO: 602726 - protein, 11 aa, Mycobacterium
TTFGPYSPGQA

SEQ ID NO: 602727 - protein, 15 aa, Mycobacterium
TTFGSAGSGTASSLG

SEQ ID NO: 602728 - protein, 16 aa, Mycobacterium
TTFGSGGHRPAVSSDA

SEQ ID NO: 602729 - protein, 4 aa, Mycobacterium
TTFP

SEQ ID NO: 602730 - protein, 11 aa, Mycobacterium
TTFPATTRAAK

SEQ ID NO: 602731 - protein, 7 aa, Mycobacterium
TTFPDDR

SEQ ID NO: 602732 - protein, 7 aa, Mycobacterium
TTFPPTV

SEQ ID NO: 602733 - protein, 10 aa, Mycobacterium
TTFSDDDTRN

SEQ ID NO: 602734 - protein, 11 aa, Mycobacterium
TTFSGGRGRPS

SEQ ID NO: 602735 - protein, 7 aa, Mycobacterium
TTFSGQR

SEQ ID NO: 602736 - protein, 9 aa, Mycobacterium
TTFTSGPKA

SEQ ID NO: 602737 - protein, 6 aa, Mycobacterium
TTFTSS

SEQ ID NO: 602738 - protein, 8 aa, Mycobacterium
TTGAADPM

SEQ ID NO: 602739 - protein, 6 aa, Mycobacterium
TTGAAR

SEQ ID NO: 602740 - protein, 7 aa, Mycobacterium
TTGADQD

SEQ ID NO: 602741 - protein, 24 aa, Mycobacterium
TTGADRYADEASAGPADVIPGTPR

SEQ ID NO: 602742 - protein, 6 aa, Mycobacterium
TTGAGA

SEQ ID NO: 602743 - protein, 8 aa, Mycobacterium
TTGAGAAR

SEQ ID NO: 602744 - protein, 8 aa, Mycobacterium
TTGAGPTH

SEQ ID NO: 602745 - protein, 5 aa, Mycobacterium
TTGAH

SEQ ID NO: 602746 - protein, 16 aa, Mycobacterium
TTGAHSSYAIYGEPIK

SEQ ID NO: 602747 - protein, 11 aa, Mycobacterium
TTGAKSGQQRV

SEQ ID NO: 602748 - protein, 11 aa, Mycobacterium
TTGAKSGRKRE

SEQ ID NO: 602749 - protein, 10 aa, Mycobacterium
TTGAPSAHAY

SEQ ID NO: 602750 - protein, 9 aa, Mycobacterium
TTGAPVDSG

SEQ ID NO: 602751 - protein, 8 aa, Mycobacterium
TTGASAAR

SEQ ID NO: 602752 - protein, 10 aa, Mycobacterium
TTGATARESV

SEQ ID NO: 602753 - protein, 7 aa, Mycobacterium
TTGATSA

SEQ ID NO: 602754 - protein, 6 aa, Mycobacterium
TTGCGD

SEQ ID NO: 602755 - protein, 7 aa, Mycobacterium
TTGCRPE

SEQ ID NO: 602756 - protein, 17 aa, Mycobacterium
TTGDAQRHDLGTGGPGE

SEQ ID NO: 602757 - protein, 12 aa, Mycobacterium
TTGDGEPPDNGS

SEQ ID NO: 602758 - protein, 19 aa, Mycobacterium
TTGDPGPITPEPAPQPAED

SEQ ID NO: 602759 - protein, 10 aa, Mycobacterium
TTGDPGWAPG

SEQ ID NO: 602760 - protein, 8 aa, Mycobacterium
TTGDTRAG

SEQ ID NO: 602761 - protein, 9 aa, Mycobacterium
TTGDTRSGR

SEQ ID NO: 602762 - protein, 9 aa, Mycobacterium
TTGDTRTGR

SEQ ID NO: 602763 - protein, 16 aa, Mycobacterium
TTGDVEIGGKTIPADA

SEQ ID NO: 602764 - protein, 6 aa, Mycobacterium
TTGEGG

SEQ ID NO: 602765 - protein, 5 aa, Mycobacterium
TTGEN

SEQ ID NO: 602766 - protein, 7 aa, Mycobacterium
TTGEPDT

SEQ ID NO: 602767 - protein, 10 aa, Mycobacterium
TTGEPTGALG

SEQ ID NO: 602768 - protein, 6 aa, Mycobacterium
TTGEQA

SEQ ID NO: 602769 - protein, 5 aa, Mycobacterium
TTGET

SEQ ID NO: 602770 - protein, 7 aa, Mycobacterium
TTGEVTP

SEQ ID NO: 602771 - protein, 20 aa, Mycobacterium
TTGEWQTSTSGLRFRFCSYR

SEQ ID NO: 602772 - protein, 4 aa, Mycobacterium
TTGG

SEQ ID NO: 602773 - protein, 14 aa, Mycobacterium
TTGGDAWEGKTGDY

SEQ ID NO: 602774 - protein, 9 aa, Mycobacterium
TTGGDPAVP

SEQ ID NO: 602775 - protein, 5 aa, Mycobacterium
TTGGG

SEQ ID NO: 602776 - protein, 16 aa, Mycobacterium
TTGGGAYAAAEAANVQ

SEQ ID NO: 602777 - protein, 9 aa, Mycobacterium
TTGGGEVRT

SEQ ID NO: 602778 - protein, 16 aa, Mycobacterium
TTGGGTPGGALLLRRE

SEQ ID NO: 602779 - protein, 14 aa, Mycobacterium
TTGGGYPTGEEIYL

SEQ ID NO: 602780 - protein, 6 aa, Mycobacterium
TTGGHD

SEQ ID NO: 602781 - protein, 10 aa, Mycobacterium
TTGGPAANRA

SEQ ID NO: 602782 - protein, 5 aa, Mycobacterium
TTGGR

SEQ ID NO: 602783 - protein, 10 aa, Mycobacterium
TTGGRAGQRI

SEQ ID NO: 602784 - protein, 13 aa, Mycobacterium
TTGGRASGDRHDA

SEQ ID NO: 602785 - protein, 17 aa, Mycobacterium
TTGGRATGTEASPPDAI

SEQ ID NO: 602786 - protein, 6 aa, Mycobacterium
TTGGRI

SEQ ID NO: 602787 - protein, 7 aa, Mycobacterium
TTGGRMA

SEQ ID NO: 602788 - protein, 17 aa, Mycobacterium
TTGGRTTGTEAAPPDAI

SEQ ID NO: 602789 - protein, 7 aa, Mycobacterium
TTGGSHA

SEQ ID NO: 602790 - protein, 15 aa, Mycobacterium
TTGGSQKAVNAQERG

SEQ ID NO: 602791 - protein, 9 aa, Mycobacterium
TTGHSARTL

SEQ ID NO: 602792 - protein, 8 aa, Mycobacterium
TTGISDPT

SEQ ID NO: 602793 - protein, 4 aa, Mycobacterium
TTGK

SEQ ID NO: 602794 - protein, 7 aa, Mycobacterium
TTGKGDL

SEQ ID NO: 602795 - protein, 8 aa, Mycobacterium
TTGKTPSL

SEQ ID NO: 602796 - protein, 6 aa, Mycobacterium
TTGLDS

SEQ ID NO: 602797 - protein, 8 aa, Mycobacterium
TTGLGGRT

SEQ ID NO: 602798 - protein, 21 aa, Mycobacterium
TTGLTGRASYGGIGARRPAAA

SEQ ID NO: 602799 - protein, 9 aa, Mycobacterium
TTGMGRSTA

SEQ ID NO: 602800 - protein, 9 aa, Mycobacterium
TTGMNPPAD

SEQ ID NO: 602801 - protein, 5 aa, Mycobacterium
TTGMT

SEQ ID NO: 602802 - protein, 5 aa, Mycobacterium
TTGNA

SEQ ID NO: 602803 - protein, 5 aa, Mycobacterium
TTGNG

SEQ ID NO: 602804 - protein, 9 aa, Mycobacterium
TTGNGGEAP

SEQ ID NO: 602805 - protein, 8 aa, Mycobacterium
TTGNGGID

SEQ ID NO: 602806 - protein, 5 aa, Mycobacterium
TTGNK

SEQ ID NO: 602807 - protein, 8 aa, Mycobacterium
TTGNLKPA

SEQ ID NO: 602808 - protein, 5 aa, Mycobacterium
TTGNM

SEQ ID NO: 602809 - protein, 5 aa, Mycobacterium
TTGNT

SEQ ID NO: 602810 - protein, 7 aa, Mycobacterium
TTGPAEI

SEQ ID NO: 602811 - protein, 14 aa, Mycobacterium
TTGPDGAPISPRDR

SEQ ID NO: 602812 - protein, 8 aa, Mycobacterium
TTGPLGQG

SEQ ID NO: 602813 - protein, 6 aa, Mycobacterium
TTGPLT

SEQ ID NO: 602814 - protein, 9 aa, Mycobacterium
TTGPPGSMG

SEQ ID NO: 602815 - protein, 7 aa, Mycobacterium
TTGPSSG

SEQ ID NO: 602816 - protein, 8 aa, Mycobacterium
TTGPTGPG

SEQ ID NO: 602817 - protein, 13 aa, Mycobacterium
TTGPTLSGTDGLG

SEQ ID NO: 602818 - protein, 24 aa, Mycobacterium
TTGPTPEFKQAQERVADGIDPDLA

SEQ ID NO: 602819 - protein, 5 aa, Mycobacterium
TTGPW

SEQ ID NO: 602820 - protein, 6 aa, Mycobacterium
TTGPWV

SEQ ID NO: 602821 - protein, 4 aa, Mycobacterium
TTGQ

SEQ ID NO: 602822 - protein, 7 aa, Mycobacterium
TTGQDLD

SEQ ID NO: 602823 - protein, 9 aa, Mycobacterium
TTGQDPATA

SEQ ID NO: 602824 - protein, 23 aa, Mycobacterium
TTGQIEARTDPWDPETEPSADDF

SEQ ID NO: 602825 - protein, 7 aa, Mycobacterium
TTGQSEA

SEQ ID NO: 602826 - protein, 12 aa, Mycobacterium
TTGRAGRALNGY

SEQ ID NO: 602827 - protein, 5 aa, Mycobacterium
TTGRE

SEQ ID NO: 602828 - protein, 14 aa, Mycobacterium
TTGRGDSASAQARD

SEQ ID NO: 602829 - protein, 13 aa, Mycobacterium
TTGRGYSYPTARE

SEQ ID NO: 602830 - protein, 5 aa, Mycobacterium
TTGRI

SEQ ID NO: 602831 - protein, 18 aa, Mycobacterium
TTGRKSGLPRTTPLGGRR

SEQ ID NO: 602832 - protein, 15 aa, Mycobacterium
TTGRKSGQPRRTAVG

SEQ ID NO: 602833 - protein, 11 aa, Mycobacterium
TTGRKSGRPRV

SEQ ID NO: 602834 - protein, 11 aa, Mycobacterium
TTGRKTGQPRV

SEQ ID NO: 602835 - protein, 13 aa, Mycobacterium
TTGRRFGGSEAHE

SEQ ID NO: 602836 - protein, 7 aa, Mycobacterium
TTGRSTH

SEQ ID NO: 602837 - protein, 7 aa, Mycobacterium
TTGRSYG

SEQ ID NO: 602838 - protein, 5 aa, Mycobacterium
TTGRV

SEQ ID NO: 602839 - protein, 10 aa, Mycobacterium
TTGRVKRPQM

SEQ ID NO: 602840 - protein, 4 aa, Mycobacterium
TTGS

SEQ ID NO: 602841 - protein, 9 aa, Mycobacterium
TTGSAPGPL

SEQ ID NO: 602842 - protein, 11 aa, Mycobacterium
TTGSGTGQPTG

SEQ ID NO: 602843 - protein, 8 aa, Mycobacterium
TTGSGTKT

SEQ ID NO: 602844 - protein, 7 aa, Mycobacterium
TTGSPAA

SEQ ID NO: 602845 - protein, 6 aa, Mycobacterium
TTGSRG

SEQ ID NO: 602846 - protein, 9 aa, Mycobacterium
TTGSSKPVT

SEQ ID NO: 602847 - protein, 23 aa, Mycobacterium
TTGTAGAADAEQTAVSAGPAGTP

SEQ ID NO: 602848 - protein, 16 aa, Mycobacterium
TTGTARQAPVAPAPAA

SEQ ID NO: 602849 - protein, 16 aa, Mycobacterium
TTGTDPLEAGPGAELA

SEQ ID NO: 602850 - protein, 7 aa, Mycobacterium
TTGTDTW

SEQ ID NO: 602851 - protein, 9 aa, Mycobacterium
TTGTGLDTA

SEQ ID NO: 602852 - protein, 10 aa, Mycobacterium
TTGTGSGKSM

SEQ ID NO: 602853 - protein, 5 aa, Mycobacterium
TTGTK

SEQ ID NO: 602854 - protein, 9 aa, Mycobacterium
TTGTSRGGC

SEQ ID NO: 602855 - protein, 5 aa, Mycobacterium
TTGTV

SEQ ID NO: 602856 - protein, 7 aa, Mycobacterium
TTGTVTT

SEQ ID NO: 602857 - protein, 4 aa, Mycobacterium
TTGV

SEQ ID NO: 602858 - protein, 30 aa, Mycobacterium
TTGVATGNTATGGDGGAATTAGATGGAGGF

SEQ ID NO: 602859 - protein, 8 aa, Mycobacterium
TTGVPPAG

SEQ ID NO: 602860 - protein, 6 aa, Mycobacterium
TTGVSD

SEQ ID NO: 602861 - protein, 6 aa, Mycobacterium
TTGVTD

SEQ ID NO: 602862 - protein, 7 aa, Mycobacterium
TTGWDDK

SEQ ID NO: 602863 - protein, 7 aa, Mycobacterium
TTGWDDR

SEQ ID NO: 602864 - protein, 9 aa, Mycobacterium
TTGYGSAVR

SEQ ID NO: 602865 - protein, 17 aa, Mycobacterium
TTGYGSAVRSGDIRPGD

SEQ ID NO: 602866 - protein, 16 aa, Mycobacterium
TTGYGSAVRTGEVRAG

SEQ ID NO: 602867 - protein, 17 aa, Mycobacterium
TTGYGSSVRTADIRPGQ

SEQ ID NO: 602868 - protein, 11 aa, Mycobacterium
TTGYRAPTTPV

SEQ ID NO: 602869 - protein, 6 aa, Mycobacterium
TTHDGK

SEQ ID NO: 602870 - protein, 7 aa, Mycobacterium
TTHEDRY

SEQ ID NO: 602871 - protein, 15 aa, Mycobacterium
TTHELDGSRAAGMTS

SEQ ID NO: 602872 - protein, 6 aa, Mycobacterium
TTHEPY

SEQ ID NO: 602873 - protein, 6 aa, Mycobacterium
TTHEQN

SEQ ID NO: 602874 - protein, 5 aa, Mycobacterium
TTHEY

SEQ ID NO: 602875 - protein, 11 aa, Mycobacterium
TTHGGRRGTGI

SEQ ID NO: 602876 - protein, 7 aa, Mycobacterium
TTHGPRN

SEQ ID NO: 602877 - protein, 16 aa, Mycobacterium
TTHGREKQYRADAEQV

SEQ ID NO: 602878 - protein, 4 aa, Mycobacterium
TTHN

SEQ ID NO: 602879 - protein, 5 aa, Mycobacterium
TTHPA

SEQ ID NO: 602880 - protein, 8 aa, Mycobacterium
TTHPDGDL

SEQ ID NO: 602881 - protein, 9 aa, Mycobacterium
TTHPGGHKG

SEQ ID NO: 602882 - protein, 7 aa, Mycobacterium
TTHPQDA

SEQ ID NO: 602883 - protein, 10 aa, Mycobacterium
TTHPSPEDYE

SEQ ID NO: 602884 - protein, 9 aa, Mycobacterium
TTHTEPAAL

SEQ ID NO: 602885 - protein, 8 aa, Mycobacterium
TTHTGSDD

SEQ ID NO: 602886 - protein, 24 aa, Mycobacterium
TTHTNRPPQTPHPPEPHPTLPTTP

SEQ ID NO: 602887 - protein, 5 aa, Mycobacterium
TTHTQ

SEQ ID NO: 602888 - protein, 5 aa, Mycobacterium
TTIAR

SEQ ID NO: 602889 - protein, 12 aa, Mycobacterium
TTIDGSAAARAA

SEQ ID NO: 602890 - protein, 13 aa, Mycobacterium
TTIGAGTAEIQRN

SEQ ID NO: 602891 - protein, 12 aa, Mycobacterium
TTIGDEDHSGID

SEQ ID NO: 602892 - protein, 9 aa, Mycobacterium
TTIGDQPLG

SEQ ID NO: 602893 - protein, 5 aa, Mycobacterium
TTIGG

SEQ ID NO: 602894 - protein, 8 aa, Mycobacterium
TTIGPGVE

SEQ ID NO: 602895 - protein, 6 aa, Mycobacterium
TTIPGG

SEQ ID NO: 602896 - protein, 5 aa, Mycobacterium
TTIQP

SEQ ID NO: 602897 - protein, 15 aa, Mycobacterium
TTITAGRSPAVTTRS

SEQ ID NO: 602898 - protein, 12 aa, Mycobacterium
TTITNDGGITRA

SEQ ID NO: 602899 - protein, 15 aa, Mycobacterium
TTITSANTAAMGPTS

SEQ ID NO: 602900 - protein, 9 aa, Mycobacterium
TTIYGGTTE

SEQ ID NO: 602901 - protein, 10 aa, Mycobacterium
TTKAAADELP

SEQ ID NO: 602902 - protein, 9 aa, Mycobacterium
TTKAGQKCT

SEQ ID NO: 602903 - protein, 8 aa, Mycobacterium
TTKAGRRV

SEQ ID NO: 602904 - protein, 8 aa, Mycobacterium
TTKAKRDL

SEQ ID NO: 602905 - protein, 9 aa, Mycobacterium
TTKATAEQV

SEQ ID NO: 602906 - protein, 7 aa, Mycobacterium
TTKDTPS

SEQ ID NO: 602907 - protein, 4 aa, Mycobacterium
TTKE

SEQ ID NO: 602908 - protein, 5 aa, Mycobacterium
TTKER

SEQ ID NO: 602909 - protein, 5 aa, Mycobacterium
TTKET

SEQ ID NO: 602910 - protein, 6 aa, Mycobacterium
TTKGPA

SEQ ID NO: 602911 - protein, 9 aa, Mycobacterium
TTKGPKKQL

SEQ ID NO: 602912 - protein, 16 aa, Mycobacterium
TTKGVTTHPDREADEL

SEQ ID NO: 602913 - protein, 12 aa, Mycobacterium
TTKIEDKDGNLV

SEQ ID NO: 602914 - protein, 6 aa, Mycobacterium
TTKNTT

SEQ ID NO: 602915 - protein, 15 aa, Mycobacterium
TTKPAAGADPRSGRW

SEQ ID NO: 602916 - protein, 7 aa, Mycobacterium
TTKQERG

SEQ ID NO: 602917 - protein, 4 aa, Mycobacterium
TTKR

SEQ ID NO: 602918 - protein, 4 aa, Mycobacterium
TTKT

SEQ ID NO: 602919 - protein, 8 aa, Mycobacterium
TTKTHQGA

SEQ ID NO: 602920 - protein, 8 aa, Mycobacterium
TTKTQGRL

SEQ ID NO: 602921 - protein, 8 aa, Mycobacterium
TTKTSPRD

SEQ ID NO: 602922 - protein, 4 aa, Mycobacterium
TTKV

SEQ ID NO: 602923 - protein, 17 aa, Mycobacterium
TTLAASAAAATYAPEAH

SEQ ID NO: 602924 - protein, 16 aa, Mycobacterium
TTLAESGVTPSADRRE

SEQ ID NO: 602925 - protein, 24 aa, Mycobacterium
TTLAGNTAKYGAGSAESASPAGRE

SEQ ID NO: 602926 - protein, 4 aa, Mycobacterium
TTLD

SEQ ID NO: 602927 - protein, 7 aa, Mycobacterium
TTLDPTA

SEQ ID NO: 602928 - protein, 10 aa, Mycobacterium
TTLEQQAQSG

SEQ ID NO: 602929 - protein, 4 aa, Mycobacterium
TTLG

SEQ ID NO: 602930 - protein, 7 aa, Mycobacterium
TTLGEGP

SEQ ID NO: 602931 - protein, 6 aa, Mycobacterium
TTLGPG

SEQ ID NO: 602932 - protein, 8 aa, Mycobacterium
TTLNPDGT

SEQ ID NO: 602933 - protein, 4 aa, Mycobacterium
TTLP

SEQ ID NO: 602934 - protein, 6 aa, Mycobacterium
TTLPAE

SEQ ID NO: 602935 - protein, 16 aa, Mycobacterium
TTLPAGDAGGAGMPGM

SEQ ID NO: 602936 - protein, 18 aa, Mycobacterium
TTLPGDPNEMDTPVTGPT

SEQ ID NO: 602937 - protein, 18 aa, Mycobacterium
TTLPPGLTDRQAAAVTTA

SEQ ID NO: 602938 - protein, 8 aa, Mycobacterium
TTLPRPYD

SEQ ID NO: 602939 - protein, 6 aa, Mycobacterium
TTLPTS

SEQ ID NO: 602940 - protein, 9 aa, Mycobacterium
TTLRDRKGL

SEQ ID NO: 602941 - protein, 9 aa, Mycobacterium
TTLSATQSA

SEQ ID NO: 602942 - protein, 12 aa, Mycobacterium
TTLSDSSASSSA

SEQ ID NO: 602943 - protein, 10 aa, Mycobacterium
TTLSGGERQR

SEQ ID NO: 602944 - protein, 12 aa, Mycobacterium
TTLSSSGKQREE

SEQ ID NO: 602945 - protein, 5 aa, Mycobacterium
TTLTA

SEQ ID NO: 602946 - protein, 8 aa, Mycobacterium
TTLTGGQL

SEQ ID NO: 602947 - protein, 8 aa, Mycobacterium
TTLTPQER

SEQ ID NO: 602948 - protein, 6 aa, Mycobacterium
TTMDPT

SEQ ID NO: 602949 - protein, 9 aa, Mycobacterium
TTMESRGSP

SEQ ID NO: 602950 - protein, 12 aa, Mycobacterium
TTMGAASGAKLD

SEQ ID NO: 602951 - protein, 17 aa, Mycobacterium
TTMRGRGGPNHTSRSAG

SEQ ID NO: 602952 - protein, 4 aa, Mycobacterium
TTMS

SEQ ID NO: 602953 - protein, 17 aa, Mycobacterium
TTMSAQNAAAAAPTTGV

SEQ ID NO: 602954 - protein, 5 aa, Mycobacterium
TTMST

SEQ ID NO: 602955 - protein, 10 aa, Mycobacterium
TTNADSRGVE

SEQ ID NO: 602956 - protein, 7 aa, Mycobacterium
TTNAKEA

SEQ ID NO: 602957 - protein, 13 aa, Mycobacterium
TTNATSVMSGYFW

SEQ ID NO: 602958 - protein, 4 aa, Mycobacterium
TTND

SEQ ID NO: 602959 - protein, 10 aa, Mycobacterium
TTNDENHTHT

SEQ ID NO: 602960 - protein, 7 aa, Mycobacterium
TTNDREW

SEQ ID NO: 602961 - protein, 15 aa, Mycobacterium
TTNDYVKEYQRNGAT

SEQ ID NO: 602962 - protein, 7 aa, Mycobacterium
TTNEERA

SEQ ID NO: 602963 - protein, 7 aa, Mycobacterium
TTNGQHA

SEQ ID NO: 602964 - protein, 9 aa, Mycobacterium
TTNGRPQIT

SEQ ID NO: 602965 - protein, 10 aa, Mycobacterium
TTNGRPTLGP

SEQ ID NO: 602966 - protein, 7 aa, Mycobacterium
TTNGTEI

SEQ ID NO: 602967 - protein, 5 aa, Mycobacterium
TTNNP

SEQ ID NO: 602968 - protein, 9 aa, Mycobacterium
TTNPQLAGS

SEQ ID NO: 602969 - protein, 5 aa, Mycobacterium
TTNPS

SEQ ID NO: 602970 - protein, 11 aa, Mycobacterium
TTNPVGSTGDG

SEQ ID NO: 602971 - protein, 12 aa, Mycobacterium
TTNQPRRGGSLN

SEQ ID NO: 602972 - protein, 11 aa, Mycobacterium
TTNRPGARFGP

SEQ ID NO: 602973 - protein, 10 aa, Mycobacterium
TTNSEEQALN

SEQ ID NO: 602974 - protein, 6 aa, Mycobacterium
TTNSPL

SEQ ID NO: 602975 - protein, 10 aa, Mycobacterium
TTNTEEQALD

SEQ ID NO: 602976 - protein, 30 aa, Mycobacterium
TTNTEEQARARAGLPGSTEDKGAQAAAAAL

SEQ ID NO: 602977 - protein, 10 aa, Mycobacterium
TTNTEQQALD

SEQ ID NO: 602978 - protein, 15 aa, Mycobacterium
TTNTGEPETTRGEAE

SEQ ID NO: 602979 - protein, 6 aa, Mycobacterium
TTNTPG

SEQ ID NO: 602980 - protein, 5 aa, Mycobacterium
TTPAA

SEQ ID NO: 602981 - protein, 12 aa, Mycobacterium
TTPAAVNSSLQR

SEQ ID NO: 602982 - protein, 13 aa, Mycobacterium
TTPAAVNSSLQRA

SEQ ID NO: 602983 - protein, 8 aa, Mycobacterium
TTPADDTH

SEQ ID NO: 602984 - protein, 9 aa, Mycobacterium
TTPAEAGSV

SEQ ID NO: 602985 - protein, 7 aa, Mycobacterium
TTPAEDD

SEQ ID NO: 602986 - protein, 8 aa, Mycobacterium
TTPAGAGA

SEQ ID NO: 602987 - protein, 7 aa, Mycobacterium
TTPAGDA

SEQ ID NO: 602988 - protein, 16 aa, Mycobacterium
TTPAGFDRREGELETP

SEQ ID NO: 602989 - protein, 19 aa, Mycobacterium
TTPAGGGGVSSMGSGVGGG

SEQ ID NO: 602990 - protein, 9 aa, Mycobacterium
TTPAGREHP

SEQ ID NO: 602991 - protein, 8 aa, Mycobacterium
TTPAGTAV

SEQ ID NO: 602992 - protein, 5 aa, Mycobacterium
TTPAH

SEQ ID NO: 602993 - protein, 11 aa, Mycobacterium
TTPAPEPAEGE

SEQ ID NO: 602994 - protein, 16 aa, Mycobacterium
TTPAPPPAHPLPAPEA

SEQ ID NO: 602995 - protein, 11 aa, Mycobacterium
TTPAPTSGPLR

SEQ ID NO: 602996 - protein, 7 aa, Mycobacterium
TTPAPVR

SEQ ID NO: 602997 - protein, 5 aa, Mycobacterium
TTPAR

SEQ ID NO: 602998 - protein, 17 aa, Mycobacterium
TTPARFARRDRTESGDS

SEQ ID NO: 602999 - protein, 6 aa, Mycobacterium
TTPART

SEQ ID NO: 603000 - protein, 8 aa, Mycobacterium
TTPATGEM

SEQ ID NO: 603001 - protein, 6 aa, Mycobacterium
TTPATL

SEQ ID NO: 603002 - protein, 6 aa, Mycobacterium
TTPATT

SEQ ID NO: 603003 - protein, 14 aa, Mycobacterium
TTPATVATDDRLSH

SEQ ID NO: 603004 - protein, 23 aa, Mycobacterium
TTPATVDPEWDRPGDSVTSDHDF

SEQ ID NO: 603005 - protein, 9 aa, Mycobacterium
TTPDADGDF

SEQ ID NO: 603006 - protein, 12 aa, Mycobacterium
TTPDAIDNSHER

SEQ ID NO: 603007 - protein, 5 aa, Mycobacterium
TTPDD

SEQ ID NO: 603008 - protein, 5 aa, Mycobacterium
TTPDF

SEQ ID NO: 603009 - protein, 13 aa, Mycobacterium
TTPDFDQARAEAA

SEQ ID NO: 603010 - protein, 5 aa, Mycobacterium
TTPDG

SEQ ID NO: 603011 - protein, 17 aa, Mycobacterium
TTPDGDYQTYKANDGSY

SEQ ID NO: 603012 - protein, 12 aa, Mycobacterium
TTPDGKGELTLP

SEQ ID NO: 603013 - protein, 7 aa, Mycobacterium
TTPDGVP

SEQ ID NO: 603014 - protein, 13 aa, Mycobacterium
TTPDKAATTDERI

SEQ ID NO: 603015 - protein, 6 aa, Mycobacterium
TTPDNA

SEQ ID NO: 603016 - protein, 15 aa, Mycobacterium
TTPDRLRKETGCTSL

SEQ ID NO: 603017 - protein, 5 aa, Mycobacterium
TTPEA

SEQ ID NO: 603018 - protein, 11 aa, Mycobacterium
TTPEAAARTEA

SEQ ID NO: 603019 - protein, 9 aa, Mycobacterium
TTPEAATDA

SEQ ID NO: 603020 - protein, 10 aa, Mycobacterium
TTPEAREAVG

SEQ ID NO: 603021 - protein, 5 aa, Mycobacterium
TTPED

SEQ ID NO: 603022 - protein, 6 aa, Mycobacterium
TTPEDF

SEQ ID NO: 603023 - protein, 9 aa, Mycobacterium
TTPEDGRAV

SEQ ID NO: 603024 - protein, 10 aa, Mycobacterium
TTPEETGSIH

SEQ ID NO: 603025 - protein, 7 aa, Mycobacterium
TTPEGAQ

SEQ ID NO: 603026 - protein, 24 aa, Mycobacterium
TTPEGKTLATAGKGPAVTVTGAPG

SEQ ID NO: 603027 - protein, 10 aa, Mycobacterium
TTPEHTAKAR

SEQ ID NO: 603028 - protein, 12 aa, Mycobacterium
TTPEHTAKAREL

SEQ ID NO: 603029 - protein, 5 aa, Mycobacterium
TTPEI

SEQ ID NO: 603030 - protein, 9 aa, Mycobacterium
TTPENAQPH

SEQ ID NO: 603031 - protein, 13 aa, Mycobacterium
TTPEPRGVGTTRT

SEQ ID NO: 603032 - protein, 14 aa, Mycobacterium
TTPEPRPPAVDASR

SEQ ID NO: 603033 - protein, 12 aa, Mycobacterium
TTPEQADRTIAE

SEQ ID NO: 603034 - protein, 6 aa, Mycobacterium
TTPEQK

SEQ ID NO: 603035 - protein, 7 aa, Mycobacterium
TTPESSL

SEQ ID NO: 603036 - protein, 5 aa, Mycobacterium
TTPET

SEQ ID NO: 603037 - protein, 6 aa, Mycobacterium
TTPETY

SEQ ID NO: 603038 - protein, 6 aa, Mycobacterium
TTPEVD

SEQ ID NO: 603039 - protein, 15 aa, Mycobacterium
TTPFAAGRTPNAVDQ

SEQ ID NO: 603040 - protein, 5 aa, Mycobacterium
TTPFP

SEQ ID NO: 603041 - protein, 18 aa, Mycobacterium
TTPFSPGDAAQLRTDPGA

SEQ ID NO: 603042 - protein, 24 aa, Mycobacterium
TTPGAAGDDGGVGRNVAFSVGGVA

SEQ ID NO: 603043 - protein, 9 aa, Mycobacterium
TTPGAEPAA

SEQ ID NO: 603044 - protein, 10 aa, Mycobacterium
TTPGAPAPGL

SEQ ID NO: 603045 - protein, 21 aa, Mycobacterium
TTPGARDEQADTIANWIADRW

SEQ ID NO: 603046 - protein, 20 aa, Mycobacterium
TTPGARSEKADTIAKWITRR

SEQ ID NO: 603047 - protein, 21 aa, Mycobacterium
TTPGARSEQADTIARWIAKRW

SEQ ID NO: 603048 - protein, 6 aa, Mycobacterium
TTPGFH

SEQ ID NO: 603049 - protein, 8 aa, Mycobacterium
TTPGKQTP

SEQ ID NO: 603050 - protein, 17 aa, Mycobacterium
TTPGLDGFASSTELAEK

SEQ ID NO: 603051 - protein, 9 aa, Mycobacterium
TTPGPGPGQ

SEQ ID NO: 603052 - protein, 8 aa, Mycobacterium
TTPGPGSF

SEQ ID NO: 603053 - protein, 7 aa, Mycobacterium
TTPGPIR

SEQ ID NO: 603054 - protein, 7 aa, Mycobacterium
TTPGPQS

SEQ ID NO: 603055 - protein, 8 aa, Mycobacterium
TTPGPQSC

SEQ ID NO: 603056 - protein, 8 aa, Mycobacterium
TTPGPVAG

SEQ ID NO: 603057 - protein, 7 aa, Mycobacterium
TTPGQQS

SEQ ID NO: 603058 - protein, 6 aa, Mycobacterium
TTPGRP

SEQ ID NO: 603059 - protein, 7 aa, Mycobacterium
TTPGRST

SEQ ID NO: 603060 - protein, 6 aa, Mycobacterium
TTPGRT

SEQ ID NO: 603061 - protein, 6 aa, Mycobacterium
TTPGRW

SEQ ID NO: 603062 - protein, 7 aa, Mycobacterium
TTPGTDQ

SEQ ID NO: 603063 - protein, 6 aa, Mycobacterium
TTPGTF

SEQ ID NO: 603064 - protein, 9 aa, Mycobacterium
TTPGVDRPL

SEQ ID NO: 603065 - protein, 7 aa, Mycobacterium
TTPGVTP

SEQ ID NO: 603066 - protein, 5 aa, Mycobacterium
TTPHP

SEQ ID NO: 603067 - protein, 10 aa, Mycobacterium
TTPHPSAPDW

SEQ ID NO: 603068 - protein, 12 aa, Mycobacterium
TTPIAKASNTLI

SEQ ID NO: 603069 - protein, 10 aa, Mycobacterium
TTPIDGSGLS

SEQ ID NO: 603070 - protein, 12 aa, Mycobacterium
TTPIDKASNTLI

SEQ ID NO: 603071 - protein, 8 aa, Mycobacterium
TTPIEKAS

SEQ ID NO: 603072 - protein, 13 aa, Mycobacterium
TTPIGKSSNTLIP

SEQ ID NO: 603073 - protein, 5 aa, Mycobacterium
TTPIT

SEQ ID NO: 603074 - protein, 12 aa, Mycobacterium
TTPKAPTGVRGD

SEQ ID NO: 603075 - protein, 9 aa, Mycobacterium
TTPKAPVGV

SEQ ID NO: 603076 - protein, 5 aa, Mycobacterium
TTPKM

SEQ ID NO: 603077 - protein, 10 aa, Mycobacterium
TTPKSDAGVR

SEQ ID NO: 603078 - protein, 6 aa, Mycobacterium
TTPKVE

SEQ ID NO: 603079 - protein, 9 aa, Mycobacterium
TTPLDGDGL

SEQ ID NO: 603080 - protein, 12 aa, Mycobacterium
TTPLKADKAEWE

SEQ ID NO: 603081 - protein, 18 aa, Mycobacterium
TTPLPGAGMPRRYTHRAC

SEQ ID NO: 603082 - protein, 6 aa, Mycobacterium
TTPLTR

SEQ ID NO: 603083 - protein, 9 aa, Mycobacterium
TTPLTRPHR

SEQ ID NO: 603084 - protein, 14 aa, Mycobacterium
TTPMPPTSNSPQAV

SEQ ID NO: 603085 - protein, 5 aa, Mycobacterium
TTPMR

SEQ ID NO: 603086 - protein, 7 aa, Mycobacterium
TTPMRPD

SEQ ID NO: 603087 - protein, 4 aa, Mycobacterium
TTPN

SEQ ID NO: 603088 - protein, 7 aa, Mycobacterium
TTPPATL

SEQ ID NO: 603089 - protein, 7 aa, Mycobacterium
TTPPEFS

SEQ ID NO: 603090 - protein, 7 aa, Mycobacterium
TTPPEVA

SEQ ID NO: 603091 - protein, 18 aa, Mycobacterium
TTPPFAGSPGGKWAGNIS

SEQ ID NO: 603092 - protein, 7 aa, Mycobacterium
TTPPGSA

SEQ ID NO: 603093 - protein, 6 aa, Mycobacterium
TTPPIS

SEQ ID NO: 603094 - protein, 10 aa, Mycobacterium
TTPPKDGEPY

SEQ ID NO: 603095 - protein, 5 aa, Mycobacterium
TTPPL

SEQ ID NO: 603096 - protein, 8 aa, Mycobacterium
TTPPLPEI

SEQ ID NO: 603097 - protein, 6 aa, Mycobacterium
TTPPNF

SEQ ID NO: 603098 - protein, 6 aa, Mycobacterium
TTPPPA

SEQ ID NO: 603099 - protein, 17 aa, Mycobacterium
TTPPPAPAAPGGGRAQA

SEQ ID NO: 603100 - protein, 17 aa, Mycobacterium
TTPPPGGTAEQHLSTKP

SEQ ID NO: 603101 - protein, 9 aa, Mycobacterium
TTPPQVPWP

SEQ ID NO: 603102 - protein, 9 aa, Mycobacterium
TTPPSGGEL

SEQ ID NO: 603103 - protein, 9 aa, Mycobacterium
TTPPTGRGA

SEQ ID NO: 603104 - protein, 7 aa, Mycobacterium
TTPPVPC

SEQ ID NO: 603105 - protein, 4 aa, Mycobacterium
TTPQ

SEQ ID NO: 603106 - protein, 5 aa, Mycobacterium
TTPQI

SEQ ID NO: 603107 - protein, 9 aa, Mycobacterium
TTPQPGAAE

SEQ ID NO: 603108 - protein, 4 aa, Mycobacterium
TTPR

SEQ ID NO: 603109 - protein, 5 aa, Mycobacterium
TTPRD

SEQ ID NO: 603110 - protein, 10 aa, Mycobacterium
TTPRDAAATV

SEQ ID NO: 603111 - protein, 20 aa, Mycobacterium
TTPRERRDRNGCGDGADTGR

SEQ ID NO: 603112 - protein, 5 aa, Mycobacterium
TTPRM

SEQ ID NO: 603113 - protein, 6 aa, Mycobacterium
TTPRQS

SEQ ID NO: 603114 - protein, 8 aa, Mycobacterium
TTPRRRAD

SEQ ID NO: 603115 - protein, 18 aa, Mycobacterium
TTPRSDDPPAAETAPPTL

SEQ ID NO: 603116 - protein, 19 aa, Mycobacterium
TTPRSPGSATDADSGAATD

SEQ ID NO: 603117 - protein, 4 aa, Mycobacterium
TTPS

SEQ ID NO: 603118 - protein, 9 aa, Mycobacterium
TTPSAEEPK

SEQ ID NO: 603119 - protein, 10 aa, Mycobacterium
TTPSDPEARL

SEQ ID NO: 603120 - protein, 9 aa, Mycobacterium
TTPSDPEER

SEQ ID NO: 603121 - protein, 12 aa, Mycobacterium
TTPSDYRSAFTG

SEQ ID NO: 603122 - protein, 6 aa, Mycobacterium
TTPSGR

SEQ ID NO: 603123 - protein, 24 aa, Mycobacterium
TTPSKLRTELPRKECPAPEPIPGA

SEQ ID NO: 603124 - protein, 5 aa, Mycobacterium
TTPSL

SEQ ID NO: 603125 - protein, 7 aa, Mycobacterium
TTPSLGE

SEQ ID NO: 603126 - protein, 6 aa, Mycobacterium
TTPSNA

SEQ ID NO: 603127 - protein, 15 aa, Mycobacterium
TTPSQLREDTGCTSL

SEQ ID NO: 603128 - protein, 5 aa, Mycobacterium
TTPSR

SEQ ID NO: 603129 - protein, 6 aa, Mycobacterium
TTPSSH

SEQ ID NO: 603130 - protein, 42 aa, Mycobacterium
TTPTAMAAGPAGTSGAPGTAGTGFAGTTGMAEDPARAAGTAI

SEQ ID NO: 603131 - protein, 13 aa, Mycobacterium
TTPTATWPPVPYP

SEQ ID NO: 603132 - protein, 6 aa, Mycobacterium
TTPTED

SEQ ID NO: 603133 - protein, 19 aa, Mycobacterium
TTPTGKSYRSAAPPRAPTI

SEQ ID NO: 603134 - protein, 15 aa, Mycobacterium
TTPTGTAYRSTAPPL

SEQ ID NO: 603135 - protein, 7 aa, Mycobacterium
TTPTTMP

SEQ ID NO: 603136 - protein, 15 aa, Mycobacterium
TTPTYKPEDLANGAS

SEQ ID NO: 603137 - protein, 4 aa, Mycobacterium
TTPV

SEQ ID NO: 603138 - protein, 16 aa, Mycobacterium
TTPVAQPISPNSPQVA

SEQ ID NO: 603139 - protein, 5 aa, Mycobacterium
TTPVD

SEQ ID NO: 603140 - protein, 7 aa, Mycobacterium
TTPVEPY

SEQ ID NO: 603141 - protein, 7 aa, Mycobacterium
TTPVGPR

SEQ ID NO: 603142 - protein, 6 aa, Mycobacterium
TTPVPV

SEQ ID NO: 603143 - protein, 9 aa, Mycobacterium
TTPWPTDEN

SEQ ID NO: 603144 - protein, 14 aa, Mycobacterium
TTPWPTGVTHPSNT

SEQ ID NO: 603145 - protein, 4 aa, Mycobacterium
TTQA

SEQ ID NO: 603146 - protein, 6 aa, Mycobacterium
TTQAAL

SEQ ID NO: 603147 - protein, 6 aa, Mycobacterium
TTQAAT

SEQ ID NO: 603148 - protein, 6 aa, Mycobacterium
TTQAGD

SEQ ID NO: 603149 - protein, 8 aa, Mycobacterium
TTQAGGIR

SEQ ID NO: 603150 - protein, 7 aa, Mycobacterium
TTQAGTI

SEQ ID NO: 603151 - protein, 7 aa, Mycobacterium
TTQAGTV

SEQ ID NO: 603152 - protein, 7 aa, Mycobacterium
TTQAHPA

SEQ ID NO: 603153 - protein, 6 aa, Mycobacterium
TTQAQA

SEQ ID NO: 603154 - protein, 5 aa, Mycobacterium
TTQDL

SEQ ID NO: 603155 - protein, 5 aa, Mycobacterium
TTQDN

SEQ ID NO: 603156 - protein, 8 aa, Mycobacterium
TTQEERAQ

SEQ ID NO: 603157 - protein, 6 aa, Mycobacterium
TTQEGI

SEQ ID NO: 603158 - protein, 10 aa, Mycobacterium
TTQEGINDEM

SEQ ID NO: 603159 - protein, 8 aa, Mycobacterium
TTQFPAES

SEQ ID NO: 603160 - protein, 4 aa, Mycobacterium
TTQG

SEQ ID NO: 603161 - protein, 5 aa, Mycobacterium
TTQGG

SEQ ID NO: 603162 - protein, 5 aa, Mycobacterium
TTQNA

SEQ ID NO: 603163 - protein, 7 aa, Mycobacterium
TTQNATY

SEQ ID NO: 603164 - protein, 15 aa, Mycobacterium
TTQPGSKSQQNTQRQ

SEQ ID NO: 603165 - protein, 7 aa, Mycobacterium
TTQPNTA

SEQ ID NO: 603166 - protein, 16 aa, Mycobacterium
TTQPPGRGAADPSKTI

SEQ ID NO: 603167 - protein, 7 aa, Mycobacterium
TTQPTGF

SEQ ID NO: 603168 - protein, 19 aa, Mycobacterium
TTQQAAAREAIEAGADGLE

SEQ ID NO: 603169 - protein, 4 aa, Mycobacterium
TTQR

SEQ ID NO: 603170 - protein, 6 aa, Mycobacterium
TTQSKI

SEQ ID NO: 603171 - protein, 8 aa, Mycobacterium
TTQSQGAY

SEQ ID NO: 603172 - protein, 8 aa, Mycobacterium
TTQSRSDE

SEQ ID NO: 603173 - protein, 7 aa, Mycobacterium
TTQSTPT

SEQ ID NO: 603174 - protein, 13 aa, Mycobacterium
TTQTGSPGDTSHE

SEQ ID NO: 603175 - protein, 6 aa, Mycobacterium
TTQTPL

SEQ ID NO: 603176 - protein, 5 aa, Mycobacterium
TTQTR

SEQ ID NO: 603177 - protein, 8 aa, Mycobacterium
TTQVREQG

SEQ ID NO: 603178 - protein, 6 aa, Mycobacterium
TTRAEL

SEQ ID NO: 603179 - protein, 12 aa, Mycobacterium
TTRAFDQPRAEA

SEQ ID NO: 603180 - protein, 16 aa, Mycobacterium
TTRAKWATGKGNADKR

SEQ ID NO: 603181 - protein, 5 aa, Mycobacterium
TTRAN

SEQ ID NO: 603182 - protein, 6 aa, Mycobacterium
TTRAPF

SEQ ID NO: 603183 - protein, 11 aa, Mycobacterium
TTRAPRPGEVD

SEQ ID NO: 603184 - protein, 15 aa, Mycobacterium
TTRASIERKILGELE

SEQ ID NO: 603185 - protein, 8 aa, Mycobacterium
TTRATRVE

SEQ ID NO: 603186 - protein, 13 aa, Mycobacterium
TTRAVAGSGPLTR

SEQ ID NO: 603187 - protein, 10 aa, Mycobacterium
TTRDESVEVR

SEQ ID NO: 603188 - protein, 6 aa, Mycobacterium
TTRDGA

SEQ ID NO: 603189 - protein, 7 aa, Mycobacterium
TTRDPKT

SEQ ID NO: 603190 - protein, 9 aa, Mycobacterium
TTRDSSIAA

SEQ ID NO: 603191 - protein, 5 aa, Mycobacterium
TTRDV

SEQ ID NO: 603192 - protein, 4 aa, Mycobacterium
TTRE

SEQ ID NO: 603193 - protein, 9 aa, Mycobacterium
TTREAQDLT

SEQ ID NO: 603194 - protein, 7 aa, Mycobacterium
TTREERA

SEQ ID NO: 603195 - protein, 9 aa, Mycobacterium
TTRELASRT

SEQ ID NO: 603196 - protein, 7 aa, Mycobacterium
TTREPGA

SEQ ID NO: 603197 - protein, 6 aa, Mycobacterium
TTRERR

SEQ ID NO: 603198 - protein, 5 aa, Mycobacterium
TTRET

SEQ ID NO: 603199 - protein, 6 aa, Mycobacterium
TTREVN

SEQ ID NO: 603200 - protein, 4 aa, Mycobacterium
TTRF

SEQ ID NO: 603201 - protein, 6 aa, Mycobacterium
TTRFGD

SEQ ID NO: 603202 - protein, 10 aa, Mycobacterium
TTRGAKKQQG

SEQ ID NO: 603203 - protein, 13 aa, Mycobacterium
TTRGDLPGAADYA

SEQ ID NO: 603204 - protein, 10 aa, Mycobacterium
TTRGGQDSGD

SEQ ID NO: 603205 - protein, 7 aa, Mycobacterium
TTRGGTI

SEQ ID NO: 603206 - protein, 7 aa, Mycobacterium
TTRGRGD

SEQ ID NO: 603207 - protein, 7 aa, Mycobacterium
TTRGTLQ

SEQ ID NO: 603208 - protein, 6 aa, Mycobacterium
TTRHGS

SEQ ID NO: 603209 - protein, 9 aa, Mycobacterium
TTRHSLRTD

SEQ ID NO: 603210 - protein, 6 aa, Mycobacterium
TTRIRT

SEQ ID NO: 603211 - protein, 9 aa, Mycobacterium
TTRKPEQFT

SEQ ID NO: 603212 - protein, 13 aa, Mycobacterium
TTRKRKDGTTEWI

SEQ ID NO: 603213 - protein, 10 aa, Mycobacterium
TTRKRRSDGI

SEQ ID NO: 603214 - protein, 11 aa, Mycobacterium
TTRKRWPNGRV

SEQ ID NO: 603215 - protein, 4 aa, Mycobacterium
TTRL

SEQ ID NO: 603216 - protein, 9 aa, Mycobacterium
TTRLPAQSV

SEQ ID NO: 603217 - protein, 5 aa, Mycobacterium
TTRNQ

SEQ ID NO: 603218 - protein, 14 aa, Mycobacterium
TTRNSAGTGLQGVT

SEQ ID NO: 603219 - protein, 6 aa, Mycobacterium
TTRNTK

SEQ ID NO: 603220 - protein, 4 aa, Mycobacterium
TTRP

SEQ ID NO: 603221 - protein, 5 aa, Mycobacterium
TTRPA

SEQ ID NO: 603222 - protein, 6 aa, Mycobacterium
TTRPAL

SEQ ID NO: 603223 - protein, 12 aa, Mycobacterium
TTRPAPPQPLSP

SEQ ID NO: 603224 - protein, 13 aa, Mycobacterium
TTRPGNSGGPIVA

SEQ ID NO: 603225 - protein, 5 aa, Mycobacterium
TTRPI

SEQ ID NO: 603226 - protein, 5 aa, Mycobacterium
TTRPP

SEQ ID NO: 603227 - protein, 14 aa, Mycobacterium
TTRPPLGPGTAAKY

SEQ ID NO: 603228 - protein, 9 aa, Mycobacterium
TTRPPSQEW

SEQ ID NO: 603229 - protein, 22 aa, Mycobacterium
TTRPQRVTEAADAVSSPPDAET

SEQ ID NO: 603230 - protein, 6 aa, Mycobacterium
TTRPRE

SEQ ID NO: 603231 - protein, 7 aa, Mycobacterium
TTRPRES

SEQ ID NO: 603232 - protein, 10 aa, Mycobacterium
TTRPSVTGGT

SEQ ID NO: 603233 - protein, 22 aa, Mycobacterium
TTRPTASSASLPTPTADSPAID

SEQ ID NO: 603234 - protein, 13 aa, Mycobacterium
TTRPVGDGTSSGA

SEQ ID NO: 603235 - protein, 7 aa, Mycobacterium
TTRPVTG

SEQ ID NO: 603236 - protein, 4 aa, Mycobacterium
TTRR

SEQ ID NO: 603237 - protein, 11 aa, Mycobacterium
TTRRDKLAGDR

SEQ ID NO: 603238 - protein, 7 aa, Mycobacterium
TTRRDNP

SEQ ID NO: 603239 - protein, 5 aa, Mycobacterium
TTRRG

SEQ ID NO: 603240 - protein, 6 aa, Mycobacterium
TTRRGA

SEQ ID NO: 603241 - protein, 9 aa, Mycobacterium
TTRRGEGLA

SEQ ID NO: 603242 - protein, 6 aa, Mycobacterium
TTRRGP

SEQ ID NO: 603243 - protein, 9 aa, Mycobacterium
TTRRGSALG

SEQ ID NO: 603244 - protein, 7 aa, Mycobacterium
TTRRPAL

SEQ ID NO: 603245 - protein, 6 aa, Mycobacterium
TTRRPR

SEQ ID NO: 603246 - protein, 10 aa, Mycobacterium
TTRRQAATTS

SEQ ID NO: 603247 - protein, 16 aa, Mycobacterium
TTRRRIRNDPAETRLT

SEQ ID NO: 603248 - protein, 6 aa, Mycobacterium
TTRRRK

SEQ ID NO: 603249 - protein, 5 aa, Mycobacterium
TTRRT

SEQ ID NO: 603250 - protein, 7 aa, Mycobacterium
TTRSARP

SEQ ID NO: 603251 - protein, 10 aa, Mycobacterium
TTRSGALTGP

SEQ ID NO: 603252 - protein, 12 aa, Mycobacterium
TTRSGRSERAAQ

SEQ ID NO: 603253 - protein, 9 aa, Mycobacterium
TTRSKGGLA

SEQ ID NO: 603254 - protein, 6 aa, Mycobacterium
TTRSTA

SEQ ID NO: 603255 - protein, 10 aa, Mycobacterium
TTRSTKQSGT

SEQ ID NO: 603256 - protein, 5 aa, Mycobacterium
TTRSV

SEQ ID NO: 603257 - protein, 4 aa, Mycobacterium
TTRT

SEQ ID NO: 603258 - protein, 8 aa, Mycobacterium
TTRTDERL

SEQ ID NO: 603259 - protein, 10 aa, Mycobacterium
TTRTDKKQRG

SEQ ID NO: 603260 - protein, 7 aa, Mycobacterium
TTRTEGR

SEQ ID NO: 603261 - protein, 12 aa, Mycobacterium
TTRTPEDAEDAL

SEQ ID NO: 603262 - protein, 7 aa, Mycobacterium
TTRTTRA

SEQ ID NO: 603263 - protein, 8 aa, Mycobacterium
TTRTTRAR

SEQ ID NO: 603264 - protein, 5 aa, Mycobacterium
TTRTW

SEQ ID NO: 603265 - protein, 4 aa, Mycobacterium
TTRV

SEQ ID NO: 603266 - protein, 10 aa, Mycobacterium
TTRVGRPSDL

SEQ ID NO: 603267 - protein, 11 aa, Mycobacterium
TTRVGSGPFPT

SEQ ID NO: 603268 - protein, 5 aa, Mycobacterium
TTRYE

SEQ ID NO: 603269 - protein, 6 aa, Mycobacterium
TTSAAA

SEQ ID NO: 603270 - protein, 10 aa, Mycobacterium
TTSAAPTAAS

SEQ ID NO: 603271 - protein, 7 aa, Mycobacterium
TTSADDE

SEQ ID NO: 603272 - protein, 111 aa, Mycobacterium
TTSADGPAPNGQMEPTARHDGLTSETDSRTLRDTDQDSIDRASNKPDADVRAEPSHSWRDDTDQQRGDDRGYSDDDGPRENAVGPDGRYKISGHGDYHSGDGTFTVPADTS

SEQ ID NO: 603273 - protein, 19 aa, Mycobacterium
TTSAENAAAKRPAAGGRYP

SEQ ID NO: 603274 - protein, 13 aa, Mycobacterium
TTSASGDGSLPIA

SEQ ID NO: 603275 - protein, 12 aa, Mycobacterium
TTSATLEGGAEP

SEQ ID NO: 603276 - protein, 12 aa, Mycobacterium
TTSAVGAATAKA

SEQ ID NO: 603277 - protein, 6 aa, Mycobacterium
TTSDGP

SEQ ID NO: 603278 - protein, 7 aa, Mycobacterium
TTSDKAL

SEQ ID NO: 603279 - protein, 5 aa, Mycobacterium
TTSDL

SEQ ID NO: 603280 - protein, 10 aa, Mycobacterium
TTSDQGRADL

SEQ ID NO: 603281 - protein, 9 aa, Mycobacterium
TTSDSAEGV

SEQ ID NO: 603282 - protein, 20 aa, Mycobacterium
TTSEGGISVPSKARVQSDPI

SEQ ID NO: 603283 - protein, 9 aa, Mycobacterium
TTSEQGRAD

SEQ ID NO: 603284 - protein, 6 aa, Mycobacterium
TTSFSD

SEQ ID NO: 603285 - protein, 6 aa, Mycobacterium
TTSGAG

SEQ ID NO: 603286 - protein, 7 aa, Mycobacterium
TTSGDGE

SEQ ID NO: 603287 - protein, 5 aa, Mycobacterium
TTSGE

SEQ ID NO: 603288 - protein, 7 aa, Mycobacterium
TTSGGGA

SEQ ID NO: 603289 - protein, 17 aa, Mycobacterium
TTSGKLDKRALPTPDAL

SEQ ID NO: 603290 - protein, 5 aa, Mycobacterium
TTSGL

SEQ ID NO: 603291 - protein, 7 aa, Mycobacterium
TTSGPFG

SEQ ID NO: 603292 - protein, 8 aa, Mycobacterium
TTSGPNNL

SEQ ID NO: 603293 - protein, 12 aa, Mycobacterium
TTSGRKTGLARG

SEQ ID NO: 603294 - protein, 12 aa, Mycobacterium
TTSGRKTGLART

SEQ ID NO: 603295 - protein, 7 aa, Mycobacterium
TTSGRPC

SEQ ID NO: 603296 - protein, 8 aa, Mycobacterium
TTSGRPHR

SEQ ID NO: 603297 - protein, 9 aa, Mycobacterium
TTSGTSGEP

SEQ ID NO: 603298 - protein, 13 aa, Mycobacterium
TTSHPDPAIPPEC

SEQ ID NO: 603299 - protein, 4 aa, Mycobacterium
TTSI

SEQ ID NO: 603300 - protein, 10 aa, Mycobacterium
TTSIAPDIEG

SEQ ID NO: 603301 - protein, 67 aa, Mycobacterium
TTSIGDANGGNGGSGADGGAGVTGGTGGVGGFANNEGSGDANGGFGGTGGNGGAPGASGGEGGTGGV

SEQ ID NO: 603302 - protein, 10 aa, Mycobacterium
TTSIREGSRL

SEQ ID NO: 603303 - protein, 8 aa, Mycobacterium
TTSKLDDE

SEQ ID NO: 603304 - protein, 8 aa, Mycobacterium
TTSKLDDQ

SEQ ID NO: 603305 - protein, 18 aa, Mycobacterium
TTSKVKAHDENGDAGVGD

SEQ ID NO: 603306 - protein, 8 aa, Mycobacterium
TTSLPEDI

SEQ ID NO: 603307 - protein, 13 aa, Mycobacterium
TTSLPETPQGERN

SEQ ID NO: 603308 - protein, 6 aa, Mycobacterium
TTSLPG

SEQ ID NO: 603309 - protein, 6 aa, Mycobacterium
TTSMTS

SEQ ID NO: 603310 - protein, 13 aa, Mycobacterium
TTSNARRVYGLAA

SEQ ID NO: 603311 - protein, 7 aa, Mycobacterium
TTSNGEV

SEQ ID NO: 603312 - protein, 9 aa, Mycobacterium
TTSNPLHPA

SEQ ID NO: 603313 - protein, 9 aa, Mycobacterium
TTSNPLQPD

SEQ ID NO: 603314 - protein, 20 aa, Mycobacterium
TTSNPLQPDADPVPIGTPIP

SEQ ID NO: 603315 - protein, 8 aa, Mycobacterium
TTSNSFTA

SEQ ID NO: 603316 - protein, 8 aa, Mycobacterium
TTSPAPID

SEQ ID NO: 603317 - protein, 8 aa, Mycobacterium
TTSPERPE

SEQ ID NO: 603318 - protein, 8 aa, Mycobacterium
TTSPLGPR

SEQ ID NO: 603319 - protein, 9 aa, Mycobacterium
TTSPQHQRT

SEQ ID NO: 603320 - protein, 13 aa, Mycobacterium
TTSPQPQRSIGEV

SEQ ID NO: 603321 - protein, 7 aa, Mycobacterium
TTSPTSV

SEQ ID NO: 603322 - protein, 5 aa, Mycobacterium
TTSQL

SEQ ID NO: 603323 - protein, 7 aa, Mycobacterium
TTSQPVR

SEQ ID NO: 603324 - protein, 15 aa, Mycobacterium
TTSQSPRVDEGRPDA

SEQ ID NO: 603325 - protein, 11 aa, Mycobacterium
TTSRKKPPFGI

SEQ ID NO: 603326 - protein, 8 aa, Mycobacterium
TTSRLDDS

SEQ ID NO: 603327 - protein, 10 aa, Mycobacterium
TTSRQKPPFG

SEQ ID NO: 603328 - protein, 7 aa, Mycobacterium
TTSRQLA

SEQ ID NO: 603329 - protein, 5 aa, Mycobacterium
TTSRR

SEQ ID NO: 603330 - protein, 6 aa, Mycobacterium
TTSRRR

SEQ ID NO: 603331 - protein, 6 aa, Mycobacterium
TTSRTR

SEQ ID NO: 603332 - protein, 40 aa, Mycobacterium
TTSSDGADVATGVTASGAGPVAATTAASARTVTPAGVGAT

SEQ ID NO: 603333 - protein, 8 aa, Mycobacterium
TTSSPVRD

SEQ ID NO: 603334 - protein, 9 aa, Mycobacterium
TTSSSERAS

SEQ ID NO: 603335 - protein, 11 aa, Mycobacterium
TTSTAPRPHLD

SEQ ID NO: 603336 - protein, 9 aa, Mycobacterium
TTSTERDSQ

SEQ ID NO: 603337 - protein, 8 aa, Mycobacterium
TTSTKDLK

SEQ ID NO: 603338 - protein, 12 aa, Mycobacterium
TTSTNPSPRRAV

SEQ ID NO: 603339 - protein, 22 aa, Mycobacterium
TTSTQGPSHSPKRERRRRGSIT

SEQ ID NO: 603340 - protein, 12 aa, Mycobacterium
TTSTQVTQAYTA

SEQ ID NO: 603341 - protein, 5 aa, Mycobacterium
TTSTR

SEQ ID NO: 603342 - protein, 6 aa, Mycobacterium
TTSTRD

SEQ ID NO: 603343 - protein, 13 aa, Mycobacterium
TTSTRQSRKGAIS

SEQ ID NO: 603344 - protein, 20 aa, Mycobacterium
TTSTSVGGTRAALEIVYRVE

SEQ ID NO: 603345 - protein, 5 aa, Mycobacterium
TTSTT

SEQ ID NO: 603346 - protein, 9 aa, Mycobacterium
TTSTTNTTV

SEQ ID NO: 603347 - protein, 6 aa, Mycobacterium
TTSVGG

SEQ ID NO: 603348 - protein, 14 aa, Mycobacterium
TTSYPDPATSPQCA

SEQ ID NO: 603349 - protein, 10 aa, Mycobacterium
TTSYSATQGW

SEQ ID NO: 603350 - protein, 6 aa, Mycobacterium
TTTAAE

SEQ ID NO: 603351 - protein, 8 aa, Mycobacterium
TTTAAQAK

SEQ ID NO: 603352 - protein, 7 aa, Mycobacterium
TTTAARA

SEQ ID NO: 603353 - protein, 15 aa, Mycobacterium
TTTADPSRSPAGTES

SEQ ID NO: 603354 - protein, 14 aa, Mycobacterium
TTTADPTRSPIGTE

SEQ ID NO: 603355 - protein, 15 aa, Mycobacterium
TTTADPTRSPPGTES

SEQ ID NO: 603356 - protein, 6 aa, Mycobacterium
TTTAEA

SEQ ID NO: 603357 - protein, 5 aa, Mycobacterium
TTTAH

SEQ ID NO: 603358 - protein, 6 aa, Mycobacterium
TTTAKA

SEQ ID NO: 603359 - protein, 6 aa, Mycobacterium
TTTAKE

SEQ ID NO: 603360 - protein, 10 aa, Mycobacterium
TTTAPDEKWH

SEQ ID NO: 603361 - protein, 9 aa, Mycobacterium
TTTAPDERY

SEQ ID NO: 603362 - protein, 10 aa, Mycobacterium
TTTAPGEKMH

SEQ ID NO: 603363 - protein, 9 aa, Mycobacterium
TTTAPGERR

SEQ ID NO: 603364 - protein, 10 aa, Mycobacterium
TTTAPPEKIR

SEQ ID NO: 603365 - protein, 10 aa, Mycobacterium
TTTAPPGAYN

SEQ ID NO: 603366 - protein, 9 aa, Mycobacterium
TTTAQSRDF

SEQ ID NO: 603367 - protein, 9 aa, Mycobacterium
TTTARAEGN

SEQ ID NO: 603368 - protein, 7 aa, Mycobacterium
TTTARTK

SEQ ID NO: 603369 - protein, 10 aa, Mycobacterium
TTTASGEKWH

SEQ ID NO: 603370 - protein, 12 aa, Mycobacterium
TTTASRAGTARA

SEQ ID NO: 603371 - protein, 15 aa, Mycobacterium
TTTATAATDDRPITS

SEQ ID NO: 603372 - protein, 6 aa, Mycobacterium
TTTATP

SEQ ID NO: 603373 - protein, 8 aa, Mycobacterium
TTTATRVG

SEQ ID NO: 603374 - protein, 6 aa, Mycobacterium
TTTDAQ

SEQ ID NO: 603375 - protein, 6 aa, Mycobacterium
TTTDEM

SEQ ID NO: 603376 - protein, 6 aa, Mycobacterium
TTTDEQ

SEQ ID NO: 603377 - protein, 15 aa, Mycobacterium
TTTDETPSTSASRYQ

SEQ ID NO: 603378 - protein, 6 aa, Mycobacterium
TTTDHK

SEQ ID NO: 603379 - protein, 5 aa, Mycobacterium
TTTDI

SEQ ID NO: 603380 - protein, 5 aa, Mycobacterium
TTTDL

SEQ ID NO: 603381 - protein, 6 aa, Mycobacterium
TTTDLD

SEQ ID NO: 603382 - protein, 14 aa, Mycobacterium
TTTDPAVAQSPTFA

SEQ ID NO: 603383 - protein, 9 aa, Mycobacterium
TTTDRDESQ

SEQ ID NO: 603384 - protein, 6 aa, Mycobacterium
TTTDRG

SEQ ID NO: 603385 - protein, 9 aa, Mycobacterium
TTTDRRVTE

SEQ ID NO: 603386 - protein, 5 aa, Mycobacterium
TTTEA

SEQ ID NO: 603387 - protein, 12 aa, Mycobacterium
TTTEAQSAALSQ

SEQ ID NO: 603388 - protein, 6 aa, Mycobacterium
TTTEEM

SEQ ID NO: 603389 - protein, 8 aa, Mycobacterium
TTTEEVEI

SEQ ID NO: 603390 - protein, 8 aa, Mycobacterium
TTTELGDD

SEQ ID NO: 603391 - protein, 11 aa, Mycobacterium
TTTEPGPSDVA

SEQ ID NO: 603392 - protein, 7 aa, Mycobacterium
TTTEQSD

SEQ ID NO: 603393 - protein, 7 aa, Mycobacterium
TTTERAT

SEQ ID NO: 603394 - protein, 6 aa, Mycobacterium
TTTERL

SEQ ID NO: 603395 - protein, 16 aa, Mycobacterium
TTTESSGTGMAGPEAV

SEQ ID NO: 603396 - protein, 6 aa, Mycobacterium
TTTEVG

SEQ ID NO: 603397 - protein, 5 aa, Mycobacterium
TTTFA

SEQ ID NO: 603398 - protein, 5 aa, Mycobacterium
TTTFK

SEQ ID NO: 603399 - protein, 18 aa, Mycobacterium
TTTGDLPPTPTPATTVGD

SEQ ID NO: 603400 - protein, 5 aa, Mycobacterium
TTTGG

SEQ ID NO: 603401 - protein, 9 aa, Mycobacterium
TTTGGGGID

SEQ ID NO: 603402 - protein, 16 aa, Mycobacterium
TTTGGGYPKGDEMYLA

SEQ ID NO: 603403 - protein, 6 aa, Mycobacterium
TTTGIQ

SEQ ID NO: 603404 - protein, 6 aa, Mycobacterium
TTTGLR

SEQ ID NO: 603405 - protein, 14 aa, Mycobacterium
TTTGRKSDQPRTTA

SEQ ID NO: 603406 - protein, 14 aa, Mycobacterium
TTTGRKSNRPRTTA

SEQ ID NO: 603407 - protein, 10 aa, Mycobacterium
TTTGSAGQSY

SEQ ID NO: 603408 - protein, 10 aa, Mycobacterium
TTTGTDSPVV

SEQ ID NO: 603409 - protein, 7 aa, Mycobacterium
TTTGYNS

SEQ ID NO: 603410 - protein, 20 aa, Mycobacterium
TTTHGQLSPAEQVASGVTPG

SEQ ID NO: 603411 - protein, 12 aa, Mycobacterium
TTTHKSLRGPRG

SEQ ID NO: 603412 - protein, 5 aa, Mycobacterium
TTTHP

SEQ ID NO: 603413 - protein, 8 aa, Mycobacterium
TTTKTHDV

SEQ ID NO: 603414 - protein, 4 aa, Mycobacterium
TTTL

SEQ ID NO: 603415 - protein, 17 aa, Mycobacterium
TTTLDDVRSGEYRPGRF

SEQ ID NO: 603416 - protein, 5 aa, Mycobacterium
TTTLG

SEQ ID NO: 603417 - protein, 11 aa, Mycobacterium
TTTLGRASTPV

SEQ ID NO: 603418 - protein, 12 aa, Mycobacterium
TTTLQARRAARN

SEQ ID NO: 603419 - protein, 5 aa, Mycobacterium
TTTLS

SEQ ID NO: 603420 - protein, 4 aa, Mycobacterium
TTTM

SEQ ID NO: 603421 - protein, 16 aa, Mycobacterium
TTTNHSNDGGAPMTPD

SEQ ID NO: 603422 - protein, 6 aa, Mycobacterium
TTTNPN

SEQ ID NO: 603423 - protein, 17 aa, Mycobacterium
TTTNTPYNTRQFQVNAN

SEQ ID NO: 603424 - protein, 6 aa, Mycobacterium
TTTPDT

SEQ ID NO: 603425 - protein, 6 aa, Mycobacterium
TTTPDW

SEQ ID NO: 603426 - protein, 6 aa, Mycobacterium
TTTPEF

SEQ ID NO: 603427 - protein, 8 aa, Mycobacterium
TTTPEYRI

SEQ ID NO: 603428 - protein, 5 aa, Mycobacterium
TTTPG

SEQ ID NO: 603429 - protein, 13 aa, Mycobacterium
TTTPGPVSDYTGQ

SEQ ID NO: 603430 - protein, 5 aa, Mycobacterium
TTTPL

SEQ ID NO: 603431 - protein, 7 aa, Mycobacterium
TTTPLPL

SEQ ID NO: 603432 - protein, 10 aa, Mycobacterium
TTTPPSSASE

SEQ ID NO: 603433 - protein, 10 aa, Mycobacterium
TTTPPSSETA

SEQ ID NO: 603434 - protein, 9 aa, Mycobacterium
TTTPPTSES

SEQ ID NO: 603435 - protein, 21 aa, Mycobacterium
TTTPQPPTPRPHTPTPPDQHH

SEQ ID NO: 603436 - protein, 11 aa, Mycobacterium
TTTPRKPNSAL

SEQ ID NO: 603437 - protein, 13 aa, Mycobacterium
TTTPSRGAETAEA

SEQ ID NO: 603438 - protein, 11 aa, Mycobacterium
TTTPSTPEDPL

SEQ ID NO: 603439 - protein, 4 aa, Mycobacterium
TTTQ

SEQ ID NO: 603440 - protein, 13 aa, Mycobacterium
TTTQARQLVAESV

SEQ ID NO: 603441 - protein, 7 aa, Mycobacterium
TTTQDVD

SEQ ID NO: 603442 - protein, 13 aa, Mycobacterium
TTTQHSPAHATGV

SEQ ID NO: 603443 - protein, 7 aa, Mycobacterium
TTTQTPM

SEQ ID NO: 603444 - protein, 18 aa, Mycobacterium
TTTQTPMVQPTGSDDVPD

SEQ ID NO: 603445 - protein, 4 aa, Mycobacterium
TTTR

SEQ ID NO: 603446 - protein, 16 aa, Mycobacterium
TTTRRQATTTNTETFT

SEQ ID NO: 603447 - protein, 9 aa, Mycobacterium
TTTRSSGRP

SEQ ID NO: 603448 - protein, 8 aa, Mycobacterium
TTTRVGGP

SEQ ID NO: 603449 - protein, 13 aa, Mycobacterium
TTTSAHDSRPPIS

SEQ ID NO: 603450 - protein, 19 aa, Mycobacterium
TTTSALPPPPPRSDSGQRG

SEQ ID NO: 603451 - protein, 7 aa, Mycobacterium
TTTSGAI

SEQ ID NO: 603452 - protein, 8 aa, Mycobacterium
TTTSLPEP

SEQ ID NO: 603453 - protein, 13 aa, Mycobacterium
TTTSLSEASGMTR

SEQ ID NO: 603454 - protein, 10 aa, Mycobacterium
TTTSPEGARE

SEQ ID NO: 603455 - protein, 13 aa, Mycobacterium
TTTSQTDLDDLLT

SEQ ID NO: 603456 - protein, 5 aa, Mycobacterium
TTTTA

SEQ ID NO: 603457 - protein, 17 aa, Mycobacterium
TTTTAAESPSAAASRYQ

SEQ ID NO: 603458 - protein, 6 aa, Mycobacterium
TTTTAD

SEQ ID NO: 603459 - protein, 11 aa, Mycobacterium
TTTTASGERQK

SEQ ID NO: 603460 - protein, 6 aa, Mycobacterium
TTTTEH

SEQ ID NO: 603461 - protein, 14 aa, Mycobacterium
TTTTEPSRYLGPDK

SEQ ID NO: 603462 - protein, 9 aa, Mycobacterium
TTTTGADGK

SEQ ID NO: 603463 - protein, 7 aa, Mycobacterium
TTTTGRA

SEQ ID NO: 603464 - protein, 11 aa, Mycobacterium
TTTTLETADGQ

SEQ ID NO: 603465 - protein, 16 aa, Mycobacterium
TTTTPPPPRPAGTAPV

SEQ ID NO: 603466 - protein, 21 aa, Mycobacterium
TTTTPTPPRPQSPSPPRPGRN

SEQ ID NO: 603467 - protein, 18 aa, Mycobacterium
TTTTTLPPPPPRATSPAR

SEQ ID NO: 603468 - protein, 28 aa, Mycobacterium
TTTTTPATAPRREPPRSCAPPPPKEARC

SEQ ID NO: 603469 - protein, 9 aa, Mycobacterium
TTTTTTTQQ

SEQ ID NO: 603470 - protein, 6 aa, Mycobacterium
TTTTTY

SEQ ID NO: 603471 - protein, 5 aa, Mycobacterium
TTTTV

SEQ ID NO: 603472 - protein, 4 aa, Mycobacterium
TTTV

SEQ ID NO: 603473 - protein, 5 aa, Mycobacterium
TTTVE

SEQ ID NO: 603474 - protein, 5 aa, Mycobacterium
TTTVS

SEQ ID NO: 603475 - protein, 4 aa, Mycobacterium
TTTW

SEQ ID NO: 603476 - protein, 4 aa, Mycobacterium
TTTY

SEQ ID NO: 603477 - protein, 5 aa, Mycobacterium
TTTYP

SEQ ID NO: 603478 - protein, 8 aa, Mycobacterium
TTTYSAET

SEQ ID NO: 603479 - protein, 4 aa, Mycobacterium
TTVA

SEQ ID NO: 603480 - protein, 5 aa, Mycobacterium
TTVAA

SEQ ID NO: 603481 - protein, 14 aa, Mycobacterium
TTVAAEEEAARNAG

SEQ ID NO: 603482 - protein, 6 aa, Mycobacterium
TTVADG

SEQ ID NO: 603483 - protein, 9 aa, Mycobacterium
TTVAENPRE

SEQ ID NO: 603484 - protein, 20 aa, Mycobacterium
TTVAGAGDCAPPADAIEAAL

SEQ ID NO: 603485 - protein, 9 aa, Mycobacterium
TTVAPDENV

SEQ ID NO: 603486 - protein, 6 aa, Mycobacterium
TTVARQ

SEQ ID NO: 603487 - protein, 9 aa, Mycobacterium
TTVASGEWE

SEQ ID NO: 603488 - protein, 13 aa, Mycobacterium
TTVDDSRERRLRT

SEQ ID NO: 603489 - protein, 7 aa, Mycobacterium
TTVDEGS

SEQ ID NO: 603490 - protein, 12 aa, Mycobacterium
TTVDGERRLDEA

SEQ ID NO: 603491 - protein, 9 aa, Mycobacterium
TTVDGETST

SEQ ID NO: 603492 - protein, 9 aa, Mycobacterium
TTVDSPAET

SEQ ID NO: 603493 - protein, 7 aa, Mycobacterium
TTVEADE

SEQ ID NO: 603494 - protein, 13 aa, Mycobacterium
TTVEGSAANAATA

SEQ ID NO: 603495 - protein, 4 aa, Mycobacterium
TTVG

SEQ ID NO: 603496 - protein, 9 aa, Mycobacterium
TTVGAQPAQ

SEQ ID NO: 603497 - protein, 11 aa, Mycobacterium
TTVGDEDPDFA

SEQ ID NO: 603498 - protein, 12 aa, Mycobacterium
TTVHGKSGSLTL

SEQ ID NO: 603499 - protein, 5 aa, Mycobacterium
TTVKK

SEQ ID NO: 603500 - protein, 4 aa, Mycobacterium
TTVP

SEQ ID NO: 603501 - protein, 7 aa, Mycobacterium
TTVPAAP

SEQ ID NO: 603502 - protein, 14 aa, Mycobacterium
TTVPDDRSPDPAHA

SEQ ID NO: 603503 - protein, 6 aa, Mycobacterium
TTVPDT

SEQ ID NO: 603504 - protein, 10 aa, Mycobacterium
TTVPGPDAEF

SEQ ID NO: 603505 - protein, 6 aa, Mycobacterium
TTVPPS

SEQ ID NO: 603506 - protein, 9 aa, Mycobacterium
TTVPRGPAG

SEQ ID NO: 603507 - protein, 6 aa, Mycobacterium
TTVQGS

SEQ ID NO: 603508 - protein, 9 aa, Mycobacterium
TTVQPGPLA

SEQ ID NO: 603509 - protein, 10 aa, Mycobacterium
TTVQPGPLGA

SEQ ID NO: 603510 - protein, 6 aa, Mycobacterium
TTVRDG

SEQ ID NO: 603511 - protein, 27 aa, Mycobacterium
TTVRQEPADTRTAPSGTLAATTKSKSL

SEQ ID NO: 603512 - protein, 6 aa, Mycobacterium
TTVSAG

SEQ ID NO: 603513 - protein, 9 aa, Mycobacterium
TTVSDSGLS

SEQ ID NO: 603514 - protein, 15 aa, Mycobacterium
TTVSQPSLHKGRRAG

SEQ ID NO: 603515 - protein, 5 aa, Mycobacterium
TTVST

SEQ ID NO: 603516 - protein, 6 aa, Mycobacterium
TTVSVD

SEQ ID NO: 603517 - protein, 17 aa, Mycobacterium
TTVTATRDATDATLKST

SEQ ID NO: 603518 - protein, 8 aa, Mycobacterium
TTVTDPSG

SEQ ID NO: 603519 - protein, 6 aa, Mycobacterium
TTVTMS

SEQ ID NO: 603520 - protein, 9 aa, Mycobacterium
TTVTPDDEA

SEQ ID NO: 603521 - protein, 5 aa, Mycobacterium
TTVTT

SEQ ID NO: 603522 - protein, 16 aa, Mycobacterium
TTVTVSATGDQDGDDL

SEQ ID NO: 603523 - protein, 4 aa, Mycobacterium
TTVV

SEQ ID NO: 603524 - protein, 14 aa, Mycobacterium
TTVVTGPNGAGKSA

SEQ ID NO: 603525 - protein, 4 aa, Mycobacterium
TTVY

SEQ ID NO: 603526 - protein, 36 aa, Mycobacterium
TTWATGTTGTGTTAGTGTTAGTRRPRSHGTGRRTRR

SEQ ID NO: 603527 - protein, 5 aa, Mycobacterium
TTWGE

SEQ ID NO: 603528 - protein, 10 aa, Mycobacterium
TTWRTSPSDV

SEQ ID NO: 603529 - protein, 5 aa, Mycobacterium
TTYAA

SEQ ID NO: 603530 - protein, 6 aa, Mycobacterium
TTYDSA

SEQ ID NO: 603531 - protein, 5 aa, Mycobacterium
TTYEP

SEQ ID NO: 603532 - protein, 5 aa, Mycobacterium
TTYES

SEQ ID NO: 603533 - protein, 6 aa, Mycobacterium
TTYESA

SEQ ID NO: 603534 - protein, 11 aa, Mycobacterium
TTYETPTDGEL

SEQ ID NO: 603535 - protein, 5 aa, Mycobacterium
TTYLS

SEQ ID NO: 603536 - protein, 13 aa, Mycobacterium
TTYNTSLDQAREG

SEQ ID NO: 603537 - protein, 5 aa, Mycobacterium
TTYPG

SEQ ID NO: 603538 - protein, 13 aa, Mycobacterium
TTYPGHGRTLDRQ

SEQ ID NO: 603539 - protein, 8 aa, Mycobacterium
TTYPNPPV

SEQ ID NO: 603540 - protein, 5 aa, Mycobacterium
TTYPQ

SEQ ID NO: 603541 - protein, 5 aa, Mycobacterium
TTYQQ

SEQ ID NO: 603542 - protein, 5 aa, Mycobacterium
TTYQR

SEQ ID NO: 603543 - protein, 6 aa, Mycobacterium
TTYSGQ

SEQ ID NO: 603544 - protein, 7 aa, Mycobacterium
TTYTERV

SEQ ID NO: 603545 - protein, 18 aa, Mycobacterium
TVAAEGGAGYCTRGNRGG

SEQ ID NO: 603546 - protein, 8 aa, Mycobacterium
TVAAETDV

SEQ ID NO: 603547 - protein, 11 aa, Mycobacterium
TVAANPAIADD

SEQ ID NO: 603548 - protein, 8 aa, Mycobacterium
TVAASARH

SEQ ID NO: 603549 - protein, 4 aa, Mycobacterium
TVAD

SEQ ID NO: 603550 - protein, 8 aa, Mycobacterium
TVADASPL

SEQ ID NO: 603551 - protein, 9 aa, Mycobacterium
TVADETPRI

SEQ ID NO: 603552 - protein, 11 aa, Mycobacterium
TVADGSTVLPP

SEQ ID NO: 603553 - protein, 10 aa, Mycobacterium
TVADNASSGA

SEQ ID NO: 603554 - protein, 14 aa, Mycobacterium
TVADPAATRAPDRV

SEQ ID NO: 603555 - protein, 5 aa, Mycobacterium
TVADT

SEQ ID NO: 603556 - protein, 17 aa, Mycobacterium
TVADTATFEQPRQPATG

SEQ ID NO: 603557 - protein, 5 aa, Mycobacterium
TVAEE

SEQ ID NO: 603558 - protein, 8 aa, Mycobacterium
TVAEEIGG

SEQ ID NO: 603559 - protein, 9 aa, Mycobacterium
TVAENPDLA

SEQ ID NO: 603560 - protein, 5 aa, Mycobacterium
TVAEP

SEQ ID NO: 603561 - protein, 6 aa, Mycobacterium
TVAEPG

SEQ ID NO: 603562 - protein, 14 aa, Mycobacterium
TVAEPTAPYAPNPL

SEQ ID NO: 603563 - protein, 17 aa, Mycobacterium
TVAEPTSFSGQPPPNPL

SEQ ID NO: 603564 - protein, 5 aa, Mycobacterium
TVAEQ

SEQ ID NO: 603565 - protein, 7 aa, Mycobacterium
TVAERER

SEQ ID NO: 603566 - protein, 5 aa, Mycobacterium
TVAGL

SEQ ID NO: 603567 - protein, 19 aa, Mycobacterium
TVAGPAPGAAALPPAGFPS

SEQ ID NO: 603568 - protein, 8 aa, Mycobacterium
TVAGPGLR

SEQ ID NO: 603569 - protein, 5 aa, Mycobacterium
TVAGR

SEQ ID NO: 603570 - protein, 14 aa, Mycobacterium
TVAGRGRHPLPSGR

SEQ ID NO: 603571 - protein, 10 aa, Mycobacterium
TVAGRPDDGC

SEQ ID NO: 603572 - protein, 12 aa, Mycobacterium
TVAGRRQRADEI

SEQ ID NO: 603573 - protein, 9 aa, Mycobacterium
TVAGTSEIA

SEQ ID NO: 603574 - protein, 5 aa, Mycobacterium
TVAGV

SEQ ID NO: 603575 - protein, 21 aa, Mycobacterium
TVAKTDPSASRPPRGEAPDRN

SEQ ID NO: 603576 - protein, 11 aa, Mycobacterium
TVANGKTPVPQ

SEQ ID NO: 603577 - protein, 8 aa, Mycobacterium
TVANGRVE

SEQ ID NO: 603578 - protein, 10 aa, Mycobacterium
TVAPDGSTRT

SEQ ID NO: 603579 - protein, 7 aa, Mycobacterium
TVAPEQS

SEQ ID NO: 603580 - protein, 8 aa, Mycobacterium
TVAPGADS

SEQ ID NO: 603581 - protein, 22 aa, Mycobacterium
TVAPGDLPAPAELAGLLAGPAA

SEQ ID NO: 603582 - protein, 7 aa, Mycobacterium
TVAPGRE

SEQ ID NO: 603583 - protein, 14 aa, Mycobacterium
TVAPNRRPYETKDG

SEQ ID NO: 603584 - protein, 13 aa, Mycobacterium
TVAPNRRPYHTSD

SEQ ID NO: 603585 - protein, 14 aa, Mycobacterium
TVAPNRRPYRTSDG

SEQ ID NO: 603586 - protein, 7 aa, Mycobacterium
TVAPPPE

SEQ ID NO: 603587 - protein, 10 aa, Mycobacterium
TVAPPPPRVD

SEQ ID NO: 603588 - protein, 7 aa, Mycobacterium
TVAPRAP

SEQ ID NO: 603589 - protein, 5 aa, Mycobacterium
TVAPS

SEQ ID NO: 603590 - protein, 11 aa, Mycobacterium
TVAPTDATEAT

SEQ ID NO: 603591 - protein, 13 aa, Mycobacterium
TVAPTDTAVRPGG

SEQ ID NO: 603592 - protein, 12 aa, Mycobacterium
TVAPYEAGRRGA

SEQ ID NO: 603593 - protein, 5 aa, Mycobacterium
TVAQT

SEQ ID NO: 603594 - protein, 22 aa, Mycobacterium
TVARATAEPPAQYRPAETLPGQ

SEQ ID NO: 603595 - protein, 14 aa, Mycobacterium
TVARDKRDKTGKHV

SEQ ID NO: 603596 - protein, 9 aa, Mycobacterium
TVARPDPST

SEQ ID NO: 603597 - protein, 17 aa, Mycobacterium
TVARYRPGSDESEPLAA

SEQ ID NO: 603598 - protein, 6 aa, Mycobacterium
TVASGG

SEQ ID NO: 603599 - protein, 6 aa, Mycobacterium
TVASGT

SEQ ID NO: 603600 - protein, 10 aa, Mycobacterium
TVASGTPTEL

SEQ ID NO: 603601 - protein, 7 aa, Mycobacterium
TVASTSE

SEQ ID NO: 603602 - protein, 9 aa, Mycobacterium
TVATPAGDE

SEQ ID NO: 603603 - protein, 5 aa, Mycobacterium
TVDAA

SEQ ID NO: 603604 - protein, 7 aa, Mycobacterium
TVDAAYR

SEQ ID NO: 603605 - protein, 10 aa, Mycobacterium
TVDADGRPRS

SEQ ID NO: 603606 - protein, 6 aa, Mycobacterium
TVDADP

SEQ ID NO: 603607 - protein, 7 aa, Mycobacterium
TVDAQTV

SEQ ID NO: 603608 - protein, 4 aa, Mycobacterium
TVDE

SEQ ID NO: 603609 - protein, 6 aa, Mycobacterium
TVDEAN

SEQ ID NO: 603610 - protein, 6 aa, Mycobacterium
TVDEDR

SEQ ID NO: 603611 - protein, 7 aa, Mycobacterium
TVDEGPF

SEQ ID NO: 603612 - protein, 6 aa, Mycobacterium
TVDEQT

SEQ ID NO: 603613 - protein, 12 aa, Mycobacterium
TVDESTDSDTPK

SEQ ID NO: 603614 - protein, 23 aa, Mycobacterium
TVDEYNRGIAGGAGDPAHKDPSL

SEQ ID NO: 603615 - protein, 4 aa, Mycobacterium
TVDG

SEQ ID NO: 603616 - protein, 5 aa, Mycobacterium
TVDGA

SEQ ID NO: 603617 - protein, 8 aa, Mycobacterium
TVDGAGTT

SEQ ID NO: 603618 - protein, 11 aa, Mycobacterium
TVDGDGPDEIY

SEQ ID NO: 603619 - protein, 8 aa, Mycobacterium
TVDGEEHH

SEQ ID NO: 603620 - protein, 10 aa, Mycobacterium
TVDGEQLTPE

SEQ ID NO: 603621 - protein, 7 aa, Mycobacterium
TVDGESV

SEQ ID NO: 603622 - protein, 5 aa, Mycobacterium
TVDGG

SEQ ID NO: 603623 - protein, 7 aa, Mycobacterium
TVDGGAP

SEQ ID NO: 603624 - protein, 5 aa, Mycobacterium
TVDGH

SEQ ID NO: 603625 - protein, 21 aa, Mycobacterium
TVDGKDVPEAKTEGLSHELGS

SEQ ID NO: 603626 - protein, 16 aa, Mycobacterium
TVDGKEVEEAATTGLS

SEQ ID NO: 603627 - protein, 22 aa, Mycobacterium
TVDGNEVPEAATEGLSHEVGSG

SEQ ID NO: 603628 - protein, 7 aa, Mycobacterium
TVDGPAV

SEQ ID NO: 603629 - protein, 12 aa, Mycobacterium
TVDGRRVAAGRD

SEQ ID NO: 603630 - protein, 13 aa, Mycobacterium
TVDGRRVATGRDF

SEQ ID NO: 603631 - protein, 11 aa, Mycobacterium
TVDGSGGIRGP

SEQ ID NO: 603632 - protein, 9 aa, Mycobacterium
TVDGSGTTI

SEQ ID NO: 603633 - protein, 5 aa, Mycobacterium
TVDIE

SEQ ID NO: 603634 - protein, 18 aa, Mycobacterium
TVDNSTARDRASGLRSSL

SEQ ID NO: 603635 - protein, 9 aa, Mycobacterium
TVDPAPQVD

SEQ ID NO: 603636 - protein, 12 aa, Mycobacterium
TVDPAQGSPFDT

SEQ ID NO: 603637 - protein, 10 aa, Mycobacterium
TVDPARQDGR

SEQ ID NO: 603638 - protein, 26 aa, Mycobacterium
TVDPDGPAAGTIGETADEVTAAGGQG

SEQ ID NO: 603639 - protein, 10 aa, Mycobacterium
TVDPDGPEPA

SEQ ID NO: 603640 - protein, 8 aa, Mycobacterium
TVDPDPNV

SEQ ID NO: 603641 - protein, 8 aa, Mycobacterium
TVDPEPCP

SEQ ID NO: 603642 - protein, 7 aa, Mycobacterium
TVDPGGN

SEQ ID NO: 603643 - protein, 13 aa, Mycobacterium
TVDPKPGEDDQLT

SEQ ID NO: 603644 - protein, 12 aa, Mycobacterium
TVDPNDRKPGTC

SEQ ID NO: 603645 - protein, 20 aa, Mycobacterium
TVDPNSSTTALAGSTEEGQF

SEQ ID NO: 603646 - protein, 20 aa, Mycobacterium
TVDPNTSTAALKGSTEEGQF

SEQ ID NO: 603647 - protein, 7 aa, Mycobacterium
TVDPPAP

SEQ ID NO: 603648 - protein, 20 aa, Mycobacterium
TVDPSSSTTALTGSTEEGQF

SEQ ID NO: 603649 - protein, 20 aa, Mycobacterium
TVDPTSSTTALTGSTEEGQF

SEQ ID NO: 603650 - protein, 8 aa, Mycobacterium
TVDRDGVG

SEQ ID NO: 603651 - protein, 8 aa, Mycobacterium
TVDREGVG

SEQ ID NO: 603652 - protein, 8 aa, Mycobacterium
TVDREGVT

SEQ ID NO: 603653 - protein, 9 aa, Mycobacterium
TVDREGVTG

SEQ ID NO: 603654 - protein, 13 aa, Mycobacterium
TVDRGGLSADDVA

SEQ ID NO: 603655 - protein, 6 aa, Mycobacterium
TVDRHR

SEQ ID NO: 603656 - protein, 5 aa, Mycobacterium
TVDSG

SEQ ID NO: 603657 - protein, 9 aa, Mycobacterium
TVDSGQSSS

SEQ ID NO: 603658 - protein, 6 aa, Mycobacterium
TVDSPE

SEQ ID NO: 603659 - protein, 8 aa, Mycobacterium
TVDSPTRI

SEQ ID NO: 603660 - protein, 11 aa, Mycobacterium
TVDSSQAGGTT

SEQ ID NO: 603661 - protein, 10 aa, Mycobacterium
TVDTADGPRL

SEQ ID NO: 603662 - protein, 16 aa, Mycobacterium
TVDTGDAPASRPGDRH

SEQ ID NO: 603663 - protein, 11 aa, Mycobacterium
TVDTGKTLAES

SEQ ID NO: 603664 - protein, 18 aa, Mycobacterium
TVDTPRTETNNKRGGNHN

SEQ ID NO: 603665 - protein, 11 aa, Mycobacterium
TVDTSTAAGRF

SEQ ID NO: 603666 - protein, 5 aa, Mycobacterium
TVEAA

SEQ ID NO: 603667 - protein, 5 aa, Mycobacterium
TVEAG

SEQ ID NO: 603668 - protein, 10 aa, Mycobacterium
TVEAGGKGIN

SEQ ID NO: 603669 - protein, 50 aa, Mycobacterium
TVEANQRAAESSIRNAEQQLKREKRQMQEARERAARRSSAAARNLKDAGL

SEQ ID NO: 603670 - protein, 8 aa, Mycobacterium
TVEDASPV

SEQ ID NO: 603671 - protein, 6 aa, Mycobacterium
TVEDDA

SEQ ID NO: 603672 - protein, 10 aa, Mycobacterium
TVEDENSDSN

SEQ ID NO: 603673 - protein, 6 aa, Mycobacterium
TVEDNG

SEQ ID NO: 603674 - protein, 17 aa, Mycobacterium
TVEDPDGTSVDLFAALD

SEQ ID NO: 603675 - protein, 6 aa, Mycobacterium
TVEDPE

SEQ ID NO: 603676 - protein, 7 aa, Mycobacterium
TVEDRTA

SEQ ID NO: 603677 - protein, 10 aa, Mycobacterium
TVEDSEVEAE

SEQ ID NO: 603678 - protein, 6 aa, Mycobacterium
TVEDTA

SEQ ID NO: 603679 - protein, 10 aa, Mycobacterium
TVEEASPAVR

SEQ ID NO: 603680 - protein, 5 aa, Mycobacterium
TVEEG

SEQ ID NO: 603681 - protein, 9 aa, Mycobacterium
TVEEQQKRA

SEQ ID NO: 603682 - protein, 4 aa, Mycobacterium
TVEG

SEQ ID NO: 603683 - protein, 11 aa, Mycobacterium
TVEGADAAQGA

SEQ ID NO: 603684 - protein, 8 aa, Mycobacterium
TVEGAQAN

SEQ ID NO: 603685 - protein, 9 aa, Mycobacterium
TVEGDASGF

SEQ ID NO: 603686 - protein, 17 aa, Mycobacterium
TVEGDGDRPAASPADST

SEQ ID NO: 603687 - protein, 15 aa, Mycobacterium
TVEGEANEESAVGAN

SEQ ID NO: 603688 - protein, 9 aa, Mycobacterium
TVEGPQLDG

SEQ ID NO: 603689 - protein, 8 aa, Mycobacterium
TVEGTTVR

SEQ ID NO: 603690 - protein, 5 aa, Mycobacterium
TVEGY

SEQ ID NO: 603691 - protein, 5 aa, Mycobacterium
TVEKA

SEQ ID NO: 603692 - protein, 14 aa, Mycobacterium
TVEKQTPAEPEPIP

SEQ ID NO: 603693 - protein, 12 aa, Mycobacterium
TVELTEDKTRPV

SEQ ID NO: 603694 - protein, 29 aa, Mycobacterium
TVEPASAPAGPALGADNGAVTRLIAGSRP

SEQ ID NO: 603695 - protein, 15 aa, Mycobacterium
TVEPATDGGGADTVT

SEQ ID NO: 603696 - protein, 10 aa, Mycobacterium
TVEPDPAGVR

SEQ ID NO: 603697 - protein, 6 aa, Mycobacterium
TVEPDT

SEQ ID NO: 603698 - protein, 9 aa, Mycobacterium
TVEPGGSFD

SEQ ID NO: 603699 - protein, 5 aa, Mycobacterium
TVEPP

SEQ ID NO: 603700 - protein, 10 aa, Mycobacterium
TVEPPPSELA

SEQ ID NO: 603701 - protein, 14 aa, Mycobacterium
TVEPQPAQISTGKS

SEQ ID NO: 603702 - protein, 10 aa, Mycobacterium
TVEPRKTTTA

SEQ ID NO: 603703 - protein, 10 aa, Mycobacterium
TVEPSQGAQD

SEQ ID NO: 603704 - protein, 9 aa, Mycobacterium
TVEPSTGSQ

SEQ ID NO: 603705 - protein, 5 aa, Mycobacterium
TVEQA

SEQ ID NO: 603706 - protein, 4 aa, Mycobacterium
TVER

SEQ ID NO: 603707 - protein, 13 aa, Mycobacterium
TVERPEKPGKAQG

SEQ ID NO: 603708 - protein, 12 aa, Mycobacterium
TVERRARVGAGA

SEQ ID NO: 603709 - protein, 19 aa, Mycobacterium
TVERSDDRLGQGGIPSDRV

SEQ ID NO: 603710 - protein, 6 aa, Mycobacterium
TVERYT

SEQ ID NO: 603711 - protein, 6 aa, Mycobacterium
TVESAG

SEQ ID NO: 603712 - protein, 11 aa, Mycobacterium
TVESEAPAAEV

SEQ ID NO: 603713 - protein, 8 aa, Mycobacterium
TVESGAGI

SEQ ID NO: 603714 - protein, 8 aa, Mycobacterium
TVESGASV

SEQ ID NO: 603715 - protein, 7 aa, Mycobacterium
TVESGDI

SEQ ID NO: 603716 - protein, 8 aa, Mycobacterium
TVESHPPH

SEQ ID NO: 603717 - protein, 8 aa, Mycobacterium
TVESRPVT

SEQ ID NO: 603718 - protein, 12 aa, Mycobacterium
TVESSGTGMADP

SEQ ID NO: 603719 - protein, 7 aa, Mycobacterium
TVESSPD

SEQ ID NO: 603720 - protein, 6 aa, Mycobacterium
TVETRD

SEQ ID NO: 603721 - protein, 5 aa, Mycobacterium
TVETT

SEQ ID NO: 603722 - protein, 12 aa, Mycobacterium
TVFESPKDALNA

SEQ ID NO: 603723 - protein, 5 aa, Mycobacterium
TVFPG

SEQ ID NO: 603724 - protein, 15 aa, Mycobacterium
TVGAAAESMAGPLAA

SEQ ID NO: 603725 - protein, 17 aa, Mycobacterium
TVGADEGGPRPDVATPG

SEQ ID NO: 603726 - protein, 5 aa, Mycobacterium
TVGAG

SEQ ID NO: 603727 - protein, 36 aa, Mycobacterium
TVGAGGAGAGAGGGPGRTTGSAVSAGSMAVGSPLPP

SEQ ID NO: 603728 - protein, 12 aa, Mycobacterium
TVGANTTPSLST

SEQ ID NO: 603729 - protein, 18 aa, Mycobacterium
TVGAPEAGALVDLSSLDA

SEQ ID NO: 603730 - protein, 11 aa, Mycobacterium
TVGAPGQGNYA

SEQ ID NO: 603731 - protein, 13 aa, Mycobacterium
TVGASKKDGQRAK

SEQ ID NO: 603732 - protein, 9 aa, Mycobacterium
TVGDETHSA

SEQ ID NO: 603733 - protein, 5 aa, Mycobacterium
TVGDG

SEQ ID NO: 603734 - protein, 12 aa, Mycobacterium
TVGDGEAGAPTL

SEQ ID NO: 603735 - protein, 6 aa, Mycobacterium
TVGDGP

SEQ ID NO: 603736 - protein, 7 aa, Mycobacterium
TVGDHDY

SEQ ID NO: 603737 - protein, 5 aa, Mycobacterium
TVGDM

SEQ ID NO: 603738 - protein, 7 aa, Mycobacterium
TVGDPDK

SEQ ID NO: 603739 - protein, 9 aa, Mycobacterium
TVGDQTAAD

SEQ ID NO: 603740 - protein, 4 aa, Mycobacterium
TVGE

SEQ ID NO: 603741 - protein, 7 aa, Mycobacterium
TVGEDPR

SEQ ID NO: 603742 - protein, 11 aa, Mycobacterium
TVGEEEGSTIH

SEQ ID NO: 603743 - protein, 14 aa, Mycobacterium
TVGELGKEAPTTHN

SEQ ID NO: 603744 - protein, 8 aa, Mycobacterium
TVGEPGNR

SEQ ID NO: 603745 - protein, 11 aa, Mycobacterium
TVGETHPQAAT

SEQ ID NO: 603746 - protein, 13 aa, Mycobacterium
TVGEVTRADASEE

SEQ ID NO: 603747 - protein, 7 aa, Mycobacterium
TVGGAEH

SEQ ID NO: 603748 - protein, 13 aa, Mycobacterium
TVGGAGAAPGSLV

SEQ ID NO: 603749 - protein, 19 aa, Mycobacterium
TVGGDNNTALAGDQSGGLA

SEQ ID NO: 603750 - protein, 12 aa, Mycobacterium
TVGGGNPSLTVS

SEQ ID NO: 603751 - protein, 6 aa, Mycobacterium
TVGGKG

SEQ ID NO: 603752 - protein, 13 aa, Mycobacterium
TVGGNTRVGPTLS

SEQ ID NO: 603753 - protein, 5 aa, Mycobacterium
TVGGP

SEQ ID NO: 603754 - protein, 11 aa, Mycobacterium
TVGGTGVGGTS

SEQ ID NO: 603755 - protein, 9 aa, Mycobacterium
TVGGTNNKI

SEQ ID NO: 603756 - protein, 5 aa, Mycobacterium
TVGKA

SEQ ID NO: 603757 - protein, 9 aa, Mycobacterium
TVGKTGRGI

SEQ ID NO: 603758 - protein, 25 aa, Mycobacterium
TVGNASSLHGSGRTARRRLEESRET

SEQ ID NO: 603759 - protein, 6 aa, Mycobacterium
TVGNPT

SEQ ID NO: 603760 - protein, 9 aa, Mycobacterium
TVGNPTAKA

SEQ ID NO: 603761 - protein, 9 aa, Mycobacterium
TVGNSAPAV

SEQ ID NO: 603762 - protein, 9 aa, Mycobacterium
TVGNSAPKV

SEQ ID NO: 603763 - protein, 9 aa, Mycobacterium
TVGNSSPRV

SEQ ID NO: 603764 - protein, 6 aa, Mycobacterium
TVGPAT

SEQ ID NO: 603765 - protein, 5 aa, Mycobacterium
TVGPE

SEQ ID NO: 603766 - protein, 7 aa, Mycobacterium
TVGPGEA

SEQ ID NO: 603767 - protein, 7 aa, Mycobacterium
TVGPPTV

SEQ ID NO: 603768 - protein, 10 aa, Mycobacterium
TVGPTDAPYG

SEQ ID NO: 603769 - protein, 7 aa, Mycobacterium
TVGPTST

SEQ ID NO: 603770 - protein, 5 aa, Mycobacterium
TVGQA

SEQ ID NO: 603771 - protein, 5 aa, Mycobacterium
TVGQG

SEQ ID NO: 603772 - protein, 14 aa, Mycobacterium
TVGRNGGSGVSDRY

SEQ ID NO: 603773 - protein, 13 aa, Mycobacterium
TVGRNGGSGVSSR

SEQ ID NO: 603774 - protein, 9 aa, Mycobacterium
TVGRPEGTC

SEQ ID NO: 603775 - protein, 19 aa, Mycobacterium
TVGRQAAGRKAIGNTGSEI

SEQ ID NO: 603776 - protein, 5 aa, Mycobacterium
TVGRR

SEQ ID NO: 603777 - protein, 6 aa, Mycobacterium
TVGRRG

SEQ ID NO: 603778 - protein, 13 aa, Mycobacterium
TVGRRRGRVATED

SEQ ID NO: 603779 - protein, 10 aa, Mycobacterium
TVGRTNAPRG

SEQ ID NO: 603780 - protein, 13 aa, Mycobacterium
TVGSDSAVQRSSH

SEQ ID NO: 603781 - protein, 6 aa, Mycobacterium
TVGSKS

SEQ ID NO: 603782 - protein, 12 aa, Mycobacterium
TVGSPGQGNYSA

SEQ ID NO: 603783 - protein, 6 aa, Mycobacterium
TVGSSE

SEQ ID NO: 603784 - protein, 12 aa, Mycobacterium
TVGSSGQANYAA

SEQ ID NO: 603785 - protein, 6 aa, Mycobacterium
TVGSSP

SEQ ID NO: 603786 - protein, 8 aa, Mycobacterium
TVGTGDEE

SEQ ID NO: 603787 - protein, 15 aa, Mycobacterium
TVGTKGWDGFAVALV

SEQ ID NO: 603788 - protein, 5 aa, Mycobacterium
TVGTR

SEQ ID NO: 603789 - protein, 8 aa, Mycobacterium
TVHGDGDL

SEQ ID NO: 603790 - protein, 5 aa, Mycobacterium
TVHGE

SEQ ID NO: 603791 - protein, 8 aa, Mycobacterium
TVHGGTST

SEQ ID NO: 603792 - protein, 10 aa, Mycobacterium
TVHGKSGSLT

SEQ ID NO: 603793 - protein, 5 aa, Mycobacterium
TVHGN

SEQ ID NO: 603794 - protein, 5 aa, Mycobacterium
TVHPH

SEQ ID NO: 603795 - protein, 14 aa, Mycobacterium
TVHPSPSTLTESGR

SEQ ID NO: 603796 - protein, 5 aa, Mycobacterium
TVHTR

SEQ ID NO: 603797 - protein, 9 aa, Mycobacterium
TVIGPGAKR

SEQ ID NO: 603798 - protein, 5 aa, Mycobacterium
TVITT

SEQ ID NO: 603799 - protein, 14 aa, Mycobacterium
TVKANKAGARDRAD

SEQ ID NO: 603800 - protein, 8 aa, Mycobacterium
TVKASPDR

SEQ ID NO: 603801 - protein, 9 aa, Mycobacterium
TVKDTTGQD

SEQ ID NO: 603802 - protein, 17 aa, Mycobacterium
TVKPAQSAEGASPEPSF

SEQ ID NO: 603803 - protein, 11 aa, Mycobacterium
TVKPEAQAAKD

SEQ ID NO: 603804 - protein, 11 aa, Mycobacterium
TVKPEGQAAKD

SEQ ID NO: 603805 - protein, 10 aa, Mycobacterium
TVKPEGVDSS

SEQ ID NO: 603806 - protein, 14 aa, Mycobacterium
TVKPKAQRNFTDPD

SEQ ID NO: 603807 - protein, 7 aa, Mycobacterium
TVKPQSC

SEQ ID NO: 603808 - protein, 16 aa, Mycobacterium
TVKSAAEKAGRDPDSV

SEQ ID NO: 603809 - protein, 16 aa, Mycobacterium
TVKTGQSLTSITPKRD

SEQ ID NO: 603810 - protein, 5 aa, Mycobacterium
TVLTD

SEQ ID NO: 603811 - protein, 8 aa, Mycobacterium
TVLTPQGD

SEQ ID NO: 603812 - protein, 5 aa, Mycobacterium
TVNAG

SEQ ID NO: 603813 - protein, 8 aa, Mycobacterium
TVNANATS

SEQ ID NO: 603814 - protein, 6 aa, Mycobacterium
TVNDAV

SEQ ID NO: 603815 - protein, 11 aa, Mycobacterium
TVNGEGATVAR

SEQ ID NO: 603816 - protein, 8 aa, Mycobacterium
TVNGGDDH

SEQ ID NO: 603817 - protein, 6 aa, Mycobacterium
TVNGTT

SEQ ID NO: 603818 - protein, 12 aa, Mycobacterium
TVNPDLPKSTKS

SEQ ID NO: 603819 - protein, 15 aa, Mycobacterium
TVNPDTPYGRPSAPI

SEQ ID NO: 603820 - protein, 7 aa, Mycobacterium
TVNPPAP

SEQ ID NO: 603821 - protein, 8 aa, Mycobacterium
TVNPPAPL

SEQ ID NO: 603822 - protein, 21 aa, Mycobacterium
TVNPSRSHTAGKLRGSPADGV

SEQ ID NO: 603823 - protein, 12 aa, Mycobacterium
TVNPTSGPPPAI

SEQ ID NO: 603824 - protein, 6 aa, Mycobacterium
TVNQGA

SEQ ID NO: 603825 - protein, 4 aa, Mycobacterium
TVNS

SEQ ID NO: 603826 - protein, 8 aa, Mycobacterium
TVNSQSQQ

SEQ ID NO: 603827 - protein, 32 aa, Mycobacterium
TVNTTDATGVTAGSPGTTCATDTTGSTGVESA

SEQ ID NO: 603828 - protein, 11 aa, Mycobacterium
TVPADEQTRAG

SEQ ID NO: 603829 - protein, 10 aa, Mycobacterium
TVPARRREWP

SEQ ID NO: 603830 - protein, 8 aa, Mycobacterium
TVPASDRE

SEQ ID NO: 603831 - protein, 12 aa, Mycobacterium
TVPAYGDTDTEG

SEQ ID NO: 603832 - protein, 53 aa, Mycobacterium
TVPDAKDVAAAGRGAGRVGGDRRHGSPQRGRGGWPPARCASSSAPGWRSPRAA

SEQ ID NO: 603833 - protein, 19 aa, Mycobacterium
TVPDAKDVGGTPGFGSSSA

SEQ ID NO: 603834 - protein, 5 aa, Mycobacterium
TVPDD

SEQ ID NO: 603835 - protein, 9 aa, Mycobacterium
TVPDPATIQ

SEQ ID NO: 603836 - protein, 9 aa, Mycobacterium
TVPDPTVES

SEQ ID NO: 603837 - protein, 9 aa, Mycobacterium
TVPDSATIA

SEQ ID NO: 603838 - protein, 7 aa, Mycobacterium
TVPDSQV

SEQ ID NO: 603839 - protein, 6 aa, Mycobacterium
TVPDTP

SEQ ID NO: 603840 - protein, 21 aa, Mycobacterium
TVPEAKDVTGIPGLGSSSALG

SEQ ID NO: 603841 - protein, 9 aa, Mycobacterium
TVPEDGGRF

SEQ ID NO: 603842 - protein, 5 aa, Mycobacterium
TVPEG

SEQ ID NO: 603843 - protein, 8 aa, Mycobacterium
TVPEPNAA

SEQ ID NO: 603844 - protein, 5 aa, Mycobacterium
TVPES

SEQ ID NO: 603845 - protein, 13 aa, Mycobacterium
TVPETGQAAEGPF

SEQ ID NO: 603846 - protein, 6 aa, Mycobacterium
TVPGAG

SEQ ID NO: 603847 - protein, 6 aa, Mycobacterium
TVPGAS

SEQ ID NO: 603848 - protein, 10 aa, Mycobacterium
TVPGDEPAAL

SEQ ID NO: 603849 - protein, 8 aa, Mycobacterium
TVPGDPSA

SEQ ID NO: 603850 - protein, 9 aa, Mycobacterium
TVPGDTAAQ

SEQ ID NO: 603851 - protein, 10 aa, Mycobacterium
TVPGDTAAQH

SEQ ID NO: 603852 - protein, 16 aa, Mycobacterium
TVPGGGPTMWQMWRQP

SEQ ID NO: 603853 - protein, 9 aa, Mycobacterium
TVPGGLSAA

SEQ ID NO: 603854 - protein, 16 aa, Mycobacterium
TVPGGLSAAARLADAT

SEQ ID NO: 603855 - protein, 12 aa, Mycobacterium
TVPGPIPAAGTG

SEQ ID NO: 603856 - protein, 7 aa, Mycobacterium
TVPGPPI

SEQ ID NO: 603857 - protein, 7 aa, Mycobacterium
TVPGRTR

SEQ ID NO: 603858 - protein, 12 aa, Mycobacterium
TVPGSKSQTNRT

SEQ ID NO: 603859 - protein, 5 aa, Mycobacterium
TVPGT

SEQ ID NO: 603860 - protein, 9 aa, Mycobacterium
TVPGTADRI

SEQ ID NO: 603861 - protein, 6 aa, Mycobacterium
TVPGVE

SEQ ID NO: 603862 - protein, 4 aa, Mycobacterium
TVPK

SEQ ID NO: 603863 - protein, 5 aa, Mycobacterium
TVPKG

SEQ ID NO: 603864 - protein, 7 aa, Mycobacterium
TVPLPEA

SEQ ID NO: 603865 - protein, 6 aa, Mycobacterium
TVPNSR

SEQ ID NO: 603866 - protein, 4 aa, Mycobacterium
TVPP

SEQ ID NO: 603867 - protein, 7 aa, Mycobacterium
TVPPAAV

SEQ ID NO: 603868 - protein, 14 aa, Mycobacterium
TVPPAGNLPSRLEN

SEQ ID NO: 603869 - protein, 18 aa, Mycobacterium
TVPPAQAYGEAGAGHQLS

SEQ ID NO: 603870 - protein, 5 aa, Mycobacterium
TVPPE

SEQ ID NO: 603871 - protein, 7 aa, Mycobacterium
TVPPFPD

SEQ ID NO: 603872 - protein, 6 aa, Mycobacterium
TVPPGV

SEQ ID NO: 603873 - protein, 5 aa, Mycobacterium
TVPPN

SEQ ID NO: 603874 - protein, 13 aa, Mycobacterium
TVPPNGGGPSLGQ

SEQ ID NO: 603875 - protein, 6 aa, Mycobacterium
TVPPNT

SEQ ID NO: 603876 - protein, 7 aa, Mycobacterium
TVPPPAI

SEQ ID NO: 603877 - protein, 9 aa, Mycobacterium
TVPPPAIAA

SEQ ID NO: 603878 - protein, 10 aa, Mycobacterium
TVPPPAVTAN

SEQ ID NO: 603879 - protein, 7 aa, Mycobacterium
TVPPPEI

SEQ ID NO: 603880 - protein, 10 aa, Mycobacterium
TVPPPEQARA

SEQ ID NO: 603881 - protein, 8 aa, Mycobacterium
TVPPPEVA

SEQ ID NO: 603882 - protein, 7 aa, Mycobacterium
TVPPPPI

SEQ ID NO: 603883 - protein, 7 aa, Mycobacterium
TVPPPQI

SEQ ID NO: 603884 - protein, 8 aa, Mycobacterium
TVPPPQIA

SEQ ID NO: 603885 - protein, 8 aa, Mycobacterium
TVPPPRIA

SEQ ID NO: 603886 - protein, 6 aa, Mycobacterium
TVPPSQ

SEQ ID NO: 603887 - protein, 16 aa, Mycobacterium
TVPPSWRGRDEGSPEM

SEQ ID NO: 603888 - protein, 7 aa, Mycobacterium
TVPPTAG

SEQ ID NO: 603889 - protein, 6 aa, Mycobacterium
TVPPTT

SEQ ID NO: 603890 - protein, 5 aa, Mycobacterium
TVPQG

SEQ ID NO: 603891 - protein, 5 aa, Mycobacterium
TVPQH

SEQ ID NO: 603892 - protein, 6 aa, Mycobacterium
TVPRGG

SEQ ID NO: 603893 - protein, 6 aa, Mycobacterium
TVPRGS

SEQ ID NO: 603894 - protein, 4 aa, Mycobacterium
TVPS

SEQ ID NO: 603895 - protein, 7 aa, Mycobacterium
TVPSPAR

SEQ ID NO: 603896 - protein, 7 aa, Mycobacterium
TVPSPTR

SEQ ID NO: 603897 - protein, 6 aa, Mycobacterium
TVPSRA

SEQ ID NO: 603898 - protein, 12 aa, Mycobacterium
TVPTAEDAEPKC

SEQ ID NO: 603899 - protein, 5 aa, Mycobacterium
TVPTD

SEQ ID NO: 603900 - protein, 13 aa, Mycobacterium
TVPTDGGTGAAGG

SEQ ID NO: 603901 - protein, 13 aa, Mycobacterium
TVPTKTAAAPAGL

SEQ ID NO: 603902 - protein, 5 aa, Mycobacterium
TVPTL

SEQ ID NO: 603903 - protein, 5 aa, Mycobacterium
TVPTS

SEQ ID NO: 603904 - protein, 4 aa, Mycobacterium
TVPV

SEQ ID NO: 603905 - protein, 13 aa, Mycobacterium
TVPVGSPPTPSGW

SEQ ID NO: 603906 - protein, 7 aa, Mycobacterium
TVPVGTA

SEQ ID NO: 603907 - protein, 14 aa, Mycobacterium
TVPVGTARELGQRA

SEQ ID NO: 603908 - protein, 8 aa, Mycobacterium
TVPVGTAT

SEQ ID NO: 603909 - protein, 4 aa, Mycobacterium
TVQA

SEQ ID NO: 603910 - protein, 11 aa, Mycobacterium
TVQDTIRPGTT

SEQ ID NO: 603911 - protein, 5 aa, Mycobacterium
TVQGG

SEQ ID NO: 603912 - protein, 16 aa, Mycobacterium
TVQPEADTYESAGQLS

SEQ ID NO: 603913 - protein, 8 aa, Mycobacterium
TVQPGPLA

SEQ ID NO: 603914 - protein, 7 aa, Mycobacterium
TVQPGSD

SEQ ID NO: 603915 - protein, 6 aa, Mycobacterium
TVQPPA

SEQ ID NO: 603916 - protein, 12 aa, Mycobacterium
TVQQDAHGVTAA

SEQ ID NO: 603917 - protein, 10 aa, Mycobacterium
TVQQHGQHGE

SEQ ID NO: 603918 - protein, 16 aa, Mycobacterium
TVQQPNSLAYDETSGT

SEQ ID NO: 603919 - protein, 10 aa, Mycobacterium
TVQSITKDDL

SEQ ID NO: 603920 - protein, 11 aa, Mycobacterium
TVQSPDREIDG

SEQ ID NO: 603921 - protein, 4 aa, Mycobacterium
TVQT

SEQ ID NO: 603922 - protein, 8 aa, Mycobacterium
TVQTSDGA

SEQ ID NO: 603923 - protein, 5 aa, Mycobacterium
TVRAE

SEQ ID NO: 603924 - protein, 10 aa, Mycobacterium
TVRAGGNEIQ

SEQ ID NO: 603925 - protein, 11 aa, Mycobacterium
TVRAGQSGNGA

SEQ ID NO: 603926 - protein, 12 aa, Mycobacterium
TVRAGRGPRCAN

SEQ ID NO: 603927 - protein, 12 aa, Mycobacterium
TVRAGYDAPFPD

SEQ ID NO: 603928 - protein, 9 aa, Mycobacterium
TVRAKGPVP

SEQ ID NO: 603929 - protein, 11 aa, Mycobacterium
TVRARTDATAV

SEQ ID NO: 603930 - protein, 17 aa, Mycobacterium
TVRATSPLGVGIDVTAK

SEQ ID NO: 603931 - protein, 5 aa, Mycobacterium
TVRDE

SEQ ID NO: 603932 - protein, 13 aa, Mycobacterium
TVRDEADLAEAQR

SEQ ID NO: 603933 - protein, 5 aa, Mycobacterium
TVRDG

SEQ ID NO: 603934 - protein, 6 aa, Mycobacterium
TVRDPE

SEQ ID NO: 603935 - protein, 6 aa, Mycobacterium
TVRDQA

SEQ ID NO: 603936 - protein, 7 aa, Mycobacterium
TVRDQSG

SEQ ID NO: 603937 - protein, 5 aa, Mycobacterium
TVRDR

SEQ ID NO: 603938 - protein, 7 aa, Mycobacterium
TVRDSAG

SEQ ID NO: 603939 - protein, 10 aa, Mycobacterium
TVRDTDTAGD

SEQ ID NO: 603940 - protein, 9 aa, Mycobacterium
TVRDTTGSD

SEQ ID NO: 603941 - protein, 11 aa, Mycobacterium
TVREGEAGGIT

SEQ ID NO: 603942 - protein, 7 aa, Mycobacterium
TVREGRE

SEQ ID NO: 603943 - protein, 8 aa, Mycobacterium
TVREQNGD

SEQ ID NO: 603944 - protein, 9 aa, Mycobacterium
TVREQNGEE

SEQ ID NO: 603945 - protein, 9 aa, Mycobacterium
TVRERAARE

SEQ ID NO: 603946 - protein, 6 aa, Mycobacterium
TVRESE

SEQ ID NO: 603947 - protein, 14 aa, Mycobacterium
TVRETSDAASMQRG

SEQ ID NO: 603948 - protein, 6 aa, Mycobacterium
TVRGAD

SEQ ID NO: 603949 - protein, 20 aa, Mycobacterium
TVRGGARSRPAAVRPDDAAD

SEQ ID NO: 603950 - protein, 14 aa, Mycobacterium
TVRGGTPHGEQDGI

SEQ ID NO: 603951 - protein, 14 aa, Mycobacterium
TVRGNADPAALQRG

SEQ ID NO: 603952 - protein, 8 aa, Mycobacterium
TVRGSTSD

SEQ ID NO: 603953 - protein, 6 aa, Mycobacterium
TVRGTA

SEQ ID NO: 603954 - protein, 6 aa, Mycobacterium
TVRGTE

SEQ ID NO: 603955 - protein, 7 aa, Mycobacterium
TVRKKDD

SEQ ID NO: 603956 - protein, 4 aa, Mycobacterium
TVRN

SEQ ID NO: 603957 - protein, 17 aa, Mycobacterium
TVRPAEADCGAQSADAP

SEQ ID NO: 603958 - protein, 7 aa, Mycobacterium
TVRPDGT

SEQ ID NO: 603959 - protein, 6 aa, Mycobacterium
TVRPHG

SEQ ID NO: 603960 - protein, 12 aa, Mycobacterium
TVRQAAAGTDRR

SEQ ID NO: 603961 - protein, 10 aa, Mycobacterium
TVRQNSPGAL

SEQ ID NO: 603962 - protein, 10 aa, Mycobacterium
TVRQNSPGSL

SEQ ID NO: 603963 - protein, 15 aa, Mycobacterium
TVRQPHQPEAFDDGS

SEQ ID NO: 603964 - protein, 4 aa, Mycobacterium
TVRR

SEQ ID NO: 603965 - protein, 7 aa, Mycobacterium
TVRRGAG

SEQ ID NO: 603966 - protein, 7 aa, Mycobacterium
TVRRNGL

SEQ ID NO: 603967 - protein, 4 aa, Mycobacterium
TVRS

SEQ ID NO: 603968 - protein, 16 aa, Mycobacterium
TVRSAPDGSGFAAGQR

SEQ ID NO: 603969 - protein, 16 aa, Mycobacterium
TVRSAPESSGFAPGQR

SEQ ID NO: 603970 - protein, 11 aa, Mycobacterium
TVRSASLNGRQ

SEQ ID NO: 603971 - protein, 6 aa, Mycobacterium
TVRSAT

SEQ ID NO: 603972 - protein, 9 aa, Mycobacterium
TVRSEDYSG

SEQ ID NO: 603973 - protein, 8 aa, Mycobacterium
TVRSPGGA

SEQ ID NO: 603974 - protein, 8 aa, Mycobacterium
TVRTAGGT

SEQ ID NO: 603975 - protein, 9 aa, Mycobacterium
TVRTDDPEL

SEQ ID NO: 603976 - protein, 6 aa, Mycobacterium
TVRTGA

SEQ ID NO: 603977 - protein, 9 aa, Mycobacterium
TVRTPNDVS

SEQ ID NO: 603978 - protein, 6 aa, Mycobacterium
TVSADG

SEQ ID NO: 603979 - protein, 11 aa, Mycobacterium
TVSAGEADRRG

SEQ ID NO: 603980 - protein, 46 aa, Mycobacterium
TVSAGSGASKERAIDPSVNAAGSDSHDVNMSGGPRNQTKSSASAQG

SEQ ID NO: 603981 - protein, 8 aa, Mycobacterium
TVSAGSVS

SEQ ID NO: 603982 - protein, 10 aa, Mycobacterium
TVSAKGGDII

SEQ ID NO: 603983 - protein, 7 aa, Mycobacterium
TVSAPDG

SEQ ID NO: 603984 - protein, 16 aa, Mycobacterium
TVSAPEAERVAPPECG

SEQ ID NO: 603985 - protein, 7 aa, Mycobacterium
TVSATSR

SEQ ID NO: 603986 - protein, 10 aa, Mycobacterium
TVSDARRRLG

SEQ ID NO: 603987 - protein, 6 aa, Mycobacterium
TVSDDE

SEQ ID NO: 603988 - protein, 10 aa, Mycobacterium
TVSDDGSSMA

SEQ ID NO: 603989 - protein, 7 aa, Mycobacterium
TVSDDNA

SEQ ID NO: 603990 - protein, 11 aa, Mycobacterium
TVSDPGGRATD

SEQ ID NO: 603991 - protein, 8 aa, Mycobacterium
TVSEDPAD

SEQ ID NO: 603992 - protein, 22 aa, Mycobacterium
TVSEETAKKMAERLSERAEGTI

SEQ ID NO: 603993 - protein, 5 aa, Mycobacterium
TVSEH

SEQ ID NO: 603994 - protein, 6 aa, Mycobacterium
TVSEHN

SEQ ID NO: 603995 - protein, 12 aa, Mycobacterium
TVSEHNATRNAA

SEQ ID NO: 603996 - protein, 12 aa, Mycobacterium
TVSGDGPDDGDG

SEQ ID NO: 603997 - protein, 9 aa, Mycobacterium
TVSGEPAEV

SEQ ID NO: 603998 - protein, 16 aa, Mycobacterium
TVSGHVDDAKAKGATV

SEQ ID NO: 603999 - protein, 23 aa, Mycobacterium
TVSGNDNRVAVDSTDALSASGAG

SEQ ID NO: 604000 - protein, 5 aa, Mycobacterium
TVSGR

SEQ ID NO: 604001 - protein, 8 aa, Mycobacterium
TVSGRGAE

SEQ ID NO: 604002 - protein, 12 aa, Mycobacterium
TVSGRPADVPGA

SEQ ID NO: 604003 - protein, 13 aa, Mycobacterium
TVSGRSADLAGSE

SEQ ID NO: 604004 - protein, 13 aa, Mycobacterium
TVSGRSAEVAGAE

SEQ ID NO: 604005 - protein, 12 aa, Mycobacterium
TVSGSESRSVSN

SEQ ID NO: 604006 - protein, 9 aa, Mycobacterium
TVSGSGAGD

SEQ ID NO: 604007 - protein, 15 aa, Mycobacterium
TVSGSSIATQSVSSA

SEQ ID NO: 604008 - protein, 10 aa, Mycobacterium
TVSGTADGFN

SEQ ID NO: 604009 - protein, 27 aa, Mycobacterium
TVSGTANGYQTDKPSEPATATFKIVVT

SEQ ID NO: 604010 - protein, 5 aa, Mycobacterium
TVSGV

SEQ ID NO: 604011 - protein, 10 aa, Mycobacterium
TVSKDTISRI

SEQ ID NO: 604012 - protein, 10 aa, Mycobacterium
TVSKSTAELQ

SEQ ID NO: 604013 - protein, 12 aa, Mycobacterium
TVSKTQPKSEVA

SEQ ID NO: 604014 - protein, 12 aa, Mycobacterium
TVSLNENGQVTT

SEQ ID NO: 604015 - protein, 6 aa, Mycobacterium
TVSNRG

SEQ ID NO: 604016 - protein, 8 aa, Mycobacterium
TVSPAPDE

SEQ ID NO: 604017 - protein, 8 aa, Mycobacterium
TVSPDGIP

SEQ ID NO: 604018 - protein, 7 aa, Mycobacterium
TVSPEQA

SEQ ID NO: 604019 - protein, 10 aa, Mycobacterium
TVSPGNAASR

SEQ ID NO: 604020 - protein, 10 aa, Mycobacterium
TVSPGPTETP

SEQ ID NO: 604021 - protein, 17 aa, Mycobacterium
TVSPRSAPAPVTAEVTG

SEQ ID NO: 604022 - protein, 6 aa, Mycobacterium
TVSPSF

SEQ ID NO: 604023 - protein, 7 aa, Mycobacterium
TVSPSFD

SEQ ID NO: 604024 - protein, 7 aa, Mycobacterium
TVSPSFE

SEQ ID NO: 604025 - protein, 4 aa, Mycobacterium
TVSQ

SEQ ID NO: 604026 - protein, 11 aa, Mycobacterium
TVSRQGGREGD

SEQ ID NO: 604027 - protein, 13 aa, Mycobacterium
TVSRSQSTAPLVG

SEQ ID NO: 604028 - protein, 7 aa, Mycobacterium
TVSSDSG

SEQ ID NO: 604029 - protein, 11 aa, Mycobacterium
TVSSDTPLTTA

SEQ ID NO: 604030 - protein, 13 aa, Mycobacterium
TVSSEAMRAAALT

SEQ ID NO: 604031 - protein, 16 aa, Mycobacterium
TVSSISSKSVGRGARA

SEQ ID NO: 604032 - protein, 9 aa, Mycobacterium
TVSSNPSDR

SEQ ID NO: 604033 - protein, 13 aa, Mycobacterium
TVSSPGPVGRTQS

SEQ ID NO: 604034 - protein, 6 aa, Mycobacterium
TVSSRA

SEQ ID NO: 604035 - protein, 6 aa, Mycobacterium
TVSSTG

SEQ ID NO: 604036 - protein, 15 aa, Mycobacterium
TVSTASRSATVGGRT

SEQ ID NO: 604037 - protein, 23 aa, Mycobacterium
TVSTEPDRFDPTRLEPPRREDQA

SEQ ID NO: 604038 - protein, 5 aa, Mycobacterium
TVSTV

SEQ ID NO: 604039 - protein, 5 aa, Mycobacterium
TVSVG

SEQ ID NO: 604040 - protein, 13 aa, Mycobacterium
TVSVTGETGSEAS

SEQ ID NO: 604041 - protein, 10 aa, Mycobacterium
TVSYSSEGRL

SEQ ID NO: 604042 - protein, 4 aa, Mycobacterium
TVTA

SEQ ID NO: 604043 - protein, 5 aa, Mycobacterium
TVTAA

SEQ ID NO: 604044 - protein, 11 aa, Mycobacterium
TVTAARGGTMG

SEQ ID NO: 604045 - protein, 12 aa, Mycobacterium
TVTADAAPTGIP

SEQ ID NO: 604046 - protein, 12 aa, Mycobacterium
TVTADSSTALNA

SEQ ID NO: 604047 - protein, 5 aa, Mycobacterium
TVTAG

SEQ ID NO: 604048 - protein, 9 aa, Mycobacterium
TVTAGGDSV

SEQ ID NO: 604049 - protein, 9 aa, Mycobacterium
TVTAGGMPD

SEQ ID NO: 604050 - protein, 8 aa, Mycobacterium
TVTAKTAT

SEQ ID NO: 604051 - protein, 10 aa, Mycobacterium
TVTAKTATHQ

SEQ ID NO: 604052 - protein, 7 aa, Mycobacterium
TVTAPDG

SEQ ID NO: 604053 - protein, 9 aa, Mycobacterium
TVTAPGQPA

SEQ ID NO: 604054 - protein, 7 aa, Mycobacterium
TVTASAE

SEQ ID NO: 604055 - protein, 5 aa, Mycobacterium
TVTCP

SEQ ID NO: 604056 - protein, 17 aa, Mycobacterium
TVTCPGGHTRAMSPKRT

SEQ ID NO: 604057 - protein, 5 aa, Mycobacterium
TVTDA

SEQ ID NO: 604058 - protein, 6 aa, Mycobacterium
TVTDDA

SEQ ID NO: 604059 - protein, 11 aa, Mycobacterium
TVTDEAGQILS

SEQ ID NO: 604060 - protein, 10 aa, Mycobacterium
TVTDPGPGGV

SEQ ID NO: 604061 - protein, 13 aa, Mycobacterium
TVTDREDTFDGTA

SEQ ID NO: 604062 - protein, 9 aa, Mycobacterium
TVTDRRPDV

SEQ ID NO: 604063 - protein, 12 aa, Mycobacterium
TVTDTAGNTIDT

SEQ ID NO: 604064 - protein, 7 aa, Mycobacterium
TVTDTDG

SEQ ID NO: 604065 - protein, 9 aa, Mycobacterium
TVTDTDGNV

SEQ ID NO: 604066 - protein, 8 aa, Mycobacterium
TVTEADPG

SEQ ID NO: 604067 - protein, 12 aa, Mycobacterium
TVTEATGSNLAP

SEQ ID NO: 604068 - protein, 9 aa, Mycobacterium
TVTEQPGVR

SEQ ID NO: 604069 - protein, 6 aa, Mycobacterium
TVTEST

SEQ ID NO: 604070 - protein, 5 aa, Mycobacterium
TVTET

SEQ ID NO: 604071 - protein, 4 aa, Mycobacterium
TVTG

SEQ ID NO: 604072 - protein, 6 aa, Mycobacterium
TVTGAA

SEQ ID NO: 604073 - protein, 6 aa, Mycobacterium
TVTGDP

SEQ ID NO: 604074 - protein, 28 aa, Mycobacterium
TVTGDTAGTALTTGPAGTLGAVGESRGL

SEQ ID NO: 604075 - protein, 9 aa, Mycobacterium
TVTGEESKL

SEQ ID NO: 604076 - protein, 9 aa, Mycobacterium
TVTGEETTL

SEQ ID NO: 604077 - protein, 8 aa, Mycobacterium
TVTGGRDA

SEQ ID NO: 604078 - protein, 9 aa, Mycobacterium
TVTGGSATY

SEQ ID NO: 604079 - protein, 12 aa, Mycobacterium
TVTGNASLREPQ

SEQ ID NO: 604080 - protein, 8 aa, Mycobacterium
TVTGPEQR

SEQ ID NO: 604081 - protein, 7 aa, Mycobacterium
TVTGPQA

SEQ ID NO: 604082 - protein, 10 aa, Mycobacterium
TVTGQAPART

SEQ ID NO: 604083 - protein, 12 aa, Mycobacterium
TVTGQGNDLKVN

SEQ ID NO: 604084 - protein, 12 aa, Mycobacterium
TVTGQGNSLSVN

SEQ ID NO: 604085 - protein, 5 aa, Mycobacterium
TVTGR

SEQ ID NO: 604086 - protein, 13 aa, Mycobacterium
TVTGRRRRADDVD

SEQ ID NO: 604087 - protein, 17 aa, Mycobacterium
TVTGTRESATDYSETDL

SEQ ID NO: 604088 - protein, 6 aa, Mycobacterium
TVTGTS

SEQ ID NO: 604089 - protein, 7 aa, Mycobacterium
TVTGTSD

SEQ ID NO: 604090 - protein, 4 aa, Mycobacterium
TVTH

SEQ ID NO: 604091 - protein, 8 aa, Mycobacterium
TVTHGRNM

SEQ ID NO: 604092 - protein, 5 aa, Mycobacterium
TVTHR

SEQ ID NO: 604093 - protein, 8 aa, Mycobacterium
TVTKTTVT

SEQ ID NO: 604094 - protein, 6 aa, Mycobacterium
TVTNRT

SEQ ID NO: 604095 - protein, 8 aa, Mycobacterium
TVTNTPGV

SEQ ID NO: 604096 - protein, 4 aa, Mycobacterium
TVTP

SEQ ID NO: 604097 - protein, 12 aa, Mycobacterium
TVTPADGTHGTQ

SEQ ID NO: 604098 - protein, 14 aa, Mycobacterium
TVTPATPYGEPSAP

SEQ ID NO: 604099 - protein, 6 aa, Mycobacterium
TVTPDG

SEQ ID NO: 604100 - protein, 7 aa, Mycobacterium
TVTPDRV

SEQ ID NO: 604101 - protein, 26 aa, Mycobacterium
TVTPEAAAATGVPAGTPVSAGTVDAY

SEQ ID NO: 604102 - protein, 8 aa, Mycobacterium
TVTPEDDA

SEQ ID NO: 604103 - protein, 9 aa, Mycobacterium
TVTPEREGR

SEQ ID NO: 604104 - protein, 8 aa, Mycobacterium
TVTPGGAP

SEQ ID NO: 604105 - protein, 14 aa, Mycobacterium
TVTPGNVTSPGADA

SEQ ID NO: 604106 - protein, 12 aa, Mycobacterium
TVTPGRTRERRR

SEQ ID NO: 604107 - protein, 7 aa, Mycobacterium
TVTPNYP

SEQ ID NO: 604108 - protein, 30 aa, Mycobacterium
TVTPPAENTAPESTPAKAPRKAAGKRSKTI

SEQ ID NO: 604109 - protein, 6 aa, Mycobacterium
TVTPPP

SEQ ID NO: 604110 - protein, 9 aa, Mycobacterium
TVTPQTQVS

SEQ ID NO: 604111 - protein, 9 aa, Mycobacterium
TVTPSTAAA

SEQ ID NO: 604112 - protein, 4 aa, Mycobacterium
TVTQ

SEQ ID NO: 604113 - protein, 9 aa, Mycobacterium
TVTQPYRAG

SEQ ID NO: 604114 - protein, 14 aa, Mycobacterium
TVTRAELDATSNRI

SEQ ID NO: 604115 - protein, 11 aa, Mycobacterium
TVTRDRRSGRH

SEQ ID NO: 604116 - protein, 21 aa, Mycobacterium
TVTRRDGVDTGARPGRLVRGA

SEQ ID NO: 604117 - protein, 21 aa, Mycobacterium
TVTRRKDVDTGARPGRLVRGA

SEQ ID NO: 604118 - protein, 21 aa, Mycobacterium
TVTRRNDVDTGARPGRLVRGA

SEQ ID NO: 604119 - protein, 8 aa, Mycobacterium
TVTRSPRQ

SEQ ID NO: 604120 - protein, 39 aa, Mycobacterium
TVTSEADRARRVKASQAASQDAPSEPQAAEEPAAEEAVA

SEQ ID NO: 604121 - protein, 10 aa, Mycobacterium
TVTSERADAP

SEQ ID NO: 604122 - protein, 6 aa, Mycobacterium
TVTSGS

SEQ ID NO: 604123 - protein, 6 aa, Mycobacterium
TVTSGT

SEQ ID NO: 604124 - protein, 11 aa, Mycobacterium
TVTSPGGTTAA

SEQ ID NO: 604125 - protein, 8 aa, Mycobacterium
TVTSPGHA

SEQ ID NO: 604126 - protein, 15 aa, Mycobacterium
TVTSPYADSSGQAET

SEQ ID NO: 604127 - protein, 8 aa, Mycobacterium
TVTTADGR

SEQ ID NO: 604128 - protein, 8 aa, Mycobacterium
TVTTAGPL

SEQ ID NO: 604129 - protein, 10 aa, Mycobacterium
TVTTARREWP

SEQ ID NO: 604130 - protein, 12 aa, Mycobacterium
TVTTATGDGYRG

SEQ ID NO: 604131 - protein, 9 aa, Mycobacterium
TVTTDDPRA

SEQ ID NO: 604132 - protein, 6 aa, Mycobacterium
TVTTDV

SEQ ID NO: 604133 - protein, 10 aa, Mycobacterium
TVTTGSTITG

SEQ ID NO: 604134 - protein, 14 aa, Mycobacterium
TVTTNHPDAPTVAT

SEQ ID NO: 604135 - protein, 7 aa, Mycobacterium
TVTTPED

SEQ ID NO: 604136 - protein, 10 aa, Mycobacterium
TVTTSRREWP

SEQ ID NO: 604137 - protein, 7 aa, Mycobacterium
TVTYEAG

SEQ ID NO: 604138 - protein, 11 aa, Mycobacterium
TVVDGDAGQIS

SEQ ID NO: 604139 - protein, 15 aa, Mycobacterium
TVVPGHGPVTDPDGI

SEQ ID NO: 604140 - protein, 10 aa, Mycobacterium
TVVTGDRDAA

SEQ ID NO: 604141 - protein, 13 aa, Mycobacterium
TVWSGEANDAYQA

SEQ ID NO: 604142 - protein, 12 aa, Mycobacterium
TVYDNSRVSGPR

SEQ ID NO: 604143 - protein, 26 aa, Mycobacterium
TVYNGSGVGNMGGVDATEDPWHGRPA

SEQ ID NO: 604144 - protein, 6 aa, Mycobacterium
TVYPGS

SEQ ID NO: 604145 - protein, 6 aa, Mycobacterium
TVYPSE

SEQ ID NO: 604146 - protein, 12 aa, Mycobacterium
TWDDTSTEYSAV

SEQ ID NO: 604147 - protein, 28 aa, Mycobacterium
TWDGKRAAGPHNSAASSAPGPAEPGAGE

SEQ ID NO: 604148 - protein, 11 aa, Mycobacterium
TWDNGKPIRES

SEQ ID NO: 604149 - protein, 10 aa, Mycobacterium
TWDTTTSEQW

SEQ ID NO: 604150 - protein, 7 aa, Mycobacterium
TWDYEGR

SEQ ID NO: 604151 - protein, 10 aa, Mycobacterium
TWEEAGPDGD

SEQ ID NO: 604152 - protein, 7 aa, Mycobacterium
TWEPTTH

SEQ ID NO: 604153 - protein, 7 aa, Mycobacterium
TWEPTTY

SEQ ID NO: 604154 - protein, 13 aa, Mycobacterium
TWEQRRDEVERAS

SEQ ID NO: 604155 - protein, 13 aa, Mycobacterium
TWERRDAPDIPPV

SEQ ID NO: 604156 - protein, 12 aa, Mycobacterium
TWGDDEDRDDEQ

SEQ ID NO: 604157 - protein, 18 aa, Mycobacterium
TWGDPGQKGDDVSGSGAY

SEQ ID NO: 604158 - protein, 14 aa, Mycobacterium
TWGEDDLPLRPWWT

SEQ ID NO: 604159 - protein, 6 aa, Mycobacterium
TWGGRQ

SEQ ID NO: 604160 - protein, 5 aa, Mycobacterium
TWGGS

SEQ ID NO: 604161 - protein, 10 aa, Mycobacterium
TWGGTDPDLA

SEQ ID NO: 604162 - protein, 19 aa, Mycobacterium
TWGLPGGARDSHETPEQTA

SEQ ID NO: 604163 - protein, 10 aa, Mycobacterium
TWGPARDVRD

SEQ ID NO: 604164 - protein, 9 aa, Mycobacterium
TWGPPSAND

SEQ ID NO: 604165 - protein, 14 aa, Mycobacterium
TWGPVTDGAAAGSV

SEQ ID NO: 604166 - protein, 11 aa, Mycobacterium
TWGRDKRPEAF

SEQ ID NO: 604167 - protein, 11 aa, Mycobacterium
TWGSTPTGSGK

SEQ ID NO: 604168 - protein, 4 aa, Mycobacterium
TWGT

SEQ ID NO: 604169 - protein, 4 aa, Mycobacterium
TWND

SEQ ID NO: 604170 - protein, 5 aa, Mycobacterium
TWNDP

SEQ ID NO: 604171 - protein, 7 aa, Mycobacterium
TWNGTKA

SEQ ID NO: 604172 - protein, 5 aa, Mycobacterium
TWNNA

SEQ ID NO: 604173 - protein, 12 aa, Mycobacterium
TWPAGGGAGATA

SEQ ID NO: 604174 - protein, 9 aa, Mycobacterium
TWPDENPQL

SEQ ID NO: 604175 - protein, 5 aa, Mycobacterium
TWPDV

SEQ ID NO: 604176 - protein, 7 aa, Mycobacterium
TWPEETE

SEQ ID NO: 604177 - protein, 16 aa, Mycobacterium
TWPEPFNSDPSTRPGL

SEQ ID NO: 604178 - protein, 5 aa, Mycobacterium
TWPGA

SEQ ID NO: 604179 - protein, 6 aa, Mycobacterium
TWPNGR

SEQ ID NO: 604180 - protein, 5 aa, Mycobacterium
TWPPE

SEQ ID NO: 604181 - protein, 14 aa, Mycobacterium
TWPPGDGKGAPGSG

SEQ ID NO: 604182 - protein, 16 aa, Mycobacterium
TWPPGFPHDKRPSYSL

SEQ ID NO: 604183 - protein, 7 aa, Mycobacterium
TWPQPEA

SEQ ID NO: 604184 - protein, 5 aa, Mycobacterium
TWPTL

SEQ ID NO: 604185 - protein, 11 aa, Mycobacterium
TWQDKGSSYLS

SEQ ID NO: 604186 - protein, 8 aa, Mycobacterium
TWQGPSAT

SEQ ID NO: 604187 - protein, 14 aa, Mycobacterium
TWQPETDLSKTSEV

SEQ ID NO: 604188 - protein, 7 aa, Mycobacterium
TWRDERE

SEQ ID NO: 604189 - protein, 4 aa, Mycobacterium
TWRN

SEQ ID NO: 604190 - protein, 7 aa, Mycobacterium
TWRPADE

SEQ ID NO: 604191 - protein, 13 aa, Mycobacterium
TWRPDSDRQVRGR

SEQ ID NO: 604192 - protein, 12 aa, Mycobacterium
TWRPENRGAPAA

SEQ ID NO: 604193 - protein, 41 aa, Mycobacterium
TWRSRTRTRAAGNKMQGTRQDESVPMAPGSDENMPMAGPGD

SEQ ID NO: 604194 - protein, 5 aa, Mycobacterium
TWRTD

SEQ ID NO: 604195 - protein, 15 aa, Mycobacterium
TWRTRRDEVEQTSDH

SEQ ID NO: 604196 - protein, 13 aa, Mycobacterium
TWRTRTGLKSKGA

SEQ ID NO: 604197 - protein, 19 aa, Mycobacterium
TWSAARGEGARLDSITQSA

SEQ ID NO: 604198 - protein, 24 aa, Mycobacterium
TWSDAEATPPTAPEPDGLEQAASP

SEQ ID NO: 604199 - protein, 5 aa, Mycobacterium
TWSDE

SEQ ID NO: 604200 - protein, 24 aa, Mycobacterium
TWSDTEPSMPAAPAPEDIAPTGLP

SEQ ID NO: 604201 - protein, 11 aa, Mycobacterium
TWSESAPAGHF

SEQ ID NO: 604202 - protein, 8 aa, Mycobacterium
TWSETAPA

SEQ ID NO: 604203 - protein, 6 aa, Mycobacterium
TWSGDA

SEQ ID NO: 604204 - protein, 8 aa, Mycobacterium
TWSPEGPY

SEQ ID NO: 604205 - protein, 10 aa, Mycobacterium
TWSPPPRPAD

SEQ ID NO: 604206 - protein, 10 aa, Mycobacterium
TWSQTSRDER

SEQ ID NO: 604207 - protein, 4 aa, Mycobacterium
TWSY

SEQ ID NO: 604208 - protein, 6 aa, Mycobacterium
TWTDPA

SEQ ID NO: 604209 - protein, 7 aa, Mycobacterium
TWTGAGG

SEQ ID NO: 604210 - protein, 8 aa, Mycobacterium
TWTGDKES

SEQ ID NO: 604211 - protein, 14 aa, Mycobacterium
TWTPDDADKRYSTY

SEQ ID NO: 604212 - protein, 6 aa, Mycobacterium
TWTPGQ

SEQ ID NO: 604213 - protein, 29 aa, Mycobacterium
TWTQESGKASRNQEGGYTLTPEGDKTRTK

SEQ ID NO: 604214 - protein, 10 aa, Mycobacterium
TWTTPKADLG

SEQ ID NO: 604215 - protein, 7 aa, Mycobacterium
TWTTTGD

SEQ ID NO: 604216 - protein, 10 aa, Mycobacterium
TYAAESDAEG

SEQ ID NO: 604217 - protein, 31 aa, Mycobacterium
TYAAGRYGQKVDETFSTAGIPSSAYSRAKSA

SEQ ID NO: 604218 - protein, 5 aa, Mycobacterium
TYAAH

SEQ ID NO: 604219 - protein, 9 aa, Mycobacterium
TYADDGGMI

SEQ ID NO: 604220 - protein, 4 aa, Mycobacterium
TYAE

SEQ ID NO: 604221 - protein, 5 aa, Mycobacterium
TYAGK

SEQ ID NO: 604222 - protein, 5 aa, Mycobacterium
TYAGQ

SEQ ID NO: 604223 - protein, 6 aa, Mycobacterium
TYAGSE

SEQ ID NO: 604224 - protein, 23 aa, Mycobacterium
TYAGSGYTGLATQGLQEPKPGRH

SEQ ID NO: 604225 - protein, 8 aa, Mycobacterium
TYAKQSDA

SEQ ID NO: 604226 - protein, 10 aa, Mycobacterium
TYANRTQHEM

SEQ ID NO: 604227 - protein, 7 aa, Mycobacterium
TYAPGQA

SEQ ID NO: 604228 - protein, 7 aa, Mycobacterium
TYAPGRE

SEQ ID NO: 604229 - protein, 5 aa, Mycobacterium
TYAPH

SEQ ID NO: 604230 - protein, 9 aa, Mycobacterium
TYAPPPQRF

SEQ ID NO: 604231 - protein, 11 aa, Mycobacterium
TYAQARDDYDT

SEQ ID NO: 604232 - protein, 4 aa, Mycobacterium
TYAR

SEQ ID NO: 604233 - protein, 7 aa, Mycobacterium
TYARDGD

SEQ ID NO: 604234 - protein, 4 aa, Mycobacterium
TYAS

SEQ ID NO: 604235 - protein, 6 aa, Mycobacterium
TYASGG

SEQ ID NO: 604236 - protein, 9 aa, Mycobacterium
TYATADPPV

SEQ ID NO: 604237 - protein, 9 aa, Mycobacterium
TYATGRTRD

SEQ ID NO: 604238 - protein, 24 aa, Mycobacterium
TYDAASAAAAVRGRVTANSQRKID

SEQ ID NO: 604239 - protein, 15 aa, Mycobacterium
TYDAEKFNDSAEKGE

SEQ ID NO: 604240 - protein, 8 aa, Mycobacterium
TYDAERDR

SEQ ID NO: 604241 - protein, 14 aa, Mycobacterium
TYDDGSAMSRKDIG

SEQ ID NO: 604242 - protein, 13 aa, Mycobacterium
TYDDGSTMSHKDI

SEQ ID NO: 604243 - protein, 14 aa, Mycobacterium
TYDDGTTMSRSDVS

SEQ ID NO: 604244 - protein, 8 aa, Mycobacterium
TYDGAGTN

SEQ ID NO: 604245 - protein, 10 aa, Mycobacterium
TYDGDSSNEL

SEQ ID NO: 604246 - protein, 17 aa, Mycobacterium
TYDGGAGYTSAKHAQGA

SEQ ID NO: 604247 - protein, 8 aa, Mycobacterium
TYDGTDQG

SEQ ID NO: 604248 - protein, 11 aa, Mycobacterium
TYDKVSRNPEV

SEQ ID NO: 604249 - protein, 11 aa, Mycobacterium
TYDNPTAADLP

SEQ ID NO: 604250 - protein, 4 aa, Mycobacterium
TYDP

SEQ ID NO: 604251 - protein, 10 aa, Mycobacterium
TYDPESRNKV

SEQ ID NO: 604252 - protein, 16 aa, Mycobacterium
TYDQVSRNPDVQYGDR

SEQ ID NO: 604253 - protein, 9 aa, Mycobacterium
TYDRDRDRY

SEQ ID NO: 604254 - protein, 7 aa, Mycobacterium
TYDRTTG

SEQ ID NO: 604255 - protein, 13 aa, Mycobacterium
TYDTDGDGDPRPV

SEQ ID NO: 604256 - protein, 19 aa, Mycobacterium
TYDTEKFRDDSRNGSEKGE

SEQ ID NO: 604257 - protein, 4 aa, Mycobacterium
TYEA

SEQ ID NO: 604258 - protein, 15 aa, Mycobacterium
TYEAEKFNDSAENGE

SEQ ID NO: 604259 - protein, 9 aa, Mycobacterium
TYEDETGVT

SEQ ID NO: 604260 - protein, 13 aa, Mycobacterium
TYEDGSSMSRQDI

SEQ ID NO: 604261 - protein, 11 aa, Mycobacterium
TYEGDDETVER

SEQ ID NO: 604262 - protein, 9 aa, Mycobacterium
TYEGREKEI

SEQ ID NO: 604263 - protein, 12 aa, Mycobacterium
TYEGSSDKHPDI

SEQ ID NO: 604264 - protein, 12 aa, Mycobacterium
TYENSPDYDSDH

SEQ ID NO: 604265 - protein, 4 aa, Mycobacterium
TYEP

SEQ ID NO: 604266 - protein, 7 aa, Mycobacterium
TYEPDRA

SEQ ID NO: 604267 - protein, 6 aa, Mycobacterium
TYEPET

SEQ ID NO: 604268 - protein, 25 aa, Mycobacterium
TYEPKRPFAPTAPTVTATRTATGYR

SEQ ID NO: 604269 - protein, 6 aa, Mycobacterium
TYEPSR

SEQ ID NO: 604270 - protein, 16 aa, Mycobacterium
TYEPSRAGWSPNPRAF

SEQ ID NO: 604271 - protein, 8 aa, Mycobacterium
TYEPSRTG

SEQ ID NO: 604272 - protein, 10 aa, Mycobacterium
TYEPTFGEAS

SEQ ID NO: 604273 - protein, 10 aa, Mycobacterium
TYERSAQAHP

SEQ ID NO: 604274 - protein, 7 aa, Mycobacterium
TYERTAD

SEQ ID NO: 604275 - protein, 6 aa, Mycobacterium
TYESPG

SEQ ID NO: 604276 - protein, 24 aa, Mycobacterium
TYETASAAAAARGRLTATSQRKID

SEQ ID NO: 604277 - protein, 4 aa, Mycobacterium
TYFG

SEQ ID NO: 604278 - protein, 5 aa, Mycobacterium
TYGAD

SEQ ID NO: 604279 - protein, 5 aa, Mycobacterium
TYGAG

SEQ ID NO: 604280 - protein, 25 aa, Mycobacterium
TYGAGGSNALLGSAKSNAGHAQSAA

SEQ ID NO: 604281 - protein, 7 aa, Mycobacterium
TYGAPTY

SEQ ID NO: 604282 - protein, 13 aa, Mycobacterium
TYGATRPGSGGVL

SEQ ID NO: 604283 - protein, 12 aa, Mycobacterium
TYGDESTLPSEP

SEQ ID NO: 604284 - protein, 8 aa, Mycobacterium
TYGDGGNS

SEQ ID NO: 604285 - protein, 8 aa, Mycobacterium
TYGDSGNA

SEQ ID NO: 604286 - protein, 5 aa, Mycobacterium
TYGET

SEQ ID NO: 604287 - protein, 6 aa, Mycobacterium
TYGGSA

SEQ ID NO: 604288 - protein, 13 aa, Mycobacterium
TYGGSVAAGYENP

SEQ ID NO: 604289 - protein, 7 aa, Mycobacterium
TYGGTPG

SEQ ID NO: 604290 - protein, 5 aa, Mycobacterium
TYGIP

SEQ ID NO: 604291 - protein, 4 aa, Mycobacterium
TYGL

SEQ ID NO: 604292 - protein, 4 aa, Mycobacterium
TYGP

SEQ ID NO: 604293 - protein, 7 aa, Mycobacterium
TYGPDRV

SEQ ID NO: 604294 - protein, 13 aa, Mycobacterium
TYGPGDFQPTPHG

SEQ ID NO: 604295 - protein, 13 aa, Mycobacterium
TYGPGDWAPTPHG

SEQ ID NO: 604296 - protein, 13 aa, Mycobacterium
TYGPGDWQPTPHG

SEQ ID NO: 604297 - protein, 7 aa, Mycobacterium
TYGPTET

SEQ ID NO: 604298 - protein, 5 aa, Mycobacterium
TYGQP

SEQ ID NO: 604299 - protein, 17 aa, Mycobacterium
TYGQSPHTTLRHMTAPP

SEQ ID NO: 604300 - protein, 7 aa, Mycobacterium
TYGRKSK

SEQ ID NO: 604301 - protein, 5 aa, Mycobacterium
TYGRP

SEQ ID NO: 604302 - protein, 6 aa, Mycobacterium
TYGRPG

SEQ ID NO: 604303 - protein, 6 aa, Mycobacterium
TYGRSP

SEQ ID NO: 604304 - protein, 8 aa, Mycobacterium
TYGRSRPG

SEQ ID NO: 604305 - protein, 12 aa, Mycobacterium
TYGSGDWGGTPH

SEQ ID NO: 604306 - protein, 6 aa, Mycobacterium
TYGSPV

SEQ ID NO: 604307 - protein, 10 aa, Mycobacterium
TYGSRQSKAR

SEQ ID NO: 604308 - protein, 11 aa, Mycobacterium
TYGTLSEGERK

SEQ ID NO: 604309 - protein, 6 aa, Mycobacterium
TYGTMP

SEQ ID NO: 604310 - protein, 6 aa, Mycobacterium
TYGTTK

SEQ ID NO: 604311 - protein, 6 aa, Mycobacterium
TYGTYD

SEQ ID NO: 604312 - protein, 8 aa, Mycobacterium
TYGTYDDS

SEQ ID NO: 604313 - protein, 7 aa, Mycobacterium
TYGTYDT

SEQ ID NO: 604314 - protein, 13 aa, Mycobacterium
TYGVNSGADLPPE

SEQ ID NO: 604315 - protein, 14 aa, Mycobacterium
TYGVPVNSPDGYRT

SEQ ID NO: 604316 - protein, 4 aa, Mycobacterium
TYHA

SEQ ID NO: 604317 - protein, 6 aa, Mycobacterium
TYHGEL

SEQ ID NO: 604318 - protein, 4 aa, Mycobacterium
TYIT

SEQ ID NO: 604319 - protein, 21 aa, Mycobacterium
TYKDGDPKVDNIGSGNTINKG

SEQ ID NO: 604320 - protein, 21 aa, Mycobacterium
TYKDGEPKVDNLGSGNTISKG

SEQ ID NO: 604321 - protein, 6 aa, Mycobacterium
TYKGKT

SEQ ID NO: 604322 - protein, 5 aa, Mycobacterium
TYKGP

SEQ ID NO: 604323 - protein, 14 aa, Mycobacterium
TYKNSRVDSLPRAG

SEQ ID NO: 604324 - protein, 6 aa, Mycobacterium
TYKPYG

SEQ ID NO: 604325 - protein, 20 aa, Mycobacterium
TYLDPEAAAAGAAAVAGQGR

SEQ ID NO: 604326 - protein, 20 aa, Mycobacterium
TYLDPEAAAAGAAAVASQGR

SEQ ID NO: 604327 - protein, 8 aa, Mycobacterium
TYLKPGDE

SEQ ID NO: 604328 - protein, 12 aa, Mycobacterium
TYNDTRGHTAGD

SEQ ID NO: 604329 - protein, 4 aa, Mycobacterium
TYNE

SEQ ID NO: 604330 - protein, 9 aa, Mycobacterium
TYNRPDPKL

SEQ ID NO: 604331 - protein, 11 aa, Mycobacterium
TYNSDLGGGDL

SEQ ID NO: 604332 - protein, 4 aa, Mycobacterium
TYPA

SEQ ID NO: 604333 - protein, 5 aa, Mycobacterium
TYPAE

SEQ ID NO: 604334 - protein, 6 aa, Mycobacterium
TYPAEA

SEQ ID NO: 604335 - protein, 10 aa, Mycobacterium
TYPAEQAAAA

SEQ ID NO: 604336 - protein, 5 aa, Mycobacterium
TYPDD

SEQ ID NO: 604337 - protein, 8 aa, Mycobacterium
TYPDSNAT

SEQ ID NO: 604338 - protein, 7 aa, Mycobacterium
TYPESVA

SEQ ID NO: 604339 - protein, 9 aa, Mycobacterium
TYPESVADG

SEQ ID NO: 604340 - protein, 9 aa, Mycobacterium
TYPGAGASI

SEQ ID NO: 604341 - protein, 9 aa, Mycobacterium
TYPGDGITP

SEQ ID NO: 604342 - protein, 14 aa, Mycobacterium
TYPGHNGGGPMPKL

SEQ ID NO: 604343 - protein, 25 aa, Mycobacterium
TYPGHQESDRVEAGYARNPNRQNRG

SEQ ID NO: 604344 - protein, 6 aa, Mycobacterium
TYPGPF

SEQ ID NO: 604345 - protein, 10 aa, Mycobacterium
TYPGQGTSVE

SEQ ID NO: 604346 - protein, 7 aa, Mycobacterium
TYPGRGE

SEQ ID NO: 604347 - protein, 7 aa, Mycobacterium
TYPGVGG

SEQ ID NO: 604348 - protein, 6 aa, Mycobacterium
TYPPAQ

SEQ ID NO: 604349 - protein, 4 aa, Mycobacterium
TYPQ

SEQ ID NO: 604350 - protein, 12 aa, Mycobacterium
TYPSRSAEYGPF

SEQ ID NO: 604351 - protein, 10 aa, Mycobacterium
TYPTATDAEL

SEQ ID NO: 604352 - protein, 10 aa, Mycobacterium
TYQATNDETL

SEQ ID NO: 604353 - protein, 5 aa, Mycobacterium
TYQGK

SEQ ID NO: 604354 - protein, 6 aa, Mycobacterium
TYQGKG

SEQ ID NO: 604355 - protein, 6 aa, Mycobacterium
TYQPDK

SEQ ID NO: 604356 - protein, 4 aa, Mycobacterium
TYQQ

SEQ ID NO: 604357 - protein, 8 aa, Mycobacterium
TYQRNAQR

SEQ ID NO: 604358 - protein, 11 aa, Mycobacterium
TYRDANAAANR

SEQ ID NO: 604359 - protein, 8 aa, Mycobacterium
TYRDEHTE

SEQ ID NO: 604360 - protein, 8 aa, Mycobacterium
TYRDGGDV

SEQ ID NO: 604361 - protein, 8 aa, Mycobacterium
TYRDPDGR

SEQ ID NO: 604362 - protein, 10 aa, Mycobacterium
TYRGAPADFT

SEQ ID NO: 604363 - protein, 13 aa, Mycobacterium
TYRGDGKTDAKNA

SEQ ID NO: 604364 - protein, 7 aa, Mycobacterium
TYRGEPA

SEQ ID NO: 604365 - protein, 6 aa, Mycobacterium
TYRGES

SEQ ID NO: 604366 - protein, 8 aa, Mycobacterium
TYRGGGAD

SEQ ID NO: 604367 - protein, 12 aa, Mycobacterium
TYRGPATPGSAA

SEQ ID NO: 604368 - protein, 14 aa, Mycobacterium
TYRGSARQSGNRVD

SEQ ID NO: 604369 - protein, 9 aa, Mycobacterium
TYRGTESHA

SEQ ID NO: 604370 - protein, 15 aa, Mycobacterium
TYRPDPSEPSQAAAV

SEQ ID NO: 604371 - protein, 13 aa, Mycobacterium
TYRPGARFGPNAI

SEQ ID NO: 604372 - protein, 8 aa, Mycobacterium
TYRPRQEL

SEQ ID NO: 604373 - protein, 5 aa, Mycobacterium
TYRPT

SEQ ID NO: 604374 - protein, 4 aa, Mycobacterium
TYRR

SEQ ID NO: 604375 - protein, 12 aa, Mycobacterium
TYRREQATNPLS

SEQ ID NO: 604376 - protein, 12 aa, Mycobacterium
TYRRGRERNTPV

SEQ ID NO: 604377 - protein, 9 aa, Mycobacterium
TYRRGRSRI

SEQ ID NO: 604378 - protein, 9 aa, Mycobacterium
TYRSPRPEL

SEQ ID NO: 604379 - protein, 9 aa, Mycobacterium
TYRTEGPAN

SEQ ID NO: 604380 - protein, 20 aa, Mycobacterium
TYRTGEPQVAKSGNNNTVEQ

SEQ ID NO: 604381 - protein, 13 aa, Mycobacterium
TYRTPTEHNNPME

SEQ ID NO: 604382 - protein, 9 aa, Mycobacterium
TYRTRGRAE

SEQ ID NO: 604383 - protein, 7 aa, Mycobacterium
TYSASGG

SEQ ID NO: 604384 - protein, 5 aa, Mycobacterium
TYSGA

SEQ ID NO: 604385 - protein, 10 aa, Mycobacterium
TYSGNPDNRA

SEQ ID NO: 604386 - protein, 8 aa, Mycobacterium
TYSGPDAV

SEQ ID NO: 604387 - protein, 13 aa, Mycobacterium
TYSPGSSDPIDGA

SEQ ID NO: 604388 - protein, 9 aa, Mycobacterium
TYSPGTVDQ

SEQ ID NO: 604389 - protein, 13 aa, Mycobacterium
TYSQSSRLQAAGL

SEQ ID NO: 604390 - protein, 8 aa, Mycobacterium
TYSRTADG

SEQ ID NO: 604391 - protein, 4 aa, Mycobacterium
TYSS

SEQ ID NO: 604392 - protein, 5 aa, Mycobacterium
TYSSA

SEQ ID NO: 604393 - protein, 9 aa, Mycobacterium
TYSSAKSAL

SEQ ID NO: 604394 - protein, 10 aa, Mycobacterium
TYSSRGRESF

SEQ ID NO: 604395 - protein, 6 aa, Mycobacterium
TYSTDN

SEQ ID NO: 604396 - protein, 8 aa, Mycobacterium
TYSTGTTN

SEQ ID NO: 604397 - protein, 5 aa, Mycobacterium
TYSTN

SEQ ID NO: 604398 - protein, 6 aa, Mycobacterium
TYSTNN

SEQ ID NO: 604399 - protein, 5 aa, Mycobacterium
TYSTT

SEQ ID NO: 604400 - protein, 5 aa, Mycobacterium
TYTAG

SEQ ID NO: 604401 - protein, 4 aa, Mycobacterium
TYTD

SEQ ID NO: 604402 - protein, 20 aa, Mycobacterium
TYTEGATRWDADDQRPPAGE

SEQ ID NO: 604403 - protein, 4 aa, Mycobacterium
TYTG

SEQ ID NO: 604404 - protein, 5 aa, Mycobacterium
TYTGG

SEQ ID NO: 604405 - protein, 13 aa, Mycobacterium
TYTKVSETTAHGY

SEQ ID NO: 604406 - protein, 14 aa, Mycobacterium
TYTPALKASDAPKL

SEQ ID NO: 604407 - protein, 6 aa, Mycobacterium
TYTPNI

SEQ ID NO: 604408 - protein, 5 aa, Mycobacterium
TYTPQ

SEQ ID NO: 604409 - protein, 7 aa, Mycobacterium
TYTPRDL

SEQ ID NO: 604410 - protein, 4 aa, Mycobacterium
TYTQ

SEQ ID NO: 604411 - protein, 10 aa, Mycobacterium
TYTRGCGARG

SEQ ID NO: 604412 - protein, 12 aa, Mycobacterium
TYTSDPRIAQTQ

SEQ ID NO: 604413 - protein, 16 aa, Mycobacterium
TYTSQANTKQGNRRSE

SEQ ID NO: 604414 - protein, 4 aa, Mycobacterium
TYTT

SEQ ID NO: 604415 - protein, 9 aa, Mycobacterium
TYTTDDVTG

SEQ ID NO: 604416 - protein, 9 aa, Mycobacterium
TYTTKDGHV

SEQ ID NO: 604417 - protein, 10 aa, Mycobacterium
TYTTSDGEIA

SEQ ID NO: 604418 - protein, 10 aa, Mycobacterium
TYTTSDGEVA

SEQ ID NO: 604419 - protein, 6 aa, Mycobacterium
TYWGPE

SEQ ID NO: 604420 - protein, 4 aa, Mycobacterium
TYYR

SEQ ID NO: 604421 - protein, 63 aa, Mycobacterium
VAAAAAPQAAVEPEAAVGTTADEAAGEAAGDEAGGAAPADEAGEADEAGEATEDTEDAEGATE

SEQ ID NO: 604422 - protein, 11 aa, Mycobacterium
VAAADRPAARD

SEQ ID NO: 604423 - protein, 8 aa, Mycobacterium
VAAADSDG

SEQ ID NO: 604424 - protein, 17 aa, Mycobacterium
VAAAGDPAPPIRGVGQP

SEQ ID NO: 604425 - protein, 83 aa, Mycobacterium
VAAAGGGGGGGGAAGGPGGTAGNGGVGGNAFGGGSSGTGGTAGAGAPGGVGGGGGGGAVAQSSFANNGGPGRDGADGGDGGAG

SEQ ID NO: 604426 - protein, 9 aa, Mycobacterium
VAAAGSTTT

SEQ ID NO: 604427 - protein, 6 aa, Mycobacterium
VAAAGV

SEQ ID NO: 604428 - protein, 13 aa, Mycobacterium
VAAAPPATATPPI

SEQ ID NO: 604429 - protein, 9 aa, Mycobacterium
VAAASGSDL

SEQ ID NO: 604430 - protein, 9 aa, Mycobacterium
VAAASPDEL

SEQ ID NO: 604431 - protein, 17 aa, Mycobacterium
VAAASSPIKADLTGGLA

SEQ ID NO: 604432 - protein, 111 aa, Mycobacterium
VAAASTARKAAKKAPAKKAAPAKKTAAKKAAPAKKAATKAPAKKAAPAKKAAPAKKTAAKKAAPAKKAPAAKKAAPAKKAPAKKAATKAAPAKKAPAKKAPAKKAPAKRGR

SEQ ID NO: 604433 - protein, 13 aa, Mycobacterium
VAAASTGATEASS

SEQ ID NO: 604434 - protein, 10 aa, Mycobacterium
VAAASTPIKA

SEQ ID NO: 604435 - protein, 11 aa, Mycobacterium
VAAASTPIKAD

SEQ ID NO: 604436 - protein, 5 aa, Mycobacterium
VAAAT

SEQ ID NO: 604437 - protein, 7 aa, Mycobacterium
VAAATDD

SEQ ID NO: 604438 - protein, 7 aa, Mycobacterium
VAADAAG

SEQ ID NO: 604439 - protein, 8 aa, Mycobacterium
VAADAGGG

SEQ ID NO: 604440 - protein, 12 aa, Mycobacterium
VAADAKAQARTQ

SEQ ID NO: 604441 - protein, 8 aa, Mycobacterium
VAADCDDD

SEQ ID NO: 604442 - protein, 11 aa, Mycobacterium
VAADDETTARH

SEQ ID NO: 604443 - protein, 24 aa, Mycobacterium
VAADDIDSAPLESAVTEQAASGLL

SEQ ID NO: 604444 - protein, 9 aa, Mycobacterium
VAADGAQEL

SEQ ID NO: 604445 - protein, 9 aa, Mycobacterium
VAADGPDAF

SEQ ID NO: 604446 - protein, 6 aa, Mycobacterium
VAADPE

SEQ ID NO: 604447 - protein, 10 aa, Mycobacterium
VAADPGADYS

SEQ ID NO: 604448 - protein, 8 aa, Mycobacterium
VAADPQDR

SEQ ID NO: 604449 - protein, 6 aa, Mycobacterium
VAADPR

SEQ ID NO: 604450 - protein, 9 aa, Mycobacterium
VAADPTGPG

SEQ ID NO: 604451 - protein, 23 aa, Mycobacterium
VAADSTDKWRRDHERRAARAAVD

SEQ ID NO: 604452 - protein, 8 aa, Mycobacterium
VAADTAKG

SEQ ID NO: 604453 - protein, 8 aa, Mycobacterium
VAADTATA

SEQ ID NO: 604454 - protein, 4 aa, Mycobacterium
VAAE

SEQ ID NO: 604455 - protein, 5 aa, Mycobacterium
VAAEA

SEQ ID NO: 604456 - protein, 13 aa, Mycobacterium
VAAEAKDEARQRV

SEQ ID NO: 604457 - protein, 16 aa, Mycobacterium
VAAEGRAGYGVRGDHG

SEQ ID NO: 604458 - protein, 8 aa, Mycobacterium
VAAEQQSG

SEQ ID NO: 604459 - protein, 6 aa, Mycobacterium
VAAERG

SEQ ID NO: 604460 - protein, 6 aa, Mycobacterium
VAAESG

SEQ ID NO: 604461 - protein, 11 aa, Mycobacterium
VAAESKASKAT

SEQ ID NO: 604462 - protein, 6 aa, Mycobacterium
VAAESR

SEQ ID NO: 604463 - protein, 8 aa, Mycobacterium
VAAETGGH

SEQ ID NO: 604464 - protein, 5 aa, Mycobacterium
VAAGA

SEQ ID NO: 604465 - protein, 7 aa, Mycobacterium
VAAGADG

SEQ ID NO: 604466 - protein, 11 aa, Mycobacterium
VAAGDDERGSV

SEQ ID NO: 604467 - protein, 6 aa, Mycobacterium
VAAGDP

SEQ ID NO: 604468 - protein, 8 aa, Mycobacterium
VAAGDSAR

SEQ ID NO: 604469 - protein, 16 aa, Mycobacterium
VAAGDTNKATEYNNAA

SEQ ID NO: 604470 - protein, 6 aa, Mycobacterium
VAAGEG

SEQ ID NO: 604471 - protein, 31 aa, Mycobacterium
VAAGESAPSAPAVVSSGPDIRPALGEPADVA

SEQ ID NO: 604472 - protein, 20 aa, Mycobacterium
VAAGGDPDFGRGSSAYDGYW

SEQ ID NO: 604473 - protein, 7 aa, Mycobacterium
VAAGGER

SEQ ID NO: 604474 - protein, 7 aa, Mycobacterium
VAAGKDP

SEQ ID NO: 604475 - protein, 10 aa, Mycobacterium
VAAGNAKLSR

SEQ ID NO: 604476 - protein, 7 aa, Mycobacterium
VAAGPGE

SEQ ID NO: 604477 - protein, 7 aa, Mycobacterium
VAAGPNL

SEQ ID NO: 604478 - protein, 15 aa, Mycobacterium
VAAGPRAPGAHRSEQ

SEQ ID NO: 604479 - protein, 14 aa, Mycobacterium
VAAGPTDAASAPVA

SEQ ID NO: 604480 - protein, 5 aa, Mycobacterium
VAAGQ

SEQ ID NO: 604481 - protein, 9 aa, Mycobacterium
VAAGQHTSL

SEQ ID NO: 604482 - protein, 11 aa, Mycobacterium
VAAGQRDRGLE

SEQ ID NO: 604483 - protein, 8 aa, Mycobacterium
VAAGRAGD

SEQ ID NO: 604484 - protein, 9 aa, Mycobacterium
VAAGRDPAA

SEQ ID NO: 604485 - protein, 6 aa, Mycobacterium
VAAGRL

SEQ ID NO: 604486 - protein, 7 aa, Mycobacterium
VAAGRPA

SEQ ID NO: 604487 - protein, 11 aa, Mycobacterium
VAAGRPAVTTA

SEQ ID NO: 604488 - protein, 6 aa, Mycobacterium
VAAGRQ

SEQ ID NO: 604489 - protein, 8 aa, Mycobacterium
VAAGTPAE

SEQ ID NO: 604490 - protein, 8 aa, Mycobacterium
VAAGTSLN

SEQ ID NO: 604491 - protein, 5 aa, Mycobacterium
VAAHQ

SEQ ID NO: 604492 - protein, 11 aa, Mycobacterium
VAAKAGALAES

SEQ ID NO: 604493 - protein, 15 aa, Mycobacterium
VAANDGRKEVPEVSP

SEQ ID NO: 604494 - protein, 9 aa, Mycobacterium
VAANGGSKP

SEQ ID NO: 604495 - protein, 8 aa, Mycobacterium
VAANPGPF

SEQ ID NO: 604496 - protein, 13 aa, Mycobacterium
VAANTATATSGAV

SEQ ID NO: 604497 - protein, 4 aa, Mycobacterium
VAAP

SEQ ID NO: 604498 - protein, 11 aa, Mycobacterium
VAAPAKVEARR

SEQ ID NO: 604499 - protein, 6 aa, Mycobacterium
VAAPAR

SEQ ID NO: 604500 - protein, 7 aa, Mycobacterium
VAAPDRP

SEQ ID NO: 604501 - protein, 9 aa, Mycobacterium
VAAPGGRRE

SEQ ID NO: 604502 - protein, 15 aa, Mycobacterium
VAAPGGSEWSGNAGE

SEQ ID NO: 604503 - protein, 6 aa, Mycobacterium
VAAPGL

SEQ ID NO: 604504 - protein, 7 aa, Mycobacterium
VAAPGVA

SEQ ID NO: 604505 - protein, 18 aa, Mycobacterium
VAAPPDRETGEAADAIAR

SEQ ID NO: 604506 - protein, 9 aa, Mycobacterium
VAAPPGATT

SEQ ID NO: 604507 - protein, 6 aa, Mycobacterium
VAAPQA

SEQ ID NO: 604508 - protein, 7 aa, Mycobacterium
VAAPQPW

SEQ ID NO: 604509 - protein, 6 aa, Mycobacterium
VAAPRD

SEQ ID NO: 604510 - protein, 14 aa, Mycobacterium
VAAPRGPALGADNA

SEQ ID NO: 604511 - protein, 14 aa, Mycobacterium
VAAPRKRRAAAGTI

SEQ ID NO: 604512 - protein, 8 aa, Mycobacterium
VAAPRSVR

SEQ ID NO: 604513 - protein, 31 aa, Mycobacterium
VAAPTPPSAPPSATSTVANAAPPPPPAPAAA

SEQ ID NO: 604514 - protein, 4 aa, Mycobacterium
VAAQ

SEQ ID NO: 604515 - protein, 9 aa, Mycobacterium
VAAQAAEQY

SEQ ID NO: 604516 - protein, 10 aa, Mycobacterium
VAAQAQSPDN

SEQ ID NO: 604517 - protein, 5 aa, Mycobacterium
VAAQG

SEQ ID NO: 604518 - protein, 6 aa, Mycobacterium
VAAQGP

SEQ ID NO: 604519 - protein, 6 aa, Mycobacterium
VAARDD

SEQ ID NO: 604520 - protein, 7 aa, Mycobacterium
VAARDGH

SEQ ID NO: 604521 - protein, 7 aa, Mycobacterium
VAARETA

SEQ ID NO: 604522 - protein, 6 aa, Mycobacterium
VAARGD

SEQ ID NO: 604523 - protein, 8 aa, Mycobacterium
VAARGGNG

SEQ ID NO: 604524 - protein, 6 aa, Mycobacterium
VAARSS

SEQ ID NO: 604525 - protein, 11 aa, Mycobacterium
VAASDDQPALI

SEQ ID NO: 604526 - protein, 12 aa, Mycobacterium
VAASGAATPADA

SEQ ID NO: 604527 - protein, 7 aa, Mycobacterium
VAASGGE

SEQ ID NO: 604528 - protein, 11 aa, Mycobacterium
VAASGQGMLSP

SEQ ID NO: 604529 - protein, 17 aa, Mycobacterium
VAASGTGAGSGDFPGEP

SEQ ID NO: 604530 - protein, 13 aa, Mycobacterium
VAASLGSGRQRPG

SEQ ID NO: 604531 - protein, 7 aa, Mycobacterium
VAASPDE

SEQ ID NO: 604532 - protein, 7 aa, Mycobacterium
VAASPDV

SEQ ID NO: 604533 - protein, 24 aa, Mycobacterium
VAASPTRGLGRRSSDNDDKTPDKL

SEQ ID NO: 604534 - protein, 8 aa, Mycobacterium
VAASTAKG

SEQ ID NO: 604535 - protein, 4 aa, Mycobacterium
VAAT

SEQ ID NO: 604536 - protein, 7 aa, Mycobacterium
VAATAGR

SEQ ID NO: 604537 - protein, 11 aa, Mycobacterium
VAATARKPGQL

SEQ ID NO: 604538 - protein, 8 aa, Mycobacterium
VAATGDSA

SEQ ID NO: 604539 - protein, 7 aa, Mycobacterium
VAATGGA

SEQ ID NO: 604540 - protein, 54 aa, Mycobacterium
VAATGGAALQPSGDPGGRPPARRRGHRRPPRRPGRAAPTRRSRRGRTARHPRRR

SEQ ID NO: 604541 - protein, 9 aa, Mycobacterium
VAATNNEQL

SEQ ID NO: 604542 - protein, 5 aa, Mycobacterium
VAATP

SEQ ID NO: 604543 - protein, 35 aa, Mycobacterium
VAATPQTDPAPPIVKSDASSDDSGDEDHDPKIDNP

SEQ ID NO: 604544 - protein, 16 aa, Mycobacterium
VAATQSTGASAAAPSL

SEQ ID NO: 604545 - protein, 5 aa, Mycobacterium
VAATS

SEQ ID NO: 604546 - protein, 8 aa, Mycobacterium
VAATSEEV

SEQ ID NO: 604547 - protein, 8 aa, Mycobacterium
VACSPDEL

SEQ ID NO: 604548 - protein, 7 aa, Mycobacterium
VADAASE

SEQ ID NO: 604549 - protein, 10 aa, Mycobacterium
VADAASGDTL

SEQ ID NO: 604550 - protein, 10 aa, Mycobacterium
VADAENGPSL

SEQ ID NO: 604551 - protein, 9 aa, Mycobacterium
VADAEPKAA

SEQ ID NO: 604552 - protein, 8 aa, Mycobacterium
VADAGEAQ

SEQ ID NO: 604553 - protein, 6 aa, Mycobacterium
VADAGQ

SEQ ID NO: 604554 - protein, 8 aa, Mycobacterium
VADAGSPS

SEQ ID NO: 604555 - protein, 6 aa, Mycobacterium
VADAPT

SEQ ID NO: 604556 - protein, 9 aa, Mycobacterium
VADATAAAA

SEQ ID NO: 604557 - protein, 4 aa, Mycobacterium
VADD

SEQ ID NO: 604558 - protein, 10 aa, Mycobacterium
VADDASADRL

SEQ ID NO: 604559 - protein, 9 aa, Mycobacterium
VADDDEATR

SEQ ID NO: 604560 - protein, 7 aa, Mycobacterium
VADDDPR

SEQ ID NO: 604561 - protein, 9 aa, Mycobacterium
VADDGQLTD

SEQ ID NO: 604562 - protein, 11 aa, Mycobacterium
VADDGTEFGGA

SEQ ID NO: 604563 - protein, 10 aa, Mycobacterium
VADDPKKRRK

SEQ ID NO: 604564 - protein, 8 aa, Mycobacterium
VADDPSEQ

SEQ ID NO: 604565 - protein, 21 aa, Mycobacterium
VADDPTLAYGPGRGAIGSPET

SEQ ID NO: 604566 - protein, 8 aa, Mycobacterium
VADDQQAP

SEQ ID NO: 604567 - protein, 10 aa, Mycobacterium
VADDSAYEYE

SEQ ID NO: 604568 - protein, 7 aa, Mycobacterium
VADDSGL

SEQ ID NO: 604569 - protein, 10 aa, Mycobacterium
VADEAGPLAE

SEQ ID NO: 604570 - protein, 6 aa, Mycobacterium
VADEDA

SEQ ID NO: 604571 - protein, 8 aa, Mycobacterium
VADEDDPN

SEQ ID NO: 604572 - protein, 6 aa, Mycobacterium
VADEQQ

SEQ ID NO: 604573 - protein, 19 aa, Mycobacterium
VADERRALAASKPDIDPLN

SEQ ID NO: 604574 - protein, 10 aa, Mycobacterium
VADETRRGLT

SEQ ID NO: 604575 - protein, 11 aa, Mycobacterium
VADGDPGAGVA

SEQ ID NO: 604576 - protein, 7 aa, Mycobacterium
VADGEDL

SEQ ID NO: 604577 - protein, 10 aa, Mycobacterium
VADGEPVRTP

SEQ ID NO: 604578 - protein, 6 aa, Mycobacterium
VADGGH

SEQ ID NO: 604579 - protein, 10 aa, Mycobacterium
VADGGYGLDP

SEQ ID NO: 604580 - protein, 17 aa, Mycobacterium
VADGPAAETLAQQRDRL

SEQ ID NO: 604581 - protein, 11 aa, Mycobacterium
VADGRLSPTAL

SEQ ID NO: 604582 - protein, 9 aa, Mycobacterium
VADGSFRPD

SEQ ID NO: 604583 - protein, 15 aa, Mycobacterium
VADGSGTVELNPDRV

SEQ ID NO: 604584 - protein, 6 aa, Mycobacterium
VADGSR

SEQ ID NO: 604585 - protein, 20 aa, Mycobacterium
VADGSSDAYTAAERLFAGSV

SEQ ID NO: 604586 - protein, 7 aa, Mycobacterium
VADGTAH

SEQ ID NO: 604587 - protein, 9 aa, Mycobacterium
VADGTELAA

SEQ ID NO: 604588 - protein, 12 aa, Mycobacterium
VADGTLEAKPSR

SEQ ID NO: 604589 - protein, 12 aa, Mycobacterium
VADGTVRPSVNA

SEQ ID NO: 604590 - protein, 32 aa, Mycobacterium
VADKGVRFSSGAAGSATSGRGNASHEAPVAIG

SEQ ID NO: 604591 - protein, 7 aa, Mycobacterium
VADKSEL

SEQ ID NO: 604592 - protein, 9 aa, Mycobacterium
VADNAKSLA

SEQ ID NO: 604593 - protein, 8 aa, Mycobacterium
VADNAQAL

SEQ ID NO: 604594 - protein, 19 aa, Mycobacterium
VADNASQGLQAGATASTPL

SEQ ID NO: 604595 - protein, 10 aa, Mycobacterium
VADNASSGGV

SEQ ID NO: 604596 - protein, 33 aa, Mycobacterium
VADNDDHSARDVADTADVAAGADAADRNALPLS

SEQ ID NO: 604597 - protein, 8 aa, Mycobacterium
VADNGSSG

SEQ ID NO: 604598 - protein, 7 aa, Mycobacterium
VADPAEA

SEQ ID NO: 604599 - protein, 7 aa, Mycobacterium
VADPAER

SEQ ID NO: 604600 - protein, 12 aa, Mycobacterium
VADPASAADPDL

SEQ ID NO: 604601 - protein, 7 aa, Mycobacterium
VADPDAY

SEQ ID NO: 604602 - protein, 10 aa, Mycobacterium
VADPDGTEAT

SEQ ID NO: 604603 - protein, 14 aa, Mycobacterium
VADPEAALANAGLS

SEQ ID NO: 604604 - protein, 7 aa, Mycobacterium
VADPERL

SEQ ID NO: 604605 - protein, 9 aa, Mycobacterium
VADPETLPS

SEQ ID NO: 604606 - protein, 10 aa, Mycobacterium
VADPGGQHQR

SEQ ID NO: 604607 - protein, 10 aa, Mycobacterium
VADPGHGGST

SEQ ID NO: 604608 - protein, 27 aa, Mycobacterium
VADPGLGGVGSGLSSGVGSGLAGAGQQ

SEQ ID NO: 604609 - protein, 13 aa, Mycobacterium
VADPGPRYTGDIP

SEQ ID NO: 604610 - protein, 8 aa, Mycobacterium
VADPKLSA

SEQ ID NO: 604611 - protein, 8 aa, Mycobacterium
VADPLGAG

SEQ ID NO: 604612 - protein, 6 aa, Mycobacterium
VADPPD

SEQ ID NO: 604613 - protein, 8 aa, Mycobacterium
VADPPLGQ

SEQ ID NO: 604614 - protein, 7 aa, Mycobacterium
VADPRAW

SEQ ID NO: 604615 - protein, 7 aa, Mycobacterium
VADPRDV

SEQ ID NO: 604616 - protein, 7 aa, Mycobacterium
VADPRER

SEQ ID NO: 604617 - protein, 9 aa, Mycobacterium
VADPRSRAT

SEQ ID NO: 604618 - protein, 7 aa, Mycobacterium
VADPSAL

SEQ ID NO: 604619 - protein, 7 aa, Mycobacterium
VADPSPI

SEQ ID NO: 604620 - protein, 14 aa, Mycobacterium
VADPSRAHTGSGLP

SEQ ID NO: 604621 - protein, 7 aa, Mycobacterium
VADPTDV

SEQ ID NO: 604622 - protein, 15 aa, Mycobacterium
VADPTGAGFNLSSLQ

SEQ ID NO: 604623 - protein, 16 aa, Mycobacterium
VADQATAKLQAAIGAL

SEQ ID NO: 604624 - protein, 7 aa, Mycobacterium
VADQPTA

SEQ ID NO: 604625 - protein, 9 aa, Mycobacterium
VADRDDTTR

SEQ ID NO: 604626 - protein, 7 aa, Mycobacterium
VADRDGL

SEQ ID NO: 604627 - protein, 15 aa, Mycobacterium
VADREAPAARARAIR

SEQ ID NO: 604628 - protein, 5 aa, Mycobacterium
VADRG

SEQ ID NO: 604629 - protein, 10 aa, Mycobacterium
VADRGAAERA

SEQ ID NO: 604630 - protein, 10 aa, Mycobacterium
VADRGGSRNM

SEQ ID NO: 604631 - protein, 7 aa, Mycobacterium
VADRPAV

SEQ ID NO: 604632 - protein, 8 aa, Mycobacterium
VADRPETT

SEQ ID NO: 604633 - protein, 9 aa, Mycobacterium
VADRPQARS

SEQ ID NO: 604634 - protein, 17 aa, Mycobacterium
VADRPRPVTPTPAPGGF

SEQ ID NO: 604635 - protein, 12 aa, Mycobacterium
VADRQSPAARVS

SEQ ID NO: 604636 - protein, 6 aa, Mycobacterium
VADRSS

SEQ ID NO: 604637 - protein, 8 aa, Mycobacterium
VADRSSVS

SEQ ID NO: 604638 - protein, 8 aa, Mycobacterium
VADSAALD

SEQ ID NO: 604639 - protein, 8 aa, Mycobacterium
VADSAEAA

SEQ ID NO: 604640 - protein, 8 aa, Mycobacterium
VADSAGAI

SEQ ID NO: 604641 - protein, 5 aa, Mycobacterium
VADSD

SEQ ID NO: 604642 - protein, 12 aa, Mycobacterium
VADSGRVEDHDE

SEQ ID NO: 604643 - protein, 18 aa, Mycobacterium
VADSNGPYEYNEARNKAR

SEQ ID NO: 604644 - protein, 9 aa, Mycobacterium
VADSRSALT

SEQ ID NO: 604645 - protein, 18 aa, Mycobacterium
VADSSGLGNAGGTGNSGY

SEQ ID NO: 604646 - protein, 9 aa, Mycobacterium
VADSSQSGV

SEQ ID NO: 604647 - protein, 6 aa, Mycobacterium
VADTEG

SEQ ID NO: 604648 - protein, 9 aa, Mycobacterium
VADTGTAAL

SEQ ID NO: 604649 - protein, 21 aa, Mycobacterium
VADTRTSRTAAEQASRQAQAQ

SEQ ID NO: 604650 - protein, 13 aa, Mycobacterium
VADTSAEQIAADA

SEQ ID NO: 604651 - protein, 15 aa, Mycobacterium
VADTVRPAVAGAKER

SEQ ID NO: 604652 - protein, 12 aa, Mycobacterium
VADVPASAIAAS

SEQ ID NO: 604653 - protein, 14 aa, Mycobacterium
VADYSAALQAFLSP

SEQ ID NO: 604654 - protein, 4 aa, Mycobacterium
VAEA

SEQ ID NO: 604655 - protein, 5 aa, Mycobacterium
VAEAA

SEQ ID NO: 604656 - protein, 6 aa, Mycobacterium
VAEAEA

SEQ ID NO: 604657 - protein, 8 aa, Mycobacterium
VAEAEDAV

SEQ ID NO: 604658 - protein, 9 aa, Mycobacterium
VAEAGLSDT

SEQ ID NO: 604659 - protein, 9 aa, Mycobacterium
VAEAGPTRT

SEQ ID NO: 604660 - protein, 6 aa, Mycobacterium
VAEAGR

SEQ ID NO: 604661 - protein, 7 aa, Mycobacterium
VAEAGSR

SEQ ID NO: 604662 - protein, 12 aa, Mycobacterium
VAEAKSALAGTD

SEQ ID NO: 604663 - protein, 21 aa, Mycobacterium
VAEAPKSASEKAAESAAPHKV

SEQ ID NO: 604664 - protein, 11 aa, Mycobacterium
VAEAQKPAARQ

SEQ ID NO: 604665 - protein, 18 aa, Mycobacterium
VAEARNALADNGADDIAP

SEQ ID NO: 604666 - protein, 13 aa, Mycobacterium
VAEARSRLNPAAG

SEQ ID NO: 604667 - protein, 5 aa, Mycobacterium
VAEAT

SEQ ID NO: 604668 - protein, 9 aa, Mycobacterium
VAEATSGAE

SEQ ID NO: 604669 - protein, 7 aa, Mycobacterium
VAEDAAR

SEQ ID NO: 604670 - protein, 6 aa, Mycobacterium
VAEDDD

SEQ ID NO: 604671 - protein, 11 aa, Mycobacterium
VAEDDGETSLE

SEQ ID NO: 604672 - protein, 22 aa, Mycobacterium
VAEDGLQATRARADEAATAGRL

SEQ ID NO: 604673 - protein, 7 aa, Mycobacterium
VAEDGPD

SEQ ID NO: 604674 - protein, 7 aa, Mycobacterium
VAEDGSR

SEQ ID NO: 604675 - protein, 10 aa, Mycobacterium
VAEDGTPSVR

SEQ ID NO: 604676 - protein, 15 aa, Mycobacterium
VAEDGTYSSPIENEN

SEQ ID NO: 604677 - protein, 15 aa, Mycobacterium
VAEDGTYSSPIENPN

SEQ ID NO: 604678 - protein, 5 aa, Mycobacterium
VAEDQ

SEQ ID NO: 604679 - protein, 8 aa, Mycobacterium
VAEDREQM

SEQ ID NO: 604680 - protein, 8 aa, Mycobacterium
VAEDSARR

SEQ ID NO: 604681 - protein, 12 aa, Mycobacterium
VAEDSEIAGGGE

SEQ ID NO: 604682 - protein, 10 aa, Mycobacterium
VAEDSEKEAH

SEQ ID NO: 604683 - protein, 19 aa, Mycobacterium
VAEDVERGTFRGQLIQGEL

SEQ ID NO: 604684 - protein, 6 aa, Mycobacterium
VAEEAK

SEQ ID NO: 604685 - protein, 16 aa, Mycobacterium
VAEEEAGEAEPAAEKS

SEQ ID NO: 604686 - protein, 11 aa, Mycobacterium
VAEEGGNPQLA

SEQ ID NO: 604687 - protein, 9 aa, Mycobacterium
VAEEHDGDL

SEQ ID NO: 604688 - protein, 14 aa, Mycobacterium
VAEEIGRRAAQAGI

SEQ ID NO: 604689 - protein, 5 aa, Mycobacterium
VAEEK

SEQ ID NO: 604690 - protein, 12 aa, Mycobacterium
VAEERNRLAQSQ

SEQ ID NO: 604691 - protein, 7 aa, Mycobacterium
VAEETGA

SEQ ID NO: 604692 - protein, 11 aa, Mycobacterium
VAEGAQREALG

SEQ ID NO: 604693 - protein, 10 aa, Mycobacterium
VAEGAREAGA

SEQ ID NO: 604694 - protein, 12 aa, Mycobacterium
VAEGASSEDARS

SEQ ID NO: 604695 - protein, 18 aa, Mycobacterium
VAEGDAPYPAAVAQDDRG

SEQ ID NO: 604696 - protein, 11 aa, Mycobacterium
VAEGDSGVMRR

SEQ ID NO: 604697 - protein, 24 aa, Mycobacterium
VAEGGQEAEAKLAEASAAIARLVR

SEQ ID NO: 604698 - protein, 6 aa, Mycobacterium
VAEGGR

SEQ ID NO: 604699 - protein, 10 aa, Mycobacterium
VAEGKQKPYV

SEQ ID NO: 604700 - protein, 10 aa, Mycobacterium
VAEGNAKLSR

SEQ ID NO: 604701 - protein, 14 aa, Mycobacterium
VAEGPGINDNGSGV

SEQ ID NO: 604702 - protein, 17 aa, Mycobacterium
VAEGPGREPAGHAERGP

SEQ ID NO: 604703 - protein, 8 aa, Mycobacterium
VAEGPTVE

SEQ ID NO: 604704 - protein, 7 aa, Mycobacterium
VAEGRGV

SEQ ID NO: 604705 - protein, 13 aa, Mycobacterium
VAEGRTLTSYPSI

SEQ ID NO: 604706 - protein, 9 aa, Mycobacterium
VAEGTPSEL

SEQ ID NO: 604707 - protein, 6 aa, Mycobacterium
VAEGTV

SEQ ID NO: 604708 - protein, 6 aa, Mycobacterium
VAEHES

SEQ ID NO: 604709 - protein, 10 aa, Mycobacterium
VAEHNATRST

SEQ ID NO: 604710 - protein, 9 aa, Mycobacterium
VAEHSDSEI

SEQ ID NO: 604711 - protein, 12 aa, Mycobacterium
VAEHSGDDAIGE

SEQ ID NO: 604712 - protein, 18 aa, Mycobacterium
VAEKAPPADGAAEGDDLE

SEQ ID NO: 604713 - protein, 17 aa, Mycobacterium
VAEKGIDGLAADRGSVI

SEQ ID NO: 604714 - protein, 8 aa, Mycobacterium
VAEKPEEV

SEQ ID NO: 604715 - protein, 9 aa, Mycobacterium
VAEKTNKYL

SEQ ID NO: 604716 - protein, 7 aa, Mycobacterium
VAELGDT

SEQ ID NO: 604717 - protein, 11 aa, Mycobacterium
VAELQDPGSIA

SEQ ID NO: 604718 - protein, 8 aa, Mycobacterium
VAENGYDQ

SEQ ID NO: 604719 - protein, 8 aa, Mycobacterium
VAENRDEA

SEQ ID NO: 604720 - protein, 4 aa, Mycobacterium
VAEP

SEQ ID NO: 604721 - protein, 5 aa, Mycobacterium
VAEPA

SEQ ID NO: 604722 - protein, 21 aa, Mycobacterium
VAEPAGNTAQNTSQVASPQAL

SEQ ID NO: 604723 - protein, 19 aa, Mycobacterium
VAEPAGNTAQTTSQLASPH

SEQ ID NO: 604724 - protein, 19 aa, Mycobacterium
VAEPARLAPAGAQPARPSD

SEQ ID NO: 604725 - protein, 6 aa, Mycobacterium
VAEPED

SEQ ID NO: 604726 - protein, 20 aa, Mycobacterium
VAEPEPAGQPDVEEVPDELT

SEQ ID NO: 604727 - protein, 12 aa, Mycobacterium
VAEPEPDGVPDI

SEQ ID NO: 604728 - protein, 21 aa, Mycobacterium
VAEPEPPGEPDIEEVPDDLTP

SEQ ID NO: 604729 - protein, 9 aa, Mycobacterium
VAEPGDAEL

SEQ ID NO: 604730 - protein, 16 aa, Mycobacterium
VAEPGDHTARMPGGNA

SEQ ID NO: 604731 - protein, 7 aa, Mycobacterium
VAEPGHT

SEQ ID NO: 604732 - protein, 10 aa, Mycobacterium
VAEPGQTLAS

SEQ ID NO: 604733 - protein, 10 aa, Mycobacterium
VAEPGSDDDL

SEQ ID NO: 604734 - protein, 27 aa, Mycobacterium
VAEPGSDEPALSGDRPARSAAPQVDEL

SEQ ID NO: 604735 - protein, 5 aa, Mycobacterium
VAEPL

SEQ ID NO: 604736 - protein, 46 aa, Mycobacterium
VAEPPPPPPRWRPRPAEPVAPAEPVEPEAGEPEATHAEEPAAAPDV

SEQ ID NO: 604737 - protein, 13 aa, Mycobacterium
VAEPSDDIERPAR

SEQ ID NO: 604738 - protein, 10 aa, Mycobacterium
VAEPSSTSAA

SEQ ID NO: 604739 - protein, 8 aa, Mycobacterium
VAEPSYDG

SEQ ID NO: 604740 - protein, 13 aa, Mycobacterium
VAEPTAPAPGNPL

SEQ ID NO: 604741 - protein, 13 aa, Mycobacterium
VAEPTAPPPANPL

SEQ ID NO: 604742 - protein, 11 aa, Mycobacterium
VAEPTAPYAQT

SEQ ID NO: 604743 - protein, 6 aa, Mycobacterium
VAEPTG

SEQ ID NO: 604744 - protein, 9 aa, Mycobacterium
VAEPTPGQG

SEQ ID NO: 604745 - protein, 5 aa, Mycobacterium
VAEQR

SEQ ID NO: 604746 - protein, 11 aa, Mycobacterium
VAEQRGTIPAD

SEQ ID NO: 604747 - protein, 11 aa, Mycobacterium
VAEQRGTIPTD

SEQ ID NO: 604748 - protein, 8 aa, Mycobacterium
VAEQSDTA

SEQ ID NO: 604749 - protein, 7 aa, Mycobacterium
VAEQSNT

SEQ ID NO: 604750 - protein, 5 aa, Mycobacterium
VAEQT

SEQ ID NO: 604751 - protein, 17 aa, Mycobacterium
VAERDSLDASSNLAGAG

SEQ ID NO: 604752 - protein, 17 aa, Mycobacterium
VAEREARTQTATFEDEP

SEQ ID NO: 604753 - protein, 8 aa, Mycobacterium
VAEREPGV

SEQ ID NO: 604754 - protein, 5 aa, Mycobacterium
VAERG

SEQ ID NO: 604755 - protein, 9 aa, Mycobacterium
VAERGGTPL

SEQ ID NO: 604756 - protein, 8 aa, Mycobacterium
VAERGRAG

SEQ ID NO: 604757 - protein, 5 aa, Mycobacterium
VAERI

SEQ ID NO: 604758 - protein, 8 aa, Mycobacterium
VAERSDDI

SEQ ID NO: 604759 - protein, 12 aa, Mycobacterium
VAERSDRPAGVG

SEQ ID NO: 604760 - protein, 8 aa, Mycobacterium
VAERSGVN

SEQ ID NO: 604761 - protein, 8 aa, Mycobacterium
VAERTDET

SEQ ID NO: 604762 - protein, 11 aa, Mycobacterium
VAERTNASTTG

SEQ ID NO: 604763 - protein, 4 aa, Mycobacterium
VAES

SEQ ID NO: 604764 - protein, 6 aa, Mycobacterium
VAESAE

SEQ ID NO: 604765 - protein, 7 aa, Mycobacterium
VAESAET

SEQ ID NO: 604766 - protein, 18 aa, Mycobacterium
VAESAGGAATPETATESA

SEQ ID NO: 604767 - protein, 10 aa, Mycobacterium
VAESAPAEAI

SEQ ID NO: 604768 - protein, 11 aa, Mycobacterium
VAESDDESVDP

SEQ ID NO: 604769 - protein, 7 aa, Mycobacterium
VAESDEA

SEQ ID NO: 604770 - protein, 5 aa, Mycobacterium
VAESE

SEQ ID NO: 604771 - protein, 7 aa, Mycobacterium
VAESEDR

SEQ ID NO: 604772 - protein, 6 aa, Mycobacterium
VAESEE

SEQ ID NO: 604773 - protein, 7 aa, Mycobacterium
VAESEEL

SEQ ID NO: 604774 - protein, 5 aa, Mycobacterium
VAESG

SEQ ID NO: 604775 - protein, 10 aa, Mycobacterium
VAESGERQEL

SEQ ID NO: 604776 - protein, 30 aa, Mycobacterium
VAESGGRMPDRAPRRRARVRSTASLAECGL

SEQ ID NO: 604777 - protein, 6 aa, Mycobacterium
VAESGR

SEQ ID NO: 604778 - protein, 8 aa, Mycobacterium
VAESGRAV

SEQ ID NO: 604779 - protein, 8 aa, Mycobacterium
VAESIPCG

SEQ ID NO: 604780 - protein, 5 aa, Mycobacterium
VAESR

SEQ ID NO: 604781 - protein, 9 aa, Mycobacterium
VAESRGQSL

SEQ ID NO: 604782 - protein, 6 aa, Mycobacterium
VAESSG

SEQ ID NO: 604783 - protein, 6 aa, Mycobacterium
VAESSV

SEQ ID NO: 604784 - protein, 7 aa, Mycobacterium
VAETAKT

SEQ ID NO: 604785 - protein, 11 aa, Mycobacterium
VAETARRAGTR

SEQ ID NO: 604786 - protein, 11 aa, Mycobacterium
VAETDSRTAVT

SEQ ID NO: 604787 - protein, 21 aa, Mycobacterium
VAETEPEGRPDIEEVPDELTP

SEQ ID NO: 604788 - protein, 5 aa, Mycobacterium
VAETG

SEQ ID NO: 604789 - protein, 18 aa, Mycobacterium
VAETGYGPVRGTDDGTAK

SEQ ID NO: 604790 - protein, 36 aa, Mycobacterium
VAETRTIGPPPPAGPQPADAPDDHPPAARPAREPST

SEQ ID NO: 604791 - protein, 8 aa, Mycobacterium
VAETSDAL

SEQ ID NO: 604792 - protein, 16 aa, Mycobacterium
VAETTRLTEGLGAGRA

SEQ ID NO: 604793 - protein, 4 aa, Mycobacterium
VAGA

SEQ ID NO: 604794 - protein, 5 aa, Mycobacterium
VAGAD

SEQ ID NO: 604795 - protein, 7 aa, Mycobacterium
VAGADAA

SEQ ID NO: 604796 - protein, 16 aa, Mycobacterium
VAGAEEKFRPGSSAQW

SEQ ID NO: 604797 - protein, 19 aa, Mycobacterium
VAGAELPAEPPGPGDTVTR

SEQ ID NO: 604798 - protein, 5 aa, Mycobacterium
VAGAG

SEQ ID NO: 604799 - protein, 7 aa, Mycobacterium
VAGAGEA

SEQ ID NO: 604800 - protein, 8 aa, Mycobacterium
VAGAGGAP

SEQ ID NO: 604801 - protein, 69 aa, Mycobacterium
VAGAGVGAGDCGPPGNCPGAGGFGAPGSCPGPGAPGGGPPRKAWPAGGTGIGGGPPGIGPRSAPGPGGG

SEQ ID NO: 604802 - protein, 7 aa, Mycobacterium
VAGAPDA

SEQ ID NO: 604803 - protein, 6 aa, Mycobacterium
VAGARR

SEQ ID NO: 604804 - protein, 7 aa, Mycobacterium
VAGARRI

SEQ ID NO: 604805 - protein, 11 aa, Mycobacterium
VAGASAQRGLS

SEQ ID NO: 604806 - protein, 7 aa, Mycobacterium
VAGASPA

SEQ ID NO: 604807 - protein, 5 aa, Mycobacterium
VAGAT

SEQ ID NO: 604808 - protein, 5 aa, Mycobacterium
VAGDA

SEQ ID NO: 604809 - protein, 8 aa, Mycobacterium
VAGDAEAA

SEQ ID NO: 604810 - protein, 9 aa, Mycobacterium
VAGDDEDAV

SEQ ID NO: 604811 - protein, 9 aa, Mycobacterium
VAGDDGTVG

SEQ ID NO: 604812 - protein, 10 aa, Mycobacterium
VAGDDPPAIR

SEQ ID NO: 604813 - protein, 5 aa, Mycobacterium
VAGDE

SEQ ID NO: 604814 - protein, 5 aa, Mycobacterium
VAGDG

SEQ ID NO: 604815 - protein, 6 aa, Mycobacterium
VAGDGA

SEQ ID NO: 604816 - protein, 11 aa, Mycobacterium
VAGDGGPRAAA

SEQ ID NO: 604817 - protein, 14 aa, Mycobacterium
VAGDGSPRLQHGTE

SEQ ID NO: 604818 - protein, 12 aa, Mycobacterium
VAGDGSRGAPKV

SEQ ID NO: 604819 - protein, 9 aa, Mycobacterium
VAGDIEGAA

SEQ ID NO: 604820 - protein, 10 aa, Mycobacterium
VAGDPDGGAV

SEQ ID NO: 604821 - protein, 9 aa, Mycobacterium
VAGDPDNPM

SEQ ID NO: 604822 - protein, 6 aa, Mycobacterium
VAGDPL

SEQ ID NO: 604823 - protein, 8 aa, Mycobacterium
VAGDPRLA

SEQ ID NO: 604824 - protein, 8 aa, Mycobacterium
VAGDPTDY

SEQ ID NO: 604825 - protein, 13 aa, Mycobacterium
VAGDQGSAAAIHG

SEQ ID NO: 604826 - protein, 11 aa, Mycobacterium
VAGDRDERGWE

SEQ ID NO: 604827 - protein, 7 aa, Mycobacterium
VAGDRGV

SEQ ID NO: 604828 - protein, 9 aa, Mycobacterium
VAGDSDAGV

SEQ ID NO: 604829 - protein, 7 aa, Mycobacterium
VAGDSDL

SEQ ID NO: 604830 - protein, 10 aa, Mycobacterium
VAGDSDSGFT

SEQ ID NO: 604831 - protein, 9 aa, Mycobacterium
VAGDSDSGV

SEQ ID NO: 604832 - protein, 8 aa, Mycobacterium
VAGDTAAN

SEQ ID NO: 604833 - protein, 8 aa, Mycobacterium
VAGDTDAG

SEQ ID NO: 604834 - protein, 7 aa, Mycobacterium
VAGDTSA

SEQ ID NO: 604835 - protein, 5 aa, Mycobacterium
VAGDV

SEQ ID NO: 604836 - protein, 10 aa, Mycobacterium
VAGDVAGATE

SEQ ID NO: 604837 - protein, 4 aa, Mycobacterium
VAGE

SEQ ID NO: 604838 - protein, 8 aa, Mycobacterium
VAGEESAA

SEQ ID NO: 604839 - protein, 8 aa, Mycobacterium
VAGEETAA

SEQ ID NO: 604840 - protein, 9 aa, Mycobacterium
VAGEGPDVR

SEQ ID NO: 604841 - protein, 7 aa, Mycobacterium
VAGEGRP

SEQ ID NO: 604842 - protein, 7 aa, Mycobacterium
VAGEHNA

SEQ ID NO: 604843 - protein, 9 aa, Mycobacterium
VAGESAKFG

SEQ ID NO: 604844 - protein, 11 aa, Mycobacterium
VAGESAKFGVS

SEQ ID NO: 604845 - protein, 11 aa, Mycobacterium
VAGESTSQVRD

SEQ ID NO: 604846 - protein, 8 aa, Mycobacterium
VAGETAPP

SEQ ID NO: 604847 - protein, 55 aa, Mycobacterium
VAGETTDATDTLTKAAEDIKAKSKTRASRTSKNNNDESTTSTAASSESASDDKAA

SEQ ID NO: 604848 - protein, 5 aa, Mycobacterium
VAGGA

SEQ ID NO: 604849 - protein, 6 aa, Mycobacterium
VAGGAT

SEQ ID NO: 604850 - protein, 10 aa, Mycobacterium
VAGGATDPRF

SEQ ID NO: 604851 - protein, 13 aa, Mycobacterium
VAGGDVADAPWTP

SEQ ID NO: 604852 - protein, 34 aa, Mycobacterium
VAGGGDGGDGGNGGAGGFGQNGGPGGRGGGGGHS

SEQ ID NO: 604853 - protein, 19 aa, Mycobacterium
VAGGGDGRVAGGELPDGSA

SEQ ID NO: 604854 - protein, 12 aa, Mycobacterium
VAGGGELGAESS

SEQ ID NO: 604855 - protein, 11 aa, Mycobacterium
VAGGGGTRDAP

SEQ ID NO: 604856 - protein, 6 aa, Mycobacterium
VAGGGP

SEQ ID NO: 604857 - protein, 8 aa, Mycobacterium
VAGGGPEI

SEQ ID NO: 604858 - protein, 6 aa, Mycobacterium
VAGGGS

SEQ ID NO: 604859 - protein, 11 aa, Mycobacterium
VAGGKDVTQTA

SEQ ID NO: 604860 - protein, 10 aa, Mycobacterium
VAGGPDRTRS

SEQ ID NO: 604861 - protein, 7 aa, Mycobacterium
VAGGPDT

SEQ ID NO: 604862 - protein, 17 aa, Mycobacterium
VAGGPHSADGERLHGAA

SEQ ID NO: 604863 - protein, 6 aa, Mycobacterium
VAGGPL

SEQ ID NO: 604864 - protein, 18 aa, Mycobacterium
VAGGRAAETRSADPLISD

SEQ ID NO: 604865 - protein, 8 aa, Mycobacterium
VAGGSAAD

SEQ ID NO: 604866 - protein, 10 aa, Mycobacterium
VAGGSPAAAA

SEQ ID NO: 604867 - protein, 10 aa, Mycobacterium
VAGGSRGAGR

SEQ ID NO: 604868 - protein, 16 aa, Mycobacterium
VAGGTATAHCPTPTGA

SEQ ID NO: 604869 - protein, 6 aa, Mycobacterium
VAGGTN

SEQ ID NO: 604870 - protein, 8 aa, Mycobacterium
VAGGTVQG

SEQ ID NO: 604871 - protein, 4 aa, Mycobacterium
VAGI

SEQ ID NO: 604872 - protein, 7 aa, Mycobacterium
VAGISGS

SEQ ID NO: 604873 - protein, 4 aa, Mycobacterium
VAGK

SEQ ID NO: 604874 - protein, 9 aa, Mycobacterium
VAGKAGTFN

SEQ ID NO: 604875 - protein, 10 aa, Mycobacterium
VAGKDPDFNR

SEQ ID NO: 604876 - protein, 11 aa, Mycobacterium
VAGKGSQATRA

SEQ ID NO: 604877 - protein, 12 aa, Mycobacterium
VAGKPVDAPPTA

SEQ ID NO: 604878 - protein, 18 aa, Mycobacterium
VAGKSARAAAAARLATLD

SEQ ID NO: 604879 - protein, 5 aa, Mycobacterium
VAGLE

SEQ ID NO: 604880 - protein, 4 aa, Mycobacterium
VAGN

SEQ ID NO: 604881 - protein, 9 aa, Mycobacterium
VAGNTQQSF

SEQ ID NO: 604882 - protein, 7 aa, Mycobacterium
VAGNTSL

SEQ ID NO: 604883 - protein, 12 aa, Mycobacterium
VAGPATAGRRPQ

SEQ ID NO: 604884 - protein, 5 aa, Mycobacterium
VAGPD

SEQ ID NO: 604885 - protein, 7 aa, Mycobacterium
VAGPDED

SEQ ID NO: 604886 - protein, 15 aa, Mycobacterium
VAGPDSSLQLQPANA

SEQ ID NO: 604887 - protein, 8 aa, Mycobacterium
VAGPDSTF

SEQ ID NO: 604888 - protein, 13 aa, Mycobacterium
VAGPDVANARREL

SEQ ID NO: 604889 - protein, 10 aa, Mycobacterium
VAGPEADELT

SEQ ID NO: 604890 - protein, 13 aa, Mycobacterium
VAGPEAHGGHPPG

SEQ ID NO: 604891 - protein, 6 aa, Mycobacterium
VAGPEL

SEQ ID NO: 604892 - protein, 5 aa, Mycobacterium
VAGPG

SEQ ID NO: 604893 - protein, 11 aa, Mycobacterium
VAGPGADEFEG

SEQ ID NO: 604894 - protein, 16 aa, Mycobacterium
VAGPGDPLGGATPTYG

SEQ ID NO: 604895 - protein, 6 aa, Mycobacterium
VAGPGE

SEQ ID NO: 604896 - protein, 7 aa, Mycobacterium
VAGPGEG

SEQ ID NO: 604897 - protein, 8 aa, Mycobacterium
VAGPGGEA

SEQ ID NO: 604898 - protein, 15 aa, Mycobacterium
VAGPGGIGGAAANRS

SEQ ID NO: 604899 - protein, 9 aa, Mycobacterium
VAGPGKGGS

SEQ ID NO: 604900 - protein, 8 aa, Mycobacterium
VAGPGPDR

SEQ ID NO: 604901 - protein, 11 aa, Mycobacterium
VAGPGPVDVEN

SEQ ID NO: 604902 - protein, 9 aa, Mycobacterium
VAGPGQSIR

SEQ ID NO: 604903 - protein, 12 aa, Mycobacterium
VAGPGSDLGTGG

SEQ ID NO: 604904 - protein, 7 aa, Mycobacterium
VAGPGSF

SEQ ID NO: 604905 - protein, 10 aa, Mycobacterium
VAGPGVPAGT

SEQ ID NO: 604906 - protein, 5 aa, Mycobacterium
VAGPR

SEQ ID NO: 604907 - protein, 7 aa, Mycobacterium
VAGPRES

SEQ ID NO: 604908 - protein, 9 aa, Mycobacterium
VAGPRIGKD

SEQ ID NO: 604909 - protein, 9 aa, Mycobacterium
VAGPRPVTR

SEQ ID NO: 604910 - protein, 6 aa, Mycobacterium
VAGPTT

SEQ ID NO: 604911 - protein, 9 aa, Mycobacterium
VAGPTTGLA

SEQ ID NO: 604912 - protein, 11 aa, Mycobacterium
VAGQGGSRTAR

SEQ ID NO: 604913 - protein, 7 aa, Mycobacterium
VAGQHGT

SEQ ID NO: 604914 - protein, 11 aa, Mycobacterium
VAGQNLERAGV

SEQ ID NO: 604915 - protein, 12 aa, Mycobacterium
VAGQPSAAHSDG

SEQ ID NO: 604916 - protein, 9 aa, Mycobacterium
VAGQPTMHG

SEQ ID NO: 604917 - protein, 6 aa, Mycobacterium
VAGQPV

SEQ ID NO: 604918 - protein, 6 aa, Mycobacterium
VAGQQY

SEQ ID NO: 604919 - protein, 5 aa, Mycobacterium
VAGQT

SEQ ID NO: 604920 - protein, 5 aa, Mycobacterium
VAGRA

SEQ ID NO: 604921 - protein, 9 aa, Mycobacterium
VAGRAGTVG

SEQ ID NO: 604922 - protein, 10 aa, Mycobacterium
VAGRAKDAFP

SEQ ID NO: 604923 - protein, 7 aa, Mycobacterium
VAGRDQA

SEQ ID NO: 604924 - protein, 7 aa, Mycobacterium
VAGREDA

SEQ ID NO: 604925 - protein, 7 aa, Mycobacterium
VAGRGER

SEQ ID NO: 604926 - protein, 5 aa, Mycobacterium
VAGRP

SEQ ID NO: 604927 - protein, 6 aa, Mycobacterium
VAGRPA

SEQ ID NO: 604928 - protein, 12 aa, Mycobacterium
VAGRPIKQRTRE

SEQ ID NO: 604929 - protein, 15 aa, Mycobacterium
VAGRPKEEYGLEPQG

SEQ ID NO: 604930 - protein, 17 aa, Mycobacterium
VAGRPKEEYGLEPQGLD

SEQ ID NO: 604931 - protein, 8 aa, Mycobacterium
VAGRPLSQ

SEQ ID NO: 604932 - protein, 12 aa, Mycobacterium
VAGRPRGGRDGV

SEQ ID NO: 604933 - protein, 16 aa, Mycobacterium
VAGRRRRSRANDRGVE

SEQ ID NO: 604934 - protein, 24 aa, Mycobacterium
VAGRRTGAATGTRARAGLRPRDRP

SEQ ID NO: 604935 - protein, 8 aa, Mycobacterium
VAGRSTAD

SEQ ID NO: 604936 - protein, 8 aa, Mycobacterium
VAGRTRPI

SEQ ID NO: 604937 - protein, 6 aa, Mycobacterium
VAGSAE

SEQ ID NO: 604938 - protein, 15 aa, Mycobacterium
VAGSASVPTIPAAPS

SEQ ID NO: 604939 - protein, 10 aa, Mycobacterium
VAGSDALPEP

SEQ ID NO: 604940 - protein, 13 aa, Mycobacterium
VAGSDGRPAPEGW

SEQ ID NO: 604941 - protein, 5 aa, Mycobacterium
VAGSG

SEQ ID NO: 604942 - protein, 6 aa, Mycobacterium
VAGSGG

SEQ ID NO: 604943 - protein, 14 aa, Mycobacterium
VAGSGGSGGTGGAA

SEQ ID NO: 604944 - protein, 11 aa, Mycobacterium
VAGSGKSSLID

SEQ ID NO: 604945 - protein, 9 aa, Mycobacterium
VAGSGTGHG

SEQ ID NO: 604946 - protein, 15 aa, Mycobacterium
VAGSGTGVSAARAAH

SEQ ID NO: 604947 - protein, 19 aa, Mycobacterium
VAGSLGSSRADAAVTDDAR

SEQ ID NO: 604948 - protein, 8 aa, Mycobacterium
VAGSPAHT

SEQ ID NO: 604949 - protein, 7 aa, Mycobacterium
VAGSPDD

SEQ ID NO: 604950 - protein, 7 aa, Mycobacterium
VAGSPDE

SEQ ID NO: 604951 - protein, 7 aa, Mycobacterium
VAGSPQH

SEQ ID NO: 604952 - protein, 11 aa, Mycobacterium
VAGSQAGTVSA

SEQ ID NO: 604953 - protein, 6 aa, Mycobacterium
VAGSRG

SEQ ID NO: 604954 - protein, 9 aa, Mycobacterium
VAGSRSGRE

SEQ ID NO: 604955 - protein, 6 aa, Mycobacterium
VAGSSR

SEQ ID NO: 604956 - protein, 5 aa, Mycobacterium
VAGST

SEQ ID NO: 604957 - protein, 4 aa, Mycobacterium
VAGT

SEQ ID NO: 604958 - protein, 7 aa, Mycobacterium
VAGTAEV

SEQ ID NO: 604959 - protein, 28 aa, Mycobacterium
VAGTAGSGLAAGTADPAVPASTADTGKT

SEQ ID NO: 604960 - protein, 10 aa, Mycobacterium
VAGTATLANG

SEQ ID NO: 604961 - protein, 5 aa, Mycobacterium
VAGTG

SEQ ID NO: 604962 - protein, 10 aa, Mycobacterium
VAGTGAREID

SEQ ID NO: 604963 - protein, 8 aa, Mycobacterium
VAGTGESA

SEQ ID NO: 604964 - protein, 7 aa, Mycobacterium
VAGTGPE

SEQ ID NO: 604965 - protein, 8 aa, Mycobacterium
VAGTPDDV

SEQ ID NO: 604966 - protein, 5 aa, Mycobacterium
VAGTQ

SEQ ID NO: 604967 - protein, 6 aa, Mycobacterium
VAGTRA

SEQ ID NO: 604968 - protein, 12 aa, Mycobacterium
VAGTRTGYDPAD

SEQ ID NO: 604969 - protein, 5 aa, Mycobacterium
VAGTS

SEQ ID NO: 604970 - protein, 8 aa, Mycobacterium
VAGTSELP

SEQ ID NO: 604971 - protein, 10 aa, Mycobacterium
VAGTSPEALE

SEQ ID NO: 604972 - protein, 7 aa, Mycobacterium
VAGTTDL

SEQ ID NO: 604973 - protein, 8 aa, Mycobacterium
VAGTTGYD

SEQ ID NO: 604974 - protein, 13 aa, Mycobacterium
VAGTTGYDALREN

SEQ ID NO: 604975 - protein, 8 aa, Mycobacterium
VAGTTPVT

SEQ ID NO: 604976 - protein, 7 aa, Mycobacterium
VAGTYSG

SEQ ID NO: 604977 - protein, 5 aa, Mycobacterium
VAGYD

SEQ ID NO: 604978 - protein, 5 aa, Mycobacterium
VAGYG

SEQ ID NO: 604979 - protein, 6 aa, Mycobacterium
VAGYPG

SEQ ID NO: 604980 - protein, 7 aa, Mycobacterium
VAHENAR

SEQ ID NO: 604981 - protein, 13 aa, Mycobacterium
VAHESGASDSQEL

SEQ ID NO: 604982 - protein, 9 aa, Mycobacterium
VAHGRNPDQ

SEQ ID NO: 604983 - protein, 8 aa, Mycobacterium
VAHPGQPL

SEQ ID NO: 604984 - protein, 15 aa, Mycobacterium
VAHPRGSAGEDGAVG

SEQ ID NO: 604985 - protein, 6 aa, Mycobacterium
VAISGD

SEQ ID NO: 604986 - protein, 4 aa, Mycobacterium
VAKA

SEQ ID NO: 604987 - protein, 40 aa, Mycobacterium
VAKAAGAAVAPHTATTAEAGAGTAVSAATSIASRGADTAV

SEQ ID NO: 604988 - protein, 6 aa, Mycobacterium
VAKAQA

SEQ ID NO: 604989 - protein, 14 aa, Mycobacterium
VAKDDGPRAGTTYE

SEQ ID NO: 604990 - protein, 16 aa, Mycobacterium
VAKDQANGQEPDTPKH

SEQ ID NO: 604991 - protein, 9 aa, Mycobacterium
VAKDSQTET

SEQ ID NO: 604992 - protein, 18 aa, Mycobacterium
VAKDTVKAAEIAAKSAAA

SEQ ID NO: 604993 - protein, 24 aa, Mycobacterium
VAKEAPKAEVKDAKEADKPAKPVV

SEQ ID NO: 604994 - protein, 5 aa, Mycobacterium
VAKET

SEQ ID NO: 604995 - protein, 10 aa, Mycobacterium
VAKGDPATFP

SEQ ID NO: 604996 - protein, 20 aa, Mycobacterium
VAKGTENCSKYPSDMSVWDG

SEQ ID NO: 604997 - protein, 6 aa, Mycobacterium
VAKGTQ

SEQ ID NO: 604998 - protein, 16 aa, Mycobacterium
VAKGYRNPVEPDPFSE

SEQ ID NO: 604999 - protein, 9 aa, Mycobacterium
VAKPADAAA

SEQ ID NO: 605000 - protein, 11 aa, Mycobacterium
VAKPPTGLDED

SEQ ID NO: 605001 - protein, 15 aa, Mycobacterium
VAKPSTTVAPGDEVR

SEQ ID NO: 605002 - protein, 14 aa, Mycobacterium
VAKQALKEKKTIRQ

SEQ ID NO: 605003 - protein, 8 aa, Mycobacterium
VAKQKGAS

SEQ ID NO: 605004 - protein, 12 aa, Mycobacterium
VAKRRDTSVDPP

SEQ ID NO: 605005 - protein, 10 aa, Mycobacterium
VAKSASANMT

SEQ ID NO: 605006 - protein, 5 aa, Mycobacterium
VAKST

SEQ ID NO: 605007 - protein, 8 aa, Mycobacterium
VAKTAVQA

SEQ ID NO: 605008 - protein, 9 aa, Mycobacterium
VAKTRSVDA

SEQ ID NO: 605009 - protein, 4 aa, Mycobacterium
VALP

SEQ ID NO: 605010 - protein, 9 aa, Mycobacterium
VALPGAEAL

SEQ ID NO: 605011 - protein, 10 aa, Mycobacterium
VALSGSEPDL

SEQ ID NO: 605012 - protein, 4 aa, Mycobacterium
VALT

SEQ ID NO: 605013 - protein, 13 aa, Mycobacterium
VAMPNGNGTYDVS

SEQ ID NO: 605014 - protein, 21 aa, Mycobacterium
VANAGHSPAGQTVPSARGEAD

SEQ ID NO: 605015 - protein, 9 aa, Mycobacterium
VANATRATS

SEQ ID NO: 605016 - protein, 4 aa, Mycobacterium
VAND

SEQ ID NO: 605017 - protein, 8 aa, Mycobacterium
VANEDDPR

SEQ ID NO: 605018 - protein, 5 aa, Mycobacterium
VANEI

SEQ ID NO: 605019 - protein, 7 aa, Mycobacterium
VANEIEK

SEQ ID NO: 605020 - protein, 8 aa, Mycobacterium
VANETDSA

SEQ ID NO: 605021 - protein, 4 aa, Mycobacterium
VANG

SEQ ID NO: 605022 - protein, 6 aa, Mycobacterium
VANGAA

SEQ ID NO: 605023 - protein, 14 aa, Mycobacterium
VANGAAPQPPNIPA

SEQ ID NO: 605024 - protein, 10 aa, Mycobacterium
VANGAGGADL

SEQ ID NO: 605025 - protein, 9 aa, Mycobacterium
VANGATPAS

SEQ ID NO: 605026 - protein, 7 aa, Mycobacterium
VANNGPE

SEQ ID NO: 605027 - protein, 4 aa, Mycobacterium
VANP

SEQ ID NO: 605028 - protein, 7 aa, Mycobacterium
VANPGYR

SEQ ID NO: 605029 - protein, 7 aa, Mycobacterium
VANPRDD

SEQ ID NO: 605030 - protein, 7 aa, Mycobacterium
VANPRDI

SEQ ID NO: 605031 - protein, 5 aa, Mycobacterium
VANRA

SEQ ID NO: 605032 - protein, 4 aa, Mycobacterium
VANT

SEQ ID NO: 605033 - protein, 5 aa, Mycobacterium
VANTM

SEQ ID NO: 605034 - protein, 5 aa, Mycobacterium
VANTP

SEQ ID NO: 605035 - protein, 11 aa, Mycobacterium
VANTQGTGMGG

SEQ ID NO: 605036 - protein, 7 aa, Mycobacterium
VAPAAAD

SEQ ID NO: 605037 - protein, 10 aa, Mycobacterium
VAPAAAGSRA

SEQ ID NO: 605038 - protein, 9 aa, Mycobacterium
VAPAADGTL

SEQ ID NO: 605039 - protein, 68 aa, Mycobacterium
VAPAAPGGGGVPAGPAGALPPFGSDVPRTAVAASGAAVSSASGAPLAPSAAGGGSSASPSVTPLPPGV

SEQ ID NO: 605040 - protein, 9 aa, Mycobacterium
VAPAAPSPH

SEQ ID NO: 605041 - protein, 5 aa, Mycobacterium
VAPAD

SEQ ID NO: 605042 - protein, 5 aa, Mycobacterium
VAPAE

SEQ ID NO: 605043 - protein, 10 aa, Mycobacterium
VAPAETDADR

SEQ ID NO: 605044 - protein, 15 aa, Mycobacterium
VAPAGESTQPRSVPG

SEQ ID NO: 605045 - protein, 12 aa, Mycobacterium
VAPAGSTAEGER

SEQ ID NO: 605046 - protein, 11 aa, Mycobacterium
VAPAGYEKEQF

SEQ ID NO: 605047 - protein, 5 aa, Mycobacterium
VAPAN

SEQ ID NO: 605048 - protein, 15 aa, Mycobacterium
VAPAPAVAPAPAPPT

SEQ ID NO: 605049 - protein, 10 aa, Mycobacterium
VAPAPDGLQD

SEQ ID NO: 605050 - protein, 7 aa, Mycobacterium
VAPAPEL

SEQ ID NO: 605051 - protein, 12 aa, Mycobacterium
VAPAQTPSTVGA

SEQ ID NO: 605052 - protein, 15 aa, Mycobacterium
VAPARAQTSSPARPS

SEQ ID NO: 605053 - protein, 16 aa, Mycobacterium
VAPARGVAAPESDDER

SEQ ID NO: 605054 - protein, 8 aa, Mycobacterium
VAPASAAV

SEQ ID NO: 605055 - protein, 21 aa, Mycobacterium
VAPASIEHAGSQAGYPAPPLQ

SEQ ID NO: 605056 - protein, 9 aa, Mycobacterium
VAPATADSE

SEQ ID NO: 605057 - protein, 7 aa, Mycobacterium
VAPATPG

SEQ ID NO: 605058 - protein, 8 aa, Mycobacterium
VAPDAGTA

SEQ ID NO: 605059 - protein, 10 aa, Mycobacterium
VAPDAPAAAV

SEQ ID NO: 605060 - protein, 10 aa, Mycobacterium
VAPDDPASYY

SEQ ID NO: 605061 - protein, 6 aa, Mycobacterium
VAPDED

SEQ ID NO: 605062 - protein, 12 aa, Mycobacterium
VAPDGASRPLSQ

SEQ ID NO: 605063 - protein, 7 aa, Mycobacterium
VAPDGPL

SEQ ID NO: 605064 - protein, 11 aa, Mycobacterium
VAPDGQTTDVT

SEQ ID NO: 605065 - protein, 6 aa, Mycobacterium
VAPDGR

SEQ ID NO: 605066 - protein, 7 aa, Mycobacterium
VAPDGRS

SEQ ID NO: 605067 - protein, 12 aa, Mycobacterium
VAPDGSNSMGGN

SEQ ID NO: 605068 - protein, 8 aa, Mycobacterium
VAPDGSRQ

SEQ ID NO: 605069 - protein, 12 aa, Mycobacterium
VAPDGTPYEAGD

SEQ ID NO: 605070 - protein, 8 aa, Mycobacterium
VAPDHQHT

SEQ ID NO: 605071 - protein, 11 aa, Mycobacterium
VAPDHQSTKRV

SEQ ID NO: 605072 - protein, 6 aa, Mycobacterium
VAPDNP

SEQ ID NO: 605073 - protein, 9 aa, Mycobacterium
VAPDPDGQG

SEQ ID NO: 605074 - protein, 8 aa, Mycobacterium
VAPDPLPS

SEQ ID NO: 605075 - protein, 16 aa, Mycobacterium
VAPDPRTSGVPSTKGV

SEQ ID NO: 605076 - protein, 10 aa, Mycobacterium
VAPDSPEAQD

SEQ ID NO: 605077 - protein, 25 aa, Mycobacterium
VAPDTAAVQTAVSEAAAAHGYSPEQ

SEQ ID NO: 605078 - protein, 13 aa, Mycobacterium
VAPDVAEPGEDRT

SEQ ID NO: 605079 - protein, 4 aa, Mycobacterium
VAPE

SEQ ID NO: 605080 - protein, 10 aa, Mycobacterium
VAPEAAEAAK

SEQ ID NO: 605081 - protein, 11 aa, Mycobacterium
VAPEAEEDQWQ

SEQ ID NO: 605082 - protein, 11 aa, Mycobacterium
VAPEAKAVARE

SEQ ID NO: 605083 - protein, 17 aa, Mycobacterium
VAPEDDGKLVEAVRACS

SEQ ID NO: 605084 - protein, 6 aa, Mycobacterium
VAPEEA

SEQ ID NO: 605085 - protein, 6 aa, Mycobacterium
VAPEEV

SEQ ID NO: 605086 - protein, 6 aa, Mycobacterium
VAPEGD

SEQ ID NO: 605087 - protein, 5 aa, Mycobacterium
VAPEL

SEQ ID NO: 605088 - protein, 19 aa, Mycobacterium
VAPEPAEPDPLPAPTGPLT

SEQ ID NO: 605089 - protein, 9 aa, Mycobacterium
VAPEQPETD

SEQ ID NO: 605090 - protein, 10 aa, Mycobacterium
VAPESAPTSI

SEQ ID NO: 605091 - protein, 20 aa, Mycobacterium
VAPESTTAAVDQLRSAGVTI

SEQ ID NO: 605092 - protein, 14 aa, Mycobacterium
VAPETPGSIHEGGE

SEQ ID NO: 605093 - protein, 23 aa, Mycobacterium
VAPGAQEPTPWSPQSHPDAPGIP

SEQ ID NO: 605094 - protein, 6 aa, Mycobacterium
VAPGAS

SEQ ID NO: 605095 - protein, 10 aa, Mycobacterium
VAPGATLGTD

SEQ ID NO: 605096 - protein, 5 aa, Mycobacterium
VAPGD

SEQ ID NO: 605097 - protein, 11 aa, Mycobacterium
VAPGDGADQTA

SEQ ID NO: 605098 - protein, 6 aa, Mycobacterium
VAPGDP

SEQ ID NO: 605099 - protein, 30 aa, Mycobacterium
VAPGEADDEADDEADYEADYEADEAPEPES

SEQ ID NO: 605100 - protein, 11 aa, Mycobacterium
VAPGEVAANRA

SEQ ID NO: 605101 - protein, 8 aa, Mycobacterium
VAPGGDAA

SEQ ID NO: 605102 - protein, 13 aa, Mycobacterium
VAPGGDTVEPGGA

SEQ ID NO: 605103 - protein, 8 aa, Mycobacterium
VAPGGGAR

SEQ ID NO: 605104 - protein, 8 aa, Mycobacterium
VAPGGGRR

SEQ ID NO: 605105 - protein, 9 aa, Mycobacterium
VAPGGGSRQ

SEQ ID NO: 605106 - protein, 9 aa, Mycobacterium
VAPGGTLDT

SEQ ID NO: 605107 - protein, 17 aa, Mycobacterium
VAPGKHVSTTTYNGQFP

SEQ ID NO: 605108 - protein, 13 aa, Mycobacterium
VAPGNAGTSAVAD

SEQ ID NO: 605109 - protein, 8 aa, Mycobacterium
VAPGPNAL

SEQ ID NO: 605110 - protein, 9 aa, Mycobacterium
VAPGPTATP

SEQ ID NO: 605111 - protein, 10 aa, Mycobacterium
VAPGPTDTPL

SEQ ID NO: 605112 - protein, 9 aa, Mycobacterium
VAPGPTETE

SEQ ID NO: 605113 - protein, 23 aa, Mycobacterium
VAPGPTRTEGVEAEWGDTNEQLG

SEQ ID NO: 605114 - protein, 12 aa, Mycobacterium
VAPGPTRTPGVA

SEQ ID NO: 605115 - protein, 7 aa, Mycobacterium
VAPGPVT

SEQ ID NO: 605116 - protein, 12 aa, Mycobacterium
VAPGPVTAVDQS

SEQ ID NO: 605117 - protein, 7 aa, Mycobacterium
VAPGQTY

SEQ ID NO: 605118 - protein, 6 aa, Mycobacterium
VAPGRS

SEQ ID NO: 605119 - protein, 11 aa, Mycobacterium
VAPGRTRERRR

SEQ ID NO: 605120 - protein, 5 aa, Mycobacterium
VAPGS

SEQ ID NO: 605121 - protein, 6 aa, Mycobacterium
VAPGSF

SEQ ID NO: 605122 - protein, 7 aa, Mycobacterium
VAPGSQA

SEQ ID NO: 605123 - protein, 7 aa, Mycobacterium
VAPGSSV

SEQ ID NO: 605124 - protein, 6 aa, Mycobacterium
VAPGSV

SEQ ID NO: 605125 - protein, 5 aa, Mycobacterium
VAPGT

SEQ ID NO: 605126 - protein, 7 aa, Mycobacterium
VAPGTGP

SEQ ID NO: 605127 - protein, 8 aa, Mycobacterium
VAPGTQTA

SEQ ID NO: 605128 - protein, 10 aa, Mycobacterium
VAPGTSAPLA

SEQ ID NO: 605129 - protein, 9 aa, Mycobacterium
VAPGVTTDE

SEQ ID NO: 605130 - protein, 7 aa, Mycobacterium
VAPHNPD

SEQ ID NO: 605131 - protein, 10 aa, Mycobacterium
VAPHTIRGTQ

SEQ ID NO: 605132 - protein, 9 aa, Mycobacterium
VAPKAKPGT

SEQ ID NO: 605133 - protein, 11 aa, Mycobacterium
VAPKDKGSARD

SEQ ID NO: 605134 - protein, 11 aa, Mycobacterium
VAPKDKHTARD

SEQ ID NO: 605135 - protein, 10 aa, Mycobacterium
VAPKDKHVAR

SEQ ID NO: 605136 - protein, 7 aa, Mycobacterium
VAPKPLR

SEQ ID NO: 605137 - protein, 10 aa, Mycobacterium
VAPKPPAVPA

SEQ ID NO: 605138 - protein, 8 aa, Mycobacterium
VAPKPVPP

SEQ ID NO: 605139 - protein, 10 aa, Mycobacterium
VAPKPVQRPH

SEQ ID NO: 605140 - protein, 16 aa, Mycobacterium
VAPKTAAERTPREVAT

SEQ ID NO: 605141 - protein, 15 aa, Mycobacterium
VAPLNPRINTLLQAL

SEQ ID NO: 605142 - protein, 13 aa, Mycobacterium
VAPLSSSSLAGAG

SEQ ID NO: 605143 - protein, 9 aa, Mycobacterium
VAPLSTPQF

SEQ ID NO: 605144 - protein, 230 aa, Mycobacterium
VAPMTDDSSYRGAQGPGRPSDEYHDDRYGRPQEGGAEPQGGPDPRGGYPPEQGGYPPQQGYPPPRHPEQGGYPEQGGYQAPGGYPDQRGYQAPGGYPDQRGYQAPGGYPEQGQAGYPEQGQAGYPPQYEQRPPAPGGYGGQGYDQGYRPGGGYGPPGGGQPGGAQQGYGGGYAEYGRGPARQDEGGYAPPEQRPAYPEQGGGYEQGGYEQQPGGYDQGYQQGGYGRQDYA

SEQ ID NO: 605145 - protein, 23 aa, Mycobacterium
VAPNDVGKKEKQQQERDSTNAIT

SEQ ID NO: 605146 - protein, 11 aa, Mycobacterium
VAPNEKEPARG

SEQ ID NO: 605147 - protein, 6 aa, Mycobacterium
VAPNGA

SEQ ID NO: 605148 - protein, 10 aa, Mycobacterium
VAPNGAGKST

SEQ ID NO: 605149 - protein, 6 aa, Mycobacterium
VAPNIP

SEQ ID NO: 605150 - protein, 16 aa, Mycobacterium
VAPNQPATAEFRIVAR

SEQ ID NO: 605151 - protein, 13 aa, Mycobacterium
VAPNRRPYRTKDG

SEQ ID NO: 605152 - protein, 12 aa, Mycobacterium
VAPNRRPYRTSD

SEQ ID NO: 605153 - protein, 13 aa, Mycobacterium
VAPNRRPYRTSDG

SEQ ID NO: 605154 - protein, 7 aa, Mycobacterium
VAPNSED

SEQ ID NO: 605155 - protein, 12 aa, Mycobacterium
VAPPAPARDRRL

SEQ ID NO: 605156 - protein, 6 aa, Mycobacterium
VAPPAR

SEQ ID NO: 605157 - protein, 11 aa, Mycobacterium
VAPPATPEEGY

SEQ ID NO: 605158 - protein, 7 aa, Mycobacterium
VAPPAVD

SEQ ID NO: 605159 - protein, 16 aa, Mycobacterium
VAPPDGKTKQSEPADV

SEQ ID NO: 605160 - protein, 12 aa, Mycobacterium
VAPPDSGLYTSG

SEQ ID NO: 605161 - protein, 14 aa, Mycobacterium
VAPPDSYRTPPGEL

SEQ ID NO: 605162 - protein, 7 aa, Mycobacterium
VAPPDTT

SEQ ID NO: 605163 - protein, 7 aa, Mycobacterium
VAPPEDV

SEQ ID NO: 605164 - protein, 7 aa, Mycobacterium
VAPPEYR

SEQ ID NO: 605165 - protein, 8 aa, Mycobacterium
VAPPEYTD

SEQ ID NO: 605166 - protein, 13 aa, Mycobacterium
VAPPFGSGGRTTS

SEQ ID NO: 605167 - protein, 9 aa, Mycobacterium
VAPPGDREA

SEQ ID NO: 605168 - protein, 8 aa, Mycobacterium
VAPPGEEE

SEQ ID NO: 605169 - protein, 10 aa, Mycobacterium
VAPPGIEDDP

SEQ ID NO: 605170 - protein, 32 aa, Mycobacterium
VAPPGSPPPARNALAPPAVPEARPVPPADPDG

SEQ ID NO: 605171 - protein, 6 aa, Mycobacterium
VAPPGV

SEQ ID NO: 605172 - protein, 21 aa, Mycobacterium
VAPPPAKDTPPSTVTKANNAC

SEQ ID NO: 605173 - protein, 6 aa, Mycobacterium
VAPPPE

SEQ ID NO: 605174 - protein, 8 aa, Mycobacterium
VAPPPGGV

SEQ ID NO: 605175 - protein, 8 aa, Mycobacterium
VAPPPQEH

SEQ ID NO: 605176 - protein, 6 aa, Mycobacterium
VAPPPV

SEQ ID NO: 605177 - protein, 5 aa, Mycobacterium
VAPPR

SEQ ID NO: 605178 - protein, 7 aa, Mycobacterium
VAPPREV

SEQ ID NO: 605179 - protein, 7 aa, Mycobacterium
VAPPRSL

SEQ ID NO: 605180 - protein, 8 aa, Mycobacterium
VAPPYDDA

SEQ ID NO: 605181 - protein, 6 aa, Mycobacterium
VAPQDA

SEQ ID NO: 605182 - protein, 12 aa, Mycobacterium
VAPQDNSSNDQM

SEQ ID NO: 605183 - protein, 56 aa, Mycobacterium
VAPQNGTAPDPAPGTGDPQTPADPHSAATAADIEDDRHATGATGPQMNGSEQQVDR

SEQ ID NO: 605184 - protein, 9 aa, Mycobacterium
VAPQPGKGE

SEQ ID NO: 605185 - protein, 8 aa, Mycobacterium
VAPQPMSS

SEQ ID NO: 605186 - protein, 20 aa, Mycobacterium
VAPQQPPTVNAGSPSDRPLD

SEQ ID NO: 605187 - protein, 6 aa, Mycobacterium
VAPQQV

SEQ ID NO: 605188 - protein, 20 aa, Mycobacterium
VAPQRPPAIDGDTTGDRPMD

SEQ ID NO: 605189 - protein, 20 aa, Mycobacterium
VAPQRSPQVIGGSDSDRPLD

SEQ ID NO: 605190 - protein, 9 aa, Mycobacterium
VAPQSGETV

SEQ ID NO: 605191 - protein, 7 aa, Mycobacterium
VAPRARK

SEQ ID NO: 605192 - protein, 5 aa, Mycobacterium
VAPRD

SEQ ID NO: 605193 - protein, 8 aa, Mycobacterium
VAPRGDEP

SEQ ID NO: 605194 - protein, 28 aa, Mycobacterium
VAPRGGGGDLSSGTSAAHTAATGYPTTG

SEQ ID NO: 605195 - protein, 14 aa, Mycobacterium
VAPRGYGAGNHDDD

SEQ ID NO: 605196 - protein, 6 aa, Mycobacterium
VAPRHD

SEQ ID NO: 605197 - protein, 5 aa, Mycobacterium
VAPRN

SEQ ID NO: 605198 - protein, 25 aa, Mycobacterium
VAPRNQHPATVPRSRSHPAQRLAAE

SEQ ID NO: 605199 - protein, 9 aa, Mycobacterium
VAPRPTSSF

SEQ ID NO: 605200 - protein, 7 aa, Mycobacterium
VAPRSAV

SEQ ID NO: 605201 - protein, 9 aa, Mycobacterium
VAPRSGRRR

SEQ ID NO: 605202 - protein, 21 aa, Mycobacterium
VAPRSNDNRARAKSATPRTIP

SEQ ID NO: 605203 - protein, 7 aa, Mycobacterium
VAPRTTD

SEQ ID NO: 605204 - protein, 7 aa, Mycobacterium
VAPSAEV

SEQ ID NO: 605205 - protein, 12 aa, Mycobacterium
VAPSAKPRTDPS

SEQ ID NO: 605206 - protein, 6 aa, Mycobacterium
VAPSEI

SEQ ID NO: 605207 - protein, 7 aa, Mycobacterium
VAPSGRV

SEQ ID NO: 605208 - protein, 6 aa, Mycobacterium
VAPSKD

SEQ ID NO: 605209 - protein, 6 aa, Mycobacterium
VAPSKE

SEQ ID NO: 605210 - protein, 9 aa, Mycobacterium
VAPSLQDGS

SEQ ID NO: 605211 - protein, 9 aa, Mycobacterium
VAPSNSASR

SEQ ID NO: 605212 - protein, 7 aa, Mycobacterium
VAPSPPT

SEQ ID NO: 605213 - protein, 16 aa, Mycobacterium
VAPSPSVGVGGSAGVS

SEQ ID NO: 605214 - protein, 16 aa, Mycobacterium
VAPSRTVPVSPTPEDS

SEQ ID NO: 605215 - protein, 8 aa, Mycobacterium
VAPSSTEL

SEQ ID NO: 605216 - protein, 9 aa, Mycobacterium
VAPTAERRE

SEQ ID NO: 605217 - protein, 12 aa, Mycobacterium
VAPTAHAAETFN

SEQ ID NO: 605218 - protein, 8 aa, Mycobacterium
VAPTDDPV

SEQ ID NO: 605219 - protein, 13 aa, Mycobacterium
VAPTDPPATLAYG

SEQ ID NO: 605220 - protein, 15 aa, Mycobacterium
VAPTGATPSLTGGTP

SEQ ID NO: 605221 - protein, 6 aa, Mycobacterium
VAPTGE

SEQ ID NO: 605222 - protein, 7 aa, Mycobacterium
VAPTGHP

SEQ ID NO: 605223 - protein, 6 aa, Mycobacterium
VAPTGP

SEQ ID NO: 605224 - protein, 12 aa, Mycobacterium
VAPTHGPDAISG

SEQ ID NO: 605225 - protein, 5 aa, Mycobacterium
VAPTP

SEQ ID NO: 605226 - protein, 14 aa, Mycobacterium
VAPTPYDGDSPSEV

SEQ ID NO: 605227 - protein, 5 aa, Mycobacterium
VAPTR

SEQ ID NO: 605228 - protein, 13 aa, Mycobacterium
VAPTRGADGIGGG

SEQ ID NO: 605229 - protein, 11 aa, Mycobacterium
VAPTRGDAELA

SEQ ID NO: 605230 - protein, 12 aa, Mycobacterium
VAPTRGPDAISG

SEQ ID NO: 605231 - protein, 12 aa, Mycobacterium
VAPTRSGIVLLS

SEQ ID NO: 605232 - protein, 6 aa, Mycobacterium
VAPTTA

SEQ ID NO: 605233 - protein, 11 aa, Mycobacterium
VAPTTATAGAH

SEQ ID NO: 605234 - protein, 13 aa, Mycobacterium
VAPTTGRVKRGKT

SEQ ID NO: 605235 - protein, 11 aa, Mycobacterium
VAPTTGVVPPA

SEQ ID NO: 605236 - protein, 7 aa, Mycobacterium
VAPTTTG

SEQ ID NO: 605237 - protein, 7 aa, Mycobacterium
VAPTTTI

SEQ ID NO: 605238 - protein, 135 aa, Mycobacterium
VAPTTVPPTTVAPTTVAPQPTQQPTQEPTQVPTQQVPTQQVPTQQQTVAPQAPQTVAPAPQPPLGGGGSGSGGGSGSSGGSGGSGGSGGSSGGSGGSGGGSGSSGGGSGSSGGSSGGSSGGSSSGGGSSGGGHSG

SEQ ID NO: 605239 - protein, 13 aa, Mycobacterium
VAPTVSDSVAAPA

SEQ ID NO: 605240 - protein, 16 aa, Mycobacterium
VAPVPTTPTDAPEPAA

SEQ ID NO: 605241 - protein, 13 aa, Mycobacterium
VAPVQQGKSHTSV

SEQ ID NO: 605242 - protein, 17 aa, Mycobacterium
VAQAAGTSAGAESAQSQ

SEQ ID NO: 605243 - protein, 14 aa, Mycobacterium
VAQADIDRLRNQLL

SEQ ID NO: 605244 - protein, 21 aa, Mycobacterium
VAQARAELEAGDFEAAKKSYQ

SEQ ID NO: 605245 - protein, 9 aa, Mycobacterium
VAQARTDAV

SEQ ID NO: 605246 - protein, 9 aa, Mycobacterium
VAQARTEAV

SEQ ID NO: 605247 - protein, 14 aa, Mycobacterium
VAQATAGAAADGGN

SEQ ID NO: 605248 - protein, 25 aa, Mycobacterium
VAQATETPAGNTAQMAATTTPQFAT

SEQ ID NO: 605249 - protein, 17 aa, Mycobacterium
VAQATGTSAGNQQATVS

SEQ ID NO: 605250 - protein, 11 aa, Mycobacterium
VAQDADGVTVS

SEQ ID NO: 605251 - protein, 8 aa, Mycobacterium
VAQDESWQ

SEQ ID NO: 605252 - protein, 10 aa, Mycobacterium
VAQDGDAEQG

SEQ ID NO: 605253 - protein, 5 aa, Mycobacterium
VAQDP

SEQ ID NO: 605254 - protein, 6 aa, Mycobacterium
VAQDPY

SEQ ID NO: 605255 - protein, 6 aa, Mycobacterium
VAQDQG

SEQ ID NO: 605256 - protein, 5 aa, Mycobacterium
VAQEA

SEQ ID NO: 605257 - protein, 20 aa, Mycobacterium
VAQEPAPEPEEKPVHTRRGK

SEQ ID NO: 605258 - protein, 7 aa, Mycobacterium
VAQESGI

SEQ ID NO: 605259 - protein, 11 aa, Mycobacterium
VAQESRGVDGK

SEQ ID NO: 605260 - protein, 4 aa, Mycobacterium
VAQG

SEQ ID NO: 605261 - protein, 10 aa, Mycobacterium
VAQGDPAPVV

SEQ ID NO: 605262 - protein, 12 aa, Mycobacterium
VAQGDRTDASAV

SEQ ID NO: 605263 - protein, 6 aa, Mycobacterium
VAQGGK

SEQ ID NO: 605264 - protein, 7 aa, Mycobacterium
VAQGRGL

SEQ ID NO: 605265 - protein, 9 aa, Mycobacterium
VAQGRPNAR

SEQ ID NO: 605266 - protein, 10 aa, Mycobacterium
VAQKDQPAAQ

SEQ ID NO: 605267 - protein, 6 aa, Mycobacterium
VAQKSV

SEQ ID NO: 605268 - protein, 12 aa, Mycobacterium
VAQNGESQTETT

SEQ ID NO: 605269 - protein, 4 aa, Mycobacterium
VAQP

SEQ ID NO: 605270 - protein, 10 aa, Mycobacterium
VAQPDARSTS

SEQ ID NO: 605271 - protein, 5 aa, Mycobacterium
VAQPG

SEQ ID NO: 605272 - protein, 6 aa, Mycobacterium
VAQPGD

SEQ ID NO: 605273 - protein, 6 aa, Mycobacterium
VAQPGI

SEQ ID NO: 605274 - protein, 7 aa, Mycobacterium
VAQPPLA

SEQ ID NO: 605275 - protein, 13 aa, Mycobacterium
VAQPRDDGTYVGP

SEQ ID NO: 605276 - protein, 18 aa, Mycobacterium
VAQPSSDAVRGYSSIGEQ

SEQ ID NO: 605277 - protein, 7 aa, Mycobacterium
VAQQSEK

SEQ ID NO: 605278 - protein, 7 aa, Mycobacterium
VAQRAKG

SEQ ID NO: 605279 - protein, 6 aa, Mycobacterium
VAQRDD

SEQ ID NO: 605280 - protein, 7 aa, Mycobacterium
VAQREGY

SEQ ID NO: 605281 - protein, 16 aa, Mycobacterium
VAQREHDPRPPVAKPG

SEQ ID NO: 605282 - protein, 7 aa, Mycobacterium
VAQRGGT

SEQ ID NO: 605283 - protein, 5 aa, Mycobacterium
VAQRP

SEQ ID NO: 605284 - protein, 10 aa, Mycobacterium
VAQSADAENG

SEQ ID NO: 605285 - protein, 12 aa, Mycobacterium
VAQSGEGPGGGI

SEQ ID NO: 605286 - protein, 8 aa, Mycobacterium
VAQSGTHY

SEQ ID NO: 605287 - protein, 7 aa, Mycobacterium
VAQTATV

SEQ ID NO: 605288 - protein, 9 aa, Mycobacterium
VAQTGKPVR

SEQ ID NO: 605289 - protein, 16 aa, Mycobacterium
VAQTGLDDFGDDSYRE

SEQ ID NO: 605290 - protein, 13 aa, Mycobacterium
VARAASDSTITPQ

SEQ ID NO: 605291 - protein, 9 aa, Mycobacterium
VARAGAKPF

SEQ ID NO: 605292 - protein, 8 aa, Mycobacterium
VARAGASD

SEQ ID NO: 605293 - protein, 10 aa, Mycobacterium
VARAGQKPFE

SEQ ID NO: 605294 - protein, 21 aa, Mycobacterium
VARAKAAQRSWARQAPAERAA

SEQ ID NO: 605295 - protein, 8 aa, Mycobacterium
VARAPRPE

SEQ ID NO: 605296 - protein, 8 aa, Mycobacterium
VARATEDD

SEQ ID NO: 605297 - protein, 5 aa, Mycobacterium
VARDD

SEQ ID NO: 605298 - protein, 9 aa, Mycobacterium
VARDEGDHL

SEQ ID NO: 605299 - protein, 10 aa, Mycobacterium
VARDESIREG

SEQ ID NO: 605300 - protein, 7 aa, Mycobacterium
VARDRAG

SEQ ID NO: 605301 - protein, 9 aa, Mycobacterium
VARDSDTET

SEQ ID NO: 605302 - protein, 11 aa, Mycobacterium
VARDSPGFASS

SEQ ID NO: 605303 - protein, 19 aa, Mycobacterium
VAREAAEKTADITARRGRA

SEQ ID NO: 605304 - protein, 10 aa, Mycobacterium
VAREGPTRRA

SEQ ID NO: 605305 - protein, 23 aa, Mycobacterium
VARESEVGGQRPRGRQCRTRRQS

SEQ ID NO: 605306 - protein, 27 aa, Mycobacterium
VARGAPRSRYSTALPSGVAEASSWDPE

SEQ ID NO: 605307 - protein, 10 aa, Mycobacterium
VARGDTSPYH

SEQ ID NO: 605308 - protein, 19 aa, Mycobacterium
VARGERLRAEAGAEAHASA

SEQ ID NO: 605309 - protein, 11 aa, Mycobacterium
VARGGAAGPPM

SEQ ID NO: 605310 - protein, 10 aa, Mycobacterium
VARGGGRASY

SEQ ID NO: 605311 - protein, 11 aa, Mycobacterium
VARGGGRASYR

SEQ ID NO: 605312 - protein, 10 aa, Mycobacterium
VARGGGRTSY

SEQ ID NO: 605313 - protein, 7 aa, Mycobacterium
VARGKDA

SEQ ID NO: 605314 - protein, 21 aa, Mycobacterium
VARGNGHKAIDEADAQPQVIE

SEQ ID NO: 605315 - protein, 5 aa, Mycobacterium
VARGP

SEQ ID NO: 605316 - protein, 7 aa, Mycobacterium
VARGPQV

SEQ ID NO: 605317 - protein, 5 aa, Mycobacterium
VARGQ

SEQ ID NO: 605318 - protein, 6 aa, Mycobacterium
VARGRQ

SEQ ID NO: 605319 - protein, 18 aa, Mycobacterium
VARGTAPNSPLNATVSRN

SEQ ID NO: 605320 - protein, 17 aa, Mycobacterium
VARGTAPSSPLNAPVSR

SEQ ID NO: 605321 - protein, 17 aa, Mycobacterium
VARGTAPSSPLNTTVSR

SEQ ID NO: 605322 - protein, 18 aa, Mycobacterium
VARGTAPSSPLNTTVSRN

SEQ ID NO: 605323 - protein, 12 aa, Mycobacterium
VARGYPGRPGLT

SEQ ID NO: 605324 - protein, 12 aa, Mycobacterium
VARKGRPNRGPV

SEQ ID NO: 605325 - protein, 4 aa, Mycobacterium
VARN

SEQ ID NO: 605326 - protein, 6 aa, Mycobacterium
VARNER

SEQ ID NO: 605327 - protein, 8 aa, Mycobacterium
VARNGASD

SEQ ID NO: 605328 - protein, 9 aa, Mycobacterium
VARPALPPH

SEQ ID NO: 605329 - protein, 8 aa, Mycobacterium
VARPDTQD

SEQ ID NO: 605330 - protein, 27 aa, Mycobacterium
VARPDTQDALNADASTRLPRPATGDEL

SEQ ID NO: 605331 - protein, 7 aa, Mycobacterium
VARPEDV

SEQ ID NO: 605332 - protein, 27 aa, Mycobacterium
VARPESQDALNADRSTSLPRPATGEEL

SEQ ID NO: 605333 - protein, 5 aa, Mycobacterium
VARPG

SEQ ID NO: 605334 - protein, 9 aa, Mycobacterium
VARPGQYEA

SEQ ID NO: 605335 - protein, 13 aa, Mycobacterium
VARPGRGLTGRGW

SEQ ID NO: 605336 - protein, 8 aa, Mycobacterium
VARPGRGV

SEQ ID NO: 605337 - protein, 6 aa, Mycobacterium
VARPGT

SEQ ID NO: 605338 - protein, 12 aa, Mycobacterium
VARPHSGVTAPA

SEQ ID NO: 605339 - protein, 24 aa, Mycobacterium
VARPPAALAGKQPGAIAQAAPAHA

SEQ ID NO: 605340 - protein, 7 aa, Mycobacterium
VARPRKA

SEQ ID NO: 605341 - protein, 9 aa, Mycobacterium
VARPTGTGI

SEQ ID NO: 605342 - protein, 27 aa, Mycobacterium
VARQDSESDDPRTAARGRARLRAVGAI

SEQ ID NO: 605343 - protein, 6 aa, Mycobacterium
VARQRR

SEQ ID NO: 605344 - protein, 6 aa, Mycobacterium
VARQYR

SEQ ID NO: 605345 - protein, 4 aa, Mycobacterium
VARR

SEQ ID NO: 605346 - protein, 8 aa, Mycobacterium
VARREDGK

SEQ ID NO: 605347 - protein, 6 aa, Mycobacterium
VARRGE

SEQ ID NO: 605348 - protein, 10 aa, Mycobacterium
VARRGSDGAY

SEQ ID NO: 605349 - protein, 7 aa, Mycobacterium
VARRGTT

SEQ ID NO: 605350 - protein, 6 aa, Mycobacterium
VARRKA

SEQ ID NO: 605351 - protein, 8 aa, Mycobacterium
VARRSRNR

SEQ ID NO: 605352 - protein, 11 aa, Mycobacterium
VARSAGPHNKQ

SEQ ID NO: 605353 - protein, 12 aa, Mycobacterium
VARSAQKSFDEC

SEQ ID NO: 605354 - protein, 12 aa, Mycobacterium
VARSGADTPFDR

SEQ ID NO: 605355 - protein, 10 aa, Mycobacterium
VARSGGGMNA

SEQ ID NO: 605356 - protein, 7 aa, Mycobacterium
VARSGQA

SEQ ID NO: 605357 - protein, 7 aa, Mycobacterium
VARSPED

SEQ ID NO: 605358 - protein, 7 aa, Mycobacterium
VARSPRD

SEQ ID NO: 605359 - protein, 10 aa, Mycobacterium
VARSQGVTIE

SEQ ID NO: 605360 - protein, 6 aa, Mycobacterium
VARSSG

SEQ ID NO: 605361 - protein, 12 aa, Mycobacterium
VARTEDPDPPGP

SEQ ID NO: 605362 - protein, 11 aa, Mycobacterium
VARTGGPGRLT

SEQ ID NO: 605363 - protein, 7 aa, Mycobacterium
VARTGSV

SEQ ID NO: 605364 - protein, 8 aa, Mycobacterium
VARTGSVT

SEQ ID NO: 605365 - protein, 6 aa, Mycobacterium
VARTNL

SEQ ID NO: 605366 - protein, 7 aa, Mycobacterium
VARTPED

SEQ ID NO: 605367 - protein, 11 aa, Mycobacterium
VARTRANADPR

SEQ ID NO: 605368 - protein, 25 aa, Mycobacterium
VARTTGVDPEDIKGGTEEEMRESAE

SEQ ID NO: 605369 - protein, 4 aa, Mycobacterium
VASA

SEQ ID NO: 605370 - protein, 7 aa, Mycobacterium
VASAAAN

SEQ ID NO: 605371 - protein, 8 aa, Mycobacterium
VASADRSS

SEQ ID NO: 605372 - protein, 16 aa, Mycobacterium
VASAERGQEAKRRGIA

SEQ ID NO: 605373 - protein, 5 aa, Mycobacterium
VASAN

SEQ ID NO: 605374 - protein, 7 aa, Mycobacterium
VASARDA

SEQ ID NO: 605375 - protein, 11 aa, Mycobacterium
VASARDAAAQR

SEQ ID NO: 605376 - protein, 7 aa, Mycobacterium
VASASER

SEQ ID NO: 605377 - protein, 4 aa, Mycobacterium
VASD

SEQ ID NO: 605378 - protein, 6 aa, Mycobacterium
VASDAA

SEQ ID NO: 605379 - protein, 7 aa, Mycobacterium
VASDAAP

SEQ ID NO: 605380 - protein, 8 aa, Mycobacterium
VASDDGGA

SEQ ID NO: 605381 - protein, 5 aa, Mycobacterium
VASDE

SEQ ID NO: 605382 - protein, 8 aa, Mycobacterium
VASDEDVV

SEQ ID NO: 605383 - protein, 10 aa, Mycobacterium
VASDGSNAAD

SEQ ID NO: 605384 - protein, 6 aa, Mycobacterium
VASDSA

SEQ ID NO: 605385 - protein, 20 aa, Mycobacterium
VASDSTVAAVTEGSGGGAAI

SEQ ID NO: 605386 - protein, 10 aa, Mycobacterium
VASDTAAAIA

SEQ ID NO: 605387 - protein, 8 aa, Mycobacterium
VASDTAAQ

SEQ ID NO: 605388 - protein, 8 aa, Mycobacterium
VASDVGDY

SEQ ID NO: 605389 - protein, 4 aa, Mycobacterium
VASE

SEQ ID NO: 605390 - protein, 7 aa, Mycobacterium
VASENAE

SEQ ID NO: 605391 - protein, 6 aa, Mycobacterium
VASENF

SEQ ID NO: 605392 - protein, 7 aa, Mycobacterium
VASENGR

SEQ ID NO: 605393 - protein, 5 aa, Mycobacterium
VASES

SEQ ID NO: 605394 - protein, 11 aa, Mycobacterium
VASGAATPSRV

SEQ ID NO: 605395 - protein, 6 aa, Mycobacterium
VASGAG

SEQ ID NO: 605396 - protein, 10 aa, Mycobacterium
VASGASEDEC

SEQ ID NO: 605397 - protein, 8 aa, Mycobacterium
VASGASVD

SEQ ID NO: 605398 - protein, 14 aa, Mycobacterium
VASGDADSPDAAET

SEQ ID NO: 605399 - protein, 9 aa, Mycobacterium
VASGDPGRA

SEQ ID NO: 605400 - protein, 11 aa, Mycobacterium
VASGDSTDEAY

SEQ ID NO: 605401 - protein, 13 aa, Mycobacterium
VASGEFPPTVDPE

SEQ ID NO: 605402 - protein, 8 aa, Mycobacterium
VASGELPD

SEQ ID NO: 605403 - protein, 11 aa, Mycobacterium
VASGEPGPGAV

SEQ ID NO: 605404 - protein, 24 aa, Mycobacterium
VASGGADADEKLAEASAAIARLVR

SEQ ID NO: 605405 - protein, 8 aa, Mycobacterium
VASGGTVL

SEQ ID NO: 605406 - protein, 13 aa, Mycobacterium
VASGIKKANPGIK

SEQ ID NO: 605407 - protein, 8 aa, Mycobacterium
VASGNGKG

SEQ ID NO: 605408 - protein, 17 aa, Mycobacterium
VASGPDTITTGPPTYSD

SEQ ID NO: 605409 - protein, 9 aa, Mycobacterium
VASGPPADV

SEQ ID NO: 605410 - protein, 11 aa, Mycobacterium
VASGSGVGAGD

SEQ ID NO: 605411 - protein, 6 aa, Mycobacterium
VASGSP

SEQ ID NO: 605412 - protein, 14 aa, Mycobacterium
VASGSTDTTGTTIT

SEQ ID NO: 605413 - protein, 11 aa, Mycobacterium
VASGSTQEFTR

SEQ ID NO: 605414 - protein, 7 aa, Mycobacterium
VASGTDP

SEQ ID NO: 605415 - protein, 10 aa, Mycobacterium
VASGVSAGTS

SEQ ID NO: 605416 - protein, 10 aa, Mycobacterium
VASLDPENAG

SEQ ID NO: 605417 - protein, 7 aa, Mycobacterium
VASLGGD

SEQ ID NO: 605418 - protein, 12 aa, Mycobacterium
VASNEHGGLGGE

SEQ ID NO: 605419 - protein, 7 aa, Mycobacterium
VASNEPK

SEQ ID NO: 605420 - protein, 7 aa, Mycobacterium
VASPAAE

SEQ ID NO: 605421 - protein, 6 aa, Mycobacterium
VASPDA

SEQ ID NO: 605422 - protein, 9 aa, Mycobacterium
VASPDDGRG

SEQ ID NO: 605423 - protein, 7 aa, Mycobacterium
VASPDEN

SEQ ID NO: 605424 - protein, 8 aa, Mycobacterium
VASPEDRV

SEQ ID NO: 605425 - protein, 11 aa, Mycobacterium
VASPGPAETLR

SEQ ID NO: 605426 - protein, 8 aa, Mycobacterium
VASPPPVP

SEQ ID NO: 605427 - protein, 6 aa, Mycobacterium
VASPRL

SEQ ID NO: 605428 - protein, 7 aa, Mycobacterium
VASPRRV

SEQ ID NO: 605429 - protein, 7 aa, Mycobacterium
VASPRTF

SEQ ID NO: 605430 - protein, 8 aa, Mycobacterium
VASPTEGV

SEQ ID NO: 605431 - protein, 9 aa, Mycobacterium
VASPTGARL

SEQ ID NO: 605432 - protein, 8 aa, Mycobacterium
VASPTGDV

SEQ ID NO: 605433 - protein, 4 aa, Mycobacterium
VASQ

SEQ ID NO: 605434 - protein, 10 aa, Mycobacterium
VASQAGVSRP

SEQ ID NO: 605435 - protein, 14 aa, Mycobacterium
VASQPRERRPGNTV

SEQ ID NO: 605436 - protein, 14 aa, Mycobacterium
VASQPRPMSDGSRR

SEQ ID NO: 605437 - protein, 9 aa, Mycobacterium
VASQSGGTV

SEQ ID NO: 605438 - protein, 10 aa, Mycobacterium
VASRDGQGQP

SEQ ID NO: 605439 - protein, 8 aa, Mycobacterium
VASREARE

SEQ ID NO: 605440 - protein, 7 aa, Mycobacterium
VASRGER

SEQ ID NO: 605441 - protein, 10 aa, Mycobacterium
VASRISPDTG

SEQ ID NO: 605442 - protein, 10 aa, Mycobacterium
VASRQDASAR

SEQ ID NO: 605443 - protein, 20 aa, Mycobacterium
VASRRAKATELGATQTVDPA

SEQ ID NO: 605444 - protein, 8 aa, Mycobacterium
VASRRGPQ

SEQ ID NO: 605445 - protein, 29 aa, Mycobacterium
VASRRKDIPARSGPHGQRGGRNGRSLGRH

SEQ ID NO: 605446 - protein, 10 aa, Mycobacterium
VASRSEPDKV

SEQ ID NO: 605447 - protein, 11 aa, Mycobacterium
VASRSETERDA

SEQ ID NO: 605448 - protein, 11 aa, Mycobacterium
VASRSGAPYEH

SEQ ID NO: 605449 - protein, 5 aa, Mycobacterium
VASRY

SEQ ID NO: 605450 - protein, 7 aa, Mycobacterium
VASSAAL

SEQ ID NO: 605451 - protein, 8 aa, Mycobacterium
VASSAEKL

SEQ ID NO: 605452 - protein, 7 aa, Mycobacterium
VASSPAD

SEQ ID NO: 605453 - protein, 7 aa, Mycobacterium
VASSPDD

SEQ ID NO: 605454 - protein, 10 aa, Mycobacterium
VASSPDSAAW

SEQ ID NO: 605455 - protein, 7 aa, Mycobacterium
VASSPEE

SEQ ID NO: 605456 - protein, 20 aa, Mycobacterium
VASSPIKGTLPRSADPAALR

SEQ ID NO: 605457 - protein, 7 aa, Mycobacterium
VASSPQD

SEQ ID NO: 605458 - protein, 13 aa, Mycobacterium
VASSSEKLDAAAR

SEQ ID NO: 605459 - protein, 9 aa, Mycobacterium
VASSSERAG

SEQ ID NO: 605460 - protein, 9 aa, Mycobacterium
VASSSQSVE

SEQ ID NO: 605461 - protein, 9 aa, Mycobacterium
VASSSQTVE

SEQ ID NO: 605462 - protein, 12 aa, Mycobacterium
VASSTRPDAQAK

SEQ ID NO: 605463 - protein, 11 aa, Mycobacterium
VASTGSSLRKA

SEQ ID NO: 605464 - protein, 21 aa, Mycobacterium
VASTGVEGSGCDENPAESTGL

SEQ ID NO: 605465 - protein, 8 aa, Mycobacterium
VASTNSVT

SEQ ID NO: 605466 - protein, 10 aa, Mycobacterium
VASTTQVGGP

SEQ ID NO: 605467 - protein, 12 aa, Mycobacterium
VASTVAGSAYAA

SEQ ID NO: 605468 - protein, 4 aa, Mycobacterium
VASV

SEQ ID NO: 605469 - protein, 5 aa, Mycobacterium
VASWS

SEQ ID NO: 605470 - protein, 4 aa, Mycobacterium
VASY

SEQ ID NO: 605471 - protein, 13 aa, Mycobacterium
VASYGSVQQVDPE

SEQ ID NO: 605472 - protein, 5 aa, Mycobacterium
VASYP

SEQ ID NO: 605473 - protein, 9 aa, Mycobacterium
VATAAGGDA

SEQ ID NO: 605474 - protein, 18 aa, Mycobacterium
VATAATEPIGTGQTGATY

SEQ ID NO: 605475 - protein, 13 aa, Mycobacterium
VATAEGKVVDSQG

SEQ ID NO: 605476 - protein, 7 aa, Mycobacterium
VATAESL

SEQ ID NO: 605477 - protein, 11 aa, Mycobacterium
VATARQPGAGG

SEQ ID NO: 605478 - protein, 14 aa, Mycobacterium
VATASARPDGKVSH

SEQ ID NO: 605479 - protein, 7 aa, Mycobacterium
VATASAT

SEQ ID NO: 605480 - protein, 6 aa, Mycobacterium
VATASE

SEQ ID NO: 605481 - protein, 5 aa, Mycobacterium
VATAT

SEQ ID NO: 605482 - protein, 8 aa, Mycobacterium
VATATGGA

SEQ ID NO: 605483 - protein, 4 aa, Mycobacterium
VATD

SEQ ID NO: 605484 - protein, 18 aa, Mycobacterium
VATDAAREANFTNEVGAD

SEQ ID NO: 605485 - protein, 5 aa, Mycobacterium
VATDD

SEQ ID NO: 605486 - protein, 6 aa, Mycobacterium
VATDEG

SEQ ID NO: 605487 - protein, 16 aa, Mycobacterium
VATDGRPDPDPTRYGN

SEQ ID NO: 605488 - protein, 7 aa, Mycobacterium
VATDGTA

SEQ ID NO: 605489 - protein, 15 aa, Mycobacterium
VATDGTYSSPIDNPN

SEQ ID NO: 605490 - protein, 9 aa, Mycobacterium
VATDNGADH

SEQ ID NO: 605491 - protein, 8 aa, Mycobacterium
VATDPDGN

SEQ ID NO: 605492 - protein, 6 aa, Mycobacterium
VATDPE

SEQ ID NO: 605493 - protein, 10 aa, Mycobacterium
VATDRERGQK

SEQ ID NO: 605494 - protein, 19 aa, Mycobacterium
VATDTGDYLDENPQTNQAL

SEQ ID NO: 605495 - protein, 13 aa, Mycobacterium
VATEAARALHLYG

SEQ ID NO: 605496 - protein, 8 aa, Mycobacterium
VATEAASA

SEQ ID NO: 605497 - protein, 9 aa, Mycobacterium
VATEGVPGG

SEQ ID NO: 605498 - protein, 9 aa, Mycobacterium
VATEGVTGG

SEQ ID NO: 605499 - protein, 10 aa, Mycobacterium
VATEPATATL

SEQ ID NO: 605500 - protein, 11 aa, Mycobacterium
VATEPGERVDP

SEQ ID NO: 605501 - protein, 11 aa, Mycobacterium
VATEPGKGNER

SEQ ID NO: 605502 - protein, 5 aa, Mycobacterium
VATEQ

SEQ ID NO: 605503 - protein, 16 aa, Mycobacterium
VATERDAAARLIKEAM

SEQ ID NO: 605504 - protein, 13 aa, Mycobacterium
VATESGAISTSGR

SEQ ID NO: 605505 - protein, 20 aa, Mycobacterium
VATGAAAELAADGGDGRTAL

SEQ ID NO: 605506 - protein, 8 aa, Mycobacterium
VATGATAA

SEQ ID NO: 605507 - protein, 9 aa, Mycobacterium
VATGATAQA

SEQ ID NO: 605508 - protein, 8 aa, Mycobacterium
VATGATAR

SEQ ID NO: 605509 - protein, 5 aa, Mycobacterium
VATGE

SEQ ID NO: 605510 - protein, 5 aa, Mycobacterium
VATGG

SEQ ID NO: 605511 - protein, 7 aa, Mycobacterium
VATGGLP

SEQ ID NO: 605512 - protein, 10 aa, Mycobacterium
VATGGRTDNL

SEQ ID NO: 605513 - protein, 14 aa, Mycobacterium
VATGHGSEDGNRLA

SEQ ID NO: 605514 - protein, 8 aa, Mycobacterium
VATGNGVG

SEQ ID NO: 605515 - protein, 19 aa, Mycobacterium
VATGPAGTTFDADSTTAAV

SEQ ID NO: 605516 - protein, 24 aa, Mycobacterium
VATGPARTAGSTGHDSGAPSPAVT

SEQ ID NO: 605517 - protein, 6 aa, Mycobacterium
VATGQA

SEQ ID NO: 605518 - protein, 11 aa, Mycobacterium
VATGRSHAADV

SEQ ID NO: 605519 - protein, 7 aa, Mycobacterium
VATGTRL

SEQ ID NO: 605520 - protein, 13 aa, Mycobacterium
VATKAPETDLFAG

SEQ ID NO: 605521 - protein, 8 aa, Mycobacterium
VATKEDVD

SEQ ID NO: 605522 - protein, 7 aa, Mycobacterium
VATKYRG

SEQ ID NO: 605523 - protein, 4 aa, Mycobacterium
VATP

SEQ ID NO: 605524 - protein, 5 aa, Mycobacterium
VATPA

SEQ ID NO: 605525 - protein, 6 aa, Mycobacterium
VATPDG

SEQ ID NO: 605526 - protein, 13 aa, Mycobacterium
VATPEDETFERDA

SEQ ID NO: 605527 - protein, 7 aa, Mycobacterium
VATPEDV

SEQ ID NO: 605528 - protein, 8 aa, Mycobacterium
VATPGEQA

SEQ ID NO: 605529 - protein, 8 aa, Mycobacterium
VATPGGQA

SEQ ID NO: 605530 - protein, 7 aa, Mycobacterium
VATPNPP

SEQ ID NO: 605531 - protein, 8 aa, Mycobacterium
VATPPGAR

SEQ ID NO: 605532 - protein, 54 aa, Mycobacterium
VATPPVPGVPGGGTTVPAASVTPPAPGVPGGASTVPGNAGTPSTPGLPPGSTDT

SEQ ID NO: 605533 - protein, 5 aa, Mycobacterium
VATPY

SEQ ID NO: 605534 - protein, 10 aa, Mycobacterium
VATQAGVSRP

SEQ ID NO: 605535 - protein, 5 aa, Mycobacterium
VATQE

SEQ ID NO: 605536 - protein, 5 aa, Mycobacterium
VATQG

SEQ ID NO: 605537 - protein, 7 aa, Mycobacterium
VATQGSA

SEQ ID NO: 605538 - protein, 9 aa, Mycobacterium
VATQKGTEA

SEQ ID NO: 605539 - protein, 6 aa, Mycobacterium
VATQPV

SEQ ID NO: 605540 - protein, 11 aa, Mycobacterium
VATQTRAVGER

SEQ ID NO: 605541 - protein, 12 aa, Mycobacterium
VATQVTEPAHSV

SEQ ID NO: 605542 - protein, 6 aa, Mycobacterium
VATRAA

SEQ ID NO: 605543 - protein, 8 aa, Mycobacterium
VATRADRP

SEQ ID NO: 605544 - protein, 10 aa, Mycobacterium
VATRAEDPVI

SEQ ID NO: 605545 - protein, 7 aa, Mycobacterium
VATRDGA

SEQ ID NO: 605546 - protein, 12 aa, Mycobacterium
VATRGDEAVREY

SEQ ID NO: 605547 - protein, 5 aa, Mycobacterium
VATRS

SEQ ID NO: 605548 - protein, 12 aa, Mycobacterium
VATSAGAAQNTL

SEQ ID NO: 605549 - protein, 8 aa, Mycobacterium
VATSAGQL

SEQ ID NO: 605550 - protein, 15 aa, Mycobacterium
VATSDRREGRAPGGF

SEQ ID NO: 605551 - protein, 8 aa, Mycobacterium
VATSEDAF

SEQ ID NO: 605552 - protein, 7 aa, Mycobacterium
VATSGGR

SEQ ID NO: 605553 - protein, 5 aa, Mycobacterium
VATSL

SEQ ID NO: 605554 - protein, 8 aa, Mycobacterium
VATSPADC

SEQ ID NO: 605555 - protein, 7 aa, Mycobacterium
VATSPAE

SEQ ID NO: 605556 - protein, 18 aa, Mycobacterium
VATSRDHATCEAANEATR

SEQ ID NO: 605557 - protein, 45 aa, Mycobacterium
VATSTAAATVTGNGPAITTSTAGATSTAVTTVSTRGPESHGRGAV

SEQ ID NO: 605558 - protein, 21 aa, Mycobacterium
VATTDEASAPSAAATETTTEE

SEQ ID NO: 605559 - protein, 8 aa, Mycobacterium
VATTERYT

SEQ ID NO: 605560 - protein, 27 aa, Mycobacterium
VATTGIGNTENPAATPGLVGRSTGPEI

SEQ ID NO: 605561 - protein, 13 aa, Mycobacterium
VATTHHSGDEVAT

SEQ ID NO: 605562 - protein, 5 aa, Mycobacterium
VATTI

SEQ ID NO: 605563 - protein, 7 aa, Mycobacterium
VATTQRY

SEQ ID NO: 605564 - protein, 6 aa, Mycobacterium
VATTTE

SEQ ID NO: 605565 - protein, 6 aa, Mycobacterium
VATVST

SEQ ID NO: 605566 - protein, 4 aa, Mycobacterium
VAVD

SEQ ID NO: 605567 - protein, 7 aa, Mycobacterium
VAVEPAT

SEQ ID NO: 605568 - protein, 12 aa, Mycobacterium
VAVGGDSAGGNL

SEQ ID NO: 605569 - protein, 11 aa, Mycobacterium
VAVPDGATDTE

SEQ ID NO: 605570 - protein, 20 aa, Mycobacterium
VAVPPEAALPPVPPSPPRDP

SEQ ID NO: 605571 - protein, 7 aa, Mycobacterium
VAVSGAS

SEQ ID NO: 605572 - protein, 7 aa, Mycobacterium
VAVSPET

SEQ ID NO: 605573 - protein, 4 aa, Mycobacterium
VAVT

SEQ ID NO: 605574 - protein, 12 aa, Mycobacterium
VAWPKSGTFNEA

SEQ ID NO: 605575 - protein, 8 aa, Mycobacterium
VAYEPDRR

SEQ ID NO: 605576 - protein, 21 aa, Mycobacterium
VAYGAEEGTVPAEQPSWKRTN

SEQ ID NO: 605577 - protein, 14 aa, Mycobacterium
VAYGASGEHEGFPG

SEQ ID NO: 605578 - protein, 5 aa, Mycobacterium
VAYPD

SEQ ID NO: 605579 - protein, 4 aa, Mycobacterium
VAYR

SEQ ID NO: 605580 - protein, 11 aa, Mycobacterium
VCESDGDEGAK

SEQ ID NO: 605581 - protein, 9 aa, Mycobacterium
VCGDKTPPR

SEQ ID NO: 605582 - protein, 11 aa, Mycobacterium
VCGSDGDVAED

SEQ ID NO: 605583 - protein, 5 aa, Mycobacterium
VDAAA

SEQ ID NO: 605584 - protein, 12 aa, Mycobacterium
VDAAAAAGNAGL

SEQ ID NO: 605585 - protein, 14 aa, Mycobacterium
VDAADAPAYGGHND

SEQ ID NO: 605586 - protein, 23 aa, Mycobacterium
VDAAEAAARLDRARGRVRDALGG

SEQ ID NO: 605587 - protein, 11 aa, Mycobacterium
VDAAESDEARA

SEQ ID NO: 605588 - protein, 9 aa, Mycobacterium
VDAAGAPVK

SEQ ID NO: 605589 - protein, 6 aa, Mycobacterium
VDAAGG

SEQ ID NO: 605590 - protein, 7 aa, Mycobacterium
VDAANTD

SEQ ID NO: 605591 - protein, 33 aa, Mycobacterium
VDAAPATGRKSESGGRRNRRSKKSRAEEPSDKG

SEQ ID NO: 605592 - protein, 8 aa, Mycobacterium
VDAAPGEG

SEQ ID NO: 605593 - protein, 17 aa, Mycobacterium
VDAAPGESLTVPRSATP

SEQ ID NO: 605594 - protein, 8 aa, Mycobacterium
VDAAPGRI

SEQ ID NO: 605595 - protein, 5 aa, Mycobacterium
VDAAR

SEQ ID NO: 605596 - protein, 7 aa, Mycobacterium
VDAARAA

SEQ ID NO: 605597 - protein, 12 aa, Mycobacterium
VDAARAARLSGA

SEQ ID NO: 605598 - protein, 13 aa, Mycobacterium
VDAARAARRVGAE

SEQ ID NO: 605599 - protein, 11 aa, Mycobacterium
VDAASTSYASM

SEQ ID NO: 605600 - protein, 8 aa, Mycobacterium
VDAATQAG

SEQ ID NO: 605601 - protein, 14 aa, Mycobacterium
VDAAVTGAAEAQKE

SEQ ID NO: 605602 - protein, 9 aa, Mycobacterium
VDADAPNRF

SEQ ID NO: 605603 - protein, 9 aa, Mycobacterium
VDADAQRAA

SEQ ID NO: 605604 - protein, 5 aa, Mycobacterium
VDADE

SEQ ID NO: 605605 - protein, 9 aa, Mycobacterium
VDADEAKSI

SEQ ID NO: 605606 - protein, 10 aa, Mycobacterium
VDADEPEPQE

SEQ ID NO: 605607 - protein, 9 aa, Mycobacterium
VDADETDLE

SEQ ID NO: 605608 - protein, 6 aa, Mycobacterium
VDADEV

SEQ ID NO: 605609 - protein, 18 aa, Mycobacterium
VDADGQPTALADPRADEL

SEQ ID NO: 605610 - protein, 18 aa, Mycobacterium
VDADGREKLPAFLLTAHR

SEQ ID NO: 605611 - protein, 7 aa, Mycobacterium
VDADGRR

SEQ ID NO: 605612 - protein, 18 aa, Mycobacterium
VDADHTALEGHSVAILRC

SEQ ID NO: 605613 - protein, 8 aa, Mycobacterium
VDADKVAA

SEQ ID NO: 605614 - protein, 7 aa, Mycobacterium
VDADNPA

SEQ ID NO: 605615 - protein, 8 aa, Mycobacterium
VDADPDAL

SEQ ID NO: 605616 - protein, 10 aa, Mycobacterium
VDADRGAGVT

SEQ ID NO: 605617 - protein, 6 aa, Mycobacterium
VDADSV

SEQ ID NO: 605618 - protein, 6 aa, Mycobacterium
VDADSY

SEQ ID NO: 605619 - protein, 14 aa, Mycobacterium
VDADTREAAEKQLA

SEQ ID NO: 605620 - protein, 4 aa, Mycobacterium
VDAE

SEQ ID NO: 605621 - protein, 8 aa, Mycobacterium
VDAEAARR

SEQ ID NO: 605622 - protein, 19 aa, Mycobacterium
VDAEATVTAGNASGQNDGA

SEQ ID NO: 605623 - protein, 7 aa, Mycobacterium
VDAEDAW

SEQ ID NO: 605624 - protein, 10 aa, Mycobacterium
VDAEKDPRKL

SEQ ID NO: 605625 - protein, 13 aa, Mycobacterium
VDAEKLSTQHDTA

SEQ ID NO: 605626 - protein, 16 aa, Mycobacterium
VDAEKRKAYESRARGE

SEQ ID NO: 605627 - protein, 19 aa, Mycobacterium
VDAENASPAVDVERDTAPM

SEQ ID NO: 605628 - protein, 7 aa, Mycobacterium
VDAENSL

SEQ ID NO: 605629 - protein, 13 aa, Mycobacterium
VDAEPSAGAGEQV

SEQ ID NO: 605630 - protein, 9 aa, Mycobacterium
VDAERPAAH

SEQ ID NO: 605631 - protein, 10 aa, Mycobacterium
VDAESADTAT

SEQ ID NO: 605632 - protein, 9 aa, Mycobacterium
VDAGDAAAV

SEQ ID NO: 605633 - protein, 6 aa, Mycobacterium
VDAGDD

SEQ ID NO: 605634 - protein, 11 aa, Mycobacterium
VDAGDKDKASE

SEQ ID NO: 605635 - protein, 16 aa, Mycobacterium
VDAGDPLSTLTETNTE

SEQ ID NO: 605636 - protein, 8 aa, Mycobacterium
VDAGEPES

SEQ ID NO: 605637 - protein, 5 aa, Mycobacterium
VDAGG

SEQ ID NO: 605638 - protein, 7 aa, Mycobacterium
VDAGGQN

SEQ ID NO: 605639 - protein, 15 aa, Mycobacterium
VDAGGRSRNVSDGYR

SEQ ID NO: 605640 - protein, 12 aa, Mycobacterium
VDAGPERDQTPL

SEQ ID NO: 605641 - protein, 10 aa, Mycobacterium
VDAGPTDERA

SEQ ID NO: 605642 - protein, 19 aa, Mycobacterium
VDAGPVSESWRQQPGTPVY

SEQ ID NO: 605643 - protein, 7 aa, Mycobacterium
VDAGQDV

SEQ ID NO: 605644 - protein, 9 aa, Mycobacterium
VDAGRDPRG

SEQ ID NO: 605645 - protein, 12 aa, Mycobacterium
VDAGRGSPESLS

SEQ ID NO: 605646 - protein, 8 aa, Mycobacterium
VDAGSSRR

SEQ ID NO: 605647 - protein, 19 aa, Mycobacterium
VDAGSTVTAGNASGQNDGA

SEQ ID NO: 605648 - protein, 10 aa, Mycobacterium
VDAGTEDSRV

SEQ ID NO: 605649 - protein, 8 aa, Mycobacterium
VDAGTGPV

SEQ ID NO: 605650 - protein, 14 aa, Mycobacterium
VDAGTGYDSDEMPA

SEQ ID NO: 605651 - protein, 7 aa, Mycobacterium
VDAGYGK

SEQ ID NO: 605652 - protein, 4 aa, Mycobacterium
VDAK

SEQ ID NO: 605653 - protein, 12 aa, Mycobacterium
VDAKGSGHDGPI

SEQ ID NO: 605654 - protein, 9 aa, Mycobacterium
VDAKPDPYV

SEQ ID NO: 605655 - protein, 9 aa, Mycobacterium
VDAKSEPIH

SEQ ID NO: 605656 - protein, 13 aa, Mycobacterium
VDANADGLTGQEG

SEQ ID NO: 605657 - protein, 11 aa, Mycobacterium
VDANDPHGPMT

SEQ ID NO: 605658 - protein, 8 aa, Mycobacterium
VDANGGWT

SEQ ID NO: 605659 - protein, 5 aa, Mycobacterium
VDAPA

SEQ ID NO: 605660 - protein, 13 aa, Mycobacterium
VDAPADRDQKARL

SEQ ID NO: 605661 - protein, 12 aa, Mycobacterium
VDAPAVDEHRRR

SEQ ID NO: 605662 - protein, 7 aa, Mycobacterium
VDAPDGY

SEQ ID NO: 605663 - protein, 17 aa, Mycobacterium
VDAPEPAGDGSSSDEVG

SEQ ID NO: 605664 - protein, 5 aa, Mycobacterium
VDAPG

SEQ ID NO: 605665 - protein, 7 aa, Mycobacterium
VDAPGDA

SEQ ID NO: 605666 - protein, 5 aa, Mycobacterium
VDAPM

SEQ ID NO: 605667 - protein, 7 aa, Mycobacterium
VDAPPSA

SEQ ID NO: 605668 - protein, 5 aa, Mycobacterium
VDAPS

SEQ ID NO: 605669 - protein, 7 aa, Mycobacterium
VDAPSRI

SEQ ID NO: 605670 - protein, 7 aa, Mycobacterium
VDAPTVG

SEQ ID NO: 605671 - protein, 8 aa, Mycobacterium
VDAQPQHG

SEQ ID NO: 605672 - protein, 12 aa, Mycobacterium
VDAQRQAREALR

SEQ ID NO: 605673 - protein, 11 aa, Mycobacterium
VDAQSQARTAL

SEQ ID NO: 605674 - protein, 8 aa, Mycobacterium
VDARDGEA

SEQ ID NO: 605675 - protein, 7 aa, Mycobacterium
VDARGAA

SEQ ID NO: 605676 - protein, 16 aa, Mycobacterium
VDARGADHLPLRPWWT

SEQ ID NO: 605677 - protein, 9 aa, Mycobacterium
VDASGEPYQ

SEQ ID NO: 605678 - protein, 12 aa, Mycobacterium
VDASGNPSSFAD

SEQ ID NO: 605679 - protein, 11 aa, Mycobacterium
VDASGRKTYPT

SEQ ID NO: 605680 - protein, 5 aa, Mycobacterium
VDASQ

SEQ ID NO: 605681 - protein, 7 aa, Mycobacterium
VDASRGD

SEQ ID NO: 605682 - protein, 12 aa, Mycobacterium
VDASRTAAMGGS

SEQ ID NO: 605683 - protein, 9 aa, Mycobacterium
VDASTSGAV

SEQ ID NO: 605684 - protein, 20 aa, Mycobacterium
VDATAGDLIGPDGYGHTGFT

SEQ ID NO: 605685 - protein, 7 aa, Mycobacterium
VDATGEF

SEQ ID NO: 605686 - protein, 8 aa, Mycobacterium
VDATGQFA

SEQ ID NO: 605687 - protein, 9 aa, Mycobacterium
VDATPAAVT

SEQ ID NO: 605688 - protein, 7 aa, Mycobacterium
VDDAAAA

SEQ ID NO: 605689 - protein, 10 aa, Mycobacterium
VDDAAGEAYD

SEQ ID NO: 605690 - protein, 11 aa, Mycobacterium
VDDADGPSPRE

SEQ ID NO: 605691 - protein, 6 aa, Mycobacterium
VDDAEA

SEQ ID NO: 605692 - protein, 10 aa, Mycobacterium
VDDAGAAEGA

SEQ ID NO: 605693 - protein, 22 aa, Mycobacterium
VDDAGREAARGGAGSSSRPVDG

SEQ ID NO: 605694 - protein, 22 aa, Mycobacterium
VDDAKQRLAAPVEKPSEPVETP

SEQ ID NO: 605695 - protein, 5 aa, Mycobacterium
VDDAL

SEQ ID NO: 605696 - protein, 11 aa, Mycobacterium
VDDATAKGAKV

SEQ ID NO: 605697 - protein, 8 aa, Mycobacterium
VDDATARA

SEQ ID NO: 605698 - protein, 8 aa, Mycobacterium
VDDATEQL

SEQ ID NO: 605699 - protein, 6 aa, Mycobacterium
VDDATV

SEQ ID NO: 605700 - protein, 7 aa, Mycobacterium
VDDDDAT

SEQ ID NO: 605701 - protein, 6 aa, Mycobacterium
VDDDDN

SEQ ID NO: 605702 - protein, 6 aa, Mycobacterium
VDDDEA

SEQ ID NO: 605703 - protein, 7 aa, Mycobacterium
VDDDEAL

SEQ ID NO: 605704 - protein, 7 aa, Mycobacterium
VDDDEAV

SEQ ID NO: 605705 - protein, 7 aa, Mycobacterium
VDDDERR

SEQ ID NO: 605706 - protein, 7 aa, Mycobacterium
VDDDESL

SEQ ID NO: 605707 - protein, 5 aa, Mycobacterium
VDDDG

SEQ ID NO: 605708 - protein, 6 aa, Mycobacterium
VDDDGA

SEQ ID NO: 605709 - protein, 13 aa, Mycobacterium
VDDDGLTALRAAL

SEQ ID NO: 605710 - protein, 18 aa, Mycobacterium
VDDDGNELERSPDHGEHA

SEQ ID NO: 605711 - protein, 9 aa, Mycobacterium
VDDDPNAAP

SEQ ID NO: 605712 - protein, 7 aa, Mycobacterium
VDDDPQQ

SEQ ID NO: 605713 - protein, 17 aa, Mycobacterium
VDDDQTFRYGPAAGDPM

SEQ ID NO: 605714 - protein, 6 aa, Mycobacterium
VDDDTR

SEQ ID NO: 605715 - protein, 4 aa, Mycobacterium
VDDE

SEQ ID NO: 605716 - protein, 7 aa, Mycobacterium
VDDEELR

SEQ ID NO: 605717 - protein, 7 aa, Mycobacterium
VDDEEQR

SEQ ID NO: 605718 - protein, 30 aa, Mycobacterium
VDDEGDESASAGEAEETAPVESDDNAGTSG

SEQ ID NO: 605719 - protein, 17 aa, Mycobacterium
VDDEGNQLVPGADEAEH

SEQ ID NO: 605720 - protein, 6 aa, Mycobacterium
VDDEGY

SEQ ID NO: 605721 - protein, 8 aa, Mycobacterium
VDDEHPNA

SEQ ID NO: 605722 - protein, 7 aa, Mycobacterium
VDDEIAD

SEQ ID NO: 605723 - protein, 11 aa, Mycobacterium
VDDEITTTAGP

SEQ ID NO: 605724 - protein, 7 aa, Mycobacterium
VDDEPLR

SEQ ID NO: 605725 - protein, 6 aa, Mycobacterium
VDDEPT

SEQ ID NO: 605726 - protein, 17 aa, Mycobacterium
VDDEREAVETARTRLAD

SEQ ID NO: 605727 - protein, 5 aa, Mycobacterium
VDDET

SEQ ID NO: 605728 - protein, 14 aa, Mycobacterium
VDDGAADHLQDRPL

SEQ ID NO: 605729 - protein, 9 aa, Mycobacterium
VDDGAPAHR

SEQ ID NO: 605730 - protein, 15 aa, Mycobacterium
VDDGAVTGVALHRLP

SEQ ID NO: 605731 - protein, 6 aa, Mycobacterium
VDDGDA

SEQ ID NO: 605732 - protein, 10 aa, Mycobacterium
VDDGDGKPVE

SEQ ID NO: 605733 - protein, 10 aa, Mycobacterium
VDDGDTGYPC

SEQ ID NO: 605734 - protein, 8 aa, Mycobacterium
VDDGEVSR

SEQ ID NO: 605735 - protein, 5 aa, Mycobacterium
VDDGM

SEQ ID NO: 605736 - protein, 10 aa, Mycobacterium
VDDGNGGSVE

SEQ ID NO: 605737 - protein, 7 aa, Mycobacterium
VDDGPTA

SEQ ID NO: 605738 - protein, 17 aa, Mycobacterium
VDDGSGETDEDQKLRHE

SEQ ID NO: 605739 - protein, 18 aa, Mycobacterium
VDDGSGETDEDQKLRNES

SEQ ID NO: 605740 - protein, 7 aa, Mycobacterium
VDDGTTV

SEQ ID NO: 605741 - protein, 7 aa, Mycobacterium
VDDHRDA

SEQ ID NO: 605742 - protein, 18 aa, Mycobacterium
VDDHSRARAALRDSRPIR

SEQ ID NO: 605743 - protein, 16 aa, Mycobacterium
VDDHSTVDEVSDTLEP

SEQ ID NO: 605744 - protein, 12 aa, Mycobacterium
VDDKTQGKYSDT

SEQ ID NO: 605745 - protein, 6 aa, Mycobacterium
VDDNGA

SEQ ID NO: 605746 - protein, 11 aa, Mycobacterium
VDDNPLRGAPH

SEQ ID NO: 605747 - protein, 10 aa, Mycobacterium
VDDPAEKSRA

SEQ ID NO: 605748 - protein, 9 aa, Mycobacterium
VDDPAPEPL

SEQ ID NO: 605749 - protein, 7 aa, Mycobacterium
VDDPAQR

SEQ ID NO: 605750 - protein, 16 aa, Mycobacterium
VDDPARRDRLEATTRD

SEQ ID NO: 605751 - protein, 5 aa, Mycobacterium
VDDPD

SEQ ID NO: 605752 - protein, 6 aa, Mycobacterium
VDDPDA

SEQ ID NO: 605753 - protein, 9 aa, Mycobacterium
VDDPDLQPA

SEQ ID NO: 605754 - protein, 7 aa, Mycobacterium
VDDPDRP

SEQ ID NO: 605755 - protein, 7 aa, Mycobacterium
VDDPDRV

SEQ ID NO: 605756 - protein, 8 aa, Mycobacterium
VDDPDSLQ

SEQ ID NO: 605757 - protein, 5 aa, Mycobacterium
VDDPE

SEQ ID NO: 605758 - protein, 7 aa, Mycobacterium
VDDPELE

SEQ ID NO: 605759 - protein, 14 aa, Mycobacterium
VDDPELGADPLRNN

SEQ ID NO: 605760 - protein, 7 aa, Mycobacterium
VDDPEWG

SEQ ID NO: 605761 - protein, 7 aa, Mycobacterium
VDDPHIN

SEQ ID NO: 605762 - protein, 8 aa, Mycobacterium
VDDPPGSG

SEQ ID NO: 605763 - protein, 7 aa, Mycobacterium
VDDPRAD

SEQ ID NO: 605764 - protein, 8 aa, Mycobacterium
VDDPRPIT

SEQ ID NO: 605765 - protein, 6 aa, Mycobacterium
VDDPSG

SEQ ID NO: 605766 - protein, 7 aa, Mycobacterium
VDDPSGA

SEQ ID NO: 605767 - protein, 10 aa, Mycobacterium
VDDPSGDTRI

SEQ ID NO: 605768 - protein, 44 aa, Mycobacterium
VDDPSPPNPISAQDLGSSETSPSKFGGGSGQGGSGQGGGASGVS

SEQ ID NO: 605769 - protein, 11 aa, Mycobacterium
VDDPTDVPGTV

SEQ ID NO: 605770 - protein, 6 aa, Mycobacterium
VDDPTE

SEQ ID NO: 605771 - protein, 7 aa, Mycobacterium
VDDPTQN

SEQ ID NO: 605772 - protein, 8 aa, Mycobacterium
VDDPTRQR

SEQ ID NO: 605773 - protein, 8 aa, Mycobacterium
VDDPYPIS

SEQ ID NO: 605774 - protein, 19 aa, Mycobacterium
VDDQREAFEAAKGKLAGTG

SEQ ID NO: 605775 - protein, 16 aa, Mycobacterium
VDDQREALDTARERLA

SEQ ID NO: 605776 - protein, 11 aa, Mycobacterium
VDDQSRARAAL

SEQ ID NO: 605777 - protein, 11 aa, Mycobacterium
VDDQSRTRAAL

SEQ ID NO: 605778 - protein, 5 aa, Mycobacterium
VDDQT

SEQ ID NO: 605779 - protein, 7 aa, Mycobacterium
VDDRDGV

SEQ ID NO: 605780 - protein, 5 aa, Mycobacterium
VDDRG

SEQ ID NO: 605781 - protein, 8 aa, Mycobacterium
VDDRPPNA

SEQ ID NO: 605782 - protein, 7 aa, Mycobacterium
VDDRPTL

SEQ ID NO: 605783 - protein, 20 aa, Mycobacterium
VDDRPVAERAEAKQISSEST

SEQ ID NO: 605784 - protein, 24 aa, Mycobacterium
VDDRPVAERAETKQISAESTFPDD

SEQ ID NO: 605785 - protein, 4 aa, Mycobacterium
VDDS

SEQ ID NO: 605786 - protein, 6 aa, Mycobacterium
VDDSAA

SEQ ID NO: 605787 - protein, 12 aa, Mycobacterium
VDDSDAEPWGST

SEQ ID NO: 605788 - protein, 9 aa, Mycobacterium
VDDSEPEGY

SEQ ID NO: 605789 - protein, 5 aa, Mycobacterium
VDDSI

SEQ ID NO: 605790 - protein, 6 aa, Mycobacterium
VDDSPE

SEQ ID NO: 605791 - protein, 7 aa, Mycobacterium
VDDSQLD

SEQ ID NO: 605792 - protein, 8 aa, Mycobacterium
VDDSTAHE

SEQ ID NO: 605793 - protein, 7 aa, Mycobacterium
VDDSYAA

SEQ ID NO: 605794 - protein, 4 aa, Mycobacterium
VDDT

SEQ ID NO: 605795 - protein, 7 aa, Mycobacterium
VDDTAAP

SEQ ID NO: 605796 - protein, 16 aa, Mycobacterium
VDDTAEDRVFTPRTYP

SEQ ID NO: 605797 - protein, 11 aa, Mycobacterium
VDDTALKPREW

SEQ ID NO: 605798 - protein, 8 aa, Mycobacterium
VDDTARSR

SEQ ID NO: 605799 - protein, 6 aa, Mycobacterium
VDDTDA

SEQ ID NO: 605800 - protein, 9 aa, Mycobacterium
VDDTDPDSP

SEQ ID NO: 605801 - protein, 17 aa, Mycobacterium
VDDTDQDTSDAVDTTDT

SEQ ID NO: 605802 - protein, 11 aa, Mycobacterium
VDDTEEGARNR

SEQ ID NO: 605803 - protein, 6 aa, Mycobacterium
VDDTGA

SEQ ID NO: 605804 - protein, 11 aa, Mycobacterium
VDDTPYGGGPG

SEQ ID NO: 605805 - protein, 15 aa, Mycobacterium
VDDTSRKRYPSLGAG

SEQ ID NO: 605806 - protein, 29 aa, Mycobacterium
VDEADAAGAVEDAVEGAEGGAAEAVEVDG

SEQ ID NO: 605807 - protein, 6 aa, Mycobacterium
VDEAGV

SEQ ID NO: 605808 - protein, 14 aa, Mycobacterium
VDEAPPAESPAAAA

SEQ ID NO: 605809 - protein, 35 aa, Mycobacterium
VDEAPSRPAYYPGSDDRVAGAQQSYPDAERHGQNG

SEQ ID NO: 605810 - protein, 5 aa, Mycobacterium
VDEAR

SEQ ID NO: 605811 - protein, 5 aa, Mycobacterium
VDEAS

SEQ ID NO: 605812 - protein, 5 aa, Mycobacterium
VDEAT

SEQ ID NO: 605813 - protein, 4 aa, Mycobacterium
VDED

SEQ ID NO: 605814 - protein, 7 aa, Mycobacterium
VDEDAAR

SEQ ID NO: 605815 - protein, 18 aa, Mycobacterium
VDEDALTEARAASYDARA

SEQ ID NO: 605816 - protein, 11 aa, Mycobacterium
VDEDEATGSVA

SEQ ID NO: 605817 - protein, 12 aa, Mycobacterium
VDEDGDGSGPGK

SEQ ID NO: 605818 - protein, 9 aa, Mycobacterium
VDEDGDLSD

SEQ ID NO: 605819 - protein, 13 aa, Mycobacterium
VDEDGEGTGPGDL

SEQ ID NO: 605820 - protein, 8 aa, Mycobacterium
VDEDPAEL

SEQ ID NO: 605821 - protein, 6 aa, Mycobacterium
VDEDPN

SEQ ID NO: 605822 - protein, 9 aa, Mycobacterium
VDEEDPTTA

SEQ ID NO: 605823 - protein, 7 aa, Mycobacterium
VDEEPLS

SEQ ID NO: 605824 - protein, 14 aa, Mycobacterium
VDEEQLTAAAASYE

SEQ ID NO: 605825 - protein, 6 aa, Mycobacterium
VDEEQQ

SEQ ID NO: 605826 - protein, 5 aa, Mycobacterium
VDEES

SEQ ID NO: 605827 - protein, 4 aa, Mycobacterium
VDEG

SEQ ID NO: 605828 - protein, 15 aa, Mycobacterium
VDEGAKPGKSTGESV

SEQ ID NO: 605829 - protein, 6 aa, Mycobacterium
VDEGNA

SEQ ID NO: 605830 - protein, 11 aa, Mycobacterium
VDEGPRANTSL

SEQ ID NO: 605831 - protein, 10 aa, Mycobacterium
VDEGPRETTL

SEQ ID NO: 605832 - protein, 5 aa, Mycobacterium
VDEHG

SEQ ID NO: 605833 - protein, 4 aa, Mycobacterium
VDEN

SEQ ID NO: 605834 - protein, 8 aa, Mycobacterium
VDENDPAG

SEQ ID NO: 605835 - protein, 5 aa, Mycobacterium
VDENN

SEQ ID NO: 605836 - protein, 9 aa, Mycobacterium
VDENPATAR

SEQ ID NO: 605837 - protein, 7 aa, Mycobacterium
VDENRTH

SEQ ID NO: 605838 - protein, 10 aa, Mycobacterium
VDENSRFPQE

SEQ ID NO: 605839 - protein, 4 aa, Mycobacterium
VDEP

SEQ ID NO: 605840 - protein, 12 aa, Mycobacterium
VDEPAVDAAADD

SEQ ID NO: 605841 - protein, 12 aa, Mycobacterium
VDEPDGSRRRLE

SEQ ID NO: 605842 - protein, 12 aa, Mycobacterium
VDEPGGSRRRLE

SEQ ID NO: 605843 - protein, 7 aa, Mycobacterium
VDEPGSY

SEQ ID NO: 605844 - protein, 6 aa, Mycobacterium
VDEPNA

SEQ ID NO: 605845 - protein, 7 aa, Mycobacterium
VDEPNAR

SEQ ID NO: 605846 - protein, 8 aa, Mycobacterium
VDEPNGAD

SEQ ID NO: 605847 - protein, 12 aa, Mycobacterium
VDEPPAPAPVDP

SEQ ID NO: 605848 - protein, 10 aa, Mycobacterium
VDEPPRTAAG

SEQ ID NO: 605849 - protein, 6 aa, Mycobacterium
VDEPRP

SEQ ID NO: 605850 - protein, 8 aa, Mycobacterium
VDEPSGDG

SEQ ID NO: 605851 - protein, 8 aa, Mycobacterium
VDEPTGDG

SEQ ID NO: 605852 - protein, 4 aa, Mycobacterium
VDEQ

SEQ ID NO: 605853 - protein, 7 aa, Mycobacterium
VDEQALP

SEQ ID NO: 605854 - protein, 13 aa, Mycobacterium
VDEQERAPHTADA

SEQ ID NO: 605855 - protein, 9 aa, Mycobacterium
VDEQERFPE

SEQ ID NO: 605856 - protein, 11 aa, Mycobacterium
VDEQGSRWRDE

SEQ ID NO: 605857 - protein, 7 aa, Mycobacterium
VDEQTGA

SEQ ID NO: 605858 - protein, 6 aa, Mycobacterium
VDEQTT

SEQ ID NO: 605859 - protein, 7 aa, Mycobacterium
VDERADG

SEQ ID NO: 605860 - protein, 12 aa, Mycobacterium
VDERDPAPPRLD

SEQ ID NO: 605861 - protein, 6 aa, Mycobacterium
VDERDR

SEQ ID NO: 605862 - protein, 8 aa, Mycobacterium
VDERGASY

SEQ ID NO: 605863 - protein, 6 aa, Mycobacterium
VDERNR

SEQ ID NO: 605864 - protein, 6 aa, Mycobacterium
VDERQK

SEQ ID NO: 605865 - protein, 8 aa, Mycobacterium
VDERRDFA

SEQ ID NO: 605866 - protein, 8 aa, Mycobacterium
VDERRGVP

SEQ ID NO: 605867 - protein, 5 aa, Mycobacterium
VDESA

SEQ ID NO: 605868 - protein, 12 aa, Mycobacterium
VDESEPGSGPGE

SEQ ID NO: 605869 - protein, 11 aa, Mycobacterium
VDESESAENFE

SEQ ID NO: 605870 - protein, 12 aa, Mycobacterium
VDESESAESFEL

SEQ ID NO: 605871 - protein, 49 aa, Mycobacterium
VDESFPASDPGALENGHADDAPKFESAAAHAKGRVSSPVRVKSDERGEF

SEQ ID NO: 605872 - protein, 6 aa, Mycobacterium
VDESGA

SEQ ID NO: 605873 - protein, 11 aa, Mycobacterium
VDESGQAQTGL

SEQ ID NO: 605874 - protein, 12 aa, Mycobacterium
VDESGRFRSREE

SEQ ID NO: 605875 - protein, 9 aa, Mycobacterium
VDESLPDDA

SEQ ID NO: 605876 - protein, 7 aa, Mycobacterium
VDESNAR

SEQ ID NO: 605877 - protein, 11 aa, Mycobacterium
VDESQSTGDTV

SEQ ID NO: 605878 - protein, 16 aa, Mycobacterium
VDESQSVGNGRPLEPA

SEQ ID NO: 605879 - protein, 7 aa, Mycobacterium
VDESSAR

SEQ ID NO: 605880 - protein, 8 aa, Mycobacterium
VDESSPKR

SEQ ID NO: 605881 - protein, 7 aa, Mycobacterium
VDESSPN

SEQ ID NO: 605882 - protein, 4 aa, Mycobacterium
VDET

SEQ ID NO: 605883 - protein, 16 aa, Mycobacterium
VDETATSAVQSPTIPN

SEQ ID NO: 605884 - protein, 5 aa, Mycobacterium
VDETG

SEQ ID NO: 605885 - protein, 6 aa, Mycobacterium
VDETGD

SEQ ID NO: 605886 - protein, 10 aa, Mycobacterium
VDETGNASGV

SEQ ID NO: 605887 - protein, 7 aa, Mycobacterium
VDETPDR

SEQ ID NO: 605888 - protein, 6 aa, Mycobacterium
VDETQG

SEQ ID NO: 605889 - protein, 6 aa, Mycobacterium
VDETSV

SEQ ID NO: 605890 - protein, 8 aa, Mycobacterium
VDETTEAL

SEQ ID NO: 605891 - protein, 5 aa, Mycobacterium
VDGAA

SEQ ID NO: 605892 - protein, 11 aa, Mycobacterium
VDGAAARALGE

SEQ ID NO: 605893 - protein, 11 aa, Mycobacterium
VDGAAPQGSKA

SEQ ID NO: 605894 - protein, 8 aa, Mycobacterium
VDGADIGK

SEQ ID NO: 605895 - protein, 10 aa, Mycobacterium
VDGADRPPFS

SEQ ID NO: 605896 - protein, 16 aa, Mycobacterium
VDGAESARRVGTDAIT

SEQ ID NO: 605897 - protein, 8 aa, Mycobacterium
VDGAGAPI

SEQ ID NO: 605898 - protein, 9 aa, Mycobacterium
VDGANADTG

SEQ ID NO: 605899 - protein, 11 aa, Mycobacterium
VDGAPALESAD

SEQ ID NO: 605900 - protein, 9 aa, Mycobacterium
VDGAPDMGP

SEQ ID NO: 605901 - protein, 8 aa, Mycobacterium
VDGAQAAA

SEQ ID NO: 605902 - protein, 5 aa, Mycobacterium
VDGAR

SEQ ID NO: 605903 - protein, 6 aa, Mycobacterium
VDGARR

SEQ ID NO: 605904 - protein, 10 aa, Mycobacterium
VDGARSNLES

SEQ ID NO: 605905 - protein, 12 aa, Mycobacterium
VDGARWDDDTES

SEQ ID NO: 605906 - protein, 9 aa, Mycobacterium
VDGASAPIG

SEQ ID NO: 605907 - protein, 26 aa, Mycobacterium
VDGATRPKSATPPAQPDELGDATPGP

SEQ ID NO: 605908 - protein, 4 aa, Mycobacterium
VDGD

SEQ ID NO: 605909 - protein, 23 aa, Mycobacterium
VDGDDALARDPMTGERDIRSEDR

SEQ ID NO: 605910 - protein, 8 aa, Mycobacterium
VDGDEASA

SEQ ID NO: 605911 - protein, 8 aa, Mycobacterium
VDGDESPR

SEQ ID NO: 605912 - protein, 5 aa, Mycobacterium
VDGDG

SEQ ID NO: 605913 - protein, 9 aa, Mycobacterium
VDGDGNPAY

SEQ ID NO: 605914 - protein, 6 aa, Mycobacterium
VDGDGR

SEQ ID NO: 605915 - protein, 7 aa, Mycobacterium
VDGDPTQ

SEQ ID NO: 605916 - protein, 7 aa, Mycobacterium
VDGDQQT

SEQ ID NO: 605917 - protein, 9 aa, Mycobacterium
VDGDQYSEQ

SEQ ID NO: 605918 - protein, 5 aa, Mycobacterium
VDGDR

SEQ ID NO: 605919 - protein, 10 aa, Mycobacterium
VDGDRASARS

SEQ ID NO: 605920 - protein, 10 aa, Mycobacterium
VDGDRATART

SEQ ID NO: 605921 - protein, 9 aa, Mycobacterium
VDGDRGQSL

SEQ ID NO: 605922 - protein, 8 aa, Mycobacterium
VDGDRLAD

SEQ ID NO: 605923 - protein, 9 aa, Mycobacterium
VDGDRLEDA

SEQ ID NO: 605924 - protein, 9 aa, Mycobacterium
VDGDRLNRD

SEQ ID NO: 605925 - protein, 9 aa, Mycobacterium
VDGDRLSDA

SEQ ID NO: 605926 - protein, 10 aa, Mycobacterium
VDGDRLTDGE

SEQ ID NO: 605927 - protein, 7 aa, Mycobacterium
VDGDRTN

SEQ ID NO: 605928 - protein, 8 aa, Mycobacterium
VDGDRTNI

SEQ ID NO: 605929 - protein, 5 aa, Mycobacterium
VDGDT

SEQ ID NO: 605930 - protein, 26 aa, Mycobacterium
VDGDTGEYQPAAADRPETGVYSSPAE

SEQ ID NO: 605931 - protein, 4 aa, Mycobacterium
VDGE

SEQ ID NO: 605932 - protein, 13 aa, Mycobacterium
VDGEADLDDPDLE

SEQ ID NO: 605933 - protein, 11 aa, Mycobacterium
VDGEAPADETV

SEQ ID NO: 605934 - protein, 20 aa, Mycobacterium
VDGEDVPNAAAEGLSHEVGS

SEQ ID NO: 605935 - protein, 20 aa, Mycobacterium
VDGEEVPNAAAEGLSHEVGS

SEQ ID NO: 605936 - protein, 10 aa, Mycobacterium
VDGEGSPGAP

SEQ ID NO: 605937 - protein, 10 aa, Mycobacterium
VDGEGTTVAR

SEQ ID NO: 605938 - protein, 7 aa, Mycobacterium
VDGEHGP

SEQ ID NO: 605939 - protein, 10 aa, Mycobacterium
VDGEKLNRDQ

SEQ ID NO: 605940 - protein, 9 aa, Mycobacterium
VDGEKLTED

SEQ ID NO: 605941 - protein, 10 aa, Mycobacterium
VDGEKRLDES

SEQ ID NO: 605942 - protein, 13 aa, Mycobacterium
VDGELPPDTAAWL

SEQ ID NO: 605943 - protein, 5 aa, Mycobacterium
VDGEP

SEQ ID NO: 605944 - protein, 9 aa, Mycobacterium
VDGEQLTDD

SEQ ID NO: 605945 - protein, 6 aa, Mycobacterium
VDGEQQ

SEQ ID NO: 605946 - protein, 5 aa, Mycobacterium
VDGER

SEQ ID NO: 605947 - protein, 8 aa, Mycobacterium
VDGERLSD

SEQ ID NO: 605948 - protein, 9 aa, Mycobacterium
VDGERLSSA

SEQ ID NO: 605949 - protein, 7 aa, Mycobacterium
VDGERLT

SEQ ID NO: 605950 - protein, 8 aa, Mycobacterium
VDGERLTS

SEQ ID NO: 605951 - protein, 9 aa, Mycobacterium
VDGERLTSA

SEQ ID NO: 605952 - protein, 11 aa, Mycobacterium
VDGERRDPDAP

SEQ ID NO: 605953 - protein, 5 aa, Mycobacterium
VDGES

SEQ ID NO: 605954 - protein, 9 aa, Mycobacterium
VDGETARSL

SEQ ID NO: 605955 - protein, 12 aa, Mycobacterium
VDGETSLDDADP

SEQ ID NO: 605956 - protein, 11 aa, Mycobacterium
VDGEVSRNTVG

SEQ ID NO: 605957 - protein, 4 aa, Mycobacterium
VDGG

SEQ ID NO: 605958 - protein, 20 aa, Mycobacterium
VDGGATSAGKSGGLGGDGDR

SEQ ID NO: 605959 - protein, 20 aa, Mycobacterium
VDGGATVAGTSGGLGGPGDR

SEQ ID NO: 605960 - protein, 21 aa, Mycobacterium
VDGGDDPYTAAERLLSPHPRQ

SEQ ID NO: 605961 - protein, 9 aa, Mycobacterium
VDGGGAPIE

SEQ ID NO: 605962 - protein, 6 aa, Mycobacterium
VDGGGL

SEQ ID NO: 605963 - protein, 13 aa, Mycobacterium
VDGGHGLRRGPDI

SEQ ID NO: 605964 - protein, 6 aa, Mycobacterium
VDGGLS

SEQ ID NO: 605965 - protein, 7 aa, Mycobacterium
VDGGNTS

SEQ ID NO: 605966 - protein, 5 aa, Mycobacterium
VDGGP

SEQ ID NO: 605967 - protein, 12 aa, Mycobacterium
VDGGPGDDTGEV

SEQ ID NO: 605968 - protein, 14 aa, Mycobacterium
VDGGPRLLPDQPAV

SEQ ID NO: 605969 - protein, 6 aa, Mycobacterium
VDGGRE

SEQ ID NO: 605970 - protein, 7 aa, Mycobacterium
VDGGRGG

SEQ ID NO: 605971 - protein, 6 aa, Mycobacterium
VDGGRV

SEQ ID NO: 605972 - protein, 18 aa, Mycobacterium
VDGGSDAAAGARASFRVV

SEQ ID NO: 605973 - protein, 9 aa, Mycobacterium
VDGGSGEAA

SEQ ID NO: 605974 - protein, 5 aa, Mycobacterium
VDGGT

SEQ ID NO: 605975 - protein, 16 aa, Mycobacterium
VDGGTGDPSTTVGNPA

SEQ ID NO: 605976 - protein, 16 aa, Mycobacterium
VDGGTGGAGGAGGAGG

SEQ ID NO: 605977 - protein, 20 aa, Mycobacterium
VDGGTSAGKVNRPRNESRKV

SEQ ID NO: 605978 - protein, 7 aa, Mycobacterium
VDGGVEQ

SEQ ID NO: 605979 - protein, 8 aa, Mycobacterium
VDGGYRIT

SEQ ID NO: 605980 - protein, 8 aa, Mycobacterium
VDGHDEHA

SEQ ID NO: 605981 - protein, 7 aa, Mycobacterium
VDGHDER

SEQ ID NO: 605982 - protein, 8 aa, Mycobacterium
VDGHDERA

SEQ ID NO: 605983 - protein, 8 aa, Mycobacterium
VDGHDERS

SEQ ID NO: 605984 - protein, 12 aa, Mycobacterium
VDGHEGEVRDGS

SEQ ID NO: 605985 - protein, 8 aa, Mycobacterium
VDGHGGDF

SEQ ID NO: 605986 - protein, 5 aa, Mycobacterium
VDGHP

SEQ ID NO: 605987 - protein, 7 aa, Mycobacterium
VDGHRAS

SEQ ID NO: 605988 - protein, 4 aa, Mycobacterium
VDGK

SEQ ID NO: 605989 - protein, 10 aa, Mycobacterium
VDGKANEAAA

SEQ ID NO: 605990 - protein, 14 aa, Mycobacterium
VDGKCGKPKQPGQG

SEQ ID NO: 605991 - protein, 7 aa, Mycobacterium
VDGKGDY

SEQ ID NO: 605992 - protein, 8 aa, Mycobacterium
VDGKGLSE

SEQ ID NO: 605993 - protein, 23 aa, Mycobacterium
VDGKRGASEYHREEGNVKQAAMR

SEQ ID NO: 605994 - protein, 8 aa, Mycobacterium
VDGKYDPN

SEQ ID NO: 605995 - protein, 21 aa, Mycobacterium
VDGLDGTRETGLPRRKPLSVA

SEQ ID NO: 605996 - protein, 11 aa, Mycobacterium
VDGLPATKDTC

SEQ ID NO: 605997 - protein, 4 aa, Mycobacterium
VDGN

SEQ ID NO: 605998 - protein, 5 aa, Mycobacterium
VDGND

SEQ ID NO: 605999 - protein, 8 aa, Mycobacterium
VDGNPEAG

SEQ ID NO: 606000 - protein, 7 aa, Mycobacterium
VDGNPLN

SEQ ID NO: 606001 - protein, 11 aa, Mycobacterium
VDGNTPGLGSA

SEQ ID NO: 606002 - protein, 16 aa, Mycobacterium
VDGNTSYAAAKSAEWG

SEQ ID NO: 606003 - protein, 5 aa, Mycobacterium
VDGPA

SEQ ID NO: 606004 - protein, 8 aa, Mycobacterium
VDGPAAVT

SEQ ID NO: 606005 - protein, 16 aa, Mycobacterium
VDGPAGETGGVARLGP

SEQ ID NO: 606006 - protein, 8 aa, Mycobacterium
VDGPDIAR

SEQ ID NO: 606007 - protein, 8 aa, Mycobacterium
VDGPDSLP

SEQ ID NO: 606008 - protein, 5 aa, Mycobacterium
VDGPE

SEQ ID NO: 606009 - protein, 6 aa, Mycobacterium
VDGPED

SEQ ID NO: 606010 - protein, 6 aa, Mycobacterium
VDGPEF

SEQ ID NO: 606011 - protein, 16 aa, Mycobacterium
VDGPESLPPVTDGTAT

SEQ ID NO: 606012 - protein, 16 aa, Mycobacterium
VDGPGGFSGVDGDAAW

SEQ ID NO: 606013 - protein, 10 aa, Mycobacterium
VDGPGGQPAL

SEQ ID NO: 606014 - protein, 6 aa, Mycobacterium
VDGPGL

SEQ ID NO: 606015 - protein, 8 aa, Mycobacterium
VDGPGNSV

SEQ ID NO: 606016 - protein, 5 aa, Mycobacterium
VDGPL

SEQ ID NO: 606017 - protein, 8 aa, Mycobacterium
VDGPPGRA

SEQ ID NO: 606018 - protein, 7 aa, Mycobacterium
VDGPQRD

SEQ ID NO: 606019 - protein, 6 aa, Mycobacterium
VDGPRL

SEQ ID NO: 606020 - protein, 8 aa, Mycobacterium
VDGPRTLY

SEQ ID NO: 606021 - protein, 7 aa, Mycobacterium
VDGPSGM

SEQ ID NO: 606022 - protein, 21 aa, Mycobacterium
VDGPTTVARDGEVGDKYDQAR

SEQ ID NO: 606023 - protein, 4 aa, Mycobacterium
VDGQ

SEQ ID NO: 606024 - protein, 5 aa, Mycobacterium
VDGQA

SEQ ID NO: 606025 - protein, 5 aa, Mycobacterium
VDGQD

SEQ ID NO: 606026 - protein, 10 aa, Mycobacterium
VDGQPVSTAT

SEQ ID NO: 606027 - protein, 6 aa, Mycobacterium
VDGQRA

SEQ ID NO: 606028 - protein, 7 aa, Mycobacterium
VDGQRRR

SEQ ID NO: 606029 - protein, 15 aa, Mycobacterium
VDGRDPAETLRDGTA

SEQ ID NO: 606030 - protein, 12 aa, Mycobacterium
VDGRDVTSSIGT

SEQ ID NO: 606031 - protein, 6 aa, Mycobacterium
VDGREA

SEQ ID NO: 606032 - protein, 8 aa, Mycobacterium
VDGRGGPQ

SEQ ID NO: 606033 - protein, 10 aa, Mycobacterium
VDGRIGTETM

SEQ ID NO: 606034 - protein, 6 aa, Mycobacterium
VDGRPQ

SEQ ID NO: 606035 - protein, 8 aa, Mycobacterium
VDGRPRGH

SEQ ID NO: 606036 - protein, 8 aa, Mycobacterium
VDGRPVRA

SEQ ID NO: 606037 - protein, 11 aa, Mycobacterium
VDGRQLTDDEL

SEQ ID NO: 606038 - protein, 13 aa, Mycobacterium
VDGRSAAADGTSQ

SEQ ID NO: 606039 - protein, 34 aa, Mycobacterium
VDGRSGHGLGGNRFDDRGGQRRGGGQRRVGAGRG

SEQ ID NO: 606040 - protein, 6 aa, Mycobacterium
VDGRTV

SEQ ID NO: 606041 - protein, 16 aa, Mycobacterium
VDGSADSETAKQAQRI

SEQ ID NO: 606042 - protein, 6 aa, Mycobacterium
VDGSAT

SEQ ID NO: 606043 - protein, 5 aa, Mycobacterium
VDGSD

SEQ ID NO: 606044 - protein, 8 aa, Mycobacterium
VDGSDDRM

SEQ ID NO: 606045 - protein, 8 aa, Mycobacterium
VDGSDPAA

SEQ ID NO: 606046 - protein, 9 aa, Mycobacterium
VDGSDYPNL

SEQ ID NO: 606047 - protein, 8 aa, Mycobacterium
VDGSETEA

SEQ ID NO: 606048 - protein, 14 aa, Mycobacterium
VDGSGAADRDDQAV

SEQ ID NO: 606049 - protein, 7 aa, Mycobacterium
VDGSGAV

SEQ ID NO: 606050 - protein, 8 aa, Mycobacterium
VDGSKAAI

SEQ ID NO: 606051 - protein, 10 aa, Mycobacterium
VDGSPDGMTV

SEQ ID NO: 606052 - protein, 10 aa, Mycobacterium
VDGSPSLGDR

SEQ ID NO: 606053 - protein, 10 aa, Mycobacterium
VDGSRRKLRD

SEQ ID NO: 606054 - protein, 10 aa, Mycobacterium
VDGSSRPNHA

SEQ ID NO: 606055 - protein, 7 aa, Mycobacterium
VDGSTAS

SEQ ID NO: 606056 - protein, 7 aa, Mycobacterium
VDGSTLG

SEQ ID NO: 606057 - protein, 9 aa, Mycobacterium
VDGSTPDTL

SEQ ID NO: 606058 - protein, 7 aa, Mycobacterium
VDGTAAG

SEQ ID NO: 606059 - protein, 13 aa, Mycobacterium
VDGTADDSRRKNT

SEQ ID NO: 606060 - protein, 11 aa, Mycobacterium
VDGTARKRYPA

SEQ ID NO: 606061 - protein, 7 aa, Mycobacterium
VDGTAVD

SEQ ID NO: 606062 - protein, 7 aa, Mycobacterium
VDGTDEE

SEQ ID NO: 606063 - protein, 8 aa, Mycobacterium
VDGTDEGR

SEQ ID NO: 606064 - protein, 9 aa, Mycobacterium
VDGTENTVY

SEQ ID NO: 606065 - protein, 9 aa, Mycobacterium
VDGTGAARY

SEQ ID NO: 606066 - protein, 9 aa, Mycobacterium
VDGTGAERY

SEQ ID NO: 606067 - protein, 7 aa, Mycobacterium
VDGTGAG

SEQ ID NO: 606068 - protein, 16 aa, Mycobacterium
VDGTGAGWGAPETVRA

SEQ ID NO: 606069 - protein, 13 aa, Mycobacterium
VDGTGAPAHHGDV

SEQ ID NO: 606070 - protein, 6 aa, Mycobacterium
VDGTGE

SEQ ID NO: 606071 - protein, 14 aa, Mycobacterium
VDGTGEVVGRAPSE

SEQ ID NO: 606072 - protein, 17 aa, Mycobacterium
VDGTGIGPISAGGNGAA

SEQ ID NO: 606073 - protein, 7 aa, Mycobacterium
VDGTGNV

SEQ ID NO: 606074 - protein, 6 aa, Mycobacterium
VDGTGQ

SEQ ID NO: 606075 - protein, 8 aa, Mycobacterium
VDGTGSVI

SEQ ID NO: 606076 - protein, 7 aa, Mycobacterium
VDGTNRR

SEQ ID NO: 606077 - protein, 8 aa, Mycobacterium
VDGTPPDE

SEQ ID NO: 606078 - protein, 9 aa, Mycobacterium
VDGTPRPLP

SEQ ID NO: 606079 - protein, 6 aa, Mycobacterium
VDGTRV

SEQ ID NO: 606080 - protein, 6 aa, Mycobacterium
VDGTTG

SEQ ID NO: 606081 - protein, 5 aa, Mycobacterium
VDGTY

SEQ ID NO: 606082 - protein, 8 aa, Mycobacterium
VDGVAQPN

SEQ ID NO: 606083 - protein, 5 aa, Mycobacterium
VDGVH

SEQ ID NO: 606084 - protein, 6 aa, Mycobacterium
VDGVTG

SEQ ID NO: 606085 - protein, 9 aa, Mycobacterium
VDGYAGSTH

SEQ ID NO: 606086 - protein, 7 aa, Mycobacterium
VDGYGEG

SEQ ID NO: 606087 - protein, 7 aa, Mycobacterium
VDGYGSP

SEQ ID NO: 606088 - protein, 8 aa, Mycobacterium
VDHADPER

SEQ ID NO: 606089 - protein, 13 aa, Mycobacterium
VDHATGKVNPPTE

SEQ ID NO: 606090 - protein, 15 aa, Mycobacterium
VDHATGKVSPPPEVV

SEQ ID NO: 606091 - protein, 11 aa, Mycobacterium
VDHDSSSKYGN

SEQ ID NO: 606092 - protein, 7 aa, Mycobacterium
VDHETGR

SEQ ID NO: 606093 - protein, 14 aa, Mycobacterium
VDHKTRKVSPPPEV

SEQ ID NO: 606094 - protein, 4 aa, Mycobacterium
VDHP

SEQ ID NO: 606095 - protein, 5 aa, Mycobacterium
VDHPE

SEQ ID NO: 606096 - protein, 36 aa, Mycobacterium
VDHPPTDSDHHAPAVSDHNGGSGGDHSTPGDSPPHF

SEQ ID NO: 606097 - protein, 6 aa, Mycobacterium
VDHPSL

SEQ ID NO: 606098 - protein, 8 aa, Mycobacterium
VDHSDDDA

SEQ ID NO: 606099 - protein, 12 aa, Mycobacterium
VDHSDGADCGDA

SEQ ID NO: 606100 - protein, 9 aa, Mycobacterium
VDHTGRYRG

SEQ ID NO: 606101 - protein, 10 aa, Mycobacterium
VDHTGRYRGR

SEQ ID NO: 606102 - protein, 11 aa, Mycobacterium
VDHTGRYRGRA

SEQ ID NO: 606103 - protein, 5 aa, Mycobacterium
VDHTT

SEQ ID NO: 606104 - protein, 7 aa, Mycobacterium
VDIPSRD

SEQ ID NO: 606105 - protein, 8 aa, Mycobacterium
VDITDSDQ

SEQ ID NO: 606106 - protein, 12 aa, Mycobacterium
VDITPDSPGTQL

SEQ ID NO: 606107 - protein, 7 aa, Mycobacterium
VDKAAAD

SEQ ID NO: 606108 - protein, 11 aa, Mycobacterium
VDKAASAHPNV

SEQ ID NO: 606109 - protein, 9 aa, Mycobacterium
VDKAGGTIA

SEQ ID NO: 606110 - protein, 8 aa, Mycobacterium
VDKDSRTT

SEQ ID NO: 606111 - protein, 13 aa, Mycobacterium
VDKGQVGGPQAPG

SEQ ID NO: 606112 - protein, 8 aa, Mycobacterium
VDKGVGEL

SEQ ID NO: 606113 - protein, 6 aa, Mycobacterium
VDKHGN

SEQ ID NO: 606114 - protein, 69 aa, Mycobacterium
VDKKTQGKYSSTVDKVQEAARKAVADNTDQGRVPPTQGSGQVPPSSPPPSSPPPPATPPPPAPPTAPPT

SEQ ID NO: 606115 - protein, 15 aa, Mycobacterium
VDKPAAVAELIARFV

SEQ ID NO: 606116 - protein, 18 aa, Mycobacterium
VDKPAEEADHGHGHHGHA

SEQ ID NO: 606117 - protein, 5 aa, Mycobacterium
VDKPG

SEQ ID NO: 606118 - protein, 6 aa, Mycobacterium
VDKPGT

SEQ ID NO: 606119 - protein, 13 aa, Mycobacterium
VDKPRNLAKSVTV

SEQ ID NO: 606120 - protein, 9 aa, Mycobacterium
VDKQTAKLG

SEQ ID NO: 606121 - protein, 13 aa, Mycobacterium
VDKREKKELPAPV

SEQ ID NO: 606122 - protein, 7 aa, Mycobacterium
VDKRSEA

SEQ ID NO: 606123 - protein, 8 aa, Mycobacterium
VDKSGQSV

SEQ ID NO: 606124 - protein, 10 aa, Mycobacterium
VDKSKGRISA

SEQ ID NO: 606125 - protein, 9 aa, Mycobacterium
VDKSRREIA

SEQ ID NO: 606126 - protein, 8 aa, Mycobacterium
VDKSSVTQ

SEQ ID NO: 606127 - protein, 10 aa, Mycobacterium
VDKSTARAKA

SEQ ID NO: 606128 - protein, 7 aa, Mycobacterium
VDKTDPT

SEQ ID NO: 606129 - protein, 8 aa, Mycobacterium
VDKTEYDL

SEQ ID NO: 606130 - protein, 5 aa, Mycobacterium
VDLPD

SEQ ID NO: 606131 - protein, 11 aa, Mycobacterium
VDLPEGAEQYR

SEQ ID NO: 606132 - protein, 9 aa, Mycobacterium
VDLSDPASF

SEQ ID NO: 606133 - protein, 9 aa, Mycobacterium
VDLSDPDSF

SEQ ID NO: 606134 - protein, 9 aa, Mycobacterium
VDLSNPDSF

SEQ ID NO: 606135 - protein, 10 aa, Mycobacterium
VDLSTAQGRL

SEQ ID NO: 606136 - protein, 4 aa, Mycobacterium
VDLT

SEQ ID NO: 606137 - protein, 17 aa, Mycobacterium
VDLTPGENGVRADPNGL

SEQ ID NO: 606138 - protein, 7 aa, Mycobacterium
VDNAEAL

SEQ ID NO: 606139 - protein, 7 aa, Mycobacterium
VDNASDA

SEQ ID NO: 606140 - protein, 30 aa, Mycobacterium
VDNASNASSPAKKAETGRRAKRSRKGKTDD

SEQ ID NO: 606141 - protein, 5 aa, Mycobacterium
VDNDP

SEQ ID NO: 606142 - protein, 11 aa, Mycobacterium
VDNEKGEADAA

SEQ ID NO: 606143 - protein, 14 aa, Mycobacterium
VDNEPQPDPADLAR

SEQ ID NO: 606144 - protein, 10 aa, Mycobacterium
VDNERGEADA

SEQ ID NO: 606145 - protein, 6 aa, Mycobacterium
VDNERN

SEQ ID NO: 606146 - protein, 7 aa, Mycobacterium
VDNERSA

SEQ ID NO: 606147 - protein, 10 aa, Mycobacterium
VDNETADKAI

SEQ ID NO: 606148 - protein, 8 aa, Mycobacterium
VDNGDTDS

SEQ ID NO: 606149 - protein, 11 aa, Mycobacterium
VDNGPSRNPLQ

SEQ ID NO: 606150 - protein, 5 aa, Mycobacterium
VDNGV

SEQ ID NO: 606151 - protein, 8 aa, Mycobacterium
VDNMSEPR

SEQ ID NO: 606152 - protein, 10 aa, Mycobacterium
VDNNGENTRT

SEQ ID NO: 606153 - protein, 10 aa, Mycobacterium
VDNPATEEVS

SEQ ID NO: 606154 - protein, 8 aa, Mycobacterium
VDNPKAMA

SEQ ID NO: 606155 - protein, 10 aa, Mycobacterium
VDNPPQTTRA

SEQ ID NO: 606156 - protein, 7 aa, Mycobacterium
VDNPQRD

SEQ ID NO: 606157 - protein, 9 aa, Mycobacterium
VDNPTTEQV

SEQ ID NO: 606158 - protein, 16 aa, Mycobacterium
VDNRNSAVARGRELGL

SEQ ID NO: 606159 - protein, 13 aa, Mycobacterium
VDNRPDPALPGSD

SEQ ID NO: 606160 - protein, 5 aa, Mycobacterium
VDNSP

SEQ ID NO: 606161 - protein, 4 aa, Mycobacterium
VDNT

SEQ ID NO: 606162 - protein, 13 aa, Mycobacterium
VDNTSPLAQTETF

SEQ ID NO: 606163 - protein, 5 aa, Mycobacterium
VDPAA

SEQ ID NO: 606164 - protein, 10 aa, Mycobacterium
VDPAADPAAA

SEQ ID NO: 606165 - protein, 11 aa, Mycobacterium
VDPAAEPPGAE

SEQ ID NO: 606166 - protein, 17 aa, Mycobacterium
VDPAAKTVTTTDGTQIG

SEQ ID NO: 606167 - protein, 5 aa, Mycobacterium
VDPAD

SEQ ID NO: 606168 - protein, 10 aa, Mycobacterium
VDPADANDGF

SEQ ID NO: 606169 - protein, 11 aa, Mycobacterium
VDPADATDAFG

SEQ ID NO: 606170 - protein, 10 aa, Mycobacterium
VDPADATEEF

SEQ ID NO: 606171 - protein, 11 aa, Mycobacterium
VDPADATPEFG

SEQ ID NO: 606172 - protein, 9 aa, Mycobacterium
VDPADGYEQ

SEQ ID NO: 606173 - protein, 10 aa, Mycobacterium
VDPADKRAQR

SEQ ID NO: 606174 - protein, 8 aa, Mycobacterium
VDPADPMR

SEQ ID NO: 606175 - protein, 18 aa, Mycobacterium
VDPADTRITGPHQNATRS

SEQ ID NO: 606176 - protein, 6 aa, Mycobacterium
VDPAEQ

SEQ ID NO: 606177 - protein, 6 aa, Mycobacterium
VDPAEV

SEQ ID NO: 606178 - protein, 10 aa, Mycobacterium
VDPAGAEIGR

SEQ ID NO: 606179 - protein, 8 aa, Mycobacterium
VDPAGDGG

SEQ ID NO: 606180 - protein, 10 aa, Mycobacterium
VDPAGSQKTL

SEQ ID NO: 606181 - protein, 6 aa, Mycobacterium
VDPAGV

SEQ ID NO: 606182 - protein, 5 aa, Mycobacterium
VDPAK

SEQ ID NO: 606183 - protein, 6 aa, Mycobacterium
VDPAKS

SEQ ID NO: 606184 - protein, 5 aa, Mycobacterium
VDPAL

SEQ ID NO: 606185 - protein, 7 aa, Mycobacterium
VDPANGM

SEQ ID NO: 606186 - protein, 7 aa, Mycobacterium
VDPANRR

SEQ ID NO: 606187 - protein, 8 aa, Mycobacterium
VDPAPQEG

SEQ ID NO: 606188 - protein, 53 aa, Mycobacterium
VDPAPTPPDGQCRDPVHPQAAGRATPRAPGVPPPYPGPAPVRRNRSSSSASNL

SEQ ID NO: 606189 - protein, 7 aa, Mycobacterium
VDPAPTV

SEQ ID NO: 606190 - protein, 17 aa, Mycobacterium
VDPAQDSPYATDASRKH

SEQ ID NO: 606191 - protein, 10 aa, Mycobacterium
VDPAQLPPAE

SEQ ID NO: 606192 - protein, 5 aa, Mycobacterium
VDPAR

SEQ ID NO: 606193 - protein, 9 aa, Mycobacterium
VDPASGTPL

SEQ ID NO: 606194 - protein, 8 aa, Mycobacterium
VDPASPLA

SEQ ID NO: 606195 - protein, 14 aa, Mycobacterium
VDPATLGPNPPDEL

SEQ ID NO: 606196 - protein, 8 aa, Mycobacterium
VDPAVSSP

SEQ ID NO: 606197 - protein, 5 aa, Mycobacterium
VDPDA

SEQ ID NO: 606198 - protein, 9 aa, Mycobacterium
VDPDAAATS

SEQ ID NO: 606199 - protein, 6 aa, Mycobacterium
VDPDAD

SEQ ID NO: 606200 - protein, 10 aa, Mycobacterium
VDPDAPVSVQ

SEQ ID NO: 606201 - protein, 10 aa, Mycobacterium
VDPDDGSVQG

SEQ ID NO: 606202 - protein, 5 aa, Mycobacterium
VDPDE

SEQ ID NO: 606203 - protein, 10 aa, Mycobacterium
VDPDGAGIGA

SEQ ID NO: 606204 - protein, 7 aa, Mycobacterium
VDPDGGV

SEQ ID NO: 606205 - protein, 12 aa, Mycobacterium
VDPDGPVSVQPN

SEQ ID NO: 606206 - protein, 7 aa, Mycobacterium
VDPDGTT

SEQ ID NO: 606207 - protein, 9 aa, Mycobacterium
VDPDKPALE

SEQ ID NO: 606208 - protein, 5 aa, Mycobacterium
VDPDL

SEQ ID NO: 606209 - protein, 7 aa, Mycobacterium
VDPDNPA

SEQ ID NO: 606210 - protein, 8 aa, Mycobacterium
VDPDNRRA

SEQ ID NO: 606211 - protein, 6 aa, Mycobacterium
VDPDPA

SEQ ID NO: 606212 - protein, 9 aa, Mycobacterium
VDPDPANAA

SEQ ID NO: 606213 - protein, 7 aa, Mycobacterium
VDPDPEE

SEQ ID NO: 606214 - protein, 7 aa, Mycobacterium
VDPDPKL

SEQ ID NO: 606215 - protein, 17 aa, Mycobacterium
VDPDPLDAEDSGVDAGQ

SEQ ID NO: 606216 - protein, 11 aa, Mycobacterium
VDPDSGAATVP

SEQ ID NO: 606217 - protein, 19 aa, Mycobacterium
VDPDSGEEITAQNGRYGPY

SEQ ID NO: 606218 - protein, 14 aa, Mycobacterium
VDPDSGGRTAAAEA

SEQ ID NO: 606219 - protein, 12 aa, Mycobacterium
VDPDTAAGATPG

SEQ ID NO: 606220 - protein, 8 aa, Mycobacterium
VDPDTDGS

SEQ ID NO: 606221 - protein, 12 aa, Mycobacterium
VDPDTGEAATPG

SEQ ID NO: 606222 - protein, 8 aa, Mycobacterium
VDPDTRHA

SEQ ID NO: 606223 - protein, 7 aa, Mycobacterium
VDPDTSL

SEQ ID NO: 606224 - protein, 6 aa, Mycobacterium
VDPEAD

SEQ ID NO: 606225 - protein, 7 aa, Mycobacterium
VDPEARH

SEQ ID NO: 606226 - protein, 6 aa, Mycobacterium
VDPEDT

SEQ ID NO: 606227 - protein, 15 aa, Mycobacterium
VDPEGDTDTPPQVSQ

SEQ ID NO: 606228 - protein, 6 aa, Mycobacterium
VDPEGL

SEQ ID NO: 606229 - protein, 7 aa, Mycobacterium
VDPEQAA

SEQ ID NO: 606230 - protein, 5 aa, Mycobacterium
VDPER

SEQ ID NO: 606231 - protein, 6 aa, Mycobacterium
VDPERA

SEQ ID NO: 606232 - protein, 7 aa, Mycobacterium
VDPERGE

SEQ ID NO: 606233 - protein, 7 aa, Mycobacterium
VDPERPE

SEQ ID NO: 606234 - protein, 6 aa, Mycobacterium
VDPERR

SEQ ID NO: 606235 - protein, 7 aa, Mycobacterium
VDPESAA

SEQ ID NO: 606236 - protein, 9 aa, Mycobacterium
VDPESAAET

SEQ ID NO: 606237 - protein, 15 aa, Mycobacterium
VDPESDSADPGTPPM

SEQ ID NO: 606238 - protein, 7 aa, Mycobacterium
VDPESDW

SEQ ID NO: 606239 - protein, 18 aa, Mycobacterium
VDPESGEEITAQNGRYGP

SEQ ID NO: 606240 - protein, 7 aa, Mycobacterium
VDPESVG

SEQ ID NO: 606241 - protein, 5 aa, Mycobacterium
VDPEV

SEQ ID NO: 606242 - protein, 22 aa, Mycobacterium
VDPEWTTAADGPHKRERASALT

SEQ ID NO: 606243 - protein, 21 aa, Mycobacterium
VDPEWTTDADGPHKRERASAL

SEQ ID NO: 606244 - protein, 7 aa, Mycobacterium
VDPEYDR

SEQ ID NO: 606245 - protein, 5 aa, Mycobacterium
VDPFA

SEQ ID NO: 606246 - protein, 5 aa, Mycobacterium
VDPGA

SEQ ID NO: 606247 - protein, 7 aa, Mycobacterium
VDPGAGR

SEQ ID NO: 606248 - protein, 9 aa, Mycobacterium
VDPGAGSFD

SEQ ID NO: 606249 - protein, 9 aa, Mycobacterium
VDPGAKDRK

SEQ ID NO: 606250 - protein, 10 aa, Mycobacterium
VDPGALSAAD

SEQ ID NO: 606251 - protein, 13 aa, Mycobacterium
VDPGARAAQLADR

SEQ ID NO: 606252 - protein, 6 aa, Mycobacterium
VDPGAV

SEQ ID NO: 606253 - protein, 5 aa, Mycobacterium
VDPGD

SEQ ID NO: 606254 - protein, 7 aa, Mycobacterium
VDPGDAR

SEQ ID NO: 606255 - protein, 10 aa, Mycobacterium
VDPGDATDEF

SEQ ID NO: 606256 - protein, 9 aa, Mycobacterium
VDPGEEEQI

SEQ ID NO: 606257 - protein, 12 aa, Mycobacterium
VDPGENPADCAS

SEQ ID NO: 606258 - protein, 6 aa, Mycobacterium
VDPGEV

SEQ ID NO: 606259 - protein, 8 aa, Mycobacterium
VDPGGANG

SEQ ID NO: 606260 - protein, 9 aa, Mycobacterium
VDPGGATSA

SEQ ID NO: 606261 - protein, 5 aa, Mycobacterium
VDPGN

SEQ ID NO: 606262 - protein, 6 aa, Mycobacterium
VDPGNL

SEQ ID NO: 606263 - protein, 6 aa, Mycobacterium
VDPGSA

SEQ ID NO: 606264 - protein, 7 aa, Mycobacterium
VDPGSAK

SEQ ID NO: 606265 - protein, 13 aa, Mycobacterium
VDPGTAARRTLPG

SEQ ID NO: 606266 - protein, 12 aa, Mycobacterium
VDPGTAQSVGQR

SEQ ID NO: 606267 - protein, 8 aa, Mycobacterium
VDPGTATA

SEQ ID NO: 606268 - protein, 7 aa, Mycobacterium
VDPGTGM

SEQ ID NO: 606269 - protein, 9 aa, Mycobacterium
VDPGTRVAA

SEQ ID NO: 606270 - protein, 7 aa, Mycobacterium
VDPGTVA

SEQ ID NO: 606271 - protein, 6 aa, Mycobacterium
VDPGWA

SEQ ID NO: 606272 - protein, 7 aa, Mycobacterium
VDPGYSR

SEQ ID NO: 606273 - protein, 17 aa, Mycobacterium
VDPHASSDLPYPTVNDP

SEQ ID NO: 606274 - protein, 18 aa, Mycobacterium
VDPHTSTDLPYPPAISTE

SEQ ID NO: 606275 - protein, 14 aa, Mycobacterium
VDPIGDPAGTRKRL

SEQ ID NO: 606276 - protein, 9 aa, Mycobacterium
VDPKAAEFS

SEQ ID NO: 606277 - protein, 13 aa, Mycobacterium
VDPKGRSRNVSEA

SEQ ID NO: 606278 - protein, 9 aa, Mycobacterium
VDPKTTAEL

SEQ ID NO: 606279 - protein, 19 aa, Mycobacterium
VDPLSQTPALNSAYVAVTR

SEQ ID NO: 606280 - protein, 6 aa, Mycobacterium
VDPNAG

SEQ ID NO: 606281 - protein, 7 aa, Mycobacterium
VDPNDIE

SEQ ID NO: 606282 - protein, 4 aa, Mycobacterium
VDPP

SEQ ID NO: 606283 - protein, 14 aa, Mycobacterium
VDPPAAGNVPSAPG

SEQ ID NO: 606284 - protein, 13 aa, Mycobacterium
VDPPACSPAEARL

SEQ ID NO: 606285 - protein, 17 aa, Mycobacterium
VDPPALPDPLPTGPTRR

SEQ ID NO: 606286 - protein, 8 aa, Mycobacterium
VDPPAPDH

SEQ ID NO: 606287 - protein, 15 aa, Mycobacterium
VDPPEEEVFSPPSEG

SEQ ID NO: 606288 - protein, 15 aa, Mycobacterium
VDPPEVDEPHTRPPI

SEQ ID NO: 606289 - protein, 12 aa, Mycobacterium
VDPPGRPRSRGP

SEQ ID NO: 606290 - protein, 13 aa, Mycobacterium
VDPPGTVSVQPNS

SEQ ID NO: 606291 - protein, 17 aa, Mycobacterium
VDPPPPDLYQGPSARAP

SEQ ID NO: 606292 - protein, 8 aa, Mycobacterium
VDPPPRPL

SEQ ID NO: 606293 - protein, 7 aa, Mycobacterium
VDPPPTV

SEQ ID NO: 606294 - protein, 7 aa, Mycobacterium
VDPPQSA

SEQ ID NO: 606295 - protein, 9 aa, Mycobacterium
VDPPRAAAN

SEQ ID NO: 606296 - protein, 13 aa, Mycobacterium
VDPPSHGPVDPHG

SEQ ID NO: 606297 - protein, 9 aa, Mycobacterium
VDPPSNPEL

SEQ ID NO: 606298 - protein, 8 aa, Mycobacterium
VDPPWETR

SEQ ID NO: 606299 - protein, 8 aa, Mycobacterium
VDPPYDDA

SEQ ID NO: 606300 - protein, 6 aa, Mycobacterium
VDPQGE

SEQ ID NO: 606301 - protein, 6 aa, Mycobacterium
VDPQGM

SEQ ID NO: 606302 - protein, 10 aa, Mycobacterium
VDPQIAAKGD

SEQ ID NO: 606303 - protein, 9 aa, Mycobacterium
VDPQPGEDD

SEQ ID NO: 606304 - protein, 9 aa, Mycobacterium
VDPQPGEDE

SEQ ID NO: 606305 - protein, 6 aa, Mycobacterium
VDPQSA

SEQ ID NO: 606306 - protein, 5 aa, Mycobacterium
VDPQV

SEQ ID NO: 606307 - protein, 11 aa, Mycobacterium
VDPRAAARARQ

SEQ ID NO: 606308 - protein, 7 aa, Mycobacterium
VDPRCSG

SEQ ID NO: 606309 - protein, 10 aa, Mycobacterium
VDPRDDADAH

SEQ ID NO: 606310 - protein, 14 aa, Mycobacterium
VDPRDPSKVLVVET

SEQ ID NO: 606311 - protein, 11 aa, Mycobacterium
VDPRGPVSVQP

SEQ ID NO: 606312 - protein, 13 aa, Mycobacterium
VDPRNGDGGRGYR

SEQ ID NO: 606313 - protein, 6 aa, Mycobacterium
VDPRNS

SEQ ID NO: 606314 - protein, 20 aa, Mycobacterium
VDPRTGEGYEFQPDSTHGEV

SEQ ID NO: 606315 - protein, 14 aa, Mycobacterium
VDPRTGRTIIEMIE

SEQ ID NO: 606316 - protein, 15 aa, Mycobacterium
VDPRTLPPDAPDDRK

SEQ ID NO: 606317 - protein, 4 aa, Mycobacterium
VDPS

SEQ ID NO: 606318 - protein, 16 aa, Mycobacterium
VDPSALTDAQRTESGA

SEQ ID NO: 606319 - protein, 9 aa, Mycobacterium
VDPSAPPET

SEQ ID NO: 606320 - protein, 9 aa, Mycobacterium
VDPSEPERA

SEQ ID NO: 606321 - protein, 9 aa, Mycobacterium
VDPSGLTTD

SEQ ID NO: 606322 - protein, 15 aa, Mycobacterium
VDPSGNLVELFQVNP

SEQ ID NO: 606323 - protein, 9 aa, Mycobacterium
VDPSLKPQA

SEQ ID NO: 606324 - protein, 10 aa, Mycobacterium
VDPSNPEGRA

SEQ ID NO: 606325 - protein, 9 aa, Mycobacterium
VDPSPAAQV

SEQ ID NO: 606326 - protein, 6 aa, Mycobacterium
VDPSQA

SEQ ID NO: 606327 - protein, 5 aa, Mycobacterium
VDPSR

SEQ ID NO: 606328 - protein, 6 aa, Mycobacterium
VDPSRV

SEQ ID NO: 606329 - protein, 13 aa, Mycobacterium
VDPSSLSQTARAE

SEQ ID NO: 606330 - protein, 13 aa, Mycobacterium
VDPSTRTARVQAG

SEQ ID NO: 606331 - protein, 5 aa, Mycobacterium
VDPSV

SEQ ID NO: 606332 - protein, 5 aa, Mycobacterium
VDPTA

SEQ ID NO: 606333 - protein, 9 aa, Mycobacterium
VDPTDATRG

SEQ ID NO: 606334 - protein, 7 aa, Mycobacterium
VDPTDDP

SEQ ID NO: 606335 - protein, 8 aa, Mycobacterium
VDPTDRDR

SEQ ID NO: 606336 - protein, 5 aa, Mycobacterium
VDPTE

SEQ ID NO: 606337 - protein, 6 aa, Mycobacterium
VDPTES

SEQ ID NO: 606338 - protein, 9 aa, Mycobacterium
VDPTGAGDA

SEQ ID NO: 606339 - protein, 10 aa, Mycobacterium
VDPTSPTHAA

SEQ ID NO: 606340 - protein, 5 aa, Mycobacterium
VDPTT

SEQ ID NO: 606341 - protein, 6 aa, Mycobacterium
VDPTTL

SEQ ID NO: 606342 - protein, 18 aa, Mycobacterium
VDPTTNEEITAQNGRYGP

SEQ ID NO: 606343 - protein, 11 aa, Mycobacterium
VDPTVTATPIA

SEQ ID NO: 606344 - protein, 8 aa, Mycobacterium
VDPVDSEA

SEQ ID NO: 606345 - protein, 9 aa, Mycobacterium
VDPVGRSSH

SEQ ID NO: 606346 - protein, 8 aa, Mycobacterium
VDPVSGKR

SEQ ID NO: 606347 - protein, 8 aa, Mycobacterium
VDQDDGSV

SEQ ID NO: 606348 - protein, 8 aa, Mycobacterium
VDQDKDQS

SEQ ID NO: 606349 - protein, 5 aa, Mycobacterium
VDQEG

SEQ ID NO: 606350 - protein, 6 aa, Mycobacterium
VDQEGL

SEQ ID NO: 606351 - protein, 5 aa, Mycobacterium
VDQEN

SEQ ID NO: 606352 - protein, 5 aa, Mycobacterium
VDQGA

SEQ ID NO: 606353 - protein, 5 aa, Mycobacterium
VDQGR

SEQ ID NO: 606354 - protein, 7 aa, Mycobacterium
VDQGSIA

SEQ ID NO: 606355 - protein, 6 aa, Mycobacterium
VDQNGG

SEQ ID NO: 606356 - protein, 8 aa, Mycobacterium
VDQPDKVA

SEQ ID NO: 606357 - protein, 11 aa, Mycobacterium
VDQPDKVAETT

SEQ ID NO: 606358 - protein, 10 aa, Mycobacterium
VDQPDNAARL

SEQ ID NO: 606359 - protein, 7 aa, Mycobacterium
VDQPGTA

SEQ ID NO: 606360 - protein, 7 aa, Mycobacterium
VDQPGVT

SEQ ID NO: 606361 - protein, 8 aa, Mycobacterium
VDQPPHEP

SEQ ID NO: 606362 - protein, 9 aa, Mycobacterium
VDQPPHEPI

SEQ ID NO: 606363 - protein, 11 aa, Mycobacterium
VDQPPQTTRAK

SEQ ID NO: 606364 - protein, 7 aa, Mycobacterium
VDQPTAI

SEQ ID NO: 606365 - protein, 5 aa, Mycobacterium
VDQPY

SEQ ID NO: 606366 - protein, 7 aa, Mycobacterium
VDQQPDH

SEQ ID NO: 606367 - protein, 13 aa, Mycobacterium
VDQRGDGPAAGRV

SEQ ID NO: 606368 - protein, 7 aa, Mycobacterium
VDQRPGF

SEQ ID NO: 606369 - protein, 13 aa, Mycobacterium
VDQRRRAEQAFAE

SEQ ID NO: 606370 - protein, 10 aa, Mycobacterium
VDQSDEQFNA

SEQ ID NO: 606371 - protein, 8 aa, Mycobacterium
VDQSEALR

SEQ ID NO: 606372 - protein, 4 aa, Mycobacterium
VDQT

SEQ ID NO: 606373 - protein, 16 aa, Mycobacterium
VDQTARPPHQRRPRFD

SEQ ID NO: 606374 - protein, 6 aa, Mycobacterium
VDQTGL

SEQ ID NO: 606375 - protein, 5 aa, Mycobacterium
VDQYD

SEQ ID NO: 606376 - protein, 6 aa, Mycobacterium
VDRAGA

SEQ ID NO: 606377 - protein, 6 aa, Mycobacterium
VDRAPA

SEQ ID NO: 606378 - protein, 7 aa, Mycobacterium
VDRAPEA

SEQ ID NO: 606379 - protein, 14 aa, Mycobacterium
VDRAPEPAGQNTDD

SEQ ID NO: 606380 - protein, 6 aa, Mycobacterium
VDRAQA

SEQ ID NO: 606381 - protein, 11 aa, Mycobacterium
VDRARDAADEL

SEQ ID NO: 606382 - protein, 13 aa, Mycobacterium
VDRASDRAGQVRG

SEQ ID NO: 606383 - protein, 7 aa, Mycobacterium
VDRASRS

SEQ ID NO: 606384 - protein, 7 aa, Mycobacterium
VDRDEAQ

SEQ ID NO: 606385 - protein, 8 aa, Mycobacterium
VDRDGEDA

SEQ ID NO: 606386 - protein, 33 aa, Mycobacterium
VDRDKLETLGTKLESSKKIAPTRPHSDTPGSSV

SEQ ID NO: 606387 - protein, 5 aa, Mycobacterium
VDRDQ

SEQ ID NO: 606388 - protein, 7 aa, Mycobacterium
VDRDRNA

SEQ ID NO: 606389 - protein, 8 aa, Mycobacterium
VDREDPNV

SEQ ID NO: 606390 - protein, 7 aa, Mycobacterium
VDRENEN

SEQ ID NO: 606391 - protein, 10 aa, Mycobacterium
VDREPATDED

SEQ ID NO: 606392 - protein, 5 aa, Mycobacterium
VDRET

SEQ ID NO: 606393 - protein, 7 aa, Mycobacterium
VDRETAI

SEQ ID NO: 606394 - protein, 4 aa, Mycobacterium
VDRG

SEQ ID NO: 606395 - protein, 8 aa, Mycobacterium
VDRGATIA

SEQ ID NO: 606396 - protein, 12 aa, Mycobacterium
VDRGDRQQTAIS

SEQ ID NO: 606397 - protein, 13 aa, Mycobacterium
VDRGDTGYPHGTA

SEQ ID NO: 606398 - protein, 7 aa, Mycobacterium
VDRGGRT

SEQ ID NO: 606399 - protein, 11 aa, Mycobacterium
VDRGQASVRGR

SEQ ID NO: 606400 - protein, 6 aa, Mycobacterium
VDRIPD

SEQ ID NO: 606401 - protein, 6 aa, Mycobacterium
VDRKKL

SEQ ID NO: 606402 - protein, 8 aa, Mycobacterium
VDRKTDDA

SEQ ID NO: 606403 - protein, 8 aa, Mycobacterium
VDRKTGQL

SEQ ID NO: 606404 - protein, 5 aa, Mycobacterium
VDRNP

SEQ ID NO: 606405 - protein, 7 aa, Mycobacterium
VDRNTRG

SEQ ID NO: 606406 - protein, 10 aa, Mycobacterium
VDRPADPARH

SEQ ID NO: 606407 - protein, 8 aa, Mycobacterium
VDRPEGLT

SEQ ID NO: 606408 - protein, 6 aa, Mycobacterium
VDRPGT

SEQ ID NO: 606409 - protein, 6 aa, Mycobacterium
VDRPPF

SEQ ID NO: 606410 - protein, 5 aa, Mycobacterium
VDRPQ

SEQ ID NO: 606411 - protein, 11 aa, Mycobacterium
VDRQAGAGAYA

SEQ ID NO: 606412 - protein, 10 aa, Mycobacterium
VDRQRGDPNV

SEQ ID NO: 606413 - protein, 10 aa, Mycobacterium
VDRRPDLPTG

SEQ ID NO: 606414 - protein, 9 aa, Mycobacterium
VDRRPDSEA

SEQ ID NO: 606415 - protein, 10 aa, Mycobacterium
VDRRRSRTGR

SEQ ID NO: 606416 - protein, 7 aa, Mycobacterium
VDRSGRF

SEQ ID NO: 606417 - protein, 12 aa, Mycobacterium
VDRSQPGHREGD

SEQ ID NO: 606418 - protein, 7 aa, Mycobacterium
VDRTEAR

SEQ ID NO: 606419 - protein, 25 aa, Mycobacterium
VDRTGLDHRDATPARRRRERDLERA

SEQ ID NO: 606420 - protein, 10 aa, Mycobacterium
VDRTPRTTTW

SEQ ID NO: 606421 - protein, 10 aa, Mycobacterium
VDRTQRYAPH

SEQ ID NO: 606422 - protein, 10 aa, Mycobacterium
VDRTSDGTGL

SEQ ID NO: 606423 - protein, 10 aa, Mycobacterium
VDRTSTGTGL

SEQ ID NO: 606424 - protein, 5 aa, Mycobacterium
VDRVD

SEQ ID NO: 606425 - protein, 9 aa, Mycobacterium
VDRVGQKSD

SEQ ID NO: 606426 - protein, 20 aa, Mycobacterium
VDRVGSSGTLTSSPTADAGR

SEQ ID NO: 606427 - protein, 7 aa, Mycobacterium
VDRYGNQ

SEQ ID NO: 606428 - protein, 8 aa, Mycobacterium
VDSAASAL

SEQ ID NO: 606429 - protein, 5 aa, Mycobacterium
VDSAD

SEQ ID NO: 606430 - protein, 7 aa, Mycobacterium
VDSAEAV

SEQ ID NO: 606431 - protein, 6 aa, Mycobacterium
VDSAGT

SEQ ID NO: 606432 - protein, 7 aa, Mycobacterium
VDSAKTK

SEQ ID NO: 606433 - protein, 35 aa, Mycobacterium
VDSAPTTGRKADSGGRRNRRSKKNRAEEPSEKEAV

SEQ ID NO: 606434 - protein, 14 aa, Mycobacterium
VDSAREATQQTAAE

SEQ ID NO: 606435 - protein, 7 aa, Mycobacterium
VDSATDG

SEQ ID NO: 606436 - protein, 7 aa, Mycobacterium
VDSAVGE

SEQ ID NO: 606437 - protein, 5 aa, Mycobacterium
VDSDA

SEQ ID NO: 606438 - protein, 16 aa, Mycobacterium
VDSDEMDQIRDPATEE

SEQ ID NO: 606439 - protein, 7 aa, Mycobacterium
VDSDGAQ

SEQ ID NO: 606440 - protein, 10 aa, Mycobacterium
VDSDGLAQTE

SEQ ID NO: 606441 - protein, 9 aa, Mycobacterium
VDSDGNPAY

SEQ ID NO: 606442 - protein, 8 aa, Mycobacterium
VDSDGPTV

SEQ ID NO: 606443 - protein, 10 aa, Mycobacterium
VDSDGRPVTP

SEQ ID NO: 606444 - protein, 7 aa, Mycobacterium
VDSDGSF

SEQ ID NO: 606445 - protein, 9 aa, Mycobacterium
VDSDGSPAY

SEQ ID NO: 606446 - protein, 11 aa, Mycobacterium
VDSDKAEADAA

SEQ ID NO: 606447 - protein, 7 aa, Mycobacterium
VDSDPEI

SEQ ID NO: 606448 - protein, 9 aa, Mycobacterium
VDSDRAEAD

SEQ ID NO: 606449 - protein, 9 aa, Mycobacterium
VDSEASDQA

SEQ ID NO: 606450 - protein, 7 aa, Mycobacterium
VDSEEFT

SEQ ID NO: 606451 - protein, 10 aa, Mycobacterium
VDSEETAAWR

SEQ ID NO: 606452 - protein, 13 aa, Mycobacterium
VDSEGTSTHPVTG

SEQ ID NO: 606453 - protein, 11 aa, Mycobacterium
VDSEKGEADAA

SEQ ID NO: 606454 - protein, 9 aa, Mycobacterium
VDSEPQDRV

SEQ ID NO: 606455 - protein, 4 aa, Mycobacterium
VDSF

SEQ ID NO: 606456 - protein, 4 aa, Mycobacterium
VDSG

SEQ ID NO: 606457 - protein, 7 aa, Mycobacterium
VDSGAAR

SEQ ID NO: 606458 - protein, 9 aa, Mycobacterium
VDSGDDVPG

SEQ ID NO: 606459 - protein, 6 aa, Mycobacterium
VDSGDG

SEQ ID NO: 606460 - protein, 9 aa, Mycobacterium
VDSGDPGLA

SEQ ID NO: 606461 - protein, 8 aa, Mycobacterium
VDSGDTRL

SEQ ID NO: 606462 - protein, 6 aa, Mycobacterium
VDSGDW

SEQ ID NO: 606463 - protein, 6 aa, Mycobacterium
VDSGES

SEQ ID NO: 606464 - protein, 8 aa, Mycobacterium
VDSGGRLR

SEQ ID NO: 606465 - protein, 25 aa, Mycobacterium
VDSGGTTADELRTTRPGRGRRRRSG

SEQ ID NO: 606466 - protein, 8 aa, Mycobacterium
VDSGLDTK

SEQ ID NO: 606467 - protein, 7 aa, Mycobacterium
VDSGTRT

SEQ ID NO: 606468 - protein, 11 aa, Mycobacterium
VDSGVSDPDLA

SEQ ID NO: 606469 - protein, 9 aa, Mycobacterium
VDSHTASTL

SEQ ID NO: 606470 - protein, 8 aa, Mycobacterium
VDSKGLTE

SEQ ID NO: 606471 - protein, 24 aa, Mycobacterium
VDSNGRSRNVSDGYQRLGDAPETV

SEQ ID NO: 606472 - protein, 10 aa, Mycobacterium
VDSNTAPTLD

SEQ ID NO: 606473 - protein, 7 aa, Mycobacterium
VDSPADT

SEQ ID NO: 606474 - protein, 8 aa, Mycobacterium
VDSPEDVA

SEQ ID NO: 606475 - protein, 7 aa, Mycobacterium
VDSPGGS

SEQ ID NO: 606476 - protein, 9 aa, Mycobacterium
VDSPPGSGV

SEQ ID NO: 606477 - protein, 6 aa, Mycobacterium
VDSPPV

SEQ ID NO: 606478 - protein, 8 aa, Mycobacterium
VDSPRLPA

SEQ ID NO: 606479 - protein, 10 aa, Mycobacterium
VDSPRPWSQE

SEQ ID NO: 606480 - protein, 6 aa, Mycobacterium
VDSPTM

SEQ ID NO: 606481 - protein, 15 aa, Mycobacterium
VDSPVTGGKAPSAPG

SEQ ID NO: 606482 - protein, 13 aa, Mycobacterium
VDSQDAPADADYG

SEQ ID NO: 606483 - protein, 10 aa, Mycobacterium
VDSQGRRYSA

SEQ ID NO: 606484 - protein, 8 aa, Mycobacterium
VDSQREAL

SEQ ID NO: 606485 - protein, 7 aa, Mycobacterium
VDSRAAA

SEQ ID NO: 606486 - protein, 6 aa, Mycobacterium
VDSRAR

SEQ ID NO: 606487 - protein, 6 aa, Mycobacterium
VDSRDD

SEQ ID NO: 606488 - protein, 13 aa, Mycobacterium
VDSREADEGQAIR

SEQ ID NO: 606489 - protein, 13 aa, Mycobacterium
VDSRETDEGQAIR

SEQ ID NO: 606490 - protein, 4 aa, Mycobacterium
VDSS

SEQ ID NO: 606491 - protein, 8 aa, Mycobacterium
VDSSDDRM

SEQ ID NO: 606492 - protein, 15 aa, Mycobacterium
VDSSEGGGYKASGRK

SEQ ID NO: 606493 - protein, 6 aa, Mycobacterium
VDSSEL

SEQ ID NO: 606494 - protein, 6 aa, Mycobacterium
VDSSGA

SEQ ID NO: 606495 - protein, 7 aa, Mycobacterium
VDSSGKI

SEQ ID NO: 606496 - protein, 5 aa, Mycobacterium
VDSSP

SEQ ID NO: 606497 - protein, 15 aa, Mycobacterium
VDSSPDFSSMVMAVD

SEQ ID NO: 606498 - protein, 7 aa, Mycobacterium
VDSSRSR

SEQ ID NO: 606499 - protein, 13 aa, Mycobacterium
VDSSTAGATQGTS

SEQ ID NO: 606500 - protein, 25 aa, Mycobacterium
VDSTFDTGCGGGPGGTNSWPFTLVR

SEQ ID NO: 606501 - protein, 9 aa, Mycobacterium
VDSTREPVD

SEQ ID NO: 606502 - protein, 29 aa, Mycobacterium
VDSVDAEDAAGDQNGAGDGEVGHDENEDE

SEQ ID NO: 606503 - protein, 4 aa, Mycobacterium
VDTA

SEQ ID NO: 606504 - protein, 12 aa, Mycobacterium
VDTAAAGKDPER

SEQ ID NO: 606505 - protein, 22 aa, Mycobacterium
VDTAADRVRTRQPGNSDATPQI

SEQ ID NO: 606506 - protein, 9 aa, Mycobacterium
VDTAEARPN

SEQ ID NO: 606507 - protein, 11 aa, Mycobacterium
VDTAGLAQTAE

SEQ ID NO: 606508 - protein, 9 aa, Mycobacterium
VDTAPLTGA

SEQ ID NO: 606509 - protein, 6 aa, Mycobacterium
VDTARA

SEQ ID NO: 606510 - protein, 19 aa, Mycobacterium
VDTARRNAAEAASRVTPRA

SEQ ID NO: 606511 - protein, 19 aa, Mycobacterium
VDTATAPIPPAYSPSAPVR

SEQ ID NO: 606512 - protein, 9 aa, Mycobacterium
VDTATASAI

SEQ ID NO: 606513 - protein, 19 aa, Mycobacterium
VDTDAAERFEQENPREARA

SEQ ID NO: 606514 - protein, 10 aa, Mycobacterium
VDTDASDKAA

SEQ ID NO: 606515 - protein, 15 aa, Mycobacterium
VDTDAVGTAAAPGTG

SEQ ID NO: 606516 - protein, 8 aa, Mycobacterium
VDTDDATF

SEQ ID NO: 606517 - protein, 7 aa, Mycobacterium
VDTDDSV

SEQ ID NO: 606518 - protein, 5 aa, Mycobacterium
VDTDE

SEQ ID NO: 606519 - protein, 12 aa, Mycobacterium
VDTDEGPRRQTT

SEQ ID NO: 606520 - protein, 6 aa, Mycobacterium
VDTDEI

SEQ ID NO: 606521 - protein, 5 aa, Mycobacterium
VDTDG

SEQ ID NO: 606522 - protein, 8 aa, Mycobacterium
VDTDGDGK

SEQ ID NO: 606523 - protein, 7 aa, Mycobacterium
VDTDGNF

SEQ ID NO: 606524 - protein, 6 aa, Mycobacterium
VDTDHP

SEQ ID NO: 606525 - protein, 10 aa, Mycobacterium
VDTDPTAGTS

SEQ ID NO: 606526 - protein, 8 aa, Mycobacterium
VDTDQGRL

SEQ ID NO: 606527 - protein, 8 aa, Mycobacterium
VDTDRARS

SEQ ID NO: 606528 - protein, 7 aa, Mycobacterium
VDTDRDI

SEQ ID NO: 606529 - protein, 7 aa, Mycobacterium
VDTDRRE

SEQ ID NO: 606530 - protein, 10 aa, Mycobacterium
VDTDTGEAVD

SEQ ID NO: 606531 - protein, 5 aa, Mycobacterium
VDTEA

SEQ ID NO: 606532 - protein, 9 aa, Mycobacterium
VDTEAEQAL

SEQ ID NO: 606533 - protein, 11 aa, Mycobacterium
VDTEAEQALAS

SEQ ID NO: 606534 - protein, 6 aa, Mycobacterium
VDTEAR

SEQ ID NO: 606535 - protein, 6 aa, Mycobacterium
VDTEDT

SEQ ID NO: 606536 - protein, 8 aa, Mycobacterium
VDTEGEPY

SEQ ID NO: 606537 - protein, 6 aa, Mycobacterium
VDTEGL

SEQ ID NO: 606538 - protein, 9 aa, Mycobacterium
VDTEGLAQT

SEQ ID NO: 606539 - protein, 8 aa, Mycobacterium
VDTEPYRK

SEQ ID NO: 606540 - protein, 9 aa, Mycobacterium
VDTEQSPRR

SEQ ID NO: 606541 - protein, 8 aa, Mycobacterium
VDTEREHD

SEQ ID NO: 606542 - protein, 11 aa, Mycobacterium
VDTERGEADAA

SEQ ID NO: 606543 - protein, 7 aa, Mycobacterium
VDTERPE

SEQ ID NO: 606544 - protein, 11 aa, Mycobacterium
VDTESAAKSLV

SEQ ID NO: 606545 - protein, 5 aa, Mycobacterium
VDTET

SEQ ID NO: 606546 - protein, 9 aa, Mycobacterium
VDTGATEPF

SEQ ID NO: 606547 - protein, 6 aa, Mycobacterium
VDTGDP

SEQ ID NO: 606548 - protein, 7 aa, Mycobacterium
VDTGDTP

SEQ ID NO: 606549 - protein, 5 aa, Mycobacterium
VDTGE

SEQ ID NO: 606550 - protein, 7 aa, Mycobacterium
VDTGEHA

SEQ ID NO: 606551 - protein, 7 aa, Mycobacterium
VDTGGDV

SEQ ID NO: 606552 - protein, 11 aa, Mycobacterium
VDTGGQGGTPV

SEQ ID NO: 606553 - protein, 6 aa, Mycobacterium
VDTGPI

SEQ ID NO: 606554 - protein, 12 aa, Mycobacterium
VDTGQKSIAKTK

SEQ ID NO: 606555 - protein, 11 aa, Mycobacterium
VDTGRAPATVH

SEQ ID NO: 606556 - protein, 8 aa, Mycobacterium
VDTGRAPT

SEQ ID NO: 606557 - protein, 8 aa, Mycobacterium
VDTGSDVG

SEQ ID NO: 606558 - protein, 10 aa, Mycobacterium
VDTGSPVAPY

SEQ ID NO: 606559 - protein, 8 aa, Mycobacterium
VDTGTEVG

SEQ ID NO: 606560 - protein, 7 aa, Mycobacterium
VDTGVEQ

SEQ ID NO: 606561 - protein, 4 aa, Mycobacterium
VDTH

SEQ ID NO: 606562 - protein, 9 aa, Mycobacterium
VDTHPNATS

SEQ ID NO: 606563 - protein, 16 aa, Mycobacterium
VDTKGRSRNVSDGYRR

SEQ ID NO: 606564 - protein, 12 aa, Mycobacterium
VDTKPPRHSEPL

SEQ ID NO: 606565 - protein, 7 aa, Mycobacterium
VDTNDND

SEQ ID NO: 606566 - protein, 6 aa, Mycobacterium
VDTNRS

SEQ ID NO: 606567 - protein, 4 aa, Mycobacterium
VDTP

SEQ ID NO: 606568 - protein, 6 aa, Mycobacterium
VDTPAA

SEQ ID NO: 606569 - protein, 7 aa, Mycobacterium
VDTPAKV

SEQ ID NO: 606570 - protein, 8 aa, Mycobacterium
VDTPDGAR

SEQ ID NO: 606571 - protein, 7 aa, Mycobacterium
VDTPEEV

SEQ ID NO: 606572 - protein, 6 aa, Mycobacterium
VDTPEG

SEQ ID NO: 606573 - protein, 10 aa, Mycobacterium
VDTPERPEGE

SEQ ID NO: 606574 - protein, 8 aa, Mycobacterium
VDTPGPVF

SEQ ID NO: 606575 - protein, 8 aa, Mycobacterium
VDTPVTDA

SEQ ID NO: 606576 - protein, 5 aa, Mycobacterium
VDTQA

SEQ ID NO: 606577 - protein, 9 aa, Mycobacterium
VDTQAEREL

SEQ ID NO: 606578 - protein, 7 aa, Mycobacterium
VDTQPIE

SEQ ID NO: 606579 - protein, 30 aa, Mycobacterium
VDTQPVGNRHAGTDIPAVQDDSPHGRALPG

SEQ ID NO: 606580 - protein, 4 aa, Mycobacterium
VDTR

SEQ ID NO: 606581 - protein, 10 aa, Mycobacterium
VDTRDGDALT

SEQ ID NO: 606582 - protein, 12 aa, Mycobacterium
VDTRNDQRDTHL

SEQ ID NO: 606583 - protein, 11 aa, Mycobacterium
VDTRNEQRDAH

SEQ ID NO: 606584 - protein, 13 aa, Mycobacterium
VDTRPDPRLPGPD

SEQ ID NO: 606585 - protein, 14 aa, Mycobacterium
VDTRPDPTLPGPDG

SEQ ID NO: 606586 - protein, 7 aa, Mycobacterium
VDTRREH

SEQ ID NO: 606587 - protein, 6 aa, Mycobacterium
VDTRTA

SEQ ID NO: 606588 - protein, 4 aa, Mycobacterium
VDTS

SEQ ID NO: 606589 - protein, 6 aa, Mycobacterium
VDTSAR

SEQ ID NO: 606590 - protein, 7 aa, Mycobacterium
VDTSATY

SEQ ID NO: 606591 - protein, 7 aa, Mycobacterium
VDTSAVE

SEQ ID NO: 606592 - protein, 9 aa, Mycobacterium
VDTSDMTQE

SEQ ID NO: 606593 - protein, 8 aa, Mycobacterium
VDTSEETL

SEQ ID NO: 606594 - protein, 17 aa, Mycobacterium
VDTSGGNGGGADGGGSL

SEQ ID NO: 606595 - protein, 6 aa, Mycobacterium
VDTSGR

SEQ ID NO: 606596 - protein, 16 aa, Mycobacterium
VDTSGTVDVEAERRRL

SEQ ID NO: 606597 - protein, 9 aa, Mycobacterium
VDTSNPGHD

SEQ ID NO: 606598 - protein, 7 aa, Mycobacterium
VDTSQRG

SEQ ID NO: 606599 - protein, 7 aa, Mycobacterium
VDTSRRE

SEQ ID NO: 606600 - protein, 5 aa, Mycobacterium
VDTST

SEQ ID NO: 606601 - protein, 6 aa, Mycobacterium
VDTTGT

SEQ ID NO: 606602 - protein, 12 aa, Mycobacterium
VDTTQAAAQLET

SEQ ID NO: 606603 - protein, 7 aa, Mycobacterium
VDTTTDD

SEQ ID NO: 606604 - protein, 8 aa, Mycobacterium
VDTTTDDL

SEQ ID NO: 606605 - protein, 9 aa, Mycobacterium
VDTTTPALP

SEQ ID NO: 606606 - protein, 8 aa, Mycobacterium
VDTTTSQT

SEQ ID NO: 606607 - protein, 12 aa, Mycobacterium
VDTTTTPAPGGA

SEQ ID NO: 606608 - protein, 5 aa, Mycobacterium
VDTYA

SEQ ID NO: 606609 - protein, 4 aa, Mycobacterium
VDVA

SEQ ID NO: 606610 - protein, 8 aa, Mycobacterium
VDVDGKVE

SEQ ID NO: 606611 - protein, 13 aa, Mycobacterium
VDVDGPLAGRLTS

SEQ ID NO: 606612 - protein, 9 aa, Mycobacterium
VDVDPDAPV

SEQ ID NO: 606613 - protein, 7 aa, Mycobacterium
VDVDPDE

SEQ ID NO: 606614 - protein, 6 aa, Mycobacterium
VDVGDE

SEQ ID NO: 606615 - protein, 7 aa, Mycobacterium
VDVGDGA

SEQ ID NO: 606616 - protein, 8 aa, Mycobacterium
VDVGEGVT

SEQ ID NO: 606617 - protein, 9 aa, Mycobacterium
VDVPEDAGA

SEQ ID NO: 606618 - protein, 25 aa, Mycobacterium
VDVPGQRVTAGAGQPGGGDVGIGET

SEQ ID NO: 606619 - protein, 6 aa, Mycobacterium
VDVPNN

SEQ ID NO: 606620 - protein, 4 aa, Mycobacterium
VDVS

SEQ ID NO: 606621 - protein, 19 aa, Mycobacterium
VDVTPEERRRIAETGFYAY

SEQ ID NO: 606622 - protein, 18 aa, Mycobacterium
VDWDNTEDQPDAEPAEGL

SEQ ID NO: 606623 - protein, 4 aa, Mycobacterium
VDWP

SEQ ID NO: 606624 - protein, 13 aa, Mycobacterium
VDWPEGDGPRRAG

SEQ ID NO: 606625 - protein, 8 aa, Mycobacterium
VDYEGEPT

SEQ ID NO: 606626 - protein, 5 aa, Mycobacterium
VDYGQ

SEQ ID NO: 606627 - protein, 7 aa, Mycobacterium
VDYKDTN

SEQ ID NO: 606628 - protein, 11 aa, Mycobacterium
VDYPPERVRAD

SEQ ID NO: 606629 - protein, 14 aa, Mycobacterium
VDYPPERVRADSGL

SEQ ID NO: 606630 - protein, 4 aa, Mycobacterium
VEAA

SEQ ID NO: 606631 - protein, 27 aa, Mycobacterium
VEAAAPDDRWQGSGANAYAAANKEHAQ

SEQ ID NO: 606632 - protein, 8 aa, Mycobacterium
VEAADKAG

SEQ ID NO: 606633 - protein, 9 aa, Mycobacterium
VEAADKAGF

SEQ ID NO: 606634 - protein, 5 aa, Mycobacterium
VEAAG

SEQ ID NO: 606635 - protein, 8 aa, Mycobacterium
VEAAGREA

SEQ ID NO: 606636 - protein, 10 aa, Mycobacterium
VEAAKGAFAE

SEQ ID NO: 606637 - protein, 15 aa, Mycobacterium
VEAAKKRSEQLGITT

SEQ ID NO: 606638 - protein, 15 aa, Mycobacterium
VEAAKTRSEQLGITS

SEQ ID NO: 606639 - protein, 5 aa, Mycobacterium
VEAAP

SEQ ID NO: 606640 - protein, 7 aa, Mycobacterium
VEAAPGE

SEQ ID NO: 606641 - protein, 9 aa, Mycobacterium
VEAATGRPL

SEQ ID NO: 606642 - protein, 17 aa, Mycobacterium
VEAATKPSHLDRDEDPV

SEQ ID NO: 606643 - protein, 4 aa, Mycobacterium
VEAD

SEQ ID NO: 606644 - protein, 16 aa, Mycobacterium
VEADDGDLVHRWLEGR

SEQ ID NO: 606645 - protein, 5 aa, Mycobacterium
VEADG

SEQ ID NO: 606646 - protein, 8 aa, Mycobacterium
VEADGDFD

SEQ ID NO: 606647 - protein, 8 aa, Mycobacterium
VEADGPEL

SEQ ID NO: 606648 - protein, 6 aa, Mycobacterium
VEADGT

SEQ ID NO: 606649 - protein, 10 aa, Mycobacterium
VEADKSETVT

SEQ ID NO: 606650 - protein, 6 aa, Mycobacterium
VEADPG

SEQ ID NO: 606651 - protein, 4 aa, Mycobacterium
VEAE

SEQ ID NO: 606652 - protein, 6 aa, Mycobacterium
VEAEET

SEQ ID NO: 606653 - protein, 14 aa, Mycobacterium
VEAEGGDVQSRVTR

SEQ ID NO: 606654 - protein, 6 aa, Mycobacterium
VEAEGR

SEQ ID NO: 606655 - protein, 20 aa, Mycobacterium
VEAERSRRWASPGDPSASAA

SEQ ID NO: 606656 - protein, 9 aa, Mycobacterium
VEAESRRGR

SEQ ID NO: 606657 - protein, 5 aa, Mycobacterium
VEAET

SEQ ID NO: 606658 - protein, 4 aa, Mycobacterium
VEAG

SEQ ID NO: 606659 - protein, 12 aa, Mycobacterium
VEAGDDAVARAG

SEQ ID NO: 606660 - protein, 11 aa, Mycobacterium
VEAGDEDSWVS

SEQ ID NO: 606661 - protein, 5 aa, Mycobacterium
VEAGG

SEQ ID NO: 606662 - protein, 12 aa, Mycobacterium
VEAGLGQAAGVG

SEQ ID NO: 606663 - protein, 5 aa, Mycobacterium
VEAGN

SEQ ID NO: 606664 - protein, 8 aa, Mycobacterium
VEAGPPEQ

SEQ ID NO: 606665 - protein, 5 aa, Mycobacterium
VEAGR

SEQ ID NO: 606666 - protein, 8 aa, Mycobacterium
VEAGRAPQ

SEQ ID NO: 606667 - protein, 5 aa, Mycobacterium
VEAGS

SEQ ID NO: 606668 - protein, 5 aa, Mycobacterium
VEAKS

SEQ ID NO: 606669 - protein, 9 aa, Mycobacterium
VEALGDGVS

SEQ ID NO: 606670 - protein, 16 aa, Mycobacterium
VEANAQDRFSAPDRDD

SEQ ID NO: 606671 - protein, 7 aa, Mycobacterium
VEANNNG

SEQ ID NO: 606672 - protein, 4 aa, Mycobacterium
VEAP

SEQ ID NO: 606673 - protein, 10 aa, Mycobacterium
VEAPDGDVAI

SEQ ID NO: 606674 - protein, 6 aa, Mycobacterium
VEAPGV

SEQ ID NO: 606675 - protein, 20 aa, Mycobacterium
VEAPLPPGKVPPTDVPNPPC

SEQ ID NO: 606676 - protein, 24 aa, Mycobacterium
VEAPNGNGRRRRTEAAAVEEPDPL

SEQ ID NO: 606677 - protein, 7 aa, Mycobacterium
VEAPRGK

SEQ ID NO: 606678 - protein, 5 aa, Mycobacterium
VEAPV

SEQ ID NO: 606679 - protein, 10 aa, Mycobacterium
VEAQQQSDGR

SEQ ID NO: 606680 - protein, 4 aa, Mycobacterium
VEAR

SEQ ID NO: 606681 - protein, 6 aa, Mycobacterium
VEARAG

SEQ ID NO: 606682 - protein, 11 aa, Mycobacterium
VEARTGTDLTT

SEQ ID NO: 606683 - protein, 20 aa, Mycobacterium
VEASAKEVRAREARDAVQTE

SEQ ID NO: 606684 - protein, 13 aa, Mycobacterium
VEASEEDSGTTTI

SEQ ID NO: 606685 - protein, 9 aa, Mycobacterium
VEASNDRYV

SEQ ID NO: 606686 - protein, 9 aa, Mycobacterium
VEASPEAEA

SEQ ID NO: 606687 - protein, 7 aa, Mycobacterium
VEASRKV

SEQ ID NO: 606688 - protein, 14 aa, Mycobacterium
VEASSKAKGETQTN

SEQ ID NO: 606689 - protein, 4 aa, Mycobacterium
VEAT

SEQ ID NO: 606690 - protein, 13 aa, Mycobacterium
VEATDEPWHGRPA

SEQ ID NO: 606691 - protein, 6 aa, Mycobacterium
VEATEA

SEQ ID NO: 606692 - protein, 6 aa, Mycobacterium
VEATGA

SEQ ID NO: 606693 - protein, 20 aa, Mycobacterium
VEATGEAAPMPAPAQPEEPG

SEQ ID NO: 606694 - protein, 9 aa, Mycobacterium
VEATGNPLK

SEQ ID NO: 606695 - protein, 9 aa, Mycobacterium
VEATGNRGK

SEQ ID NO: 606696 - protein, 9 aa, Mycobacterium
VEATGQPVK

SEQ ID NO: 606697 - protein, 10 aa, Mycobacterium
VEATGTPEKI

SEQ ID NO: 606698 - protein, 6 aa, Mycobacterium
VEATSD

SEQ ID NO: 606699 - protein, 14 aa, Mycobacterium
VECSTGSACTAGVA

SEQ ID NO: 606700 - protein, 4 aa, Mycobacterium
VEDA

SEQ ID NO: 606701 - protein, 37 aa, Mycobacterium
VEDAAGQHGLSPESLRDNALNNRDNDVFSNPGKYGLT

SEQ ID NO: 606702 - protein, 12 aa, Mycobacterium
VEDAGRAKDSLT

SEQ ID NO: 606703 - protein, 12 aa, Mycobacterium
VEDANGSRKESK

SEQ ID NO: 606704 - protein, 9 aa, Mycobacterium
VEDANSDSN

SEQ ID NO: 606705 - protein, 7 aa, Mycobacterium
VEDAQRR

SEQ ID NO: 606706 - protein, 21 aa, Mycobacterium
VEDARSSVNGYTAAPNGDGSV

SEQ ID NO: 606707 - protein, 9 aa, Mycobacterium
VEDDEKLPR

SEQ ID NO: 606708 - protein, 9 aa, Mycobacterium
VEDDPDSPH

SEQ ID NO: 606709 - protein, 17 aa, Mycobacterium
VEDDRHSDASASVSSVA

SEQ ID NO: 606710 - protein, 9 aa, Mycobacterium
VEDDTPAEI

SEQ ID NO: 606711 - protein, 6 aa, Mycobacterium
VEDDVA

SEQ ID NO: 606712 - protein, 12 aa, Mycobacterium
VEDEDTEPDTAP

SEQ ID NO: 606713 - protein, 8 aa, Mycobacterium
VEDEPQGR

SEQ ID NO: 606714 - protein, 12 aa, Mycobacterium
VEDEQGATLGTM

SEQ ID NO: 606715 - protein, 4 aa, Mycobacterium
VEDG

SEQ ID NO: 606716 - protein, 8 aa, Mycobacterium
VEDGAAGV

SEQ ID NO: 606717 - protein, 6 aa, Mycobacterium
VEDGDT

SEQ ID NO: 606718 - protein, 7 aa, Mycobacterium
VEDGEDF

SEQ ID NO: 606719 - protein, 28 aa, Mycobacterium
VEDGELRTADTETLATDAKNAAVTLRER

SEQ ID NO: 606720 - protein, 14 aa, Mycobacterium
VEDGNGYPPPAYPP

SEQ ID NO: 606721 - protein, 6 aa, Mycobacterium
VEDGPR

SEQ ID NO: 606722 - protein, 5 aa, Mycobacterium
VEDGR

SEQ ID NO: 606723 - protein, 8 aa, Mycobacterium
VEDGRTVE

SEQ ID NO: 606724 - protein, 9 aa, Mycobacterium
VEDGTEDDW

SEQ ID NO: 606725 - protein, 7 aa, Mycobacterium
VEDGTYD

SEQ ID NO: 606726 - protein, 4 aa, Mycobacterium
VEDP

SEQ ID NO: 606727 - protein, 6 aa, Mycobacterium
VEDPAE

SEQ ID NO: 606728 - protein, 8 aa, Mycobacterium
VEDPARQR

SEQ ID NO: 606729 - protein, 6 aa, Mycobacterium
VEDPDE

SEQ ID NO: 606730 - protein, 11 aa, Mycobacterium
VEDPDTQAHSI

SEQ ID NO: 606731 - protein, 11 aa, Mycobacterium
VEDPEYRTGRY

SEQ ID NO: 606732 - protein, 20 aa, Mycobacterium
VEDPGLEASPETSQEVSDEI

SEQ ID NO: 606733 - protein, 10 aa, Mycobacterium
VEDPGSRGAV

SEQ ID NO: 606734 - protein, 7 aa, Mycobacterium
VEDPGWT

SEQ ID NO: 606735 - protein, 5 aa, Mycobacterium
VEDPN

SEQ ID NO: 606736 - protein, 6 aa, Mycobacterium
VEDPRI

SEQ ID NO: 606737 - protein, 7 aa, Mycobacterium
VEDPRVR

SEQ ID NO: 606738 - protein, 11 aa, Mycobacterium
VEDPSRREKVT

SEQ ID NO: 606739 - protein, 5 aa, Mycobacterium
VEDPT

SEQ ID NO: 606740 - protein, 6 aa, Mycobacterium
VEDPTS

SEQ ID NO: 606741 - protein, 7 aa, Mycobacterium
VEDPVSG

SEQ ID NO: 606742 - protein, 7 aa, Mycobacterium
VEDQQGQ

SEQ ID NO: 606743 - protein, 8 aa, Mycobacterium
VEDQRADL

SEQ ID NO: 606744 - protein, 16 aa, Mycobacterium
VEDQRDADLEARAQKL

SEQ ID NO: 606745 - protein, 7 aa, Mycobacterium
VEDQRQA

SEQ ID NO: 606746 - protein, 6 aa, Mycobacterium
VEDRAR

SEQ ID NO: 606747 - protein, 9 aa, Mycobacterium
VEDRDPSGF

SEQ ID NO: 606748 - protein, 6 aa, Mycobacterium
VEDRGR

SEQ ID NO: 606749 - protein, 10 aa, Mycobacterium
VEDRPLNGTP

SEQ ID NO: 606750 - protein, 7 aa, Mycobacterium
VEDRPYE

SEQ ID NO: 606751 - protein, 7 aa, Mycobacterium
VEDRRGI

SEQ ID NO: 606752 - protein, 7 aa, Mycobacterium
VEDRTDT

SEQ ID NO: 606753 - protein, 9 aa, Mycobacterium
VEDSDPESF

SEQ ID NO: 606754 - protein, 5 aa, Mycobacterium
VEDSG

SEQ ID NO: 606755 - protein, 6 aa, Mycobacterium
VEDSGE

SEQ ID NO: 606756 - protein, 15 aa, Mycobacterium
VEDSGSDGDAAGMSG

SEQ ID NO: 606757 - protein, 9 aa, Mycobacterium
VEDSSPAEF

SEQ ID NO: 606758 - protein, 4 aa, Mycobacterium
VEDT

SEQ ID NO: 606759 - protein, 6 aa, Mycobacterium
VEDTDE

SEQ ID NO: 606760 - protein, 7 aa, Mycobacterium
VEDTGYT

SEQ ID NO: 606761 - protein, 14 aa, Mycobacterium
VEDTPGCEAGDYDG

SEQ ID NO: 606762 - protein, 9 aa, Mycobacterium
VEDTPSASL

SEQ ID NO: 606763 - protein, 12 aa, Mycobacterium
VEDTSAEQIAAD

SEQ ID NO: 606764 - protein, 13 aa, Mycobacterium
VEDTSAEQIAADA

SEQ ID NO: 606765 - protein, 12 aa, Mycobacterium
VEDTTKAATAEQ

SEQ ID NO: 606766 - protein, 7 aa, Mycobacterium
VEDTVGG

SEQ ID NO: 606767 - protein, 18 aa, Mycobacterium
VEDVKGKAKEAIGTVAGR

SEQ ID NO: 606768 - protein, 13 aa, Mycobacterium
VEEAAATAARAGV

SEQ ID NO: 606769 - protein, 6 aa, Mycobacterium
VEEAGA

SEQ ID NO: 606770 - protein, 7 aa, Mycobacterium
VEEAGSR

SEQ ID NO: 606771 - protein, 11 aa, Mycobacterium
VEEAQAELANE

SEQ ID NO: 606772 - protein, 12 aa, Mycobacterium
VEEATKRRLRAK

SEQ ID NO: 606773 - protein, 6 aa, Mycobacterium
VEEDQE

SEQ ID NO: 606774 - protein, 8 aa, Mycobacterium
VEEDRDED

SEQ ID NO: 606775 - protein, 8 aa, Mycobacterium
VEEEDPVQ

SEQ ID NO: 606776 - protein, 9 aa, Mycobacterium
VEEEQPGVA

SEQ ID NO: 606777 - protein, 5 aa, Mycobacterium
VEEER

SEQ ID NO: 606778 - protein, 7 aa, Mycobacterium
VEEGATA

SEQ ID NO: 606779 - protein, 12 aa, Mycobacterium
VEEGATRPTDRS

SEQ ID NO: 606780 - protein, 9 aa, Mycobacterium
VEEGDDADV

SEQ ID NO: 606781 - protein, 5 aa, Mycobacterium
VEEGG

SEQ ID NO: 606782 - protein, 8 aa, Mycobacterium
VEEGSYGR

SEQ ID NO: 606783 - protein, 12 aa, Mycobacterium
VEEIDADNTRVN

SEQ ID NO: 606784 - protein, 12 aa, Mycobacterium
VEEKPYSRRPYP

SEQ ID NO: 606785 - protein, 8 aa, Mycobacterium
VEEKQGPV

SEQ ID NO: 606786 - protein, 9 aa, Mycobacterium
VEEKTGRSG

SEQ ID NO: 606787 - protein, 5 aa, Mycobacterium
VEEPG

SEQ ID NO: 606788 - protein, 6 aa, Mycobacterium
VEEPGI

SEQ ID NO: 606789 - protein, 16 aa, Mycobacterium
VEEPGPHLIDAVLSRV

SEQ ID NO: 606790 - protein, 8 aa, Mycobacterium
VEEPPQRV

SEQ ID NO: 606791 - protein, 6 aa, Mycobacterium
VEEPSA

SEQ ID NO: 606792 - protein, 5 aa, Mycobacterium
VEEQE

SEQ ID NO: 606793 - protein, 5 aa, Mycobacterium
VEEQT

SEQ ID NO: 606794 - protein, 7 aa, Mycobacterium
VEERGAT

SEQ ID NO: 606795 - protein, 15 aa, Mycobacterium
VEERPLDDAAEAYGA

SEQ ID NO: 606796 - protein, 6 aa, Mycobacterium
VEERRG

SEQ ID NO: 606797 - protein, 8 aa, Mycobacterium
VEERTRAQ

SEQ ID NO: 606798 - protein, 6 aa, Mycobacterium
VEESAN

SEQ ID NO: 606799 - protein, 5 aa, Mycobacterium
VEESE

SEQ ID NO: 606800 - protein, 8 aa, Mycobacterium
VEESEPPH

SEQ ID NO: 606801 - protein, 11 aa, Mycobacterium
VEESFPASDPV

SEQ ID NO: 606802 - protein, 5 aa, Mycobacterium
VEESG

SEQ ID NO: 606803 - protein, 7 aa, Mycobacterium
VEESPRQ

SEQ ID NO: 606804 - protein, 9 aa, Mycobacterium
VEESSTLST

SEQ ID NO: 606805 - protein, 8 aa, Mycobacterium
VEESTRGR

SEQ ID NO: 606806 - protein, 6 aa, Mycobacterium
VEETDE

SEQ ID NO: 606807 - protein, 13 aa, Mycobacterium
VEETGPGATRNRL

SEQ ID NO: 606808 - protein, 9 aa, Mycobacterium
VEETGSDSV

SEQ ID NO: 606809 - protein, 20 aa, Mycobacterium
VEETKDAKDADVSPAPEAEV

SEQ ID NO: 606810 - protein, 10 aa, Mycobacterium
VEETPDAGSY

SEQ ID NO: 606811 - protein, 12 aa, Mycobacterium
VEETSAEQIAAD

SEQ ID NO: 606812 - protein, 13 aa, Mycobacterium
VEETTAEQIAADA

SEQ ID NO: 606813 - protein, 4 aa, Mycobacterium
VEEV

SEQ ID NO: 606814 - protein, 7 aa, Mycobacterium
VEFPGSD

SEQ ID NO: 606815 - protein, 6 aa, Mycobacterium
VEGAAS

SEQ ID NO: 606816 - protein, 12 aa, Mycobacterium
VEGADGAPGGLR

SEQ ID NO: 606817 - protein, 12 aa, Mycobacterium
VEGADPAKIRGQ

SEQ ID NO: 606818 - protein, 8 aa, Mycobacterium
VEGAEPGD

SEQ ID NO: 606819 - protein, 8 aa, Mycobacterium
VEGAGDTQ

SEQ ID NO: 606820 - protein, 7 aa, Mycobacterium
VEGAGEV

SEQ ID NO: 606821 - protein, 10 aa, Mycobacterium
VEGAGRSADS

SEQ ID NO: 606822 - protein, 10 aa, Mycobacterium
VEGAGSPTMT

SEQ ID NO: 606823 - protein, 10 aa, Mycobacterium
VEGAHGAPLP

SEQ ID NO: 606824 - protein, 8 aa, Mycobacterium
VEGAKPGD

SEQ ID NO: 606825 - protein, 8 aa, Mycobacterium
VEGAQTPH

SEQ ID NO: 606826 - protein, 24 aa, Mycobacterium
VEGARRGKRVKTTRPDLSAERHPD

SEQ ID NO: 606827 - protein, 11 aa, Mycobacterium
VEGARSSLESA

SEQ ID NO: 606828 - protein, 11 aa, Mycobacterium
VEGASDSSQTL

SEQ ID NO: 606829 - protein, 17 aa, Mycobacterium
VEGASTKSELRRAEDPV

SEQ ID NO: 606830 - protein, 15 aa, Mycobacterium
VEGATESDEGTDGAL

SEQ ID NO: 606831 - protein, 9 aa, Mycobacterium
VEGDAASGE

SEQ ID NO: 606832 - protein, 49 aa, Mycobacterium
VEGDEVGLDNAGSTVLSSTPKPPKTAGEKVTDEGEGGNQIAQYLVGQKI

SEQ ID NO: 606833 - protein, 26 aa, Mycobacterium
VEGDKGAYQPAGQDSPETGVYSSPAE

SEQ ID NO: 606834 - protein, 8 aa, Mycobacterium
VEGDPDCQ

SEQ ID NO: 606835 - protein, 10 aa, Mycobacterium
VEGDPESQQA

SEQ ID NO: 606836 - protein, 4 aa, Mycobacterium
VEGE

SEQ ID NO: 606837 - protein, 6 aa, Mycobacterium
VEGEDV

SEQ ID NO: 606838 - protein, 5 aa, Mycobacterium
VEGEG

SEQ ID NO: 606839 - protein, 11 aa, Mycobacterium
VEGEGKLSDDE

SEQ ID NO: 606840 - protein, 6 aa, Mycobacterium
VEGEID

SEQ ID NO: 606841 - protein, 7 aa, Mycobacterium
VEGEPAD

SEQ ID NO: 606842 - protein, 11 aa, Mycobacterium
VEGEPEGEATG

SEQ ID NO: 606843 - protein, 6 aa, Mycobacterium
VEGEPL

SEQ ID NO: 606844 - protein, 5 aa, Mycobacterium
VEGEQ

SEQ ID NO: 606845 - protein, 6 aa, Mycobacterium
VEGGAK

SEQ ID NO: 606846 - protein, 5 aa, Mycobacterium
VEGGD

SEQ ID NO: 606847 - protein, 6 aa, Mycobacterium
VEGGDD

SEQ ID NO: 606848 - protein, 9 aa, Mycobacterium
VEGGENVTG

SEQ ID NO: 606849 - protein, 12 aa, Mycobacterium
VEGGGFKSALGA

SEQ ID NO: 606850 - protein, 7 aa, Mycobacterium
VEGGGYA

SEQ ID NO: 606851 - protein, 15 aa, Mycobacterium
VEGGKVTGERETDDG

SEQ ID NO: 606852 - protein, 14 aa, Mycobacterium
VEGGKVTGERETDE

SEQ ID NO: 606853 - protein, 9 aa, Mycobacterium
VEGGNKELE

SEQ ID NO: 606854 - protein, 21 aa, Mycobacterium
VEGGNKELEGLRKENAEHPIE

SEQ ID NO: 606855 - protein, 21 aa, Mycobacterium
VEGGNKELEGLRKQNAEHPIE

SEQ ID NO: 606856 - protein, 8 aa, Mycobacterium
VEGGNKQL

SEQ ID NO: 606857 - protein, 5 aa, Mycobacterium
VEGGR

SEQ ID NO: 606858 - protein, 9 aa, Mycobacterium
VEGGRGEQA

SEQ ID NO: 606859 - protein, 5 aa, Mycobacterium
VEGGS

SEQ ID NO: 606860 - protein, 14 aa, Mycobacterium
VEGGSAVTTGERVS

SEQ ID NO: 606861 - protein, 9 aa, Mycobacterium
VEGGTGEQS

SEQ ID NO: 606862 - protein, 15 aa, Mycobacterium
VEGHGTGTTLGDPIE

SEQ ID NO: 606863 - protein, 12 aa, Mycobacterium
VEGIADDGSTVK

SEQ ID NO: 606864 - protein, 12 aa, Mycobacterium
VEGKDTSNMPRA

SEQ ID NO: 606865 - protein, 5 aa, Mycobacterium
VEGKG

SEQ ID NO: 606866 - protein, 18 aa, Mycobacterium
VEGKQGARTVPIGKPKIN

SEQ ID NO: 606867 - protein, 10 aa, Mycobacterium
VEGKSAGEYM

SEQ ID NO: 606868 - protein, 5 aa, Mycobacterium
VEGKT

SEQ ID NO: 606869 - protein, 14 aa, Mycobacterium
VEGNAGVDPDEAAA

SEQ ID NO: 606870 - protein, 17 aa, Mycobacterium
VEGNAYTSGADRLPTTL

SEQ ID NO: 606871 - protein, 12 aa, Mycobacterium
VEGNNPAGNPTL

SEQ ID NO: 606872 - protein, 11 aa, Mycobacterium
VEGNSDKARST

SEQ ID NO: 606873 - protein, 9 aa, Mycobacterium
VEGNTDAGV

SEQ ID NO: 606874 - protein, 6 aa, Mycobacterium
VEGNTL

SEQ ID NO: 606875 - protein, 8 aa, Mycobacterium
VEGNTNAG

SEQ ID NO: 606876 - protein, 4 aa, Mycobacterium
VEGP

SEQ ID NO: 606877 - protein, 6 aa, Mycobacterium
VEGPAG

SEQ ID NO: 606878 - protein, 5 aa, Mycobacterium
VEGPD

SEQ ID NO: 606879 - protein, 8 aa, Mycobacterium
VEGPENLP

SEQ ID NO: 606880 - protein, 5 aa, Mycobacterium
VEGPL

SEQ ID NO: 606881 - protein, 15 aa, Mycobacterium
VEGPPGQPEEPAPPS

SEQ ID NO: 606882 - protein, 14 aa, Mycobacterium
VEGPQPSDLPPGVE

SEQ ID NO: 606883 - protein, 10 aa, Mycobacterium
VEGPTDDPAI

SEQ ID NO: 606884 - protein, 10 aa, Mycobacterium
VEGPTDDPDI

SEQ ID NO: 606885 - protein, 9 aa, Mycobacterium
VEGPTDDPQ

SEQ ID NO: 606886 - protein, 7 aa, Mycobacterium
VEGQDRV

SEQ ID NO: 606887 - protein, 5 aa, Mycobacterium
VEGQL

SEQ ID NO: 606888 - protein, 8 aa, Mycobacterium
VEGQRMSD

SEQ ID NO: 606889 - protein, 8 aa, Mycobacterium
VEGRAPQD

SEQ ID NO: 606890 - protein, 6 aa, Mycobacterium
VEGRDQ

SEQ ID NO: 606891 - protein, 6 aa, Mycobacterium
VEGRGG

SEQ ID NO: 606892 - protein, 9 aa, Mycobacterium
VEGRRGSQR

SEQ ID NO: 606893 - protein, 8 aa, Mycobacterium
VEGRRSEI

SEQ ID NO: 606894 - protein, 10 aa, Mycobacterium
VEGRTGRKLY

SEQ ID NO: 606895 - protein, 6 aa, Mycobacterium
VEGRVE

SEQ ID NO: 606896 - protein, 10 aa, Mycobacterium
VEGSAVTPAT

SEQ ID NO: 606897 - protein, 5 aa, Mycobacterium
VEGSD

SEQ ID NO: 606898 - protein, 8 aa, Mycobacterium
VEGSDRPA

SEQ ID NO: 606899 - protein, 6 aa, Mycobacterium
VEGSGP

SEQ ID NO: 606900 - protein, 13 aa, Mycobacterium
VEGSPAAELQPDQ

SEQ ID NO: 606901 - protein, 8 aa, Mycobacterium
VEGSPAPV

SEQ ID NO: 606902 - protein, 8 aa, Mycobacterium
VEGSRMSD

SEQ ID NO: 606903 - protein, 16 aa, Mycobacterium
VEGSSGASESSASESW

SEQ ID NO: 606904 - protein, 7 aa, Mycobacterium
VEGSSIE

SEQ ID NO: 606905 - protein, 5 aa, Mycobacterium
VEGST

SEQ ID NO: 606906 - protein, 8 aa, Mycobacterium
VEGTAKAA

SEQ ID NO: 606907 - protein, 9 aa, Mycobacterium
VEGTDSVTG

SEQ ID NO: 606908 - protein, 7 aa, Mycobacterium
VEGTLSS

SEQ ID NO: 606909 - protein, 7 aa, Mycobacterium
VEGTPGA

SEQ ID NO: 606910 - protein, 17 aa, Mycobacterium
VEGTPYKEATAAQLADR

SEQ ID NO: 606911 - protein, 5 aa, Mycobacterium
VEGTR

SEQ ID NO: 606912 - protein, 8 aa, Mycobacterium
VEGTRARG

SEQ ID NO: 606913 - protein, 6 aa, Mycobacterium
VEGTSA

SEQ ID NO: 606914 - protein, 7 aa, Mycobacterium
VEGTSIE

SEQ ID NO: 606915 - protein, 4 aa, Mycobacterium
VEGV

SEQ ID NO: 606916 - protein, 14 aa, Mycobacterium
VEGVKGKAKEVGGA

SEQ ID NO: 606917 - protein, 18 aa, Mycobacterium
VEGVKGKVKEVGGAALGR

SEQ ID NO: 606918 - protein, 7 aa, Mycobacterium
VEHADSA

SEQ ID NO: 606919 - protein, 6 aa, Mycobacterium
VEHATT

SEQ ID NO: 606920 - protein, 4 aa, Mycobacterium
VEHG

SEQ ID NO: 606921 - protein, 6 aa, Mycobacterium
VEHGAS

SEQ ID NO: 606922 - protein, 11 aa, Mycobacterium
VEHGDTDPEIG

SEQ ID NO: 606923 - protein, 7 aa, Mycobacterium
VEHPTGE

SEQ ID NO: 606924 - protein, 14 aa, Mycobacterium
VEHRTDSPRGNDPP

SEQ ID NO: 606925 - protein, 10 aa, Mycobacterium
VEKAAKAAGF

SEQ ID NO: 606926 - protein, 5 aa, Mycobacterium
VEKAG

SEQ ID NO: 606927 - protein, 9 aa, Mycobacterium
VEKAGTFTQ

SEQ ID NO: 606928 - protein, 24 aa, Mycobacterium
VEKDRAKEEAMAPQVAPPAPQDFP

SEQ ID NO: 606929 - protein, 10 aa, Mycobacterium
VEKEAGEFSA

SEQ ID NO: 606930 - protein, 4 aa, Mycobacterium
VEKG

SEQ ID NO: 606931 - protein, 8 aa, Mycobacterium
VEKGGDSV

SEQ ID NO: 606932 - protein, 9 aa, Mycobacterium
VEKHATKAS

SEQ ID NO: 606933 - protein, 9 aa, Mycobacterium
VEKPAGSEL

SEQ ID NO: 606934 - protein, 16 aa, Mycobacterium
VEKPSGSDAGRSIGAP

SEQ ID NO: 606935 - protein, 10 aa, Mycobacterium
VEKQADFADK

SEQ ID NO: 606936 - protein, 6 aa, Mycobacterium
VEKRPE

SEQ ID NO: 606937 - protein, 14 aa, Mycobacterium
VEKRQAYEARARGE

SEQ ID NO: 606938 - protein, 16 aa, Mycobacterium
VEKRSSHKQSHGGRKQ

SEQ ID NO: 606939 - protein, 9 aa, Mycobacterium
VEKSAGRMS

SEQ ID NO: 606940 - protein, 10 aa, Mycobacterium
VEKSGTFTQT

SEQ ID NO: 606941 - protein, 8 aa, Mycobacterium
VEKTDYDL

SEQ ID NO: 606942 - protein, 20 aa, Mycobacterium
VEKTERKDLAKPAAEPEPVV

SEQ ID NO: 606943 - protein, 8 aa, Mycobacterium
VEKTEYDL

SEQ ID NO: 606944 - protein, 12 aa, Mycobacterium
VEKTGRKAYTAE

SEQ ID NO: 606945 - protein, 5 aa, Mycobacterium
VEKTR

SEQ ID NO: 606946 - protein, 8 aa, Mycobacterium
VEKTSYDL

SEQ ID NO: 606947 - protein, 6 aa, Mycobacterium
VEKTTT

SEQ ID NO: 606948 - protein, 7 aa, Mycobacterium
VEKTTTS

SEQ ID NO: 606949 - protein, 8 aa, Mycobacterium
VEKYTQST

SEQ ID NO: 606950 - protein, 10 aa, Mycobacterium
VELEPGKTGG

SEQ ID NO: 606951 - protein, 7 aa, Mycobacterium
VELGPGE

SEQ ID NO: 606952 - protein, 11 aa, Mycobacterium
VELGSRKERPM

SEQ ID NO: 606953 - protein, 11 aa, Mycobacterium
VELGSRNERPL

SEQ ID NO: 606954 - protein, 11 aa, Mycobacterium
VELGSRNERPM

SEQ ID NO: 606955 - protein, 10 aa, Mycobacterium
VELPSGGTSF

SEQ ID NO: 606956 - protein, 22 aa, Mycobacterium
VELPTDGADPGRKIDPSDVKPG

SEQ ID NO: 606957 - protein, 6 aa, Mycobacterium
VELPTR

SEQ ID NO: 606958 - protein, 4 aa, Mycobacterium
VELT

SEQ ID NO: 606959 - protein, 18 aa, Mycobacterium
VELTDAGERLRSSTAAPL

SEQ ID NO: 606960 - protein, 7 aa, Mycobacterium
VELTPAG

SEQ ID NO: 606961 - protein, 9 aa, Mycobacterium
VELTPSDDL

SEQ ID NO: 606962 - protein, 4 aa, Mycobacterium
VENA

SEQ ID NO: 606963 - protein, 8 aa, Mycobacterium
VENAASED

SEQ ID NO: 606964 - protein, 11 aa, Mycobacterium
VENADGPQVGR

SEQ ID NO: 606965 - protein, 21 aa, Mycobacterium
VENAGGKPYPIPAGASEHKYG

SEQ ID NO: 606966 - protein, 6 aa, Mycobacterium
VENATA

SEQ ID NO: 606967 - protein, 15 aa, Mycobacterium
VENCSSDARGVGTDG

SEQ ID NO: 606968 - protein, 6 aa, Mycobacterium
VENDDV

SEQ ID NO: 606969 - protein, 5 aa, Mycobacterium
VENDK

SEQ ID NO: 606970 - protein, 17 aa, Mycobacterium
VENDQRKQLTEAQRARG

SEQ ID NO: 606971 - protein, 7 aa, Mycobacterium
VENDRSV

SEQ ID NO: 606972 - protein, 4 aa, Mycobacterium
VENE

SEQ ID NO: 606973 - protein, 19 aa, Mycobacterium
VENEPTPNPADLARQATTL

SEQ ID NO: 606974 - protein, 5 aa, Mycobacterium
VENGD

SEQ ID NO: 606975 - protein, 9 aa, Mycobacterium
VENGEKNLA

SEQ ID NO: 606976 - protein, 15 aa, Mycobacterium
VENGKVTGERETDDG

SEQ ID NO: 606977 - protein, 14 aa, Mycobacterium
VENGLPPAPSVAAR

SEQ ID NO: 606978 - protein, 9 aa, Mycobacterium
VENGLPPAQ

SEQ ID NO: 606979 - protein, 13 aa, Mycobacterium
VENGLPPAQPAVA

SEQ ID NO: 606980 - protein, 13 aa, Mycobacterium
VENLTQDEADRLA

SEQ ID NO: 606981 - protein, 7 aa, Mycobacterium
VENNDHG

SEQ ID NO: 606982 - protein, 9 aa, Mycobacterium
VENNRPPFD

SEQ ID NO: 606983 - protein, 4 aa, Mycobacterium
VENP

SEQ ID NO: 606984 - protein, 5 aa, Mycobacterium
VENPN

SEQ ID NO: 606985 - protein, 7 aa, Mycobacterium
VENPPEE

SEQ ID NO: 606986 - protein, 10 aa, Mycobacterium
VENPVPPWKS

SEQ ID NO: 606987 - protein, 7 aa, Mycobacterium
VENQDEV

SEQ ID NO: 606988 - protein, 17 aa, Mycobacterium
VENRGTTDTVVFVEVER

SEQ ID NO: 606989 - protein, 7 aa, Mycobacterium
VENSGIG

SEQ ID NO: 606990 - protein, 5 aa, Mycobacterium
VENSP

SEQ ID NO: 606991 - protein, 6 aa, Mycobacterium
VENSPG

SEQ ID NO: 606992 - protein, 24 aa, Mycobacterium
VENSTGGWGMTDTPPEAYERAASS

SEQ ID NO: 606993 - protein, 12 aa, Mycobacterium
VENTETADPSGL

SEQ ID NO: 606994 - protein, 8 aa, Mycobacterium
VENTSSTG

SEQ ID NO: 606995 - protein, 4 aa, Mycobacterium
VENY

SEQ ID NO: 606996 - protein, 6 aa, Mycobacterium
VEPAER

SEQ ID NO: 606997 - protein, 6 aa, Mycobacterium
VEPAGA

SEQ ID NO: 606998 - protein, 15 aa, Mycobacterium
VEPAGVSKKDGARTK

SEQ ID NO: 606999 - protein, 7 aa, Mycobacterium
VEPAPRR

SEQ ID NO: 607000 - protein, 8 aa, Mycobacterium
VEPAPRRA

SEQ ID NO: 607001 - protein, 10 aa, Mycobacterium
VEPAPSAAAT

SEQ ID NO: 607002 - protein, 5 aa, Mycobacterium
VEPAQ

SEQ ID NO: 607003 - protein, 21 aa, Mycobacterium
VEPASIEHAGSQAGYPAPPLQ

SEQ ID NO: 607004 - protein, 21 aa, Mycobacterium
VEPASIEQAGSQAGYPAPPLQ

SEQ ID NO: 607005 - protein, 5 aa, Mycobacterium
VEPAT

SEQ ID NO: 607006 - protein, 7 aa, Mycobacterium
VEPDAAG

SEQ ID NO: 607007 - protein, 8 aa, Mycobacterium
VEPDDAAT

SEQ ID NO: 607008 - protein, 7 aa, Mycobacterium
VEPDDGQ

SEQ ID NO: 607009 - protein, 15 aa, Mycobacterium
VEPDEVGVANAGSKV

SEQ ID NO: 607010 - protein, 6 aa, Mycobacterium
VEPDPA

SEQ ID NO: 607011 - protein, 9 aa, Mycobacterium
VEPDPGEMH

SEQ ID NO: 607012 - protein, 8 aa, Mycobacterium
VEPDPPRL

SEQ ID NO: 607013 - protein, 16 aa, Mycobacterium
VEPDPRVSGVPSTKGV

SEQ ID NO: 607014 - protein, 8 aa, Mycobacterium
VEPDPVPV

SEQ ID NO: 607015 - protein, 6 aa, Mycobacterium
VEPEAG

SEQ ID NO: 607016 - protein, 13 aa, Mycobacterium
VEPEALAAQLLRR

SEQ ID NO: 607017 - protein, 7 aa, Mycobacterium
VEPEEME

SEQ ID NO: 607018 - protein, 6 aa, Mycobacterium
VEPENH

SEQ ID NO: 607019 - protein, 18 aa, Mycobacterium
VEPFTGGDPIDEEDTIPR

SEQ ID NO: 607020 - protein, 5 aa, Mycobacterium
VEPGA

SEQ ID NO: 607021 - protein, 19 aa, Mycobacterium
VEPGAAITQGTVIAELKDA

SEQ ID NO: 607022 - protein, 7 aa, Mycobacterium
VEPGAGS

SEQ ID NO: 607023 - protein, 13 aa, Mycobacterium
VEPGDDVTAGQTV

SEQ ID NO: 607024 - protein, 10 aa, Mycobacterium
VEPGDFADPD

SEQ ID NO: 607025 - protein, 5 aa, Mycobacterium
VEPGE

SEQ ID NO: 607026 - protein, 6 aa, Mycobacterium
VEPGGA

SEQ ID NO: 607027 - protein, 11 aa, Mycobacterium
VEPGHESDGLP

SEQ ID NO: 607028 - protein, 14 aa, Mycobacterium
VEPGHRGDDTVDGW

SEQ ID NO: 607029 - protein, 16 aa, Mycobacterium
VEPGHRGDPTVDGHNS

SEQ ID NO: 607030 - protein, 6 aa, Mycobacterium
VEPGSA

SEQ ID NO: 607031 - protein, 10 aa, Mycobacterium
VEPGSQPGSV

SEQ ID NO: 607032 - protein, 7 aa, Mycobacterium
VEPGSRR

SEQ ID NO: 607033 - protein, 5 aa, Mycobacterium
VEPGT

SEQ ID NO: 607034 - protein, 7 aa, Mycobacterium
VEPGTRI

SEQ ID NO: 607035 - protein, 13 aa, Mycobacterium
VEPHAGGAGTGRE

SEQ ID NO: 607036 - protein, 17 aa, Mycobacterium
VEPHRDGLESGELSPYP

SEQ ID NO: 607037 - protein, 10 aa, Mycobacterium
VEPKARRNEV

SEQ ID NO: 607038 - protein, 10 aa, Mycobacterium
VEPKQGRNSI

SEQ ID NO: 607039 - protein, 4 aa, Mycobacterium
VEPL

SEQ ID NO: 607040 - protein, 18 aa, Mycobacterium
VEPLESEQTSNERSSIWR

SEQ ID NO: 607041 - protein, 12 aa, Mycobacterium
VEPLTKSSHGVP

SEQ ID NO: 607042 - protein, 14 aa, Mycobacterium
VEPNASRHRSTGIG

SEQ ID NO: 607043 - protein, 6 aa, Mycobacterium
VEPNGA

SEQ ID NO: 607044 - protein, 8 aa, Mycobacterium
VEPNGPTH

SEQ ID NO: 607045 - protein, 7 aa, Mycobacterium
VEPNNSG

SEQ ID NO: 607046 - protein, 5 aa, Mycobacterium
VEPNS

SEQ ID NO: 607047 - protein, 8 aa, Mycobacterium
VEPNSTIA

SEQ ID NO: 607048 - protein, 15 aa, Mycobacterium
VEPPAQPQGRRHVVQ

SEQ ID NO: 607049 - protein, 10 aa, Mycobacterium
VEPPATPEQG

SEQ ID NO: 607050 - protein, 8 aa, Mycobacterium
VEPPEGDP

SEQ ID NO: 607051 - protein, 13 aa, Mycobacterium
VEPPEGDPLRSWS

SEQ ID NO: 607052 - protein, 19 aa, Mycobacterium
VEPPESAPAAGGGDADARA

SEQ ID NO: 607053 - protein, 7 aa, Mycobacterium
VEPPGGC

SEQ ID NO: 607054 - protein, 10 aa, Mycobacterium
VEPPGGGGFR

SEQ ID NO: 607055 - protein, 17 aa, Mycobacterium
VEPPGGSPGRNQAPTLA

SEQ ID NO: 607056 - protein, 8 aa, Mycobacterium
VEPPHPTR

SEQ ID NO: 607057 - protein, 10 aa, Mycobacterium
VEPPNGDDTR

SEQ ID NO: 607058 - protein, 11 aa, Mycobacterium
VEPPPAAPDRP

SEQ ID NO: 607059 - protein, 9 aa, Mycobacterium
VEPPPGARQ

SEQ ID NO: 607060 - protein, 10 aa, Mycobacterium
VEPPPSGLAA

SEQ ID NO: 607061 - protein, 15 aa, Mycobacterium
VEPPPVADPETRPPI

SEQ ID NO: 607062 - protein, 10 aa, Mycobacterium
VEPPQGDDTR

SEQ ID NO: 607063 - protein, 7 aa, Mycobacterium
VEPPRRG

SEQ ID NO: 607064 - protein, 18 aa, Mycobacterium
VEPPSGSPARAAAPTLAG

SEQ ID NO: 607065 - protein, 7 aa, Mycobacterium
VEPPTAA

SEQ ID NO: 607066 - protein, 6 aa, Mycobacterium
VEPPVD

SEQ ID NO: 607067 - protein, 4 aa, Mycobacterium
VEPQ

SEQ ID NO: 607068 - protein, 13 aa, Mycobacterium
VEPQDSLLYARIL

SEQ ID NO: 607069 - protein, 15 aa, Mycobacterium
VEPQGPLPTVQTDTP

SEQ ID NO: 607070 - protein, 17 aa, Mycobacterium
VEPQKEPPEPVAPPSPI

SEQ ID NO: 607071 - protein, 8 aa, Mycobacterium
VEPQPPMR

SEQ ID NO: 607072 - protein, 4 aa, Mycobacterium
VEPR

SEQ ID NO: 607073 - protein, 5 aa, Mycobacterium
VEPRP

SEQ ID NO: 607074 - protein, 11 aa, Mycobacterium
VEPRQGRNPIQ

SEQ ID NO: 607075 - protein, 6 aa, Mycobacterium
VEPRTA

SEQ ID NO: 607076 - protein, 5 aa, Mycobacterium
VEPSA

SEQ ID NO: 607077 - protein, 9 aa, Mycobacterium
VEPSASPDR

SEQ ID NO: 607078 - protein, 12 aa, Mycobacterium
VEPSDAASTRVS

SEQ ID NO: 607079 - protein, 11 aa, Mycobacterium
VEPSDEPTGTA

SEQ ID NO: 607080 - protein, 5 aa, Mycobacterium
VEPSE

SEQ ID NO: 607081 - protein, 14 aa, Mycobacterium
VEPSGPMPAVITYL

SEQ ID NO: 607082 - protein, 9 aa, Mycobacterium
VEPSPQRQA

SEQ ID NO: 607083 - protein, 9 aa, Mycobacterium
VEPSQQAQD

SEQ ID NO: 607084 - protein, 6 aa, Mycobacterium
VEPSRK

SEQ ID NO: 607085 - protein, 20 aa, Mycobacterium
VEPSSIEQAGSQAGYPAPPL

SEQ ID NO: 607086 - protein, 7 aa, Mycobacterium
VEPSTPL

SEQ ID NO: 607087 - protein, 10 aa, Mycobacterium
VEPSTTRREW

SEQ ID NO: 607088 - protein, 11 aa, Mycobacterium
VEPSTTTPEAI

SEQ ID NO: 607089 - protein, 6 aa, Mycobacterium
VEPSVA

SEQ ID NO: 607090 - protein, 18 aa, Mycobacterium
VEPSVAKTKMPDSEVAGR

SEQ ID NO: 607091 - protein, 17 aa, Mycobacterium
VEPSVAQTKMPDSAVAG

SEQ ID NO: 607092 - protein, 4 aa, Mycobacterium
VEPT

SEQ ID NO: 607093 - protein, 5 aa, Mycobacterium
VEPTA

SEQ ID NO: 607094 - protein, 5 aa, Mycobacterium
VEPTE

SEQ ID NO: 607095 - protein, 6 aa, Mycobacterium
VEPTGC

SEQ ID NO: 607096 - protein, 7 aa, Mycobacterium
VEPTKGD

SEQ ID NO: 607097 - protein, 5 aa, Mycobacterium
VEPTP

SEQ ID NO: 607098 - protein, 7 aa, Mycobacterium
VEPTPDN

SEQ ID NO: 607099 - protein, 6 aa, Mycobacterium
VEPTPL

SEQ ID NO: 607100 - protein, 7 aa, Mycobacterium
VEPTREN

SEQ ID NO: 607101 - protein, 10 aa, Mycobacterium
VEPTSGNTGV

SEQ ID NO: 607102 - protein, 7 aa, Mycobacterium
VEPTTGA

SEQ ID NO: 607103 - protein, 8 aa, Mycobacterium
VEPVQPKR

SEQ ID NO: 607104 - protein, 4 aa, Mycobacterium
VEPW

SEQ ID NO: 607105 - protein, 12 aa, Mycobacterium
VEPYPDLGAPAY

SEQ ID NO: 607106 - protein, 4 aa, Mycobacterium
VEQA

SEQ ID NO: 607107 - protein, 10 aa, Mycobacterium
VEQAAEASGV

SEQ ID NO: 607108 - protein, 12 aa, Mycobacterium
VEQAAETATRAG

SEQ ID NO: 607109 - protein, 6 aa, Mycobacterium
VEQAGD

SEQ ID NO: 607110 - protein, 12 aa, Mycobacterium
VEQAKGSGVPDD

SEQ ID NO: 607111 - protein, 17 aa, Mycobacterium
VEQARNGGADVLVARTA

SEQ ID NO: 607112 - protein, 8 aa, Mycobacterium
VEQASTEH

SEQ ID NO: 607113 - protein, 14 aa, Mycobacterium
VEQEIEAGASGTVQ

SEQ ID NO: 607114 - protein, 13 aa, Mycobacterium
VEQEIEAGATGTV

SEQ ID NO: 607115 - protein, 8 aa, Mycobacterium
VEQEQAGK

SEQ ID NO: 607116 - protein, 12 aa, Mycobacterium
VEQGADPRADLG

SEQ ID NO: 607117 - protein, 8 aa, Mycobacterium
VEQGDADA

SEQ ID NO: 607118 - protein, 17 aa, Mycobacterium
VEQGDSEQVFGDPQHDY

SEQ ID NO: 607119 - protein, 10 aa, Mycobacterium
VEQGGYGLDP

SEQ ID NO: 607120 - protein, 5 aa, Mycobacterium
VEQGL

SEQ ID NO: 607121 - protein, 26 aa, Mycobacterium
VEQGPPKEVLDSPSHPRTASFLSKVL

SEQ ID NO: 607122 - protein, 8 aa, Mycobacterium
VEQGPSDD

SEQ ID NO: 607123 - protein, 11 aa, Mycobacterium
VEQGRSPGDDF

SEQ ID NO: 607124 - protein, 25 aa, Mycobacterium
VEQGSARDVLDSPSNPRTAAFLSAV

SEQ ID NO: 607125 - protein, 17 aa, Mycobacterium
VEQGSTDQVFTSPRDPY

SEQ ID NO: 607126 - protein, 11 aa, Mycobacterium
VEQGVKNGFSG

SEQ ID NO: 607127 - protein, 9 aa, Mycobacterium
VEQHPGKTW

SEQ ID NO: 607128 - protein, 10 aa, Mycobacterium
VEQIGTPTEI

SEQ ID NO: 607129 - protein, 11 aa, Mycobacterium
VEQIGTPTEIY

SEQ ID NO: 607130 - protein, 4 aa, Mycobacterium
VEQP

SEQ ID NO: 607131 - protein, 7 aa, Mycobacterium
VEQPARQ

SEQ ID NO: 607132 - protein, 10 aa, Mycobacterium
VEQPKSDGYR

SEQ ID NO: 607133 - protein, 17 aa, Mycobacterium
VEQPPDSEEAISTAPQR

SEQ ID NO: 607134 - protein, 6 aa, Mycobacterium
VEQQDT

SEQ ID NO: 607135 - protein, 49 aa, Mycobacterium
VEQQQGAVRPPIDDDTPGSDPGSPPLEASDGDWQEQRETVEFDPDDDRE

SEQ ID NO: 607136 - protein, 5 aa, Mycobacterium
VEQRA

SEQ ID NO: 607137 - protein, 16 aa, Mycobacterium
VEQRIKGSTGTDSGEV

SEQ ID NO: 607138 - protein, 5 aa, Mycobacterium
VEQRK

SEQ ID NO: 607139 - protein, 6 aa, Mycobacterium
VEQSGY

SEQ ID NO: 607140 - protein, 8 aa, Mycobacterium
VEQSPGES

SEQ ID NO: 607141 - protein, 5 aa, Mycobacterium
VEQTA

SEQ ID NO: 607142 - protein, 6 aa, Mycobacterium
VEQTAN

SEQ ID NO: 607143 - protein, 14 aa, Mycobacterium
VEQTPDAEAALSDE

SEQ ID NO: 607144 - protein, 12 aa, Mycobacterium
VEQTSKERGHEY

SEQ ID NO: 607145 - protein, 12 aa, Mycobacterium
VEQTSRERGHDY

SEQ ID NO: 607146 - protein, 10 aa, Mycobacterium
VEQVGAPTEI

SEQ ID NO: 607147 - protein, 4 aa, Mycobacterium
VERA

SEQ ID NO: 607148 - protein, 15 aa, Mycobacterium
VERAAATPDQPQPYR

SEQ ID NO: 607149 - protein, 9 aa, Mycobacterium
VERAAENGD

SEQ ID NO: 607150 - protein, 13 aa, Mycobacterium
VERADPGAQSPKE

SEQ ID NO: 607151 - protein, 5 aa, Mycobacterium
VERAG

SEQ ID NO: 607152 - protein, 12 aa, Mycobacterium
VERAGGDPNTLQ

SEQ ID NO: 607153 - protein, 10 aa, Mycobacterium
VERDADGKSL

SEQ ID NO: 607154 - protein, 10 aa, Mycobacterium
VERDEGTRSR

SEQ ID NO: 607155 - protein, 10 aa, Mycobacterium
VERDEGTRTR

SEQ ID NO: 607156 - protein, 7 aa, Mycobacterium
VERDGLG

SEQ ID NO: 607157 - protein, 11 aa, Mycobacterium
VERDGTTQRVG

SEQ ID NO: 607158 - protein, 5 aa, Mycobacterium
VERDT

SEQ ID NO: 607159 - protein, 5 aa, Mycobacterium
VERED

SEQ ID NO: 607160 - protein, 8 aa, Mycobacterium
VERENGEL

SEQ ID NO: 607161 - protein, 6 aa, Mycobacterium
VERESG

SEQ ID NO: 607162 - protein, 4 aa, Mycobacterium
VERG

SEQ ID NO: 607163 - protein, 16 aa, Mycobacterium
VERGANDSDWDPVKAA

SEQ ID NO: 607164 - protein, 16 aa, Mycobacterium
VERGAQDSDWDPVKAA

SEQ ID NO: 607165 - protein, 12 aa, Mycobacterium
VERGDAPAADSA

SEQ ID NO: 607166 - protein, 6 aa, Mycobacterium
VERGDE

SEQ ID NO: 607167 - protein, 17 aa, Mycobacterium
VERGDERLGQGGVPADR

SEQ ID NO: 607168 - protein, 12 aa, Mycobacterium
VERGDNESGGEG

SEQ ID NO: 607169 - protein, 13 aa, Mycobacterium
VERGEVRESVDPD

SEQ ID NO: 607170 - protein, 6 aa, Mycobacterium
VERGPG

SEQ ID NO: 607171 - protein, 19 aa, Mycobacterium
VERGRRAGQDLGADPAGAV

SEQ ID NO: 607172 - protein, 8 aa, Mycobacterium
VERGTPGE

SEQ ID NO: 607173 - protein, 7 aa, Mycobacterium
VERGVQE

SEQ ID NO: 607174 - protein, 5 aa, Mycobacterium
VERNA

SEQ ID NO: 607175 - protein, 7 aa, Mycobacterium
VERNEDG

SEQ ID NO: 607176 - protein, 7 aa, Mycobacterium
VERPAAG

SEQ ID NO: 607177 - protein, 9 aa, Mycobacterium
VERPAENGD

SEQ ID NO: 607178 - protein, 8 aa, Mycobacterium
VERPDGTQ

SEQ ID NO: 607179 - protein, 6 aa, Mycobacterium
VERPEC

SEQ ID NO: 607180 - protein, 6 aa, Mycobacterium
VERPES

SEQ ID NO: 607181 - protein, 12 aa, Mycobacterium
VERPPDGRETAT

SEQ ID NO: 607182 - protein, 6 aa, Mycobacterium
VERPPE

SEQ ID NO: 607183 - protein, 13 aa, Mycobacterium
VERPRNPEHGDYA

SEQ ID NO: 607184 - protein, 8 aa, Mycobacterium
VERPSGAT

SEQ ID NO: 607185 - protein, 14 aa, Mycobacterium
VERQTRSVAAAGGR

SEQ ID NO: 607186 - protein, 10 aa, Mycobacterium
VERRAGKKKL

SEQ ID NO: 607187 - protein, 11 aa, Mycobacterium
VERRAPESATA

SEQ ID NO: 607188 - protein, 30 aa, Mycobacterium
VERRDGPFGDYSQAPPELRPDPSHVIVPDR

SEQ ID NO: 607189 - protein, 7 aa, Mycobacterium
VERRDKG

SEQ ID NO: 607190 - protein, 24 aa, Mycobacterium
VERRDPVSDDGPRQRRDRDLARTN

SEQ ID NO: 607191 - protein, 8 aa, Mycobacterium
VERRGRTT

SEQ ID NO: 607192 - protein, 8 aa, Mycobacterium
VERRPDSE

SEQ ID NO: 607193 - protein, 11 aa, Mycobacterium
VERRTDELTTQ

SEQ ID NO: 607194 - protein, 5 aa, Mycobacterium
VERSD

SEQ ID NO: 607195 - protein, 15 aa, Mycobacterium
VERSGNELTLVVAAG

SEQ ID NO: 607196 - protein, 20 aa, Mycobacterium
VERSPPRRRRARLPVPGRVA

SEQ ID NO: 607197 - protein, 9 aa, Mycobacterium
VERSPSQSL

SEQ ID NO: 607198 - protein, 22 aa, Mycobacterium
VERSTGRSRSLSRGGRDVGGLE

SEQ ID NO: 607199 - protein, 10 aa, Mycobacterium
VERTATAEAV

SEQ ID NO: 607200 - protein, 5 aa, Mycobacterium
VERTG

SEQ ID NO: 607201 - protein, 7 aa, Mycobacterium
VERTRAA

SEQ ID NO: 607202 - protein, 11 aa, Mycobacterium
VERTRKALADQ

SEQ ID NO: 607203 - protein, 12 aa, Mycobacterium
VERTSKERGHDY

SEQ ID NO: 607204 - protein, 13 aa, Mycobacterium
VERTSKERGNDYT

SEQ ID NO: 607205 - protein, 11 aa, Mycobacterium
VERTTKALAEQ

SEQ ID NO: 607206 - protein, 8 aa, Mycobacterium
VERTTQAL

SEQ ID NO: 607207 - protein, 6 aa, Mycobacterium
VERVPE

SEQ ID NO: 607208 - protein, 4 aa, Mycobacterium
VESA

SEQ ID NO: 607209 - protein, 5 aa, Mycobacterium
VESAA

SEQ ID NO: 607210 - protein, 5 aa, Mycobacterium
VESAG

SEQ ID NO: 607211 - protein, 8 aa, Mycobacterium
VESAGELS

SEQ ID NO: 607212 - protein, 6 aa, Mycobacterium
VESAGL

SEQ ID NO: 607213 - protein, 7 aa, Mycobacterium
VESAGRG

SEQ ID NO: 607214 - protein, 9 aa, Mycobacterium
VESAGTTAI

SEQ ID NO: 607215 - protein, 17 aa, Mycobacterium
VESAPAPVVEENASAAT

SEQ ID NO: 607216 - protein, 25 aa, Mycobacterium
VESAPYPLATPADLDETAREIKARG

SEQ ID NO: 607217 - protein, 5 aa, Mycobacterium
VESAR

SEQ ID NO: 607218 - protein, 9 aa, Mycobacterium
VESARERLA

SEQ ID NO: 607219 - protein, 14 aa, Mycobacterium
VESARSGSAADEFD

SEQ ID NO: 607220 - protein, 7 aa, Mycobacterium
VESATQV

SEQ ID NO: 607221 - protein, 11 aa, Mycobacterium
VESAVAGKGAF

SEQ ID NO: 607222 - protein, 6 aa, Mycobacterium
VESDDE

SEQ ID NO: 607223 - protein, 49 aa, Mycobacterium
VESDEVGLANAGSTVLSSTPKPPKTAGEKVTDEGEGGNQVAQYLVAQKI

SEQ ID NO: 607224 - protein, 9 aa, Mycobacterium
VESDGRNRY

SEQ ID NO: 607225 - protein, 8 aa, Mycobacterium
VESDGRTL

SEQ ID NO: 607226 - protein, 6 aa, Mycobacterium
VESEGR

SEQ ID NO: 607227 - protein, 9 aa, Mycobacterium
VESEMTDEE

SEQ ID NO: 607228 - protein, 22 aa, Mycobacterium
VESERLPRGADPNTHTKLGRGG

SEQ ID NO: 607229 - protein, 7 aa, Mycobacterium
VESERRG

SEQ ID NO: 607230 - protein, 15 aa, Mycobacterium
VESESPLPEAVSPTA

SEQ ID NO: 607231 - protein, 20 aa, Mycobacterium
VESFGEQAPYNRAAQPDEIA

SEQ ID NO: 607232 - protein, 6 aa, Mycobacterium
VESGAA

SEQ ID NO: 607233 - protein, 11 aa, Mycobacterium
VESGDKEKAGE

SEQ ID NO: 607234 - protein, 7 aa, Mycobacterium
VESGDQV

SEQ ID NO: 607235 - protein, 17 aa, Mycobacterium
VESGEGGLTPLTGPEKT

SEQ ID NO: 607236 - protein, 8 aa, Mycobacterium
VESGEPDQ

SEQ ID NO: 607237 - protein, 11 aa, Mycobacterium
VESGEPVRNDK

SEQ ID NO: 607238 - protein, 8 aa, Mycobacterium
VESGERPV

SEQ ID NO: 607239 - protein, 7 aa, Mycobacterium
VESGGAP

SEQ ID NO: 607240 - protein, 7 aa, Mycobacterium
VESGKMT

SEQ ID NO: 607241 - protein, 7 aa, Mycobacterium
VESGNRQ

SEQ ID NO: 607242 - protein, 8 aa, Mycobacterium
VESGPPEQ

SEQ ID NO: 607243 - protein, 8 aa, Mycobacterium
VESGQGGL

SEQ ID NO: 607244 - protein, 5 aa, Mycobacterium
VESGR

SEQ ID NO: 607245 - protein, 6 aa, Mycobacterium
VESGRI

SEQ ID NO: 607246 - protein, 7 aa, Mycobacterium
VESGRVD

SEQ ID NO: 607247 - protein, 5 aa, Mycobacterium
VESGS

SEQ ID NO: 607248 - protein, 18 aa, Mycobacterium
VESGSQVVNSTKGKKERL

SEQ ID NO: 607249 - protein, 10 aa, Mycobacterium
VESGTGEGKI

SEQ ID NO: 607250 - protein, 12 aa, Mycobacterium
VESITDSGSQVT

SEQ ID NO: 607251 - protein, 21 aa, Mycobacterium
VESKTDPTKAVEPKADPTKVV

SEQ ID NO: 607252 - protein, 6 aa, Mycobacterium
VESLGE

SEQ ID NO: 607253 - protein, 38 aa, Mycobacterium
VESNATPAAHQSAPTTKEDPVKKSRAATKRCPTRHPLT

SEQ ID NO: 607254 - protein, 8 aa, Mycobacterium
VESNPKDY

SEQ ID NO: 607255 - protein, 5 aa, Mycobacterium
VESPA

SEQ ID NO: 607256 - protein, 8 aa, Mycobacterium
VESPADVA

SEQ ID NO: 607257 - protein, 7 aa, Mycobacterium
VESPAET

SEQ ID NO: 607258 - protein, 6 aa, Mycobacterium
VESPDA

SEQ ID NO: 607259 - protein, 6 aa, Mycobacterium
VESPDG

SEQ ID NO: 607260 - protein, 22 aa, Mycobacterium
VESPDRRPGGREEHLDRMWRRT

SEQ ID NO: 607261 - protein, 16 aa, Mycobacterium
VESPEDTAKLLTSVVS

SEQ ID NO: 607262 - protein, 6 aa, Mycobacterium
VESPGT

SEQ ID NO: 607263 - protein, 28 aa, Mycobacterium
VESPPVVEAPEAAPAETLKTTSSASRRV

SEQ ID NO: 607264 - protein, 16 aa, Mycobacterium
VESPSELSDLSDEDAG

SEQ ID NO: 607265 - protein, 6 aa, Mycobacterium
VESPSG

SEQ ID NO: 607266 - protein, 9 aa, Mycobacterium
VESPTRADA

SEQ ID NO: 607267 - protein, 9 aa, Mycobacterium
VESPTRANA

SEQ ID NO: 607268 - protein, 5 aa, Mycobacterium
VESPV

SEQ ID NO: 607269 - protein, 9 aa, Mycobacterium
VESQDFSKV

SEQ ID NO: 607270 - protein, 10 aa, Mycobacterium
VESQNTDLPV

SEQ ID NO: 607271 - protein, 10 aa, Mycobacterium
VESQRAEVAG

SEQ ID NO: 607272 - protein, 12 aa, Mycobacterium
VESQRGDSGGPV

SEQ ID NO: 607273 - protein, 10 aa, Mycobacterium
VESRAESEEF

SEQ ID NO: 607274 - protein, 11 aa, Mycobacterium
VESRPRAGTTV

SEQ ID NO: 607275 - protein, 7 aa, Mycobacterium
VESRSGL

SEQ ID NO: 607276 - protein, 4 aa, Mycobacterium
VESS

SEQ ID NO: 607277 - protein, 20 aa, Mycobacterium
VESSDTRPNTRIRGFDGPSV

SEQ ID NO: 607278 - protein, 11 aa, Mycobacterium
VESSGGSPFPT

SEQ ID NO: 607279 - protein, 8 aa, Mycobacterium
VESSGRGT

SEQ ID NO: 607280 - protein, 5 aa, Mycobacterium
VESST

SEQ ID NO: 607281 - protein, 8 aa, Mycobacterium
VESTGSAL

SEQ ID NO: 607282 - protein, 8 aa, Mycobacterium
VESTPATA

SEQ ID NO: 607283 - protein, 8 aa, Mycobacterium
VESTPETA

SEQ ID NO: 607284 - protein, 10 aa, Mycobacterium
VESTPTLPLP

SEQ ID NO: 607285 - protein, 8 aa, Mycobacterium
VESTRDPK

SEQ ID NO: 607286 - protein, 6 aa, Mycobacterium
VESTRR

SEQ ID NO: 607287 - protein, 9 aa, Mycobacterium
VESTSGGHR

SEQ ID NO: 607288 - protein, 9 aa, Mycobacterium
VESTSPDFA

SEQ ID NO: 607289 - protein, 14 aa, Mycobacterium
VESTTDEDSRPRVN

SEQ ID NO: 607290 - protein, 9 aa, Mycobacterium
VESTTTKGA

SEQ ID NO: 607291 - protein, 4 aa, Mycobacterium
VESV

SEQ ID NO: 607292 - protein, 16 aa, Mycobacterium
VESVPSTERKGQRTRR

SEQ ID NO: 607293 - protein, 21 aa, Mycobacterium
VESYAGTDAPWPTHSRQAADP

SEQ ID NO: 607294 - protein, 8 aa, Mycobacterium
VESYEGGY

SEQ ID NO: 607295 - protein, 12 aa, Mycobacterium
VETADLRESSRA

SEQ ID NO: 607296 - protein, 11 aa, Mycobacterium
VETAGRRGTRV

SEQ ID NO: 607297 - protein, 23 aa, Mycobacterium
VETATPRSSASSALASLADSAGR

SEQ ID NO: 607298 - protein, 9 aa, Mycobacterium
VETAVSGRT

SEQ ID NO: 607299 - protein, 30 aa, Mycobacterium
VETDPIDSNSPIAGVADGGQIAGEGVKVES

SEQ ID NO: 607300 - protein, 5 aa, Mycobacterium
VETDR

SEQ ID NO: 607301 - protein, 13 aa, Mycobacterium
VETDTDRSDYPHA

SEQ ID NO: 607302 - protein, 7 aa, Mycobacterium
VETEDDS

SEQ ID NO: 607303 - protein, 13 aa, Mycobacterium
VETEISGSGNGPL

SEQ ID NO: 607304 - protein, 13 aa, Mycobacterium
VETELRNKGTGVA

SEQ ID NO: 607305 - protein, 12 aa, Mycobacterium
VETEPGSGDRYG

SEQ ID NO: 607306 - protein, 15 aa, Mycobacterium
VETERAEGPATEAGW

SEQ ID NO: 607307 - protein, 9 aa, Mycobacterium
VETETGGQT

SEQ ID NO: 607308 - protein, 13 aa, Mycobacterium
VETEVTGTGNGPL

SEQ ID NO: 607309 - protein, 11 aa, Mycobacterium
VETGADSGVTP

SEQ ID NO: 607310 - protein, 11 aa, Mycobacterium
VETGASSTAVP

SEQ ID NO: 607311 - protein, 6 aa, Mycobacterium
VETGDP

SEQ ID NO: 607312 - protein, 11 aa, Mycobacterium
VETGGKSKRIG

SEQ ID NO: 607313 - protein, 6 aa, Mycobacterium
VETGGP

SEQ ID NO: 607314 - protein, 8 aa, Mycobacterium
VETGPPEQ

SEQ ID NO: 607315 - protein, 6 aa, Mycobacterium
VETGPQ

SEQ ID NO: 607316 - protein, 6 aa, Mycobacterium
VETGPR

SEQ ID NO: 607317 - protein, 7 aa, Mycobacterium
VETGPRT

SEQ ID NO: 607318 - protein, 7 aa, Mycobacterium
VETGQQV

SEQ ID NO: 607319 - protein, 10 aa, Mycobacterium
VETGRLPSAE

SEQ ID NO: 607320 - protein, 10 aa, Mycobacterium
VETGSDPNKI

SEQ ID NO: 607321 - protein, 10 aa, Mycobacterium
VETGTGASKI

SEQ ID NO: 607322 - protein, 6 aa, Mycobacterium
VETHGS

SEQ ID NO: 607323 - protein, 7 aa, Mycobacterium
VETKPAS

SEQ ID NO: 607324 - protein, 7 aa, Mycobacterium
VETKPEH

SEQ ID NO: 607325 - protein, 4 aa, Mycobacterium
VETM

SEQ ID NO: 607326 - protein, 12 aa, Mycobacterium
VETNGKGCSGGV

SEQ ID NO: 607327 - protein, 9 aa, Mycobacterium
VETNSKGCV

SEQ ID NO: 607328 - protein, 9 aa, Mycobacterium
VETPAAPDI

SEQ ID NO: 607329 - protein, 10 aa, Mycobacterium
VETPARNLPP

SEQ ID NO: 607330 - protein, 10 aa, Mycobacterium
VETPDAPAKD

SEQ ID NO: 607331 - protein, 11 aa, Mycobacterium
VETPDAPSRDM

SEQ ID NO: 607332 - protein, 11 aa, Mycobacterium
VETPDAPTKDM

SEQ ID NO: 607333 - protein, 6 aa, Mycobacterium
VETPDD

SEQ ID NO: 607334 - protein, 13 aa, Mycobacterium
VETPDTGALEPGH

SEQ ID NO: 607335 - protein, 6 aa, Mycobacterium
VETPEA

SEQ ID NO: 607336 - protein, 20 aa, Mycobacterium
VETPKQVNELSSTMAGAGGT

SEQ ID NO: 607337 - protein, 10 aa, Mycobacterium
VETPPPDRGQ

SEQ ID NO: 607338 - protein, 11 aa, Mycobacterium
VETPPSRNPLQ

SEQ ID NO: 607339 - protein, 17 aa, Mycobacterium
VETPTPLSPAGTALGSL

SEQ ID NO: 607340 - protein, 22 aa, Mycobacterium
VETPTPLSSAGPALASLSESAA

SEQ ID NO: 607341 - protein, 13 aa, Mycobacterium
VETPYGPPSAPIT

SEQ ID NO: 607342 - protein, 5 aa, Mycobacterium
VETRT

SEQ ID NO: 607343 - protein, 6 aa, Mycobacterium
VETSDR

SEQ ID NO: 607344 - protein, 6 aa, Mycobacterium
VETSGG

SEQ ID NO: 607345 - protein, 8 aa, Mycobacterium
VETSPAGG

SEQ ID NO: 607346 - protein, 8 aa, Mycobacterium
VETSPGGG

SEQ ID NO: 607347 - protein, 5 aa, Mycobacterium
VETSR

SEQ ID NO: 607348 - protein, 12 aa, Mycobacterium
VETSRKMRRAER

SEQ ID NO: 607349 - protein, 4 aa, Mycobacterium
VETT

SEQ ID NO: 607350 - protein, 8 aa, Mycobacterium
VETTAGAM

SEQ ID NO: 607351 - protein, 8 aa, Mycobacterium
VETTAGDM

SEQ ID NO: 607352 - protein, 8 aa, Mycobacterium
VETTAGEM

SEQ ID NO: 607353 - protein, 6 aa, Mycobacterium
VETTES

SEQ ID NO: 607354 - protein, 9 aa, Mycobacterium
VETTGADVD

SEQ ID NO: 607355 - protein, 11 aa, Mycobacterium
VETTGEGDLTP

SEQ ID NO: 607356 - protein, 12 aa, Mycobacterium
VETTKPAPADLQ

SEQ ID NO: 607357 - protein, 9 aa, Mycobacterium
VETTPLTRQ

SEQ ID NO: 607358 - protein, 11 aa, Mycobacterium
VETTQRAELQR

SEQ ID NO: 607359 - protein, 7 aa, Mycobacterium
VETTSSV

SEQ ID NO: 607360 - protein, 7 aa, Mycobacterium
VETVTGE

SEQ ID NO: 607361 - protein, 10 aa, Mycobacterium
VEVADDGRGI

SEQ ID NO: 607362 - protein, 9 aa, Mycobacterium
VEVAPGEEG

SEQ ID NO: 607363 - protein, 10 aa, Mycobacterium
VEVDDERVSR

SEQ ID NO: 607364 - protein, 6 aa, Mycobacterium
VEVDDS

SEQ ID NO: 607365 - protein, 16 aa, Mycobacterium
VEVDEAGTWREGGETW

SEQ ID NO: 607366 - protein, 10 aa, Mycobacterium
VEVEGDPDCQ

SEQ ID NO: 607367 - protein, 11 aa, Mycobacterium
VEVGDGKPARM

SEQ ID NO: 607368 - protein, 9 aa, Mycobacterium
VEVGSSSDL

SEQ ID NO: 607369 - protein, 6 aa, Mycobacterium
VEVPEG

SEQ ID NO: 607370 - protein, 18 aa, Mycobacterium
VEVPPDPGLPAALSPETG

SEQ ID NO: 607371 - protein, 11 aa, Mycobacterium
VEVRSPDSACN

SEQ ID NO: 607372 - protein, 37 aa, Mycobacterium
VEWPGAANDPRRRANQAPVAKETQADDDVDGQLGFTF

SEQ ID NO: 607373 - protein, 15 aa, Mycobacterium
VEYAEGDKAEVSDRK

SEQ ID NO: 607374 - protein, 6 aa, Mycobacterium
VEYEQD

SEQ ID NO: 607375 - protein, 13 aa, Mycobacterium
VFEPPGADLSGEE

SEQ ID NO: 607376 - protein, 10 aa, Mycobacterium
VFGGGKTMRE

SEQ ID NO: 607377 - protein, 6 aa, Mycobacterium
VFGTKE

SEQ ID NO: 607378 - protein, 6 aa, Mycobacterium
VFPDPN

SEQ ID NO: 607379 - protein, 10 aa, Mycobacterium
VFPDPQRFDP

SEQ ID NO: 607380 - protein, 5 aa, Mycobacterium
VFPPG

SEQ ID NO: 607381 - protein, 11 aa, Mycobacterium
VFPPPGAIKES

SEQ ID NO: 607382 - protein, 7 aa, Mycobacterium
VFTGPGR

SEQ ID NO: 607383 - protein, 5 aa, Mycobacterium
VGAAA

SEQ ID NO: 607384 - protein, 27 aa, Mycobacterium
VGAAAEAVGAPVPSDAAPSPANADTAV

SEQ ID NO: 607385 - protein, 9 aa, Mycobacterium
VGAAAGALA

SEQ ID NO: 607386 - protein, 9 aa, Mycobacterium
VGAAARTGA

SEQ ID NO: 607387 - protein, 22 aa, Mycobacterium
VGAADPERRDARSLHSARRPGL

SEQ ID NO: 607388 - protein, 17 aa, Mycobacterium
VGAAEAPDYRPAPLPSW

SEQ ID NO: 607389 - protein, 11 aa, Mycobacterium
VGAAEDAQRQH

SEQ ID NO: 607390 - protein, 8 aa, Mycobacterium
VGAAGDED

SEQ ID NO: 607391 - protein, 11 aa, Mycobacterium
VGAAGSPTMTP

SEQ ID NO: 607392 - protein, 5 aa, Mycobacterium
VGAAP

SEQ ID NO: 607393 - protein, 6 aa, Mycobacterium
VGAAPG

SEQ ID NO: 607394 - protein, 13 aa, Mycobacterium
VGAAPGERVQDGA

SEQ ID NO: 607395 - protein, 13 aa, Mycobacterium
VGAARDAIARAGD

SEQ ID NO: 607396 - protein, 8 aa, Mycobacterium
VGAARKAT

SEQ ID NO: 607397 - protein, 14 aa, Mycobacterium
VGAARKGARPPAGL

SEQ ID NO: 607398 - protein, 16 aa, Mycobacterium
VGAASEIGATTVPSES

SEQ ID NO: 607399 - protein, 16 aa, Mycobacterium
VGAASGARWMVVALHI

SEQ ID NO: 607400 - protein, 9 aa, Mycobacterium
VGAASSAAR

SEQ ID NO: 607401 - protein, 18 aa, Mycobacterium
VGAATGGLDAYGAEPADN

SEQ ID NO: 607402 - protein, 11 aa, Mycobacterium
VGAATGRAAAA

SEQ ID NO: 607403 - protein, 7 aa, Mycobacterium
VGADADA

SEQ ID NO: 607404 - protein, 10 aa, Mycobacterium
VGADADAKAM

SEQ ID NO: 607405 - protein, 8 aa, Mycobacterium
VGADARDG

SEQ ID NO: 607406 - protein, 8 aa, Mycobacterium
VGADARDS

SEQ ID NO: 607407 - protein, 8 aa, Mycobacterium
VGADDPAS

SEQ ID NO: 607408 - protein, 6 aa, Mycobacterium
VGADGA

SEQ ID NO: 607409 - protein, 11 aa, Mycobacterium
VGADGAGSTIA

SEQ ID NO: 607410 - protein, 8 aa, Mycobacterium
VGADGDIA

SEQ ID NO: 607411 - protein, 9 aa, Mycobacterium
VGADGDIAG

SEQ ID NO: 607412 - protein, 8 aa, Mycobacterium
VGADGDIS

SEQ ID NO: 607413 - protein, 9 aa, Mycobacterium
VGADGDISG

SEQ ID NO: 607414 - protein, 8 aa, Mycobacterium
VGADGDSA

SEQ ID NO: 607415 - protein, 9 aa, Mycobacterium
VGADGDVAG

SEQ ID NO: 607416 - protein, 19 aa, Mycobacterium
VGADGGLEPHLSARLSRFA

SEQ ID NO: 607417 - protein, 9 aa, Mycobacterium
VGADGGRSL

SEQ ID NO: 607418 - protein, 7 aa, Mycobacterium
VGADGGV

SEQ ID NO: 607419 - protein, 7 aa, Mycobacterium
VGADGQP

SEQ ID NO: 607420 - protein, 10 aa, Mycobacterium
VGADGSAVNV

SEQ ID NO: 607421 - protein, 6 aa, Mycobacterium
VGADGV

SEQ ID NO: 607422 - protein, 5 aa, Mycobacterium
VGADN

SEQ ID NO: 607423 - protein, 10 aa, Mycobacterium
VGADPATQTM

SEQ ID NO: 607424 - protein, 7 aa, Mycobacterium
VGADPGK

SEQ ID NO: 607425 - protein, 6 aa, Mycobacterium
VGADPL

SEQ ID NO: 607426 - protein, 18 aa, Mycobacterium
VGADPRPLPYGADYDDAR

SEQ ID NO: 607427 - protein, 9 aa, Mycobacterium
VGADPSTAE

SEQ ID NO: 607428 - protein, 25 aa, Mycobacterium
VGADRGNRVTGADAHVTGSTHEGAV

SEQ ID NO: 607429 - protein, 7 aa, Mycobacterium
VGAEDAQ

SEQ ID NO: 607430 - protein, 7 aa, Mycobacterium
VGAEDGR

SEQ ID NO: 607431 - protein, 11 aa, Mycobacterium
VGAEGDPDAAN

SEQ ID NO: 607432 - protein, 13 aa, Mycobacterium
VGAEGIASGPGTG

SEQ ID NO: 607433 - protein, 6 aa, Mycobacterium
VGAEKA

SEQ ID NO: 607434 - protein, 16 aa, Mycobacterium
VGAEPAADHSAPTEQA

SEQ ID NO: 607435 - protein, 7 aa, Mycobacterium
VGAEPDE

SEQ ID NO: 607436 - protein, 6 aa, Mycobacterium
VGAERD

SEQ ID NO: 607437 - protein, 5 aa, Mycobacterium
VGAES

SEQ ID NO: 607438 - protein, 7 aa, Mycobacterium
VGAESEV

SEQ ID NO: 607439 - protein, 12 aa, Mycobacterium
VGAESSKHASHG

SEQ ID NO: 607440 - protein, 12 aa, Mycobacterium
VGAESSKRASHG

SEQ ID NO: 607441 - protein, 14 aa, Mycobacterium
VGAEVSAEDAKPLA

SEQ ID NO: 607442 - protein, 13 aa, Mycobacterium
VGAGATGRSTGIV

SEQ ID NO: 607443 - protein, 10 aa, Mycobacterium
VGAGDRAPQI

SEQ ID NO: 607444 - protein, 8 aa, Mycobacterium
VGAGDTYT

SEQ ID NO: 607445 - protein, 8 aa, Mycobacterium
VGAGEGNA

SEQ ID NO: 607446 - protein, 20 aa, Mycobacterium
VGAGEPERTDAGDAGAPVAL

SEQ ID NO: 607447 - protein, 7 aa, Mycobacterium
VGAGGHA

SEQ ID NO: 607448 - protein, 11 aa, Mycobacterium
VGAGGKTSRKF

SEQ ID NO: 607449 - protein, 12 aa, Mycobacterium
VGAGGLDDDTAR

SEQ ID NO: 607450 - protein, 99 aa, Mycobacterium
VGAGGSGGAGGTGGRGGDGGDGGQAGRGGAGGLAGRSGADGEAGDAGTGGRGGAGGSGGKGGISGTGTPGGAGQSGQSATGRSGGAGGEGGAGGAGGTD

SEQ ID NO: 607451 - protein, 12 aa, Mycobacterium
VGAGKGNTSSTF

SEQ ID NO: 607452 - protein, 7 aa, Mycobacterium
VGAGKSL

SEQ ID NO: 607453 - protein, 11 aa, Mycobacterium
VGAGNSGDGNL

SEQ ID NO: 607454 - protein, 9 aa, Mycobacterium
VGAGNSGLD

SEQ ID NO: 607455 - protein, 5 aa, Mycobacterium
VGAGP

SEQ ID NO: 607456 - protein, 6 aa, Mycobacterium
VGAGPL

SEQ ID NO: 607457 - protein, 8 aa, Mycobacterium
VGAGPLDT

SEQ ID NO: 607458 - protein, 16 aa, Mycobacterium
VGAGRAADSSESRDRV

SEQ ID NO: 607459 - protein, 13 aa, Mycobacterium
VGAGRDDPKIRGE

SEQ ID NO: 607460 - protein, 11 aa, Mycobacterium
VGAGRPRDPRI

SEQ ID NO: 607461 - protein, 6 aa, Mycobacterium
VGAGRS

SEQ ID NO: 607462 - protein, 16 aa, Mycobacterium
VGAGSGEDAIADAGYP

SEQ ID NO: 607463 - protein, 6 aa, Mycobacterium
VGAGTG

SEQ ID NO: 607464 - protein, 7 aa, Mycobacterium
VGAGVDP

SEQ ID NO: 607465 - protein, 9 aa, Mycobacterium
VGAGYGPGH

SEQ ID NO: 607466 - protein, 20 aa, Mycobacterium
VGAKQGSDTVKGGVTQLPES

SEQ ID NO: 607467 - protein, 5 aa, Mycobacterium
VGAKS

SEQ ID NO: 607468 - protein, 16 aa, Mycobacterium
VGAKSKSALLRELDGV

SEQ ID NO: 607469 - protein, 21 aa, Mycobacterium
VGAMSSGQCPDDPRTKGQRLS

SEQ ID NO: 607470 - protein, 10 aa, Mycobacterium
VGANPDPRAL

SEQ ID NO: 607471 - protein, 14 aa, Mycobacterium
VGANPENPHSEGHG

SEQ ID NO: 607472 - protein, 16 aa, Mycobacterium
VGAPAPPLADADAELG

SEQ ID NO: 607473 - protein, 8 aa, Mycobacterium
VGAPDALK

SEQ ID NO: 607474 - protein, 10 aa, Mycobacterium
VGAPDGPVGA

SEQ ID NO: 607475 - protein, 6 aa, Mycobacterium
VGAPEE

SEQ ID NO: 607476 - protein, 8 aa, Mycobacterium
VGAPESKD

SEQ ID NO: 607477 - protein, 10 aa, Mycobacterium
VGAPESRSLA

SEQ ID NO: 607478 - protein, 15 aa, Mycobacterium
VGAPGARDVDLSGEE

SEQ ID NO: 607479 - protein, 20 aa, Mycobacterium
VGAPGPVTTGAPGAAGAADT

SEQ ID NO: 607480 - protein, 13 aa, Mycobacterium
VGAPGSGNPGFTT

SEQ ID NO: 607481 - protein, 5 aa, Mycobacterium
VGAPP

SEQ ID NO: 607482 - protein, 7 aa, Mycobacterium
VGAPPAV

SEQ ID NO: 607483 - protein, 17 aa, Mycobacterium
VGAPPEPANPAEPLGCA

SEQ ID NO: 607484 - protein, 17 aa, Mycobacterium
VGAPRARVSARPSPACH

SEQ ID NO: 607485 - protein, 14 aa, Mycobacterium
VGAPREGYPAGTSW

SEQ ID NO: 607486 - protein, 28 aa, Mycobacterium
VGAPRNPVADGAPTGTTGRPTAKPGAIP

SEQ ID NO: 607487 - protein, 7 aa, Mycobacterium
VGAPSGV

SEQ ID NO: 607488 - protein, 8 aa, Mycobacterium
VGAPTPGV

SEQ ID NO: 607489 - protein, 6 aa, Mycobacterium
VGAPVP

SEQ ID NO: 607490 - protein, 12 aa, Mycobacterium
VGAQGGARSARD

SEQ ID NO: 607491 - protein, 11 aa, Mycobacterium
VGAQGRTNTSH

SEQ ID NO: 607492 - protein, 6 aa, Mycobacterium
VGAQPG

SEQ ID NO: 607493 - protein, 8 aa, Mycobacterium
VGARAANR

SEQ ID NO: 607494 - protein, 11 aa, Mycobacterium
VGARPADPQVR

SEQ ID NO: 607495 - protein, 8 aa, Mycobacterium
VGARPPRI

SEQ ID NO: 607496 - protein, 10 aa, Mycobacterium
VGARPRSHGR

SEQ ID NO: 607497 - protein, 10 aa, Mycobacterium
VGARQAADAG

SEQ ID NO: 607498 - protein, 7 aa, Mycobacterium
VGARSKR

SEQ ID NO: 607499 - protein, 15 aa, Mycobacterium
VGARSPAAGRAASVA

SEQ ID NO: 607500 - protein, 7 aa, Mycobacterium
VGASAGG

SEQ ID NO: 607501 - protein, 24 aa, Mycobacterium
VGASAGSGILGSGKDLASGDSVYT

SEQ ID NO: 607502 - protein, 5 aa, Mycobacterium
VGASE

SEQ ID NO: 607503 - protein, 5 aa, Mycobacterium
VGASG

SEQ ID NO: 607504 - protein, 10 aa, Mycobacterium
VGASGAAPIP

SEQ ID NO: 607505 - protein, 18 aa, Mycobacterium
VGASGEADAVPPRLTQPS

SEQ ID NO: 607506 - protein, 11 aa, Mycobacterium
VGASGRPDTVD

SEQ ID NO: 607507 - protein, 11 aa, Mycobacterium
VGASGTTGATR

SEQ ID NO: 607508 - protein, 13 aa, Mycobacterium
VGASKMSGSNIGE

SEQ ID NO: 607509 - protein, 5 aa, Mycobacterium
VGASN

SEQ ID NO: 607510 - protein, 6 aa, Mycobacterium
VGASPG

SEQ ID NO: 607511 - protein, 5 aa, Mycobacterium
VGASR

SEQ ID NO: 607512 - protein, 10 aa, Mycobacterium
VGASRGKGGT

SEQ ID NO: 607513 - protein, 14 aa, Mycobacterium
VGASRRFSATTRDT

SEQ ID NO: 607514 - protein, 88 aa, Mycobacterium
VGASSPVPQADPAAAASGASSAPAAPTTSFASGGAAAGPGVRSSAPVAGTRSGRTPTTPAADKSAGKAPVHARSTADGDFAGTAETMD

SEQ ID NO: 607515 - protein, 7 aa, Mycobacterium
VGASSRD

SEQ ID NO: 607516 - protein, 6 aa, Mycobacterium
VGASTD

SEQ ID NO: 607517 - protein, 14 aa, Mycobacterium
VGASTEGEYPKTID

SEQ ID NO: 607518 - protein, 7 aa, Mycobacterium
VGASTFG

SEQ ID NO: 607519 - protein, 8 aa, Mycobacterium
VGASTGTN

SEQ ID NO: 607520 - protein, 12 aa, Mycobacterium
VGATEGATNRAI

SEQ ID NO: 607521 - protein, 8 aa, Mycobacterium
VGATERHG

SEQ ID NO: 607522 - protein, 5 aa, Mycobacterium
VGATG

SEQ ID NO: 607523 - protein, 10 aa, Mycobacterium
VGATGSAEQL

SEQ ID NO: 607524 - protein, 8 aa, Mycobacterium
VGATPSRL

SEQ ID NO: 607525 - protein, 10 aa, Mycobacterium
VGATSADEAA

SEQ ID NO: 607526 - protein, 11 aa, Mycobacterium
VGATSTDEEAA

SEQ ID NO: 607527 - protein, 12 aa, Mycobacterium
VGATTPDDTSGR

SEQ ID NO: 607528 - protein, 4 aa, Mycobacterium
VGAY

SEQ ID NO: 607529 - protein, 19 aa, Mycobacterium
VGAYGPSGKHTGTSSADRR

SEQ ID NO: 607530 - protein, 4 aa, Mycobacterium
VGDA

SEQ ID NO: 607531 - protein, 5 aa, Mycobacterium
VGDAD

SEQ ID NO: 607532 - protein, 9 aa, Mycobacterium
VGDAEFPER

SEQ ID NO: 607533 - protein, 14 aa, Mycobacterium
VGDAGAGGSGGSGG

SEQ ID NO: 607534 - protein, 8 aa, Mycobacterium
VGDAGPQG

SEQ ID NO: 607535 - protein, 17 aa, Mycobacterium
VGDAPPAARPLIIDRIV

SEQ ID NO: 607536 - protein, 16 aa, Mycobacterium
VGDAPPQELPLIIDRI

SEQ ID NO: 607537 - protein, 6 aa, Mycobacterium
VGDARA

SEQ ID NO: 607538 - protein, 12 aa, Mycobacterium
VGDASDRAREAL

SEQ ID NO: 607539 - protein, 11 aa, Mycobacterium
VGDDGSPVPGT

SEQ ID NO: 607540 - protein, 9 aa, Mycobacterium
VGDDGSVEH

SEQ ID NO: 607541 - protein, 5 aa, Mycobacterium
VGDDH

SEQ ID NO: 607542 - protein, 5 aa, Mycobacterium
VGDDP

SEQ ID NO: 607543 - protein, 11 aa, Mycobacterium
VGDDPAAVAAN

SEQ ID NO: 607544 - protein, 14 aa, Mycobacterium
VGDDPAAVAANRAR

SEQ ID NO: 607545 - protein, 14 aa, Mycobacterium
VGDDPAAVAANRQR

SEQ ID NO: 607546 - protein, 14 aa, Mycobacterium
VGDDPAAVSANRNR

SEQ ID NO: 607547 - protein, 11 aa, Mycobacterium
VGDDPADAIRT

SEQ ID NO: 607548 - protein, 11 aa, Mycobacterium
VGDDPAQAIEA

SEQ ID NO: 607549 - protein, 12 aa, Mycobacterium
VGDDPASVAANR

SEQ ID NO: 607550 - protein, 13 aa, Mycobacterium
VGDDPDKKDYSKL

SEQ ID NO: 607551 - protein, 14 aa, Mycobacterium
VGDDPDKKEYSKLD

SEQ ID NO: 607552 - protein, 7 aa, Mycobacterium
VGDDPFG

SEQ ID NO: 607553 - protein, 14 aa, Mycobacterium
VGDDPGAVAANRSR

SEQ ID NO: 607554 - protein, 9 aa, Mycobacterium
VGDDPSLTA

SEQ ID NO: 607555 - protein, 8 aa, Mycobacterium
VGDDPVEL

SEQ ID NO: 607556 - protein, 7 aa, Mycobacterium
VGDDQRQ

SEQ ID NO: 607557 - protein, 5 aa, Mycobacterium
VGDDR

SEQ ID NO: 607558 - protein, 8 aa, Mycobacterium
VGDDTARA

SEQ ID NO: 607559 - protein, 10 aa, Mycobacterium
VGDEAEPTGT

SEQ ID NO: 607560 - protein, 6 aa, Mycobacterium
VGDEAQ

SEQ ID NO: 607561 - protein, 7 aa, Mycobacterium
VGDEEAV

SEQ ID NO: 607562 - protein, 9 aa, Mycobacterium
VGDEEKRAA

SEQ ID NO: 607563 - protein, 9 aa, Mycobacterium
VGDEGSAAV

SEQ ID NO: 607564 - protein, 5 aa, Mycobacterium
VGDEP

SEQ ID NO: 607565 - protein, 7 aa, Mycobacterium
VGDESEV

SEQ ID NO: 607566 - protein, 8 aa, Mycobacterium
VGDESGEA

SEQ ID NO: 607567 - protein, 7 aa, Mycobacterium
VGDEWGS

SEQ ID NO: 607568 - protein, 5 aa, Mycobacterium
VGDGA

SEQ ID NO: 607569 - protein, 9 aa, Mycobacterium
VGDGADFDT

SEQ ID NO: 607570 - protein, 11 aa, Mycobacterium
VGDGAEATPGS

SEQ ID NO: 607571 - protein, 5 aa, Mycobacterium
VGDGD

SEQ ID NO: 607572 - protein, 8 aa, Mycobacterium
VGDGDSAD

SEQ ID NO: 607573 - protein, 14 aa, Mycobacterium
VGDGDTGPNTGGMG

SEQ ID NO: 607574 - protein, 9 aa, Mycobacterium
VGDGEGSEL

SEQ ID NO: 607575 - protein, 8 aa, Mycobacterium
VGDGEPTL

SEQ ID NO: 607576 - protein, 7 aa, Mycobacterium
VGDGETL

SEQ ID NO: 607577 - protein, 61 aa, Mycobacterium
VGDGGAGGGGGITALSGNAGGDGGNGGKAGLIGSGGSGGAGGQALQPGSTGGNGGAGGNAQ

SEQ ID NO: 607578 - protein, 14 aa, Mycobacterium
VGDGGSGGEPGERA

SEQ ID NO: 607579 - protein, 6 aa, Mycobacterium
VGDGPA

SEQ ID NO: 607580 - protein, 6 aa, Mycobacterium
VGDGPM

SEQ ID NO: 607581 - protein, 7 aa, Mycobacterium
VGDGRTT

SEQ ID NO: 607582 - protein, 9 aa, Mycobacterium
VGDGSSIAL

SEQ ID NO: 607583 - protein, 10 aa, Mycobacterium
VGDGSTTGAV

SEQ ID NO: 607584 - protein, 8 aa, Mycobacterium
VGDGTENN

SEQ ID NO: 607585 - protein, 9 aa, Mycobacterium
VGDGTGDDE

SEQ ID NO: 607586 - protein, 5 aa, Mycobacterium
VGDGV

SEQ ID NO: 607587 - protein, 7 aa, Mycobacterium
VGDGVTS

SEQ ID NO: 607588 - protein, 6 aa, Mycobacterium
VGDKGM

SEQ ID NO: 607589 - protein, 13 aa, Mycobacterium
VGDLPNEPEPEAP

SEQ ID NO: 607590 - protein, 9 aa, Mycobacterium
VGDNSTLEL

SEQ ID NO: 607591 - protein, 5 aa, Mycobacterium
VGDPA

SEQ ID NO: 607592 - protein, 7 aa, Mycobacterium
VGDPAAV

SEQ ID NO: 607593 - protein, 12 aa, Mycobacterium
VGDPADASSLTG

SEQ ID NO: 607594 - protein, 12 aa, Mycobacterium
VGDPADDTTDIG

SEQ ID NO: 607595 - protein, 10 aa, Mycobacterium
VGDPADPDVQ

SEQ ID NO: 607596 - protein, 9 aa, Mycobacterium
VGDPADPEV

SEQ ID NO: 607597 - protein, 10 aa, Mycobacterium
VGDPAQPTGR

SEQ ID NO: 607598 - protein, 9 aa, Mycobacterium
VGDPARPLT

SEQ ID NO: 607599 - protein, 10 aa, Mycobacterium
VGDPATQTTE

SEQ ID NO: 607600 - protein, 8 aa, Mycobacterium
VGDPDAGA

SEQ ID NO: 607601 - protein, 8 aa, Mycobacterium
VGDPDDLA

SEQ ID NO: 607602 - protein, 7 aa, Mycobacterium
VGDPDGR

SEQ ID NO: 607603 - protein, 6 aa, Mycobacterium
VGDPDH

SEQ ID NO: 607604 - protein, 6 aa, Mycobacterium
VGDPDR

SEQ ID NO: 607605 - protein, 8 aa, Mycobacterium
VGDPDTAA

SEQ ID NO: 607606 - protein, 9 aa, Mycobacterium
VGDPDTATH

SEQ ID NO: 607607 - protein, 7 aa, Mycobacterium
VGDPFDP

SEQ ID NO: 607608 - protein, 8 aa, Mycobacterium
VGDPGDYL

SEQ ID NO: 607609 - protein, 7 aa, Mycobacterium
VGDPHAA

SEQ ID NO: 607610 - protein, 12 aa, Mycobacterium
VGDPLDEKTEIG

SEQ ID NO: 607611 - protein, 8 aa, Mycobacterium
VGDPLPFD

SEQ ID NO: 607612 - protein, 6 aa, Mycobacterium
VGDPLQ

SEQ ID NO: 607613 - protein, 7 aa, Mycobacterium
VGDPNAG

SEQ ID NO: 607614 - protein, 12 aa, Mycobacterium
VGDPNDPDTQLG

SEQ ID NO: 607615 - protein, 8 aa, Mycobacterium
VGDPNSGV

SEQ ID NO: 607616 - protein, 12 aa, Mycobacterium
VGDPPRLGEPGP

SEQ ID NO: 607617 - protein, 9 aa, Mycobacterium
VGDPQDPAV

SEQ ID NO: 607618 - protein, 8 aa, Mycobacterium
VGDPRAAE

SEQ ID NO: 607619 - protein, 16 aa, Mycobacterium
VGDPRLPQMPATPEQI

SEQ ID NO: 607620 - protein, 9 aa, Mycobacterium
VGDPRTTAR

SEQ ID NO: 607621 - protein, 11 aa, Mycobacterium
VGDPSDPATQL

SEQ ID NO: 607622 - protein, 7 aa, Mycobacterium
VGDPSIP

SEQ ID NO: 607623 - protein, 8 aa, Mycobacterium
VGDPSVPA

SEQ ID NO: 607624 - protein, 12 aa, Mycobacterium
VGDPTDDATEMG

SEQ ID NO: 607625 - protein, 31 aa, Mycobacterium
VGDPTDPATDVGPLATEQGRDEVDKQVQQAV

SEQ ID NO: 607626 - protein, 20 aa, Mycobacterium
VGDPTDPATQMGPLSTRPQF

SEQ ID NO: 607627 - protein, 36 aa, Mycobacterium
VGDPTDPDTDVGPLATESGRDDIAKQVDDAAAAGAT

SEQ ID NO: 607628 - protein, 37 aa, Mycobacterium
VGDPTDPDTDVGPLATESGRDEIAKQVDDAAAAGATI

SEQ ID NO: 607629 - protein, 10 aa, Mycobacterium
VGDPTDPDVQ

SEQ ID NO: 607630 - protein, 10 aa, Mycobacterium
VGDPTDPGTL

SEQ ID NO: 607631 - protein, 26 aa, Mycobacterium
VGDPTDPQTQVGPLATEQSRDEIAQQ

SEQ ID NO: 607632 - protein, 7 aa, Mycobacterium
VGDPTQG

SEQ ID NO: 607633 - protein, 20 aa, Mycobacterium
VGDPWDPATRIGPSASQRQF

SEQ ID NO: 607634 - protein, 8 aa, Mycobacterium
VGDPYTSQ

SEQ ID NO: 607635 - protein, 4 aa, Mycobacterium
VGDQ

SEQ ID NO: 607636 - protein, 6 aa, Mycobacterium
VGDQAQ

SEQ ID NO: 607637 - protein, 11 aa, Mycobacterium
VGDQNVDGAPR

SEQ ID NO: 607638 - protein, 7 aa, Mycobacterium
VGDQNVG

SEQ ID NO: 607639 - protein, 11 aa, Mycobacterium
VGDQPADDGAF

SEQ ID NO: 607640 - protein, 8 aa, Mycobacterium
VGDQSSNI

SEQ ID NO: 607641 - protein, 8 aa, Mycobacterium
VGDQTADR

SEQ ID NO: 607642 - protein, 4 aa, Mycobacterium
VGDR

SEQ ID NO: 607643 - protein, 5 aa, Mycobacterium
VGDRA

SEQ ID NO: 607644 - protein, 14 aa, Mycobacterium
VGDRGDLAPVLREV

SEQ ID NO: 607645 - protein, 9 aa, Mycobacterium
VGDRPLTDD

SEQ ID NO: 607646 - protein, 17 aa, Mycobacterium
VGDRPSAALGELGDTAG

SEQ ID NO: 607647 - protein, 17 aa, Mycobacterium
VGDRQTQNQPGTTDEYP

SEQ ID NO: 607648 - protein, 17 aa, Mycobacterium
VGDRRTQNQPGTTDEYP

SEQ ID NO: 607649 - protein, 9 aa, Mycobacterium
VGDRSAPAR

SEQ ID NO: 607650 - protein, 9 aa, Mycobacterium
VGDRSEFTR

SEQ ID NO: 607651 - protein, 4 aa, Mycobacterium
VGDS

SEQ ID NO: 607652 - protein, 5 aa, Mycobacterium
VGDSA

SEQ ID NO: 607653 - protein, 10 aa, Mycobacterium
VGDSDAPVRE

SEQ ID NO: 607654 - protein, 16 aa, Mycobacterium
VGDSGGAAGATGGGRV

SEQ ID NO: 607655 - protein, 8 aa, Mycobacterium
VGDSPQSW

SEQ ID NO: 607656 - protein, 11 aa, Mycobacterium
VGDSRRDDTAG

SEQ ID NO: 607657 - protein, 10 aa, Mycobacterium
VGDSSSREFA

SEQ ID NO: 607658 - protein, 5 aa, Mycobacterium
VGDTG

SEQ ID NO: 607659 - protein, 9 aa, Mycobacterium
VGDTPAGEV

SEQ ID NO: 607660 - protein, 10 aa, Mycobacterium
VGDTSHPIGG

SEQ ID NO: 607661 - protein, 12 aa, Mycobacterium
VGDTVAEQLADR

SEQ ID NO: 607662 - protein, 4 aa, Mycobacterium
VGDY

SEQ ID NO: 607663 - protein, 12 aa, Mycobacterium
VGDYGSYTGPLD

SEQ ID NO: 607664 - protein, 11 aa, Mycobacterium
VGEADGPRAGL

SEQ ID NO: 607665 - protein, 8 aa, Mycobacterium
VGEAETTE

SEQ ID NO: 607666 - protein, 17 aa, Mycobacterium
VGEAGPAPRPLIIDRIT

SEQ ID NO: 607667 - protein, 8 aa, Mycobacterium
VGEAPDGR

SEQ ID NO: 607668 - protein, 16 aa, Mycobacterium
VGEAPDGVDASSVWPR

SEQ ID NO: 607669 - protein, 7 aa, Mycobacterium
VGEAPGQ

SEQ ID NO: 607670 - protein, 10 aa, Mycobacterium
VGEAPLHKST

SEQ ID NO: 607671 - protein, 7 aa, Mycobacterium
VGEAPRQ

SEQ ID NO: 607672 - protein, 5 aa, Mycobacterium
VGEAQ

SEQ ID NO: 607673 - protein, 6 aa, Mycobacterium
VGEARV

SEQ ID NO: 607674 - protein, 7 aa, Mycobacterium
VGEATAE

SEQ ID NO: 607675 - protein, 7 aa, Mycobacterium
VGEATAT

SEQ ID NO: 607676 - protein, 9 aa, Mycobacterium
VGEDGAGGF

SEQ ID NO: 607677 - protein, 6 aa, Mycobacterium
VGEDKR

SEQ ID NO: 607678 - protein, 6 aa, Mycobacterium
VGEDNP

SEQ ID NO: 607679 - protein, 6 aa, Mycobacterium
VGEDPD

SEQ ID NO: 607680 - protein, 8 aa, Mycobacterium
VGEDPEQL

SEQ ID NO: 607681 - protein, 12 aa, Mycobacterium
VGEDPPDDGIAE

SEQ ID NO: 607682 - protein, 8 aa, Mycobacterium
VGEDPRSY

SEQ ID NO: 607683 - protein, 5 aa, Mycobacterium
VGEED

SEQ ID NO: 607684 - protein, 7 aa, Mycobacterium
VGEEGQG

SEQ ID NO: 607685 - protein, 7 aa, Mycobacterium
VGEENGG

SEQ ID NO: 607686 - protein, 8 aa, Mycobacterium
VGEETANR

SEQ ID NO: 607687 - protein, 9 aa, Mycobacterium
VGEETANRL

SEQ ID NO: 607688 - protein, 10 aa, Mycobacterium
VGEEVEAGQT

SEQ ID NO: 607689 - protein, 17 aa, Mycobacterium
VGEGAEEALHDGDGRGG

SEQ ID NO: 607690 - protein, 7 aa, Mycobacterium
VGEGDEV

SEQ ID NO: 607691 - protein, 7 aa, Mycobacterium
VGEGDID

SEQ ID NO: 607692 - protein, 7 aa, Mycobacterium
VGEGEDA

SEQ ID NO: 607693 - protein, 12 aa, Mycobacterium
VGEGEPAGRRAT

SEQ ID NO: 607694 - protein, 7 aa, Mycobacterium
VGEGEQQ

SEQ ID NO: 607695 - protein, 5 aa, Mycobacterium
VGEGG

SEQ ID NO: 607696 - protein, 18 aa, Mycobacterium
VGEGGAGGAGGMGGSGFT

SEQ ID NO: 607697 - protein, 8 aa, Mycobacterium
VGEGGNLG

SEQ ID NO: 607698 - protein, 6 aa, Mycobacterium
VGEGGT

SEQ ID NO: 607699 - protein, 5 aa, Mycobacterium
VGEGH

SEQ ID NO: 607700 - protein, 5 aa, Mycobacterium
VGEGQ

SEQ ID NO: 607701 - protein, 18 aa, Mycobacterium
VGEGSKTALIGPNGTGKT

SEQ ID NO: 607702 - protein, 11 aa, Mycobacterium
VGEGSRGAPKV

SEQ ID NO: 607703 - protein, 5 aa, Mycobacterium
VGEGV

SEQ ID NO: 607704 - protein, 9 aa, Mycobacterium
VGEGVERSA

SEQ ID NO: 607705 - protein, 7 aa, Mycobacterium
VGEGVSE

SEQ ID NO: 607706 - protein, 4 aa, Mycobacterium
VGEH

SEQ ID NO: 607707 - protein, 5 aa, Mycobacterium
VGEHA

SEQ ID NO: 607708 - protein, 23 aa, Mycobacterium
VGEHGGADAPDEVRRSRKAPGCP

SEQ ID NO: 607709 - protein, 13 aa, Mycobacterium
VGEHHGGWLVLDR

SEQ ID NO: 607710 - protein, 14 aa, Mycobacterium
VGEIDGANRSMVEN

SEQ ID NO: 607711 - protein, 11 aa, Mycobacterium
VGEIEPDATAL

SEQ ID NO: 607712 - protein, 28 aa, Mycobacterium
VGEKAAAAEQASAKSAAEAKTAAEQAAA

SEQ ID NO: 607713 - protein, 11 aa, Mycobacterium
VGELDQGEVGL

SEQ ID NO: 607714 - protein, 23 aa, Mycobacterium
VGELSEPAGANRGRSSSMPHKRN

SEQ ID NO: 607715 - protein, 6 aa, Mycobacterium
VGENDA

SEQ ID NO: 607716 - protein, 13 aa, Mycobacterium
VGENDVDAGLRPK

SEQ ID NO: 607717 - protein, 6 aa, Mycobacterium
VGENER

SEQ ID NO: 607718 - protein, 7 aa, Mycobacterium
VGENESD

SEQ ID NO: 607719 - protein, 5 aa, Mycobacterium
VGENK

SEQ ID NO: 607720 - protein, 4 aa, Mycobacterium
VGEP

SEQ ID NO: 607721 - protein, 7 aa, Mycobacterium
VGEPDEV

SEQ ID NO: 607722 - protein, 7 aa, Mycobacterium
VGEPELE

SEQ ID NO: 607723 - protein, 15 aa, Mycobacterium
VGEPEPAGRPADPPF

SEQ ID NO: 607724 - protein, 10 aa, Mycobacterium
VGEPESDAEA

SEQ ID NO: 607725 - protein, 6 aa, Mycobacterium
VGEPGP

SEQ ID NO: 607726 - protein, 7 aa, Mycobacterium
VGEPGVT

SEQ ID NO: 607727 - protein, 17 aa, Mycobacterium
VGEPKELPPPPRGGEEP

SEQ ID NO: 607728 - protein, 5 aa, Mycobacterium
VGEPN

SEQ ID NO: 607729 - protein, 8 aa, Mycobacterium
VGEPNSGW

SEQ ID NO: 607730 - protein, 7 aa, Mycobacterium
VGEPPAA

SEQ ID NO: 607731 - protein, 13 aa, Mycobacterium
VGEPPALDDPKDH

SEQ ID NO: 607732 - protein, 16 aa, Mycobacterium
VGEPPDGAEALSRWPR

SEQ ID NO: 607733 - protein, 16 aa, Mycobacterium
VGEPPDSPDALAQWPR

SEQ ID NO: 607734 - protein, 16 aa, Mycobacterium
VGEPPGDVAALAQWPR

SEQ ID NO: 607735 - protein, 16 aa, Mycobacterium
VGEPPPGAEALAQWPR

SEQ ID NO: 607736 - protein, 7 aa, Mycobacterium
VGEPQRL

SEQ ID NO: 607737 - protein, 7 aa, Mycobacterium
VGEPSEV

SEQ ID NO: 607738 - protein, 7 aa, Mycobacterium
VGEQQVV

SEQ ID NO: 607739 - protein, 6 aa, Mycobacterium
VGEQSL

SEQ ID NO: 607740 - protein, 8 aa, Mycobacterium
VGEQTAER

SEQ ID NO: 607741 - protein, 8 aa, Mycobacterium
VGEQTANR

SEQ ID NO: 607742 - protein, 11 aa, Mycobacterium
VGEQVRDRSPR

SEQ ID NO: 607743 - protein, 5 aa, Mycobacterium
VGERD

SEQ ID NO: 607744 - protein, 16 aa, Mycobacterium
VGERDSTRAEQKDAIA

SEQ ID NO: 607745 - protein, 7 aa, Mycobacterium
VGERGRL

SEQ ID NO: 607746 - protein, 5 aa, Mycobacterium
VGERP

SEQ ID NO: 607747 - protein, 5 aa, Mycobacterium
VGERQ

SEQ ID NO: 607748 - protein, 9 aa, Mycobacterium
VGERSAPAR

SEQ ID NO: 607749 - protein, 7 aa, Mycobacterium
VGERTDE

SEQ ID NO: 607750 - protein, 35 aa, Mycobacterium
VGERTSPSAHPPLADADDPAERLKTEENEAEWGFT

SEQ ID NO: 607751 - protein, 21 aa, Mycobacterium
VGESAAEPGSGSDAAAVAPSS

SEQ ID NO: 607752 - protein, 10 aa, Mycobacterium
VGESADAARA

SEQ ID NO: 607753 - protein, 10 aa, Mycobacterium
VGESAEAAGA

SEQ ID NO: 607754 - protein, 10 aa, Mycobacterium
VGESGSGKSV

SEQ ID NO: 607755 - protein, 15 aa, Mycobacterium
VGESRDQEASAKVSE

SEQ ID NO: 607756 - protein, 13 aa, Mycobacterium
VGESRDQEATAKV

SEQ ID NO: 607757 - protein, 14 aa, Mycobacterium
VGESRSYTVPSGNT

SEQ ID NO: 607758 - protein, 9 aa, Mycobacterium
VGESTTLTH

SEQ ID NO: 607759 - protein, 6 aa, Mycobacterium
VGESTV

SEQ ID NO: 607760 - protein, 4 aa, Mycobacterium
VGET

SEQ ID NO: 607761 - protein, 5 aa, Mycobacterium
VGETA

SEQ ID NO: 607762 - protein, 8 aa, Mycobacterium
VGETEPDL

SEQ ID NO: 607763 - protein, 6 aa, Mycobacterium
VGETPA

SEQ ID NO: 607764 - protein, 9 aa, Mycobacterium
VGETRGELG

SEQ ID NO: 607765 - protein, 8 aa, Mycobacterium
VGETRSNR

SEQ ID NO: 607766 - protein, 15 aa, Mycobacterium
VGETRSYKVPNGNTV

SEQ ID NO: 607767 - protein, 12 aa, Mycobacterium
VGETRSYTVPNG

SEQ ID NO: 607768 - protein, 14 aa, Mycobacterium
VGETRSYTVPNGTE

SEQ ID NO: 607769 - protein, 12 aa, Mycobacterium
VGETSDGETQPN

SEQ ID NO: 607770 - protein, 18 aa, Mycobacterium
VGETTAAAALAQTAPRVA

SEQ ID NO: 607771 - protein, 16 aa, Mycobacterium
VGETTLHAQTSDRMPT

SEQ ID NO: 607772 - protein, 8 aa, Mycobacterium
VGEVDEGT

SEQ ID NO: 607773 - protein, 6 aa, Mycobacterium
VGEVGD

SEQ ID NO: 607774 - protein, 6 aa, Mycobacterium
VGFGGT

SEQ ID NO: 607775 - protein, 6 aa, Mycobacterium
VGFPGP

SEQ ID NO: 607776 - protein, 9 aa, Mycobacterium
VGFPTPTRH

SEQ ID NO: 607777 - protein, 8 aa, Mycobacterium
VGFSNTSS

SEQ ID NO: 607778 - protein, 5 aa, Mycobacterium
VGGAA

SEQ ID NO: 607779 - protein, 10 aa, Mycobacterium
VGGAAAEGIR

SEQ ID NO: 607780 - protein, 9 aa, Mycobacterium
VGGAAAEGV

SEQ ID NO: 607781 - protein, 6 aa, Mycobacterium
VGGAAD

SEQ ID NO: 607782 - protein, 6 aa, Mycobacterium
VGGAAI

SEQ ID NO: 607783 - protein, 7 aa, Mycobacterium
VGGAARG

SEQ ID NO: 607784 - protein, 13 aa, Mycobacterium
VGGADAARGGDGL

SEQ ID NO: 607785 - protein, 16 aa, Mycobacterium
VGGADDPVAPPRDDEH

SEQ ID NO: 607786 - protein, 9 aa, Mycobacterium
VGGAEPSQR

SEQ ID NO: 607787 - protein, 8 aa, Mycobacterium
VGGAGESV

SEQ ID NO: 607788 - protein, 10 aa, Mycobacterium
VGGAGGAAGL

SEQ ID NO: 607789 - protein, 12 aa, Mycobacterium
VGGAGGAGGNAG

SEQ ID NO: 607790 - protein, 116 aa, Mycobacterium
VGGAGGAGGWANSIDGSATGGNGGDGGNGAFGGRGGNGGAGGSAYGRGGITTGGNGGAGGHGSTGAAGGRGGDGASASGGYAVGGNGGDGGRGGAGATGGTGGTGGAGGDGGRGGL

SEQ ID NO: 607791 - protein, 11 aa, Mycobacterium
VGGAGGDGGRG

SEQ ID NO: 607792 - protein, 11 aa, Mycobacterium
VGGAGGNGGNG

SEQ ID NO: 607793 - protein, 33 aa, Mycobacterium
VGGAGGSAGLIGNGGAGGTGGAGATGGAGGNGG

SEQ ID NO: 607794 - protein, 21 aa, Mycobacterium
VGGAGGSGGIGGRLFGQAGAA

SEQ ID NO: 607795 - protein, 14 aa, Mycobacterium
VGGAGPADATDPAR

SEQ ID NO: 607796 - protein, 8 aa, Mycobacterium
VGGAGTPI

SEQ ID NO: 607797 - protein, 8 aa, Mycobacterium
VGGALETG

SEQ ID NO: 607798 - protein, 15 aa, Mycobacterium
VGGANSSASATGGIN

SEQ ID NO: 607799 - protein, 7 aa, Mycobacterium
VGGAPNP

SEQ ID NO: 607800 - protein, 14 aa, Mycobacterium
VGGAPPAPETEPTR

SEQ ID NO: 607801 - protein, 11 aa, Mycobacterium
VGGAPQTGKST

SEQ ID NO: 607802 - protein, 6 aa, Mycobacterium
VGGAPT

SEQ ID NO: 607803 - protein, 6 aa, Mycobacterium
VGGAQQ

SEQ ID NO: 607804 - protein, 8 aa, Mycobacterium
VGGASGPL

SEQ ID NO: 607805 - protein, 6 aa, Mycobacterium
VGGATA

SEQ ID NO: 607806 - protein, 8 aa, Mycobacterium
VGGATQGK

SEQ ID NO: 607807 - protein, 17 aa, Mycobacterium
VGGATRRAVAPASPAVP

SEQ ID NO: 607808 - protein, 10 aa, Mycobacterium
VGGATSNRRD

SEQ ID NO: 607809 - protein, 5 aa, Mycobacterium
VGGAV

SEQ ID NO: 607810 - protein, 5 aa, Mycobacterium
VGGDA

SEQ ID NO: 607811 - protein, 9 aa, Mycobacterium
VGGDAGTGE

SEQ ID NO: 607812 - protein, 9 aa, Mycobacterium
VGGDDARSA

SEQ ID NO: 607813 - protein, 7 aa, Mycobacterium
VGGDDGV

SEQ ID NO: 607814 - protein, 9 aa, Mycobacterium
VGGDDLRPQ

SEQ ID NO: 607815 - protein, 5 aa, Mycobacterium
VGGDF

SEQ ID NO: 607816 - protein, 5 aa, Mycobacterium
VGGDG

SEQ ID NO: 607817 - protein, 7 aa, Mycobacterium
VGGDGAE

SEQ ID NO: 607818 - protein, 7 aa, Mycobacterium
VGGDGFA

SEQ ID NO: 607819 - protein, 21 aa, Mycobacterium
VGGDGGAGGAGGGAGGDGGAG

SEQ ID NO: 607820 - protein, 22 aa, Mycobacterium
VGGDGGAGGAGGLGGNGTDGGW

SEQ ID NO: 607821 - protein, 11 aa, Mycobacterium
VGGDGGAQSSP

SEQ ID NO: 607822 - protein, 43 aa, Mycobacterium
VGGDGGTGGAGGNGQAGQLSNDVGGDGGRGGAGGAAGAGGDAG

SEQ ID NO: 607823 - protein, 8 aa, Mycobacterium
VGGDGKPF

SEQ ID NO: 607824 - protein, 6 aa, Mycobacterium
VGGDKP

SEQ ID NO: 607825 - protein, 10 aa, Mycobacterium
VGGDPDTFPG

SEQ ID NO: 607826 - protein, 9 aa, Mycobacterium
VGGDPRAYT

SEQ ID NO: 607827 - protein, 7 aa, Mycobacterium
VGGDRFT

SEQ ID NO: 607828 - protein, 11 aa, Mycobacterium
VGGDSITGSPI

SEQ ID NO: 607829 - protein, 11 aa, Mycobacterium
VGGDTGDDDTV

SEQ ID NO: 607830 - protein, 8 aa, Mycobacterium
VGGEAPLD

SEQ ID NO: 607831 - protein, 18 aa, Mycobacterium
VGGEFRGGVGQGARGSAG

SEQ ID NO: 607832 - protein, 5 aa, Mycobacterium
VGGEL

SEQ ID NO: 607833 - protein, 7 aa, Mycobacterium
VGGELPD

SEQ ID NO: 607834 - protein, 6 aa, Mycobacterium
VGGENQ

SEQ ID NO: 607835 - protein, 8 aa, Mycobacterium
VGGENTGF

SEQ ID NO: 607836 - protein, 7 aa, Mycobacterium
VGGEPGS

SEQ ID NO: 607837 - protein, 16 aa, Mycobacterium
VGGESAANVGRGYGLP

SEQ ID NO: 607838 - protein, 7 aa, Mycobacterium
VGGESAR

SEQ ID NO: 607839 - protein, 10 aa, Mycobacterium
VGGESLTDEI

SEQ ID NO: 607840 - protein, 27 aa, Mycobacterium
VGGESPGLSRLGGSDWTNTKTKARKAV

SEQ ID NO: 607841 - protein, 6 aa, Mycobacterium
VGGESQ

SEQ ID NO: 607842 - protein, 6 aa, Mycobacterium
VGGESV

SEQ ID NO: 607843 - protein, 9 aa, Mycobacterium
VGGETGDLR

SEQ ID NO: 607844 - protein, 5 aa, Mycobacterium
VGGFS

SEQ ID NO: 607845 - protein, 6 aa, Mycobacterium
VGGFSE

SEQ ID NO: 607846 - protein, 6 aa, Mycobacterium
VGGGAE

SEQ ID NO: 607847 - protein, 10 aa, Mycobacterium
VGGGAPAHGA

SEQ ID NO: 607848 - protein, 9 aa, Mycobacterium
VGGGAVGEE

SEQ ID NO: 607849 - protein, 11 aa, Mycobacterium
VGGGDEPGDPI

SEQ ID NO: 607850 - protein, 10 aa, Mycobacterium
VGGGDGTVAA

SEQ ID NO: 607851 - protein, 12 aa, Mycobacterium
VGGGDPAGNPTL

SEQ ID NO: 607852 - protein, 8 aa, Mycobacterium
VGGGDSAA

SEQ ID NO: 607853 - protein, 5 aa, Mycobacterium
VGGGF

SEQ ID NO: 607854 - protein, 8 aa, Mycobacterium
VGGGFGTK

SEQ ID NO: 607855 - protein, 5 aa, Mycobacterium
VGGGG

SEQ ID NO: 607856 - protein, 9 aa, Mycobacterium
VGGGGRHLN

SEQ ID NO: 607857 - protein, 6 aa, Mycobacterium
VGGGHG

SEQ ID NO: 607858 - protein, 7 aa, Mycobacterium
VGGGHPG

SEQ ID NO: 607859 - protein, 7 aa, Mycobacterium
VGGGNVG

SEQ ID NO: 607860 - protein, 16 aa, Mycobacterium
VGGGNVGNGNNGFGNF

SEQ ID NO: 607861 - protein, 10 aa, Mycobacterium
VGGGPGAVRD

SEQ ID NO: 607862 - protein, 10 aa, Mycobacterium
VGGGPSESDF

SEQ ID NO: 607863 - protein, 14 aa, Mycobacterium
VGGGPVAGSMLLSS

SEQ ID NO: 607864 - protein, 16 aa, Mycobacterium
VGGGPVSASLAQASTI

SEQ ID NO: 607865 - protein, 6 aa, Mycobacterium
VGGGQL

SEQ ID NO: 607866 - protein, 13 aa, Mycobacterium
VGGGRDDPKARDE

SEQ ID NO: 607867 - protein, 11 aa, Mycobacterium
VGGGRDDPKMR

SEQ ID NO: 607868 - protein, 9 aa, Mycobacterium
VGGGRSGAV

SEQ ID NO: 607869 - protein, 5 aa, Mycobacterium
VGGGS

SEQ ID NO: 607870 - protein, 10 aa, Mycobacterium
VGGGSAPVRT

SEQ ID NO: 607871 - protein, 7 aa, Mycobacterium
VGGGSNA

SEQ ID NO: 607872 - protein, 21 aa, Mycobacterium
VGGGSRLGRRAHGPAVPTSQA

SEQ ID NO: 607873 - protein, 13 aa, Mycobacterium
VGGGSTGAGPRYG

SEQ ID NO: 607874 - protein, 16 aa, Mycobacterium
VGGGTGLARPGAVSRA

SEQ ID NO: 607875 - protein, 15 aa, Mycobacterium
VGGHGREHPAQPLDQ

SEQ ID NO: 607876 - protein, 9 aa, Mycobacterium
VGGHQASSA

SEQ ID NO: 607877 - protein, 10 aa, Mycobacterium
VGGHQSSSAS

SEQ ID NO: 607878 - protein, 7 aa, Mycobacterium
VGGHREQ

SEQ ID NO: 607879 - protein, 7 aa, Mycobacterium
VGGHRPG

SEQ ID NO: 607880 - protein, 7 aa, Mycobacterium
VGGHSAS

SEQ ID NO: 607881 - protein, 8 aa, Mycobacterium
VGGISSGA

SEQ ID NO: 607882 - protein, 9 aa, Mycobacterium
VGGKDSQVV

SEQ ID NO: 607883 - protein, 8 aa, Mycobacterium
VGGKPQTE

SEQ ID NO: 607884 - protein, 11 aa, Mycobacterium
VGGKPVDQQTL

SEQ ID NO: 607885 - protein, 7 aa, Mycobacterium
VGGKPYG

SEQ ID NO: 607886 - protein, 6 aa, Mycobacterium
VGGKRA

SEQ ID NO: 607887 - protein, 9 aa, Mycobacterium
VGGKTDRRA

SEQ ID NO: 607888 - protein, 14 aa, Mycobacterium
VGGKTGINTEAGKN

SEQ ID NO: 607889 - protein, 13 aa, Mycobacterium
VGGLEAAARSARY

SEQ ID NO: 607890 - protein, 5 aa, Mycobacterium
VGGLG

SEQ ID NO: 607891 - protein, 36 aa, Mycobacterium
VGGLGGNGGDATGATNSSSVAGIGGQAGNGGNGGHS

SEQ ID NO: 607892 - protein, 6 aa, Mycobacterium
VGGLPG

SEQ ID NO: 607893 - protein, 7 aa, Mycobacterium
VGGLPGD

SEQ ID NO: 607894 - protein, 6 aa, Mycobacterium
VGGMSS

SEQ ID NO: 607895 - protein, 5 aa, Mycobacterium
VGGMT

SEQ ID NO: 607896 - protein, 22 aa, Mycobacterium
VGGNDANPVTGAGTIGQAGNTG

SEQ ID NO: 607897 - protein, 9 aa, Mycobacterium
VGGNDPREL

SEQ ID NO: 607898 - protein, 5 aa, Mycobacterium
VGGNS

SEQ ID NO: 607899 - protein, 7 aa, Mycobacterium
VGGNSAV

SEQ ID NO: 607900 - protein, 14 aa, Mycobacterium
VGGNTGHPASGDLT

SEQ ID NO: 607901 - protein, 4 aa, Mycobacterium
VGGP

SEQ ID NO: 607902 - protein, 6 aa, Mycobacterium
VGGPAL

SEQ ID NO: 607903 - protein, 9 aa, Mycobacterium
VGGPDDKWG

SEQ ID NO: 607904 - protein, 9 aa, Mycobacterium
VGGPGAYQA

SEQ ID NO: 607905 - protein, 6 aa, Mycobacterium
VGGPGL

SEQ ID NO: 607906 - protein, 10 aa, Mycobacterium
VGGPGQCQRR

SEQ ID NO: 607907 - protein, 7 aa, Mycobacterium
VGGPPRN

SEQ ID NO: 607908 - protein, 30 aa, Mycobacterium
VGGPRSDAALAASSGRTATTKSMGKGSTQH

SEQ ID NO: 607909 - protein, 30 aa, Mycobacterium
VGGPRSDAALTASSGRTATTKSMGEGSTQH

SEQ ID NO: 607910 - protein, 10 aa, Mycobacterium
VGGPRSPAKK

SEQ ID NO: 607911 - protein, 14 aa, Mycobacterium
VGGPSVGGQASGAM

SEQ ID NO: 607912 - protein, 11 aa, Mycobacterium
VGGPTALSTRT

SEQ ID NO: 607913 - protein, 20 aa, Mycobacterium
VGGPTLAKGYRNPVDPDPFA

SEQ ID NO: 607914 - protein, 10 aa, Mycobacterium
VGGPVGGRPT

SEQ ID NO: 607915 - protein, 5 aa, Mycobacterium
VGGPY

SEQ ID NO: 607916 - protein, 4 aa, Mycobacterium
VGGQ

SEQ ID NO: 607917 - protein, 8 aa, Mycobacterium
VGGQAGNI

SEQ ID NO: 607918 - protein, 28 aa, Mycobacterium
VGGQAPVPAEFDENGRGGVHGRAAGKRQ

SEQ ID NO: 607919 - protein, 8 aa, Mycobacterium
VGGQEHAE

SEQ ID NO: 607920 - protein, 10 aa, Mycobacterium
VGGQPDGYDI

SEQ ID NO: 607921 - protein, 6 aa, Mycobacterium
VGGQPE

SEQ ID NO: 607922 - protein, 9 aa, Mycobacterium
VGGQPQGEW

SEQ ID NO: 607923 - protein, 6 aa, Mycobacterium
VGGQRA

SEQ ID NO: 607924 - protein, 11 aa, Mycobacterium
VGGQSGDDDTV

SEQ ID NO: 607925 - protein, 10 aa, Mycobacterium
VGGQSPQKLV

SEQ ID NO: 607926 - protein, 6 aa, Mycobacterium
VGGQST

SEQ ID NO: 607927 - protein, 12 aa, Mycobacterium
VGGQTTTRGFPI

SEQ ID NO: 607928 - protein, 8 aa, Mycobacterium
VGGQTTYV

SEQ ID NO: 607929 - protein, 10 aa, Mycobacterium
VGGQVSGSLG

SEQ ID NO: 607930 - protein, 5 aa, Mycobacterium
VGGRA

SEQ ID NO: 607931 - protein, 11 aa, Mycobacterium
VGGRASTDDID

SEQ ID NO: 607932 - protein, 9 aa, Mycobacterium
VGGRDTAGL

SEQ ID NO: 607933 - protein, 7 aa, Mycobacterium
VGGRPVR

SEQ ID NO: 607934 - protein, 7 aa, Mycobacterium
VGGRPYP

SEQ ID NO: 607935 - protein, 5 aa, Mycobacterium
VGGRR

SEQ ID NO: 607936 - protein, 11 aa, Mycobacterium
VGGRRDDSGGW

SEQ ID NO: 607937 - protein, 10 aa, Mycobacterium
VGGRRDEQGN

SEQ ID NO: 607938 - protein, 10 aa, Mycobacterium
VGGRRDGDGA

SEQ ID NO: 607939 - protein, 8 aa, Mycobacterium
VGGRRQSQ

SEQ ID NO: 607940 - protein, 5 aa, Mycobacterium
VGGRS

SEQ ID NO: 607941 - protein, 6 aa, Mycobacterium
VGGRST

SEQ ID NO: 607942 - protein, 9 aa, Mycobacterium
VGGRTTGLA

SEQ ID NO: 607943 - protein, 4 aa, Mycobacterium
VGGS

SEQ ID NO: 607944 - protein, 9 aa, Mycobacterium
VGGSAGAAA

SEQ ID NO: 607945 - protein, 10 aa, Mycobacterium
VGGSAGAAAR

SEQ ID NO: 607946 - protein, 10 aa, Mycobacterium
VGGSAGAAGR

SEQ ID NO: 607947 - protein, 8 aa, Mycobacterium
VGGSAGVS

SEQ ID NO: 607948 - protein, 5 aa, Mycobacterium
VGGSD

SEQ ID NO: 607949 - protein, 7 aa, Mycobacterium
VGGSDVN

SEQ ID NO: 607950 - protein, 5 aa, Mycobacterium
VGGSE

SEQ ID NO: 607951 - protein, 8 aa, Mycobacterium
VGGSEDIG

SEQ ID NO: 607952 - protein, 8 aa, Mycobacterium
VGGSEDLG

SEQ ID NO: 607953 - protein, 9 aa, Mycobacterium
VGGSEDVGY

SEQ ID NO: 607954 - protein, 7 aa, Mycobacterium
VGGSERT

SEQ ID NO: 607955 - protein, 6 aa, Mycobacterium
VGGSEY

SEQ ID NO: 607956 - protein, 9 aa, Mycobacterium
VGGSGAING

SEQ ID NO: 607957 - protein, 6 aa, Mycobacterium
VGGSGL

SEQ ID NO: 607958 - protein, 7 aa, Mycobacterium
VGGSGRS

SEQ ID NO: 607959 - protein, 17 aa, Mycobacterium
VGGSGSSADHGGSRASA

SEQ ID NO: 607960 - protein, 7 aa, Mycobacterium
VGGSGVD

SEQ ID NO: 607961 - protein, 8 aa, Mycobacterium
VGGSGVKG

SEQ ID NO: 607962 - protein, 9 aa, Mycobacterium
VGGSLTTKT

SEQ ID NO: 607963 - protein, 7 aa, Mycobacterium
VGGSPAA

SEQ ID NO: 607964 - protein, 9 aa, Mycobacterium
VGGSPPREL

SEQ ID NO: 607965 - protein, 9 aa, Mycobacterium
VGGSRNARR

SEQ ID NO: 607966 - protein, 8 aa, Mycobacterium
VGGSRTAR

SEQ ID NO: 607967 - protein, 7 aa, Mycobacterium
VGGSRTR

SEQ ID NO: 607968 - protein, 15 aa, Mycobacterium
VGGSSERLDVLAAAQ

SEQ ID NO: 607969 - protein, 7 aa, Mycobacterium
VGGSSGA

SEQ ID NO: 607970 - protein, 8 aa, Mycobacterium
VGGSSGAL

SEQ ID NO: 607971 - protein, 6 aa, Mycobacterium
VGGSSS

SEQ ID NO: 607972 - protein, 10 aa, Mycobacterium
VGGSTARSGG

SEQ ID NO: 607973 - protein, 11 aa, Mycobacterium
VGGSTMGATGL

SEQ ID NO: 607974 - protein, 10 aa, Mycobacterium
VGGSYSEPAL

SEQ ID NO: 607975 - protein, 11 aa, Mycobacterium
VGGTAAAGSIP

SEQ ID NO: 607976 - protein, 7 aa, Mycobacterium
VGGTAAG

SEQ ID NO: 607977 - protein, 9 aa, Mycobacterium
VGGTASEPI

SEQ ID NO: 607978 - protein, 5 aa, Mycobacterium
VGGTE

SEQ ID NO: 607979 - protein, 6 aa, Mycobacterium
VGGTEN

SEQ ID NO: 607980 - protein, 11 aa, Mycobacterium
VGGTEPAGGDH

SEQ ID NO: 607981 - protein, 7 aa, Mycobacterium
VGGTERT

SEQ ID NO: 607982 - protein, 11 aa, Mycobacterium
VGGTETPRETF

SEQ ID NO: 607983 - protein, 14 aa, Mycobacterium
VGGTETWQAPTTAF

SEQ ID NO: 607984 - protein, 7 aa, Mycobacterium
VGGTGES

SEQ ID NO: 607985 - protein, 11 aa, Mycobacterium
VGGTGRRAPRG

SEQ ID NO: 607986 - protein, 7 aa, Mycobacterium
VGGTGVV

SEQ ID NO: 607987 - protein, 10 aa, Mycobacterium
VGGTKDSGLE

SEQ ID NO: 607988 - protein, 7 aa, Mycobacterium
VGGTKNG

SEQ ID NO: 607989 - protein, 10 aa, Mycobacterium
VGGTLKSGRR

SEQ ID NO: 607990 - protein, 7 aa, Mycobacterium
VGGTPDR

SEQ ID NO: 607991 - protein, 6 aa, Mycobacterium
VGGTPI

SEQ ID NO: 607992 - protein, 7 aa, Mycobacterium
VGGTPRF

SEQ ID NO: 607993 - protein, 9 aa, Mycobacterium
VGGTRDDQA

SEQ ID NO: 607994 - protein, 8 aa, Mycobacterium
VGGTRDPD

SEQ ID NO: 607995 - protein, 11 aa, Mycobacterium
VGGTRGRDAAQ

SEQ ID NO: 607996 - protein, 31 aa, Mycobacterium
VGGTRRSANSIAPAISNSRVAQAGQGQTLRS

SEQ ID NO: 607997 - protein, 6 aa, Mycobacterium
VGGTSK

SEQ ID NO: 607998 - protein, 7 aa, Mycobacterium
VGGTSME

SEQ ID NO: 607999 - protein, 9 aa, Mycobacterium
VGGTTRQLR

SEQ ID NO: 608000 - protein, 6 aa, Mycobacterium
VGGTVE

SEQ ID NO: 608001 - protein, 7 aa, Mycobacterium
VGGTVEG

SEQ ID NO: 608002 - protein, 8 aa, Mycobacterium
VGGTVGRY

SEQ ID NO: 608003 - protein, 12 aa, Mycobacterium
VGGTWRDNSYPG

SEQ ID NO: 608004 - protein, 5 aa, Mycobacterium
VGGVA

SEQ ID NO: 608005 - protein, 12 aa, Mycobacterium
VGGVDDTTSYPN

SEQ ID NO: 608006 - protein, 9 aa, Mycobacterium
VGGVGKTGV

SEQ ID NO: 608007 - protein, 5 aa, Mycobacterium
VGGVP

SEQ ID NO: 608008 - protein, 7 aa, Mycobacterium
VGGVPGS

SEQ ID NO: 608009 - protein, 6 aa, Mycobacterium
VGGVRT

SEQ ID NO: 608010 - protein, 7 aa, Mycobacterium
VGGYGNS

SEQ ID NO: 608011 - protein, 5 aa, Mycobacterium
VGGYP

SEQ ID NO: 608012 - protein, 12 aa, Mycobacterium
VGGYRDDTALAR

SEQ ID NO: 608013 - protein, 4 aa, Mycobacterium
VGHA

SEQ ID NO: 608014 - protein, 6 aa, Mycobacterium
VGHAGP

SEQ ID NO: 608015 - protein, 22 aa, Mycobacterium
VGHAPGKEDEEVTRKPSTDEPF

SEQ ID NO: 608016 - protein, 22 aa, Mycobacterium
VGHAPGKEDVEVTRKPSTDEPF

SEQ ID NO: 608017 - protein, 14 aa, Mycobacterium
VGHDHDSVGPFQQR

SEQ ID NO: 608018 - protein, 18 aa, Mycobacterium
VGHGPERTRYDLPAGAPR

SEQ ID NO: 608019 - protein, 9 aa, Mycobacterium
VGHGPGPFE

SEQ ID NO: 608020 - protein, 7 aa, Mycobacterium
VGHPGPI

SEQ ID NO: 608021 - protein, 7 aa, Mycobacterium
VGHPQPR

SEQ ID NO: 608022 - protein, 4 aa, Mycobacterium
VGHQ

SEQ ID NO: 608023 - protein, 17 aa, Mycobacterium
VGHQPRRAAAGARRQPV

SEQ ID NO: 608024 - protein, 5 aa, Mycobacterium
VGIGE

SEQ ID NO: 608025 - protein, 13 aa, Mycobacterium
VGIGPSGDEPGFQ

SEQ ID NO: 608026 - protein, 6 aa, Mycobacterium
VGINTA

SEQ ID NO: 608027 - protein, 10 aa, Mycobacterium
VGIPVDDPNG

SEQ ID NO: 608028 - protein, 19 aa, Mycobacterium
VGITEANSAEFDPKTPDPV

SEQ ID NO: 608029 - protein, 10 aa, Mycobacterium
VGKAASVGGL

SEQ ID NO: 608030 - protein, 11 aa, Mycobacterium
VGKAERRRRAA

SEQ ID NO: 608031 - protein, 8 aa, Mycobacterium
VGKAPGPL

SEQ ID NO: 608032 - protein, 12 aa, Mycobacterium
VGKATRRQFNGP

SEQ ID NO: 608033 - protein, 8 aa, Mycobacterium
VGKDAGEL

SEQ ID NO: 608034 - protein, 13 aa, Mycobacterium
VGKDGQPTQGGYS

SEQ ID NO: 608035 - protein, 6 aa, Mycobacterium
VGKEIP

SEQ ID NO: 608036 - protein, 8 aa, Mycobacterium
VGKGDDRL

SEQ ID NO: 608037 - protein, 6 aa, Mycobacterium
VGKGDH

SEQ ID NO: 608038 - protein, 7 aa, Mycobacterium
VGKGEDR

SEQ ID NO: 608039 - protein, 7 aa, Mycobacterium
VGKGGNR

SEQ ID NO: 608040 - protein, 14 aa, Mycobacterium
VGKGGTGAGPSPFS

SEQ ID NO: 608041 - protein, 15 aa, Mycobacterium
VGKGSAESVAGQGAR

SEQ ID NO: 608042 - protein, 11 aa, Mycobacterium
VGKGVDQSRVG

SEQ ID NO: 608043 - protein, 7 aa, Mycobacterium
VGKHEAV

SEQ ID NO: 608044 - protein, 4 aa, Mycobacterium
VGKK

SEQ ID NO: 608045 - protein, 10 aa, Mycobacterium
VGKKELENDP

SEQ ID NO: 608046 - protein, 11 aa, Mycobacterium
VGKKPADAVTG

SEQ ID NO: 608047 - protein, 9 aa, Mycobacterium
VGKPAPAGF

SEQ ID NO: 608048 - protein, 8 aa, Mycobacterium
VGKPAPTV

SEQ ID NO: 608049 - protein, 7 aa, Mycobacterium
VGKPGAV

SEQ ID NO: 608050 - protein, 7 aa, Mycobacterium
VGKPGEV

SEQ ID NO: 608051 - protein, 6 aa, Mycobacterium
VGKPLR

SEQ ID NO: 608052 - protein, 13 aa, Mycobacterium
VGKPTAREGTEPW

SEQ ID NO: 608053 - protein, 7 aa, Mycobacterium
VGKRPPG

SEQ ID NO: 608054 - protein, 18 aa, Mycobacterium
VGKTPSETAAKARELLQN

SEQ ID NO: 608055 - protein, 18 aa, Mycobacterium
VGKTPSETAALAREILKT

SEQ ID NO: 608056 - protein, 18 aa, Mycobacterium
VGKTPSETAALAREILQN

SEQ ID NO: 608057 - protein, 18 aa, Mycobacterium
VGKTPSETAALAREILQS

SEQ ID NO: 608058 - protein, 18 aa, Mycobacterium
VGKTPSETAMLAREILKG

SEQ ID NO: 608059 - protein, 20 aa, Mycobacterium
VGLGEDASGVRPTPAIEPPV

SEQ ID NO: 608060 - protein, 6 aa, Mycobacterium
VGLGGD

SEQ ID NO: 608061 - protein, 60 aa, Mycobacterium
VGLGNKGNANLGSGNTGGQNLGSGNSGFGNIGGGNRGNDNTGSGNIGNGNFGAGNRYNGN

SEQ ID NO: 608062 - protein, 8 aa, Mycobacterium
VGLPADEY

SEQ ID NO: 608063 - protein, 10 aa, Mycobacterium
VGLPAGERRR

SEQ ID NO: 608064 - protein, 17 aa, Mycobacterium
VGLPEGPRRRTAGLRRE

SEQ ID NO: 608065 - protein, 10 aa, Mycobacterium
VGLPGGAGGH

SEQ ID NO: 608066 - protein, 8 aa, Mycobacterium
VGLPGSDI

SEQ ID NO: 608067 - protein, 23 aa, Mycobacterium
VGLPPQPSQGRRRRDGVPQAAGG

SEQ ID NO: 608068 - protein, 7 aa, Mycobacterium
VGLSDPV

SEQ ID NO: 608069 - protein, 19 aa, Mycobacterium
VGLSQANSAEFEPDTPDPV

SEQ ID NO: 608070 - protein, 17 aa, Mycobacterium
VGLSSRTEHCDSGPSMP

SEQ ID NO: 608071 - protein, 19 aa, Mycobacterium
VGLTEASSAEFDPDTPDPV

SEQ ID NO: 608072 - protein, 10 aa, Mycobacterium
VGLTPEDRKH

SEQ ID NO: 608073 - protein, 7 aa, Mycobacterium
VGMADPT

SEQ ID NO: 608074 - protein, 8 aa, Mycobacterium
VGNADEVA

SEQ ID NO: 608075 - protein, 10 aa, Mycobacterium
VGNAEGASAQ

SEQ ID NO: 608076 - protein, 5 aa, Mycobacterium
VGNAG

SEQ ID NO: 608077 - protein, 7 aa, Mycobacterium
VGNAGAN

SEQ ID NO: 608078 - protein, 21 aa, Mycobacterium
VGNAGHSSAGLTAPSTSAEAD

SEQ ID NO: 608079 - protein, 6 aa, Mycobacterium
VGNAQK

SEQ ID NO: 608080 - protein, 21 aa, Mycobacterium
VGNASSLHTSGRAARRRIEES

SEQ ID NO: 608081 - protein, 10 aa, Mycobacterium
VGNDEDSGAV

SEQ ID NO: 608082 - protein, 12 aa, Mycobacterium
VGNDETTSDGSV

SEQ ID NO: 608083 - protein, 30 aa, Mycobacterium
VGNDGAGSGDGKKARAKSSGVRRLDDDDRV

SEQ ID NO: 608084 - protein, 6 aa, Mycobacterium
VGNDRA

SEQ ID NO: 608085 - protein, 7 aa, Mycobacterium
VGNEEGE

SEQ ID NO: 608086 - protein, 6 aa, Mycobacterium
VGNGAV

SEQ ID NO: 608087 - protein, 35 aa, Mycobacterium
VGNGGNGGAGGSGVTDGAGGRGGAGGGLYGTPGMS

SEQ ID NO: 608088 - protein, 6 aa, Mycobacterium
VGNGKD

SEQ ID NO: 608089 - protein, 22 aa, Mycobacterium
VGNGNAVVSPSGAGIHEVDVKI

SEQ ID NO: 608090 - protein, 18 aa, Mycobacterium
VGNHDTLGGACSQESNTL

SEQ ID NO: 608091 - protein, 26 aa, Mycobacterium
VGNIGNENIGGGNTGIGNLGAGNNGI

SEQ ID NO: 608092 - protein, 4 aa, Mycobacterium
VGNN

SEQ ID NO: 608093 - protein, 7 aa, Mycobacterium
VGNNQKA

SEQ ID NO: 608094 - protein, 7 aa, Mycobacterium
VGNPATV

SEQ ID NO: 608095 - protein, 8 aa, Mycobacterium
VGNPDEVA

SEQ ID NO: 608096 - protein, 9 aa, Mycobacterium
VGNPDTAEH

SEQ ID NO: 608097 - protein, 10 aa, Mycobacterium
VGNPEGAPAL

SEQ ID NO: 608098 - protein, 5 aa, Mycobacterium
VGNPT

SEQ ID NO: 608099 - protein, 8 aa, Mycobacterium
VGNPTAKA

SEQ ID NO: 608100 - protein, 6 aa, Mycobacterium
VGNPVA

SEQ ID NO: 608101 - protein, 4 aa, Mycobacterium
VGNR

SEQ ID NO: 608102 - protein, 17 aa, Mycobacterium
VGNRAIGDRPSQNLTTG

SEQ ID NO: 608103 - protein, 17 aa, Mycobacterium
VGNRALGDRPSQNLTSG

SEQ ID NO: 608104 - protein, 20 aa, Mycobacterium
VGNRNSKADKSSGRRSKWGD

SEQ ID NO: 608105 - protein, 5 aa, Mycobacterium
VGNRP

SEQ ID NO: 608106 - protein, 8 aa, Mycobacterium
VGNRSPDA

SEQ ID NO: 608107 - protein, 4 aa, Mycobacterium
VGNS

SEQ ID NO: 608108 - protein, 7 aa, Mycobacterium
VGNSAPA

SEQ ID NO: 608109 - protein, 5 aa, Mycobacterium
VGNSD

SEQ ID NO: 608110 - protein, 35 aa, Mycobacterium
VGNSGEGNSALVPPQSGNYNIGGGNNGNNNLGAGN

SEQ ID NO: 608111 - protein, 10 aa, Mycobacterium
VGNSGTGNLG

SEQ ID NO: 608112 - protein, 5 aa, Mycobacterium
VGNSL

SEQ ID NO: 608113 - protein, 13 aa, Mycobacterium
VGNSTGSAGLDTN

SEQ ID NO: 608114 - protein, 13 aa, Mycobacterium
VGNSTGSSGLDTN

SEQ ID NO: 608115 - protein, 13 aa, Mycobacterium
VGNSTRRNAAAHP

SEQ ID NO: 608116 - protein, 4 aa, Mycobacterium
VGNT

SEQ ID NO: 608117 - protein, 7 aa, Mycobacterium
VGNTDGV

SEQ ID NO: 608118 - protein, 18 aa, Mycobacterium
VGNTPGQPVKPGSMGRPM

SEQ ID NO: 608119 - protein, 9 aa, Mycobacterium
VGNYNTGNY

SEQ ID NO: 608120 - protein, 6 aa, Mycobacterium
VGPAAP

SEQ ID NO: 608121 - protein, 9 aa, Mycobacterium
VGPAASPAT

SEQ ID NO: 608122 - protein, 5 aa, Mycobacterium
VGPAD

SEQ ID NO: 608123 - protein, 7 aa, Mycobacterium
VGPADAA

SEQ ID NO: 608124 - protein, 6 aa, Mycobacterium
VGPAED

SEQ ID NO: 608125 - protein, 7 aa, Mycobacterium
VGPAESR

SEQ ID NO: 608126 - protein, 8 aa, Mycobacterium
VGPAGEHA

SEQ ID NO: 608127 - protein, 9 aa, Mycobacterium
VGPAGPDHI

SEQ ID NO: 608128 - protein, 6 aa, Mycobacterium
VGPAGT

SEQ ID NO: 608129 - protein, 8 aa, Mycobacterium
VGPANAKK

SEQ ID NO: 608130 - protein, 8 aa, Mycobacterium
VGPAPLTA

SEQ ID NO: 608131 - protein, 12 aa, Mycobacterium
VGPAPVRNTEYT

SEQ ID NO: 608132 - protein, 27 aa, Mycobacterium
VGPAQRTPISPVSQGSGPLPGPAVTST

SEQ ID NO: 608133 - protein, 6 aa, Mycobacterium
VGPATA

SEQ ID NO: 608134 - protein, 17 aa, Mycobacterium
VGPATAAALRLKAEPAL

SEQ ID NO: 608135 - protein, 8 aa, Mycobacterium
VGPATDEA

SEQ ID NO: 608136 - protein, 4 aa, Mycobacterium
VGPD

SEQ ID NO: 608137 - protein, 5 aa, Mycobacterium
VGPDA

SEQ ID NO: 608138 - protein, 6 aa, Mycobacterium
VGPDAA

SEQ ID NO: 608139 - protein, 17 aa, Mycobacterium
VGPDALADTRQSGGGED

SEQ ID NO: 608140 - protein, 10 aa, Mycobacterium
VGPDDAPTRI

SEQ ID NO: 608141 - protein, 7 aa, Mycobacterium
VGPDGDV

SEQ ID NO: 608142 - protein, 17 aa, Mycobacterium
VGPDGEAQHRSGTGVAA

SEQ ID NO: 608143 - protein, 7 aa, Mycobacterium
VGPDGHE

SEQ ID NO: 608144 - protein, 6 aa, Mycobacterium
VGPDGM

SEQ ID NO: 608145 - protein, 11 aa, Mycobacterium
VGPDGMGNSEE

SEQ ID NO: 608146 - protein, 10 aa, Mycobacterium
VGPDGRRDVG

SEQ ID NO: 608147 - protein, 8 aa, Mycobacterium
VGPDGVGV

SEQ ID NO: 608148 - protein, 7 aa, Mycobacterium
VGPDGYD

SEQ ID NO: 608149 - protein, 9 aa, Mycobacterium
VGPDHPKRS

SEQ ID NO: 608150 - protein, 5 aa, Mycobacterium
VGPDK

SEQ ID NO: 608151 - protein, 12 aa, Mycobacterium
VGPDNDKRQEFR

SEQ ID NO: 608152 - protein, 10 aa, Mycobacterium
VGPDPDPRTL

SEQ ID NO: 608153 - protein, 6 aa, Mycobacterium
VGPDPG

SEQ ID NO: 608154 - protein, 5 aa, Mycobacterium
VGPDQ

SEQ ID NO: 608155 - protein, 7 aa, Mycobacterium
VGPDRTG

SEQ ID NO: 608156 - protein, 10 aa, Mycobacterium
VGPDSGADDA

SEQ ID NO: 608157 - protein, 7 aa, Mycobacterium
VGPDSPL

SEQ ID NO: 608158 - protein, 5 aa, Mycobacterium
VGPEA

SEQ ID NO: 608159 - protein, 7 aa, Mycobacterium
VGPEAED

SEQ ID NO: 608160 - protein, 6 aa, Mycobacterium
VGPEDA

SEQ ID NO: 608161 - protein, 7 aa, Mycobacterium
VGPEDGI

SEQ ID NO: 608162 - protein, 9 aa, Mycobacterium
VGPEDLDAE

SEQ ID NO: 608163 - protein, 6 aa, Mycobacterium
VGPEDR

SEQ ID NO: 608164 - protein, 9 aa, Mycobacterium
VGPEEGHTN

SEQ ID NO: 608165 - protein, 10 aa, Mycobacterium
VGPEEGHTNR

SEQ ID NO: 608166 - protein, 9 aa, Mycobacterium
VGPEEPIES

SEQ ID NO: 608167 - protein, 6 aa, Mycobacterium
VGPEGA

SEQ ID NO: 608168 - protein, 12 aa, Mycobacterium
VGPEGSVTSYEV

SEQ ID NO: 608169 - protein, 5 aa, Mycobacterium
VGPEL

SEQ ID NO: 608170 - protein, 9 aa, Mycobacterium
VGPELGGQA

SEQ ID NO: 608171 - protein, 5 aa, Mycobacterium
VGPEN

SEQ ID NO: 608172 - protein, 6 aa, Mycobacterium
VGPENS

SEQ ID NO: 608173 - protein, 5 aa, Mycobacterium
VGPEQ

SEQ ID NO: 608174 - protein, 14 aa, Mycobacterium
VGPERAASPTADGR

SEQ ID NO: 608175 - protein, 6 aa, Mycobacterium
VGPERM

SEQ ID NO: 608176 - protein, 6 aa, Mycobacterium
VGPESA

SEQ ID NO: 608177 - protein, 9 aa, Mycobacterium
VGPESDSYE

SEQ ID NO: 608178 - protein, 9 aa, Mycobacterium
VGPESGAEE

SEQ ID NO: 608179 - protein, 7 aa, Mycobacterium
VGPETAA

SEQ ID NO: 608180 - protein, 4 aa, Mycobacterium
VGPF

SEQ ID NO: 608181 - protein, 10 aa, Mycobacterium
VGPGAAGTFD

SEQ ID NO: 608182 - protein, 10 aa, Mycobacterium
VGPGATGHRV

SEQ ID NO: 608183 - protein, 12 aa, Mycobacterium
VGPGATKVTETF

SEQ ID NO: 608184 - protein, 9 aa, Mycobacterium
VGPGEPAER

SEQ ID NO: 608185 - protein, 6 aa, Mycobacterium
VGPGES

SEQ ID NO: 608186 - protein, 7 aa, Mycobacterium
VGPGESG

SEQ ID NO: 608187 - protein, 5 aa, Mycobacterium
VGPGF

SEQ ID NO: 608188 - protein, 80 aa, Mycobacterium
VGPGGDGGLGGTGGNGGNGSQPPFGSTPAGSGGDGGNGGAGGSSGFVSGQSGTDGQDGGDPSGQFGGTGGAGGSGGAGAG

SEQ ID NO: 608189 - protein, 6 aa, Mycobacterium
VGPGGR

SEQ ID NO: 608190 - protein, 7 aa, Mycobacterium
VGPGGYQ

SEQ ID NO: 608191 - protein, 6 aa, Mycobacterium
VGPGNP

SEQ ID NO: 608192 - protein, 12 aa, Mycobacterium
VGPGPGRRRRRA

SEQ ID NO: 608193 - protein, 7 aa, Mycobacterium
VGPGPMD

SEQ ID NO: 608194 - protein, 10 aa, Mycobacterium
VGPGQDVTTA

SEQ ID NO: 608195 - protein, 5 aa, Mycobacterium
VGPGR

SEQ ID NO: 608196 - protein, 17 aa, Mycobacterium
VGPGRDQTIVRRDILAT

SEQ ID NO: 608197 - protein, 17 aa, Mycobacterium
VGPGRDQTIVRRDVLAA

SEQ ID NO: 608198 - protein, 18 aa, Mycobacterium
VGPGRDQTIVRRDVLAAR

SEQ ID NO: 608199 - protein, 10 aa, Mycobacterium
VGPGSLPTDS

SEQ ID NO: 608200 - protein, 19 aa, Mycobacterium
VGPGTDGAPGTGQAGGPGG

SEQ ID NO: 608201 - protein, 6 aa, Mycobacterium
VGPGTH

SEQ ID NO: 608202 - protein, 11 aa, Mycobacterium
VGPGTTETDMN

SEQ ID NO: 608203 - protein, 11 aa, Mycobacterium
VGPGVDDIAPG

SEQ ID NO: 608204 - protein, 11 aa, Mycobacterium
VGPGVEGIEPG

SEQ ID NO: 608205 - protein, 11 aa, Mycobacterium
VGPGVEGLEPG

SEQ ID NO: 608206 - protein, 12 aa, Mycobacterium
VGPGVSKVKPGD

SEQ ID NO: 608207 - protein, 10 aa, Mycobacterium
VGPGVTDFAP

SEQ ID NO: 608208 - protein, 12 aa, Mycobacterium
VGPGVTKVKPGD

SEQ ID NO: 608209 - protein, 14 aa, Mycobacterium
VGPHARDTDGCGRD

SEQ ID NO: 608210 - protein, 27 aa, Mycobacterium
VGPHARTRRRRRHTARDPRPADRCRPA

SEQ ID NO: 608211 - protein, 5 aa, Mycobacterium
VGPHV

SEQ ID NO: 608212 - protein, 13 aa, Mycobacterium
VGPIAPDQTAAAE

SEQ ID NO: 608213 - protein, 6 aa, Mycobacterium
VGPIDN

SEQ ID NO: 608214 - protein, 13 aa, Mycobacterium
VGPIEPEQTAAAE

SEQ ID NO: 608215 - protein, 12 aa, Mycobacterium
VGPIESDDTAVA

SEQ ID NO: 608216 - protein, 4 aa, Mycobacterium
VGPK

SEQ ID NO: 608217 - protein, 8 aa, Mycobacterium
VGPKQTAL

SEQ ID NO: 608218 - protein, 10 aa, Mycobacterium
VGPKTRRLAA

SEQ ID NO: 608219 - protein, 13 aa, Mycobacterium
VGPKTRRLTSHPG

SEQ ID NO: 608220 - protein, 5 aa, Mycobacterium
VGPLD

SEQ ID NO: 608221 - protein, 7 aa, Mycobacterium
VGPLDQD

SEQ ID NO: 608222 - protein, 4 aa, Mycobacterium
VGPM

SEQ ID NO: 608223 - protein, 8 aa, Mycobacterium
VGPMTGTD

SEQ ID NO: 608224 - protein, 11 aa, Mycobacterium
VGPNGSGKSNV

SEQ ID NO: 608225 - protein, 8 aa, Mycobacterium
VGPNPGAD

SEQ ID NO: 608226 - protein, 12 aa, Mycobacterium
VGPNVSTVQPGD

SEQ ID NO: 608227 - protein, 6 aa, Mycobacterium
VGPPDS

SEQ ID NO: 608228 - protein, 5 aa, Mycobacterium
VGPPG

SEQ ID NO: 608229 - protein, 14 aa, Mycobacterium
VGPPGPDWDERYPP

SEQ ID NO: 608230 - protein, 14 aa, Mycobacterium
VGPPHQPEPGARGV

SEQ ID NO: 608231 - protein, 24 aa, Mycobacterium
VGPPNQRGAGASIRAGAHNPEDRR

SEQ ID NO: 608232 - protein, 13 aa, Mycobacterium
VGPPPAQTGGPPL

SEQ ID NO: 608233 - protein, 10 aa, Mycobacterium
VGPPPGGLTG

SEQ ID NO: 608234 - protein, 18 aa, Mycobacterium
VGPPPPSVGRNPPPTGWS

SEQ ID NO: 608235 - protein, 15 aa, Mycobacterium
VGPPQRGDGSAADRG

SEQ ID NO: 608236 - protein, 12 aa, Mycobacterium
VGPPQRPLTTTV

SEQ ID NO: 608237 - protein, 6 aa, Mycobacterium
VGPPRS

SEQ ID NO: 608238 - protein, 11 aa, Mycobacterium
VGPPSDPAAQI

SEQ ID NO: 608239 - protein, 9 aa, Mycobacterium
VGPPSNPAV

SEQ ID NO: 608240 - protein, 6 aa, Mycobacterium
VGPPST

SEQ ID NO: 608241 - protein, 8 aa, Mycobacterium
VGPPTPVA

SEQ ID NO: 608242 - protein, 7 aa, Mycobacterium
VGPPVPG

SEQ ID NO: 608243 - protein, 6 aa, Mycobacterium
VGPQPE

SEQ ID NO: 608244 - protein, 6 aa, Mycobacterium
VGPQPG

SEQ ID NO: 608245 - protein, 10 aa, Mycobacterium
VGPQPLAPDE

SEQ ID NO: 608246 - protein, 6 aa, Mycobacterium
VGPQTA

SEQ ID NO: 608247 - protein, 8 aa, Mycobacterium
VGPRAAAD

SEQ ID NO: 608248 - protein, 7 aa, Mycobacterium
VGPRAGR

SEQ ID NO: 608249 - protein, 7 aa, Mycobacterium
VGPRAQD

SEQ ID NO: 608250 - protein, 8 aa, Mycobacterium
VGPRDRTR

SEQ ID NO: 608251 - protein, 5 aa, Mycobacterium
VGPRE

SEQ ID NO: 608252 - protein, 8 aa, Mycobacterium
VGPRGEIK

SEQ ID NO: 608253 - protein, 12 aa, Mycobacterium
VGPRGRKDTAVA

SEQ ID NO: 608254 - protein, 9 aa, Mycobacterium
VGPRPASRP

SEQ ID NO: 608255 - protein, 7 aa, Mycobacterium
VGPRTEE

SEQ ID NO: 608256 - protein, 4 aa, Mycobacterium
VGPS

SEQ ID NO: 608257 - protein, 12 aa, Mycobacterium
VGPSACDKNDAI

SEQ ID NO: 608258 - protein, 6 aa, Mycobacterium
VGPSAV

SEQ ID NO: 608259 - protein, 13 aa, Mycobacterium
VGPSDLSSTPAWA

SEQ ID NO: 608260 - protein, 11 aa, Mycobacterium
VGPSEADVKDR

SEQ ID NO: 608261 - protein, 9 aa, Mycobacterium
VGPSETVDA

SEQ ID NO: 608262 - protein, 7 aa, Mycobacterium
VGPSGRV

SEQ ID NO: 608263 - protein, 5 aa, Mycobacterium
VGPSI

SEQ ID NO: 608264 - protein, 7 aa, Mycobacterium
VGPSMGT

SEQ ID NO: 608265 - protein, 7 aa, Mycobacterium
VGPSPIA

SEQ ID NO: 608266 - protein, 8 aa, Mycobacterium
VGPSPPEN

SEQ ID NO: 608267 - protein, 6 aa, Mycobacterium
VGPSPV

SEQ ID NO: 608268 - protein, 29 aa, Mycobacterium
VGPSRRNRRRGHHGGPADQHRAGAGEHQR

SEQ ID NO: 608269 - protein, 19 aa, Mycobacterium
VGPSSAGDGGNGGGGGRAG

SEQ ID NO: 608270 - protein, 6 aa, Mycobacterium
VGPSSV

SEQ ID NO: 608271 - protein, 8 aa, Mycobacterium
VGPSTGTN

SEQ ID NO: 608272 - protein, 7 aa, Mycobacterium
VGPSTHE

SEQ ID NO: 608273 - protein, 6 aa, Mycobacterium
VGPSVQ

SEQ ID NO: 608274 - protein, 21 aa, Mycobacterium
VGPSWRKGPYNVRGRGPRDTY

SEQ ID NO: 608275 - protein, 12 aa, Mycobacterium
VGPTASGMRPPT

SEQ ID NO: 608276 - protein, 8 aa, Mycobacterium
VGPTEDTE

SEQ ID NO: 608277 - protein, 9 aa, Mycobacterium
VGPTGGGGL

SEQ ID NO: 608278 - protein, 7 aa, Mycobacterium
VGPTKDR

SEQ ID NO: 608279 - protein, 6 aa, Mycobacterium
VGPTPH

SEQ ID NO: 608280 - protein, 7 aa, Mycobacterium
VGPTQAS

SEQ ID NO: 608281 - protein, 7 aa, Mycobacterium
VGPTTGR

SEQ ID NO: 608282 - protein, 6 aa, Mycobacterium
VGPTYG

SEQ ID NO: 608283 - protein, 14 aa, Mycobacterium
VGPVESGESGEPTE

SEQ ID NO: 608284 - protein, 14 aa, Mycobacterium
VGPVGGQRQPLRHS

SEQ ID NO: 608285 - protein, 8 aa, Mycobacterium
VGPVPGAD

SEQ ID NO: 608286 - protein, 6 aa, Mycobacterium
VGPVSR

SEQ ID NO: 608287 - protein, 12 aa, Mycobacterium
VGQADDLRRNGA

SEQ ID NO: 608288 - protein, 5 aa, Mycobacterium
VGQAE

SEQ ID NO: 608289 - protein, 22 aa, Mycobacterium
VGQAEDLRRNGADVVVNDLAEL

SEQ ID NO: 608290 - protein, 7 aa, Mycobacterium
VGQAERL

SEQ ID NO: 608291 - protein, 24 aa, Mycobacterium
VGQAGAGYQANEAASARALRELGH

SEQ ID NO: 608292 - protein, 8 aa, Mycobacterium
VGQAGALD

SEQ ID NO: 608293 - protein, 12 aa, Mycobacterium
VGQAGQLRRDGA

SEQ ID NO: 608294 - protein, 16 aa, Mycobacterium
VGQDDGPRPGRARGPH

SEQ ID NO: 608295 - protein, 6 aa, Mycobacterium
VGQDDL

SEQ ID NO: 608296 - protein, 19 aa, Mycobacterium
VGQDGRSNGITAPTRRGQE

SEQ ID NO: 608297 - protein, 13 aa, Mycobacterium
VGQDMGNGDQWPQ

SEQ ID NO: 608298 - protein, 11 aa, Mycobacterium
VGQDRAYKESH

SEQ ID NO: 608299 - protein, 10 aa, Mycobacterium
VGQDREFKES

SEQ ID NO: 608300 - protein, 9 aa, Mycobacterium
VGQELPTPY

SEQ ID NO: 608301 - protein, 10 aa, Mycobacterium
VGQERGQDAD

SEQ ID NO: 608302 - protein, 4 aa, Mycobacterium
VGQG

SEQ ID NO: 608303 - protein, 7 aa, Mycobacterium
VGQGDRG

SEQ ID NO: 608304 - protein, 14 aa, Mycobacterium
VGQGTAGSGNVGSA

SEQ ID NO: 608305 - protein, 6 aa, Mycobacterium
VGQPGA

SEQ ID NO: 608306 - protein, 7 aa, Mycobacterium
VGQPPHV

SEQ ID NO: 608307 - protein, 7 aa, Mycobacterium
VGQPVPG

SEQ ID NO: 608308 - protein, 10 aa, Mycobacterium
VGQQDGAQPF

SEQ ID NO: 608309 - protein, 6 aa, Mycobacterium
VGQQQA

SEQ ID NO: 608310 - protein, 4 aa, Mycobacterium
VGQR

SEQ ID NO: 608311 - protein, 5 aa, Mycobacterium
VGQRD

SEQ ID NO: 608312 - protein, 15 aa, Mycobacterium
VGQRDGQHRVDRGED

SEQ ID NO: 608313 - protein, 5 aa, Mycobacterium
VGQRR

SEQ ID NO: 608314 - protein, 8 aa, Mycobacterium
VGQSDSCR

SEQ ID NO: 608315 - protein, 9 aa, Mycobacterium
VGQSRSGAL

SEQ ID NO: 608316 - protein, 8 aa, Mycobacterium
VGQSRSGR

SEQ ID NO: 608317 - protein, 4 aa, Mycobacterium
VGQT

SEQ ID NO: 608318 - protein, 5 aa, Mycobacterium
VGQTL

SEQ ID NO: 608319 - protein, 12 aa, Mycobacterium
VGQTSLPPDAAR

SEQ ID NO: 608320 - protein, 4 aa, Mycobacterium
VGRA

SEQ ID NO: 608321 - protein, 10 aa, Mycobacterium
VGRAPDGSLA

SEQ ID NO: 608322 - protein, 25 aa, Mycobacterium
VGRAPGGPAGVGQAQVGAQRRQRHA

SEQ ID NO: 608323 - protein, 12 aa, Mycobacterium
VGRATSLADGAG

SEQ ID NO: 608324 - protein, 6 aa, Mycobacterium
VGRAYG

SEQ ID NO: 608325 - protein, 8 aa, Mycobacterium
VGRCPRKP

SEQ ID NO: 608326 - protein, 4 aa, Mycobacterium
VGRD

SEQ ID NO: 608327 - protein, 7 aa, Mycobacterium
VGRDDGA

SEQ ID NO: 608328 - protein, 7 aa, Mycobacterium
VGRDDRG

SEQ ID NO: 608329 - protein, 11 aa, Mycobacterium
VGRDPAAIERS

SEQ ID NO: 608330 - protein, 19 aa, Mycobacterium
VGRDPAGIERSAAVKNGGE

SEQ ID NO: 608331 - protein, 21 aa, Mycobacterium
VGRDPDAIERSAEAKGRTEDA

SEQ ID NO: 608332 - protein, 9 aa, Mycobacterium
VGRDPGEIR

SEQ ID NO: 608333 - protein, 6 aa, Mycobacterium
VGRDPQ

SEQ ID NO: 608334 - protein, 30 aa, Mycobacterium
VGRDSTRGLGAGADPDVGRKAAEDAKDEIE

SEQ ID NO: 608335 - protein, 18 aa, Mycobacterium
VGREPAGIERSAAVPNRG

SEQ ID NO: 608336 - protein, 9 aa, Mycobacterium
VGREPARRI

SEQ ID NO: 608337 - protein, 7 aa, Mycobacterium
VGRGDDA

SEQ ID NO: 608338 - protein, 6 aa, Mycobacterium
VGRGEF

SEQ ID NO: 608339 - protein, 8 aa, Mycobacterium
VGRGEHRA

SEQ ID NO: 608340 - protein, 7 aa, Mycobacterium
VGRGGDD

SEQ ID NO: 608341 - protein, 8 aa, Mycobacterium
VGRGGSPT

SEQ ID NO: 608342 - protein, 9 aa, Mycobacterium
VGRGLTDEG

SEQ ID NO: 608343 - protein, 7 aa, Mycobacterium
VGRGPTA

SEQ ID NO: 608344 - protein, 7 aa, Mycobacterium
VGRGQGW

SEQ ID NO: 608345 - protein, 13 aa, Mycobacterium
VGRGSENDECRAK

SEQ ID NO: 608346 - protein, 13 aa, Mycobacterium
VGRGSGRAAEGLP

SEQ ID NO: 608347 - protein, 18 aa, Mycobacterium
VGRGSPQGLAASKALTTP

SEQ ID NO: 608348 - protein, 7 aa, Mycobacterium
VGRGSPW

SEQ ID NO: 608349 - protein, 10 aa, Mycobacterium
VGRGTEDGVR

SEQ ID NO: 608350 - protein, 6 aa, Mycobacterium
VGRGTT

SEQ ID NO: 608351 - protein, 4 aa, Mycobacterium
VGRH

SEQ ID NO: 608352 - protein, 5 aa, Mycobacterium
VGRHN

SEQ ID NO: 608353 - protein, 4 aa, Mycobacterium
VGRI

SEQ ID NO: 608354 - protein, 6 aa, Mycobacterium
VGRKVG

SEQ ID NO: 608355 - protein, 9 aa, Mycobacterium
VGRNAEMPQ

SEQ ID NO: 608356 - protein, 10 aa, Mycobacterium
VGRNEDADTL

SEQ ID NO: 608357 - protein, 13 aa, Mycobacterium
VGRNGGSAVSSRY

SEQ ID NO: 608358 - protein, 7 aa, Mycobacterium
VGRNNSH

SEQ ID NO: 608359 - protein, 6 aa, Mycobacterium
VGRNSA

SEQ ID NO: 608360 - protein, 5 aa, Mycobacterium
VGRNT

SEQ ID NO: 608361 - protein, 12 aa, Mycobacterium
VGRNTGSGVSRS

SEQ ID NO: 608362 - protein, 7 aa, Mycobacterium
VGRPAEL

SEQ ID NO: 608363 - protein, 16 aa, Mycobacterium
VGRPAPEDLTDEPRRL

SEQ ID NO: 608364 - protein, 11 aa, Mycobacterium
VGRPDPRLGET

SEQ ID NO: 608365 - protein, 6 aa, Mycobacterium
VGRPGD

SEQ ID NO: 608366 - protein, 9 aa, Mycobacterium
VGRPGETAA

SEQ ID NO: 608367 - protein, 10 aa, Mycobacterium
VGRPGPGRRA

SEQ ID NO: 608368 - protein, 16 aa, Mycobacterium
VGRPGSADEKLGGDGA

SEQ ID NO: 608369 - protein, 5 aa, Mycobacterium
VGRPI

SEQ ID NO: 608370 - protein, 10 aa, Mycobacterium
VGRPKAVSAR

SEQ ID NO: 608371 - protein, 8 aa, Mycobacterium
VGRPLPGN

SEQ ID NO: 608372 - protein, 10 aa, Mycobacterium
VGRPQNNLGG

SEQ ID NO: 608373 - protein, 5 aa, Mycobacterium
VGRPR

SEQ ID NO: 608374 - protein, 8 aa, Mycobacterium
VGRPRKAF

SEQ ID NO: 608375 - protein, 6 aa, Mycobacterium
VGRPRS

SEQ ID NO: 608376 - protein, 6 aa, Mycobacterium
VGRPRT

SEQ ID NO: 608377 - protein, 8 aa, Mycobacterium
VGRPSGNI

SEQ ID NO: 608378 - protein, 13 aa, Mycobacterium
VGRPTSTRGAPPL

SEQ ID NO: 608379 - protein, 5 aa, Mycobacterium
VGRPV

SEQ ID NO: 608380 - protein, 6 aa, Mycobacterium
VGRPVP

SEQ ID NO: 608381 - protein, 14 aa, Mycobacterium
VGRQARPPNPGKGV

SEQ ID NO: 608382 - protein, 8 aa, Mycobacterium
VGRQHRGQ

SEQ ID NO: 608383 - protein, 11 aa, Mycobacterium
VGRQSGLAAEG

SEQ ID NO: 608384 - protein, 6 aa, Mycobacterium
VGRQSL

SEQ ID NO: 608385 - protein, 10 aa, Mycobacterium
VGRRDGDRLE

SEQ ID NO: 608386 - protein, 12 aa, Mycobacterium
VGRREPEREEER

SEQ ID NO: 608387 - protein, 9 aa, Mycobacterium
VGRRESSAT

SEQ ID NO: 608388 - protein, 8 aa, Mycobacterium
VGRRLPSG

SEQ ID NO: 608389 - protein, 5 aa, Mycobacterium
VGRRQ

SEQ ID NO: 608390 - protein, 5 aa, Mycobacterium
VGRRR

SEQ ID NO: 608391 - protein, 5 aa, Mycobacterium
VGRRT

SEQ ID NO: 608392 - protein, 4 aa, Mycobacterium
VGRS

SEQ ID NO: 608393 - protein, 11 aa, Mycobacterium
VGRSKAQSARD

SEQ ID NO: 608394 - protein, 10 aa, Mycobacterium
VGRSQRDLRP

SEQ ID NO: 608395 - protein, 16 aa, Mycobacterium
VGRSRDARRRPGDSAG

SEQ ID NO: 608396 - protein, 6 aa, Mycobacterium
VGRSRP

SEQ ID NO: 608397 - protein, 15 aa, Mycobacterium
VGRSTAAAPSTPGGL

SEQ ID NO: 608398 - protein, 16 aa, Mycobacterium
VGRSTASLSVVAPELS

SEQ ID NO: 608399 - protein, 14 aa, Mycobacterium
VGRSTPGADGSGRL

SEQ ID NO: 608400 - protein, 13 aa, Mycobacterium
VGRTAEKRSELER

SEQ ID NO: 608401 - protein, 7 aa, Mycobacterium
VGRTAEQ

SEQ ID NO: 608402 - protein, 7 aa, Mycobacterium
VGRTAPQ

SEQ ID NO: 608403 - protein, 10 aa, Mycobacterium
VGRTASGHPV

SEQ ID NO: 608404 - protein, 8 aa, Mycobacterium
VGRTEGLQ

SEQ ID NO: 608405 - protein, 6 aa, Mycobacterium
VGRTNT

SEQ ID NO: 608406 - protein, 19 aa, Mycobacterium
VGRTQPVRRSPRARDPQTA

SEQ ID NO: 608407 - protein, 7 aa, Mycobacterium
VGRTSAP

SEQ ID NO: 608408 - protein, 7 aa, Mycobacterium
VGRTSSM

SEQ ID NO: 608409 - protein, 8 aa, Mycobacterium
VGRTTSPF

SEQ ID NO: 608410 - protein, 6 aa, Mycobacterium
VGRVDD

SEQ ID NO: 608411 - protein, 4 aa, Mycobacterium
VGSA

SEQ ID NO: 608412 - protein, 12 aa, Mycobacterium
VGSAAKRQIAAN

SEQ ID NO: 608413 - protein, 10 aa, Mycobacterium
VGSAGAREID

SEQ ID NO: 608414 - protein, 23 aa, Mycobacterium
VGSAGSGPNGVIGGSGGDGGTGG

SEQ ID NO: 608415 - protein, 19 aa, Mycobacterium
VGSAGTVSPPRRFREAGMS

SEQ ID NO: 608416 - protein, 10 aa, Mycobacterium
VGSANAGNFN

SEQ ID NO: 608417 - protein, 12 aa, Mycobacterium
VGSASDRGAQSN

SEQ ID NO: 608418 - protein, 9 aa, Mycobacterium
VGSASRGQR

SEQ ID NO: 608419 - protein, 10 aa, Mycobacterium
VGSATRPPLR

SEQ ID NO: 608420 - protein, 6 aa, Mycobacterium
VGSAVD

SEQ ID NO: 608421 - protein, 5 aa, Mycobacterium
VGSCR

SEQ ID NO: 608422 - protein, 4 aa, Mycobacterium
VGSD

SEQ ID NO: 608423 - protein, 6 aa, Mycobacterium
VGSDAE

SEQ ID NO: 608424 - protein, 10 aa, Mycobacterium
VGSDAGDEFR

SEQ ID NO: 608425 - protein, 9 aa, Mycobacterium
VGSDEDKQR

SEQ ID NO: 608426 - protein, 9 aa, Mycobacterium
VGSDEEAPL

SEQ ID NO: 608427 - protein, 28 aa, Mycobacterium
VGSDGGPGEGPGPNRSGGEGGSRGRPGG

SEQ ID NO: 608428 - protein, 6 aa, Mycobacterium
VGSDGP

SEQ ID NO: 608429 - protein, 6 aa, Mycobacterium
VGSDHP

SEQ ID NO: 608430 - protein, 7 aa, Mycobacterium
VGSDHPI

SEQ ID NO: 608431 - protein, 10 aa, Mycobacterium
VGSDPDADLG

SEQ ID NO: 608432 - protein, 8 aa, Mycobacterium
VGSDQTGF

SEQ ID NO: 608433 - protein, 8 aa, Mycobacterium
VGSDRARF

SEQ ID NO: 608434 - protein, 12 aa, Mycobacterium
VGSDRASRRRLT

SEQ ID NO: 608435 - protein, 11 aa, Mycobacterium
VGSDSEDGGEI

SEQ ID NO: 608436 - protein, 12 aa, Mycobacterium
VGSDSHTPAAGS

SEQ ID NO: 608437 - protein, 6 aa, Mycobacterium
VGSDSN

SEQ ID NO: 608438 - protein, 11 aa, Mycobacterium
VGSDYRGDPAA

SEQ ID NO: 608439 - protein, 4 aa, Mycobacterium
VGSE

SEQ ID NO: 608440 - protein, 5 aa, Mycobacterium
VGSED

SEQ ID NO: 608441 - protein, 7 aa, Mycobacterium
VGSEDSV

SEQ ID NO: 608442 - protein, 7 aa, Mycobacterium
VGSEEAD

SEQ ID NO: 608443 - protein, 7 aa, Mycobacterium
VGSEEPD

SEQ ID NO: 608444 - protein, 8 aa, Mycobacterium
VGSEGAAY

SEQ ID NO: 608445 - protein, 8 aa, Mycobacterium
VGSENTGF

SEQ ID NO: 608446 - protein, 11 aa, Mycobacterium
VGSENVAGAPR

SEQ ID NO: 608447 - protein, 8 aa, Mycobacterium
VGSEPGSI

SEQ ID NO: 608448 - protein, 8 aa, Mycobacterium
VGSEPGSL

SEQ ID NO: 608449 - protein, 8 aa, Mycobacterium
VGSEQQRG

SEQ ID NO: 608450 - protein, 6 aa, Mycobacterium
VGSERA

SEQ ID NO: 608451 - protein, 9 aa, Mycobacterium
VGSERARFT

SEQ ID NO: 608452 - protein, 9 aa, Mycobacterium
VGSERAYEK

SEQ ID NO: 608453 - protein, 9 aa, Mycobacterium
VGSESEPTE

SEQ ID NO: 608454 - protein, 8 aa, Mycobacterium
VGSESNNL

SEQ ID NO: 608455 - protein, 8 aa, Mycobacterium
VGSEVSKY

SEQ ID NO: 608456 - protein, 4 aa, Mycobacterium
VGSF

SEQ ID NO: 608457 - protein, 5 aa, Mycobacterium
VGSFG

SEQ ID NO: 608458 - protein, 5 aa, Mycobacterium
VGSGA

SEQ ID NO: 608459 - protein, 14 aa, Mycobacterium
VGSGATSERQPAGD

SEQ ID NO: 608460 - protein, 7 aa, Mycobacterium
VGSGDDA

SEQ ID NO: 608461 - protein, 7 aa, Mycobacterium
VGSGDRE

SEQ ID NO: 608462 - protein, 5 aa, Mycobacterium
VGSGF

SEQ ID NO: 608463 - protein, 9 aa, Mycobacterium
VGSGGGWPT

SEQ ID NO: 608464 - protein, 37 aa, Mycobacterium
VGSGGNGGNGGFSATPAAGGTGGAGGALFGSDGVAGL

SEQ ID NO: 608465 - protein, 8 aa, Mycobacterium
VGSGGRIE

SEQ ID NO: 608466 - protein, 5 aa, Mycobacterium
VGSGI

SEQ ID NO: 608467 - protein, 12 aa, Mycobacterium
VGSGKRQTFAGG

SEQ ID NO: 608468 - protein, 12 aa, Mycobacterium
VGSGNADQLRDE

SEQ ID NO: 608469 - protein, 19 aa, Mycobacterium
VGSGNLGGTNLGSGNIGSA

SEQ ID NO: 608470 - protein, 17 aa, Mycobacterium
VGSGNRGSYNIGPGNLG

SEQ ID NO: 608471 - protein, 35 aa, Mycobacterium
VGSGNVGNANNGLGNIGNGNLGNGNFGSGNLGSSN

SEQ ID NO: 608472 - protein, 11 aa, Mycobacterium
VGSGPAGLAAA

SEQ ID NO: 608473 - protein, 8 aa, Mycobacterium
VGSGPQLR

SEQ ID NO: 608474 - protein, 6 aa, Mycobacterium
VGSGQA

SEQ ID NO: 608475 - protein, 11 aa, Mycobacterium
VGSGRQYRGPV

SEQ ID NO: 608476 - protein, 11 aa, Mycobacterium
VGSGTASIRTT

SEQ ID NO: 608477 - protein, 7 aa, Mycobacterium
VGSGTVP

SEQ ID NO: 608478 - protein, 10 aa, Mycobacterium
VGSGVSKSEV

SEQ ID NO: 608479 - protein, 18 aa, Mycobacterium
VGSHDTIGGACSQESNTL

SEQ ID NO: 608480 - protein, 6 aa, Mycobacterium
VGSHTT

SEQ ID NO: 608481 - protein, 5 aa, Mycobacterium
VGSKR

SEQ ID NO: 608482 - protein, 15 aa, Mycobacterium
VGSLAERRARGQKRV

SEQ ID NO: 608483 - protein, 5 aa, Mycobacterium
VGSLE

SEQ ID NO: 608484 - protein, 12 aa, Mycobacterium
VGSNAAERGRPP

SEQ ID NO: 608485 - protein, 14 aa, Mycobacterium
VGSNGGHGGQGGYG

SEQ ID NO: 608486 - protein, 13 aa, Mycobacterium
VGSNPTFSGKART

SEQ ID NO: 608487 - protein, 4 aa, Mycobacterium
VGSP

SEQ ID NO: 608488 - protein, 8 aa, Mycobacterium
VGSPAEVA

SEQ ID NO: 608489 - protein, 14 aa, Mycobacterium
VGSPAPSPDHRDDH

SEQ ID NO: 608490 - protein, 5 aa, Mycobacterium
VGSPD

SEQ ID NO: 608491 - protein, 8 aa, Mycobacterium
VGSPDELK

SEQ ID NO: 608492 - protein, 7 aa, Mycobacterium
VGSPEEL

SEQ ID NO: 608493 - protein, 7 aa, Mycobacterium
VGSPFDE

SEQ ID NO: 608494 - protein, 16 aa, Mycobacterium
VGSPGGPEAAARTARY

SEQ ID NO: 608495 - protein, 13 aa, Mycobacterium
VGSPGSDGRRHPD

SEQ ID NO: 608496 - protein, 12 aa, Mycobacterium
VGSPPRLAEPGP

SEQ ID NO: 608497 - protein, 9 aa, Mycobacterium
VGSPQQVAD

SEQ ID NO: 608498 - protein, 10 aa, Mycobacterium
VGSPTEAAEQ

SEQ ID NO: 608499 - protein, 8 aa, Mycobacterium
VGSPTYTG

SEQ ID NO: 608500 - protein, 16 aa, Mycobacterium
VGSQQPGFRRQETPYQ

SEQ ID NO: 608501 - protein, 10 aa, Mycobacterium
VGSQSPSVGQ

SEQ ID NO: 608502 - protein, 6 aa, Mycobacterium
VGSRAE

SEQ ID NO: 608503 - protein, 5 aa, Mycobacterium
VGSRC

SEQ ID NO: 608504 - protein, 27 aa, Mycobacterium
VGSREPFEAPGATSEDPVATVEQEHID

SEQ ID NO: 608505 - protein, 9 aa, Mycobacterium
VGSRETEQL

SEQ ID NO: 608506 - protein, 9 aa, Mycobacterium
VGSRPDPTV

SEQ ID NO: 608507 - protein, 11 aa, Mycobacterium
VGSRPTAMNSR

SEQ ID NO: 608508 - protein, 7 aa, Mycobacterium
VGSRRSR

SEQ ID NO: 608509 - protein, 11 aa, Mycobacterium
VGSRSSEDRLE

SEQ ID NO: 608510 - protein, 13 aa, Mycobacterium
VGSSAHDAATPQF

SEQ ID NO: 608511 - protein, 11 aa, Mycobacterium
VGSSAIQGSRI

SEQ ID NO: 608512 - protein, 10 aa, Mycobacterium
VGSSAKDDPL

SEQ ID NO: 608513 - protein, 13 aa, Mycobacterium
VGSSDSTANTRTR

SEQ ID NO: 608514 - protein, 8 aa, Mycobacterium
VGSSETGA

SEQ ID NO: 608515 - protein, 11 aa, Mycobacterium
VGSSGQGNYAA

SEQ ID NO: 608516 - protein, 12 aa, Mycobacterium
VGSSGQGNYGAA

SEQ ID NO: 608517 - protein, 16 aa, Mycobacterium
VGSSGVGNSGDGSAGL

SEQ ID NO: 608518 - protein, 24 aa, Mycobacterium
VGSSHGYDVTDPTTISAELGGPEG

SEQ ID NO: 608519 - protein, 5 aa, Mycobacterium
VGSSI

SEQ ID NO: 608520 - protein, 6 aa, Mycobacterium
VGSSIA

SEQ ID NO: 608521 - protein, 8 aa, Mycobacterium
VGSSPRSV

SEQ ID NO: 608522 - protein, 10 aa, Mycobacterium
VGSSSRASSV

SEQ ID NO: 608523 - protein, 5 aa, Mycobacterium
VGSST

SEQ ID NO: 608524 - protein, 12 aa, Mycobacterium
VGSTEAEARERR

SEQ ID NO: 608525 - protein, 12 aa, Mycobacterium
VGSTGDGDAPDQ

SEQ ID NO: 608526 - protein, 7 aa, Mycobacterium
VGSTGDT

SEQ ID NO: 608527 - protein, 11 aa, Mycobacterium
VGSTGSPLPAS

SEQ ID NO: 608528 - protein, 5 aa, Mycobacterium
VGSTI

SEQ ID NO: 608529 - protein, 35 aa, Mycobacterium
VGSTNTGSFDAGSANTGNFNPGDTNTGSYNPGNVN

SEQ ID NO: 608530 - protein, 57 aa, Mycobacterium
VGSTRPLSRAERRAQAARVTADETAPAAPEPQNTDIPPAPVATPPDGEQEARQAEPV

SEQ ID NO: 608531 - protein, 6 aa, Mycobacterium
VGSTSA

SEQ ID NO: 608532 - protein, 27 aa, Mycobacterium
VGSYNTGGFNPGDANTGGFNTGSYNTG

SEQ ID NO: 608533 - protein, 8 aa, Mycobacterium
VGSYNTGT

SEQ ID NO: 608534 - protein, 5 aa, Mycobacterium
VGTAD

SEQ ID NO: 608535 - protein, 7 aa, Mycobacterium
VGTADEV

SEQ ID NO: 608536 - protein, 9 aa, Mycobacterium
VGTADQTPA

SEQ ID NO: 608537 - protein, 7 aa, Mycobacterium
VGTAEDV

SEQ ID NO: 608538 - protein, 7 aa, Mycobacterium
VGTAEEV

SEQ ID NO: 608539 - protein, 6 aa, Mycobacterium
VGTAPG

SEQ ID NO: 608540 - protein, 7 aa, Mycobacterium
VGTAPGA

SEQ ID NO: 608541 - protein, 5 aa, Mycobacterium
VGTAQ

SEQ ID NO: 608542 - protein, 9 aa, Mycobacterium
VGTARTEAD

SEQ ID NO: 608543 - protein, 10 aa, Mycobacterium
VGTASARKLR

SEQ ID NO: 608544 - protein, 8 aa, Mycobacterium
VGTASVDD

SEQ ID NO: 608545 - protein, 6 aa, Mycobacterium
VGTAVA

SEQ ID NO: 608546 - protein, 5 aa, Mycobacterium
VGTDA

SEQ ID NO: 608547 - protein, 6 aa, Mycobacterium
VGTDAD

SEQ ID NO: 608548 - protein, 10 aa, Mycobacterium
VGTDEDTGAV

SEQ ID NO: 608549 - protein, 8 aa, Mycobacterium
VGTDEQRE

SEQ ID NO: 608550 - protein, 7 aa, Mycobacterium
VGTDERR

SEQ ID NO: 608551 - protein, 15 aa, Mycobacterium
VGTDGGGSVRIPGGF

SEQ ID NO: 608552 - protein, 7 aa, Mycobacterium
VGTDGGR

SEQ ID NO: 608553 - protein, 6 aa, Mycobacterium
VGTDGS

SEQ ID NO: 608554 - protein, 11 aa, Mycobacterium
VGTDGSGSPAR

SEQ ID NO: 608555 - protein, 11 aa, Mycobacterium
VGTDKRYGRRS

SEQ ID NO: 608556 - protein, 8 aa, Mycobacterium
VGTDKSRT

SEQ ID NO: 608557 - protein, 7 aa, Mycobacterium
VGTDNRR

SEQ ID NO: 608558 - protein, 8 aa, Mycobacterium
VGTDNRRE

SEQ ID NO: 608559 - protein, 5 aa, Mycobacterium
VGTDR

SEQ ID NO: 608560 - protein, 23 aa, Mycobacterium
VGTDRAAGAVSAASAAAAARGLS

SEQ ID NO: 608561 - protein, 6 aa, Mycobacterium
VGTEAD

SEQ ID NO: 608562 - protein, 5 aa, Mycobacterium
VGTED

SEQ ID NO: 608563 - protein, 6 aa, Mycobacterium
VGTEEA

SEQ ID NO: 608564 - protein, 12 aa, Mycobacterium
VGTEEPKYTHRP

SEQ ID NO: 608565 - protein, 19 aa, Mycobacterium
VGTEFQGGVGEGAAKSSGV

SEQ ID NO: 608566 - protein, 5 aa, Mycobacterium
VGTEN

SEQ ID NO: 608567 - protein, 6 aa, Mycobacterium
VGTENY

SEQ ID NO: 608568 - protein, 17 aa, Mycobacterium
VGTEPEQLVAEALRQFG

SEQ ID NO: 608569 - protein, 5 aa, Mycobacterium
VGTER

SEQ ID NO: 608570 - protein, 24 aa, Mycobacterium
VGTESIRPAQRNKPLKRSAEDNSM

SEQ ID NO: 608571 - protein, 11 aa, Mycobacterium
VGTESSKHASH

SEQ ID NO: 608572 - protein, 5 aa, Mycobacterium
VGTFP

SEQ ID NO: 608573 - protein, 4 aa, Mycobacterium
VGTG

SEQ ID NO: 608574 - protein, 23 aa, Mycobacterium
VGTGAGQASRKRRAERGEPTGRG

SEQ ID NO: 608575 - protein, 7 aa, Mycobacterium
VGTGAKL

SEQ ID NO: 608576 - protein, 7 aa, Mycobacterium
VGTGARL

SEQ ID NO: 608577 - protein, 15 aa, Mycobacterium
VGTGASCADGEPIGD

SEQ ID NO: 608578 - protein, 9 aa, Mycobacterium
VGTGASWGN

SEQ ID NO: 608579 - protein, 9 aa, Mycobacterium
VGTGEIQTA

SEQ ID NO: 608580 - protein, 9 aa, Mycobacterium
VGTGGDGIN

SEQ ID NO: 608581 - protein, 7 aa, Mycobacterium
VGTGGGF

SEQ ID NO: 608582 - protein, 7 aa, Mycobacterium
VGTGGNL

SEQ ID NO: 608583 - protein, 7 aa, Mycobacterium
VGTGGRL

SEQ ID NO: 608584 - protein, 26 aa, Mycobacterium
VGTGGVGGAGGTSFDAGGAGGIGGSA

SEQ ID NO: 608585 - protein, 5 aa, Mycobacterium
VGTGP

SEQ ID NO: 608586 - protein, 5 aa, Mycobacterium
VGTGR

SEQ ID NO: 608587 - protein, 9 aa, Mycobacterium
VGTGRNSMR

SEQ ID NO: 608588 - protein, 15 aa, Mycobacterium
VGTGRYRAQLSSGMY

SEQ ID NO: 608589 - protein, 7 aa, Mycobacterium
VGTGSHP

SEQ ID NO: 608590 - protein, 9 aa, Mycobacterium
VGTGSSGIQ

SEQ ID NO: 608591 - protein, 6 aa, Mycobacterium
VGTGTE

SEQ ID NO: 608592 - protein, 7 aa, Mycobacterium
VGTHAAT

SEQ ID NO: 608593 - protein, 5 aa, Mycobacterium
VGTIG

SEQ ID NO: 608594 - protein, 8 aa, Mycobacterium
VGTKPGSL

SEQ ID NO: 608595 - protein, 6 aa, Mycobacterium
VGTKPS

SEQ ID NO: 608596 - protein, 17 aa, Mycobacterium
VGTLDDARAREDPQAAG

SEQ ID NO: 608597 - protein, 6 aa, Mycobacterium
VGTPAD

SEQ ID NO: 608598 - protein, 7 aa, Mycobacterium
VGTPADV

SEQ ID NO: 608599 - protein, 8 aa, Mycobacterium
VGTPADVA

SEQ ID NO: 608600 - protein, 11 aa, Mycobacterium
VGTPDRVSTTY

SEQ ID NO: 608601 - protein, 7 aa, Mycobacterium
VGTPEIA

SEQ ID NO: 608602 - protein, 10 aa, Mycobacterium
VGTPEQIAEQ

SEQ ID NO: 608603 - protein, 6 aa, Mycobacterium
VGTPGA

SEQ ID NO: 608604 - protein, 12 aa, Mycobacterium
VGTPGNAALRDT

SEQ ID NO: 608605 - protein, 11 aa, Mycobacterium
VGTPGQANYAA

SEQ ID NO: 608606 - protein, 9 aa, Mycobacterium
VGTPGQVGR

SEQ ID NO: 608607 - protein, 7 aa, Mycobacterium
VGTPHEV

SEQ ID NO: 608608 - protein, 10 aa, Mycobacterium
VGTPNEVATE

SEQ ID NO: 608609 - protein, 16 aa, Mycobacterium
VGTPNEVATEVSQNTA

SEQ ID NO: 608610 - protein, 8 aa, Mycobacterium
VGTPNSGW

SEQ ID NO: 608611 - protein, 16 aa, Mycobacterium
VGTPPDSCHTATTSAH

SEQ ID NO: 608612 - protein, 9 aa, Mycobacterium
VGTPPRRPV

SEQ ID NO: 608613 - protein, 14 aa, Mycobacterium
VGTPPTSGQPFQAT

SEQ ID NO: 608614 - protein, 5 aa, Mycobacterium
VGTPQ

SEQ ID NO: 608615 - protein, 9 aa, Mycobacterium
VGTPQGKQV

SEQ ID NO: 608616 - protein, 7 aa, Mycobacterium
VGTPQQV

SEQ ID NO: 608617 - protein, 9 aa, Mycobacterium
VGTPRRARA

SEQ ID NO: 608618 - protein, 7 aa, Mycobacterium
VGTPTDI

SEQ ID NO: 608619 - protein, 11 aa, Mycobacterium
VGTPTLADPAL

SEQ ID NO: 608620 - protein, 6 aa, Mycobacterium
VGTQGS

SEQ ID NO: 608621 - protein, 8 aa, Mycobacterium
VGTRDRAE

SEQ ID NO: 608622 - protein, 10 aa, Mycobacterium
VGTRGSDGKI

SEQ ID NO: 608623 - protein, 6 aa, Mycobacterium
VGTRNV

SEQ ID NO: 608624 - protein, 19 aa, Mycobacterium
VGTRVQQGDAETAPLANPE

SEQ ID NO: 608625 - protein, 12 aa, Mycobacterium
VGTSAQTLLVRR

SEQ ID NO: 608626 - protein, 13 aa, Mycobacterium
VGTSASESGNKDR

SEQ ID NO: 608627 - protein, 10 aa, Mycobacterium
VGTSDDSFGQ

SEQ ID NO: 608628 - protein, 5 aa, Mycobacterium
VGTSE

SEQ ID NO: 608629 - protein, 7 aa, Mycobacterium
VGTSPGY

SEQ ID NO: 608630 - protein, 12 aa, Mycobacterium
VGTSPSGQTIPG

SEQ ID NO: 608631 - protein, 15 aa, Mycobacterium
VGTSRRFSGASRKSL

SEQ ID NO: 608632 - protein, 12 aa, Mycobacterium
VGTSSRNTIRSS

SEQ ID NO: 608633 - protein, 9 aa, Mycobacterium
VGTSVENSE

SEQ ID NO: 608634 - protein, 4 aa, Mycobacterium
VGTT

SEQ ID NO: 608635 - protein, 5 aa, Mycobacterium
VGTTA

SEQ ID NO: 608636 - protein, 5 aa, Mycobacterium
VGTTE

SEQ ID NO: 608637 - protein, 12 aa, Mycobacterium
VGTTNRPGARFG

SEQ ID NO: 608638 - protein, 13 aa, Mycobacterium
VGTTPSGYRQSTA

SEQ ID NO: 608639 - protein, 12 aa, Mycobacterium
VGTTRADPQPGI

SEQ ID NO: 608640 - protein, 5 aa, Mycobacterium
VGTTS

SEQ ID NO: 608641 - protein, 7 aa, Mycobacterium
VGTTTAD

SEQ ID NO: 608642 - protein, 12 aa, Mycobacterium
VGTTTSEASLDR

SEQ ID NO: 608643 - protein, 10 aa, Mycobacterium
VGTTTVPKGD

SEQ ID NO: 608644 - protein, 15 aa, Mycobacterium
VGTTYDIGAEIGVIT

SEQ ID NO: 608645 - protein, 14 aa, Mycobacterium
VGTYNKNDGAQDWQ

SEQ ID NO: 608646 - protein, 44 aa, Mycobacterium
VGVANAGSTVLSSTPKAAKTAGEKITDEGEGGTKVAEFLVAQKI

SEQ ID NO: 608647 - protein, 6 aa, Mycobacterium
VGVAPG

SEQ ID NO: 608648 - protein, 9 aa, Mycobacterium
VGVDGSDPY

SEQ ID NO: 608649 - protein, 8 aa, Mycobacterium
VGVDSAAR

SEQ ID NO: 608650 - protein, 5 aa, Mycobacterium
VGVET

SEQ ID NO: 608651 - protein, 10 aa, Mycobacterium
VGVGADARGP

SEQ ID NO: 608652 - protein, 5 aa, Mycobacterium
VGVGE

SEQ ID NO: 608653 - protein, 25 aa, Mycobacterium
VGVGEAGASYLAGDTAAAATFGFGG

SEQ ID NO: 608654 - protein, 25 aa, Mycobacterium
VGVGESGASYLAGDAAAAATYGIAG

SEQ ID NO: 608655 - protein, 6 aa, Mycobacterium
VGVGKQ

SEQ ID NO: 608656 - protein, 45 aa, Mycobacterium
VGVGNGGNGNVGFANSGGENTGSFNSGGDNFANGGNTGSFNSGDL

SEQ ID NO: 608657 - protein, 11 aa, Mycobacterium
VGVKGTSGMRK

SEQ ID NO: 608658 - protein, 10 aa, Mycobacterium
VGVNGESSRV

SEQ ID NO: 608659 - protein, 10 aa, Mycobacterium
VGVPGLRGSE

SEQ ID NO: 608660 - protein, 11 aa, Mycobacterium
VGVPGTSGIPE

SEQ ID NO: 608661 - protein, 6 aa, Mycobacterium
VGVPGV

SEQ ID NO: 608662 - protein, 14 aa, Mycobacterium
VGVPTGEKGQLGDG

SEQ ID NO: 608663 - protein, 11 aa, Mycobacterium
VGVQTGNAKKV

SEQ ID NO: 608664 - protein, 7 aa, Mycobacterium
VGVSGSQ

SEQ ID NO: 608665 - protein, 5 aa, Mycobacterium
VGVSN

SEQ ID NO: 608666 - protein, 5 aa, Mycobacterium
VGVTA

SEQ ID NO: 608667 - protein, 13 aa, Mycobacterium
VGVTTSGTFSPTL

SEQ ID NO: 608668 - protein, 18 aa, Mycobacterium
VGWTRSPAAHQNASRKRF

SEQ ID NO: 608669 - protein, 5 aa, Mycobacterium
VGYAG

SEQ ID NO: 608670 - protein, 8 aa, Mycobacterium
VGYEEPAA

SEQ ID NO: 608671 - protein, 12 aa, Mycobacterium
VGYGADSSSQLS

SEQ ID NO: 608672 - protein, 23 aa, Mycobacterium
VGYGADTPFGGYKDSGVGRQNGL

SEQ ID NO: 608673 - protein, 10 aa, Mycobacterium
VGYGGPSYDR

SEQ ID NO: 608674 - protein, 13 aa, Mycobacterium
VGYPDEPRFPPRE

SEQ ID NO: 608675 - protein, 6 aa, Mycobacterium
VGYPRG

SEQ ID NO: 608676 - protein, 8 aa, Mycobacterium
VGYQPGQI

SEQ ID NO: 608677 - protein, 12 aa, Mycobacterium
VGYQSDPLEHDD

SEQ ID NO: 608678 - protein, 25 aa, Mycobacterium
VGYRQTGAKDVARDVESEPFAQELG

SEQ ID NO: 608679 - protein, 15 aa, Mycobacterium
VGYSGSTDDLRPGGI

SEQ ID NO: 608680 - protein, 18 aa, Mycobacterium
VGYTDADAAALADGAWPQ

SEQ ID NO: 608681 - protein, 7 aa, Mycobacterium
VGYTPYP

SEQ ID NO: 608682 - protein, 9 aa, Mycobacterium
VGYTPYPES

SEQ ID NO: 608683 - protein, 10 aa, Mycobacterium
VGYTPYPESV

SEQ ID NO: 608684 - protein, 9 aa, Mycobacterium
VGYTPYPET

SEQ ID NO: 608685 - protein, 10 aa, Mycobacterium
VGYTPYPETV

SEQ ID NO: 608686 - protein, 8 aa, Mycobacterium
VHADQESD

SEQ ID NO: 608687 - protein, 7 aa, Mycobacterium
VHAESEV

SEQ ID NO: 608688 - protein, 6 aa, Mycobacterium
VHAETE

SEQ ID NO: 608689 - protein, 4 aa, Mycobacterium
VHAG

SEQ ID NO: 608690 - protein, 12 aa, Mycobacterium
VHAKSNGSEWKT

SEQ ID NO: 608691 - protein, 6 aa, Mycobacterium
VHAPAD

SEQ ID NO: 608692 - protein, 6 aa, Mycobacterium
VHAPDR

SEQ ID NO: 608693 - protein, 5 aa, Mycobacterium
VHARS

SEQ ID NO: 608694 - protein, 42 aa, Mycobacterium
VHDASPSLDGDAPSVGDGPAHGGDRSRRAGPPASLDGKAVRT

SEQ ID NO: 608695 - protein, 6 aa, Mycobacterium
VHDDPA

SEQ ID NO: 608696 - protein, 19 aa, Mycobacterium
VHDDSDANRLPGKTILVPG

SEQ ID NO: 608697 - protein, 6 aa, Mycobacterium
VHDEPG

SEQ ID NO: 608698 - protein, 7 aa, Mycobacterium
VHDGAGQ

SEQ ID NO: 608699 - protein, 25 aa, Mycobacterium
VHDGTDDIDNENDIDNGIDNENGNG

SEQ ID NO: 608700 - protein, 8 aa, Mycobacterium
VHDPQTAE

SEQ ID NO: 608701 - protein, 7 aa, Mycobacterium
VHDPTTG

SEQ ID NO: 608702 - protein, 13 aa, Mycobacterium
VHDRPKPAKEWDP

SEQ ID NO: 608703 - protein, 22 aa, Mycobacterium
VHDSGRPHAIGRPAGDSASQAT

SEQ ID NO: 608704 - protein, 14 aa, Mycobacterium
VHDSGRPHAVGRPA

SEQ ID NO: 608705 - protein, 14 aa, Mycobacterium
VHDSGRPHAVGRPQ

SEQ ID NO: 608706 - protein, 14 aa, Mycobacterium
VHDSGRPHAVGRPT

SEQ ID NO: 608707 - protein, 8 aa, Mycobacterium
VHEDPDAA

SEQ ID NO: 608708 - protein, 19 aa, Mycobacterium
VHEDRPALRGTVRSTRQRA

SEQ ID NO: 608709 - protein, 8 aa, Mycobacterium
VHEGSEPW

SEQ ID NO: 608710 - protein, 6 aa, Mycobacterium
VHEGSV

SEQ ID NO: 608711 - protein, 5 aa, Mycobacterium
VHELS

SEQ ID NO: 608712 - protein, 4 aa, Mycobacterium
VHER

SEQ ID NO: 608713 - protein, 8 aa, Mycobacterium
VHGDTRNN

SEQ ID NO: 608714 - protein, 7 aa, Mycobacterium
VHGEGDH

SEQ ID NO: 608715 - protein, 5 aa, Mycobacterium
VHGEP

SEQ ID NO: 608716 - protein, 6 aa, Mycobacterium
VHGEPG

SEQ ID NO: 608717 - protein, 14 aa, Mycobacterium
VHGESEELSINQDT

SEQ ID NO: 608718 - protein, 19 aa, Mycobacterium
VHGGGEPPHYLATTNASAI

SEQ ID NO: 608719 - protein, 18 aa, Mycobacterium
VHGGGEPPHYLATTTAEL

SEQ ID NO: 608720 - protein, 18 aa, Mycobacterium
VHGGGEPPHYLSTTTADI

SEQ ID NO: 608721 - protein, 12 aa, Mycobacterium
VHGGRGSRAHGP

SEQ ID NO: 608722 - protein, 15 aa, Mycobacterium
VHGNPKSATAHEPGC

SEQ ID NO: 608723 - protein, 5 aa, Mycobacterium
VHGPA

SEQ ID NO: 608724 - protein, 7 aa, Mycobacterium
VHGPAGD

SEQ ID NO: 608725 - protein, 11 aa, Mycobacterium
VHGQGTPGAPT

SEQ ID NO: 608726 - protein, 10 aa, Mycobacterium
VHGTNGSDAS

SEQ ID NO: 608727 - protein, 6 aa, Mycobacterium
VHIGPS

SEQ ID NO: 608728 - protein, 13 aa, Mycobacterium
VHKEGKRLRTATE

SEQ ID NO: 608729 - protein, 13 aa, Mycobacterium
VHKPAPKKEKKEK

SEQ ID NO: 608730 - protein, 5 aa, Mycobacterium
VHNEP

SEQ ID NO: 608731 - protein, 4 aa, Mycobacterium
VHNP

SEQ ID NO: 608732 - protein, 5 aa, Mycobacterium
VHNPS

SEQ ID NO: 608733 - protein, 5 aa, Mycobacterium
VHNPT

SEQ ID NO: 608734 - protein, 5 aa, Mycobacterium
VHPAK

SEQ ID NO: 608735 - protein, 10 aa, Mycobacterium
VHPAPRRGEL

SEQ ID NO: 608736 - protein, 5 aa, Mycobacterium
VHPDG

SEQ ID NO: 608737 - protein, 6 aa, Mycobacterium
VHPDGE

SEQ ID NO: 608738 - protein, 9 aa, Mycobacterium
VHPDSRTLP

SEQ ID NO: 608739 - protein, 5 aa, Mycobacterium
VHPDT

SEQ ID NO: 608740 - protein, 5 aa, Mycobacterium
VHPED

SEQ ID NO: 608741 - protein, 6 aa, Mycobacterium
VHPEDI

SEQ ID NO: 608742 - protein, 15 aa, Mycobacterium
VHPEPAGAAGRVRQP

SEQ ID NO: 608743 - protein, 11 aa, Mycobacterium
VHPERRGEGIG

SEQ ID NO: 608744 - protein, 7 aa, Mycobacterium
VHPGDPH

SEQ ID NO: 608745 - protein, 5 aa, Mycobacterium
VHPGQ

SEQ ID NO: 608746 - protein, 7 aa, Mycobacterium
VHPGQVQ

SEQ ID NO: 608747 - protein, 41 aa, Mycobacterium
VHPGRRRRAATASAGPGARGARADLPAAAPPRRAAAAAGRI

SEQ ID NO: 608748 - protein, 12 aa, Mycobacterium
VHPGSSLYEPAS

SEQ ID NO: 608749 - protein, 6 aa, Mycobacterium
VHPNRT

SEQ ID NO: 608750 - protein, 6 aa, Mycobacterium
VHPPTK

SEQ ID NO: 608751 - protein, 20 aa, Mycobacterium
VHPQAKAGLSELARSAANRT

SEQ ID NO: 608752 - protein, 29 aa, Mycobacterium
VHPRQGQRNIRHPRRRHPRRGPDDRRGRQ

SEQ ID NO: 608753 - protein, 6 aa, Mycobacterium
VHPSGV

SEQ ID NO: 608754 - protein, 16 aa, Mycobacterium
VHPTGADPMTYASTGR

SEQ ID NO: 608755 - protein, 15 aa, Mycobacterium
VHQGEGAATCKRDQR

SEQ ID NO: 608756 - protein, 7 aa, Mycobacterium
VHQGEGV

SEQ ID NO: 608757 - protein, 16 aa, Mycobacterium
VHQGEGVAAGKRDQRD

SEQ ID NO: 608758 - protein, 16 aa, Mycobacterium
VHQGEGVATGKRDPRD

SEQ ID NO: 608759 - protein, 16 aa, Mycobacterium
VHQGEGVATGKRDQRD

SEQ ID NO: 608760 - protein, 7 aa, Mycobacterium
VHRGTRS

SEQ ID NO: 608761 - protein, 10 aa, Mycobacterium
VHRHNSDGTV

SEQ ID NO: 608762 - protein, 8 aa, Mycobacterium
VHRSGPPP

SEQ ID NO: 608763 - protein, 11 aa, Mycobacterium
VHRTGADDGVT

SEQ ID NO: 608764 - protein, 11 aa, Mycobacterium
VHRTGPGPMGP

SEQ ID NO: 608765 - protein, 9 aa, Mycobacterium
VHRTHPDGT

SEQ ID NO: 608766 - protein, 6 aa, Mycobacterium
VHSEEG

SEQ ID NO: 608767 - protein, 13 aa, Mycobacterium
VHSEGARLRSRRE

SEQ ID NO: 608768 - protein, 14 aa, Mycobacterium
VHSEGGRLREPQEH

SEQ ID NO: 608769 - protein, 14 aa, Mycobacterium
VHSEGGRLRSAEEH

SEQ ID NO: 608770 - protein, 14 aa, Mycobacterium
VHSEGGRLRSSGEH

SEQ ID NO: 608771 - protein, 9 aa, Mycobacterium
VHSGGKAAQ

SEQ ID NO: 608772 - protein, 12 aa, Mycobacterium
VHSGKTAIDPTM

SEQ ID NO: 608773 - protein, 11 aa, Mycobacterium
VHSGREATASA

SEQ ID NO: 608774 - protein, 12 aa, Mycobacterium
VHSPASGPGTIA

SEQ ID NO: 608775 - protein, 11 aa, Mycobacterium
VHSPSSGPGTI

SEQ ID NO: 608776 - protein, 15 aa, Mycobacterium
VHSSAGGQGLNTSVQ

SEQ ID NO: 608777 - protein, 5 aa, Mycobacterium
VHSTE

SEQ ID NO: 608778 - protein, 11 aa, Mycobacterium
VHTDPDDVAGP

SEQ ID NO: 608779 - protein, 11 aa, Mycobacterium
VHTDPGEVSGP

SEQ ID NO: 608780 - protein, 10 aa, Mycobacterium
VHTEDGKSYP

SEQ ID NO: 608781 - protein, 6 aa, Mycobacterium
VHTESG

SEQ ID NO: 608782 - protein, 25 aa, Mycobacterium
VHTHDHDDPDHRHGDHGGYQTGKQR

SEQ ID NO: 608783 - protein, 7 aa, Mycobacterium
VHTRPNG

SEQ ID NO: 608784 - protein, 8 aa, Mycobacterium
VIDPGADG

SEQ ID NO: 608785 - protein, 7 aa, Mycobacterium
VIEPTEQ

SEQ ID NO: 608786 - protein, 7 aa, Mycobacterium
VIEPTGQ

SEQ ID NO: 608787 - protein, 13 aa, Mycobacterium
VIGGNQPTLTGPS

SEQ ID NO: 608788 - protein, 6 aa, Mycobacterium
VIGGPG

SEQ ID NO: 608789 - protein, 9 aa, Mycobacterium
VIGNSRTAG

SEQ ID NO: 608790 - protein, 9 aa, Mycobacterium
VIGPDGAAT

SEQ ID NO: 608791 - protein, 5 aa, Mycobacterium
VIGPG

SEQ ID NO: 608792 - protein, 15 aa, Mycobacterium
VIGPRTRLTPEQAAN

SEQ ID NO: 608793 - protein, 5 aa, Mycobacterium
VIGRG

SEQ ID NO: 608794 - protein, 7 aa, Mycobacterium
VIGRGGG

SEQ ID NO: 608795 - protein, 8 aa, Mycobacterium
VIGRGQDA

SEQ ID NO: 608796 - protein, 6 aa, Mycobacterium
VIGRGR

SEQ ID NO: 608797 - protein, 5 aa, Mycobacterium
VIGSG

SEQ ID NO: 608798 - protein, 6 aa, Mycobacterium
VINRNQ

SEQ ID NO: 608799 - protein, 4 aa, Mycobacterium
VIPA

SEQ ID NO: 608800 - protein, 20 aa, Mycobacterium
VIPDPQPIDDGTGPQTDGEY

SEQ ID NO: 608801 - protein, 10 aa, Mycobacterium
VIPGGVNSPV

SEQ ID NO: 608802 - protein, 6 aa, Mycobacterium
VIPPGK

SEQ ID NO: 608803 - protein, 7 aa, Mycobacterium
VIPRGAD

SEQ ID NO: 608804 - protein, 5 aa, Mycobacterium
VIQDS

SEQ ID NO: 608805 - protein, 19 aa, Mycobacterium
VIQGADTATLAVTSDDDPL

SEQ ID NO: 608806 - protein, 7 aa, Mycobacterium
VIQPGAD

SEQ ID NO: 608807 - protein, 5 aa, Mycobacterium
VIQSG

SEQ ID NO: 608808 - protein, 10 aa, Mycobacterium
VISAPGSRRL

SEQ ID NO: 608809 - protein, 37 aa, Mycobacterium
VISPERRAEVKANYAERRRQSRESGGGSPHQAYPKKT

SEQ ID NO: 608810 - protein, 7 aa, Mycobacterium
VISPGAD

SEQ ID NO: 608811 - protein, 11 aa, Mycobacterium
VISPRGQTPYV

SEQ ID NO: 608812 - protein, 4 aa, Mycobacterium
VITD

SEQ ID NO: 608813 - protein, 12 aa, Mycobacterium
VITDPESGRELG

SEQ ID NO: 608814 - protein, 5 aa, Mycobacterium
VITEE

SEQ ID NO: 608815 - protein, 17 aa, Mycobacterium
VITPEGKQMKAREFSGG

SEQ ID NO: 608816 - protein, 6 aa, Mycobacterium
VITPQD

SEQ ID NO: 608817 - protein, 9 aa, Mycobacterium
VKAAARDTF

SEQ ID NO: 608818 - protein, 14 aa, Mycobacterium
VKAAESEQADAEAA

SEQ ID NO: 608819 - protein, 10 aa, Mycobacterium
VKAAGEHGTA

SEQ ID NO: 608820 - protein, 14 aa, Mycobacterium
VKAAHTASRSATAM

SEQ ID NO: 608821 - protein, 17 aa, Mycobacterium
VKAAQAEKDARAAKEAA

SEQ ID NO: 608822 - protein, 6 aa, Mycobacterium
VKAARK

SEQ ID NO: 608823 - protein, 10 aa, Mycobacterium
VKAASSGPTI

SEQ ID NO: 608824 - protein, 9 aa, Mycobacterium
VKAATDKPF

SEQ ID NO: 608825 - protein, 13 aa, Mycobacterium
VKAATTAGAMTER

SEQ ID NO: 608826 - protein, 4 aa, Mycobacterium
VKAD

SEQ ID NO: 608827 - protein, 9 aa, Mycobacterium
VKADGGQEG

SEQ ID NO: 608828 - protein, 13 aa, Mycobacterium
VKAERDNAAVQST

SEQ ID NO: 608829 - protein, 11 aa, Mycobacterium
VKAERDSAQVK

SEQ ID NO: 608830 - protein, 4 aa, Mycobacterium
VKAG

SEQ ID NO: 608831 - protein, 18 aa, Mycobacterium
VKAGDGVVNPDGTLTAGP

SEQ ID NO: 608832 - protein, 7 aa, Mycobacterium
VKAGDTS

SEQ ID NO: 608833 - protein, 16 aa, Mycobacterium
VKAGEGVVNPDGTLTA

SEQ ID NO: 608834 - protein, 15 aa, Mycobacterium
VKAGISDTLPAGTIT

SEQ ID NO: 608835 - protein, 15 aa, Mycobacterium
VKAGPGEDVDPDTEI

SEQ ID NO: 608836 - protein, 14 aa, Mycobacterium
VKAGPGENVDADAE

SEQ ID NO: 608837 - protein, 14 aa, Mycobacterium
VKAGPGQDVDAGTE

SEQ ID NO: 608838 - protein, 11 aa, Mycobacterium
VKAGPGQEVDA

SEQ ID NO: 608839 - protein, 14 aa, Mycobacterium
VKAGPGQEVDADTE

SEQ ID NO: 608840 - protein, 15 aa, Mycobacterium
VKAGPGSNVDAEEEI

SEQ ID NO: 608841 - protein, 10 aa, Mycobacterium
VKAGPGTTVD

SEQ ID NO: 608842 - protein, 11 aa, Mycobacterium
VKAGRGSPHGG

SEQ ID NO: 608843 - protein, 10 aa, Mycobacterium
VKAGRGTPHG

SEQ ID NO: 608844 - protein, 7 aa, Mycobacterium
VKAGRNG

SEQ ID NO: 608845 - protein, 9 aa, Mycobacterium
VKAGSSALN

SEQ ID NO: 608846 - protein, 14 aa, Mycobacterium
VKAHDENGEAGIGD

SEQ ID NO: 608847 - protein, 14 aa, Mycobacterium
VKAHDENSAAGIGD

SEQ ID NO: 608848 - protein, 12 aa, Mycobacterium
VKAHDENSIAGI

SEQ ID NO: 608849 - protein, 11 aa, Mycobacterium
VKAKQGDRDAA

SEQ ID NO: 608850 - protein, 11 aa, Mycobacterium
VKANKAAEDIE

SEQ ID NO: 608851 - protein, 6 aa, Mycobacterium
VKAPAD

SEQ ID NO: 608852 - protein, 7 aa, Mycobacterium
VKAPTSI

SEQ ID NO: 608853 - protein, 12 aa, Mycobacterium
VKARERAAAQLE

SEQ ID NO: 608854 - protein, 14 aa, Mycobacterium
VKASAKAPKARPRS

SEQ ID NO: 608855 - protein, 8 aa, Mycobacterium
VKASARRA

SEQ ID NO: 608856 - protein, 17 aa, Mycobacterium
VKASDDAAAKRRPSQRR

SEQ ID NO: 608857 - protein, 10 aa, Mycobacterium
VKASGGVRTL

SEQ ID NO: 608858 - protein, 11 aa, Mycobacterium
VKASKDGSDAV

SEQ ID NO: 608859 - protein, 9 aa, Mycobacterium
VKATTDKPF

SEQ ID NO: 608860 - protein, 5 aa, Mycobacterium
VKDAA

SEQ ID NO: 608861 - protein, 14 aa, Mycobacterium
VKDAAEQAGRDPAS

SEQ ID NO: 608862 - protein, 8 aa, Mycobacterium
VKDAAGVS

SEQ ID NO: 608863 - protein, 13 aa, Mycobacterium
VKDAQKKGDFAGY

SEQ ID NO: 608864 - protein, 6 aa, Mycobacterium
VKDDGE

SEQ ID NO: 608865 - protein, 7 aa, Mycobacterium
VKDEIDD

SEQ ID NO: 608866 - protein, 10 aa, Mycobacterium
VKDEVDAPPP

SEQ ID NO: 608867 - protein, 4 aa, Mycobacterium
VKDG

SEQ ID NO: 608868 - protein, 8 aa, Mycobacterium
VKDGPTAV

SEQ ID NO: 608869 - protein, 5 aa, Mycobacterium
VKDGR

SEQ ID NO: 608870 - protein, 9 aa, Mycobacterium
VKDGVTPDE

SEQ ID NO: 608871 - protein, 22 aa, Mycobacterium
VKDPGEHPRRRPAQAGGVDPRA

SEQ ID NO: 608872 - protein, 8 aa, Mycobacterium
VKDPGSLQ

SEQ ID NO: 608873 - protein, 5 aa, Mycobacterium
VKDRA

SEQ ID NO: 608874 - protein, 6 aa, Mycobacterium
VKDREL

SEQ ID NO: 608875 - protein, 6 aa, Mycobacterium
VKDRGV

SEQ ID NO: 608876 - protein, 12 aa, Mycobacterium
VKDRKGSVQSPK

SEQ ID NO: 608877 - protein, 7 aa, Mycobacterium
VKDRPDR

SEQ ID NO: 608878 - protein, 17 aa, Mycobacterium
VKDRPPTCSACPREPAH

SEQ ID NO: 608879 - protein, 8 aa, Mycobacterium
VKDSSELL

SEQ ID NO: 608880 - protein, 4 aa, Mycobacterium
VKDT

SEQ ID NO: 608881 - protein, 10 aa, Mycobacterium
VKDTGPPTMA

SEQ ID NO: 608882 - protein, 8 aa, Mycobacterium
VKDTSGRI

SEQ ID NO: 608883 - protein, 6 aa, Mycobacterium
VKEDGI

SEQ ID NO: 608884 - protein, 21 aa, Mycobacterium
VKEDPTLAYGPGRGAIGSPET

SEQ ID NO: 608885 - protein, 12 aa, Mycobacterium
VKEEAGDEATEV

SEQ ID NO: 608886 - protein, 12 aa, Mycobacterium
VKEEASKEAEEV

SEQ ID NO: 608887 - protein, 9 aa, Mycobacterium
VKEEQLSES

SEQ ID NO: 608888 - protein, 6 aa, Mycobacterium
VKEHAD

SEQ ID NO: 608889 - protein, 4 aa, Mycobacterium
VKEI

SEQ ID NO: 608890 - protein, 7 aa, Mycobacterium
VKEISRR

SEQ ID NO: 608891 - protein, 10 aa, Mycobacterium
VKEKAGSIGR

SEQ ID NO: 608892 - protein, 7 aa, Mycobacterium
VKELPEE

SEQ ID NO: 608893 - protein, 7 aa, Mycobacterium
VKEPLQT

SEQ ID NO: 608894 - protein, 9 aa, Mycobacterium
VKERAKANG

SEQ ID NO: 608895 - protein, 12 aa, Mycobacterium
VKERKGSVQSPK

SEQ ID NO: 608896 - protein, 7 aa, Mycobacterium
VKESGAA

SEQ ID NO: 608897 - protein, 8 aa, Mycobacterium
VKESGADL

SEQ ID NO: 608898 - protein, 11 aa, Mycobacterium
VKESGSDRDAY

SEQ ID NO: 608899 - protein, 20 aa, Mycobacterium
VKESLKSEDPETVLRQGSGE

SEQ ID NO: 608900 - protein, 4 aa, Mycobacterium
VKET

SEQ ID NO: 608901 - protein, 6 aa, Mycobacterium
VKETAK

SEQ ID NO: 608902 - protein, 10 aa, Mycobacterium
VKETGKRLGA

SEQ ID NO: 608903 - protein, 11 aa, Mycobacterium
VKETGKRLGAT

SEQ ID NO: 608904 - protein, 5 aa, Mycobacterium
VKETQ

SEQ ID NO: 608905 - protein, 9 aa, Mycobacterium
VKETSNGPG

SEQ ID NO: 608906 - protein, 4 aa, Mycobacterium
VKEV

SEQ ID NO: 608907 - protein, 7 aa, Mycobacterium
VKEVSKR

SEQ ID NO: 608908 - protein, 8 aa, Mycobacterium
VKEVSKRS

SEQ ID NO: 608909 - protein, 8 aa, Mycobacterium
VKEVSRRS

SEQ ID NO: 608910 - protein, 8 aa, Mycobacterium
VKGDDLSN

SEQ ID NO: 608911 - protein, 10 aa, Mycobacterium
VKGDPSASVT

SEQ ID NO: 608912 - protein, 5 aa, Mycobacterium
VKGDR

SEQ ID NO: 608913 - protein, 4 aa, Mycobacterium
VKGE

SEQ ID NO: 608914 - protein, 8 aa, Mycobacterium
VKGEARGE

SEQ ID NO: 608915 - protein, 6 aa, Mycobacterium
VKGERA

SEQ ID NO: 608916 - protein, 5 aa, Mycobacterium
VKGET

SEQ ID NO: 608917 - protein, 6 aa, Mycobacterium
VKGETV

SEQ ID NO: 608918 - protein, 9 aa, Mycobacterium
VKGGERPFQ

SEQ ID NO: 608919 - protein, 14 aa, Mycobacterium
VKGGSAASSEPFSD

SEQ ID NO: 608920 - protein, 25 aa, Mycobacterium
VKGGSNGAGAHPGPKDAARIPETAA

SEQ ID NO: 608921 - protein, 7 aa, Mycobacterium
VKGKAKE

SEQ ID NO: 608922 - protein, 16 aa, Mycobacterium
VKGKAKEAAGTVTGRD

SEQ ID NO: 608923 - protein, 59 aa, Mycobacterium
VKGKAKEAVGAVAGRDDLTREGQAQQDKAEAQRDAAKKEAEAEAARGGAEAAEERQKSN

SEQ ID NO: 608924 - protein, 59 aa, Mycobacterium
VKGKAKEAVGAVTGQDDLTREGQAQQDKAEAQRDAAKKEAEAEAARGGAEAAEERQKAN

SEQ ID NO: 608925 - protein, 14 aa, Mycobacterium
VKGKAKETIGTVAG

SEQ ID NO: 608926 - protein, 8 aa, Mycobacterium
VKGKAKEV

SEQ ID NO: 608927 - protein, 10 aa, Mycobacterium
VKGKGTSGKQ

SEQ ID NO: 608928 - protein, 9 aa, Mycobacterium
VKGKVGDAL

SEQ ID NO: 608929 - protein, 8 aa, Mycobacterium
VKGPDFPT

SEQ ID NO: 608930 - protein, 8 aa, Mycobacterium
VKGPGAAA

SEQ ID NO: 608931 - protein, 7 aa, Mycobacterium
VKGPGGE

SEQ ID NO: 608932 - protein, 7 aa, Mycobacterium
VKGPGLQ

SEQ ID NO: 608933 - protein, 23 aa, Mycobacterium
VKGRKQPVKDGASLKDGDSPENL

SEQ ID NO: 608934 - protein, 16 aa, Mycobacterium
VKGRRPSWNAAAPRAV

SEQ ID NO: 608935 - protein, 6 aa, Mycobacterium
VKGSGE

SEQ ID NO: 608936 - protein, 15 aa, Mycobacterium
VKGSGYGRELGPEGI

SEQ ID NO: 608937 - protein, 7 aa, Mycobacterium
VKGSQIG

SEQ ID NO: 608938 - protein, 8 aa, Mycobacterium
VKGSQIGL

SEQ ID NO: 608939 - protein, 10 aa, Mycobacterium
VKGTGVGGRI

SEQ ID NO: 608940 - protein, 11 aa, Mycobacterium
VKGTGVGGRIR

SEQ ID NO: 608941 - protein, 8 aa, Mycobacterium
VKGTLQDG

SEQ ID NO: 608942 - protein, 11 aa, Mycobacterium
VKGTQAGRRRG

SEQ ID NO: 608943 - protein, 9 aa, Mycobacterium
VKGTSGMRK

SEQ ID NO: 608944 - protein, 11 aa, Mycobacterium
VKGVTEETTTG

SEQ ID NO: 608945 - protein, 18 aa, Mycobacterium
VKHDEDVAEDVPEDVTAA

SEQ ID NO: 608946 - protein, 17 aa, Mycobacterium
VKHDGASNAPQAPNGLA

SEQ ID NO: 608947 - protein, 6 aa, Mycobacterium
VKHPDR

SEQ ID NO: 608948 - protein, 7 aa, Mycobacterium
VKHPDRE

SEQ ID NO: 608949 - protein, 47 aa, Mycobacterium
VKKAEAELDEPAPEEDDEDIAVEDTEDAEADTEADTDESDDDDDDAV

SEQ ID NO: 608950 - protein, 6 aa, Mycobacterium
VKKDDK

SEQ ID NO: 608951 - protein, 10 aa, Mycobacterium
VKKDEAVTRG

SEQ ID NO: 608952 - protein, 10 aa, Mycobacterium
VKKGDKDFSA

SEQ ID NO: 608953 - protein, 19 aa, Mycobacterium
VKKGGKDSVRAQLVGQHPR

SEQ ID NO: 608954 - protein, 9 aa, Mycobacterium
VKKGKPDLD

SEQ ID NO: 608955 - protein, 7 aa, Mycobacterium
VKKPETI

SEQ ID NO: 608956 - protein, 6 aa, Mycobacterium
VKKPGE

SEQ ID NO: 608957 - protein, 9 aa, Mycobacterium
VKKTYDPDS

SEQ ID NO: 608958 - protein, 4 aa, Mycobacterium
VKNA

SEQ ID NO: 608959 - protein, 21 aa, Mycobacterium
VKNAGGTPYAIPAGASDHPLG

SEQ ID NO: 608960 - protein, 23 aa, Mycobacterium
VKNAQEAHEAIRPAGETFATPDA

SEQ ID NO: 608961 - protein, 24 aa, Mycobacterium
VKNAQEAHEAIRPAGETFATPDAV

SEQ ID NO: 608962 - protein, 25 aa, Mycobacterium
VKNAQEAHEAIRPAGETFKTPGQLH

SEQ ID NO: 608963 - protein, 7 aa, Mycobacterium
VKNGERA

SEQ ID NO: 608964 - protein, 10 aa, Mycobacterium
VKNGPALGGY

SEQ ID NO: 608965 - protein, 8 aa, Mycobacterium
VKNNSSER

SEQ ID NO: 608966 - protein, 10 aa, Mycobacterium
VKNYDGSWTE

SEQ ID NO: 608967 - protein, 5 aa, Mycobacterium
VKPAA

SEQ ID NO: 608968 - protein, 7 aa, Mycobacterium
VKPADSH

SEQ ID NO: 608969 - protein, 9 aa, Mycobacterium
VKPAKPSKL

SEQ ID NO: 608970 - protein, 12 aa, Mycobacterium
VKPAQASVQSPR

SEQ ID NO: 608971 - protein, 8 aa, Mycobacterium
VKPATAVA

SEQ ID NO: 608972 - protein, 13 aa, Mycobacterium
VKPATLSGGQKQR

SEQ ID NO: 608973 - protein, 6 aa, Mycobacterium
VKPCGP

SEQ ID NO: 608974 - protein, 4 aa, Mycobacterium
VKPD

SEQ ID NO: 608975 - protein, 69 aa, Mycobacterium
VKPDAGLGGGAGSGGGGAGLGGGTTPASSLGPPPVPTSSPPTTPAGAAKAAMTPPVSGAPTTAGPTSMG

SEQ ID NO: 608976 - protein, 6 aa, Mycobacterium
VKPDDA

SEQ ID NO: 608977 - protein, 5 aa, Mycobacterium
VKPDL

SEQ ID NO: 608978 - protein, 7 aa, Mycobacterium
VKPDPSI

SEQ ID NO: 608979 - protein, 8 aa, Mycobacterium
VKPDTVSG

SEQ ID NO: 608980 - protein, 6 aa, Mycobacterium
VKPGDA

SEQ ID NO: 608981 - protein, 7 aa, Mycobacterium
VKPGDRV

SEQ ID NO: 608982 - protein, 13 aa, Mycobacterium
VKPGGHYDAQHFA

SEQ ID NO: 608983 - protein, 13 aa, Mycobacterium
VKPGGNYDGQHFA

SEQ ID NO: 608984 - protein, 9 aa, Mycobacterium
VKPGKGPAF

SEQ ID NO: 608985 - protein, 8 aa, Mycobacterium
VKPGTQGC

SEQ ID NO: 608986 - protein, 6 aa, Mycobacterium
VKPHAS

SEQ ID NO: 608987 - protein, 7 aa, Mycobacterium
VKPHASP

SEQ ID NO: 608988 - protein, 10 aa, Mycobacterium
VKPIGSPPRC

SEQ ID NO: 608989 - protein, 11 aa, Mycobacterium
VKPPGYDPELA

SEQ ID NO: 608990 - protein, 8 aa, Mycobacterium
VKPPKPSK

SEQ ID NO: 608991 - protein, 8 aa, Mycobacterium
VKPPPSEG

SEQ ID NO: 608992 - protein, 10 aa, Mycobacterium
VKPPSRERQA

SEQ ID NO: 608993 - protein, 8 aa, Mycobacterium
VKPPSTFG

SEQ ID NO: 608994 - protein, 10 aa, Mycobacterium
VKPPTPNRRL

SEQ ID NO: 608995 - protein, 8 aa, Mycobacterium
VKPPYDDA

SEQ ID NO: 608996 - protein, 7 aa, Mycobacterium
VKPRDVP

SEQ ID NO: 608997 - protein, 8 aa, Mycobacterium
VKPRRDGF

SEQ ID NO: 608998 - protein, 10 aa, Mycobacterium
VKPSGTADYR

SEQ ID NO: 608999 - protein, 12 aa, Mycobacterium
VKPTPAPSKTIS

SEQ ID NO: 609000 - protein, 6 aa, Mycobacterium
VKPTPL

SEQ ID NO: 609001 - protein, 5 aa, Mycobacterium
VKPTQ

SEQ ID NO: 609002 - protein, 10 aa, Mycobacterium
VKPTRNGEDI

SEQ ID NO: 609003 - protein, 8 aa, Mycobacterium
VKPTSVPA

SEQ ID NO: 609004 - protein, 12 aa, Mycobacterium
VKPTSVPTFRPG

SEQ ID NO: 609005 - protein, 6 aa, Mycobacterium
VKPTVS

SEQ ID NO: 609006 - protein, 8 aa, Mycobacterium
VKPTYGTV

SEQ ID NO: 609007 - protein, 5 aa, Mycobacterium
VKPVP

SEQ ID NO: 609008 - protein, 7 aa, Mycobacterium
VKPVSAN

SEQ ID NO: 609009 - protein, 7 aa, Mycobacterium
VKPVTSA

SEQ ID NO: 609010 - protein, 6 aa, Mycobacterium
VKQAAA

SEQ ID NO: 609011 - protein, 13 aa, Mycobacterium
VKQANQAVSQAES

SEQ ID NO: 609012 - protein, 10 aa, Mycobacterium
VKQKDKPAAV

SEQ ID NO: 609013 - protein, 15 aa, Mycobacterium
VKQKTSGPAPFQNPR

SEQ ID NO: 609014 - protein, 16 aa, Mycobacterium
VKQPKTAPLAGNSIAT

SEQ ID NO: 609015 - protein, 9 aa, Mycobacterium
VKQPRPGAT

SEQ ID NO: 609016 - protein, 12 aa, Mycobacterium
VKQPSMEKGRRA

SEQ ID NO: 609017 - protein, 8 aa, Mycobacterium
VKQTGKHL

SEQ ID NO: 609018 - protein, 9 aa, Mycobacterium
VKQTTLPTE

SEQ ID NO: 609019 - protein, 4 aa, Mycobacterium
VKRA

SEQ ID NO: 609020 - protein, 5 aa, Mycobacterium
VKRAA

SEQ ID NO: 609021 - protein, 5 aa, Mycobacterium
VKRAE

SEQ ID NO: 609022 - protein, 11 aa, Mycobacterium
VKRAQQADRIR

SEQ ID NO: 609023 - protein, 4 aa, Mycobacterium
VKRD

SEQ ID NO: 609024 - protein, 8 aa, Mycobacterium
VKRDGPMS

SEQ ID NO: 609025 - protein, 10 aa, Mycobacterium
VKRDTTATRQ

SEQ ID NO: 609026 - protein, 6 aa, Mycobacterium
VKRGAT

SEQ ID NO: 609027 - protein, 21 aa, Mycobacterium
VKRGATVAAGGEAPSGPGTFY

SEQ ID NO: 609028 - protein, 10 aa, Mycobacterium
VKRNAEGALN

SEQ ID NO: 609029 - protein, 7 aa, Mycobacterium
VKRNGGR

SEQ ID NO: 609030 - protein, 5 aa, Mycobacterium
VKRPE

SEQ ID NO: 609031 - protein, 5 aa, Mycobacterium
VKRRD

SEQ ID NO: 609032 - protein, 9 aa, Mycobacterium
VKRRPKDRK

SEQ ID NO: 609033 - protein, 15 aa, Mycobacterium
VKRRPKDRKAQIARA

SEQ ID NO: 609034 - protein, 7 aa, Mycobacterium
VKRTPAV

SEQ ID NO: 609035 - protein, 8 aa, Mycobacterium
VKRTREAL

SEQ ID NO: 609036 - protein, 9 aa, Mycobacterium
VKSAPSDAG

SEQ ID NO: 609037 - protein, 12 aa, Mycobacterium
VKSEGGANSAAG

SEQ ID NO: 609038 - protein, 6 aa, Mycobacterium
VKSGAD

SEQ ID NO: 609039 - protein, 6 aa, Mycobacterium
VKSGDR

SEQ ID NO: 609040 - protein, 14 aa, Mycobacterium
VKSGRGFYADYDGV

SEQ ID NO: 609041 - protein, 6 aa, Mycobacterium
VKSGRT

SEQ ID NO: 609042 - protein, 10 aa, Mycobacterium
VKSPEAGDAP

SEQ ID NO: 609043 - protein, 5 aa, Mycobacterium
VKSPG

SEQ ID NO: 609044 - protein, 13 aa, Mycobacterium
VKSPRNQGNPFTR

SEQ ID NO: 609045 - protein, 10 aa, Mycobacterium
VKSPSVTAGR

SEQ ID NO: 609046 - protein, 11 aa, Mycobacterium
VKSPYPTGDGY

SEQ ID NO: 609047 - protein, 11 aa, Mycobacterium
VKSPYPTGSGY

SEQ ID NO: 609048 - protein, 11 aa, Mycobacterium
VKSSDLSRGAV

SEQ ID NO: 609049 - protein, 18 aa, Mycobacterium
VKSSGESHLAAGDKANDI

SEQ ID NO: 609050 - protein, 11 aa, Mycobacterium
VKSSSDPFGRA

SEQ ID NO: 609051 - protein, 9 aa, Mycobacterium
VKSTGPGLA

SEQ ID NO: 609052 - protein, 10 aa, Mycobacterium
VKSTPSSPVR

SEQ ID NO: 609053 - protein, 23 aa, Mycobacterium
VKSTQPGLRPPRRTRAPRDRTVM

SEQ ID NO: 609054 - protein, 9 aa, Mycobacterium
VKSVDQARG

SEQ ID NO: 609055 - protein, 15 aa, Mycobacterium
VKTAAEQAGRDPGSV

SEQ ID NO: 609056 - protein, 8 aa, Mycobacterium
VKTADEIG

SEQ ID NO: 609057 - protein, 14 aa, Mycobacterium
VKTAEDSRRGKTRA

SEQ ID NO: 609058 - protein, 12 aa, Mycobacterium
VKTANGSRETIS

SEQ ID NO: 609059 - protein, 4 aa, Mycobacterium
VKTD

SEQ ID NO: 609060 - protein, 9 aa, Mycobacterium
VKTDGRKRR

SEQ ID NO: 609061 - protein, 5 aa, Mycobacterium
VKTDI

SEQ ID NO: 609062 - protein, 7 aa, Mycobacterium
VKTESPP

SEQ ID NO: 609063 - protein, 4 aa, Mycobacterium
VKTF

SEQ ID NO: 609064 - protein, 5 aa, Mycobacterium
VKTGD

SEQ ID NO: 609065 - protein, 8 aa, Mycobacterium
VKTGENNE

SEQ ID NO: 609066 - protein, 22 aa, Mycobacterium
VKTGGRGKAGGVKYAATPDDAF

SEQ ID NO: 609067 - protein, 7 aa, Mycobacterium
VKTGSDT

SEQ ID NO: 609068 - protein, 19 aa, Mycobacterium
VKTNEGLNHDKAGSDARSR

SEQ ID NO: 609069 - protein, 13 aa, Mycobacterium
VKTPSAAQRHTAL

SEQ ID NO: 609070 - protein, 8 aa, Mycobacterium
VKTPTSAP

SEQ ID NO: 609071 - protein, 8 aa, Mycobacterium
VKTRDGLE

SEQ ID NO: 609072 - protein, 7 aa, Mycobacterium
VKTRREP

SEQ ID NO: 609073 - protein, 7 aa, Mycobacterium
VKTSSDA

SEQ ID NO: 609074 - protein, 9 aa, Mycobacterium
VKTTPQDAV

SEQ ID NO: 609075 - protein, 4 aa, Mycobacterium
VKTV

SEQ ID NO: 609076 - protein, 9 aa, Mycobacterium
VKTVDGEFR

SEQ ID NO: 609077 - protein, 13 aa, Mycobacterium
VKVGGPSEFQTRQ

SEQ ID NO: 609078 - protein, 16 aa, Mycobacterium
VKVGPKRSPLHTPEQA

SEQ ID NO: 609079 - protein, 6 aa, Mycobacterium
VKVGSP

SEQ ID NO: 609080 - protein, 7 aa, Mycobacterium
VKVPDEA

SEQ ID NO: 609081 - protein, 14 aa, Mycobacterium
VKYPSDKEPSIGTL

SEQ ID NO: 609082 - protein, 15 aa, Mycobacterium
VKYSKERQSFGQPIG

SEQ ID NO: 609083 - protein, 9 aa, Mycobacterium
VLAGSGDLS

SEQ ID NO: 609084 - protein, 13 aa, Mycobacterium
VLDEDGEPPITAK

SEQ ID NO: 609085 - protein, 5 aa, Mycobacterium
VLDGE

SEQ ID NO: 609086 - protein, 11 aa, Mycobacterium
VLDGKDPDHQL

SEQ ID NO: 609087 - protein, 5 aa, Mycobacterium
VLDGS

SEQ ID NO: 609088 - protein, 15 aa, Mycobacterium
VLDPNSKRRFAPESK

SEQ ID NO: 609089 - protein, 4 aa, Mycobacterium
VLDS

SEQ ID NO: 609090 - protein, 4 aa, Mycobacterium
VLES

SEQ ID NO: 609091 - protein, 6 aa, Mycobacterium
VLESPG

SEQ ID NO: 609092 - protein, 8 aa, Mycobacterium
VLGGDEDR

SEQ ID NO: 609093 - protein, 12 aa, Mycobacterium
VLGGTDPAGPLT

SEQ ID NO: 609094 - protein, 6 aa, Mycobacterium
VLGNPT

SEQ ID NO: 609095 - protein, 8 aa, Mycobacterium
VLGPGETG

SEQ ID NO: 609096 - protein, 11 aa, Mycobacterium
VLGSPGQANYA

SEQ ID NO: 609097 - protein, 13 aa, Mycobacterium
VLPAGADTSSQLT

SEQ ID NO: 609098 - protein, 9 aa, Mycobacterium
VLPDDPDYP

SEQ ID NO: 609099 - protein, 7 aa, Mycobacterium
VLPDGAT

SEQ ID NO: 609100 - protein, 10 aa, Mycobacterium
VLPDGDEVAD

SEQ ID NO: 609101 - protein, 7 aa, Mycobacterium
VLPENSG

SEQ ID NO: 609102 - protein, 11 aa, Mycobacterium
VLPEPGEFTAA

SEQ ID NO: 609103 - protein, 4 aa, Mycobacterium
VLPG

SEQ ID NO: 609104 - protein, 16 aa, Mycobacterium
VLPGDGDFSARPDGGE

SEQ ID NO: 609105 - protein, 9 aa, Mycobacterium
VLPGDGPYV

SEQ ID NO: 609106 - protein, 15 aa, Mycobacterium
VLPGGDATGLDPDKL

SEQ ID NO: 609107 - protein, 6 aa, Mycobacterium
VLPGGT

SEQ ID NO: 609108 - protein, 13 aa, Mycobacterium
VLPGPDSPGTRSN

SEQ ID NO: 609109 - protein, 12 aa, Mycobacterium
VLPGPGKRPVTQ

SEQ ID NO: 609110 - protein, 7 aa, Mycobacterium
VLPGSDP

SEQ ID NO: 609111 - protein, 10 aa, Mycobacterium
VLPGYGGSKA

SEQ ID NO: 609112 - protein, 4 aa, Mycobacterium
VLPP

SEQ ID NO: 609113 - protein, 7 aa, Mycobacterium
VLPPAAG

SEQ ID NO: 609114 - protein, 6 aa, Mycobacterium
VLPPGA

SEQ ID NO: 609115 - protein, 6 aa, Mycobacterium
VLPPMG

SEQ ID NO: 609116 - protein, 9 aa, Mycobacterium
VLPPPDVAA

SEQ ID NO: 609117 - protein, 8 aa, Mycobacterium
VLPPPSAA

SEQ ID NO: 609118 - protein, 17 aa, Mycobacterium
VLPPQGHDKGGRAGQRR

SEQ ID NO: 609119 - protein, 13 aa, Mycobacterium
VLPSADELRTRAQ

SEQ ID NO: 609120 - protein, 8 aa, Mycobacterium
VLPSGRSA

SEQ ID NO: 609121 - protein, 13 aa, Mycobacterium
VLPSSTNPTRPHT

SEQ ID NO: 609122 - protein, 11 aa, Mycobacterium
VLPTSSQANPT

SEQ ID NO: 609123 - protein, 12 aa, Mycobacterium
VLPTSSQANPTL

SEQ ID NO: 609124 - protein, 8 aa, Mycobacterium
VLQSPAEL

SEQ ID NO: 609125 - protein, 22 aa, Mycobacterium
VLRDNSGRFEVSGDGAERTGLR

SEQ ID NO: 609126 - protein, 9 aa, Mycobacterium
VLSEPGRGL

SEQ ID NO: 609127 - protein, 17 aa, Mycobacterium
VLSGAADPRQEGIAIGV

SEQ ID NO: 609128 - protein, 12 aa, Mycobacterium
VLSGAGSKKVAK

SEQ ID NO: 609129 - protein, 9 aa, Mycobacterium
VLSGPGADL

SEQ ID NO: 609130 - protein, 8 aa, Mycobacterium
VLSGTTGD

SEQ ID NO: 609131 - protein, 8 aa, Mycobacterium
VLSPADQR

SEQ ID NO: 609132 - protein, 22 aa, Mycobacterium
VLSPGSGPEPQDISVPTEQVLA

SEQ ID NO: 609133 - protein, 9 aa, Mycobacterium
VLSRPDGTV

SEQ ID NO: 609134 - protein, 11 aa, Mycobacterium
VLSSKNESELR

SEQ ID NO: 609135 - protein, 13 aa, Mycobacterium
VLSTPGGDKLDEA

SEQ ID NO: 609136 - protein, 14 aa, Mycobacterium
VLTDPAKRKEYDET

SEQ ID NO: 609137 - protein, 4 aa, Mycobacterium
VLTG

SEQ ID NO: 609138 - protein, 12 aa, Mycobacterium
VLTGSDSDRDRR

SEQ ID NO: 609139 - protein, 4 aa, Mycobacterium
VLTP

SEQ ID NO: 609140 - protein, 10 aa, Mycobacterium
VMDSEDGSLT

SEQ ID NO: 609141 - protein, 12 aa, Mycobacterium
VMGGGEPAGPVN

SEQ ID NO: 609142 - protein, 11 aa, Mycobacterium
VMNDEGDGDEW

SEQ ID NO: 609143 - protein, 4 aa, Mycobacterium
VMPG

SEQ ID NO: 609144 - protein, 5 aa, Mycobacterium
VMPGG

SEQ ID NO: 609145 - protein, 12 aa, Mycobacterium
VMPGPVGANPSL

SEQ ID NO: 609146 - protein, 8 aa, Mycobacterium
VMREGPSF

SEQ ID NO: 609147 - protein, 8 aa, Mycobacterium
VNAAAAQN

SEQ ID NO: 609148 - protein, 8 aa, Mycobacterium
VNAAADSM

SEQ ID NO: 609149 - protein, 16 aa, Mycobacterium
VNAAGGAALDTTPAQL

SEQ ID NO: 609150 - protein, 5 aa, Mycobacterium
VNAAQ

SEQ ID NO: 609151 - protein, 7 aa, Mycobacterium
VNAASDA

SEQ ID NO: 609152 - protein, 10 aa, Mycobacterium
VNAASDAMGY

SEQ ID NO: 609153 - protein, 6 aa, Mycobacterium
VNAASQ

SEQ ID NO: 609154 - protein, 8 aa, Mycobacterium
VNAASRSM

SEQ ID NO: 609155 - protein, 14 aa, Mycobacterium
VNAASRVTGVARPG

SEQ ID NO: 609156 - protein, 13 aa, Mycobacterium
VNADEGVRRGTTV

SEQ ID NO: 609157 - protein, 6 aa, Mycobacterium
VNADGY

SEQ ID NO: 609158 - protein, 5 aa, Mycobacterium
VNADK

SEQ ID NO: 609159 - protein, 12 aa, Mycobacterium
VNADPDSKPAVI

SEQ ID NO: 609160 - protein, 10 aa, Mycobacterium
VNADPGADHS

SEQ ID NO: 609161 - protein, 8 aa, Mycobacterium
VNADTDPA

SEQ ID NO: 609162 - protein, 4 aa, Mycobacterium
VNAG

SEQ ID NO: 609163 - protein, 11 aa, Mycobacterium
VNAGGGGGPRR

SEQ ID NO: 609164 - protein, 7 aa, Mycobacterium
VNAGTGA

SEQ ID NO: 609165 - protein, 6 aa, Mycobacterium
VNAGYR

SEQ ID NO: 609166 - protein, 12 aa, Mycobacterium
VNAIDDEGSTPL

SEQ ID NO: 609167 - protein, 5 aa, Mycobacterium
VNAKN

SEQ ID NO: 609168 - protein, 7 aa, Mycobacterium
VNAKNVG

SEQ ID NO: 609169 - protein, 4 aa, Mycobacterium
VNAN

SEQ ID NO: 609170 - protein, 18 aa, Mycobacterium
VNANGKVDRAKLEARSVG

SEQ ID NO: 609171 - protein, 5 aa, Mycobacterium
VNAPA

SEQ ID NO: 609172 - protein, 6 aa, Mycobacterium
VNAPAQ

SEQ ID NO: 609173 - protein, 7 aa, Mycobacterium
VNAPAQT

SEQ ID NO: 609174 - protein, 25 aa, Mycobacterium
VNAPDLKQAQRARHSLRTSRKDAPA

SEQ ID NO: 609175 - protein, 7 aa, Mycobacterium
VNAPEYT

SEQ ID NO: 609176 - protein, 9 aa, Mycobacterium
VNAPNPRPW

SEQ ID NO: 609177 - protein, 4 aa, Mycobacterium
VNAR

SEQ ID NO: 609178 - protein, 7 aa, Mycobacterium
VNARESD

SEQ ID NO: 609179 - protein, 5 aa, Mycobacterium
VNARP

SEQ ID NO: 609180 - protein, 5 aa, Mycobacterium
VNARQ

SEQ ID NO: 609181 - protein, 4 aa, Mycobacterium
VNAS

SEQ ID NO: 609182 - protein, 8 aa, Mycobacterium
VNASADAA

SEQ ID NO: 609183 - protein, 7 aa, Mycobacterium
VNASANA

SEQ ID NO: 609184 - protein, 8 aa, Mycobacterium
VNATGSPL

SEQ ID NO: 609185 - protein, 11 aa, Mycobacterium
VNATKGKKERL

SEQ ID NO: 609186 - protein, 15 aa, Mycobacterium
VNDDTKYDKRQPAEA

SEQ ID NO: 609187 - protein, 8 aa, Mycobacterium
VNDGPTAI

SEQ ID NO: 609188 - protein, 8 aa, Mycobacterium
VNDGPTAL

SEQ ID NO: 609189 - protein, 7 aa, Mycobacterium
VNDIKGG

SEQ ID NO: 609190 - protein, 8 aa, Mycobacterium
VNDPELPE

SEQ ID NO: 609191 - protein, 5 aa, Mycobacterium
VNDPG

SEQ ID NO: 609192 - protein, 6 aa, Mycobacterium
VNDPGN

SEQ ID NO: 609193 - protein, 13 aa, Mycobacterium
VNDPVGSRPHIGE

SEQ ID NO: 609194 - protein, 9 aa, Mycobacterium
VNDQEDGRH

SEQ ID NO: 609195 - protein, 4 aa, Mycobacterium
VNDR

SEQ ID NO: 609196 - protein, 6 aa, Mycobacterium
VNDRDP

SEQ ID NO: 609197 - protein, 10 aa, Mycobacterium
VNDRGYPPSI

SEQ ID NO: 609198 - protein, 10 aa, Mycobacterium
VNDSAGNAVT

SEQ ID NO: 609199 - protein, 10 aa, Mycobacterium
VNDSDGNAVT

SEQ ID NO: 609200 - protein, 9 aa, Mycobacterium
VNDSEAQNF

SEQ ID NO: 609201 - protein, 8 aa, Mycobacterium
VNDTAGLS

SEQ ID NO: 609202 - protein, 9 aa, Mycobacterium
VNDTGTMTT

SEQ ID NO: 609203 - protein, 8 aa, Mycobacterium
VNDTSDLL

SEQ ID NO: 609204 - protein, 11 aa, Mycobacterium
VNDTTKTRVSA

SEQ ID NO: 609205 - protein, 6 aa, Mycobacterium
VNDYPA

SEQ ID NO: 609206 - protein, 19 aa, Mycobacterium
VNEAADTTFYDSPATERPV

SEQ ID NO: 609207 - protein, 20 aa, Mycobacterium
VNEAADTTFYDSPETEKPVG

SEQ ID NO: 609208 - protein, 19 aa, Mycobacterium
VNEAADTTFYDSPETERPV

SEQ ID NO: 609209 - protein, 7 aa, Mycobacterium
VNEDGSF

SEQ ID NO: 609210 - protein, 7 aa, Mycobacterium
VNEDPDL

SEQ ID NO: 609211 - protein, 6 aa, Mycobacterium
VNEGGG

SEQ ID NO: 609212 - protein, 13 aa, Mycobacterium
VNEGGGIQVDGEG

SEQ ID NO: 609213 - protein, 6 aa, Mycobacterium
VNEGQG

SEQ ID NO: 609214 - protein, 7 aa, Mycobacterium
VNEGQGD

SEQ ID NO: 609215 - protein, 21 aa, Mycobacterium
VNEGYEDMREGRNIRGVILHD

SEQ ID NO: 609216 - protein, 7 aa, Mycobacterium
VNEPADV

SEQ ID NO: 609217 - protein, 7 aa, Mycobacterium
VNEPATG

SEQ ID NO: 609218 - protein, 5 aa, Mycobacterium
VNEPE

SEQ ID NO: 609219 - protein, 7 aa, Mycobacterium
VNEPSEL

SEQ ID NO: 609220 - protein, 4 aa, Mycobacterium
VNEQ

SEQ ID NO: 609221 - protein, 10 aa, Mycobacterium
VNEQPPSSIA

SEQ ID NO: 609222 - protein, 10 aa, Mycobacterium
VNERGYPPSI

SEQ ID NO: 609223 - protein, 5 aa, Mycobacterium
VNERS

SEQ ID NO: 609224 - protein, 9 aa, Mycobacterium
VNESSTGEQ

SEQ ID NO: 609225 - protein, 11 aa, Mycobacterium
VNETRERTEQL

SEQ ID NO: 609226 - protein, 9 aa, Mycobacterium
VNETSTGQQ

SEQ ID NO: 609227 - protein, 9 aa, Mycobacterium
VNETSTGRQ

SEQ ID NO: 609228 - protein, 5 aa, Mycobacterium
VNETW

SEQ ID NO: 609229 - protein, 19 aa, Mycobacterium
VNEVDTGPETGPDSGSDNG

SEQ ID NO: 609230 - protein, 8 aa, Mycobacterium
VNFSGSGC

SEQ ID NO: 609231 - protein, 9 aa, Mycobacterium
VNGAEPSHN

SEQ ID NO: 609232 - protein, 10 aa, Mycobacterium
VNGAPDIGPH

SEQ ID NO: 609233 - protein, 12 aa, Mycobacterium
VNGAPGPGRLPG

SEQ ID NO: 609234 - protein, 15 aa, Mycobacterium
VNGAPGTGQSGGAGG

SEQ ID NO: 609235 - protein, 8 aa, Mycobacterium
VNGDGPSY

SEQ ID NO: 609236 - protein, 7 aa, Mycobacterium
VNGDPTA

SEQ ID NO: 609237 - protein, 7 aa, Mycobacterium
VNGDPTK

SEQ ID NO: 609238 - protein, 20 aa, Mycobacterium
VNGDQTVTTATGQGGFRTTT

SEQ ID NO: 609239 - protein, 20 aa, Mycobacterium
VNGDTATASMTSSNEALGTR

SEQ ID NO: 609240 - protein, 7 aa, Mycobacterium
VNGDYAA

SEQ ID NO: 609241 - protein, 10 aa, Mycobacterium
VNGEESQWDA

SEQ ID NO: 609242 - protein, 6 aa, Mycobacterium
VNGEKT

SEQ ID NO: 609243 - protein, 5 aa, Mycobacterium
VNGER

SEQ ID NO: 609244 - protein, 4 aa, Mycobacterium
VNGG

SEQ ID NO: 609245 - protein, 6 aa, Mycobacterium
VNGGNH

SEQ ID NO: 609246 - protein, 8 aa, Mycobacterium
VNGGNRTV

SEQ ID NO: 609247 - protein, 16 aa, Mycobacterium
VNGGPVEDAKKRPDFS

SEQ ID NO: 609248 - protein, 16 aa, Mycobacterium
VNGGPVEDAKKRPDFT

SEQ ID NO: 609249 - protein, 6 aa, Mycobacterium
VNGGQI

SEQ ID NO: 609250 - protein, 7 aa, Mycobacterium
VNGNGPR

SEQ ID NO: 609251 - protein, 4 aa, Mycobacterium
VNGP

SEQ ID NO: 609252 - protein, 10 aa, Mycobacterium
VNGPAEKPLQ

SEQ ID NO: 609253 - protein, 5 aa, Mycobacterium
VNGPD

SEQ ID NO: 609254 - protein, 6 aa, Mycobacterium
VNGPDS

SEQ ID NO: 609255 - protein, 10 aa, Mycobacterium
VNGPDSVTFS

SEQ ID NO: 609256 - protein, 5 aa, Mycobacterium
VNGPE

SEQ ID NO: 609257 - protein, 5 aa, Mycobacterium
VNGPQ

SEQ ID NO: 609258 - protein, 6 aa, Mycobacterium
VNGPQS

SEQ ID NO: 609259 - protein, 9 aa, Mycobacterium
VNGPRDRRH

SEQ ID NO: 609260 - protein, 9 aa, Mycobacterium
VNGPSLTGK

SEQ ID NO: 609261 - protein, 9 aa, Mycobacterium
VNGPSSTVV

SEQ ID NO: 609262 - protein, 15 aa, Mycobacterium
VNGPSSTVVSGDHEA

SEQ ID NO: 609263 - protein, 7 aa, Mycobacterium
VNGPTEA

SEQ ID NO: 609264 - protein, 5 aa, Mycobacterium
VNGQP

SEQ ID NO: 609265 - protein, 14 aa, Mycobacterium
VNGQSAPAQPPTVS

SEQ ID NO: 609266 - protein, 10 aa, Mycobacterium
VNGRASDELD

SEQ ID NO: 609267 - protein, 22 aa, Mycobacterium
VNGRGGGKADLAQGSGKGAAGI

SEQ ID NO: 609268 - protein, 7 aa, Mycobacterium
VNGRPVR

SEQ ID NO: 609269 - protein, 15 aa, Mycobacterium
VNGRQAKPSTMVSPG

SEQ ID NO: 609270 - protein, 6 aa, Mycobacterium
VNGRQV

SEQ ID NO: 609271 - protein, 8 aa, Mycobacterium
VNGRRPTH

SEQ ID NO: 609272 - protein, 9 aa, Mycobacterium
VNGRRSAES

SEQ ID NO: 609273 - protein, 10 aa, Mycobacterium
VNGRRSPESL

SEQ ID NO: 609274 - protein, 4 aa, Mycobacterium
VNGS

SEQ ID NO: 609275 - protein, 5 aa, Mycobacterium
VNGSA

SEQ ID NO: 609276 - protein, 19 aa, Mycobacterium
VNGSEPGREFLRRRIAECA

SEQ ID NO: 609277 - protein, 9 aa, Mycobacterium
VNGSEVAER

SEQ ID NO: 609278 - protein, 6 aa, Mycobacterium
VNGSGI

SEQ ID NO: 609279 - protein, 8 aa, Mycobacterium
VNGSGKST

SEQ ID NO: 609280 - protein, 6 aa, Mycobacterium
VNGSSE

SEQ ID NO: 609281 - protein, 4 aa, Mycobacterium
VNGT

SEQ ID NO: 609282 - protein, 7 aa, Mycobacterium
VNGTDAG

SEQ ID NO: 609283 - protein, 9 aa, Mycobacterium
VNGTPLGGV

SEQ ID NO: 609284 - protein, 11 aa, Mycobacterium
VNGTRAAPVMP

SEQ ID NO: 609285 - protein, 8 aa, Mycobacterium
VNGTREGL

SEQ ID NO: 609286 - protein, 13 aa, Mycobacterium
VNGTTVQDASTDE

SEQ ID NO: 609287 - protein, 7 aa, Mycobacterium
VNGTYAA

SEQ ID NO: 609288 - protein, 14 aa, Mycobacterium
VNGVPERDRRDRRT

SEQ ID NO: 609289 - protein, 20 aa, Mycobacterium
VNHDGRTNGLTAPSRGSQEA

SEQ ID NO: 609290 - protein, 20 aa, Mycobacterium
VNHNGRGAGLTVPRSSAQRD

SEQ ID NO: 609291 - protein, 58 aa, Mycobacterium
VNKASRGGGGGGFGGGGGGGGGGGARQAPAQASSPAGGDDPWGSAPASGSFGGDDEPP

SEQ ID NO: 609292 - protein, 48 aa, Mycobacterium
VNKASRGGGGGGGFGGGGGGGSRSSEPADDPWGSAPASGSTAADDEPP

SEQ ID NO: 609293 - protein, 53 aa, Mycobacterium
VNKASRSGGGGGFGGGGGSRPATPPASGTPGPGDDPWGSAPASGSFGGDDEPP

SEQ ID NO: 609294 - protein, 52 aa, Mycobacterium
VNKASRSGGGGGFGGGGGSRQGSAPASGAPADDPWGSAPASGSFGGGDDEPP

SEQ ID NO: 609295 - protein, 55 aa, Mycobacterium
VNKASRSGGGGGGFGGGGGGGSRQQAAPATSAPADDPWGSAPASGSFGGGDDEPP

SEQ ID NO: 609296 - protein, 53 aa, Mycobacterium
VNKASRSGGGGGGFGGGGGGNSRPAPSNTGPAEDPWGSAPASGSFGGADDEPP

SEQ ID NO: 609297 - protein, 6 aa, Mycobacterium
VNKPHA

SEQ ID NO: 609298 - protein, 7 aa, Mycobacterium
VNKPHAR

SEQ ID NO: 609299 - protein, 8 aa, Mycobacterium
VNKSGAPH

SEQ ID NO: 609300 - protein, 10 aa, Mycobacterium
VNLGRPDPNL

SEQ ID NO: 609301 - protein, 14 aa, Mycobacterium
VNMSQSSNDTFPTA

SEQ ID NO: 609302 - protein, 12 aa, Mycobacterium
VNNCPTGALSID

SEQ ID NO: 609303 - protein, 7 aa, Mycobacterium
VNNDESR

SEQ ID NO: 609304 - protein, 13 aa, Mycobacterium
VNNPGGGYKPEGA

SEQ ID NO: 609305 - protein, 7 aa, Mycobacterium
VNNPGVA

SEQ ID NO: 609306 - protein, 16 aa, Mycobacterium
VNNPRKYGLSGSDVTR

SEQ ID NO: 609307 - protein, 6 aa, Mycobacterium
VNNSPV

SEQ ID NO: 609308 - protein, 10 aa, Mycobacterium
VNPAAAHSTL

SEQ ID NO: 609309 - protein, 7 aa, Mycobacterium
VNPAEEP

SEQ ID NO: 609310 - protein, 13 aa, Mycobacterium
VNPAEVPRSRDEV

SEQ ID NO: 609311 - protein, 19 aa, Mycobacterium
VNPAGTAQALDVAATVLDV

SEQ ID NO: 609312 - protein, 5 aa, Mycobacterium
VNPAH

SEQ ID NO: 609313 - protein, 9 aa, Mycobacterium
VNPAPKPGV

SEQ ID NO: 609314 - protein, 5 aa, Mycobacterium
VNPAS

SEQ ID NO: 609315 - protein, 7 aa, Mycobacterium
VNPATEE

SEQ ID NO: 609316 - protein, 6 aa, Mycobacterium
VNPDAD

SEQ ID NO: 609317 - protein, 9 aa, Mycobacterium
VNPDAVDAT

SEQ ID NO: 609318 - protein, 17 aa, Mycobacterium
VNPDDPNADNADPGIPP

SEQ ID NO: 609319 - protein, 10 aa, Mycobacterium
VNPDEPDETT

SEQ ID NO: 609320 - protein, 9 aa, Mycobacterium
VNPDEPGCS

SEQ ID NO: 609321 - protein, 12 aa, Mycobacterium
VNPDGDKGGPQI

SEQ ID NO: 609322 - protein, 12 aa, Mycobacterium
VNPDGDQGGPQI

SEQ ID NO: 609323 - protein, 12 aa, Mycobacterium
VNPDGTTSAPTI

SEQ ID NO: 609324 - protein, 11 aa, Mycobacterium
VNPDGTTVAPT

SEQ ID NO: 609325 - protein, 7 aa, Mycobacterium
VNPDPAA

SEQ ID NO: 609326 - protein, 8 aa, Mycobacterium
VNPDPDAL

SEQ ID NO: 609327 - protein, 13 aa, Mycobacterium
VNPDPTTPASMTP

SEQ ID NO: 609328 - protein, 8 aa, Mycobacterium
VNPDRDAL

SEQ ID NO: 609329 - protein, 7 aa, Mycobacterium
VNPDRTA

SEQ ID NO: 609330 - protein, 10 aa, Mycobacterium
VNPDRTPEEP

SEQ ID NO: 609331 - protein, 240 aa, Mycobacterium
VNPDSKRDRPHGAVTTAPPTPDPQPGAPMTDNPGPQQGRPGEEYGREDDRYGRPDQDPRGQQPQGGQGYPPRQGGYEGGGYGQGQPYGQDYGRPPAGYDQGGYQQRPPQQGGYDQGGYGAPPQAPQGGGDYGRPPAPPQQGGGYGAPPQQGGYGEPPRPNYGEYEQGGGYGGGQYGGQQGPPPGQDYGRPPAYPQQGGYGAPPQQGGYGSPEYGDYEQGGYQSSPDYGAPAGGPGGGRTT

SEQ ID NO: 609332 - protein, 10 aa, Mycobacterium
VNPEDPKGAV

SEQ ID NO: 609333 - protein, 9 aa, Mycobacterium
VNPEDRRSA

SEQ ID NO: 609334 - protein, 11 aa, Mycobacterium
VNPGGAAQVPH

SEQ ID NO: 609335 - protein, 10 aa, Mycobacterium
VNPGGGPSTF

SEQ ID NO: 609336 - protein, 11 aa, Mycobacterium
VNPGGNAQVPH

SEQ ID NO: 609337 - protein, 8 aa, Mycobacterium
VNPGGPAL

SEQ ID NO: 609338 - protein, 7 aa, Mycobacterium
VNPGTVD

SEQ ID NO: 609339 - protein, 7 aa, Mycobacterium
VNPHADG

SEQ ID NO: 609340 - protein, 20 aa, Mycobacterium
VNPKPDPGGNGAGKDPVDAT

SEQ ID NO: 609341 - protein, 5 aa, Mycobacterium
VNPKR

SEQ ID NO: 609342 - protein, 4 aa, Mycobacterium
VNPN

SEQ ID NO: 609343 - protein, 12 aa, Mycobacterium
VNPNGTTSAPTV

SEQ ID NO: 609344 - protein, 6 aa, Mycobacterium
VNPNTI

SEQ ID NO: 609345 - protein, 9 aa, Mycobacterium
VNPNTTDPV

SEQ ID NO: 609346 - protein, 6 aa, Mycobacterium
VNPNTV

SEQ ID NO: 609347 - protein, 6 aa, Mycobacterium
VNPPGK

SEQ ID NO: 609348 - protein, 6 aa, Mycobacterium
VNPPGT

SEQ ID NO: 609349 - protein, 12 aa, Mycobacterium
VNPPIATESSYY

SEQ ID NO: 609350 - protein, 14 aa, Mycobacterium
VNPPLREAADASAL

SEQ ID NO: 609351 - protein, 14 aa, Mycobacterium
VNPPPDDADPSPLL

SEQ ID NO: 609352 - protein, 10 aa, Mycobacterium
VNPPPPPTCC

SEQ ID NO: 609353 - protein, 4 aa, Mycobacterium
VNPR

SEQ ID NO: 609354 - protein, 7 aa, Mycobacterium
VNPRDRR

SEQ ID NO: 609355 - protein, 10 aa, Mycobacterium
VNPSKVPERD

SEQ ID NO: 609356 - protein, 13 aa, Mycobacterium
VNPSMGPASIESH

SEQ ID NO: 609357 - protein, 10 aa, Mycobacterium
VNPSRSIGHD

SEQ ID NO: 609358 - protein, 12 aa, Mycobacterium
VNPTATLPTPTI

SEQ ID NO: 609359 - protein, 22 aa, Mycobacterium
VNPTPTHRVNDNRRKGRRAEDI

SEQ ID NO: 609360 - protein, 5 aa, Mycobacterium
VNPVE

SEQ ID NO: 609361 - protein, 15 aa, Mycobacterium
VNPVPNLAGATNSRE

SEQ ID NO: 609362 - protein, 18 aa, Mycobacterium
VNQAAQSATGSSTQSALN

SEQ ID NO: 609363 - protein, 19 aa, Mycobacterium
VNQDGASNGLTAPNGPAQE

SEQ ID NO: 609364 - protein, 11 aa, Mycobacterium
VNQNPEEGKRR

SEQ ID NO: 609365 - protein, 9 aa, Mycobacterium
VNQNTSRAA

SEQ ID NO: 609366 - protein, 4 aa, Mycobacterium
VNQR

SEQ ID NO: 609367 - protein, 5 aa, Mycobacterium
VNQSV

SEQ ID NO: 609368 - protein, 15 aa, Mycobacterium
VNQTYATTHPDAERL

SEQ ID NO: 609369 - protein, 26 aa, Mycobacterium
VNRAAEDAARARDAYERDDGLQRRTG

SEQ ID NO: 609370 - protein, 6 aa, Mycobacterium
VNRAGT

SEQ ID NO: 609371 - protein, 4 aa, Mycobacterium
VNRD

SEQ ID NO: 609372 - protein, 6 aa, Mycobacterium
VNRDGG

SEQ ID NO: 609373 - protein, 9 aa, Mycobacterium
VNRDPRRFD

SEQ ID NO: 609374 - protein, 9 aa, Mycobacterium
VNRDQTAAG

SEQ ID NO: 609375 - protein, 6 aa, Mycobacterium
VNRDSG

SEQ ID NO: 609376 - protein, 10 aa, Mycobacterium
VNREESEEGV

SEQ ID NO: 609377 - protein, 11 aa, Mycobacterium
VNREESEEGVA

SEQ ID NO: 609378 - protein, 9 aa, Mycobacterium
VNRGNRNAF

SEQ ID NO: 609379 - protein, 9 aa, Mycobacterium
VNRGPRAPF

SEQ ID NO: 609380 - protein, 10 aa, Mycobacterium
VNRNQGAEST

SEQ ID NO: 609381 - protein, 7 aa, Mycobacterium
VNRPDEP

SEQ ID NO: 609382 - protein, 10 aa, Mycobacterium
VNRRHRREQY

SEQ ID NO: 609383 - protein, 11 aa, Mycobacterium
VNRSEGQKHPW

SEQ ID NO: 609384 - protein, 6 aa, Mycobacterium
VNRSGE

SEQ ID NO: 609385 - protein, 7 aa, Mycobacterium
VNRSPDA

SEQ ID NO: 609386 - protein, 18 aa, Mycobacterium
VNRSPSDAERAATANNVG

SEQ ID NO: 609387 - protein, 5 aa, Mycobacterium
VNRTA

SEQ ID NO: 609388 - protein, 11 aa, Mycobacterium
VNRTRNALAQN

SEQ ID NO: 609389 - protein, 4 aa, Mycobacterium
VNRV

SEQ ID NO: 609390 - protein, 45 aa, Mycobacterium
VNSARQRLDRDRSALGRLGGEVNSGTQMVSSPRAAGTGMSPGIGR

SEQ ID NO: 609391 - protein, 12 aa, Mycobacterium
VNSASTSPRPRM

SEQ ID NO: 609392 - protein, 8 aa, Mycobacterium
VNSDRDPG

SEQ ID NO: 609393 - protein, 4 aa, Mycobacterium
VNSG

SEQ ID NO: 609394 - protein, 8 aa, Mycobacterium
VNSGAGVD

SEQ ID NO: 609395 - protein, 11 aa, Mycobacterium
VNSGAQEGDPI

SEQ ID NO: 609396 - protein, 16 aa, Mycobacterium
VNSGDSPPAAEPPLPA

SEQ ID NO: 609397 - protein, 5 aa, Mycobacterium
VNSGL

SEQ ID NO: 609398 - protein, 10 aa, Mycobacterium
VNSGQSGLAS

SEQ ID NO: 609399 - protein, 7 aa, Mycobacterium
VNSGTTI

SEQ ID NO: 609400 - protein, 6 aa, Mycobacterium
VNSHDG

SEQ ID NO: 609401 - protein, 7 aa, Mycobacterium
VNSHSSV

SEQ ID NO: 609402 - protein, 8 aa, Mycobacterium
VNSHSSVR

SEQ ID NO: 609403 - protein, 17 aa, Mycobacterium
VNSKGSGVRRLDDEDRV

SEQ ID NO: 609404 - protein, 5 aa, Mycobacterium
VNSLS

SEQ ID NO: 609405 - protein, 8 aa, Mycobacterium
VNSPGTEI

SEQ ID NO: 609406 - protein, 12 aa, Mycobacterium
VNSPLAGEANEA

SEQ ID NO: 609407 - protein, 7 aa, Mycobacterium
VNSPQGY

SEQ ID NO: 609408 - protein, 15 aa, Mycobacterium
VNSPQRQRSSVGAGQ

SEQ ID NO: 609409 - protein, 15 aa, Mycobacterium
VNSPSSSVVSGDRDA

SEQ ID NO: 609410 - protein, 9 aa, Mycobacterium
VNSPTASLT

SEQ ID NO: 609411 - protein, 10 aa, Mycobacterium
VNSRSRRPRD

SEQ ID NO: 609412 - protein, 4 aa, Mycobacterium
VNST

SEQ ID NO: 609413 - protein, 10 aa, Mycobacterium
VNSYSKDGAM

SEQ ID NO: 609414 - protein, 25 aa, Mycobacterium
VNTANRPGKRKRTRTGYGRRKNTKR

SEQ ID NO: 609415 - protein, 25 aa, Mycobacterium
VNTANRQGKRKRTRTGFGKRKSTKR

SEQ ID NO: 609416 - protein, 25 aa, Mycobacterium
VNTANRQGKRKRTRTGYGKRKSTKR

SEQ ID NO: 609417 - protein, 8 aa, Mycobacterium
VNTDAANL

SEQ ID NO: 609418 - protein, 9 aa, Mycobacterium
VNTDAASFE

SEQ ID NO: 609419 - protein, 8 aa, Mycobacterium
VNTDATGL

SEQ ID NO: 609420 - protein, 5 aa, Mycobacterium
VNTDG

SEQ ID NO: 609421 - protein, 7 aa, Mycobacterium
VNTDPHP

SEQ ID NO: 609422 - protein, 8 aa, Mycobacterium
VNTDPHPL

SEQ ID NO: 609423 - protein, 14 aa, Mycobacterium
VNTFTDGSGPEEGQ

SEQ ID NO: 609424 - protein, 4 aa, Mycobacterium
VNTG

SEQ ID NO: 609425 - protein, 6 aa, Mycobacterium
VNTGAQ

SEQ ID NO: 609426 - protein, 5 aa, Mycobacterium
VNTGF

SEQ ID NO: 609427 - protein, 10 aa, Mycobacterium
VNTGGVTRDD

SEQ ID NO: 609428 - protein, 23 aa, Mycobacterium
VNTGIGNATDAGEVGLTATDSSG

SEQ ID NO: 609429 - protein, 34 aa, Mycobacterium
VNTGIGNPGNYNTGSFNTGSFNTAGLNPGDYNTG

SEQ ID NO: 609430 - protein, 37 aa, Mycobacterium
VNTGIGSPDTQPGSISGFGNTGAGVSGFNNSGDATSG

SEQ ID NO: 609431 - protein, 11 aa, Mycobacterium
VNTGNVGRDDT

SEQ ID NO: 609432 - protein, 8 aa, Mycobacterium
VNTNTAAA

SEQ ID NO: 609433 - protein, 10 aa, Mycobacterium
VNTPESHARR

SEQ ID NO: 609434 - protein, 6 aa, Mycobacterium
VNTPKV

SEQ ID NO: 609435 - protein, 11 aa, Mycobacterium
VNTPPQTTRAK

SEQ ID NO: 609436 - protein, 7 aa, Mycobacterium
VNTPPSH

SEQ ID NO: 609437 - protein, 9 aa, Mycobacterium
VNTSSSSQR

SEQ ID NO: 609438 - protein, 9 aa, Mycobacterium
VNTTGTKLR

SEQ ID NO: 609439 - protein, 7 aa, Mycobacterium
VNTTSSS

SEQ ID NO: 609440 - protein, 9 aa, Mycobacterium
VNTTSSSQR

SEQ ID NO: 609441 - protein, 5 aa, Mycobacterium
VNVEN

SEQ ID NO: 609442 - protein, 4 aa, Mycobacterium
VNVP

SEQ ID NO: 609443 - protein, 5 aa, Mycobacterium
VNVPE

SEQ ID NO: 609444 - protein, 9 aa, Mycobacterium
VNVQPPPSA

SEQ ID NO: 609445 - protein, 9 aa, Mycobacterium
VNVSGSGCS

SEQ ID NO: 609446 - protein, 4 aa, Mycobacterium
VPAA

SEQ ID NO: 609447 - protein, 10 aa, Mycobacterium
VPAAAAEPTL

SEQ ID NO: 609448 - protein, 8 aa, Mycobacterium
VPAAAGVP

SEQ ID NO: 609449 - protein, 14 aa, Mycobacterium
VPAADGAPDLTDDE

SEQ ID NO: 609450 - protein, 12 aa, Mycobacterium
VPAADNVPSRHE

SEQ ID NO: 609451 - protein, 11 aa, Mycobacterium
VPAADQLSGSV

SEQ ID NO: 609452 - protein, 5 aa, Mycobacterium
VPAAE

SEQ ID NO: 609453 - protein, 15 aa, Mycobacterium
VPAAEGPGSDSSTTT

SEQ ID NO: 609454 - protein, 13 aa, Mycobacterium
VPAAERRKKVEEA

SEQ ID NO: 609455 - protein, 10 aa, Mycobacterium
VPAAGDARPD

SEQ ID NO: 609456 - protein, 26 aa, Mycobacterium
VPAAGDPVSVQARPGRTHLFDSTGAR

SEQ ID NO: 609457 - protein, 12 aa, Mycobacterium
VPAAGPAKTNPA

SEQ ID NO: 609458 - protein, 10 aa, Mycobacterium
VPAAKGNTRR

SEQ ID NO: 609459 - protein, 18 aa, Mycobacterium
VPAANGADYADTASAAYQ

SEQ ID NO: 609460 - protein, 5 aa, Mycobacterium
VPAAP

SEQ ID NO: 609461 - protein, 8 aa, Mycobacterium
VPAAPAET

SEQ ID NO: 609462 - protein, 11 aa, Mycobacterium
VPAAPAGGPLA

SEQ ID NO: 609463 - protein, 7 aa, Mycobacterium
VPAASAR

SEQ ID NO: 609464 - protein, 19 aa, Mycobacterium
VPAASIEQAGAQAGYPAAP

SEQ ID NO: 609465 - protein, 21 aa, Mycobacterium
VPAASIEQAGSQAGYPAPPLQ

SEQ ID NO: 609466 - protein, 7 aa, Mycobacterium
VPAATAA

SEQ ID NO: 609467 - protein, 10 aa, Mycobacterium
VPADAPADAV

SEQ ID NO: 609468 - protein, 8 aa, Mycobacterium
VPADATPA

SEQ ID NO: 609469 - protein, 17 aa, Mycobacterium
VPADATSTAFEPEPIRA

SEQ ID NO: 609470 - protein, 6 aa, Mycobacterium
VPADAV

SEQ ID NO: 609471 - protein, 14 aa, Mycobacterium
VPADAVAKKPHGDN

SEQ ID NO: 609472 - protein, 7 aa, Mycobacterium
VPADDAD

SEQ ID NO: 609473 - protein, 10 aa, Mycobacterium
VPADEERRVR

SEQ ID NO: 609474 - protein, 12 aa, Mycobacterium
VPADEKEVDPVI

SEQ ID NO: 609475 - protein, 20 aa, Mycobacterium
VPADGRVSVAGEPLRGPRDR

SEQ ID NO: 609476 - protein, 6 aa, Mycobacterium
VPADGT

SEQ ID NO: 609477 - protein, 7 aa, Mycobacterium
VPADQED

SEQ ID NO: 609478 - protein, 11 aa, Mycobacterium
VPADRSESASA

SEQ ID NO: 609479 - protein, 17 aa, Mycobacterium
VPADRVAKKASPYSGDA

SEQ ID NO: 609480 - protein, 17 aa, Mycobacterium
VPADSGGPTVPASTTNA

SEQ ID NO: 609481 - protein, 4 aa, Mycobacterium
VPAE

SEQ ID NO: 609482 - protein, 5 aa, Mycobacterium
VPAED

SEQ ID NO: 609483 - protein, 6 aa, Mycobacterium
VPAEDR

SEQ ID NO: 609484 - protein, 9 aa, Mycobacterium
VPAEGESLP

SEQ ID NO: 609485 - protein, 8 aa, Mycobacterium
VPAEGTAV

SEQ ID NO: 609486 - protein, 6 aa, Mycobacterium
VPAEHD

SEQ ID NO: 609487 - protein, 6 aa, Mycobacterium
VPAEHT

SEQ ID NO: 609488 - protein, 8 aa, Mycobacterium
VPAEPDVL

SEQ ID NO: 609489 - protein, 10 aa, Mycobacterium
VPAERKVGGA

SEQ ID NO: 609490 - protein, 8 aa, Mycobacterium
VPAETEGL

SEQ ID NO: 609491 - protein, 5 aa, Mycobacterium
VPAEV

SEQ ID NO: 609492 - protein, 8 aa, Mycobacterium
VPAEYDED

SEQ ID NO: 609493 - protein, 5 aa, Mycobacterium
VPAGA

SEQ ID NO: 609494 - protein, 10 aa, Mycobacterium
VPAGAAVPAA

SEQ ID NO: 609495 - protein, 57 aa, Mycobacterium
VPAGADRPRRERPAGSRPRRSGASGTTATGTEAGRAVGSEEPAAAESATTPEAQSTE

SEQ ID NO: 609496 - protein, 17 aa, Mycobacterium
VPAGADSVNIDSDTEDW

SEQ ID NO: 609497 - protein, 7 aa, Mycobacterium
VPAGAGH

SEQ ID NO: 609498 - protein, 16 aa, Mycobacterium
VPAGARDLSTGNPAPE

SEQ ID NO: 609499 - protein, 17 aa, Mycobacterium
VPAGASSTAFEPDPIRT

SEQ ID NO: 609500 - protein, 6 aa, Mycobacterium
VPAGCS

SEQ ID NO: 609501 - protein, 5 aa, Mycobacterium
VPAGD

SEQ ID NO: 609502 - protein, 12 aa, Mycobacterium
VPAGDPDKGQLR

SEQ ID NO: 609503 - protein, 12 aa, Mycobacterium
VPAGDQRALGQA

SEQ ID NO: 609504 - protein, 5 aa, Mycobacterium
VPAGE

SEQ ID NO: 609505 - protein, 18 aa, Mycobacterium
VPAGEDEEIQSSQSKVGP

SEQ ID NO: 609506 - protein, 8 aa, Mycobacterium
VPAGEGVS

SEQ ID NO: 609507 - protein, 6 aa, Mycobacterium
VPAGGD

SEQ ID NO: 609508 - protein, 7 aa, Mycobacterium
VPAGGED

SEQ ID NO: 609509 - protein, 8 aa, Mycobacterium
VPAGGEQD

SEQ ID NO: 609510 - protein, 6 aa, Mycobacterium
VPAGGL

SEQ ID NO: 609511 - protein, 6 aa, Mycobacterium
VPAGKL

SEQ ID NO: 609512 - protein, 59 aa, Mycobacterium
VPAGPERPRRERPAGTRPRRSGASGTTATGTDAGRAAGGEEGTAAVGNEAAPAVEAQST

SEQ ID NO: 609513 - protein, 20 aa, Mycobacterium
VPAGPERRDRRADTDSADTS

SEQ ID NO: 609514 - protein, 22 aa, Mycobacterium
VPAGPFSGADEEFTASPTDPAA

SEQ ID NO: 609515 - protein, 7 aa, Mycobacterium
VPAGPIN

SEQ ID NO: 609516 - protein, 8 aa, Mycobacterium
VPAGPIND

SEQ ID NO: 609517 - protein, 7 aa, Mycobacterium
VPAGPRV

SEQ ID NO: 609518 - protein, 14 aa, Mycobacterium
VPAGPSAAKSASDV

SEQ ID NO: 609519 - protein, 6 aa, Mycobacterium
VPAGPV

SEQ ID NO: 609520 - protein, 9 aa, Mycobacterium
VPAGPVGTA

SEQ ID NO: 609521 - protein, 5 aa, Mycobacterium
VPAGR

SEQ ID NO: 609522 - protein, 6 aa, Mycobacterium
VPAGRV

SEQ ID NO: 609523 - protein, 5 aa, Mycobacterium
VPAGS

SEQ ID NO: 609524 - protein, 13 aa, Mycobacterium
VPAGSGVDESSSL

SEQ ID NO: 609525 - protein, 7 aa, Mycobacterium
VPAGSTS

SEQ ID NO: 609526 - protein, 5 aa, Mycobacterium
VPAGT

SEQ ID NO: 609527 - protein, 22 aa, Mycobacterium
VPAGTAVKAGRVGGGASAAAAA

SEQ ID NO: 609528 - protein, 6 aa, Mycobacterium
VPAGTL

SEQ ID NO: 609529 - protein, 9 aa, Mycobacterium
VPAGTSDGR

SEQ ID NO: 609530 - protein, 7 aa, Mycobacterium
VPAGTTA

SEQ ID NO: 609531 - protein, 8 aa, Mycobacterium
VPAGTTTA

SEQ ID NO: 609532 - protein, 17 aa, Mycobacterium
VPAGVDPATVPKPLQPD

SEQ ID NO: 609533 - protein, 6 aa, Mycobacterium
VPAGVG

SEQ ID NO: 609534 - protein, 9 aa, Mycobacterium
VPAHTGDVD

SEQ ID NO: 609535 - protein, 6 aa, Mycobacterium
VPAIPP

SEQ ID NO: 609536 - protein, 13 aa, Mycobacterium
VPAISSRTEPDVA

SEQ ID NO: 609537 - protein, 5 aa, Mycobacterium
VPAKR

SEQ ID NO: 609538 - protein, 9 aa, Mycobacterium
VPAKSDAQT

SEQ ID NO: 609539 - protein, 5 aa, Mycobacterium
VPAKV

SEQ ID NO: 609540 - protein, 4 aa, Mycobacterium
VPAN

SEQ ID NO: 609541 - protein, 10 aa, Mycobacterium
VPAPADEARA

SEQ ID NO: 609542 - protein, 26 aa, Mycobacterium
VPAPAENATKITSREPAVAGDRPELT

SEQ ID NO: 609543 - protein, 27 aa, Mycobacterium
VPAPAENATKITSRQPAVAGDRPELTE

SEQ ID NO: 609544 - protein, 11 aa, Mycobacterium
VPAPAPQTAKM

SEQ ID NO: 609545 - protein, 13 aa, Mycobacterium
VPAPDSYRAGDDV

SEQ ID NO: 609546 - protein, 13 aa, Mycobacterium
VPAPDVPRPETLP

SEQ ID NO: 609547 - protein, 16 aa, Mycobacterium
VPAPEHPAAETPEAPS

SEQ ID NO: 609548 - protein, 6 aa, Mycobacterium
VPAPEL

SEQ ID NO: 609549 - protein, 6 aa, Mycobacterium
VPAPEP

SEQ ID NO: 609550 - protein, 10 aa, Mycobacterium
VPAPERPDGA

SEQ ID NO: 609551 - protein, 5 aa, Mycobacterium
VPAPG

SEQ ID NO: 609552 - protein, 6 aa, Mycobacterium
VPAPGA

SEQ ID NO: 609553 - protein, 8 aa, Mycobacterium
VPAPGAAL

SEQ ID NO: 609554 - protein, 9 aa, Mycobacterium
VPAPGAPPL

SEQ ID NO: 609555 - protein, 11 aa, Mycobacterium
VPAPGATVAEA

SEQ ID NO: 609556 - protein, 7 aa, Mycobacterium
VPAPGDP

SEQ ID NO: 609557 - protein, 8 aa, Mycobacterium
VPAPGDPY

SEQ ID NO: 609558 - protein, 9 aa, Mycobacterium
VPAPGGGAR

SEQ ID NO: 609559 - protein, 12 aa, Mycobacterium
VPAPGGRKELEE

SEQ ID NO: 609560 - protein, 8 aa, Mycobacterium
VPAPGRAN

SEQ ID NO: 609561 - protein, 7 aa, Mycobacterium
VPAPGTG

SEQ ID NO: 609562 - protein, 7 aa, Mycobacterium
VPAPGYS

SEQ ID NO: 609563 - protein, 14 aa, Mycobacterium
VPAPHEEGEEPGEE

SEQ ID NO: 609564 - protein, 6 aa, Mycobacterium
VPAPLT

SEQ ID NO: 609565 - protein, 8 aa, Mycobacterium
VPAPMPPD

SEQ ID NO: 609566 - protein, 18 aa, Mycobacterium
VPAPNRKGNRLPRDERRG

SEQ ID NO: 609567 - protein, 7 aa, Mycobacterium
VPAPPDR

SEQ ID NO: 609568 - protein, 7 aa, Mycobacterium
VPAPPIP

SEQ ID NO: 609569 - protein, 11 aa, Mycobacterium
VPAPPTQDSSW

SEQ ID NO: 609570 - protein, 6 aa, Mycobacterium
VPAPPV

SEQ ID NO: 609571 - protein, 8 aa, Mycobacterium
VPAPQPDI

SEQ ID NO: 609572 - protein, 13 aa, Mycobacterium
VPAPRNSAQHRSA

SEQ ID NO: 609573 - protein, 10 aa, Mycobacterium
VPAPRPARRS

SEQ ID NO: 609574 - protein, 12 aa, Mycobacterium
VPAPRPPCRPRR

SEQ ID NO: 609575 - protein, 12 aa, Mycobacterium
VPAPRRGAPPCT

SEQ ID NO: 609576 - protein, 13 aa, Mycobacterium
VPAPRRSARKRAR

SEQ ID NO: 609577 - protein, 10 aa, Mycobacterium
VPAPSDDDPL

SEQ ID NO: 609578 - protein, 16 aa, Mycobacterium
VPAPSGVDERDGATPI

SEQ ID NO: 609579 - protein, 9 aa, Mycobacterium
VPAPSNEPV

SEQ ID NO: 609580 - protein, 5 aa, Mycobacterium
VPAPT

SEQ ID NO: 609581 - protein, 8 aa, Mycobacterium
VPAPTRAD

SEQ ID NO: 609582 - protein, 16 aa, Mycobacterium
VPAPTSDDEDPDDPDH

SEQ ID NO: 609583 - protein, 5 aa, Mycobacterium
VPAPV

SEQ ID NO: 609584 - protein, 100 aa, Mycobacterium
VPAPVDLPPAPEDLPPAPEDLAPPAPADLPPAPEDLAPPAPADLPPAPEDLAPPAPADLPPAPEDLAPPAPADLPPAPEDLPPAPEDLPPPADADNPPVD

SEQ ID NO: 609585 - protein, 4 aa, Mycobacterium
VPAQ

SEQ ID NO: 609586 - protein, 5 aa, Mycobacterium
VPAQA

SEQ ID NO: 609587 - protein, 7 aa, Mycobacterium
VPAQRLG

SEQ ID NO: 609588 - protein, 11 aa, Mycobacterium
VPAQRNAQMRG

SEQ ID NO: 609589 - protein, 23 aa, Mycobacterium
VPAQRSSGSESSRGGAITNAAGG

SEQ ID NO: 609590 - protein, 15 aa, Mycobacterium
VPAQVSKEIIAKATG

SEQ ID NO: 609591 - protein, 4 aa, Mycobacterium
VPAR

SEQ ID NO: 609592 - protein, 10 aa, Mycobacterium
VPARAGNDAD

SEQ ID NO: 609593 - protein, 6 aa, Mycobacterium
VPARAR

SEQ ID NO: 609594 - protein, 6 aa, Mycobacterium
VPARGG

SEQ ID NO: 609595 - protein, 33 aa, Mycobacterium
VPARGGSDPGRTLDPCDGTGPALPADAADAGVT

SEQ ID NO: 609596 - protein, 6 aa, Mycobacterium
VPARLP

SEQ ID NO: 609597 - protein, 16 aa, Mycobacterium
VPARNTPPSDQDAPIP

SEQ ID NO: 609598 - protein, 17 aa, Mycobacterium
VPARNTPPSDRSAPIPG

SEQ ID NO: 609599 - protein, 6 aa, Mycobacterium
VPARPA

SEQ ID NO: 609600 - protein, 6 aa, Mycobacterium
VPARPE

SEQ ID NO: 609601 - protein, 13 aa, Mycobacterium
VPARPRPLTGNER

SEQ ID NO: 609602 - protein, 8 aa, Mycobacterium
VPARRDDL

SEQ ID NO: 609603 - protein, 10 aa, Mycobacterium
VPARRPSRDR

SEQ ID NO: 609604 - protein, 9 aa, Mycobacterium
VPARTGRQH

SEQ ID NO: 609605 - protein, 8 aa, Mycobacterium
VPASAGVP

SEQ ID NO: 609606 - protein, 8 aa, Mycobacterium
VPASATAS

SEQ ID NO: 609607 - protein, 8 aa, Mycobacterium
VPASEGAA

SEQ ID NO: 609608 - protein, 5 aa, Mycobacterium
VPASG

SEQ ID NO: 609609 - protein, 28 aa, Mycobacterium
VPASIDPDSLPPPDSVGAGRLAIERLRH

SEQ ID NO: 609610 - protein, 10 aa, Mycobacterium
VPASKGHTKR

SEQ ID NO: 609611 - protein, 8 aa, Mycobacterium
VPASNPAG

SEQ ID NO: 609612 - protein, 6 aa, Mycobacterium
VPASQM

SEQ ID NO: 609613 - protein, 10 aa, Mycobacterium
VPASRRASAR

SEQ ID NO: 609614 - protein, 5 aa, Mycobacterium
VPAST

SEQ ID NO: 609615 - protein, 5 aa, Mycobacterium
VPATA

SEQ ID NO: 609616 - protein, 6 aa, Mycobacterium
VPATEA

SEQ ID NO: 609617 - protein, 7 aa, Mycobacterium
VPATEAA

SEQ ID NO: 609618 - protein, 21 aa, Mycobacterium
VPATGGAGMPGGNGGNGGNGG

SEQ ID NO: 609619 - protein, 6 aa, Mycobacterium
VPATGK

SEQ ID NO: 609620 - protein, 12 aa, Mycobacterium
VPATKGNTKRLA

SEQ ID NO: 609621 - protein, 15 aa, Mycobacterium
VPATPADPDSAPGHT

SEQ ID NO: 609622 - protein, 7 aa, Mycobacterium
VPATPGL

SEQ ID NO: 609623 - protein, 16 aa, Mycobacterium
VPATPPAFGERETPKS

SEQ ID NO: 609624 - protein, 11 aa, Mycobacterium
VPATPPPQDTH

SEQ ID NO: 609625 - protein, 5 aa, Mycobacterium
VPATR

SEQ ID NO: 609626 - protein, 7 aa, Mycobacterium
VPATRGN

SEQ ID NO: 609627 - protein, 16 aa, Mycobacterium
VPATSAAAPAATIPPF

SEQ ID NO: 609628 - protein, 7 aa, Mycobacterium
VPATSTD

SEQ ID NO: 609629 - protein, 9 aa, Mycobacterium
VPATTAGHR

SEQ ID NO: 609630 - protein, 9 aa, Mycobacterium
VPATTAGTA

SEQ ID NO: 609631 - protein, 12 aa, Mycobacterium
VPATTEREREAA

SEQ ID NO: 609632 - protein, 5 aa, Mycobacterium
VPATV

SEQ ID NO: 609633 - protein, 5 aa, Mycobacterium
VPAVP

SEQ ID NO: 609634 - protein, 4 aa, Mycobacterium
VPCG

SEQ ID NO: 609635 - protein, 15 aa, Mycobacterium
VPCGSATRRIEDSTG

SEQ ID NO: 609636 - protein, 4 aa, Mycobacterium
VPCP

SEQ ID NO: 609637 - protein, 5 aa, Mycobacterium
VPDAA

SEQ ID NO: 609638 - protein, 8 aa, Mycobacterium
VPDAAAEQ

SEQ ID NO: 609639 - protein, 20 aa, Mycobacterium
VPDAASGTPIAATQAASTAE

SEQ ID NO: 609640 - protein, 10 aa, Mycobacterium
VPDADTSGRA

SEQ ID NO: 609641 - protein, 6 aa, Mycobacterium
VPDAER

SEQ ID NO: 609642 - protein, 7 aa, Mycobacterium
VPDAGAD

SEQ ID NO: 609643 - protein, 6 aa, Mycobacterium
VPDAGT

SEQ ID NO: 609644 - protein, 5 aa, Mycobacterium
VPDAK

SEQ ID NO: 609645 - protein, 16 aa, Mycobacterium
VPDAPGEPAEPDEPES

SEQ ID NO: 609646 - protein, 8 aa, Mycobacterium
VPDARRGA

SEQ ID NO: 609647 - protein, 19 aa, Mycobacterium
VPDASGSGNADSGAQQPSE

SEQ ID NO: 609648 - protein, 10 aa, Mycobacterium
VPDASRAVDD

SEQ ID NO: 609649 - protein, 8 aa, Mycobacterium
VPDATTRV

SEQ ID NO: 609650 - protein, 5 aa, Mycobacterium
VPDCE

SEQ ID NO: 609651 - protein, 7 aa, Mycobacterium
VPDDATK

SEQ ID NO: 609652 - protein, 5 aa, Mycobacterium
VPDDE

SEQ ID NO: 609653 - protein, 15 aa, Mycobacterium
VPDDEDLPAQLPPPT

SEQ ID NO: 609654 - protein, 12 aa, Mycobacterium
VPDDEHAEAAEE

SEQ ID NO: 609655 - protein, 7 aa, Mycobacterium
VPDDERL

SEQ ID NO: 609656 - protein, 9 aa, Mycobacterium
VPDDEVEHA

SEQ ID NO: 609657 - protein, 8 aa, Mycobacterium
VPDDGGRF

SEQ ID NO: 609658 - protein, 8 aa, Mycobacterium
VPDDLDPD

SEQ ID NO: 609659 - protein, 7 aa, Mycobacterium
VPDDPAA

SEQ ID NO: 609660 - protein, 12 aa, Mycobacterium
VPDDPAARERRR

SEQ ID NO: 609661 - protein, 14 aa, Mycobacterium
VPDDQGGDVSQKFE

SEQ ID NO: 609662 - protein, 9 aa, Mycobacterium
VPDDRSGSA

SEQ ID NO: 609663 - protein, 7 aa, Mycobacterium
VPDDSDV

SEQ ID NO: 609664 - protein, 5 aa, Mycobacterium
VPDDV

SEQ ID NO: 609665 - protein, 4 aa, Mycobacterium
VPDE

SEQ ID NO: 609666 - protein, 8 aa, Mycobacterium
VPDEAEGL

SEQ ID NO: 609667 - protein, 8 aa, Mycobacterium
VPDEDRGT

SEQ ID NO: 609668 - protein, 12 aa, Mycobacterium
VPDEDRSARRQQ

SEQ ID NO: 609669 - protein, 6 aa, Mycobacterium
VPDEPF

SEQ ID NO: 609670 - protein, 5 aa, Mycobacterium
VPDER

SEQ ID NO: 609671 - protein, 5 aa, Mycobacterium
VPDET

SEQ ID NO: 609672 - protein, 9 aa, Mycobacterium
VPDETDDAF

SEQ ID NO: 609673 - protein, 6 aa, Mycobacterium
VPDETT

SEQ ID NO: 609674 - protein, 8 aa, Mycobacterium
VPDGAATV

SEQ ID NO: 609675 - protein, 11 aa, Mycobacterium
VPDGAEGASTN

SEQ ID NO: 609676 - protein, 13 aa, Mycobacterium
VPDGAKNAVGRAR

SEQ ID NO: 609677 - protein, 6 aa, Mycobacterium
VPDGAP

SEQ ID NO: 609678 - protein, 8 aa, Mycobacterium
VPDGASSV

SEQ ID NO: 609679 - protein, 7 aa, Mycobacterium
VPDGDAA

SEQ ID NO: 609680 - protein, 28 aa, Mycobacterium
VPDGDKQADQTTTTPPPLGSEDTQAGPV

SEQ ID NO: 609681 - protein, 6 aa, Mycobacterium
VPDGEA

SEQ ID NO: 609682 - protein, 9 aa, Mycobacterium
VPDGESSVP

SEQ ID NO: 609683 - protein, 6 aa, Mycobacterium
VPDGGP

SEQ ID NO: 609684 - protein, 11 aa, Mycobacterium
VPDGNGKTETW

SEQ ID NO: 609685 - protein, 6 aa, Mycobacterium
VPDGPT

SEQ ID NO: 609686 - protein, 6 aa, Mycobacterium
VPDGQT

SEQ ID NO: 609687 - protein, 17 aa, Mycobacterium
VPDGRARDAARRQRTAL

SEQ ID NO: 609688 - protein, 7 aa, Mycobacterium
VPDGRDG

SEQ ID NO: 609689 - protein, 5 aa, Mycobacterium
VPDGS

SEQ ID NO: 609690 - protein, 10 aa, Mycobacterium
VPDGSDVTAG

SEQ ID NO: 609691 - protein, 15 aa, Mycobacterium
VPDGSLETLFSGPVP

SEQ ID NO: 609692 - protein, 9 aa, Mycobacterium
VPDGSPYRD

SEQ ID NO: 609693 - protein, 5 aa, Mycobacterium
VPDGT

SEQ ID NO: 609694 - protein, 8 aa, Mycobacterium
VPDGTSLN

SEQ ID NO: 609695 - protein, 9 aa, Mycobacterium
VPDGVPDDL

SEQ ID NO: 609696 - protein, 10 aa, Mycobacterium
VPDGVSSEVA

SEQ ID NO: 609697 - protein, 4 aa, Mycobacterium
VPDH

SEQ ID NO: 609698 - protein, 14 aa, Mycobacterium
VPDHPFNDEQARRL

SEQ ID NO: 609699 - protein, 10 aa, Mycobacterium
VPDKALSGPM

SEQ ID NO: 609700 - protein, 5 aa, Mycobacterium
VPDKK

SEQ ID NO: 609701 - protein, 12 aa, Mycobacterium
VPDKPDADTDSA

SEQ ID NO: 609702 - protein, 9 aa, Mycobacterium
VPDKPQSPD

SEQ ID NO: 609703 - protein, 5 aa, Mycobacterium
VPDLA

SEQ ID NO: 609704 - protein, 33 aa, Mycobacterium
VPDNASEDGSGAQPEDGSGDKPDAAAEQAAESD

SEQ ID NO: 609705 - protein, 6 aa, Mycobacterium
VPDNPA

SEQ ID NO: 609706 - protein, 8 aa, Mycobacterium
VPDPADGR

SEQ ID NO: 609707 - protein, 11 aa, Mycobacterium
VPDPADPTMKT

SEQ ID NO: 609708 - protein, 5 aa, Mycobacterium
VPDPD

SEQ ID NO: 609709 - protein, 6 aa, Mycobacterium
VPDPDL

SEQ ID NO: 609710 - protein, 5 aa, Mycobacterium
VPDPE

SEQ ID NO: 609711 - protein, 6 aa, Mycobacterium
VPDPEL

SEQ ID NO: 609712 - protein, 9 aa, Mycobacterium
VPDPEPRGA

SEQ ID NO: 609713 - protein, 17 aa, Mycobacterium
VPDPEQQRIRREERQAL

SEQ ID NO: 609714 - protein, 12 aa, Mycobacterium
VPDPEYRQTRTA

SEQ ID NO: 609715 - protein, 10 aa, Mycobacterium
VPDPGGAAFY

SEQ ID NO: 609716 - protein, 6 aa, Mycobacterium
VPDPGL

SEQ ID NO: 609717 - protein, 6 aa, Mycobacterium
VPDPGV

SEQ ID NO: 609718 - protein, 8 aa, Mycobacterium
VPDPIPEA

SEQ ID NO: 609719 - protein, 9 aa, Mycobacterium
VPDPKRLEP

SEQ ID NO: 609720 - protein, 8 aa, Mycobacterium
VPDPLPAE

SEQ ID NO: 609721 - protein, 8 aa, Mycobacterium
VPDPLPDW

SEQ ID NO: 609722 - protein, 8 aa, Mycobacterium
VPDPLPED

SEQ ID NO: 609723 - protein, 8 aa, Mycobacterium
VPDPNVPN

SEQ ID NO: 609724 - protein, 17 aa, Mycobacterium
VPDPPEQAGATDPETRT

SEQ ID NO: 609725 - protein, 17 aa, Mycobacterium
VPDPPEQAGVTDPETAA

SEQ ID NO: 609726 - protein, 7 aa, Mycobacterium
VPDPPRM

SEQ ID NO: 609727 - protein, 7 aa, Mycobacterium
VPDPQEA

SEQ ID NO: 609728 - protein, 19 aa, Mycobacterium
VPDPQRPVRIGPARGDLRL

SEQ ID NO: 609729 - protein, 9 aa, Mycobacterium
VPDPRPAPG

SEQ ID NO: 609730 - protein, 8 aa, Mycobacterium
VPDPSAER

SEQ ID NO: 609731 - protein, 10 aa, Mycobacterium
VPDPSSGEIP

SEQ ID NO: 609732 - protein, 6 aa, Mycobacterium
VPDPTG

SEQ ID NO: 609733 - protein, 10 aa, Mycobacterium
VPDPTPGPGE

SEQ ID NO: 609734 - protein, 13 aa, Mycobacterium
VPDPVKQRARRNG

SEQ ID NO: 609735 - protein, 9 aa, Mycobacterium
VPDPVTPDQ

SEQ ID NO: 609736 - protein, 5 aa, Mycobacterium
VPDQN

SEQ ID NO: 609737 - protein, 7 aa, Mycobacterium
VPDQSGR

SEQ ID NO: 609738 - protein, 6 aa, Mycobacterium
VPDQWS

SEQ ID NO: 609739 - protein, 4 aa, Mycobacterium
VPDR

SEQ ID NO: 609740 - protein, 16 aa, Mycobacterium
VPDRAGGQTSADNGLG

SEQ ID NO: 609741 - protein, 8 aa, Mycobacterium
VPDRPARA

SEQ ID NO: 609742 - protein, 20 aa, Mycobacterium
VPDRPTTIGVPGAADDQLTS

SEQ ID NO: 609743 - protein, 5 aa, Mycobacterium
VPDRV

SEQ ID NO: 609744 - protein, 4 aa, Mycobacterium
VPDS

SEQ ID NO: 609745 - protein, 8 aa, Mycobacterium
VPDSAAPA

SEQ ID NO: 609746 - protein, 9 aa, Mycobacterium
VPDSAGADF

SEQ ID NO: 609747 - protein, 8 aa, Mycobacterium
VPDSAGES

SEQ ID NO: 609748 - protein, 7 aa, Mycobacterium
VPDSDGE

SEQ ID NO: 609749 - protein, 9 aa, Mycobacterium
VPDSDNAAY

SEQ ID NO: 609750 - protein, 8 aa, Mycobacterium
VPDSDPHI

SEQ ID NO: 609751 - protein, 9 aa, Mycobacterium
VPDSDQAAV

SEQ ID NO: 609752 - protein, 8 aa, Mycobacterium
VPDSEIGS

SEQ ID NO: 609753 - protein, 6 aa, Mycobacterium
VPDSER

SEQ ID NO: 609754 - protein, 6 aa, Mycobacterium
VPDSGD

SEQ ID NO: 609755 - protein, 6 aa, Mycobacterium
VPDSGI

SEQ ID NO: 609756 - protein, 7 aa, Mycobacterium
VPDSGLR

SEQ ID NO: 609757 - protein, 8 aa, Mycobacterium
VPDSGLRD

SEQ ID NO: 609758 - protein, 8 aa, Mycobacterium
VPDSGLRG

SEQ ID NO: 609759 - protein, 12 aa, Mycobacterium
VPDSTAFLARAF

SEQ ID NO: 609760 - protein, 6 aa, Mycobacterium
VPDSTL

SEQ ID NO: 609761 - protein, 14 aa, Mycobacterium
VPDSTPFLRAAFDR

SEQ ID NO: 609762 - protein, 4 aa, Mycobacterium
VPDT

SEQ ID NO: 609763 - protein, 8 aa, Mycobacterium
VPDTAAEQ

SEQ ID NO: 609764 - protein, 5 aa, Mycobacterium
VPDTD

SEQ ID NO: 609765 - protein, 16 aa, Mycobacterium
VPDTDELKKAKGRGLQ

SEQ ID NO: 609766 - protein, 9 aa, Mycobacterium
VPDTGGRAG

SEQ ID NO: 609767 - protein, 10 aa, Mycobacterium
VPDTGPPTVL

SEQ ID NO: 609768 - protein, 9 aa, Mycobacterium
VPDTGSLRG

SEQ ID NO: 609769 - protein, 9 aa, Mycobacterium
VPDTGSTRS

SEQ ID NO: 609770 - protein, 7 aa, Mycobacterium
VPDTGVD

SEQ ID NO: 609771 - protein, 6 aa, Mycobacterium
VPDTPT

SEQ ID NO: 609772 - protein, 16 aa, Mycobacterium
VPDTRERVQNGGRKLN

SEQ ID NO: 609773 - protein, 8 aa, Mycobacterium
VPDTSAPA

SEQ ID NO: 609774 - protein, 9 aa, Mycobacterium
VPDTTNSAI

SEQ ID NO: 609775 - protein, 4 aa, Mycobacterium
VPDW

SEQ ID NO: 609776 - protein, 4 aa, Mycobacterium
VPDY

SEQ ID NO: 609777 - protein, 7 aa, Mycobacterium
VPDYEGQ

SEQ ID NO: 609778 - protein, 6 aa, Mycobacterium
VPDYSP

SEQ ID NO: 609779 - protein, 5 aa, Mycobacterium
VPEAD

SEQ ID NO: 609780 - protein, 12 aa, Mycobacterium
VPEADGASAAPR

SEQ ID NO: 609781 - protein, 16 aa, Mycobacterium
VPEADTEHTPEAFDSE

SEQ ID NO: 609782 - protein, 10 aa, Mycobacterium
VPEAEATDEV

SEQ ID NO: 609783 - protein, 9 aa, Mycobacterium
VPEAETTDE

SEQ ID NO: 609784 - protein, 7 aa, Mycobacterium
VPEAKRS

SEQ ID NO: 609785 - protein, 8 aa, Mycobacterium
VPEAKRSL

SEQ ID NO: 609786 - protein, 7 aa, Mycobacterium
VPEAPED

SEQ ID NO: 609787 - protein, 22 aa, Mycobacterium
VPEAPGDRTAQQPIPASASETV

SEQ ID NO: 609788 - protein, 5 aa, Mycobacterium
VPEAQ

SEQ ID NO: 609789 - protein, 8 aa, Mycobacterium
VPEASLAG

SEQ ID NO: 609790 - protein, 4 aa, Mycobacterium
VPED

SEQ ID NO: 609791 - protein, 18 aa, Mycobacterium
VPEDADDPDASTEPIEQD

SEQ ID NO: 609792 - protein, 7 aa, Mycobacterium
VPEDAVT

SEQ ID NO: 609793 - protein, 7 aa, Mycobacterium
VPEDDRK

SEQ ID NO: 609794 - protein, 19 aa, Mycobacterium
VPEDDSLDTYGRASNPSWR

SEQ ID NO: 609795 - protein, 11 aa, Mycobacterium
VPEDEATGSAA

SEQ ID NO: 609796 - protein, 6 aa, Mycobacterium
VPEDGG

SEQ ID NO: 609797 - protein, 12 aa, Mycobacterium
VPEDGPDGTKTF

SEQ ID NO: 609798 - protein, 5 aa, Mycobacterium
VPEDP

SEQ ID NO: 609799 - protein, 6 aa, Mycobacterium
VPEDPD

SEQ ID NO: 609800 - protein, 5 aa, Mycobacterium
VPEDQ

SEQ ID NO: 609801 - protein, 6 aa, Mycobacterium
VPEDTS

SEQ ID NO: 609802 - protein, 8 aa, Mycobacterium
VPEEDRDK

SEQ ID NO: 609803 - protein, 8 aa, Mycobacterium
VPEEGNPA

SEQ ID NO: 609804 - protein, 8 aa, Mycobacterium
VPEESGPI

SEQ ID NO: 609805 - protein, 9 aa, Mycobacterium
VPEESLSTF

SEQ ID NO: 609806 - protein, 5 aa, Mycobacterium
VPEEV

SEQ ID NO: 609807 - protein, 5 aa, Mycobacterium
VPEGA

SEQ ID NO: 609808 - protein, 7 aa, Mycobacterium
VPEGAGD

SEQ ID NO: 609809 - protein, 16 aa, Mycobacterium
VPEGARDLSTGNPDPA

SEQ ID NO: 609810 - protein, 6 aa, Mycobacterium
VPEGAT

SEQ ID NO: 609811 - protein, 9 aa, Mycobacterium
VPEGDHEWN

SEQ ID NO: 609812 - protein, 6 aa, Mycobacterium
VPEGEA

SEQ ID NO: 609813 - protein, 5 aa, Mycobacterium
VPEGG

SEQ ID NO: 609814 - protein, 8 aa, Mycobacterium
VPEGGSDA

SEQ ID NO: 609815 - protein, 5 aa, Mycobacterium
VPEGK

SEQ ID NO: 609816 - protein, 6 aa, Mycobacterium
VPEGTR

SEQ ID NO: 609817 - protein, 12 aa, Mycobacterium
VPEGTRLQVWDL

SEQ ID NO: 609818 - protein, 8 aa, Mycobacterium
VPEGVDPA

SEQ ID NO: 609819 - protein, 7 aa, Mycobacterium
VPEHPLR

SEQ ID NO: 609820 - protein, 7 aa, Mycobacterium
VPEKGGR

SEQ ID NO: 609821 - protein, 7 aa, Mycobacterium
VPEKRPD

SEQ ID NO: 609822 - protein, 7 aa, Mycobacterium
VPEKRQE

SEQ ID NO: 609823 - protein, 7 aa, Mycobacterium
VPEKTAA

SEQ ID NO: 609824 - protein, 5 aa, Mycobacterium
VPELP

SEQ ID NO: 609825 - protein, 4 aa, Mycobacterium
VPEN

SEQ ID NO: 609826 - protein, 6 aa, Mycobacterium
VPENEH

SEQ ID NO: 609827 - protein, 7 aa, Mycobacterium
VPENGGR

SEQ ID NO: 609828 - protein, 8 aa, Mycobacterium
VPENREQM

SEQ ID NO: 609829 - protein, 8 aa, Mycobacterium
VPENSTEK

SEQ ID NO: 609830 - protein, 4 aa, Mycobacterium
VPEP

SEQ ID NO: 609831 - protein, 25 aa, Mycobacterium
VPEPADTERPVRSITTGPRGYEGEG

SEQ ID NO: 609832 - protein, 21 aa, Mycobacterium
VPEPAKSAALPGTDTEHRTDF

SEQ ID NO: 609833 - protein, 10 aa, Mycobacterium
VPEPAPGPGQ

SEQ ID NO: 609834 - protein, 8 aa, Mycobacterium
VPEPDGPH

SEQ ID NO: 609835 - protein, 8 aa, Mycobacterium
VPEPDRPN

SEQ ID NO: 609836 - protein, 15 aa, Mycobacterium
VPEPEATEEAKTLAA

SEQ ID NO: 609837 - protein, 6 aa, Mycobacterium
VPEPEL

SEQ ID NO: 609838 - protein, 13 aa, Mycobacterium
VPEPETARPSGQP

SEQ ID NO: 609839 - protein, 6 aa, Mycobacterium
VPEPGA

SEQ ID NO: 609840 - protein, 8 aa, Mycobacterium
VPEPGSVD

SEQ ID NO: 609841 - protein, 7 aa, Mycobacterium
VPEPGTL

SEQ ID NO: 609842 - protein, 6 aa, Mycobacterium
VPEPGW

SEQ ID NO: 609843 - protein, 15 aa, Mycobacterium
VPEPPGGVASSVNQG

SEQ ID NO: 609844 - protein, 8 aa, Mycobacterium
VPEPPRAL

SEQ ID NO: 609845 - protein, 15 aa, Mycobacterium
VPEPRPGPALGGRSV

SEQ ID NO: 609846 - protein, 13 aa, Mycobacterium
VPEPRSDRPQQEL

SEQ ID NO: 609847 - protein, 35 aa, Mycobacterium
VPEPVRSPAPEAAAPANDADETADTATSSSGAAEL

SEQ ID NO: 609848 - protein, 5 aa, Mycobacterium
VPEQA

SEQ ID NO: 609849 - protein, 5 aa, Mycobacterium
VPEQD

SEQ ID NO: 609850 - protein, 9 aa, Mycobacterium
VPEQGNPAA

SEQ ID NO: 609851 - protein, 6 aa, Mycobacterium
VPEQLQ

SEQ ID NO: 609852 - protein, 7 aa, Mycobacterium
VPEQRRG

SEQ ID NO: 609853 - protein, 4 aa, Mycobacterium
VPER

SEQ ID NO: 609854 - protein, 7 aa, Mycobacterium
VPERARR

SEQ ID NO: 609855 - protein, 8 aa, Mycobacterium
VPERNRDA

SEQ ID NO: 609856 - protein, 10 aa, Mycobacterium
VPERSDGDAF

SEQ ID NO: 609857 - protein, 10 aa, Mycobacterium
VPERSEGDAF

SEQ ID NO: 609858 - protein, 17 aa, Mycobacterium
VPERSPSPALEGRSTDD

SEQ ID NO: 609859 - protein, 12 aa, Mycobacterium
VPERSSRARRDG

SEQ ID NO: 609860 - protein, 9 aa, Mycobacterium
VPESAASRR

SEQ ID NO: 609861 - protein, 7 aa, Mycobacterium
VPESADQ

SEQ ID NO: 609862 - protein, 11 aa, Mycobacterium
VPESAGGDGAT

SEQ ID NO: 609863 - protein, 8 aa, Mycobacterium
VPESDTAV

SEQ ID NO: 609864 - protein, 7 aa, Mycobacterium
VPESEGA

SEQ ID NO: 609865 - protein, 6 aa, Mycobacterium
VPESEV

SEQ ID NO: 609866 - protein, 12 aa, Mycobacterium
VPESGDGAAPQG

SEQ ID NO: 609867 - protein, 5 aa, Mycobacterium
VPESL

SEQ ID NO: 609868 - protein, 6 aa, Mycobacterium
VPESLR

SEQ ID NO: 609869 - protein, 7 aa, Mycobacterium
VPESLRG

SEQ ID NO: 609870 - protein, 7 aa, Mycobacterium
VPESTRY

SEQ ID NO: 609871 - protein, 32 aa, Mycobacterium
VPESVDSVESAQPIPGGANAIPPASAAAANPY

SEQ ID NO: 609872 - protein, 12 aa, Mycobacterium
VPETDDVNVTFD

SEQ ID NO: 609873 - protein, 21 aa, Mycobacterium
VPETEPSAESDDAPSERDSES

SEQ ID NO: 609874 - protein, 7 aa, Mycobacterium
VPETGGQ

SEQ ID NO: 609875 - protein, 8 aa, Mycobacterium
VPETGSTT

SEQ ID NO: 609876 - protein, 12 aa, Mycobacterium
VPETPTAPPVHA

SEQ ID NO: 609877 - protein, 6 aa, Mycobacterium
VPEVES

SEQ ID NO: 609878 - protein, 8 aa, Mycobacterium
VPFDSTSA

SEQ ID NO: 609879 - protein, 19 aa, Mycobacterium
VPFGGTAASGLGDDLGGRA

SEQ ID NO: 609880 - protein, 22 aa, Mycobacterium
VPFPAAANGPRGRQGSAASVTL

SEQ ID NO: 609881 - protein, 20 aa, Mycobacterium
VPFPDAASGPRGRQGSPARV

SEQ ID NO: 609882 - protein, 20 aa, Mycobacterium
VPFPSAGNGPRGRQGSPARV

SEQ ID NO: 609883 - protein, 19 aa, Mycobacterium
VPFPTGPRPDVTKADDHEY

SEQ ID NO: 609884 - protein, 20 aa, Mycobacterium
VPFPTGPRPDVTRADDHEYA

SEQ ID NO: 609885 - protein, 6 aa, Mycobacterium
VPFPTT

SEQ ID NO: 609886 - protein, 19 aa, Mycobacterium
VPFRGGAGPSYKTSYPTDD

SEQ ID NO: 609887 - protein, 5 aa, Mycobacterium
VPGAA

SEQ ID NO: 609888 - protein, 33 aa, Mycobacterium
VPGAANGLAEQDQPASAREPQHAAAGRDPDAVR

SEQ ID NO: 609889 - protein, 6 aa, Mycobacterium
VPGAAS

SEQ ID NO: 609890 - protein, 12 aa, Mycobacterium
VPGAATSCDFGQ

SEQ ID NO: 609891 - protein, 6 aa, Mycobacterium
VPGADA

SEQ ID NO: 609892 - protein, 7 aa, Mycobacterium
VPGADGR

SEQ ID NO: 609893 - protein, 5 aa, Mycobacterium
VPGAE

SEQ ID NO: 609894 - protein, 9 aa, Mycobacterium
VPGAEPAAL

SEQ ID NO: 609895 - protein, 5 aa, Mycobacterium
VPGAG

SEQ ID NO: 609896 - protein, 6 aa, Mycobacterium
VPGAGD

SEQ ID NO: 609897 - protein, 10 aa, Mycobacterium
VPGAGEQAKV

SEQ ID NO: 609898 - protein, 9 aa, Mycobacterium
VPGAGGLSN

SEQ ID NO: 609899 - protein, 7 aa, Mycobacterium
VPGAGTA

SEQ ID NO: 609900 - protein, 7 aa, Mycobacterium
VPGAPAA

SEQ ID NO: 609901 - protein, 7 aa, Mycobacterium
VPGAPAS

SEQ ID NO: 609902 - protein, 6 aa, Mycobacterium
VPGAPG

SEQ ID NO: 609903 - protein, 7 aa, Mycobacterium
VPGAPNP

SEQ ID NO: 609904 - protein, 8 aa, Mycobacterium
VPGAPVPS

SEQ ID NO: 609905 - protein, 9 aa, Mycobacterium
VPGAQGPLD

SEQ ID NO: 609906 - protein, 7 aa, Mycobacterium
VPGAQIG

SEQ ID NO: 609907 - protein, 17 aa, Mycobacterium
VPGAQRGGATHPGTGQY

SEQ ID NO: 609908 - protein, 5 aa, Mycobacterium
VPGAR

SEQ ID NO: 609909 - protein, 9 aa, Mycobacterium
VPGARTSTV

SEQ ID NO: 609910 - protein, 8 aa, Mycobacterium
VPGASGAS

SEQ ID NO: 609911 - protein, 6 aa, Mycobacterium
VPGATA

SEQ ID NO: 609912 - protein, 7 aa, Mycobacterium
VPGATDA

SEQ ID NO: 609913 - protein, 4 aa, Mycobacterium
VPGC

SEQ ID NO: 609914 - protein, 5 aa, Mycobacterium
VPGDA

SEQ ID NO: 609915 - protein, 10 aa, Mycobacterium
VPGDAEDDAS

SEQ ID NO: 609916 - protein, 5 aa, Mycobacterium
VPGDD

SEQ ID NO: 609917 - protein, 8 aa, Mycobacterium
VPGDDPLP

SEQ ID NO: 609918 - protein, 5 aa, Mycobacterium
VPGDE

SEQ ID NO: 609919 - protein, 8 aa, Mycobacterium
VPGDGEPT

SEQ ID NO: 609920 - protein, 18 aa, Mycobacterium
VPGDGMGSGVESCVGQGV

SEQ ID NO: 609921 - protein, 8 aa, Mycobacterium
VPGDGTTA

SEQ ID NO: 609922 - protein, 6 aa, Mycobacterium
VPGDPA

SEQ ID NO: 609923 - protein, 6 aa, Mycobacterium
VPGDPR

SEQ ID NO: 609924 - protein, 9 aa, Mycobacterium
VPGDPSTDI

SEQ ID NO: 609925 - protein, 5 aa, Mycobacterium
VPGDR

SEQ ID NO: 609926 - protein, 13 aa, Mycobacterium
VPGDRARHGADGS

SEQ ID NO: 609927 - protein, 10 aa, Mycobacterium
VPGDRARHRA

SEQ ID NO: 609928 - protein, 8 aa, Mycobacterium
VPGDRSTE

SEQ ID NO: 609929 - protein, 5 aa, Mycobacterium
VPGDV

SEQ ID NO: 609930 - protein, 5 aa, Mycobacterium
VPGEA

SEQ ID NO: 609931 - protein, 33 aa, Mycobacterium
VPGEADDALETSPETDPATGKESRGGSKKRKGR

SEQ ID NO: 609932 - protein, 10 aa, Mycobacterium
VPGEDKTYQA

SEQ ID NO: 609933 - protein, 6 aa, Mycobacterium
VPGEEL

SEQ ID NO: 609934 - protein, 7 aa, Mycobacterium
VPGEGAA

SEQ ID NO: 609935 - protein, 11 aa, Mycobacterium
VPGEHADVDRA

SEQ ID NO: 609936 - protein, 8 aa, Mycobacterium
VPGEPESV

SEQ ID NO: 609937 - protein, 6 aa, Mycobacterium
VPGEPP

SEQ ID NO: 609938 - protein, 6 aa, Mycobacterium
VPGEQC

SEQ ID NO: 609939 - protein, 13 aa, Mycobacterium
VPGEQSVADKERA

SEQ ID NO: 609940 - protein, 8 aa, Mycobacterium
VPGESKAV

SEQ ID NO: 609941 - protein, 6 aa, Mycobacterium
VPGGAN

SEQ ID NO: 609942 - protein, 7 aa, Mycobacterium
VPGGAQP

SEQ ID NO: 609943 - protein, 11 aa, Mycobacterium
VPGGATEGAAN

SEQ ID NO: 609944 - protein, 10 aa, Mycobacterium
VPGGDGPRKV

SEQ ID NO: 609945 - protein, 7 aa, Mycobacterium
VPGGDIT

SEQ ID NO: 609946 - protein, 8 aa, Mycobacterium
VPGGDITP

SEQ ID NO: 609947 - protein, 7 aa, Mycobacterium
VPGGGPP

SEQ ID NO: 609948 - protein, 11 aa, Mycobacterium
VPGGGSKPHYG

SEQ ID NO: 609949 - protein, 10 aa, Mycobacterium
VPGGGTKPHY

SEQ ID NO: 609950 - protein, 6 aa, Mycobacterium
VPGGLS

SEQ ID NO: 609951 - protein, 5 aa, Mycobacterium
VPGGN

SEQ ID NO: 609952 - protein, 8 aa, Mycobacterium
VPGGPGRR

SEQ ID NO: 609953 - protein, 6 aa, Mycobacterium
VPGGPS

SEQ ID NO: 609954 - protein, 9 aa, Mycobacterium
VPGGRGPVP

SEQ ID NO: 609955 - protein, 12 aa, Mycobacterium
VPGGRLTASNTD

SEQ ID NO: 609956 - protein, 7 aa, Mycobacterium
VPGGRYA

SEQ ID NO: 609957 - protein, 7 aa, Mycobacterium
VPGGRYT

SEQ ID NO: 609958 - protein, 6 aa, Mycobacterium
VPGGSA

SEQ ID NO: 609959 - protein, 8 aa, Mycobacterium
VPGGTEAD

SEQ ID NO: 609960 - protein, 8 aa, Mycobacterium
VPGGTEPL

SEQ ID NO: 609961 - protein, 16 aa, Mycobacterium
VPGGTRADGGNTTAAN

SEQ ID NO: 609962 - protein, 11 aa, Mycobacterium
VPGHADVQPDS

SEQ ID NO: 609963 - protein, 5 aa, Mycobacterium
VPGHE

SEQ ID NO: 609964 - protein, 12 aa, Mycobacterium
VPGIGPAGLSAA

SEQ ID NO: 609965 - protein, 4 aa, Mycobacterium
VPGK

SEQ ID NO: 609966 - protein, 19 aa, Mycobacterium
VPGKEDEEVVRKPSTDEPF

SEQ ID NO: 609967 - protein, 6 aa, Mycobacterium
VPGKNL

SEQ ID NO: 609968 - protein, 6 aa, Mycobacterium
VPGKPE

SEQ ID NO: 609969 - protein, 8 aa, Mycobacterium
VPGKRAPT

SEQ ID NO: 609970 - protein, 17 aa, Mycobacterium
VPGKVRREMSDDEVEHN

SEQ ID NO: 609971 - protein, 6 aa, Mycobacterium
VPGLEA

SEQ ID NO: 609972 - protein, 6 aa, Mycobacterium
VPGLEE

SEQ ID NO: 609973 - protein, 6 aa, Mycobacterium
VPGLHG

SEQ ID NO: 609974 - protein, 5 aa, Mycobacterium
VPGLN

SEQ ID NO: 609975 - protein, 11 aa, Mycobacterium
VPGLPDGASTA

SEQ ID NO: 609976 - protein, 8 aa, Mycobacterium
VPGLPNIP

SEQ ID NO: 609977 - protein, 14 aa, Mycobacterium
VPGMPPGVAAPGQI

SEQ ID NO: 609978 - protein, 4 aa, Mycobacterium
VPGN

SEQ ID NO: 609979 - protein, 7 aa, Mycobacterium
VPGNAGV

SEQ ID NO: 609980 - protein, 6 aa, Mycobacterium
VPGNEE

SEQ ID NO: 609981 - protein, 14 aa, Mycobacterium
VPGNRIDPDDPASL

SEQ ID NO: 609982 - protein, 14 aa, Mycobacterium
VPGPADALQPAGHR

SEQ ID NO: 609983 - protein, 24 aa, Mycobacterium
VPGPAEDAGGFTPVRTDSTPGALS

SEQ ID NO: 609984 - protein, 8 aa, Mycobacterium
VPGPDARF

SEQ ID NO: 609985 - protein, 8 aa, Mycobacterium
VPGPDEKV

SEQ ID NO: 609986 - protein, 8 aa, Mycobacterium
VPGPGPSA

SEQ ID NO: 609987 - protein, 7 aa, Mycobacterium
VPGPGTL

SEQ ID NO: 609988 - protein, 13 aa, Mycobacterium
VPGPHDDKYTQGV

SEQ ID NO: 609989 - protein, 7 aa, Mycobacterium
VPGPKAF

SEQ ID NO: 609990 - protein, 7 aa, Mycobacterium
VPGPKKP

SEQ ID NO: 609991 - protein, 7 aa, Mycobacterium
VPGPLDP

SEQ ID NO: 609992 - protein, 6 aa, Mycobacterium
VPGPLT

SEQ ID NO: 609993 - protein, 6 aa, Mycobacterium
VPGPPF

SEQ ID NO: 609994 - protein, 20 aa, Mycobacterium
VPGPPSNRTGSKEHEHTVKS

SEQ ID NO: 609995 - protein, 13 aa, Mycobacterium
VPGPQAAGAAPAT

SEQ ID NO: 609996 - protein, 7 aa, Mycobacterium
VPGPQAP

SEQ ID NO: 609997 - protein, 6 aa, Mycobacterium
VPGPQE

SEQ ID NO: 609998 - protein, 7 aa, Mycobacterium
VPGPQKQ

SEQ ID NO: 609999 - protein, 6 aa, Mycobacterium
VPGPQT

SEQ ID NO: 610000 - protein, 13 aa, Mycobacterium
VPGPRDDKYTQGV

SEQ ID NO: 610001 - protein, 7 aa, Mycobacterium
VPGPREP

SEQ ID NO: 610002 - protein, 6 aa, Mycobacterium
VPGPRQ

SEQ ID NO: 610003 - protein, 6 aa, Mycobacterium
VPGPRR

SEQ ID NO: 610004 - protein, 7 aa, Mycobacterium
VPGPRSP

SEQ ID NO: 610005 - protein, 6 aa, Mycobacterium
VPGPRT

SEQ ID NO: 610006 - protein, 7 aa, Mycobacterium
VPGPSGT

SEQ ID NO: 610007 - protein, 8 aa, Mycobacterium
VPGPSGTA

SEQ ID NO: 610008 - protein, 5 aa, Mycobacterium
VPGPT

SEQ ID NO: 610009 - protein, 9 aa, Mycobacterium
VPGPVASTA

SEQ ID NO: 610010 - protein, 5 aa, Mycobacterium
VPGPY

SEQ ID NO: 610011 - protein, 5 aa, Mycobacterium
VPGQA

SEQ ID NO: 610012 - protein, 5 aa, Mycobacterium
VPGQD

SEQ ID NO: 610013 - protein, 7 aa, Mycobacterium
VPGQGGG

SEQ ID NO: 610014 - protein, 9 aa, Mycobacterium
VPGQPAPSV

SEQ ID NO: 610015 - protein, 7 aa, Mycobacterium
VPGQRDH

SEQ ID NO: 610016 - protein, 12 aa, Mycobacterium
VPGQRGLAAIGL

SEQ ID NO: 610017 - protein, 5 aa, Mycobacterium
VPGQT

SEQ ID NO: 610018 - protein, 5 aa, Mycobacterium
VPGRD

SEQ ID NO: 610019 - protein, 6 aa, Mycobacterium
VPGRDN

SEQ ID NO: 610020 - protein, 10 aa, Mycobacterium
VPGRESNFEA

SEQ ID NO: 610021 - protein, 7 aa, Mycobacterium
VPGRGTR

SEQ ID NO: 610022 - protein, 14 aa, Mycobacterium
VPGRPAPLHPNADG

SEQ ID NO: 610023 - protein, 5 aa, Mycobacterium
VPGRQ

SEQ ID NO: 610024 - protein, 11 aa, Mycobacterium
VPGRSADLRQA

SEQ ID NO: 610025 - protein, 6 aa, Mycobacterium
VPGRSS

SEQ ID NO: 610026 - protein, 8 aa, Mycobacterium
VPGRSTMN

SEQ ID NO: 610027 - protein, 5 aa, Mycobacterium
VPGSA

SEQ ID NO: 610028 - protein, 17 aa, Mycobacterium
VPGSAPNNHASTPSQPA

SEQ ID NO: 610029 - protein, 6 aa, Mycobacterium
VPGSAV

SEQ ID NO: 610030 - protein, 15 aa, Mycobacterium
VPGSDEPDGTADRGY

SEQ ID NO: 610031 - protein, 7 aa, Mycobacterium
VPGSDQW

SEQ ID NO: 610032 - protein, 6 aa, Mycobacterium
VPGSEK

SEQ ID NO: 610033 - protein, 9 aa, Mycobacterium
VPGSESREK

SEQ ID NO: 610034 - protein, 12 aa, Mycobacterium
VPGSNGQTGEIV

SEQ ID NO: 610035 - protein, 7 aa, Mycobacterium
VPGSNSA

SEQ ID NO: 610036 - protein, 7 aa, Mycobacterium
VPGSNTA

SEQ ID NO: 610037 - protein, 11 aa, Mycobacterium
VPGSPEPQVAN

SEQ ID NO: 610038 - protein, 7 aa, Mycobacterium
VPGSPNL

SEQ ID NO: 610039 - protein, 7 aa, Mycobacterium
VPGSPTP

SEQ ID NO: 610040 - protein, 12 aa, Mycobacterium
VPGSPWTAAPGN

SEQ ID NO: 610041 - protein, 5 aa, Mycobacterium
VPGSR

SEQ ID NO: 610042 - protein, 9 aa, Mycobacterium
VPGSRNPLY

SEQ ID NO: 610043 - protein, 11 aa, Mycobacterium
VPGSSDPIDGA

SEQ ID NO: 610044 - protein, 12 aa, Mycobacterium
VPGSSDPIDGAA

SEQ ID NO: 610045 - protein, 14 aa, Mycobacterium
VPGSTSAKKTPTAQ

SEQ ID NO: 610046 - protein, 5 aa, Mycobacterium
VPGSV

SEQ ID NO: 610047 - protein, 6 aa, Mycobacterium
VPGSVP

SEQ ID NO: 610048 - protein, 10 aa, Mycobacterium
VPGSYDPEQR

SEQ ID NO: 610049 - protein, 9 aa, Mycobacterium
VPGTAGDRV

SEQ ID NO: 610050 - protein, 7 aa, Mycobacterium
VPGTEDR

SEQ ID NO: 610051 - protein, 7 aa, Mycobacterium
VPGTEKL

SEQ ID NO: 610052 - protein, 8 aa, Mycobacterium
VPGTEKLP

SEQ ID NO: 610053 - protein, 9 aa, Mycobacterium
VPGTGGRHE

SEQ ID NO: 610054 - protein, 8 aa, Mycobacterium
VPGTGLSP

SEQ ID NO: 610055 - protein, 7 aa, Mycobacterium
VPGTGPA

SEQ ID NO: 610056 - protein, 22 aa, Mycobacterium
VPGTGWPGDPATPQTPVAADAA

SEQ ID NO: 610057 - protein, 17 aa, Mycobacterium
VPGTLKQGEATKKTGTT

SEQ ID NO: 610058 - protein, 17 aa, Mycobacterium
VPGTPRPAVNGTGPGSL

SEQ ID NO: 610059 - protein, 11 aa, Mycobacterium
VPGTPSPIAPL

SEQ ID NO: 610060 - protein, 6 aa, Mycobacterium
VPGTRA

SEQ ID NO: 610061 - protein, 11 aa, Mycobacterium
VPGTTGVHSSG

SEQ ID NO: 610062 - protein, 6 aa, Mycobacterium
VPGTWG

SEQ ID NO: 610063 - protein, 5 aa, Mycobacterium
VPGTY

SEQ ID NO: 610064 - protein, 10 aa, Mycobacterium
VPGVGKSTAI

SEQ ID NO: 610065 - protein, 10 aa, Mycobacterium
VPGVGKSTTI

SEQ ID NO: 610066 - protein, 11 aa, Mycobacterium
VPGVGKSTTIE

SEQ ID NO: 610067 - protein, 5 aa, Mycobacterium
VPGVS

SEQ ID NO: 610068 - protein, 6 aa, Mycobacterium
VPGWTT

SEQ ID NO: 610069 - protein, 13 aa, Mycobacterium
VPGYDGPVGTVTE

SEQ ID NO: 610070 - protein, 13 aa, Mycobacterium
VPGYHAPPERTVS

SEQ ID NO: 610071 - protein, 10 aa, Mycobacterium
VPHGPRRKQV

SEQ ID NO: 610072 - protein, 6 aa, Mycobacterium
VPHPSP

SEQ ID NO: 610073 - protein, 13 aa, Mycobacterium
VPHPSRLGNPGEY

SEQ ID NO: 610074 - protein, 4 aa, Mycobacterium
VPHQ

SEQ ID NO: 610075 - protein, 23 aa, Mycobacterium
VPHQPPQLGEPPVAGGSDAPTRA

SEQ ID NO: 610076 - protein, 24 aa, Mycobacterium
VPHSPDDSGAGTTAEDGSAEQLAQ

SEQ ID NO: 610077 - protein, 7 aa, Mycobacterium
VPIDDET

SEQ ID NO: 610078 - protein, 8 aa, Mycobacterium
VPIDEKDV

SEQ ID NO: 610079 - protein, 18 aa, Mycobacterium
VPIDRTNADAAQAALETA

SEQ ID NO: 610080 - protein, 4 aa, Mycobacterium
VPIG

SEQ ID NO: 610081 - protein, 7 aa, Mycobacterium
VPIPAGS

SEQ ID NO: 610082 - protein, 11 aa, Mycobacterium
VPKADTPQSDL

SEQ ID NO: 610083 - protein, 4 aa, Mycobacterium
VPKD

SEQ ID NO: 610084 - protein, 13 aa, Mycobacterium
VPKDGEQPNQRQK

SEQ ID NO: 610085 - protein, 8 aa, Mycobacterium
VPKDPEID

SEQ ID NO: 610086 - protein, 6 aa, Mycobacterium
VPKDSA

SEQ ID NO: 610087 - protein, 10 aa, Mycobacterium
VPKEGEPPLD

SEQ ID NO: 610088 - protein, 13 aa, Mycobacterium
VPKEGEQPNQRQK

SEQ ID NO: 610089 - protein, 8 aa, Mycobacterium
VPKEGRAR

SEQ ID NO: 610090 - protein, 26 aa, Mycobacterium
VPKERGRYAIPPGSDHGQDYRTVGEA

SEQ ID NO: 610091 - protein, 6 aa, Mycobacterium
VPKERV

SEQ ID NO: 610092 - protein, 26 aa, Mycobacterium
VPKEYEGQVREAAQSCPEQAIVIDGT

SEQ ID NO: 610093 - protein, 11 aa, Mycobacterium
VPKGKAPIADV

SEQ ID NO: 610094 - protein, 7 aa, Mycobacterium
VPKGPDL

SEQ ID NO: 610095 - protein, 9 aa, Mycobacterium
VPKGPDLSG

SEQ ID NO: 610096 - protein, 13 aa, Mycobacterium
VPKGQSRRAAEEL

SEQ ID NO: 610097 - protein, 5 aa, Mycobacterium
VPKGT

SEQ ID NO: 610098 - protein, 8 aa, Mycobacterium
VPKGTADG

SEQ ID NO: 610099 - protein, 18 aa, Mycobacterium
VPKGYGPIAASKRAGETA

SEQ ID NO: 610100 - protein, 23 aa, Mycobacterium
VPKPGEPGSETWPADGEAWQRGG

SEQ ID NO: 610101 - protein, 12 aa, Mycobacterium
VPKPPPADGLPP

SEQ ID NO: 610102 - protein, 22 aa, Mycobacterium
VPKPPPSPTPRATTRRSLRRTA

SEQ ID NO: 610103 - protein, 102 aa, Mycobacterium
VPKPSAPVTDTKTTPQDSTSQQADKAAPTVDSASEKPGGATSGADAKASKIERNEHEGKTADKAAEVPKAEHETKPGAASEETPKTDPAKEVVEPKVDPAKV

SEQ ID NO: 610104 - protein, 22 aa, Mycobacterium
VPKPSGDHSHSKSKRGPATGPV

SEQ ID NO: 610105 - protein, 16 aa, Mycobacterium
VPKSSADNIPGAPADL

SEQ ID NO: 610106 - protein, 9 aa, Mycobacterium
VPKTPPSAI

SEQ ID NO: 610107 - protein, 7 aa, Mycobacterium
VPKTRVE

SEQ ID NO: 610108 - protein, 6 aa, Mycobacterium
VPKTSR

SEQ ID NO: 610109 - protein, 21 aa, Mycobacterium
VPKTSTPAGPRVSIQFRPRGV

SEQ ID NO: 610110 - protein, 7 aa, Mycobacterium
VPLETPA

SEQ ID NO: 610111 - protein, 8 aa, Mycobacterium
VPLGPASM

SEQ ID NO: 610112 - protein, 4 aa, Mycobacterium
VPLN

SEQ ID NO: 610113 - protein, 4 aa, Mycobacterium
VPLP

SEQ ID NO: 610114 - protein, 5 aa, Mycobacterium
VPLPD

SEQ ID NO: 610115 - protein, 7 aa, Mycobacterium
VPLPDPA

SEQ ID NO: 610116 - protein, 8 aa, Mycobacterium
VPLPDPDM

SEQ ID NO: 610117 - protein, 11 aa, Mycobacterium
VPLPGGDAAVR

SEQ ID NO: 610118 - protein, 8 aa, Mycobacterium
VPLPGPGY

SEQ ID NO: 610119 - protein, 9 aa, Mycobacterium
VPLPKPPQP

SEQ ID NO: 610120 - protein, 5 aa, Mycobacterium
VPLPT

SEQ ID NO: 610121 - protein, 12 aa, Mycobacterium
VPLPTSPGYTGN

SEQ ID NO: 610122 - protein, 5 aa, Mycobacterium
VPLQT

SEQ ID NO: 610123 - protein, 7 aa, Mycobacterium
VPLRPAS

SEQ ID NO: 610124 - protein, 18 aa, Mycobacterium
VPLRSSDQLGLPSDAKEA

SEQ ID NO: 610125 - protein, 21 aa, Mycobacterium
VPLSPPPQSATGDGPADETAA

SEQ ID NO: 610126 - protein, 6 aa, Mycobacterium
VPMAGE

SEQ ID NO: 610127 - protein, 16 aa, Mycobacterium
VPMPASATTGGGSRLP

SEQ ID NO: 610128 - protein, 4 aa, Mycobacterium
VPMT

SEQ ID NO: 610129 - protein, 11 aa, Mycobacterium
VPNADQPPLRG

SEQ ID NO: 610130 - protein, 13 aa, Mycobacterium
VPNDEFAGSAEAS

SEQ ID NO: 610131 - protein, 7 aa, Mycobacterium
VPNDGVG

SEQ ID NO: 610132 - protein, 5 aa, Mycobacterium
VPNDN

SEQ ID NO: 610133 - protein, 8 aa, Mycobacterium
VPNDRERG

SEQ ID NO: 610134 - protein, 4 aa, Mycobacterium
VPNE

SEQ ID NO: 610135 - protein, 8 aa, Mycobacterium
VPNEGTEQ

SEQ ID NO: 610136 - protein, 7 aa, Mycobacterium
VPNGDEL

SEQ ID NO: 610137 - protein, 5 aa, Mycobacterium
VPNGE

SEQ ID NO: 610138 - protein, 10 aa, Mycobacterium
VPNGPAFSAS

SEQ ID NO: 610139 - protein, 8 aa, Mycobacterium
VPNGPELA

SEQ ID NO: 610140 - protein, 10 aa, Mycobacterium
VPNPADGRGT

SEQ ID NO: 610141 - protein, 8 aa, Mycobacterium
VPNPLRGQ

SEQ ID NO: 610142 - protein, 7 aa, Mycobacterium
VPNPVGS

SEQ ID NO: 610143 - protein, 14 aa, Mycobacterium
VPNQGARGEDGPPF

SEQ ID NO: 610144 - protein, 13 aa, Mycobacterium
VPNQGRPGEPGPT

SEQ ID NO: 610145 - protein, 12 aa, Mycobacterium
VPNQGRRGEPGP

SEQ ID NO: 610146 - protein, 13 aa, Mycobacterium
VPNQGRRGEPGPP

SEQ ID NO: 610147 - protein, 13 aa, Mycobacterium
VPNQGRRGEPGPT

SEQ ID NO: 610148 - protein, 4 aa, Mycobacterium
VPNR

SEQ ID NO: 610149 - protein, 4 aa, Mycobacterium
VPNS

SEQ ID NO: 610150 - protein, 7 aa, Mycobacterium
VPNTDDL

SEQ ID NO: 610151 - protein, 7 aa, Mycobacterium
VPNTDGL

SEQ ID NO: 610152 - protein, 7 aa, Mycobacterium
VPNTGGL

SEQ ID NO: 610153 - protein, 9 aa, Mycobacterium
VPNTGGRAG

SEQ ID NO: 610154 - protein, 8 aa, Mycobacterium
VPNTKKLP

SEQ ID NO: 610155 - protein, 7 aa, Mycobacterium
VPNTKRL

SEQ ID NO: 610156 - protein, 7 aa, Mycobacterium
VPNTNGL

SEQ ID NO: 610157 - protein, 7 aa, Mycobacterium
VPPAADE

SEQ ID NO: 610158 - protein, 6 aa, Mycobacterium
VPPAAG

SEQ ID NO: 610159 - protein, 5 aa, Mycobacterium
VPPAD

SEQ ID NO: 610160 - protein, 11 aa, Mycobacterium
VPPADDNDSAE

SEQ ID NO: 610161 - protein, 18 aa, Mycobacterium
VPPADELADRYSKVSGRD

SEQ ID NO: 610162 - protein, 8 aa, Mycobacterium
VPPADPAA

SEQ ID NO: 610163 - protein, 11 aa, Mycobacterium
VPPADPDSYYS

SEQ ID NO: 610164 - protein, 8 aa, Mycobacterium
VPPADPGE

SEQ ID NO: 610165 - protein, 9 aa, Mycobacterium
VPPADPQTI

SEQ ID NO: 610166 - protein, 8 aa, Mycobacterium
VPPADSDA

SEQ ID NO: 610167 - protein, 8 aa, Mycobacterium
VPPADTDQ

SEQ ID NO: 610168 - protein, 6 aa, Mycobacterium
VPPAEL

SEQ ID NO: 610169 - protein, 6 aa, Mycobacterium
VPPAGA

SEQ ID NO: 610170 - protein, 10 aa, Mycobacterium
VPPAGAGATA

SEQ ID NO: 610171 - protein, 16 aa, Mycobacterium
VPPAGQGSPARYDGDL

SEQ ID NO: 610172 - protein, 7 aa, Mycobacterium
VPPAGTL

SEQ ID NO: 610173 - protein, 9 aa, Mycobacterium
VPPAGVPPI

SEQ ID NO: 610174 - protein, 5 aa, Mycobacterium
VPPAI

SEQ ID NO: 610175 - protein, 11 aa, Mycobacterium
VPPAKASAYKC

SEQ ID NO: 610176 - protein, 17 aa, Mycobacterium
VPPAKLPPGDYRQISGN

SEQ ID NO: 610177 - protein, 9 aa, Mycobacterium
VPPANPDEV

SEQ ID NO: 610178 - protein, 5 aa, Mycobacterium
VPPAQ

SEQ ID NO: 610179 - protein, 8 aa, Mycobacterium
VPPAQRRD

SEQ ID NO: 610180 - protein, 7 aa, Mycobacterium
VPPASSQ

SEQ ID NO: 610181 - protein, 6 aa, Mycobacterium
VPPATP

SEQ ID NO: 610182 - protein, 13 aa, Mycobacterium
VPPATTDTLRSDP

SEQ ID NO: 610183 - protein, 6 aa, Mycobacterium
VPPAVE

SEQ ID NO: 610184 - protein, 6 aa, Mycobacterium
VPPAVT

SEQ ID NO: 610185 - protein, 7 aa, Mycobacterium
VPPCPAP

SEQ ID NO: 610186 - protein, 4 aa, Mycobacterium
VPPD

SEQ ID NO: 610187 - protein, 10 aa, Mycobacterium
VPPDAGPELE

SEQ ID NO: 610188 - protein, 6 aa, Mycobacterium
VPPDAI

SEQ ID NO: 610189 - protein, 18 aa, Mycobacterium
VPPDALPNAYPRAPRVGE

SEQ ID NO: 610190 - protein, 7 aa, Mycobacterium
VPPDAPD

SEQ ID NO: 610191 - protein, 7 aa, Mycobacterium
VPPDDPC

SEQ ID NO: 610192 - protein, 6 aa, Mycobacterium
VPPDDY

SEQ ID NO: 610193 - protein, 7 aa, Mycobacterium
VPPDERR

SEQ ID NO: 610194 - protein, 5 aa, Mycobacterium
VPPDN

SEQ ID NO: 610195 - protein, 6 aa, Mycobacterium
VPPDPV

SEQ ID NO: 610196 - protein, 9 aa, Mycobacterium
VPPDQEAAV

SEQ ID NO: 610197 - protein, 10 aa, Mycobacterium
VPPDQEAAVR

SEQ ID NO: 610198 - protein, 11 aa, Mycobacterium
VPPDQRPAQEE

SEQ ID NO: 610199 - protein, 6 aa, Mycobacterium
VPPDRP

SEQ ID NO: 610200 - protein, 7 aa, Mycobacterium
VPPDTEL

SEQ ID NO: 610201 - protein, 9 aa, Mycobacterium
VPPDTELSP

SEQ ID NO: 610202 - protein, 8 aa, Mycobacterium
VPPDVPPE

SEQ ID NO: 610203 - protein, 5 aa, Mycobacterium
VPPEA

SEQ ID NO: 610204 - protein, 14 aa, Mycobacterium
VPPEARLDRPDQPR

SEQ ID NO: 610205 - protein, 5 aa, Mycobacterium
VPPED

SEQ ID NO: 610206 - protein, 10 aa, Mycobacterium
VPPEDPDSYY

SEQ ID NO: 610207 - protein, 7 aa, Mycobacterium
VPPEDRQ

SEQ ID NO: 610208 - protein, 11 aa, Mycobacterium
VPPEDTDKAAL

SEQ ID NO: 610209 - protein, 5 aa, Mycobacterium
VPPEE

SEQ ID NO: 610210 - protein, 9 aa, Mycobacterium
VPPEEDRPI

SEQ ID NO: 610211 - protein, 10 aa, Mycobacterium
VPPEEDRPIY

SEQ ID NO: 610212 - protein, 13 aa, Mycobacterium
VPPEEFARNESEL

SEQ ID NO: 610213 - protein, 5 aa, Mycobacterium
VPPEG

SEQ ID NO: 610214 - protein, 8 aa, Mycobacterium
VPPEGERI

SEQ ID NO: 610215 - protein, 9 aa, Mycobacterium
VPPEPTLSR

SEQ ID NO: 610216 - protein, 11 aa, Mycobacterium
VPPEQDTERRG

SEQ ID NO: 610217 - protein, 7 aa, Mycobacterium
VPPERQW

SEQ ID NO: 610218 - protein, 13 aa, Mycobacterium
VPPERRDADGVGN

SEQ ID NO: 610219 - protein, 6 aa, Mycobacterium
VPPERS

SEQ ID NO: 610220 - protein, 5 aa, Mycobacterium
VPPET

SEQ ID NO: 610221 - protein, 5 aa, Mycobacterium
VPPFP

SEQ ID NO: 610222 - protein, 5 aa, Mycobacterium
VPPGA

SEQ ID NO: 610223 - protein, 18 aa, Mycobacterium
VPPGADVEATATATSSCN

SEQ ID NO: 610224 - protein, 7 aa, Mycobacterium
VPPGAGT

SEQ ID NO: 610225 - protein, 12 aa, Mycobacterium
VPPGAPEHGQHT

SEQ ID NO: 610226 - protein, 6 aa, Mycobacterium
VPPGAR

SEQ ID NO: 610227 - protein, 10 aa, Mycobacterium
VPPGASGGTL

SEQ ID NO: 610228 - protein, 16 aa, Mycobacterium
VPPGATEIARTSRSSQ

SEQ ID NO: 610229 - protein, 9 aa, Mycobacterium
VPPGAYGPL

SEQ ID NO: 610230 - protein, 5 aa, Mycobacterium
VPPGD

SEQ ID NO: 610231 - protein, 8 aa, Mycobacterium
VPPGDFGS

SEQ ID NO: 610232 - protein, 7 aa, Mycobacterium
VPPGDMA

SEQ ID NO: 610233 - protein, 22 aa, Mycobacterium
VPPGDTPGGTPPAGADSSAAKV

SEQ ID NO: 610234 - protein, 22 aa, Mycobacterium
VPPGDTPGGTVPGSSAVGTDKL

SEQ ID NO: 610235 - protein, 7 aa, Mycobacterium
VPPGEFP

SEQ ID NO: 610236 - protein, 6 aa, Mycobacterium
VPPGEH

SEQ ID NO: 610237 - protein, 7 aa, Mycobacterium
VPPGERQ

SEQ ID NO: 610238 - protein, 7 aa, Mycobacterium
VPPGGDA

SEQ ID NO: 610239 - protein, 9 aa, Mycobacterium
VPPGGGEES

SEQ ID NO: 610240 - protein, 15 aa, Mycobacterium
VPPGGGFAGSDPDFA

SEQ ID NO: 610241 - protein, 16 aa, Mycobacterium
VPPGGPDHTAGEGRNI

SEQ ID NO: 610242 - protein, 7 aa, Mycobacterium
VPPGGQP

SEQ ID NO: 610243 - protein, 6 aa, Mycobacterium
VPPGGY

SEQ ID NO: 610244 - protein, 12 aa, Mycobacterium
VPPGPAPDDRAL

SEQ ID NO: 610245 - protein, 7 aa, Mycobacterium
VPPGPGL

SEQ ID NO: 610246 - protein, 5 aa, Mycobacterium
VPPGQ

SEQ ID NO: 610247 - protein, 6 aa, Mycobacterium
VPPGQA

SEQ ID NO: 610248 - protein, 6 aa, Mycobacterium
VPPGQQ

SEQ ID NO: 610249 - protein, 5 aa, Mycobacterium
VPPGR

SEQ ID NO: 610250 - protein, 6 aa, Mycobacterium
VPPGRY

SEQ ID NO: 610251 - protein, 5 aa, Mycobacterium
VPPGS

SEQ ID NO: 610252 - protein, 9 aa, Mycobacterium
VPPGSDAAL

SEQ ID NO: 610253 - protein, 8 aa, Mycobacterium
VPPGSPNA

SEQ ID NO: 610254 - protein, 6 aa, Mycobacterium
VPPGTA

SEQ ID NO: 610255 - protein, 9 aa, Mycobacterium
VPPGTDGRL

SEQ ID NO: 610256 - protein, 9 aa, Mycobacterium
VPPGTQPGS

SEQ ID NO: 610257 - protein, 6 aa, Mycobacterium
VPPGTR

SEQ ID NO: 610258 - protein, 8 aa, Mycobacterium
VPPGTYRP

SEQ ID NO: 610259 - protein, 5 aa, Mycobacterium
VPPGV

SEQ ID NO: 610260 - protein, 6 aa, Mycobacterium
VPPGVD

SEQ ID NO: 610261 - protein, 13 aa, Mycobacterium
VPPGVTDNTDDAC

SEQ ID NO: 610262 - protein, 16 aa, Mycobacterium
VPPGWSATGPVPVPSV

SEQ ID NO: 610263 - protein, 10 aa, Mycobacterium
VPPHERPSAE

SEQ ID NO: 610264 - protein, 10 aa, Mycobacterium
VPPHERTSPD

SEQ ID NO: 610265 - protein, 14 aa, Mycobacterium
VPPHTASRVTESTY

SEQ ID NO: 610266 - protein, 14 aa, Mycobacterium
VPPHTASRVTRSEY

SEQ ID NO: 610267 - protein, 15 aa, Mycobacterium
VPPHTASRVTRSKYT

SEQ ID NO: 610268 - protein, 4 aa, Mycobacterium
VPPI

SEQ ID NO: 610269 - protein, 5 aa, Mycobacterium
VPPIA

SEQ ID NO: 610270 - protein, 24 aa, Mycobacterium
VPPIAPTAAEPGHKAAEDENTLTS

SEQ ID NO: 610271 - protein, 16 aa, Mycobacterium
VPPKPFHPDTPTVPAL

SEQ ID NO: 610272 - protein, 9 aa, Mycobacterium
VPPKREQAA

SEQ ID NO: 610273 - protein, 11 aa, Mycobacterium
VPPKRQPPSGG

SEQ ID NO: 610274 - protein, 8 aa, Mycobacterium
VPPKRRRA

SEQ ID NO: 610275 - protein, 14 aa, Mycobacterium
VPPLPRAQVPPTEA

SEQ ID NO: 610276 - protein, 22 aa, Mycobacterium
VPPLSESRLPAPAELADDPWSH

SEQ ID NO: 610277 - protein, 8 aa, Mycobacterium
VPPNDGGL

SEQ ID NO: 610278 - protein, 5 aa, Mycobacterium
VPPNI

SEQ ID NO: 610279 - protein, 12 aa, Mycobacterium
VPPNLSDYEQAR

SEQ ID NO: 610280 - protein, 5 aa, Mycobacterium
VPPNT

SEQ ID NO: 610281 - protein, 9 aa, Mycobacterium
VPPNTGTLR

SEQ ID NO: 610282 - protein, 14 aa, Mycobacterium
VPPPASEEAGEPAG

SEQ ID NO: 610283 - protein, 11 aa, Mycobacterium
VPPPAYTSTEL

SEQ ID NO: 610284 - protein, 8 aa, Mycobacterium
VPPPDFAP

SEQ ID NO: 610285 - protein, 9 aa, Mycobacterium
VPPPDGSRQ

SEQ ID NO: 610286 - protein, 12 aa, Mycobacterium
VPPPDGVGAAFS

SEQ ID NO: 610287 - protein, 10 aa, Mycobacterium
VPPPEKRGRV

SEQ ID NO: 610288 - protein, 7 aa, Mycobacterium
VPPPELG

SEQ ID NO: 610289 - protein, 8 aa, Mycobacterium
VPPPEYDP

SEQ ID NO: 610290 - protein, 8 aa, Mycobacterium
VPPPGEPA

SEQ ID NO: 610291 - protein, 8 aa, Mycobacterium
VPPPGGSL

SEQ ID NO: 610292 - protein, 6 aa, Mycobacterium
VPPPGH

SEQ ID NO: 610293 - protein, 11 aa, Mycobacterium
VPPPGPATSEI

SEQ ID NO: 610294 - protein, 11 aa, Mycobacterium
VPPPGPSTSEI

SEQ ID NO: 610295 - protein, 5 aa, Mycobacterium
VPPPI

SEQ ID NO: 610296 - protein, 12 aa, Mycobacterium
VPPPKGDPEAPL

SEQ ID NO: 610297 - protein, 24 aa, Mycobacterium
VPPPKGSRGPRRTQTARGTARTAS

SEQ ID NO: 610298 - protein, 6 aa, Mycobacterium
VPPPLA

SEQ ID NO: 610299 - protein, 5 aa, Mycobacterium
VPPPP

SEQ ID NO: 610300 - protein, 15 aa, Mycobacterium
VPPPPEPRPGRSARE

SEQ ID NO: 610301 - protein, 15 aa, Mycobacterium
VPPPPPPPLNYPQPR

SEQ ID NO: 610302 - protein, 11 aa, Mycobacterium
VPPPPSADDAV

SEQ ID NO: 610303 - protein, 13 aa, Mycobacterium
VPPPQGDADAPTR

SEQ ID NO: 610304 - protein, 5 aa, Mycobacterium
VPPPR

SEQ ID NO: 610305 - protein, 7 aa, Mycobacterium
VPPPRDS

SEQ ID NO: 610306 - protein, 7 aa, Mycobacterium
VPPPRDT

SEQ ID NO: 610307 - protein, 7 aa, Mycobacterium
VPPPREA

SEQ ID NO: 610308 - protein, 13 aa, Mycobacterium
VPPPRGDADAPTR

SEQ ID NO: 610309 - protein, 46 aa, Mycobacterium
VPPPTAAQPPTVPTRRDIPAPASAAAAPAPRRPAPVPQQPIPDPEQ

SEQ ID NO: 610310 - protein, 5 aa, Mycobacterium
VPPPV

SEQ ID NO: 610311 - protein, 13 aa, Mycobacterium
VPPPVGDPDAPTR

SEQ ID NO: 610312 - protein, 8 aa, Mycobacterium
VPPQEGTD

SEQ ID NO: 610313 - protein, 17 aa, Mycobacterium
VPPQPPGREPLRRRPAG

SEQ ID NO: 610314 - protein, 6 aa, Mycobacterium
VPPQRD

SEQ ID NO: 610315 - protein, 8 aa, Mycobacterium
VPPQTASR

SEQ ID NO: 610316 - protein, 4 aa, Mycobacterium
VPPR

SEQ ID NO: 610317 - protein, 9 aa, Mycobacterium
VPPRDTGLG

SEQ ID NO: 610318 - protein, 20 aa, Mycobacterium
VPPRGPVRPSPDTDRPRAEV

SEQ ID NO: 610319 - protein, 13 aa, Mycobacterium
VPPRGTRPTTDRV

SEQ ID NO: 610320 - protein, 5 aa, Mycobacterium
VPPRN

SEQ ID NO: 610321 - protein, 14 aa, Mycobacterium
VPPRNQGQAGRNFG

SEQ ID NO: 610322 - protein, 6 aa, Mycobacterium
VPPRRE

SEQ ID NO: 610323 - protein, 19 aa, Mycobacterium
VPPRTGAAALGAAEPPARE

SEQ ID NO: 610324 - protein, 8 aa, Mycobacterium
VPPRTGSL

SEQ ID NO: 610325 - protein, 5 aa, Mycobacterium
VPPRY

SEQ ID NO: 610326 - protein, 23 aa, Mycobacterium
VPPSAPGSKSGEAKPTVVTNRPN

SEQ ID NO: 610327 - protein, 8 aa, Mycobacterium
VPPSDDPV

SEQ ID NO: 610328 - protein, 12 aa, Mycobacterium
VPPSPSEPTEPG

SEQ ID NO: 610329 - protein, 5 aa, Mycobacterium
VPPSQ

SEQ ID NO: 610330 - protein, 6 aa, Mycobacterium
VPPSQA

SEQ ID NO: 610331 - protein, 7 aa, Mycobacterium
VPPSQKS

SEQ ID NO: 610332 - protein, 5 aa, Mycobacterium
VPPSR

SEQ ID NO: 610333 - protein, 8 aa, Mycobacterium
VPPSRATD

SEQ ID NO: 610334 - protein, 6 aa, Mycobacterium
VPPSRD

SEQ ID NO: 610335 - protein, 6 aa, Mycobacterium
VPPSVP

SEQ ID NO: 610336 - protein, 6 aa, Mycobacterium
VPPSVW

SEQ ID NO: 610337 - protein, 6 aa, Mycobacterium
VPPSWA

SEQ ID NO: 610338 - protein, 21 aa, Mycobacterium
VPPSWAGPATPVVGTSAAPLQ

SEQ ID NO: 610339 - protein, 9 aa, Mycobacterium
VPPSWAGSG

SEQ ID NO: 610340 - protein, 21 aa, Mycobacterium
VPPSWAGSTPVVGSSAAPLQT

SEQ ID NO: 610341 - protein, 12 aa, Mycobacterium
VPPSWATATPAI

SEQ ID NO: 610342 - protein, 23 aa, Mycobacterium
VPPSWTGAAPLASPLGSALGGTP

SEQ ID NO: 610343 - protein, 9 aa, Mycobacterium
VPPTGRGEP

SEQ ID NO: 610344 - protein, 5 aa, Mycobacterium
VPPTL

SEQ ID NO: 610345 - protein, 12 aa, Mycobacterium
VPPTNHTYPHME

SEQ ID NO: 610346 - protein, 6 aa, Mycobacterium
VPPTNV

SEQ ID NO: 610347 - protein, 7 aa, Mycobacterium
VPPTPAD

SEQ ID NO: 610348 - protein, 22 aa, Mycobacterium
VPPTPANYAQRSGRAGRSGQPA

SEQ ID NO: 610349 - protein, 10 aa, Mycobacterium
VPPTPEERAY

SEQ ID NO: 610350 - protein, 7 aa, Mycobacterium
VPPTPER

SEQ ID NO: 610351 - protein, 6 aa, Mycobacterium
VPPTPF

SEQ ID NO: 610352 - protein, 9 aa, Mycobacterium
VPPTSANGG

SEQ ID NO: 610353 - protein, 7 aa, Mycobacterium
VPPTSRH

SEQ ID NO: 610354 - protein, 6 aa, Mycobacterium
VPPTVQ

SEQ ID NO: 610355 - protein, 17 aa, Mycobacterium
VPPTWAGASPVATPTST

SEQ ID NO: 610356 - protein, 22 aa, Mycobacterium
VPPTWSANPGPGPAVADAAPLA

SEQ ID NO: 610357 - protein, 4 aa, Mycobacterium
VPPV

SEQ ID NO: 610358 - protein, 8 aa, Mycobacterium
VPPVGGDQ

SEQ ID NO: 610359 - protein, 6 aa, Mycobacterium
VPPVHP

SEQ ID NO: 610360 - protein, 6 aa, Mycobacterium
VPPVNA

SEQ ID NO: 610361 - protein, 47 aa, Mycobacterium
VPPVNTRDTRSSTTTRDANRHNGNGDRNSAENRNGPSKNAAGDDDEP

SEQ ID NO: 610362 - protein, 24 aa, Mycobacterium
VPPVPAAPPMPPVPPWPPAPPAAP

SEQ ID NO: 610363 - protein, 13 aa, Mycobacterium
VPPVPPSPELPSA

SEQ ID NO: 610364 - protein, 16 aa, Mycobacterium
VPPVSASVKTTKRSRK

SEQ ID NO: 610365 - protein, 4 aa, Mycobacterium
VPPY

SEQ ID NO: 610366 - protein, 14 aa, Mycobacterium
VPPYDDPRTIAGQG

SEQ ID NO: 610367 - protein, 14 aa, Mycobacterium
VPPYDDPRTMAGQG

SEQ ID NO: 610368 - protein, 15 aa, Mycobacterium
VPPYPGQAADFIAGL

SEQ ID NO: 610369 - protein, 13 aa, Mycobacterium
VPPYPPGTWAAFG

SEQ ID NO: 610370 - protein, 4 aa, Mycobacterium
VPQA

SEQ ID NO: 610371 - protein, 21 aa, Mycobacterium
VPQAGAAPACPTLTDGGAENY

SEQ ID NO: 610372 - protein, 11 aa, Mycobacterium
VPQDDDAPAAW

SEQ ID NO: 610373 - protein, 15 aa, Mycobacterium
VPQDDDERNDKQARE

SEQ ID NO: 610374 - protein, 9 aa, Mycobacterium
VPQEGFSDP

SEQ ID NO: 610375 - protein, 13 aa, Mycobacterium
VPQGGASDERATS

SEQ ID NO: 610376 - protein, 24 aa, Mycobacterium
VPQGPGLGIDPDPDVITAYRRPST

SEQ ID NO: 610377 - protein, 8 aa, Mycobacterium
VPQGTADG

SEQ ID NO: 610378 - protein, 11 aa, Mycobacterium
VPQGYNPTFPD

SEQ ID NO: 610379 - protein, 7 aa, Mycobacterium
VPQMRKQ

SEQ ID NO: 610380 - protein, 4 aa, Mycobacterium
VPQP

SEQ ID NO: 610381 - protein, 28 aa, Mycobacterium
VPQPAPAPRFSRTRPQPPTAPSLPGDHT

SEQ ID NO: 610382 - protein, 6 aa, Mycobacterium
VPQPAQ

SEQ ID NO: 610383 - protein, 11 aa, Mycobacterium
VPQPEPGPGEV

SEQ ID NO: 610384 - protein, 8 aa, Mycobacterium
VPQPGAGT

SEQ ID NO: 610385 - protein, 11 aa, Mycobacterium
VPQPLSPRMPD

SEQ ID NO: 610386 - protein, 14 aa, Mycobacterium
VPQPPERSETGGVS

SEQ ID NO: 610387 - protein, 10 aa, Mycobacterium
VPQPPSKTLE

SEQ ID NO: 610388 - protein, 6 aa, Mycobacterium
VPQPRR

SEQ ID NO: 610389 - protein, 5 aa, Mycobacterium
VPQQA

SEQ ID NO: 610390 - protein, 20 aa, Mycobacterium
VPQQGQSVPPVMQPAGAASG

SEQ ID NO: 610391 - protein, 5 aa, Mycobacterium
VPQQP

SEQ ID NO: 610392 - protein, 8 aa, Mycobacterium
VPQQPHDG

SEQ ID NO: 610393 - protein, 24 aa, Mycobacterium
VPQQPPPIDTPEGGNRTPDPPLDR

SEQ ID NO: 610394 - protein, 16 aa, Mycobacterium
VPQQRSETLRRSGETA

SEQ ID NO: 610395 - protein, 6 aa, Mycobacterium
VPQQTN

SEQ ID NO: 610396 - protein, 4 aa, Mycobacterium
VPQR

SEQ ID NO: 610397 - protein, 9 aa, Mycobacterium
VPQREPEPI

SEQ ID NO: 610398 - protein, 23 aa, Mycobacterium
VPQRGDKKALAETVERNAKEALA

SEQ ID NO: 610399 - protein, 13 aa, Mycobacterium
VPQRGDKRALAET

SEQ ID NO: 610400 - protein, 6 aa, Mycobacterium
VPQRPE

SEQ ID NO: 610401 - protein, 18 aa, Mycobacterium
VPQRPGASTVTAATAVSA

SEQ ID NO: 610402 - protein, 11 aa, Mycobacterium
VPQRRKKKRLD

SEQ ID NO: 610403 - protein, 12 aa, Mycobacterium
VPQRRKKKRLTG

SEQ ID NO: 610404 - protein, 5 aa, Mycobacterium
VPQRT

SEQ ID NO: 610405 - protein, 8 aa, Mycobacterium
VPQRTAGE

SEQ ID NO: 610406 - protein, 4 aa, Mycobacterium
VPQS

SEQ ID NO: 610407 - protein, 6 aa, Mycobacterium
VPQSDD

SEQ ID NO: 610408 - protein, 12 aa, Mycobacterium
VPQSNEPPQPHQ

SEQ ID NO: 610409 - protein, 5 aa, Mycobacterium
VPQSQ

SEQ ID NO: 610410 - protein, 19 aa, Mycobacterium
VPQSVSSDSFEEATEAGIP

SEQ ID NO: 610411 - protein, 11 aa, Mycobacterium
VPQSWSASPGI

SEQ ID NO: 610412 - protein, 10 aa, Mycobacterium
VPQTEALATA

SEQ ID NO: 610413 - protein, 27 aa, Mycobacterium
VPQTPASPAAGDHPEPQHAGPQHRTPT

SEQ ID NO: 610414 - protein, 39 aa, Mycobacterium
VPQTQAPPAPQAPQYTPYPQYPQYPQYPGNAQNPFLGPG

SEQ ID NO: 610415 - protein, 10 aa, Mycobacterium
VPQTQPSTQL

SEQ ID NO: 610416 - protein, 5 aa, Mycobacterium
VPRAA

SEQ ID NO: 610417 - protein, 5 aa, Mycobacterium
VPRAE

SEQ ID NO: 610418 - protein, 5 aa, Mycobacterium
VPRAG

SEQ ID NO: 610419 - protein, 8 aa, Mycobacterium
VPRAGDPL

SEQ ID NO: 610420 - protein, 10 aa, Mycobacterium
VPRAPYGLAG

SEQ ID NO: 610421 - protein, 5 aa, Mycobacterium
VPRAS

SEQ ID NO: 610422 - protein, 13 aa, Mycobacterium
VPRDGTPITYEAR

SEQ ID NO: 610423 - protein, 17 aa, Mycobacterium
VPRDNEGGGDKNPRQKF

SEQ ID NO: 610424 - protein, 15 aa, Mycobacterium
VPRDPDAGNQNQRQK

SEQ ID NO: 610425 - protein, 9 aa, Mycobacterium
VPRDSLGRT

SEQ ID NO: 610426 - protein, 12 aa, Mycobacterium
VPRDTNSSFDPQ

SEQ ID NO: 610427 - protein, 12 aa, Mycobacterium
VPRDTNSSFEPQ

SEQ ID NO: 610428 - protein, 10 aa, Mycobacterium
VPREESRQRF

SEQ ID NO: 610429 - protein, 15 aa, Mycobacterium
VPREGDSGGQNQRQK

SEQ ID NO: 610430 - protein, 16 aa, Mycobacterium
VPREGEAGDKNPRQKF

SEQ ID NO: 610431 - protein, 11 aa, Mycobacterium
VPRERRAERRT

SEQ ID NO: 610432 - protein, 9 aa, Mycobacterium
VPRERSAEL

SEQ ID NO: 610433 - protein, 8 aa, Mycobacterium
VPRERTAE

SEQ ID NO: 610434 - protein, 6 aa, Mycobacterium
VPRERW

SEQ ID NO: 610435 - protein, 6 aa, Mycobacterium
VPRESN

SEQ ID NO: 610436 - protein, 10 aa, Mycobacterium
VPREYDPAYS

SEQ ID NO: 610437 - protein, 12 aa, Mycobacterium
VPRFSDSDGRID

SEQ ID NO: 610438 - protein, 13 aa, Mycobacterium
VPRGDSALDGESL

SEQ ID NO: 610439 - protein, 9 aa, Mycobacterium
VPRGEEAGK

SEQ ID NO: 610440 - protein, 10 aa, Mycobacterium
VPRGKAPIAD

SEQ ID NO: 610441 - protein, 5 aa, Mycobacterium
VPRGL

SEQ ID NO: 610442 - protein, 10 aa, Mycobacterium
VPRGTGGEIQ

SEQ ID NO: 610443 - protein, 7 aa, Mycobacterium
VPRHPEH

SEQ ID NO: 610444 - protein, 4 aa, Mycobacterium
VPRK

SEQ ID NO: 610445 - protein, 19 aa, Mycobacterium
VPRKDLSARKIETPKRDTD

SEQ ID NO: 610446 - protein, 11 aa, Mycobacterium
VPRKSEPRTVV

SEQ ID NO: 610447 - protein, 7 aa, Mycobacterium
VPRLGSS

SEQ ID NO: 610448 - protein, 12 aa, Mycobacterium
VPRNGDGGPRSI

SEQ ID NO: 610449 - protein, 10 aa, Mycobacterium
VPRNKAPIAD

SEQ ID NO: 610450 - protein, 13 aa, Mycobacterium
VPRPASSSYAQDA

SEQ ID NO: 610451 - protein, 7 aa, Mycobacterium
VPRPDAS

SEQ ID NO: 610452 - protein, 10 aa, Mycobacterium
VPRPDVHSGE

SEQ ID NO: 610453 - protein, 9 aa, Mycobacterium
VPRPEGHPA

SEQ ID NO: 610454 - protein, 10 aa, Mycobacterium
VPRPEGQPAL

SEQ ID NO: 610455 - protein, 9 aa, Mycobacterium
VPRPEPGDG

SEQ ID NO: 610456 - protein, 12 aa, Mycobacterium
VPRPEQPVTGPE

SEQ ID NO: 610457 - protein, 8 aa, Mycobacterium
VPRPRDPL

SEQ ID NO: 610458 - protein, 15 aa, Mycobacterium
VPRPSAVNIVTGLPT

SEQ ID NO: 610459 - protein, 10 aa, Mycobacterium
VPRPTTNSYA

SEQ ID NO: 610460 - protein, 4 aa, Mycobacterium
VPRQ

SEQ ID NO: 610461 - protein, 22 aa, Mycobacterium
VPRQSEPHTPQVRTSGGSPAPV

SEQ ID NO: 610462 - protein, 5 aa, Mycobacterium
VPRRA

SEQ ID NO: 610463 - protein, 14 aa, Mycobacterium
VPRRAEPRTSVPAG

SEQ ID NO: 610464 - protein, 6 aa, Mycobacterium
VPRREQ

SEQ ID NO: 610465 - protein, 23 aa, Mycobacterium
VPRRGDKRALAETVQRNAKEALQ

SEQ ID NO: 610466 - protein, 16 aa, Mycobacterium
VPRRNGKVPAVFGPVG

SEQ ID NO: 610467 - protein, 8 aa, Mycobacterium
VPRRPNET

SEQ ID NO: 610468 - protein, 10 aa, Mycobacterium
VPRRQGGQEL

SEQ ID NO: 610469 - protein, 15 aa, Mycobacterium
VPRRSEPRTSVPAGS

SEQ ID NO: 610470 - protein, 7 aa, Mycobacterium
VPRSEAS

SEQ ID NO: 610471 - protein, 6 aa, Mycobacterium
VPRSGA

SEQ ID NO: 610472 - protein, 7 aa, Mycobacterium
VPRSGEL

SEQ ID NO: 610473 - protein, 8 aa, Mycobacterium
VPRSPQGR

SEQ ID NO: 610474 - protein, 11 aa, Mycobacterium
VPRSSGSARES

SEQ ID NO: 610475 - protein, 7 aa, Mycobacterium
VPRSTEL

SEQ ID NO: 610476 - protein, 6 aa, Mycobacterium
VPRSVP

SEQ ID NO: 610477 - protein, 11 aa, Mycobacterium
VPRTASGAADI

SEQ ID NO: 610478 - protein, 5 aa, Mycobacterium
VPRTD

SEQ ID NO: 610479 - protein, 9 aa, Mycobacterium
VPRTPGRLD

SEQ ID NO: 610480 - protein, 17 aa, Mycobacterium
VPRTSVGKYDKKTIRAG

SEQ ID NO: 610481 - protein, 31 aa, Mycobacterium
VPRTSVNSTLASGTPATATTDLRTPATTMSA

SEQ ID NO: 610482 - protein, 5 aa, Mycobacterium
VPRTT

SEQ ID NO: 610483 - protein, 6 aa, Mycobacterium
VPRTTR

SEQ ID NO: 610484 - protein, 9 aa, Mycobacterium
VPSAAEQAK

SEQ ID NO: 610485 - protein, 7 aa, Mycobacterium
VPSAAGG

SEQ ID NO: 610486 - protein, 11 aa, Mycobacterium
VPSAARDRRGF

SEQ ID NO: 610487 - protein, 20 aa, Mycobacterium
VPSAATTSPATSAGIPSIPG

SEQ ID NO: 610488 - protein, 7 aa, Mycobacterium
VPSALGE

SEQ ID NO: 610489 - protein, 9 aa, Mycobacterium
VPSALRGKR

SEQ ID NO: 610490 - protein, 5 aa, Mycobacterium
VPSAP

SEQ ID NO: 610491 - protein, 4 aa, Mycobacterium
VPSD

SEQ ID NO: 610492 - protein, 8 aa, Mycobacterium
VPSDAPDA

SEQ ID NO: 610493 - protein, 8 aa, Mycobacterium
VPSDGNDV

SEQ ID NO: 610494 - protein, 5 aa, Mycobacterium
VPSDL

SEQ ID NO: 610495 - protein, 6 aa, Mycobacterium
VPSDRL

SEQ ID NO: 610496 - protein, 8 aa, Mycobacterium
VPSDRSTE

SEQ ID NO: 610497 - protein, 8 aa, Mycobacterium
VPSDRTAL

SEQ ID NO: 610498 - protein, 18 aa, Mycobacterium
VPSDVARRSKCDVLIVHT

SEQ ID NO: 610499 - protein, 10 aa, Mycobacterium
VPSDVDQTSI

SEQ ID NO: 610500 - protein, 5 aa, Mycobacterium
VPSED

SEQ ID NO: 610501 - protein, 21 aa, Mycobacterium
VPSEDGLRRRQTVSAKDKGVA

SEQ ID NO: 610502 - protein, 9 aa, Mycobacterium
VPSEEDLRD

SEQ ID NO: 610503 - protein, 8 aa, Mycobacterium
VPSEFTAS

SEQ ID NO: 610504 - protein, 6 aa, Mycobacterium
VPSEQT

SEQ ID NO: 610505 - protein, 7 aa, Mycobacterium
VPSESAA

SEQ ID NO: 610506 - protein, 5 aa, Mycobacterium
VPSEV

SEQ ID NO: 610507 - protein, 8 aa, Mycobacterium
VPSEVSRR

SEQ ID NO: 610508 - protein, 4 aa, Mycobacterium
VPSG

SEQ ID NO: 610509 - protein, 7 aa, Mycobacterium
VPSGAAG

SEQ ID NO: 610510 - protein, 11 aa, Mycobacterium
VPSGAAPVAQA

SEQ ID NO: 610511 - protein, 13 aa, Mycobacterium
VPSGAARQEAEDL

SEQ ID NO: 610512 - protein, 9 aa, Mycobacterium
VPSGALPSQ

SEQ ID NO: 610513 - protein, 14 aa, Mycobacterium
VPSGDGDDPDDPDH

SEQ ID NO: 610514 - protein, 9 aa, Mycobacterium
VPSGEQSSL

SEQ ID NO: 610515 - protein, 6 aa, Mycobacterium
VPSGEV

SEQ ID NO: 610516 - protein, 7 aa, Mycobacterium
VPSGGTD

SEQ ID NO: 610517 - protein, 18 aa, Mycobacterium
VPSGGYKESGLGRESGVE

SEQ ID NO: 610518 - protein, 5 aa, Mycobacterium
VPSGR

SEQ ID NO: 610519 - protein, 5 aa, Mycobacterium
VPSGS

SEQ ID NO: 610520 - protein, 8 aa, Mycobacterium
VPSGTSAR

SEQ ID NO: 610521 - protein, 10 aa, Mycobacterium
VPSHEQARAG

SEQ ID NO: 610522 - protein, 7 aa, Mycobacterium
VPSKSAK

SEQ ID NO: 610523 - protein, 9 aa, Mycobacterium
VPSKTDFTG

SEQ ID NO: 610524 - protein, 8 aa, Mycobacterium
VPSLDPRD

SEQ ID NO: 610525 - protein, 12 aa, Mycobacterium
VPSLPTDDPVAV

SEQ ID NO: 610526 - protein, 20 aa, Mycobacterium
VPSLSYPGGYAESVTAPANA

SEQ ID NO: 610527 - protein, 6 aa, Mycobacterium
VPSNTS

SEQ ID NO: 610528 - protein, 10 aa, Mycobacterium
VPSPGGRKEL

SEQ ID NO: 610529 - protein, 9 aa, Mycobacterium
VPSPGGRRE

SEQ ID NO: 610530 - protein, 11 aa, Mycobacterium
VPSPINPPSGC

SEQ ID NO: 610531 - protein, 11 aa, Mycobacterium
VPSPLDPRVGP

SEQ ID NO: 610532 - protein, 11 aa, Mycobacterium
VPSPLNPPSGC

SEQ ID NO: 610533 - protein, 8 aa, Mycobacterium
VPSPLPAH

SEQ ID NO: 610534 - protein, 12 aa, Mycobacterium
VPSPNAMEAGPD

SEQ ID NO: 610535 - protein, 15 aa, Mycobacterium
VPSPPTADDTSNPVV

SEQ ID NO: 610536 - protein, 9 aa, Mycobacterium
VPSPPYGQG

SEQ ID NO: 610537 - protein, 6 aa, Mycobacterium
VPSQET

SEQ ID NO: 610538 - protein, 7 aa, Mycobacterium
VPSQRTA

SEQ ID NO: 610539 - protein, 5 aa, Mycobacterium
VPSQS

SEQ ID NO: 610540 - protein, 9 aa, Mycobacterium
VPSRDGGDR

SEQ ID NO: 610541 - protein, 8 aa, Mycobacterium
VPSRGDPG

SEQ ID NO: 610542 - protein, 6 aa, Mycobacterium
VPSRPA

SEQ ID NO: 610543 - protein, 11 aa, Mycobacterium
VPSRPRPPAAP

SEQ ID NO: 610544 - protein, 15 aa, Mycobacterium
VPSRQTLTDAAAQHG

SEQ ID NO: 610545 - protein, 9 aa, Mycobacterium
VPSRSDDEL

SEQ ID NO: 610546 - protein, 6 aa, Mycobacterium
VPSRYG

SEQ ID NO: 610547 - protein, 17 aa, Mycobacterium
VPSSAFDGKHPREHAET

SEQ ID NO: 610548 - protein, 22 aa, Mycobacterium
VPSSAPHDAEPVLSPDPAALQD

SEQ ID NO: 610549 - protein, 20 aa, Mycobacterium
VPSSKAPSPRPHPTSIEGAS

SEQ ID NO: 610550 - protein, 5 aa, Mycobacterium
VPSSL

SEQ ID NO: 610551 - protein, 12 aa, Mycobacterium
VPSSTGGQNDTR

SEQ ID NO: 610552 - protein, 14 aa, Mycobacterium
VPSSWEDRTAGTSK

SEQ ID NO: 610553 - protein, 4 aa, Mycobacterium
VPST

SEQ ID NO: 610554 - protein, 21 aa, Mycobacterium
VPSTPGRVTDSAEGAKAIATE

SEQ ID NO: 610555 - protein, 7 aa, Mycobacterium
VPSTPSN

SEQ ID NO: 610556 - protein, 5 aa, Mycobacterium
VPSTT

SEQ ID NO: 610557 - protein, 7 aa, Mycobacterium
VPSVGGE

SEQ ID NO: 610558 - protein, 4 aa, Mycobacterium
VPTA

SEQ ID NO: 610559 - protein, 5 aa, Mycobacterium
VPTAA

SEQ ID NO: 610560 - protein, 18 aa, Mycobacterium
VPTAAAPAPGSRLDDTAA

SEQ ID NO: 610561 - protein, 7 aa, Mycobacterium
VPTAANA

SEQ ID NO: 610562 - protein, 10 aa, Mycobacterium
VPTAARPGKL

SEQ ID NO: 610563 - protein, 5 aa, Mycobacterium
VPTAG

SEQ ID NO: 610564 - protein, 6 aa, Mycobacterium
VPTAGR

SEQ ID NO: 610565 - protein, 6 aa, Mycobacterium
VPTAHR

SEQ ID NO: 610566 - protein, 6 aa, Mycobacterium
VPTAID

SEQ ID NO: 610567 - protein, 6 aa, Mycobacterium
VPTANA

SEQ ID NO: 610568 - protein, 7 aa, Mycobacterium
VPTAQPD

SEQ ID NO: 610569 - protein, 14 aa, Mycobacterium
VPTARPPGRIRERP

SEQ ID NO: 610570 - protein, 6 aa, Mycobacterium
VPTATR

SEQ ID NO: 610571 - protein, 7 aa, Mycobacterium
VPTATRR

SEQ ID NO: 610572 - protein, 8 aa, Mycobacterium
VPTATSVR

SEQ ID NO: 610573 - protein, 9 aa, Mycobacterium
VPTAYGTEG

SEQ ID NO: 610574 - protein, 17 aa, Mycobacterium
VPTAYGTEGYVPPATHD

SEQ ID NO: 610575 - protein, 8 aa, Mycobacterium
VPTDAPGF

SEQ ID NO: 610576 - protein, 6 aa, Mycobacterium
VPTDPE

SEQ ID NO: 610577 - protein, 6 aa, Mycobacterium
VPTDQL

SEQ ID NO: 610578 - protein, 8 aa, Mycobacterium
VPTDTIGT

SEQ ID NO: 610579 - protein, 4 aa, Mycobacterium
VPTE

SEQ ID NO: 610580 - protein, 12 aa, Mycobacterium
VPTEARRRRQRT

SEQ ID NO: 610581 - protein, 8 aa, Mycobacterium
VPTEDERK

SEQ ID NO: 610582 - protein, 7 aa, Mycobacterium
VPTEGTA

SEQ ID NO: 610583 - protein, 8 aa, Mycobacterium
VPTEGTSV

SEQ ID NO: 610584 - protein, 5 aa, Mycobacterium
VPTEL

SEQ ID NO: 610585 - protein, 8 aa, Mycobacterium
VPTETAEA

SEQ ID NO: 610586 - protein, 19 aa, Mycobacterium
VPTGEDEEIQSSEAKVGPY

SEQ ID NO: 610587 - protein, 9 aa, Mycobacterium
VPTGEGPWP

SEQ ID NO: 610588 - protein, 9 aa, Mycobacterium
VPTGEQSSL

SEQ ID NO: 610589 - protein, 6 aa, Mycobacterium
VPTGGD

SEQ ID NO: 610590 - protein, 35 aa, Mycobacterium
VPTGGTAARSSGATGGATAGEASGPVNIFIVPAGA

SEQ ID NO: 610591 - protein, 13 aa, Mycobacterium
VPTGQARQAAEEL

SEQ ID NO: 610592 - protein, 6 aa, Mycobacterium
VPTGQK

SEQ ID NO: 610593 - protein, 11 aa, Mycobacterium
VPTGRAAGRVA

SEQ ID NO: 610594 - protein, 6 aa, Mycobacterium
VPTGRP

SEQ ID NO: 610595 - protein, 12 aa, Mycobacterium
VPTGSTGEQPES

SEQ ID NO: 610596 - protein, 8 aa, Mycobacterium
VPTGTDPR

SEQ ID NO: 610597 - protein, 9 aa, Mycobacterium
VPTGTPKQR

SEQ ID NO: 610598 - protein, 8 aa, Mycobacterium
VPTHAPGE

SEQ ID NO: 610599 - protein, 7 aa, Mycobacterium
VPTHTGD

SEQ ID NO: 610600 - protein, 11 aa, Mycobacterium
VPTIDGNNPDL

SEQ ID NO: 610601 - protein, 6 aa, Mycobacterium
VPTITT

SEQ ID NO: 610602 - protein, 4 aa, Mycobacterium
VPTK

SEQ ID NO: 610603 - protein, 7 aa, Mycobacterium
VPTKDDA

SEQ ID NO: 610604 - protein, 5 aa, Mycobacterium
VPTKI

SEQ ID NO: 610605 - protein, 6 aa, Mycobacterium
VPTKSL

SEQ ID NO: 610606 - protein, 5 aa, Mycobacterium
VPTND

SEQ ID NO: 610607 - protein, 5 aa, Mycobacterium
VPTNF

SEQ ID NO: 610608 - protein, 4 aa, Mycobacterium
VPTP

SEQ ID NO: 610609 - protein, 8 aa, Mycobacterium
VPTPAASE

SEQ ID NO: 610610 - protein, 23 aa, Mycobacterium
VPTPAGPFGRDEHPRPGTTAEAL

SEQ ID NO: 610611 - protein, 6 aa, Mycobacterium
VPTPAR

SEQ ID NO: 610612 - protein, 8 aa, Mycobacterium
VPTPAREG

SEQ ID NO: 610613 - protein, 6 aa, Mycobacterium
VPTPEN

SEQ ID NO: 610614 - protein, 7 aa, Mycobacterium
VPTPESY

SEQ ID NO: 610615 - protein, 14 aa, Mycobacterium
VPTPFQNGQRAEEI

SEQ ID NO: 610616 - protein, 8 aa, Mycobacterium
VPTPGGQV

SEQ ID NO: 610617 - protein, 9 aa, Mycobacterium
VPTPGGRAE

SEQ ID NO: 610618 - protein, 10 aa, Mycobacterium
VPTPGLKHRG

SEQ ID NO: 610619 - protein, 106 aa, Mycobacterium
VPTPGQPAPRPPGPKPFEPTPVNPHKPVTPGGPGTPVNPKPGAPVVPTPGGPTHPVTPGIPGTPGTPGIPGIPGTPITPGTPITPGKPVTPVTPGKPKPGKPDTPV

SEQ ID NO: 610620 - protein, 6 aa, Mycobacterium
VPTPIG

SEQ ID NO: 610621 - protein, 5 aa, Mycobacterium
VPTPL

SEQ ID NO: 610622 - protein, 29 aa, Mycobacterium
VPTPLPATEIGPTTSPPTVPPITTGGLVP

SEQ ID NO: 610623 - protein, 11 aa, Mycobacterium
VPTPQPGKGEV

SEQ ID NO: 610624 - protein, 7 aa, Mycobacterium
VPTPQVA

SEQ ID NO: 610625 - protein, 5 aa, Mycobacterium
VPTPR

SEQ ID NO: 610626 - protein, 9 aa, Mycobacterium
VPTPRRTNN

SEQ ID NO: 610627 - protein, 10 aa, Mycobacterium
VPTPRSYGID

SEQ ID NO: 610628 - protein, 5 aa, Mycobacterium
VPTPT

SEQ ID NO: 610629 - protein, 4 aa, Mycobacterium
VPTQ

SEQ ID NO: 610630 - protein, 5 aa, Mycobacterium
VPTQI

SEQ ID NO: 610631 - protein, 6 aa, Mycobacterium
VPTQVG

SEQ ID NO: 610632 - protein, 6 aa, Mycobacterium
VPTRDD

SEQ ID NO: 610633 - protein, 6 aa, Mycobacterium
VPTRDG

SEQ ID NO: 610634 - protein, 5 aa, Mycobacterium
VPTRI

SEQ ID NO: 610635 - protein, 11 aa, Mycobacterium
VPTRPGDDNPL

SEQ ID NO: 610636 - protein, 5 aa, Mycobacterium
VPTSA

SEQ ID NO: 610637 - protein, 5 aa, Mycobacterium
VPTSD

SEQ ID NO: 610638 - protein, 6 aa, Mycobacterium
VPTSEI

SEQ ID NO: 610639 - protein, 18 aa, Mycobacterium
VPTSGAEAEGGKSSDGSM

SEQ ID NO: 610640 - protein, 21 aa, Mycobacterium
VPTSPGRVTDSAEDAKTIAEE

SEQ ID NO: 610641 - protein, 7 aa, Mycobacterium
VPTSPQQ

SEQ ID NO: 610642 - protein, 18 aa, Mycobacterium
VPTSQAYASFTDDPISAA

SEQ ID NO: 610643 - protein, 17 aa, Mycobacterium
VPTTDEEQKAKDFTSDQ

SEQ ID NO: 610644 - protein, 5 aa, Mycobacterium
VPTTE

SEQ ID NO: 610645 - protein, 5 aa, Mycobacterium
VPTTG

SEQ ID NO: 610646 - protein, 8 aa, Mycobacterium
VPTTGSSF

SEQ ID NO: 610647 - protein, 21 aa, Mycobacterium
VPTTPGRVTDSAEDAKAIATE

SEQ ID NO: 610648 - protein, 17 aa, Mycobacterium
VPTTPGRVTDTAEGARA

SEQ ID NO: 610649 - protein, 21 aa, Mycobacterium
VPTTPGRVTTTAEDAKAIAEE

SEQ ID NO: 610650 - protein, 10 aa, Mycobacterium
VPTTPTHHDG

SEQ ID NO: 610651 - protein, 5 aa, Mycobacterium
VPTTT

SEQ ID NO: 610652 - protein, 7 aa, Mycobacterium
VPTTTAD

SEQ ID NO: 610653 - protein, 6 aa, Mycobacterium
VPTTTQ

SEQ ID NO: 610654 - protein, 12 aa, Mycobacterium
VPTVTVTSDTPV

SEQ ID NO: 610655 - protein, 4 aa, Mycobacterium
VPVA

SEQ ID NO: 610656 - protein, 6 aa, Mycobacterium
VPVAGG

SEQ ID NO: 610657 - protein, 18 aa, Mycobacterium
VPVDEPGQRRQRRVAGRA

SEQ ID NO: 610658 - protein, 14 aa, Mycobacterium
VPVDPSAVVAELGL

SEQ ID NO: 610659 - protein, 8 aa, Mycobacterium
VPVDTQSA

SEQ ID NO: 610660 - protein, 4 aa, Mycobacterium
VPVG

SEQ ID NO: 610661 - protein, 12 aa, Mycobacterium
VPVGAGLSSSAA

SEQ ID NO: 610662 - protein, 9 aa, Mycobacterium
VPVGDDDTW

SEQ ID NO: 610663 - protein, 17 aa, Mycobacterium
VPVGGSPVGAAVDPGTH

SEQ ID NO: 610664 - protein, 9 aa, Mycobacterium
VPVGNEEGE

SEQ ID NO: 610665 - protein, 8 aa, Mycobacterium
VPVGTTSA

SEQ ID NO: 610666 - protein, 10 aa, Mycobacterium
VPVPADSSQL

SEQ ID NO: 610667 - protein, 7 aa, Mycobacterium
VPVPDDA

SEQ ID NO: 610668 - protein, 6 aa, Mycobacterium
VPVPDP

SEQ ID NO: 610669 - protein, 27 aa, Mycobacterium
VPVPDVPGADVPAGAGGLPPHSALSPR

SEQ ID NO: 610670 - protein, 8 aa, Mycobacterium
VPVPGELG

SEQ ID NO: 610671 - protein, 6 aa, Mycobacterium
VPVPGG

SEQ ID NO: 610672 - protein, 9 aa, Mycobacterium
VPVPGGAHE

SEQ ID NO: 610673 - protein, 8 aa, Mycobacterium
VPVPPAPP

SEQ ID NO: 610674 - protein, 5 aa, Mycobacterium
VPVPR

SEQ ID NO: 610675 - protein, 18 aa, Mycobacterium
VPVQDNGTDVPVGRQPAA

SEQ ID NO: 610676 - protein, 6 aa, Mycobacterium
VPVRTD

SEQ ID NO: 610677 - protein, 8 aa, Mycobacterium
VPVSGEAT

SEQ ID NO: 610678 - protein, 12 aa, Mycobacterium
VPVSGTPGDVAR

SEQ ID NO: 610679 - protein, 5 aa, Mycobacterium
VPVTD

SEQ ID NO: 610680 - protein, 14 aa, Mycobacterium
VPWETDADGGEALT

SEQ ID NO: 610681 - protein, 4 aa, Mycobacterium
VPWP

SEQ ID NO: 610682 - protein, 12 aa, Mycobacterium
VPWTTDADGGEA

SEQ ID NO: 610683 - protein, 5 aa, Mycobacterium
VPYAG

SEQ ID NO: 610684 - protein, 6 aa, Mycobacterium
VPYAGD

SEQ ID NO: 610685 - protein, 8 aa, Mycobacterium
VPYDPAAA

SEQ ID NO: 610686 - protein, 7 aa, Mycobacterium
VPYGAET

SEQ ID NO: 610687 - protein, 15 aa, Mycobacterium
VPYGPDSRKQQDDNF

SEQ ID NO: 610688 - protein, 5 aa, Mycobacterium
VPYHT

SEQ ID NO: 610689 - protein, 12 aa, Mycobacterium
VPYKEATAAQLA

SEQ ID NO: 610690 - protein, 12 aa, Mycobacterium
VPYTGSLAPYGG

SEQ ID NO: 610691 - protein, 10 aa, Mycobacterium
VQAAAEPAVR

SEQ ID NO: 610692 - protein, 10 aa, Mycobacterium
VQAAATPEGL

SEQ ID NO: 610693 - protein, 9 aa, Mycobacterium
VQAAGGRLN

SEQ ID NO: 610694 - protein, 8 aa, Mycobacterium
VQAAGRQA

SEQ ID NO: 610695 - protein, 10 aa, Mycobacterium
VQAARTADAE

SEQ ID NO: 610696 - protein, 5 aa, Mycobacterium
VQAAS

SEQ ID NO: 610697 - protein, 4 aa, Mycobacterium
VQAD

SEQ ID NO: 610698 - protein, 5 aa, Mycobacterium
VQADG

SEQ ID NO: 610699 - protein, 11 aa, Mycobacterium
VQADPDGNATV

SEQ ID NO: 610700 - protein, 8 aa, Mycobacterium
VQADRDRA

SEQ ID NO: 610701 - protein, 4 aa, Mycobacterium
VQAE

SEQ ID NO: 610702 - protein, 17 aa, Mycobacterium
VQAEETAARARTAAAAY

SEQ ID NO: 610703 - protein, 13 aa, Mycobacterium
VQAEQAAKQAEAA

SEQ ID NO: 610704 - protein, 10 aa, Mycobacterium
VQAEQAASQV

SEQ ID NO: 610705 - protein, 18 aa, Mycobacterium
VQAEQTAVQAEAAAGAYE

SEQ ID NO: 610706 - protein, 5 aa, Mycobacterium
VQAGD

SEQ ID NO: 610707 - protein, 12 aa, Mycobacterium
VQAGDKNVEQAI

SEQ ID NO: 610708 - protein, 6 aa, Mycobacterium
VQAGDL

SEQ ID NO: 610709 - protein, 9 aa, Mycobacterium
VQAGEFDAS

SEQ ID NO: 610710 - protein, 11 aa, Mycobacterium
VQAGGAAGQAR

SEQ ID NO: 610711 - protein, 25 aa, Mycobacterium
VQAGGGVVADSNGPYEYNEARNKAR

SEQ ID NO: 610712 - protein, 25 aa, Mycobacterium
VQAGGGVVADSNGPYEYTEAANKAR

SEQ ID NO: 610713 - protein, 7 aa, Mycobacterium
VQAGHAG

SEQ ID NO: 610714 - protein, 7 aa, Mycobacterium
VQAGRGY

SEQ ID NO: 610715 - protein, 5 aa, Mycobacterium
VQAGT

SEQ ID NO: 610716 - protein, 9 aa, Mycobacterium
VQAKDALGR

SEQ ID NO: 610717 - protein, 8 aa, Mycobacterium
VQAPADVP

SEQ ID NO: 610718 - protein, 17 aa, Mycobacterium
VQAPATDPAPAAPSLRP

SEQ ID NO: 610719 - protein, 7 aa, Mycobacterium
VQAPEGL

SEQ ID NO: 610720 - protein, 5 aa, Mycobacterium
VQAPI

SEQ ID NO: 610721 - protein, 6 aa, Mycobacterium
VQAPNG

SEQ ID NO: 610722 - protein, 17 aa, Mycobacterium
VQAPQGPLGARTTDPAV

SEQ ID NO: 610723 - protein, 7 aa, Mycobacterium
VQAPTGL

SEQ ID NO: 610724 - protein, 19 aa, Mycobacterium
VQARNSSRRPGPTGAARRI

SEQ ID NO: 610725 - protein, 15 aa, Mycobacterium
VQASAGDELEINQET

SEQ ID NO: 610726 - protein, 7 aa, Mycobacterium
VQASDPG

SEQ ID NO: 610727 - protein, 9 aa, Mycobacterium
VQATDNPLK

SEQ ID NO: 610728 - protein, 21 aa, Mycobacterium
VQATLGDAQSLDPLRATTGSG

SEQ ID NO: 610729 - protein, 8 aa, Mycobacterium
VQATPPGW

SEQ ID NO: 610730 - protein, 23 aa, Mycobacterium
VQDAAKSAVEKVEGAAAPKDGDA

SEQ ID NO: 610731 - protein, 15 aa, Mycobacterium
VQDAAQRAVDARGGK

SEQ ID NO: 610732 - protein, 6 aa, Mycobacterium
VQDAPD

SEQ ID NO: 610733 - protein, 10 aa, Mycobacterium
VQDDAGGGYE

SEQ ID NO: 610734 - protein, 8 aa, Mycobacterium
VQDDIDSG

SEQ ID NO: 610735 - protein, 5 aa, Mycobacterium
VQDED

SEQ ID NO: 610736 - protein, 7 aa, Mycobacterium
VQDEGSQ

SEQ ID NO: 610737 - protein, 6 aa, Mycobacterium
VQDEND

SEQ ID NO: 610738 - protein, 5 aa, Mycobacterium
VQDGR

SEQ ID NO: 610739 - protein, 11 aa, Mycobacterium
VQDGRPRRAGV

SEQ ID NO: 610740 - protein, 6 aa, Mycobacterium
VQDGTT

SEQ ID NO: 610741 - protein, 7 aa, Mycobacterium
VQDIKGG

SEQ ID NO: 610742 - protein, 5 aa, Mycobacterium
VQDLR

SEQ ID NO: 610743 - protein, 9 aa, Mycobacterium
VQDPQTGRT

SEQ ID NO: 610744 - protein, 4 aa, Mycobacterium
VQDQ

SEQ ID NO: 610745 - protein, 10 aa, Mycobacterium
VQDQAGRLPD

SEQ ID NO: 610746 - protein, 5 aa, Mycobacterium
VQDRG

SEQ ID NO: 610747 - protein, 5 aa, Mycobacterium
VQDRT

SEQ ID NO: 610748 - protein, 8 aa, Mycobacterium
VQDSNQKH

SEQ ID NO: 610749 - protein, 9 aa, Mycobacterium
VQDTTARRM

SEQ ID NO: 610750 - protein, 4 aa, Mycobacterium
VQDV

SEQ ID NO: 610751 - protein, 4 aa, Mycobacterium
VQEA

SEQ ID NO: 610752 - protein, 12 aa, Mycobacterium
VQEAAATAARAG

SEQ ID NO: 610753 - protein, 13 aa, Mycobacterium
VQEAAATANRAGV

SEQ ID NO: 610754 - protein, 16 aa, Mycobacterium
VQEAATSALGASVGPE

SEQ ID NO: 610755 - protein, 10 aa, Mycobacterium
VQEAGAGTVS

SEQ ID NO: 610756 - protein, 8 aa, Mycobacterium
VQEANGEV

SEQ ID NO: 610757 - protein, 14 aa, Mycobacterium
VQEASKDALPLPKG

SEQ ID NO: 610758 - protein, 15 aa, Mycobacterium
VQEDGLRTRASLSGA

SEQ ID NO: 610759 - protein, 18 aa, Mycobacterium
VQEEAKKAAESAAKGDDQ

SEQ ID NO: 610760 - protein, 7 aa, Mycobacterium
VQEELEN

SEQ ID NO: 610761 - protein, 18 aa, Mycobacterium
VQEGAKKVAGPGAAGEQQ

SEQ ID NO: 610762 - protein, 20 aa, Mycobacterium
VQEGDDVLGPDGQPPITAKG

SEQ ID NO: 610763 - protein, 13 aa, Mycobacterium
VQEGPAGRKSVAH

SEQ ID NO: 610764 - protein, 6 aa, Mycobacterium
VQEGRS

SEQ ID NO: 610765 - protein, 7 aa, Mycobacterium
VQENNSA

SEQ ID NO: 610766 - protein, 7 aa, Mycobacterium
VQENPDQ

SEQ ID NO: 610767 - protein, 14 aa, Mycobacterium
VQEPDSGRATHTSG

SEQ ID NO: 610768 - protein, 7 aa, Mycobacterium
VQEPNGN

SEQ ID NO: 610769 - protein, 28 aa, Mycobacterium
VQEQAREDPRTDVTDEKSAPVDGLPDFN

SEQ ID NO: 610770 - protein, 4 aa, Mycobacterium
VQER

SEQ ID NO: 610771 - protein, 21 aa, Mycobacterium
VQERAGRVDTIDRDSSWAAKR

SEQ ID NO: 610772 - protein, 10 aa, Mycobacterium
VQERYEDRAR

SEQ ID NO: 610773 - protein, 14 aa, Mycobacterium
VQESGPVRGIPSGI

SEQ ID NO: 610774 - protein, 6 aa, Mycobacterium
VQETAG

SEQ ID NO: 610775 - protein, 4 aa, Mycobacterium
VQGD

SEQ ID NO: 610776 - protein, 8 aa, Mycobacterium
VQGDTDSE

SEQ ID NO: 610777 - protein, 4 aa, Mycobacterium
VQGE

SEQ ID NO: 610778 - protein, 6 aa, Mycobacterium
VQGEAA

SEQ ID NO: 610779 - protein, 14 aa, Mycobacterium
VQGGDSDGLEINQE

SEQ ID NO: 610780 - protein, 5 aa, Mycobacterium
VQGGE

SEQ ID NO: 610781 - protein, 6 aa, Mycobacterium
VQGGEN

SEQ ID NO: 610782 - protein, 9 aa, Mycobacterium
VQGGRPEAL

SEQ ID NO: 610783 - protein, 19 aa, Mycobacterium
VQGGRPEALGGLGGAAPDQ

SEQ ID NO: 610784 - protein, 19 aa, Mycobacterium
VQGGRPEALGGLGGAAPQQ

SEQ ID NO: 610785 - protein, 7 aa, Mycobacterium
VQGGTAD

SEQ ID NO: 610786 - protein, 7 aa, Mycobacterium
VQGGTQV

SEQ ID NO: 610787 - protein, 9 aa, Mycobacterium
VQGNRATDL

SEQ ID NO: 610788 - protein, 14 aa, Mycobacterium
VQGPETEHLLALAG

SEQ ID NO: 610789 - protein, 24 aa, Mycobacterium
VQGPNAGGHRGTFDPAAAPATQSL

SEQ ID NO: 610790 - protein, 6 aa, Mycobacterium
VQGPQA

SEQ ID NO: 610791 - protein, 9 aa, Mycobacterium
VQGRDDAAA

SEQ ID NO: 610792 - protein, 10 aa, Mycobacterium
VQGRGTSGRK

SEQ ID NO: 610793 - protein, 11 aa, Mycobacterium
VQGSASASNAL

SEQ ID NO: 610794 - protein, 5 aa, Mycobacterium
VQGSG

SEQ ID NO: 610795 - protein, 9 aa, Mycobacterium
VQGSPADIG

SEQ ID NO: 610796 - protein, 7 aa, Mycobacterium
VQGSPVS

SEQ ID NO: 610797 - protein, 9 aa, Mycobacterium
VQGSREGLA

SEQ ID NO: 610798 - protein, 7 aa, Mycobacterium
VQGSTDL

SEQ ID NO: 610799 - protein, 13 aa, Mycobacterium
VQGTSTIAGSTAT

SEQ ID NO: 610800 - protein, 4 aa, Mycobacterium
VQHG

SEQ ID NO: 610801 - protein, 4 aa, Mycobacterium
VQHR

SEQ ID NO: 610802 - protein, 9 aa, Mycobacterium
VQIPTGPGL

SEQ ID NO: 610803 - protein, 8 aa, Mycobacterium
VQKGPYGA

SEQ ID NO: 610804 - protein, 6 aa, Mycobacterium
VQKGRK

SEQ ID NO: 610805 - protein, 28 aa, Mycobacterium
VQKRSSHKESHGGHKEALRTARSSGTIT

SEQ ID NO: 610806 - protein, 17 aa, Mycobacterium
VQKRSSHKESRGGRKEA

SEQ ID NO: 610807 - protein, 16 aa, Mycobacterium
VQKRSSRKESRGGRKE

SEQ ID NO: 610808 - protein, 10 aa, Mycobacterium
VQKSSRYPGG

SEQ ID NO: 610809 - protein, 10 aa, Mycobacterium
VQKSTRYPGG

SEQ ID NO: 610810 - protein, 8 aa, Mycobacterium
VQKTGYDL

SEQ ID NO: 610811 - protein, 15 aa, Mycobacterium
VQNAAQNAVNTTGKQ

SEQ ID NO: 610812 - protein, 7 aa, Mycobacterium
VQNATGA

SEQ ID NO: 610813 - protein, 5 aa, Mycobacterium
VQNGD

SEQ ID NO: 610814 - protein, 7 aa, Mycobacterium
VQNGGTS

SEQ ID NO: 610815 - protein, 5 aa, Mycobacterium
VQNGT

SEQ ID NO: 610816 - protein, 9 aa, Mycobacterium
VQNPSEGAV

SEQ ID NO: 610817 - protein, 6 aa, Mycobacterium
VQNQPG

SEQ ID NO: 610818 - protein, 4 aa, Mycobacterium
VQNS

SEQ ID NO: 610819 - protein, 8 aa, Mycobacterium
VQNTGNGA

SEQ ID NO: 610820 - protein, 5 aa, Mycobacterium
VQNVE

SEQ ID NO: 610821 - protein, 14 aa, Mycobacterium
VQPAAGVRGEVPDR

SEQ ID NO: 610822 - protein, 13 aa, Mycobacterium
VQPADSSAAPREL

SEQ ID NO: 610823 - protein, 9 aa, Mycobacterium
VQPAEPEGI

SEQ ID NO: 610824 - protein, 12 aa, Mycobacterium
VQPAEPENFDPE

SEQ ID NO: 610825 - protein, 12 aa, Mycobacterium
VQPAEPENVDTE

SEQ ID NO: 610826 - protein, 6 aa, Mycobacterium
VQPAEQ

SEQ ID NO: 610827 - protein, 12 aa, Mycobacterium
VQPAESPDSERW

SEQ ID NO: 610828 - protein, 19 aa, Mycobacterium
VQPAPGAAGRGRGDGDRLR

SEQ ID NO: 610829 - protein, 11 aa, Mycobacterium
VQPASLGSSWE

SEQ ID NO: 610830 - protein, 15 aa, Mycobacterium
VQPATLAGPAPRPTV

SEQ ID NO: 610831 - protein, 9 aa, Mycobacterium
VQPCPNAPA

SEQ ID NO: 610832 - protein, 9 aa, Mycobacterium
VQPDDGPVD

SEQ ID NO: 610833 - protein, 5 aa, Mycobacterium
VQPDG

SEQ ID NO: 610834 - protein, 5 aa, Mycobacterium
VQPDR

SEQ ID NO: 610835 - protein, 7 aa, Mycobacterium
VQPDRSL

SEQ ID NO: 610836 - protein, 8 aa, Mycobacterium
VQPDSTIA

SEQ ID NO: 610837 - protein, 5 aa, Mycobacterium
VQPEE

SEQ ID NO: 610838 - protein, 36 aa, Mycobacterium
VQPEGDAGQWASPPFEPTESGGRLYGRGSADDKAGI

SEQ ID NO: 610839 - protein, 9 aa, Mycobacterium
VQPEGDPAQ

SEQ ID NO: 610840 - protein, 37 aa, Mycobacterium
VQPEGDPAQWDSPPFEPTERDGRLYGRGTADDKAGIA

SEQ ID NO: 610841 - protein, 10 aa, Mycobacterium
VQPEGDPDQW

SEQ ID NO: 610842 - protein, 36 aa, Mycobacterium
VQPEGDRDQWASPPFEPTERDGRLYGRGTADDKAGI

SEQ ID NO: 610843 - protein, 36 aa, Mycobacterium
VQPEGDRGQWTSPPFEPTERDGRLYGRGSADDKAGI

SEQ ID NO: 610844 - protein, 18 aa, Mycobacterium
VQPEGGESSEESVNLRLS

SEQ ID NO: 610845 - protein, 5 aa, Mycobacterium
VQPEL

SEQ ID NO: 610846 - protein, 14 aa, Mycobacterium
VQPELRKGRYPDRK

SEQ ID NO: 610847 - protein, 4 aa, Mycobacterium
VQPG

SEQ ID NO: 610848 - protein, 14 aa, Mycobacterium
VQPGDGVAPGPGLE

SEQ ID NO: 610849 - protein, 10 aa, Mycobacterium
VQPGDLSPGD

SEQ ID NO: 610850 - protein, 5 aa, Mycobacterium
VQPGE

SEQ ID NO: 610851 - protein, 6 aa, Mycobacterium
VQPGEP

SEQ ID NO: 610852 - protein, 5 aa, Mycobacterium
VQPGG

SEQ ID NO: 610853 - protein, 9 aa, Mycobacterium
VQPGGETRI

SEQ ID NO: 610854 - protein, 8 aa, Mycobacterium
VQPGGQGI

SEQ ID NO: 610855 - protein, 14 aa, Mycobacterium
VQPGMGGRQDPRWQ

SEQ ID NO: 610856 - protein, 17 aa, Mycobacterium
VQPGPIDTDMNPADGGL

SEQ ID NO: 610857 - protein, 16 aa, Mycobacterium
VQPGPIGTDMNPEDGQ

SEQ ID NO: 610858 - protein, 9 aa, Mycobacterium
VQPGPSENY

SEQ ID NO: 610859 - protein, 9 aa, Mycobacterium
VQPGPVPVP

SEQ ID NO: 610860 - protein, 10 aa, Mycobacterium
VQPGRRPRGP

SEQ ID NO: 610861 - protein, 29 aa, Mycobacterium
VQPGSISSGMTDGTGASRQSIGPGLPEDA

SEQ ID NO: 610862 - protein, 7 aa, Mycobacterium
VQPGSKH

SEQ ID NO: 610863 - protein, 10 aa, Mycobacterium
VQPGSKYTSL

SEQ ID NO: 610864 - protein, 10 aa, Mycobacterium
VQPGSRTPGL

SEQ ID NO: 610865 - protein, 6 aa, Mycobacterium
VQPGST

SEQ ID NO: 610866 - protein, 7 aa, Mycobacterium
VQPHAPG

SEQ ID NO: 610867 - protein, 10 aa, Mycobacterium
VQPHSGAQAN

SEQ ID NO: 610868 - protein, 12 aa, Mycobacterium
VQPHSGATANAS

SEQ ID NO: 610869 - protein, 9 aa, Mycobacterium
VQPLGQPDI

SEQ ID NO: 610870 - protein, 8 aa, Mycobacterium
VQPNGPGV

SEQ ID NO: 610871 - protein, 8 aa, Mycobacterium
VQPPADAI

SEQ ID NO: 610872 - protein, 16 aa, Mycobacterium
VQPPADTGEAYGLSPA

SEQ ID NO: 610873 - protein, 6 aa, Mycobacterium
VQPPGH

SEQ ID NO: 610874 - protein, 10 aa, Mycobacterium
VQPPGHEDGR

SEQ ID NO: 610875 - protein, 7 aa, Mycobacterium
VQPPGKK

SEQ ID NO: 610876 - protein, 12 aa, Mycobacterium
VQPPGKKSMNAA

SEQ ID NO: 610877 - protein, 8 aa, Mycobacterium
VQPPGVSD

SEQ ID NO: 610878 - protein, 7 aa, Mycobacterium
VQPPLAK

SEQ ID NO: 610879 - protein, 10 aa, Mycobacterium
VQPPLGGPGL

SEQ ID NO: 610880 - protein, 6 aa, Mycobacterium
VQPPPL

SEQ ID NO: 610881 - protein, 8 aa, Mycobacterium
VQPPPSDG

SEQ ID NO: 610882 - protein, 17 aa, Mycobacterium
VQPPTDTGEAHGLSPAS

SEQ ID NO: 610883 - protein, 5 aa, Mycobacterium
VQPPW

SEQ ID NO: 610884 - protein, 17 aa, Mycobacterium
VQPQDAEAIGADPGLAD

SEQ ID NO: 610885 - protein, 7 aa, Mycobacterium
VQPQGKK

SEQ ID NO: 610886 - protein, 8 aa, Mycobacterium
VQPQPEGL

SEQ ID NO: 610887 - protein, 5 aa, Mycobacterium
VQPQQ

SEQ ID NO: 610888 - protein, 24 aa, Mycobacterium
VQPRPDADPQHDNRPAAPRTVAGH

SEQ ID NO: 610889 - protein, 12 aa, Mycobacterium
VQPRPDGRGGTV

SEQ ID NO: 610890 - protein, 9 aa, Mycobacterium
VQPRSPFTG

SEQ ID NO: 610891 - protein, 10 aa, Mycobacterium
VQPRVSTDEP

SEQ ID NO: 610892 - protein, 16 aa, Mycobacterium
VQPSDDGSEYALIAEV

SEQ ID NO: 610893 - protein, 13 aa, Mycobacterium
VQPSEGGRRRRRD

SEQ ID NO: 610894 - protein, 16 aa, Mycobacterium
VQPSMSVESEQQVPRG

SEQ ID NO: 610895 - protein, 14 aa, Mycobacterium
VQPSPDARKGVAEM

SEQ ID NO: 610896 - protein, 51 aa, Mycobacterium
VQPSQGPRADAGGDPERVPDDDVDRRDADDEPDDLADDDVADLAGDGLPLT

SEQ ID NO: 610897 - protein, 9 aa, Mycobacterium
VQPSSQHNA

SEQ ID NO: 610898 - protein, 6 aa, Mycobacterium
VQPSSV

SEQ ID NO: 610899 - protein, 8 aa, Mycobacterium
VQPTASAR

SEQ ID NO: 610900 - protein, 14 aa, Mycobacterium
VQPTKQQTRRSKKT

SEQ ID NO: 610901 - protein, 13 aa, Mycobacterium
VQPTLDPDNSPHT

SEQ ID NO: 610902 - protein, 7 aa, Mycobacterium
VQPTREN

SEQ ID NO: 610903 - protein, 13 aa, Mycobacterium
VQPWEDARPAGRI

SEQ ID NO: 610904 - protein, 7 aa, Mycobacterium
VQQAADS

SEQ ID NO: 610905 - protein, 14 aa, Mycobacterium
VQQAGNSTGDKKGM

SEQ ID NO: 610906 - protein, 10 aa, Mycobacterium
VQQAQNTIPD

SEQ ID NO: 610907 - protein, 18 aa, Mycobacterium
VQQERDELARGTHAERRE

SEQ ID NO: 610908 - protein, 6 aa, Mycobacterium
VQQGAD

SEQ ID NO: 610909 - protein, 18 aa, Mycobacterium
VQQGTSSAGQAASGGQDF

SEQ ID NO: 610910 - protein, 15 aa, Mycobacterium
VQQIGTTDDIYNRPA

SEQ ID NO: 610911 - protein, 22 aa, Mycobacterium
VQQPAGNTAQAAADASSQLATP

SEQ ID NO: 610912 - protein, 6 aa, Mycobacterium
VQQPAS

SEQ ID NO: 610913 - protein, 18 aa, Mycobacterium
VQQPDGAAVAPQEAPEGL

SEQ ID NO: 610914 - protein, 7 aa, Mycobacterium
VQQPLPA

SEQ ID NO: 610915 - protein, 16 aa, Mycobacterium
VQQPRAGQRPTRRQAA

SEQ ID NO: 610916 - protein, 4 aa, Mycobacterium
VQQR

SEQ ID NO: 610917 - protein, 5 aa, Mycobacterium
VQQRA

SEQ ID NO: 610918 - protein, 18 aa, Mycobacterium
VQQRDTSTPQYEISDPQP

SEQ ID NO: 610919 - protein, 13 aa, Mycobacterium
VQQVGAPQELYDT

SEQ ID NO: 610920 - protein, 17 aa, Mycobacterium
VQQYGPQRPDGVEQRLR

SEQ ID NO: 610921 - protein, 13 aa, Mycobacterium
VQRAQQDRKRDQE

SEQ ID NO: 610922 - protein, 12 aa, Mycobacterium
VQRASAGGGPTL

SEQ ID NO: 610923 - protein, 7 aa, Mycobacterium
VQRATKD

SEQ ID NO: 610924 - protein, 28 aa, Mycobacterium
VQRDGSAALKQRKRNYPQGLSEVPSDDA

SEQ ID NO: 610925 - protein, 6 aa, Mycobacterium
VQRDNP

SEQ ID NO: 610926 - protein, 8 aa, Mycobacterium
VQRDPDGI

SEQ ID NO: 610927 - protein, 6 aa, Mycobacterium
VQRDPR

SEQ ID NO: 610928 - protein, 10 aa, Mycobacterium
VQREDGAVDR

SEQ ID NO: 610929 - protein, 6 aa, Mycobacterium
VQREGR

SEQ ID NO: 610930 - protein, 10 aa, Mycobacterium
VQRESARNPY

SEQ ID NO: 610931 - protein, 10 aa, Mycobacterium
VQRESSPQVR

SEQ ID NO: 610932 - protein, 6 aa, Mycobacterium
VQRGAD

SEQ ID NO: 610933 - protein, 5 aa, Mycobacterium
VQRGD

SEQ ID NO: 610934 - protein, 12 aa, Mycobacterium
VQRGGDRVAGAV

SEQ ID NO: 610935 - protein, 7 aa, Mycobacterium
VQRGGKQ

SEQ ID NO: 610936 - protein, 4 aa, Mycobacterium
VQRP

SEQ ID NO: 610937 - protein, 8 aa, Mycobacterium
VQRPDTQD

SEQ ID NO: 610938 - protein, 5 aa, Mycobacterium
VQRPR

SEQ ID NO: 610939 - protein, 16 aa, Mycobacterium
VQRPSSDDELGGRAGE

SEQ ID NO: 610940 - protein, 8 aa, Mycobacterium
VQRQSSAM

SEQ ID NO: 610941 - protein, 6 aa, Mycobacterium
VQRQYP

SEQ ID NO: 610942 - protein, 20 aa, Mycobacterium
VQRRADRRDTIDRDSAWRAK

SEQ ID NO: 610943 - protein, 5 aa, Mycobacterium
VQRRR

SEQ ID NO: 610944 - protein, 9 aa, Mycobacterium
VQRSAAHED

SEQ ID NO: 610945 - protein, 15 aa, Mycobacterium
VQRSADSPTDKSQRD

SEQ ID NO: 610946 - protein, 10 aa, Mycobacterium
VQRSAGVDAT

SEQ ID NO: 610947 - protein, 12 aa, Mycobacterium
VQRSATKDTELE

SEQ ID NO: 610948 - protein, 34 aa, Mycobacterium
VQRSEQPETWSERGESGSRDSAPSSTEEGGADPL

SEQ ID NO: 610949 - protein, 9 aa, Mycobacterium
VQRSERSQL

SEQ ID NO: 610950 - protein, 12 aa, Mycobacterium
VQRSSSGKIAGL

SEQ ID NO: 610951 - protein, 5 aa, Mycobacterium
VQRTE

SEQ ID NO: 610952 - protein, 22 aa, Mycobacterium
VQSADAPDADEQRELEARAAGL

SEQ ID NO: 610953 - protein, 8 aa, Mycobacterium
VQSADGSL

SEQ ID NO: 610954 - protein, 11 aa, Mycobacterium
VQSAPDLAGPH

SEQ ID NO: 610955 - protein, 12 aa, Mycobacterium
VQSARRGRRAAR

SEQ ID NO: 610956 - protein, 12 aa, Mycobacterium
VQSCPEQAISIE

SEQ ID NO: 610957 - protein, 8 aa, Mycobacterium
VQSEPYGT

SEQ ID NO: 610958 - protein, 13 aa, Mycobacterium
VQSESAGAQLPHG

SEQ ID NO: 610959 - protein, 7 aa, Mycobacterium
VQSETGI

SEQ ID NO: 610960 - protein, 8 aa, Mycobacterium
VQSETGIR

SEQ ID NO: 610961 - protein, 4 aa, Mycobacterium
VQSG

SEQ ID NO: 610962 - protein, 16 aa, Mycobacterium
VQSGDAPKPTLSIKVL

SEQ ID NO: 610963 - protein, 10 aa, Mycobacterium
VQSGGPATSE

SEQ ID NO: 610964 - protein, 14 aa, Mycobacterium
VQSGNLDAAKTTYA

SEQ ID NO: 610965 - protein, 7 aa, Mycobacterium
VQSGQDA

SEQ ID NO: 610966 - protein, 6 aa, Mycobacterium
VQSGQS

SEQ ID NO: 610967 - protein, 9 aa, Mycobacterium
VQSGTPRQW

SEQ ID NO: 610968 - protein, 13 aa, Mycobacterium
VQSMGGNGLTKEY

SEQ ID NO: 610969 - protein, 8 aa, Mycobacterium
VQSNHTRQ

SEQ ID NO: 610970 - protein, 7 aa, Mycobacterium
VQSPADA

SEQ ID NO: 610971 - protein, 12 aa, Mycobacterium
VQSPGAERLGDR

SEQ ID NO: 610972 - protein, 12 aa, Mycobacterium
VQSPGAQRLGDR

SEQ ID NO: 610973 - protein, 21 aa, Mycobacterium
VQSPGGQPSPETDPKVPSGPG

SEQ ID NO: 610974 - protein, 5 aa, Mycobacterium
VQSPQ

SEQ ID NO: 610975 - protein, 7 aa, Mycobacterium
VQSPRGG

SEQ ID NO: 610976 - protein, 7 aa, Mycobacterium
VQSQSRA

SEQ ID NO: 610977 - protein, 32 aa, Mycobacterium
VQSQTQPDDASADALRAAAPEARAEILEPVPL

SEQ ID NO: 610978 - protein, 17 aa, Mycobacterium
VQSRDNISGTHRDHPRF

SEQ ID NO: 610979 - protein, 6 aa, Mycobacterium
VQSRGG

SEQ ID NO: 610980 - protein, 10 aa, Mycobacterium
VQSRPRPQAL

SEQ ID NO: 610981 - protein, 14 aa, Mycobacterium
VQSSNSGLQEDGAA

SEQ ID NO: 610982 - protein, 13 aa, Mycobacterium
VQSSRTPVIVART

SEQ ID NO: 610983 - protein, 6 aa, Mycobacterium
VQTAEG

SEQ ID NO: 610984 - protein, 6 aa, Mycobacterium
VQTAER

SEQ ID NO: 610985 - protein, 5 aa, Mycobacterium
VQTAR

SEQ ID NO: 610986 - protein, 19 aa, Mycobacterium
VQTARRNAAEAASRMKPRA

SEQ ID NO: 610987 - protein, 8 aa, Mycobacterium
VQTATTDI

SEQ ID NO: 610988 - protein, 10 aa, Mycobacterium
VQTDSGDTVA

SEQ ID NO: 610989 - protein, 14 aa, Mycobacterium
VQTEEGEPWAENGR

SEQ ID NO: 610990 - protein, 9 aa, Mycobacterium
VQTEEIDAS

SEQ ID NO: 610991 - protein, 12 aa, Mycobacterium
VQTGDDHDAGEV

SEQ ID NO: 610992 - protein, 13 aa, Mycobacterium
VQTGGTLAGGLGA

SEQ ID NO: 610993 - protein, 13 aa, Mycobacterium
VQTGTGAGDDDLA

SEQ ID NO: 610994 - protein, 23 aa, Mycobacterium
VQTPARNLPPLDERDNPAHYCPR

SEQ ID NO: 610995 - protein, 5 aa, Mycobacterium
VQTPE

SEQ ID NO: 610996 - protein, 6 aa, Mycobacterium
VQTPQG

SEQ ID NO: 610997 - protein, 12 aa, Mycobacterium
VQTPSTSTSTVT

SEQ ID NO: 610998 - protein, 7 aa, Mycobacterium
VQTPYRK

SEQ ID NO: 610999 - protein, 7 aa, Mycobacterium
VQTRAPR

SEQ ID NO: 611000 - protein, 17 aa, Mycobacterium
VQTRASSVPGYTEITRS

SEQ ID NO: 611001 - protein, 5 aa, Mycobacterium
VQTRE

SEQ ID NO: 611002 - protein, 8 aa, Mycobacterium
VQTREGTP

SEQ ID NO: 611003 - protein, 5 aa, Mycobacterium
VQTRQ

SEQ ID NO: 611004 - protein, 5 aa, Mycobacterium
VQTSD

SEQ ID NO: 611005 - protein, 14 aa, Mycobacterium
VQTTATTASAAPTV

SEQ ID NO: 611006 - protein, 10 aa, Mycobacterium
VQVGDGETCS

SEQ ID NO: 611007 - protein, 5 aa, Mycobacterium
VQVNT

SEQ ID NO: 611008 - protein, 27 aa, Mycobacterium
VQVPASAPSPAPPSAPRAGASAVEPAA

SEQ ID NO: 611009 - protein, 10 aa, Mycobacterium
VQVPPDPAIP

SEQ ID NO: 611010 - protein, 8 aa, Mycobacterium
VQVPSSYE

SEQ ID NO: 611011 - protein, 5 aa, Mycobacterium
VQWGP

SEQ ID NO: 611012 - protein, 19 aa, Mycobacterium
VQYSKADEEQQQALSSQMG

SEQ ID NO: 611013 - protein, 16 aa, Mycobacterium
VRAAASAAEIAATGAD

SEQ ID NO: 611014 - protein, 14 aa, Mycobacterium
VRAADGTGEFGGRV

SEQ ID NO: 611015 - protein, 9 aa, Mycobacterium
VRAAEKLGA

SEQ ID NO: 611016 - protein, 22 aa, Mycobacterium
VRAAENAWNTRDPEGVAAAYTE

SEQ ID NO: 611017 - protein, 6 aa, Mycobacterium
VRAAGD

SEQ ID NO: 611018 - protein, 13 aa, Mycobacterium
VRAAGSPEIPSNE

SEQ ID NO: 611019 - protein, 15 aa, Mycobacterium
VRAARSSSALDGGTM

SEQ ID NO: 611020 - protein, 8 aa, Mycobacterium
VRAASGTE

SEQ ID NO: 611021 - protein, 5 aa, Mycobacterium
VRAAT

SEQ ID NO: 611022 - protein, 6 aa, Mycobacterium
VRAATD

SEQ ID NO: 611023 - protein, 4 aa, Mycobacterium
VRAD

SEQ ID NO: 611024 - protein, 8 aa, Mycobacterium
VRADNGGP

SEQ ID NO: 611025 - protein, 9 aa, Mycobacterium
VRADNTGYD

SEQ ID NO: 611026 - protein, 5 aa, Mycobacterium
VRADP

SEQ ID NO: 611027 - protein, 5 aa, Mycobacterium
VRADQ

SEQ ID NO: 611028 - protein, 22 aa, Mycobacterium
VRADQQPYGGVKESGNTREGPR

SEQ ID NO: 611029 - protein, 10 aa, Mycobacterium
VRADSAKRVA

SEQ ID NO: 611030 - protein, 4 aa, Mycobacterium
VRAE

SEQ ID NO: 611031 - protein, 9 aa, Mycobacterium
VRAEAGKGL

SEQ ID NO: 611032 - protein, 13 aa, Mycobacterium
VRAEGPNGEPGWK

SEQ ID NO: 611033 - protein, 12 aa, Mycobacterium
VRAEKASERSVD

SEQ ID NO: 611034 - protein, 8 aa, Mycobacterium
VRAERHGD

SEQ ID NO: 611035 - protein, 12 aa, Mycobacterium
VRAERPRNARGL

SEQ ID NO: 611036 - protein, 9 aa, Mycobacterium
VRAESAKRV

SEQ ID NO: 611037 - protein, 6 aa, Mycobacterium
VRAESV

SEQ ID NO: 611038 - protein, 9 aa, Mycobacterium
VRAGARKTA

SEQ ID NO: 611039 - protein, 6 aa, Mycobacterium
VRAGDL

SEQ ID NO: 611040 - protein, 15 aa, Mycobacterium
VRAGDSGGPVVSSTG

SEQ ID NO: 611041 - protein, 6 aa, Mycobacterium
VRAGEH

SEQ ID NO: 611042 - protein, 6 aa, Mycobacterium
VRAGEK

SEQ ID NO: 611043 - protein, 8 aa, Mycobacterium
VRAGEPEF

SEQ ID NO: 611044 - protein, 5 aa, Mycobacterium
VRAGG

SEQ ID NO: 611045 - protein, 7 aa, Mycobacterium
VRAGGDA

SEQ ID NO: 611046 - protein, 10 aa, Mycobacterium
VRAGGGPESN

SEQ ID NO: 611047 - protein, 13 aa, Mycobacterium
VRAGGHDISDADV

SEQ ID NO: 611048 - protein, 8 aa, Mycobacterium
VRAGPGLE

SEQ ID NO: 611049 - protein, 8 aa, Mycobacterium
VRAGRDGI

SEQ ID NO: 611050 - protein, 9 aa, Mycobacterium
VRAGRGPRC

SEQ ID NO: 611051 - protein, 7 aa, Mycobacterium
VRAGRRP

SEQ ID NO: 611052 - protein, 8 aa, Mycobacterium
VRAGSDAV

SEQ ID NO: 611053 - protein, 7 aa, Mycobacterium
VRAGSGV

SEQ ID NO: 611054 - protein, 7 aa, Mycobacterium
VRAGTAP

SEQ ID NO: 611055 - protein, 10 aa, Mycobacterium
VRAGTTDTTI

SEQ ID NO: 611056 - protein, 14 aa, Mycobacterium
VRAGTVKPSADPRA

SEQ ID NO: 611057 - protein, 13 aa, Mycobacterium
VRAHSSDDAAAAL

SEQ ID NO: 611058 - protein, 7 aa, Mycobacterium
VRANGVD

SEQ ID NO: 611059 - protein, 10 aa, Mycobacterium
VRANPDARVS

SEQ ID NO: 611060 - protein, 7 aa, Mycobacterium
VRANTDA

SEQ ID NO: 611061 - protein, 8 aa, Mycobacterium
VRAPDGHT

SEQ ID NO: 611062 - protein, 10 aa, Mycobacterium
VRAPEDDDPL

SEQ ID NO: 611063 - protein, 5 aa, Mycobacterium
VRAPG

SEQ ID NO: 611064 - protein, 14 aa, Mycobacterium
VRAPGAHPRGPSLA

SEQ ID NO: 611065 - protein, 12 aa, Mycobacterium
VRAPGKPGDRAT

SEQ ID NO: 611066 - protein, 15 aa, Mycobacterium
VRAPRARMTGSERRQ

SEQ ID NO: 611067 - protein, 12 aa, Mycobacterium
VRAPSGGNTQPW

SEQ ID NO: 611068 - protein, 18 aa, Mycobacterium
VRAPTATVRGWDSMPAIV

SEQ ID NO: 611069 - protein, 12 aa, Mycobacterium
VRAPTDGGYGTT

SEQ ID NO: 611070 - protein, 24 aa, Mycobacterium
VRAPTPSAPSGLGMPRRTQTRAQV

SEQ ID NO: 611071 - protein, 11 aa, Mycobacterium
VRAQASAAIAD

SEQ ID NO: 611072 - protein, 12 aa, Mycobacterium
VRAQASAAIEDG

SEQ ID NO: 611073 - protein, 33 aa, Mycobacterium
VRAQQDAQKREAEAAARRDAERQKTQADIDAQR

SEQ ID NO: 611074 - protein, 5 aa, Mycobacterium
VRARG

SEQ ID NO: 611075 - protein, 5 aa, Mycobacterium
VRARQ

SEQ ID NO: 611076 - protein, 11 aa, Mycobacterium
VRARTDATAVG

SEQ ID NO: 611077 - protein, 5 aa, Mycobacterium
VRASG

SEQ ID NO: 611078 - protein, 9 aa, Mycobacterium
VRASGRKAL

SEQ ID NO: 611079 - protein, 6 aa, Mycobacterium
VRASQP

SEQ ID NO: 611080 - protein, 6 aa, Mycobacterium
VRATEA

SEQ ID NO: 611081 - protein, 12 aa, Mycobacterium
VRATGSPEVPAN

SEQ ID NO: 611082 - protein, 22 aa, Mycobacterium
VRATNGAKSGSKTAKAATPVEA

SEQ ID NO: 611083 - protein, 7 aa, Mycobacterium
VRATNNH

SEQ ID NO: 611084 - protein, 11 aa, Mycobacterium
VRATNPDGKDV

SEQ ID NO: 611085 - protein, 9 aa, Mycobacterium
VRATPDARV

SEQ ID NO: 611086 - protein, 7 aa, Mycobacterium
VRATPSI

SEQ ID NO: 611087 - protein, 6 aa, Mycobacterium
VRATRD

SEQ ID NO: 611088 - protein, 14 aa, Mycobacterium
VRATTDAAEALGGA

SEQ ID NO: 611089 - protein, 8 aa, Mycobacterium
VRATTDAD

SEQ ID NO: 611090 - protein, 12 aa, Mycobacterium
VRATYEGLTGAE

SEQ ID NO: 611091 - protein, 9 aa, Mycobacterium
VRATYGPNY

SEQ ID NO: 611092 - protein, 8 aa, Mycobacterium
VRDAADGC

SEQ ID NO: 611093 - protein, 9 aa, Mycobacterium
VRDAAERGD

SEQ ID NO: 611094 - protein, 10 aa, Mycobacterium
VRDAALGKPG

SEQ ID NO: 611095 - protein, 7 aa, Mycobacterium
VRDADAL

SEQ ID NO: 611096 - protein, 7 aa, Mycobacterium
VRDADQV

SEQ ID NO: 611097 - protein, 9 aa, Mycobacterium
VRDAENEHK

SEQ ID NO: 611098 - protein, 5 aa, Mycobacterium
VRDAG

SEQ ID NO: 611099 - protein, 20 aa, Mycobacterium
VRDAGGQAGDRDSNRSRGDK

SEQ ID NO: 611100 - protein, 20 aa, Mycobacterium
VRDAGLESAGRRGPGGGLPI

SEQ ID NO: 611101 - protein, 18 aa, Mycobacterium
VRDAGLESAGRRGTGGRL

SEQ ID NO: 611102 - protein, 16 aa, Mycobacterium
VRDAGLESGGRLGAEG

SEQ ID NO: 611103 - protein, 19 aa, Mycobacterium
VRDAGLTSAGRRGPAGGLP

SEQ ID NO: 611104 - protein, 10 aa, Mycobacterium
VRDAGNSDDV

SEQ ID NO: 611105 - protein, 9 aa, Mycobacterium
VRDARNSEE

SEQ ID NO: 611106 - protein, 6 aa, Mycobacterium
VRDASK

SEQ ID NO: 611107 - protein, 10 aa, Mycobacterium
VRDATNSDEV

SEQ ID NO: 611108 - protein, 9 aa, Mycobacterium
VRDATNSED

SEQ ID NO: 611109 - protein, 8 aa, Mycobacterium
VRDDGPGE

SEQ ID NO: 611110 - protein, 9 aa, Mycobacterium
VRDDGSTAR

SEQ ID NO: 611111 - protein, 8 aa, Mycobacterium
VRDDHGPA

SEQ ID NO: 611112 - protein, 12 aa, Mycobacterium
VRDDPAGERIAG

SEQ ID NO: 611113 - protein, 6 aa, Mycobacterium
VRDDPS

SEQ ID NO: 611114 - protein, 15 aa, Mycobacterium
VRDDRTAALSDAEDV

SEQ ID NO: 611115 - protein, 8 aa, Mycobacterium
VRDEAEIR

SEQ ID NO: 611116 - protein, 5 aa, Mycobacterium
VRDED

SEQ ID NO: 611117 - protein, 20 aa, Mycobacterium
VRDEHSSSHANADVTCRVKS

SEQ ID NO: 611118 - protein, 12 aa, Mycobacterium
VRDEPEGLTADE

SEQ ID NO: 611119 - protein, 14 aa, Mycobacterium
VRDESDRLGDGPLD

SEQ ID NO: 611120 - protein, 7 aa, Mycobacterium
VRDFSSG

SEQ ID NO: 611121 - protein, 20 aa, Mycobacterium
VRDGADEVAGADRRAAGGWA

SEQ ID NO: 611122 - protein, 7 aa, Mycobacterium
VRDGAGD

SEQ ID NO: 611123 - protein, 9 aa, Mycobacterium
VRDGDADRA

SEQ ID NO: 611124 - protein, 7 aa, Mycobacterium
VRDGEAD

SEQ ID NO: 611125 - protein, 7 aa, Mycobacterium
VRDGGYR

SEQ ID NO: 611126 - protein, 7 aa, Mycobacterium
VRDGHRN

SEQ ID NO: 611127 - protein, 6 aa, Mycobacterium
VRDGNT

SEQ ID NO: 611128 - protein, 8 aa, Mycobacterium
VRDGPDGT

SEQ ID NO: 611129 - protein, 9 aa, Mycobacterium
VRDGPGGQL

SEQ ID NO: 611130 - protein, 6 aa, Mycobacterium
VRDGRG

SEQ ID NO: 611131 - protein, 6 aa, Mycobacterium
VRDGSA

SEQ ID NO: 611132 - protein, 10 aa, Mycobacterium
VRDGSGPDAD

SEQ ID NO: 611133 - protein, 5 aa, Mycobacterium
VRDGT

SEQ ID NO: 611134 - protein, 7 aa, Mycobacterium
VRDGTAD

SEQ ID NO: 611135 - protein, 9 aa, Mycobacterium
VRDGTPDEF

SEQ ID NO: 611136 - protein, 8 aa, Mycobacterium
VRDHPGTT

SEQ ID NO: 611137 - protein, 17 aa, Mycobacterium
VRDKTEPPLAPATTGRH

SEQ ID NO: 611138 - protein, 9 aa, Mycobacterium
VRDKTGPAR

SEQ ID NO: 611139 - protein, 8 aa, Mycobacterium
VRDNGAGR

SEQ ID NO: 611140 - protein, 9 aa, Mycobacterium
VRDNGGGTV

SEQ ID NO: 611141 - protein, 10 aa, Mycobacterium
VRDNGRAAGG

SEQ ID NO: 611142 - protein, 11 aa, Mycobacterium
VRDNSRRATAV

SEQ ID NO: 611143 - protein, 8 aa, Mycobacterium
VRDPADRR

SEQ ID NO: 611144 - protein, 15 aa, Mycobacterium
VRDPAGTMIRIQERA

SEQ ID NO: 611145 - protein, 12 aa, Mycobacterium
VRDPDDASATAR

SEQ ID NO: 611146 - protein, 16 aa, Mycobacterium
VRDPDGRVLSLQAPIG

SEQ ID NO: 611147 - protein, 7 aa, Mycobacterium
VRDPDTI

SEQ ID NO: 611148 - protein, 7 aa, Mycobacterium
VRDPEGN

SEQ ID NO: 611149 - protein, 7 aa, Mycobacterium
VRDPGSL

SEQ ID NO: 611150 - protein, 12 aa, Mycobacterium
VRDPQPERTTRI

SEQ ID NO: 611151 - protein, 9 aa, Mycobacterium
VRDPSNRVS

SEQ ID NO: 611152 - protein, 7 aa, Mycobacterium
VRDPTEA

SEQ ID NO: 611153 - protein, 20 aa, Mycobacterium
VRDQQSTNGKHALASCLVKA

SEQ ID NO: 611154 - protein, 14 aa, Mycobacterium
VRDQTGDWDAAGQS

SEQ ID NO: 611155 - protein, 14 aa, Mycobacterium
VRDQTGDWGTVGQT

SEQ ID NO: 611156 - protein, 4 aa, Mycobacterium
VRDR

SEQ ID NO: 611157 - protein, 6 aa, Mycobacterium
VRDRDA

SEQ ID NO: 611158 - protein, 6 aa, Mycobacterium
VRDRDD

SEQ ID NO: 611159 - protein, 16 aa, Mycobacterium
VRDRGGNSVLNRGSAT

SEQ ID NO: 611160 - protein, 15 aa, Mycobacterium
VRDRTAALEDANEEI

SEQ ID NO: 611161 - protein, 14 aa, Mycobacterium
VRDRTAAVEQANEE

SEQ ID NO: 611162 - protein, 12 aa, Mycobacterium
VRDRTGDPNAWQ

SEQ ID NO: 611163 - protein, 8 aa, Mycobacterium
VRDSAASY

SEQ ID NO: 611164 - protein, 7 aa, Mycobacterium
VRDSDAR

SEQ ID NO: 611165 - protein, 9 aa, Mycobacterium
VRDSERDLQ

SEQ ID NO: 611166 - protein, 8 aa, Mycobacterium
VRDSGTAL

SEQ ID NO: 611167 - protein, 8 aa, Mycobacterium
VRDSRTAT

SEQ ID NO: 611168 - protein, 15 aa, Mycobacterium
VRDSSTNTFREQGER

SEQ ID NO: 611169 - protein, 9 aa, Mycobacterium
VRDSTVSAA

SEQ ID NO: 611170 - protein, 7 aa, Mycobacterium
VRDTDNV

SEQ ID NO: 611171 - protein, 7 aa, Mycobacterium
VRDTGAA

SEQ ID NO: 611172 - protein, 6 aa, Mycobacterium
VRDTGG

SEQ ID NO: 611173 - protein, 7 aa, Mycobacterium
VRDTKAR

SEQ ID NO: 611174 - protein, 14 aa, Mycobacterium
VRDTKRSRRLESDV

SEQ ID NO: 611175 - protein, 14 aa, Mycobacterium
VRDTQRSRRLANDV

SEQ ID NO: 611176 - protein, 5 aa, Mycobacterium
VRDTR

SEQ ID NO: 611177 - protein, 8 aa, Mycobacterium
VRDTRGAA

SEQ ID NO: 611178 - protein, 5 aa, Mycobacterium
VRDTY

SEQ ID NO: 611179 - protein, 11 aa, Mycobacterium
VRDVSPEAIGG

SEQ ID NO: 611180 - protein, 4 aa, Mycobacterium
VREA

SEQ ID NO: 611181 - protein, 10 aa, Mycobacterium
VREAENSDDV

SEQ ID NO: 611182 - protein, 9 aa, Mycobacterium
VREAENSED

SEQ ID NO: 611183 - protein, 6 aa, Mycobacterium
VREAGA

SEQ ID NO: 611184 - protein, 12 aa, Mycobacterium
VREAGAASRAQT

SEQ ID NO: 611185 - protein, 8 aa, Mycobacterium
VREAGGTV

SEQ ID NO: 611186 - protein, 18 aa, Mycobacterium
VREAPGEPVAPVSGAVGG

SEQ ID NO: 611187 - protein, 4 aa, Mycobacterium
VRED

SEQ ID NO: 611188 - protein, 6 aa, Mycobacterium
VREDDD

SEQ ID NO: 611189 - protein, 15 aa, Mycobacterium
VREDGSAKVVTTTDA

SEQ ID NO: 611190 - protein, 9 aa, Mycobacterium
VREDQRRGA

SEQ ID NO: 611191 - protein, 4 aa, Mycobacterium
VREE

SEQ ID NO: 611192 - protein, 5 aa, Mycobacterium
VREEG

SEQ ID NO: 611193 - protein, 10 aa, Mycobacterium
VREELAPKGV

SEQ ID NO: 611194 - protein, 5 aa, Mycobacterium
VREET

SEQ ID NO: 611195 - protein, 7 aa, Mycobacterium
VREETGH

SEQ ID NO: 611196 - protein, 4 aa, Mycobacterium
VREG

SEQ ID NO: 611197 - protein, 7 aa, Mycobacterium
VREGAGE

SEQ ID NO: 611198 - protein, 15 aa, Mycobacterium
VREGAKHAGDSDPYR

SEQ ID NO: 611199 - protein, 19 aa, Mycobacterium
VREGAPGERAMPYGGAPIN

SEQ ID NO: 611200 - protein, 12 aa, Mycobacterium
VREGDPAPDGAG

SEQ ID NO: 611201 - protein, 9 aa, Mycobacterium
VREGDPFGG

SEQ ID NO: 611202 - protein, 10 aa, Mycobacterium
VREGGPVAAG

SEQ ID NO: 611203 - protein, 22 aa, Mycobacterium
VREGGSGDRGAPYGGAPTPVNG

SEQ ID NO: 611204 - protein, 9 aa, Mycobacterium
VREGKASQQ

SEQ ID NO: 611205 - protein, 12 aa, Mycobacterium
VREGKKAAGQAA

SEQ ID NO: 611206 - protein, 7 aa, Mycobacterium
VREGPAA

SEQ ID NO: 611207 - protein, 13 aa, Mycobacterium
VREGQPTEDARSG

SEQ ID NO: 611208 - protein, 6 aa, Mycobacterium
VREGRA

SEQ ID NO: 611209 - protein, 6 aa, Mycobacterium
VREGRD

SEQ ID NO: 611210 - protein, 6 aa, Mycobacterium
VREGRE

SEQ ID NO: 611211 - protein, 7 aa, Mycobacterium
VREGREG

SEQ ID NO: 611212 - protein, 12 aa, Mycobacterium
VREGRTGPGPVN

SEQ ID NO: 611213 - protein, 11 aa, Mycobacterium
VREGSEEYLDS

SEQ ID NO: 611214 - protein, 4 aa, Mycobacterium
VREH

SEQ ID NO: 611215 - protein, 8 aa, Mycobacterium
VREHGTPT

SEQ ID NO: 611216 - protein, 12 aa, Mycobacterium
VREHPGTRVASA

SEQ ID NO: 611217 - protein, 4 aa, Mycobacterium
VREI

SEQ ID NO: 611218 - protein, 7 aa, Mycobacterium
VREKEAQ

SEQ ID NO: 611219 - protein, 7 aa, Mycobacterium
VREKETQ

SEQ ID NO: 611220 - protein, 5 aa, Mycobacterium
VREMS

SEQ ID NO: 611221 - protein, 5 aa, Mycobacterium
VREPE

SEQ ID NO: 611222 - protein, 9 aa, Mycobacterium
VREPNGTTR

SEQ ID NO: 611223 - protein, 12 aa, Mycobacterium
VREPRQPRRATA

SEQ ID NO: 611224 - protein, 4 aa, Mycobacterium
VREQ

SEQ ID NO: 611225 - protein, 5 aa, Mycobacterium
VREQA

SEQ ID NO: 611226 - protein, 7 aa, Mycobacterium
VREQDVG

SEQ ID NO: 611227 - protein, 11 aa, Mycobacterium
VREQKASGAAD

SEQ ID NO: 611228 - protein, 7 aa, Mycobacterium
VREQNGD

SEQ ID NO: 611229 - protein, 7 aa, Mycobacterium
VREQNGR

SEQ ID NO: 611230 - protein, 14 aa, Mycobacterium
VREQTQRRKATRRA

SEQ ID NO: 611231 - protein, 13 aa, Mycobacterium
VREQTRHRREERK

SEQ ID NO: 611232 - protein, 9 aa, Mycobacterium
VRERAPDRA

SEQ ID NO: 611233 - protein, 13 aa, Mycobacterium
VRERLDPSTRAHD

SEQ ID NO: 611234 - protein, 6 aa, Mycobacterium
VRERPG

SEQ ID NO: 611235 - protein, 7 aa, Mycobacterium
VRERQTR

SEQ ID NO: 611236 - protein, 8 aa, Mycobacterium
VRERSRTT

SEQ ID NO: 611237 - protein, 9 aa, Mycobacterium
VRESDGLAL

SEQ ID NO: 611238 - protein, 7 aa, Mycobacterium
VRESDTV

SEQ ID NO: 611239 - protein, 5 aa, Mycobacterium
VRESG

SEQ ID NO: 611240 - protein, 12 aa, Mycobacterium
VRESGQGREGGW

SEQ ID NO: 611241 - protein, 5 aa, Mycobacterium
VRESN

SEQ ID NO: 611242 - protein, 7 aa, Mycobacterium
VRESPAL

SEQ ID NO: 611243 - protein, 14 aa, Mycobacterium
VRESRVDDRAQEFP

SEQ ID NO: 611244 - protein, 12 aa, Mycobacterium
VRESTVGGSSET

SEQ ID NO: 611245 - protein, 12 aa, Mycobacterium
VRETEGPQPVLD

SEQ ID NO: 611246 - protein, 8 aa, Mycobacterium
VRETGSAV

SEQ ID NO: 611247 - protein, 12 aa, Mycobacterium
VRETHGGTSIET

SEQ ID NO: 611248 - protein, 9 aa, Mycobacterium
VRETSGRTR

SEQ ID NO: 611249 - protein, 10 aa, Mycobacterium
VRETSSDQPL

SEQ ID NO: 611250 - protein, 8 aa, Mycobacterium
VRETTGGV

SEQ ID NO: 611251 - protein, 4 aa, Mycobacterium
VRGA

SEQ ID NO: 611252 - protein, 5 aa, Mycobacterium
VRGAA

SEQ ID NO: 611253 - protein, 8 aa, Mycobacterium
VRGAAEAE

SEQ ID NO: 611254 - protein, 7 aa, Mycobacterium
VRGAAGA

SEQ ID NO: 611255 - protein, 24 aa, Mycobacterium
VRGADDDVAAPATEVAGSDALPEP

SEQ ID NO: 611256 - protein, 11 aa, Mycobacterium
VRGADPADYRR

SEQ ID NO: 611257 - protein, 16 aa, Mycobacterium
VRGAGRTARDDDPDFG

SEQ ID NO: 611258 - protein, 9 aa, Mycobacterium
VRGANTNNL

SEQ ID NO: 611259 - protein, 6 aa, Mycobacterium
VRGATG

SEQ ID NO: 611260 - protein, 8 aa, Mycobacterium
VRGATGLS

SEQ ID NO: 611261 - protein, 6 aa, Mycobacterium
VRGDDI

SEQ ID NO: 611262 - protein, 7 aa, Mycobacterium
VRGDGAF

SEQ ID NO: 611263 - protein, 14 aa, Mycobacterium
VRGDGGVLKNSDDD

SEQ ID NO: 611264 - protein, 6 aa, Mycobacterium
VRGDGH

SEQ ID NO: 611265 - protein, 14 aa, Mycobacterium
VRGDKDHPASRGYT

SEQ ID NO: 611266 - protein, 13 aa, Mycobacterium
VRGDLRADSDTDA

SEQ ID NO: 611267 - protein, 10 aa, Mycobacterium
VRGDPSKSVS

SEQ ID NO: 611268 - protein, 7 aa, Mycobacterium
VRGDTQR

SEQ ID NO: 611269 - protein, 6 aa, Mycobacterium
VRGDTR

SEQ ID NO: 611270 - protein, 4 aa, Mycobacterium
VRGE

SEQ ID NO: 611271 - protein, 11 aa, Mycobacterium
VRGEAAQTEFD

SEQ ID NO: 611272 - protein, 13 aa, Mycobacterium
VRGEGEDLDLEEG

SEQ ID NO: 611273 - protein, 7 aa, Mycobacterium
VRGEGRV

SEQ ID NO: 611274 - protein, 9 aa, Mycobacterium
VRGEKRTAV

SEQ ID NO: 611275 - protein, 5 aa, Mycobacterium
VRGEP

SEQ ID NO: 611276 - protein, 11 aa, Mycobacterium
VRGEPPPPTAK

SEQ ID NO: 611277 - protein, 5 aa, Mycobacterium
VRGEQ

SEQ ID NO: 611278 - protein, 5 aa, Mycobacterium
VRGGA

SEQ ID NO: 611279 - protein, 9 aa, Mycobacterium
VRGGADAST

SEQ ID NO: 611280 - protein, 7 aa, Mycobacterium
VRGGAKI

SEQ ID NO: 611281 - protein, 5 aa, Mycobacterium
VRGGD

SEQ ID NO: 611282 - protein, 9 aa, Mycobacterium
VRGGDRSAL

SEQ ID NO: 611283 - protein, 9 aa, Mycobacterium
VRGGDTVAA

SEQ ID NO: 611284 - protein, 10 aa, Mycobacterium
VRGGEKVRRS

SEQ ID NO: 611285 - protein, 10 aa, Mycobacterium
VRGGGDTDTV

SEQ ID NO: 611286 - protein, 6 aa, Mycobacterium
VRGGGG

SEQ ID NO: 611287 - protein, 8 aa, Mycobacterium
VRGGGGIE

SEQ ID NO: 611288 - protein, 11 aa, Mycobacterium
VRGGGRAEEPL

SEQ ID NO: 611289 - protein, 12 aa, Mycobacterium
VRGGISTDESLT

SEQ ID NO: 611290 - protein, 6 aa, Mycobacterium
VRGGKP

SEQ ID NO: 611291 - protein, 6 aa, Mycobacterium
VRGGRA

SEQ ID NO: 611292 - protein, 7 aa, Mycobacterium
VRGGSIP

SEQ ID NO: 611293 - protein, 7 aa, Mycobacterium
VRGGWRS

SEQ ID NO: 611294 - protein, 7 aa, Mycobacterium
VRGKSRD

SEQ ID NO: 611295 - protein, 10 aa, Mycobacterium
VRGKSRTETI

SEQ ID NO: 611296 - protein, 7 aa, Mycobacterium
VRGKVGD

SEQ ID NO: 611297 - protein, 4 aa, Mycobacterium
VRGL

SEQ ID NO: 611298 - protein, 7 aa, Mycobacterium
VRGLEQR

SEQ ID NO: 611299 - protein, 14 aa, Mycobacterium
VRGMQGDKKARSVR

SEQ ID NO: 611300 - protein, 4 aa, Mycobacterium
VRGN

SEQ ID NO: 611301 - protein, 5 aa, Mycobacterium
VRGNH

SEQ ID NO: 611302 - protein, 8 aa, Mycobacterium
VRGNQGVR

SEQ ID NO: 611303 - protein, 4 aa, Mycobacterium
VRGP

SEQ ID NO: 611304 - protein, 6 aa, Mycobacterium
VRGPDG

SEQ ID NO: 611305 - protein, 12 aa, Mycobacterium
VRGPDGAHTPAH

SEQ ID NO: 611306 - protein, 6 aa, Mycobacterium
VRGPDS

SEQ ID NO: 611307 - protein, 6 aa, Mycobacterium
VRGPGA

SEQ ID NO: 611308 - protein, 7 aa, Mycobacterium
VRGPGAD

SEQ ID NO: 611309 - protein, 11 aa, Mycobacterium
VRGPHRGGDTR

SEQ ID NO: 611310 - protein, 7 aa, Mycobacterium
VRGPLTR

SEQ ID NO: 611311 - protein, 15 aa, Mycobacterium
VRGPNDGGWTTSRPR

SEQ ID NO: 611312 - protein, 17 aa, Mycobacterium
VRGPQTPSLPIADGPKH

SEQ ID NO: 611313 - protein, 20 aa, Mycobacterium
VRGPSADVAPEPQPTPQVEQ

SEQ ID NO: 611314 - protein, 5 aa, Mycobacterium
VRGQA

SEQ ID NO: 611315 - protein, 148 aa, Mycobacterium
VRGQANGVPANGTKSTEDSGKPDTKDDDTKDTKDDNGADAPAAKEGQNGAAPTEAPRRERRGASRDAGSTDRANEDADRERAGGRDGGATGETDGREGKQDKDNQNENRGQGGGSEDQQGSGGQQGRGGSNQQDDDGEGRGGRRGRRF

SEQ ID NO: 611316 - protein, 22 aa, Mycobacterium
VRGQGPLPATGGGLRAAAETGA

SEQ ID NO: 611317 - protein, 6 aa, Mycobacterium
VRGRED

SEQ ID NO: 611318 - protein, 10 aa, Mycobacterium
VRGREQSSRG

SEQ ID NO: 611319 - protein, 13 aa, Mycobacterium
VRGRGAESAAPLG

SEQ ID NO: 611320 - protein, 14 aa, Mycobacterium
VRGRGAESSAPLGV

SEQ ID NO: 611321 - protein, 12 aa, Mycobacterium
VRGRGGIPYEPY

SEQ ID NO: 611322 - protein, 8 aa, Mycobacterium
VRGRVTDE

SEQ ID NO: 611323 - protein, 7 aa, Mycobacterium
VRGSAEY

SEQ ID NO: 611324 - protein, 30 aa, Mycobacterium
VRGSALPADGVPEEIDTSSAAAEAAALERG

SEQ ID NO: 611325 - protein, 5 aa, Mycobacterium
VRGSD

SEQ ID NO: 611326 - protein, 11 aa, Mycobacterium
VRGSGAALATG

SEQ ID NO: 611327 - protein, 14 aa, Mycobacterium
VRGSGDSSKPARRT

SEQ ID NO: 611328 - protein, 9 aa, Mycobacterium
VRGSGSDRD

SEQ ID NO: 611329 - protein, 6 aa, Mycobacterium
VRGSQA

SEQ ID NO: 611330 - protein, 5 aa, Mycobacterium
VRGST

SEQ ID NO: 611331 - protein, 4 aa, Mycobacterium
VRGT

SEQ ID NO: 611332 - protein, 11 aa, Mycobacterium
VRGTASTASNP

SEQ ID NO: 611333 - protein, 5 aa, Mycobacterium
VRGTD

SEQ ID NO: 611334 - protein, 14 aa, Mycobacterium
VRGTGKDSFSDTRY

SEQ ID NO: 611335 - protein, 7 aa, Mycobacterium
VRGTGNY

SEQ ID NO: 611336 - protein, 27 aa, Mycobacterium
VRGTGSEVTPDNRRSSQSVRERTGSES

SEQ ID NO: 611337 - protein, 6 aa, Mycobacterium
VRGTGV

SEQ ID NO: 611338 - protein, 7 aa, Mycobacterium
VRGTQNV

SEQ ID NO: 611339 - protein, 7 aa, Mycobacterium
VRGTRGQ

SEQ ID NO: 611340 - protein, 17 aa, Mycobacterium
VRGTSPRSAVPSDDGLC

SEQ ID NO: 611341 - protein, 11 aa, Mycobacterium
VRGTSRNQVDG

SEQ ID NO: 611342 - protein, 9 aa, Mycobacterium
VRGTSYNQV

SEQ ID NO: 611343 - protein, 12 aa, Mycobacterium
VRGVRTEAGEEL

SEQ ID NO: 611344 - protein, 4 aa, Mycobacterium
VRGY

SEQ ID NO: 611345 - protein, 10 aa, Mycobacterium
VRHDGDDLGG

SEQ ID NO: 611346 - protein, 13 aa, Mycobacterium
VRHEPRAGLGNRG

SEQ ID NO: 611347 - protein, 8 aa, Mycobacterium
VRHGRQSL

SEQ ID NO: 611348 - protein, 5 aa, Mycobacterium
VRHPD

SEQ ID NO: 611349 - protein, 5 aa, Mycobacterium
VRHPG

SEQ ID NO: 611350 - protein, 14 aa, Mycobacterium
VRHPPEGSFRNGAT

SEQ ID NO: 611351 - protein, 9 aa, Mycobacterium
VRHSGATSV

SEQ ID NO: 611352 - protein, 4 aa, Mycobacterium
VRIA

SEQ ID NO: 611353 - protein, 7 aa, Mycobacterium
VRISPTK

SEQ ID NO: 611354 - protein, 8 aa, Mycobacterium
VRISTSPG

SEQ ID NO: 611355 - protein, 8 aa, Mycobacterium
VRKAAKVA

SEQ ID NO: 611356 - protein, 8 aa, Mycobacterium
VRKGEKAA

SEQ ID NO: 611357 - protein, 5 aa, Mycobacterium
VRKGG

SEQ ID NO: 611358 - protein, 5 aa, Mycobacterium
VRKNG

SEQ ID NO: 611359 - protein, 8 aa, Mycobacterium
VRKNRACS

SEQ ID NO: 611360 - protein, 7 aa, Mycobacterium
VRKPDGV

SEQ ID NO: 611361 - protein, 9 aa, Mycobacterium
VRKPSTHTV

SEQ ID NO: 611362 - protein, 4 aa, Mycobacterium
VRKR

SEQ ID NO: 611363 - protein, 29 aa, Mycobacterium
VRKRGSTTAVAQPTVPTPTVNGPRGDDPW

SEQ ID NO: 611364 - protein, 13 aa, Mycobacterium
VRKRSTTPYTDYS

SEQ ID NO: 611365 - protein, 18 aa, Mycobacterium
VRKSGAGRPKLTYEPAPR

SEQ ID NO: 611366 - protein, 5 aa, Mycobacterium
VRKSY

SEQ ID NO: 611367 - protein, 9 aa, Mycobacterium
VRKTDTEHN

SEQ ID NO: 611368 - protein, 10 aa, Mycobacterium
VRKTSKKLPH

SEQ ID NO: 611369 - protein, 4 aa, Mycobacterium
VRNA

SEQ ID NO: 611370 - protein, 8 aa, Mycobacterium
VRNAGGQV

SEQ ID NO: 611371 - protein, 10 aa, Mycobacterium
VRNAGPQLSG

SEQ ID NO: 611372 - protein, 13 aa, Mycobacterium
VRNARTLKELVAH

SEQ ID NO: 611373 - protein, 8 aa, Mycobacterium
VRNDPRDA

SEQ ID NO: 611374 - protein, 7 aa, Mycobacterium
VRNDSAV

SEQ ID NO: 611375 - protein, 8 aa, Mycobacterium
VRNDSSGA

SEQ ID NO: 611376 - protein, 4 aa, Mycobacterium
VRNE

SEQ ID NO: 611377 - protein, 7 aa, Mycobacterium
VRNEPTK

SEQ ID NO: 611378 - protein, 4 aa, Mycobacterium
VRNG

SEQ ID NO: 611379 - protein, 9 aa, Mycobacterium
VRNGDRAAL

SEQ ID NO: 611380 - protein, 6 aa, Mycobacterium
VRNGER

SEQ ID NO: 611381 - protein, 10 aa, Mycobacterium
VRNGRIDRDA

SEQ ID NO: 611382 - protein, 6 aa, Mycobacterium
VRNGTA

SEQ ID NO: 611383 - protein, 6 aa, Mycobacterium
VRNGTG

SEQ ID NO: 611384 - protein, 9 aa, Mycobacterium
VRNNSTGAV

SEQ ID NO: 611385 - protein, 14 aa, Mycobacterium
VRNPAAVMDIATSA

SEQ ID NO: 611386 - protein, 10 aa, Mycobacterium
VRNPDGAGVR

SEQ ID NO: 611387 - protein, 5 aa, Mycobacterium
VRNPG

SEQ ID NO: 611388 - protein, 7 aa, Mycobacterium
VRNQPSR

SEQ ID NO: 611389 - protein, 4 aa, Mycobacterium
VRNR

SEQ ID NO: 611390 - protein, 5 aa, Mycobacterium
VRNSD

SEQ ID NO: 611391 - protein, 9 aa, Mycobacterium
VRNSGALDE

SEQ ID NO: 611392 - protein, 15 aa, Mycobacterium
VRNSPAGTGLNAATG

SEQ ID NO: 611393 - protein, 18 aa, Mycobacterium
VRNSPAGTGLNAATGEYE

SEQ ID NO: 611394 - protein, 18 aa, Mycobacterium
VRNSPSGTGLNAATGEYE

SEQ ID NO: 611395 - protein, 4 aa, Mycobacterium
VRNT

SEQ ID NO: 611396 - protein, 8 aa, Mycobacterium
VRNTTGLA

SEQ ID NO: 611397 - protein, 11 aa, Mycobacterium
VRNYRDRSHKP

SEQ ID NO: 611398 - protein, 11 aa, Mycobacterium
VRNYRDTSHKP

SEQ ID NO: 611399 - protein, 4 aa, Mycobacterium
VRPA

SEQ ID NO: 611400 - protein, 5 aa, Mycobacterium
VRPAA

SEQ ID NO: 611401 - protein, 7 aa, Mycobacterium
VRPAATA

SEQ ID NO: 611402 - protein, 5 aa, Mycobacterium
VRPAD

SEQ ID NO: 611403 - protein, 7 aa, Mycobacterium
VRPAEGI

SEQ ID NO: 611404 - protein, 7 aa, Mycobacterium
VRPAGGI

SEQ ID NO: 611405 - protein, 6 aa, Mycobacterium
VRPAGT

SEQ ID NO: 611406 - protein, 6 aa, Mycobacterium
VRPAGY

SEQ ID NO: 611407 - protein, 11 aa, Mycobacterium
VRPAPGSTDGL

SEQ ID NO: 611408 - protein, 13 aa, Mycobacterium
VRPAQSTATHQPI

SEQ ID NO: 611409 - protein, 43 aa, Mycobacterium
VRPARGRAPAADSSDPDGTDGGESGAESDSEDVKDPLVDPLHT

SEQ ID NO: 611410 - protein, 36 aa, Mycobacterium
VRPARGRAPIAEPEDGEAVESDSEDLQEPLGDPLRS

SEQ ID NO: 611411 - protein, 35 aa, Mycobacterium
VRPARGRTAVAEPDDEGSGPDSADFQDPLVDPLRS

SEQ ID NO: 611412 - protein, 9 aa, Mycobacterium
VRPASSNSI

SEQ ID NO: 611413 - protein, 8 aa, Mycobacterium
VRPDDAEF

SEQ ID NO: 611414 - protein, 6 aa, Mycobacterium
VRPDDG

SEQ ID NO: 611415 - protein, 8 aa, Mycobacterium
VRPDDGEF

SEQ ID NO: 611416 - protein, 6 aa, Mycobacterium
VRPDGD

SEQ ID NO: 611417 - protein, 7 aa, Mycobacterium
VRPDGDD

SEQ ID NO: 611418 - protein, 9 aa, Mycobacterium
VRPDGQNDA

SEQ ID NO: 611419 - protein, 10 aa, Mycobacterium
VRPDGRHDAA

SEQ ID NO: 611420 - protein, 16 aa, Mycobacterium
VRPDGSSGLASAGTTL

SEQ ID NO: 611421 - protein, 9 aa, Mycobacterium
VRPDGTPQV

SEQ ID NO: 611422 - protein, 7 aa, Mycobacterium
VRPDLDG

SEQ ID NO: 611423 - protein, 6 aa, Mycobacterium
VRPDQQ

SEQ ID NO: 611424 - protein, 4 aa, Mycobacterium
VRPE

SEQ ID NO: 611425 - protein, 5 aa, Mycobacterium
VRPEA

SEQ ID NO: 611426 - protein, 9 aa, Mycobacterium
VRPEAKTLP

SEQ ID NO: 611427 - protein, 12 aa, Mycobacterium
VRPEDAQLTRDG

SEQ ID NO: 611428 - protein, 13 aa, Mycobacterium
VRPEDEQVARDGV

SEQ ID NO: 611429 - protein, 7 aa, Mycobacterium
VRPEGAT

SEQ ID NO: 611430 - protein, 6 aa, Mycobacterium
VRPELA

SEQ ID NO: 611431 - protein, 10 aa, Mycobacterium
VRPENGASRA

SEQ ID NO: 611432 - protein, 10 aa, Mycobacterium
VRPENGPSRA

SEQ ID NO: 611433 - protein, 10 aa, Mycobacterium
VRPENTPSRA

SEQ ID NO: 611434 - protein, 20 aa, Mycobacterium
VRPERVSDVDTGEDYEPAGD

SEQ ID NO: 611435 - protein, 9 aa, Mycobacterium
VRPESAEAL

SEQ ID NO: 611436 - protein, 9 aa, Mycobacterium
VRPESKTLP

SEQ ID NO: 611437 - protein, 13 aa, Mycobacterium
VRPETTGNRKGST

SEQ ID NO: 611438 - protein, 21 aa, Mycobacterium
VRPGAGKAIPDTQFRGPAARP

SEQ ID NO: 611439 - protein, 12 aa, Mycobacterium
VRPGAGTDEYDV

SEQ ID NO: 611440 - protein, 10 aa, Mycobacterium
VRPGDARTLP

SEQ ID NO: 611441 - protein, 8 aa, Mycobacterium
VRPGDGAE

SEQ ID NO: 611442 - protein, 10 aa, Mycobacterium
VRPGDLSPGD

SEQ ID NO: 611443 - protein, 15 aa, Mycobacterium
VRPGEECDGEDNRLG

SEQ ID NO: 611444 - protein, 5 aa, Mycobacterium
VRPGF

SEQ ID NO: 611445 - protein, 7 aa, Mycobacterium
VRPGGGI

SEQ ID NO: 611446 - protein, 7 aa, Mycobacterium
VRPGGTV

SEQ ID NO: 611447 - protein, 10 aa, Mycobacterium
VRPGHAETAR

SEQ ID NO: 611448 - protein, 14 aa, Mycobacterium
VRPGKESAPIREGG

SEQ ID NO: 611449 - protein, 8 aa, Mycobacterium
VRPGKRGG

SEQ ID NO: 611450 - protein, 6 aa, Mycobacterium
VRPGNT

SEQ ID NO: 611451 - protein, 6 aa, Mycobacterium
VRPGQS

SEQ ID NO: 611452 - protein, 5 aa, Mycobacterium
VRPGR

SEQ ID NO: 611453 - protein, 21 aa, Mycobacterium
VRPGRCSAGVQEPQPRTPDNV

SEQ ID NO: 611454 - protein, 6 aa, Mycobacterium
VRPGRE

SEQ ID NO: 611455 - protein, 18 aa, Mycobacterium
VRPGRGSRPRTKTRPVHA

SEQ ID NO: 611456 - protein, 25 aa, Mycobacterium
VRPGRGWPGDPATSRTAVASNPAQV

SEQ ID NO: 611457 - protein, 10 aa, Mycobacterium
VRPGRRPRGP

SEQ ID NO: 611458 - protein, 9 aa, Mycobacterium
VRPGSAEQV

SEQ ID NO: 611459 - protein, 6 aa, Mycobacterium
VRPGSE

SEQ ID NO: 611460 - protein, 6 aa, Mycobacterium
VRPGSR

SEQ ID NO: 611461 - protein, 12 aa, Mycobacterium
VRPGTAAPPTLG

SEQ ID NO: 611462 - protein, 8 aa, Mycobacterium
VRPGTAEQ

SEQ ID NO: 611463 - protein, 6 aa, Mycobacterium
VRPGTE

SEQ ID NO: 611464 - protein, 6 aa, Mycobacterium
VRPGTV

SEQ ID NO: 611465 - protein, 14 aa, Mycobacterium
VRPGVTAEQVDAAA

SEQ ID NO: 611466 - protein, 14 aa, Mycobacterium
VRPHEPAFDPEPEA

SEQ ID NO: 611467 - protein, 5 aa, Mycobacterium
VRPKE

SEQ ID NO: 611468 - protein, 5 aa, Mycobacterium
VRPLP

SEQ ID NO: 611469 - protein, 7 aa, Mycobacterium
VRPLPGR

SEQ ID NO: 611470 - protein, 5 aa, Mycobacterium
VRPND

SEQ ID NO: 611471 - protein, 11 aa, Mycobacterium
VRPNDADPAGL

SEQ ID NO: 611472 - protein, 9 aa, Mycobacterium
VRPNPSGLK

SEQ ID NO: 611473 - protein, 6 aa, Mycobacterium
VRPNTK

SEQ ID NO: 611474 - protein, 9 aa, Mycobacterium
VRPNTSGLK

SEQ ID NO: 611475 - protein, 4 aa, Mycobacterium
VRPP

SEQ ID NO: 611476 - protein, 14 aa, Mycobacterium
VRPPAANAPTPAAV

SEQ ID NO: 611477 - protein, 11 aa, Mycobacterium
VRPPDGMTPTQ

SEQ ID NO: 611478 - protein, 6 aa, Mycobacterium
VRPPEE

SEQ ID NO: 611479 - protein, 11 aa, Mycobacterium
VRPPGAGLPAR

SEQ ID NO: 611480 - protein, 6 aa, Mycobacterium
VRPPGQ

SEQ ID NO: 611481 - protein, 5 aa, Mycobacterium
VRPPK

SEQ ID NO: 611482 - protein, 44 aa, Mycobacterium
VRPPRAKGEPGPSAADDDDESDIDDLDDDGTDQDIASEPGAINA

SEQ ID NO: 611483 - protein, 24 aa, Mycobacterium
VRPPRARQAGGGRDRHPHRADGEH

SEQ ID NO: 611484 - protein, 28 aa, Mycobacterium
VRPPRRARTAAPLDRPRLPRSRLPTGEG

SEQ ID NO: 611485 - protein, 9 aa, Mycobacterium
VRPPTKREL

SEQ ID NO: 611486 - protein, 11 aa, Mycobacterium
VRPPTPGRRLP

SEQ ID NO: 611487 - protein, 5 aa, Mycobacterium
VRPPV

SEQ ID NO: 611488 - protein, 6 aa, Mycobacterium
VRPPVP

SEQ ID NO: 611489 - protein, 28 aa, Mycobacterium
VRPQAATLPQAPAPFEPSAASSNLPTRL

SEQ ID NO: 611490 - protein, 6 aa, Mycobacterium
VRPREA

SEQ ID NO: 611491 - protein, 8 aa, Mycobacterium
VRPRPGKV

SEQ ID NO: 611492 - protein, 8 aa, Mycobacterium
VRPRRGAP

SEQ ID NO: 611493 - protein, 11 aa, Mycobacterium
VRPRRGDPLTA

SEQ ID NO: 611494 - protein, 7 aa, Mycobacterium
VRPRSQP

SEQ ID NO: 611495 - protein, 8 aa, Mycobacterium
VRPRTERR

SEQ ID NO: 611496 - protein, 11 aa, Mycobacterium
VRPSLDAPAGL

SEQ ID NO: 611497 - protein, 5 aa, Mycobacterium
VRPSQ

SEQ ID NO: 611498 - protein, 29 aa, Mycobacterium
VRPSRGKPPAADASGEDVPDGPDEGFGDD

SEQ ID NO: 611499 - protein, 15 aa, Mycobacterium
VRPSRSRRLYGRHNP

SEQ ID NO: 611500 - protein, 7 aa, Mycobacterium
VRPTAAA

SEQ ID NO: 611501 - protein, 16 aa, Mycobacterium
VRPTAEQIAEASAFSR

SEQ ID NO: 611502 - protein, 8 aa, Mycobacterium
VRPTDDDI

SEQ ID NO: 611503 - protein, 5 aa, Mycobacterium
VRPTG

SEQ ID NO: 611504 - protein, 17 aa, Mycobacterium
VRPTGRHRARAGKSDVI

SEQ ID NO: 611505 - protein, 7 aa, Mycobacterium
VRPTPQR

SEQ ID NO: 611506 - protein, 9 aa, Mycobacterium
VRPTSSGDV

SEQ ID NO: 611507 - protein, 10 aa, Mycobacterium
VRPVEQGEGD

SEQ ID NO: 611508 - protein, 13 aa, Mycobacterium
VRPYPSSSPLTSP

SEQ ID NO: 611509 - protein, 4 aa, Mycobacterium
VRQA

SEQ ID NO: 611510 - protein, 15 aa, Mycobacterium
VRQAAEAALQAYARC

SEQ ID NO: 611511 - protein, 11 aa, Mycobacterium
VRQATSPAETL

SEQ ID NO: 611512 - protein, 15 aa, Mycobacterium
VRQDDPSALVPETTY

SEQ ID NO: 611513 - protein, 8 aa, Mycobacterium
VRQDGRTV

SEQ ID NO: 611514 - protein, 7 aa, Mycobacterium
VRQEPHD

SEQ ID NO: 611515 - protein, 9 aa, Mycobacterium
VRQESKTLP

SEQ ID NO: 611516 - protein, 6 aa, Mycobacterium
VRQGAT

SEQ ID NO: 611517 - protein, 8 aa, Mycobacterium
VRQGGTQL

SEQ ID NO: 611518 - protein, 5 aa, Mycobacterium
VRQGK

SEQ ID NO: 611519 - protein, 10 aa, Mycobacterium
VRQGPGGSDT

SEQ ID NO: 611520 - protein, 8 aa, Mycobacterium
VRQGRDAA

SEQ ID NO: 611521 - protein, 7 aa, Mycobacterium
VRQGRHQ

SEQ ID NO: 611522 - protein, 11 aa, Mycobacterium
VRQGSAEVNRD

SEQ ID NO: 611523 - protein, 10 aa, Mycobacterium
VRQPDGTMAH

SEQ ID NO: 611524 - protein, 13 aa, Mycobacterium
VRQPGGGLRGQGG

SEQ ID NO: 611525 - protein, 5 aa, Mycobacterium
VRQPV

SEQ ID NO: 611526 - protein, 16 aa, Mycobacterium
VRQPVSSLSGGQRQTV

SEQ ID NO: 611527 - protein, 20 aa, Mycobacterium
VRQQPKPAPAVSTDHSFSDE

SEQ ID NO: 611528 - protein, 5 aa, Mycobacterium
VRQRA

SEQ ID NO: 611529 - protein, 11 aa, Mycobacterium
VRQRARSAGER

SEQ ID NO: 611530 - protein, 9 aa, Mycobacterium
VRQREDRDK

SEQ ID NO: 611531 - protein, 11 aa, Mycobacterium
VRQREDRDRSL

SEQ ID NO: 611532 - protein, 6 aa, Mycobacterium
VRQRPG

SEQ ID NO: 611533 - protein, 12 aa, Mycobacterium
VRQRSGRAQAGL

SEQ ID NO: 611534 - protein, 8 aa, Mycobacterium
VRQSAPSR

SEQ ID NO: 611535 - protein, 29 aa, Mycobacterium
VRQSKVGDTVTAARNGAKEPLTGYREPKP

SEQ ID NO: 611536 - protein, 28 aa, Mycobacterium
VRQSKVGDTVTTAKRGAAEALTGYREPR

SEQ ID NO: 611537 - protein, 28 aa, Mycobacterium
VRQSKVGDTVTTARKGATEALTGYREPK

SEQ ID NO: 611538 - protein, 29 aa, Mycobacterium
VRQSKVGDTVTTARRGATEALTGYREPKP

SEQ ID NO: 611539 - protein, 29 aa, Mycobacterium
VRQSKVGDTVTTVRNGAKEALTGYREPKP

SEQ ID NO: 611540 - protein, 6 aa, Mycobacterium
VRQTAA

SEQ ID NO: 611541 - protein, 6 aa, Mycobacterium
VRQTPT

SEQ ID NO: 611542 - protein, 4 aa, Mycobacterium
VRRA

SEQ ID NO: 611543 - protein, 6 aa, Mycobacterium
VRRAGD

SEQ ID NO: 611544 - protein, 12 aa, Mycobacterium
VRRAGQAAGLRP

SEQ ID NO: 611545 - protein, 6 aa, Mycobacterium
VRRATA

SEQ ID NO: 611546 - protein, 15 aa, Mycobacterium
VRRDAENGDALFGTP

SEQ ID NO: 611547 - protein, 7 aa, Mycobacterium
VRRDGLD

SEQ ID NO: 611548 - protein, 28 aa, Mycobacterium
VRRDPDGSLNPSDINRAAARESMVTIRL

SEQ ID NO: 611549 - protein, 9 aa, Mycobacterium
VRRDPDLAP

SEQ ID NO: 611550 - protein, 6 aa, Mycobacterium
VRRDPG

SEQ ID NO: 611551 - protein, 4 aa, Mycobacterium
VRRE

SEQ ID NO: 611552 - protein, 7 aa, Mycobacterium
VRREAND

SEQ ID NO: 611553 - protein, 5 aa, Mycobacterium
VRREL

SEQ ID NO: 611554 - protein, 6 aa, Mycobacterium
VRREPG

SEQ ID NO: 611555 - protein, 8 aa, Mycobacterium
VRRGARNL

SEQ ID NO: 611556 - protein, 7 aa, Mycobacterium
VRRGARV

SEQ ID NO: 611557 - protein, 5 aa, Mycobacterium
VRRGD

SEQ ID NO: 611558 - protein, 6 aa, Mycobacterium
VRRGDA

SEQ ID NO: 611559 - protein, 17 aa, Mycobacterium
VRRGDERLGQGGVPADR

SEQ ID NO: 611560 - protein, 6 aa, Mycobacterium
VRRGDL

SEQ ID NO: 611561 - protein, 10 aa, Mycobacterium
VRRGDPEEVE

SEQ ID NO: 611562 - protein, 6 aa, Mycobacterium
VRRGDR

SEQ ID NO: 611563 - protein, 11 aa, Mycobacterium
VRRGDSLSKDD

SEQ ID NO: 611564 - protein, 5 aa, Mycobacterium
VRRGE

SEQ ID NO: 611565 - protein, 6 aa, Mycobacterium
VRRGEA

SEQ ID NO: 611566 - protein, 6 aa, Mycobacterium
VRRGGA

SEQ ID NO: 611567 - protein, 19 aa, Mycobacterium
VRRGGEAQTLTPSFVLPMS

SEQ ID NO: 611568 - protein, 6 aa, Mycobacterium
VRRGGT

SEQ ID NO: 611569 - protein, 12 aa, Mycobacterium
VRRGGVDRQVGR

SEQ ID NO: 611570 - protein, 9 aa, Mycobacterium
VRRGPGGAD

SEQ ID NO: 611571 - protein, 9 aa, Mycobacterium
VRRGPGGEH

SEQ ID NO: 611572 - protein, 5 aa, Mycobacterium
VRRGR

SEQ ID NO: 611573 - protein, 8 aa, Mycobacterium
VRRGSGDI

SEQ ID NO: 611574 - protein, 22 aa, Mycobacterium
VRRGSGDIATEDALTDDQTAAA

SEQ ID NO: 611575 - protein, 8 aa, Mycobacterium
VRRGSGNI

SEQ ID NO: 611576 - protein, 42 aa, Mycobacterium
VRRGTSAAARSSAREQAAAAETAAARQARRRRDKGKQQGRGI

SEQ ID NO: 611577 - protein, 7 aa, Mycobacterium
VRRNGSD

SEQ ID NO: 611578 - protein, 6 aa, Mycobacterium
VRRNPA

SEQ ID NO: 611579 - protein, 11 aa, Mycobacterium
VRRNRSATDKR

SEQ ID NO: 611580 - protein, 6 aa, Mycobacterium
VRRNST

SEQ ID NO: 611581 - protein, 4 aa, Mycobacterium
VRRP

SEQ ID NO: 611582 - protein, 13 aa, Mycobacterium
VRRPAGTPAGTPV

SEQ ID NO: 611583 - protein, 18 aa, Mycobacterium
VRRPDRRTAERALTGLTR

SEQ ID NO: 611584 - protein, 9 aa, Mycobacterium
VRRPGGPAA

SEQ ID NO: 611585 - protein, 10 aa, Mycobacterium
VRRPGGPGAV

SEQ ID NO: 611586 - protein, 13 aa, Mycobacterium
VRRPNEDELPAAR

SEQ ID NO: 611587 - protein, 7 aa, Mycobacterium
VRRQRSG

SEQ ID NO: 611588 - protein, 13 aa, Mycobacterium
VRRRDGAKPPAPL

SEQ ID NO: 611589 - protein, 20 aa, Mycobacterium
VRRRGRGLYSPGALPRSTQH

SEQ ID NO: 611590 - protein, 14 aa, Mycobacterium
VRRRSADQGAHGDL

SEQ ID NO: 611591 - protein, 7 aa, Mycobacterium
VRRRSDT

SEQ ID NO: 611592 - protein, 4 aa, Mycobacterium
VRRS

SEQ ID NO: 611593 - protein, 11 aa, Mycobacterium
VRRSASSIQRT

SEQ ID NO: 611594 - protein, 10 aa, Mycobacterium
VRRSETEATR

SEQ ID NO: 611595 - protein, 19 aa, Mycobacterium
VRRSGEPQSITPSFVLPMS

SEQ ID NO: 611596 - protein, 5 aa, Mycobacterium
VRRSR

SEQ ID NO: 611597 - protein, 10 aa, Mycobacterium
VRRSRRDAAD

SEQ ID NO: 611598 - protein, 7 aa, Mycobacterium
VRRSSCG

SEQ ID NO: 611599 - protein, 12 aa, Mycobacterium
VRRSSRKLSPEL

SEQ ID NO: 611600 - protein, 8 aa, Mycobacterium
VRRSTAES

SEQ ID NO: 611601 - protein, 6 aa, Mycobacterium
VRRTAG

SEQ ID NO: 611602 - protein, 17 aa, Mycobacterium
VRRTEDRTIPGPGGDIP

SEQ ID NO: 611603 - protein, 6 aa, Mycobacterium
VRRTGP

SEQ ID NO: 611604 - protein, 4 aa, Mycobacterium
VRSA

SEQ ID NO: 611605 - protein, 13 aa, Mycobacterium
VRSAADAIRTQAP

SEQ ID NO: 611606 - protein, 6 aa, Mycobacterium
VRSAAT

SEQ ID NO: 611607 - protein, 7 aa, Mycobacterium
VRSAATE

SEQ ID NO: 611608 - protein, 29 aa, Mycobacterium
VRSADRGRPADGAAAPNRRGNRLPRDERR

SEQ ID NO: 611609 - protein, 5 aa, Mycobacterium
VRSAE

SEQ ID NO: 611610 - protein, 9 aa, Mycobacterium
VRSAEASAA

SEQ ID NO: 611611 - protein, 8 aa, Mycobacterium
VRSAGDSW

SEQ ID NO: 611612 - protein, 9 aa, Mycobacterium
VRSARGGFE

SEQ ID NO: 611613 - protein, 18 aa, Mycobacterium
VRSARKRNPYLSDTRPEL

SEQ ID NO: 611614 - protein, 11 aa, Mycobacterium
VRSASGGAPAG

SEQ ID NO: 611615 - protein, 11 aa, Mycobacterium
VRSASLSNSGQ

SEQ ID NO: 611616 - protein, 10 aa, Mycobacterium
VRSATDPEGF

SEQ ID NO: 611617 - protein, 4 aa, Mycobacterium
VRSD

SEQ ID NO: 611618 - protein, 12 aa, Mycobacterium
VRSDDEANLEQA

SEQ ID NO: 611619 - protein, 10 aa, Mycobacterium
VRSDGAAKLV

SEQ ID NO: 611620 - protein, 19 aa, Mycobacterium
VRSDGTLRSETVDGGGYPV

SEQ ID NO: 611621 - protein, 7 aa, Mycobacterium
VRSDRAG

SEQ ID NO: 611622 - protein, 18 aa, Mycobacterium
VRSDSSGLKVGGHQASSA

SEQ ID NO: 611623 - protein, 26 aa, Mycobacterium
VRSEEAASSRDSRYGAATIETPTDHV

SEQ ID NO: 611624 - protein, 25 aa, Mycobacterium
VRSEEAFGRRESRYAATSADPASDV

SEQ ID NO: 611625 - protein, 10 aa, Mycobacterium
VRSEPRPARV

SEQ ID NO: 611626 - protein, 7 aa, Mycobacterium
VRSETPR

SEQ ID NO: 611627 - protein, 4 aa, Mycobacterium
VRSG

SEQ ID NO: 611628 - protein, 5 aa, Mycobacterium
VRSGA

SEQ ID NO: 611629 - protein, 11 aa, Mycobacterium
VRSGAANTAGW

SEQ ID NO: 611630 - protein, 8 aa, Mycobacterium
VRSGAGRE

SEQ ID NO: 611631 - protein, 7 aa, Mycobacterium
VRSGAGT

SEQ ID NO: 611632 - protein, 31 aa, Mycobacterium
VRSGAKPAGDADPYRASGSSDEDTGDDDRRE

SEQ ID NO: 611633 - protein, 36 aa, Mycobacterium
VRSGAKPAGEADPYRDSGSGVEPGLDGSIGDDDQRE

SEQ ID NO: 611634 - protein, 8 aa, Mycobacterium
VRSGASEI

SEQ ID NO: 611635 - protein, 5 aa, Mycobacterium
VRSGD

SEQ ID NO: 611636 - protein, 7 aa, Mycobacterium
VRSGDQV

SEQ ID NO: 611637 - protein, 13 aa, Mycobacterium
VRSGEQAAQIGGY

SEQ ID NO: 611638 - protein, 14 aa, Mycobacterium
VRSGEQAAQIGSYS

SEQ ID NO: 611639 - protein, 12 aa, Mycobacterium
VRSGEQVKVLLT

SEQ ID NO: 611640 - protein, 16 aa, Mycobacterium
VRSGERTTLALVFHDA

SEQ ID NO: 611641 - protein, 7 aa, Mycobacterium
VRSGERY

SEQ ID NO: 611642 - protein, 9 aa, Mycobacterium
VRSGPPGPV

SEQ ID NO: 611643 - protein, 15 aa, Mycobacterium
VRSGPTRLKSSGKDY

SEQ ID NO: 611644 - protein, 21 aa, Mycobacterium
VRSGQRAATEVAEALKSSAAA

SEQ ID NO: 611645 - protein, 5 aa, Mycobacterium
VRSGR

SEQ ID NO: 611646 - protein, 21 aa, Mycobacterium
VRSGRGSRPRTKTRPEHADAE

SEQ ID NO: 611647 - protein, 14 aa, Mycobacterium
VRSGRRAATEVSAL

SEQ ID NO: 611648 - protein, 7 aa, Mycobacterium
VRSGRRD

SEQ ID NO: 611649 - protein, 17 aa, Mycobacterium
VRSGRSHARDTEQGPDE

SEQ ID NO: 611650 - protein, 7 aa, Mycobacterium
VRSGSRM

SEQ ID NO: 611651 - protein, 7 aa, Mycobacterium
VRSGTDQ

SEQ ID NO: 611652 - protein, 7 aa, Mycobacterium
VRSGVTG

SEQ ID NO: 611653 - protein, 6 aa, Mycobacterium
VRSKAD

SEQ ID NO: 611654 - protein, 18 aa, Mycobacterium
VRSKGVARSPGEGGYGTT

SEQ ID NO: 611655 - protein, 15 aa, Mycobacterium
VRSKRSLPKPLQQIA

SEQ ID NO: 611656 - protein, 5 aa, Mycobacterium
VRSNP

SEQ ID NO: 611657 - protein, 16 aa, Mycobacterium
VRSNRGVAGIDGTIST

SEQ ID NO: 611658 - protein, 17 aa, Mycobacterium
VRSNRGVAGIDGTVSTA

SEQ ID NO: 611659 - protein, 14 aa, Mycobacterium
VRSPGAPGLDEGAD

SEQ ID NO: 611660 - protein, 13 aa, Mycobacterium
VRSPGPRRGGLGS

SEQ ID NO: 611661 - protein, 18 aa, Mycobacterium
VRSPTATVRGWESMPAIL

SEQ ID NO: 611662 - protein, 6 aa, Mycobacterium
VRSPTR

SEQ ID NO: 611663 - protein, 10 aa, Mycobacterium
VRSPTVNGNT

SEQ ID NO: 611664 - protein, 10 aa, Mycobacterium
VRSQDGSPPY

SEQ ID NO: 611665 - protein, 7 aa, Mycobacterium
VRSQNQK

SEQ ID NO: 611666 - protein, 15 aa, Mycobacterium
VRSSAERAGRDPQQI

SEQ ID NO: 611667 - protein, 7 aa, Mycobacterium
VRSSEPV

SEQ ID NO: 611668 - protein, 16 aa, Mycobacterium
VRSSGGIDVTNPVDGT

SEQ ID NO: 611669 - protein, 10 aa, Mycobacterium
VRSSGKTGEQ

SEQ ID NO: 611670 - protein, 12 aa, Mycobacterium
VRSSGQKLSPEL

SEQ ID NO: 611671 - protein, 14 aa, Mycobacterium
VRSSGSAANHNGSG

SEQ ID NO: 611672 - protein, 8 aa, Mycobacterium
VRSSTAET

SEQ ID NO: 611673 - protein, 4 aa, Mycobacterium
VRST

SEQ ID NO: 611674 - protein, 17 aa, Mycobacterium
VRSTAQASIPGDGATAT

SEQ ID NO: 611675 - protein, 11 aa, Mycobacterium
VRSTARARAVA

SEQ ID NO: 611676 - protein, 5 aa, Mycobacterium
VRSTG

SEQ ID NO: 611677 - protein, 20 aa, Mycobacterium
VRSTNRAGGLEGGMTNGQPL

SEQ ID NO: 611678 - protein, 14 aa, Mycobacterium
VRSTSLRDAFLEVT

SEQ ID NO: 611679 - protein, 11 aa, Mycobacterium
VRSTSSSPVSY

SEQ ID NO: 611680 - protein, 6 aa, Mycobacterium
VRSTTD

SEQ ID NO: 611681 - protein, 8 aa, Mycobacterium
VRSTTEMS

SEQ ID NO: 611682 - protein, 18 aa, Mycobacterium
VRSTTGKGASRRARREGR

SEQ ID NO: 611683 - protein, 7 aa, Mycobacterium
VRSYGRE

SEQ ID NO: 611684 - protein, 14 aa, Mycobacterium
VRTAASETVDSPAH

SEQ ID NO: 611685 - protein, 13 aa, Mycobacterium
VRTAATEAGLPPG

SEQ ID NO: 611686 - protein, 10 aa, Mycobacterium
VRTAGGEPLY

SEQ ID NO: 611687 - protein, 8 aa, Mycobacterium
VRTAGQRD

SEQ ID NO: 611688 - protein, 8 aa, Mycobacterium
VRTARPGV

SEQ ID NO: 611689 - protein, 7 aa, Mycobacterium
VRTARSE

SEQ ID NO: 611690 - protein, 7 aa, Mycobacterium
VRTASRQ

SEQ ID NO: 611691 - protein, 8 aa, Mycobacterium
VRTASSEI

SEQ ID NO: 611692 - protein, 6 aa, Mycobacterium
VRTATA

SEQ ID NO: 611693 - protein, 8 aa, Mycobacterium
VRTATAPV

SEQ ID NO: 611694 - protein, 7 aa, Mycobacterium
VRTATRD

SEQ ID NO: 611695 - protein, 5 aa, Mycobacterium
VRTDD

SEQ ID NO: 611696 - protein, 10 aa, Mycobacterium
VRTDDPDERF

SEQ ID NO: 611697 - protein, 8 aa, Mycobacterium
VRTDEGVE

SEQ ID NO: 611698 - protein, 7 aa, Mycobacterium
VRTDGLE

SEQ ID NO: 611699 - protein, 12 aa, Mycobacterium
VRTDPDAPKHAG

SEQ ID NO: 611700 - protein, 11 aa, Mycobacterium
VRTDPDVPKHA

SEQ ID NO: 611701 - protein, 12 aa, Mycobacterium
VRTDPEAPKHAG

SEQ ID NO: 611702 - protein, 12 aa, Mycobacterium
VRTDPKARKHKG

SEQ ID NO: 611703 - protein, 7 aa, Mycobacterium
VRTDRGD

SEQ ID NO: 611704 - protein, 7 aa, Mycobacterium
VRTDTGF

SEQ ID NO: 611705 - protein, 11 aa, Mycobacterium
VRTEPPHEGAR

SEQ ID NO: 611706 - protein, 19 aa, Mycobacterium
VRTETGKGASRRARREGKI

SEQ ID NO: 611707 - protein, 6 aa, Mycobacterium
VRTGAS

SEQ ID NO: 611708 - protein, 9 aa, Mycobacterium
VRTGDRHEV

SEQ ID NO: 611709 - protein, 8 aa, Mycobacterium
VRTGEPAA

SEQ ID NO: 611710 - protein, 11 aa, Mycobacterium
VRTGEPNPPKV

SEQ ID NO: 611711 - protein, 7 aa, Mycobacterium
VRTGESA

SEQ ID NO: 611712 - protein, 9 aa, Mycobacterium
VRTGETEYK

SEQ ID NO: 611713 - protein, 6 aa, Mycobacterium
VRTGGD

SEQ ID NO: 611714 - protein, 8 aa, Mycobacterium
VRTGGGRK

SEQ ID NO: 611715 - protein, 20 aa, Mycobacterium
VRTGGGSFQVTTPKSDAGVR

SEQ ID NO: 611716 - protein, 10 aa, Mycobacterium
VRTGGPGYGG

SEQ ID NO: 611717 - protein, 12 aa, Mycobacterium
VRTGIGKRDEHL

SEQ ID NO: 611718 - protein, 15 aa, Mycobacterium
VRTGKRYAQAPPSNL

SEQ ID NO: 611719 - protein, 8 aa, Mycobacterium
VRTGPERF

SEQ ID NO: 611720 - protein, 7 aa, Mycobacterium
VRTGQPG

SEQ ID NO: 611721 - protein, 8 aa, Mycobacterium
VRTGQSSL

SEQ ID NO: 611722 - protein, 8 aa, Mycobacterium
VRTGQTGA

SEQ ID NO: 611723 - protein, 7 aa, Mycobacterium
VRTGSGT

SEQ ID NO: 611724 - protein, 9 aa, Mycobacterium
VRTGSQAIH

SEQ ID NO: 611725 - protein, 5 aa, Mycobacterium
VRTGT

SEQ ID NO: 611726 - protein, 8 aa, Mycobacterium
VRTHGPRN

SEQ ID NO: 611727 - protein, 10 aa, Mycobacterium
VRTHGSAAVA

SEQ ID NO: 611728 - protein, 11 aa, Mycobacterium
VRTKSSETDPV

SEQ ID NO: 611729 - protein, 4 aa, Mycobacterium
VRTM

SEQ ID NO: 611730 - protein, 6 aa, Mycobacterium
VRTNNA

SEQ ID NO: 611731 - protein, 11 aa, Mycobacterium
VRTNQHDGYGQ

SEQ ID NO: 611732 - protein, 8 aa, Mycobacterium
VRTPEDDR

SEQ ID NO: 611733 - protein, 12 aa, Mycobacterium
VRTPGAEQTVTE

SEQ ID NO: 611734 - protein, 8 aa, Mycobacterium
VRTPGDGV

SEQ ID NO: 611735 - protein, 8 aa, Mycobacterium
VRTPGGTR

SEQ ID NO: 611736 - protein, 14 aa, Mycobacterium
VRTPGPDASGDTRR

SEQ ID NO: 611737 - protein, 10 aa, Mycobacterium
VRTPGQYEAP

SEQ ID NO: 611738 - protein, 6 aa, Mycobacterium
VRTPGT

SEQ ID NO: 611739 - protein, 7 aa, Mycobacterium
VRTPQGT

SEQ ID NO: 611740 - protein, 5 aa, Mycobacterium
VRTPT

SEQ ID NO: 611741 - protein, 7 aa, Mycobacterium
VRTPTTT

SEQ ID NO: 611742 - protein, 17 aa, Mycobacterium
VRTRRATLEEATARGED

SEQ ID NO: 611743 - protein, 7 aa, Mycobacterium
VRTRSGE

SEQ ID NO: 611744 - protein, 7 aa, Mycobacterium
VRTRYSS

SEQ ID NO: 611745 - protein, 7 aa, Mycobacterium
VRTSARY

SEQ ID NO: 611746 - protein, 10 aa, Mycobacterium
VRTSDGQAAT

SEQ ID NO: 611747 - protein, 15 aa, Mycobacterium
VRTSGMTPYVVRYIE

SEQ ID NO: 611748 - protein, 7 aa, Mycobacterium
VRTSPRV

SEQ ID NO: 611749 - protein, 10 aa, Mycobacterium
VRTSSDRRSV

SEQ ID NO: 611750 - protein, 6 aa, Mycobacterium
VRTTAD

SEQ ID NO: 611751 - protein, 8 aa, Mycobacterium
VRTTAESG

SEQ ID NO: 611752 - protein, 11 aa, Mycobacterium
VRTTDTARGER

SEQ ID NO: 611753 - protein, 6 aa, Mycobacterium
VRTTPD

SEQ ID NO: 611754 - protein, 6 aa, Mycobacterium
VRTTSE

SEQ ID NO: 611755 - protein, 7 aa, Mycobacterium
VRTTSGV

SEQ ID NO: 611756 - protein, 8 aa, Mycobacterium
VRTTSPDV

SEQ ID NO: 611757 - protein, 4 aa, Mycobacterium
VRTV

SEQ ID NO: 611758 - protein, 15 aa, Mycobacterium
VRVDTRPDPALTGPD

SEQ ID NO: 611759 - protein, 4 aa, Mycobacterium
VRVG

SEQ ID NO: 611760 - protein, 9 aa, Mycobacterium
VRVNPNDPL

SEQ ID NO: 611761 - protein, 4 aa, Mycobacterium
VRVP

SEQ ID NO: 611762 - protein, 8 aa, Mycobacterium
VRVPSNKL

SEQ ID NO: 611763 - protein, 12 aa, Mycobacterium
VRVTGGPDAPVI

SEQ ID NO: 611764 - protein, 9 aa, Mycobacterium
VRVTKTDNG

SEQ ID NO: 611765 - protein, 12 aa, Mycobacterium
VRVTTGRDTYTA

SEQ ID NO: 611766 - protein, 11 aa, Mycobacterium
VRYPSATADDF

SEQ ID NO: 611767 - protein, 10 aa, Mycobacterium
VRYRSSTGVY

SEQ ID NO: 611768 - protein, 9 aa, Mycobacterium
VSAAAASLN

SEQ ID NO: 611769 - protein, 10 aa, Mycobacterium
VSAAANDLAA

SEQ ID NO: 611770 - protein, 12 aa, Mycobacterium
VSAAARSAGSIG

SEQ ID NO: 611771 - protein, 13 aa, Mycobacterium
VSAAASGKPDDIP

SEQ ID NO: 611772 - protein, 17 aa, Mycobacterium
VSAADGATFDSYEPRSG

SEQ ID NO: 611773 - protein, 5 aa, Mycobacterium
VSAAE

SEQ ID NO: 611774 - protein, 8 aa, Mycobacterium
VSAAEAAD

SEQ ID NO: 611775 - protein, 10 aa, Mycobacterium
VSAAEADRRG

SEQ ID NO: 611776 - protein, 8 aa, Mycobacterium
VSAAGARW

SEQ ID NO: 611777 - protein, 6 aa, Mycobacterium
VSAAGG

SEQ ID NO: 611778 - protein, 8 aa, Mycobacterium
VSAAGGRV

SEQ ID NO: 611779 - protein, 5 aa, Mycobacterium
VSAAL

SEQ ID NO: 611780 - protein, 20 aa, Mycobacterium
VSAANAAVNTTQQQSSTLAG

SEQ ID NO: 611781 - protein, 14 aa, Mycobacterium
VSAAPADDVTDVPG

SEQ ID NO: 611782 - protein, 24 aa, Mycobacterium
VSAAPAPTAPTRRKSRKPAAKAAP

SEQ ID NO: 611783 - protein, 12 aa, Mycobacterium
VSAAPGGAPAAA

SEQ ID NO: 611784 - protein, 6 aa, Mycobacterium
VSAAQA

SEQ ID NO: 611785 - protein, 8 aa, Mycobacterium
VSAAQAAD

SEQ ID NO: 611786 - protein, 6 aa, Mycobacterium
VSAAQN

SEQ ID NO: 611787 - protein, 5 aa, Mycobacterium
VSAAR

SEQ ID NO: 611788 - protein, 6 aa, Mycobacterium
VSAARR

SEQ ID NO: 611789 - protein, 8 aa, Mycobacterium
VSAASAAI

SEQ ID NO: 611790 - protein, 13 aa, Mycobacterium
VSAASAATGTPLV

SEQ ID NO: 611791 - protein, 12 aa, Mycobacterium
VSAASAAVSTPL

SEQ ID NO: 611792 - protein, 10 aa, Mycobacterium
VSAATGATGR

SEQ ID NO: 611793 - protein, 4 aa, Mycobacterium
VSAD

SEQ ID NO: 611794 - protein, 8 aa, Mycobacterium
VSADADTA

SEQ ID NO: 611795 - protein, 8 aa, Mycobacterium
VSADEADR

SEQ ID NO: 611796 - protein, 7 aa, Mycobacterium
VSADEAI

SEQ ID NO: 611797 - protein, 13 aa, Mycobacterium
VSADEFAADPERF

SEQ ID NO: 611798 - protein, 14 aa, Mycobacterium
VSADEFASDPGRFD

SEQ ID NO: 611799 - protein, 11 aa, Mycobacterium
VSADEFASEPA

SEQ ID NO: 611800 - protein, 8 aa, Mycobacterium
VSADNPVE

SEQ ID NO: 611801 - protein, 11 aa, Mycobacterium
VSADPDAATWD

SEQ ID NO: 611802 - protein, 11 aa, Mycobacterium
VSADPESKPAV

SEQ ID NO: 611803 - protein, 9 aa, Mycobacterium
VSADPGDDV

SEQ ID NO: 611804 - protein, 7 aa, Mycobacterium
VSADPNA

SEQ ID NO: 611805 - protein, 10 aa, Mycobacterium
VSADPQNPGG

SEQ ID NO: 611806 - protein, 8 aa, Mycobacterium
VSADQADQ

SEQ ID NO: 611807 - protein, 10 aa, Mycobacterium
VSADSGRGFD

SEQ ID NO: 611808 - protein, 12 aa, Mycobacterium
VSADTDSENELR

SEQ ID NO: 611809 - protein, 6 aa, Mycobacterium
VSADTG

SEQ ID NO: 611810 - protein, 5 aa, Mycobacterium
VSADV

SEQ ID NO: 611811 - protein, 4 aa, Mycobacterium
VSAE

SEQ ID NO: 611812 - protein, 5 aa, Mycobacterium
VSAEE

SEQ ID NO: 611813 - protein, 15 aa, Mycobacterium
VSAEELGADPARYNI

SEQ ID NO: 611814 - protein, 6 aa, Mycobacterium
VSAEER

SEQ ID NO: 611815 - protein, 17 aa, Mycobacterium
VSAEERRRIAESGFYSY

SEQ ID NO: 611816 - protein, 8 aa, Mycobacterium
VSAEETAD

SEQ ID NO: 611817 - protein, 8 aa, Mycobacterium
VSAEEVTA

SEQ ID NO: 611818 - protein, 9 aa, Mycobacterium
VSAEGRPAH

SEQ ID NO: 611819 - protein, 9 aa, Mycobacterium
VSAEGTRDL

SEQ ID NO: 611820 - protein, 9 aa, Mycobacterium
VSAEGTREL

SEQ ID NO: 611821 - protein, 12 aa, Mycobacterium
VSAEIRGDDVTR

SEQ ID NO: 611822 - protein, 8 aa, Mycobacterium
VSAEPDAE

SEQ ID NO: 611823 - protein, 12 aa, Mycobacterium
VSAEPDSKPAVL

SEQ ID NO: 611824 - protein, 7 aa, Mycobacterium
VSAEPKV

SEQ ID NO: 611825 - protein, 6 aa, Mycobacterium
VSAEPP

SEQ ID NO: 611826 - protein, 8 aa, Mycobacterium
VSAEPPTD

SEQ ID NO: 611827 - protein, 7 aa, Mycobacterium
VSAERGG

SEQ ID NO: 611828 - protein, 6 aa, Mycobacterium
VSAERP

SEQ ID NO: 611829 - protein, 12 aa, Mycobacterium
VSAESDTDGWKL

SEQ ID NO: 611830 - protein, 8 aa, Mycobacterium
VSAESGRT

SEQ ID NO: 611831 - protein, 11 aa, Mycobacterium
VSAESKAAIGQ

SEQ ID NO: 611832 - protein, 12 aa, Mycobacterium
VSAESSHEDRSA

SEQ ID NO: 611833 - protein, 15 aa, Mycobacterium
VSAETGALAPAAMPN

SEQ ID NO: 611834 - protein, 7 aa, Mycobacterium
VSAFGPP

SEQ ID NO: 611835 - protein, 19 aa, Mycobacterium
VSAGAGSTRRERSDSPELA

SEQ ID NO: 611836 - protein, 7 aa, Mycobacterium
VSAGANV

SEQ ID NO: 611837 - protein, 8 aa, Mycobacterium
VSAGEGVS

SEQ ID NO: 611838 - protein, 5 aa, Mycobacterium
VSAGG

SEQ ID NO: 611839 - protein, 7 aa, Mycobacterium
VSAGGHS

SEQ ID NO: 611840 - protein, 8 aa, Mycobacterium
VSAGGNLK

SEQ ID NO: 611841 - protein, 9 aa, Mycobacterium
VSAGIKGHQ

SEQ ID NO: 611842 - protein, 5 aa, Mycobacterium
VSAGM

SEQ ID NO: 611843 - protein, 5 aa, Mycobacterium
VSAGN

SEQ ID NO: 611844 - protein, 9 aa, Mycobacterium
VSAGRTKAL

SEQ ID NO: 611845 - protein, 8 aa, Mycobacterium
VSAGTAEG

SEQ ID NO: 611846 - protein, 7 aa, Mycobacterium
VSAGTAH

SEQ ID NO: 611847 - protein, 7 aa, Mycobacterium
VSAGVDP

SEQ ID NO: 611848 - protein, 7 aa, Mycobacterium
VSAGVGR

SEQ ID NO: 611849 - protein, 10 aa, Mycobacterium
VSAGVGSTAP

SEQ ID NO: 611850 - protein, 4 aa, Mycobacterium
VSAH

SEQ ID NO: 611851 - protein, 4 aa, Mycobacterium
VSAL

SEQ ID NO: 611852 - protein, 8 aa, Mycobacterium
VSANGGRL

SEQ ID NO: 611853 - protein, 6 aa, Mycobacterium
VSANRA

SEQ ID NO: 611854 - protein, 6 aa, Mycobacterium
VSANTT

SEQ ID NO: 611855 - protein, 15 aa, Mycobacterium
VSAPAGPDSPHSDEA

SEQ ID NO: 611856 - protein, 8 aa, Mycobacterium
VSAPANAV

SEQ ID NO: 611857 - protein, 17 aa, Mycobacterium
VSAPDGDPGHPDPAVPL

SEQ ID NO: 611858 - protein, 14 aa, Mycobacterium
VSAPDGEPAHPDPA

SEQ ID NO: 611859 - protein, 17 aa, Mycobacterium
VSAPDPGIADAARARQH

SEQ ID NO: 611860 - protein, 15 aa, Mycobacterium
VSAPEQSVRRTPEAG

SEQ ID NO: 611861 - protein, 7 aa, Mycobacterium
VSAPERR

SEQ ID NO: 611862 - protein, 8 aa, Mycobacterium
VSAPGGQL

SEQ ID NO: 611863 - protein, 5 aa, Mycobacterium
VSAPH

SEQ ID NO: 611864 - protein, 19 aa, Mycobacterium
VSAPQTAQTPPQNSHQPMA

SEQ ID NO: 611865 - protein, 6 aa, Mycobacterium
VSAPRD

SEQ ID NO: 611866 - protein, 7 aa, Mycobacterium
VSAPRDA

SEQ ID NO: 611867 - protein, 8 aa, Mycobacterium
VSAPRSAF

SEQ ID NO: 611868 - protein, 8 aa, Mycobacterium
VSAPTDAV

SEQ ID NO: 611869 - protein, 10 aa, Mycobacterium
VSAPYDDGQL

SEQ ID NO: 611870 - protein, 8 aa, Mycobacterium
VSAQGTRD

SEQ ID NO: 611871 - protein, 24 aa, Mycobacterium
VSAQNVAASAHTTSVTPAAADQVS

SEQ ID NO: 611872 - protein, 7 aa, Mycobacterium
VSAQPDR

SEQ ID NO: 611873 - protein, 6 aa, Mycobacterium
VSAQPW

SEQ ID NO: 611874 - protein, 5 aa, Mycobacterium
VSAQS

SEQ ID NO: 611875 - protein, 10 aa, Mycobacterium
VSAQTPELAG

SEQ ID NO: 611876 - protein, 5 aa, Mycobacterium
VSARA

SEQ ID NO: 611877 - protein, 13 aa, Mycobacterium
VSARDQQKKDGQW

SEQ ID NO: 611878 - protein, 7 aa, Mycobacterium
VSARDRA

SEQ ID NO: 611879 - protein, 15 aa, Mycobacterium
VSARDSRGGTAPKRV

SEQ ID NO: 611880 - protein, 6 aa, Mycobacterium
VSARDV

SEQ ID NO: 611881 - protein, 11 aa, Mycobacterium
VSAREPSGRTR

SEQ ID NO: 611882 - protein, 13 aa, Mycobacterium
VSARFGSKEPDKF

SEQ ID NO: 611883 - protein, 7 aa, Mycobacterium
VSARGPL

SEQ ID NO: 611884 - protein, 22 aa, Mycobacterium
VSARGTGGPMSVTSPPDPNPIA

SEQ ID NO: 611885 - protein, 8 aa, Mycobacterium
VSARNGSY

SEQ ID NO: 611886 - protein, 8 aa, Mycobacterium
VSARPDDT

SEQ ID NO: 611887 - protein, 7 aa, Mycobacterium
VSARPGE

SEQ ID NO: 611888 - protein, 8 aa, Mycobacterium
VSARPSDS

SEQ ID NO: 611889 - protein, 9 aa, Mycobacterium
VSARPSDSV

SEQ ID NO: 611890 - protein, 5 aa, Mycobacterium
VSARR

SEQ ID NO: 611891 - protein, 7 aa, Mycobacterium
VSARRDA

SEQ ID NO: 611892 - protein, 7 aa, Mycobacterium
VSARRDP

SEQ ID NO: 611893 - protein, 7 aa, Mycobacterium
VSASAAA

SEQ ID NO: 611894 - protein, 75 aa, Mycobacterium
VSASADTGASTSSESESSASREISRGASREARPEHVTPNSDDASSTTDSAADAPHTVSRRTATGRANGDAGDRDL

SEQ ID NO: 611895 - protein, 8 aa, Mycobacterium
VSASASTL

SEQ ID NO: 611896 - protein, 10 aa, Mycobacterium
VSASERDAAA

SEQ ID NO: 611897 - protein, 12 aa, Mycobacterium
VSASGGLGSGHA

SEQ ID NO: 611898 - protein, 6 aa, Mycobacterium
VSASGH

SEQ ID NO: 611899 - protein, 8 aa, Mycobacterium
VSASGPDR

SEQ ID NO: 611900 - protein, 10 aa, Mycobacterium
VSASLGKGDS

SEQ ID NO: 611901 - protein, 13 aa, Mycobacterium
VSASPAPARSGSA

SEQ ID NO: 611902 - protein, 6 aa, Mycobacterium
VSASPG

SEQ ID NO: 611903 - protein, 15 aa, Mycobacterium
VSASPIAESSRTSCA

SEQ ID NO: 611904 - protein, 9 aa, Mycobacterium
VSASRDGDQ

SEQ ID NO: 611905 - protein, 10 aa, Mycobacterium
VSASRPLQSA

SEQ ID NO: 611906 - protein, 6 aa, Mycobacterium
VSASTR

SEQ ID NO: 611907 - protein, 4 aa, Mycobacterium
VSAT

SEQ ID NO: 611908 - protein, 7 aa, Mycobacterium
VSATDDV

SEQ ID NO: 611909 - protein, 10 aa, Mycobacterium
VSATEADRRG

SEQ ID NO: 611910 - protein, 5 aa, Mycobacterium
VSATG

SEQ ID NO: 611911 - protein, 9 aa, Mycobacterium
VSATGEDPV

SEQ ID NO: 611912 - protein, 6 aa, Mycobacterium
VSATGS

SEQ ID NO: 611913 - protein, 26 aa, Mycobacterium
VSATGTKVRPAGLSATGGGEFGSGAG

SEQ ID NO: 611914 - protein, 8 aa, Mycobacterium
VSATGTRD

SEQ ID NO: 611915 - protein, 17 aa, Mycobacterium
VSATNGHAQAGSGNANV

SEQ ID NO: 611916 - protein, 20 aa, Mycobacterium
VSATRAVNDNYANGYGNSKW

SEQ ID NO: 611917 - protein, 6 aa, Mycobacterium
VSATTG

SEQ ID NO: 611918 - protein, 17 aa, Mycobacterium
VSATTTDGLGLTGRGEG

SEQ ID NO: 611919 - protein, 28 aa, Mycobacterium
VSATTTDGLGLTGRGEGLAAVATALVTA

SEQ ID NO: 611920 - protein, 20 aa, Mycobacterium
VSATTTDGLGLTGRGEGRAA

SEQ ID NO: 611921 - protein, 29 aa, Mycobacterium
VSATTTDGLGLTGRGEGRAAVATALVVPV

SEQ ID NO: 611922 - protein, 7 aa, Mycobacterium
VSAVDSR

SEQ ID NO: 611923 - protein, 8 aa, Mycobacterium
VSAYPASV

SEQ ID NO: 611924 - protein, 7 aa, Mycobacterium
VSDADGF

SEQ ID NO: 611925 - protein, 7 aa, Mycobacterium
VSDADPV

SEQ ID NO: 611926 - protein, 9 aa, Mycobacterium
VSDAGAAEA

SEQ ID NO: 611927 - protein, 7 aa, Mycobacterium
VSDAGVQ

SEQ ID NO: 611928 - protein, 8 aa, Mycobacterium
VSDARSNT

SEQ ID NO: 611929 - protein, 10 aa, Mycobacterium
VSDDDPEYAH

SEQ ID NO: 611930 - protein, 6 aa, Mycobacterium
VSDDEC

SEQ ID NO: 611931 - protein, 9 aa, Mycobacterium
VSDDFDEQD

SEQ ID NO: 611932 - protein, 10 aa, Mycobacterium
VSDDGDDRDP

SEQ ID NO: 611933 - protein, 10 aa, Mycobacterium
VSDDGGEGGV

SEQ ID NO: 611934 - protein, 14 aa, Mycobacterium
VSDDGTELNSLVAP

SEQ ID NO: 611935 - protein, 5 aa, Mycobacterium
VSDDM

SEQ ID NO: 611936 - protein, 8 aa, Mycobacterium
VSDDNEAR

SEQ ID NO: 611937 - protein, 8 aa, Mycobacterium
VSDDPCQY

SEQ ID NO: 611938 - protein, 10 aa, Mycobacterium
VSDDPDVSSA

SEQ ID NO: 611939 - protein, 10 aa, Mycobacterium
VSDDPEVAEA

SEQ ID NO: 611940 - protein, 14 aa, Mycobacterium
VSDDPGAGAAGGLG

SEQ ID NO: 611941 - protein, 10 aa, Mycobacterium
VSDDPRQYRA

SEQ ID NO: 611942 - protein, 11 aa, Mycobacterium
VSDDSGDSQKM

SEQ ID NO: 611943 - protein, 7 aa, Mycobacterium
VSDDVYE

SEQ ID NO: 611944 - protein, 18 aa, Mycobacterium
VSDEDPAAELAAGRTPRL

SEQ ID NO: 611945 - protein, 16 aa, Mycobacterium
VSDEDVEDDPTPHGTL

SEQ ID NO: 611946 - protein, 11 aa, Mycobacterium
VSDEEERAASR

SEQ ID NO: 611947 - protein, 14 aa, Mycobacterium
VSDEESAKDMAQRT

SEQ ID NO: 611948 - protein, 16 aa, Mycobacterium
VSDEHRDAFAGTDKGS

SEQ ID NO: 611949 - protein, 17 aa, Mycobacterium
VSDEHRDAFAGTTKGKD

SEQ ID NO: 611950 - protein, 12 aa, Mycobacterium
VSDEHRDAFVRK

SEQ ID NO: 611951 - protein, 10 aa, Mycobacterium
VSDEKETALG

SEQ ID NO: 611952 - protein, 10 aa, Mycobacterium
VSDEPPAPEG

SEQ ID NO: 611953 - protein, 5 aa, Mycobacterium
VSDER

SEQ ID NO: 611954 - protein, 7 aa, Mycobacterium
VSDERAG

SEQ ID NO: 611955 - protein, 9 aa, Mycobacterium
VSDETPNSA

SEQ ID NO: 611956 - protein, 6 aa, Mycobacterium
VSDETR

SEQ ID NO: 611957 - protein, 7 aa, Mycobacterium
VSDEYSA

SEQ ID NO: 611958 - protein, 6 aa, Mycobacterium
VSDGER

SEQ ID NO: 611959 - protein, 7 aa, Mycobacterium
VSDGKIS

SEQ ID NO: 611960 - protein, 10 aa, Mycobacterium
VSDGKTKREA

SEQ ID NO: 611961 - protein, 10 aa, Mycobacterium
VSDGQGTQPL

SEQ ID NO: 611962 - protein, 12 aa, Mycobacterium
VSDGRAVDSARH

SEQ ID NO: 611963 - protein, 6 aa, Mycobacterium
VSDGRQ

SEQ ID NO: 611964 - protein, 15 aa, Mycobacterium
VSDGSLETLFSEPVS

SEQ ID NO: 611965 - protein, 9 aa, Mycobacterium
VSDGSNAPA

SEQ ID NO: 611966 - protein, 10 aa, Mycobacterium
VSDGSTAPAI

SEQ ID NO: 611967 - protein, 15 aa, Mycobacterium
VSDGTKTVSKKGPFP

SEQ ID NO: 611968 - protein, 7 aa, Mycobacterium
VSDGTTV

SEQ ID NO: 611969 - protein, 7 aa, Mycobacterium
VSDHDGQ

SEQ ID NO: 611970 - protein, 5 aa, Mycobacterium
VSDKE

SEQ ID NO: 611971 - protein, 8 aa, Mycobacterium
VSDKYRGT

SEQ ID NO: 611972 - protein, 5 aa, Mycobacterium
VSDND

SEQ ID NO: 611973 - protein, 14 aa, Mycobacterium
VSDNDTQDKSSLRE

SEQ ID NO: 611974 - protein, 15 aa, Mycobacterium
VSDNRPESFRPRQDE

SEQ ID NO: 611975 - protein, 4 aa, Mycobacterium
VSDP

SEQ ID NO: 611976 - protein, 17 aa, Mycobacterium
VSDPDGPRTTDCPADSW

SEQ ID NO: 611977 - protein, 8 aa, Mycobacterium
VSDPDGRA

SEQ ID NO: 611978 - protein, 7 aa, Mycobacterium
VSDPDQV

SEQ ID NO: 611979 - protein, 8 aa, Mycobacterium
VSDPDRPS

SEQ ID NO: 611980 - protein, 8 aa, Mycobacterium
VSDPDSAI

SEQ ID NO: 611981 - protein, 11 aa, Mycobacterium
VSDPDSAKEMA

SEQ ID NO: 611982 - protein, 6 aa, Mycobacterium
VSDPEH

SEQ ID NO: 611983 - protein, 6 aa, Mycobacterium
VSDPEI

SEQ ID NO: 611984 - protein, 7 aa, Mycobacterium
VSDPEQM

SEQ ID NO: 611985 - protein, 7 aa, Mycobacterium
VSDPETI

SEQ ID NO: 611986 - protein, 11 aa, Mycobacterium
VSDPISDAERL

SEQ ID NO: 611987 - protein, 7 aa, Mycobacterium
VSDPMTR

SEQ ID NO: 611988 - protein, 11 aa, Mycobacterium
VSDPNLSQADL

SEQ ID NO: 611989 - protein, 11 aa, Mycobacterium
VSDPPRTEGEL

SEQ ID NO: 611990 - protein, 7 aa, Mycobacterium
VSDPQEP

SEQ ID NO: 611991 - protein, 6 aa, Mycobacterium
VSDPQL

SEQ ID NO: 611992 - protein, 10 aa, Mycobacterium
VSDPTGPTRA

SEQ ID NO: 611993 - protein, 14 aa, Mycobacterium
VSDPTRPKPRKRGR

SEQ ID NO: 611994 - protein, 9 aa, Mycobacterium
VSDPTTGER

SEQ ID NO: 611995 - protein, 11 aa, Mycobacterium
VSDQDPGATAS

SEQ ID NO: 611996 - protein, 8 aa, Mycobacterium
VSDQPRPG

SEQ ID NO: 611997 - protein, 12 aa, Mycobacterium
VSDQVAKQARDC

SEQ ID NO: 611998 - protein, 4 aa, Mycobacterium
VSDR

SEQ ID NO: 611999 - protein, 17 aa, Mycobacterium
VSDRAGAVATALREGIY

SEQ ID NO: 612000 - protein, 17 aa, Mycobacterium
VSDRGAAVAEAMRRKLL

SEQ ID NO: 612001 - protein, 17 aa, Mycobacterium
VSDRGAAVAEAMRRRLL

SEQ ID NO: 612002 - protein, 5 aa, Mycobacterium
VSDRI

SEQ ID NO: 612003 - protein, 9 aa, Mycobacterium
VSDRPAPAL

SEQ ID NO: 612004 - protein, 8 aa, Mycobacterium
VSDRSGAI

SEQ ID NO: 612005 - protein, 8 aa, Mycobacterium
VSDRSGQI

SEQ ID NO: 612006 - protein, 8 aa, Mycobacterium
VSDRSGRE

SEQ ID NO: 612007 - protein, 17 aa, Mycobacterium
VSDRTAAVATALREGIF

SEQ ID NO: 612008 - protein, 4 aa, Mycobacterium
VSDS

SEQ ID NO: 612009 - protein, 9 aa, Mycobacterium
VSDSARATL

SEQ ID NO: 612010 - protein, 6 aa, Mycobacterium
VSDSAS

SEQ ID NO: 612011 - protein, 7 aa, Mycobacterium
VSDSEPV

SEQ ID NO: 612012 - protein, 6 aa, Mycobacterium
VSDSGA

SEQ ID NO: 612013 - protein, 18 aa, Mycobacterium
VSDSLNGSGSLPEKTRQR

SEQ ID NO: 612014 - protein, 4 aa, Mycobacterium
VSDT

SEQ ID NO: 612015 - protein, 7 aa, Mycobacterium
VSDTANV

SEQ ID NO: 612016 - protein, 8 aa, Mycobacterium
VSDTDLGA

SEQ ID NO: 612017 - protein, 12 aa, Mycobacterium
VSDTEAPDKSAI

SEQ ID NO: 612018 - protein, 7 aa, Mycobacterium
VSDTGDL

SEQ ID NO: 612019 - protein, 7 aa, Mycobacterium
VSDTSPM

SEQ ID NO: 612020 - protein, 9 aa, Mycobacterium
VSDTTAPTV

SEQ ID NO: 612021 - protein, 9 aa, Mycobacterium
VSDTTEAAR

SEQ ID NO: 612022 - protein, 4 aa, Mycobacterium
VSDV

SEQ ID NO: 612023 - protein, 7 aa, Mycobacterium
VSEAAGA

SEQ ID NO: 612024 - protein, 6 aa, Mycobacterium
VSEAES

SEQ ID NO: 612025 - protein, 5 aa, Mycobacterium
VSEAG

SEQ ID NO: 612026 - protein, 10 aa, Mycobacterium
VSEAGASVYS

SEQ ID NO: 612027 - protein, 6 aa, Mycobacterium
VSEAGG

SEQ ID NO: 612028 - protein, 8 aa, Mycobacterium
VSEANRSR

SEQ ID NO: 612029 - protein, 17 aa, Mycobacterium
VSEAQGGDYDLSTAAGR

SEQ ID NO: 612030 - protein, 8 aa, Mycobacterium
VSEARRGQ

SEQ ID NO: 612031 - protein, 6 aa, Mycobacterium
VSEART

SEQ ID NO: 612032 - protein, 16 aa, Mycobacterium
VSEASRRRAEQRLPES

SEQ ID NO: 612033 - protein, 8 aa, Mycobacterium
VSEASVGE

SEQ ID NO: 612034 - protein, 4 aa, Mycobacterium
VSED

SEQ ID NO: 612035 - protein, 11 aa, Mycobacterium
VSEDGAGSPLR

SEQ ID NO: 612036 - protein, 8 aa, Mycobacterium
VSEDGPVD

SEQ ID NO: 612037 - protein, 7 aa, Mycobacterium
VSEDKQN

SEQ ID NO: 612038 - protein, 7 aa, Mycobacterium
VSEDPAE

SEQ ID NO: 612039 - protein, 8 aa, Mycobacterium
VSEDRGRP

SEQ ID NO: 612040 - protein, 6 aa, Mycobacterium
VSEDTV

SEQ ID NO: 612041 - protein, 5 aa, Mycobacterium
VSEEA

SEQ ID NO: 612042 - protein, 7 aa, Mycobacterium
VSEEARH

SEQ ID NO: 612043 - protein, 9 aa, Mycobacterium
VSEEARRRS

SEQ ID NO: 612044 - protein, 8 aa, Mycobacterium
VSEEDPVA

SEQ ID NO: 612045 - protein, 8 aa, Mycobacterium
VSEEISTE

SEQ ID NO: 612046 - protein, 9 aa, Mycobacterium
VSEENAPPR

SEQ ID NO: 612047 - protein, 7 aa, Mycobacterium
VSEEQDA

SEQ ID NO: 612048 - protein, 10 aa, Mycobacterium
VSEEQRRGAW

SEQ ID NO: 612049 - protein, 6 aa, Mycobacterium
VSEESD

SEQ ID NO: 612050 - protein, 4 aa, Mycobacterium
VSEF

SEQ ID NO: 612051 - protein, 14 aa, Mycobacterium
VSEGGEVRLSPRKS

SEQ ID NO: 612052 - protein, 7 aa, Mycobacterium
VSEGGPA

SEQ ID NO: 612053 - protein, 11 aa, Mycobacterium
VSEGNSGTSTL

SEQ ID NO: 612054 - protein, 9 aa, Mycobacterium
VSEGRDGRA

SEQ ID NO: 612055 - protein, 16 aa, Mycobacterium
VSEGRRRLPDDGTDRT

SEQ ID NO: 612056 - protein, 8 aa, Mycobacterium
VSEGTGVA

SEQ ID NO: 612057 - protein, 14 aa, Mycobacterium
VSEGTNQTLHNFDA

SEQ ID NO: 612058 - protein, 18 aa, Mycobacterium
VSEKAGDLITGGRRLGGE

SEQ ID NO: 612059 - protein, 9 aa, Mycobacterium
VSEKKPKPL

SEQ ID NO: 612060 - protein, 8 aa, Mycobacterium
VSELGNRD

SEQ ID NO: 612061 - protein, 4 aa, Mycobacterium
VSEN

SEQ ID NO: 612062 - protein, 17 aa, Mycobacterium
VSENLKAKESEDVPAEQ

SEQ ID NO: 612063 - protein, 12 aa, Mycobacterium
VSEPADVAREGL

SEQ ID NO: 612064 - protein, 15 aa, Mycobacterium
VSEPAKPEKHIQVAT

SEQ ID NO: 612065 - protein, 7 aa, Mycobacterium
VSEPERK

SEQ ID NO: 612066 - protein, 14 aa, Mycobacterium
VSEPGGPSSAAVST

SEQ ID NO: 612067 - protein, 9 aa, Mycobacterium
VSEPGGPVA

SEQ ID NO: 612068 - protein, 10 aa, Mycobacterium
VSEPGGPVTA

SEQ ID NO: 612069 - protein, 9 aa, Mycobacterium
VSEPGQTTY

SEQ ID NO: 612070 - protein, 5 aa, Mycobacterium
VSEPH

SEQ ID NO: 612071 - protein, 7 aa, Mycobacterium
VSEPPLL

SEQ ID NO: 612072 - protein, 4 aa, Mycobacterium
VSEQ

SEQ ID NO: 612073 - protein, 7 aa, Mycobacterium
VSEQPGV

SEQ ID NO: 612074 - protein, 8 aa, Mycobacterium
VSEQSRGM

SEQ ID NO: 612075 - protein, 9 aa, Mycobacterium
VSEQSRGTL

SEQ ID NO: 612076 - protein, 26 aa, Mycobacterium
VSERGETRADDRTSVAAMEDRKREGY

SEQ ID NO: 612077 - protein, 6 aa, Mycobacterium
VSERGK

SEQ ID NO: 612078 - protein, 6 aa, Mycobacterium
VSERGV

SEQ ID NO: 612079 - protein, 11 aa, Mycobacterium
VSERPDNSLGM

SEQ ID NO: 612080 - protein, 5 aa, Mycobacterium
VSERQ

SEQ ID NO: 612081 - protein, 7 aa, Mycobacterium
VSERRDD

SEQ ID NO: 612082 - protein, 7 aa, Mycobacterium
VSERRQE

SEQ ID NO: 612083 - protein, 11 aa, Mycobacterium
VSESADVEDGL

SEQ ID NO: 612084 - protein, 14 aa, Mycobacterium
VSESDTVAHPDPST

SEQ ID NO: 612085 - protein, 9 aa, Mycobacterium
VSESENKTR

SEQ ID NO: 612086 - protein, 24 aa, Mycobacterium
VSESERLRAAEAKRREKAETELDE

SEQ ID NO: 612087 - protein, 10 aa, Mycobacterium
VSESGGAAGE

SEQ ID NO: 612088 - protein, 5 aa, Mycobacterium
VSESP

SEQ ID NO: 612089 - protein, 5 aa, Mycobacterium
VSEST

SEQ ID NO: 612090 - protein, 7 aa, Mycobacterium
VSESTIR

SEQ ID NO: 612091 - protein, 4 aa, Mycobacterium
VSET

SEQ ID NO: 612092 - protein, 16 aa, Mycobacterium
VSETAAPAEPADLPGR

SEQ ID NO: 612093 - protein, 8 aa, Mycobacterium
VSETEGVP

SEQ ID NO: 612094 - protein, 6 aa, Mycobacterium
VSETEK

SEQ ID NO: 612095 - protein, 9 aa, Mycobacterium
VSETETRTQ

SEQ ID NO: 612096 - protein, 4 aa, Mycobacterium
VSEV

SEQ ID NO: 612097 - protein, 11 aa, Mycobacterium
VSEYGADPAWA

SEQ ID NO: 612098 - protein, 11 aa, Mycobacterium
VSEYPRDPSWA

SEQ ID NO: 612099 - protein, 14 aa, Mycobacterium
VSEYQSKKSAYETG

SEQ ID NO: 612100 - protein, 11 aa, Mycobacterium
VSEYSADPAWA

SEQ ID NO: 612101 - protein, 12 aa, Mycobacterium
VSEYSTDPPWAR

SEQ ID NO: 612102 - protein, 8 aa, Mycobacterium
VSFPETPG

SEQ ID NO: 612103 - protein, 19 aa, Mycobacterium
VSFPGGATDPGDGGPVGTA

SEQ ID NO: 612104 - protein, 12 aa, Mycobacterium
VSFPPEGSFRRG

SEQ ID NO: 612105 - protein, 10 aa, Mycobacterium
VSGAADHVES

SEQ ID NO: 612106 - protein, 7 aa, Mycobacterium
VSGADGM

SEQ ID NO: 612107 - protein, 9 aa, Mycobacterium
VSGADPDMA

SEQ ID NO: 612108 - protein, 21 aa, Mycobacterium
VSGADPELGSRHADPSRDTWG

SEQ ID NO: 612109 - protein, 6 aa, Mycobacterium
VSGAEA

SEQ ID NO: 612110 - protein, 11 aa, Mycobacterium
VSGAEAAASAA

SEQ ID NO: 612111 - protein, 5 aa, Mycobacterium
VSGAG

SEQ ID NO: 612112 - protein, 11 aa, Mycobacterium
VSGAGGDGRTV

SEQ ID NO: 612113 - protein, 8 aa, Mycobacterium
VSGAGPDR

SEQ ID NO: 612114 - protein, 14 aa, Mycobacterium
VSGAIGGSSHVGGA

SEQ ID NO: 612115 - protein, 12 aa, Mycobacterium
VSGAKSDASDAK

SEQ ID NO: 612116 - protein, 11 aa, Mycobacterium
VSGAKSDVSDA

SEQ ID NO: 612117 - protein, 10 aa, Mycobacterium
VSGANGDRAY

SEQ ID NO: 612118 - protein, 10 aa, Mycobacterium
VSGAPGEGES

SEQ ID NO: 612119 - protein, 16 aa, Mycobacterium
VSGAQGNPGQAQFLIV

SEQ ID NO: 612120 - protein, 11 aa, Mycobacterium
VSGAQPSGDGA

SEQ ID NO: 612121 - protein, 6 aa, Mycobacterium
VSGARR

SEQ ID NO: 612122 - protein, 14 aa, Mycobacterium
VSGARREFVSRRTL

SEQ ID NO: 612123 - protein, 7 aa, Mycobacterium
VSGARWD

SEQ ID NO: 612124 - protein, 12 aa, Mycobacterium
VSGASAPSDEQG

SEQ ID NO: 612125 - protein, 8 aa, Mycobacterium
VSGATTTA

SEQ ID NO: 612126 - protein, 11 aa, Mycobacterium
VSGDAVSAGYE

SEQ ID NO: 612127 - protein, 5 aa, Mycobacterium
VSGDD

SEQ ID NO: 612128 - protein, 7 aa, Mycobacterium
VSGDDED

SEQ ID NO: 612129 - protein, 10 aa, Mycobacterium
VSGDETPELA

SEQ ID NO: 612130 - protein, 8 aa, Mycobacterium
VSGDGDCT

SEQ ID NO: 612131 - protein, 7 aa, Mycobacterium
VSGDGGA

SEQ ID NO: 612132 - protein, 8 aa, Mycobacterium
VSGDGGGT

SEQ ID NO: 612133 - protein, 6 aa, Mycobacterium
VSGDLP

SEQ ID NO: 612134 - protein, 14 aa, Mycobacterium
VSGDPTDADHLPAR

SEQ ID NO: 612135 - protein, 9 aa, Mycobacterium
VSGDTPREL

SEQ ID NO: 612136 - protein, 4 aa, Mycobacterium
VSGE

SEQ ID NO: 612137 - protein, 5 aa, Mycobacterium
VSGEA

SEQ ID NO: 612138 - protein, 11 aa, Mycobacterium
VSGEASTREDQ

SEQ ID NO: 612139 - protein, 12 aa, Mycobacterium
VSGEDYRNAAPN

SEQ ID NO: 612140 - protein, 21 aa, Mycobacterium
VSGELKPGGTIVEPTSGNTGV

SEQ ID NO: 612141 - protein, 5 aa, Mycobacterium
VSGEQ

SEQ ID NO: 612142 - protein, 6 aa, Mycobacterium
VSGERS

SEQ ID NO: 612143 - protein, 5 aa, Mycobacterium
VSGES

SEQ ID NO: 612144 - protein, 11 aa, Mycobacterium
VSGESARDAGE

SEQ ID NO: 612145 - protein, 11 aa, Mycobacterium
VSGESDGSGVS

SEQ ID NO: 612146 - protein, 6 aa, Mycobacterium
VSGESE

SEQ ID NO: 612147 - protein, 8 aa, Mycobacterium
VSGETTTG

SEQ ID NO: 612148 - protein, 4 aa, Mycobacterium
VSGF

SEQ ID NO: 612149 - protein, 6 aa, Mycobacterium
VSGFSD

SEQ ID NO: 612150 - protein, 4 aa, Mycobacterium
VSGG

SEQ ID NO: 612151 - protein, 13 aa, Mycobacterium
VSGGAGAASKGQL

SEQ ID NO: 612152 - protein, 12 aa, Mycobacterium
VSGGAGGAGGAA

SEQ ID NO: 612153 - protein, 8 aa, Mycobacterium
VSGGAPLG

SEQ ID NO: 612154 - protein, 6 aa, Mycobacterium
VSGGDA

SEQ ID NO: 612155 - protein, 9 aa, Mycobacterium
VSGGDPRTV

SEQ ID NO: 612156 - protein, 7 aa, Mycobacterium
VSGGDSA

SEQ ID NO: 612157 - protein, 8 aa, Mycobacterium
VSGGDTVR

SEQ ID NO: 612158 - protein, 9 aa, Mycobacterium
VSGGEEISA

SEQ ID NO: 612159 - protein, 7 aa, Mycobacterium
VSGGELQ

SEQ ID NO: 612160 - protein, 7 aa, Mycobacterium
VSGGGQP

SEQ ID NO: 612161 - protein, 6 aa, Mycobacterium
VSGGGR

SEQ ID NO: 612162 - protein, 8 aa, Mycobacterium
VSGGGTAL

SEQ ID NO: 612163 - protein, 29 aa, Mycobacterium
VSGGHAQTHRREPGPQQEAERRFSAGGDI

SEQ ID NO: 612164 - protein, 7 aa, Mycobacterium
VSGGHVG

SEQ ID NO: 612165 - protein, 8 aa, Mycobacterium
VSGGHVGR

SEQ ID NO: 612166 - protein, 9 aa, Mycobacterium
VSGGISGAR

SEQ ID NO: 612167 - protein, 5 aa, Mycobacterium
VSGGK

SEQ ID NO: 612168 - protein, 25 aa, Mycobacterium
VSGGNGPTGGGRAEVHRRGRARTRA

SEQ ID NO: 612169 - protein, 9 aa, Mycobacterium
VSGGPQRNI

SEQ ID NO: 612170 - protein, 6 aa, Mycobacterium
VSGGPT

SEQ ID NO: 612171 - protein, 7 aa, Mycobacterium
VSGGQSY

SEQ ID NO: 612172 - protein, 10 aa, Mycobacterium
VSGGRADPGM

SEQ ID NO: 612173 - protein, 7 aa, Mycobacterium
VSGGRAI

SEQ ID NO: 612174 - protein, 10 aa, Mycobacterium
VSGGRSDPEM

SEQ ID NO: 612175 - protein, 5 aa, Mycobacterium
VSGGS

SEQ ID NO: 612176 - protein, 54 aa, Mycobacterium
VSGGTGGDGGDGGDAREIGNGGNGGNAGAGATAGNEGTGGTGGQLIGVSGTDGS

SEQ ID NO: 612177 - protein, 6 aa, Mycobacterium
VSGGTI

SEQ ID NO: 612178 - protein, 7 aa, Mycobacterium
VSGGYTR

SEQ ID NO: 612179 - protein, 15 aa, Mycobacterium
VSGGYTRDFTKEGEQ

SEQ ID NO: 612180 - protein, 5 aa, Mycobacterium
VSGHG

SEQ ID NO: 612181 - protein, 13 aa, Mycobacterium
VSGHGDSGTRSHY

SEQ ID NO: 612182 - protein, 7 aa, Mycobacterium
VSGHPRE

SEQ ID NO: 612183 - protein, 22 aa, Mycobacterium
VSGHRREEGDARGTRLDAGEGL

SEQ ID NO: 612184 - protein, 8 aa, Mycobacterium
VSGHSGVE

SEQ ID NO: 612185 - protein, 6 aa, Mycobacterium
VSGIAN

SEQ ID NO: 612186 - protein, 7 aa, Mycobacterium
VSGISPG

SEQ ID NO: 612187 - protein, 16 aa, Mycobacterium
VSGITDPTHERYKEAA

SEQ ID NO: 612188 - protein, 11 aa, Mycobacterium
VSGKGSAARRR

SEQ ID NO: 612189 - protein, 9 aa, Mycobacterium
VSGKNNTIT

SEQ ID NO: 612190 - protein, 6 aa, Mycobacterium
VSGKNR

SEQ ID NO: 612191 - protein, 6 aa, Mycobacterium
VSGKSR

SEQ ID NO: 612192 - protein, 6 aa, Mycobacterium
VSGLNA

SEQ ID NO: 612193 - protein, 7 aa, Mycobacterium
VSGLREA

SEQ ID NO: 612194 - protein, 7 aa, Mycobacterium
VSGLSSD

SEQ ID NO: 612195 - protein, 4 aa, Mycobacterium
VSGN

SEQ ID NO: 612196 - protein, 10 aa, Mycobacterium
VSGNGPSRAY

SEQ ID NO: 612197 - protein, 7 aa, Mycobacterium
VSGNPAK

SEQ ID NO: 612198 - protein, 6 aa, Mycobacterium
VSGNQP

SEQ ID NO: 612199 - protein, 8 aa, Mycobacterium
VSGNSGHV

SEQ ID NO: 612200 - protein, 6 aa, Mycobacterium
VSGNTI

SEQ ID NO: 612201 - protein, 12 aa, Mycobacterium
VSGPADGPSQSD

SEQ ID NO: 612202 - protein, 8 aa, Mycobacterium
VSGPAESE

SEQ ID NO: 612203 - protein, 8 aa, Mycobacterium
VSGPAGQP

SEQ ID NO: 612204 - protein, 13 aa, Mycobacterium
VSGPASAFSQSPK

SEQ ID NO: 612205 - protein, 6 aa, Mycobacterium
VSGPAV

SEQ ID NO: 612206 - protein, 7 aa, Mycobacterium
VSGPAYR

SEQ ID NO: 612207 - protein, 8 aa, Mycobacterium
VSGPDDLA

SEQ ID NO: 612208 - protein, 10 aa, Mycobacterium
VSGPDDWDPP

SEQ ID NO: 612209 - protein, 7 aa, Mycobacterium
VSGPDEA

SEQ ID NO: 612210 - protein, 10 aa, Mycobacterium
VSGPDGPASV

SEQ ID NO: 612211 - protein, 9 aa, Mycobacterium
VSGPDGRVT

SEQ ID NO: 612212 - protein, 9 aa, Mycobacterium
VSGPDKGTT

SEQ ID NO: 612213 - protein, 10 aa, Mycobacterium
VSGPDLDRAA

SEQ ID NO: 612214 - protein, 7 aa, Mycobacterium
VSGPEDL

SEQ ID NO: 612215 - protein, 7 aa, Mycobacterium
VSGPEYQ

SEQ ID NO: 612216 - protein, 8 aa, Mycobacterium
VSGPGERS

SEQ ID NO: 612217 - protein, 15 aa, Mycobacterium
VSGPGGPASAAVGTG

SEQ ID NO: 612218 - protein, 7 aa, Mycobacterium
VSGPGLT

SEQ ID NO: 612219 - protein, 6 aa, Mycobacterium
VSGPIE

SEQ ID NO: 612220 - protein, 14 aa, Mycobacterium
VSGPNGPTTASVST

SEQ ID NO: 612221 - protein, 15 aa, Mycobacterium
VSGPPPGGKSPLPPM

SEQ ID NO: 612222 - protein, 7 aa, Mycobacterium
VSGPPRN

SEQ ID NO: 612223 - protein, 10 aa, Mycobacterium
VSGPQKLGPL

SEQ ID NO: 612224 - protein, 9 aa, Mycobacterium
VSGPSTDHY

SEQ ID NO: 612225 - protein, 6 aa, Mycobacterium
VSGPSY

SEQ ID NO: 612226 - protein, 4 aa, Mycobacterium
VSGQ

SEQ ID NO: 612227 - protein, 13 aa, Mycobacterium
VSGQDTGAQASAR

SEQ ID NO: 612228 - protein, 21 aa, Mycobacterium
VSGQLRPGGTIVEPTSGNTGV

SEQ ID NO: 612229 - protein, 5 aa, Mycobacterium
VSGQR

SEQ ID NO: 612230 - protein, 5 aa, Mycobacterium
VSGQS

SEQ ID NO: 612231 - protein, 13 aa, Mycobacterium
VSGQSVVSAHPVS

SEQ ID NO: 612232 - protein, 4 aa, Mycobacterium
VSGR

SEQ ID NO: 612233 - protein, 10 aa, Mycobacterium
VSGRASGEDL

SEQ ID NO: 612234 - protein, 6 aa, Mycobacterium
VSGRAT

SEQ ID NO: 612235 - protein, 7 aa, Mycobacterium
VSGRDHR

SEQ ID NO: 612236 - protein, 9 aa, Mycobacterium
VSGRDRTAR

SEQ ID NO: 612237 - protein, 5 aa, Mycobacterium
VSGRE

SEQ ID NO: 612238 - protein, 6 aa, Mycobacterium
VSGRES

SEQ ID NO: 612239 - protein, 8 aa, Mycobacterium
VSGRGATE

SEQ ID NO: 612240 - protein, 14 aa, Mycobacterium
VSGRGDLAADLRAI

SEQ ID NO: 612241 - protein, 8 aa, Mycobacterium
VSGRGEGV

SEQ ID NO: 612242 - protein, 7 aa, Mycobacterium
VSGRGRD

SEQ ID NO: 612243 - protein, 13 aa, Mycobacterium
VSGRGRPEEGTDA

SEQ ID NO: 612244 - protein, 7 aa, Mycobacterium
VSGRLNP

SEQ ID NO: 612245 - protein, 12 aa, Mycobacterium
VSGRPADLAGAD

SEQ ID NO: 612246 - protein, 11 aa, Mycobacterium
VSGRPAEIPGA

SEQ ID NO: 612247 - protein, 12 aa, Mycobacterium
VSGRPAELAGSD

SEQ ID NO: 612248 - protein, 8 aa, Mycobacterium
VSGRPAEV

SEQ ID NO: 612249 - protein, 7 aa, Mycobacterium
VSGRPGG

SEQ ID NO: 612250 - protein, 6 aa, Mycobacterium
VSGRPN

SEQ ID NO: 612251 - protein, 8 aa, Mycobacterium
VSGRPTDL

SEQ ID NO: 612252 - protein, 11 aa, Mycobacterium
VSGRPTDLAGA

SEQ ID NO: 612253 - protein, 13 aa, Mycobacterium
VSGRPTDLAGSES

SEQ ID NO: 612254 - protein, 12 aa, Mycobacterium
VSGRPTDVPGAD

SEQ ID NO: 612255 - protein, 12 aa, Mycobacterium
VSGRPTELAGSD

SEQ ID NO: 612256 - protein, 13 aa, Mycobacterium
VSGRPTELSGSES

SEQ ID NO: 612257 - protein, 23 aa, Mycobacterium
VSGRRPTPGTAAYGAAKAGVDNL

SEQ ID NO: 612258 - protein, 11 aa, Mycobacterium
VSGRSAEGTGI

SEQ ID NO: 612259 - protein, 20 aa, Mycobacterium
VSGRSGPRLFPPGPASGGDV

SEQ ID NO: 612260 - protein, 10 aa, Mycobacterium
VSGRTGGGTR

SEQ ID NO: 612261 - protein, 7 aa, Mycobacterium
VSGRYTG

SEQ ID NO: 612262 - protein, 4 aa, Mycobacterium
VSGS

SEQ ID NO: 612263 - protein, 9 aa, Mycobacterium
VSGSARSAE

SEQ ID NO: 612264 - protein, 5 aa, Mycobacterium
VSGSD

SEQ ID NO: 612265 - protein, 12 aa, Mycobacterium
VSGSDAKESRGV

SEQ ID NO: 612266 - protein, 12 aa, Mycobacterium
VSGSDRTTRSIP

SEQ ID NO: 612267 - protein, 5 aa, Mycobacterium
VSGSE

SEQ ID NO: 612268 - protein, 11 aa, Mycobacterium
VSGSEEDETAW

SEQ ID NO: 612269 - protein, 5 aa, Mycobacterium
VSGSG

SEQ ID NO: 612270 - protein, 17 aa, Mycobacterium
VSGSGESRKYDAAPLAR

SEQ ID NO: 612271 - protein, 7 aa, Mycobacterium
VSGSGGL

SEQ ID NO: 612272 - protein, 10 aa, Mycobacterium
VSGSGGPRLP

SEQ ID NO: 612273 - protein, 8 aa, Mycobacterium
VSGSGKSS

SEQ ID NO: 612274 - protein, 14 aa, Mycobacterium
VSGSGLATDGGAVD

SEQ ID NO: 612275 - protein, 10 aa, Mycobacterium
VSGSLGSDNR

SEQ ID NO: 612276 - protein, 10 aa, Mycobacterium
VSGSPADPRF

SEQ ID NO: 612277 - protein, 5 aa, Mycobacterium
VSGSR

SEQ ID NO: 612278 - protein, 11 aa, Mycobacterium
VSGSRQYPAIR

SEQ ID NO: 612279 - protein, 8 aa, Mycobacterium
VSGSSGHI

SEQ ID NO: 612280 - protein, 18 aa, Mycobacterium
VSGSSGTAAAKKEALEAA

SEQ ID NO: 612281 - protein, 18 aa, Mycobacterium
VSGSSGTAQAKKEALEAA

SEQ ID NO: 612282 - protein, 11 aa, Mycobacterium
VSGSTRSPLYD

SEQ ID NO: 612283 - protein, 5 aa, Mycobacterium
VSGSV

SEQ ID NO: 612284 - protein, 6 aa, Mycobacterium
VSGTAR

SEQ ID NO: 612285 - protein, 6 aa, Mycobacterium
VSGTDA

SEQ ID NO: 612286 - protein, 8 aa, Mycobacterium
VSGTDNED

SEQ ID NO: 612287 - protein, 7 aa, Mycobacterium
VSGTEAA

SEQ ID NO: 612288 - protein, 7 aa, Mycobacterium
VSGTESD

SEQ ID NO: 612289 - protein, 10 aa, Mycobacterium
VSGTGAGHVE

SEQ ID NO: 612290 - protein, 14 aa, Mycobacterium
VSGTGALGAAGVGA

SEQ ID NO: 612291 - protein, 7 aa, Mycobacterium
VSGTGPS

SEQ ID NO: 612292 - protein, 8 aa, Mycobacterium
VSGTPNDS

SEQ ID NO: 612293 - protein, 8 aa, Mycobacterium
VSGTRTER

SEQ ID NO: 612294 - protein, 5 aa, Mycobacterium
VSGTS

SEQ ID NO: 612295 - protein, 9 aa, Mycobacterium
VSGTSDPEL

SEQ ID NO: 612296 - protein, 9 aa, Mycobacterium
VSGTSGDDI

SEQ ID NO: 612297 - protein, 17 aa, Mycobacterium
VSGTTLSAQARYAAGTR

SEQ ID NO: 612298 - protein, 7 aa, Mycobacterium
VSGTVEN

SEQ ID NO: 612299 - protein, 4 aa, Mycobacterium
VSGV

SEQ ID NO: 612300 - protein, 4 aa, Mycobacterium
VSGY

SEQ ID NO: 612301 - protein, 8 aa, Mycobacterium
VSGYPREY

SEQ ID NO: 612302 - protein, 9 aa, Mycobacterium
VSHAENEFT

SEQ ID NO: 612303 - protein, 16 aa, Mycobacterium
VSHAERVGGGMRERPA

SEQ ID NO: 612304 - protein, 8 aa, Mycobacterium
VSHGSGVT

SEQ ID NO: 612305 - protein, 16 aa, Mycobacterium
VSHGTGKSMPVPLGPE

SEQ ID NO: 612306 - protein, 4 aa, Mycobacterium
VSHT

SEQ ID NO: 612307 - protein, 4 aa, Mycobacterium
VSID

SEQ ID NO: 612308 - protein, 7 aa, Mycobacterium
VSIDGQT

SEQ ID NO: 612309 - protein, 9 aa, Mycobacterium
VSIDGQTHQ

SEQ ID NO: 612310 - protein, 4 aa, Mycobacterium
VSIG

SEQ ID NO: 612311 - protein, 9 aa, Mycobacterium
VSIGGGSVT

SEQ ID NO: 612312 - protein, 8 aa, Mycobacterium
VSIGGSGS

SEQ ID NO: 612313 - protein, 13 aa, Mycobacterium
VSINSGGEKIYPE

SEQ ID NO: 612314 - protein, 10 aa, Mycobacterium
VSINTGGEKV

SEQ ID NO: 612315 - protein, 10 aa, Mycobacterium
VSKAEARDKA

SEQ ID NO: 612316 - protein, 13 aa, Mycobacterium
VSKAYTKATRTHL

SEQ ID NO: 612317 - protein, 5 aa, Mycobacterium
VSKCE

SEQ ID NO: 612318 - protein, 12 aa, Mycobacterium
VSKDGKTEELKA

SEQ ID NO: 612319 - protein, 11 aa, Mycobacterium
VSKDGTLTGPN

SEQ ID NO: 612320 - protein, 9 aa, Mycobacterium
VSKDNGQNW

SEQ ID NO: 612321 - protein, 9 aa, Mycobacterium
VSKDNYRVE

SEQ ID NO: 612322 - protein, 6 aa, Mycobacterium
VSKDQL

SEQ ID NO: 612323 - protein, 9 aa, Mycobacterium
VSKGTAELE

SEQ ID NO: 612324 - protein, 14 aa, Mycobacterium
VSKLTDDSDELSRT

SEQ ID NO: 612325 - protein, 8 aa, Mycobacterium
VSKPEGQE

SEQ ID NO: 612326 - protein, 8 aa, Mycobacterium
VSKPPHPL

SEQ ID NO: 612327 - protein, 6 aa, Mycobacterium
VSKQCP

SEQ ID NO: 612328 - protein, 8 aa, Mycobacterium
VSKQPIYK

SEQ ID NO: 612329 - protein, 10 aa, Mycobacterium
VSKSDQTPWY

SEQ ID NO: 612330 - protein, 7 aa, Mycobacterium
VSKSPVA

SEQ ID NO: 612331 - protein, 6 aa, Mycobacterium
VSKVSD

SEQ ID NO: 612332 - protein, 5 aa, Mycobacterium
VSKYT

SEQ ID NO: 612333 - protein, 10 aa, Mycobacterium
VSLAGSGGFH

SEQ ID NO: 612334 - protein, 6 aa, Mycobacterium
VSLDEG

SEQ ID NO: 612335 - protein, 7 aa, Mycobacterium
VSLDGNT

SEQ ID NO: 612336 - protein, 7 aa, Mycobacterium
VSLEGDD

SEQ ID NO: 612337 - protein, 5 aa, Mycobacterium
VSLET

SEQ ID NO: 612338 - protein, 7 aa, Mycobacterium
VSLGDGS

SEQ ID NO: 612339 - protein, 6 aa, Mycobacterium
VSLGEG

SEQ ID NO: 612340 - protein, 9 aa, Mycobacterium
VSLGPGSMS

SEQ ID NO: 612341 - protein, 5 aa, Mycobacterium
VSLPE

SEQ ID NO: 612342 - protein, 6 aa, Mycobacterium
VSLPEA

SEQ ID NO: 612343 - protein, 10 aa, Mycobacterium
VSLPPRDVEG

SEQ ID NO: 612344 - protein, 10 aa, Mycobacterium
VSLSTGDTLT

SEQ ID NO: 612345 - protein, 14 aa, Mycobacterium
VSLTGDGSDEGPAH

SEQ ID NO: 612346 - protein, 7 aa, Mycobacterium
VSLTGGQ

SEQ ID NO: 612347 - protein, 8 aa, Mycobacterium
VSLTPAGE

SEQ ID NO: 612348 - protein, 12 aa, Mycobacterium
VSMPGGKSARRE

SEQ ID NO: 612349 - protein, 5 aa, Mycobacterium
VSNAG

SEQ ID NO: 612350 - protein, 15 aa, Mycobacterium
VSNDHDVNNERRGYK

SEQ ID NO: 612351 - protein, 15 aa, Mycobacterium
VSNDHDVSNERRGYK

SEQ ID NO: 612352 - protein, 5 aa, Mycobacterium
VSNDI

SEQ ID NO: 612353 - protein, 7 aa, Mycobacterium
VSNDIPS

SEQ ID NO: 612354 - protein, 8 aa, Mycobacterium
VSNDLPSW

SEQ ID NO: 612355 - protein, 4 aa, Mycobacterium
VSNE

SEQ ID NO: 612356 - protein, 6 aa, Mycobacterium
VSNEEA

SEQ ID NO: 612357 - protein, 12 aa, Mycobacterium
VSNEEKAEIARA

SEQ ID NO: 612358 - protein, 8 aa, Mycobacterium
VSNESQGE

SEQ ID NO: 612359 - protein, 5 aa, Mycobacterium
VSNGA

SEQ ID NO: 612360 - protein, 21 aa, Mycobacterium
VSNGAERRDQVGQSIPEPANR

SEQ ID NO: 612361 - protein, 5 aa, Mycobacterium
VSNGD

SEQ ID NO: 612362 - protein, 10 aa, Mycobacterium
VSNGNGDVVQ

SEQ ID NO: 612363 - protein, 14 aa, Mycobacterium
VSNGSLATAADFPG

SEQ ID NO: 612364 - protein, 4 aa, Mycobacterium
VSNL

SEQ ID NO: 612365 - protein, 17 aa, Mycobacterium
VSNPGAPVAPNLGPEPL

SEQ ID NO: 612366 - protein, 17 aa, Mycobacterium
VSNPGAPVPPNVGPEPL

SEQ ID NO: 612367 - protein, 7 aa, Mycobacterium
VSNPGQC

SEQ ID NO: 612368 - protein, 10 aa, Mycobacterium
VSNPNKVGRD

SEQ ID NO: 612369 - protein, 7 aa, Mycobacterium
VSNPREI

SEQ ID NO: 612370 - protein, 15 aa, Mycobacterium
VSNPSGNWPQTNNTA

SEQ ID NO: 612371 - protein, 5 aa, Mycobacterium
VSNST

SEQ ID NO: 612372 - protein, 8 aa, Mycobacterium
VSNTPDVL

SEQ ID NO: 612373 - protein, 4 aa, Mycobacterium
VSPA

SEQ ID NO: 612374 - protein, 25 aa, Mycobacterium
VSPAAAPLSGAAGVAAAQSGASGNL

SEQ ID NO: 612375 - protein, 8 aa, Mycobacterium
VSPAADAL

SEQ ID NO: 612376 - protein, 30 aa, Mycobacterium
VSPAAQRGGAGSAASAQTEIDHPADQLAGN

SEQ ID NO: 612377 - protein, 6 aa, Mycobacterium
VSPAAR

SEQ ID NO: 612378 - protein, 9 aa, Mycobacterium
VSPAATYRS

SEQ ID NO: 612379 - protein, 5 aa, Mycobacterium
VSPAD

SEQ ID NO: 612380 - protein, 6 aa, Mycobacterium
VSPADA

SEQ ID NO: 612381 - protein, 7 aa, Mycobacterium
VSPADRG

SEQ ID NO: 612382 - protein, 5 aa, Mycobacterium
VSPAE

SEQ ID NO: 612383 - protein, 13 aa, Mycobacterium
VSPAGTGGGTQTT

SEQ ID NO: 612384 - protein, 18 aa, Mycobacterium
VSPAKLPAGEYRQISGNT

SEQ ID NO: 612385 - protein, 6 aa, Mycobacterium
VSPANV

SEQ ID NO: 612386 - protein, 5 aa, Mycobacterium
VSPAP

SEQ ID NO: 612387 - protein, 9 aa, Mycobacterium
VSPAPPPRE

SEQ ID NO: 612388 - protein, 8 aa, Mycobacterium
VSPAPQDF

SEQ ID NO: 612389 - protein, 19 aa, Mycobacterium
VSPAPRAAALPATRGASGV

SEQ ID NO: 612390 - protein, 7 aa, Mycobacterium
VSPARAQ

SEQ ID NO: 612391 - protein, 19 aa, Mycobacterium
VSPARSRTAEAGGNFGRRY

SEQ ID NO: 612392 - protein, 8 aa, Mycobacterium
VSPASTGM

SEQ ID NO: 612393 - protein, 12 aa, Mycobacterium
VSPATDKPSTVA

SEQ ID NO: 612394 - protein, 6 aa, Mycobacterium
VSPDAG

SEQ ID NO: 612395 - protein, 6 aa, Mycobacterium
VSPDAP

SEQ ID NO: 612396 - protein, 7 aa, Mycobacterium
VSPDGAT

SEQ ID NO: 612397 - protein, 8 aa, Mycobacterium
VSPDGKRV

SEQ ID NO: 612398 - protein, 6 aa, Mycobacterium
VSPDGR

SEQ ID NO: 612399 - protein, 7 aa, Mycobacterium
VSPDGTG

SEQ ID NO: 612400 - protein, 8 aa, Mycobacterium
VSPDGTRV

SEQ ID NO: 612401 - protein, 6 aa, Mycobacterium
VSPDIA

SEQ ID NO: 612402 - protein, 13 aa, Mycobacterium
VSPDNVEAGTPPY

SEQ ID NO: 612403 - protein, 9 aa, Mycobacterium
VSPDPRAEA

SEQ ID NO: 612404 - protein, 15 aa, Mycobacterium
VSPDRSSCDTPAPRT

SEQ ID NO: 612405 - protein, 7 aa, Mycobacterium
VSPDRYP

SEQ ID NO: 612406 - protein, 6 aa, Mycobacterium
VSPDVA

SEQ ID NO: 612407 - protein, 7 aa, Mycobacterium
VSPEAEW

SEQ ID NO: 612408 - protein, 7 aa, Mycobacterium
VSPEAVA

SEQ ID NO: 612409 - protein, 8 aa, Mycobacterium
VSPEDPAD

SEQ ID NO: 612410 - protein, 7 aa, Mycobacterium
VSPEEAI

SEQ ID NO: 612411 - protein, 7 aa, Mycobacterium
VSPEELG

SEQ ID NO: 612412 - protein, 9 aa, Mycobacterium
VSPEERREA

SEQ ID NO: 612413 - protein, 5 aa, Mycobacterium
VSPEG

SEQ ID NO: 612414 - protein, 8 aa, Mycobacterium
VSPEGEVP

SEQ ID NO: 612415 - protein, 15 aa, Mycobacterium
VSPEGVYSSPIENPG

SEQ ID NO: 612416 - protein, 8 aa, Mycobacterium
VSPEKAAE

SEQ ID NO: 612417 - protein, 6 aa, Mycobacterium
VSPEKV

SEQ ID NO: 612418 - protein, 11 aa, Mycobacterium
VSPEPPPVQHS

SEQ ID NO: 612419 - protein, 11 aa, Mycobacterium
VSPEQAAPGLR

SEQ ID NO: 612420 - protein, 18 aa, Mycobacterium
VSPEQAAPGLRDATVPGR

SEQ ID NO: 612421 - protein, 17 aa, Mycobacterium
VSPEQAAPGLRETRVPG

SEQ ID NO: 612422 - protein, 9 aa, Mycobacterium
VSPEQASTG

SEQ ID NO: 612423 - protein, 6 aa, Mycobacterium
VSPEQD

SEQ ID NO: 612424 - protein, 13 aa, Mycobacterium
VSPEQHGAATPCS

SEQ ID NO: 612425 - protein, 6 aa, Mycobacterium
VSPESV

SEQ ID NO: 612426 - protein, 10 aa, Mycobacterium
VSPESVARTT

SEQ ID NO: 612427 - protein, 5 aa, Mycobacterium
VSPET

SEQ ID NO: 612428 - protein, 10 aa, Mycobacterium
VSPGAGSGQI

SEQ ID NO: 612429 - protein, 31 aa, Mycobacterium
VSPGAQAGAPGGGAADEYAGESPEEAGKATE

SEQ ID NO: 612430 - protein, 10 aa, Mycobacterium
VSPGARTDFS

SEQ ID NO: 612431 - protein, 9 aa, Mycobacterium
VSPGATYRS

SEQ ID NO: 612432 - protein, 8 aa, Mycobacterium
VSPGDVGE

SEQ ID NO: 612433 - protein, 11 aa, Mycobacterium
VSPGEKMSGPM

SEQ ID NO: 612434 - protein, 6 aa, Mycobacterium
VSPGEL

SEQ ID NO: 612435 - protein, 10 aa, Mycobacterium
VSPGGGEAQT

SEQ ID NO: 612436 - protein, 9 aa, Mycobacterium
VSPGNDGRG

SEQ ID NO: 612437 - protein, 9 aa, Mycobacterium
VSPGNEGRG

SEQ ID NO: 612438 - protein, 8 aa, Mycobacterium
VSPGNNGL

SEQ ID NO: 612439 - protein, 7 aa, Mycobacterium
VSPGQPK

SEQ ID NO: 612440 - protein, 12 aa, Mycobacterium
VSPGSCRKPPCA

SEQ ID NO: 612441 - protein, 10 aa, Mycobacterium
VSPGSSHADS

SEQ ID NO: 612442 - protein, 7 aa, Mycobacterium
VSPGTGA

SEQ ID NO: 612443 - protein, 6 aa, Mycobacterium
VSPGTL

SEQ ID NO: 612444 - protein, 5 aa, Mycobacterium
VSPGY

SEQ ID NO: 612445 - protein, 4 aa, Mycobacterium
VSPH

SEQ ID NO: 612446 - protein, 7 aa, Mycobacterium
VSPIPDD

SEQ ID NO: 612447 - protein, 14 aa, Mycobacterium
VSPKAYRERFRTAA

SEQ ID NO: 612448 - protein, 13 aa, Mycobacterium
VSPKGGTSPLEPR

SEQ ID NO: 612449 - protein, 7 aa, Mycobacterium
VSPKRLD

SEQ ID NO: 612450 - protein, 11 aa, Mycobacterium
VSPLPADAGLT

SEQ ID NO: 612451 - protein, 6 aa, Mycobacterium
VSPLQT

SEQ ID NO: 612452 - protein, 41 aa, Mycobacterium
VSPLSTGTPTNSETPVTTTTATKTAPRVPTPPRPPQPGAPR

SEQ ID NO: 612453 - protein, 19 aa, Mycobacterium
VSPMPGGTDIEFPAPQHHG

SEQ ID NO: 612454 - protein, 10 aa, Mycobacterium
VSPNAGAAHM

SEQ ID NO: 612455 - protein, 6 aa, Mycobacterium
VSPNTI

SEQ ID NO: 612456 - protein, 10 aa, Mycobacterium
VSPNYRPRYD

SEQ ID NO: 612457 - protein, 12 aa, Mycobacterium
VSPPADGPSVHG

SEQ ID NO: 612458 - protein, 11 aa, Mycobacterium
VSPPAGGPTGM

SEQ ID NO: 612459 - protein, 7 aa, Mycobacterium
VSPPAIG

SEQ ID NO: 612460 - protein, 19 aa, Mycobacterium
VSPPDSPSSMKSPRVCTAG

SEQ ID NO: 612461 - protein, 6 aa, Mycobacterium
VSPPFK

SEQ ID NO: 612462 - protein, 7 aa, Mycobacterium
VSPPGDG

SEQ ID NO: 612463 - protein, 11 aa, Mycobacterium
VSPPGPSTSEI

SEQ ID NO: 612464 - protein, 10 aa, Mycobacterium
VSPPGYDSAR

SEQ ID NO: 612465 - protein, 10 aa, Mycobacterium
VSPPNDTGDG

SEQ ID NO: 612466 - protein, 10 aa, Mycobacterium
VSPPNNTGDG

SEQ ID NO: 612467 - protein, 10 aa, Mycobacterium
VSPPNNTGEG

SEQ ID NO: 612468 - protein, 7 aa, Mycobacterium
VSPPPEV

SEQ ID NO: 612469 - protein, 6 aa, Mycobacterium
VSPPPV

SEQ ID NO: 612470 - protein, 6 aa, Mycobacterium
VSPQNA

SEQ ID NO: 612471 - protein, 9 aa, Mycobacterium
VSPQPEPDL

SEQ ID NO: 612472 - protein, 4 aa, Mycobacterium
VSPR

SEQ ID NO: 612473 - protein, 7 aa, Mycobacterium
VSPRAQA

SEQ ID NO: 612474 - protein, 9 aa, Mycobacterium
VSPRDGRDD

SEQ ID NO: 612475 - protein, 8 aa, Mycobacterium
VSPRGATA

SEQ ID NO: 612476 - protein, 6 aa, Mycobacterium
VSPRGG

SEQ ID NO: 612477 - protein, 16 aa, Mycobacterium
VSPRKGGPRAPRGQRN

SEQ ID NO: 612478 - protein, 8 aa, Mycobacterium
VSPRPADL

SEQ ID NO: 612479 - protein, 4 aa, Mycobacterium
VSPS

SEQ ID NO: 612480 - protein, 10 aa, Mycobacterium
VSPSATPGTV

SEQ ID NO: 612481 - protein, 8 aa, Mycobacterium
VSPSAYRR

SEQ ID NO: 612482 - protein, 12 aa, Mycobacterium
VSPSEATSGPLA

SEQ ID NO: 612483 - protein, 7 aa, Mycobacterium
VSPSMGP

SEQ ID NO: 612484 - protein, 7 aa, Mycobacterium
VSPSPDV

SEQ ID NO: 612485 - protein, 7 aa, Mycobacterium
VSPSPHR

SEQ ID NO: 612486 - protein, 5 aa, Mycobacterium
VSPSS

SEQ ID NO: 612487 - protein, 23 aa, Mycobacterium
VSPSSADALPAGFANSPGSLPGR

SEQ ID NO: 612488 - protein, 13 aa, Mycobacterium
VSPSSVTENPQLR

SEQ ID NO: 612489 - protein, 19 aa, Mycobacterium
VSPSTAVSAKAASGGDTGI

SEQ ID NO: 612490 - protein, 39 aa, Mycobacterium
VSPSTLPQAIEPPGLPSGRVQEAGVEPDPGQLAALKWCE

SEQ ID NO: 612491 - protein, 9 aa, Mycobacterium
VSPTADAVR

SEQ ID NO: 612492 - protein, 169 aa, Mycobacterium
VSPTAGYQGGQGGMGGKGGDGGAGIGGVGGGAGGEGGVGGAGGTGGQGGANTGATGGMGADGGKGGTGGAAGAGGMGTDGGAAGANGTGGVGGTGGDGGAGGTGIAGTDDQVSPTAGHQGGQGGMGGTGGDGGAGIGGVGGGAGGKGGVGGAGGTGGQGGGPGGTGGIA

SEQ ID NO: 612493 - protein, 6 aa, Mycobacterium
VSPTAR

SEQ ID NO: 612494 - protein, 13 aa, Mycobacterium
VSPTARRPRTGPR

SEQ ID NO: 612495 - protein, 6 aa, Mycobacterium
VSPTAT

SEQ ID NO: 612496 - protein, 6 aa, Mycobacterium
VSPTDA

SEQ ID NO: 612497 - protein, 6 aa, Mycobacterium
VSPTGC

SEQ ID NO: 612498 - protein, 6 aa, Mycobacterium
VSPTGS

SEQ ID NO: 612499 - protein, 18 aa, Mycobacterium
VSPTGVLGDPTTATAAAG

SEQ ID NO: 612500 - protein, 7 aa, Mycobacterium
VSPTHRR

SEQ ID NO: 612501 - protein, 12 aa, Mycobacterium
VSPTIDPAAEVS

SEQ ID NO: 612502 - protein, 9 aa, Mycobacterium
VSPTKEKKA

SEQ ID NO: 612503 - protein, 6 aa, Mycobacterium
VSPTPD

SEQ ID NO: 612504 - protein, 9 aa, Mycobacterium
VSPTPLQED

SEQ ID NO: 612505 - protein, 6 aa, Mycobacterium
VSPTTL

SEQ ID NO: 612506 - protein, 6 aa, Mycobacterium
VSPTTV

SEQ ID NO: 612507 - protein, 15 aa, Mycobacterium
VSPVDPARMTPRDVE

SEQ ID NO: 612508 - protein, 9 aa, Mycobacterium
VSPVPSESA

SEQ ID NO: 612509 - protein, 7 aa, Mycobacterium
VSQAADR

SEQ ID NO: 612510 - protein, 10 aa, Mycobacterium
VSQAARDGDT

SEQ ID NO: 612511 - protein, 10 aa, Mycobacterium
VSQAPYGLAG

SEQ ID NO: 612512 - protein, 4 aa, Mycobacterium
VSQD

SEQ ID NO: 612513 - protein, 17 aa, Mycobacterium
VSQDDAATALQRETGGR

SEQ ID NO: 612514 - protein, 20 aa, Mycobacterium
VSQDGHTDGITVPNEEAQEA

SEQ ID NO: 612515 - protein, 8 aa, Mycobacterium
VSQDPGGL

SEQ ID NO: 612516 - protein, 6 aa, Mycobacterium
VSQDTV

SEQ ID NO: 612517 - protein, 5 aa, Mycobacterium
VSQDV

SEQ ID NO: 612518 - protein, 11 aa, Mycobacterium
VSQEAPGLPVD

SEQ ID NO: 612519 - protein, 7 aa, Mycobacterium
VSQEQRQ

SEQ ID NO: 612520 - protein, 11 aa, Mycobacterium
VSQGKAATYRA

SEQ ID NO: 612521 - protein, 12 aa, Mycobacterium
VSQGKATSYRAA

SEQ ID NO: 612522 - protein, 17 aa, Mycobacterium
VSQGLAAAADQLDSSAD

SEQ ID NO: 612523 - protein, 12 aa, Mycobacterium
VSQGPSSTVHSG

SEQ ID NO: 612524 - protein, 7 aa, Mycobacterium
VSQGRQV

SEQ ID NO: 612525 - protein, 11 aa, Mycobacterium
VSQLPAAKRGV

SEQ ID NO: 612526 - protein, 5 aa, Mycobacterium
VSQPA

SEQ ID NO: 612527 - protein, 7 aa, Mycobacterium
VSQPAAE

SEQ ID NO: 612528 - protein, 15 aa, Mycobacterium
VSQPAPEEKHVKIAA

SEQ ID NO: 612529 - protein, 7 aa, Mycobacterium
VSQPEQV

SEQ ID NO: 612530 - protein, 18 aa, Mycobacterium
VSQPGTEPETGYKPSAKL

SEQ ID NO: 612531 - protein, 13 aa, Mycobacterium
VSQPSLQKGRRAG

SEQ ID NO: 612532 - protein, 6 aa, Mycobacterium
VSQPTI

SEQ ID NO: 612533 - protein, 19 aa, Mycobacterium
VSQQAGSGLPALPPAPQFA

SEQ ID NO: 612534 - protein, 12 aa, Mycobacterium
VSQQFEKTAEDP

SEQ ID NO: 612535 - protein, 12 aa, Mycobacterium
VSQQFEKTAQDP

SEQ ID NO: 612536 - protein, 4 aa, Mycobacterium
VSQR

SEQ ID NO: 612537 - protein, 8 aa, Mycobacterium
VSQSAGDL

SEQ ID NO: 612538 - protein, 18 aa, Mycobacterium
VSQSGGKMPVSTGSTEER

SEQ ID NO: 612539 - protein, 8 aa, Mycobacterium
VSQSGTHY

SEQ ID NO: 612540 - protein, 5 aa, Mycobacterium
VSQTA

SEQ ID NO: 612541 - protein, 5 aa, Mycobacterium
VSQTG

SEQ ID NO: 612542 - protein, 7 aa, Mycobacterium
VSQTGEW

SEQ ID NO: 612543 - protein, 8 aa, Mycobacterium
VSQTGKPV

SEQ ID NO: 612544 - protein, 7 aa, Mycobacterium
VSQTPVR

SEQ ID NO: 612545 - protein, 4 aa, Mycobacterium
VSRA

SEQ ID NO: 612546 - protein, 7 aa, Mycobacterium
VSRAEDG

SEQ ID NO: 612547 - protein, 10 aa, Mycobacterium
VSRAEDIGRG

SEQ ID NO: 612548 - protein, 8 aa, Mycobacterium
VSRAEQPR

SEQ ID NO: 612549 - protein, 6 aa, Mycobacterium
VSRAGT

SEQ ID NO: 612550 - protein, 6 aa, Mycobacterium
VSRARP

SEQ ID NO: 612551 - protein, 5 aa, Mycobacterium
VSRAS

SEQ ID NO: 612552 - protein, 5 aa, Mycobacterium
VSRDA

SEQ ID NO: 612553 - protein, 8 aa, Mycobacterium
VSRDDAGK

SEQ ID NO: 612554 - protein, 12 aa, Mycobacterium
VSRDERSTKGGT

SEQ ID NO: 612555 - protein, 5 aa, Mycobacterium
VSRDG

SEQ ID NO: 612556 - protein, 8 aa, Mycobacterium
VSRDGATV

SEQ ID NO: 612557 - protein, 10 aa, Mycobacterium
VSRDGPSRAY

SEQ ID NO: 612558 - protein, 10 aa, Mycobacterium
VSRDGSNQRA

SEQ ID NO: 612559 - protein, 8 aa, Mycobacterium
VSRDRGVP

SEQ ID NO: 612560 - protein, 4 aa, Mycobacterium
VSRE

SEQ ID NO: 612561 - protein, 5 aa, Mycobacterium
VSREG

SEQ ID NO: 612562 - protein, 10 aa, Mycobacterium
VSRELSPSYT

SEQ ID NO: 612563 - protein, 6 aa, Mycobacterium
VSREPG

SEQ ID NO: 612564 - protein, 14 aa, Mycobacterium
VSRGADASRIQHDP

SEQ ID NO: 612565 - protein, 6 aa, Mycobacterium
VSRGAT

SEQ ID NO: 612566 - protein, 5 aa, Mycobacterium
VSRGL

SEQ ID NO: 612567 - protein, 8 aa, Mycobacterium
VSRGPLPP

SEQ ID NO: 612568 - protein, 8 aa, Mycobacterium
VSRGPLRE

SEQ ID NO: 612569 - protein, 5 aa, Mycobacterium
VSRGR

SEQ ID NO: 612570 - protein, 14 aa, Mycobacterium
VSRGRGQDNKVDAD

SEQ ID NO: 612571 - protein, 11 aa, Mycobacterium
VSRGTEQEARH

SEQ ID NO: 612572 - protein, 5 aa, Mycobacterium
VSRHG

SEQ ID NO: 612573 - protein, 9 aa, Mycobacterium
VSRIEPATD

SEQ ID NO: 612574 - protein, 4 aa, Mycobacterium
VSRP

SEQ ID NO: 612575 - protein, 22 aa, Mycobacterium
VSRPASVPSGRALPATLTAPGR

SEQ ID NO: 612576 - protein, 17 aa, Mycobacterium
VSRPATSYTAAAPDNSI

SEQ ID NO: 612577 - protein, 23 aa, Mycobacterium
VSRPDTVDTGRARPAQLSRSGTA

SEQ ID NO: 612578 - protein, 10 aa, Mycobacterium
VSRPGGNKKR

SEQ ID NO: 612579 - protein, 7 aa, Mycobacterium
VSRPGTH

SEQ ID NO: 612580 - protein, 9 aa, Mycobacterium
VSRPGTNAQ

SEQ ID NO: 612581 - protein, 10 aa, Mycobacterium
VSRPKKRNAL

SEQ ID NO: 612582 - protein, 8 aa, Mycobacterium
VSRPTAGR

SEQ ID NO: 612583 - protein, 6 aa, Mycobacterium
VSRPTG

SEQ ID NO: 612584 - protein, 5 aa, Mycobacterium
VSRQN

SEQ ID NO: 612585 - protein, 5 aa, Mycobacterium
VSRQS

SEQ ID NO: 612586 - protein, 6 aa, Mycobacterium
VSRQSC

SEQ ID NO: 612587 - protein, 7 aa, Mycobacterium
VSRREPG

SEQ ID NO: 612588 - protein, 6 aa, Mycobacterium
VSRRGY

SEQ ID NO: 612589 - protein, 4 aa, Mycobacterium
VSRS

SEQ ID NO: 612590 - protein, 5 aa, Mycobacterium
VSRSD

SEQ ID NO: 612591 - protein, 7 aa, Mycobacterium
VSRSDVG

SEQ ID NO: 612592 - protein, 15 aa, Mycobacterium
VSRSEYDHYCEVRGI

SEQ ID NO: 612593 - protein, 7 aa, Mycobacterium
VSRSFGA

SEQ ID NO: 612594 - protein, 7 aa, Mycobacterium
VSRSGEV

SEQ ID NO: 612595 - protein, 8 aa, Mycobacterium
VSRSGEVI

SEQ ID NO: 612596 - protein, 13 aa, Mycobacterium
VSRSGRDKMKEAR

SEQ ID NO: 612597 - protein, 7 aa, Mycobacterium
VSRSPEE

SEQ ID NO: 612598 - protein, 11 aa, Mycobacterium
VSRTARDGDTF

SEQ ID NO: 612599 - protein, 9 aa, Mycobacterium
VSRTGTAMA

SEQ ID NO: 612600 - protein, 6 aa, Mycobacterium
VSRTGV

SEQ ID NO: 612601 - protein, 6 aa, Mycobacterium
VSRTPA

SEQ ID NO: 612602 - protein, 5 aa, Mycobacterium
VSRTT

SEQ ID NO: 612603 - protein, 4 aa, Mycobacterium
VSRY

SEQ ID NO: 612604 - protein, 5 aa, Mycobacterium
VSRYT

SEQ ID NO: 612605 - protein, 11 aa, Mycobacterium
VSSAAAALPGG

SEQ ID NO: 612606 - protein, 9 aa, Mycobacterium
VSSAEGGVV

SEQ ID NO: 612607 - protein, 9 aa, Mycobacterium
VSSAEVTDA

SEQ ID NO: 612608 - protein, 8 aa, Mycobacterium
VSSAGASV

SEQ ID NO: 612609 - protein, 9 aa, Mycobacterium
VSSAGEQAK

SEQ ID NO: 612610 - protein, 10 aa, Mycobacterium
VSSAGEQAKI

SEQ ID NO: 612611 - protein, 8 aa, Mycobacterium
VSSAGTGD

SEQ ID NO: 612612 - protein, 8 aa, Mycobacterium
VSSAGTGN

SEQ ID NO: 612613 - protein, 15 aa, Mycobacterium
VSSANGDGLTESQRY

SEQ ID NO: 612614 - protein, 7 aa, Mycobacterium
VSSANGR

SEQ ID NO: 612615 - protein, 9 aa, Mycobacterium
VSSAPYGSA

SEQ ID NO: 612616 - protein, 9 aa, Mycobacterium
VSSAQARIA

SEQ ID NO: 612617 - protein, 10 aa, Mycobacterium
VSSAQARIAA

SEQ ID NO: 612618 - protein, 8 aa, Mycobacterium
VSSAQARL

SEQ ID NO: 612619 - protein, 9 aa, Mycobacterium
VSSATGTTI

SEQ ID NO: 612620 - protein, 11 aa, Mycobacterium
VSSDAAPEEIK

SEQ ID NO: 612621 - protein, 12 aa, Mycobacterium
VSSDAKVLNDDS

SEQ ID NO: 612622 - protein, 12 aa, Mycobacterium
VSSDASADEIKK

SEQ ID NO: 612623 - protein, 27 aa, Mycobacterium
VSSDASKFERETEGRTPAQGIQDGVEA

SEQ ID NO: 612624 - protein, 6 aa, Mycobacterium
VSSDDL

SEQ ID NO: 612625 - protein, 7 aa, Mycobacterium
VSSDDLA

SEQ ID NO: 612626 - protein, 7 aa, Mycobacterium
VSSDDLD

SEQ ID NO: 612627 - protein, 24 aa, Mycobacterium
VSSDHPGDRPHPPQTNGDGTNWPR

SEQ ID NO: 612628 - protein, 10 aa, Mycobacterium
VSSDPDAQTA

SEQ ID NO: 612629 - protein, 4 aa, Mycobacterium
VSSE

SEQ ID NO: 612630 - protein, 15 aa, Mycobacterium
VSSEAKEKLSREAGA

SEQ ID NO: 612631 - protein, 18 aa, Mycobacterium
VSSEATDEFNDQAREAMK

SEQ ID NO: 612632 - protein, 6 aa, Mycobacterium
VSSEEH

SEQ ID NO: 612633 - protein, 7 aa, Mycobacterium
VSSEETF

SEQ ID NO: 612634 - protein, 10 aa, Mycobacterium
VSSESDRHRA

SEQ ID NO: 612635 - protein, 5 aa, Mycobacterium
VSSGA

SEQ ID NO: 612636 - protein, 31 aa, Mycobacterium
VSSGATVAGATPTAHAAAAPSGPSSAGPVAA

SEQ ID NO: 612637 - protein, 9 aa, Mycobacterium
VSSGDDSAL

SEQ ID NO: 612638 - protein, 8 aa, Mycobacterium
VSSGDNSN

SEQ ID NO: 612639 - protein, 9 aa, Mycobacterium
VSSGDNSNI

SEQ ID NO: 612640 - protein, 7 aa, Mycobacterium
VSSGEPL

SEQ ID NO: 612641 - protein, 7 aa, Mycobacterium
VSSGETH

SEQ ID NO: 612642 - protein, 10 aa, Mycobacterium
VSSGKPGAHF

SEQ ID NO: 612643 - protein, 15 aa, Mycobacterium
VSSGKPGRDPEAKRY

SEQ ID NO: 612644 - protein, 14 aa, Mycobacterium
VSSGKPGRDPEARR

SEQ ID NO: 612645 - protein, 6 aa, Mycobacterium
VSSGPN

SEQ ID NO: 612646 - protein, 8 aa, Mycobacterium
VSSGRAEQ

SEQ ID NO: 612647 - protein, 9 aa, Mycobacterium
VSSGRPPRY

SEQ ID NO: 612648 - protein, 5 aa, Mycobacterium
VSSGV

SEQ ID NO: 612649 - protein, 29 aa, Mycobacterium
VSSHGSGTASTGAAGTNVEHSTAPPPTEI

SEQ ID NO: 612650 - protein, 11 aa, Mycobacterium
VSSHQTASRRR

SEQ ID NO: 612651 - protein, 9 aa, Mycobacterium
VSSKAADVD

SEQ ID NO: 612652 - protein, 10 aa, Mycobacterium
VSSKAADVDA

SEQ ID NO: 612653 - protein, 10 aa, Mycobacterium
VSSKKRDDLQ

SEQ ID NO: 612654 - protein, 4 aa, Mycobacterium
VSSN

SEQ ID NO: 612655 - protein, 6 aa, Mycobacterium
VSSNDG

SEQ ID NO: 612656 - protein, 7 aa, Mycobacterium
VSSNPDA

SEQ ID NO: 612657 - protein, 18 aa, Mycobacterium
VSSNRSRPAEGGPEPELG

SEQ ID NO: 612658 - protein, 7 aa, Mycobacterium
VSSNTIA

SEQ ID NO: 612659 - protein, 10 aa, Mycobacterium
VSSPAASAGW

SEQ ID NO: 612660 - protein, 19 aa, Mycobacterium
VSSPDTPEVPDRMGADEVN

SEQ ID NO: 612661 - protein, 6 aa, Mycobacterium
VSSPEA

SEQ ID NO: 612662 - protein, 10 aa, Mycobacterium
VSSPGGNKQR

SEQ ID NO: 612663 - protein, 7 aa, Mycobacterium
VSSPGLA

SEQ ID NO: 612664 - protein, 8 aa, Mycobacterium
VSSPPGRR

SEQ ID NO: 612665 - protein, 9 aa, Mycobacterium
VSSPQRSYE

SEQ ID NO: 612666 - protein, 5 aa, Mycobacterium
VSSPT

SEQ ID NO: 612667 - protein, 6 aa, Mycobacterium
VSSPYQ

SEQ ID NO: 612668 - protein, 8 aa, Mycobacterium
VSSQHSVA

SEQ ID NO: 612669 - protein, 11 aa, Mycobacterium
VSSQHTAARRR

SEQ ID NO: 612670 - protein, 12 aa, Mycobacterium
VSSQHTASRRRV

SEQ ID NO: 612671 - protein, 10 aa, Mycobacterium
VSSQNGTEQQ

SEQ ID NO: 612672 - protein, 9 aa, Mycobacterium
VSSQSDGDL

SEQ ID NO: 612673 - protein, 8 aa, Mycobacterium
VSSQSVRS

SEQ ID NO: 612674 - protein, 4 aa, Mycobacterium
VSSR

SEQ ID NO: 612675 - protein, 17 aa, Mycobacterium
VSSRASVSGLAQAAAGL

SEQ ID NO: 612676 - protein, 6 aa, Mycobacterium
VSSRDE

SEQ ID NO: 612677 - protein, 9 aa, Mycobacterium
VSSRDEQIG

SEQ ID NO: 612678 - protein, 8 aa, Mycobacterium
VSSRDEQL

SEQ ID NO: 612679 - protein, 9 aa, Mycobacterium
VSSRDEQVG

SEQ ID NO: 612680 - protein, 9 aa, Mycobacterium
VSSRDPEIG

SEQ ID NO: 612681 - protein, 18 aa, Mycobacterium
VSSRGQAVSEAIRIGLLA

SEQ ID NO: 612682 - protein, 7 aa, Mycobacterium
VSSRNYQ

SEQ ID NO: 612683 - protein, 8 aa, Mycobacterium
VSSRPRTG

SEQ ID NO: 612684 - protein, 7 aa, Mycobacterium
VSSRRQG

SEQ ID NO: 612685 - protein, 6 aa, Mycobacterium
VSSRTA

SEQ ID NO: 612686 - protein, 6 aa, Mycobacterium
VSSRTV

SEQ ID NO: 612687 - protein, 6 aa, Mycobacterium
VSSSAA

SEQ ID NO: 612688 - protein, 10 aa, Mycobacterium
VSSSGPSRAY

SEQ ID NO: 612689 - protein, 12 aa, Mycobacterium
VSSSGSTAPLGR

SEQ ID NO: 612690 - protein, 6 aa, Mycobacterium
VSSSPD

SEQ ID NO: 612691 - protein, 4 aa, Mycobacterium
VSST

SEQ ID NO: 612692 - protein, 21 aa, Mycobacterium
VSSTAKLDTANQIAGRAEGTL

SEQ ID NO: 612693 - protein, 14 aa, Mycobacterium
VSSTATQDEIKKAA

SEQ ID NO: 612694 - protein, 6 aa, Mycobacterium
VSSTGI

SEQ ID NO: 612695 - protein, 8 aa, Mycobacterium
VSSTPNTL

SEQ ID NO: 612696 - protein, 11 aa, Mycobacterium
VSSTSAGALRG

SEQ ID NO: 612697 - protein, 13 aa, Mycobacterium
VSSTTAGALQGAG

SEQ ID NO: 612698 - protein, 8 aa, Mycobacterium
VSSVDPTP

SEQ ID NO: 612699 - protein, 11 aa, Mycobacterium
VSSVTKSNAQQ

SEQ ID NO: 612700 - protein, 4 aa, Mycobacterium
VSTA

SEQ ID NO: 612701 - protein, 11 aa, Mycobacterium
VSTAAGAAGAL

SEQ ID NO: 612702 - protein, 15 aa, Mycobacterium
VSTACDDAGATEPPE

SEQ ID NO: 612703 - protein, 7 aa, Mycobacterium
VSTADAR

SEQ ID NO: 612704 - protein, 6 aa, Mycobacterium
VSTAET

SEQ ID NO: 612705 - protein, 6 aa, Mycobacterium
VSTAPW

SEQ ID NO: 612706 - protein, 6 aa, Mycobacterium
VSTARA

SEQ ID NO: 612707 - protein, 7 aa, Mycobacterium
VSTARAR

SEQ ID NO: 612708 - protein, 7 aa, Mycobacterium
VSTASTT

SEQ ID NO: 612709 - protein, 12 aa, Mycobacterium
VSTATAAAARST

SEQ ID NO: 612710 - protein, 6 aa, Mycobacterium
VSTATD

SEQ ID NO: 612711 - protein, 7 aa, Mycobacterium
VSTDADA

SEQ ID NO: 612712 - protein, 22 aa, Mycobacterium
VSTDAGAPGTTPAPPPAPIAAP

SEQ ID NO: 612713 - protein, 10 aa, Mycobacterium
VSTDARADLA

SEQ ID NO: 612714 - protein, 9 aa, Mycobacterium
VSTDASGRY

SEQ ID NO: 612715 - protein, 11 aa, Mycobacterium
VSTDASGRYTQ

SEQ ID NO: 612716 - protein, 5 aa, Mycobacterium
VSTDD

SEQ ID NO: 612717 - protein, 6 aa, Mycobacterium
VSTDDT

SEQ ID NO: 612718 - protein, 18 aa, Mycobacterium
VSTDGRRGRGRKANDVRA

SEQ ID NO: 612719 - protein, 15 aa, Mycobacterium
VSTDKSTDRVTGNEI

SEQ ID NO: 612720 - protein, 6 aa, Mycobacterium
VSTDPD

SEQ ID NO: 612721 - protein, 24 aa, Mycobacterium
VSTDPDDGGVAAGGAGGENVSTEF

SEQ ID NO: 612722 - protein, 11 aa, Mycobacterium
VSTDPDLTSSS

SEQ ID NO: 612723 - protein, 17 aa, Mycobacterium
VSTDPDPETWNEAADRV

SEQ ID NO: 612724 - protein, 14 aa, Mycobacterium
VSTDPHATGPERLE

SEQ ID NO: 612725 - protein, 27 aa, Mycobacterium
VSTDPPHRESPPLQTERKRHRRGAQDW

SEQ ID NO: 612726 - protein, 6 aa, Mycobacterium
VSTDRG

SEQ ID NO: 612727 - protein, 10 aa, Mycobacterium
VSTDSAAGRI

SEQ ID NO: 612728 - protein, 8 aa, Mycobacterium
VSTEGTIS

SEQ ID NO: 612729 - protein, 11 aa, Mycobacterium
VSTEPLPTGDV

SEQ ID NO: 612730 - protein, 7 aa, Mycobacterium
VSTERAR

SEQ ID NO: 612731 - protein, 11 aa, Mycobacterium
VSTERYPEWGP

SEQ ID NO: 612732 - protein, 6 aa, Mycobacterium
VSTGAV

SEQ ID NO: 612733 - protein, 5 aa, Mycobacterium
VSTGE

SEQ ID NO: 612734 - protein, 17 aa, Mycobacterium
VSTGGGVPSGVMLLHRA

SEQ ID NO: 612735 - protein, 7 aa, Mycobacterium
VSTGLDG

SEQ ID NO: 612736 - protein, 14 aa, Mycobacterium
VSTGLTKAARGRQV

SEQ ID NO: 612737 - protein, 8 aa, Mycobacterium
VSTGPDED

SEQ ID NO: 612738 - protein, 5 aa, Mycobacterium
VSTGQ

SEQ ID NO: 612739 - protein, 8 aa, Mycobacterium
VSTGQNPA

SEQ ID NO: 612740 - protein, 5 aa, Mycobacterium
VSTGR

SEQ ID NO: 612741 - protein, 8 aa, Mycobacterium
VSTGRGQR

SEQ ID NO: 612742 - protein, 7 aa, Mycobacterium
VSTGRSE

SEQ ID NO: 612743 - protein, 17 aa, Mycobacterium
VSTGSPEDSSDPDDPDH

SEQ ID NO: 612744 - protein, 6 aa, Mycobacterium
VSTHAD

SEQ ID NO: 612745 - protein, 4 aa, Mycobacterium
VSTK

SEQ ID NO: 612746 - protein, 6 aa, Mycobacterium
VSTKAA

SEQ ID NO: 612747 - protein, 9 aa, Mycobacterium
VSTKAARTH

SEQ ID NO: 612748 - protein, 10 aa, Mycobacterium
VSTKAARTHA

SEQ ID NO: 612749 - protein, 8 aa, Mycobacterium
VSTKPDRA

SEQ ID NO: 612750 - protein, 6 aa, Mycobacterium
VSTKPG

SEQ ID NO: 612751 - protein, 7 aa, Mycobacterium
VSTKSID

SEQ ID NO: 612752 - protein, 4 aa, Mycobacterium
VSTP

SEQ ID NO: 612753 - protein, 11 aa, Mycobacterium
VSTPAAPFGGV

SEQ ID NO: 612754 - protein, 7 aa, Mycobacterium
VSTPADA

SEQ ID NO: 612755 - protein, 14 aa, Mycobacterium
VSTPDKAELSRRAG

SEQ ID NO: 612756 - protein, 6 aa, Mycobacterium
VSTPEF

SEQ ID NO: 612757 - protein, 7 aa, Mycobacterium
VSTPEGQ

SEQ ID NO: 612758 - protein, 16 aa, Mycobacterium
VSTPEKAKLSRDAGAA

SEQ ID NO: 612759 - protein, 16 aa, Mycobacterium
VSTPEKAKLSREAGAA

SEQ ID NO: 612760 - protein, 17 aa, Mycobacterium
VSTPEKARMSAKAGADE

SEQ ID NO: 612761 - protein, 17 aa, Mycobacterium
VSTPEKARMSRAAGADE

SEQ ID NO: 612762 - protein, 7 aa, Mycobacterium
VSTPGDL

SEQ ID NO: 612763 - protein, 5 aa, Mycobacterium
VSTPR

SEQ ID NO: 612764 - protein, 5 aa, Mycobacterium
VSTPY

SEQ ID NO: 612765 - protein, 14 aa, Mycobacterium
VSTQAIEKAADGTL

SEQ ID NO: 612766 - protein, 16 aa, Mycobacterium
VSTRAKLEDDARRAEA

SEQ ID NO: 612767 - protein, 14 aa, Mycobacterium
VSTRAQADDTVGNQ

SEQ ID NO: 612768 - protein, 9 aa, Mycobacterium
VSTRDADRS

SEQ ID NO: 612769 - protein, 8 aa, Mycobacterium
VSTRDDGV

SEQ ID NO: 612770 - protein, 9 aa, Mycobacterium
VSTRDGAPL

SEQ ID NO: 612771 - protein, 12 aa, Mycobacterium
VSTRDPDRPPVQ

SEQ ID NO: 612772 - protein, 7 aa, Mycobacterium
VSTRPAP

SEQ ID NO: 612773 - protein, 8 aa, Mycobacterium
VSTRRART

SEQ ID NO: 612774 - protein, 9 aa, Mycobacterium
VSTRSQISG

SEQ ID NO: 612775 - protein, 7 aa, Mycobacterium
VSTSATR

SEQ ID NO: 612776 - protein, 7 aa, Mycobacterium
VSTSDAR

SEQ ID NO: 612777 - protein, 7 aa, Mycobacterium
VSTSGHT

SEQ ID NO: 612778 - protein, 7 aa, Mycobacterium
VSTSSDD

SEQ ID NO: 612779 - protein, 4 aa, Mycobacterium
VSTT

SEQ ID NO: 612780 - protein, 7 aa, Mycobacterium
VSTTAGL

SEQ ID NO: 612781 - protein, 8 aa, Mycobacterium
VSTTEPGV

SEQ ID NO: 612782 - protein, 12 aa, Mycobacterium
VSTTGRDAATDD

SEQ ID NO: 612783 - protein, 21 aa, Mycobacterium
VSTTTGPGIPVDPSITRNFAE

SEQ ID NO: 612784 - protein, 21 aa, Mycobacterium
VSTTTGPGIPVDPSVTRNFAE

SEQ ID NO: 612785 - protein, 21 aa, Mycobacterium
VSTTTGPGIPVDPSVTRNFSE

SEQ ID NO: 612786 - protein, 9 aa, Mycobacterium
VSTTTRTEI

SEQ ID NO: 612787 - protein, 20 aa, Mycobacterium
VSTVTGGERSAVRHDRATSR

SEQ ID NO: 612788 - protein, 12 aa, Mycobacterium
VSVDASGLGLSA

SEQ ID NO: 612789 - protein, 5 aa, Mycobacterium
VSVDD

SEQ ID NO: 612790 - protein, 6 aa, Mycobacterium
VSVDDR

SEQ ID NO: 612791 - protein, 11 aa, Mycobacterium
VSVDGQPRPLP

SEQ ID NO: 612792 - protein, 12 aa, Mycobacterium
VSVEGEPQPLPD

SEQ ID NO: 612793 - protein, 6 aa, Mycobacterium
VSVEGQ

SEQ ID NO: 612794 - protein, 10 aa, Mycobacterium
VSVKGPKGTL

SEQ ID NO: 612795 - protein, 35 aa, Mycobacterium
VSVPPQRPGPAPAASRGPAAARGRRRRSRRPAAAS

SEQ ID NO: 612796 - protein, 11 aa, Mycobacterium
VSVSDAAQTEF

SEQ ID NO: 612797 - protein, 9 aa, Mycobacterium
VSVSDESYV

SEQ ID NO: 612798 - protein, 11 aa, Mycobacterium
VSVSGADGGPY

SEQ ID NO: 612799 - protein, 9 aa, Mycobacterium
VSWSDAAGR

SEQ ID NO: 612800 - protein, 13 aa, Mycobacterium
VSYKATGSGAGRE

SEQ ID NO: 612801 - protein, 12 aa, Mycobacterium
VSYRPGARFGPT

SEQ ID NO: 612802 - protein, 7 aa, Mycobacterium
VSYSAGD

SEQ ID NO: 612803 - protein, 14 aa, Mycobacterium
VSYSPDLDGRADPG

SEQ ID NO: 612804 - protein, 20 aa, Mycobacterium
VSYTAGDAAAALTYAPAAGL

SEQ ID NO: 612805 - protein, 6 aa, Mycobacterium
VSYTGQ

SEQ ID NO: 612806 - protein, 9 aa, Mycobacterium
VSYTSEGRL

SEQ ID NO: 612807 - protein, 12 aa, Mycobacterium
VTAAAAPSVQTA

SEQ ID NO: 612808 - protein, 19 aa, Mycobacterium
VTAADPGTRISSATVESAE

SEQ ID NO: 612809 - protein, 9 aa, Mycobacterium
VTAADQDNP

SEQ ID NO: 612810 - protein, 6 aa, Mycobacterium
VTAADT

SEQ ID NO: 612811 - protein, 10 aa, Mycobacterium
VTAAEARPRL

SEQ ID NO: 612812 - protein, 18 aa, Mycobacterium
VTAAETEAEQVERRRTTY

SEQ ID NO: 612813 - protein, 18 aa, Mycobacterium
VTAAETEAEQVSRRRNAY

SEQ ID NO: 612814 - protein, 7 aa, Mycobacterium
VTAAGDA

SEQ ID NO: 612815 - protein, 11 aa, Mycobacterium
VTAAGDRETHR

SEQ ID NO: 612816 - protein, 16 aa, Mycobacterium
VTAAGGARWLVVALHI

SEQ ID NO: 612817 - protein, 16 aa, Mycobacterium
VTAAGSAALGHQPGGL

SEQ ID NO: 612818 - protein, 18 aa, Mycobacterium
VTAAPGEDEFDAAGGTVL

SEQ ID NO: 612819 - protein, 17 aa, Mycobacterium
VTAAPPADTDHADRAAV

SEQ ID NO: 612820 - protein, 6 aa, Mycobacterium
VTAARD

SEQ ID NO: 612821 - protein, 12 aa, Mycobacterium
VTAATADRKARM

SEQ ID NO: 612822 - protein, 6 aa, Mycobacterium
VTAATG

SEQ ID NO: 612823 - protein, 8 aa, Mycobacterium
VTAATPDE

SEQ ID NO: 612824 - protein, 4 aa, Mycobacterium
VTAD

SEQ ID NO: 612825 - protein, 10 aa, Mycobacterium
VTADAAPVGV

SEQ ID NO: 612826 - protein, 12 aa, Mycobacterium
VTADAGAAAAAD

SEQ ID NO: 612827 - protein, 12 aa, Mycobacterium
VTADAKAAAAAD

SEQ ID NO: 612828 - protein, 7 aa, Mycobacterium
VTADASM

SEQ ID NO: 612829 - protein, 11 aa, Mycobacterium
VTADDVASNTS

SEQ ID NO: 612830 - protein, 10 aa, Mycobacterium
VTADEKAAMA

SEQ ID NO: 612831 - protein, 13 aa, Mycobacterium
VTADGRDGYRVEP

SEQ ID NO: 612832 - protein, 8 aa, Mycobacterium
VTADGRKT

SEQ ID NO: 612833 - protein, 7 aa, Mycobacterium
VTADGSV

SEQ ID NO: 612834 - protein, 24 aa, Mycobacterium
VTADKASDRFPPLPEYPAGPTPQA

SEQ ID NO: 612835 - protein, 5 aa, Mycobacterium
VTADM

SEQ ID NO: 612836 - protein, 5 aa, Mycobacterium
VTADP

SEQ ID NO: 612837 - protein, 9 aa, Mycobacterium
VTADPAGTT

SEQ ID NO: 612838 - protein, 16 aa, Mycobacterium
VTADPHTDSVGPDTPA

SEQ ID NO: 612839 - protein, 12 aa, Mycobacterium
VTADPSAAAAAD

SEQ ID NO: 612840 - protein, 8 aa, Mycobacterium
VTADQGAL

SEQ ID NO: 612841 - protein, 12 aa, Mycobacterium
VTADSDAAANAD

SEQ ID NO: 612842 - protein, 6 aa, Mycobacterium
VTADSR

SEQ ID NO: 612843 - protein, 6 aa, Mycobacterium
VTADTS

SEQ ID NO: 612844 - protein, 5 aa, Mycobacterium
VTADV

SEQ ID NO: 612845 - protein, 16 aa, Mycobacterium
VTAEAGGIAGRATTLG

SEQ ID NO: 612846 - protein, 5 aa, Mycobacterium
VTAED

SEQ ID NO: 612847 - protein, 5 aa, Mycobacterium
VTAEE

SEQ ID NO: 612848 - protein, 5 aa, Mycobacterium
VTAEG

SEQ ID NO: 612849 - protein, 6 aa, Mycobacterium
VTAEPD

SEQ ID NO: 612850 - protein, 7 aa, Mycobacterium
VTAEPGR

SEQ ID NO: 612851 - protein, 8 aa, Mycobacterium
VTAEPGSQ

SEQ ID NO: 612852 - protein, 10 aa, Mycobacterium
VTAEQVDAAA

SEQ ID NO: 612853 - protein, 5 aa, Mycobacterium
VTAET

SEQ ID NO: 612854 - protein, 5 aa, Mycobacterium
VTAEV

SEQ ID NO: 612855 - protein, 6 aa, Mycobacterium
VTAGAD

SEQ ID NO: 612856 - protein, 6 aa, Mycobacterium
VTAGAG

SEQ ID NO: 612857 - protein, 10 aa, Mycobacterium
VTAGAPGAHA

SEQ ID NO: 612858 - protein, 16 aa, Mycobacterium
VTAGATSTNLPVTASP

SEQ ID NO: 612859 - protein, 29 aa, Mycobacterium
VTAGDGAEPIRPVGTDGGAGSAGPTGATG

SEQ ID NO: 612860 - protein, 15 aa, Mycobacterium
VTAGDSARAKALSER

SEQ ID NO: 612861 - protein, 8 aa, Mycobacterium
VTAGDSPG

SEQ ID NO: 612862 - protein, 5 aa, Mycobacterium
VTAGE

SEQ ID NO: 612863 - protein, 10 aa, Mycobacterium
VTAGGEAAQL

SEQ ID NO: 612864 - protein, 7 aa, Mycobacterium
VTAGGLV

SEQ ID NO: 612865 - protein, 10 aa, Mycobacterium
VTAGGRAEPI

SEQ ID NO: 612866 - protein, 9 aa, Mycobacterium
VTAGGRAPS

SEQ ID NO: 612867 - protein, 15 aa, Mycobacterium
VTAGMAGDRSAASEL

SEQ ID NO: 612868 - protein, 28 aa, Mycobacterium
VTAGPRRTHAGRQRRRASRAMNQQPPRV

SEQ ID NO: 612869 - protein, 21 aa, Mycobacterium
VTAGQSTTTRIDAPERIGVHA

SEQ ID NO: 612870 - protein, 10 aa, Mycobacterium
VTAGQTINGS

SEQ ID NO: 612871 - protein, 5 aa, Mycobacterium
VTAGR

SEQ ID NO: 612872 - protein, 6 aa, Mycobacterium
VTAGSD

SEQ ID NO: 612873 - protein, 14 aa, Mycobacterium
VTAGSGDVAQTAER

SEQ ID NO: 612874 - protein, 7 aa, Mycobacterium
VTAGSSP

SEQ ID NO: 612875 - protein, 13 aa, Mycobacterium
VTAGSSSPLSDGA

SEQ ID NO: 612876 - protein, 17 aa, Mycobacterium
VTAGTSSPNDPSVPKAL

SEQ ID NO: 612877 - protein, 12 aa, Mycobacterium
VTAKSAGSGGEN

SEQ ID NO: 612878 - protein, 9 aa, Mycobacterium
VTANTRADA

SEQ ID NO: 612879 - protein, 10 aa, Mycobacterium
VTANTRADSR

SEQ ID NO: 612880 - protein, 24 aa, Mycobacterium
VTAPAAAPGYQLPNDVGSAADAAR

SEQ ID NO: 612881 - protein, 14 aa, Mycobacterium
VTAPAGDARPSVGG

SEQ ID NO: 612882 - protein, 8 aa, Mycobacterium
VTAPDASL

SEQ ID NO: 612883 - protein, 8 aa, Mycobacterium
VTAPDGSE

SEQ ID NO: 612884 - protein, 7 aa, Mycobacterium
VTAPEAA

SEQ ID NO: 612885 - protein, 6 aa, Mycobacterium
VTAPEL

SEQ ID NO: 612886 - protein, 14 aa, Mycobacterium
VTAPGKIRQYSNPS

SEQ ID NO: 612887 - protein, 7 aa, Mycobacterium
VTAPGPN

SEQ ID NO: 612888 - protein, 8 aa, Mycobacterium
VTAPGTAE

SEQ ID NO: 612889 - protein, 8 aa, Mycobacterium
VTAPPSVA

SEQ ID NO: 612890 - protein, 9 aa, Mycobacterium
VTAPPTPWN

SEQ ID NO: 612891 - protein, 12 aa, Mycobacterium
VTAPSAEQLTEA

SEQ ID NO: 612892 - protein, 7 aa, Mycobacterium
VTAPSEM

SEQ ID NO: 612893 - protein, 7 aa, Mycobacterium
VTAPSGL

SEQ ID NO: 612894 - protein, 8 aa, Mycobacterium
VTAPTAGE

SEQ ID NO: 612895 - protein, 5 aa, Mycobacterium
VTAPV

SEQ ID NO: 612896 - protein, 25 aa, Mycobacterium
VTAQADPPEPPTETLKTPSSASRRV

SEQ ID NO: 612897 - protein, 17 aa, Mycobacterium
VTAQDEKTATSFDALKP

SEQ ID NO: 612898 - protein, 5 aa, Mycobacterium
VTAQG

SEQ ID NO: 612899 - protein, 12 aa, Mycobacterium
VTAQPGKSAPSI

SEQ ID NO: 612900 - protein, 4 aa, Mycobacterium
VTAR

SEQ ID NO: 612901 - protein, 16 aa, Mycobacterium
VTARDGKSAAAGGGSV

SEQ ID NO: 612902 - protein, 17 aa, Mycobacterium
VTARDREVANPFGKDPQ

SEQ ID NO: 612903 - protein, 7 aa, Mycobacterium
VTARQGD

SEQ ID NO: 612904 - protein, 8 aa, Mycobacterium
VTARRDAD

SEQ ID NO: 612905 - protein, 8 aa, Mycobacterium
VTARRDET

SEQ ID NO: 612906 - protein, 10 aa, Mycobacterium
VTARRDGRGA

SEQ ID NO: 612907 - protein, 5 aa, Mycobacterium
VTART

SEQ ID NO: 612908 - protein, 6 aa, Mycobacterium
VTARTV

SEQ ID NO: 612909 - protein, 4 aa, Mycobacterium
VTAS

SEQ ID NO: 612910 - protein, 8 aa, Mycobacterium
VTASDRQR

SEQ ID NO: 612911 - protein, 13 aa, Mycobacterium
VTASEEDGGTDSI

SEQ ID NO: 612912 - protein, 14 aa, Mycobacterium
VTASESGKCPPPAG

SEQ ID NO: 612913 - protein, 5 aa, Mycobacterium
VTASG

SEQ ID NO: 612914 - protein, 7 aa, Mycobacterium
VTASGED

SEQ ID NO: 612915 - protein, 5 aa, Mycobacterium
VTASL

SEQ ID NO: 612916 - protein, 9 aa, Mycobacterium
VTASPDQHS

SEQ ID NO: 612917 - protein, 5 aa, Mycobacterium
VTASR

SEQ ID NO: 612918 - protein, 7 aa, Mycobacterium
VTASRAG

SEQ ID NO: 612919 - protein, 10 aa, Mycobacterium
VTASRTPPGL

SEQ ID NO: 612920 - protein, 8 aa, Mycobacterium
VTASTTEL

SEQ ID NO: 612921 - protein, 4 aa, Mycobacterium
VTAT

SEQ ID NO: 612922 - protein, 17 aa, Mycobacterium
VTATARAGTTRAAAPSH

SEQ ID NO: 612923 - protein, 12 aa, Mycobacterium
VTATASAAIDTE

SEQ ID NO: 612924 - protein, 10 aa, Mycobacterium
VTATDGEAFD

SEQ ID NO: 612925 - protein, 6 aa, Mycobacterium
VTATDQ

SEQ ID NO: 612926 - protein, 6 aa, Mycobacterium
VTATEA

SEQ ID NO: 612927 - protein, 8 aa, Mycobacterium
VTATESVD

SEQ ID NO: 612928 - protein, 11 aa, Mycobacterium
VTATETDAGYR

SEQ ID NO: 612929 - protein, 7 aa, Mycobacterium
VTATGDR

SEQ ID NO: 612930 - protein, 8 aa, Mycobacterium
VTATGDTA

SEQ ID NO: 612931 - protein, 52 aa, Mycobacterium
VTATGRANPVKAGGTCNRAAPSGATLAPSTRIATSPTIAASQPRARRGIGTT

SEQ ID NO: 612932 - protein, 5 aa, Mycobacterium
VTATL

SEQ ID NO: 612933 - protein, 6 aa, Mycobacterium
VTATND

SEQ ID NO: 612934 - protein, 6 aa, Mycobacterium
VTATPT

SEQ ID NO: 612935 - protein, 11 aa, Mycobacterium
VTATPTDSGYR

SEQ ID NO: 612936 - protein, 7 aa, Mycobacterium
VTATSER

SEQ ID NO: 612937 - protein, 10 aa, Mycobacterium
VTATSSAEEI

SEQ ID NO: 612938 - protein, 7 aa, Mycobacterium
VTATTGA

SEQ ID NO: 612939 - protein, 9 aa, Mycobacterium
VTATTSADE

SEQ ID NO: 612940 - protein, 13 aa, Mycobacterium
VTATTSSATDTDM

SEQ ID NO: 612941 - protein, 7 aa, Mycobacterium
VTAVDGT

SEQ ID NO: 612942 - protein, 8 aa, Mycobacterium
VTCSADAD

SEQ ID NO: 612943 - protein, 10 aa, Mycobacterium
VTCSPDNTLA

SEQ ID NO: 612944 - protein, 6 aa, Mycobacterium
VTDAAG

SEQ ID NO: 612945 - protein, 9 aa, Mycobacterium
VTDADPGRR

SEQ ID NO: 612946 - protein, 7 aa, Mycobacterium
VTDAEAR

SEQ ID NO: 612947 - protein, 7 aa, Mycobacterium
VTDAEEH

SEQ ID NO: 612948 - protein, 9 aa, Mycobacterium
VTDAGGRAI

SEQ ID NO: 612949 - protein, 16 aa, Mycobacterium
VTDAGPEIASGAADEY

SEQ ID NO: 612950 - protein, 17 aa, Mycobacterium
VTDAGPEIASGAADEYA

SEQ ID NO: 612951 - protein, 7 aa, Mycobacterium
VTDAGVQ

SEQ ID NO: 612952 - protein, 8 aa, Mycobacterium
VTDANDNE

SEQ ID NO: 612953 - protein, 9 aa, Mycobacterium
VTDAPDGAR

SEQ ID NO: 612954 - protein, 9 aa, Mycobacterium
VTDAPSARV

SEQ ID NO: 612955 - protein, 6 aa, Mycobacterium
VTDASH

SEQ ID NO: 612956 - protein, 13 aa, Mycobacterium
VTDATPDLGAGDI

SEQ ID NO: 612957 - protein, 18 aa, Mycobacterium
VTDDAAEKLRKAISSLQD

SEQ ID NO: 612958 - protein, 6 aa, Mycobacterium
VTDDAQ

SEQ ID NO: 612959 - protein, 9 aa, Mycobacterium
VTDDATVGP

SEQ ID NO: 612960 - protein, 11 aa, Mycobacterium
VTDDDGKPVAT

SEQ ID NO: 612961 - protein, 7 aa, Mycobacterium
VTDDDIA

SEQ ID NO: 612962 - protein, 19 aa, Mycobacterium
VTDDEAELGTTRLSDWLAL

SEQ ID NO: 612963 - protein, 8 aa, Mycobacterium
VTDDEGVA

SEQ ID NO: 612964 - protein, 7 aa, Mycobacterium
VTDDELR

SEQ ID NO: 612965 - protein, 8 aa, Mycobacterium
VTDDESVN

SEQ ID NO: 612966 - protein, 7 aa, Mycobacterium
VTDDGAV

SEQ ID NO: 612967 - protein, 29 aa, Mycobacterium
VTDDGEGISGPVTESGLSNLRQRADQCGG

SEQ ID NO: 612968 - protein, 10 aa, Mycobacterium
VTDDGSTARD

SEQ ID NO: 612969 - protein, 8 aa, Mycobacterium
VTDDTAGM

SEQ ID NO: 612970 - protein, 4 aa, Mycobacterium
VTDE

SEQ ID NO: 612971 - protein, 6 aa, Mycobacterium
VTDEAA

SEQ ID NO: 612972 - protein, 7 aa, Mycobacterium
VTDEAAV

SEQ ID NO: 612973 - protein, 8 aa, Mycobacterium
VTDEAGVT

SEQ ID NO: 612974 - protein, 6 aa, Mycobacterium
VTDEDA

SEQ ID NO: 612975 - protein, 9 aa, Mycobacterium
VTDEEVDAE

SEQ ID NO: 612976 - protein, 10 aa, Mycobacterium
VTDEPKAYPQ

SEQ ID NO: 612977 - protein, 10 aa, Mycobacterium
VTDEPKEYPQ

SEQ ID NO: 612978 - protein, 5 aa, Mycobacterium
VTDEQ

SEQ ID NO: 612979 - protein, 6 aa, Mycobacterium
VTDEQI

SEQ ID NO: 612980 - protein, 9 aa, Mycobacterium
VTDEQTRSA

SEQ ID NO: 612981 - protein, 12 aa, Mycobacterium
VTDESGDAPGVV

SEQ ID NO: 612982 - protein, 7 aa, Mycobacterium
VTDETAG

SEQ ID NO: 612983 - protein, 6 aa, Mycobacterium
VTDFAP

SEQ ID NO: 612984 - protein, 27 aa, Mycobacterium
VTDGAPAPAPSLAPAAQPPPSFAPGLP

SEQ ID NO: 612985 - protein, 6 aa, Mycobacterium
VTDGDR

SEQ ID NO: 612986 - protein, 6 aa, Mycobacterium
VTDGHR

SEQ ID NO: 612987 - protein, 8 aa, Mycobacterium
VTDGKDRD

SEQ ID NO: 612988 - protein, 8 aa, Mycobacterium
VTDGPPCD

SEQ ID NO: 612989 - protein, 7 aa, Mycobacterium
VTDGPTA

SEQ ID NO: 612990 - protein, 9 aa, Mycobacterium
VTDGRPEEF

SEQ ID NO: 612991 - protein, 18 aa, Mycobacterium
VTDGTATPDTKVAPAYRS

SEQ ID NO: 612992 - protein, 10 aa, Mycobacterium
VTDGTETPFP

SEQ ID NO: 612993 - protein, 6 aa, Mycobacterium
VTDHDT

SEQ ID NO: 612994 - protein, 13 aa, Mycobacterium
VTDHPEHGQKIQV

SEQ ID NO: 612995 - protein, 9 aa, Mycobacterium
VTDHPGGYA

SEQ ID NO: 612996 - protein, 10 aa, Mycobacterium
VTDHPGGYAG

SEQ ID NO: 612997 - protein, 7 aa, Mycobacterium
VTDIKGG

SEQ ID NO: 612998 - protein, 7 aa, Mycobacterium
VTDKPVT

SEQ ID NO: 612999 - protein, 4 aa, Mycobacterium
VTDL

SEQ ID NO: 613000 - protein, 7 aa, Mycobacterium
VTDNAGL

SEQ ID NO: 613001 - protein, 9 aa, Mycobacterium
VTDNSGREK

SEQ ID NO: 613002 - protein, 9 aa, Mycobacterium
VTDNSPLAT

SEQ ID NO: 613003 - protein, 5 aa, Mycobacterium
VTDPA

SEQ ID NO: 613004 - protein, 13 aa, Mycobacterium
VTDPADGESDRAL

SEQ ID NO: 613005 - protein, 6 aa, Mycobacterium
VTDPAG

SEQ ID NO: 613006 - protein, 13 aa, Mycobacterium
VTDPAQASALADD

SEQ ID NO: 613007 - protein, 6 aa, Mycobacterium
VTDPAS

SEQ ID NO: 613008 - protein, 7 aa, Mycobacterium
VTDPASM

SEQ ID NO: 613009 - protein, 11 aa, Mycobacterium
VTDPATGRRRG

SEQ ID NO: 613010 - protein, 7 aa, Mycobacterium
VTDPAVR

SEQ ID NO: 613011 - protein, 10 aa, Mycobacterium
VTDPDEVSSA

SEQ ID NO: 613012 - protein, 10 aa, Mycobacterium
VTDPDNPANW

SEQ ID NO: 613013 - protein, 12 aa, Mycobacterium
VTDPDSDPDRRA

SEQ ID NO: 613014 - protein, 6 aa, Mycobacterium
VTDPDT

SEQ ID NO: 613015 - protein, 8 aa, Mycobacterium
VTDPEAKR

SEQ ID NO: 613016 - protein, 9 aa, Mycobacterium
VTDPELDEP

SEQ ID NO: 613017 - protein, 8 aa, Mycobacterium
VTDPEPLP

SEQ ID NO: 613018 - protein, 17 aa, Mycobacterium
VTDPEPTDETKKLAGEY

SEQ ID NO: 613019 - protein, 7 aa, Mycobacterium
VTDPEQV

SEQ ID NO: 613020 - protein, 8 aa, Mycobacterium
VTDPESIA

SEQ ID NO: 613021 - protein, 21 aa, Mycobacterium
VTDPGASPNLSDVSKQRVGGS

SEQ ID NO: 613022 - protein, 7 aa, Mycobacterium
VTDPGHT

SEQ ID NO: 613023 - protein, 6 aa, Mycobacterium
VTDPGI

SEQ ID NO: 613024 - protein, 14 aa, Mycobacterium
VTDPGQGARELQER

SEQ ID NO: 613025 - protein, 8 aa, Mycobacterium
VTDPKARE

SEQ ID NO: 613026 - protein, 7 aa, Mycobacterium
VTDPNSF

SEQ ID NO: 613027 - protein, 13 aa, Mycobacterium
VTDPPNSQEWVPP

SEQ ID NO: 613028 - protein, 7 aa, Mycobacterium
VTDPRIG

SEQ ID NO: 613029 - protein, 5 aa, Mycobacterium
VTDPS

SEQ ID NO: 613030 - protein, 9 aa, Mycobacterium
VTDPSVSGL

SEQ ID NO: 613031 - protein, 7 aa, Mycobacterium
VTDPTGR

SEQ ID NO: 613032 - protein, 9 aa, Mycobacterium
VTDPTKRRA

SEQ ID NO: 613033 - protein, 7 aa, Mycobacterium
VTDPTRI

SEQ ID NO: 613034 - protein, 9 aa, Mycobacterium
VTDQGISSK

SEQ ID NO: 613035 - protein, 8 aa, Mycobacterium
VTDQPATW

SEQ ID NO: 613036 - protein, 8 aa, Mycobacterium
VTDQQGTR

SEQ ID NO: 613037 - protein, 6 aa, Mycobacterium
VTDRAG

SEQ ID NO: 613038 - protein, 9 aa, Mycobacterium
VTDRAPGGV

SEQ ID NO: 613039 - protein, 7 aa, Mycobacterium
VTDRAQV

SEQ ID NO: 613040 - protein, 13 aa, Mycobacterium
VTDRASRLPADRQ

SEQ ID NO: 613041 - protein, 6 aa, Mycobacterium
VTDRDS

SEQ ID NO: 613042 - protein, 10 aa, Mycobacterium
VTDRERRELA

SEQ ID NO: 613043 - protein, 12 aa, Mycobacterium
VTDRGKALGSSM

SEQ ID NO: 613044 - protein, 10 aa, Mycobacterium
VTDRRSAERS

SEQ ID NO: 613045 - protein, 7 aa, Mycobacterium
VTDRSAV

SEQ ID NO: 613046 - protein, 8 aa, Mycobacterium
VTDRSQDT

SEQ ID NO: 613047 - protein, 7 aa, Mycobacterium
VTDRSQV

SEQ ID NO: 613048 - protein, 21 aa, Mycobacterium
VTDRSTGGSSAARSARQAQAQ

SEQ ID NO: 613049 - protein, 26 aa, Mycobacterium
VTDRVGPPPSGGGPSPIRSRSCQRQI

SEQ ID NO: 613050 - protein, 6 aa, Mycobacterium
VTDSAS

SEQ ID NO: 613051 - protein, 17 aa, Mycobacterium
VTDSEGKKFGKSTGGGN

SEQ ID NO: 613052 - protein, 17 aa, Mycobacterium
VTDSEGKKFGKSTGGGS

SEQ ID NO: 613053 - protein, 6 aa, Mycobacterium
VTDSGR

SEQ ID NO: 613054 - protein, 8 aa, Mycobacterium
VTDSGTRT

SEQ ID NO: 613055 - protein, 16 aa, Mycobacterium
VTDSPALPKPVQEPHP

SEQ ID NO: 613056 - protein, 12 aa, Mycobacterium
VTDSPAQISPED

SEQ ID NO: 613057 - protein, 7 aa, Mycobacterium
VTDSRGR

SEQ ID NO: 613058 - protein, 31 aa, Mycobacterium
VTDSRQRGITHNPADPSRTAGGSSGGSAAAV

SEQ ID NO: 613059 - protein, 5 aa, Mycobacterium
VTDSS

SEQ ID NO: 613060 - protein, 4 aa, Mycobacterium
VTDT

SEQ ID NO: 613061 - protein, 17 aa, Mycobacterium
VTDTADGPQWSLQAGPD

SEQ ID NO: 613062 - protein, 11 aa, Mycobacterium
VTDTAETDGPW

SEQ ID NO: 613063 - protein, 12 aa, Mycobacterium
VTDTAGNTVDTD

SEQ ID NO: 613064 - protein, 8 aa, Mycobacterium
VTDTASGT

SEQ ID NO: 613065 - protein, 9 aa, Mycobacterium
VTDTDDSPH

SEQ ID NO: 613066 - protein, 10 aa, Mycobacterium
VTDTDGTEID

SEQ ID NO: 613067 - protein, 19 aa, Mycobacterium
VTDTESAERTYADATTTID

SEQ ID NO: 613068 - protein, 9 aa, Mycobacterium
VTDTGASIS

SEQ ID NO: 613069 - protein, 27 aa, Mycobacterium
VTDTGEVSHPDAKKAQAAADHQRRIQS

SEQ ID NO: 613070 - protein, 10 aa, Mycobacterium
VTDTGKPISV

SEQ ID NO: 613071 - protein, 9 aa, Mycobacterium
VTDTGNSIS

SEQ ID NO: 613072 - protein, 8 aa, Mycobacterium
VTDTGRSI

SEQ ID NO: 613073 - protein, 9 aa, Mycobacterium
VTDTGTPRL

SEQ ID NO: 613074 - protein, 22 aa, Mycobacterium
VTDTHRSGTPAEQAARQAQAQA

SEQ ID NO: 613075 - protein, 9 aa, Mycobacterium
VTDTKRTYT

SEQ ID NO: 613076 - protein, 16 aa, Mycobacterium
VTDTPAREPERRPRKV

SEQ ID NO: 613077 - protein, 13 aa, Mycobacterium
VTDTPDTAHGDES

SEQ ID NO: 613078 - protein, 7 aa, Mycobacterium
VTDTRPG

SEQ ID NO: 613079 - protein, 14 aa, Mycobacterium
VTDTRSSGTAAEQV

SEQ ID NO: 613080 - protein, 4 aa, Mycobacterium
VTDV

SEQ ID NO: 613081 - protein, 13 aa, Mycobacterium
VTDVAGSDALPEP

SEQ ID NO: 613082 - protein, 6 aa, Mycobacterium
VTDVPD

SEQ ID NO: 613083 - protein, 9 aa, Mycobacterium
VTDVPPEAV

SEQ ID NO: 613084 - protein, 11 aa, Mycobacterium
VTDYRDKHGVT

SEQ ID NO: 613085 - protein, 28 aa, Mycobacterium
VTEADSRYNATEVASAQEEAAVVPPQIR

SEQ ID NO: 613086 - protein, 36 aa, Mycobacterium
VTEAERRSAAAERAARQANEREQTAEREREEADALA

SEQ ID NO: 613087 - protein, 11 aa, Mycobacterium
VTEAGATVGPR

SEQ ID NO: 613088 - protein, 8 aa, Mycobacterium
VTEAGSPA

SEQ ID NO: 613089 - protein, 12 aa, Mycobacterium
VTEAPDPENDEV

SEQ ID NO: 613090 - protein, 8 aa, Mycobacterium
VTEAPTGM

SEQ ID NO: 613091 - protein, 5 aa, Mycobacterium
VTEAT

SEQ ID NO: 613092 - protein, 7 aa, Mycobacterium
VTEATTG

SEQ ID NO: 613093 - protein, 9 aa, Mycobacterium
VTEDEPNRR

SEQ ID NO: 613094 - protein, 7 aa, Mycobacterium
VTEDGRE

SEQ ID NO: 613095 - protein, 11 aa, Mycobacterium
VTEDGSPQGAR

SEQ ID NO: 613096 - protein, 8 aa, Mycobacterium
VTEDGTEL

SEQ ID NO: 613097 - protein, 7 aa, Mycobacterium
VTEDNPV

SEQ ID NO: 613098 - protein, 7 aa, Mycobacterium
VTEDPER

SEQ ID NO: 613099 - protein, 58 aa, Mycobacterium
VTEDSIEARQAAQKRAAERAAQQTAATEQTRAELDAQQQIQRAKADEREEIGDATEDV

SEQ ID NO: 613100 - protein, 21 aa, Mycobacterium
VTEDSTAGKDPIAGHVELHRL

SEQ ID NO: 613101 - protein, 4 aa, Mycobacterium
VTEE

SEQ ID NO: 613102 - protein, 7 aa, Mycobacterium
VTEEAND

SEQ ID NO: 613103 - protein, 10 aa, Mycobacterium
VTEELEAEGW

SEQ ID NO: 613104 - protein, 19 aa, Mycobacterium
VTEERPADEVHANHVAANA

SEQ ID NO: 613105 - protein, 7 aa, Mycobacterium
VTEETAG

SEQ ID NO: 613106 - protein, 14 aa, Mycobacterium
VTEEYPEKPGPVAK

SEQ ID NO: 613107 - protein, 4 aa, Mycobacterium
VTEG

SEQ ID NO: 613108 - protein, 5 aa, Mycobacterium
VTEGD

SEQ ID NO: 613109 - protein, 11 aa, Mycobacterium
VTEGDKVEAES

SEQ ID NO: 613110 - protein, 9 aa, Mycobacterium
VTEGGEGGT

SEQ ID NO: 613111 - protein, 8 aa, Mycobacterium
VTEGGSAN

SEQ ID NO: 613112 - protein, 8 aa, Mycobacterium
VTEGGSEN

SEQ ID NO: 613113 - protein, 5 aa, Mycobacterium
VTEGK

SEQ ID NO: 613114 - protein, 8 aa, Mycobacterium
VTEGNGDH

SEQ ID NO: 613115 - protein, 27 aa, Mycobacterium
VTEGPSGTRPDAPAPRRQAENTDGGQI

SEQ ID NO: 613116 - protein, 9 aa, Mycobacterium
VTEGSDRLA

SEQ ID NO: 613117 - protein, 18 aa, Mycobacterium
VTEGTATPDTKVAPAYRS

SEQ ID NO: 613118 - protein, 10 aa, Mycobacterium
VTEGTKSTHG

SEQ ID NO: 613119 - protein, 9 aa, Mycobacterium
VTEGTPDEF

SEQ ID NO: 613120 - protein, 6 aa, Mycobacterium
VTEGYT

SEQ ID NO: 613121 - protein, 6 aa, Mycobacterium
VTEHAD

SEQ ID NO: 613122 - protein, 14 aa, Mycobacterium
VTEITAGRAATPWG

SEQ ID NO: 613123 - protein, 9 aa, Mycobacterium
VTEKQLSDE

SEQ ID NO: 613124 - protein, 9 aa, Mycobacterium
VTELPTADG

SEQ ID NO: 613125 - protein, 7 aa, Mycobacterium
VTENGRG

SEQ ID NO: 613126 - protein, 5 aa, Mycobacterium
VTENR

SEQ ID NO: 613127 - protein, 7 aa, Mycobacterium
VTEPADL

SEQ ID NO: 613128 - protein, 10 aa, Mycobacterium
VTEPADVARA

SEQ ID NO: 613129 - protein, 7 aa, Mycobacterium
VTEPAEF

SEQ ID NO: 613130 - protein, 12 aa, Mycobacterium
VTEPDARGGRIN

SEQ ID NO: 613131 - protein, 10 aa, Mycobacterium
VTEPDGNPGQ

SEQ ID NO: 613132 - protein, 7 aa, Mycobacterium
VTEPDGS

SEQ ID NO: 613133 - protein, 10 aa, Mycobacterium
VTEPDGTPGQ

SEQ ID NO: 613134 - protein, 8 aa, Mycobacterium
VTEPDSAK

SEQ ID NO: 613135 - protein, 11 aa, Mycobacterium
VTEPGAGSDVA

SEQ ID NO: 613136 - protein, 6 aa, Mycobacterium
VTEPGD

SEQ ID NO: 613137 - protein, 6 aa, Mycobacterium
VTEPGV

SEQ ID NO: 613138 - protein, 8 aa, Mycobacterium
VTEPNENL

SEQ ID NO: 613139 - protein, 7 aa, Mycobacterium
VTEPPQG

SEQ ID NO: 613140 - protein, 7 aa, Mycobacterium
VTEPPSG

SEQ ID NO: 613141 - protein, 11 aa, Mycobacterium
VTEPRFDPARQ

SEQ ID NO: 613142 - protein, 9 aa, Mycobacterium
VTEPTAAPK

SEQ ID NO: 613143 - protein, 8 aa, Mycobacterium
VTEQPDGT

SEQ ID NO: 613144 - protein, 14 aa, Mycobacterium
VTEQQKAANMQTEA

SEQ ID NO: 613145 - protein, 14 aa, Mycobacterium
VTERAAKALSDTVT

SEQ ID NO: 613146 - protein, 10 aa, Mycobacterium
VTERDGGSLY

SEQ ID NO: 613147 - protein, 7 aa, Mycobacterium
VTEREGV

SEQ ID NO: 613148 - protein, 7 aa, Mycobacterium
VTERERE

SEQ ID NO: 613149 - protein, 7 aa, Mycobacterium
VTERGRK

SEQ ID NO: 613150 - protein, 6 aa, Mycobacterium
VTERKP

SEQ ID NO: 613151 - protein, 8 aa, Mycobacterium
VTERPKTT

SEQ ID NO: 613152 - protein, 10 aa, Mycobacterium
VTESGDDVPP

SEQ ID NO: 613153 - protein, 5 aa, Mycobacterium
VTESH

SEQ ID NO: 613154 - protein, 5 aa, Mycobacterium
VTESL

SEQ ID NO: 613155 - protein, 9 aa, Mycobacterium
VTESPAAKA

SEQ ID NO: 613156 - protein, 9 aa, Mycobacterium
VTESPELSR

SEQ ID NO: 613157 - protein, 8 aa, Mycobacterium
VTESSGTT

SEQ ID NO: 613158 - protein, 7 aa, Mycobacterium
VTESTGS

SEQ ID NO: 613159 - protein, 9 aa, Mycobacterium
VTESTSYLR

SEQ ID NO: 613160 - protein, 12 aa, Mycobacterium
VTETAADSDYGR

SEQ ID NO: 613161 - protein, 9 aa, Mycobacterium
VTETAKRLP

SEQ ID NO: 613162 - protein, 10 aa, Mycobacterium
VTETAKRLPG

SEQ ID NO: 613163 - protein, 14 aa, Mycobacterium
VTETALDDEQSTRR

SEQ ID NO: 613164 - protein, 9 aa, Mycobacterium
VTETANRLP

SEQ ID NO: 613165 - protein, 5 aa, Mycobacterium
VTETD

SEQ ID NO: 613166 - protein, 7 aa, Mycobacterium
VTETDTA

SEQ ID NO: 613167 - protein, 7 aa, Mycobacterium
VTETGDG

SEQ ID NO: 613168 - protein, 6 aa, Mycobacterium
VTETGE

SEQ ID NO: 613169 - protein, 6 aa, Mycobacterium
VTETGK

SEQ ID NO: 613170 - protein, 9 aa, Mycobacterium
VTETVSSTA

SEQ ID NO: 613171 - protein, 4 aa, Mycobacterium
VTEV

SEQ ID NO: 613172 - protein, 15 aa, Mycobacterium
VTEVPAGTSVQVWDL

SEQ ID NO: 613173 - protein, 15 aa, Mycobacterium
VTGAACSATAAAGSG

SEQ ID NO: 613174 - protein, 7 aa, Mycobacterium
VTGADAA

SEQ ID NO: 613175 - protein, 14 aa, Mycobacterium
VTGADETQEVGGHT

SEQ ID NO: 613176 - protein, 7 aa, Mycobacterium
VTGADGE

SEQ ID NO: 613177 - protein, 8 aa, Mycobacterium
VTGADQTR

SEQ ID NO: 613178 - protein, 8 aa, Mycobacterium
VTGAERSE

SEQ ID NO: 613179 - protein, 5 aa, Mycobacterium
VTGAG

SEQ ID NO: 613180 - protein, 13 aa, Mycobacterium
VTGAGERSGHGPV

SEQ ID NO: 613181 - protein, 10 aa, Mycobacterium
VTGAGGDGLG

SEQ ID NO: 613182 - protein, 9 aa, Mycobacterium
VTGAGSGIG

SEQ ID NO: 613183 - protein, 10 aa, Mycobacterium
VTGAGSGIGR

SEQ ID NO: 613184 - protein, 5 aa, Mycobacterium
VTGAK

SEQ ID NO: 613185 - protein, 6 aa, Mycobacterium
VTGAKN

SEQ ID NO: 613186 - protein, 10 aa, Mycobacterium
VTGAKSVAAG

SEQ ID NO: 613187 - protein, 12 aa, Mycobacterium
VTGANADPDPVD

SEQ ID NO: 613188 - protein, 6 aa, Mycobacterium
VTGARE

SEQ ID NO: 613189 - protein, 5 aa, Mycobacterium
VTGAS

SEQ ID NO: 613190 - protein, 11 aa, Mycobacterium
VTGASAESAAT

SEQ ID NO: 613191 - protein, 7 aa, Mycobacterium
VTGATEA

SEQ ID NO: 613192 - protein, 7 aa, Mycobacterium
VTGDASV

SEQ ID NO: 613193 - protein, 6 aa, Mycobacterium
VTGDGA

SEQ ID NO: 613194 - protein, 7 aa, Mycobacterium
VTGDGDV

SEQ ID NO: 613195 - protein, 7 aa, Mycobacterium
VTGDGQP

SEQ ID NO: 613196 - protein, 23 aa, Mycobacterium
VTGDNGEPAPQRANLDDSLTPDE

SEQ ID NO: 613197 - protein, 6 aa, Mycobacterium
VTGDPA

SEQ ID NO: 613198 - protein, 35 aa, Mycobacterium
VTGDPQRGLRQTGPLRVDGDPNPNIEHANRGKRSI

SEQ ID NO: 613199 - protein, 5 aa, Mycobacterium
VTGDQ

SEQ ID NO: 613200 - protein, 6 aa, Mycobacterium
VTGDQR

SEQ ID NO: 613201 - protein, 8 aa, Mycobacterium
VTGDSGEA

SEQ ID NO: 613202 - protein, 24 aa, Mycobacterium
VTGDTAKVTATATVENEDEPDTQT

SEQ ID NO: 613203 - protein, 9 aa, Mycobacterium
VTGDTATGS

SEQ ID NO: 613204 - protein, 9 aa, Mycobacterium
VTGEAGRPV

SEQ ID NO: 613205 - protein, 19 aa, Mycobacterium
VTGEDTGDGTDYDGPRCQS

SEQ ID NO: 613206 - protein, 6 aa, Mycobacterium
VTGEEY

SEQ ID NO: 613207 - protein, 6 aa, Mycobacterium
VTGEGG

SEQ ID NO: 613208 - protein, 9 aa, Mycobacterium
VTGEGGLTD

SEQ ID NO: 613209 - protein, 6 aa, Mycobacterium
VTGEKD

SEQ ID NO: 613210 - protein, 12 aa, Mycobacterium
VTGEKPDGRKEI

SEQ ID NO: 613211 - protein, 11 aa, Mycobacterium
VTGENNGKKEI

SEQ ID NO: 613212 - protein, 6 aa, Mycobacterium
VTGEPA

SEQ ID NO: 613213 - protein, 18 aa, Mycobacterium
VTGEPEPPLQAAATPEVT

SEQ ID NO: 613214 - protein, 7 aa, Mycobacterium
VTGEPGS

SEQ ID NO: 613215 - protein, 10 aa, Mycobacterium
VTGERTSEGF

SEQ ID NO: 613216 - protein, 8 aa, Mycobacterium
VTGESNES

SEQ ID NO: 613217 - protein, 12 aa, Mycobacterium
VTGETSGPPAGV

SEQ ID NO: 613218 - protein, 5 aa, Mycobacterium
VTGEV

SEQ ID NO: 613219 - protein, 6 aa, Mycobacterium
VTGGAV

SEQ ID NO: 613220 - protein, 5 aa, Mycobacterium
VTGGD

SEQ ID NO: 613221 - protein, 12 aa, Mycobacterium
VTGGDAAGVPPS

SEQ ID NO: 613222 - protein, 7 aa, Mycobacterium
VTGGDGE

SEQ ID NO: 613223 - protein, 10 aa, Mycobacterium
VTGGEKVDPG

SEQ ID NO: 613224 - protein, 6 aa, Mycobacterium
VTGGES

SEQ ID NO: 613225 - protein, 12 aa, Mycobacterium
VTGGGDAQMAER

SEQ ID NO: 613226 - protein, 7 aa, Mycobacterium
VTGGGRG

SEQ ID NO: 613227 - protein, 9 aa, Mycobacterium
VTGGGRGLG

SEQ ID NO: 613228 - protein, 11 aa, Mycobacterium
VTGGGRPEGLD

SEQ ID NO: 613229 - protein, 7 aa, Mycobacterium
VTGGHGA

SEQ ID NO: 613230 - protein, 14 aa, Mycobacterium
VTGGLGQPRPVDSP

SEQ ID NO: 613231 - protein, 10 aa, Mycobacterium
VTGGNGGDSG

SEQ ID NO: 613232 - protein, 6 aa, Mycobacterium
VTGGPT

SEQ ID NO: 613233 - protein, 9 aa, Mycobacterium
VTGGQDPFA

SEQ ID NO: 613234 - protein, 6 aa, Mycobacterium
VTGGRG

SEQ ID NO: 613235 - protein, 9 aa, Mycobacterium
VTGGRRKDQ

SEQ ID NO: 613236 - protein, 9 aa, Mycobacterium
VTGGRSSFA

SEQ ID NO: 613237 - protein, 7 aa, Mycobacterium
VTGGRVP

SEQ ID NO: 613238 - protein, 7 aa, Mycobacterium
VTGGSAH

SEQ ID NO: 613239 - protein, 9 aa, Mycobacterium
VTGGSPHAL

SEQ ID NO: 613240 - protein, 16 aa, Mycobacterium
VTGGSQPECARVRRSA

SEQ ID NO: 613241 - protein, 9 aa, Mycobacterium
VTGGSQSSF

SEQ ID NO: 613242 - protein, 6 aa, Mycobacterium
VTGGTD

SEQ ID NO: 613243 - protein, 13 aa, Mycobacterium
VTGHPSGTSRDVE

SEQ ID NO: 613244 - protein, 5 aa, Mycobacterium
VTGKG

SEQ ID NO: 613245 - protein, 6 aa, Mycobacterium
VTGKPI

SEQ ID NO: 613246 - protein, 10 aa, Mycobacterium
VTGKPLPAPV

SEQ ID NO: 613247 - protein, 5 aa, Mycobacterium
VTGKQ

SEQ ID NO: 613248 - protein, 12 aa, Mycobacterium
VTGKSAGKDGEN

SEQ ID NO: 613249 - protein, 4 aa, Mycobacterium
VTGL

SEQ ID NO: 613250 - protein, 7 aa, Mycobacterium
VTGLREG

SEQ ID NO: 613251 - protein, 57 aa, Mycobacterium
VTGNDSLTAEGQLEQTQAHERKEANATEAVAEAQAKQARDDAAEAKADGARQRLAAN

SEQ ID NO: 613252 - protein, 8 aa, Mycobacterium
VTGNLGGQ

SEQ ID NO: 613253 - protein, 7 aa, Mycobacterium
VTGPAGT

SEQ ID NO: 613254 - protein, 8 aa, Mycobacterium
VTGPAQRA

SEQ ID NO: 613255 - protein, 7 aa, Mycobacterium
VTGPAVP

SEQ ID NO: 613256 - protein, 7 aa, Mycobacterium
VTGPDGA

SEQ ID NO: 613257 - protein, 8 aa, Mycobacterium
VTGPDKGS

SEQ ID NO: 613258 - protein, 8 aa, Mycobacterium
VTGPDQTR

SEQ ID NO: 613259 - protein, 10 aa, Mycobacterium
VTGPDSPASG

SEQ ID NO: 613260 - protein, 5 aa, Mycobacterium
VTGPF

SEQ ID NO: 613261 - protein, 7 aa, Mycobacterium
VTGPGAA

SEQ ID NO: 613262 - protein, 8 aa, Mycobacterium
VTGPGAGA

SEQ ID NO: 613263 - protein, 10 aa, Mycobacterium
VTGPGEGATA

SEQ ID NO: 613264 - protein, 11 aa, Mycobacterium
VTGPGERVDHG

SEQ ID NO: 613265 - protein, 6 aa, Mycobacterium
VTGPGL

SEQ ID NO: 613266 - protein, 18 aa, Mycobacterium
VTGPGSARVQVTSPSDPE

SEQ ID NO: 613267 - protein, 8 aa, Mycobacterium
VTGPHPDE

SEQ ID NO: 613268 - protein, 8 aa, Mycobacterium
VTGPHPEE

SEQ ID NO: 613269 - protein, 5 aa, Mycobacterium
VTGPL

SEQ ID NO: 613270 - protein, 6 aa, Mycobacterium
VTGPLT

SEQ ID NO: 613271 - protein, 12 aa, Mycobacterium
VTGPNGSGKSTL

SEQ ID NO: 613272 - protein, 12 aa, Mycobacterium
VTGPQSRPTTAG

SEQ ID NO: 613273 - protein, 8 aa, Mycobacterium
VTGPSRAK

SEQ ID NO: 613274 - protein, 14 aa, Mycobacterium
VTGQARYAADAEVP

SEQ ID NO: 613275 - protein, 14 aa, Mycobacterium
VTGQATKVAGPGWT

SEQ ID NO: 613276 - protein, 9 aa, Mycobacterium
VTGQEEFPR

SEQ ID NO: 613277 - protein, 13 aa, Mycobacterium
VTGQGATHASGAS

SEQ ID NO: 613278 - protein, 8 aa, Mycobacterium
VTGQGEDL

SEQ ID NO: 613279 - protein, 9 aa, Mycobacterium
VTGQPNQVI

SEQ ID NO: 613280 - protein, 5 aa, Mycobacterium
VTGQT

SEQ ID NO: 613281 - protein, 5 aa, Mycobacterium
VTGRD

SEQ ID NO: 613282 - protein, 10 aa, Mycobacterium
VTGRDGGRDV

SEQ ID NO: 613283 - protein, 7 aa, Mycobacterium
VTGRNGV

SEQ ID NO: 613284 - protein, 5 aa, Mycobacterium
VTGRP

SEQ ID NO: 613285 - protein, 9 aa, Mycobacterium
VTGRPAEGV

SEQ ID NO: 613286 - protein, 9 aa, Mycobacterium
VTGRPGSKY

SEQ ID NO: 613287 - protein, 10 aa, Mycobacterium
VTGRPQRAST

SEQ ID NO: 613288 - protein, 12 aa, Mycobacterium
VTGRSADGSPEI

SEQ ID NO: 613289 - protein, 20 aa, Mycobacterium
VTGRSGPGAGRTAKRYRRAR

SEQ ID NO: 613290 - protein, 9 aa, Mycobacterium
VTGRTGTAG

SEQ ID NO: 613291 - protein, 7 aa, Mycobacterium
VTGSAEV

SEQ ID NO: 613292 - protein, 11 aa, Mycobacterium
VTGSAGDGFEE

SEQ ID NO: 613293 - protein, 10 aa, Mycobacterium
VTGSAPSSEL

SEQ ID NO: 613294 - protein, 7 aa, Mycobacterium
VTGSDPD

SEQ ID NO: 613295 - protein, 10 aa, Mycobacterium
VTGSGAPTAG

SEQ ID NO: 613296 - protein, 10 aa, Mycobacterium
VTGSGAPTAS

SEQ ID NO: 613297 - protein, 7 aa, Mycobacterium
VTGSGER

SEQ ID NO: 613298 - protein, 7 aa, Mycobacterium
VTGSGGR

SEQ ID NO: 613299 - protein, 9 aa, Mycobacterium
VTGSGIPTA

SEQ ID NO: 613300 - protein, 6 aa, Mycobacterium
VTGSGR

SEQ ID NO: 613301 - protein, 18 aa, Mycobacterium
VTGSGRVGIGPSGDDAGF

SEQ ID NO: 613302 - protein, 6 aa, Mycobacterium
VTGSGS

SEQ ID NO: 613303 - protein, 42 aa, Mycobacterium
VTGSGSSGFGHSGDGSSGLANSGDSSSGAFNETDNTAGFFGQ

SEQ ID NO: 613304 - protein, 17 aa, Mycobacterium
VTGSKGGPKRLDKANAD

SEQ ID NO: 613305 - protein, 8 aa, Mycobacterium
VTGSPADP

SEQ ID NO: 613306 - protein, 7 aa, Mycobacterium
VTGSPHE

SEQ ID NO: 613307 - protein, 7 aa, Mycobacterium
VTGSPLE

SEQ ID NO: 613308 - protein, 9 aa, Mycobacterium
VTGSPPPET

SEQ ID NO: 613309 - protein, 12 aa, Mycobacterium
VTGSPTADTRFS

SEQ ID NO: 613310 - protein, 7 aa, Mycobacterium
VTGSQGH

SEQ ID NO: 613311 - protein, 9 aa, Mycobacterium
VTGSSRGIG

SEQ ID NO: 613312 - protein, 10 aa, Mycobacterium
VTGSSRGIGR

SEQ ID NO: 613313 - protein, 8 aa, Mycobacterium
VTGSTQGI

SEQ ID NO: 613314 - protein, 5 aa, Mycobacterium
VTGSV

SEQ ID NO: 613315 - protein, 39 aa, Mycobacterium
VTGTAGAGGTGGAGGDAGLLGGPGGAGGTGGTGGPNIDA

SEQ ID NO: 613316 - protein, 14 aa, Mycobacterium
VTGTDELAAALPVP

SEQ ID NO: 613317 - protein, 9 aa, Mycobacterium
VTGTDGEDQ

SEQ ID NO: 613318 - protein, 7 aa, Mycobacterium
VTGTGGR

SEQ ID NO: 613319 - protein, 10 aa, Mycobacterium
VTGTGPQGAV

SEQ ID NO: 613320 - protein, 6 aa, Mycobacterium
VTGTGQ

SEQ ID NO: 613321 - protein, 12 aa, Mycobacterium
VTGTGRVDAAAE

SEQ ID NO: 613322 - protein, 6 aa, Mycobacterium
VTGTPI

SEQ ID NO: 613323 - protein, 8 aa, Mycobacterium
VTGTPNPK

SEQ ID NO: 613324 - protein, 13 aa, Mycobacterium
VTGTPSSGRQRTS

SEQ ID NO: 613325 - protein, 9 aa, Mycobacterium
VTGTPVADE

SEQ ID NO: 613326 - protein, 5 aa, Mycobacterium
VTGTR

SEQ ID NO: 613327 - protein, 8 aa, Mycobacterium
VTGTRDPD

SEQ ID NO: 613328 - protein, 5 aa, Mycobacterium
VTGTS

SEQ ID NO: 613329 - protein, 9 aa, Mycobacterium
VTGTSEAQQ

SEQ ID NO: 613330 - protein, 12 aa, Mycobacterium
VTGTSGTTQVRA

SEQ ID NO: 613331 - protein, 12 aa, Mycobacterium
VTGTSKGKGFAG

SEQ ID NO: 613332 - protein, 5 aa, Mycobacterium
VTGTT

SEQ ID NO: 613333 - protein, 7 aa, Mycobacterium
VTGTTKA

SEQ ID NO: 613334 - protein, 10 aa, Mycobacterium
VTGTTRKLSS

SEQ ID NO: 613335 - protein, 6 aa, Mycobacterium
VTGTTV

SEQ ID NO: 613336 - protein, 7 aa, Mycobacterium
VTGTYGR

SEQ ID NO: 613337 - protein, 27 aa, Mycobacterium
VTGVAGAPFGAGLGQSGDLDPGRAMAG

SEQ ID NO: 613338 - protein, 28 aa, Mycobacterium
VTGVAGAPFGAGLGQSGDLDPGRAMAGA

SEQ ID NO: 613339 - protein, 9 aa, Mycobacterium
VTGVPPQRR

SEQ ID NO: 613340 - protein, 5 aa, Mycobacterium
VTGVR

SEQ ID NO: 613341 - protein, 11 aa, Mycobacterium
VTGVRTEAGET

SEQ ID NO: 613342 - protein, 9 aa, Mycobacterium
VTGYGPPAS

SEQ ID NO: 613343 - protein, 6 aa, Mycobacterium
VTHGGT

SEQ ID NO: 613344 - protein, 10 aa, Mycobacterium
VTHPGAGHTT

SEQ ID NO: 613345 - protein, 5 aa, Mycobacterium
VTHPQ

SEQ ID NO: 613346 - protein, 4 aa, Mycobacterium
VTHR

SEQ ID NO: 613347 - protein, 23 aa, Mycobacterium
VTHSADSSGSVKVTANGVTKALR

SEQ ID NO: 613348 - protein, 5 aa, Mycobacterium
VTHTD

SEQ ID NO: 613349 - protein, 7 aa, Mycobacterium
VTIEDRR

SEQ ID NO: 613350 - protein, 7 aa, Mycobacterium
VTIGDTS

SEQ ID NO: 613351 - protein, 6 aa, Mycobacterium
VTIGSG

SEQ ID NO: 613352 - protein, 4 aa, Mycobacterium
VTIN

SEQ ID NO: 613353 - protein, 12 aa, Mycobacterium
VTITGSAGVTPS

SEQ ID NO: 613354 - protein, 11 aa, Mycobacterium
VTKDGSPQGAR

SEQ ID NO: 613355 - protein, 6 aa, Mycobacterium
VTKDPE

SEQ ID NO: 613356 - protein, 5 aa, Mycobacterium
VTKER

SEQ ID NO: 613357 - protein, 4 aa, Mycobacterium
VTKG

SEQ ID NO: 613358 - protein, 9 aa, Mycobacterium
VTKGATTVT

SEQ ID NO: 613359 - protein, 9 aa, Mycobacterium
VTKGDLTEA

SEQ ID NO: 613360 - protein, 9 aa, Mycobacterium
VTKGDLTGA

SEQ ID NO: 613361 - protein, 8 aa, Mycobacterium
VTKGRHTG

SEQ ID NO: 613362 - protein, 13 aa, Mycobacterium
VTKISADKRNPHS

SEQ ID NO: 613363 - protein, 7 aa, Mycobacterium
VTKPEGL

SEQ ID NO: 613364 - protein, 6 aa, Mycobacterium
VTKPGG

SEQ ID NO: 613365 - protein, 7 aa, Mycobacterium
VTKPGGR

SEQ ID NO: 613366 - protein, 7 aa, Mycobacterium
VTKPHPP

SEQ ID NO: 613367 - protein, 6 aa, Mycobacterium
VTKPYP

SEQ ID NO: 613368 - protein, 10 aa, Mycobacterium
VTKRGGGAAL

SEQ ID NO: 613369 - protein, 10 aa, Mycobacterium
VTKRGRHGRP

SEQ ID NO: 613370 - protein, 11 aa, Mycobacterium
VTKSDQTPWYE

SEQ ID NO: 613371 - protein, 5 aa, Mycobacterium
VTKSF

SEQ ID NO: 613372 - protein, 5 aa, Mycobacterium
VTKSG

SEQ ID NO: 613373 - protein, 5 aa, Mycobacterium
VTKTA

SEQ ID NO: 613374 - protein, 5 aa, Mycobacterium
VTKYG

SEQ ID NO: 613375 - protein, 4 aa, Mycobacterium
VTLA

SEQ ID NO: 613376 - protein, 13 aa, Mycobacterium
VTLAGSKTRPQLG

SEQ ID NO: 613377 - protein, 27 aa, Mycobacterium
VTLDGNADFRQPGHAEFEDKDATDPLE

SEQ ID NO: 613378 - protein, 11 aa, Mycobacterium
VTLDGSGAGLK

SEQ ID NO: 613379 - protein, 12 aa, Mycobacterium
VTLDSQQSVDPL

SEQ ID NO: 613380 - protein, 10 aa, Mycobacterium
VTLGNDTEYG

SEQ ID NO: 613381 - protein, 13 aa, Mycobacterium
VTLNPGANGVRVD

SEQ ID NO: 613382 - protein, 12 aa, Mycobacterium
VTLPSGERVDPD

SEQ ID NO: 613383 - protein, 4 aa, Mycobacterium
VTLQ

SEQ ID NO: 613384 - protein, 10 aa, Mycobacterium
VTLSGEPADV

SEQ ID NO: 613385 - protein, 12 aa, Mycobacterium
VTLSGSADAVGR

SEQ ID NO: 613386 - protein, 5 aa, Mycobacterium
VTLTD

SEQ ID NO: 613387 - protein, 5 aa, Mycobacterium
VTLTP

SEQ ID NO: 613388 - protein, 19 aa, Mycobacterium
VTNASSAGLGEAPAAGSGL

SEQ ID NO: 613389 - protein, 5 aa, Mycobacterium
VTNDL

SEQ ID NO: 613390 - protein, 13 aa, Mycobacterium
VTNDQPTGPDERI

SEQ ID NO: 613391 - protein, 11 aa, Mycobacterium
VTNEKEESTIA

SEQ ID NO: 613392 - protein, 10 aa, Mycobacterium
VTNGLGTHPS

SEQ ID NO: 613393 - protein, 10 aa, Mycobacterium
VTNGRVKAGD

SEQ ID NO: 613394 - protein, 5 aa, Mycobacterium
VTNGT

SEQ ID NO: 613395 - protein, 8 aa, Mycobacterium
VTNGTTTH

SEQ ID NO: 613396 - protein, 5 aa, Mycobacterium
VTNHG

SEQ ID NO: 613397 - protein, 9 aa, Mycobacterium
VTNNPKNPM

SEQ ID NO: 613398 - protein, 9 aa, Mycobacterium
VTNPATKSL

SEQ ID NO: 613399 - protein, 5 aa, Mycobacterium
VTNPD

SEQ ID NO: 613400 - protein, 7 aa, Mycobacterium
VTNPDKR

SEQ ID NO: 613401 - protein, 11 aa, Mycobacterium
VTNPGGGNDTA

SEQ ID NO: 613402 - protein, 29 aa, Mycobacterium
VTNPGGRAQRTQGYIPAGAGGSGQAGTSL

SEQ ID NO: 613403 - protein, 9 aa, Mycobacterium
VTNPTETTA

SEQ ID NO: 613404 - protein, 7 aa, Mycobacterium
VTNPTST

SEQ ID NO: 613405 - protein, 11 aa, Mycobacterium
VTNPVATASAL

SEQ ID NO: 613406 - protein, 9 aa, Mycobacterium
VTNPVPPWK

SEQ ID NO: 613407 - protein, 9 aa, Mycobacterium
VTNQINGEL

SEQ ID NO: 613408 - protein, 10 aa, Mycobacterium
VTNRGYPPSI

SEQ ID NO: 613409 - protein, 5 aa, Mycobacterium
VTNRP

SEQ ID NO: 613410 - protein, 16 aa, Mycobacterium
VTNSDTDPDALDAEAE

SEQ ID NO: 613411 - protein, 12 aa, Mycobacterium
VTNTDNGNRATL

SEQ ID NO: 613412 - protein, 21 aa, Mycobacterium
VTNTSPAAMPNYGDDSIDSRH

SEQ ID NO: 613413 - protein, 10 aa, Mycobacterium
VTNVDPKDRD

SEQ ID NO: 613414 - protein, 10 aa, Mycobacterium
VTNVDPKSRD

SEQ ID NO: 613415 - protein, 7 aa, Mycobacterium
VTNVTEG

SEQ ID NO: 613416 - protein, 9 aa, Mycobacterium
VTPAADGQS

SEQ ID NO: 613417 - protein, 6 aa, Mycobacterium
VTPAAR

SEQ ID NO: 613418 - protein, 5 aa, Mycobacterium
VTPAD

SEQ ID NO: 613419 - protein, 6 aa, Mycobacterium
VTPADF

SEQ ID NO: 613420 - protein, 7 aa, Mycobacterium
VTPADFE

SEQ ID NO: 613421 - protein, 6 aa, Mycobacterium
VTPADT

SEQ ID NO: 613422 - protein, 5 aa, Mycobacterium
VTPAE

SEQ ID NO: 613423 - protein, 15 aa, Mycobacterium
VTPAEAKERYGRRAT

SEQ ID NO: 613424 - protein, 6 aa, Mycobacterium
VTPAEL

SEQ ID NO: 613425 - protein, 9 aa, Mycobacterium
VTPAGALDS

SEQ ID NO: 613426 - protein, 10 aa, Mycobacterium
VTPAGDAVRS

SEQ ID NO: 613427 - protein, 10 aa, Mycobacterium
VTPAGGGADT

SEQ ID NO: 613428 - protein, 15 aa, Mycobacterium
VTPAGTEEIGADPGI

SEQ ID NO: 613429 - protein, 26 aa, Mycobacterium
VTPAPTQPAVPAAPAPFTRGNPAQAP

SEQ ID NO: 613430 - protein, 6 aa, Mycobacterium
VTPARV

SEQ ID NO: 613431 - protein, 5 aa, Mycobacterium
VTPAS

SEQ ID NO: 613432 - protein, 7 aa, Mycobacterium
VTPASLR

SEQ ID NO: 613433 - protein, 7 aa, Mycobacterium
VTPATGL

SEQ ID NO: 613434 - protein, 8 aa, Mycobacterium
VTPATPGR

SEQ ID NO: 613435 - protein, 8 aa, Mycobacterium
VTPATSGR

SEQ ID NO: 613436 - protein, 8 aa, Mycobacterium
VTPATVPD

SEQ ID NO: 613437 - protein, 5 aa, Mycobacterium
VTPAV

SEQ ID NO: 613438 - protein, 6 aa, Mycobacterium
VTPAVR

SEQ ID NO: 613439 - protein, 9 aa, Mycobacterium
VTPDAENKT

SEQ ID NO: 613440 - protein, 10 aa, Mycobacterium
VTPDATGITA

SEQ ID NO: 613441 - protein, 9 aa, Mycobacterium
VTPDATSKT

SEQ ID NO: 613442 - protein, 5 aa, Mycobacterium
VTPDD

SEQ ID NO: 613443 - protein, 6 aa, Mycobacterium
VTPDDA

SEQ ID NO: 613444 - protein, 6 aa, Mycobacterium
VTPDEI

SEQ ID NO: 613445 - protein, 6 aa, Mycobacterium
VTPDEV

SEQ ID NO: 613446 - protein, 11 aa, Mycobacterium
VTPDGFEGQIG

SEQ ID NO: 613447 - protein, 6 aa, Mycobacterium
VTPDGG

SEQ ID NO: 613448 - protein, 20 aa, Mycobacterium
VTPDGQHPLPTTDASGEPIT

SEQ ID NO: 613449 - protein, 7 aa, Mycobacterium
VTPDGRP

SEQ ID NO: 613450 - protein, 9 aa, Mycobacterium
VTPDNQAHA

SEQ ID NO: 613451 - protein, 6 aa, Mycobacterium
VTPDQL

SEQ ID NO: 613452 - protein, 6 aa, Mycobacterium
VTPDRL

SEQ ID NO: 613453 - protein, 7 aa, Mycobacterium
VTPDSQR

SEQ ID NO: 613454 - protein, 5 aa, Mycobacterium
VTPEA

SEQ ID NO: 613455 - protein, 10 aa, Mycobacterium
VTPEANAKFR

SEQ ID NO: 613456 - protein, 5 aa, Mycobacterium
VTPEG

SEQ ID NO: 613457 - protein, 8 aa, Mycobacterium
VTPEGRAD

SEQ ID NO: 613458 - protein, 7 aa, Mycobacterium
VTPEHPS

SEQ ID NO: 613459 - protein, 5 aa, Mycobacterium
VTPEL

SEQ ID NO: 613460 - protein, 5 aa, Mycobacterium
VTPEM

SEQ ID NO: 613461 - protein, 5 aa, Mycobacterium
VTPEP

SEQ ID NO: 613462 - protein, 10 aa, Mycobacterium
VTPEPDEATI

SEQ ID NO: 613463 - protein, 11 aa, Mycobacterium
VTPEPDETTIR

SEQ ID NO: 613464 - protein, 8 aa, Mycobacterium
VTPEPVDT

SEQ ID NO: 613465 - protein, 5 aa, Mycobacterium
VTPEQ

SEQ ID NO: 613466 - protein, 11 aa, Mycobacterium
VTPEQAGAHPT

SEQ ID NO: 613467 - protein, 6 aa, Mycobacterium
VTPEQL

SEQ ID NO: 613468 - protein, 8 aa, Mycobacterium
VTPEQQVP

SEQ ID NO: 613469 - protein, 5 aa, Mycobacterium
VTPER

SEQ ID NO: 613470 - protein, 6 aa, Mycobacterium
VTPERV

SEQ ID NO: 613471 - protein, 6 aa, Mycobacterium
VTPETA

SEQ ID NO: 613472 - protein, 8 aa, Mycobacterium
VTPETSNT

SEQ ID NO: 613473 - protein, 4 aa, Mycobacterium
VTPG

SEQ ID NO: 613474 - protein, 10 aa, Mycobacterium
VTPGDIGQPY

SEQ ID NO: 613475 - protein, 10 aa, Mycobacterium
VTPGDVGEPY

SEQ ID NO: 613476 - protein, 7 aa, Mycobacterium
VTPGERY

SEQ ID NO: 613477 - protein, 5 aa, Mycobacterium
VTPGG

SEQ ID NO: 613478 - protein, 5 aa, Mycobacterium
VTPGH

SEQ ID NO: 613479 - protein, 6 aa, Mycobacterium
VTPGHE

SEQ ID NO: 613480 - protein, 9 aa, Mycobacterium
VTPGNEGRG

SEQ ID NO: 613481 - protein, 7 aa, Mycobacterium
VTPGPGE

SEQ ID NO: 613482 - protein, 12 aa, Mycobacterium
VTPGPGPVIDPD

SEQ ID NO: 613483 - protein, 10 aa, Mycobacterium
VTPGPPRPGY

SEQ ID NO: 613484 - protein, 7 aa, Mycobacterium
VTPGQLP

SEQ ID NO: 613485 - protein, 7 aa, Mycobacterium
VTPGRAS

SEQ ID NO: 613486 - protein, 6 aa, Mycobacterium
VTPGRD

SEQ ID NO: 613487 - protein, 14 aa, Mycobacterium
VTPGREDAMAADPQ

SEQ ID NO: 613488 - protein, 11 aa, Mycobacterium
VTPGRTRERRR

SEQ ID NO: 613489 - protein, 6 aa, Mycobacterium
VTPGSD

SEQ ID NO: 613490 - protein, 5 aa, Mycobacterium
VTPGY

SEQ ID NO: 613491 - protein, 10 aa, Mycobacterium
VTPGYGAPAN

SEQ ID NO: 613492 - protein, 9 aa, Mycobacterium
VTPHTNARA

SEQ ID NO: 613493 - protein, 16 aa, Mycobacterium
VTPIDEDRQTHEQDLE

SEQ ID NO: 613494 - protein, 45 aa, Mycobacterium
VTPKEPTTTPAEKSQTETTASEQTKEAATETTADAQDAPAKRKKP

SEQ ID NO: 613495 - protein, 5 aa, Mycobacterium
VTPKG

SEQ ID NO: 613496 - protein, 12 aa, Mycobacterium
VTPKGETELTPE

SEQ ID NO: 613497 - protein, 9 aa, Mycobacterium
VTPKGGVAR

SEQ ID NO: 613498 - protein, 5 aa, Mycobacterium
VTPKR

SEQ ID NO: 613499 - protein, 6 aa, Mycobacterium
VTPLSR

SEQ ID NO: 613500 - protein, 6 aa, Mycobacterium
VTPNDV

SEQ ID NO: 613501 - protein, 17 aa, Mycobacterium
VTPNSTAGEDIAQLLGI

SEQ ID NO: 613502 - protein, 13 aa, Mycobacterium
VTPPAIPTTKEAV

SEQ ID NO: 613503 - protein, 17 aa, Mycobacterium
VTPPAPGVPGGAAAVPA

SEQ ID NO: 613504 - protein, 32 aa, Mycobacterium; identical to SEQ ID NO: 76828

SEQ ID NO: 613505 - protein, 8 aa, Mycobacterium
VTPPASTG

SEQ ID NO: 613506 - protein, 10 aa, Mycobacterium
VTPPDATGFA

SEQ ID NO: 613507 - protein, 9 aa, Mycobacterium
VTPPDDDGS

SEQ ID NO: 613508 - protein, 6 aa, Mycobacterium
VTPPES

SEQ ID NO: 613509 - protein, 10 aa, Mycobacterium
VTPPGPTIEA

SEQ ID NO: 613510 - protein, 5 aa, Mycobacterium
VTPPM

SEQ ID NO: 613511 - protein, 8 aa, Mycobacterium
VTPPPHPR

SEQ ID NO: 613512 - protein, 14 aa, Mycobacterium
VTPPSWRPDITEGA

SEQ ID NO: 613513 - protein, 14 aa, Mycobacterium
VTPPSWRPDLQQPA

SEQ ID NO: 613514 - protein, 5 aa, Mycobacterium
VTPQE

SEQ ID NO: 613515 - protein, 11 aa, Mycobacterium
VTPQGTSGSPW

SEQ ID NO: 613516 - protein, 16 aa, Mycobacterium
VTPQPHNGCRPPKRRR

SEQ ID NO: 613517 - protein, 8 aa, Mycobacterium
VTPQQAKD

SEQ ID NO: 613518 - protein, 16 aa, Mycobacterium
VTPQSYDATIAPGSSV

SEQ ID NO: 613519 - protein, 4 aa, Mycobacterium
VTPR

SEQ ID NO: 613520 - protein, 7 aa, Mycobacterium
VTPRAQV

SEQ ID NO: 613521 - protein, 10 aa, Mycobacterium
VTPRDSQEKA

SEQ ID NO: 613522 - protein, 10 aa, Mycobacterium
VTPRKREAAG

SEQ ID NO: 613523 - protein, 11 aa, Mycobacterium
VTPRPRVAPTK

SEQ ID NO: 613524 - protein, 7 aa, Mycobacterium
VTPRRDG

SEQ ID NO: 613525 - protein, 5 aa, Mycobacterium
VTPRT

SEQ ID NO: 613526 - protein, 7 aa, Mycobacterium
VTPRTAE

SEQ ID NO: 613527 - protein, 9 aa, Mycobacterium
VTPRTDAAA

SEQ ID NO: 613528 - protein, 8 aa, Mycobacterium
VTPRTGYV

SEQ ID NO: 613529 - protein, 5 aa, Mycobacterium
VTPRY

SEQ ID NO: 613530 - protein, 13 aa, Mycobacterium
VTPSALSAPAGDF

SEQ ID NO: 613531 - protein, 6 aa, Mycobacterium
VTPSAY

SEQ ID NO: 613532 - protein, 5 aa, Mycobacterium
VTPSD

SEQ ID NO: 613533 - protein, 5 aa, Mycobacterium
VTPSG

SEQ ID NO: 613534 - protein, 6 aa, Mycobacterium
VTPSGE

SEQ ID NO: 613535 - protein, 8 aa, Mycobacterium
VTPSIARP

SEQ ID NO: 613536 - protein, 6 aa, Mycobacterium
VTPSNL

SEQ ID NO: 613537 - protein, 9 aa, Mycobacterium
VTPSPGDLL

SEQ ID NO: 613538 - protein, 9 aa, Mycobacterium
VTPSPPPER

SEQ ID NO: 613539 - protein, 6 aa, Mycobacterium
VTPSQR

SEQ ID NO: 613540 - protein, 11 aa, Mycobacterium
VTPSRSASGYR

SEQ ID NO: 613541 - protein, 24 aa, Mycobacterium
VTPSSQTTPPLDFPESASPQEGSE

SEQ ID NO: 613542 - protein, 10 aa, Mycobacterium
VTPSTGHSMQ

SEQ ID NO: 613543 - protein, 14 aa, Mycobacterium
VTPSVGPDATASGA

SEQ ID NO: 613544 - protein, 8 aa, Mycobacterium
VTPTADGS

SEQ ID NO: 613545 - protein, 5 aa, Mycobacterium
VTPTC

SEQ ID NO: 613546 - protein, 17 aa, Mycobacterium
VTPTESGYRAATYGEVG

SEQ ID NO: 613547 - protein, 5 aa, Mycobacterium
VTPTG

SEQ ID NO: 613548 - protein, 8 aa, Mycobacterium
VTPTGDTA

SEQ ID NO: 613549 - protein, 6 aa, Mycobacterium
VTPTGR

SEQ ID NO: 613550 - protein, 5 aa, Mycobacterium
VTPTT

SEQ ID NO: 613551 - protein, 10 aa, Mycobacterium
VTPVAPERPR

SEQ ID NO: 613552 - protein, 8 aa, Mycobacterium
VTPVPGPK

SEQ ID NO: 613553 - protein, 7 aa, Mycobacterium
VTPYPDS

SEQ ID NO: 613554 - protein, 7 aa, Mycobacterium
VTPYPPG

SEQ ID NO: 613555 - protein, 5 aa, Mycobacterium
VTPYT

SEQ ID NO: 613556 - protein, 32 aa, Mycobacterium
VTQAAPAPRFSRTPSGPLGAPPKDTTELSDIG

SEQ ID NO: 613557 - protein, 4 aa, Mycobacterium
VTQD

SEQ ID NO: 613558 - protein, 11 aa, Mycobacterium
VTQDPGATAAN

SEQ ID NO: 613559 - protein, 7 aa, Mycobacterium
VTQESDR

SEQ ID NO: 613560 - protein, 5 aa, Mycobacterium
VTQGN

SEQ ID NO: 613561 - protein, 5 aa, Mycobacterium
VTQGR

SEQ ID NO: 613562 - protein, 10 aa, Mycobacterium
VTQGRSRGTV

SEQ ID NO: 613563 - protein, 8 aa, Mycobacterium
VTQGTASS

SEQ ID NO: 613564 - protein, 5 aa, Mycobacterium
VTQPG

SEQ ID NO: 613565 - protein, 7 aa, Mycobacterium
VTQPKGR

SEQ ID NO: 613566 - protein, 8 aa, Mycobacterium
VTQPTAWS

SEQ ID NO: 613567 - protein, 12 aa, Mycobacterium
VTQQPSTSSFIP

SEQ ID NO: 613568 - protein, 6 aa, Mycobacterium
VTQRFS

SEQ ID NO: 613569 - protein, 16 aa, Mycobacterium
VTQRQQWSGRPGPALG

SEQ ID NO: 613570 - protein, 7 aa, Mycobacterium
VTQRRDD

SEQ ID NO: 613571 - protein, 4 aa, Mycobacterium
VTQS

SEQ ID NO: 613572 - protein, 9 aa, Mycobacterium
VTQSNTASR

SEQ ID NO: 613573 - protein, 10 aa, Mycobacterium
VTQTRGADGN

SEQ ID NO: 613574 - protein, 10 aa, Mycobacterium
VTRADPKDRD

SEQ ID NO: 613575 - protein, 7 aa, Mycobacterium
VTRAGRQ

SEQ ID NO: 613576 - protein, 8 aa, Mycobacterium
VTRAPNVA

SEQ ID NO: 613577 - protein, 10 aa, Mycobacterium
VTRARADADP

SEQ ID NO: 613578 - protein, 5 aa, Mycobacterium
VTRDD

SEQ ID NO: 613579 - protein, 8 aa, Mycobacterium
VTRDDEGR

SEQ ID NO: 613580 - protein, 17 aa, Mycobacterium
VTRDENLEKVSTSSTLN

SEQ ID NO: 613581 - protein, 6 aa, Mycobacterium
VTRDGE

SEQ ID NO: 613582 - protein, 9 aa, Mycobacterium
VTRDGSTVR

SEQ ID NO: 613583 - protein, 8 aa, Mycobacterium
VTRDGTKK

SEQ ID NO: 613584 - protein, 9 aa, Mycobacterium
VTRDPEAVR

SEQ ID NO: 613585 - protein, 9 aa, Mycobacterium
VTRDRNGLP

SEQ ID NO: 613586 - protein, 7 aa, Mycobacterium
VTRDSDI

SEQ ID NO: 613587 - protein, 7 aa, Mycobacterium
VTREGEQ

SEQ ID NO: 613588 - protein, 24 aa, Mycobacterium
VTREGQVRSGDRHEKDDRHRVDDP

SEQ ID NO: 613589 - protein, 5 aa, Mycobacterium
VTREP

SEQ ID NO: 613590 - protein, 7 aa, Mycobacterium
VTRETEG

SEQ ID NO: 613591 - protein, 5 aa, Mycobacterium
VTRGA

SEQ ID NO: 613592 - protein, 7 aa, Mycobacterium
VTRGASV

SEQ ID NO: 613593 - protein, 17 aa, Mycobacterium
VTRGGKAAGSVSKKTSY

SEQ ID NO: 613594 - protein, 7 aa, Mycobacterium
VTRGSEL

SEQ ID NO: 613595 - protein, 14 aa, Mycobacterium
VTRGTAQAYATNYE

SEQ ID NO: 613596 - protein, 8 aa, Mycobacterium
VTRGVDDR

SEQ ID NO: 613597 - protein, 4 aa, Mycobacterium
VTRH

SEQ ID NO: 613598 - protein, 6 aa, Mycobacterium
VTRHPY

SEQ ID NO: 613599 - protein, 9 aa, Mycobacterium
VTRKGGREA

SEQ ID NO: 613600 - protein, 9 aa, Mycobacterium
VTRLGDRKN

SEQ ID NO: 613601 - protein, 8 aa, Mycobacterium
VTRNGEQI

SEQ ID NO: 613602 - protein, 11 aa, Mycobacterium
VTRNGGGAALP

SEQ ID NO: 613603 - protein, 8 aa, Mycobacterium
VTRNPNPH

SEQ ID NO: 613604 - protein, 13 aa, Mycobacterium
VTRPDAGHAAFGG

SEQ ID NO: 613605 - protein, 6 aa, Mycobacterium
VTRPDE

SEQ ID NO: 613606 - protein, 10 aa, Mycobacterium
VTRPDEPAPC

SEQ ID NO: 613607 - protein, 10 aa, Mycobacterium
VTRPDEPTPC

SEQ ID NO: 613608 - protein, 7 aa, Mycobacterium
VTRPDTV

SEQ ID NO: 613609 - protein, 9 aa, Mycobacterium
VTRPEQVTA

SEQ ID NO: 613610 - protein, 7 aa, Mycobacterium
VTRPGAE

SEQ ID NO: 613611 - protein, 11 aa, Mycobacterium
VTRPGGNKQRI

SEQ ID NO: 613612 - protein, 9 aa, Mycobacterium
VTRPGPGGY

SEQ ID NO: 613613 - protein, 8 aa, Mycobacterium
VTRPGQYE

SEQ ID NO: 613614 - protein, 8 aa, Mycobacterium
VTRPGRSF

SEQ ID NO: 613615 - protein, 6 aa, Mycobacterium
VTRPRD

SEQ ID NO: 613616 - protein, 16 aa, Mycobacterium
VTRPSTPGQPARRAPT

SEQ ID NO: 613617 - protein, 10 aa, Mycobacterium
VTRQGGRDGD

SEQ ID NO: 613618 - protein, 7 aa, Mycobacterium
VTRQTLG

SEQ ID NO: 613619 - protein, 4 aa, Mycobacterium
VTRR

SEQ ID NO: 613620 - protein, 9 aa, Mycobacterium
VTRRAERSA

SEQ ID NO: 613621 - protein, 11 aa, Mycobacterium
VTRRGGGAALP

SEQ ID NO: 613622 - protein, 9 aa, Mycobacterium
VTRRGGRDG

SEQ ID NO: 613623 - protein, 9 aa, Mycobacterium
VTRRGGREA

SEQ ID NO: 613624 - protein, 20 aa, Mycobacterium
VTRRGGVDTGARPGRLVRGA

SEQ ID NO: 613625 - protein, 6 aa, Mycobacterium
VTRRGR

SEQ ID NO: 613626 - protein, 15 aa, Mycobacterium
VTRRQQWSGRPGPVL

SEQ ID NO: 613627 - protein, 9 aa, Mycobacterium
VTRRTEGQM

SEQ ID NO: 613628 - protein, 16 aa, Mycobacterium
VTRRTRGGGVHRPDQA

SEQ ID NO: 613629 - protein, 4 aa, Mycobacterium
VTRS

SEQ ID NO: 613630 - protein, 20 aa, Mycobacterium
VTRSARSTARSLRLDQARPS

SEQ ID NO: 613631 - protein, 9 aa, Mycobacterium
VTRSEPEKS

SEQ ID NO: 613632 - protein, 5 aa, Mycobacterium
VTRSG

SEQ ID NO: 613633 - protein, 12 aa, Mycobacterium
VTRSGGGDPEDD

SEQ ID NO: 613634 - protein, 8 aa, Mycobacterium
VTRSGSER

SEQ ID NO: 613635 - protein, 8 aa, Mycobacterium
VTRSGTSI

SEQ ID NO: 613636 - protein, 12 aa, Mycobacterium
VTRSPEHARQGA

SEQ ID NO: 613637 - protein, 7 aa, Mycobacterium
VTRSPTD

SEQ ID NO: 613638 - protein, 7 aa, Mycobacterium
VTRSRNE

SEQ ID NO: 613639 - protein, 8 aa, Mycobacterium
VTRSTAPP

SEQ ID NO: 613640 - protein, 12 aa, Mycobacterium
VTRTAEPWTAED

SEQ ID NO: 613641 - protein, 8 aa, Mycobacterium
VTRTGDGD

SEQ ID NO: 613642 - protein, 13 aa, Mycobacterium
VTRTGGDGGAGGD

SEQ ID NO: 613643 - protein, 19 aa, Mycobacterium
VTRTGRPAAHHDAPPGDPY

SEQ ID NO: 613644 - protein, 5 aa, Mycobacterium
VTRTR

SEQ ID NO: 613645 - protein, 6 aa, Mycobacterium
VTRTRK

SEQ ID NO: 613646 - protein, 9 aa, Mycobacterium
VTRVDPKNR

SEQ ID NO: 613647 - protein, 23 aa, Mycobacterium
VTRVNGANYRGRPVRPSQTPGTV

SEQ ID NO: 613648 - protein, 9 aa, Mycobacterium
VTRYGGGDL

SEQ ID NO: 613649 - protein, 10 aa, Mycobacterium
VTRYGGGVTG

SEQ ID NO: 613650 - protein, 14 aa, Mycobacterium
VTRYSSTALRRNSS

SEQ ID NO: 613651 - protein, 4 aa, Mycobacterium
VTSA

SEQ ID NO: 613652 - protein, 12 aa, Mycobacterium
VTSAAENAQRQA

SEQ ID NO: 613653 - protein, 8 aa, Mycobacterium
VTSAAETA

SEQ ID NO: 613654 - protein, 9 aa, Mycobacterium
VTSADGSAA

SEQ ID NO: 613655 - protein, 5 aa, Mycobacterium
VTSAE

SEQ ID NO: 613656 - protein, 8 aa, Mycobacterium
VTSAESVD

SEQ ID NO: 613657 - protein, 15 aa, Mycobacterium
VTSAGDVDTAKPRPD

SEQ ID NO: 613658 - protein, 6 aa, Mycobacterium
VTSAGG

SEQ ID NO: 613659 - protein, 10 aa, Mycobacterium
VTSAGRHADN

SEQ ID NO: 613660 - protein, 7 aa, Mycobacterium
VTSAGSH

SEQ ID NO: 613661 - protein, 8 aa, Mycobacterium
VTSAGTGN

SEQ ID NO: 613662 - protein, 10 aa, Mycobacterium
VTSALSASHG

SEQ ID NO: 613663 - protein, 10 aa, Mycobacterium
VTSALSNSHG

SEQ ID NO: 613664 - protein, 9 aa, Mycobacterium
VTSAQSAAR

SEQ ID NO: 613665 - protein, 8 aa, Mycobacterium
VTSARSNT

SEQ ID NO: 613666 - protein, 4 aa, Mycobacterium
VTSD

SEQ ID NO: 613667 - protein, 9 aa, Mycobacterium
VTSDAGTEY

SEQ ID NO: 613668 - protein, 11 aa, Mycobacterium
VTSDESVQGAI

SEQ ID NO: 613669 - protein, 7 aa, Mycobacterium
VTSDQLP

SEQ ID NO: 613670 - protein, 11 aa, Mycobacterium
VTSDQPLDTTT

SEQ ID NO: 613671 - protein, 5 aa, Mycobacterium
VTSEA

SEQ ID NO: 613672 - protein, 8 aa, Mycobacterium
VTSEADGI

SEQ ID NO: 613673 - protein, 6 aa, Mycobacterium
VTSEAG

SEQ ID NO: 613674 - protein, 10 aa, Mycobacterium
VTSEAVTASY

SEQ ID NO: 613675 - protein, 6 aa, Mycobacterium
VTSEDY

SEQ ID NO: 613676 - protein, 11 aa, Mycobacterium
VTSEPEDVTYA

SEQ ID NO: 613677 - protein, 16 aa, Mycobacterium
VTSEQSTNQVGGQTYD

SEQ ID NO: 613678 - protein, 12 aa, Mycobacterium
VTSESRGPAAIA

SEQ ID NO: 613679 - protein, 4 aa, Mycobacterium
VTSG

SEQ ID NO: 613680 - protein, 6 aa, Mycobacterium
VTSGAG

SEQ ID NO: 613681 - protein, 5 aa, Mycobacterium
VTSGD

SEQ ID NO: 613682 - protein, 10 aa, Mycobacterium
VTSGDPRSAV

SEQ ID NO: 613683 - protein, 9 aa, Mycobacterium
VTSGDVAGQ

SEQ ID NO: 613684 - protein, 6 aa, Mycobacterium
VTSGEL

SEQ ID NO: 613685 - protein, 7 aa, Mycobacterium
VTSGEVS

SEQ ID NO: 613686 - protein, 9 aa, Mycobacterium
VTSGGDSLT

SEQ ID NO: 613687 - protein, 7 aa, Mycobacterium
VTSGQRA

SEQ ID NO: 613688 - protein, 8 aa, Mycobacterium
VTSGREGV

SEQ ID NO: 613689 - protein, 14 aa, Mycobacterium
VTSGRSTPGPLPDG

SEQ ID NO: 613690 - protein, 7 aa, Mycobacterium
VTSGSKG

SEQ ID NO: 613691 - protein, 9 aa, Mycobacterium
VTSGTADLQ

SEQ ID NO: 613692 - protein, 5 aa, Mycobacterium
VTSGY

SEQ ID NO: 613693 - protein, 10 aa, Mycobacterium
VTSKKRDDLQ

SEQ ID NO: 613694 - protein, 8 aa, Mycobacterium
VTSLKPGD

SEQ ID NO: 613695 - protein, 9 aa, Mycobacterium
VTSNREPSE

SEQ ID NO: 613696 - protein, 12 aa, Mycobacterium
VTSNSWEYTGDG

SEQ ID NO: 613697 - protein, 9 aa, Mycobacterium
VTSNTRGDA

SEQ ID NO: 613698 - protein, 4 aa, Mycobacterium
VTSP

SEQ ID NO: 613699 - protein, 11 aa, Mycobacterium
VTSPAGTTAAG

SEQ ID NO: 613700 - protein, 9 aa, Mycobacterium
VTSPATGEL

SEQ ID NO: 613701 - protein, 10 aa, Mycobacterium
VTSPEDVATG

SEQ ID NO: 613702 - protein, 6 aa, Mycobacterium
VTSPEL

SEQ ID NO: 613703 - protein, 12 aa, Mycobacterium
VTSPGGNKQRVN

SEQ ID NO: 613704 - protein, 10 aa, Mycobacterium
VTSPGGTTAA

SEQ ID NO: 613705 - protein, 13 aa, Mycobacterium
VTSPGLEVSGDES

SEQ ID NO: 613706 - protein, 6 aa, Mycobacterium
VTSPNL

SEQ ID NO: 613707 - protein, 12 aa, Mycobacterium
VTSPPAQQPAAT

SEQ ID NO: 613708 - protein, 11 aa, Mycobacterium
VTSPPDPRTGL

SEQ ID NO: 613709 - protein, 7 aa, Mycobacterium
VTSPPGG

SEQ ID NO: 613710 - protein, 24 aa, Mycobacterium
VTSPPVASPPAEALPPPPPRDQPL

SEQ ID NO: 613711 - protein, 9 aa, Mycobacterium
VTSPRGKRQ

SEQ ID NO: 613712 - protein, 9 aa, Mycobacterium
VTSPRPGTG

SEQ ID NO: 613713 - protein, 8 aa, Mycobacterium
VTSPTGNH

SEQ ID NO: 613714 - protein, 8 aa, Mycobacterium
VTSPTRTA

SEQ ID NO: 613715 - protein, 5 aa, Mycobacterium
VTSPV

SEQ ID NO: 613716 - protein, 13 aa, Mycobacterium
VTSPYPAAEGGHE

SEQ ID NO: 613717 - protein, 13 aa, Mycobacterium
VTSPYPAPGGGHE

SEQ ID NO: 613718 - protein, 12 aa, Mycobacterium
VTSPYPTDGGHE

SEQ ID NO: 613719 - protein, 11 aa, Mycobacterium
VTSQAGGKGVN

SEQ ID NO: 613720 - protein, 4 aa, Mycobacterium
VTSR

SEQ ID NO: 613721 - protein, 14 aa, Mycobacterium
VTSRAQLAQFIHRA

SEQ ID NO: 613722 - protein, 8 aa, Mycobacterium
VTSRDGRT

SEQ ID NO: 613723 - protein, 8 aa, Mycobacterium
VTSRGTPL

SEQ ID NO: 613724 - protein, 7 aa, Mycobacterium
VTSRPAG

SEQ ID NO: 613725 - protein, 6 aa, Mycobacterium
VTSRSD

SEQ ID NO: 613726 - protein, 13 aa, Mycobacterium
VTSRSGPPSIESH

SEQ ID NO: 613727 - protein, 5 aa, Mycobacterium
VTSRT

SEQ ID NO: 613728 - protein, 20 aa, Mycobacterium
VTSRWPSGIKDGAEFVIPTM

SEQ ID NO: 613729 - protein, 5 aa, Mycobacterium
VTSRY

SEQ ID NO: 613730 - protein, 7 aa, Mycobacterium
VTSSADV

SEQ ID NO: 613731 - protein, 14 aa, Mycobacterium
VTSSDELAAALRPP

SEQ ID NO: 613732 - protein, 8 aa, Mycobacterium
VTSSDTRD

SEQ ID NO: 613733 - protein, 15 aa, Mycobacterium
VTSSECNECKKLALA

SEQ ID NO: 613734 - protein, 9 aa, Mycobacterium
VTSSGDGVV

SEQ ID NO: 613735 - protein, 10 aa, Mycobacterium
VTSSLTNWGT

SEQ ID NO: 613736 - protein, 18 aa, Mycobacterium
VTSSPFGNRDLGNNRGAN

SEQ ID NO: 613737 - protein, 20 aa, Mycobacterium
VTSSSVVETEVGEKPEEPVS

SEQ ID NO: 613738 - protein, 4 aa, Mycobacterium
VTST

SEQ ID NO: 613739 - protein, 12 aa, Mycobacterium
VTSTADGGGKVA

SEQ ID NO: 613740 - protein, 15 aa, Mycobacterium
VTSTDDLLQAWDKGA

SEQ ID NO: 613741 - protein, 14 aa, Mycobacterium
VTSTGGTGGAGGNA

SEQ ID NO: 613742 - protein, 11 aa, Mycobacterium
VTSTGPDHDKE

SEQ ID NO: 613743 - protein, 10 aa, Mycobacterium
VTSTSGPGVA

SEQ ID NO: 613744 - protein, 11 aa, Mycobacterium
VTSTSGPGVSL

SEQ ID NO: 613745 - protein, 11 aa, Mycobacterium
VTSVEQKPGAV

SEQ ID NO: 613746 - protein, 10 aa, Mycobacterium
VTTADEPLED

SEQ ID NO: 613747 - protein, 6 aa, Mycobacterium
VTTAEE

SEQ ID NO: 613748 - protein, 7 aa, Mycobacterium
VTTAEEL

SEQ ID NO: 613749 - protein, 19 aa, Mycobacterium
VTTAGGNGGNGGTGGGGGL

SEQ ID NO: 613750 - protein, 6 aa, Mycobacterium
VTTAKT

SEQ ID NO: 613751 - protein, 18 aa, Mycobacterium
VTTAKTVRRAQYAQRAGA

SEQ ID NO: 613752 - protein, 8 aa, Mycobacterium
VTTAPDAP

SEQ ID NO: 613753 - protein, 7 aa, Mycobacterium
VTTAPGY

SEQ ID NO: 613754 - protein, 8 aa, Mycobacterium
VTTARAKT

SEQ ID NO: 613755 - protein, 17 aa, Mycobacterium
VTTDDQSGALGKAARTG

SEQ ID NO: 613756 - protein, 6 aa, Mycobacterium
VTTDDV

SEQ ID NO: 613757 - protein, 5 aa, Mycobacterium
VTTDE

SEQ ID NO: 613758 - protein, 8 aa, Mycobacterium
VTTDGRKT

SEQ ID NO: 613759 - protein, 20 aa, Mycobacterium
VTTDHISPAGAIKPGTPAAE

SEQ ID NO: 613760 - protein, 20 aa, Mycobacterium
VTTDHISPAGSIKPGTPAAQ

SEQ ID NO: 613761 - protein, 20 aa, Mycobacterium
VTTDHISPAGSIKSGTPAAQ

SEQ ID NO: 613762 - protein, 20 aa, Mycobacterium
VTTDHISPASSIKPGTPAAQ

SEQ ID NO: 613763 - protein, 7 aa, Mycobacterium
VTTDSAP

SEQ ID NO: 613764 - protein, 11 aa, Mycobacterium
VTTEAGSSTQK

SEQ ID NO: 613765 - protein, 7 aa, Mycobacterium
VTTEDGV

SEQ ID NO: 613766 - protein, 20 aa, Mycobacterium
VTTEETASWRDAADAANIPY

SEQ ID NO: 613767 - protein, 7 aa, Mycobacterium
VTTEGDL

SEQ ID NO: 613768 - protein, 6 aa, Mycobacterium
VTTETV

SEQ ID NO: 613769 - protein, 12 aa, Mycobacterium
VTTGAEQRRAAS

SEQ ID NO: 613770 - protein, 11 aa, Mycobacterium
VTTGGPDDLAD

SEQ ID NO: 613771 - protein, 8 aa, Mycobacterium
VTTGGRAR

SEQ ID NO: 613772 - protein, 11 aa, Mycobacterium
VTTGGYAGPGF

SEQ ID NO: 613773 - protein, 22 aa, Mycobacterium
VTTGPIAGSSKAYRTLDGVPGA

SEQ ID NO: 613774 - protein, 35 aa, Mycobacterium
VTTGRLDPARADAETDARTPSRAARDASRAQGRGL

SEQ ID NO: 613775 - protein, 7 aa, Mycobacterium
VTTHPNS

SEQ ID NO: 613776 - protein, 18 aa, Mycobacterium
VTTLSDEDRALTKGDPLR

SEQ ID NO: 613777 - protein, 14 aa, Mycobacterium
VTTPAGPPAEGEGI

SEQ ID NO: 613778 - protein, 6 aa, Mycobacterium
VTTPAR

SEQ ID NO: 613779 - protein, 8 aa, Mycobacterium
VTTPARTA

SEQ ID NO: 613780 - protein, 6 aa, Mycobacterium
VTTPDE

SEQ ID NO: 613781 - protein, 7 aa, Mycobacterium
VTTPEAG

SEQ ID NO: 613782 - protein, 7 aa, Mycobacterium
VTTPERT

SEQ ID NO: 613783 - protein, 8 aa, Mycobacterium
VTTPESSV

SEQ ID NO: 613784 - protein, 8 aa, Mycobacterium
VTTPGLNT

SEQ ID NO: 613785 - protein, 9 aa, Mycobacterium
VTTPGQYEA

SEQ ID NO: 613786 - protein, 14 aa, Mycobacterium
VTTPGVGTRPESLG

SEQ ID NO: 613787 - protein, 9 aa, Mycobacterium
VTTPKAGKV

SEQ ID NO: 613788 - protein, 10 aa, Mycobacterium
VTTPMAGGGM

SEQ ID NO: 613789 - protein, 7 aa, Mycobacterium
VTTPPNI

SEQ ID NO: 613790 - protein, 11 aa, Mycobacterium
VTTPPQTTRAK

SEQ ID NO: 613791 - protein, 9 aa, Mycobacterium
VTTPPTRNP

SEQ ID NO: 613792 - protein, 10 aa, Mycobacterium
VTTPQRTAYD

SEQ ID NO: 613793 - protein, 5 aa, Mycobacterium
VTTPT

SEQ ID NO: 613794 - protein, 6 aa, Mycobacterium
VTTPTK

SEQ ID NO: 613795 - protein, 19 aa, Mycobacterium
VTTPTQARALKEQTGARGL

SEQ ID NO: 613796 - protein, 15 aa, Mycobacterium
VTTQPERRGELESDD

SEQ ID NO: 613797 - protein, 20 aa, Mycobacterium
VTTRAASTTFATGGTRRTAA

SEQ ID NO: 613798 - protein, 10 aa, Mycobacterium
VTTRAEQHRA

SEQ ID NO: 613799 - protein, 6 aa, Mycobacterium
VTTRDG

SEQ ID NO: 613800 - protein, 17 aa, Mycobacterium
VTTRGAGGYGSSGGHAS

SEQ ID NO: 613801 - protein, 10 aa, Mycobacterium
VTTRGYPPSI

SEQ ID NO: 613802 - protein, 5 aa, Mycobacterium
VTTRP

SEQ ID NO: 613803 - protein, 7 aa, Mycobacterium
VTTRRAR

SEQ ID NO: 613804 - protein, 8 aa, Mycobacterium
VTTRTDEP

SEQ ID NO: 613805 - protein, 26 aa, Mycobacterium
VTTRTGARARHHGAARRRAPDEQGRR

SEQ ID NO: 613806 - protein, 6 aa, Mycobacterium
VTTRTT

SEQ ID NO: 613807 - protein, 13 aa, Mycobacterium
VTTSEMDDDVRKD

SEQ ID NO: 613808 - protein, 10 aa, Mycobacterium
VTTSGKQRSR

SEQ ID NO: 613809 - protein, 16 aa, Mycobacterium
VTTSGVDDEITTTAGP

SEQ ID NO: 613810 - protein, 7 aa, Mycobacterium
VTTSLGG

SEQ ID NO: 613811 - protein, 12 aa, Mycobacterium
VTTSPKGGDIVA

SEQ ID NO: 613812 - protein, 20 aa, Mycobacterium
VTTSTPGTTTTEEPRIATGP

SEQ ID NO: 613813 - protein, 6 aa, Mycobacterium
VTTTAD

SEQ ID NO: 613814 - protein, 11 aa, Mycobacterium
VTTTAEANALP

SEQ ID NO: 613815 - protein, 15 aa, Mycobacterium
VTTTALTSPVTGLGK

SEQ ID NO: 613816 - protein, 6 aa, Mycobacterium
VTTTAY

SEQ ID NO: 613817 - protein, 6 aa, Mycobacterium
VTTTEA

SEQ ID NO: 613818 - protein, 12 aa, Mycobacterium
VTTTGAATGAMA

SEQ ID NO: 613819 - protein, 9 aa, Mycobacterium
VTTTGPAAV

SEQ ID NO: 613820 - protein, 11 aa, Mycobacterium
VTTTSGPGISL

SEQ ID NO: 613821 - protein, 7 aa, Mycobacterium
VTTVSPG

SEQ ID NO: 613822 - protein, 15 aa, Mycobacterium
VTTYGGGGHGPAVTA

SEQ ID NO: 613823 - protein, 18 aa, Mycobacterium
VTTYGSGGHGAPAGSDAE

SEQ ID NO: 613824 - protein, 4 aa, Mycobacterium
VTVA

SEQ ID NO: 613825 - protein, 11 aa, Mycobacterium
VTVATTSGRPI

SEQ ID NO: 613826 - protein, 9 aa, Mycobacterium
VTVDGNTLD

SEQ ID NO: 613827 - protein, 4 aa, Mycobacterium
VTVG

SEQ ID NO: 613828 - protein, 6 aa, Mycobacterium
VTVGAQ

SEQ ID NO: 613829 - protein, 8 aa, Mycobacterium
VTVGDSGR

SEQ ID NO: 613830 - protein, 9 aa, Mycobacterium
VTVGPGDDA

SEQ ID NO: 613831 - protein, 8 aa, Mycobacterium
VTVGPSGR

SEQ ID NO: 613832 - protein, 8 aa, Mycobacterium
VTVGPTGR

SEQ ID NO: 613833 - protein, 5 aa, Mycobacterium
VTVGR

SEQ ID NO: 613834 - protein, 4 aa, Mycobacterium
VTVN

SEQ ID NO: 613835 - protein, 17 aa, Mycobacterium
VTVNGEVERRRGRQLHP

SEQ ID NO: 613836 - protein, 16 aa, Mycobacterium
VTVPDDGPKDLEPGEI

SEQ ID NO: 613837 - protein, 11 aa, Mycobacterium
VTVPGSKSLTN

SEQ ID NO: 613838 - protein, 7 aa, Mycobacterium
VTVPPGS

SEQ ID NO: 613839 - protein, 7 aa, Mycobacterium
VTVPTNP

SEQ ID NO: 613840 - protein, 7 aa, Mycobacterium
VTVRRDG

SEQ ID NO: 613841 - protein, 9 aa, Mycobacterium
VTVRRGGKT

SEQ ID NO: 613842 - protein, 8 aa, Mycobacterium
VTVSGETT

SEQ ID NO: 613843 - protein, 20 aa, Mycobacterium
VTVSGSRAAEIAEWLPLIPL

SEQ ID NO: 613844 - protein, 16 aa, Mycobacterium
VTVSGSRLATQSISPA

SEQ ID NO: 613845 - protein, 16 aa, Mycobacterium
VTVSSTGTTASDPLAP

SEQ ID NO: 613846 - protein, 8 aa, Mycobacterium
VTVTDGPF

SEQ ID NO: 613847 - protein, 9 aa, Mycobacterium
VTVTDPPAD

SEQ ID NO: 613848 - protein, 15 aa, Mycobacterium
VTVTGTRSTAADYPE

SEQ ID NO: 613849 - protein, 13 aa, Mycobacterium
VTVTPGAPATPGD

SEQ ID NO: 613850 - protein, 6 aa, Mycobacterium
VTYNGK

SEQ ID NO: 613851 - protein, 5 aa, Mycobacterium
VTYQP

SEQ ID NO: 613852 - protein, 9 aa, Mycobacterium
VTYRDPDGR

SEQ ID NO: 613853 - protein, 10 aa, Mycobacterium
VTYRGTEVGR

SEQ ID NO: 613854 - protein, 7 aa, Mycobacterium
VTYRPDL

SEQ ID NO: 613855 - protein, 9 aa, Mycobacterium
VTYRPGARF

SEQ ID NO: 613856 - protein, 14 aa, Mycobacterium
VTYRPGARFGPSAI

SEQ ID NO: 613857 - protein, 6 aa, Mycobacterium
VTYSGS

SEQ ID NO: 613858 - protein, 6 aa, Mycobacterium
VTYSSS

SEQ ID NO: 613859 - protein, 15 aa, Mycobacterium
VTYSSVTGGERPFGG

SEQ ID NO: 613860 - protein, 16 aa, Mycobacterium
VTYSSVTGGERPYGGT

SEQ ID NO: 613861 - protein, 9 aa, Mycobacterium
VVAEGRSDA

SEQ ID NO: 613862 - protein, 9 aa, Mycobacterium
VVAGTSAAA

SEQ ID NO: 613863 - protein, 11 aa, Mycobacterium
VVATNRKARHN

SEQ ID NO: 613864 - protein, 7 aa, Mycobacterium
VVDATSR

SEQ ID NO: 613865 - protein, 5 aa, Mycobacterium
VVDGG

SEQ ID NO: 613866 - protein, 7 aa, Mycobacterium
VVDGPED

SEQ ID NO: 613867 - protein, 10 aa, Mycobacterium
VVDGTGAERF

SEQ ID NO: 613868 - protein, 8 aa, Mycobacterium
VVDPDDVE

SEQ ID NO: 613869 - protein, 7 aa, Mycobacterium
VVDPGGN

SEQ ID NO: 613870 - protein, 8 aa, Mycobacterium
VVDPGQDA

SEQ ID NO: 613871 - protein, 8 aa, Mycobacterium
VVDPSDVE

SEQ ID NO: 613872 - protein, 9 aa, Mycobacterium
VVDQDGQRI

SEQ ID NO: 613873 - protein, 10 aa, Mycobacterium
VVDQTGAGDV

SEQ ID NO: 613874 - protein, 9 aa, Mycobacterium
VVDRPDDGC

SEQ ID NO: 613875 - protein, 7 aa, Mycobacterium
VVDSGGR

SEQ ID NO: 613876 - protein, 7 aa, Mycobacterium
VVDTGKA

SEQ ID NO: 613877 - protein, 12 aa, Mycobacterium
VVEASSGSTAVS

SEQ ID NO: 613878 - protein, 8 aa, Mycobacterium
VVEGGAPE

SEQ ID NO: 613879 - protein, 5 aa, Mycobacterium
VVEPG

SEQ ID NO: 613880 - protein, 8 aa, Mycobacterium
VVEPGGDA

SEQ ID NO: 613881 - protein, 8 aa, Mycobacterium
VVEQGDAE

SEQ ID NO: 613882 - protein, 5 aa, Mycobacterium
VVERD

SEQ ID NO: 613883 - protein, 10 aa, Mycobacterium
VVERGDSRQV

SEQ ID NO: 613884 - protein, 9 aa, Mycobacterium
VVESGPPEQ

SEQ ID NO: 613885 - protein, 10 aa, Mycobacterium
VVESGPRDQI

SEQ ID NO: 613886 - protein, 8 aa, Mycobacterium
VVESGSAA

SEQ ID NO: 613887 - protein, 8 aa, Mycobacterium
VVETDDGG

SEQ ID NO: 613888 - protein, 12 aa, Mycobacterium
VVETDKPEQPDV

SEQ ID NO: 613889 - protein, 13 aa, Mycobacterium
VVETERPEPPEAK

SEQ ID NO: 613890 - protein, 5 aa, Mycobacterium
VVETG

SEQ ID NO: 613891 - protein, 10 aa, Mycobacterium
VVETGPPDRV

SEQ ID NO: 613892 - protein, 13 aa, Mycobacterium
VVETPGADLETGQ

SEQ ID NO: 613893 - protein, 12 aa, Mycobacterium
VVGADDDAASTL

SEQ ID NO: 613894 - protein, 26 aa, Mycobacterium
VVGDDDEASPAQQRAEDLPDREVEGR

SEQ ID NO: 613895 - protein, 12 aa, Mycobacterium
VVGEDGKTVPIE

SEQ ID NO: 613896 - protein, 10 aa, Mycobacterium
VVGEPGKGWE

SEQ ID NO: 613897 - protein, 9 aa, Mycobacterium
VVGESDANL

SEQ ID NO: 613898 - protein, 7 aa, Mycobacterium
VVGGTEK

SEQ ID NO: 613899 - protein, 109 aa, Mycobacterium
VVGGTGAAKKTAAKKAPAKKAAAKKAPAKKAAAKKAPAKKAAVKKAPAKKAAVKKAPARKAATKAPAKKTAAKKAPARKAATKAPAKKAASKSTARKAPAKKTTARRGR

SEQ ID NO: 613900 - protein, 10 aa, Mycobacterium
VVGPDSAASG

SEQ ID NO: 613901 - protein, 6 aa, Mycobacterium
VVGPGG

SEQ ID NO: 613902 - protein, 10 aa, Mycobacterium
VVGQPGEGLQ

SEQ ID NO: 613903 - protein, 10 aa, Mycobacterium
VVGRPGSASA

SEQ ID NO: 613904 - protein, 19 aa, Mycobacterium
VVGSAGSGRDLECSDGSCR

SEQ ID NO: 613905 - protein, 5 aa, Mycobacterium
VVGTG

SEQ ID NO: 613906 - protein, 7 aa, Mycobacterium
VVKSSNG

SEQ ID NO: 613907 - protein, 8 aa, Mycobacterium
VVKSSNGA

SEQ ID NO: 613908 - protein, 9 aa, Mycobacterium
VVKSSNGAP

SEQ ID NO: 613909 - protein, 5 aa, Mycobacterium
VVNPD

SEQ ID NO: 613910 - protein, 12 aa, Mycobacterium
VVNPSTPTMPNR

SEQ ID NO: 613911 - protein, 11 aa, Mycobacterium
VVPADGPASTV

SEQ ID NO: 613912 - protein, 12 aa, Mycobacterium
VVPAEGTEIEYS

SEQ ID NO: 613913 - protein, 14 aa, Mycobacterium
VVPATADTSSQLTT

SEQ ID NO: 613914 - protein, 4 aa, Mycobacterium
VVPE

SEQ ID NO: 613915 - protein, 7 aa, Mycobacterium
VVPEQGR

SEQ ID NO: 613916 - protein, 7 aa, Mycobacterium
VVPGGSA

SEQ ID NO: 613917 - protein, 14 aa, Mycobacterium
VVPGHGPVSDPDGI

SEQ ID NO: 613918 - protein, 20 aa, Mycobacterium
VVPNDGGRVVDPDSGEPVSG

SEQ ID NO: 613919 - protein, 20 aa, Mycobacterium
VVPNDGGRVVNPGTGQPVPG

SEQ ID NO: 613920 - protein, 8 aa, Mycobacterium
VVPNPPRS

SEQ ID NO: 613921 - protein, 12 aa, Mycobacterium
VVPPAEDDDPAE

SEQ ID NO: 613922 - protein, 12 aa, Mycobacterium
VVPPAEDDDSAE

SEQ ID NO: 613923 - protein, 12 aa, Mycobacterium
VVPPAEEDDPSE

SEQ ID NO: 613924 - protein, 6 aa, Mycobacterium
VVPPAR

SEQ ID NO: 613925 - protein, 12 aa, Mycobacterium
VVPPESVRSTGV

SEQ ID NO: 613926 - protein, 6 aa, Mycobacterium
VVPPGG

SEQ ID NO: 613927 - protein, 7 aa, Mycobacterium
VVPPKGT

SEQ ID NO: 613928 - protein, 30 aa, Mycobacterium
VVPPPPRERLPEPPAEHGVDGAETDHEPGR

SEQ ID NO: 613929 - protein, 5 aa, Mycobacterium
VVPPS

SEQ ID NO: 613930 - protein, 9 aa, Mycobacterium
VVPPSPKPV

SEQ ID NO: 613931 - protein, 12 aa, Mycobacterium
VVPPSSRRAYRG

SEQ ID NO: 613932 - protein, 6 aa, Mycobacterium
VVPRDA

SEQ ID NO: 613933 - protein, 11 aa, Mycobacterium
VVPSDRASFED

SEQ ID NO: 613934 - protein, 9 aa, Mycobacterium
VVPSPQTRD

SEQ ID NO: 613935 - protein, 13 aa, Mycobacterium
VVPSTADTSSQLT

SEQ ID NO: 613936 - protein, 7 aa, Mycobacterium
VVQGDGD

SEQ ID NO: 613937 - protein, 16 aa, Mycobacterium
VVQGPEEGIAADTAHA

SEQ ID NO: 613938 - protein, 7 aa, Mycobacterium
VVQGTSG

SEQ ID NO: 613939 - protein, 11 aa, Mycobacterium
VVQPRSGFDTH

SEQ ID NO: 613940 - protein, 5 aa, Mycobacterium
VVQRS

SEQ ID NO: 613941 - protein, 8 aa, Mycobacterium
VVRDDSGK

SEQ ID NO: 613942 - protein, 11 aa, Mycobacterium
VVRPAEDTPYG

SEQ ID NO: 613943 - protein, 6 aa, Mycobacterium
VVRSGP

SEQ ID NO: 613944 - protein, 4 aa, Mycobacterium
VVSE

SEQ ID NO: 613945 - protein, 6 aa, Mycobacterium
VVSERA

SEQ ID NO: 613946 - protein, 10 aa, Mycobacterium
VVSGDKTVTD

SEQ ID NO: 613947 - protein, 9 aa, Mycobacterium
VVSGERQGR

SEQ ID NO: 613948 - protein, 6 aa, Mycobacterium
VVSGGA

SEQ ID NO: 613949 - protein, 22 aa, Mycobacterium
VVSGGGVRARAGGATKAAEPVK

SEQ ID NO: 613950 - protein, 11 aa, Mycobacterium
VVSGPDGARLD

SEQ ID NO: 613951 - protein, 11 aa, Mycobacterium
VVSGTGALGAA

SEQ ID NO: 613952 - protein, 6 aa, Mycobacterium
VVSPEG

SEQ ID NO: 613953 - protein, 7 aa, Mycobacterium
VVSPEGV

SEQ ID NO: 613954 - protein, 7 aa, Mycobacterium
VVSPQRA

SEQ ID NO: 613955 - protein, 9 aa, Mycobacterium
VVSQTGEVD

SEQ ID NO: 613956 - protein, 7 aa, Mycobacterium
VVSRNQG

SEQ ID NO: 613957 - protein, 7 aa, Mycobacterium
VVSSEGV

SEQ ID NO: 613958 - protein, 9 aa, Mycobacterium
VVSSERAGR

SEQ ID NO: 613959 - protein, 4 aa, Mycobacterium
VVTA

SEQ ID NO: 613960 - protein, 10 aa, Mycobacterium
VVTADGTRHG

SEQ ID NO: 613961 - protein, 13 aa, Mycobacterium
VVTDDEDRRPIAD

SEQ ID NO: 613962 - protein, 9 aa, Mycobacterium
VVTDPDAPY

SEQ ID NO: 613963 - protein, 6 aa, Mycobacterium
VVTDRA

SEQ ID NO: 613964 - protein, 12 aa, Mycobacterium
VVTGAASGIGAA

SEQ ID NO: 613965 - protein, 5 aa, Mycobacterium
VVTGE

SEQ ID NO: 613966 - protein, 11 aa, Mycobacterium
VVTGSGAPTAS

SEQ ID NO: 613967 - protein, 5 aa, Mycobacterium
VVTNP

SEQ ID NO: 613968 - protein, 16 aa, Mycobacterium
VVTPAGDEASDEIEEL

SEQ ID NO: 613969 - protein, 10 aa, Mycobacterium
VVTPGGDDGL

SEQ ID NO: 613970 - protein, 24 aa, Mycobacterium
VVTPNGPIPADQPAWNTQKNSSMP

SEQ ID NO: 613971 - protein, 13 aa, Mycobacterium
VVTTDSSDWATNC

SEQ ID NO: 613972 - protein, 10 aa, Mycobacterium
VVTTEESDTL

SEQ ID NO: 613973 - protein, 5 aa, Mycobacterium
VWGPA

SEQ ID NO: 613974 - protein, 11 aa, Mycobacterium
VWGPPADRDEA

SEQ ID NO: 613975 - protein, 9 aa, Mycobacterium
VWGPPADRE

SEQ ID NO: 613976 - protein, 10 aa, Mycobacterium
VWGPPDDRDE

SEQ ID NO: 613977 - protein, 6 aa, Mycobacterium
VWTPEP

SEQ ID NO: 613978 - protein, 16 aa, Mycobacterium
VWTSPGGSSIPSPPVV

SEQ ID NO: 613979 - protein, 13 aa, Mycobacterium
VWTSSSDRKIARY

SEQ ID NO: 613980 - protein, 8 aa, Mycobacterium
VYDEDEEL

SEQ ID NO: 613981 - protein, 6 aa, Mycobacterium
VYDPAT

SEQ ID NO: 613982 - protein, 18 aa, Mycobacterium
VYDPPDDDPRAEDAALGD

SEQ ID NO: 613983 - protein, 20 aa, Mycobacterium
VYDPPDDDPRSERSALGDNH

SEQ ID NO: 613984 - protein, 18 aa, Mycobacterium
VYDPPDDLPRTEGAALGD

SEQ ID NO: 613985 - protein, 13 aa, Mycobacterium
VYEGRDTKNMPRA

SEQ ID NO: 613986 - protein, 9 aa, Mycobacterium
VYESSADYR

SEQ ID NO: 613987 - protein, 11 aa, Mycobacterium
VYGADNPATAV

SEQ ID NO: 613988 - protein, 10 aa, Mycobacterium
VYGATKAGIA

SEQ ID NO: 613989 - protein, 12 aa, Mycobacterium
VYGDSRNPFDVD

SEQ ID NO: 613990 - protein, 4 aa, Mycobacterium
VYGN

SEQ ID NO: 613991 - protein, 5 aa, Mycobacterium
VYGNT

SEQ ID NO: 613992 - protein, 4 aa, Mycobacterium
VYGP

SEQ ID NO: 613993 - protein, 5 aa, Mycobacterium
VYGPD

SEQ ID NO: 613994 - protein, 9 aa, Mycobacterium
VYGPGEGDI

SEQ ID NO: 613995 - protein, 12 aa, Mycobacterium
VYGPRQDPHGEA

SEQ ID NO: 613996 - protein, 20 aa, Mycobacterium
VYGSETAMAPRVGASGEDDG

SEQ ID NO: 613997 - protein, 20 aa, Mycobacterium
VYGSETAMAPRVGGTGEDDG

SEQ ID NO: 613998 - protein, 20 aa, Mycobacterium
VYGSETQMAPRVGGTAEDDG

SEQ ID NO: 613999 - protein, 9 aa, Mycobacterium
VYGSGNNER

SEQ ID NO: 614000 - protein, 5 aa, Mycobacterium
VYNPG

SEQ ID NO: 614001 - protein, 5 aa, Mycobacterium
VYNPS

SEQ ID NO: 614002 - protein, 20 aa, Mycobacterium
VYPAPQSQSRTSTGRRGEDL

SEQ ID NO: 614003 - protein, 10 aa, Mycobacterium
VYPDPDRFDP

SEQ ID NO: 614004 - protein, 6 aa, Mycobacterium
VYPDPH

SEQ ID NO: 614005 - protein, 6 aa, Mycobacterium
VYPPAS

SEQ ID NO: 614006 - protein, 14 aa, Mycobacterium
VYPPERSIAPGSAR

SEQ ID NO: 614007 - protein, 8 aa, Mycobacterium
VYPPGDPT

SEQ ID NO: 614008 - protein, 7 aa, Mycobacterium
VYPPRED

SEQ ID NO: 614009 - protein, 4 aa, Mycobacterium
VYPQ

SEQ ID NO: 614010 - protein, 4 aa, Mycobacterium
VYQG

SEQ ID NO: 614011 - protein, 5 aa, Mycobacterium
VYQGN

SEQ ID NO: 614012 - protein, 5 aa, Mycobacterium
VYRDQ

SEQ ID NO: 614013 - protein, 17 aa, Mycobacterium
VYRGDEAADGADPAPTV

SEQ ID NO: 614014 - protein, 18 aa, Mycobacterium
VYRGDEASASGSDPAPTV

SEQ ID NO: 614015 - protein, 24 aa, Mycobacterium
VYRGDEATKAQATDASPNDPAPTV

SEQ ID NO: 614016 - protein, 18 aa, Mycobacterium
VYRGDETAAHPSDPAPTV

SEQ ID NO: 614017 - protein, 4 aa, Mycobacterium
VYSA

SEQ ID NO: 614018 - protein, 10 aa, Mycobacterium
VYSDGASEEV

SEQ ID NO: 614019 - protein, 9 aa, Mycobacterium
VYSDGKPVT

SEQ ID NO: 614020 - protein, 10 aa, Mycobacterium
VYSGSKGLTS

SEQ ID NO: 614021 - protein, 11 aa, Mycobacterium
VYSPGGGNTAT

SEQ ID NO: 614022 - protein, 8 aa, Mycobacterium
VYSPTDES

SEQ ID NO: 614023 - protein, 12 aa, Mycobacterium
VYSRDGHSDYGN

SEQ ID NO: 614024 - protein, 11 aa, Mycobacterium
VYSTEDSPVQY

SEQ ID NO: 614025 - protein, 7 aa, Mycobacterium
VYSTGNV

SEQ ID NO: 614026 - protein, 5 aa, Mycobacterium
VYTGD

SEQ ID NO: 614027 - protein, 12 aa, Mycobacterium
VYTPPDSPDAER

SEQ ID NO: 614028 - protein, 11 aa, Mycobacterium
VYTPPDSPDVA

SEQ ID NO: 614029 - protein, 10 aa, Mycobacterium
VYTSTRRFDT

SEQ ID NO: 614030 - protein, 9 aa, Mycobacterium
VYTTDNDRA

SEQ ID NO: 614031 - protein, 4 aa, Mycobacterium
WAAA

SEQ ID NO: 614032 - protein, 7 aa, Mycobacterium
WAAAPTD

SEQ ID NO: 614033 - protein, 7 aa, Mycobacterium
WAAGAEG

SEQ ID NO: 614034 - protein, 8 aa, Mycobacterium
WAAGTGKW

SEQ ID NO: 614035 - protein, 8 aa, Mycobacterium
WAAPATRQ

SEQ ID NO: 614036 - protein, 7 aa, Mycobacterium
WAAPSGR

SEQ ID NO: 614037 - protein, 5 aa, Mycobacterium
WAAPT

SEQ ID NO: 614038 - protein, 11 aa, Mycobacterium
WAASAAPGQPA

SEQ ID NO: 614039 - protein, 9 aa, Mycobacterium
WAASATPGR

SEQ ID NO: 614040 - protein, 9 aa, Mycobacterium
WAASGKPPI

SEQ ID NO: 614041 - protein, 9 aa, Mycobacterium
WAASRDQLG

SEQ ID NO: 614042 - protein, 9 aa, Mycobacterium
WAATAGSGD

SEQ ID NO: 614043 - protein, 17 aa, Mycobacterium
WAATDDVPQTQRTQASG

SEQ ID NO: 614044 - protein, 6 aa, Mycobacterium
WADATA

SEQ ID NO: 614045 - protein, 22 aa, Mycobacterium
WADENGQTADDDATTGARPPHR

SEQ ID NO: 614046 - protein, 10 aa, Mycobacterium
WADGANAAAR

SEQ ID NO: 614047 - protein, 10 aa, Mycobacterium
WADGASAAAK

SEQ ID NO: 614048 - protein, 12 aa, Mycobacterium
WADGSAPVDGDA

SEQ ID NO: 614049 - protein, 8 aa, Mycobacterium
WADPAKRT

SEQ ID NO: 614050 - protein, 11 aa, Mycobacterium
WADPASPPRVQ

SEQ ID NO: 614051 - protein, 7 aa, Mycobacterium
WADPETG

SEQ ID NO: 614052 - protein, 8 aa, Mycobacterium
WADPGADG

SEQ ID NO: 614053 - protein, 6 aa, Mycobacterium
WADPKR

SEQ ID NO: 614054 - protein, 10 aa, Mycobacterium
WADPTPAPGW

SEQ ID NO: 614055 - protein, 11 aa, Mycobacterium
WADQNRQRPFT

SEQ ID NO: 614056 - protein, 9 aa, Mycobacterium
WADSATDDP

SEQ ID NO: 614057 - protein, 10 aa, Mycobacterium
WADSGDNDAV

SEQ ID NO: 614058 - protein, 10 aa, Mycobacterium
WADSPDGPRV

SEQ ID NO: 614059 - protein, 18 aa, Mycobacterium
WADTEAHPPSAPAPEQLS

SEQ ID NO: 614060 - protein, 11 aa, Mycobacterium
WAEAGKPKPHL

SEQ ID NO: 614061 - protein, 7 aa, Mycobacterium
WAEGPRT

SEQ ID NO: 614062 - protein, 13 aa, Mycobacterium
WAEPARDVADAAG

SEQ ID NO: 614063 - protein, 11 aa, Mycobacterium
WAERAQPGDTI

SEQ ID NO: 614064 - protein, 10 aa, Mycobacterium
WAERDGSHYV

SEQ ID NO: 614065 - protein, 8 aa, Mycobacterium
WAESDPDE

SEQ ID NO: 614066 - protein, 12 aa, Mycobacterium
WAESSVGTNGIG

SEQ ID NO: 614067 - protein, 5 aa, Mycobacterium
WAGEG

SEQ ID NO: 614068 - protein, 7 aa, Mycobacterium
WAGNDAN

SEQ ID NO: 614069 - protein, 8 aa, Mycobacterium
WAGNGSDV

SEQ ID NO: 614070 - protein, 6 aa, Mycobacterium
WAGPAS

SEQ ID NO: 614071 - protein, 8 aa, Mycobacterium
WAGPGADA

SEQ ID NO: 614072 - protein, 5 aa, Mycobacterium
WAGPP

SEQ ID NO: 614073 - protein, 7 aa, Mycobacterium
WAGPPPQ

SEQ ID NO: 614074 - protein, 6 aa, Mycobacterium
WAGPPR

SEQ ID NO: 614075 - protein, 4 aa, Mycobacterium
WAGQ

SEQ ID NO: 614076 - protein, 13 aa, Mycobacterium
WAGRQQDNSTSPQ

SEQ ID NO: 614077 - protein, 6 aa, Mycobacterium
WAGRSV

SEQ ID NO: 614078 - protein, 4 aa, Mycobacterium
WAGT

SEQ ID NO: 614079 - protein, 7 aa, Mycobacterium
WAGTENL

SEQ ID NO: 614080 - protein, 6 aa, Mycobacterium
WAGTSG

SEQ ID NO: 614081 - protein, 11 aa, Mycobacterium
WAGTSTGDEAD

SEQ ID NO: 614082 - protein, 8 aa, Mycobacterium
WAGYGRGG

SEQ ID NO: 614083 - protein, 4 aa, Mycobacterium
WAKT

SEQ ID NO: 614084 - protein, 4 aa, Mycobacterium
WANA

SEQ ID NO: 614085 - protein, 4 aa, Mycobacterium
WANG

SEQ ID NO: 614086 - protein, 8 aa, Mycobacterium
WANTPATR

SEQ ID NO: 614087 - protein, 15 aa, Mycobacterium
WAPAAGELGTPATTI

SEQ ID NO: 614088 - protein, 6 aa, Mycobacterium
WAPAPG

SEQ ID NO: 614089 - protein, 8 aa, Mycobacterium
WAPDAPLP

SEQ ID NO: 614090 - protein, 12 aa, Mycobacterium
WAPDARAAAAQL

SEQ ID NO: 614091 - protein, 9 aa, Mycobacterium
WAPEEAFAK

SEQ ID NO: 614092 - protein, 19 aa, Mycobacterium
WAPETGGSAAGGPVTSEDG

SEQ ID NO: 614093 - protein, 4 aa, Mycobacterium
WAPG

SEQ ID NO: 614094 - protein, 12 aa, Mycobacterium
WAPGAQPQVPRY

SEQ ID NO: 614095 - protein, 7 aa, Mycobacterium
WAPGPST

SEQ ID NO: 614096 - protein, 8 aa, Mycobacterium
WAPGSGKH

SEQ ID NO: 614097 - protein, 10 aa, Mycobacterium
WAPGYAEAGA

SEQ ID NO: 614098 - protein, 9 aa, Mycobacterium
WAPHGGESR

SEQ ID NO: 614099 - protein, 10 aa, Mycobacterium
WAPHGGESRI

SEQ ID NO: 614100 - protein, 12 aa, Mycobacterium
WAPHGGESRVDV

SEQ ID NO: 614101 - protein, 9 aa, Mycobacterium
WAPKSAGAI

SEQ ID NO: 614102 - protein, 9 aa, Mycobacterium
WAPKSGGAL

SEQ ID NO: 614103 - protein, 12 aa, Mycobacterium
WAPKSSGAAAYR

SEQ ID NO: 614104 - protein, 10 aa, Mycobacterium
WAPKSSGAQA

SEQ ID NO: 614105 - protein, 9 aa, Mycobacterium
WAPPPPAGT

SEQ ID NO: 614106 - protein, 10 aa, Mycobacterium
WAPPYAEAGA

SEQ ID NO: 614107 - protein, 10 aa, Mycobacterium
WAPRPDRPDP

SEQ ID NO: 614108 - protein, 9 aa, Mycobacterium
WAPSGANAQ

SEQ ID NO: 614109 - protein, 11 aa, Mycobacterium
WAPSGANAQGR

SEQ ID NO: 614110 - protein, 10 aa, Mycobacterium
WAPSGGNQQP

SEQ ID NO: 614111 - protein, 17 aa, Mycobacterium
WAPSKARSRGWPINSGT

SEQ ID NO: 614112 - protein, 12 aa, Mycobacterium
WAPSKDGEQPLG

SEQ ID NO: 614113 - protein, 9 aa, Mycobacterium
WAPSPQTPA

SEQ ID NO: 614114 - protein, 4 aa, Mycobacterium
WAPT

SEQ ID NO: 614115 - protein, 11 aa, Mycobacterium
WAPTPGGHPTL

SEQ ID NO: 614116 - protein, 11 aa, Mycobacterium
WAQAGKPKPHL

SEQ ID NO: 614117 - protein, 11 aa, Mycobacterium
WAQEGKPKPHL

SEQ ID NO: 614118 - protein, 7 aa, Mycobacterium
WAQGPRT

SEQ ID NO: 614119 - protein, 11 aa, Mycobacterium
WAQPAAGGGSY

SEQ ID NO: 614120 - protein, 11 aa, Mycobacterium
WAQPAQEGGSY

SEQ ID NO: 614121 - protein, 9 aa, Mycobacterium
WAQTPTPHA

SEQ ID NO: 614122 - protein, 11 aa, Mycobacterium
WARASGSPTVA

SEQ ID NO: 614123 - protein, 5 aa, Mycobacterium
WARNT

SEQ ID NO: 614124 - protein, 5 aa, Mycobacterium
WARPE

SEQ ID NO: 614125 - protein, 15 aa, Mycobacterium
WARPGGQLWRAWTAL

SEQ ID NO: 614126 - protein, 15 aa, Mycobacterium
WARTDGGEAGLHPSN

SEQ ID NO: 614127 - protein, 9 aa, Mycobacterium
WASAGGEPL

SEQ ID NO: 614128 - protein, 9 aa, Mycobacterium
WASDARTAA

SEQ ID NO: 614129 - protein, 17 aa, Mycobacterium
WASEGAESAAKAAKGAI

SEQ ID NO: 614130 - protein, 12 aa, Mycobacterium
WASQQSAPIESR

SEQ ID NO: 614131 - protein, 12 aa, Mycobacterium
WASSDHSATDRR

SEQ ID NO: 614132 - protein, 8 aa, Mycobacterium
WASSGGPF

SEQ ID NO: 614133 - protein, 19 aa, Mycobacterium
WASSGKPDPYEAGTWGPES

SEQ ID NO: 614134 - protein, 4 aa, Mycobacterium
WAST

SEQ ID NO: 614135 - protein, 13 aa, Mycobacterium
WASTDSSGEYAES

SEQ ID NO: 614136 - protein, 11 aa, Mycobacterium
WATETRSDTDD

SEQ ID NO: 614137 - protein, 4 aa, Mycobacterium
WATG

SEQ ID NO: 614138 - protein, 4 aa, Mycobacterium
WATH

SEQ ID NO: 614139 - protein, 5 aa, Mycobacterium
WATKQ

SEQ ID NO: 614140 - protein, 16 aa, Mycobacterium
WATPGYDRQIPQPRTL

SEQ ID NO: 614141 - protein, 6 aa, Mycobacterium
WATPQY

SEQ ID NO: 614142 - protein, 8 aa, Mycobacterium
WATPTADL

SEQ ID NO: 614143 - protein, 10 aa, Mycobacterium
WATREGLGGA

SEQ ID NO: 614144 - protein, 6 aa, Mycobacterium
WATTGA

SEQ ID NO: 614145 - protein, 7 aa, Mycobacterium
WATTKHK

SEQ ID NO: 614146 - protein, 9 aa, Mycobacterium
WATTNPAAV

SEQ ID NO: 614147 - protein, 6 aa, Mycobacterium
WDAPRA

SEQ ID NO: 614148 - protein, 33 aa, Mycobacterium
WDAQDAAERKAQRAAREAEKQAQQAQKDGAQKE

SEQ ID NO: 614149 - protein, 14 aa, Mycobacterium
WDARAQSLGGTSNT

SEQ ID NO: 614150 - protein, 5 aa, Mycobacterium
WDARS

SEQ ID NO: 614151 - protein, 12 aa, Mycobacterium
WDASADDRARQT

SEQ ID NO: 614152 - protein, 8 aa, Mycobacterium
WDDDDGTW

SEQ ID NO: 614153 - protein, 5 aa, Mycobacterium
WDDDE

SEQ ID NO: 614154 - protein, 12 aa, Mycobacterium
WDDHPDSRWVVS

SEQ ID NO: 614155 - protein, 8 aa, Mycobacterium
WDDPGATT

SEQ ID NO: 614156 - protein, 6 aa, Mycobacterium
WDDPQP

SEQ ID NO: 614157 - protein, 8 aa, Mycobacterium
WDDPSDDA

SEQ ID NO: 614158 - protein, 8 aa, Mycobacterium
WDDSGQAD

SEQ ID NO: 614159 - protein, 12 aa, Mycobacterium
WDDTPERVAEAY

SEQ ID NO: 614160 - protein, 12 aa, Mycobacterium
WDENGKSVRGEV

SEQ ID NO: 614161 - protein, 6 aa, Mycobacterium
WDEPQS

SEQ ID NO: 614162 - protein, 8 aa, Mycobacterium
WDEREETP

SEQ ID NO: 614163 - protein, 8 aa, Mycobacterium
WDERTSTA

SEQ ID NO: 614164 - protein, 6 aa, Mycobacterium
WDGAAE

SEQ ID NO: 614165 - protein, 23 aa, Mycobacterium
WDGDELKSRISDSLQDAARAAGL

SEQ ID NO: 614166 - protein, 5 aa, Mycobacterium
WDGEG

SEQ ID NO: 614167 - protein, 9 aa, Mycobacterium
WDGEGAGED

SEQ ID NO: 614168 - protein, 10 aa, Mycobacterium
WDGEGAGEDA

SEQ ID NO: 614169 - protein, 9 aa, Mycobacterium
WDGEGQGED

SEQ ID NO: 614170 - protein, 11 aa, Mycobacterium
WDGEGQGEDAK

SEQ ID NO: 614171 - protein, 7 aa, Mycobacterium
WDGEQIS

SEQ ID NO: 614172 - protein, 15 aa, Mycobacterium
WDGERQWSTPQGADR

SEQ ID NO: 614173 - protein, 9 aa, Mycobacterium
WDGESAGED

SEQ ID NO: 614174 - protein, 10 aa, Mycobacterium
WDGESAGEDA

SEQ ID NO: 614175 - protein, 11 aa, Mycobacterium
WDGESAGEDAK

SEQ ID NO: 614176 - protein, 4 aa, Mycobacterium
WDGP

SEQ ID NO: 614177 - protein, 7 aa, Mycobacterium
WDGPSAT

SEQ ID NO: 614178 - protein, 10 aa, Mycobacterium
WDGPSGPRSL

SEQ ID NO: 614179 - protein, 6 aa, Mycobacterium
WDGQDA

SEQ ID NO: 614180 - protein, 9 aa, Mycobacterium
WDGQDGQAA

SEQ ID NO: 614181 - protein, 15 aa, Mycobacterium
WDGQPPEPVRGPMAP

SEQ ID NO: 614182 - protein, 4 aa, Mycobacterium
WDGR

SEQ ID NO: 614183 - protein, 6 aa, Mycobacterium
WDGSDP

SEQ ID NO: 614184 - protein, 12 aa, Mycobacterium
WDGSDPVRELGG

SEQ ID NO: 614185 - protein, 6 aa, Mycobacterium
WDGSSS

SEQ ID NO: 614186 - protein, 7 aa, Mycobacterium
WDGTDER

SEQ ID NO: 614187 - protein, 8 aa, Mycobacterium
WDIGGPQP

SEQ ID NO: 614188 - protein, 9 aa, Mycobacterium
WDKDDDPRW

SEQ ID NO: 614189 - protein, 8 aa, Mycobacterium
WDKTDASY

SEQ ID NO: 614190 - protein, 4 aa, Mycobacterium
WDLS

SEQ ID NO: 614191 - protein, 12 aa, Mycobacterium
WDNTAVDDEALR

SEQ ID NO: 614192 - protein, 9 aa, Mycobacterium
WDPAAGHRC

SEQ ID NO: 614193 - protein, 12 aa, Mycobacterium
WDPARQARRGRA

SEQ ID NO: 614194 - protein, 10 aa, Mycobacterium
WDPASTPVKH

SEQ ID NO: 614195 - protein, 12 aa, Mycobacterium
WDPDGARDAGKG

SEQ ID NO: 614196 - protein, 4 aa, Mycobacterium
WDPG

SEQ ID NO: 614197 - protein, 11 aa, Mycobacterium
WDPGGDELTPT

SEQ ID NO: 614198 - protein, 5 aa, Mycobacterium
WDPGL

SEQ ID NO: 614199 - protein, 11 aa, Mycobacterium
WDPNSGETIGQ

SEQ ID NO: 614200 - protein, 6 aa, Mycobacterium
WDPPEE

SEQ ID NO: 614201 - protein, 7 aa, Mycobacterium
WDPPEEK

SEQ ID NO: 614202 - protein, 6 aa, Mycobacterium
WDPPQE

SEQ ID NO: 614203 - protein, 7 aa, Mycobacterium
WDPPQEK

SEQ ID NO: 614204 - protein, 14 aa, Mycobacterium
WDPQSWDPAAVPSA

SEQ ID NO: 614205 - protein, 4 aa, Mycobacterium
WDPR

SEQ ID NO: 614206 - protein, 8 aa, Mycobacterium
WDPRAQRP

SEQ ID NO: 614207 - protein, 10 aa, Mycobacterium
WDPRAQRPEP

SEQ ID NO: 614208 - protein, 15 aa, Mycobacterium
WDPRTQSVDPAGTTV

SEQ ID NO: 614209 - protein, 9 aa, Mycobacterium
WDPSADPSV

SEQ ID NO: 614210 - protein, 8 aa, Mycobacterium
WDPSAGVR

SEQ ID NO: 614211 - protein, 8 aa, Mycobacterium
WDPSGEWS

SEQ ID NO: 614212 - protein, 6 aa, Mycobacterium
WDPSGT

SEQ ID NO: 614213 - protein, 10 aa, Mycobacterium
WDPSKGLRCD

SEQ ID NO: 614214 - protein, 15 aa, Mycobacterium
WDPSRAGEAIMAGCV

SEQ ID NO: 614215 - protein, 8 aa, Mycobacterium
WDPTEGYR

SEQ ID NO: 614216 - protein, 5 aa, Mycobacterium
WDPTH

SEQ ID NO: 614217 - protein, 5 aa, Mycobacterium
WDPTT

SEQ ID NO: 614218 - protein, 7 aa, Mycobacterium
WDPTTSS

SEQ ID NO: 614219 - protein, 14 aa, Mycobacterium
WDQENAAARYETDK

SEQ ID NO: 614220 - protein, 6 aa, Mycobacterium
WDQTSQ

SEQ ID NO: 614221 - protein, 8 aa, Mycobacterium
WDREESDR

SEQ ID NO: 614222 - protein, 11 aa, Mycobacterium
WDRPENPDPLG

SEQ ID NO: 614223 - protein, 13 aa, Mycobacterium
WDRSAPPGTTPPW

SEQ ID NO: 614224 - protein, 8 aa, Mycobacterium
WDRTDPSY

SEQ ID NO: 614225 - protein, 8 aa, Mycobacterium
WDSASADL

SEQ ID NO: 614226 - protein, 7 aa, Mycobacterium
WDSATDT

SEQ ID NO: 614227 - protein, 9 aa, Mycobacterium
WDSNRDSKI

SEQ ID NO: 614228 - protein, 12 aa, Mycobacterium
WDSPSGRRTDLP

SEQ ID NO: 614229 - protein, 11 aa, Mycobacterium
WDSPTTASDHR

SEQ ID NO: 614230 - protein, 8 aa, Mycobacterium
WDSSSNEL

SEQ ID NO: 614231 - protein, 8 aa, Mycobacterium
WDSTAQEL

SEQ ID NO: 614232 - protein, 7 aa, Mycobacterium
WDSTSNE

SEQ ID NO: 614233 - protein, 13 aa, Mycobacterium
WDSTYQPGRRSSS

SEQ ID NO: 614234 - protein, 7 aa, Mycobacterium
WDTDPAP

SEQ ID NO: 614235 - protein, 8 aa, Mycobacterium
WDTEAETV

SEQ ID NO: 614236 - protein, 15 aa, Mycobacterium
WDTEASEAPAPYKKR

SEQ ID NO: 614237 - protein, 8 aa, Mycobacterium
WDYDGRPS

SEQ ID NO: 614238 - protein, 6 aa, Mycobacterium
WEAPDP

SEQ ID NO: 614239 - protein, 7 aa, Mycobacterium
WEAPDPA

SEQ ID NO: 614240 - protein, 5 aa, Mycobacterium
WEARQ

SEQ ID NO: 614241 - protein, 13 aa, Mycobacterium
WEATGAPPVRNGY

SEQ ID NO: 614242 - protein, 5 aa, Mycobacterium
WEDED

SEQ ID NO: 614243 - protein, 11 aa, Mycobacterium
WEDENNPKPLG

SEQ ID NO: 614244 - protein, 6 aa, Mycobacterium
WEDSGG

SEQ ID NO: 614245 - protein, 9 aa, Mycobacterium
WEEAGPEGN

SEQ ID NO: 614246 - protein, 10 aa, Mycobacterium
WEEGQPMSDT

SEQ ID NO: 614247 - protein, 11 aa, Mycobacterium
WEEPDNPKPLG

SEQ ID NO: 614248 - protein, 11 aa, Mycobacterium
WEERGARADDA

SEQ ID NO: 614249 - protein, 6 aa, Mycobacterium
WEERTA

SEQ ID NO: 614250 - protein, 18 aa, Mycobacterium
WEGADARELAEAAGRGED

SEQ ID NO: 614251 - protein, 8 aa, Mycobacterium
WEGAGGDA

SEQ ID NO: 614252 - protein, 4 aa, Mycobacterium
WEGH

SEQ ID NO: 614253 - protein, 14 aa, Mycobacterium
WEGPGGASHSASPS

SEQ ID NO: 614254 - protein, 22 aa, Mycobacterium
WEGPLASGEGKLSQGSSGALDG

SEQ ID NO: 614255 - protein, 13 aa, Mycobacterium
WEGSGAQSALEEA

SEQ ID NO: 614256 - protein, 4 aa, Mycobacterium
WEIP

SEQ ID NO: 614257 - protein, 7 aa, Mycobacterium
WEKDASI

SEQ ID NO: 614258 - protein, 8 aa, Mycobacterium
WEKGPKAY

SEQ ID NO: 614259 - protein, 7 aa, Mycobacterium
WENGGLS

SEQ ID NO: 614260 - protein, 11 aa, Mycobacterium
WENPENPKPLG

SEQ ID NO: 614261 - protein, 9 aa, Mycobacterium
WEPDPDAAT

SEQ ID NO: 614262 - protein, 7 aa, Mycobacterium
WEPDTQN

SEQ ID NO: 614263 - protein, 5 aa, Mycobacterium
WEPET

SEQ ID NO: 614264 - protein, 12 aa, Mycobacterium
WEPGQAGPDGVV

SEQ ID NO: 614265 - protein, 16 aa, Mycobacterium
WEPGSKELATRAASGK

SEQ ID NO: 614266 - protein, 15 aa, Mycobacterium
WEPGSLDAAHTVLAS

SEQ ID NO: 614267 - protein, 7 aa, Mycobacterium
WEPKTEK

SEQ ID NO: 614268 - protein, 9 aa, Mycobacterium
WEPNADTAK

SEQ ID NO: 614269 - protein, 7 aa, Mycobacterium
WEPPDAV

SEQ ID NO: 614270 - protein, 6 aa, Mycobacterium
WEPPHT

SEQ ID NO: 614271 - protein, 6 aa, Mycobacterium
WEPPYT

SEQ ID NO: 614272 - protein, 7 aa, Mycobacterium
WEPQTDK

SEQ ID NO: 614273 - protein, 18 aa, Mycobacterium
WEPRRSGRGGYGRGGRPR

SEQ ID NO: 614274 - protein, 9 aa, Mycobacterium
WEPSAEGDW

SEQ ID NO: 614275 - protein, 11 aa, Mycobacterium
WEPSAEGDWTS

SEQ ID NO: 614276 - protein, 6 aa, Mycobacterium
WEPSRV

SEQ ID NO: 614277 - protein, 4 aa, Mycobacterium
WEQR

SEQ ID NO: 614278 - protein, 5 aa, Mycobacterium
WEQSA

SEQ ID NO: 614279 - protein, 7 aa, Mycobacterium
WEQSHSQ

SEQ ID NO: 614280 - protein, 7 aa, Mycobacterium
WEQTPTV

SEQ ID NO: 614281 - protein, 15 aa, Mycobacterium
WERAQRSGTHEPDSL

SEQ ID NO: 614282 - protein, 9 aa, Mycobacterium
WERDGKVSR

SEQ ID NO: 614283 - protein, 12 aa, Mycobacterium
WERGGHRGSERA

SEQ ID NO: 614284 - protein, 12 aa, Mycobacterium
WERPDDGSFPEA

SEQ ID NO: 614285 - protein, 11 aa, Mycobacterium
WERPEKPDPLG

SEQ ID NO: 614286 - protein, 54 aa, Mycobacterium
WERPTTAPDSETPSITQPQGRDTAADPAEQQATSTNTTDQPTSDSLGAQPTAQV

SEQ ID NO: 614287 - protein, 19 aa, Mycobacterium
WERSPGSITDNHVFDAQHH

SEQ ID NO: 614288 - protein, 18 aa, Mycobacterium
WESDEAMRASGEAVTGIR

SEQ ID NO: 614289 - protein, 16 aa, Mycobacterium
WESDGGTAPDRPDAGR

SEQ ID NO: 614290 - protein, 8 aa, Mycobacterium
WESDGPGV

SEQ ID NO: 614291 - protein, 6 aa, Mycobacterium
WESQTR

SEQ ID NO: 614292 - protein, 11 aa, Mycobacterium
WESRDATSAAL

SEQ ID NO: 614293 - protein, 10 aa, Mycobacterium
WESRDETSAA

SEQ ID NO: 614294 - protein, 10 aa, Mycobacterium
WESRDETTAA

SEQ ID NO: 614295 - protein, 12 aa, Mycobacterium
WESSNDKPAGIG

SEQ ID NO: 614296 - protein, 7 aa, Mycobacterium
WETAESR

SEQ ID NO: 614297 - protein, 6 aa, Mycobacterium
WETANA

SEQ ID NO: 614298 - protein, 6 aa, Mycobacterium
WETDPN

SEQ ID NO: 614299 - protein, 15 aa, Mycobacterium
WETEDQPDATPAEGM

SEQ ID NO: 614300 - protein, 4 aa, Mycobacterium
WETG

SEQ ID NO: 614301 - protein, 11 aa, Mycobacterium
WETPGPAIEPV

SEQ ID NO: 614302 - protein, 6 aa, Mycobacterium
WETPSG

SEQ ID NO: 614303 - protein, 11 aa, Mycobacterium
WETRDETSAAL

SEQ ID NO: 614304 - protein, 7 aa, Mycobacterium
WETRGRD

SEQ ID NO: 614305 - protein, 10 aa, Mycobacterium
WETSAAERAE

SEQ ID NO: 614306 - protein, 14 aa, Mycobacterium
WETTNSSRVTRARR

SEQ ID NO: 614307 - protein, 4 aa, Mycobacterium
WETV

SEQ ID NO: 614308 - protein, 4 aa, Mycobacterium
WFGE

SEQ ID NO: 614309 - protein, 5 aa, Mycobacterium
WFGPT

SEQ ID NO: 614310 - protein, 4 aa, Mycobacterium
WGAD

SEQ ID NO: 614311 - protein, 5 aa, Mycobacterium
WGAGA

SEQ ID NO: 614312 - protein, 11 aa, Mycobacterium
WGAGADRGTVN

SEQ ID NO: 614313 - protein, 15 aa, Mycobacterium
WGAPAGPDESVRNDE

SEQ ID NO: 614314 - protein, 15 aa, Mycobacterium
WGAPESAEYDNGEAG

SEQ ID NO: 614315 - protein, 13 aa, Mycobacterium
WGAPESGTAEERF

SEQ ID NO: 614316 - protein, 11 aa, Mycobacterium
WGARTTPGIPA

SEQ ID NO: 614317 - protein, 7 aa, Mycobacterium
WGDGGVH

SEQ ID NO: 614318 - protein, 18 aa, Mycobacterium
WGDGPGPWGPGEPPRPAW

SEQ ID NO: 614319 - protein, 7 aa, Mycobacterium
WGDPAGK

SEQ ID NO: 614320 - protein, 7 aa, Mycobacterium
WGDPEEF

SEQ ID NO: 614321 - protein, 17 aa, Mycobacterium
WGDPGQKSDDVSGSGSY

SEQ ID NO: 614322 - protein, 17 aa, Mycobacterium
WGEAGTRSYGSDRSSVG

SEQ ID NO: 614323 - protein, 14 aa, Mycobacterium
WGEGGSGATAAAAG

SEQ ID NO: 614324 - protein, 5 aa, Mycobacterium
WGEGP

SEQ ID NO: 614325 - protein, 11 aa, Mycobacterium
WGEKTGTFTNA

SEQ ID NO: 614326 - protein, 6 aa, Mycobacterium
WGEPGA

SEQ ID NO: 614327 - protein, 6 aa, Mycobacterium
WGEPPK

SEQ ID NO: 614328 - protein, 11 aa, Mycobacterium
WGEPSKTQETF

SEQ ID NO: 614329 - protein, 5 aa, Mycobacterium
WGERA

SEQ ID NO: 614330 - protein, 6 aa, Mycobacterium
WGERAK

SEQ ID NO: 614331 - protein, 8 aa, Mycobacterium
WGESAHRR

SEQ ID NO: 614332 - protein, 4 aa, Mycobacterium
WGGA

SEQ ID NO: 614333 - protein, 6 aa, Mycobacterium
WGGANG

SEQ ID NO: 614334 - protein, 60 aa, Mycobacterium
WGGDGGAGGDGGGAGGDGGTGGASSGANGFTGQAGNGGNGGIGGNGGGSGGNGGDGGDAN

SEQ ID NO: 614335 - protein, 7 aa, Mycobacterium
WGGDNTD

SEQ ID NO: 614336 - protein, 14 aa, Mycobacterium
WGGEGRPLAETGGR

SEQ ID NO: 614337 - protein, 15 aa, Mycobacterium
WGGGAGGSRLVTGNT

SEQ ID NO: 614338 - protein, 9 aa, Mycobacterium
WGGGGRPLA

SEQ ID NO: 614339 - protein, 29 aa, Mycobacterium
WGGNGGNGGRGFNGGDGGDGGNGGSGPTT

SEQ ID NO: 614340 - protein, 35 aa, Mycobacterium
WGGNKSVGGPTQGTLAGDPPDGGAHRYHDDQRTGF

SEQ ID NO: 614341 - protein, 6 aa, Mycobacterium
WGGPPV

SEQ ID NO: 614342 - protein, 10 aa, Mycobacterium
WGGPTVTNDG

SEQ ID NO: 614343 - protein, 5 aa, Mycobacterium
WGGRG

SEQ ID NO: 614344 - protein, 12 aa, Mycobacterium
WGGRGDDAAPAH

SEQ ID NO: 614345 - protein, 15 aa, Mycobacterium
WGGRSTKDGSTATAP

SEQ ID NO: 614346 - protein, 12 aa, Mycobacterium
WGGSGSEAYQGV

SEQ ID NO: 614347 - protein, 11 aa, Mycobacterium
WGGSGSEAYRG

SEQ ID NO: 614348 - protein, 13 aa, Mycobacterium
WGGSQVRTEATGY

SEQ ID NO: 614349 - protein, 8 aa, Mycobacterium
WGGSSNGR

SEQ ID NO: 614350 - protein, 10 aa, Mycobacterium
WGGSSTTENV

SEQ ID NO: 614351 - protein, 7 aa, Mycobacterium
WGGTRNG

SEQ ID NO: 614352 - protein, 5 aa, Mycobacterium
WGGYS

SEQ ID NO: 614353 - protein, 33 aa, Mycobacterium
WGHQGVKEERRGGDDAVRPEFGERPGPDAPGAD

SEQ ID NO: 614354 - protein, 6 aa, Mycobacterium
WGKPNY

SEQ ID NO: 614355 - protein, 9 aa, Mycobacterium
WGKSESDAM

SEQ ID NO: 614356 - protein, 17 aa, Mycobacterium
WGLPGPADVEAITQLMT

SEQ ID NO: 614357 - protein, 85 aa, Mycobacterium
WGNGGAGGLGGNGAAGMSGVNPPTEPAPPGDPGQNGGPIGGDGDPGDSGTVFGQDGGQGGRGGNGTSRGGAGGSGGNGADGAPGT

SEQ ID NO: 614358 - protein, 34 aa, Mycobacterium
WGNGGTGGAGGGPGTQGSDNSGSGGNGGNGGNAG

SEQ ID NO: 614359 - protein, 14 aa, Mycobacterium
WGPADAAQRVTGSA

SEQ ID NO: 614360 - protein, 7 aa, Mycobacterium
WGPADGP

SEQ ID NO: 614361 - protein, 5 aa, Mycobacterium
WGPAE

SEQ ID NO: 614362 - protein, 6 aa, Mycobacterium
WGPAGA

SEQ ID NO: 614363 - protein, 8 aa, Mycobacterium
WGPAQGGV

SEQ ID NO: 614364 - protein, 7 aa, Mycobacterium
WGPARDV

SEQ ID NO: 614365 - protein, 9 aa, Mycobacterium
WGPARDVRD

SEQ ID NO: 614366 - protein, 11 aa, Mycobacterium
WGPARDVRDRQ

SEQ ID NO: 614367 - protein, 25 aa, Mycobacterium
WGPARNPWNTGHTPGGSSGGSGAAV

SEQ ID NO: 614368 - protein, 10 aa, Mycobacterium
WGPDAEMARA

SEQ ID NO: 614369 - protein, 17 aa, Mycobacterium
WGPDGGPGWQRNDPTVQ

SEQ ID NO: 614370 - protein, 13 aa, Mycobacterium
WGPDSDVDDRADH

SEQ ID NO: 614371 - protein, 4 aa, Mycobacterium
WGPE

SEQ ID NO: 614372 - protein, 13 aa, Mycobacterium
WGPEEAAQRVTGS

SEQ ID NO: 614373 - protein, 8 aa, Mycobacterium
WGPETGAA

SEQ ID NO: 614374 - protein, 10 aa, Mycobacterium
WGPGKDPGTI

SEQ ID NO: 614375 - protein, 6 aa, Mycobacterium
WGPHAT

SEQ ID NO: 614376 - protein, 4 aa, Mycobacterium
WGPL

SEQ ID NO: 614377 - protein, 12 aa, Mycobacterium
WGPLSASKLEQA

SEQ ID NO: 614378 - protein, 9 aa, Mycobacterium
WGPPADRAE

SEQ ID NO: 614379 - protein, 7 aa, Mycobacterium
WGPPDAA

SEQ ID NO: 614380 - protein, 8 aa, Mycobacterium
WGPPDAPG

SEQ ID NO: 614381 - protein, 6 aa, Mycobacterium
WGPPDG

SEQ ID NO: 614382 - protein, 12 aa, Mycobacterium
WGPPGGESEDIA

SEQ ID NO: 614383 - protein, 8 aa, Mycobacterium
WGPPIGPD

SEQ ID NO: 614384 - protein, 6 aa, Mycobacterium
WGPPPG

SEQ ID NO: 614385 - protein, 7 aa, Mycobacterium
WGPPPGD

SEQ ID NO: 614386 - protein, 7 aa, Mycobacterium
WGPPSSR

SEQ ID NO: 614387 - protein, 5 aa, Mycobacterium
WGPRS

SEQ ID NO: 614388 - protein, 14 aa, Mycobacterium
WGPSDAAQRVTGSA

SEQ ID NO: 614389 - protein, 26 aa, Mycobacterium
WGPSGSWQRSIPGGTQRRRSSGHRSG

SEQ ID NO: 614390 - protein, 16 aa, Mycobacterium
WGPSSDPAWQRNDPSL

SEQ ID NO: 614391 - protein, 16 aa, Mycobacterium
WGPSSDPAWQRNDPTI

SEQ ID NO: 614392 - protein, 5 aa, Mycobacterium
WGPTG

SEQ ID NO: 614393 - protein, 20 aa, Mycobacterium
WGPTGSVGRSPLARRTDTQR

SEQ ID NO: 614394 - protein, 14 aa, Mycobacterium
WGPVNDGTATASIA

SEQ ID NO: 614395 - protein, 11 aa, Mycobacterium
WGQDGPRALQA

SEQ ID NO: 614396 - protein, 13 aa, Mycobacterium
WGQDGPRAQQAGH

SEQ ID NO: 614397 - protein, 17 aa, Mycobacterium
WGQGGMASSEAATANIS

SEQ ID NO: 614398 - protein, 17 aa, Mycobacterium
WGQGGMASSEAATANIT

SEQ ID NO: 614399 - protein, 4 aa, Mycobacterium
WGQP

SEQ ID NO: 614400 - protein, 10 aa, Mycobacterium
WGQPQGRSAI

SEQ ID NO: 614401 - protein, 8 aa, Mycobacterium
WGQRPTAE

SEQ ID NO: 614402 - protein, 8 aa, Mycobacterium
WGRAAGPV

SEQ ID NO: 614403 - protein, 8 aa, Mycobacterium
WGRAASPV

SEQ ID NO: 614404 - protein, 9 aa, Mycobacterium
WGRAGGGEA

SEQ ID NO: 614405 - protein, 8 aa, Mycobacterium
WGRASSPV

SEQ ID NO: 614406 - protein, 5 aa, Mycobacterium
WGREP

SEQ ID NO: 614407 - protein, 12 aa, Mycobacterium
WGRPATGFGPEA

SEQ ID NO: 614408 - protein, 5 aa, Mycobacterium
WGRRT

SEQ ID NO: 614409 - protein, 9 aa, Mycobacterium
WGSADQQAT

SEQ ID NO: 614410 - protein, 9 aa, Mycobacterium
WGSARPGDT

SEQ ID NO: 614411 - protein, 23 aa, Mycobacterium
WGSDPAAVPLSDPDKLSSTTASV

SEQ ID NO: 614412 - protein, 5 aa, Mycobacterium
WGSGF

SEQ ID NO: 614413 - protein, 7 aa, Mycobacterium
WGSGKSS

SEQ ID NO: 614414 - protein, 7 aa, Mycobacterium
WGSPDAP

SEQ ID NO: 614415 - protein, 7 aa, Mycobacterium
WGSSPAA

SEQ ID NO: 614416 - protein, 7 aa, Mycobacterium
WGSSRDA

SEQ ID NO: 614417 - protein, 6 aa, Mycobacterium
WGSSSP

SEQ ID NO: 614418 - protein, 6 aa, Mycobacterium
WGSSTH

SEQ ID NO: 614419 - protein, 7 aa, Mycobacterium
WGSSTHS

SEQ ID NO: 614420 - protein, 10 aa, Mycobacterium
WGSTPTSDGK

SEQ ID NO: 614421 - protein, 11 aa, Mycobacterium
WGSTSAEAEAH

SEQ ID NO: 614422 - protein, 6 aa, Mycobacterium
WGTAAR

SEQ ID NO: 614423 - protein, 14 aa, Mycobacterium
WGTATPAGSDEEAD

SEQ ID NO: 614424 - protein, 8 aa, Mycobacterium
WGTDRRGC

SEQ ID NO: 614425 - protein, 13 aa, Mycobacterium
WGTEDADQRVEGS

SEQ ID NO: 614426 - protein, 7 aa, Mycobacterium
WGTETGA

SEQ ID NO: 614427 - protein, 8 aa, Mycobacterium
WGTGPGKL

SEQ ID NO: 614428 - protein, 8 aa, Mycobacterium
WGTGSPRR

SEQ ID NO: 614429 - protein, 16 aa, Mycobacterium
WGTGYSKQQSTRPQTL

SEQ ID NO: 614430 - protein, 14 aa, Mycobacterium
WGTPEVHRRRVLEA

SEQ ID NO: 614431 - protein, 7 aa, Mycobacterium
WGTRGAR

SEQ ID NO: 614432 - protein, 7 aa, Mycobacterium
WGTSDNN

SEQ ID NO: 614433 - protein, 6 aa, Mycobacterium
WGTTLG

SEQ ID NO: 614434 - protein, 6 aa, Mycobacterium
WGTTPA

SEQ ID NO: 614435 - protein, 8 aa, Mycobacterium
WGVEPGDY

SEQ ID NO: 614436 - protein, 13 aa, Mycobacterium
WGYTPKGATGVPT

SEQ ID NO: 614437 - protein, 11 aa, Mycobacterium
WHDRQDPDGTI

SEQ ID NO: 614438 - protein, 6 aa, Mycobacterium
WHGAGG

SEQ ID NO: 614439 - protein, 5 aa, Mycobacterium
WHGAR

SEQ ID NO: 614440 - protein, 10 aa, Mycobacterium
WHNETDRPRL

SEQ ID NO: 614441 - protein, 15 aa, Mycobacterium
WHPDADKHAGKPLTG

SEQ ID NO: 614442 - protein, 7 aa, Mycobacterium
WHPEGGE

SEQ ID NO: 614443 - protein, 7 aa, Mycobacterium
WHSPSGR

SEQ ID NO: 614444 - protein, 5 aa, Mycobacterium
WIGPT

SEQ ID NO: 614445 - protein, 9 aa, Mycobacterium
WKANGRTDI

SEQ ID NO: 614446 - protein, 8 aa, Mycobacterium
WKANPQYA

SEQ ID NO: 614447 - protein, 14 aa, Mycobacterium
WKAPAANPVNGGRG

SEQ ID NO: 614448 - protein, 13 aa, Mycobacterium
WKAPTSGGSTGRP

SEQ ID NO: 614449 - protein, 7 aa, Mycobacterium
WKASPTQ

SEQ ID NO: 614450 - protein, 14 aa, Mycobacterium
WKDGDDAGRQGNQR

SEQ ID NO: 614451 - protein, 14 aa, Mycobacterium
WKDPADDDKYDDWA

SEQ ID NO: 614452 - protein, 9 aa, Mycobacterium
WKDPTRRQL

SEQ ID NO: 614453 - protein, 16 aa, Mycobacterium
WKEAQRDPAPNTADHA

SEQ ID NO: 614454 - protein, 8 aa, Mycobacterium
WKGAPDYD

SEQ ID NO: 614455 - protein, 4 aa, Mycobacterium
WKGN

SEQ ID NO: 614456 - protein, 12 aa, Mycobacterium
WKGNVKKSGFLP

SEQ ID NO: 614457 - protein, 8 aa, Mycobacterium
WKKPGTSD

SEQ ID NO: 614458 - protein, 21 aa, Mycobacterium
WKPDQYANPEGPASHYATTGP

SEQ ID NO: 614459 - protein, 21 aa, Mycobacterium
WKPDQYSNPMGPESHYETTGP

SEQ ID NO: 614460 - protein, 22 aa, Mycobacterium
WKPDQYSNPNGPASHYETTGPE

SEQ ID NO: 614461 - protein, 22 aa, Mycobacterium
WKPDQYSNQMGPESHYETTGPE

SEQ ID NO: 614462 - protein, 10 aa, Mycobacterium
WKPESEGGFT

SEQ ID NO: 614463 - protein, 13 aa, Mycobacterium
WKPETWNPTAVPS

SEQ ID NO: 614464 - protein, 12 aa, Mycobacterium
WKPGDAQAVVSY

SEQ ID NO: 614465 - protein, 12 aa, Mycobacterium
WKPGDAWTAETT

SEQ ID NO: 614466 - protein, 8 aa, Mycobacterium
WKPKPDTD

SEQ ID NO: 614467 - protein, 12 aa, Mycobacterium
WKPLPAPDHREQ

SEQ ID NO: 614468 - protein, 6 aa, Mycobacterium
WKPPHN

SEQ ID NO: 614469 - protein, 7 aa, Mycobacterium
WKPSELS

SEQ ID NO: 614470 - protein, 26 aa, Mycobacterium
WKPSPADDGTYIGTDRATGSPKWTGT

SEQ ID NO: 614471 - protein, 15 aa, Mycobacterium
WKREGVDPRPLHNRV

SEQ ID NO: 614472 - protein, 5 aa, Mycobacterium
WKRPA

SEQ ID NO: 614473 - protein, 10 aa, Mycobacterium
WKRQPGRPAG

SEQ ID NO: 614474 - protein, 6 aa, Mycobacterium
WKRSAE

SEQ ID NO: 614475 - protein, 7 aa, Mycobacterium
WKRSTEE

SEQ ID NO: 614476 - protein, 5 aa, Mycobacterium
WKSAE

SEQ ID NO: 614477 - protein, 9 aa, Mycobacterium
WKSPNADQL

SEQ ID NO: 614478 - protein, 19 aa, Mycobacterium
WKSTEAATPTNEKQRDKAR

SEQ ID NO: 614479 - protein, 11 aa, Mycobacterium
WKTSETTENVY

SEQ ID NO: 614480 - protein, 14 aa, Mycobacterium
WLGPASTSMTAASA

SEQ ID NO: 614481 - protein, 6 aa, Mycobacterium
WLGPSS

SEQ ID NO: 614482 - protein, 12 aa, Mycobacterium
WLGPSSASMAAA

SEQ ID NO: 614483 - protein, 8 aa, Mycobacterium
WNARNGTE

SEQ ID NO: 614484 - protein, 4 aa, Mycobacterium
WNDA

SEQ ID NO: 614485 - protein, 7 aa, Mycobacterium
WNDAPED

SEQ ID NO: 614486 - protein, 9 aa, Mycobacterium
WNDPDESFE

SEQ ID NO: 614487 - protein, 13 aa, Mycobacterium
WNDPNDHSGCDTR

SEQ ID NO: 614488 - protein, 10 aa, Mycobacterium
WNEEESGAYG

SEQ ID NO: 614489 - protein, 9 aa, Mycobacterium
WNEEESQAY

SEQ ID NO: 614490 - protein, 8 aa, Mycobacterium
WNEPDTEF

SEQ ID NO: 614491 - protein, 7 aa, Mycobacterium
WNGGAND

SEQ ID NO: 614492 - protein, 8 aa, Mycobacterium
WNGGANDG

SEQ ID NO: 614493 - protein, 10 aa, Mycobacterium
WNGGRSESQY

SEQ ID NO: 614494 - protein, 4 aa, Mycobacterium
WNGN

SEQ ID NO: 614495 - protein, 13 aa, Mycobacterium
WNGNDAPMRTLGS

SEQ ID NO: 614496 - protein, 6 aa, Mycobacterium
WNGTED

SEQ ID NO: 614497 - protein, 11 aa, Mycobacterium
WNHEDSESRGD

SEQ ID NO: 614498 - protein, 8 aa, Mycobacterium
WNIEGSPD

SEQ ID NO: 614499 - protein, 9 aa, Mycobacterium
WNIEGSPDW

SEQ ID NO: 614500 - protein, 12 aa, Mycobacterium
WNKGAERAADRP

SEQ ID NO: 614501 - protein, 14 aa, Mycobacterium
WNNPAQTEAFDRSR

SEQ ID NO: 614502 - protein, 14 aa, Mycobacterium
WNNPGGQSINVTPT

SEQ ID NO: 614503 - protein, 10 aa, Mycobacterium
WNNPGPAARR

SEQ ID NO: 614504 - protein, 5 aa, Mycobacterium
WNPDD

SEQ ID NO: 614505 - protein, 13 aa, Mycobacterium
WNPGEITSADRTL

SEQ ID NO: 614506 - protein, 7 aa, Mycobacterium
WNPPVTA

SEQ ID NO: 614507 - protein, 10 aa, Mycobacterium
WNPQTQTIDP

SEQ ID NO: 614508 - protein, 4 aa, Mycobacterium
WNRG

SEQ ID NO: 614509 - protein, 19 aa, Mycobacterium
WNRPADRPTIAPATDSRPV

SEQ ID NO: 614510 - protein, 5 aa, Mycobacterium
WNRPS

SEQ ID NO: 614511 - protein, 13 aa, Mycobacterium
WNRTTTGDTRNGR

SEQ ID NO: 614512 - protein, 4 aa, Mycobacterium
WNSD

SEQ ID NO: 614513 - protein, 8 aa, Mycobacterium
WNSGSGNI

SEQ ID NO: 614514 - protein, 16 aa, Mycobacterium
WNTDHTAGASSSGSGA

SEQ ID NO: 614515 - protein, 8 aa, Mycobacterium
WNTEARQA

SEQ ID NO: 614516 - protein, 11 aa, Mycobacterium
WNTGAGNGGNL

SEQ ID NO: 614517 - protein, 9 aa, Mycobacterium
WNTGNSNSG

SEQ ID NO: 614518 - protein, 7 aa, Mycobacterium
WNTSQSW

SEQ ID NO: 614519 - protein, 6 aa, Mycobacterium
WPAAGK

SEQ ID NO: 614520 - protein, 9 aa, Mycobacterium
WPAAGSRRR

SEQ ID NO: 614521 - protein, 12 aa, Mycobacterium
WPAATRREVVVP

SEQ ID NO: 614522 - protein, 9 aa, Mycobacterium
WPADGVAGA

SEQ ID NO: 614523 - protein, 16 aa, Mycobacterium
WPADPLAGRRDDIEAG

SEQ ID NO: 614524 - protein, 5 aa, Mycobacterium
WPAED

SEQ ID NO: 614525 - protein, 4 aa, Mycobacterium
WPAG

SEQ ID NO: 614526 - protein, 6 aa, Mycobacterium
WPAGAG

SEQ ID NO: 614527 - protein, 10 aa, Mycobacterium
WPAPDDTGLR

SEQ ID NO: 614528 - protein, 5 aa, Mycobacterium
WPAPF

SEQ ID NO: 614529 - protein, 7 aa, Mycobacterium
WPAPQNL

SEQ ID NO: 614530 - protein, 8 aa, Mycobacterium
WPAPSGEH

SEQ ID NO: 614531 - protein, 16 aa, Mycobacterium
WPAQDNPLRGAPHTAE

SEQ ID NO: 614532 - protein, 12 aa, Mycobacterium
WPARTRPEAMLS

SEQ ID NO: 614533 - protein, 19 aa, Mycobacterium
WPASGGEGARPAARPARSS

SEQ ID NO: 614534 - protein, 15 aa, Mycobacterium
WPASSAEGARPGRKA

SEQ ID NO: 614535 - protein, 8 aa, Mycobacterium
WPATGPRE

SEQ ID NO: 614536 - protein, 5 aa, Mycobacterium
WPDAD

SEQ ID NO: 614537 - protein, 8 aa, Mycobacterium
WPDDQTID

SEQ ID NO: 614538 - protein, 11 aa, Mycobacterium
WPDEGIAPGTR

SEQ ID NO: 614539 - protein, 16 aa, Mycobacterium
WPDEPDGEHESDAPSL

SEQ ID NO: 614540 - protein, 8 aa, Mycobacterium
WPDGHPDH

SEQ ID NO: 614541 - protein, 8 aa, Mycobacterium
WPDGPDAI

SEQ ID NO: 614542 - protein, 9 aa, Mycobacterium
WPDGTDPRW

SEQ ID NO: 614543 - protein, 9 aa, Mycobacterium
WPDNANLDK

SEQ ID NO: 614544 - protein, 10 aa, Mycobacterium
WPDPATAPRA

SEQ ID NO: 614545 - protein, 9 aa, Mycobacterium
WPDPATTPQ

SEQ ID NO: 614546 - protein, 8 aa, Mycobacterium
WPDPDTAE

SEQ ID NO: 614547 - protein, 5 aa, Mycobacterium
WPDPV

SEQ ID NO: 614548 - protein, 4 aa, Mycobacterium
WPDQ

SEQ ID NO: 614549 - protein, 5 aa, Mycobacterium
WPDQA

SEQ ID NO: 614550 - protein, 8 aa, Mycobacterium
WPDQEGLA

SEQ ID NO: 614551 - protein, 5 aa, Mycobacterium
WPDRD

SEQ ID NO: 614552 - protein, 5 aa, Mycobacterium
WPDRG

SEQ ID NO: 614553 - protein, 5 aa, Mycobacterium
WPDRN

SEQ ID NO: 614554 - protein, 9 aa, Mycobacterium
WPDSPGRAQ

SEQ ID NO: 614555 - protein, 11 aa, Mycobacterium
WPDSPPSTPIS

SEQ ID NO: 614556 - protein, 6 aa, Mycobacterium
WPDTAL

SEQ ID NO: 614557 - protein, 11 aa, Mycobacterium
WPDTGHPRRAG

SEQ ID NO: 614558 - protein, 12 aa, Mycobacterium
WPDTGRPRRAGV

SEQ ID NO: 614559 - protein, 9 aa, Mycobacterium
WPDTPGKAR

SEQ ID NO: 614560 - protein, 8 aa, Mycobacterium
WPEASAHD

SEQ ID NO: 614561 - protein, 9 aa, Mycobacterium
WPEDPDDNI

SEQ ID NO: 614562 - protein, 9 aa, Mycobacterium
WPEDQGPRR

SEQ ID NO: 614563 - protein, 11 aa, Mycobacterium
WPEESLSGVGR

SEQ ID NO: 614564 - protein, 6 aa, Mycobacterium
WPEGEG

SEQ ID NO: 614565 - protein, 6 aa, Mycobacterium
WPEGQQ

SEQ ID NO: 614566 - protein, 6 aa, Mycobacterium
WPEGQS

SEQ ID NO: 614567 - protein, 7 aa, Mycobacterium
WPEGSPF

SEQ ID NO: 614568 - protein, 6 aa, Mycobacterium
WPEGTG

SEQ ID NO: 614569 - protein, 14 aa, Mycobacterium
WPEPAESLPPPYDN

SEQ ID NO: 614570 - protein, 12 aa, Mycobacterium
WPETAGGLGGPD

SEQ ID NO: 614571 - protein, 8 aa, Mycobacterium
WPGAAGAG

SEQ ID NO: 614572 - protein, 8 aa, Mycobacterium
WPGAGPRP

SEQ ID NO: 614573 - protein, 4 aa, Mycobacterium
WPGC

SEQ ID NO: 614574 - protein, 8 aa, Mycobacterium
WPGDPDLP

SEQ ID NO: 614575 - protein, 11 aa, Mycobacterium
WPGDPDPDTGI

SEQ ID NO: 614576 - protein, 12 aa, Mycobacterium
WPGDSREDKAKR

SEQ ID NO: 614577 - protein, 7 aa, Mycobacterium
WPGEEIP

SEQ ID NO: 614578 - protein, 18 aa, Mycobacterium
WPGESAEPVDDGDEIGTG

SEQ ID NO: 614579 - protein, 11 aa, Mycobacterium
WPGESPLQASY

SEQ ID NO: 614580 - protein, 10 aa, Mycobacterium
WPGESPLQSS

SEQ ID NO: 614581 - protein, 4 aa, Mycobacterium
WPGG

SEQ ID NO: 614582 - protein, 5 aa, Mycobacterium
WPGGT

SEQ ID NO: 614583 - protein, 4 aa, Mycobacterium
WPGI

SEQ ID NO: 614584 - protein, 5 aa, Mycobacterium
WPGKR

SEQ ID NO: 614585 - protein, 5 aa, Mycobacterium
WPGNG

SEQ ID NO: 614586 - protein, 18 aa, Mycobacterium
WPGNRSPDGSERLTQTGR

SEQ ID NO: 614587 - protein, 4 aa, Mycobacterium
WPGP

SEQ ID NO: 614588 - protein, 15 aa, Mycobacterium
WPGRTIGKDGQYASA

SEQ ID NO: 614589 - protein, 7 aa, Mycobacterium
WPGSPPR

SEQ ID NO: 614590 - protein, 6 aa, Mycobacterium
WPGSQR

SEQ ID NO: 614591 - protein, 6 aa, Mycobacterium
WPGTEQ

SEQ ID NO: 614592 - protein, 16 aa, Mycobacterium
WPGTVTREPRGDGGFG

SEQ ID NO: 614593 - protein, 11 aa, Mycobacterium
WPGVDSDGKPT

SEQ ID NO: 614594 - protein, 15 aa, Mycobacterium
WPHGDPRPALADPER

SEQ ID NO: 614595 - protein, 6 aa, Mycobacterium
WPHPEG

SEQ ID NO: 614596 - protein, 7 aa, Mycobacterium
WPHPEGL

SEQ ID NO: 614597 - protein, 11 aa, Mycobacterium
WPKEDGSPTPA

SEQ ID NO: 614598 - protein, 5 aa, Mycobacterium
WPKPV

SEQ ID NO: 614599 - protein, 12 aa, Mycobacterium
WPKSDRKRREGE

SEQ ID NO: 614600 - protein, 4 aa, Mycobacterium
WPLG

SEQ ID NO: 614601 - protein, 4 aa, Mycobacterium
WPLP

SEQ ID NO: 614602 - protein, 8 aa, Mycobacterium
WPNDNPQL

SEQ ID NO: 614603 - protein, 7 aa, Mycobacterium
WPNGVEE

SEQ ID NO: 614604 - protein, 5 aa, Mycobacterium
WPPAR

SEQ ID NO: 614605 - protein, 9 aa, Mycobacterium
WPPASGRAS

SEQ ID NO: 614606 - protein, 8 aa, Mycobacterium
WPPDDAKG

SEQ ID NO: 614607 - protein, 11 aa, Mycobacterium
WPPDGASPAQR

SEQ ID NO: 614608 - protein, 6 aa, Mycobacterium
WPPEGA

SEQ ID NO: 614609 - protein, 10 aa, Mycobacterium
WPPGPRASRD

SEQ ID NO: 614610 - protein, 19 aa, Mycobacterium
WPPGPTYDPNTWTTTFGVQ

SEQ ID NO: 614611 - protein, 13 aa, Mycobacterium
WPPGTVPGADEPV

SEQ ID NO: 614612 - protein, 7 aa, Mycobacterium
WPPKTTD

SEQ ID NO: 614613 - protein, 6 aa, Mycobacterium
WPPNAA

SEQ ID NO: 614614 - protein, 12 aa, Mycobacterium
WPPNPGSADERR

SEQ ID NO: 614615 - protein, 4 aa, Mycobacterium
WPPQ

SEQ ID NO: 614616 - protein, 6 aa, Mycobacterium
WPPRGR

SEQ ID NO: 614617 - protein, 16 aa, Mycobacterium
WPPRGYGDTRLEMAER

SEQ ID NO: 614618 - protein, 4 aa, Mycobacterium
WPPS

SEQ ID NO: 614619 - protein, 19 aa, Mycobacterium
WPPSEPEPEEGQGTETERG

SEQ ID NO: 614620 - protein, 9 aa, Mycobacterium
WPPSGARAS

SEQ ID NO: 614621 - protein, 7 aa, Mycobacterium
WPPSMTP

SEQ ID NO: 614622 - protein, 5 aa, Mycobacterium
WPPTS

SEQ ID NO: 614623 - protein, 10 aa, Mycobacterium
WPPTSANGNP

SEQ ID NO: 614624 - protein, 6 aa, Mycobacterium
WPPVTT

SEQ ID NO: 614625 - protein, 20 aa, Mycobacterium
WPQDTDPRWTGGQDSPRAAI

SEQ ID NO: 614626 - protein, 5 aa, Mycobacterium
WPQGR

SEQ ID NO: 614627 - protein, 8 aa, Mycobacterium
WPQHNPSA

SEQ ID NO: 614628 - protein, 10 aa, Mycobacterium
WPQNADPLED

SEQ ID NO: 614629 - protein, 6 aa, Mycobacterium
WPQQPG

SEQ ID NO: 614630 - protein, 15 aa, Mycobacterium
WPQTAAESALRGARA

SEQ ID NO: 614631 - protein, 8 aa, Mycobacterium
WPRAAEES

SEQ ID NO: 614632 - protein, 17 aa, Mycobacterium
WPRANPRATSEPAPQSL

SEQ ID NO: 614633 - protein, 10 aa, Mycobacterium
WPRASDPRIM

SEQ ID NO: 614634 - protein, 11 aa, Mycobacterium
WPRDPGSPAQR

SEQ ID NO: 614635 - protein, 5 aa, Mycobacterium
WPRPV

SEQ ID NO: 614636 - protein, 8 aa, Mycobacterium
WPRRQQPA

SEQ ID NO: 614637 - protein, 6 aa, Mycobacterium
WPRRRA

SEQ ID NO: 614638 - protein, 10 aa, Mycobacterium
WPRSRSWPSI

SEQ ID NO: 614639 - protein, 10 aa, Mycobacterium
WPSAPRPVSA

SEQ ID NO: 614640 - protein, 11 aa, Mycobacterium
WPSDSGPRRAA

SEQ ID NO: 614641 - protein, 6 aa, Mycobacterium
WPSGEA

SEQ ID NO: 614642 - protein, 15 aa, Mycobacterium
WPSGLGKNAGPNHPY

SEQ ID NO: 614643 - protein, 10 aa, Mycobacterium
WPSPARTGRD

SEQ ID NO: 614644 - protein, 18 aa, Mycobacterium
WPSRGTDGDTAHRPGRKA

SEQ ID NO: 614645 - protein, 14 aa, Mycobacterium
WPSRPRSTTPSTRC

SEQ ID NO: 614646 - protein, 4 aa, Mycobacterium
WPTA

SEQ ID NO: 614647 - protein, 9 aa, Mycobacterium
WPTAGNAYA

SEQ ID NO: 614648 - protein, 15 aa, Mycobacterium
WPTDSEAHRPGRKAG

SEQ ID NO: 614649 - protein, 16 aa, Mycobacterium
WPTESAAGAPPPRLDE

SEQ ID NO: 614650 - protein, 16 aa, Mycobacterium
WPTGETGGAAPPPLDE

SEQ ID NO: 614651 - protein, 5 aa, Mycobacterium
WPTGP

SEQ ID NO: 614652 - protein, 6 aa, Mycobacterium
WPTGQA

SEQ ID NO: 614653 - protein, 16 aa, Mycobacterium
WPTGSPAGALPPSADE

SEQ ID NO: 614654 - protein, 17 aa, Mycobacterium
WPTGSPAGVLPPPAEEA

SEQ ID NO: 614655 - protein, 5 aa, Mycobacterium
WPTND

SEQ ID NO: 614656 - protein, 12 aa, Mycobacterium
WPTNGEQTRTAA

SEQ ID NO: 614657 - protein, 9 aa, Mycobacterium
WPTPSGEHV

SEQ ID NO: 614658 - protein, 10 aa, Mycobacterium
WPTPSGPKTY

SEQ ID NO: 614659 - protein, 8 aa, Mycobacterium
WPTPTGEH

SEQ ID NO: 614660 - protein, 19 aa, Mycobacterium
WPTSDDDGSNVGARPGRKA

SEQ ID NO: 614661 - protein, 4 aa, Mycobacterium
WPTV

SEQ ID NO: 614662 - protein, 6 aa, Mycobacterium
WPVPSG

SEQ ID NO: 614663 - protein, 9 aa, Mycobacterium
WPYGPQTGD

SEQ ID NO: 614664 - protein, 4 aa, Mycobacterium
WQAG

SEQ ID NO: 614665 - protein, 7 aa, Mycobacterium
WQAGPRT

SEQ ID NO: 614666 - protein, 4 aa, Mycobacterium
WQAP

SEQ ID NO: 614667 - protein, 16 aa, Mycobacterium
WQAQPGEYHHQSDGKL

SEQ ID NO: 614668 - protein, 7 aa, Mycobacterium
WQARARA

SEQ ID NO: 614669 - protein, 10 aa, Mycobacterium
WQATTGVTLS

SEQ ID NO: 614670 - protein, 4 aa, Mycobacterium
WQDE

SEQ ID NO: 614671 - protein, 7 aa, Mycobacterium
WQDESDS

SEQ ID NO: 614672 - protein, 7 aa, Mycobacterium
WQDTESW

SEQ ID NO: 614673 - protein, 6 aa, Mycobacterium
WQEERA

SEQ ID NO: 614674 - protein, 8 aa, Mycobacterium
WQENEHQR

SEQ ID NO: 614675 - protein, 12 aa, Mycobacterium
WQEPDANESTTA

SEQ ID NO: 614676 - protein, 4 aa, Mycobacterium
WQGA

SEQ ID NO: 614677 - protein, 7 aa, Mycobacterium
WQGDTGM

SEQ ID NO: 614678 - protein, 8 aa, Mycobacterium
WQGDTGMT

SEQ ID NO: 614679 - protein, 5 aa, Mycobacterium
WQGEA

SEQ ID NO: 614680 - protein, 9 aa, Mycobacterium
WQGEAGEAF

SEQ ID NO: 614681 - protein, 12 aa, Mycobacterium
WQGGSADRQTEL

SEQ ID NO: 614682 - protein, 7 aa, Mycobacterium
WQGPAAA

SEQ ID NO: 614683 - protein, 8 aa, Mycobacterium
WQGPAGAA

SEQ ID NO: 614684 - protein, 7 aa, Mycobacterium
WQGPASA

SEQ ID NO: 614685 - protein, 10 aa, Mycobacterium
WQGPASAAMT

SEQ ID NO: 614686 - protein, 7 aa, Mycobacterium
WQGSERV

SEQ ID NO: 614687 - protein, 4 aa, Mycobacterium
WQGT

SEQ ID NO: 614688 - protein, 14 aa, Mycobacterium
WQGTGESDHRGRGG

SEQ ID NO: 614689 - protein, 11 aa, Mycobacterium
WQKEYESRTGQ

SEQ ID NO: 614690 - protein, 5 aa, Mycobacterium
WQLSP

SEQ ID NO: 614691 - protein, 6 aa, Mycobacterium
WQNEKN

SEQ ID NO: 614692 - protein, 8 aa, Mycobacterium
WQPADEQI

SEQ ID NO: 614693 - protein, 5 aa, Mycobacterium
WQPER

SEQ ID NO: 614694 - protein, 6 aa, Mycobacterium
WQPESV

SEQ ID NO: 614695 - protein, 5 aa, Mycobacterium
WQPGD

SEQ ID NO: 614696 - protein, 7 aa, Mycobacterium
WQPGDAW

SEQ ID NO: 614697 - protein, 11 aa, Mycobacterium
WQPGSKMPAFS

SEQ ID NO: 614698 - protein, 14 aa, Mycobacterium
WQPLGGEPERPVTA

SEQ ID NO: 614699 - protein, 4 aa, Mycobacterium
WQPN

SEQ ID NO: 614700 - protein, 12 aa, Mycobacterium
WQPNGRPRRAGV

SEQ ID NO: 614701 - protein, 6 aa, Mycobacterium
WQPPFD

SEQ ID NO: 614702 - protein, 18 aa, Mycobacterium
WQPRRGRGAGRGGPGRPR

SEQ ID NO: 614703 - protein, 16 aa, Mycobacterium
WQPRRQGGRGGPGRSR

SEQ ID NO: 614704 - protein, 20 aa, Mycobacterium
WQPRRSAGRGRPPARSGRPR

SEQ ID NO: 614705 - protein, 8 aa, Mycobacterium
WQPRTEPR

SEQ ID NO: 614706 - protein, 8 aa, Mycobacterium
WQPTPDTD

SEQ ID NO: 614707 - protein, 5 aa, Mycobacterium
WQPVR

SEQ ID NO: 614708 - protein, 23 aa, Mycobacterium
WQPVRDGRTSGKVAGSIPGAPVS

SEQ ID NO: 614709 - protein, 12 aa, Mycobacterium
WQRARSADHRSD

SEQ ID NO: 614710 - protein, 10 aa, Mycobacterium
WQRGERDRAV

SEQ ID NO: 614711 - protein, 11 aa, Mycobacterium
WQRGTNENTNG

SEQ ID NO: 614712 - protein, 12 aa, Mycobacterium
WQRLGRKHGLIP

SEQ ID NO: 614713 - protein, 9 aa, Mycobacterium
WQSDQPSKL

SEQ ID NO: 614714 - protein, 6 aa, Mycobacterium
WQSEED

SEQ ID NO: 614715 - protein, 9 aa, Mycobacterium
WQSSGGASL

SEQ ID NO: 614716 - protein, 8 aa, Mycobacterium
WQSSPEAL

SEQ ID NO: 614717 - protein, 6 aa, Mycobacterium
WQTDDG

SEQ ID NO: 614718 - protein, 6 aa, Mycobacterium
WQTDDS

SEQ ID NO: 614719 - protein, 5 aa, Mycobacterium
WQTNP

SEQ ID NO: 614720 - protein, 15 aa, Mycobacterium
WRAAAGDYGKAGSHM

SEQ ID NO: 614721 - protein, 26 aa, Mycobacterium
WRADGGCRTGTFGSDTRRLVRYRMAP

SEQ ID NO: 614722 - protein, 11 aa, Mycobacterium
WRADNTDIDGV

SEQ ID NO: 614723 - protein, 4 aa, Mycobacterium
WRAE

SEQ ID NO: 614724 - protein, 19 aa, Mycobacterium
WRANGGSGSPSGASREEQI

SEQ ID NO: 614725 - protein, 4 aa, Mycobacterium
WRAR

SEQ ID NO: 614726 - protein, 9 aa, Mycobacterium
WRARGGTRL

SEQ ID NO: 614727 - protein, 5 aa, Mycobacterium
WRARR

SEQ ID NO: 614728 - protein, 10 aa, Mycobacterium
WRDAGGTRLT

SEQ ID NO: 614729 - protein, 7 aa, Mycobacterium
WRDDPAP

SEQ ID NO: 614730 - protein, 9 aa, Mycobacterium
WRDDQRQAV

SEQ ID NO: 614731 - protein, 12 aa, Mycobacterium
WRDGDREDWSGP

SEQ ID NO: 614732 - protein, 5 aa, Mycobacterium
WRDGG

SEQ ID NO: 614733 - protein, 11 aa, Mycobacterium
WRDPGTREAAQ

SEQ ID NO: 614734 - protein, 9 aa, Mycobacterium
WRDPYAGTP

SEQ ID NO: 614735 - protein, 8 aa, Mycobacterium
WRDRPATE

SEQ ID NO: 614736 - protein, 18 aa, Mycobacterium
WRDRRGEVERASDQITTE

SEQ ID NO: 614737 - protein, 4 aa, Mycobacterium
WRDS

SEQ ID NO: 614738 - protein, 12 aa, Mycobacterium
WRDSESAAGAIG

SEQ ID NO: 614739 - protein, 11 aa, Mycobacterium
WRDTRNQLRST

SEQ ID NO: 614740 - protein, 14 aa, Mycobacterium
WRERRGEVEEASDH

SEQ ID NO: 614741 - protein, 7 aa, Mycobacterium
WRGAPRP

SEQ ID NO: 614742 - protein, 9 aa, Mycobacterium
WRGAPRPVQ

SEQ ID NO: 614743 - protein, 11 aa, Mycobacterium
WRGAPRPVSSR

SEQ ID NO: 614744 - protein, 6 aa, Mycobacterium
WRGDGR

SEQ ID NO: 614745 - protein, 10 aa, Mycobacterium
WRGDPPNDDW

SEQ ID NO: 614746 - protein, 11 aa, Mycobacterium
WRGDTDEEDQL

SEQ ID NO: 614747 - protein, 9 aa, Mycobacterium
WRGDTEEED

SEQ ID NO: 614748 - protein, 12 aa, Mycobacterium
WRGEPPAPSGAI

SEQ ID NO: 614749 - protein, 14 aa, Mycobacterium
WRGGSNRFSAPPPV

SEQ ID NO: 614750 - protein, 11 aa, Mycobacterium
WRGNTDEEDQL

SEQ ID NO: 614751 - protein, 5 aa, Mycobacterium
WRGPA

SEQ ID NO: 614752 - protein, 6 aa, Mycobacterium
WRGPAS

SEQ ID NO: 614753 - protein, 10 aa, Mycobacterium
WRGPASETMA

SEQ ID NO: 614754 - protein, 12 aa, Mycobacterium
WRGPGPKTPVSG

SEQ ID NO: 614755 - protein, 7 aa, Mycobacterium
WRGPPAV

SEQ ID NO: 614756 - protein, 8 aa, Mycobacterium
WRGSPERF

SEQ ID NO: 614757 - protein, 9 aa, Mycobacterium
WRGTPARDL

SEQ ID NO: 614758 - protein, 11 aa, Mycobacterium
WRHGQGERVEG

SEQ ID NO: 614759 - protein, 6 aa, Mycobacterium
WRKRGA

SEQ ID NO: 614760 - protein, 7 aa, Mycobacterium
WRKRGSR

SEQ ID NO: 614761 - protein, 9 aa, Mycobacterium
WRNEKPKEL

SEQ ID NO: 614762 - protein, 5 aa, Mycobacterium
WRNPP

SEQ ID NO: 614763 - protein, 6 aa, Mycobacterium
WRNPPE

SEQ ID NO: 614764 - protein, 7 aa, Mycobacterium
WRNPPRT

SEQ ID NO: 614765 - protein, 7 aa, Mycobacterium
WRNPPST

SEQ ID NO: 614766 - protein, 14 aa, Mycobacterium
WRNQNKNPGRWPGN

SEQ ID NO: 614767 - protein, 4 aa, Mycobacterium
WRNR

SEQ ID NO: 614768 - protein, 13 aa, Mycobacterium
WRPAADALGPPTA

SEQ ID NO: 614769 - protein, 11 aa, Mycobacterium
WRPADNGEVRG

SEQ ID NO: 614770 - protein, 15 aa, Mycobacterium
WRPDPDQRNDPDTPK

SEQ ID NO: 614771 - protein, 11 aa, Mycobacterium
WRPDSHDPGAP

SEQ ID NO: 614772 - protein, 4 aa, Mycobacterium
WRPE

SEQ ID NO: 614773 - protein, 9 aa, Mycobacterium
WRPESSSRG

SEQ ID NO: 614774 - protein, 5 aa, Mycobacterium
WRPEY

SEQ ID NO: 614775 - protein, 5 aa, Mycobacterium
WRPGA

SEQ ID NO: 614776 - protein, 6 aa, Mycobacterium
WRPGES

SEQ ID NO: 614777 - protein, 12 aa, Mycobacterium
WRPGLADSKAAD

SEQ ID NO: 614778 - protein, 16 aa, Mycobacterium
WRPGTAEDVPVDDGTA

SEQ ID NO: 614779 - protein, 6 aa, Mycobacterium
WRPGTL

SEQ ID NO: 614780 - protein, 11 aa, Mycobacterium
WRPPDRGPTVP

SEQ ID NO: 614781 - protein, 6 aa, Mycobacterium
WRPPNN

SEQ ID NO: 614782 - protein, 22 aa, Mycobacterium
WRPPPGRAAPGASACSTSRTPG

SEQ ID NO: 614783 - protein, 9 aa, Mycobacterium
WRPQTTEWD

SEQ ID NO: 614784 - protein, 5 aa, Mycobacterium
WRPRK

SEQ ID NO: 614785 - protein, 30 aa, Mycobacterium
WRPRSSPRRDRDPRGNLGAAPPPRYRPRYQ

SEQ ID NO: 614786 - protein, 8 aa, Mycobacterium
WRPSEISS

SEQ ID NO: 614787 - protein, 6 aa, Mycobacterium
WRPSEL

SEQ ID NO: 614788 - protein, 10 aa, Mycobacterium
WRPSGLPPIG

SEQ ID NO: 614789 - protein, 4 aa, Mycobacterium
WRPV

SEQ ID NO: 614790 - protein, 8 aa, Mycobacterium
WRQNRGGV

SEQ ID NO: 614791 - protein, 8 aa, Mycobacterium
WRRDGAGV

SEQ ID NO: 614792 - protein, 12 aa, Mycobacterium
WRRGATQGHSGT

SEQ ID NO: 614793 - protein, 11 aa, Mycobacterium
WRRGRAPRARP

SEQ ID NO: 614794 - protein, 11 aa, Mycobacterium
WRRGTSDALQR

SEQ ID NO: 614795 - protein, 4 aa, Mycobacterium
WRRP

SEQ ID NO: 614796 - protein, 17 aa, Mycobacterium
WRRPGPQAAADRRRGRG

SEQ ID NO: 614797 - protein, 19 aa, Mycobacterium
WRRQRSPQCAAGAPELQEN

SEQ ID NO: 614798 - protein, 15 aa, Mycobacterium
WRRRPSDSSALFSGG

SEQ ID NO: 614799 - protein, 6 aa, Mycobacterium
WRRSDP

SEQ ID NO: 614800 - protein, 5 aa, Mycobacterium
WRRTS

SEQ ID NO: 614801 - protein, 16 aa, Mycobacterium
WRSEPLPGVPDNATTQ

SEQ ID NO: 614802 - protein, 5 aa, Mycobacterium
WRSGG

SEQ ID NO: 614803 - protein, 6 aa, Mycobacterium
WRSGSD

SEQ ID NO: 614804 - protein, 4 aa, Mycobacterium
WRSR

SEQ ID NO: 614805 - protein, 10 aa, Mycobacterium
WRSSDTAELS

SEQ ID NO: 614806 - protein, 5 aa, Mycobacterium
WRSSG

SEQ ID NO: 614807 - protein, 5 aa, Mycobacterium
WRSSH

SEQ ID NO: 614808 - protein, 6 aa, Mycobacterium
WRSTEV

SEQ ID NO: 614809 - protein, 8 aa, Mycobacterium
WRTETGHF

SEQ ID NO: 614810 - protein, 22 aa, Mycobacterium
WRTGASDAMTQKVASVERYLSE

SEQ ID NO: 614811 - protein, 10 aa, Mycobacterium
WRTNSGPHGV

SEQ ID NO: 614812 - protein, 13 aa, Mycobacterium
WRTRTGLKSKGAR

SEQ ID NO: 614813 - protein, 7 aa, Mycobacterium
WRTTGKR

SEQ ID NO: 614814 - protein, 8 aa, Mycobacterium
WSAADPQL

SEQ ID NO: 614815 - protein, 9 aa, Mycobacterium
WSADESTAK

SEQ ID NO: 614816 - protein, 12 aa, Mycobacterium
WSADPSRPVATG

SEQ ID NO: 614817 - protein, 7 aa, Mycobacterium
WSAETRT

SEQ ID NO: 614818 - protein, 4 aa, Mycobacterium
WSAG

SEQ ID NO: 614819 - protein, 10 aa, Mycobacterium
WSAGAAPATG

SEQ ID NO: 614820 - protein, 8 aa, Mycobacterium
WSAGGGAY

SEQ ID NO: 614821 - protein, 17 aa, Mycobacterium
WSAGPTGNRLASRAGLS

SEQ ID NO: 614822 - protein, 8 aa, Mycobacterium
WSAPDAYL

SEQ ID NO: 614823 - protein, 7 aa, Mycobacterium
WSAPDPR

SEQ ID NO: 614824 - protein, 8 aa, Mycobacterium
WSAPDSAL

SEQ ID NO: 614825 - protein, 12 aa, Mycobacterium
WSAPEDGYPTGQ

SEQ ID NO: 614826 - protein, 8 aa, Mycobacterium
WSARGERL

SEQ ID NO: 614827 - protein, 11 aa, Mycobacterium
WSARPEAGARE

SEQ ID NO: 614828 - protein, 5 aa, Mycobacterium
WSATT

SEQ ID NO: 614829 - protein, 6 aa, Mycobacterium
WSDADR

SEQ ID NO: 614830 - protein, 6 aa, Mycobacterium
WSDAEN

SEQ ID NO: 614831 - protein, 12 aa, Mycobacterium
WSDDPSPAALRG

SEQ ID NO: 614832 - protein, 8 aa, Mycobacterium
WSDDSDRA

SEQ ID NO: 614833 - protein, 11 aa, Mycobacterium
WSDERGTRPLA

SEQ ID NO: 614834 - protein, 6 aa, Mycobacterium
WSDESQ

SEQ ID NO: 614835 - protein, 4 aa, Mycobacterium
WSDG

SEQ ID NO: 614836 - protein, 10 aa, Mycobacterium
WSDGADGKEV

SEQ ID NO: 614837 - protein, 21 aa, Mycobacterium
WSDGAQAAPATPAHPAGAEPR

SEQ ID NO: 614838 - protein, 15 aa, Mycobacterium
WSDGEPAERSLRSDH

SEQ ID NO: 614839 - protein, 6 aa, Mycobacterium
WSDGGA

SEQ ID NO: 614840 - protein, 8 aa, Mycobacterium
WSDNPPPL

SEQ ID NO: 614841 - protein, 9 aa, Mycobacterium
WSDPASGSH

SEQ ID NO: 614842 - protein, 5 aa, Mycobacterium
WSDPS

SEQ ID NO: 614843 - protein, 10 aa, Mycobacterium
WSDPSAGSQI

SEQ ID NO: 614844 - protein, 13 aa, Mycobacterium
WSDQVGSSGVGEE

SEQ ID NO: 614845 - protein, 6 aa, Mycobacterium
WSDRGT

SEQ ID NO: 614846 - protein, 4 aa, Mycobacterium
WSDS

SEQ ID NO: 614847 - protein, 11 aa, Mycobacterium
WSDTEDSPFEA

SEQ ID NO: 614848 - protein, 12 aa, Mycobacterium
WSEAGEPAGIGG

SEQ ID NO: 614849 - protein, 10 aa, Mycobacterium
WSEAGPDGQQ

SEQ ID NO: 614850 - protein, 12 aa, Mycobacterium
WSEARDAPVPPV

SEQ ID NO: 614851 - protein, 10 aa, Mycobacterium
WSENDTPELR

SEQ ID NO: 614852 - protein, 10 aa, Mycobacterium
WSEPGDDRDL

SEQ ID NO: 614853 - protein, 8 aa, Mycobacterium
WSEPHQSA

SEQ ID NO: 614854 - protein, 14 aa, Mycobacterium
WSERAVGTNAPGTA

SEQ ID NO: 614855 - protein, 5 aa, Mycobacterium
WSERD

SEQ ID NO: 614856 - protein, 14 aa, Mycobacterium
WSERGAGTNAPGTA

SEQ ID NO: 614857 - protein, 9 aa, Mycobacterium
WSERQNESG

SEQ ID NO: 614858 - protein, 11 aa, Mycobacterium
WSETTVGENPR

SEQ ID NO: 614859 - protein, 11 aa, Mycobacterium
WSGDGSRPRTG

SEQ ID NO: 614860 - protein, 8 aa, Mycobacterium
WSGDPGAI

SEQ ID NO: 614861 - protein, 7 aa, Mycobacterium
WSGDPKP

SEQ ID NO: 614862 - protein, 16 aa, Mycobacterium
WSGEAEPLSSRPTGWR

SEQ ID NO: 614863 - protein, 8 aa, Mycobacterium
WSGGGSPM

SEQ ID NO: 614864 - protein, 11 aa, Mycobacterium
WSGGSEPAAEI

SEQ ID NO: 614865 - protein, 14 aa, Mycobacterium
WSGGSEPGNEVNPA

SEQ ID NO: 614866 - protein, 11 aa, Mycobacterium
WSGGSEPGTEV

SEQ ID NO: 614867 - protein, 14 aa, Mycobacterium
WSGIPTKTDSDDIS

SEQ ID NO: 614868 - protein, 8 aa, Mycobacterium
WSGNRDRS

SEQ ID NO: 614869 - protein, 6 aa, Mycobacterium
WSGPAA

SEQ ID NO: 614870 - protein, 7 aa, Mycobacterium
WSGPASA

SEQ ID NO: 614871 - protein, 6 aa, Mycobacterium
WSGPKR

SEQ ID NO: 614872 - protein, 6 aa, Mycobacterium
WSGQEP

SEQ ID NO: 614873 - protein, 11 aa, Mycobacterium
WSGQGSISAQD

SEQ ID NO: 614874 - protein, 16 aa, Mycobacterium
WSGRSRQLTGDKLTER

SEQ ID NO: 614875 - protein, 7 aa, Mycobacterium
WSGSEAP

SEQ ID NO: 614876 - protein, 10 aa, Mycobacterium
WSGSGQNINP

SEQ ID NO: 614877 - protein, 7 aa, Mycobacterium
WSGSPEI

SEQ ID NO: 614878 - protein, 17 aa, Mycobacterium
WSGTPRDLNGDSPAGVD

SEQ ID NO: 614879 - protein, 11 aa, Mycobacterium
WSGYSSCGQYA

SEQ ID NO: 614880 - protein, 38 aa, Mycobacterium
WSHQGGTWGLPGGARDSHETPEQAAVREAEEEAGLSPH

SEQ ID NO: 614881 - protein, 13 aa, Mycobacterium
WSKDPQKRKPANV

SEQ ID NO: 614882 - protein, 9 aa, Mycobacterium
WSKESGEPV

SEQ ID NO: 614883 - protein, 11 aa, Mycobacterium
WSKSTGSAIAD

SEQ ID NO: 614884 - protein, 18 aa, Mycobacterium
WSLPGGRLRDDEDLTTSV

SEQ ID NO: 614885 - protein, 4 aa, Mycobacterium
WSLT

SEQ ID NO: 614886 - protein, 4 aa, Mycobacterium
WSND

SEQ ID NO: 614887 - protein, 9 aa, Mycobacterium
WSNQNRPNI

SEQ ID NO: 614888 - protein, 7 aa, Mycobacterium
WSNTGGA

SEQ ID NO: 614889 - protein, 7 aa, Mycobacterium
WSPASRT

SEQ ID NO: 614890 - protein, 5 aa, Mycobacterium
WSPDD

SEQ ID NO: 614891 - protein, 7 aa, Mycobacterium
WSPDGRP

SEQ ID NO: 614892 - protein, 5 aa, Mycobacterium
WSPDR

SEQ ID NO: 614893 - protein, 6 aa, Mycobacterium
WSPDRR

SEQ ID NO: 614894 - protein, 9 aa, Mycobacterium
WSPDTTRGR

SEQ ID NO: 614895 - protein, 10 aa, Mycobacterium
WSPESESSQE

SEQ ID NO: 614896 - protein, 5 aa, Mycobacterium
WSPET

SEQ ID NO: 614897 - protein, 5 aa, Mycobacterium
WSPGG

SEQ ID NO: 614898 - protein, 14 aa, Mycobacterium
WSPGPIDAPDPKVD

SEQ ID NO: 614899 - protein, 13 aa, Mycobacterium
WSPGPIEAPDPKV

SEQ ID NO: 614900 - protein, 9 aa, Mycobacterium
WSPGPIGAV

SEQ ID NO: 614901 - protein, 14 aa, Mycobacterium
WSPGVNEGQSATFS

SEQ ID NO: 614902 - protein, 6 aa, Mycobacterium
WSPHGK

SEQ ID NO: 614903 - protein, 16 aa, Mycobacterium
WSPKAGADDAAKTYRA

SEQ ID NO: 614904 - protein, 11 aa, Mycobacterium
WSPKDAPQKVS

SEQ ID NO: 614905 - protein, 69 aa, Mycobacterium
WSPPAGMPAGTPAATAPSAWSPPVPPAPVPSAPVAPAPLAAPAPEAPLPSPGSLGSGMPGLGGGPSGFG

SEQ ID NO: 614906 - protein, 6 aa, Mycobacterium
WSPPGR

SEQ ID NO: 614907 - protein, 18 aa, Mycobacterium
WSPPSDGWTDAGWQGRSI

SEQ ID NO: 614908 - protein, 7 aa, Mycobacterium
WSPPTPV

SEQ ID NO: 614909 - protein, 7 aa, Mycobacterium
WSPQEQR

SEQ ID NO: 614910 - protein, 15 aa, Mycobacterium
WSPQWSDEQRAEGYA

SEQ ID NO: 614911 - protein, 10 aa, Mycobacterium
WSPRSESSSE

SEQ ID NO: 614912 - protein, 15 aa, Mycobacterium
WSPSGIATPVEGGYK

SEQ ID NO: 614913 - protein, 13 aa, Mycobacterium
WSPSQERFDGFVE

SEQ ID NO: 614914 - protein, 12 aa, Mycobacterium
WSQASNDPNRAA

SEQ ID NO: 614915 - protein, 7 aa, Mycobacterium
WSQPPPP

SEQ ID NO: 614916 - protein, 9 aa, Mycobacterium
WSQPPWRPD

SEQ ID NO: 614917 - protein, 11 aa, Mycobacterium
WSQQEDAYNPA

SEQ ID NO: 614918 - protein, 7 aa, Mycobacterium
WSQQRGT

SEQ ID NO: 614919 - protein, 18 aa, Mycobacterium
WSRARAAGEIRPDASGGG

SEQ ID NO: 614920 - protein, 5 aa, Mycobacterium
WSRGG

SEQ ID NO: 614921 - protein, 6 aa, Mycobacterium
WSRGKG

SEQ ID NO: 614922 - protein, 4 aa, Mycobacterium
WSRP

SEQ ID NO: 614923 - protein, 8 aa, Mycobacterium
WSRPDGEC

SEQ ID NO: 614924 - protein, 6 aa, Mycobacterium
WSRPEA

SEQ ID NO: 614925 - protein, 7 aa, Mycobacterium
WSRPGGE

SEQ ID NO: 614926 - protein, 21 aa, Mycobacterium
WSRPRAPRSQSLQSCVRTFQP

SEQ ID NO: 614927 - protein, 4 aa, Mycobacterium
WSRR

SEQ ID NO: 614928 - protein, 13 aa, Mycobacterium
WSRSDRTSKTVAA

SEQ ID NO: 614929 - protein, 4 aa, Mycobacterium
WSSA

SEQ ID NO: 614930 - protein, 6 aa, Mycobacterium
WSSATD

SEQ ID NO: 614931 - protein, 7 aa, Mycobacterium
WSSATSN

SEQ ID NO: 614932 - protein, 7 aa, Mycobacterium
WSSDDGG

SEQ ID NO: 614933 - protein, 15 aa, Mycobacterium
WSSDPQRPVATGPNP

SEQ ID NO: 614934 - protein, 4 aa, Mycobacterium
WSSE

SEQ ID NO: 614935 - protein, 5 aa, Mycobacterium
WSSED

SEQ ID NO: 614936 - protein, 7 aa, Mycobacterium
WSSEETC

SEQ ID NO: 614937 - protein, 7 aa, Mycobacterium
WSSLSDE

SEQ ID NO: 614938 - protein, 8 aa, Mycobacterium
WSSPHQSA

SEQ ID NO: 614939 - protein, 7 aa, Mycobacterium
WSSQGVR

SEQ ID NO: 614940 - protein, 6 aa, Mycobacterium
WSSRGS

SEQ ID NO: 614941 - protein, 8 aa, Mycobacterium
WSSTADSL

SEQ ID NO: 614942 - protein, 7 aa, Mycobacterium
WSSTGDQ

SEQ ID NO: 614943 - protein, 6 aa, Mycobacterium
WSSTGN

SEQ ID NO: 614944 - protein, 18 aa, Mycobacterium
WSSTKYLSESALTARWIT

SEQ ID NO: 614945 - protein, 6 aa, Mycobacterium
WSSTRG

SEQ ID NO: 614946 - protein, 5 aa, Mycobacterium
WSSTS

SEQ ID NO: 614947 - protein, 7 aa, Mycobacterium
WSTADAR

SEQ ID NO: 614948 - protein, 7 aa, Mycobacterium
WSTDNDV

SEQ ID NO: 614949 - protein, 9 aa, Mycobacterium
WSTDPRARV

SEQ ID NO: 614950 - protein, 8 aa, Mycobacterium
WSTDPRSR

SEQ ID NO: 614951 - protein, 11 aa, Mycobacterium
WSTDPRSRVPA

SEQ ID NO: 614952 - protein, 10 aa, Mycobacterium
WSTGGPSAIR

SEQ ID NO: 614953 - protein, 23 aa, Mycobacterium
WSTGGQLPNFAPSDDAGRASRVY

SEQ ID NO: 614954 - protein, 11 aa, Mycobacterium
WSTGRAPDDPK

SEQ ID NO: 614955 - protein, 17 aa, Mycobacterium
WSTGSSIMPQKKNPDIA

SEQ ID NO: 614956 - protein, 10 aa, Mycobacterium
WSTGTNGQDV

SEQ ID NO: 614957 - protein, 12 aa, Mycobacterium
WSTPEPTRAAAL

SEQ ID NO: 614958 - protein, 5 aa, Mycobacterium
WSTQD

SEQ ID NO: 614959 - protein, 8 aa, Mycobacterium
WSTRSTQL

SEQ ID NO: 614960 - protein, 4 aa, Mycobacterium
WSTT

SEQ ID NO: 614961 - protein, 4 aa, Mycobacterium
WTAE

SEQ ID NO: 614962 - protein, 7 aa, Mycobacterium
WTAGDSL

SEQ ID NO: 614963 - protein, 8 aa, Mycobacterium
WTASTTTL

SEQ ID NO: 614964 - protein, 8 aa, Mycobacterium
WTAYPDTA

SEQ ID NO: 614965 - protein, 6 aa, Mycobacterium
WTDARA

SEQ ID NO: 614966 - protein, 10 aa, Mycobacterium
WTDEHGTRPL

SEQ ID NO: 614967 - protein, 12 aa, Mycobacterium
WTDERGTRPLTA

SEQ ID NO: 614968 - protein, 12 aa, Mycobacterium
WTDESGTRPLEQ

SEQ ID NO: 614969 - protein, 6 aa, Mycobacterium
WTDEVQ

SEQ ID NO: 614970 - protein, 11 aa, Mycobacterium
WTDGGQPAGIG

SEQ ID NO: 614971 - protein, 5 aa, Mycobacterium
WTDGP

SEQ ID NO: 614972 - protein, 15 aa, Mycobacterium
WTDGTGPPETNHAHH

SEQ ID NO: 614973 - protein, 5 aa, Mycobacterium
WTDPD

SEQ ID NO: 614974 - protein, 6 aa, Mycobacterium
WTDPDC

SEQ ID NO: 614975 - protein, 6 aa, Mycobacterium
WTDPET

SEQ ID NO: 614976 - protein, 10 aa, Mycobacterium
WTDQVSHQGQ

SEQ ID NO: 614977 - protein, 12 aa, Mycobacterium
WTDRTIPIVVCE

SEQ ID NO: 614978 - protein, 9 aa, Mycobacterium
WTDSEQRSW

SEQ ID NO: 614979 - protein, 6 aa, Mycobacterium
WTDSPE

SEQ ID NO: 614980 - protein, 4 aa, Mycobacterium
WTED

SEQ ID NO: 614981 - protein, 11 aa, Mycobacterium
WTEDGRPAGIG

SEQ ID NO: 614982 - protein, 13 aa, Mycobacterium
WTEDGRPAGIGGA

SEQ ID NO: 614983 - protein, 12 aa, Mycobacterium
WTEGNEPGGIGG

SEQ ID NO: 614984 - protein, 9 aa, Mycobacterium
WTENGQRTA

SEQ ID NO: 614985 - protein, 18 aa, Mycobacterium
WTENYPDLGTAPVDYTDS

SEQ ID NO: 614986 - protein, 18 aa, Mycobacterium
WTENYPDLGTEPVDYTDS

SEQ ID NO: 614987 - protein, 4 aa, Mycobacterium
WTEP

SEQ ID NO: 614988 - protein, 7 aa, Mycobacterium
WTEPSTD

SEQ ID NO: 614989 - protein, 5 aa, Mycobacterium
WTERS

SEQ ID NO: 614990 - protein, 12 aa, Mycobacterium
WTETGEAAGIGG

SEQ ID NO: 614991 - protein, 10 aa, Mycobacterium
WTETGPDGSR

SEQ ID NO: 614992 - protein, 11 aa, Mycobacterium
WTGDGRSAGIG

SEQ ID NO: 614993 - protein, 9 aa, Mycobacterium
WTGDSAKLY

SEQ ID NO: 614994 - protein, 26 aa, Mycobacterium
WTGEGAEAAKQGISDYKSHAEKVSDG

SEQ ID NO: 614995 - protein, 14 aa, Mycobacterium
WTGEPGPAPAAHAA

SEQ ID NO: 614996 - protein, 8 aa, Mycobacterium
WTGHEGAE

SEQ ID NO: 614997 - protein, 9 aa, Mycobacterium
WTGKSTRLA

SEQ ID NO: 614998 - protein, 6 aa, Mycobacterium
WTGNGG

SEQ ID NO: 614999 - protein, 8 aa, Mycobacterium
WTGPGGDA

SEQ ID NO: 615000 - protein, 6 aa, Mycobacterium
WTGRSV

SEQ ID NO: 615001 - protein, 14 aa, Mycobacterium
WTGSDAPMRSLGSS

SEQ ID NO: 615002 - protein, 7 aa, Mycobacterium
WTGSEET

SEQ ID NO: 615003 - protein, 15 aa, Mycobacterium
WTHPPAPPARPRRSC

SEQ ID NO: 615004 - protein, 20 aa, Mycobacterium
WTHSGATQAPCANGASVPAT

SEQ ID NO: 615005 - protein, 10 aa, Mycobacterium
WTKSTGADRL

SEQ ID NO: 615006 - protein, 8 aa, Mycobacterium
WTNKTAPS

SEQ ID NO: 615007 - protein, 4 aa, Mycobacterium
WTNP

SEQ ID NO: 615008 - protein, 10 aa, Mycobacterium
WTNPDCGRAG

SEQ ID NO: 615009 - protein, 10 aa, Mycobacterium
WTNPQARRAG

SEQ ID NO: 615010 - protein, 5 aa, Mycobacterium
WTPAY

SEQ ID NO: 615011 - protein, 15 aa, Mycobacterium
WTPAYDSDGGIRDGA

SEQ ID NO: 615012 - protein, 7 aa, Mycobacterium
WTPDDYA

SEQ ID NO: 615013 - protein, 8 aa, Mycobacterium
WTPDGPHD

SEQ ID NO: 615014 - protein, 12 aa, Mycobacterium
WTPESDTEVEPV

SEQ ID NO: 615015 - protein, 16 aa, Mycobacterium
WTPGEHNGTFRGNNPA

SEQ ID NO: 615016 - protein, 8 aa, Mycobacterium
WTPKPTEG

SEQ ID NO: 615017 - protein, 7 aa, Mycobacterium
WTPPNAV

SEQ ID NO: 615018 - protein, 6 aa, Mycobacterium
WTPPRN

SEQ ID NO: 615019 - protein, 12 aa, Mycobacterium
WTPPSIKPPAPW

SEQ ID NO: 615020 - protein, 7 aa, Mycobacterium
WTPPSLQ

SEQ ID NO: 615021 - protein, 7 aa, Mycobacterium
WTPPVTA

SEQ ID NO: 615022 - protein, 14 aa, Mycobacterium
WTPQQEVRGRIDRT

SEQ ID NO: 615023 - protein, 6 aa, Mycobacterium
WTPQWT

SEQ ID NO: 615024 - protein, 7 aa, Mycobacterium
WTPSYQR

SEQ ID NO: 615025 - protein, 6 aa, Mycobacterium
WTPTRE

SEQ ID NO: 615026 - protein, 10 aa, Mycobacterium
WTPVGKADGC

SEQ ID NO: 615027 - protein, 4 aa, Mycobacterium
WTQA

SEQ ID NO: 615028 - protein, 12 aa, Mycobacterium
WTQGDQDAADAR

SEQ ID NO: 615029 - protein, 21 aa, Mycobacterium
WTQNYPELGTAPVDYTDSIDP

SEQ ID NO: 615030 - protein, 4 aa, Mycobacterium
WTRE

SEQ ID NO: 615031 - protein, 6 aa, Mycobacterium
WTREQA

SEQ ID NO: 615032 - protein, 9 aa, Mycobacterium
WTRETAEQQ

SEQ ID NO: 615033 - protein, 8 aa, Mycobacterium
WTRGDGRR

SEQ ID NO: 615034 - protein, 8 aa, Mycobacterium
WTRGNARA

SEQ ID NO: 615035 - protein, 6 aa, Mycobacterium
WTRNPD

SEQ ID NO: 615036 - protein, 5 aa, Mycobacterium
WTRPE

SEQ ID NO: 615037 - protein, 21 aa, Mycobacterium
WTRPERRPKGTTTPDAPARPV

SEQ ID NO: 615038 - protein, 9 aa, Mycobacterium
WTRPSSAGR

SEQ ID NO: 615039 - protein, 12 aa, Mycobacterium
WTRTRPSELGHP

SEQ ID NO: 615040 - protein, 7 aa, Mycobacterium
WTSASDS

SEQ ID NO: 615041 - protein, 11 aa, Mycobacterium
WTSPEAIETRS

SEQ ID NO: 615042 - protein, 8 aa, Mycobacterium
WTSPYDAT

SEQ ID NO: 615043 - protein, 8 aa, Mycobacterium
WTSRPGGG

SEQ ID NO: 615044 - protein, 7 aa, Mycobacterium
WTSTRTP

SEQ ID NO: 615045 - protein, 11 aa, Mycobacterium
WTTGQLDGEIE

SEQ ID NO: 615046 - protein, 11 aa, Mycobacterium
WTTGSARTATE

SEQ ID NO: 615047 - protein, 5 aa, Mycobacterium
WTTPE

SEQ ID NO: 615048 - protein, 11 aa, Mycobacterium
WTTPEGDADPL

SEQ ID NO: 615049 - protein, 12 aa, Mycobacterium
WTTRKRANGDTD

SEQ ID NO: 615050 - protein, 12 aa, Mycobacterium
WTTRKRPNGDTD

SEQ ID NO: 615051 - protein, 4 aa, Mycobacterium
WTTS

SEQ ID NO: 615052 - protein, 17 aa, Mycobacterium
WVPGAANQRAQPLPSVG

SEQ ID NO: 615053 - protein, 4 aa, Mycobacterium
WVPT

SEQ ID NO: 615054 - protein, 13 aa, Mycobacterium
WVTGEDRRIAPSA

SEQ ID NO: 615055 - protein, 7 aa, Mycobacterium
WYPGEPL

SEQ ID NO: 615056 - protein, 4 aa, Mycobacterium
WYST

SEQ ID NO: 615057 - protein, 4 aa, Mycobacterium
YAAA

SEQ ID NO: 615058 - protein, 7 aa, Mycobacterium
YAAAAES

SEQ ID NO: 615059 - protein, 10 aa, Mycobacterium
YAAAEANRSV

SEQ ID NO: 615060 - protein, 12 aa, Mycobacterium
YAAAGGAEAALD

SEQ ID NO: 615061 - protein, 6 aa, Mycobacterium
YAAAGT

SEQ ID NO: 615062 - protein, 14 aa, Mycobacterium
YAAAPGLAPYNATK

SEQ ID NO: 615063 - protein, 8 aa, Mycobacterium
YAAASGAF

SEQ ID NO: 615064 - protein, 13 aa, Mycobacterium
YAAATSKTQGLIF

SEQ ID NO: 615065 - protein, 16 aa, Mycobacterium
YAAATSRRVAAEAGVK

SEQ ID NO: 615066 - protein, 16 aa, Mycobacterium
YAAATSRRVANEAGVK

SEQ ID NO: 615067 - protein, 23 aa, Mycobacterium
YAADADQLSATTYDQGTYSSGPQ

SEQ ID NO: 615068 - protein, 8 aa, Mycobacterium
YAADATGL

SEQ ID NO: 615069 - protein, 10 aa, Mycobacterium
YAADDDERTV

SEQ ID NO: 615070 - protein, 14 aa, Mycobacterium
YAADPEADQQSGTG

SEQ ID NO: 615071 - protein, 5 aa, Mycobacterium
YAAEG

SEQ ID NO: 615072 - protein, 6 aa, Mycobacterium
YAAEGE

SEQ ID NO: 615073 - protein, 7 aa, Mycobacterium
YAAEPGA

SEQ ID NO: 615074 - protein, 5 aa, Mycobacterium
YAAER

SEQ ID NO: 615075 - protein, 15 aa, Mycobacterium
YAAERAKRLRPEGAD

SEQ ID NO: 615076 - protein, 7 aa, Mycobacterium
YAAERGL

SEQ ID NO: 615077 - protein, 9 aa, Mycobacterium
YAAERGLTN

SEQ ID NO: 615078 - protein, 9 aa, Mycobacterium
YAAESEAGR

SEQ ID NO: 615079 - protein, 4 aa, Mycobacterium
YAAG

SEQ ID NO: 615080 - protein, 8 aa, Mycobacterium
YAAGGQGL

SEQ ID NO: 615081 - protein, 15 aa, Mycobacterium
YAAGRETPEPVRHPH

SEQ ID NO: 615082 - protein, 10 aa, Mycobacterium
YAAKGEDPDF

SEQ ID NO: 615083 - protein, 15 aa, Mycobacterium
YAAKRSLPQQLRAMV

SEQ ID NO: 615084 - protein, 8 aa, Mycobacterium
YAAKTKPN

SEQ ID NO: 615085 - protein, 7 aa, Mycobacterium
YAANPER

SEQ ID NO: 615086 - protein, 9 aa, Mycobacterium
YAANRNASV

SEQ ID NO: 615087 - protein, 10 aa, Mycobacterium
YAANRNSSVA

SEQ ID NO: 615088 - protein, 12 aa, Mycobacterium
YAANRQAGSAVG

SEQ ID NO: 615089 - protein, 26 aa, Mycobacterium
YAAPAPAPEAAETDSPDTPSDRPGTS

SEQ ID NO: 615090 - protein, 62 aa, Mycobacterium
YAAPEREVRRDRERRGRRSDLRRRPPRRGHGLPGAQRTHRRDRRAGRSPARRQARSGRAEPL

SEQ ID NO: 615091 - protein, 8 aa, Mycobacterium
YAAPGGDA

SEQ ID NO: 615092 - protein, 8 aa, Mycobacterium
YAAPKSAG

SEQ ID NO: 615093 - protein, 6 aa, Mycobacterium
YAAPQH

SEQ ID NO: 615094 - protein, 12 aa, Mycobacterium
YAAQPTQDVNHQ

SEQ ID NO: 615095 - protein, 9 aa, Mycobacterium
YAAQTAFDS

SEQ ID NO: 615096 - protein, 8 aa, Mycobacterium
YAARDSGI

SEQ ID NO: 615097 - protein, 11 aa, Mycobacterium
YAARGEDPDFH

SEQ ID NO: 615098 - protein, 12 aa, Mycobacterium
YAARGGGPDQLR

SEQ ID NO: 615099 - protein, 13 aa, Mycobacterium
YAARHGDAERLGS

SEQ ID NO: 615100 - protein, 11 aa, Mycobacterium
YAARNGGPEQL

SEQ ID NO: 615101 - protein, 14 aa, Mycobacterium
YAARSQERAAAAWS

SEQ ID NO: 615102 - protein, 16 aa, Mycobacterium
YAARSQERAAAAWSGG

SEQ ID NO: 615103 - protein, 12 aa, Mycobacterium
YAASDEAAPPRA

SEQ ID NO: 615104 - protein, 16 aa, Mycobacterium
YAASGDAQVDETAAEV

SEQ ID NO: 615105 - protein, 12 aa, Mycobacterium
YAASGTADVGTN

SEQ ID NO: 615106 - protein, 12 aa, Mycobacterium
YAASGTAEVGRN

SEQ ID NO: 615107 - protein, 12 aa, Mycobacterium
YAASGTPDVGAN

SEQ ID NO: 615108 - protein, 14 aa, Mycobacterium
YAASPGLAPYNASK

SEQ ID NO: 615109 - protein, 14 aa, Mycobacterium
YAASSGARLTRTDL

SEQ ID NO: 615110 - protein, 4 aa, Mycobacterium
YAAT

SEQ ID NO: 615111 - protein, 7 aa, Mycobacterium
YAATATG

SEQ ID NO: 615112 - protein, 12 aa, Mycobacterium
YAATEAANSVLV

SEQ ID NO: 615113 - protein, 10 aa, Mycobacterium
YAATEGDPPL

SEQ ID NO: 615114 - protein, 10 aa, Mycobacterium
YAATPDDAYE

SEQ ID NO: 615115 - protein, 11 aa, Mycobacterium
YAATRSAGGAV

SEQ ID NO: 615116 - protein, 5 aa, Mycobacterium
YAATT

SEQ ID NO: 615117 - protein, 7 aa, Mycobacterium
YAATTGT

SEQ ID NO: 615118 - protein, 8 aa, Mycobacterium
YAATTRFG

SEQ ID NO: 615119 - protein, 4 aa, Mycobacterium
YAAY

SEQ ID NO: 615120 - protein, 12 aa, Mycobacterium
YADAPDGAEIPR

SEQ ID NO: 615121 - protein, 6 aa, Mycobacterium
YADDGT

SEQ ID NO: 615122 - protein, 11 aa, Mycobacterium
YADDPEPFTAA

SEQ ID NO: 615123 - protein, 5 aa, Mycobacterium
YADED

SEQ ID NO: 615124 - protein, 9 aa, Mycobacterium
YADEDQQSM

SEQ ID NO: 615125 - protein, 8 aa, Mycobacterium
YADEPERF

SEQ ID NO: 615126 - protein, 9 aa, Mycobacterium
YADEPERFT

SEQ ID NO: 615127 - protein, 8 aa, Mycobacterium
YADESDYD

SEQ ID NO: 615128 - protein, 7 aa, Mycobacterium
YADETPR

SEQ ID NO: 615129 - protein, 10 aa, Mycobacterium
YADGAGPGYL

SEQ ID NO: 615130 - protein, 8 aa, Mycobacterium
YADGASER

SEQ ID NO: 615131 - protein, 24 aa, Mycobacterium
YADGLRGKPLAATPKFEGDPAPVH

SEQ ID NO: 615132 - protein, 8 aa, Mycobacterium
YADGPDER

SEQ ID NO: 615133 - protein, 9 aa, Mycobacterium
YADGRVSGT

SEQ ID NO: 615134 - protein, 8 aa, Mycobacterium
YADGSAER

SEQ ID NO: 615135 - protein, 8 aa, Mycobacterium
YADGSQAW

SEQ ID NO: 615136 - protein, 8 aa, Mycobacterium
YADGSRDR

SEQ ID NO: 615137 - protein, 16 aa, Mycobacterium
YADGTGSAGGTGAYQG

SEQ ID NO: 615138 - protein, 9 aa, Mycobacterium
YADGTTREV

SEQ ID NO: 615139 - protein, 7 aa, Mycobacterium
YADHEAA

SEQ ID NO: 615140 - protein, 4 aa, Mycobacterium
YADN

SEQ ID NO: 615141 - protein, 6 aa, Mycobacterium
YADNGA

SEQ ID NO: 615142 - protein, 4 aa, Mycobacterium
YADP

SEQ ID NO: 615143 - protein, 5 aa, Mycobacterium
YADPA

SEQ ID NO: 615144 - protein, 17 aa, Mycobacterium
YADPAPEDFGNYQTFCG

SEQ ID NO: 615145 - protein, 11 aa, Mycobacterium
YADPERTAEAF

SEQ ID NO: 615146 - protein, 6 aa, Mycobacterium
YADPGS

SEQ ID NO: 615147 - protein, 11 aa, Mycobacterium
YADPQTAAQLG

SEQ ID NO: 615148 - protein, 13 aa, Mycobacterium
YADPQTAAQLGEP

SEQ ID NO: 615149 - protein, 10 aa, Mycobacterium
YADPRPAGPL

SEQ ID NO: 615150 - protein, 15 aa, Mycobacterium
YADPSGMGKSPQFVS

SEQ ID NO: 615151 - protein, 21 aa, Mycobacterium
YADPSVGGSSGGRQPTGPDGS

SEQ ID NO: 615152 - protein, 17 aa, Mycobacterium
YADQKARIAEAGRNPSA

SEQ ID NO: 615153 - protein, 7 aa, Mycobacterium
YADQTDE

SEQ ID NO: 615154 - protein, 4 aa, Mycobacterium
YADR

SEQ ID NO: 615155 - protein, 7 aa, Mycobacterium
YADRARE

SEQ ID NO: 615156 - protein, 16 aa, Mycobacterium
YADRRADTLSGGQQQR

SEQ ID NO: 615157 - protein, 16 aa, Mycobacterium
YADRTGSAGGTGAYAG

SEQ ID NO: 615158 - protein, 17 aa, Mycobacterium
YADRTGSAGGTGAYKGT

SEQ ID NO: 615159 - protein, 9 aa, Mycobacterium
YADSGRPVA

SEQ ID NO: 615160 - protein, 9 aa, Mycobacterium
YADSPDYHR

SEQ ID NO: 615161 - protein, 4 aa, Mycobacterium
YADT

SEQ ID NO: 615162 - protein, 11 aa, Mycobacterium
YADTAGAARTA

SEQ ID NO: 615163 - protein, 5 aa, Mycobacterium
YADTG

SEQ ID NO: 615164 - protein, 6 aa, Mycobacterium
YADTVG

SEQ ID NO: 615165 - protein, 4 aa, Mycobacterium
YADV

SEQ ID NO: 615166 - protein, 7 aa, Mycobacterium
YADYDQA

SEQ ID NO: 615167 - protein, 4 aa, Mycobacterium
YAEA

SEQ ID NO: 615168 - protein, 13 aa, Mycobacterium
YAEAARNAKAAGF

SEQ ID NO: 615169 - protein, 11 aa, Mycobacterium
YAEAARNAVEA

SEQ ID NO: 615170 - protein, 7 aa, Mycobacterium
YAEAEKD

SEQ ID NO: 615171 - protein, 8 aa, Mycobacterium
YAEAENDD

SEQ ID NO: 615172 - protein, 8 aa, Mycobacterium
YAEAESDD

SEQ ID NO: 615173 - protein, 13 aa, Mycobacterium
YAEASPQRNEPAY

SEQ ID NO: 615174 - protein, 5 aa, Mycobacterium
YAEDD

SEQ ID NO: 615175 - protein, 5 aa, Mycobacterium
YAEDM

SEQ ID NO: 615176 - protein, 7 aa, Mycobacterium
YAEEAGI

SEQ ID NO: 615177 - protein, 13 aa, Mycobacterium
YAEERTKRLRPDG

SEQ ID NO: 615178 - protein, 10 aa, Mycobacterium
YAEETVDQYG

SEQ ID NO: 615179 - protein, 6 aa, Mycobacterium
YAEGAR

SEQ ID NO: 615180 - protein, 9 aa, Mycobacterium
YAEGDDDEL

SEQ ID NO: 615181 - protein, 22 aa, Mycobacterium
YAEGGLARQSVDDSTSPPVPPN

SEQ ID NO: 615182 - protein, 16 aa, Mycobacterium
YAEGKGFGSTEAARGA

SEQ ID NO: 615183 - protein, 9 aa, Mycobacterium
YAEGQVQNS

SEQ ID NO: 615184 - protein, 10 aa, Mycobacterium
YAEGRLPRER

SEQ ID NO: 615185 - protein, 7 aa, Mycobacterium
YAEGSDV

SEQ ID NO: 615186 - protein, 17 aa, Mycobacterium
YAEGSSSAGGGSPYEGT

SEQ ID NO: 615187 - protein, 16 aa, Mycobacterium
YAEGSSSSGAEGGYRG

SEQ ID NO: 615188 - protein, 6 aa, Mycobacterium
YAEGTV

SEQ ID NO: 615189 - protein, 8 aa, Mycobacterium
YAEHDGKP

SEQ ID NO: 615190 - protein, 14 aa, Mycobacterium
YAEKKGIDDPDSVP

SEQ ID NO: 615191 - protein, 8 aa, Mycobacterium
YAEKTGVD

SEQ ID NO: 615192 - protein, 4 aa, Mycobacterium
YAEN

SEQ ID NO: 615193 - protein, 10 aa, Mycobacterium
YAEPDKGAEA

SEQ ID NO: 615194 - protein, 6 aa, Mycobacterium
YAEPPV

SEQ ID NO: 615195 - protein, 10 aa, Mycobacterium
YAEPQAAQRN

SEQ ID NO: 615196 - protein, 10 aa, Mycobacterium
YAEPQAARRN

SEQ ID NO: 615197 - protein, 5 aa, Mycobacterium
YAEQP

SEQ ID NO: 615198 - protein, 12 aa, Mycobacterium
YAEQTGARRAGM

SEQ ID NO: 615199 - protein, 7 aa, Mycobacterium
YAERAGA

SEQ ID NO: 615200 - protein, 9 aa, Mycobacterium
YAESASGEV

SEQ ID NO: 615201 - protein, 10 aa, Mycobacterium
YAESEQEADQ

SEQ ID NO: 615202 - protein, 27 aa, Mycobacterium
YAESGGQIADEGTISGTGAGESARAAV

SEQ ID NO: 615203 - protein, 29 aa, Mycobacterium
YAESGGQIADEGTVTGTGASQTAKAAVTD

SEQ ID NO: 615204 - protein, 14 aa, Mycobacterium
YAESGGRKSSNARR

SEQ ID NO: 615205 - protein, 6 aa, Mycobacterium
YAESGV

SEQ ID NO: 615206 - protein, 14 aa, Mycobacterium
YAESSTPPHRSQAS

SEQ ID NO: 615207 - protein, 9 aa, Mycobacterium
YAETAEEAD

SEQ ID NO: 615208 - protein, 7 aa, Mycobacterium
YAETGKP

SEQ ID NO: 615209 - protein, 5 aa, Mycobacterium
YAETH

SEQ ID NO: 615210 - protein, 11 aa, Mycobacterium
YAETTQDLPLP

SEQ ID NO: 615211 - protein, 4 aa, Mycobacterium
YAGA

SEQ ID NO: 615212 - protein, 14 aa, Mycobacterium
YAGAADGTGFSEGG

SEQ ID NO: 615213 - protein, 16 aa, Mycobacterium
YAGAADGVGWSEGGAV

SEQ ID NO: 615214 - protein, 9 aa, Mycobacterium
YAGADPPVS

SEQ ID NO: 615215 - protein, 30 aa, Mycobacterium
YAGAGAGDELNDLSDSRTERASRGGISTPV

SEQ ID NO: 615216 - protein, 9 aa, Mycobacterium
YAGAGGPSL

SEQ ID NO: 615217 - protein, 6 aa, Mycobacterium
YAGAGI

SEQ ID NO: 615218 - protein, 8 aa, Mycobacterium
YAGAGSGS

SEQ ID NO: 615219 - protein, 6 aa, Mycobacterium
YAGAHD

SEQ ID NO: 615220 - protein, 10 aa, Mycobacterium
YAGARGVRQA

SEQ ID NO: 615221 - protein, 5 aa, Mycobacterium
YAGAT

SEQ ID NO: 615222 - protein, 4 aa, Mycobacterium
YAGD

SEQ ID NO: 615223 - protein, 12 aa, Mycobacterium
YAGDGDGAGTAD

SEQ ID NO: 615224 - protein, 5 aa, Mycobacterium
YAGDP

SEQ ID NO: 615225 - protein, 5 aa, Mycobacterium
YAGDT

SEQ ID NO: 615226 - protein, 8 aa, Mycobacterium
YAGEGAGS

SEQ ID NO: 615227 - protein, 7 aa, Mycobacterium
YAGESVK

SEQ ID NO: 615228 - protein, 20 aa, Mycobacterium
YAGFPNANTAMKVAKGVLEG

SEQ ID NO: 615229 - protein, 4 aa, Mycobacterium
YAGG

SEQ ID NO: 615230 - protein, 118 aa, Mycobacterium
YAGGGGGGGAGGHGGNGGGNGALGGQGGTGGTGGTGGTASSSNTGPTPSAGTGGGGTGGGGGGGASASGAVGGTGGGGGGGGAGAAAGTGAVGGGGGGGGAAGGAGGTAGNGGAGGNA

SEQ ID NO: 615231 - protein, 11 aa, Mycobacterium
YAGGGSGSLRA

SEQ ID NO: 615232 - protein, 23 aa, Mycobacterium
YAGGLNGKKLEAQPKSEGDGTGV

SEQ ID NO: 615233 - protein, 5 aa, Mycobacterium
YAGGM

SEQ ID NO: 615234 - protein, 13 aa, Mycobacterium
YAGGQAQARSQSS

SEQ ID NO: 615235 - protein, 34 aa, Mycobacterium
YAGGYGGGQGGSGGGGGQGGGFGGASAGGSLGAQ

SEQ ID NO: 615236 - protein, 15 aa, Mycobacterium
YAGITRSGSYGRRPR

SEQ ID NO: 615237 - protein, 4 aa, Mycobacterium
YAGK

SEQ ID NO: 615238 - protein, 7 aa, Mycobacterium
YAGLGTP

SEQ ID NO: 615239 - protein, 14 aa, Mycobacterium
YAGLPTASGSRSLM

SEQ ID NO: 615240 - protein, 9 aa, Mycobacterium
YAGNGTVAS

SEQ ID NO: 615241 - protein, 17 aa, Mycobacterium
YAGPAPEDFGAYRTYCG

SEQ ID NO: 615242 - protein, 8 aa, Mycobacterium
YAGPAQRD

SEQ ID NO: 615243 - protein, 20 aa, Mycobacterium
YAGPDAPPTQMQGAPQRPEH

SEQ ID NO: 615244 - protein, 10 aa, Mycobacterium
YAGPDQRDAL

SEQ ID NO: 615245 - protein, 10 aa, Mycobacterium
YAGPDQRDKL

SEQ ID NO: 615246 - protein, 10 aa, Mycobacterium
YAGPDQRDTL

SEQ ID NO: 615247 - protein, 12 aa, Mycobacterium
YAGPGAAPLSAA

SEQ ID NO: 615248 - protein, 7 aa, Mycobacterium
YAGPGAG

SEQ ID NO: 615249 - protein, 10 aa, Mycobacterium
YAGPGATIGP

SEQ ID NO: 615250 - protein, 9 aa, Mycobacterium
YAGPGATSL

SEQ ID NO: 615251 - protein, 8 aa, Mycobacterium
YAGPGDDA

SEQ ID NO: 615252 - protein, 9 aa, Mycobacterium
YAGPGPGPM

SEQ ID NO: 615253 - protein, 14 aa, Mycobacterium
YAGPGSAPMSAAAS

SEQ ID NO: 615254 - protein, 8 aa, Mycobacterium
YAGPGSGP

SEQ ID NO: 615255 - protein, 9 aa, Mycobacterium
YAGPGSGPV

SEQ ID NO: 615256 - protein, 9 aa, Mycobacterium
YAGPGSGSL

SEQ ID NO: 615257 - protein, 9 aa, Mycobacterium
YAGPGSGSM

SEQ ID NO: 615258 - protein, 18 aa, Mycobacterium
YAGPNQKTFGHGGSGGSY

SEQ ID NO: 615259 - protein, 5 aa, Mycobacterium
YAGPP

SEQ ID NO: 615260 - protein, 8 aa, Mycobacterium
YAGPTDDA

SEQ ID NO: 615261 - protein, 7 aa, Mycobacterium
YAGQTGG

SEQ ID NO: 615262 - protein, 11 aa, Mycobacterium
YAGQVNASDTV

SEQ ID NO: 615263 - protein, 15 aa, Mycobacterium
YAGRGYGDLKKDTAE

SEQ ID NO: 615264 - protein, 16 aa, Mycobacterium
YAGRGYGDLKKDTAEA

SEQ ID NO: 615265 - protein, 9 aa, Mycobacterium
YAGRREESE

SEQ ID NO: 615266 - protein, 7 aa, Mycobacterium
YAGSPRR

SEQ ID NO: 615267 - protein, 10 aa, Mycobacterium
YAGSRDRHGN

SEQ ID NO: 615268 - protein, 11 aa, Mycobacterium
YAGSTSKTLAP

SEQ ID NO: 615269 - protein, 4 aa, Mycobacterium
YAGT

SEQ ID NO: 615270 - protein, 6 aa, Mycobacterium
YAGTAP

SEQ ID NO: 615271 - protein, 26 aa, Mycobacterium
YAGTDTWPTTAGTGQPPTGQTGTTTK

SEQ ID NO: 615272 - protein, 8 aa, Mycobacterium
YAGTEDDA

SEQ ID NO: 615273 - protein, 5 aa, Mycobacterium
YAGTM

SEQ ID NO: 615274 - protein, 8 aa, Mycobacterium
YAGTNSPI

SEQ ID NO: 615275 - protein, 8 aa, Mycobacterium
YAGTPEGL

SEQ ID NO: 615276 - protein, 7 aa, Mycobacterium
YAGTPIN

SEQ ID NO: 615277 - protein, 18 aa, Mycobacterium
YAGTPPPVRAHQPPVFTP

SEQ ID NO: 615278 - protein, 6 aa, Mycobacterium
YAGTRP

SEQ ID NO: 615279 - protein, 44 aa, Mycobacterium
YAGTSAAASELTPFTSPPPTTTAAEPLTAAATPAAQAAAAPAAG

SEQ ID NO: 615280 - protein, 11 aa, Mycobacterium
YAGTSAAATDL

SEQ ID NO: 615281 - protein, 9 aa, Mycobacterium
YAGTTTPRI

SEQ ID NO: 615282 - protein, 10 aa, Mycobacterium
YAGTTTTRVA

SEQ ID NO: 615283 - protein, 12 aa, Mycobacterium
YAGVHDDPATES

SEQ ID NO: 615284 - protein, 4 aa, Mycobacterium
YAHA

SEQ ID NO: 615285 - protein, 9 aa, Mycobacterium
YAHDAGAGE

SEQ ID NO: 615286 - protein, 14 aa, Mycobacterium
YAHERDAAARTARL

SEQ ID NO: 615287 - protein, 7 aa, Mycobacterium
YAHNPQY

SEQ ID NO: 615288 - protein, 4 aa, Mycobacterium
YAHP

SEQ ID NO: 615289 - protein, 10 aa, Mycobacterium
YAISNEEGEV

SEQ ID NO: 615290 - protein, 4 aa, Mycobacterium
YAKA

SEQ ID NO: 615291 - protein, 9 aa, Mycobacterium
YAKDSIGNF

SEQ ID NO: 615292 - protein, 22 aa, Mycobacterium
YAKEKKLLKEKDSNLTGDDIRE

SEQ ID NO: 615293 - protein, 7 aa, Mycobacterium
YAKERQA

SEQ ID NO: 615294 - protein, 22 aa, Mycobacterium
YAKGAGATYAEGDTRAERKAKV

SEQ ID NO: 615295 - protein, 14 aa, Mycobacterium
YAKHDGYPGPDIPG

SEQ ID NO: 615296 - protein, 10 aa, Mycobacterium
YAKKHETSAE

SEQ ID NO: 615297 - protein, 26 aa, Mycobacterium
YAKNQMNTGKYAGKGEVIKGDDKTIR

SEQ ID NO: 615298 - protein, 8 aa, Mycobacterium
YAKQRSQF

SEQ ID NO: 615299 - protein, 9 aa, Mycobacterium
YAKSGSAMD

SEQ ID NO: 615300 - protein, 8 aa, Mycobacterium
YAKTPEGW

SEQ ID NO: 615301 - protein, 4 aa, Mycobacterium
YALG

SEQ ID NO: 615302 - protein, 5 aa, Mycobacterium
YALGG

SEQ ID NO: 615303 - protein, 23 aa, Mycobacterium
YALSSQSVSDRGAKRLRELLSRN

SEQ ID NO: 615304 - protein, 20 aa, Mycobacterium
YALTGNDKKPHLERGGDDGG

SEQ ID NO: 615305 - protein, 5 aa, Mycobacterium
YANAG

SEQ ID NO: 615306 - protein, 11 aa, Mycobacterium
YANAQDGRPTP

SEQ ID NO: 615307 - protein, 5 aa, Mycobacterium
YANGA

SEQ ID NO: 615308 - protein, 7 aa, Mycobacterium
YANGAPV

SEQ ID NO: 615309 - protein, 9 aa, Mycobacterium
YANGEAPAL

SEQ ID NO: 615310 - protein, 9 aa, Mycobacterium
YANGYANSK

SEQ ID NO: 615311 - protein, 5 aa, Mycobacterium
YANLP

SEQ ID NO: 615312 - protein, 8 aa, Mycobacterium
YANLPRKY

SEQ ID NO: 615313 - protein, 18 aa, Mycobacterium
YANPGTARDYNPDSNESL

SEQ ID NO: 615314 - protein, 5 aa, Mycobacterium
YANPR

SEQ ID NO: 615315 - protein, 9 aa, Mycobacterium
YANRQQENE

SEQ ID NO: 615316 - protein, 7 aa, Mycobacterium
YANSEAP

SEQ ID NO: 615317 - protein, 4 aa, Mycobacterium
YAPA

SEQ ID NO: 615318 - protein, 7 aa, Mycobacterium
YAPADDI

SEQ ID NO: 615319 - protein, 10 aa, Mycobacterium
YAPAEPGQDT

SEQ ID NO: 615320 - protein, 11 aa, Mycobacterium
YAPAGDQPAAI

SEQ ID NO: 615321 - protein, 8 aa, Mycobacterium
YAPASHGG

SEQ ID NO: 615322 - protein, 11 aa, Mycobacterium
YAPATAADLSE

SEQ ID NO: 615323 - protein, 24 aa, Mycobacterium
YAPATEAAEPPATAPQPPRGKYDP

SEQ ID NO: 615324 - protein, 6 aa, Mycobacterium
YAPDDS

SEQ ID NO: 615325 - protein, 13 aa, Mycobacterium
YAPDGSSVRLGPG

SEQ ID NO: 615326 - protein, 9 aa, Mycobacterium
YAPDLEPGI

SEQ ID NO: 615327 - protein, 10 aa, Mycobacterium
YAPDNEKTTA

SEQ ID NO: 615328 - protein, 10 aa, Mycobacterium
YAPDNGPDYA

SEQ ID NO: 615329 - protein, 10 aa, Mycobacterium
YAPDPEKTNA

SEQ ID NO: 615330 - protein, 11 aa, Mycobacterium
YAPDREKTTAV

SEQ ID NO: 615331 - protein, 8 aa, Mycobacterium
YAPENRDA

SEQ ID NO: 615332 - protein, 4 aa, Mycobacterium
YAPG

SEQ ID NO: 615333 - protein, 9 aa, Mycobacterium
YAPGARARG

SEQ ID NO: 615334 - protein, 9 aa, Mycobacterium
YAPGARRRG

SEQ ID NO: 615335 - protein, 10 aa, Mycobacterium
YAPGARSRGM

SEQ ID NO: 615336 - protein, 5 aa, Mycobacterium
YAPGD

SEQ ID NO: 615337 - protein, 6 aa, Mycobacterium
YAPGDD

SEQ ID NO: 615338 - protein, 8 aa, Mycobacterium
YAPGDPGW

SEQ ID NO: 615339 - protein, 10 aa, Mycobacterium
YAPGDSLRRS

SEQ ID NO: 615340 - protein, 9 aa, Mycobacterium
YAPGREHGI

SEQ ID NO: 615341 - protein, 11 aa, Mycobacterium
YAPGSQERTRL

SEQ ID NO: 615342 - protein, 9 aa, Mycobacterium
YAPGTAARR

SEQ ID NO: 615343 - protein, 4 aa, Mycobacterium
YAPH

SEQ ID NO: 615344 - protein, 11 aa, Mycobacterium
YAPHAGEPGAE

SEQ ID NO: 615345 - protein, 4 aa, Mycobacterium
YAPK

SEQ ID NO: 615346 - protein, 13 aa, Mycobacterium
YAPKGRQLTPVQK

SEQ ID NO: 615347 - protein, 9 aa, Mycobacterium
YAPKSALGH

SEQ ID NO: 615348 - protein, 10 aa, Mycobacterium
YAPKSPERAR

SEQ ID NO: 615349 - protein, 4 aa, Mycobacterium
YAPL

SEQ ID NO: 615350 - protein, 5 aa, Mycobacterium
YAPNG

SEQ ID NO: 615351 - protein, 9 aa, Mycobacterium
YAPNRRHDP

SEQ ID NO: 615352 - protein, 4 aa, Mycobacterium
YAPP

SEQ ID NO: 615353 - protein, 6 aa, Mycobacterium
YAPPDV

SEQ ID NO: 615354 - protein, 15 aa, Mycobacterium
YAPPEPQETEQAGAD

SEQ ID NO: 615355 - protein, 8 aa, Mycobacterium
YAPPETER

SEQ ID NO: 615356 - protein, 7 aa, Mycobacterium
YAPPGSG

SEQ ID NO: 615357 - protein, 5 aa, Mycobacterium
YAPPP

SEQ ID NO: 615358 - protein, 15 aa, Mycobacterium
YAPPPPPGASPPPMW

SEQ ID NO: 615359 - protein, 12 aa, Mycobacterium
YAPPQSGPRELA

SEQ ID NO: 615360 - protein, 9 aa, Mycobacterium
YAPPRRTRA

SEQ ID NO: 615361 - protein, 5 aa, Mycobacterium
YAPPT

SEQ ID NO: 615362 - protein, 6 aa, Mycobacterium
YAPQAH

SEQ ID NO: 615363 - protein, 6 aa, Mycobacterium
YAPQAQ

SEQ ID NO: 615364 - protein, 11 aa, Mycobacterium
YAPQREHTVRP

SEQ ID NO: 615365 - protein, 6 aa, Mycobacterium
YAPRAT

SEQ ID NO: 615366 - protein, 10 aa, Mycobacterium
YAPRQGTSPM

SEQ ID NO: 615367 - protein, 6 aa, Mycobacterium
YAPRRQ

SEQ ID NO: 615368 - protein, 10 aa, Mycobacterium
YAPRSPERTR

SEQ ID NO: 615369 - protein, 9 aa, Mycobacterium
YAPSAGDDP

SEQ ID NO: 615370 - protein, 11 aa, Mycobacterium
YAPSAVSDDGS

SEQ ID NO: 615371 - protein, 6 aa, Mycobacterium
YAPSGD

SEQ ID NO: 615372 - protein, 7 aa, Mycobacterium
YAPSGWD

SEQ ID NO: 615373 - protein, 11 aa, Mycobacterium
YAPSSRFGSPD

SEQ ID NO: 615374 - protein, 9 aa, Mycobacterium
YAPSSTGDR

SEQ ID NO: 615375 - protein, 9 aa, Mycobacterium
YAPSVGAAS

SEQ ID NO: 615376 - protein, 12 aa, Mycobacterium
YAPTADEIARAE

SEQ ID NO: 615377 - protein, 14 aa, Mycobacterium
YAPTEEPTDRGQLA

SEQ ID NO: 615378 - protein, 5 aa, Mycobacterium
YAPTG

SEQ ID NO: 615379 - protein, 12 aa, Mycobacterium
YAPTGVAKPVDG

SEQ ID NO: 615380 - protein, 8 aa, Mycobacterium
YAPTPGGE

SEQ ID NO: 615381 - protein, 9 aa, Mycobacterium
YAPTRPETV

SEQ ID NO: 615382 - protein, 11 aa, Mycobacterium
YAPTSRFGTPD

SEQ ID NO: 615383 - protein, 12 aa, Mycobacterium
YAPTSRFGTPDD

SEQ ID NO: 615384 - protein, 12 aa, Mycobacterium
YAPTSRFGTPDE

SEQ ID NO: 615385 - protein, 13 aa, Mycobacterium
YAPTTDEIARAER

SEQ ID NO: 615386 - protein, 8 aa, Mycobacterium
YAPVPDEL

SEQ ID NO: 615387 - protein, 23 aa, Mycobacterium
YAPYEKAGETGGFGERIVIQLRE

SEQ ID NO: 615388 - protein, 9 aa, Mycobacterium
YAPYSKYPV

SEQ ID NO: 615389 - protein, 4 aa, Mycobacterium
YAQD

SEQ ID NO: 615390 - protein, 12 aa, Mycobacterium
YAQDPERFTSAS

SEQ ID NO: 615391 - protein, 9 aa, Mycobacterium
YAQGDDDEL

SEQ ID NO: 615392 - protein, 7 aa, Mycobacterium
YAQGSGG

SEQ ID NO: 615393 - protein, 6 aa, Mycobacterium
YAQNDD

SEQ ID NO: 615394 - protein, 18 aa, Mycobacterium
YAQPGTARDYDPESSESL

SEQ ID NO: 615395 - protein, 4 aa, Mycobacterium
YAQQ

SEQ ID NO: 615396 - protein, 12 aa, Mycobacterium
YAQQGAEPTCDR

SEQ ID NO: 615397 - protein, 9 aa, Mycobacterium
YAQRGTGST

SEQ ID NO: 615398 - protein, 6 aa, Mycobacterium
YARAKH

SEQ ID NO: 615399 - protein, 6 aa, Mycobacterium
YARDRD

SEQ ID NO: 615400 - protein, 6 aa, Mycobacterium
YARERA

SEQ ID NO: 615401 - protein, 10 aa, Mycobacterium
YAREREQFDR

SEQ ID NO: 615402 - protein, 11 aa, Mycobacterium
YARGAEKTPEG

SEQ ID NO: 615403 - protein, 26 aa, Mycobacterium
YARGEGGFGGERGPSTSDAPPERAPD

SEQ ID NO: 615404 - protein, 6 aa, Mycobacterium
YARGTW

SEQ ID NO: 615405 - protein, 8 aa, Mycobacterium
YARKAGAM

SEQ ID NO: 615406 - protein, 16 aa, Mycobacterium
YARNRGNQNSDANSAG

SEQ ID NO: 615407 - protein, 223 aa, Mycobacterium
YARPQEDPRGGPHGGPDPRGGYPPEAGGYPPQPGYPPPRPQDQGGYPEQGGYPEQGGYPDQRGYQDQRGYQDQRGYPDQGGYPDQRGYPEQGGYPPSYEQRPPAPGGYGAQGYDQGYRQAGGYGQPPGGQPGYGGYGEYGREPARQDEGAYSAPAAPSAPPEAQRPGYPDQGGGYDQGYQQGGAGYGRPEYGQGDYTQYADTSSPGGYPPQGAGYADPAGRDY

SEQ ID NO: 615408 - protein, 279 aa, Mycobacterium
YARPQEEPRSGSPGGPDPRGGYPPEGGGYPPQPGYPPPPRQPDQGGGYPEQRGYQDQGGYPEQGYPDQGGYPEQRGYQDQGGYPSSYEQRPPGYSGPGYDQGYRQGGGYGQPPGGGYGQPPGGYGQPPSGYGQPPGGGYGQPPGGQPGYGGYGDYGREPARQEDGGYGAPGGPGAPPQAPPEPQRPAYPDQGAGYEQGGYDQGYQQGGGGYGRQEYGSGDYTQYAETPAPGGYPAQAGGYAEPARDYDYGQSAAPDYGQPAGGYGGYGQGGYGSPGNTV

SEQ ID NO: 615409 - protein, 9 aa, Mycobacterium
YARPQSNHA

SEQ ID NO: 615410 - protein, 4 aa, Mycobacterium
YARQ

SEQ ID NO: 615411 - protein, 11 aa, Mycobacterium
YARQPPESQSI

SEQ ID NO: 615412 - protein, 9 aa, Mycobacterium
YARRQGNPT

SEQ ID NO: 615413 - protein, 5 aa, Mycobacterium
YARSG

SEQ ID NO: 615414 - protein, 9 aa, Mycobacterium
YARSPDPDH

SEQ ID NO: 615415 - protein, 4 aa, Mycobacterium
YART

SEQ ID NO: 615416 - protein, 6 aa, Mycobacterium
YARTAD

SEQ ID NO: 615417 - protein, 6 aa, Mycobacterium
YARTAE

SEQ ID NO: 615418 - protein, 8 aa, Mycobacterium
YARTAESQ

SEQ ID NO: 615419 - protein, 11 aa, Mycobacterium
YARTGNPTRAA

SEQ ID NO: 615420 - protein, 11 aa, Mycobacterium
YARTGNPTRTA

SEQ ID NO: 615421 - protein, 15 aa, Mycobacterium
YARTPTCVEEGLPLA

SEQ ID NO: 615422 - protein, 8 aa, Mycobacterium
YARTREQF

SEQ ID NO: 615423 - protein, 12 aa, Mycobacterium
YARTREQFGKPI

SEQ ID NO: 615424 - protein, 8 aa, Mycobacterium
YARTSPLS

SEQ ID NO: 615425 - protein, 4 aa, Mycobacterium
YARY

SEQ ID NO: 615426 - protein, 11 aa, Mycobacterium
YARYDESSATR

SEQ ID NO: 615427 - protein, 13 aa, Mycobacterium
YASAARGEPAQTA

SEQ ID NO: 615428 - protein, 41 aa, Mycobacterium
YASAEAPPPVQPPRGKYDPLPWPDENQVPPMPAPVEPKGPG

SEQ ID NO: 615429 - protein, 11 aa, Mycobacterium
YASAESNHTVG

SEQ ID NO: 615430 - protein, 7 aa, Mycobacterium
YASAGQL

SEQ ID NO: 615431 - protein, 11 aa, Mycobacterium
YASAGSDNREQ

SEQ ID NO: 615432 - protein, 4 aa, Mycobacterium
YASE

SEQ ID NO: 615433 - protein, 5 aa, Mycobacterium
YASEP

SEQ ID NO: 615434 - protein, 8 aa, Mycobacterium
YASERAAA

SEQ ID NO: 615435 - protein, 10 aa, Mycobacterium
YASEREARDA

SEQ ID NO: 615436 - protein, 4 aa, Mycobacterium
YASG

SEQ ID NO: 615437 - protein, 7 aa, Mycobacterium
YASGDSV

SEQ ID NO: 615438 - protein, 10 aa, Mycobacterium
YASGHRNKRS

SEQ ID NO: 615439 - protein, 9 aa, Mycobacterium
YASGTSAAE

SEQ ID NO: 615440 - protein, 6 aa, Mycobacterium
YASNPV

SEQ ID NO: 615441 - protein, 17 aa, Mycobacterium
YASPAPEDFGKYQTFCG

SEQ ID NO: 615442 - protein, 17 aa, Mycobacterium
YASPAPGDFGAYRTFCG

SEQ ID NO: 615443 - protein, 18 aa, Mycobacterium
YASPQQPSIPEPVRSEVT

SEQ ID NO: 615444 - protein, 8 aa, Mycobacterium
YASPTQNS

SEQ ID NO: 615445 - protein, 5 aa, Mycobacterium
YASQG

SEQ ID NO: 615446 - protein, 8 aa, Mycobacterium
YASRASNA

SEQ ID NO: 615447 - protein, 7 aa, Mycobacterium
YASRDSV

SEQ ID NO: 615448 - protein, 7 aa, Mycobacterium
YASRGGK

SEQ ID NO: 615449 - protein, 8 aa, Mycobacterium
YASRGHVP

SEQ ID NO: 615450 - protein, 10 aa, Mycobacterium
YASSEAKFSV

SEQ ID NO: 615451 - protein, 6 aa, Mycobacterium
YASTRH

SEQ ID NO: 615452 - protein, 4 aa, Mycobacterium
YASV

SEQ ID NO: 615453 - protein, 6 aa, Mycobacterium
YASVPS

SEQ ID NO: 615454 - protein, 14 aa, Mycobacterium
YASYTPDPMNGGQR

SEQ ID NO: 615455 - protein, 18 aa, Mycobacterium
YATADEAIAERDSRPRER

SEQ ID NO: 615456 - protein, 11 aa, Mycobacterium
YATAEANRTVG

SEQ ID NO: 615457 - protein, 9 aa, Mycobacterium
YATAESHQA

SEQ ID NO: 615458 - protein, 7 aa, Mycobacterium
YATDKGM

SEQ ID NO: 615459 - protein, 9 aa, Mycobacterium
YATDPGDLP

SEQ ID NO: 615460 - protein, 4 aa, Mycobacterium
YATE

SEQ ID NO: 615461 - protein, 6 aa, Mycobacterium
YATEDQ

SEQ ID NO: 615462 - protein, 7 aa, Mycobacterium
YATEDRK

SEQ ID NO: 615463 - protein, 5 aa, Mycobacterium
YATES

SEQ ID NO: 615464 - protein, 6 aa, Mycobacterium
YATEVS

SEQ ID NO: 615465 - protein, 6 aa, Mycobacterium
YATGAQ

SEQ ID NO: 615466 - protein, 6 aa, Mycobacterium
YATGAR

SEQ ID NO: 615467 - protein, 8 aa, Mycobacterium
YATGATGR

SEQ ID NO: 615468 - protein, 8 aa, Mycobacterium
YATGRTRS

SEQ ID NO: 615469 - protein, 11 aa, Mycobacterium
YATGSAAAADL

SEQ ID NO: 615470 - protein, 6 aa, Mycobacterium
YATPGE

SEQ ID NO: 615471 - protein, 6 aa, Mycobacterium
YATPGQ

SEQ ID NO: 615472 - protein, 5 aa, Mycobacterium
YATPQ

SEQ ID NO: 615473 - protein, 6 aa, Mycobacterium
YATPRA

SEQ ID NO: 615474 - protein, 14 aa, Mycobacterium
YATPRASKLDDAAR

SEQ ID NO: 615475 - protein, 5 aa, Mycobacterium
YATQG

SEQ ID NO: 615476 - protein, 5 aa, Mycobacterium
YATQP

SEQ ID NO: 615477 - protein, 16 aa, Mycobacterium
YATQTHRAVASVLTTY

SEQ ID NO: 615478 - protein, 6 aa, Mycobacterium
YATRAR

SEQ ID NO: 615479 - protein, 13 aa, Mycobacterium
YATRGADALAGGV

SEQ ID NO: 615480 - protein, 5 aa, Mycobacterium
YATSK

SEQ ID NO: 615481 - protein, 15 aa, Mycobacterium
YATSRVDHDNGARSR

SEQ ID NO: 615482 - protein, 9 aa, Mycobacterium
YATTEASTL

SEQ ID NO: 615483 - protein, 7 aa, Mycobacterium
YATVPPK

SEQ ID NO: 615484 - protein, 10 aa, Mycobacterium
YAVDTEDNGL

SEQ ID NO: 615485 - protein, 5 aa, Mycobacterium
YAVPP

SEQ ID NO: 615486 - protein, 7 aa, Mycobacterium
YAVPSYP

SEQ ID NO: 615487 - protein, 12 aa, Mycobacterium
YCPGPAVGGSTS

SEQ ID NO: 615488 - protein, 5 aa, Mycobacterium
YDAAE

SEQ ID NO: 615489 - protein, 10 aa, Mycobacterium
YDAAGGNGAT

SEQ ID NO: 615490 - protein, 5 aa, Mycobacterium
YDADD

SEQ ID NO: 615491 - protein, 7 aa, Mycobacterium
YDADDDY

SEQ ID NO: 615492 - protein, 14 aa, Mycobacterium
YDADGQVRKPGQNY

SEQ ID NO: 615493 - protein, 7 aa, Mycobacterium
YDAEDDY

SEQ ID NO: 615494 - protein, 7 aa, Mycobacterium
YDAEPDI

SEQ ID NO: 615495 - protein, 5 aa, Mycobacterium
YDAET

SEQ ID NO: 615496 - protein, 14 aa, Mycobacterium
YDAGADEAAAEAAN

SEQ ID NO: 615497 - protein, 14 aa, Mycobacterium
YDAGDDLGAAEAAN

SEQ ID NO: 615498 - protein, 8 aa, Mycobacterium
YDAGSDTL

SEQ ID NO: 615499 - protein, 8 aa, Mycobacterium
YDANGPSL

SEQ ID NO: 615500 - protein, 20 aa, Mycobacterium
YDANGSAAPQPGQSLTTAEV

SEQ ID NO: 615501 - protein, 11 aa, Mycobacterium
YDANPLESDEL

SEQ ID NO: 615502 - protein, 10 aa, Mycobacterium
YDANPLETDE

SEQ ID NO: 615503 - protein, 15 aa, Mycobacterium
YDAPFPDKRYQAGAR

SEQ ID NO: 615504 - protein, 14 aa, Mycobacterium
YDAPFPDKTYQAGA

SEQ ID NO: 615505 - protein, 11 aa, Mycobacterium
YDAPPTPLGPD

SEQ ID NO: 615506 - protein, 11 aa, Mycobacterium
YDAPPTPLGPE

SEQ ID NO: 615507 - protein, 13 aa, Mycobacterium
YDAQTADSHVPAY

SEQ ID NO: 615508 - protein, 10 aa, Mycobacterium
YDARQRAAAE

SEQ ID NO: 615509 - protein, 4 aa, Mycobacterium
YDAS

SEQ ID NO: 615510 - protein, 4 aa, Mycobacterium
YDAT

SEQ ID NO: 615511 - protein, 8 aa, Mycobacterium
YDDALTST

SEQ ID NO: 615512 - protein, 15 aa, Mycobacterium
YDDANGDAVKAGPDI

SEQ ID NO: 615513 - protein, 5 aa, Mycobacterium
YDDAR

SEQ ID NO: 615514 - protein, 13 aa, Mycobacterium
YDDARGDAVSCGP

SEQ ID NO: 615515 - protein, 10 aa, Mycobacterium
YDDDGNPVAS

SEQ ID NO: 615516 - protein, 5 aa, Mycobacterium
YDDDP

SEQ ID NO: 615517 - protein, 9 aa, Mycobacterium
YDDEGVASQ

SEQ ID NO: 615518 - protein, 5 aa, Mycobacterium
YDDEQ

SEQ ID NO: 615519 - protein, 9 aa, Mycobacterium
YDDEVDPDL

SEQ ID NO: 615520 - protein, 19 aa, Mycobacterium
YDDEYYDDHAPSRGFPRPR

SEQ ID NO: 615521 - protein, 9 aa, Mycobacterium
YDDGAAMSH

SEQ ID NO: 615522 - protein, 6 aa, Mycobacterium
YDDGDD

SEQ ID NO: 615523 - protein, 9 aa, Mycobacterium
YDDGEVNRR

SEQ ID NO: 615524 - protein, 12 aa, Mycobacterium
YDDGSPMSREDV

SEQ ID NO: 615525 - protein, 13 aa, Mycobacterium
YDDGSRMSRKDIG

SEQ ID NO: 615526 - protein, 4 aa, Mycobacterium
YDDK

SEQ ID NO: 615527 - protein, 9 aa, Mycobacterium
YDDKTDPAQ

SEQ ID NO: 615528 - protein, 5 aa, Mycobacterium
YDDLR

SEQ ID NO: 615529 - protein, 9 aa, Mycobacterium
YDDPAEPTG

SEQ ID NO: 615530 - protein, 6 aa, Mycobacterium
YDDPDA

SEQ ID NO: 615531 - protein, 5 aa, Mycobacterium
YDDPE

SEQ ID NO: 615532 - protein, 7 aa, Mycobacterium
YDDPNDE

SEQ ID NO: 615533 - protein, 12 aa, Mycobacterium
YDDPPTDATTDA

SEQ ID NO: 615534 - protein, 8 aa, Mycobacterium
YDDPTRAF

SEQ ID NO: 615535 - protein, 17 aa, Mycobacterium
YDDQGPVYTDATEGQIP

SEQ ID NO: 615536 - protein, 8 aa, Mycobacterium
YDDQGRPQ

SEQ ID NO: 615537 - protein, 8 aa, Mycobacterium
YDDRGTSA

SEQ ID NO: 615538 - protein, 7 aa, Mycobacterium
YDDRPLT

SEQ ID NO: 615539 - protein, 11 aa, Mycobacterium
YDDSDKDASTD

SEQ ID NO: 615540 - protein, 4 aa, Mycobacterium
YDDT

SEQ ID NO: 615541 - protein, 8 aa, Mycobacterium
YDDTDPGL

SEQ ID NO: 615542 - protein, 5 aa, Mycobacterium
YDDTE

SEQ ID NO: 615543 - protein, 17 aa, Mycobacterium
YDEAAAAAKADAARTGA

SEQ ID NO: 615544 - protein, 7 aa, Mycobacterium
YDEAAQR

SEQ ID NO: 615545 - protein, 13 aa, Mycobacterium
YDEAKAEAAQRGM

SEQ ID NO: 615546 - protein, 8 aa, Mycobacterium
YDEANRIG

SEQ ID NO: 615547 - protein, 11 aa, Mycobacterium
YDEDKSLPVAR

SEQ ID NO: 615548 - protein, 11 aa, Mycobacterium
YDEDPGEGRDV

SEQ ID NO: 615549 - protein, 8 aa, Mycobacterium
YDEENRLG

SEQ ID NO: 615550 - protein, 13 aa, Mycobacterium
YDEGDSFDQSSAK

SEQ ID NO: 615551 - protein, 13 aa, Mycobacterium
YDEGDTFDQSSAK

SEQ ID NO: 615552 - protein, 15 aa, Mycobacterium
YDEGKGDPREGFPAG

SEQ ID NO: 615553 - protein, 7 aa, Mycobacterium
YDEGNRI

SEQ ID NO: 615554 - protein, 4 aa, Mycobacterium
YDEP

SEQ ID NO: 615555 - protein, 12 aa, Mycobacterium
YDEPDRRAGMER

SEQ ID NO: 615556 - protein, 6 aa, Mycobacterium
YDEPER

SEQ ID NO: 615557 - protein, 20 aa, Mycobacterium
YDEPHDAPAPATPPSPEPAR

SEQ ID NO: 615558 - protein, 5 aa, Mycobacterium
YDEPK

SEQ ID NO: 615559 - protein, 6 aa, Mycobacterium
YDEPPV

SEQ ID NO: 615560 - protein, 5 aa, Mycobacterium
YDEPR

SEQ ID NO: 615561 - protein, 7 aa, Mycobacterium
YDEPRQE

SEQ ID NO: 615562 - protein, 6 aa, Mycobacterium
YDEPTS

SEQ ID NO: 615563 - protein, 8 aa, Mycobacterium
YDERNTVG

SEQ ID NO: 615564 - protein, 4 aa, Mycobacterium
YDES

SEQ ID NO: 615565 - protein, 15 aa, Mycobacterium
YDESKGEPREGFPAG

SEQ ID NO: 615566 - protein, 11 aa, Mycobacterium
YDESPGEGRDV

SEQ ID NO: 615567 - protein, 6 aa, Mycobacterium
YDGADY

SEQ ID NO: 615568 - protein, 20 aa, Mycobacterium
YDGAEESTVERDHAPRQRPA

SEQ ID NO: 615569 - protein, 11 aa, Mycobacterium
YDGAGARRAVD

SEQ ID NO: 615570 - protein, 7 aa, Mycobacterium
YDGAGTN

SEQ ID NO: 615571 - protein, 5 aa, Mycobacterium
YDGAR

SEQ ID NO: 615572 - protein, 12 aa, Mycobacterium
YDGARARAAQHR

SEQ ID NO: 615573 - protein, 5 aa, Mycobacterium
YDGAS

SEQ ID NO: 615574 - protein, 15 aa, Mycobacterium
YDGDPRKAPEDNPAR

SEQ ID NO: 615575 - protein, 15 aa, Mycobacterium
YDGDPRKATPDKPAR

SEQ ID NO: 615576 - protein, 10 aa, Mycobacterium
YDGDPSGVAQ

SEQ ID NO: 615577 - protein, 13 aa, Mycobacterium
YDGDQHQSDRAQY

SEQ ID NO: 615578 - protein, 11 aa, Mycobacterium
YDGDQHRTERA

SEQ ID NO: 615579 - protein, 5 aa, Mycobacterium
YDGDR

SEQ ID NO: 615580 - protein, 6 aa, Mycobacterium
YDGDVQ

SEQ ID NO: 615581 - protein, 14 aa, Mycobacterium
YDGDVQSDAIAQGY

SEQ ID NO: 615582 - protein, 15 aa, Mycobacterium
YDGDVQSDTVAQGYG

SEQ ID NO: 615583 - protein, 5 aa, Mycobacterium
YDGEF

SEQ ID NO: 615584 - protein, 21 aa, Mycobacterium
YDGELESAAPERSLAGQPPGV

SEQ ID NO: 615585 - protein, 11 aa, Mycobacterium
YDGEQHRSDRH

SEQ ID NO: 615586 - protein, 8 aa, Mycobacterium
YDGERDGY

SEQ ID NO: 615587 - protein, 6 aa, Mycobacterium
YDGEST

SEQ ID NO: 615588 - protein, 11 aa, Mycobacterium
YDGGAFANNPD

SEQ ID NO: 615589 - protein, 11 aa, Mycobacterium
YDGGAMADNPN

SEQ ID NO: 615590 - protein, 9 aa, Mycobacterium
YDGGDAAVP

SEQ ID NO: 615591 - protein, 11 aa, Mycobacterium
YDGGGLGKGAS

SEQ ID NO: 615592 - protein, 16 aa, Mycobacterium
YDGGQHWTDPRAHAED

SEQ ID NO: 615593 - protein, 15 aa, Mycobacterium
YDGGSIPVNTHGGQL

SEQ ID NO: 615594 - protein, 11 aa, Mycobacterium
YDGGTGAAPLT

SEQ ID NO: 615595 - protein, 6 aa, Mycobacterium
YDGKGR

SEQ ID NO: 615596 - protein, 11 aa, Mycobacterium
YDGKPNWRTRK

SEQ ID NO: 615597 - protein, 10 aa, Mycobacterium
YDGKSTPAVD

SEQ ID NO: 615598 - protein, 4 aa, Mycobacterium
YDGL

SEQ ID NO: 615599 - protein, 12 aa, Mycobacterium
YDGLPGLSADEA

SEQ ID NO: 615600 - protein, 11 aa, Mycobacterium
YDGPDGPGELR

SEQ ID NO: 615601 - protein, 10 aa, Mycobacterium
YDGPEGGWGR

SEQ ID NO: 615602 - protein, 15 aa, Mycobacterium
YDGPEQVNVGSGTDV

SEQ ID NO: 615603 - protein, 19 aa, Mycobacterium
YDGPRAAPSRGPRPKTTVE

SEQ ID NO: 615604 - protein, 18 aa, Mycobacterium
YDGPRPAPDRGPRPKTTV

SEQ ID NO: 615605 - protein, 19 aa, Mycobacterium
YDGPRPEPSRGPRPKTHAE

SEQ ID NO: 615606 - protein, 7 aa, Mycobacterium
YDGQGCS

SEQ ID NO: 615607 - protein, 6 aa, Mycobacterium
YDGRAV

SEQ ID NO: 615608 - protein, 16 aa, Mycobacterium
YDGRDRAGRYNNGQDA

SEQ ID NO: 615609 - protein, 15 aa, Mycobacterium
YDGRQDALTCERLDR

SEQ ID NO: 615610 - protein, 15 aa, Mycobacterium
YDGRQDQLTLERLGR

SEQ ID NO: 615611 - protein, 9 aa, Mycobacterium
YDGRQGATA

SEQ ID NO: 615612 - protein, 18 aa, Mycobacterium
YDGSGSLVATTTQEALWR

SEQ ID NO: 615613 - protein, 9 aa, Mycobacterium
YDGSLASDG

SEQ ID NO: 615614 - protein, 12 aa, Mycobacterium
YDGSSAGPEDAT

SEQ ID NO: 615615 - protein, 11 aa, Mycobacterium
YDGSTAGRADA

SEQ ID NO: 615616 - protein, 5 aa, Mycobacterium
YDGSW

SEQ ID NO: 615617 - protein, 4 aa, Mycobacterium
YDGT

SEQ ID NO: 615618 - protein, 7 aa, Mycobacterium
YDGTQGA

SEQ ID NO: 615619 - protein, 13 aa, Mycobacterium
YDGTTRLSNERGT

SEQ ID NO: 615620 - protein, 9 aa, Mycobacterium
YDGVPEDAW

SEQ ID NO: 615621 - protein, 9 aa, Mycobacterium
YDHRGNTTA

SEQ ID NO: 615622 - protein, 6 aa, Mycobacterium
YDHSGK

SEQ ID NO: 615623 - protein, 6 aa, Mycobacterium
YDHSSD

SEQ ID NO: 615624 - protein, 5 aa, Mycobacterium
YDITG

SEQ ID NO: 615625 - protein, 4 aa, Mycobacterium
YDKL

SEQ ID NO: 615626 - protein, 5 aa, Mycobacterium
YDKRG

SEQ ID NO: 615627 - protein, 8 aa, Mycobacterium
YDKSGPTL

SEQ ID NO: 615628 - protein, 4 aa, Mycobacterium
YDKT

SEQ ID NO: 615629 - protein, 15 aa, Mycobacterium
YDKYREDAGPNDHTV

SEQ ID NO: 615630 - protein, 19 aa, Mycobacterium
YDLESDDTTPLPPLRPGDR

SEQ ID NO: 615631 - protein, 4 aa, Mycobacterium
YDLG

SEQ ID NO: 615632 - protein, 20 aa, Mycobacterium
YDLGGPAAYPDEAPVSAFQL

SEQ ID NO: 615633 - protein, 7 aa, Mycobacterium
YDLPPSQ

SEQ ID NO: 615634 - protein, 4 aa, Mycobacterium
YDMP

SEQ ID NO: 615635 - protein, 4 aa, Mycobacterium
YDNA

SEQ ID NO: 615636 - protein, 9 aa, Mycobacterium
YDNAPGQQV

SEQ ID NO: 615637 - protein, 11 aa, Mycobacterium
YDNDGKVTGRR

SEQ ID NO: 615638 - protein, 8 aa, Mycobacterium
YDNGDPIP

SEQ ID NO: 615639 - protein, 13 aa, Mycobacterium
YDNKDAAVVGTPD

SEQ ID NO: 615640 - protein, 9 aa, Mycobacterium
YDNKDHEVV

SEQ ID NO: 615641 - protein, 8 aa, Mycobacterium
YDNKFGPR

SEQ ID NO: 615642 - protein, 14 aa, Mycobacterium
YDNPRAPHTESDTK

SEQ ID NO: 615643 - protein, 12 aa, Mycobacterium
YDNREDRRNSER

SEQ ID NO: 615644 - protein, 5 aa, Mycobacterium
YDNRS

SEQ ID NO: 615645 - protein, 8 aa, Mycobacterium
YDNSPTYH

SEQ ID NO: 615646 - protein, 4 aa, Mycobacterium
YDPA

SEQ ID NO: 615647 - protein, 11 aa, Mycobacterium
YDPAELNRPAG

SEQ ID NO: 615648 - protein, 7 aa, Mycobacterium
YDPANER

SEQ ID NO: 615649 - protein, 5 aa, Mycobacterium
YDPAP

SEQ ID NO: 615650 - protein, 8 aa, Mycobacterium
YDPASKTL

SEQ ID NO: 615651 - protein, 11 aa, Mycobacterium
YDPASPDDLSE

SEQ ID NO: 615652 - protein, 6 aa, Mycobacterium
YDPATH

SEQ ID NO: 615653 - protein, 8 aa, Mycobacterium
YDPATNTK

SEQ ID NO: 615654 - protein, 11 aa, Mycobacterium
YDPATPDDLSE

SEQ ID NO: 615655 - protein, 5 aa, Mycobacterium
YDPAY

SEQ ID NO: 615656 - protein, 11 aa, Mycobacterium
YDPDAEDEMNP

SEQ ID NO: 615657 - protein, 6 aa, Mycobacterium
YDPDAL

SEQ ID NO: 615658 - protein, 5 aa, Mycobacterium
YDPDD

SEQ ID NO: 615659 - protein, 6 aa, Mycobacterium
YDPDED

SEQ ID NO: 615660 - protein, 8 aa, Mycobacterium
YDPDGARE

SEQ ID NO: 615661 - protein, 12 aa, Mycobacterium
YDPDGQDTASSR

SEQ ID NO: 615662 - protein, 7 aa, Mycobacterium
YDPDNTH

SEQ ID NO: 615663 - protein, 12 aa, Mycobacterium
YDPDPDAAGKMY

SEQ ID NO: 615664 - protein, 12 aa, Mycobacterium
YDPDPDAKGKMY

SEQ ID NO: 615665 - protein, 10 aa, Mycobacterium
YDPDPDKALE

SEQ ID NO: 615666 - protein, 7 aa, Mycobacterium
YDPDPKL

SEQ ID NO: 615667 - protein, 11 aa, Mycobacterium
YDPDPRAPGRM

SEQ ID NO: 615668 - protein, 10 aa, Mycobacterium
YDPDPSAPGC

SEQ ID NO: 615669 - protein, 24 aa, Mycobacterium
YDPDTGAPLRDENGRVRRVPPGEA

SEQ ID NO: 615670 - protein, 25 aa, Mycobacterium
YDPDTGAPLRGDDGRVRRVPAGEPG

SEQ ID NO: 615671 - protein, 4 aa, Mycobacterium
YDPE

SEQ ID NO: 615672 - protein, 5 aa, Mycobacterium
YDPED

SEQ ID NO: 615673 - protein, 6 aa, Mycobacterium
YDPEHG

SEQ ID NO: 615674 - protein, 9 aa, Mycobacterium
YDPEKATYA

SEQ ID NO: 615675 - protein, 6 aa, Mycobacterium
YDPENT

SEQ ID NO: 615676 - protein, 7 aa, Mycobacterium
YDPEPDR

SEQ ID NO: 615677 - protein, 11 aa, Mycobacterium
YDPEPGVPGRT

SEQ ID NO: 615678 - protein, 15 aa, Mycobacterium
YDPESGVPGKSPSKW

SEQ ID NO: 615679 - protein, 6 aa, Mycobacterium
YDPETD

SEQ ID NO: 615680 - protein, 7 aa, Mycobacterium
YDPETRL

SEQ ID NO: 615681 - protein, 4 aa, Mycobacterium
YDPG

SEQ ID NO: 615682 - protein, 5 aa, Mycobacterium
YDPGG

SEQ ID NO: 615683 - protein, 14 aa, Mycobacterium
YDPGQLGGVSPTLE

SEQ ID NO: 615684 - protein, 9 aa, Mycobacterium
YDPGSRGAL

SEQ ID NO: 615685 - protein, 10 aa, Mycobacterium
YDPGSTTDTG

SEQ ID NO: 615686 - protein, 20 aa, Mycobacterium
YDPHDEQAQQAHARAADHPG

SEQ ID NO: 615687 - protein, 10 aa, Mycobacterium
YDPKKRLGED

SEQ ID NO: 615688 - protein, 44 aa, Mycobacterium
YDPNGPAGTTIDKGKAAGGNGGDGGFNGTGGATGGRGGDGAGAS

SEQ ID NO: 615689 - protein, 11 aa, Mycobacterium
YDPPCSEGEAY

SEQ ID NO: 615690 - protein, 10 aa, Mycobacterium
YDPPDDAGPE

SEQ ID NO: 615691 - protein, 14 aa, Mycobacterium
YDPPEDAKKYGLKT

SEQ ID NO: 615692 - protein, 10 aa, Mycobacterium
YDPPPDPRLR

SEQ ID NO: 615693 - protein, 5 aa, Mycobacterium
YDPPR

SEQ ID NO: 615694 - protein, 6 aa, Mycobacterium
YDPPTG

SEQ ID NO: 615695 - protein, 8 aa, Mycobacterium
YDPQQTDY

SEQ ID NO: 615696 - protein, 9 aa, Mycobacterium
YDPRPEVSD

SEQ ID NO: 615697 - protein, 5 aa, Mycobacterium
YDPRS

SEQ ID NO: 615698 - protein, 12 aa, Mycobacterium
YDPRSSADLVLA

SEQ ID NO: 615699 - protein, 6 aa, Mycobacterium
YDPRSY

SEQ ID NO: 615700 - protein, 4 aa, Mycobacterium
YDPS

SEQ ID NO: 615701 - protein, 8 aa, Mycobacterium
YDPSDSDV

SEQ ID NO: 615702 - protein, 6 aa, Mycobacterium
YDPSTD

SEQ ID NO: 615703 - protein, 7 aa, Mycobacterium
YDPTDAA

SEQ ID NO: 615704 - protein, 10 aa, Mycobacterium
YDPTDAPDYS

SEQ ID NO: 615705 - protein, 16 aa, Mycobacterium
YDPTWTPAATPALWKE

SEQ ID NO: 615706 - protein, 6 aa, Mycobacterium
YDPTYE

SEQ ID NO: 615707 - protein, 4 aa, Mycobacterium
YDQD

SEQ ID NO: 615708 - protein, 5 aa, Mycobacterium
YDQGD

SEQ ID NO: 615709 - protein, 4 aa, Mycobacterium
YDQP

SEQ ID NO: 615710 - protein, 11 aa, Mycobacterium
YDQPRIPRGPC

SEQ ID NO: 615711 - protein, 11 aa, Mycobacterium
YDQQGLDADDP

SEQ ID NO: 615712 - protein, 6 aa, Mycobacterium
YDQVPD

SEQ ID NO: 615713 - protein, 4 aa, Mycobacterium
YDRA

SEQ ID NO: 615714 - protein, 7 aa, Mycobacterium
YDRASTT

SEQ ID NO: 615715 - protein, 8 aa, Mycobacterium
YDRASTTM

SEQ ID NO: 615716 - protein, 13 aa, Mycobacterium
YDRDAGPGDPTTA

SEQ ID NO: 615717 - protein, 8 aa, Mycobacterium
YDRDGDQH

SEQ ID NO: 615718 - protein, 10 aa, Mycobacterium
YDRDGRPRWT

SEQ ID NO: 615719 - protein, 4 aa, Mycobacterium
YDRE

SEQ ID NO: 615720 - protein, 9 aa, Mycobacterium
YDREEQTDG

SEQ ID NO: 615721 - protein, 8 aa, Mycobacterium
YDRENGDE

SEQ ID NO: 615722 - protein, 18 aa, Mycobacterium
YDRGADPHRRASGAASVA

SEQ ID NO: 615723 - protein, 8 aa, Mycobacterium
YDRGGPGE

SEQ ID NO: 615724 - protein, 6 aa, Mycobacterium
YDRKGI

SEQ ID NO: 615725 - protein, 8 aa, Mycobacterium
YDRNGDQH

SEQ ID NO: 615726 - protein, 5 aa, Mycobacterium
YDRNQ

SEQ ID NO: 615727 - protein, 6 aa, Mycobacterium
YDRPAT

SEQ ID NO: 615728 - protein, 10 aa, Mycobacterium
YDRPGTNAEE

SEQ ID NO: 615729 - protein, 8 aa, Mycobacterium
YDRPGTTM

SEQ ID NO: 615730 - protein, 6 aa, Mycobacterium
YDRPPA

SEQ ID NO: 615731 - protein, 7 aa, Mycobacterium
YDRPPLS

SEQ ID NO: 615732 - protein, 8 aa, Mycobacterium
YDRPPSTA

SEQ ID NO: 615733 - protein, 7 aa, Mycobacterium
YDRQPAH

SEQ ID NO: 615734 - protein, 9 aa, Mycobacterium
YDRSGRGGA

SEQ ID NO: 615735 - protein, 9 aa, Mycobacterium
YDRTDPDRH

SEQ ID NO: 615736 - protein, 15 aa, Mycobacterium
YDRTPRNFDKDGPHV

SEQ ID NO: 615737 - protein, 7 aa, Mycobacterium
YDRTYDA

SEQ ID NO: 615738 - protein, 10 aa, Mycobacterium
YDSARDGAKY

SEQ ID NO: 615739 - protein, 16 aa, Mycobacterium
YDSDKGAQLAARPYAS

SEQ ID NO: 615740 - protein, 11 aa, Mycobacterium
YDSDPRKAKAA

SEQ ID NO: 615741 - protein, 11 aa, Mycobacterium
YDSDPRKGNAR

SEQ ID NO: 615742 - protein, 11 aa, Mycobacterium
YDSDPRKTEGA

SEQ ID NO: 615743 - protein, 8 aa, Mycobacterium
YDSEPDDL

SEQ ID NO: 615744 - protein, 6 aa, Mycobacterium
YDSERG

SEQ ID NO: 615745 - protein, 8 aa, Mycobacterium
YDSGPAGD

SEQ ID NO: 615746 - protein, 8 aa, Mycobacterium
YDSPADDT

SEQ ID NO: 615747 - protein, 7 aa, Mycobacterium
YDSPPAD

SEQ ID NO: 615748 - protein, 5 aa, Mycobacterium
YDSPR

SEQ ID NO: 615749 - protein, 26 aa, Mycobacterium
YDSRDDSTAPASDPFADREARERRKR

SEQ ID NO: 615750 - protein, 7 aa, Mycobacterium
YDSREQW

SEQ ID NO: 615751 - protein, 8 aa, Mycobacterium
YDSRFPPE

SEQ ID NO: 615752 - protein, 4 aa, Mycobacterium
YDSS

SEQ ID NO: 615753 - protein, 11 aa, Mycobacterium
YDSSDKGFDGA

SEQ ID NO: 615754 - protein, 12 aa, Mycobacterium
YDSSSKGFDGNS

SEQ ID NO: 615755 - protein, 12 aa, Mycobacterium
YDSSTKGFDGAS

SEQ ID NO: 615756 - protein, 4 aa, Mycobacterium
YDST

SEQ ID NO: 615757 - protein, 5 aa, Mycobacterium
YDSTD

SEQ ID NO: 615758 - protein, 5 aa, Mycobacterium
YDSTE

SEQ ID NO: 615759 - protein, 6 aa, Mycobacterium
YDSTGR

SEQ ID NO: 615760 - protein, 7 aa, Mycobacterium
YDSTLEE

SEQ ID NO: 615761 - protein, 8 aa, Mycobacterium
YDSTPGIT

SEQ ID NO: 615762 - protein, 7 aa, Mycobacterium
YDSTTGQ

SEQ ID NO: 615763 - protein, 12 aa, Mycobacterium
YDTAAAAASTLG

SEQ ID NO: 615764 - protein, 10 aa, Mycobacterium
YDTAARAAKA

SEQ ID NO: 615765 - protein, 19 aa, Mycobacterium
YDTADQHNADALAAEIARN

SEQ ID NO: 615766 - protein, 6 aa, Mycobacterium
YDTAPD

SEQ ID NO: 615767 - protein, 7 aa, Mycobacterium
YDTAPDI

SEQ ID NO: 615768 - protein, 8 aa, Mycobacterium
YDTAPDID

SEQ ID NO: 615769 - protein, 8 aa, Mycobacterium
YDTAPDVD

SEQ ID NO: 615770 - protein, 4 aa, Mycobacterium
YDTD

SEQ ID NO: 615771 - protein, 4 aa, Mycobacterium
YDTE

SEQ ID NO: 615772 - protein, 11 aa, Mycobacterium
YDTEADGDLGE

SEQ ID NO: 615773 - protein, 7 aa, Mycobacterium
YDTEAET

SEQ ID NO: 615774 - protein, 8 aa, Mycobacterium
YDTESPAY

SEQ ID NO: 615775 - protein, 7 aa, Mycobacterium
YDTGDRG

SEQ ID NO: 615776 - protein, 5 aa, Mycobacterium
YDTHY

SEQ ID NO: 615777 - protein, 4 aa, Mycobacterium
YDTI

SEQ ID NO: 615778 - protein, 4 aa, Mycobacterium
YDTN

SEQ ID NO: 615779 - protein, 4 aa, Mycobacterium
YDTP

SEQ ID NO: 615780 - protein, 9 aa, Mycobacterium
YDTPDTPTI

SEQ ID NO: 615781 - protein, 6 aa, Mycobacterium
YDTPIQ

SEQ ID NO: 615782 - protein, 8 aa, Mycobacterium
YDTPPPLI

SEQ ID NO: 615783 - protein, 30 aa, Mycobacterium
YDTPPPPIEKGSEFSQDADPRYADIGGGPL

SEQ ID NO: 615784 - protein, 30 aa, Mycobacterium
YDTPPPPIEKGSKYSQDADPRYADIDGGPL

SEQ ID NO: 615785 - protein, 30 aa, Mycobacterium
YDTPPPPIEKGSTYSQDTDPRYADIGGGPL

SEQ ID NO: 615786 - protein, 24 aa, Mycobacterium
YDTPPPPIERGSHYSQDQDPRYAD

SEQ ID NO: 615787 - protein, 19 aa, Mycobacterium
YDTPPPPIERGSRFSQDTD

SEQ ID NO: 615788 - protein, 25 aa, Mycobacterium
YDTPPPQIEAGSEFSQDRDPRYADI

SEQ ID NO: 615789 - protein, 14 aa, Mycobacterium
YDTPVSAKTPDAGV

SEQ ID NO: 615790 - protein, 4 aa, Mycobacterium
YDTR

SEQ ID NO: 615791 - protein, 5 aa, Mycobacterium
YDTRE

SEQ ID NO: 615792 - protein, 10 aa, Mycobacterium
YDTRGTAEEQ

SEQ ID NO: 615793 - protein, 5 aa, Mycobacterium
YDTTP

SEQ ID NO: 615794 - protein, 6 aa, Mycobacterium
YDTTSW

SEQ ID NO: 615795 - protein, 14 aa, Mycobacterium
YDTVPDDLLESSPS

SEQ ID NO: 615796 - protein, 4 aa, Mycobacterium
YDYP

SEQ ID NO: 615797 - protein, 7 aa, Mycobacterium
YDYTEDP

SEQ ID NO: 615798 - protein, 10 aa, Mycobacterium
YDYTEDPTLN

SEQ ID NO: 615799 - protein, 15 aa, Mycobacterium
YDYTEDPTVNWSSPD

SEQ ID NO: 615800 - protein, 17 aa, Mycobacterium
YEAAGDYRRFPDAGEPW

SEQ ID NO: 615801 - protein, 9 aa, Mycobacterium
YEAAGGHNA

SEQ ID NO: 615802 - protein, 22 aa, Mycobacterium
YEAAGNARPGERRRRSPARRHR

SEQ ID NO: 615803 - protein, 10 aa, Mycobacterium
YEAAKDGMPR

SEQ ID NO: 615804 - protein, 18 aa, Mycobacterium
YEAAQKARESRRNQQQTV

SEQ ID NO: 615805 - protein, 14 aa, Mycobacterium
YEAATGQDVTQEAI

SEQ ID NO: 615806 - protein, 6 aa, Mycobacterium
YEAEDQ

SEQ ID NO: 615807 - protein, 6 aa, Mycobacterium
YEAEPT

SEQ ID NO: 615808 - protein, 12 aa, Mycobacterium
YEAGDVAGATLI

SEQ ID NO: 615809 - protein, 20 aa, Mycobacterium
YEAGEGVGPANRVPELPGAG

SEQ ID NO: 615810 - protein, 9 aa, Mycobacterium
YEAGGHTGD

SEQ ID NO: 615811 - protein, 4 aa, Mycobacterium
YEAL

SEQ ID NO: 615812 - protein, 21 aa, Mycobacterium
YEAPDSDSAEHFPTTPCAPTG

SEQ ID NO: 615813 - protein, 13 aa, Mycobacterium
YEARKGSGIAQGS

SEQ ID NO: 615814 - protein, 7 aa, Mycobacterium
YEARRRD

SEQ ID NO: 615815 - protein, 9 aa, Mycobacterium
YEASGDFNG

SEQ ID NO: 615816 - protein, 10 aa, Mycobacterium
YEASGGVDGR

SEQ ID NO: 615817 - protein, 9 aa, Mycobacterium
YEATPTGRR

SEQ ID NO: 615818 - protein, 27 aa, Mycobacterium
YEDDDRGARAGGYSRRPREDRFEEEAY

SEQ ID NO: 615819 - protein, 4 aa, Mycobacterium
YEDE

SEQ ID NO: 615820 - protein, 15 aa, Mycobacterium
YEDEDESQEEEDEEA

SEQ ID NO: 615821 - protein, 8 aa, Mycobacterium
YEDEGGNH

SEQ ID NO: 615822 - protein, 4 aa, Mycobacterium
YEDG

SEQ ID NO: 615823 - protein, 5 aa, Mycobacterium
YEDGD

SEQ ID NO: 615824 - protein, 6 aa, Mycobacterium
YEDGDE

SEQ ID NO: 615825 - protein, 11 aa, Mycobacterium
YEDGDGPESRF

SEQ ID NO: 615826 - protein, 12 aa, Mycobacterium
YEDGSPISDGHV

SEQ ID NO: 615827 - protein, 13 aa, Mycobacterium
YEDGSSMSRKDIG

SEQ ID NO: 615828 - protein, 6 aa, Mycobacterium
YEDGSV

SEQ ID NO: 615829 - protein, 5 aa, Mycobacterium
YEDPA

SEQ ID NO: 615830 - protein, 7 aa, Mycobacterium
YEDPAAA

SEQ ID NO: 615831 - protein, 8 aa, Mycobacterium
YEDPDRAE

SEQ ID NO: 615832 - protein, 8 aa, Mycobacterium
YEDPNTAT

SEQ ID NO: 615833 - protein, 15 aa, Mycobacterium
YEDPPGLEPLPEEEP

SEQ ID NO: 615834 - protein, 5 aa, Mycobacterium
YEDPS

SEQ ID NO: 615835 - protein, 4 aa, Mycobacterium
YEDR

SEQ ID NO: 615836 - protein, 7 aa, Mycobacterium
YEDRASD

SEQ ID NO: 615837 - protein, 10 aa, Mycobacterium
YEDRNPDGVG

SEQ ID NO: 615838 - protein, 6 aa, Mycobacterium
YEDRNS

SEQ ID NO: 615839 - protein, 11 aa, Mycobacterium
YEDRNSGHRLK

SEQ ID NO: 615840 - protein, 14 aa, Mycobacterium
YEDSPTGYPQIEKA

SEQ ID NO: 615841 - protein, 4 aa, Mycobacterium
YEDT

SEQ ID NO: 615842 - protein, 4 aa, Mycobacterium
YEEA

SEQ ID NO: 615843 - protein, 6 aa, Mycobacterium
YEEARG

SEQ ID NO: 615844 - protein, 5 aa, Mycobacterium
YEEDA

SEQ ID NO: 615845 - protein, 6 aa, Mycobacterium
YEEGAS

SEQ ID NO: 615846 - protein, 5 aa, Mycobacterium
YEEGD

SEQ ID NO: 615847 - protein, 5 aa, Mycobacterium
YEEGG

SEQ ID NO: 615848 - protein, 6 aa, Mycobacterium
YEEGGM

SEQ ID NO: 615849 - protein, 4 aa, Mycobacterium
YEEI

SEQ ID NO: 615850 - protein, 8 aa, Mycobacterium
YEEKETDV

SEQ ID NO: 615851 - protein, 10 aa, Mycobacterium
YEESGEQEAQ

SEQ ID NO: 615852 - protein, 8 aa, Mycobacterium
YEESQARQ

SEQ ID NO: 615853 - protein, 6 aa, Mycobacterium
YEETGQ

SEQ ID NO: 615854 - protein, 18 aa, Mycobacterium
YEGASYSDLTQATGVERP

SEQ ID NO: 615855 - protein, 14 aa, Mycobacterium
YEGDDGGPQPMPAP

SEQ ID NO: 615856 - protein, 9 aa, Mycobacterium
YEGDEAGDH

SEQ ID NO: 615857 - protein, 16 aa, Mycobacterium
YEGDPPRPQTQYSPAE

SEQ ID NO: 615858 - protein, 6 aa, Mycobacterium
YEGDRA

SEQ ID NO: 615859 - protein, 13 aa, Mycobacterium
YEGDRPGAPTIGT

SEQ ID NO: 615860 - protein, 7 aa, Mycobacterium
YEGDYDR

SEQ ID NO: 615861 - protein, 7 aa, Mycobacterium
YEGFGPG

SEQ ID NO: 615862 - protein, 10 aa, Mycobacterium
YEGFGPGGLA

SEQ ID NO: 615863 - protein, 4 aa, Mycobacterium
YEGG

SEQ ID NO: 615864 - protein, 11 aa, Mycobacterium
YEGGPTSDMPG

SEQ ID NO: 615865 - protein, 5 aa, Mycobacterium
YEGGV

SEQ ID NO: 615866 - protein, 10 aa, Mycobacterium
YEGKAPYPFT

SEQ ID NO: 615867 - protein, 5 aa, Mycobacterium
YEGKS

SEQ ID NO: 615868 - protein, 4 aa, Mycobacterium
YEGL

SEQ ID NO: 615869 - protein, 12 aa, Mycobacterium
YEGLTTEQIRES

SEQ ID NO: 615870 - protein, 6 aa, Mycobacterium
YEGMDT

SEQ ID NO: 615871 - protein, 5 aa, Mycobacterium
YEGMT

SEQ ID NO: 615872 - protein, 13 aa, Mycobacterium
YEGPLRDATAGRA

SEQ ID NO: 615873 - protein, 5 aa, Mycobacterium
YEGPP

SEQ ID NO: 615874 - protein, 9 aa, Mycobacterium
YEGPPDTVH

SEQ ID NO: 615875 - protein, 7 aa, Mycobacterium
YEGPPGH

SEQ ID NO: 615876 - protein, 8 aa, Mycobacterium
YEGPPGHV

SEQ ID NO: 615877 - protein, 8 aa, Mycobacterium
YEGPPGLA

SEQ ID NO: 615878 - protein, 4 aa, Mycobacterium
YEGQ

SEQ ID NO: 615879 - protein, 15 aa, Mycobacterium
YEGQSAAKTAKTIDQ

SEQ ID NO: 615880 - protein, 10 aa, Mycobacterium
YEGRDRRTGE

SEQ ID NO: 615881 - protein, 9 aa, Mycobacterium
YEGRGRPAT

SEQ ID NO: 615882 - protein, 9 aa, Mycobacterium
YEGSDPYTV

SEQ ID NO: 615883 - protein, 9 aa, Mycobacterium
YEGSPLAGY

SEQ ID NO: 615884 - protein, 7 aa, Mycobacterium
YEGTGPE

SEQ ID NO: 615885 - protein, 6 aa, Mycobacterium
YEGTTL

SEQ ID NO: 615886 - protein, 9 aa, Mycobacterium
YEGTYAEAD

SEQ ID NO: 615887 - protein, 15 aa, Mycobacterium
YEHDRDRPDFEGTSR

SEQ ID NO: 615888 - protein, 16 aa, Mycobacterium
YEHPDDLSARTAMSNA

SEQ ID NO: 615889 - protein, 6 aa, Mycobacterium
YEHREE

SEQ ID NO: 615890 - protein, 26 aa, Mycobacterium
YEIPDNPVAYDDDEDEIGPAQTRAAQ

SEQ ID NO: 615891 - protein, 9 aa, Mycobacterium
YEKARSDQT

SEQ ID NO: 615892 - protein, 7 aa, Mycobacterium
YEKDPES

SEQ ID NO: 615893 - protein, 8 aa, Mycobacterium
YEKEGSAR

SEQ ID NO: 615894 - protein, 7 aa, Mycobacterium
YEKERVN

SEQ ID NO: 615895 - protein, 4 aa, Mycobacterium
YEKG

SEQ ID NO: 615896 - protein, 11 aa, Mycobacterium
YEKGAGGSFDG

SEQ ID NO: 615897 - protein, 8 aa, Mycobacterium
YEKGGSAR

SEQ ID NO: 615898 - protein, 18 aa, Mycobacterium
YEKKTAGIRTIPVLALTR

SEQ ID NO: 615899 - protein, 7 aa, Mycobacterium
YEKRDGT

SEQ ID NO: 615900 - protein, 4 aa, Mycobacterium
YEKS

SEQ ID NO: 615901 - protein, 9 aa, Mycobacterium
YELGAGEGV

SEQ ID NO: 615902 - protein, 6 aa, Mycobacterium
YELRPR

SEQ ID NO: 615903 - protein, 4 aa, Mycobacterium
YEMT

SEQ ID NO: 615904 - protein, 11 aa, Mycobacterium
YENEAGALNES

SEQ ID NO: 615905 - protein, 7 aa, Mycobacterium
YENPGGS

SEQ ID NO: 615906 - protein, 11 aa, Mycobacterium
YENPTNAGDGY

SEQ ID NO: 615907 - protein, 5 aa, Mycobacterium
YENQD

SEQ ID NO: 615908 - protein, 5 aa, Mycobacterium
YENVP

SEQ ID NO: 615909 - protein, 4 aa, Mycobacterium
YEPA

SEQ ID NO: 615910 - protein, 12 aa, Mycobacterium
YEPAAGDNVGGD

SEQ ID NO: 615911 - protein, 7 aa, Mycobacterium
YEPAANR

SEQ ID NO: 615912 - protein, 11 aa, Mycobacterium
YEPAGDQPAAI

SEQ ID NO: 615913 - protein, 11 aa, Mycobacterium
YEPAGDQPGAI

SEQ ID NO: 615914 - protein, 10 aa, Mycobacterium
YEPAGPDAPD

SEQ ID NO: 615915 - protein, 14 aa, Mycobacterium
YEPAGSPEAGTAPD

SEQ ID NO: 615916 - protein, 5 aa, Mycobacterium
YEPAP

SEQ ID NO: 615917 - protein, 8 aa, Mycobacterium
YEPAPQDF

SEQ ID NO: 615918 - protein, 5 aa, Mycobacterium
YEPDA

SEQ ID NO: 615919 - protein, 6 aa, Mycobacterium
YEPDEG

SEQ ID NO: 615920 - protein, 5 aa, Mycobacterium
YEPDR

SEQ ID NO: 615921 - protein, 10 aa, Mycobacterium
YEPDSADAYT

SEQ ID NO: 615922 - protein, 11 aa, Mycobacterium
YEPEDPQWPSE

SEQ ID NO: 615923 - protein, 9 aa, Mycobacterium
YEPEPGSVT

SEQ ID NO: 615924 - protein, 6 aa, Mycobacterium
YEPESA

SEQ ID NO: 615925 - protein, 14 aa, Mycobacterium
YEPEYRPPPELPSV

SEQ ID NO: 615926 - protein, 9 aa, Mycobacterium
YEPGHDDDG

SEQ ID NO: 615927 - protein, 6 aa, Mycobacterium
YEPGQK

SEQ ID NO: 615928 - protein, 5 aa, Mycobacterium
YEPGS

SEQ ID NO: 615929 - protein, 9 aa, Mycobacterium
YEPGSVEPT

SEQ ID NO: 615930 - protein, 10 aa, Mycobacterium
YEPGSVTPTT

SEQ ID NO: 615931 - protein, 10 aa, Mycobacterium
YEPGTVTPTT

SEQ ID NO: 615932 - protein, 4 aa, Mycobacterium
YEPK

SEQ ID NO: 615933 - protein, 12 aa, Mycobacterium
YEPNAPDGIDYQ

SEQ ID NO: 615934 - protein, 12 aa, Mycobacterium
YEPNAPDGVDYQ

SEQ ID NO: 615935 - protein, 7 aa, Mycobacterium
YEPPDAD

SEQ ID NO: 615936 - protein, 8 aa, Mycobacterium
YEPPSPVQ

SEQ ID NO: 615937 - protein, 9 aa, Mycobacterium
YEPQSDPAE

SEQ ID NO: 615938 - protein, 10 aa, Mycobacterium
YEPQTDPAER

SEQ ID NO: 615939 - protein, 9 aa, Mycobacterium
YEPRDADAY

SEQ ID NO: 615940 - protein, 10 aa, Mycobacterium
YEPRRTDGEV

SEQ ID NO: 615941 - protein, 4 aa, Mycobacterium
YEPS

SEQ ID NO: 615942 - protein, 11 aa, Mycobacterium
YEPSSGQKMTI

SEQ ID NO: 615943 - protein, 7 aa, Mycobacterium
YEPSSGR

SEQ ID NO: 615944 - protein, 6 aa, Mycobacterium
YEPTAK

SEQ ID NO: 615945 - protein, 12 aa, Mycobacterium
YEPTKPDRNRVS

SEQ ID NO: 615946 - protein, 6 aa, Mycobacterium
YEPTPL

SEQ ID NO: 615947 - protein, 13 aa, Mycobacterium
YEPTRGSATVSGR

SEQ ID NO: 615948 - protein, 10 aa, Mycobacterium
YEPTRGSSYI

SEQ ID NO: 615949 - protein, 9 aa, Mycobacterium
YEQDPNDTG

SEQ ID NO: 615950 - protein, 9 aa, Mycobacterium
YEQERKPHA

SEQ ID NO: 615951 - protein, 12 aa, Mycobacterium
YEQHDGTSDELR

SEQ ID NO: 615952 - protein, 5 aa, Mycobacterium
YEQMP

SEQ ID NO: 615953 - protein, 11 aa, Mycobacterium
YEQNPKRTWEA

SEQ ID NO: 615954 - protein, 8 aa, Mycobacterium
YEQQTGRK

SEQ ID NO: 615955 - protein, 6 aa, Mycobacterium
YEQSEP

SEQ ID NO: 615956 - protein, 14 aa, Mycobacterium
YEQTPVQDLESSGS

SEQ ID NO: 615957 - protein, 6 aa, Mycobacterium
YEQTTV

SEQ ID NO: 615958 - protein, 8 aa, Mycobacterium
YERDNNVP

SEQ ID NO: 615959 - protein, 7 aa, Mycobacterium
YERDRPG

SEQ ID NO: 615960 - protein, 8 aa, Mycobacterium
YERESNVP

SEQ ID NO: 615961 - protein, 11 aa, Mycobacterium
YERGERPAVPG

SEQ ID NO: 615962 - protein, 11 aa, Mycobacterium
YERGGGPVTRY

SEQ ID NO: 615963 - protein, 15 aa, Mycobacterium
YERGPLGLPTSAEIQ

SEQ ID NO: 615964 - protein, 7 aa, Mycobacterium
YERGPNV

SEQ ID NO: 615965 - protein, 7 aa, Mycobacterium
YERNGER

SEQ ID NO: 615966 - protein, 4 aa, Mycobacterium
YERP

SEQ ID NO: 615967 - protein, 23 aa, Mycobacterium
YERPGEVQERPAPRRSDPADRVT

SEQ ID NO: 615968 - protein, 7 aa, Mycobacterium
YERPQSA

SEQ ID NO: 615969 - protein, 9 aa, Mycobacterium
YERPRAEGP

SEQ ID NO: 615970 - protein, 7 aa, Mycobacterium
YERPSRP

SEQ ID NO: 615971 - protein, 6 aa, Mycobacterium
YERREE

SEQ ID NO: 615972 - protein, 5 aa, Mycobacterium
YERRG

SEQ ID NO: 615973 - protein, 9 aa, Mycobacterium
YERRSRGTA

SEQ ID NO: 615974 - protein, 6 aa, Mycobacterium
YERSGD

SEQ ID NO: 615975 - protein, 7 aa, Mycobacterium
YERSGGA

SEQ ID NO: 615976 - protein, 12 aa, Mycobacterium
YERSPDNKIYAS

SEQ ID NO: 615977 - protein, 11 aa, Mycobacterium
YERSRTVAADR

SEQ ID NO: 615978 - protein, 20 aa, Mycobacterium
YERTAAELSPSEKDAVSHRG

SEQ ID NO: 615979 - protein, 43 aa, Mycobacterium
YERTDAEEDGADAKERSVPYQSGSGGPPVEGAAGDIPNDPTLQ

SEQ ID NO: 615980 - protein, 8 aa, Mycobacterium
YERTGDAP

SEQ ID NO: 615981 - protein, 5 aa, Mycobacterium
YESAR

SEQ ID NO: 615982 - protein, 5 aa, Mycobacterium
YESAT

SEQ ID NO: 615983 - protein, 4 aa, Mycobacterium
YESG

SEQ ID NO: 615984 - protein, 10 aa, Mycobacterium
YESGDPKLSA

SEQ ID NO: 615985 - protein, 8 aa, Mycobacterium
YESGEGPD

SEQ ID NO: 615986 - protein, 8 aa, Mycobacterium
YESGYDRD

SEQ ID NO: 615987 - protein, 10 aa, Mycobacterium
YESHSAPVEG

SEQ ID NO: 615988 - protein, 4 aa, Mycobacterium
YESK

SEQ ID NO: 615989 - protein, 16 aa, Mycobacterium
YESKFGKDQTGLHGEK

SEQ ID NO: 615990 - protein, 5 aa, Mycobacterium
YESNQ

SEQ ID NO: 615991 - protein, 18 aa, Mycobacterium
YESPAAEDETWDRPDATP

SEQ ID NO: 615992 - protein, 18 aa, Mycobacterium
YESPAPEDETWDRPDAQP

SEQ ID NO: 615993 - protein, 18 aa, Mycobacterium
YESPAPEDETWDRTDATP

SEQ ID NO: 615994 - protein, 10 aa, Mycobacterium
YESPGGAGEL

SEQ ID NO: 615995 - protein, 8 aa, Mycobacterium
YESPTGIQ

SEQ ID NO: 615996 - protein, 10 aa, Mycobacterium
YESRSAPIEG

SEQ ID NO: 615997 - protein, 11 aa, Mycobacterium
YESRSAPVEGG

SEQ ID NO: 615998 - protein, 17 aa, Mycobacterium
YESRSSAVSARPDRWRR

SEQ ID NO: 615999 - protein, 5 aa, Mycobacterium
YESRT

SEQ ID NO: 616000 - protein, 10 aa, Mycobacterium
YESSTAPGAW

SEQ ID NO: 616001 - protein, 6 aa, Mycobacterium
YESTDV

SEQ ID NO: 616002 - protein, 7 aa, Mycobacterium
YESTGAY

SEQ ID NO: 616003 - protein, 23 aa, Mycobacterium
YETAAPDGASTSGPLEGPRGTDP

SEQ ID NO: 616004 - protein, 31 aa, Mycobacterium
YETAGAAAGLTEDTAAQREADAEFDDDTEEE

SEQ ID NO: 616005 - protein, 4 aa, Mycobacterium
YETD

SEQ ID NO: 616006 - protein, 6 aa, Mycobacterium
YETDEH

SEQ ID NO: 616007 - protein, 6 aa, Mycobacterium
YETEES

SEQ ID NO: 616008 - protein, 12 aa, Mycobacterium
YETGAGGSAPKH

SEQ ID NO: 616009 - protein, 13 aa, Mycobacterium
YETGASGEYRHPE

SEQ ID NO: 616010 - protein, 11 aa, Mycobacterium
YETGSTLSSRL

SEQ ID NO: 616011 - protein, 11 aa, Mycobacterium
YETKKKLAKRY

SEQ ID NO: 616012 - protein, 7 aa, Mycobacterium
YETNRTR

SEQ ID NO: 616013 - protein, 6 aa, Mycobacterium
YETPEF

SEQ ID NO: 616014 - protein, 8 aa, Mycobacterium
YETSDGGT

SEQ ID NO: 616015 - protein, 5 aa, Mycobacterium
YETSF

SEQ ID NO: 616016 - protein, 10 aa, Mycobacterium
YETTSADGDR

SEQ ID NO: 616017 - protein, 9 aa, Mycobacterium
YEVSNPDAV

SEQ ID NO: 616018 - protein, 9 aa, Mycobacterium
YEVSNPDSV

SEQ ID NO: 616019 - protein, 25 aa, Mycobacterium
YEYADGKRSVQAPDPSDAAQIEEAR

SEQ ID NO: 616020 - protein, 11 aa, Mycobacterium
YFGGAGPARTG

SEQ ID NO: 616021 - protein, 16 aa, Mycobacterium
YFGPRPAAEHGRDIPL

SEQ ID NO: 616022 - protein, 11 aa, Mycobacterium
YFGPRPKNPLN

SEQ ID NO: 616023 - protein, 9 aa, Mycobacterium
YFKGPKSMY

SEQ ID NO: 616024 - protein, 9 aa, Mycobacterium
YFPAPGVEP

SEQ ID NO: 616025 - protein, 9 aa, Mycobacterium
YFPAPGVQP

SEQ ID NO: 616026 - protein, 4 aa, Mycobacterium
YFPG

SEQ ID NO: 616027 - protein, 5 aa, Mycobacterium
YFPGP

SEQ ID NO: 616028 - protein, 9 aa, Mycobacterium
YFPGPARWQ

SEQ ID NO: 616029 - protein, 4 aa, Mycobacterium
YFTE

SEQ ID NO: 616030 - protein, 4 aa, Mycobacterium
YFTG

SEQ ID NO: 616031 - protein, 10 aa, Mycobacterium
YGAADPETAI

SEQ ID NO: 616032 - protein, 9 aa, Mycobacterium
YGAAGLPDD

SEQ ID NO: 616033 - protein, 5 aa, Mycobacterium
YGAAK

SEQ ID NO: 616034 - protein, 12 aa, Mycobacterium
YGAARATLAGAR

SEQ ID NO: 616035 - protein, 4 aa, Mycobacterium
YGAC

SEQ ID NO: 616036 - protein, 13 aa, Mycobacterium
YGADDAPAMPSQP

SEQ ID NO: 616037 - protein, 6 aa, Mycobacterium
YGADGH

SEQ ID NO: 616038 - protein, 5 aa, Mycobacterium
YGADI

SEQ ID NO: 616039 - protein, 10 aa, Mycobacterium
YGADPQEVDD

SEQ ID NO: 616040 - protein, 8 aa, Mycobacterium
YGADPTLA

SEQ ID NO: 616041 - protein, 9 aa, Mycobacterium
YGADRDPRR

SEQ ID NO: 616042 - protein, 5 aa, Mycobacterium
YGADV

SEQ ID NO: 616043 - protein, 5 aa, Mycobacterium
YGAEA

SEQ ID NO: 616044 - protein, 9 aa, Mycobacterium
YGAEDPEAA

SEQ ID NO: 616045 - protein, 9 aa, Mycobacterium
YGAESEAGR

SEQ ID NO: 616046 - protein, 9 aa, Mycobacterium
YGAESEDVP

SEQ ID NO: 616047 - protein, 5 aa, Mycobacterium
YGAEV

SEQ ID NO: 616048 - protein, 5 aa, Mycobacterium
YGAGA

SEQ ID NO: 616049 - protein, 11 aa, Mycobacterium
YGAGAQTDARN

SEQ ID NO: 616050 - protein, 11 aa, Mycobacterium
YGAGDWGRTPH

SEQ ID NO: 616051 - protein, 5 aa, Mycobacterium
YGAGF

SEQ ID NO: 616052 - protein, 7 aa, Mycobacterium
YGAGGGV

SEQ ID NO: 616053 - protein, 6 aa, Mycobacterium
YGAGHG

SEQ ID NO: 616054 - protein, 5 aa, Mycobacterium
YGAGN

SEQ ID NO: 616055 - protein, 5 aa, Mycobacterium
YGAGS

SEQ ID NO: 616056 - protein, 16 aa, Mycobacterium
YGAKDRDGTQTQGGYS

SEQ ID NO: 616057 - protein, 7 aa, Mycobacterium
YGAKTDK

SEQ ID NO: 616058 - protein, 8 aa, Mycobacterium
YGAKTDRA

SEQ ID NO: 616059 - protein, 15 aa, Mycobacterium
YGALPDDARRAKAAQ

SEQ ID NO: 616060 - protein, 5 aa, Mycobacterium
YGAPD

SEQ ID NO: 616061 - protein, 8 aa, Mycobacterium
YGAPPHGG

SEQ ID NO: 616062 - protein, 8 aa, Mycobacterium
YGAPRAST

SEQ ID NO: 616063 - protein, 9 aa, Mycobacterium
YGAQDPAAA

SEQ ID NO: 616064 - protein, 9 aa, Mycobacterium
YGAQNPEAA

SEQ ID NO: 616065 - protein, 5 aa, Mycobacterium
YGAQP

SEQ ID NO: 616066 - protein, 17 aa, Mycobacterium
YGARTGGRSKVSGSLRG

SEQ ID NO: 616067 - protein, 4 aa, Mycobacterium
YGAS

SEQ ID NO: 616068 - protein, 5 aa, Mycobacterium
YGASA

SEQ ID NO: 616069 - protein, 9 aa, Mycobacterium
YGASAVPSQ

SEQ ID NO: 616070 - protein, 18 aa, Mycobacterium
YGASGDQSRGVVDGKPAD

SEQ ID NO: 616071 - protein, 19 aa, Mycobacterium
YGASGLASSGYDKQTTAAD

SEQ ID NO: 616072 - protein, 4 aa, Mycobacterium
YGAT

SEQ ID NO: 616073 - protein, 8 aa, Mycobacterium
YGATETTP

SEQ ID NO: 616074 - protein, 12 aa, Mycobacterium
YGATGHRLDDPA

SEQ ID NO: 616075 - protein, 7 aa, Mycobacterium
YGATKDK

SEQ ID NO: 616076 - protein, 10 aa, Mycobacterium
YGATKTAAED

SEQ ID NO: 616077 - protein, 8 aa, Mycobacterium
YGATPNPA

SEQ ID NO: 616078 - protein, 7 aa, Mycobacterium
YGATTAK

SEQ ID NO: 616079 - protein, 4 aa, Mycobacterium
YGAV

SEQ ID NO: 616080 - protein, 18 aa, Mycobacterium
YGDAANRNLEYGGSGLPT

SEQ ID NO: 616081 - protein, 6 aa, Mycobacterium
YGDADK

SEQ ID NO: 616082 - protein, 10 aa, Mycobacterium
YGDAEDGDTD

SEQ ID NO: 616083 - protein, 6 aa, Mycobacterium
YGDAGG

SEQ ID NO: 616084 - protein, 19 aa, Mycobacterium
YGDASVSPSPADVPPAARG

SEQ ID NO: 616085 - protein, 10 aa, Mycobacterium
YGDATDPQAE

SEQ ID NO: 616086 - protein, 8 aa, Mycobacterium
YGDATGDV

SEQ ID NO: 616087 - protein, 7 aa, Mycobacterium
YGDDRRT

SEQ ID NO: 616088 - protein, 17 aa, Mycobacterium
YGDDRSAHDSASEQCGF

SEQ ID NO: 616089 - protein, 7 aa, Mycobacterium
YGDDSSA

SEQ ID NO: 616090 - protein, 10 aa, Mycobacterium
YGDEGGWPGL

SEQ ID NO: 616091 - protein, 5 aa, Mycobacterium
YGDEK

SEQ ID NO: 616092 - protein, 11 aa, Mycobacterium
YGDEPMPTQEE

SEQ ID NO: 616093 - protein, 12 aa, Mycobacterium
YGDEPTPSQEQI

SEQ ID NO: 616094 - protein, 11 aa, Mycobacterium
YGDEPTPTQEE

SEQ ID NO: 616095 - protein, 6 aa, Mycobacterium
YGDESR

SEQ ID NO: 616096 - protein, 4 aa, Mycobacterium
YGDG

SEQ ID NO: 616097 - protein, 5 aa, Mycobacterium
YGDGE

SEQ ID NO: 616098 - protein, 8 aa, Mycobacterium
YGDGELPY

SEQ ID NO: 616099 - protein, 30 aa, Mycobacterium
YGDGGAGGIGGMGAADPSAAGGAGGAGGSA

SEQ ID NO: 616100 - protein, 9 aa, Mycobacterium
YGDGGHTHA

SEQ ID NO: 616101 - protein, 12 aa, Mycobacterium
YGDGIDPERPDY

SEQ ID NO: 616102 - protein, 18 aa, Mycobacterium
YGDGNSGVLAQSGGVGGN

SEQ ID NO: 616103 - protein, 9 aa, Mycobacterium
YGDGPSGPH

SEQ ID NO: 616104 - protein, 9 aa, Mycobacterium
YGDGRTGPK

SEQ ID NO: 616105 - protein, 9 aa, Mycobacterium
YGDGSGGLP

SEQ ID NO: 616106 - protein, 8 aa, Mycobacterium
YGDGYPAV

SEQ ID NO: 616107 - protein, 8 aa, Mycobacterium
YGDHGRTG

SEQ ID NO: 616108 - protein, 4 aa, Mycobacterium
YGDL

SEQ ID NO: 616109 - protein, 5 aa, Mycobacterium
YGDNH

SEQ ID NO: 616110 - protein, 7 aa, Mycobacterium
YGDPAGR

SEQ ID NO: 616111 - protein, 16 aa, Mycobacterium
YGDPAGYGSGNSRNGR

SEQ ID NO: 616112 - protein, 6 aa, Mycobacterium
YGDPAL

SEQ ID NO: 616113 - protein, 5 aa, Mycobacterium
YGDPL

SEQ ID NO: 616114 - protein, 13 aa, Mycobacterium
YGDPSESADAAAE

SEQ ID NO: 616115 - protein, 7 aa, Mycobacterium
YGDPTLP

SEQ ID NO: 616116 - protein, 13 aa, Mycobacterium
YGDPTNKPNPNLG

SEQ ID NO: 616117 - protein, 14 aa, Mycobacterium
YGDPTNKPNPNLGE

SEQ ID NO: 616118 - protein, 13 aa, Mycobacterium
YGDPTVKPNPNLR

SEQ ID NO: 616119 - protein, 6 aa, Mycobacterium
YGDQQA

SEQ ID NO: 616120 - protein, 19 aa, Mycobacterium
YGDRGLKGAMRGADRSGAS

SEQ ID NO: 616121 - protein, 9 aa, Mycobacterium
YGDRKDSAP

SEQ ID NO: 616122 - protein, 10 aa, Mycobacterium
YGDRLRDPRT

SEQ ID NO: 616123 - protein, 5 aa, Mycobacterium
YGDRP

SEQ ID NO: 616124 - protein, 8 aa, Mycobacterium
YGDRPALG

SEQ ID NO: 616125 - protein, 9 aa, Mycobacterium
YGDRTPGGI

SEQ ID NO: 616126 - protein, 20 aa, Mycobacterium
YGDSAGPNRTPGAYSPFGRG

SEQ ID NO: 616127 - protein, 11 aa, Mycobacterium
YGDSDSDSSAG

SEQ ID NO: 616128 - protein, 5 aa, Mycobacterium
YGDSG

SEQ ID NO: 616129 - protein, 8 aa, Mycobacterium
YGDSLSAG

SEQ ID NO: 616130 - protein, 9 aa, Mycobacterium
YGDSSGGSY

SEQ ID NO: 616131 - protein, 5 aa, Mycobacterium
YGDTD

SEQ ID NO: 616132 - protein, 6 aa, Mycobacterium
YGDTTR

SEQ ID NO: 616133 - protein, 5 aa, Mycobacterium
YGDTV

SEQ ID NO: 616134 - protein, 11 aa, Mycobacterium
YGDYNDSATVT

SEQ ID NO: 616135 - protein, 4 aa, Mycobacterium
YGEA

SEQ ID NO: 616136 - protein, 11 aa, Mycobacterium
YGEAPSPDGKS

SEQ ID NO: 616137 - protein, 7 aa, Mycobacterium
YGEASAD

SEQ ID NO: 616138 - protein, 6 aa, Mycobacterium
YGEATD

SEQ ID NO: 616139 - protein, 4 aa, Mycobacterium
YGED

SEQ ID NO: 616140 - protein, 12 aa, Mycobacterium
YGEDAGDEEDLE

SEQ ID NO: 616141 - protein, 12 aa, Mycobacterium
YGEDDMATTEAA

SEQ ID NO: 616142 - protein, 11 aa, Mycobacterium
YGEDEGGEDDL

SEQ ID NO: 616143 - protein, 16 aa, Mycobacterium
YGEDEGGEEDLQTRPP

SEQ ID NO: 616144 - protein, 16 aa, Mycobacterium
YGEDEGGEEDLRTRPP

SEQ ID NO: 616145 - protein, 16 aa, Mycobacterium
YGEDEGTEEDLQTRPP

SEQ ID NO: 616146 - protein, 6 aa, Mycobacterium
YGEDPE

SEQ ID NO: 616147 - protein, 16 aa, Mycobacterium
YGEDSGDESELQTRPP

SEQ ID NO: 616148 - protein, 16 aa, Mycobacterium
YGEDTGDEADLQTRPP

SEQ ID NO: 616149 - protein, 11 aa, Mycobacterium
YGEDYASGAAR

SEQ ID NO: 616150 - protein, 12 aa, Mycobacterium
YGEEDKNVTDRA

SEQ ID NO: 616151 - protein, 9 aa, Mycobacterium
YGEELDPDT

SEQ ID NO: 616152 - protein, 8 aa, Mycobacterium
YGEGDRVD

SEQ ID NO: 616153 - protein, 14 aa, Mycobacterium
YGEGEGSEAFKAKL

SEQ ID NO: 616154 - protein, 9 aa, Mycobacterium
YGEGEMPDN

SEQ ID NO: 616155 - protein, 11 aa, Mycobacterium
YGEGESAQQFK

SEQ ID NO: 616156 - protein, 10 aa, Mycobacterium
YGEGPDSEAF

SEQ ID NO: 616157 - protein, 8 aa, Mycobacterium
YGEGRDVD

SEQ ID NO: 616158 - protein, 7 aa, Mycobacterium
YGEHEPS

SEQ ID NO: 616159 - protein, 8 aa, Mycobacterium
YGEHGREG

SEQ ID NO: 616160 - protein, 4 aa, Mycobacterium
YGEL

SEQ ID NO: 616161 - protein, 6 aa, Mycobacterium
YGENAW

SEQ ID NO: 616162 - protein, 8 aa, Mycobacterium
YGENGLQA

SEQ ID NO: 616163 - protein, 12 aa, Mycobacterium
YGENGPDADRAA

SEQ ID NO: 616164 - protein, 33 aa, Mycobacterium
YGEPALAADRDKPKSSVDHSRSGGRGKPKGPIP

SEQ ID NO: 616165 - protein, 12 aa, Mycobacterium
YGEPDHSRGPFP

SEQ ID NO: 616166 - protein, 7 aa, Mycobacterium
YGEPEHG

SEQ ID NO: 616167 - protein, 6 aa, Mycobacterium
YGEPSR

SEQ ID NO: 616168 - protein, 5 aa, Mycobacterium
YGEPV

SEQ ID NO: 616169 - protein, 4 aa, Mycobacterium
YGEQ

SEQ ID NO: 616170 - protein, 14 aa, Mycobacterium
YGEQSGRPAFGDDA

SEQ ID NO: 616171 - protein, 8 aa, Mycobacterium
YGEQSNNI

SEQ ID NO: 616172 - protein, 9 aa, Mycobacterium
YGEQSNNIS

SEQ ID NO: 616173 - protein, 4 aa, Mycobacterium
YGER

SEQ ID NO: 616174 - protein, 5 aa, Mycobacterium
YGERP

SEQ ID NO: 616175 - protein, 9 aa, Mycobacterium
YGESADDKT

SEQ ID NO: 616176 - protein, 12 aa, Mycobacterium
YGESGPDADRAA

SEQ ID NO: 616177 - protein, 6 aa, Mycobacterium
YGESIG

SEQ ID NO: 616178 - protein, 9 aa, Mycobacterium
YGESKPPEL

SEQ ID NO: 616179 - protein, 14 aa, Mycobacterium
YGESPHTALKRTTG

SEQ ID NO: 616180 - protein, 6 aa, Mycobacterium
YGESPY

SEQ ID NO: 616181 - protein, 12 aa, Mycobacterium
YGESQMDGEGRT

SEQ ID NO: 616182 - protein, 4 aa, Mycobacterium
YGET

SEQ ID NO: 616183 - protein, 13 aa, Mycobacterium
YGETGDPSAIRPT

SEQ ID NO: 616184 - protein, 11 aa, Mycobacterium
YGETTEAFGTT

SEQ ID NO: 616185 - protein, 8 aa, Mycobacterium
YGETTGAA

SEQ ID NO: 616186 - protein, 5 aa, Mycobacterium
YGFGE

SEQ ID NO: 616187 - protein, 5 aa, Mycobacterium
YGFSG

SEQ ID NO: 616188 - protein, 13 aa, Mycobacterium
YGFSGKPSSTGWG

SEQ ID NO: 616189 - protein, 12 aa, Mycobacterium
YGFSGKPTATGW

SEQ ID NO: 616190 - protein, 12 aa, Mycobacterium
YGFSGKPTGAGW

SEQ ID NO: 616191 - protein, 12 aa, Mycobacterium
YGFSGKPTRTGW

SEQ ID NO: 616192 - protein, 12 aa, Mycobacterium
YGFSGKPTTTGW

SEQ ID NO: 616193 - protein, 14 aa, Mycobacterium
YGGAGTWPTPREMS

SEQ ID NO: 616194 - protein, 6 aa, Mycobacterium
YGGAYG

SEQ ID NO: 616195 - protein, 4 aa, Mycobacterium
YGGD

SEQ ID NO: 616196 - protein, 5 aa, Mycobacterium
YGGDA

SEQ ID NO: 616197 - protein, 6 aa, Mycobacterium
YGGDAS

SEQ ID NO: 616198 - protein, 10 aa, Mycobacterium
YGGDPQRAAD

SEQ ID NO: 616199 - protein, 9 aa, Mycobacterium
YGGDQDHRI

SEQ ID NO: 616200 - protein, 5 aa, Mycobacterium
YGGEE

SEQ ID NO: 616201 - protein, 25 aa, Mycobacterium
YGGEVKGELEGYGLTGSTLSVTSGR

SEQ ID NO: 616202 - protein, 8 aa, Mycobacterium
YGGFEGNA

SEQ ID NO: 616203 - protein, 8 aa, Mycobacterium
YGGGGGTF

SEQ ID NO: 616204 - protein, 16 aa, Mycobacterium
YGGGRATPDLNAGGYV

SEQ ID NO: 616205 - protein, 9 aa, Mycobacterium
YGGGSSVVG

SEQ ID NO: 616206 - protein, 9 aa, Mycobacterium
YGGGTENPA

SEQ ID NO: 616207 - protein, 7 aa, Mycobacterium
YGGGTRR

SEQ ID NO: 616208 - protein, 5 aa, Mycobacterium
YGGGY

SEQ ID NO: 616209 - protein, 7 aa, Mycobacterium
YGGHDEV

SEQ ID NO: 616210 - protein, 10 aa, Mycobacterium
YGGHDTDAPR

SEQ ID NO: 616211 - protein, 11 aa, Mycobacterium
YGGHDTESPRL

SEQ ID NO: 616212 - protein, 29 aa, Mycobacterium
YGGKAPPRTGARHPTIAPYGPVTAGDGGT

SEQ ID NO: 616213 - protein, 9 aa, Mycobacterium
YGGKSTLKA

SEQ ID NO: 616214 - protein, 4 aa, Mycobacterium
YGGL

SEQ ID NO: 616215 - protein, 5 aa, Mycobacterium
YGGMG

SEQ ID NO: 616216 - protein, 20 aa, Mycobacterium
YGGNSGCPGSGGGGPAGGCV

SEQ ID NO: 616217 - protein, 25 aa, Mycobacterium
YGGPGLSSVPMSDRRTMAAQGAEVG

SEQ ID NO: 616218 - protein, 13 aa, Mycobacterium
YGGPPDGPWPDAA

SEQ ID NO: 616219 - protein, 10 aa, Mycobacterium
YGGPPPGESL

SEQ ID NO: 616220 - protein, 18 aa, Mycobacterium
YGGQDLSQHDAGAYTGEV

SEQ ID NO: 616221 - protein, 18 aa, Mycobacterium
YGGQDLSQHDSGAYTGDV

SEQ ID NO: 616222 - protein, 11 aa, Mycobacterium
YGGQDSPNDMQ

SEQ ID NO: 616223 - protein, 7 aa, Mycobacterium
YGGQGLP

SEQ ID NO: 616224 - protein, 14 aa, Mycobacterium
YGGRPAEADGQAGW

SEQ ID NO: 616225 - protein, 5 aa, Mycobacterium
YGGRQ

SEQ ID NO: 616226 - protein, 8 aa, Mycobacterium
YGGRQEIT

SEQ ID NO: 616227 - protein, 6 aa, Mycobacterium
YGGSAG

SEQ ID NO: 616228 - protein, 21 aa, Mycobacterium
YGGSGRANAEDFPDAEEARRA

SEQ ID NO: 616229 - protein, 14 aa, Mycobacterium
YGGSGYPAGKAAVN

SEQ ID NO: 616230 - protein, 10 aa, Mycobacterium
YGGSRDAAVA

SEQ ID NO: 616231 - protein, 12 aa, Mycobacterium
YGGTAGGVDADG

SEQ ID NO: 616232 - protein, 10 aa, Mycobacterium
YGGTEIKYGG

SEQ ID NO: 616233 - protein, 9 aa, Mycobacterium
YGGTETGPA

SEQ ID NO: 616234 - protein, 15 aa, Mycobacterium
YGGTGSFPVAETGDL

SEQ ID NO: 616235 - protein, 13 aa, Mycobacterium
YGGTGYPAGKGAV

SEQ ID NO: 616236 - protein, 7 aa, Mycobacterium
YGGTHGD

SEQ ID NO: 616237 - protein, 5 aa, Mycobacterium
YGGTI

SEQ ID NO: 616238 - protein, 10 aa, Mycobacterium
YGGTKSAWDY

SEQ ID NO: 616239 - protein, 8 aa, Mycobacterium
YGGTMTAA

SEQ ID NO: 616240 - protein, 15 aa, Mycobacterium
YGGTNEIMKEIIARS

SEQ ID NO: 616241 - protein, 28 aa, Mycobacterium
YGGTPPPYPGWPDRPPGEAVSCSAIEPT

SEQ ID NO: 616242 - protein, 9 aa, Mycobacterium
YGGTSDPKL

SEQ ID NO: 616243 - protein, 12 aa, Mycobacterium
YGGTVKSGVRDA

SEQ ID NO: 616244 - protein, 6 aa, Mycobacterium
YGGYKS

SEQ ID NO: 616245 - protein, 6 aa, Mycobacterium
YGGYTT

SEQ ID NO: 616246 - protein, 9 aa, Mycobacterium
YGHNNPKLK

SEQ ID NO: 616247 - protein, 12 aa, Mycobacterium
YGHPASAAPLWR

SEQ ID NO: 616248 - protein, 8 aa, Mycobacterium
YGHSRQPR

SEQ ID NO: 616249 - protein, 15 aa, Mycobacterium
YGIGEATARKLAAAG

SEQ ID NO: 616250 - protein, 10 aa, Mycobacterium
YGIGEATARR

SEQ ID NO: 616251 - protein, 21 aa, Mycobacterium
YGIGSDNPNKVVTTDFKIVAE

SEQ ID NO: 616252 - protein, 10 aa, Mycobacterium
YGIPPTSARA

SEQ ID NO: 616253 - protein, 16 aa, Mycobacterium
YGKDKVPVRKKRGRGY

SEQ ID NO: 616254 - protein, 7 aa, Mycobacterium
YGKDRLP

SEQ ID NO: 616255 - protein, 7 aa, Mycobacterium
YGKEGPA

SEQ ID NO: 616256 - protein, 9 aa, Mycobacterium
YGKGDTPCA

SEQ ID NO: 616257 - protein, 9 aa, Mycobacterium
YGKGRCADA

SEQ ID NO: 616258 - protein, 13 aa, Mycobacterium
YGKPEEKEVFADL

SEQ ID NO: 616259 - protein, 17 aa, Mycobacterium
YGKPEFTTDATHYTPAM

SEQ ID NO: 616260 - protein, 23 aa, Mycobacterium
YGKPGGSAPSDFTRGRSGGVHDA

SEQ ID NO: 616261 - protein, 12 aa, Mycobacterium
YGKPGGTAPSDF

SEQ ID NO: 616262 - protein, 13 aa, Mycobacterium
YGKPGGTAPSDFT

SEQ ID NO: 616263 - protein, 4 aa, Mycobacterium
YGKT

SEQ ID NO: 616264 - protein, 9 aa, Mycobacterium
YGKTESPTL

SEQ ID NO: 616265 - protein, 6 aa, Mycobacterium
YGKTGW

SEQ ID NO: 616266 - protein, 14 aa, Mycobacterium
YGKTPDNPFPSGEV

SEQ ID NO: 616267 - protein, 5 aa, Mycobacterium
YGLGA

SEQ ID NO: 616268 - protein, 13 aa, Mycobacterium
YGLGKDKGADSCA

SEQ ID NO: 616269 - protein, 12 aa, Mycobacterium
YGLGKGQSESAC

SEQ ID NO: 616270 - protein, 10 aa, Mycobacterium
YGLGNRPGGI

SEQ ID NO: 616271 - protein, 7 aa, Mycobacterium
YGLGTSQ

SEQ ID NO: 616272 - protein, 6 aa, Mycobacterium
YGLPDT

SEQ ID NO: 616273 - protein, 5 aa, Mycobacterium
YGLPG

SEQ ID NO: 616274 - protein, 8 aa, Mycobacterium
YGLPGTIA

SEQ ID NO: 616275 - protein, 6 aa, Mycobacterium
YGLSGT

SEQ ID NO: 616276 - protein, 6 aa, Mycobacterium
YGLSNT

SEQ ID NO: 616277 - protein, 12 aa, Mycobacterium
YGLSSAPQVTGD

SEQ ID NO: 616278 - protein, 9 aa, Mycobacterium
YGLTEPASC

SEQ ID NO: 616279 - protein, 23 aa, Mycobacterium
YGLTSSPKAADGTLPTQDEGVGV

SEQ ID NO: 616280 - protein, 6 aa, Mycobacterium
YGMSGS

SEQ ID NO: 616281 - protein, 4 aa, Mycobacterium
YGNA

SEQ ID NO: 616282 - protein, 14 aa, Mycobacterium
YGNAADKQKVQGGQ

SEQ ID NO: 616283 - protein, 13 aa, Mycobacterium
YGNAADKQKVQGR

SEQ ID NO: 616284 - protein, 8 aa, Mycobacterium
YGNEEQKQ

SEQ ID NO: 616285 - protein, 8 aa, Mycobacterium
YGNEEQRA

SEQ ID NO: 616286 - protein, 11 aa, Mycobacterium
YGNEKEVRQGI

SEQ ID NO: 616287 - protein, 11 aa, Mycobacterium
YGNEKQVAQGI

SEQ ID NO: 616288 - protein, 14 aa, Mycobacterium
YGNGGNGGGAGDTG

SEQ ID NO: 616289 - protein, 33 aa, Mycobacterium
YGNGGNGGNGVNGGSGGKGGSAGTLGTPGQNGS

SEQ ID NO: 616290 - protein, 8 aa, Mycobacterium
YGNHADDQ

SEQ ID NO: 616291 - protein, 4 aa, Mycobacterium
YGNK

SEQ ID NO: 616292 - protein, 5 aa, Mycobacterium
YGNKI

SEQ ID NO: 616293 - protein, 10 aa, Mycobacterium
YGNPADSDTA

SEQ ID NO: 616294 - protein, 10 aa, Mycobacterium
YGNPAESDTA

SEQ ID NO: 616295 - protein, 9 aa, Mycobacterium
YGNPDDPAD

SEQ ID NO: 616296 - protein, 9 aa, Mycobacterium
YGNPDDPDD

SEQ ID NO: 616297 - protein, 7 aa, Mycobacterium
YGNPEAT

SEQ ID NO: 616298 - protein, 7 aa, Mycobacterium
YGNPSER

SEQ ID NO: 616299 - protein, 6 aa, Mycobacterium
YGNQPS

SEQ ID NO: 616300 - protein, 6 aa, Mycobacterium
YGNRPG

SEQ ID NO: 616301 - protein, 9 aa, Mycobacterium
YGNSPQAQK

SEQ ID NO: 616302 - protein, 13 aa, Mycobacterium
YGNSRIDAEQYQG

SEQ ID NO: 616303 - protein, 12 aa, Mycobacterium
YGNTPANPAQLT

SEQ ID NO: 616304 - protein, 16 aa, Mycobacterium
YGNTSGNGGAGGNGGV

SEQ ID NO: 616305 - protein, 11 aa, Mycobacterium
YGPAADAVTNA

SEQ ID NO: 616306 - protein, 16 aa, Mycobacterium
YGPADRGAEPPQPGEF

SEQ ID NO: 616307 - protein, 10 aa, Mycobacterium
YGPAEGPDAR

SEQ ID NO: 616308 - protein, 6 aa, Mycobacterium
YGPAGA

SEQ ID NO: 616309 - protein, 12 aa, Mycobacterium
YGPAGGLPADDP

SEQ ID NO: 616310 - protein, 7 aa, Mycobacterium
YGPARRA

SEQ ID NO: 616311 - protein, 11 aa, Mycobacterium
YGPASASMAAA

SEQ ID NO: 616312 - protein, 9 aa, Mycobacterium
YGPATNNQI

SEQ ID NO: 616313 - protein, 5 aa, Mycobacterium
YGPDD

SEQ ID NO: 616314 - protein, 9 aa, Mycobacterium
YGPDEITPT

SEQ ID NO: 616315 - protein, 5 aa, Mycobacterium
YGPDG

SEQ ID NO: 616316 - protein, 15 aa, Mycobacterium
YGPDGDRVSDPQTLQ

SEQ ID NO: 616317 - protein, 9 aa, Mycobacterium
YGPDGQRLG

SEQ ID NO: 616318 - protein, 11 aa, Mycobacterium
YGPDGQRQDAG

SEQ ID NO: 616319 - protein, 7 aa, Mycobacterium
YGPDNEL

SEQ ID NO: 616320 - protein, 5 aa, Mycobacterium
YGPDR

SEQ ID NO: 616321 - protein, 6 aa, Mycobacterium
YGPDRV

SEQ ID NO: 616322 - protein, 12 aa, Mycobacterium
YGPDSHQQMGPA

SEQ ID NO: 616323 - protein, 12 aa, Mycobacterium
YGPDSREQLDTA

SEQ ID NO: 616324 - protein, 16 aa, Mycobacterium
YGPDSVGSALTGDPRV

SEQ ID NO: 616325 - protein, 5 aa, Mycobacterium
YGPDT

SEQ ID NO: 616326 - protein, 8 aa, Mycobacterium
YGPDTEAA

SEQ ID NO: 616327 - protein, 5 aa, Mycobacterium
YGPDV

SEQ ID NO: 616328 - protein, 19 aa, Mycobacterium
YGPDVTTTATVGADASTTG

SEQ ID NO: 616329 - protein, 4 aa, Mycobacterium
YGPE

SEQ ID NO: 616330 - protein, 6 aa, Mycobacterium
YGPEDP

SEQ ID NO: 616331 - protein, 7 aa, Mycobacterium
YGPEDPV

SEQ ID NO: 616332 - protein, 11 aa, Mycobacterium
YGPEGGAAADR

SEQ ID NO: 616333 - protein, 11 aa, Mycobacterium
YGPEGGAPADR

SEQ ID NO: 616334 - protein, 6 aa, Mycobacterium
YGPEGQ

SEQ ID NO: 616335 - protein, 5 aa, Mycobacterium
YGPEH

SEQ ID NO: 616336 - protein, 5 aa, Mycobacterium
YGPEI

SEQ ID NO: 616337 - protein, 6 aa, Mycobacterium
YGPEKV

SEQ ID NO: 616338 - protein, 5 aa, Mycobacterium
YGPEV

SEQ ID NO: 616339 - protein, 15 aa, Mycobacterium
YGPEWSEPTRDAHNE

SEQ ID NO: 616340 - protein, 9 aa, Mycobacterium
YGPFTTQDG

SEQ ID NO: 616341 - protein, 14 aa, Mycobacterium
YGPGDEAAHPLPDN

SEQ ID NO: 616342 - protein, 15 aa, Mycobacterium
YGPGDLKGKTLELDP

SEQ ID NO: 616343 - protein, 17 aa, Mycobacterium
YGPGDRTAEPPPPGEYP

SEQ ID NO: 616344 - protein, 13 aa, Mycobacterium
YGPGELPDTEPGI

SEQ ID NO: 616345 - protein, 5 aa, Mycobacterium
YGPGG

SEQ ID NO: 616346 - protein, 6 aa, Mycobacterium
YGPGLQ

SEQ ID NO: 616347 - protein, 10 aa, Mycobacterium
YGPGPSLPAG

SEQ ID NO: 616348 - protein, 11 aa, Mycobacterium
YGPGQSLTNSY

SEQ ID NO: 616349 - protein, 14 aa, Mycobacterium
YGPGTRKAPRPGTP

SEQ ID NO: 616350 - protein, 12 aa, Mycobacterium
YGPKDPAFPTPG

SEQ ID NO: 616351 - protein, 5 aa, Mycobacterium
YGPKG

SEQ ID NO: 616352 - protein, 8 aa, Mycobacterium
YGPLPEPA

SEQ ID NO: 616353 - protein, 18 aa, Mycobacterium
YGPNQEVADATSFTPSAA

SEQ ID NO: 616354 - protein, 6 aa, Mycobacterium
YGPNRD

SEQ ID NO: 616355 - protein, 9 aa, Mycobacterium
YGPNSGAGA

SEQ ID NO: 616356 - protein, 6 aa, Mycobacterium
YGPPAS

SEQ ID NO: 616357 - protein, 5 aa, Mycobacterium
YGPPE

SEQ ID NO: 616358 - protein, 7 aa, Mycobacterium
YGPPGPV

SEQ ID NO: 616359 - protein, 9 aa, Mycobacterium
YGPPPDPRI

SEQ ID NO: 616360 - protein, 9 aa, Mycobacterium
YGPPPDPRL

SEQ ID NO: 616361 - protein, 19 aa, Mycobacterium
YGPPPDPRLESTTITPDPG

SEQ ID NO: 616362 - protein, 26 aa, Mycobacterium
YGPPRRWQKSKDPDQGSDRRRAEQVE

SEQ ID NO: 616363 - protein, 19 aa, Mycobacterium
YGPPTDPRITSTTITPDPG

SEQ ID NO: 616364 - protein, 4 aa, Mycobacterium
YGPQ

SEQ ID NO: 616365 - protein, 11 aa, Mycobacterium
YGPQGGAPADR

SEQ ID NO: 616366 - protein, 6 aa, Mycobacterium
YGPQGV

SEQ ID NO: 616367 - protein, 11 aa, Mycobacterium
YGPQNELPPTD

SEQ ID NO: 616368 - protein, 11 aa, Mycobacterium
YGPQSDGSLSP

SEQ ID NO: 616369 - protein, 16 aa, Mycobacterium
YGPRAGGKSKVSGSLR

SEQ ID NO: 616370 - protein, 13 aa, Mycobacterium
YGPRASVADAYSG

SEQ ID NO: 616371 - protein, 8 aa, Mycobacterium
YGPREGES

SEQ ID NO: 616372 - protein, 6 aa, Mycobacterium
YGPRGR

SEQ ID NO: 616373 - protein, 7 aa, Mycobacterium
YGPRGTR

SEQ ID NO: 616374 - protein, 9 aa, Mycobacterium
YGPRQRPHG

SEQ ID NO: 616375 - protein, 16 aa, Mycobacterium
YGPRSAKKDKAEIKRS

SEQ ID NO: 616376 - protein, 15 aa, Mycobacterium
YGPRSKKLDKGEIRK

SEQ ID NO: 616377 - protein, 16 aa, Mycobacterium
YGPRTGGKSKVSGSLR

SEQ ID NO: 616378 - protein, 7 aa, Mycobacterium
YGPSETT

SEQ ID NO: 616379 - protein, 6 aa, Mycobacterium
YGPSGI

SEQ ID NO: 616380 - protein, 6 aa, Mycobacterium
YGPSPL

SEQ ID NO: 616381 - protein, 8 aa, Mycobacterium
YGPTEGTV

SEQ ID NO: 616382 - protein, 6 aa, Mycobacterium
YGPTES

SEQ ID NO: 616383 - protein, 8 aa, Mycobacterium
YGPTETTV

SEQ ID NO: 616384 - protein, 9 aa, Mycobacterium
YGPTGAGRQ

SEQ ID NO: 616385 - protein, 9 aa, Mycobacterium
YGPTGATAA

SEQ ID NO: 616386 - protein, 12 aa, Mycobacterium
YGPTGGLPADDP

SEQ ID NO: 616387 - protein, 7 aa, Mycobacterium
YGPTHRE

SEQ ID NO: 616388 - protein, 8 aa, Mycobacterium
YGPTTRRP

SEQ ID NO: 616389 - protein, 5 aa, Mycobacterium
YGPVQ

SEQ ID NO: 616390 - protein, 13 aa, Mycobacterium
YGPVRGTGDVRAK

SEQ ID NO: 616391 - protein, 6 aa, Mycobacterium
YGQAKH

SEQ ID NO: 616392 - protein, 6 aa, Mycobacterium
YGQARH

SEQ ID NO: 616393 - protein, 71 aa, Mycobacterium
YGQAVQGSEDFAARADTEPFGGSDGSGKELAASAPEATEAPEATEAPEAPEAPEATEAPEAPGTSRRRRNT

SEQ ID NO: 616394 - protein, 10 aa, Mycobacterium
YGQDRGPSGP

SEQ ID NO: 616395 - protein, 10 aa, Mycobacterium
YGQDRGSGGP

SEQ ID NO: 616396 - protein, 10 aa, Mycobacterium
YGQDRPPGRP

SEQ ID NO: 616397 - protein, 7 aa, Mycobacterium
YGQDRTE

SEQ ID NO: 616398 - protein, 12 aa, Mycobacterium
YGQEAADEIGAA

SEQ ID NO: 616399 - protein, 10 aa, Mycobacterium
YGQENALPTR

SEQ ID NO: 616400 - protein, 6 aa, Mycobacterium
YGQEQN

SEQ ID NO: 616401 - protein, 4 aa, Mycobacterium
YGQG

SEQ ID NO: 616402 - protein, 8 aa, Mycobacterium
YGQGETVD

SEQ ID NO: 616403 - protein, 11 aa, Mycobacterium
YGQGPGPGENI

SEQ ID NO: 616404 - protein, 9 aa, Mycobacterium
YGQGRPEER

SEQ ID NO: 616405 - protein, 6 aa, Mycobacterium
YGQNER

SEQ ID NO: 616406 - protein, 11 aa, Mycobacterium
YGQNPQTACDG

SEQ ID NO: 616407 - protein, 6 aa, Mycobacterium
YGQPGF

SEQ ID NO: 616408 - protein, 11 aa, Mycobacterium
YGQPPEAPQAE

SEQ ID NO: 616409 - protein, 7 aa, Mycobacterium
YGQPQAT

SEQ ID NO: 616410 - protein, 5 aa, Mycobacterium
YGQQS

SEQ ID NO: 616411 - protein, 8 aa, Mycobacterium
YGQRPDPA

SEQ ID NO: 616412 - protein, 6 aa, Mycobacterium
YGQSHY

SEQ ID NO: 616413 - protein, 14 aa, Mycobacterium
YGQSPHTTLRQQTP

SEQ ID NO: 616414 - protein, 5 aa, Mycobacterium
YGQTE

SEQ ID NO: 616415 - protein, 9 aa, Mycobacterium
YGQTRDEAC

SEQ ID NO: 616416 - protein, 4 aa, Mycobacterium
YGQV

SEQ ID NO: 616417 - protein, 7 aa, Mycobacterium
YGQVGDG

SEQ ID NO: 616418 - protein, 16 aa, Mycobacterium
YGQVGRPNRQAQRREE

SEQ ID NO: 616419 - protein, 9 aa, Mycobacterium
YGRADDPCA

SEQ ID NO: 616420 - protein, 5 aa, Mycobacterium
YGRAP

SEQ ID NO: 616421 - protein, 11 aa, Mycobacterium
YGRAPADDREL

SEQ ID NO: 616422 - protein, 6 aa, Mycobacterium
YGRDEC

SEQ ID NO: 616423 - protein, 9 aa, Mycobacterium
YGRDGRSTQ

SEQ ID NO: 616424 - protein, 8 aa, Mycobacterium
YGRDGSPF

SEQ ID NO: 616425 - protein, 13 aa, Mycobacterium
YGRDKQSANDRIA

SEQ ID NO: 616426 - protein, 14 aa, Mycobacterium
YGRDRTRTTRDSDR

SEQ ID NO: 616427 - protein, 6 aa, Mycobacterium
YGRDTE

SEQ ID NO: 616428 - protein, 15 aa, Mycobacterium
YGRESARKSRGNGLD

SEQ ID NO: 616429 - protein, 18 aa, Mycobacterium
YGRESDGTFTSGGTQSNL

SEQ ID NO: 616430 - protein, 4 aa, Mycobacterium
YGRG

SEQ ID NO: 616431 - protein, 7 aa, Mycobacterium
YGRGAEL

SEQ ID NO: 616432 - protein, 11 aa, Mycobacterium
YGRGGQSGRCK

SEQ ID NO: 616433 - protein, 11 aa, Mycobacterium
YGRGTSDMKGG

SEQ ID NO: 616434 - protein, 10 aa, Mycobacterium
YGRHDEGAGV

SEQ ID NO: 616435 - protein, 8 aa, Mycobacterium
YGRPATDV

SEQ ID NO: 616436 - protein, 5 aa, Mycobacterium
YGRPK

SEQ ID NO: 616437 - protein, 11 aa, Mycobacterium
YGRPPADDREL

SEQ ID NO: 616438 - protein, 7 aa, Mycobacterium
YGRPSER

SEQ ID NO: 616439 - protein, 7 aa, Mycobacterium
YGRQPAE

SEQ ID NO: 616440 - protein, 14 aa, Mycobacterium
YGRRAGRSASLFPR

SEQ ID NO: 616441 - protein, 11 aa, Mycobacterium
YGRRPGHSMPG

SEQ ID NO: 616442 - protein, 20 aa, Mycobacterium
YGRRSTTPTPVVSQRIVDAD

SEQ ID NO: 616443 - protein, 4 aa, Mycobacterium
YGRS

SEQ ID NO: 616444 - protein, 4 aa, Mycobacterium
YGRT

SEQ ID NO: 616445 - protein, 13 aa, Mycobacterium
YGRTAPKEVEDAV

SEQ ID NO: 616446 - protein, 12 aa, Mycobacterium
YGRTGQPEGSAD

SEQ ID NO: 616447 - protein, 5 aa, Mycobacterium
YGRTR

SEQ ID NO: 616448 - protein, 12 aa, Mycobacterium
YGRTSGTKYETT

SEQ ID NO: 616449 - protein, 4 aa, Mycobacterium
YGRY

SEQ ID NO: 616450 - protein, 19 aa, Mycobacterium
YGRYEGRDFEDPRRDPRAD

SEQ ID NO: 616451 - protein, 10 aa, Mycobacterium
YGSAAAADAA

SEQ ID NO: 616452 - protein, 11 aa, Mycobacterium
YGSADAAAEHL

SEQ ID NO: 616453 - protein, 23 aa, Mycobacterium
YGSAGDDLVNEDAPLRPLTPYAE

SEQ ID NO: 616454 - protein, 9 aa, Mycobacterium
YGSATSSSG

SEQ ID NO: 616455 - protein, 5 aa, Mycobacterium
YGSAV

SEQ ID NO: 616456 - protein, 8 aa, Mycobacterium
YGSDDKPL

SEQ ID NO: 616457 - protein, 5 aa, Mycobacterium
YGSDR

SEQ ID NO: 616458 - protein, 4 aa, Mycobacterium
YGSE

SEQ ID NO: 616459 - protein, 7 aa, Mycobacterium
YGSEAGH

SEQ ID NO: 616460 - protein, 24 aa, Mycobacterium
YGSEAPEGAAGRGSVKDRRTRNRE

SEQ ID NO: 616461 - protein, 9 aa, Mycobacterium
YGSEEQKQE

SEQ ID NO: 616462 - protein, 6 aa, Mycobacterium
YGSEGY

SEQ ID NO: 616463 - protein, 19 aa, Mycobacterium
YGSETAMAPRVGGSGEDDG

SEQ ID NO: 616464 - protein, 19 aa, Mycobacterium
YGSETQMAPRVGSSAEDDG

SEQ ID NO: 616465 - protein, 6 aa, Mycobacterium
YGSGGS

SEQ ID NO: 616466 - protein, 22 aa, Mycobacterium
YGSGMGRSKKEAEQKAASAAYK

SEQ ID NO: 616467 - protein, 20 aa, Mycobacterium
YGSGVGRSKKEAEQKAAAAT

SEQ ID NO: 616468 - protein, 11 aa, Mycobacterium
YGSKWDKPAAR

SEQ ID NO: 616469 - protein, 5 aa, Mycobacterium
YGSLP

SEQ ID NO: 616470 - protein, 25 aa, Mycobacterium
YGSNGNPCAVGSAKSSVGHTEAAAG

SEQ ID NO: 616471 - protein, 9 aa, Mycobacterium
YGSNPHLPG

SEQ ID NO: 616472 - protein, 18 aa, Mycobacterium
YGSPAPGPAPDKMRVPPT

SEQ ID NO: 616473 - protein, 7 aa, Mycobacterium
YGSPDEI

SEQ ID NO: 616474 - protein, 10 aa, Mycobacterium
YGSPDKDPAV

SEQ ID NO: 616475 - protein, 8 aa, Mycobacterium
YGSPDPSA

SEQ ID NO: 616476 - protein, 13 aa, Mycobacterium
YGSPEKDASPDLD

SEQ ID NO: 616477 - protein, 12 aa, Mycobacterium
YGSPFSDVAATA

SEQ ID NO: 616478 - protein, 7 aa, Mycobacterium
YGSPGDR

SEQ ID NO: 616479 - protein, 8 aa, Mycobacterium
YGSPGDVA

SEQ ID NO: 616480 - protein, 20 aa, Mycobacterium
YGSPGLGHTDSTETYISPRG

SEQ ID NO: 616481 - protein, 10 aa, Mycobacterium
YGSQGDVPQT

SEQ ID NO: 616482 - protein, 8 aa, Mycobacterium
YGSRAAKA

SEQ ID NO: 616483 - protein, 11 aa, Mycobacterium
YGSRSTAQKRA

SEQ ID NO: 616484 - protein, 13 aa, Mycobacterium
YGSRSTPVSGGAA

SEQ ID NO: 616485 - protein, 6 aa, Mycobacterium
YGSSEA

SEQ ID NO: 616486 - protein, 8 aa, Mycobacterium
YGSSEGAG

SEQ ID NO: 616487 - protein, 9 aa, Mycobacterium
YGSSEGGGA

SEQ ID NO: 616488 - protein, 9 aa, Mycobacterium
YGSSEQQKD

SEQ ID NO: 616489 - protein, 9 aa, Mycobacterium
YGSSESGNM

SEQ ID NO: 616490 - protein, 10 aa, Mycobacterium
YGSSGAVPQA

SEQ ID NO: 616491 - protein, 7 aa, Mycobacterium
YGSSITQ

SEQ ID NO: 616492 - protein, 4 aa, Mycobacterium
YGST

SEQ ID NO: 616493 - protein, 5 aa, Mycobacterium
YGSTE

SEQ ID NO: 616494 - protein, 6 aa, Mycobacterium
YGSTEM

SEQ ID NO: 616495 - protein, 6 aa, Mycobacterium
YGSTER

SEQ ID NO: 616496 - protein, 10 aa, Mycobacterium
YGSTETAERL

SEQ ID NO: 616497 - protein, 6 aa, Mycobacterium
YGSTEV

SEQ ID NO: 616498 - protein, 7 aa, Mycobacterium
YGSTEVG

SEQ ID NO: 616499 - protein, 14 aa, Mycobacterium
YGSTEVGAAATGGH

SEQ ID NO: 616500 - protein, 6 aa, Mycobacterium
YGSTRN

SEQ ID NO: 616501 - protein, 7 aa, Mycobacterium
YGSTRTV

SEQ ID NO: 616502 - protein, 5 aa, Mycobacterium
YGSTS

SEQ ID NO: 616503 - protein, 14 aa, Mycobacterium
YGSVSANVPEQGRL

SEQ ID NO: 616504 - protein, 6 aa, Mycobacterium
YGSYGG

SEQ ID NO: 616505 - protein, 6 aa, Mycobacterium
YGTAPG

SEQ ID NO: 616506 - protein, 17 aa, Mycobacterium
YGTDADGTFTSGGTQSN

SEQ ID NO: 616507 - protein, 9 aa, Mycobacterium
YGTDAQKKS

SEQ ID NO: 616508 - protein, 11 aa, Mycobacterium
YGTDDPRDSSA

SEQ ID NO: 616509 - protein, 12 aa, Mycobacterium
YGTDDTNENEAT

SEQ ID NO: 616510 - protein, 5 aa, Mycobacterium
YGTDG

SEQ ID NO: 616511 - protein, 6 aa, Mycobacterium
YGTDGH

SEQ ID NO: 616512 - protein, 7 aa, Mycobacterium
YGTDGPC

SEQ ID NO: 616513 - protein, 11 aa, Mycobacterium
YGTDGREVEEP

SEQ ID NO: 616514 - protein, 7 aa, Mycobacterium
YGTDLRG

SEQ ID NO: 616515 - protein, 8 aa, Mycobacterium
YGTDLRGP

SEQ ID NO: 616516 - protein, 8 aa, Mycobacterium
YGTDPTTG

SEQ ID NO: 616517 - protein, 8 aa, Mycobacterium
YGTEDQRK

SEQ ID NO: 616518 - protein, 12 aa, Mycobacterium
YGTEGPDADRPA

SEQ ID NO: 616519 - protein, 21 aa, Mycobacterium
YGTEGRKGQLDEAETEREHAN

SEQ ID NO: 616520 - protein, 8 aa, Mycobacterium
YGTESQKS

SEQ ID NO: 616521 - protein, 6 aa, Mycobacterium
YGTETI

SEQ ID NO: 616522 - protein, 4 aa, Mycobacterium
YGTG

SEQ ID NO: 616523 - protein, 8 aa, Mycobacterium
YGTGGPCA

SEQ ID NO: 616524 - protein, 6 aa, Mycobacterium
YGTGRD

SEQ ID NO: 616525 - protein, 6 aa, Mycobacterium
YGTHEP

SEQ ID NO: 616526 - protein, 5 aa, Mycobacterium
YGTLG

SEQ ID NO: 616527 - protein, 14 aa, Mycobacterium
YGTNLAEGKDTRVF

SEQ ID NO: 616528 - protein, 5 aa, Mycobacterium
YGTNV

SEQ ID NO: 616529 - protein, 20 aa, Mycobacterium
YGTPAPGPAPDGMRVPPSAE

SEQ ID NO: 616530 - protein, 13 aa, Mycobacterium
YGTPAPGPAPEGM

SEQ ID NO: 616531 - protein, 7 aa, Mycobacterium
YGTPEGP

SEQ ID NO: 616532 - protein, 19 aa, Mycobacterium
YGTPGYQAPEISKTGPTVA

SEQ ID NO: 616533 - protein, 15 aa, Mycobacterium
YGTPLPSSQQRSDPV

SEQ ID NO: 616534 - protein, 8 aa, Mycobacterium
YGTPRSPA

SEQ ID NO: 616535 - protein, 11 aa, Mycobacterium
YGTPTVDGETV

SEQ ID NO: 616536 - protein, 8 aa, Mycobacterium
YGTRGDIE

SEQ ID NO: 616537 - protein, 17 aa, Mycobacterium
YGTRSRTGATIDAEEIG

SEQ ID NO: 616538 - protein, 18 aa, Mycobacterium
YGTSADVDVESETHTGTQ

SEQ ID NO: 616539 - protein, 9 aa, Mycobacterium
YGTSSPSGY

SEQ ID NO: 616540 - protein, 17 aa, Mycobacterium
YGTTAGNGGDGGAGGRG

SEQ ID NO: 616541 - protein, 30 aa, Mycobacterium
YGTTESKAVPAGAQSDPTLPDRDSGRAGNL

SEQ ID NO: 616542 - protein, 9 aa, Mycobacterium
YGTTEVSER

SEQ ID NO: 616543 - protein, 7 aa, Mycobacterium
YGTTPTR

SEQ ID NO: 616544 - protein, 11 aa, Mycobacterium
YGTTTRAGDER

SEQ ID NO: 616545 - protein, 6 aa, Mycobacterium
YGTVPE

SEQ ID NO: 616546 - protein, 4 aa, Mycobacterium
YGTY

SEQ ID NO: 616547 - protein, 11 aa, Mycobacterium
YGTYDDSATVT

SEQ ID NO: 616548 - protein, 8 aa, Mycobacterium
YGTYGSKR

SEQ ID NO: 616549 - protein, 4 aa, Mycobacterium
YGVD

SEQ ID NO: 616550 - protein, 10 aa, Mycobacterium
YGVDNRPAGV

SEQ ID NO: 616551 - protein, 5 aa, Mycobacterium
YGVPA

SEQ ID NO: 616552 - protein, 16 aa, Mycobacterium
YGVPGSSRDTMGPWGN

SEQ ID NO: 616553 - protein, 18 aa, Mycobacterium
YGVPGSVRDTMGGPGSRG

SEQ ID NO: 616554 - protein, 5 aa, Mycobacterium
YGVPK

SEQ ID NO: 616555 - protein, 6 aa, Mycobacterium
YGVPPD

SEQ ID NO: 616556 - protein, 6 aa, Mycobacterium
YGVPRD

SEQ ID NO: 616557 - protein, 13 aa, Mycobacterium
YGVPVNSPNGYRT

SEQ ID NO: 616558 - protein, 21 aa, Mycobacterium
YGVQPKDWRKAAGNYGEKGTH

SEQ ID NO: 616559 - protein, 5 aa, Mycobacterium
YGVRP

SEQ ID NO: 616560 - protein, 6 aa, Mycobacterium
YGVRPG

SEQ ID NO: 616561 - protein, 12 aa, Mycobacterium
YGVSESPTATDD

SEQ ID NO: 616562 - protein, 8 aa, Mycobacterium
YGVTPEGW

SEQ ID NO: 616563 - protein, 5 aa, Mycobacterium
YGWSS

SEQ ID NO: 616564 - protein, 6 aa, Mycobacterium
YGYDPA

SEQ ID NO: 616565 - protein, 6 aa, Mycobacterium
YGYNGS

SEQ ID NO: 616566 - protein, 11 aa, Mycobacterium
YGYQPAPAEGR

SEQ ID NO: 616567 - protein, 6 aa, Mycobacterium
YGYSTE

SEQ ID NO: 616568 - protein, 6 aa, Mycobacterium
YHADPD

SEQ ID NO: 616569 - protein, 6 aa, Mycobacterium
YHANEG

SEQ ID NO: 616570 - protein, 7 aa, Mycobacterium
YHASGGW

SEQ ID NO: 616571 - protein, 4 aa, Mycobacterium
YHAT

SEQ ID NO: 616572 - protein, 5 aa, Mycobacterium
YHDGD

SEQ ID NO: 616573 - protein, 7 aa, Mycobacterium
YHDPGDR

SEQ ID NO: 616574 - protein, 9 aa, Mycobacterium
YHDPNPAKI

SEQ ID NO: 616575 - protein, 9 aa, Mycobacterium
YHDPTPPRG

SEQ ID NO: 616576 - protein, 6 aa, Mycobacterium
YHEPGE

SEQ ID NO: 616577 - protein, 9 aa, Mycobacterium
YHESDDEHF

SEQ ID NO: 616578 - protein, 8 aa, Mycobacterium
YHESSDRR

SEQ ID NO: 616579 - protein, 4 aa, Mycobacterium
YHET

SEQ ID NO: 616580 - protein, 8 aa, Mycobacterium
YHGGTDTA

SEQ ID NO: 616581 - protein, 26 aa, Mycobacterium
YHGGTTTSMSLTGEPRRWANDPGDNS

SEQ ID NO: 616582 - protein, 4 aa, Mycobacterium
YHGK

SEQ ID NO: 616583 - protein, 6 aa, Mycobacterium
YHGKPA

SEQ ID NO: 616584 - protein, 7 aa, Mycobacterium
YHGNTEA

SEQ ID NO: 616585 - protein, 6 aa, Mycobacterium
YHGPGW

SEQ ID NO: 616586 - protein, 6 aa, Mycobacterium
YHGPQP

SEQ ID NO: 616587 - protein, 18 aa, Mycobacterium
YHGSPGSQLGRPDGPPRL

SEQ ID NO: 616588 - protein, 5 aa, Mycobacterium
YHPAD

SEQ ID NO: 616589 - protein, 14 aa, Mycobacterium
YHPEEPGGSPTGRT

SEQ ID NO: 616590 - protein, 7 aa, Mycobacterium
YHPPAAP

SEQ ID NO: 616591 - protein, 7 aa, Mycobacterium
YHPSAAG

SEQ ID NO: 616592 - protein, 17 aa, Mycobacterium
YHQAGTTRMSHTPDGGV

SEQ ID NO: 616593 - protein, 13 aa, Mycobacterium
YHQAREAGGLGWR

SEQ ID NO: 616594 - protein, 13 aa, Mycobacterium
YHQAREAGGMGWR

SEQ ID NO: 616595 - protein, 9 aa, Mycobacterium
YHQGDTAGD

SEQ ID NO: 616596 - protein, 27 aa, Mycobacterium
YHQPGTASGGADPVAPTDSDPADAGVA

SEQ ID NO: 616597 - protein, 4 aa, Mycobacterium
YHRG

SEQ ID NO: 616598 - protein, 19 aa, Mycobacterium
YHRGGLDEAQPRLDYPPYR

SEQ ID NO: 616599 - protein, 6 aa, Mycobacterium
YHRPPL

SEQ ID NO: 616600 - protein, 4 aa, Mycobacterium
YHRR

SEQ ID NO: 616601 - protein, 15 aa, Mycobacterium
YHRRTHSETGQSPLD

SEQ ID NO: 616602 - protein, 9 aa, Mycobacterium
YHRTPNQGI

SEQ ID NO: 616603 - protein, 10 aa, Mycobacterium
YHSGKAEVKG

SEQ ID NO: 616604 - protein, 4 aa, Mycobacterium
YHSS

SEQ ID NO: 616605 - protein, 12 aa, Mycobacterium
YHTRRDDIDNVD

SEQ ID NO: 616606 - protein, 10 aa, Mycobacterium
YHTRRDNIDN

SEQ ID NO: 616607 - protein, 4 aa, Mycobacterium
YHTS

SEQ ID NO: 616608 - protein, 4 aa, Mycobacterium
YIEG

SEQ ID NO: 616609 - protein, 5 aa, Mycobacterium
YIPER

SEQ ID NO: 616610 - protein, 6 aa, Mycobacterium
YIPGAG

SEQ ID NO: 616611 - protein, 7 aa, Mycobacterium
YIPGHGT

SEQ ID NO: 616612 - protein, 4 aa, Mycobacterium
YITG

SEQ ID NO: 616613 - protein, 9 aa, Mycobacterium
YKAAREGRL

SEQ ID NO: 616614 - protein, 4 aa, Mycobacterium
YKAE

SEQ ID NO: 616615 - protein, 5 aa, Mycobacterium
YKAEA

SEQ ID NO: 616616 - protein, 11 aa, Mycobacterium
YKAKAEQLNTS

SEQ ID NO: 616617 - protein, 9 aa, Mycobacterium
YKAKPGRSF

SEQ ID NO: 616618 - protein, 10 aa, Mycobacterium
YKAPFEPVTP

SEQ ID NO: 616619 - protein, 8 aa, Mycobacterium
YKAPRTAS

SEQ ID NO: 616620 - protein, 10 aa, Mycobacterium
YKASARPALD

SEQ ID NO: 616621 - protein, 7 aa, Mycobacterium
YKDGYRA

SEQ ID NO: 616622 - protein, 7 aa, Mycobacterium
YKDPDTF

SEQ ID NO: 616623 - protein, 7 aa, Mycobacterium
YKDTDSF

SEQ ID NO: 616624 - protein, 6 aa, Mycobacterium
YKDTST

SEQ ID NO: 616625 - protein, 5 aa, Mycobacterium
YKDTW

SEQ ID NO: 616626 - protein, 10 aa, Mycobacterium
YKEEGTTTTP

SEQ ID NO: 616627 - protein, 8 aa, Mycobacterium
YKETSAGG

SEQ ID NO: 616628 - protein, 12 aa, Mycobacterium
YKFEGSTRTAEQ

SEQ ID NO: 616629 - protein, 7 aa, Mycobacterium
YKGARGV

SEQ ID NO: 616630 - protein, 5 aa, Mycobacterium
YKGID

SEQ ID NO: 616631 - protein, 9 aa, Mycobacterium
YKGNTTPVA

SEQ ID NO: 616632 - protein, 17 aa, Mycobacterium
YKGRTGREIRVFTLERI

SEQ ID NO: 616633 - protein, 13 aa, Mycobacterium
YKIPGGTPSSPGL

SEQ ID NO: 616634 - protein, 12 aa, Mycobacterium
YKKSGSAANAAA

SEQ ID NO: 616635 - protein, 13 aa, Mycobacterium
YKMPGGTPSSPAL

SEQ ID NO: 616636 - protein, 13 aa, Mycobacterium
YKMPGGTPSSPGL

SEQ ID NO: 616637 - protein, 7 aa, Mycobacterium
YKPANGP

SEQ ID NO: 616638 - protein, 8 aa, Mycobacterium
YKPAPETY

SEQ ID NO: 616639 - protein, 13 aa, Mycobacterium
YKPARREGTREGR

SEQ ID NO: 616640 - protein, 7 aa, Mycobacterium
YKPDAEK

SEQ ID NO: 616641 - protein, 4 aa, Mycobacterium
YKPE

SEQ ID NO: 616642 - protein, 6 aa, Mycobacterium
YKPEPM

SEQ ID NO: 616643 - protein, 9 aa, Mycobacterium
YKPSRTEDI

SEQ ID NO: 616644 - protein, 7 aa, Mycobacterium
YKPTSGS

SEQ ID NO: 616645 - protein, 4 aa, Mycobacterium
YKPY

SEQ ID NO: 616646 - protein, 8 aa, Mycobacterium
YKPYPGKA

SEQ ID NO: 616647 - protein, 5 aa, Mycobacterium
YKQGL

SEQ ID NO: 616648 - protein, 9 aa, Mycobacterium
YKQSGIGRE

SEQ ID NO: 616649 - protein, 13 aa, Mycobacterium
YKQSGYGREGGQA

SEQ ID NO: 616650 - protein, 9 aa, Mycobacterium
YKRKGSAAH

SEQ ID NO: 616651 - protein, 8 aa, Mycobacterium
YKRPPREL

SEQ ID NO: 616652 - protein, 12 aa, Mycobacterium
YKRTPSGGSAVD

SEQ ID NO: 616653 - protein, 14 aa, Mycobacterium
YKRTPTGGSSIDSA

SEQ ID NO: 616654 - protein, 9 aa, Mycobacterium
YKSAARPAL

SEQ ID NO: 616655 - protein, 23 aa, Mycobacterium
YKSERNEATGKSRAKGLRENRGT

SEQ ID NO: 616656 - protein, 8 aa, Mycobacterium
YKSGGENV

SEQ ID NO: 616657 - protein, 10 aa, Mycobacterium
YKSGGENVYP

SEQ ID NO: 616658 - protein, 5 aa, Mycobacterium
YKSGP

SEQ ID NO: 616659 - protein, 5 aa, Mycobacterium
YKSPR

SEQ ID NO: 616660 - protein, 10 aa, Mycobacterium
YKSPVTASYN

SEQ ID NO: 616661 - protein, 6 aa, Mycobacterium
YKSYRG

SEQ ID NO: 616662 - protein, 9 aa, Mycobacterium
YKTANETVN

SEQ ID NO: 616663 - protein, 17 aa, Mycobacterium
YKTGMGDKSQADETNAT

SEQ ID NO: 616664 - protein, 7 aa, Mycobacterium
YKTKDGR

SEQ ID NO: 616665 - protein, 7 aa, Mycobacterium
YKTKGAS

SEQ ID NO: 616666 - protein, 5 aa, Mycobacterium
YKTQR

SEQ ID NO: 616667 - protein, 7 aa, Mycobacterium
YKTRGRD

SEQ ID NO: 616668 - protein, 8 aa, Mycobacterium
YKTSEGEI

SEQ ID NO: 616669 - protein, 5 aa, Mycobacterium
YKTTA

SEQ ID NO: 616670 - protein, 6 aa, Mycobacterium
YKTTGK

SEQ ID NO: 616671 - protein, 4 aa, Mycobacterium
YKTY

SEQ ID NO: 616672 - protein, 8 aa, Mycobacterium
YLAGGGAV

SEQ ID NO: 616673 - protein, 6 aa, Mycobacterium
YLDGRN

SEQ ID NO: 616674 - protein, 10 aa, Mycobacterium
YLDPEQREAA

SEQ ID NO: 616675 - protein, 4 aa, Mycobacterium
YLDS

SEQ ID NO: 616676 - protein, 7 aa, Mycobacterium
YLGGHGS

SEQ ID NO: 616677 - protein, 12 aa, Mycobacterium
YLGGNQSQVSGY

SEQ ID NO: 616678 - protein, 8 aa, Mycobacterium
YLGSDDKD

SEQ ID NO: 616679 - protein, 13 aa, Mycobacterium
YLGSSRTAGGAGY

SEQ ID NO: 616680 - protein, 8 aa, Mycobacterium
YLGTPSES

SEQ ID NO: 616681 - protein, 19 aa, Mycobacterium
YLNPGNYNTGVANTGNVNT

SEQ ID NO: 616682 - protein, 16 aa, Mycobacterium
YLNSDQGLAGVIDKIF

SEQ ID NO: 616683 - protein, 9 aa, Mycobacterium
YLNTGASRA

SEQ ID NO: 616684 - protein, 5 aa, Mycobacterium
YLPDS

SEQ ID NO: 616685 - protein, 12 aa, Mycobacterium
YLPGGGVEQDPE

SEQ ID NO: 616686 - protein, 7 aa, Mycobacterium
YLPGPAL

SEQ ID NO: 616687 - protein, 13 aa, Mycobacterium
YLPGPDAASDPRV

SEQ ID NO: 616688 - protein, 9 aa, Mycobacterium
YLPPGAKPR

SEQ ID NO: 616689 - protein, 9 aa, Mycobacterium
YLPPGSKPH

SEQ ID NO: 616690 - protein, 9 aa, Mycobacterium
YLPPGTKPR

SEQ ID NO: 616691 - protein, 7 aa, Mycobacterium
YLPPGVK

SEQ ID NO: 616692 - protein, 5 aa, Mycobacterium
YLPPS

SEQ ID NO: 616693 - protein, 5 aa, Mycobacterium
YLPSA

SEQ ID NO: 616694 - protein, 5 aa, Mycobacterium
YLPSK

SEQ ID NO: 616695 - protein, 14 aa, Mycobacterium
YLPTGFAPSRRTRM

SEQ ID NO: 616696 - protein, 19 aa, Mycobacterium
YLSAPGAAYPDGDTRGERM

SEQ ID NO: 616697 - protein, 9 aa, Mycobacterium
YLSSEQKRQ

SEQ ID NO: 616698 - protein, 11 aa, Mycobacterium
YLSSGSNPWGE

SEQ ID NO: 616699 - protein, 13 aa, Mycobacterium
YLSSRADKPLVGT

SEQ ID NO: 616700 - protein, 12 aa, Mycobacterium
YLTGGTSDMSTS

SEQ ID NO: 616701 - protein, 11 aa, Mycobacterium
YLTGGTTEMST

SEQ ID NO: 616702 - protein, 17 aa, Mycobacterium
YLTSGAPTAVGATAVGP

SEQ ID NO: 616703 - protein, 6 aa, Mycobacterium
YLTTQQ

SEQ ID NO: 616704 - protein, 10 aa, Mycobacterium
YMGGSTSTIS

SEQ ID NO: 616705 - protein, 18 aa, Mycobacterium
YMNGPSRSLPLASSPEDI

SEQ ID NO: 616706 - protein, 4 aa, Mycobacterium
YNAA

SEQ ID NO: 616707 - protein, 7 aa, Mycobacterium
YNAAGGH

SEQ ID NO: 616708 - protein, 13 aa, Mycobacterium
YNADGTVRKPGQD

SEQ ID NO: 616709 - protein, 8 aa, Mycobacterium
YNAEPPVA

SEQ ID NO: 616710 - protein, 6 aa, Mycobacterium
YNAKGS

SEQ ID NO: 616711 - protein, 9 aa, Mycobacterium
YNAKSGEVA

SEQ ID NO: 616712 - protein, 8 aa, Mycobacterium
YNANPDSM

SEQ ID NO: 616713 - protein, 10 aa, Mycobacterium
YNANPDSMGA

SEQ ID NO: 616714 - protein, 9 aa, Mycobacterium
YNANPDSMR

SEQ ID NO: 616715 - protein, 10 aa, Mycobacterium
YNANPDSMTA

SEQ ID NO: 616716 - protein, 16 aa, Mycobacterium
YNANRPHTAHGELTPT

SEQ ID NO: 616717 - protein, 16 aa, Mycobacterium
YNANRPNSAHGELTPT

SEQ ID NO: 616718 - protein, 4 aa, Mycobacterium
YNAR

SEQ ID NO: 616719 - protein, 9 aa, Mycobacterium
YNARNAKEQ

SEQ ID NO: 616720 - protein, 9 aa, Mycobacterium
YNASNADLT

SEQ ID NO: 616721 - protein, 7 aa, Mycobacterium
YNDDGDV

SEQ ID NO: 616722 - protein, 9 aa, Mycobacterium
YNDDPPAAC

SEQ ID NO: 616723 - protein, 16 aa, Mycobacterium
YNDDQRADAGQSSIKK

SEQ ID NO: 616724 - protein, 6 aa, Mycobacterium
YNDGNG

SEQ ID NO: 616725 - protein, 4 aa, Mycobacterium
YNDI

SEQ ID NO: 616726 - protein, 6 aa, Mycobacterium
YNDKRV

SEQ ID NO: 616727 - protein, 4 aa, Mycobacterium
YNDV

SEQ ID NO: 616728 - protein, 14 aa, Mycobacterium
YNDYEGYPGPQIPG

SEQ ID NO: 616729 - protein, 5 aa, Mycobacterium
YNEDT

SEQ ID NO: 616730 - protein, 15 aa, Mycobacterium
YNEEAQTFNGTTAMS

SEQ ID NO: 616731 - protein, 12 aa, Mycobacterium
YNEGAARGEDPL

SEQ ID NO: 616732 - protein, 16 aa, Mycobacterium
YNENARRGEDPDFHKD

SEQ ID NO: 616733 - protein, 7 aa, Mycobacterium
YNENNQR

SEQ ID NO: 616734 - protein, 10 aa, Mycobacterium
YNEPSPGAWS

SEQ ID NO: 616735 - protein, 8 aa, Mycobacterium
YNERAAEV

SEQ ID NO: 616736 - protein, 9 aa, Mycobacterium
YNETATEDA

SEQ ID NO: 616737 - protein, 6 aa, Mycobacterium
YNETQT

SEQ ID NO: 616738 - protein, 4 aa, Mycobacterium
YNGA

SEQ ID NO: 616739 - protein, 6 aa, Mycobacterium
YNGANT

SEQ ID NO: 616740 - protein, 16 aa, Mycobacterium
YNGANTVLSGPAADLE

SEQ ID NO: 616741 - protein, 16 aa, Mycobacterium
YNGANTVLSGPAQDLE

SEQ ID NO: 616742 - protein, 5 aa, Mycobacterium
YNGPA

SEQ ID NO: 616743 - protein, 26 aa, Mycobacterium
YNGPPEPPAEPQYRPESVPQTPYPEL

SEQ ID NO: 616744 - protein, 6 aa, Mycobacterium
YNGRNT

SEQ ID NO: 616745 - protein, 5 aa, Mycobacterium
YNGRP

SEQ ID NO: 616746 - protein, 12 aa, Mycobacterium
YNGSGADEAARD

SEQ ID NO: 616747 - protein, 10 aa, Mycobacterium
YNGSGVGNFG

SEQ ID NO: 616748 - protein, 13 aa, Mycobacterium
YNHGPQPNSPAPQ

SEQ ID NO: 616749 - protein, 13 aa, Mycobacterium
YNKPGSRDTATDI

SEQ ID NO: 616750 - protein, 11 aa, Mycobacterium
YNNDDADADRI

SEQ ID NO: 616751 - protein, 12 aa, Mycobacterium
YNNEGGGSEGIR

SEQ ID NO: 616752 - protein, 7 aa, Mycobacterium
YNNGERL

SEQ ID NO: 616753 - protein, 12 aa, Mycobacterium
YNPAQRERTAED

SEQ ID NO: 616754 - protein, 7 aa, Mycobacterium
YNPDIPT

SEQ ID NO: 616755 - protein, 11 aa, Mycobacterium
YNPDPDVPGTC

SEQ ID NO: 616756 - protein, 9 aa, Mycobacterium
YNPDRDAPR

SEQ ID NO: 616757 - protein, 4 aa, Mycobacterium
YNPE

SEQ ID NO: 616758 - protein, 16 aa, Mycobacterium
YNPEPPERRDDTLSPW

SEQ ID NO: 616759 - protein, 17 aa, Mycobacterium
YNPEPPESRDDTRSPWP

SEQ ID NO: 616760 - protein, 4 aa, Mycobacterium
YNPG

SEQ ID NO: 616761 - protein, 14 aa, Mycobacterium
YNPGDAADGVEETS

SEQ ID NO: 616762 - protein, 12 aa, Mycobacterium
YNPIAPKDLPGR

SEQ ID NO: 616763 - protein, 14 aa, Mycobacterium
YNPPHGGPADTAVT

SEQ ID NO: 616764 - protein, 18 aa, Mycobacterium
YNPPHGGPADTDATGAIA

SEQ ID NO: 616765 - protein, 19 aa, Mycobacterium
YNPPNGGPADTDATGAIAK

SEQ ID NO: 616766 - protein, 18 aa, Mycobacterium
YNPPNGGPADTDATNAIA

SEQ ID NO: 616767 - protein, 7 aa, Mycobacterium
YNPQRER

SEQ ID NO: 616768 - protein, 12 aa, Mycobacterium
YNPVAPADLPGR

SEQ ID NO: 616769 - protein, 12 aa, Mycobacterium
YNPVPTTSLPDR

SEQ ID NO: 616770 - protein, 14 aa, Mycobacterium
YNQARISGGSTVWP

SEQ ID NO: 616771 - protein, 9 aa, Mycobacterium
YNRDTAAGR

SEQ ID NO: 616772 - protein, 11 aa, Mycobacterium
YNREGQVSARL

SEQ ID NO: 616773 - protein, 4 aa, Mycobacterium
YNRS

SEQ ID NO: 616774 - protein, 15 aa, Mycobacterium
YNRTPRNFDKDGPHV

SEQ ID NO: 616775 - protein, 6 aa, Mycobacterium
YNSATG

SEQ ID NO: 616776 - protein, 5 aa, Mycobacterium
YNSEE

SEQ ID NO: 616777 - protein, 9 aa, Mycobacterium
YNSNSPSSP

SEQ ID NO: 616778 - protein, 11 aa, Mycobacterium
YNSPDGRMPEL

SEQ ID NO: 616779 - protein, 11 aa, Mycobacterium
YNSSTNTWSGS

SEQ ID NO: 616780 - protein, 7 aa, Mycobacterium
YNSTATP

SEQ ID NO: 616781 - protein, 13 aa, Mycobacterium
YNTERGIDPQPLR

SEQ ID NO: 616782 - protein, 32 aa, Mycobacterium
YNTGFGNAGSYNQGLANTGSNNAGFANTGNGN

SEQ ID NO: 616783 - protein, 6 aa, Mycobacterium
YNTGSF

SEQ ID NO: 616784 - protein, 15 aa, Mycobacterium
YNTNAAAGEDPDFHK

SEQ ID NO: 616785 - protein, 8 aa, Mycobacterium
YNTSSDAY

SEQ ID NO: 616786 - protein, 11 aa, Mycobacterium
YNTTVSGGPII

SEQ ID NO: 616787 - protein, 4 aa, Mycobacterium
YNVG

SEQ ID NO: 616788 - protein, 9 aa, Mycobacterium
YPAEDGMPE

SEQ ID NO: 616789 - protein, 5 aa, Mycobacterium
YPAEQ

SEQ ID NO: 616790 - protein, 5 aa, Mycobacterium
YPAER

SEQ ID NO: 616791 - protein, 18 aa, Mycobacterium
YPAESVPDRRSADAGPEQ

SEQ ID NO: 616792 - protein, 19 aa, Mycobacterium
YPAESVPERRSADAGPEQL

SEQ ID NO: 616793 - protein, 12 aa, Mycobacterium
YPAGGASAETVQ

SEQ ID NO: 616794 - protein, 23 aa, Mycobacterium
YPAGSAAPSTPSEPPPSDGSTPH

SEQ ID NO: 616795 - protein, 8 aa, Mycobacterium
YPAGSAGR

SEQ ID NO: 616796 - protein, 12 aa, Mycobacterium
YPAGSTDKFGAE

SEQ ID NO: 616797 - protein, 21 aa, Mycobacterium
YPAGTQRDWRETGEVPVPGAT

SEQ ID NO: 616798 - protein, 8 aa, Mycobacterium
YPALDPQG

SEQ ID NO: 616799 - protein, 4 aa, Mycobacterium
YPAN

SEQ ID NO: 616800 - protein, 5 aa, Mycobacterium
YPANS

SEQ ID NO: 616801 - protein, 10 aa, Mycobacterium
YPAPDEPERT

SEQ ID NO: 616802 - protein, 11 aa, Mycobacterium
YPAPEEPERSM

SEQ ID NO: 616803 - protein, 13 aa, Mycobacterium
YPAPHSGASNNAM

SEQ ID NO: 616804 - protein, 7 aa, Mycobacterium
YPAPQTQ

SEQ ID NO: 616805 - protein, 5 aa, Mycobacterium
YPAPT

SEQ ID NO: 616806 - protein, 6 aa, Mycobacterium
YPAPTL

SEQ ID NO: 616807 - protein, 9 aa, Mycobacterium
YPAPTRGVP

SEQ ID NO: 616808 - protein, 11 aa, Mycobacterium
YPARDEPERGM

SEQ ID NO: 616809 - protein, 8 aa, Mycobacterium
YPARLPEA

SEQ ID NO: 616810 - protein, 9 aa, Mycobacterium
YPARSDGST

SEQ ID NO: 616811 - protein, 8 aa, Mycobacterium
YPARSTAA

SEQ ID NO: 616812 - protein, 11 aa, Mycobacterium
YPASRTNPDVR

SEQ ID NO: 616813 - protein, 6 aa, Mycobacterium
YPATDS

SEQ ID NO: 616814 - protein, 5 aa, Mycobacterium
YPATG

SEQ ID NO: 616815 - protein, 5 aa, Mycobacterium
YPATP

SEQ ID NO: 616816 - protein, 11 aa, Mycobacterium
YPAVSEKLEPA

SEQ ID NO: 616817 - protein, 19 aa, Mycobacterium
YPAVSTSEIGKGAGIAGPG

SEQ ID NO: 616818 - protein, 13 aa, Mycobacterium
YPCETGNAPDPAH

SEQ ID NO: 616819 - protein, 9 aa, Mycobacterium
YPDAAAEPV

SEQ ID NO: 616820 - protein, 7 aa, Mycobacterium
YPDAADD

SEQ ID NO: 616821 - protein, 5 aa, Mycobacterium
YPDAD

SEQ ID NO: 616822 - protein, 5 aa, Mycobacterium
YPDAG

SEQ ID NO: 616823 - protein, 7 aa, Mycobacterium
YPDARSA

SEQ ID NO: 616824 - protein, 5 aa, Mycobacterium
YPDDK

SEQ ID NO: 616825 - protein, 9 aa, Mycobacterium
YPDDTGREL

SEQ ID NO: 616826 - protein, 4 aa, Mycobacterium
YPDE

SEQ ID NO: 616827 - protein, 5 aa, Mycobacterium
YPDER

SEQ ID NO: 616828 - protein, 11 aa, Mycobacterium
YPDFGTSPHPT

SEQ ID NO: 616829 - protein, 8 aa, Mycobacterium
YPDGGPHL

SEQ ID NO: 616830 - protein, 9 aa, Mycobacterium
YPDGGPHLQ

SEQ ID NO: 616831 - protein, 11 aa, Mycobacterium
YPDGPAAGNGA

SEQ ID NO: 616832 - protein, 8 aa, Mycobacterium
YPDGSTPD

SEQ ID NO: 616833 - protein, 12 aa, Mycobacterium
YPDGSTVPTPST

SEQ ID NO: 616834 - protein, 4 aa, Mycobacterium
YPDH

SEQ ID NO: 616835 - protein, 5 aa, Mycobacterium
YPDHG

SEQ ID NO: 616836 - protein, 12 aa, Mycobacterium
YPDLDPANLPPG

SEQ ID NO: 616837 - protein, 7 aa, Mycobacterium
YPDLNEA

SEQ ID NO: 616838 - protein, 5 aa, Mycobacterium
YPDNG

SEQ ID NO: 616839 - protein, 7 aa, Mycobacterium
YPDNGYA

SEQ ID NO: 616840 - protein, 6 aa, Mycobacterium
YPDNVA

SEQ ID NO: 616841 - protein, 22 aa, Mycobacterium
YPDPADPDITKRARLPKVTVRR

SEQ ID NO: 616842 - protein, 10 aa, Mycobacterium
YPDPADPSEF

SEQ ID NO: 616843 - protein, 17 aa, Mycobacterium
YPDPADYQLETAAPQEV

SEQ ID NO: 616844 - protein, 11 aa, Mycobacterium
YPDPDDPQPFA

SEQ ID NO: 616845 - protein, 7 aa, Mycobacterium
YPDPDSF

SEQ ID NO: 616846 - protein, 23 aa, Mycobacterium
YPDPEKTSEVMRPSKTFNTTLES

SEQ ID NO: 616847 - protein, 9 aa, Mycobacterium
YPDPEKTTA

SEQ ID NO: 616848 - protein, 19 aa, Mycobacterium
YPDPGADAHPNRIPEAAGG

SEQ ID NO: 616849 - protein, 21 aa, Mycobacterium
YPDPGADGHGGRIPEAAGGWT

SEQ ID NO: 616850 - protein, 19 aa, Mycobacterium
YPDPGADGRGSRIPEAAGG

SEQ ID NO: 616851 - protein, 19 aa, Mycobacterium
YPDPGADGRPNRIPEAAGG

SEQ ID NO: 616852 - protein, 7 aa, Mycobacterium
YPDPQVG

SEQ ID NO: 616853 - protein, 9 aa, Mycobacterium
YPDPTSGLA

SEQ ID NO: 616854 - protein, 5 aa, Mycobacterium
YPDPV

SEQ ID NO: 616855 - protein, 5 aa, Mycobacterium
YPDQR

SEQ ID NO: 616856 - protein, 7 aa, Mycobacterium
YPDQRSA

SEQ ID NO: 616857 - protein, 9 aa, Mycobacterium
YPDRHGEEL

SEQ ID NO: 616858 - protein, 7 aa, Mycobacterium
YPDRRSA

SEQ ID NO: 616859 - protein, 8 aa, Mycobacterium
YPDRRSGE

SEQ ID NO: 616860 - protein, 5 aa, Mycobacterium
YPDRS

SEQ ID NO: 616861 - protein, 4 aa, Mycobacterium
YPDS

SEQ ID NO: 616862 - protein, 10 aa, Mycobacterium
YPDSEKTTAV

SEQ ID NO: 616863 - protein, 8 aa, Mycobacterium
YPDSQVGT

SEQ ID NO: 616864 - protein, 6 aa, Mycobacterium
YPDSTR

SEQ ID NO: 616865 - protein, 16 aa, Mycobacterium
YPDSTTDETSESDEIA

SEQ ID NO: 616866 - protein, 4 aa, Mycobacterium
YPDT

SEQ ID NO: 616867 - protein, 11 aa, Mycobacterium
YPDTPPEAEPL

SEQ ID NO: 616868 - protein, 12 aa, Mycobacterium
YPDTTTGTSRAA

SEQ ID NO: 616869 - protein, 5 aa, Mycobacterium
YPDTV

SEQ ID NO: 616870 - protein, 4 aa, Mycobacterium
YPDV

SEQ ID NO: 616871 - protein, 8 aa, Mycobacterium
YPDYPAPS

SEQ ID NO: 616872 - protein, 6 aa, Mycobacterium
YPDYPG

SEQ ID NO: 616873 - protein, 8 aa, Mycobacterium
YPDYPKPS

SEQ ID NO: 616874 - protein, 4 aa, Mycobacterium
YPED

SEQ ID NO: 616875 - protein, 5 aa, Mycobacterium
YPEDI

SEQ ID NO: 616876 - protein, 8 aa, Mycobacterium
YPEDTGRE

SEQ ID NO: 616877 - protein, 9 aa, Mycobacterium
YPEEAPAHT

SEQ ID NO: 616878 - protein, 12 aa, Mycobacterium
YPEEAPLSAFVL

SEQ ID NO: 616879 - protein, 19 aa, Mycobacterium
YPEEKSEANSGNTGVSAAG

SEQ ID NO: 616880 - protein, 20 aa, Mycobacterium
YPEEPPGPRDAADPGDLLLR

SEQ ID NO: 616881 - protein, 8 aa, Mycobacterium
YPEEQAGR

SEQ ID NO: 616882 - protein, 12 aa, Mycobacterium
YPEEVADGKRPQ

SEQ ID NO: 616883 - protein, 6 aa, Mycobacterium
YPEEVP

SEQ ID NO: 616884 - protein, 20 aa, Mycobacterium
YPEEVPGATVDRQCGSSQQA

SEQ ID NO: 616885 - protein, 4 aa, Mycobacterium
YPEG

SEQ ID NO: 616886 - protein, 6 aa, Mycobacterium
YPEGKR

SEQ ID NO: 616887 - protein, 10 aa, Mycobacterium
YPEGVPGPDR

SEQ ID NO: 616888 - protein, 8 aa, Mycobacterium
YPEGVPPK

SEQ ID NO: 616889 - protein, 10 aa, Mycobacterium
YPEGVPPPDY

SEQ ID NO: 616890 - protein, 12 aa, Mycobacterium
YPEHDSHPEEPE

SEQ ID NO: 616891 - protein, 6 aa, Mycobacterium
YPEHGL

SEQ ID NO: 616892 - protein, 14 aa, Mycobacterium
YPELGTAPVDYTDS

SEQ ID NO: 616893 - protein, 7 aa, Mycobacterium
YPELNES

SEQ ID NO: 616894 - protein, 11 aa, Mycobacterium
YPENTPVDEAD

SEQ ID NO: 616895 - protein, 6 aa, Mycobacterium
YPEPGV

SEQ ID NO: 616896 - protein, 6 aa, Mycobacterium
YPEPIE

SEQ ID NO: 616897 - protein, 5 aa, Mycobacterium
YPEPL

SEQ ID NO: 616898 - protein, 8 aa, Mycobacterium
YPEPPPDS

SEQ ID NO: 616899 - protein, 8 aa, Mycobacterium
YPEPPPHA

SEQ ID NO: 616900 - protein, 16 aa, Mycobacterium
YPEPPPPGTVPSCAEG

SEQ ID NO: 616901 - protein, 9 aa, Mycobacterium
YPEPQPTPF

SEQ ID NO: 616902 - protein, 9 aa, Mycobacterium
YPEPSPDAT

SEQ ID NO: 616903 - protein, 8 aa, Mycobacterium
YPEPSPDD

SEQ ID NO: 616904 - protein, 8 aa, Mycobacterium
YPEQAAAV

SEQ ID NO: 616905 - protein, 5 aa, Mycobacterium
YPEQR

SEQ ID NO: 616906 - protein, 23 aa, Mycobacterium
YPEQTPQPLGPRDPVPTDELLVR

SEQ ID NO: 616907 - protein, 7 aa, Mycobacterium
YPERAEY

SEQ ID NO: 616908 - protein, 15 aa, Mycobacterium
YPERPEGEKVPPTSK

SEQ ID NO: 616909 - protein, 6 aa, Mycobacterium
YPESEV

SEQ ID NO: 616910 - protein, 11 aa, Mycobacterium
YPESPIRSYRS

SEQ ID NO: 616911 - protein, 7 aa, Mycobacterium
YPEVSKK

SEQ ID NO: 616912 - protein, 4 aa, Mycobacterium
YPEW

SEQ ID NO: 616913 - protein, 7 aa, Mycobacterium
YPEYPAP

SEQ ID NO: 616914 - protein, 4 aa, Mycobacterium
YPFA

SEQ ID NO: 616915 - protein, 4 aa, Mycobacterium
YPFD

SEQ ID NO: 616916 - protein, 4 aa, Mycobacterium
YPFE

SEQ ID NO: 616917 - protein, 5 aa, Mycobacterium
YPFTP

SEQ ID NO: 616918 - protein, 5 aa, Mycobacterium
YPGAA

SEQ ID NO: 616919 - protein, 10 aa, Mycobacterium
YPGAADAERP

SEQ ID NO: 616920 - protein, 8 aa, Mycobacterium
YPGAAEAI

SEQ ID NO: 616921 - protein, 9 aa, Mycobacterium
YPGAAEPAL

SEQ ID NO: 616922 - protein, 5 aa, Mycobacterium
YPGAD

SEQ ID NO: 616923 - protein, 7 aa, Mycobacterium
YPGADAA

SEQ ID NO: 616924 - protein, 9 aa, Mycobacterium
YPGADDALR

SEQ ID NO: 616925 - protein, 11 aa, Mycobacterium
YPGADEAVRSD

SEQ ID NO: 616926 - protein, 10 aa, Mycobacterium
YPGADPADLV

SEQ ID NO: 616927 - protein, 9 aa, Mycobacterium
YPGADPDDL

SEQ ID NO: 616928 - protein, 8 aa, Mycobacterium
YPGADRAT

SEQ ID NO: 616929 - protein, 5 aa, Mycobacterium
YPGAG

SEQ ID NO: 616930 - protein, 10 aa, Mycobacterium
YPGAKQPAVD

SEQ ID NO: 616931 - protein, 10 aa, Mycobacterium
YPGANPDDLV

SEQ ID NO: 616932 - protein, 5 aa, Mycobacterium
YPGAR

SEQ ID NO: 616933 - protein, 6 aa, Mycobacterium
YPGARG

SEQ ID NO: 616934 - protein, 12 aa, Mycobacterium
YPGATAAARAAG

SEQ ID NO: 616935 - protein, 8 aa, Mycobacterium
YPGATDTD

SEQ ID NO: 616936 - protein, 10 aa, Mycobacterium
YPGDEATGFG

SEQ ID NO: 616937 - protein, 12 aa, Mycobacterium
YPGDLGGKTGFT

SEQ ID NO: 616938 - protein, 11 aa, Mycobacterium
YPGDTDGDAGD

SEQ ID NO: 616939 - protein, 10 aa, Mycobacterium
YPGEETRGTC

SEQ ID NO: 616940 - protein, 10 aa, Mycobacterium
YPGEETSGTC

SEQ ID NO: 616941 - protein, 9 aa, Mycobacterium
YPGEEVSGT

SEQ ID NO: 616942 - protein, 5 aa, Mycobacterium
YPGET

SEQ ID NO: 616943 - protein, 13 aa, Mycobacterium
YPGFTATAPPGDA

SEQ ID NO: 616944 - protein, 12 aa, Mycobacterium
YPGGAGFADRGY

SEQ ID NO: 616945 - protein, 5 aa, Mycobacterium
YPGGE

SEQ ID NO: 616946 - protein, 7 aa, Mycobacterium
YPGGETD

SEQ ID NO: 616947 - protein, 7 aa, Mycobacterium
YPGGETK

SEQ ID NO: 616948 - protein, 8 aa, Mycobacterium
YPGGGGPF

SEQ ID NO: 616949 - protein, 6 aa, Mycobacterium
YPGGKF

SEQ ID NO: 616950 - protein, 6 aa, Mycobacterium
YPGGLT

SEQ ID NO: 616951 - protein, 10 aa, Mycobacterium
YPGGPPLGTS

SEQ ID NO: 616952 - protein, 7 aa, Mycobacterium
YPGGSTE

SEQ ID NO: 616953 - protein, 6 aa, Mycobacterium
YPGGVG

SEQ ID NO: 616954 - protein, 11 aa, Mycobacterium
YPGHAAQPGEW

SEQ ID NO: 616955 - protein, 9 aa, Mycobacterium
YPGHGDDTV

SEQ ID NO: 616956 - protein, 7 aa, Mycobacterium
YPGHGGA

SEQ ID NO: 616957 - protein, 6 aa, Mycobacterium
YPGHTS

SEQ ID NO: 616958 - protein, 8 aa, Mycobacterium
YPGHTSKL

SEQ ID NO: 616959 - protein, 9 aa, Mycobacterium
YPGKSGSFR

SEQ ID NO: 616960 - protein, 6 aa, Mycobacterium
YPGLKE

SEQ ID NO: 616961 - protein, 4 aa, Mycobacterium
YPGM

SEQ ID NO: 616962 - protein, 7 aa, Mycobacterium
YPGPGGE

SEQ ID NO: 616963 - protein, 6 aa, Mycobacterium
YPGPTV

SEQ ID NO: 616964 - protein, 11 aa, Mycobacterium
YPGQNDRYGLP

SEQ ID NO: 616965 - protein, 8 aa, Mycobacterium
YPGQPVPI

SEQ ID NO: 616966 - protein, 9 aa, Mycobacterium
YPGQTATLT

SEQ ID NO: 616967 - protein, 6 aa, Mycobacterium
YPGQVN

SEQ ID NO: 616968 - protein, 5 aa, Mycobacterium
YPGRG

SEQ ID NO: 616969 - protein, 9 aa, Mycobacterium
YPGRGGATI

SEQ ID NO: 616970 - protein, 12 aa, Mycobacterium
YPGRGNRLREQP

SEQ ID NO: 616971 - protein, 6 aa, Mycobacterium
YPGRPG

SEQ ID NO: 616972 - protein, 11 aa, Mycobacterium
YPGRQDRHSEP

SEQ ID NO: 616973 - protein, 10 aa, Mycobacterium
YPGRTDSQMQ

SEQ ID NO: 616974 - protein, 9 aa, Mycobacterium
YPGRTDTDM

SEQ ID NO: 616975 - protein, 5 aa, Mycobacterium
YPGTE

SEQ ID NO: 616976 - protein, 17 aa, Mycobacterium
YPGTLPESAEPAKKAFG

SEQ ID NO: 616977 - protein, 7 aa, Mycobacterium
YPGTRDA

SEQ ID NO: 616978 - protein, 6 aa, Mycobacterium
YPGVDE

SEQ ID NO: 616979 - protein, 6 aa, Mycobacterium
YPGVGP

SEQ ID NO: 616980 - protein, 7 aa, Mycobacterium
YPGVGPE

SEQ ID NO: 616981 - protein, 5 aa, Mycobacterium
YPGVP

SEQ ID NO: 616982 - protein, 6 aa, Mycobacterium
YPGVPD

SEQ ID NO: 616983 - protein, 14 aa, Mycobacterium
YPGWTNRKTSTRDS

SEQ ID NO: 616984 - protein, 4 aa, Mycobacterium
YPGY

SEQ ID NO: 616985 - protein, 14 aa, Mycobacterium
YPGYEATPHGRQEP

SEQ ID NO: 616986 - protein, 6 aa, Mycobacterium
YPGYPD

SEQ ID NO: 616987 - protein, 7 aa, Mycobacterium
YPGYPRR

SEQ ID NO: 616988 - protein, 5 aa, Mycobacterium
YPHAA

SEQ ID NO: 616989 - protein, 5 aa, Mycobacterium
YPHAE

SEQ ID NO: 616990 - protein, 7 aa, Mycobacterium
YPHDTGR

SEQ ID NO: 616991 - protein, 10 aa, Mycobacterium
YPHEEGFAPH

SEQ ID NO: 616992 - protein, 11 aa, Mycobacterium
YPHEEGFAPQS

SEQ ID NO: 616993 - protein, 6 aa, Mycobacterium
YPHEPG

SEQ ID NO: 616994 - protein, 9 aa, Mycobacterium
YPHNDTNWP

SEQ ID NO: 616995 - protein, 12 aa, Mycobacterium
YPHNESTYGYSE

SEQ ID NO: 616996 - protein, 13 aa, Mycobacterium
YPHNESTYGYSEK

SEQ ID NO: 616997 - protein, 5 aa, Mycobacterium
YPHPE

SEQ ID NO: 616998 - protein, 7 aa, Mycobacterium
YPHPEGL

SEQ ID NO: 616999 - protein, 11 aa, Mycobacterium
YPHPEGLAEPA

SEQ ID NO: 617000 - protein, 11 aa, Mycobacterium
YPHPEGLAEPK

SEQ ID NO: 617001 - protein, 11 aa, Mycobacterium
YPHPEGLPEPK

SEQ ID NO: 617002 - protein, 6 aa, Mycobacterium
YPHPPG

SEQ ID NO: 617003 - protein, 11 aa, Mycobacterium
YPHRGADRHGI

SEQ ID NO: 617004 - protein, 5 aa, Mycobacterium
YPHSD

SEQ ID NO: 617005 - protein, 18 aa, Mycobacterium
YPHSRPPQAELPPEAKTQ

SEQ ID NO: 617006 - protein, 5 aa, Mycobacterium
YPHTD

SEQ ID NO: 617007 - protein, 9 aa, Mycobacterium
YPKASAAAV

SEQ ID NO: 617008 - protein, 4 aa, Mycobacterium
YPKG

SEQ ID NO: 617009 - protein, 11 aa, Mycobacterium
YPKGVPDNDIP

SEQ ID NO: 617010 - protein, 8 aa, Mycobacterium
YPKPVQSP

SEQ ID NO: 617011 - protein, 9 aa, Mycobacterium
YPKRDERLP

SEQ ID NO: 617012 - protein, 7 aa, Mycobacterium
YPKYGHP

SEQ ID NO: 617013 - protein, 9 aa, Mycobacterium
YPKYGHPVS

SEQ ID NO: 617014 - protein, 25 aa, Mycobacterium
YPLAEASRAHTDLQGRKTVGSIVLI

SEQ ID NO: 617015 - protein, 10 aa, Mycobacterium
YPLEDPGLKQ

SEQ ID NO: 617016 - protein, 19 aa, Mycobacterium
YPLESDSKYPYTPDGNREF

SEQ ID NO: 617017 - protein, 5 aa, Mycobacterium
YPLGT

SEQ ID NO: 617018 - protein, 13 aa, Mycobacterium
YPLGTKSDLDETA

SEQ ID NO: 617019 - protein, 13 aa, Mycobacterium
YPLPGRQTPGDRN

SEQ ID NO: 617020 - protein, 9 aa, Mycobacterium
YPLRPRTGD

SEQ ID NO: 617021 - protein, 34 aa, Mycobacterium
YPLRTDDEQTDLGSEFRSAARSYKENFDSSTAPL

SEQ ID NO: 617022 - protein, 25 aa, Mycobacterium
YPLSDARQAHEYGQTGHARGKIILL

SEQ ID NO: 617023 - protein, 4 aa, Mycobacterium
YPLT

SEQ ID NO: 617024 - protein, 12 aa, Mycobacterium
YPLTEAAGAHAD

SEQ ID NO: 617025 - protein, 8 aa, Mycobacterium
YPLTSGSK

SEQ ID NO: 617026 - protein, 4 aa, Mycobacterium
YPMN

SEQ ID NO: 617027 - protein, 7 aa, Mycobacterium
YPMNGDH

SEQ ID NO: 617028 - protein, 10 aa, Mycobacterium
YPMPTSEDLA

SEQ ID NO: 617029 - protein, 8 aa, Mycobacterium
YPNGDPHI

SEQ ID NO: 617030 - protein, 8 aa, Mycobacterium
YPNGDPHV

SEQ ID NO: 617031 - protein, 7 aa, Mycobacterium
YPNGEPH

SEQ ID NO: 617032 - protein, 8 aa, Mycobacterium
YPNGNPHV

SEQ ID NO: 617033 - protein, 4 aa, Mycobacterium
YPNK

SEQ ID NO: 617034 - protein, 5 aa, Mycobacterium
YPNNT

SEQ ID NO: 617035 - protein, 17 aa, Mycobacterium
YPNNVAGGMGGAPPDES

SEQ ID NO: 617036 - protein, 9 aa, Mycobacterium
YPNPRQRSA

SEQ ID NO: 617037 - protein, 7 aa, Mycobacterium
YPNPTHP

SEQ ID NO: 617038 - protein, 7 aa, Mycobacterium
YPNQDLS

SEQ ID NO: 617039 - protein, 12 aa, Mycobacterium
YPNQLSGGQRQR

SEQ ID NO: 617040 - protein, 7 aa, Mycobacterium
YPNRNVT

SEQ ID NO: 617041 - protein, 8 aa, Mycobacterium
YPNSTQAA

SEQ ID NO: 617042 - protein, 11 aa, Mycobacterium
YPNSTRSGRRS

SEQ ID NO: 617043 - protein, 4 aa, Mycobacterium
YPNT

SEQ ID NO: 617044 - protein, 6 aa, Mycobacterium
YPNYPE

SEQ ID NO: 617045 - protein, 18 aa, Mycobacterium
YPPAADGTFPPISGPQAS

SEQ ID NO: 617046 - protein, 5 aa, Mycobacterium
YPPAL

SEQ ID NO: 617047 - protein, 5 aa, Mycobacterium
YPPAW

SEQ ID NO: 617048 - protein, 7 aa, Mycobacterium
YPPDDEL

SEQ ID NO: 617049 - protein, 8 aa, Mycobacterium
YPPDDELE

SEQ ID NO: 617050 - protein, 7 aa, Mycobacterium
YPPDDQM

SEQ ID NO: 617051 - protein, 9 aa, Mycobacterium
YPPDGEDDL

SEQ ID NO: 617052 - protein, 17 aa, Mycobacterium
YPPDPGFAENANATEAL

SEQ ID NO: 617053 - protein, 15 aa, Mycobacterium
YPPDPSCVSPTDQPD

SEQ ID NO: 617054 - protein, 4 aa, Mycobacterium
YPPE

SEQ ID NO: 617055 - protein, 6 aa, Mycobacterium
YPPGAV

SEQ ID NO: 617056 - protein, 11 aa, Mycobacterium
YPPGRGAHTSA

SEQ ID NO: 617057 - protein, 10 aa, Mycobacterium
YPPGTRPTRR

SEQ ID NO: 617058 - protein, 4 aa, Mycobacterium
YPPH

SEQ ID NO: 617059 - protein, 16 aa, Mycobacterium
YPPHFDSTAEQPHTPQ

SEQ ID NO: 617060 - protein, 4 aa, Mycobacterium
YPPK

SEQ ID NO: 617061 - protein, 9 aa, Mycobacterium
YPPKQTTVD

SEQ ID NO: 617062 - protein, 6 aa, Mycobacterium
YPPKSN

SEQ ID NO: 617063 - protein, 5 aa, Mycobacterium
YPPLD

SEQ ID NO: 617064 - protein, 6 aa, Mycobacterium
YPPMGP

SEQ ID NO: 617065 - protein, 9 aa, Mycobacterium
YPPNFRTSG

SEQ ID NO: 617066 - protein, 12 aa, Mycobacterium
YPPNRGRQLTAT

SEQ ID NO: 617067 - protein, 5 aa, Mycobacterium
YPPPA

SEQ ID NO: 617068 - protein, 9 aa, Mycobacterium
YPPPPGVSE

SEQ ID NO: 617069 - protein, 8 aa, Mycobacterium
YPPPSAAE

SEQ ID NO: 617070 - protein, 7 aa, Mycobacterium
YPPPSLT

SEQ ID NO: 617071 - protein, 5 aa, Mycobacterium
YPPPT

SEQ ID NO: 617072 - protein, 9 aa, Mycobacterium
YPPPTPEPV

SEQ ID NO: 617073 - protein, 5 aa, Mycobacterium
YPPPV

SEQ ID NO: 617074 - protein, 5 aa, Mycobacterium
YPPPW

SEQ ID NO: 617075 - protein, 13 aa, Mycobacterium
YPPQDPRLTGRSD

SEQ ID NO: 617076 - protein, 6 aa, Mycobacterium
YPPQED

SEQ ID NO: 617077 - protein, 5 aa, Mycobacterium
YPPQL

SEQ ID NO: 617078 - protein, 7 aa, Mycobacterium
YPPRTDD

SEQ ID NO: 617079 - protein, 7 aa, Mycobacterium
YPPRTED

SEQ ID NO: 617080 - protein, 7 aa, Mycobacterium
YPPSARF

SEQ ID NO: 617081 - protein, 5 aa, Mycobacterium
YPPSD

SEQ ID NO: 617082 - protein, 5 aa, Mycobacterium
YPPSG

SEQ ID NO: 617083 - protein, 6 aa, Mycobacterium
YPPSRV

SEQ ID NO: 617084 - protein, 6 aa, Mycobacterium
YPPTRL

SEQ ID NO: 617085 - protein, 20 aa, Mycobacterium
YPPYAEYQTKTDRLIPVFIV

SEQ ID NO: 617086 - protein, 6 aa, Mycobacterium
YPPYHD

SEQ ID NO: 617087 - protein, 15 aa, Mycobacterium
YPPYTEKNLKLMQRL

SEQ ID NO: 617088 - protein, 9 aa, Mycobacterium
YPQDGNRLG

SEQ ID NO: 617089 - protein, 11 aa, Mycobacterium
YPQDKDGNRMD

SEQ ID NO: 617090 - protein, 15 aa, Mycobacterium
YPQDLEETAEGAHPA

SEQ ID NO: 617091 - protein, 16 aa, Mycobacterium
YPQDNGPGAGCPPQHG

SEQ ID NO: 617092 - protein, 5 aa, Mycobacterium
YPQES

SEQ ID NO: 617093 - protein, 5 aa, Mycobacterium
YPQET

SEQ ID NO: 617094 - protein, 8 aa, Mycobacterium
YPQGPEYQ

SEQ ID NO: 617095 - protein, 6 aa, Mycobacterium
YPQHAP

SEQ ID NO: 617096 - protein, 8 aa, Mycobacterium
YPQPDGYA

SEQ ID NO: 617097 - protein, 9 aa, Mycobacterium
YPQQPTHAE

SEQ ID NO: 617098 - protein, 11 aa, Mycobacterium
YPQRPALGQRA

SEQ ID NO: 617099 - protein, 4 aa, Mycobacterium
YPQS

SEQ ID NO: 617100 - protein, 5 aa, Mycobacterium
YPQTT

SEQ ID NO: 617101 - protein, 8 aa, Mycobacterium
YPQVTETR

SEQ ID NO: 617102 - protein, 4 aa, Mycobacterium
YPQY

SEQ ID NO: 617103 - protein, 5 aa, Mycobacterium
YPRAR

SEQ ID NO: 617104 - protein, 14 aa, Mycobacterium
YPRAVQDTGNPAAK

SEQ ID NO: 617105 - protein, 4 aa, Mycobacterium
YPRG

SEQ ID NO: 617106 - protein, 10 aa, Mycobacterium
YPRGTEDQRA

SEQ ID NO: 617107 - protein, 9 aa, Mycobacterium
YPRGTEEQR

SEQ ID NO: 617108 - protein, 9 aa, Mycobacterium
YPRGTENQR

SEQ ID NO: 617109 - protein, 10 aa, Mycobacterium
YPRGTENQRA

SEQ ID NO: 617110 - protein, 9 aa, Mycobacterium
YPRGTEQQR

SEQ ID NO: 617111 - protein, 16 aa, Mycobacterium
YPRKQSESKATKKRCA

SEQ ID NO: 617112 - protein, 7 aa, Mycobacterium
YPRNTPG

SEQ ID NO: 617113 - protein, 7 aa, Mycobacterium
YPRPEAV

SEQ ID NO: 617114 - protein, 9 aa, Mycobacterium
YPRPSGCRG

SEQ ID NO: 617115 - protein, 8 aa, Mycobacterium
YPRQSPGG

SEQ ID NO: 617116 - protein, 4 aa, Mycobacterium
YPRR

SEQ ID NO: 617117 - protein, 5 aa, Mycobacterium
YPRRA

SEQ ID NO: 617118 - protein, 8 aa, Mycobacterium
YPRRADGT

SEQ ID NO: 617119 - protein, 6 aa, Mycobacterium
YPRRPD

SEQ ID NO: 617120 - protein, 11 aa, Mycobacterium
YPRRSDRDARV

SEQ ID NO: 617121 - protein, 8 aa, Mycobacterium
YPRSDLPA

SEQ ID NO: 617122 - protein, 8 aa, Mycobacterium
YPRSGDIT

SEQ ID NO: 617123 - protein, 5 aa, Mycobacterium
YPRTA

SEQ ID NO: 617124 - protein, 5 aa, Mycobacterium
YPRTG

SEQ ID NO: 617125 - protein, 11 aa, Mycobacterium
YPSAAAAADEM

SEQ ID NO: 617126 - protein, 6 aa, Mycobacterium
YPSADA

SEQ ID NO: 617127 - protein, 8 aa, Mycobacterium
YPSAEEER

SEQ ID NO: 617128 - protein, 13 aa, Mycobacterium
YPSAQDVRAAQDA

SEQ ID NO: 617129 - protein, 20 aa, Mycobacterium
YPSEPPGPREPVPAGDLLVR

SEQ ID NO: 617130 - protein, 4 aa, Mycobacterium
YPSG

SEQ ID NO: 617131 - protein, 9 aa, Mycobacterium
YPSGNRDED

SEQ ID NO: 617132 - protein, 7 aa, Mycobacterium
YPSGTEH

SEQ ID NO: 617133 - protein, 11 aa, Mycobacterium
YPSGTPVGNTS

SEQ ID NO: 617134 - protein, 8 aa, Mycobacterium
YPSGTRPD

SEQ ID NO: 617135 - protein, 10 aa, Mycobacterium
YPSGVPGPDR

SEQ ID NO: 617136 - protein, 15 aa, Mycobacterium
YPSLKDLTPDALRPT

SEQ ID NO: 617137 - protein, 16 aa, Mycobacterium
YPSLKDLTPEALRPIY

SEQ ID NO: 617138 - protein, 43 aa, Mycobacterium
YPSNSSGTAGATGAASASATAAATVTAGAAAAAGREQRVAPTT

SEQ ID NO: 617139 - protein, 7 aa, Mycobacterium
YPSPEQE

SEQ ID NO: 617140 - protein, 7 aa, Mycobacterium
YPSPGGE

SEQ ID NO: 617141 - protein, 8 aa, Mycobacterium
YPSPNDID

SEQ ID NO: 617142 - protein, 16 aa, Mycobacterium
YPSPTGRERVSLGEAG

SEQ ID NO: 617143 - protein, 5 aa, Mycobacterium
YPSQA

SEQ ID NO: 617144 - protein, 13 aa, Mycobacterium
YPSQATAAKGRAA

SEQ ID NO: 617145 - protein, 7 aa, Mycobacterium
YPSRADA

SEQ ID NO: 617146 - protein, 5 aa, Mycobacterium
YPSRP

SEQ ID NO: 617147 - protein, 5 aa, Mycobacterium
YPSRR

SEQ ID NO: 617148 - protein, 21 aa, Mycobacterium
YPSRRRQRDPSRAGPFAIFVA

SEQ ID NO: 617149 - protein, 4 aa, Mycobacterium
YPST

SEQ ID NO: 617150 - protein, 15 aa, Mycobacterium
YPSTASASPSTAADI

SEQ ID NO: 617151 - protein, 5 aa, Mycobacterium
YPSTG

SEQ ID NO: 617152 - protein, 17 aa, Mycobacterium
YPSTVEAQDTAMSSRGY

SEQ ID NO: 617153 - protein, 6 aa, Mycobacterium
YPSYPK

SEQ ID NO: 617154 - protein, 6 aa, Mycobacterium
YPTAED

SEQ ID NO: 617155 - protein, 15 aa, Mycobacterium
YPTAPASVGATTMPP

SEQ ID NO: 617156 - protein, 9 aa, Mycobacterium
YPTATDAEV

SEQ ID NO: 617157 - protein, 8 aa, Mycobacterium
YPTDAGQF

SEQ ID NO: 617158 - protein, 15 aa, Mycobacterium
YPTDKFGDRVRALPH

SEQ ID NO: 617159 - protein, 8 aa, Mycobacterium
YPTDLTDE

SEQ ID NO: 617160 - protein, 11 aa, Mycobacterium
YPTDLTDEAAV

SEQ ID NO: 617161 - protein, 4 aa, Mycobacterium
YPTE

SEQ ID NO: 617162 - protein, 6 aa, Mycobacterium
YPTEGI

SEQ ID NO: 617163 - protein, 6 aa, Mycobacterium
YPTEQL

SEQ ID NO: 617164 - protein, 11 aa, Mycobacterium
YPTETSEHSSE

SEQ ID NO: 617165 - protein, 5 aa, Mycobacterium
YPTFT

SEQ ID NO: 617166 - protein, 9 aa, Mycobacterium
YPTGMPAPG

SEQ ID NO: 617167 - protein, 13 aa, Mycobacterium
YPTHPGSAAKNAM

SEQ ID NO: 617168 - protein, 10 aa, Mycobacterium
YPTKAETGKV

SEQ ID NO: 617169 - protein, 12 aa, Mycobacterium
YPTNGTTAPRLT

SEQ ID NO: 617170 - protein, 6 aa, Mycobacterium
YPTPAG

SEQ ID NO: 617171 - protein, 8 aa, Mycobacterium
YPTPEEER

SEQ ID NO: 617172 - protein, 6 aa, Mycobacterium
YPTPIG

SEQ ID NO: 617173 - protein, 8 aa, Mycobacterium
YPTPPNCT

SEQ ID NO: 617174 - protein, 14 aa, Mycobacterium
YPTPPSGAANNTIT

SEQ ID NO: 617175 - protein, 5 aa, Mycobacterium
YPTPY

SEQ ID NO: 617176 - protein, 6 aa, Mycobacterium
YPTRAE

SEQ ID NO: 617177 - protein, 7 aa, Mycobacterium
YPTRTEA

SEQ ID NO: 617178 - protein, 6 aa, Mycobacterium
YPTTAI

SEQ ID NO: 617179 - protein, 6 aa, Mycobacterium
YPTTDP

SEQ ID NO: 617180 - protein, 17 aa, Mycobacterium
YPTTTEAQDSAVSPRGY

SEQ ID NO: 617181 - protein, 5 aa, Mycobacterium
YPVDA

SEQ ID NO: 617182 - protein, 9 aa, Mycobacterium
YPVEGAQGT

SEQ ID NO: 617183 - protein, 10 aa, Mycobacterium
YPVEGTQGTR

SEQ ID NO: 617184 - protein, 9 aa, Mycobacterium
YPVGNTGRV

SEQ ID NO: 617185 - protein, 4 aa, Mycobacterium
YPVQ

SEQ ID NO: 617186 - protein, 7 aa, Mycobacterium
YPVQPSD

SEQ ID NO: 617187 - protein, 5 aa, Mycobacterium
YPVQQ

SEQ ID NO: 617188 - protein, 5 aa, Mycobacterium
YPVSE

SEQ ID NO: 617189 - protein, 9 aa, Mycobacterium
YPVSQGTKR

SEQ ID NO: 617190 - protein, 8 aa, Mycobacterium
YPYAPSVA

SEQ ID NO: 617191 - protein, 5 aa, Mycobacterium
YPYDE

SEQ ID NO: 617192 - protein, 19 aa, Mycobacterium
YPYESDAKYPYTPDGNREF

SEQ ID NO: 617193 - protein, 8 aa, Mycobacterium
YPYGDTSH

SEQ ID NO: 617194 - protein, 4 aa, Mycobacterium
YPYN

SEQ ID NO: 617195 - protein, 4 aa, Mycobacterium
YQAA

SEQ ID NO: 617196 - protein, 12 aa, Mycobacterium
YQAASAQAQSLG

SEQ ID NO: 617197 - protein, 4 aa, Mycobacterium
YQAD

SEQ ID NO: 617198 - protein, 8 aa, Mycobacterium
YQAEDGES

SEQ ID NO: 617199 - protein, 4 aa, Mycobacterium
YQAG

SEQ ID NO: 617200 - protein, 5 aa, Mycobacterium
YQAGE

SEQ ID NO: 617201 - protein, 8 aa, Mycobacterium
YQAGPRYV

SEQ ID NO: 617202 - protein, 9 aa, Mycobacterium
YQAGRPDPI

SEQ ID NO: 617203 - protein, 9 aa, Mycobacterium
YQAKPKLPG

SEQ ID NO: 617204 - protein, 13 aa, Mycobacterium
YQAKRRGKNRIAR

SEQ ID NO: 617205 - protein, 16 aa, Mycobacterium
YQAKTSRVIPLFELIR

SEQ ID NO: 617206 - protein, 6 aa, Mycobacterium
YQARHP

SEQ ID NO: 617207 - protein, 12 aa, Mycobacterium
YQASTQPSSPTT

SEQ ID NO: 617208 - protein, 6 aa, Mycobacterium
YQDASV

SEQ ID NO: 617209 - protein, 12 aa, Mycobacterium
YQDDAKGPSASV

SEQ ID NO: 617210 - protein, 13 aa, Mycobacterium
YQDEDGNVDFPDG

SEQ ID NO: 617211 - protein, 10 aa, Mycobacterium
YQDERKPHVT

SEQ ID NO: 617212 - protein, 13 aa, Mycobacterium
YQDEVSSTARPES

SEQ ID NO: 617213 - protein, 4 aa, Mycobacterium
YQDG

SEQ ID NO: 617214 - protein, 10 aa, Mycobacterium
YQDGPPAGWE

SEQ ID NO: 617215 - protein, 17 aa, Mycobacterium
YQDGRDPAGISTQDPEL

SEQ ID NO: 617216 - protein, 4 aa, Mycobacterium
YQDI

SEQ ID NO: 617217 - protein, 4 aa, Mycobacterium
YQDR

SEQ ID NO: 617218 - protein, 8 aa, Mycobacterium
YQDRESGQ

SEQ ID NO: 617219 - protein, 12 aa, Mycobacterium
YQDRYGVPTEQL

SEQ ID NO: 617220 - protein, 6 aa, Mycobacterium
YQDTNH

SEQ ID NO: 617221 - protein, 15 aa, Mycobacterium
YQEDPGLLDTKKKDP

SEQ ID NO: 617222 - protein, 7 aa, Mycobacterium
YQEPRQE

SEQ ID NO: 617223 - protein, 22 aa, Mycobacterium
YQEQKNPSEDGALAPVDGKVRA

SEQ ID NO: 617224 - protein, 7 aa, Mycobacterium
YQETSEK

SEQ ID NO: 617225 - protein, 12 aa, Mycobacterium
YQGEAGLTPLGS

SEQ ID NO: 617226 - protein, 8 aa, Mycobacterium
YQGERSDV

SEQ ID NO: 617227 - protein, 10 aa, Mycobacterium
YQGEVEESQF

SEQ ID NO: 617228 - protein, 4 aa, Mycobacterium
YQGG

SEQ ID NO: 617229 - protein, 7 aa, Mycobacterium
YQGGSGW

SEQ ID NO: 617230 - protein, 24 aa, Mycobacterium
YQGKEAAEAGTGGRGGESGNPSTS

SEQ ID NO: 617231 - protein, 24 aa, Mycobacterium
YQGKEAAEAGTGGRGGESGTPSTS

SEQ ID NO: 617232 - protein, 24 aa, Mycobacterium
YQGKETAESGTGGRGGEAGTPSTS

SEQ ID NO: 617233 - protein, 5 aa, Mycobacterium
YQGKG

SEQ ID NO: 617234 - protein, 8 aa, Mycobacterium
YQGNPYYS

SEQ ID NO: 617235 - protein, 15 aa, Mycobacterium
YQGPPNKFEAGTGNI

SEQ ID NO: 617236 - protein, 15 aa, Mycobacterium
YQGPPSKFEAGTGNI

SEQ ID NO: 617237 - protein, 5 aa, Mycobacterium
YQGQF

SEQ ID NO: 617238 - protein, 24 aa, Mycobacterium
YQGRETAEAGTGGRGGEAGNPSTS

SEQ ID NO: 617239 - protein, 16 aa, Mycobacterium
YQGRGRDGHYSNDQDA

SEQ ID NO: 617240 - protein, 5 aa, Mycobacterium
YQGRH

SEQ ID NO: 617241 - protein, 4 aa, Mycobacterium
YQGS

SEQ ID NO: 617242 - protein, 14 aa, Mycobacterium
YQGSLSIGSLKGSL

SEQ ID NO: 617243 - protein, 14 aa, Mycobacterium
YQGSTHVSEPERSA

SEQ ID NO: 617244 - protein, 4 aa, Mycobacterium
YQGT

SEQ ID NO: 617245 - protein, 13 aa, Mycobacterium
YQGTQYPDRERPR

SEQ ID NO: 617246 - protein, 18 aa, Mycobacterium
YQGYGDVPGVAKDSQTET

SEQ ID NO: 617247 - protein, 4 aa, Mycobacterium
YQHQ

SEQ ID NO: 617248 - protein, 8 aa, Mycobacterium
YQKDRDTD

SEQ ID NO: 617249 - protein, 17 aa, Mycobacterium
YQKKTDRQIPVFVLTPV

SEQ ID NO: 617250 - protein, 9 aa, Mycobacterium
YQKPHPPIG

SEQ ID NO: 617251 - protein, 5 aa, Mycobacterium
YQNAG

SEQ ID NO: 617252 - protein, 6 aa, Mycobacterium
YQNDPR

SEQ ID NO: 617253 - protein, 8 aa, Mycobacterium
YQNGGGDE

SEQ ID NO: 617254 - protein, 9 aa, Mycobacterium
YQNNDAKQL

SEQ ID NO: 617255 - protein, 17 aa, Mycobacterium
YQNPHASPYDPKPYDGE

SEQ ID NO: 617256 - protein, 8 aa, Mycobacterium
YQNRQDPA

SEQ ID NO: 617257 - protein, 7 aa, Mycobacterium
YQPAGEA

SEQ ID NO: 617258 - protein, 5 aa, Mycobacterium
YQPAM

SEQ ID NO: 617259 - protein, 7 aa, Mycobacterium
YQPAMNN

SEQ ID NO: 617260 - protein, 7 aa, Mycobacterium
YQPAMSN

SEQ ID NO: 617261 - protein, 7 aa, Mycobacterium
YQPAQEP

SEQ ID NO: 617262 - protein, 17 aa, Mycobacterium
YQPDGRLKDSAANIAAT

SEQ ID NO: 617263 - protein, 11 aa, Mycobacterium
YQPDPAEPTQA

SEQ ID NO: 617264 - protein, 8 aa, Mycobacterium
YQPDPPGL

SEQ ID NO: 617265 - protein, 9 aa, Mycobacterium
YQPDRPNRA

SEQ ID NO: 617266 - protein, 7 aa, Mycobacterium
YQPEQTG

SEQ ID NO: 617267 - protein, 4 aa, Mycobacterium
YQPG

SEQ ID NO: 617268 - protein, 10 aa, Mycobacterium
YQPGAADDGV

SEQ ID NO: 617269 - protein, 10 aa, Mycobacterium
YQPGAENSNQ

SEQ ID NO: 617270 - protein, 12 aa, Mycobacterium
YQPGATNTKEAL

SEQ ID NO: 617271 - protein, 12 aa, Mycobacterium
YQPGGDTAGGTM

SEQ ID NO: 617272 - protein, 9 aa, Mycobacterium
YQPGGEGGE

SEQ ID NO: 617273 - protein, 10 aa, Mycobacterium
YQPHDGTVEE

SEQ ID NO: 617274 - protein, 9 aa, Mycobacterium
YQPITDSEA

SEQ ID NO: 617275 - protein, 4 aa, Mycobacterium
YQPM

SEQ ID NO: 617276 - protein, 6 aa, Mycobacterium
YQPNRL

SEQ ID NO: 617277 - protein, 6 aa, Mycobacterium
YQPPAG

SEQ ID NO: 617278 - protein, 13 aa, Mycobacterium
YQPPERRLYRKGQ

SEQ ID NO: 617279 - protein, 6 aa, Mycobacterium
YQPPTE

SEQ ID NO: 617280 - protein, 8 aa, Mycobacterium
YQPRRAKK

SEQ ID NO: 617281 - protein, 6 aa, Mycobacterium
YQPRTR

SEQ ID NO: 617282 - protein, 7 aa, Mycobacterium
YQPSAAE

SEQ ID NO: 617283 - protein, 4 aa, Mycobacterium
YQPT

SEQ ID NO: 617284 - protein, 6 aa, Mycobacterium
YQPTAK

SEQ ID NO: 617285 - protein, 15 aa, Mycobacterium
YQPTDHGNEREIGSR

SEQ ID NO: 617286 - protein, 15 aa, Mycobacterium
YQPTEWERRQLDAAR

SEQ ID NO: 617287 - protein, 5 aa, Mycobacterium
YQPTG

SEQ ID NO: 617288 - protein, 13 aa, Mycobacterium
YQPTGEAGKPADD

SEQ ID NO: 617289 - protein, 11 aa, Mycobacterium
YQPTGGGREGY

SEQ ID NO: 617290 - protein, 7 aa, Mycobacterium
YQPTLQD

SEQ ID NO: 617291 - protein, 4 aa, Mycobacterium
YQPW

SEQ ID NO: 617292 - protein, 4 aa, Mycobacterium
YQPY

SEQ ID NO: 617293 - protein, 11 aa, Mycobacterium
YQQDRQDERDR

SEQ ID NO: 617294 - protein, 6 aa, Mycobacterium
YQQEGS

SEQ ID NO: 617295 - protein, 4 aa, Mycobacterium
YQQG

SEQ ID NO: 617296 - protein, 10 aa, Mycobacterium
YQQGAPEGWE

SEQ ID NO: 617297 - protein, 5 aa, Mycobacterium
YQQGL

SEQ ID NO: 617298 - protein, 8 aa, Mycobacterium
YQQKSEQV

SEQ ID NO: 617299 - protein, 10 aa, Mycobacterium
YQQPGTPGLE

SEQ ID NO: 617300 - protein, 6 aa, Mycobacterium
YQQPQH

SEQ ID NO: 617301 - protein, 13 aa, Mycobacterium
YQQQGAFEGPPPW

SEQ ID NO: 617302 - protein, 19 aa, Mycobacterium
YQRAGVEETQPRLSYPPYR

SEQ ID NO: 617303 - protein, 19 aa, Mycobacterium
YQRASTAARRRGAVGEARG

SEQ ID NO: 617304 - protein, 16 aa, Mycobacterium
YQRATSRPIPIVVLAP

SEQ ID NO: 617305 - protein, 9 aa, Mycobacterium
YQRDGQAGV

SEQ ID NO: 617306 - protein, 6 aa, Mycobacterium
YQRDGR

SEQ ID NO: 617307 - protein, 4 aa, Mycobacterium
YQRG

SEQ ID NO: 617308 - protein, 6 aa, Mycobacterium
YQRGPT

SEQ ID NO: 617309 - protein, 8 aa, Mycobacterium
YQRPPRDL

SEQ ID NO: 617310 - protein, 11 aa, Mycobacterium
YQRPPREASTY

SEQ ID NO: 617311 - protein, 9 aa, Mycobacterium
YQRPTEKFT

SEQ ID NO: 617312 - protein, 4 aa, Mycobacterium
YQRR

SEQ ID NO: 617313 - protein, 20 aa, Mycobacterium
YQRRGEEDSQASQRAAEAAA

SEQ ID NO: 617314 - protein, 13 aa, Mycobacterium
YQRSAPERPAGQP

SEQ ID NO: 617315 - protein, 10 aa, Mycobacterium
YQRTGDPYQL

SEQ ID NO: 617316 - protein, 7 aa, Mycobacterium
YQRTSAR

SEQ ID NO: 617317 - protein, 10 aa, Mycobacterium
YQSAGTLRDR

SEQ ID NO: 617318 - protein, 14 aa, Mycobacterium
YQSEHDRWTENRNS

SEQ ID NO: 617319 - protein, 4 aa, Mycobacterium
YQSG

SEQ ID NO: 617320 - protein, 8 aa, Mycobacterium
YQSNHTRQ

SEQ ID NO: 617321 - protein, 7 aa, Mycobacterium
YQSPAPR

SEQ ID NO: 617322 - protein, 8 aa, Mycobacterium
YQSPDGAV

SEQ ID NO: 617323 - protein, 15 aa, Mycobacterium
YQSPIDYEAQYRALR

SEQ ID NO: 617324 - protein, 10 aa, Mycobacterium
YQSPVTASYN

SEQ ID NO: 617325 - protein, 14 aa, Mycobacterium
YQSQAKAKQAWEEG

SEQ ID NO: 617326 - protein, 8 aa, Mycobacterium
YQSRQDPA

SEQ ID NO: 617327 - protein, 9 aa, Mycobacterium
YQSRQDPAI

SEQ ID NO: 617328 - protein, 9 aa, Mycobacterium
YQSRQDPAV

SEQ ID NO: 617329 - protein, 9 aa, Mycobacterium
YQSTEVSER

SEQ ID NO: 617330 - protein, 33 aa, Mycobacterium
YQSTGGANIGGGNSGSGNKGFGNTGNYNIGSGN

SEQ ID NO: 617331 - protein, 10 aa, Mycobacterium
YQSTKVSERH

SEQ ID NO: 617332 - protein, 9 aa, Mycobacterium
YQSTQVSER

SEQ ID NO: 617333 - protein, 15 aa, Mycobacterium
YQSVRRRPWQPTQSL

SEQ ID NO: 617334 - protein, 5 aa, Mycobacterium
YQSYQ

SEQ ID NO: 617335 - protein, 15 aa, Mycobacterium
YQSYTTRQIPVVILE

SEQ ID NO: 617336 - protein, 11 aa, Mycobacterium
YQTANGAMRPA

SEQ ID NO: 617337 - protein, 7 aa, Mycobacterium
YQTATAA

SEQ ID NO: 617338 - protein, 5 aa, Mycobacterium
YQTGS

SEQ ID NO: 617339 - protein, 7 aa, Mycobacterium
YQTPDSL

SEQ ID NO: 617340 - protein, 20 aa, Mycobacterium
YQTPGSLGPPGTMGSATTPD

SEQ ID NO: 617341 - protein, 4 aa, Mycobacterium
YQTS

SEQ ID NO: 617342 - protein, 12 aa, Mycobacterium
YQTTGGLKGRPC

SEQ ID NO: 617343 - protein, 7 aa, Mycobacterium
YQTTPNV

SEQ ID NO: 617344 - protein, 10 aa, Mycobacterium
YQVEGTQGTR

SEQ ID NO: 617345 - protein, 7 aa, Mycobacterium
YQVPPSQ

SEQ ID NO: 617346 - protein, 11 aa, Mycobacterium
YRAAEDHQTVG

SEQ ID NO: 617347 - protein, 20 aa, Mycobacterium
YRAAGEAPTQISGYKGSDGK

SEQ ID NO: 617348 - protein, 16 aa, Mycobacterium
YRADRDKIRAQHEKAG

SEQ ID NO: 617349 - protein, 13 aa, Mycobacterium
YRAEAGPKDHTVP

SEQ ID NO: 617350 - protein, 27 aa, Mycobacterium
YRAETEQKWGETTEWKESQRRTRSYGK

SEQ ID NO: 617351 - protein, 10 aa, Mycobacterium
YRAETPRPEY

SEQ ID NO: 617352 - protein, 4 aa, Mycobacterium
YRAG

SEQ ID NO: 617353 - protein, 9 aa, Mycobacterium
YRAGQRITE

SEQ ID NO: 617354 - protein, 9 aa, Mycobacterium
YRAGRDIKA

SEQ ID NO: 617355 - protein, 10 aa, Mycobacterium
YRAGRPPLDV

SEQ ID NO: 617356 - protein, 9 aa, Mycobacterium
YRAGRPPLE

SEQ ID NO: 617357 - protein, 5 aa, Mycobacterium
YRANP

SEQ ID NO: 617358 - protein, 4 aa, Mycobacterium
YRAP

SEQ ID NO: 617359 - protein, 6 aa, Mycobacterium
YRAPRD

SEQ ID NO: 617360 - protein, 10 aa, Mycobacterium
YRAPTPPQPE

SEQ ID NO: 617361 - protein, 8 aa, Mycobacterium
YRASGADA

SEQ ID NO: 617362 - protein, 7 aa, Mycobacterium
YRASTIN

SEQ ID NO: 617363 - protein, 5 aa, Mycobacterium
YRATT

SEQ ID NO: 617364 - protein, 10 aa, Mycobacterium
YRATTTREIA

SEQ ID NO: 617365 - protein, 4 aa, Mycobacterium
YRAV

SEQ ID NO: 617366 - protein, 4 aa, Mycobacterium
YRDA

SEQ ID NO: 617367 - protein, 7 aa, Mycobacterium
YRDAGGA

SEQ ID NO: 617368 - protein, 11 aa, Mycobacterium
YRDANGKPQIA

SEQ ID NO: 617369 - protein, 12 aa, Mycobacterium
YRDAVGDSYRTM

SEQ ID NO: 617370 - protein, 5 aa, Mycobacterium
YRDDA

SEQ ID NO: 617371 - protein, 10 aa, Mycobacterium
YRDDENSSTA

SEQ ID NO: 617372 - protein, 10 aa, Mycobacterium
YRDDETPAEV

SEQ ID NO: 617373 - protein, 5 aa, Mycobacterium
YRDDP

SEQ ID NO: 617374 - protein, 8 aa, Mycobacterium
YRDDPARN

SEQ ID NO: 617375 - protein, 6 aa, Mycobacterium
YRDDQR

SEQ ID NO: 617376 - protein, 6 aa, Mycobacterium
YRDDSL

SEQ ID NO: 617377 - protein, 5 aa, Mycobacterium
YRDEA

SEQ ID NO: 617378 - protein, 6 aa, Mycobacterium
YRDEDG

SEQ ID NO: 617379 - protein, 8 aa, Mycobacterium
YRDEGDGE

SEQ ID NO: 617380 - protein, 9 aa, Mycobacterium
YRDEGDGEE

SEQ ID NO: 617381 - protein, 7 aa, Mycobacterium
YRDEGEG

SEQ ID NO: 617382 - protein, 7 aa, Mycobacterium
YRDELSP

SEQ ID NO: 617383 - protein, 5 aa, Mycobacterium
YRDEN

SEQ ID NO: 617384 - protein, 15 aa, Mycobacterium
YRDETGSKVHTPEQM

SEQ ID NO: 617385 - protein, 4 aa, Mycobacterium
YRDG

SEQ ID NO: 617386 - protein, 9 aa, Mycobacterium
YRDGAPENW

SEQ ID NO: 617387 - protein, 9 aa, Mycobacterium
YRDGAPQGW

SEQ ID NO: 617388 - protein, 7 aa, Mycobacterium
YRDGDLD

SEQ ID NO: 617389 - protein, 9 aa, Mycobacterium
YRDGDPAPM

SEQ ID NO: 617390 - protein, 7 aa, Mycobacterium
YRDGEGD

SEQ ID NO: 617391 - protein, 7 aa, Mycobacterium
YRDGETL

SEQ ID NO: 617392 - protein, 17 aa, Mycobacterium
YRDGGAGAEVSWLSRGV

SEQ ID NO: 617393 - protein, 17 aa, Mycobacterium
YRDGGDGGEVSWLSRGV

SEQ ID NO: 617394 - protein, 5 aa, Mycobacterium
YRDGT

SEQ ID NO: 617395 - protein, 4 aa, Mycobacterium
YRDL

SEQ ID NO: 617396 - protein, 6 aa, Mycobacterium
YRDNGG

SEQ ID NO: 617397 - protein, 7 aa, Mycobacterium
YRDNLGD

SEQ ID NO: 617398 - protein, 4 aa, Mycobacterium
YRDP

SEQ ID NO: 617399 - protein, 11 aa, Mycobacterium
YRDPDGPGELR

SEQ ID NO: 617400 - protein, 8 aa, Mycobacterium
YRDPNTRG

SEQ ID NO: 617401 - protein, 9 aa, Mycobacterium
YRDPRGRMD

SEQ ID NO: 617402 - protein, 15 aa, Mycobacterium
YRDPWQDGREPASVG

SEQ ID NO: 617403 - protein, 7 aa, Mycobacterium
YRDQPES

SEQ ID NO: 617404 - protein, 10 aa, Mycobacterium
YRDRPDPRRW

SEQ ID NO: 617405 - protein, 5 aa, Mycobacterium
YRDRQ

SEQ ID NO: 617406 - protein, 4 aa, Mycobacterium
YRDS

SEQ ID NO: 617407 - protein, 10 aa, Mycobacterium
YRDSERQREG

SEQ ID NO: 617408 - protein, 4 aa, Mycobacterium
YRDT

SEQ ID NO: 617409 - protein, 7 aa, Mycobacterium
YRDTDSD

SEQ ID NO: 617410 - protein, 6 aa, Mycobacterium
YRDTED

SEQ ID NO: 617411 - protein, 7 aa, Mycobacterium
YRDTEDL

SEQ ID NO: 617412 - protein, 6 aa, Mycobacterium
YRDTQA

SEQ ID NO: 617413 - protein, 7 aa, Mycobacterium
YRDTSME

SEQ ID NO: 617414 - protein, 5 aa, Mycobacterium
YREAA

SEQ ID NO: 617415 - protein, 6 aa, Mycobacterium
YREADG

SEQ ID NO: 617416 - protein, 13 aa, Mycobacterium
YREAEAKGRGAVG

SEQ ID NO: 617417 - protein, 10 aa, Mycobacterium
YREEAGKTGP

SEQ ID NO: 617418 - protein, 12 aa, Mycobacterium
YREEQSKGSITV

SEQ ID NO: 617419 - protein, 8 aa, Mycobacterium
YREGETLR

SEQ ID NO: 617420 - protein, 8 aa, Mycobacterium
YREGTPDS

SEQ ID NO: 617421 - protein, 22 aa, Mycobacterium
YREKNRYGFTPPGHRQGRGTDE

SEQ ID NO: 617422 - protein, 4 aa, Mycobacterium
YREP

SEQ ID NO: 617423 - protein, 8 aa, Mycobacterium
YREPETAT

SEQ ID NO: 617424 - protein, 11 aa, Mycobacterium
YREPPPPRRDR

SEQ ID NO: 617425 - protein, 6 aa, Mycobacterium
YREPST

SEQ ID NO: 617426 - protein, 6 aa, Mycobacterium
YREPVS

SEQ ID NO: 617427 - protein, 29 aa, Mycobacterium
YREQGPAGMADRSSRPHRSPHQTPTRTER

SEQ ID NO: 617428 - protein, 21 aa, Mycobacterium
YRERDPEGPNADGADPGTPPM

SEQ ID NO: 617429 - protein, 8 aa, Mycobacterium
YRERGGKL

SEQ ID NO: 617430 - protein, 7 aa, Mycobacterium
YRESPLP

SEQ ID NO: 617431 - protein, 14 aa, Mycobacterium
YRETGQQPLAAGET

SEQ ID NO: 617432 - protein, 7 aa, Mycobacterium
YRETNDL

SEQ ID NO: 617433 - protein, 7 aa, Mycobacterium
YRETRRP

SEQ ID NO: 617434 - protein, 4 aa, Mycobacterium
YRGA

SEQ ID NO: 617435 - protein, 19 aa, Mycobacterium
YRGADRSVQVEPGSTRGFS

SEQ ID NO: 617436 - protein, 5 aa, Mycobacterium
YRGAR

SEQ ID NO: 617437 - protein, 7 aa, Mycobacterium
YRGDETV

SEQ ID NO: 617438 - protein, 7 aa, Mycobacterium
YRGDGRF

SEQ ID NO: 617439 - protein, 9 aa, Mycobacterium
YRGDRNNVA

SEQ ID NO: 617440 - protein, 4 aa, Mycobacterium
YRGE

SEQ ID NO: 617441 - protein, 23 aa, Mycobacterium
YRGEAPDGRGARPPWSIGEPQPE

SEQ ID NO: 617442 - protein, 10 aa, Mycobacterium
YRGEAPNFGG

SEQ ID NO: 617443 - protein, 12 aa, Mycobacterium
YRGEGGDKLDGE

SEQ ID NO: 617444 - protein, 9 aa, Mycobacterium
YRGESAEFG

SEQ ID NO: 617445 - protein, 13 aa, Mycobacterium
YRGESGRLDGETL

SEQ ID NO: 617446 - protein, 14 aa, Mycobacterium
YRGGEAKTDAKDAR

SEQ ID NO: 617447 - protein, 8 aa, Mycobacterium
YRGGGVGN

SEQ ID NO: 617448 - protein, 7 aa, Mycobacterium
YRGGPVT

SEQ ID NO: 617449 - protein, 28 aa, Mycobacterium
YRGGSAPSRAVEQPPTSPARWTRWGRRR

SEQ ID NO: 617450 - protein, 9 aa, Mycobacterium
YRGGTYSST

SEQ ID NO: 617451 - protein, 9 aa, Mycobacterium
YRGKESHAA

SEQ ID NO: 617452 - protein, 9 aa, Mycobacterium
YRGNTTPVA

SEQ ID NO: 617453 - protein, 7 aa, Mycobacterium
YRGPAAD

SEQ ID NO: 617454 - protein, 8 aa, Mycobacterium
YRGPAGPI

SEQ ID NO: 617455 - protein, 6 aa, Mycobacterium
YRGPER

SEQ ID NO: 617456 - protein, 9 aa, Mycobacterium
YRGPFTPGS

SEQ ID NO: 617457 - protein, 17 aa, Mycobacterium
YRGPHGDEPGVTEPKPI

SEQ ID NO: 617458 - protein, 17 aa, Mycobacterium
YRGPQADAPGVTSTGPL

SEQ ID NO: 617459 - protein, 8 aa, Mycobacterium
YRGPRTAS

SEQ ID NO: 617460 - protein, 6 aa, Mycobacterium
YRGPSA

SEQ ID NO: 617461 - protein, 31 aa, Mycobacterium
YRGPSPTPLRRNGSTCQTAGRPDRRPSAATA

SEQ ID NO: 617462 - protein, 8 aa, Mycobacterium
YRGPTEPT

SEQ ID NO: 617463 - protein, 5 aa, Mycobacterium
YRGQE

SEQ ID NO: 617464 - protein, 5 aa, Mycobacterium
YRGQF

SEQ ID NO: 617465 - protein, 10 aa, Mycobacterium
YRGQPAGVPT

SEQ ID NO: 617466 - protein, 15 aa, Mycobacterium
YRGQSDGGSQSPDSL

SEQ ID NO: 617467 - protein, 7 aa, Mycobacterium
YRGRQGA

SEQ ID NO: 617468 - protein, 5 aa, Mycobacterium
YRGRR

SEQ ID NO: 617469 - protein, 9 aa, Mycobacterium
YRGSPTHQQ

SEQ ID NO: 617470 - protein, 5 aa, Mycobacterium
YRGTA

SEQ ID NO: 617471 - protein, 12 aa, Mycobacterium
YRGTDPRPQAAG

SEQ ID NO: 617472 - protein, 10 aa, Mycobacterium
YRGTGAGGQH

SEQ ID NO: 617473 - protein, 9 aa, Mycobacterium
YRGTQALDG

SEQ ID NO: 617474 - protein, 23 aa, Mycobacterium
YRGVDPATAPAREATLELLAKEL

SEQ ID NO: 617475 - protein, 4 aa, Mycobacterium
YRGY

SEQ ID NO: 617476 - protein, 5 aa, Mycobacterium
YRGYG

SEQ ID NO: 617477 - protein, 9 aa, Mycobacterium
YRIEGQKTA

SEQ ID NO: 617478 - protein, 4 aa, Mycobacterium
YRIN

SEQ ID NO: 617479 - protein, 7 aa, Mycobacterium
YRKGAAK

SEQ ID NO: 617480 - protein, 13 aa, Mycobacterium
YRKGIHDDGTCFA

SEQ ID NO: 617481 - protein, 8 aa, Mycobacterium
YRKGTSHL

SEQ ID NO: 617482 - protein, 20 aa, Mycobacterium
YRKPEEPANPTSSSLTAGNS

SEQ ID NO: 617483 - protein, 9 aa, Mycobacterium
YRKPGRLPD

SEQ ID NO: 617484 - protein, 13 aa, Mycobacterium
YRKPTIGTANAGT

SEQ ID NO: 617485 - protein, 8 aa, Mycobacterium
YRLPDEAQ

SEQ ID NO: 617486 - protein, 5 aa, Mycobacterium
YRNDP

SEQ ID NO: 617487 - protein, 4 aa, Mycobacterium
YRNE

SEQ ID NO: 617488 - protein, 11 aa, Mycobacterium
YRNGDDAGLGT

SEQ ID NO: 617489 - protein, 8 aa, Mycobacterium
YRNGEAET

SEQ ID NO: 617490 - protein, 14 aa, Mycobacterium
YRNGIHEDVSALPG

SEQ ID NO: 617491 - protein, 6 aa, Mycobacterium
YRNGND

SEQ ID NO: 617492 - protein, 14 aa, Mycobacterium
YRNGPGKLDAGGQQ

SEQ ID NO: 617493 - protein, 9 aa, Mycobacterium
YRNGSGPAS

SEQ ID NO: 617494 - protein, 5 aa, Mycobacterium
YRNPS

SEQ ID NO: 617495 - protein, 12 aa, Mycobacterium
YRNQNPAGEGER

SEQ ID NO: 617496 - protein, 4 aa, Mycobacterium
YRNR

SEQ ID NO: 617497 - protein, 9 aa, Mycobacterium
YRPADGAAA

SEQ ID NO: 617498 - protein, 6 aa, Mycobacterium
YRPDDY

SEQ ID NO: 617499 - protein, 6 aa, Mycobacterium
YRPDEE

SEQ ID NO: 617500 - protein, 9 aa, Mycobacterium
YRPDGGTYD

SEQ ID NO: 617501 - protein, 13 aa, Mycobacterium
YRPDGTTSVVHVD

SEQ ID NO: 617502 - protein, 12 aa, Mycobacterium
YRPDPAEPTQAA

SEQ ID NO: 617503 - protein, 6 aa, Mycobacterium
YRPEDY

SEQ ID NO: 617504 - protein, 7 aa, Mycobacterium
YRPEEHL

SEQ ID NO: 617505 - protein, 9 aa, Mycobacterium
YRPEEYHAA

SEQ ID NO: 617506 - protein, 6 aa, Mycobacterium
YRPEGS

SEQ ID NO: 617507 - protein, 5 aa, Mycobacterium
YRPEH

SEQ ID NO: 617508 - protein, 5 aa, Mycobacterium
YRPER

SEQ ID NO: 617509 - protein, 15 aa, Mycobacterium
YRPGADGTFPAAGGS

SEQ ID NO: 617510 - protein, 14 aa, Mycobacterium
YRPGDDADAVARRA

SEQ ID NO: 617511 - protein, 12 aa, Mycobacterium
YRPGEKDGSGDL

SEQ ID NO: 617512 - protein, 5 aa, Mycobacterium
YRPGG

SEQ ID NO: 617513 - protein, 8 aa, Mycobacterium
YRPGGDAL

SEQ ID NO: 617514 - protein, 15 aa, Mycobacterium
YRPGGIAEKAAAREE

SEQ ID NO: 617515 - protein, 8 aa, Mycobacterium
YRPGRGPV

SEQ ID NO: 617516 - protein, 8 aa, Mycobacterium
YRPGTLTT

SEQ ID NO: 617517 - protein, 8 aa, Mycobacterium
YRPHDGSV

SEQ ID NO: 617518 - protein, 9 aa, Mycobacterium
YRPITDSQA

SEQ ID NO: 617519 - protein, 7 aa, Mycobacterium
YRPKGMP

SEQ ID NO: 617520 - protein, 7 aa, Mycobacterium
YRPNTAA

SEQ ID NO: 617521 - protein, 13 aa, Mycobacterium
YRPPDGRGRPGAD

SEQ ID NO: 617522 - protein, 8 aa, Mycobacterium
YRPPGDAA

SEQ ID NO: 617523 - protein, 9 aa, Mycobacterium
YRPPNGASA

SEQ ID NO: 617524 - protein, 7 aa, Mycobacterium
YRPPPRT

SEQ ID NO: 617525 - protein, 11 aa, Mycobacterium
YRPPSPPTPQT

SEQ ID NO: 617526 - protein, 5 aa, Mycobacterium
YRPQA

SEQ ID NO: 617527 - protein, 7 aa, Mycobacterium
YRPQEDS

SEQ ID NO: 617528 - protein, 4 aa, Mycobacterium
YRPR

SEQ ID NO: 617529 - protein, 6 aa, Mycobacterium
YRPRDE

SEQ ID NO: 617530 - protein, 12 aa, Mycobacterium
YRPRNGRTWPPT

SEQ ID NO: 617531 - protein, 7 aa, Mycobacterium
YRPRNRQ

SEQ ID NO: 617532 - protein, 9 aa, Mycobacterium
YRPSAAARA

SEQ ID NO: 617533 - protein, 7 aa, Mycobacterium
YRPSDEK

SEQ ID NO: 617534 - protein, 8 aa, Mycobacterium
YRPSDEKV

SEQ ID NO: 617535 - protein, 7 aa, Mycobacterium
YRPSEDR

SEQ ID NO: 617536 - protein, 12 aa, Mycobacterium
YRPSLSQAVPPA

SEQ ID NO: 617537 - protein, 6 aa, Mycobacterium
YRPSRE

SEQ ID NO: 617538 - protein, 7 aa, Mycobacterium
YRPSREN

SEQ ID NO: 617539 - protein, 10 aa, Mycobacterium
YRPSSGSVTF

SEQ ID NO: 617540 - protein, 7 aa, Mycobacterium
YRPTEDT

SEQ ID NO: 617541 - protein, 14 aa, Mycobacterium
YRPTGRGGEREIGG

SEQ ID NO: 617542 - protein, 8 aa, Mycobacterium
YRPTPAAN

SEQ ID NO: 617543 - protein, 5 aa, Mycobacterium
YRPTR

SEQ ID NO: 617544 - protein, 15 aa, Mycobacterium
YRPTSGSVTFDGSTI

SEQ ID NO: 617545 - protein, 7 aa, Mycobacterium
YRPTSRQ

SEQ ID NO: 617546 - protein, 11 aa, Mycobacterium
YRQAANDDSAA

SEQ ID NO: 617547 - protein, 9 aa, Mycobacterium
YRQADGASV

SEQ ID NO: 617548 - protein, 12 aa, Mycobacterium
YRQAEAGSVPEP

SEQ ID NO: 617549 - protein, 10 aa, Mycobacterium
YRQAEGASAP

SEQ ID NO: 617550 - protein, 9 aa, Mycobacterium
YRQCDDDDA

SEQ ID NO: 617551 - protein, 21 aa, Mycobacterium
YRQDRQQERDRRLLDKSRYFD

SEQ ID NO: 617552 - protein, 8 aa, Mycobacterium
YRQEPDET

SEQ ID NO: 617553 - protein, 11 aa, Mycobacterium
YRQGGTGDGDT

SEQ ID NO: 617554 - protein, 7 aa, Mycobacterium
YRQPDGT

SEQ ID NO: 617555 - protein, 8 aa, Mycobacterium
YRQPPPVR

SEQ ID NO: 617556 - protein, 8 aa, Mycobacterium
YRRAEEAG

SEQ ID NO: 617557 - protein, 6 aa, Mycobacterium
YRRAGK

SEQ ID NO: 617558 - protein, 6 aa, Mycobacterium
YRRAQG

SEQ ID NO: 617559 - protein, 7 aa, Mycobacterium
YRRDDGV

SEQ ID NO: 617560 - protein, 13 aa, Mycobacterium
YRREDARAHAPEP

SEQ ID NO: 617561 - protein, 11 aa, Mycobacterium
YRRESESMARP

SEQ ID NO: 617562 - protein, 6 aa, Mycobacterium
YRRGEE

SEQ ID NO: 617563 - protein, 9 aa, Mycobacterium
YRRGEETCP

SEQ ID NO: 617564 - protein, 8 aa, Mycobacterium
YRRKAQQY

SEQ ID NO: 617565 - protein, 5 aa, Mycobacterium
YRRKG

SEQ ID NO: 617566 - protein, 12 aa, Mycobacterium
YRRPAPKSTGKE

SEQ ID NO: 617567 - protein, 5 aa, Mycobacterium
YRRPE

SEQ ID NO: 617568 - protein, 7 aa, Mycobacterium
YRRPGDP

SEQ ID NO: 617569 - protein, 14 aa, Mycobacterium
YRRPTATATMRTNT

SEQ ID NO: 617570 - protein, 8 aa, Mycobacterium
YRRQPGDN

SEQ ID NO: 617571 - protein, 10 aa, Mycobacterium
YRRQTTSGLD

SEQ ID NO: 617572 - protein, 4 aa, Mycobacterium
YRRR

SEQ ID NO: 617573 - protein, 9 aa, Mycobacterium
YRRRRDPKD

SEQ ID NO: 617574 - protein, 9 aa, Mycobacterium
YRRRTDPKD

SEQ ID NO: 617575 - protein, 5 aa, Mycobacterium
YRRSK

SEQ ID NO: 617576 - protein, 13 aa, Mycobacterium
YRRSPRAPALGAS

SEQ ID NO: 617577 - protein, 13 aa, Mycobacterium
YRRSPRAPAPGES

SEQ ID NO: 617578 - protein, 15 aa, Mycobacterium
YRRSPRAPQPDTGLY

SEQ ID NO: 617579 - protein, 7 aa, Mycobacterium
YRRTDAG

SEQ ID NO: 617580 - protein, 6 aa, Mycobacterium
YRRTEA

SEQ ID NO: 617581 - protein, 7 aa, Mycobacterium
YRRTGDD

SEQ ID NO: 617582 - protein, 9 aa, Mycobacterium
YRRTGEPGQ

SEQ ID NO: 617583 - protein, 5 aa, Mycobacterium
YRRTR

SEQ ID NO: 617584 - protein, 7 aa, Mycobacterium
YRRTTDG

SEQ ID NO: 617585 - protein, 10 aa, Mycobacterium
YRRYREGSSA

SEQ ID NO: 617586 - protein, 4 aa, Mycobacterium
YRSA

SEQ ID NO: 617587 - protein, 7 aa, Mycobacterium
YRSAGDP

SEQ ID NO: 617588 - protein, 7 aa, Mycobacterium
YRSAGGN

SEQ ID NO: 617589 - protein, 23 aa, Mycobacterium
YRSERNEATGKSRPKGLRENRRT

SEQ ID NO: 617590 - protein, 12 aa, Mycobacterium
YRSGDSGRRLSN

SEQ ID NO: 617591 - protein, 9 aa, Mycobacterium
YRSGKGTTA

SEQ ID NO: 617592 - protein, 9 aa, Mycobacterium
YRSGSENIG

SEQ ID NO: 617593 - protein, 10 aa, Mycobacterium
YRSGTSAKEA

SEQ ID NO: 617594 - protein, 4 aa, Mycobacterium
YRSK

SEQ ID NO: 617595 - protein, 12 aa, Mycobacterium
YRSPFGVSGERG

SEQ ID NO: 617596 - protein, 6 aa, Mycobacterium
YRSPQA

SEQ ID NO: 617597 - protein, 7 aa, Mycobacterium
YRSQEGQ

SEQ ID NO: 617598 - protein, 7 aa, Mycobacterium
YRSRGTR

SEQ ID NO: 617599 - protein, 17 aa, Mycobacterium
YRSRPKTSATRTTRAIR

SEQ ID NO: 617600 - protein, 10 aa, Mycobacterium
YRSRRGGEDI

SEQ ID NO: 617601 - protein, 8 aa, Mycobacterium
YRSSERDF

SEQ ID NO: 617602 - protein, 10 aa, Mycobacterium
YRSSGGLTDS

SEQ ID NO: 617603 - protein, 12 aa, Mycobacterium
YRSSGVNGRSAV

SEQ ID NO: 617604 - protein, 5 aa, Mycobacterium
YRSSV

SEQ ID NO: 617605 - protein, 8 aa, Mycobacterium
YRSTGADL

SEQ ID NO: 617606 - protein, 18 aa, Mycobacterium
YRSTGADLPFGDPLPSHG

SEQ ID NO: 617607 - protein, 6 aa, Mycobacterium
YRSTQT

SEQ ID NO: 617608 - protein, 5 aa, Mycobacterium
YRTAD

SEQ ID NO: 617609 - protein, 10 aa, Mycobacterium
YRTAQTVTNH

SEQ ID NO: 617610 - protein, 13 aa, Mycobacterium
YRTAQTVTNQSDL

SEQ ID NO: 617611 - protein, 8 aa, Mycobacterium
YRTDEPDA

SEQ ID NO: 617612 - protein, 9 aa, Mycobacterium
YRTDNGEEF

SEQ ID NO: 617613 - protein, 53 aa, Mycobacterium
YRTDNRSDSGKSSSNGSSSKSSENSSSSGSSSSSSDSSSSSSSSSAAPAAAAS

SEQ ID NO: 617614 - protein, 64 aa, Mycobacterium
YRTDSREAGKSSSVSSSGGGESSSSSSTGSSETSGTSGKSETSSSSGSNGTSSTSSSPAPAAAA

SEQ ID NO: 617615 - protein, 58 aa, Mycobacterium
YRTDSREATKKSKSSSGGASSSESSSSSGSSDAKTSSTSSSSKEKSTSSATPAAASAS

SEQ ID NO: 617616 - protein, 50 aa, Mycobacterium
YRTDSRETDKKSKSSTNGSSSSESTSSETKSSSPAEKSTSTAAPVTAAAA

SEQ ID NO: 617617 - protein, 55 aa, Mycobacterium
YRTDSRSGSVDAATKSDAGTKSESKSSSDSSGSSSAGSSSSSSSSSSTATASAAA

SEQ ID NO: 617618 - protein, 4 aa, Mycobacterium
YRTE

SEQ ID NO: 617619 - protein, 9 aa, Mycobacterium
YRTEDARVG

SEQ ID NO: 617620 - protein, 15 aa, Mycobacterium
YRTEDRGDAAAHERD

SEQ ID NO: 617621 - protein, 5 aa, Mycobacterium
YRTEN

SEQ ID NO: 617622 - protein, 5 aa, Mycobacterium
YRTGD

SEQ ID NO: 617623 - protein, 12 aa, Mycobacterium
YRTGDGRLDGDR

SEQ ID NO: 617624 - protein, 8 aa, Mycobacterium
YRTGENPR

SEQ ID NO: 617625 - protein, 7 aa, Mycobacterium
YRTGGPL

SEQ ID NO: 617626 - protein, 11 aa, Mycobacterium
YRTGNGSLGAP

SEQ ID NO: 617627 - protein, 6 aa, Mycobacterium
YRTGVP

SEQ ID NO: 617628 - protein, 7 aa, Mycobacterium
YRTKDDR

SEQ ID NO: 617629 - protein, 9 aa, Mycobacterium
YRTPDDGRR

SEQ ID NO: 617630 - protein, 8 aa, Mycobacterium
YRTPGGAG

SEQ ID NO: 617631 - protein, 24 aa, Mycobacterium
YRTPPDSGGGETLDTTTILPAGNN

SEQ ID NO: 617632 - protein, 9 aa, Mycobacterium
YRTPRANPR

SEQ ID NO: 617633 - protein, 9 aa, Mycobacterium
YRTPRPNPK

SEQ ID NO: 617634 - protein, 4 aa, Mycobacterium
YRTQ

SEQ ID NO: 617635 - protein, 7 aa, Mycobacterium
YRTTSSV

SEQ ID NO: 617636 - protein, 13 aa, Mycobacterium
YRVGDGRGGAGAG

SEQ ID NO: 617637 - protein, 5 aa, Mycobacterium
YRVPD

SEQ ID NO: 617638 - protein, 13 aa, Mycobacterium
YRVSDGRGGAGAG

SEQ ID NO: 617639 - protein, 25 aa, Mycobacterium
YRYADGKRTTQPPEPSDAERIEEAR

SEQ ID NO: 617640 - protein, 7 aa, Mycobacterium
YSAAAGR

SEQ ID NO: 617641 - protein, 7 aa, Mycobacterium
YSAADGK

SEQ ID NO: 617642 - protein, 6 aa, Mycobacterium
YSAAET

SEQ ID NO: 617643 - protein, 5 aa, Mycobacterium
YSAAK

SEQ ID NO: 617644 - protein, 4 aa, Mycobacterium
YSAD

SEQ ID NO: 617645 - protein, 9 aa, Mycobacterium
YSAEDPAAA

SEQ ID NO: 617646 - protein, 10 aa, Mycobacterium
YSAEDPAAAV

SEQ ID NO: 617647 - protein, 5 aa, Mycobacterium
YSAGD

SEQ ID NO: 617648 - protein, 8 aa, Mycobacterium
YSAGGAQV

SEQ ID NO: 617649 - protein, 8 aa, Mycobacterium
YSAGGARV

SEQ ID NO: 617650 - protein, 10 aa, Mycobacterium
YSAGGPTHAS

SEQ ID NO: 617651 - protein, 12 aa, Mycobacterium
YSAGSEPAAHVN

SEQ ID NO: 617652 - protein, 18 aa, Mycobacterium
YSAGTTGGAGGAGGAGGV

SEQ ID NO: 617653 - protein, 4 aa, Mycobacterium
YSAN

SEQ ID NO: 617654 - protein, 15 aa, Mycobacterium
YSANPELAPPAPVSG

SEQ ID NO: 617655 - protein, 7 aa, Mycobacterium
YSAPKEL

SEQ ID NO: 617656 - protein, 12 aa, Mycobacterium
YSAQEASKAIRT

SEQ ID NO: 617657 - protein, 12 aa, Mycobacterium
YSAQEASKALRT

SEQ ID NO: 617658 - protein, 11 aa, Mycobacterium
YSAQEASRALR

SEQ ID NO: 617659 - protein, 10 aa, Mycobacterium
YSAQEATKAL

SEQ ID NO: 617660 - protein, 10 aa, Mycobacterium
YSAQKENYAK

SEQ ID NO: 617661 - protein, 13 aa, Mycobacterium
YSARAKAKELGVD

SEQ ID NO: 617662 - protein, 8 aa, Mycobacterium
YSASAGRY

SEQ ID NO: 617663 - protein, 8 aa, Mycobacterium
YSASPAGR

SEQ ID NO: 617664 - protein, 13 aa, Mycobacterium
YSASRAGRNHAPV

SEQ ID NO: 617665 - protein, 4 aa, Mycobacterium
YSAT

SEQ ID NO: 617666 - protein, 6 aa, Mycobacterium
YSATKG

SEQ ID NO: 617667 - protein, 11 aa, Mycobacterium
YSATPEAQRMS

SEQ ID NO: 617668 - protein, 9 aa, Mycobacterium
YSATPSAQE

SEQ ID NO: 617669 - protein, 9 aa, Mycobacterium
YSATSTREI

SEQ ID NO: 617670 - protein, 14 aa, Mycobacterium
YSAYDGYPGPQIPG

SEQ ID NO: 617671 - protein, 14 aa, Mycobacterium
YSAYTGGPDPLAPP

SEQ ID NO: 617672 - protein, 15 aa, Mycobacterium
YSAYTGGPDPLAPPV

SEQ ID NO: 617673 - protein, 7 aa, Mycobacterium
YSCETGS

SEQ ID NO: 617674 - protein, 5 aa, Mycobacterium
YSDAS

SEQ ID NO: 617675 - protein, 8 aa, Mycobacterium
YSDASKMR

SEQ ID NO: 617676 - protein, 4 aa, Mycobacterium
YSDE

SEQ ID NO: 617677 - protein, 7 aa, Mycobacterium
YSDEHGD

SEQ ID NO: 617678 - protein, 5 aa, Mycobacterium
YSDEP

SEQ ID NO: 617679 - protein, 5 aa, Mycobacterium
YSDER

SEQ ID NO: 617680 - protein, 8 aa, Mycobacterium
YSDGAAAL

SEQ ID NO: 617681 - protein, 11 aa, Mycobacterium
YSDGAAGPKLL

SEQ ID NO: 617682 - protein, 14 aa, Mycobacterium
YSDGMTVRGEGEAL

SEQ ID NO: 617683 - protein, 9 aa, Mycobacterium
YSDKGIAGT

SEQ ID NO: 617684 - protein, 9 aa, Mycobacterium
YSDNATGTV

SEQ ID NO: 617685 - protein, 8 aa, Mycobacterium
YSDPDANA

SEQ ID NO: 617686 - protein, 7 aa, Mycobacterium
YSDPDPD

SEQ ID NO: 617687 - protein, 8 aa, Mycobacterium
YSDPETTR

SEQ ID NO: 617688 - protein, 10 aa, Mycobacterium
YSDPGAWPGL

SEQ ID NO: 617689 - protein, 8 aa, Mycobacterium
YSDPGMDG

SEQ ID NO: 617690 - protein, 21 aa, Mycobacterium
YSDPGMDGPTIARATEAALQG

SEQ ID NO: 617691 - protein, 22 aa, Mycobacterium
YSDPGMDGPTIQRATEAALSGG

SEQ ID NO: 617692 - protein, 6 aa, Mycobacterium
YSDPPA

SEQ ID NO: 617693 - protein, 13 aa, Mycobacterium
YSDPPALAPDEYE

SEQ ID NO: 617694 - protein, 11 aa, Mycobacterium
YSDPPALASSE

SEQ ID NO: 617695 - protein, 10 aa, Mycobacterium
YSDPPALATA

SEQ ID NO: 617696 - protein, 13 aa, Mycobacterium
YSDPPALATDEYQ

SEQ ID NO: 617697 - protein, 14 aa, Mycobacterium
YSDPPDLAPLPEEE

SEQ ID NO: 617698 - protein, 8 aa, Mycobacterium
YSDRERDG

SEQ ID NO: 617699 - protein, 11 aa, Mycobacterium
YSDRPALTPDE

SEQ ID NO: 617700 - protein, 7 aa, Mycobacterium
YSDRPEM

SEQ ID NO: 617701 - protein, 9 aa, Mycobacterium
YSDRTGRAV

SEQ ID NO: 617702 - protein, 5 aa, Mycobacterium
YSDTA

SEQ ID NO: 617703 - protein, 12 aa, Mycobacterium
YSDTPLSEVTTN

SEQ ID NO: 617704 - protein, 5 aa, Mycobacterium
YSDTQ

SEQ ID NO: 617705 - protein, 9 aa, Mycobacterium
YSDTQRYRV

SEQ ID NO: 617706 - protein, 13 aa, Mycobacterium
YSDTTAQAGERGY

SEQ ID NO: 617707 - protein, 6 aa, Mycobacterium
YSEDGG

SEQ ID NO: 617708 - protein, 11 aa, Mycobacterium
YSEEQSKGSIT

SEQ ID NO: 617709 - protein, 10 aa, Mycobacterium
YSEGAPAGWE

SEQ ID NO: 617710 - protein, 9 aa, Mycobacterium
YSEGAPDGW

SEQ ID NO: 617711 - protein, 9 aa, Mycobacterium
YSEGPPEDW

SEQ ID NO: 617712 - protein, 4 aa, Mycobacterium
YSEL

SEQ ID NO: 617713 - protein, 5 aa, Mycobacterium
YSELG

SEQ ID NO: 617714 - protein, 11 aa, Mycobacterium
YSEPGAGSDLA

SEQ ID NO: 617715 - protein, 21 aa, Mycobacterium
YSEPGAGSDLANVSTAAELDG

SEQ ID NO: 617716 - protein, 16 aa, Mycobacterium
YSEPGAGSDLANVSTS

SEQ ID NO: 617717 - protein, 21 aa, Mycobacterium
YSEPGAGSDLANVSTTAELDG

SEQ ID NO: 617718 - protein, 18 aa, Mycobacterium
YSEPNAGSDLANVSTTAE

SEQ ID NO: 617719 - protein, 9 aa, Mycobacterium
YSEPNPEST

SEQ ID NO: 617720 - protein, 10 aa, Mycobacterium
YSEQDPAEVA

SEQ ID NO: 617721 - protein, 5 aa, Mycobacterium
YSEQP

SEQ ID NO: 617722 - protein, 4 aa, Mycobacterium
YSER

SEQ ID NO: 617723 - protein, 6 aa, Mycobacterium
YSERSR

SEQ ID NO: 617724 - protein, 11 aa, Mycobacterium
YSERTSDGRLR

SEQ ID NO: 617725 - protein, 14 aa, Mycobacterium
YSERTSDGRLRQPS

SEQ ID NO: 617726 - protein, 9 aa, Mycobacterium
YSESASYSS

SEQ ID NO: 617727 - protein, 7 aa, Mycobacterium
YSESDQP

SEQ ID NO: 617728 - protein, 6 aa, Mycobacterium
YSESET

SEQ ID NO: 617729 - protein, 5 aa, Mycobacterium
YSESR

SEQ ID NO: 617730 - protein, 5 aa, Mycobacterium
YSEVQ

SEQ ID NO: 617731 - protein, 9 aa, Mycobacterium
YSGAASDEA

SEQ ID NO: 617732 - protein, 5 aa, Mycobacterium
YSGAG

SEQ ID NO: 617733 - protein, 9 aa, Mycobacterium
YSGAGSGPL

SEQ ID NO: 617734 - protein, 23 aa, Mycobacterium
YSGAQLGAAQRQHRQARGQSEVP

SEQ ID NO: 617735 - protein, 6 aa, Mycobacterium
YSGARG

SEQ ID NO: 617736 - protein, 9 aa, Mycobacterium
YSGASAAAA

SEQ ID NO: 617737 - protein, 8 aa, Mycobacterium
YSGATTAN

SEQ ID NO: 617738 - protein, 6 aa, Mycobacterium
YSGEAD

SEQ ID NO: 617739 - protein, 18 aa, Mycobacterium
YSGEGATDLDVIVEVTRL

SEQ ID NO: 617740 - protein, 18 aa, Mycobacterium
YSGEGSTDLDVIVEITRL

SEQ ID NO: 617741 - protein, 18 aa, Mycobacterium
YSGEGSTDLDVVVEITRL

SEQ ID NO: 617742 - protein, 9 aa, Mycobacterium
YSGEQPNEG

SEQ ID NO: 617743 - protein, 7 aa, Mycobacterium
YSGESDV

SEQ ID NO: 617744 - protein, 10 aa, Mycobacterium
YSGGDSSDGY

SEQ ID NO: 617745 - protein, 5 aa, Mycobacterium
YSGGG

SEQ ID NO: 617746 - protein, 18 aa, Mycobacterium
YSGGGSTDLDVVVEVTRL

SEQ ID NO: 617747 - protein, 24 aa, Mycobacterium
YSGGKRTARPPDPSDADRIEEARG

SEQ ID NO: 617748 - protein, 8 aa, Mycobacterium
YSGGPAWN

SEQ ID NO: 617749 - protein, 7 aa, Mycobacterium
YSGGQAW

SEQ ID NO: 617750 - protein, 17 aa, Mycobacterium
YSGGTHTARPPDGSHDA

SEQ ID NO: 617751 - protein, 5 aa, Mycobacterium
YSGHT

SEQ ID NO: 617752 - protein, 9 aa, Mycobacterium
YSGKFSSDR

SEQ ID NO: 617753 - protein, 8 aa, Mycobacterium
YSGLSDRQ

SEQ ID NO: 617754 - protein, 17 aa, Mycobacterium
YSGPATSVQRDRGSRSR

SEQ ID NO: 617755 - protein, 9 aa, Mycobacterium
YSGPAYGEA

SEQ ID NO: 617756 - protein, 7 aa, Mycobacterium
YSGPEAI

SEQ ID NO: 617757 - protein, 9 aa, Mycobacterium
YSGPGPGSL

SEQ ID NO: 617758 - protein, 9 aa, Mycobacterium
YSGPGSAPL

SEQ ID NO: 617759 - protein, 8 aa, Mycobacterium
YSGPGSAS

SEQ ID NO: 617760 - protein, 9 aa, Mycobacterium
YSGPGSGQM

SEQ ID NO: 617761 - protein, 16 aa, Mycobacterium
YSGPGSGSLQAAAEGW

SEQ ID NO: 617762 - protein, 9 aa, Mycobacterium
YSGPGSSPL

SEQ ID NO: 617763 - protein, 9 aa, Mycobacterium
YSGPGSTPL

SEQ ID NO: 617764 - protein, 8 aa, Mycobacterium
YSGPHDDA

SEQ ID NO: 617765 - protein, 18 aa, Mycobacterium
YSGQGATDLDVVVEVTRL

SEQ ID NO: 617766 - protein, 11 aa, Mycobacterium
YSGQTNADPAF

SEQ ID NO: 617767 - protein, 16 aa, Mycobacterium
YSGRDQVSPQAGRDAA

SEQ ID NO: 617768 - protein, 9 aa, Mycobacterium
YSGRPSPLY

SEQ ID NO: 617769 - protein, 9 aa, Mycobacterium
YSGRPTAGT

SEQ ID NO: 617770 - protein, 5 aa, Mycobacterium
YSGRS

SEQ ID NO: 617771 - protein, 6 aa, Mycobacterium
YSGRTY

SEQ ID NO: 617772 - protein, 8 aa, Mycobacterium
YSGTADDA

SEQ ID NO: 617773 - protein, 6 aa, Mycobacterium
YSGTAV

SEQ ID NO: 617774 - protein, 8 aa, Mycobacterium
YSGTDGRV

SEQ ID NO: 617775 - protein, 7 aa, Mycobacterium
YSGTGAP

SEQ ID NO: 617776 - protein, 7 aa, Mycobacterium
YSGTGNL

SEQ ID NO: 617777 - protein, 13 aa, Mycobacterium
YSGVTPRRRTPGV

SEQ ID NO: 617778 - protein, 7 aa, Mycobacterium
YSGYKSE

SEQ ID NO: 617779 - protein, 9 aa, Mycobacterium
YSHDDPDGV

SEQ ID NO: 617780 - protein, 9 aa, Mycobacterium
YSHDSTEGV

SEQ ID NO: 617781 - protein, 16 aa, Mycobacterium
YSHENPRSLSQEQERA

SEQ ID NO: 617782 - protein, 9 aa, Mycobacterium
YSHNDPDGV

SEQ ID NO: 617783 - protein, 7 aa, Mycobacterium
YSHPGDN

SEQ ID NO: 617784 - protein, 8 aa, Mycobacterium
YSHPGDNI

SEQ ID NO: 617785 - protein, 8 aa, Mycobacterium
YSHQDGVT

SEQ ID NO: 617786 - protein, 7 aa, Mycobacterium
YSHQPNR

SEQ ID NO: 617787 - protein, 6 aa, Mycobacterium
YSHTGE

SEQ ID NO: 617788 - protein, 10 aa, Mycobacterium
YSISSSPLVS

SEQ ID NO: 617789 - protein, 11 aa, Mycobacterium
YSISSSPLVSP

SEQ ID NO: 617790 - protein, 11 aa, Mycobacterium
YSITNSGRLRS

SEQ ID NO: 617791 - protein, 6 aa, Mycobacterium
YSKDGA

SEQ ID NO: 617792 - protein, 7 aa, Mycobacterium
YSKDGAM

SEQ ID NO: 617793 - protein, 14 aa, Mycobacterium
YSKDQTGADPISRA

SEQ ID NO: 617794 - protein, 11 aa, Mycobacterium
YSKDRKAFGQS

SEQ ID NO: 617795 - protein, 4 aa, Mycobacterium
YSKE

SEQ ID NO: 617796 - protein, 12 aa, Mycobacterium
YSKNRNEAKRKL

SEQ ID NO: 617797 - protein, 10 aa, Mycobacterium
YSKPGKRGGT

SEQ ID NO: 617798 - protein, 8 aa, Mycobacterium
YSKPPQAG

SEQ ID NO: 617799 - protein, 9 aa, Mycobacterium
YSKSHGPDL

SEQ ID NO: 617800 - protein, 7 aa, Mycobacterium
YSKSKAA

SEQ ID NO: 617801 - protein, 24 aa, Mycobacterium
YSLDDAEKAWDAQADSPHVKIGIA

SEQ ID NO: 617802 - protein, 6 aa, Mycobacterium
YSLKGR

SEQ ID NO: 617803 - protein, 12 aa, Mycobacterium
YSLSSTLGRHTN

SEQ ID NO: 617804 - protein, 9 aa, Mycobacterium
YSLTGDGVS

SEQ ID NO: 617805 - protein, 8 aa, Mycobacterium
YSMPGENT

SEQ ID NO: 617806 - protein, 11 aa, Mycobacterium
YSMSSSPAVGE

SEQ ID NO: 617807 - protein, 12 aa, Mycobacterium
YSNATGGFGGLG

SEQ ID NO: 617808 - protein, 9 aa, Mycobacterium
YSNDAKTDL

SEQ ID NO: 617809 - protein, 7 aa, Mycobacterium
YSNEAKA

SEQ ID NO: 617810 - protein, 8 aa, Mycobacterium
YSNEAKAE

SEQ ID NO: 617811 - protein, 12 aa, Mycobacterium
YSNGTPVGGGIG

SEQ ID NO: 617812 - protein, 8 aa, Mycobacterium
YSNRSAQR

SEQ ID NO: 617813 - protein, 13 aa, Mycobacterium
YSNSGDNSGGEQE

SEQ ID NO: 617814 - protein, 8 aa, Mycobacterium
YSNSSQRV

SEQ ID NO: 617815 - protein, 4 aa, Mycobacterium
YSNT

SEQ ID NO: 617816 - protein, 11 aa, Mycobacterium
YSPADDSPYAN

SEQ ID NO: 617817 - protein, 8 aa, Mycobacterium
YSPAEANP

SEQ ID NO: 617818 - protein, 5 aa, Mycobacterium
YSPAG

SEQ ID NO: 617819 - protein, 33 aa, Mycobacterium
YSPANTNPALNNPATPATTPSSLPPVSGGGGTL

SEQ ID NO: 617820 - protein, 9 aa, Mycobacterium
YSPASSVAE

SEQ ID NO: 617821 - protein, 12 aa, Mycobacterium
YSPDFGQATGAA

SEQ ID NO: 617822 - protein, 8 aa, Mycobacterium
YSPDPGPV

SEQ ID NO: 617823 - protein, 6 aa, Mycobacterium
YSPDRD

SEQ ID NO: 617824 - protein, 6 aa, Mycobacterium
YSPEQI

SEQ ID NO: 617825 - protein, 10 aa, Mycobacterium
YSPESYTGTE

SEQ ID NO: 617826 - protein, 8 aa, Mycobacterium
YSPGAAGH

SEQ ID NO: 617827 - protein, 13 aa, Mycobacterium
YSPGADATPDAPR

SEQ ID NO: 617828 - protein, 6 aa, Mycobacterium
YSPGAL

SEQ ID NO: 617829 - protein, 9 aa, Mycobacterium
YSPGDPLPW

SEQ ID NO: 617830 - protein, 8 aa, Mycobacterium
YSPGDSLR

SEQ ID NO: 617831 - protein, 7 aa, Mycobacterium
YSPGTVD

SEQ ID NO: 617832 - protein, 9 aa, Mycobacterium
YSPGTVDQW

SEQ ID NO: 617833 - protein, 15 aa, Mycobacterium
YSPGVGYPSLNPGDE

SEQ ID NO: 617834 - protein, 6 aa, Mycobacterium
YSPPVL

SEQ ID NO: 617835 - protein, 7 aa, Mycobacterium
YSPQQHP

SEQ ID NO: 617836 - protein, 10 aa, Mycobacterium
YSPQRAHRPD

SEQ ID NO: 617837 - protein, 6 aa, Mycobacterium
YSPQSW

SEQ ID NO: 617838 - protein, 12 aa, Mycobacterium
YSPQSWSTIPGG

SEQ ID NO: 617839 - protein, 4 aa, Mycobacterium
YSPR

SEQ ID NO: 617840 - protein, 7 aa, Mycobacterium
YSPRLRP

SEQ ID NO: 617841 - protein, 10 aa, Mycobacterium
YSPRLRPGTP

SEQ ID NO: 617842 - protein, 5 aa, Mycobacterium
YSPRN

SEQ ID NO: 617843 - protein, 5 aa, Mycobacterium
YSPSG

SEQ ID NO: 617844 - protein, 7 aa, Mycobacterium
YSPSPPV

SEQ ID NO: 617845 - protein, 9 aa, Mycobacterium
YSPSSPLGG

SEQ ID NO: 617846 - protein, 6 aa, Mycobacterium
YSPSTA

SEQ ID NO: 617847 - protein, 11 aa, Mycobacterium
YSPTAAPGRAS

SEQ ID NO: 617848 - protein, 5 aa, Mycobacterium
YSPTG

SEQ ID NO: 617849 - protein, 4 aa, Mycobacterium
YSPV

SEQ ID NO: 617850 - protein, 9 aa, Mycobacterium
YSPVYPTDA

SEQ ID NO: 617851 - protein, 4 aa, Mycobacterium
YSQA

SEQ ID NO: 617852 - protein, 7 aa, Mycobacterium
YSQAGSQ

SEQ ID NO: 617853 - protein, 9 aa, Mycobacterium
YSQDPERHE

SEQ ID NO: 617854 - protein, 8 aa, Mycobacterium
YSQDQGWE

SEQ ID NO: 617855 - protein, 8 aa, Mycobacterium
YSQERTTF

SEQ ID NO: 617856 - protein, 8 aa, Mycobacterium
YSQGAELA

SEQ ID NO: 617857 - protein, 14 aa, Mycobacterium
YSQGGDGNADMSMT

SEQ ID NO: 617858 - protein, 6 aa, Mycobacterium
YSQGST

SEQ ID NO: 617859 - protein, 4 aa, Mycobacterium
YSQT

SEQ ID NO: 617860 - protein, 12 aa, Mycobacterium
YSQTDLATHSRR

SEQ ID NO: 617861 - protein, 12 aa, Mycobacterium
YSQTNLSTHSRR

SEQ ID NO: 617862 - protein, 12 aa, Mycobacterium
YSQVDDGAAGVV

SEQ ID NO: 617863 - protein, 10 aa, Mycobacterium
YSRDGHSDYG

SEQ ID NO: 617864 - protein, 9 aa, Mycobacterium
YSRDPERHE

SEQ ID NO: 617865 - protein, 11 aa, Mycobacterium
YSRDPRNVARK

SEQ ID NO: 617866 - protein, 6 aa, Mycobacterium
YSRGDR

SEQ ID NO: 617867 - protein, 7 aa, Mycobacterium
YSRGGRA

SEQ ID NO: 617868 - protein, 6 aa, Mycobacterium
YSRGNR

SEQ ID NO: 617869 - protein, 8 aa, Mycobacterium
YSRGSQDI

SEQ ID NO: 617870 - protein, 10 aa, Mycobacterium
YSRPPADERE

SEQ ID NO: 617871 - protein, 8 aa, Mycobacterium
YSRPPQAG

SEQ ID NO: 617872 - protein, 6 aa, Mycobacterium
YSRPVP

SEQ ID NO: 617873 - protein, 5 aa, Mycobacterium
YSRQG

SEQ ID NO: 617874 - protein, 6 aa, Mycobacterium
YSRQGW

SEQ ID NO: 617875 - protein, 9 aa, Mycobacterium
YSRRNREDH

SEQ ID NO: 617876 - protein, 9 aa, Mycobacterium
YSRSENPPL

SEQ ID NO: 617877 - protein, 9 aa, Mycobacterium
YSRTAGPKI

SEQ ID NO: 617878 - protein, 9 aa, Mycobacterium
YSRTGTGPP

SEQ ID NO: 617879 - protein, 14 aa, Mycobacterium
YSRTGTVENSHTPL

SEQ ID NO: 617880 - protein, 4 aa, Mycobacterium
YSSA

SEQ ID NO: 617881 - protein, 15 aa, Mycobacterium
YSSAPSPGDGEPSTS

SEQ ID NO: 617882 - protein, 12 aa, Mycobacterium
YSSATSPGGQVQ

SEQ ID NO: 617883 - protein, 11 aa, Mycobacterium
YSSATTPGGQV

SEQ ID NO: 617884 - protein, 9 aa, Mycobacterium
YSSDSGRTV

SEQ ID NO: 617885 - protein, 8 aa, Mycobacterium
YSSDSYTD

SEQ ID NO: 617886 - protein, 10 aa, Mycobacterium
YSSEDSATPM

SEQ ID NO: 617887 - protein, 7 aa, Mycobacterium
YSSFGSK

SEQ ID NO: 617888 - protein, 8 aa, Mycobacterium
YSSGADGI

SEQ ID NO: 617889 - protein, 9 aa, Mycobacterium
YSSGDKGRM

SEQ ID NO: 617890 - protein, 7 aa, Mycobacterium
YSSGHTD

SEQ ID NO: 617891 - protein, 8 aa, Mycobacterium
YSSGPRLQ

SEQ ID NO: 617892 - protein, 6 aa, Mycobacterium
YSSGSP

SEQ ID NO: 617893 - protein, 7 aa, Mycobacterium
YSSLDPR

SEQ ID NO: 617894 - protein, 19 aa, Mycobacterium
YSSLNPRRTAGDSIAEPLR

SEQ ID NO: 617895 - protein, 12 aa, Mycobacterium
YSSLTPDAGPYF

SEQ ID NO: 617896 - protein, 12 aa, Mycobacterium
YSSLTPNAGPYF

SEQ ID NO: 617897 - protein, 6 aa, Mycobacterium
YSSNAG

SEQ ID NO: 617898 - protein, 16 aa, Mycobacterium
YSSNNGSAIGTSRTEA

SEQ ID NO: 617899 - protein, 9 aa, Mycobacterium
YSSPHDQVT

SEQ ID NO: 617900 - protein, 7 aa, Mycobacterium
YSSPHTD

SEQ ID NO: 617901 - protein, 8 aa, Mycobacterium
YSSPQTDF

SEQ ID NO: 617902 - protein, 6 aa, Mycobacterium
YSSRAG

SEQ ID NO: 617903 - protein, 18 aa, Mycobacterium
YSSRSDRVRSGASRRIRR

SEQ ID NO: 617904 - protein, 7 aa, Mycobacterium
YSSVESL

SEQ ID NO: 617905 - protein, 6 aa, Mycobacterium
YSSVGT

SEQ ID NO: 617906 - protein, 14 aa, Mycobacterium
YSSYTPDPATGGRT

SEQ ID NO: 617907 - protein, 8 aa, Mycobacterium
YSTAGRLG

SEQ ID NO: 617908 - protein, 14 aa, Mycobacterium
YSTAPTDDIVVRRV

SEQ ID NO: 617909 - protein, 10 aa, Mycobacterium
YSTDDDPEHY

SEQ ID NO: 617910 - protein, 7 aa, Mycobacterium
YSTDGQA

SEQ ID NO: 617911 - protein, 8 aa, Mycobacterium
YSTEPAGE

SEQ ID NO: 617912 - protein, 8 aa, Mycobacterium
YSTEPQGG

SEQ ID NO: 617913 - protein, 7 aa, Mycobacterium
YSTERRP

SEQ ID NO: 617914 - protein, 8 aa, Mycobacterium
YSTETDNL

SEQ ID NO: 617915 - protein, 8 aa, Mycobacterium
YSTGTTST

SEQ ID NO: 617916 - protein, 10 aa, Mycobacterium
YSTNRAQLHT

SEQ ID NO: 617917 - protein, 8 aa, Mycobacterium
YSTPAHST

SEQ ID NO: 617918 - protein, 8 aa, Mycobacterium
YSTPEEVE

SEQ ID NO: 617919 - protein, 8 aa, Mycobacterium
YSTPESPV

SEQ ID NO: 617920 - protein, 6 aa, Mycobacterium
YSTPET

SEQ ID NO: 617921 - protein, 5 aa, Mycobacterium
YSTPF

SEQ ID NO: 617922 - protein, 8 aa, Mycobacterium
YSTRSDRL

SEQ ID NO: 617923 - protein, 18 aa, Mycobacterium
YSTRSDSGVAERIDRSSR

SEQ ID NO: 617924 - protein, 9 aa, Mycobacterium
YSTRSERLA

SEQ ID NO: 617925 - protein, 6 aa, Mycobacterium
YSTRSG

SEQ ID NO: 617926 - protein, 10 aa, Mycobacterium
YSTRSGQLAK

SEQ ID NO: 617927 - protein, 8 aa, Mycobacterium
YSTRTTTA

SEQ ID NO: 617928 - protein, 9 aa, Mycobacterium
YSTSESPVQ

SEQ ID NO: 617929 - protein, 16 aa, Mycobacterium
YSTSNGSATAAGGDYV

SEQ ID NO: 617930 - protein, 4 aa, Mycobacterium
YSTT

SEQ ID NO: 617931 - protein, 7 aa, Mycobacterium
YSTTGSI

SEQ ID NO: 617932 - protein, 7 aa, Mycobacterium
YSTTGSK

SEQ ID NO: 617933 - protein, 8 aa, Mycobacterium
YSTTGSVT

SEQ ID NO: 617934 - protein, 10 aa, Mycobacterium
YSVGDPNAGV

SEQ ID NO: 617935 - protein, 5 aa, Mycobacterium
YSVGT

SEQ ID NO: 617936 - protein, 11 aa, Mycobacterium
YSVPSAHSDTT

SEQ ID NO: 617937 - protein, 5 aa, Mycobacterium
YSVPV

SEQ ID NO: 617938 - protein, 22 aa, Mycobacterium
YSYADRDDPPRETVGNPPGPCR

SEQ ID NO: 617939 - protein, 12 aa, Mycobacterium
YSYENGGLPTNE

SEQ ID NO: 617940 - protein, 12 aa, Mycobacterium
YSYENGGVPTNE

SEQ ID NO: 617941 - protein, 8 aa, Mycobacterium
YSYGPDGT

SEQ ID NO: 617942 - protein, 7 aa, Mycobacterium
YTAAEAG

SEQ ID NO: 617943 - protein, 12 aa, Mycobacterium
YTAAGTGFDADS

SEQ ID NO: 617944 - protein, 9 aa, Mycobacterium
YTAAKGGLR

SEQ ID NO: 617945 - protein, 6 aa, Mycobacterium
YTADEA

SEQ ID NO: 617946 - protein, 7 aa, Mycobacterium
YTAEEAG

SEQ ID NO: 617947 - protein, 8 aa, Mycobacterium
YTAEEAGD

SEQ ID NO: 617948 - protein, 4 aa, Mycobacterium
YTAG

SEQ ID NO: 617949 - protein, 7 aa, Mycobacterium
YTAGAGM

SEQ ID NO: 617950 - protein, 6 aa, Mycobacterium
YTAGDG

SEQ ID NO: 617951 - protein, 7 aa, Mycobacterium
YTAGDGR

SEQ ID NO: 617952 - protein, 8 aa, Mycobacterium
YTAGPAKW

SEQ ID NO: 617953 - protein, 4 aa, Mycobacterium
YTAP

SEQ ID NO: 617954 - protein, 5 aa, Mycobacterium
YTAPH

SEQ ID NO: 617955 - protein, 7 aa, Mycobacterium
YTAPTEV

SEQ ID NO: 617956 - protein, 13 aa, Mycobacterium
YTAQEANKALRPG

SEQ ID NO: 617957 - protein, 21 aa, Mycobacterium
YTARAREISSRMSKPSESVGR

SEQ ID NO: 617958 - protein, 8 aa, Mycobacterium
YTASDGRV

SEQ ID NO: 617959 - protein, 6 aa, Mycobacterium
YTASEA

SEQ ID NO: 617960 - protein, 7 aa, Mycobacterium
YTASEAE

SEQ ID NO: 617961 - protein, 8 aa, Mycobacterium
YTASEDDP

SEQ ID NO: 617962 - protein, 6 aa, Mycobacterium
YTASGA

SEQ ID NO: 617963 - protein, 8 aa, Mycobacterium
YTASKAAI

SEQ ID NO: 617964 - protein, 11 aa, Mycobacterium
YTASKSAIEGF

SEQ ID NO: 617965 - protein, 29 aa, Mycobacterium
YTASRTARSREKIRAEQGGEVRRKDGTVT

SEQ ID NO: 617966 - protein, 12 aa, Mycobacterium
YTATDDEALTGI

SEQ ID NO: 617967 - protein, 5 aa, Mycobacterium
YTATG

SEQ ID NO: 617968 - protein, 9 aa, Mycobacterium
YTATGIAGT

SEQ ID NO: 617969 - protein, 10 aa, Mycobacterium
YTATNKAREL

SEQ ID NO: 617970 - protein, 4 aa, Mycobacterium
YTAW

SEQ ID NO: 617971 - protein, 4 aa, Mycobacterium
YTDA

SEQ ID NO: 617972 - protein, 7 aa, Mycobacterium
YTDAEAA

SEQ ID NO: 617973 - protein, 7 aa, Mycobacterium
YTDAPTG

SEQ ID NO: 617974 - protein, 4 aa, Mycobacterium
YTDD

SEQ ID NO: 617975 - protein, 17 aa, Mycobacterium
YTDDEITSLSDNAVVVI

SEQ ID NO: 617976 - protein, 13 aa, Mycobacterium
YTDDELAEHPGRR

SEQ ID NO: 617977 - protein, 7 aa, Mycobacterium
YTDDQRE

SEQ ID NO: 617978 - protein, 13 aa, Mycobacterium
YTDEELADHPGRR

SEQ ID NO: 617979 - protein, 6 aa, Mycobacterium
YTDEPR

SEQ ID NO: 617980 - protein, 6 aa, Mycobacterium
YTDEQG

SEQ ID NO: 617981 - protein, 6 aa, Mycobacterium
YTDEYG

SEQ ID NO: 617982 - protein, 10 aa, Mycobacterium
YTDGAAEDEL

SEQ ID NO: 617983 - protein, 7 aa, Mycobacterium
YTDGDAK

SEQ ID NO: 617984 - protein, 11 aa, Mycobacterium
YTDGEGDRNKV

SEQ ID NO: 617985 - protein, 5 aa, Mycobacterium
YTDGS

SEQ ID NO: 617986 - protein, 8 aa, Mycobacterium
YTDGSAER

SEQ ID NO: 617987 - protein, 7 aa, Mycobacterium
YTDGTGY

SEQ ID NO: 617988 - protein, 10 aa, Mycobacterium
YTDPAASEKK

SEQ ID NO: 617989 - protein, 9 aa, Mycobacterium
YTDPDGGRA

SEQ ID NO: 617990 - protein, 10 aa, Mycobacterium
YTDPDGGTAV

SEQ ID NO: 617991 - protein, 10 aa, Mycobacterium
YTDQHGENIA

SEQ ID NO: 617992 - protein, 5 aa, Mycobacterium
YTDRD

SEQ ID NO: 617993 - protein, 10 aa, Mycobacterium
YTDRDVPESV

SEQ ID NO: 617994 - protein, 10 aa, Mycobacterium
YTDRQQDKWS

SEQ ID NO: 617995 - protein, 10 aa, Mycobacterium
YTDSPAGPKL

SEQ ID NO: 617996 - protein, 7 aa, Mycobacterium
YTDSSRT

SEQ ID NO: 617997 - protein, 17 aa, Mycobacterium
YTDTDQRGAEILDEQID

SEQ ID NO: 617998 - protein, 9 aa, Mycobacterium
YTDTKTEGV

SEQ ID NO: 617999 - protein, 9 aa, Mycobacterium
YTDTKVNSE

SEQ ID NO: 618000 - protein, 5 aa, Mycobacterium
YTDTT

SEQ ID NO: 618001 - protein, 13 aa, Mycobacterium
YTDVASPSELGTN

SEQ ID NO: 618002 - protein, 6 aa, Mycobacterium
YTEDQK

SEQ ID NO: 618003 - protein, 9 aa, Mycobacterium
YTEDSRAEV

SEQ ID NO: 618004 - protein, 4 aa, Mycobacterium
YTEE

SEQ ID NO: 618005 - protein, 8 aa, Mycobacterium
YTEGSGYA

SEQ ID NO: 618006 - protein, 11 aa, Mycobacterium
YTEKPTAETLT

SEQ ID NO: 618007 - protein, 15 aa, Mycobacterium
YTEKVQQQVTDSTDW

SEQ ID NO: 618008 - protein, 16 aa, Mycobacterium
YTEPGTGQTFTRSEGL

SEQ ID NO: 618009 - protein, 4 aa, Mycobacterium
YTES

SEQ ID NO: 618010 - protein, 4 aa, Mycobacterium
YTET

SEQ ID NO: 618011 - protein, 13 aa, Mycobacterium
YTETKTIGWRRPR

SEQ ID NO: 618012 - protein, 9 aa, Mycobacterium
YTETRDDGS

SEQ ID NO: 618013 - protein, 11 aa, Mycobacterium
YTFEGTPRTAA

SEQ ID NO: 618014 - protein, 4 aa, Mycobacterium
YTGA

SEQ ID NO: 618015 - protein, 25 aa, Mycobacterium
YTGAKYPQKHEQQAGPPTRSGGPAI

SEQ ID NO: 618016 - protein, 17 aa, Mycobacterium
YTGARRDPLSGEGARRF

SEQ ID NO: 618017 - protein, 13 aa, Mycobacterium
YTGDQSIDPGTEQ

SEQ ID NO: 618018 - protein, 5 aa, Mycobacterium
YTGDV

SEQ ID NO: 618019 - protein, 10 aa, Mycobacterium
YTGEKGEVSA

SEQ ID NO: 618020 - protein, 10 aa, Mycobacterium
YTGGDADGGL

SEQ ID NO: 618021 - protein, 10 aa, Mycobacterium
YTGGDSGGNL

SEQ ID NO: 618022 - protein, 10 aa, Mycobacterium
YTGGDSNGGL

SEQ ID NO: 618023 - protein, 12 aa, Mycobacterium
YTGGDSTGGLTG

SEQ ID NO: 618024 - protein, 10 aa, Mycobacterium
YTGGDTGGNL

SEQ ID NO: 618025 - protein, 7 aa, Mycobacterium
YTGGQRE

SEQ ID NO: 618026 - protein, 18 aa, Mycobacterium
YTGGSTTNVQRDRGSRSR

SEQ ID NO: 618027 - protein, 15 aa, Mycobacterium
YTGGTTGKPKGVIGT

SEQ ID NO: 618028 - protein, 16 aa, Mycobacterium
YTGGTTGKPKGVIGTS

SEQ ID NO: 618029 - protein, 18 aa, Mycobacterium
YTGGTTGKPKGVIGTTQS

SEQ ID NO: 618030 - protein, 15 aa, Mycobacterium
YTGGTTGKPKGVLGT

SEQ ID NO: 618031 - protein, 13 aa, Mycobacterium
YTGGTTGKPKGVM

SEQ ID NO: 618032 - protein, 8 aa, Mycobacterium
YTGKPGHP

SEQ ID NO: 618033 - protein, 7 aa, Mycobacterium
YTGLGTP

SEQ ID NO: 618034 - protein, 5 aa, Mycobacterium
YTGNQ

SEQ ID NO: 618035 - protein, 27 aa, Mycobacterium
YTGPADALPTQAPPRPEPLPHTPYPEL

SEQ ID NO: 618036 - protein, 17 aa, Mycobacterium
YTGPATSVQRDRGSRSR

SEQ ID NO: 618037 - protein, 20 aa, Mycobacterium
YTGPGNDTLQTEIPERWLES

SEQ ID NO: 618038 - protein, 17 aa, Mycobacterium
YTGPGSASLRAASASWN

SEQ ID NO: 618039 - protein, 9 aa, Mycobacterium
YTGPGSGPM

SEQ ID NO: 618040 - protein, 9 aa, Mycobacterium
YTGPGSGSL

SEQ ID NO: 618041 - protein, 8 aa, Mycobacterium
YTGPGYKD

SEQ ID NO: 618042 - protein, 11 aa, Mycobacterium
YTGPSEDLTRP

SEQ ID NO: 618043 - protein, 11 aa, Mycobacterium
YTGPSEDWSRP

SEQ ID NO: 618044 - protein, 10 aa, Mycobacterium
YTGPSGNSPQ

SEQ ID NO: 618045 - protein, 7 aa, Mycobacterium
YTGPSTD

SEQ ID NO: 618046 - protein, 4 aa, Mycobacterium
YTGQ

SEQ ID NO: 618047 - protein, 5 aa, Mycobacterium
YTGQG

SEQ ID NO: 618048 - protein, 5 aa, Mycobacterium
YTGRP

SEQ ID NO: 618049 - protein, 9 aa, Mycobacterium
YTGRPSPLY

SEQ ID NO: 618050 - protein, 6 aa, Mycobacterium
YTGRSI

SEQ ID NO: 618051 - protein, 5 aa, Mycobacterium
YTGSA

SEQ ID NO: 618052 - protein, 20 aa, Mycobacterium
YTGSAGENTHPGTTGNSRKT

SEQ ID NO: 618053 - protein, 14 aa, Mycobacterium
YTGSGYRAPSNALE

SEQ ID NO: 618054 - protein, 6 aa, Mycobacterium
YTGSPT

SEQ ID NO: 618055 - protein, 5 aa, Mycobacterium
YTGSR

SEQ ID NO: 618056 - protein, 18 aa, Mycobacterium
YTGSSTTNVQRDRGSRSR

SEQ ID NO: 618057 - protein, 6 aa, Mycobacterium
YTGSTL

SEQ ID NO: 618058 - protein, 5 aa, Mycobacterium
YTGTA

SEQ ID NO: 618059 - protein, 12 aa, Mycobacterium
YTGTGNSLNPRH

SEQ ID NO: 618060 - protein, 11 aa, Mycobacterium
YTGTGTARAVA

SEQ ID NO: 618061 - protein, 15 aa, Mycobacterium
YTGTHQQPSSATVRR

SEQ ID NO: 618062 - protein, 7 aa, Mycobacterium
YTGTPTY

SEQ ID NO: 618063 - protein, 14 aa, Mycobacterium
YTGTVTAASEWGGL

SEQ ID NO: 618064 - protein, 14 aa, Mycobacterium
YTITGQAQGADMKN

SEQ ID NO: 618065 - protein, 12 aa, Mycobacterium
YTKDSPPPGAGA

SEQ ID NO: 618066 - protein, 13 aa, Mycobacterium
YTKDSSPPGPGAV

SEQ ID NO: 618067 - protein, 5 aa, Mycobacterium
YTKEH

SEQ ID NO: 618068 - protein, 4 aa, Mycobacterium
YTKG

SEQ ID NO: 618069 - protein, 4 aa, Mycobacterium
YTKH

SEQ ID NO: 618070 - protein, 7 aa, Mycobacterium
YTKNEGV

SEQ ID NO: 618071 - protein, 16 aa, Mycobacterium
YTKNGETYTSVGPAQR

SEQ ID NO: 618072 - protein, 4 aa, Mycobacterium
YTKT

SEQ ID NO: 618073 - protein, 4 aa, Mycobacterium
YTLE

SEQ ID NO: 618074 - protein, 5 aa, Mycobacterium
YTLPE

SEQ ID NO: 618075 - protein, 7 aa, Mycobacterium
YTLPPSQ

SEQ ID NO: 618076 - protein, 4 aa, Mycobacterium
YTLR

SEQ ID NO: 618077 - protein, 10 aa, Mycobacterium
YTLSGGQKRR

SEQ ID NO: 618078 - protein, 20 aa, Mycobacterium
YTLSTDRAAEPELGPQPDLP

SEQ ID NO: 618079 - protein, 6 aa, Mycobacterium
YTNAGQ

SEQ ID NO: 618080 - protein, 17 aa, Mycobacterium
YTNDRTDEFGGNPENRR

SEQ ID NO: 618081 - protein, 7 aa, Mycobacterium
YTNEGQG

SEQ ID NO: 618082 - protein, 10 aa, Mycobacterium
YTNGQPDDHA

SEQ ID NO: 618083 - protein, 6 aa, Mycobacterium
YTNTNA

SEQ ID NO: 618084 - protein, 12 aa, Mycobacterium
YTPADSPDAPRV

SEQ ID NO: 618085 - protein, 8 aa, Mycobacterium
YTPADSPN

SEQ ID NO: 618086 - protein, 10 aa, Mycobacterium
YTPAESPEYR

SEQ ID NO: 618087 - protein, 13 aa, Mycobacterium
YTPALKAADAPKL

SEQ ID NO: 618088 - protein, 5 aa, Mycobacterium
YTPAP

SEQ ID NO: 618089 - protein, 7 aa, Mycobacterium
YTPASGG

SEQ ID NO: 618090 - protein, 27 aa, Mycobacterium
YTPATREAAAIDPDQPKGEDYRTRGDA

SEQ ID NO: 618091 - protein, 10 aa, Mycobacterium
YTPDGAVPAV

SEQ ID NO: 618092 - protein, 5 aa, Mycobacterium
YTPDQ

SEQ ID NO: 618093 - protein, 10 aa, Mycobacterium
YTPDSQWRNR

SEQ ID NO: 618094 - protein, 13 aa, Mycobacterium
YTPEELAEHPEQK

SEQ ID NO: 618095 - protein, 13 aa, Mycobacterium
YTPEELAEHPERK

SEQ ID NO: 618096 - protein, 11 aa, Mycobacterium
YTPEFEGREEF

SEQ ID NO: 618097 - protein, 10 aa, Mycobacterium
YTPEFPGRQR

SEQ ID NO: 618098 - protein, 5 aa, Mycobacterium
YTPEQ

SEQ ID NO: 618099 - protein, 6 aa, Mycobacterium
YTPETG

SEQ ID NO: 618100 - protein, 4 aa, Mycobacterium
YTPG

SEQ ID NO: 618101 - protein, 8 aa, Mycobacterium
YTPGETRW

SEQ ID NO: 618102 - protein, 7 aa, Mycobacterium
YTPGLSD

SEQ ID NO: 618103 - protein, 5 aa, Mycobacterium
YTPGT

SEQ ID NO: 618104 - protein, 4 aa, Mycobacterium
YTPI

SEQ ID NO: 618105 - protein, 8 aa, Mycobacterium
YTPKDSPN

SEQ ID NO: 618106 - protein, 13 aa, Mycobacterium
YTPKNGGRIVVHR

SEQ ID NO: 618107 - protein, 6 aa, Mycobacterium
YTPNTA

SEQ ID NO: 618108 - protein, 10 aa, Mycobacterium
YTPPADGYHS

SEQ ID NO: 618109 - protein, 8 aa, Mycobacterium
YTPPLGSP

SEQ ID NO: 618110 - protein, 9 aa, Mycobacterium
YTPPPTERM

SEQ ID NO: 618111 - protein, 15 aa, Mycobacterium
YTPPPYRGQGYGSAV

SEQ ID NO: 618112 - protein, 7 aa, Mycobacterium
YTPPVPA

SEQ ID NO: 618113 - protein, 8 aa, Mycobacterium
YTPPVPAQ

SEQ ID NO: 618114 - protein, 12 aa, Mycobacterium
YTPQRATDAGVK

SEQ ID NO: 618115 - protein, 7 aa, Mycobacterium
YTPRDAD

SEQ ID NO: 618116 - protein, 6 aa, Mycobacterium
YTPRGL

SEQ ID NO: 618117 - protein, 5 aa, Mycobacterium
YTPRQ

SEQ ID NO: 618118 - protein, 13 aa, Mycobacterium
YTPSELGGANPEG

SEQ ID NO: 618119 - protein, 7 aa, Mycobacterium
YTPSKTE

SEQ ID NO: 618120 - protein, 13 aa, Mycobacterium
YTPSRTKIDTDGR

SEQ ID NO: 618121 - protein, 12 aa, Mycobacterium
YTPSRTRVDRDG

SEQ ID NO: 618122 - protein, 19 aa, Mycobacterium
YTPTLQGDSALGDLASRPR

SEQ ID NO: 618123 - protein, 9 aa, Mycobacterium
YTPTRAAAE

SEQ ID NO: 618124 - protein, 7 aa, Mycobacterium
YTPVGGP

SEQ ID NO: 618125 - protein, 15 aa, Mycobacterium
YTPVGGQQTGVGGQI

SEQ ID NO: 618126 - protein, 10 aa, Mycobacterium
YTPVTPRAPI

SEQ ID NO: 618127 - protein, 4 aa, Mycobacterium
YTPY

SEQ ID NO: 618128 - protein, 9 aa, Mycobacterium
YTPYDGDAT

SEQ ID NO: 618129 - protein, 11 aa, Mycobacterium
YTQAPSGAGYA

SEQ ID NO: 618130 - protein, 11 aa, Mycobacterium
YTQDGAPDPYC

SEQ ID NO: 618131 - protein, 11 aa, Mycobacterium
YTQGDTAGDFP

SEQ ID NO: 618132 - protein, 4 aa, Mycobacterium
YTQK

SEQ ID NO: 618133 - protein, 16 aa, Mycobacterium
YTQKPGAYRRANGQAF

SEQ ID NO: 618134 - protein, 16 aa, Mycobacterium
YTQNGRGDLAATEHAE

SEQ ID NO: 618135 - protein, 6 aa, Mycobacterium
YTQPDD

SEQ ID NO: 618136 - protein, 7 aa, Mycobacterium
YTQRDGE

SEQ ID NO: 618137 - protein, 15 aa, Mycobacterium
YTRAGDKWLISYITP

SEQ ID NO: 618138 - protein, 10 aa, Mycobacterium
YTRAHGEDIP

SEQ ID NO: 618139 - protein, 5 aa, Mycobacterium
YTRAS

SEQ ID NO: 618140 - protein, 9 aa, Mycobacterium
YTRDGGQHF

SEQ ID NO: 618141 - protein, 9 aa, Mycobacterium
YTRDGHSDY

SEQ ID NO: 618142 - protein, 4 aa, Mycobacterium
YTRE

SEQ ID NO: 618143 - protein, 10 aa, Mycobacterium
YTREEAAYPL

SEQ ID NO: 618144 - protein, 19 aa, Mycobacterium
YTREHGEDDPAISEWTWQA

SEQ ID NO: 618145 - protein, 11 aa, Mycobacterium
YTREHGEDDPR

SEQ ID NO: 618146 - protein, 6 aa, Mycobacterium
YTRESG

SEQ ID NO: 618147 - protein, 4 aa, Mycobacterium
YTRK

SEQ ID NO: 618148 - protein, 9 aa, Mycobacterium
YTRKTQTSQ

SEQ ID NO: 618149 - protein, 10 aa, Mycobacterium
YTRNQADAED

SEQ ID NO: 618150 - protein, 7 aa, Mycobacterium
YTRPEQP

SEQ ID NO: 618151 - protein, 6 aa, Mycobacterium
YTRSPI

SEQ ID NO: 618152 - protein, 8 aa, Mycobacterium
YTRTDAFG

SEQ ID NO: 618153 - protein, 16 aa, Mycobacterium
YTRTTKAHGVKSRSAR

SEQ ID NO: 618154 - protein, 9 aa, Mycobacterium
YTSAGVSAG

SEQ ID NO: 618155 - protein, 12 aa, Mycobacterium
YTSALTADSPEV

SEQ ID NO: 618156 - protein, 4 aa, Mycobacterium
YTSG

SEQ ID NO: 618157 - protein, 7 aa, Mycobacterium
YTSGSNH

SEQ ID NO: 618158 - protein, 10 aa, Mycobacterium
YTSGSTRPPV

SEQ ID NO: 618159 - protein, 28 aa, Mycobacterium
YTSGTGQGNASATKDGSSYKISGTATGV

SEQ ID NO: 618160 - protein, 8 aa, Mycobacterium
YTSHDADS

SEQ ID NO: 618161 - protein, 10 aa, Mycobacterium
YTSHGKDRTT

SEQ ID NO: 618162 - protein, 9 aa, Mycobacterium
YTSLSEDDR

SEQ ID NO: 618163 - protein, 12 aa, Mycobacterium
YTSPDTPPGPPA

SEQ ID NO: 618164 - protein, 22 aa, Mycobacterium
YTSPDYTDREEARQEKIGGSWG

SEQ ID NO: 618165 - protein, 7 aa, Mycobacterium
YTSPEDF

SEQ ID NO: 618166 - protein, 10 aa, Mycobacterium
YTSSEDFEKT

SEQ ID NO: 618167 - protein, 8 aa, Mycobacterium
YTSSLAAA

SEQ ID NO: 618168 - protein, 4 aa, Mycobacterium
YTST

SEQ ID NO: 618169 - protein, 10 aa, Mycobacterium
YTSTGRYNIT

SEQ ID NO: 618170 - protein, 8 aa, Mycobacterium
YTSYGDAK

SEQ ID NO: 618171 - protein, 5 aa, Mycobacterium
YTTAP

SEQ ID NO: 618172 - protein, 27 aa, Mycobacterium
YTTASIRNSGQIPSRLSKRQKKEEAAY

SEQ ID NO: 618173 - protein, 14 aa, Mycobacterium
YTTDGVKRLEDKGV

SEQ ID NO: 618174 - protein, 10 aa, Mycobacterium
YTTDHAKGVE

SEQ ID NO: 618175 - protein, 5 aa, Mycobacterium
YTTED

SEQ ID NO: 618176 - protein, 7 aa, Mycobacterium
YTTEPFG

SEQ ID NO: 618177 - protein, 4 aa, Mycobacterium
YTTG

SEQ ID NO: 618178 - protein, 15 aa, Mycobacterium
YTTGESALALKERAL

SEQ ID NO: 618179 - protein, 32 aa, Mycobacterium
YTTGHPVGGDQTGSGVARDTDAVPDASRVTPP

SEQ ID NO: 618180 - protein, 9 aa, Mycobacterium
YTTGNTEGR

SEQ ID NO: 618181 - protein, 12 aa, Mycobacterium
YTTGPDNGIYRT

SEQ ID NO: 618182 - protein, 6 aa, Mycobacterium
YTTGQF

SEQ ID NO: 618183 - protein, 10 aa, Mycobacterium
YTTGRAHRER

SEQ ID NO: 618184 - protein, 11 aa, Mycobacterium
YTTGREQFGRP

SEQ ID NO: 618185 - protein, 5 aa, Mycobacterium
YTTGS

SEQ ID NO: 618186 - protein, 7 aa, Mycobacterium
YTTPDDF

SEQ ID NO: 618187 - protein, 14 aa, Mycobacterium
YTTPGQFGGGGAGT

SEQ ID NO: 618188 - protein, 19 aa, Mycobacterium
YTTQRRPGDPNSAGASRKS

SEQ ID NO: 618189 - protein, 7 aa, Mycobacterium
YTTSAPP

SEQ ID NO: 618190 - protein, 10 aa, Mycobacterium
YTTSSAETFE

SEQ ID NO: 618191 - protein, 9 aa, Mycobacterium
YTTTSTGAR

SEQ ID NO: 618192 - protein, 8 aa, Mycobacterium
YTTTTEGV

SEQ ID NO: 618193 - protein, 9 aa, Mycobacterium
YTTTTSGDR

SEQ ID NO: 618194 - protein, 8 aa, Mycobacterium
YTTTTTGA

SEQ ID NO: 618195 - protein, 4 aa, Mycobacterium
YTTY

SEQ ID NO: 618196 - protein, 11 aa, Mycobacterium
YTVDDDDDDDP

SEQ ID NO: 618197 - protein, 6 aa, Mycobacterium
YTVPAG

SEQ ID NO: 618198 - protein, 10 aa, Mycobacterium
YTWSGGESLP

SEQ ID NO: 618199 - protein, 6 aa, Mycobacterium
YTYGSG

SEQ ID NO: 618200 - protein, 9 aa, Mycobacterium
YTYPSTGVY

SEQ ID NO: 618201 - protein, 6 aa, Mycobacterium
YTYTPS

SEQ ID NO: 618202 - protein, 8 aa, Mycobacterium
YVAPTSAA

SEQ ID NO: 618203 - protein, 7 aa, Mycobacterium
YVEDSAE

SEQ ID NO: 618204 - protein, 7 aa, Mycobacterium
YVEDSGM

SEQ ID NO: 618205 - protein, 6 aa, Mycobacterium
YVEESG

SEQ ID NO: 618206 - protein, 4 aa, Mycobacterium
YVEG

SEQ ID NO: 618207 - protein, 4 aa, Mycobacterium
YVER

SEQ ID NO: 618208 - protein, 4 aa, Mycobacterium
YVES

SEQ ID NO: 618209 - protein, 14 aa, Mycobacterium
YVGKPTAKEGTEPW

SEQ ID NO: 618210 - protein, 5 aa, Mycobacterium
YVHPS

SEQ ID NO: 618211 - protein, 9 aa, Mycobacterium
YVKTGSRDY

SEQ ID NO: 618212 - protein, 6 aa, Mycobacterium
YVPDDA

SEQ ID NO: 618213 - protein, 16 aa, Mycobacterium
YVPEDDDERNDKQARA

SEQ ID NO: 618214 - protein, 16 aa, Mycobacterium
YVPEDDDERNDKQARE

SEQ ID NO: 618215 - protein, 6 aa, Mycobacterium
YVPEGD

SEQ ID NO: 618216 - protein, 6 aa, Mycobacterium
YVPEND

SEQ ID NO: 618217 - protein, 17 aa, Mycobacterium
YVPENDDERNDKQAREA

SEQ ID NO: 618218 - protein, 5 aa, Mycobacterium
YVPET

SEQ ID NO: 618219 - protein, 4 aa, Mycobacterium
YVPG

SEQ ID NO: 618220 - protein, 11 aa, Mycobacterium
YVPKTDPERNA

SEQ ID NO: 618221 - protein, 5 aa, Mycobacterium
YVPPD

SEQ ID NO: 618222 - protein, 21 aa, Mycobacterium
YVPPPGDLPPMPPMPAPAEPG

SEQ ID NO: 618223 - protein, 14 aa, Mycobacterium
YVPPSDDPTDFDNA

SEQ ID NO: 618224 - protein, 4 aa, Mycobacterium
YVPS

SEQ ID NO: 618225 - protein, 5 aa, Mycobacterium
YVPTG

SEQ ID NO: 618226 - protein, 7 aa, Mycobacterium
YVQEERG

SEQ ID NO: 618227 - protein, 14 aa, Mycobacterium
YVQPPEPDNFDPEG

SEQ ID NO: 618228 - protein, 13 aa, Mycobacterium
YVQPPEPENFDPE

SEQ ID NO: 618229 - protein, 14 aa, Mycobacterium
YVQPPEPENLDPEG

SEQ ID NO: 618230 - protein, 26 aa, Mycobacterium
YVQSGGGVVADSNGPYEYTEATNKAR

SEQ ID NO: 618231 - protein, 9 aa, Mycobacterium
YVQTDAGVT

SEQ ID NO: 618232 - protein, 21 aa, Mycobacterium
YVRPDPPLTLPNDPGWPEGSS

SEQ ID NO: 618233 - protein, 16 aa, Mycobacterium
YVSEEDDERNDKQARA

SEQ ID NO: 618234 - protein, 14 aa, Mycobacterium
YVSGGDSPSGTDCS

SEQ ID NO: 618235 - protein, 5 aa, Mycobacterium
YVSPE

SEQ ID NO: 618236 - protein, 7 aa, Mycobacterium
YVTEDDE

SEQ ID NO: 618237 - protein, 10 aa, Mycobacterium
YVTPDNQAHA

SEQ ID NO: 618238 - protein, 5 aa, Mycobacterium
YVTRG

SEQ ID NO: 618239 - protein, 9 aa, Mycobacterium
YVTTDDGTG

SEQ ID NO: 618240 - protein, 4 aa, Mycobacterium
YWPG

SEQ ID NO: 618241 - protein, 4 aa, Mycobacterium
YYAP

SEQ ID NO: 618242 - protein, 5 aa, Mycobacterium
YYATG

SEQ ID NO: 618243 - protein, 15 aa, Mycobacterium
YYEPGGKPVSDPETL

SEQ ID NO: 618244 - protein, 5 aa, Mycobacterium
YYGAS

SEQ ID NO: 618245 - protein, 13 aa, Mycobacterium
YYGATDGSAAFTE

SEQ ID NO: 618246 - protein, 7 aa, Mycobacterium
YYGDTRD

SEQ ID NO: 618247 - protein, 5 aa, Mycobacterium
YYGKP

SEQ ID NO: 618248 - protein, 10 aa, Mycobacterium
YYGPDGELLT

SEQ ID NO: 618249 - protein, 29 aa, Mycobacterium
YYGPDGFAETRGHPKIVSSSAKSHDPDRQ

SEQ ID NO: 618250 - protein, 13 aa, Mycobacterium
YYGPDGLGQQRGA

SEQ ID NO: 618251 - protein, 11 aa, Mycobacterium
YYGPDGRRYKA

SEQ ID NO: 618252 - protein, 14 aa, Mycobacterium
YYGPTGGLAASDPR

SEQ ID NO: 618253 - protein, 13 aa, Mycobacterium
YYGPTGGLPADDP

SEQ ID NO: 618254 - protein, 14 aa, Mycobacterium
YYGPTGGLPADDPR

SEQ ID NO: 618255 - protein, 14 aa, Mycobacterium
YYGPTGGLPSDDPR

SEQ ID NO: 618256 - protein, 10 aa, Mycobacterium
YYGSDDTTVL

SEQ ID NO: 618257 - protein, 21 aa, Mycobacterium
YYPEAPGGLPSGRSIEPKPFN

SEQ ID NO: 618258 - protein, 23 aa, Mycobacterium
YYPEAPGGRAAGRSVEPKPFDAK

SEQ ID NO: 618259 - protein, 22 aa, Mycobacterium
YYPEAPGGRAEGRSIEPKPFDA

SEQ ID NO: 618260 - protein, 21 aa, Mycobacterium
YYPEAPGGRSGGRSIEPKPFD

SEQ ID NO: 618261 - protein, 5 aa, Mycobacterium
YYPED

SEQ ID NO: 618262 - protein, 21 aa, Mycobacterium
YYPESPGGRAEGRSIEPKPFD

SEQ ID NO: 618263 - protein, 30 aa, Mycobacterium
YYPETPGGKPTGRSVEPKPFDANKLGPDLK

SEQ ID NO: 618264 - protein, 21 aa, Mycobacterium
YYPETPGGKPTGRSVEPKPFN

SEQ ID NO: 618265 - protein, 7 aa, Mycobacterium
YYPGETM

SEQ ID NO: 618266 - protein, 5 aa, Mycobacterium
YYPGG

SEQ ID NO: 618267 - protein, 8 aa, Mycobacterium
YYPGSGAD

SEQ ID NO: 618268 - protein, 16 aa, Mycobacterium
YYPKRPADAKLPPTSK

SEQ ID NO: 618269 - protein, 9 aa, Mycobacterium
YYPQQRDGE

SEQ ID NO: 618270 - protein, 16 aa, Mycobacterium
YYPQRQGGEKLPPTSK

SEQ ID NO: 618271 - protein, 4 aa, Mycobacterium
YYPR

SEQ ID NO: 618272 - protein, 7 aa, Mycobacterium
YYPTGGR

SEQ ID NO: 618273 - protein, 7 aa, Mycobacterium
YYPTRTE

SEQ ID NO: 618274 - protein, 12 aa, Mycobacterium
YYQPDSEKTTAI

SEQ ID NO: 618275 - protein, 8 aa, Mycobacterium
YYRSSSGR

SEQ ID NO: 618276 - protein, 6 aa, Mycobacterium
YYRTKG

SEQ ID NO: 618277 - protein, 9 aa, Mycobacterium
YYSTGAQYS

SEQ ID NO: 618278 - protein, 6 aa, Mycobacterium
YYSTGG

SEQ ID NO: 618279 - protein, 37 aa, Mycobacterium
YYTPPRRAEPADDSSSASEPIAVPGPVAESDAQAPRI

SEQ ID NO: 618280 - protein, 23 aa, Mycobacterium
DRQKARLAALFAANAHAEIEATW

SEQ ID NO: 618281 - protein, 25 aa, Mycobacterium
GAQEMRDWLPRGWHPDRFSVAETND

SEQ ID NO: 618282 - protein, 21 aa, Mycobacterium
LAQRPQEWRDRVDVVAMDGFS

SEQ ID NO: 618283 - protein, 24 aa, Mycobacterium
TLKKRAADVLAYFDRPGTSNGPTE

SEQ ID NO: 618284 - protein, 28 aa, Mycobacterium
VDLMYAKPPIWRRLDLPGDLMLDELHVV

SEQ ID NO: 618285 - protein, 26 aa, Mycobacterium
VEGRSKKAFADWLAQRPQEWRDRVDV

SEQ ID NO: 618286 - protein, 25 aa, Mycobacterium
RTHPHLDELIGFFVNTLVLRTHTHP

SEQ ID NO: 618287 - protein, 19 aa, Mycobacterium
IADYRGASHQFSWPPELTT

SEQ ID NO: 618288 - protein, 17 aa, Mycobacterium
WFLEQLQGPSAVYNIPV

SEQ ID NO: 618289 - protein, 18 aa, Mycobacterium
LAAEIPIRATVLHTAPHQ

SEQ ID NO: 618290 - protein, 32 aa, Mycobacterium
IAGERPPRVPLSFAQSRLWFLEQLQGPSAVYN

SEQ ID NO: 618291 - protein, 26 aa, Mycobacterium
AEIFWQVVDARGWTPQHLHTAIDEAT

SEQ ID NO: 618292 - protein, 21 aa, Mycobacterium
AKIPFLPDVVREWRDKHPDEA

SEQ ID NO: 618293 - protein, 25 aa, Mycobacterium
IVLAAADLVTWARLIGFTSDPTLAR

SEQ ID NO: 618294 - protein, 25 aa, Mycobacterium
LKNTGLRNLPCHGFWANAAWLEIVL

SEQ ID NO: 618295 - protein, 21 aa, Mycobacterium
REQGVGFSFGYPVDARVQDAV

SEQ ID NO: 618296 - protein, 17 aa, Mycobacterium
RPTGSVRHVEVFQMDGV

SEQ ID NO: 618297 - protein, 17 aa, Mycobacterium
WATSIATAWQTIRTAFG

SEQ ID NO: 618298 - protein, 25 aa, Mycobacterium
DPHHPPTRIAFMLTDTTPTAIITTT

SEQ ID NO: 618299 - protein, 17 aa, Mycobacterium
ENREMAMELAFLKKAAA

SEQ ID NO: 618300 - protein, 19 aa, Mycobacterium
FGAVYGYRRIHAELVRAGE

SEQ ID NO: 618301 - protein, 18 aa, Mycobacterium
IRTWAGWLYLATVIDCFN

SEQ ID NO: 618302 - protein, 26 aa, Mycobacterium
KQRGEPVSCFLLRIEDNMESIGRSIN

SEQ ID NO: 618303 - protein, 24 aa, Mycobacterium
MAPTIVQMLKWLGVSKSGFYEWWG

SEQ ID NO: 618304 - protein, 24 aa, Mycobacterium
MRASLGRTGICWDNALAESFFAAL

SEQ ID NO: 618305 - protein, 17 aa, Mycobacterium
NRRRLHSALGYRTPHEV

SEQ ID NO: 618306 - protein, 21 aa, Mycobacterium
QQQRLCIARAIAVQPDVLLMD

SEQ ID NO: 618307 - protein, 29 aa, Mycobacterium
RREELKLKIAALFTSFGAVYGYRRIHAEL

SEQ ID NO: 618308 - protein, 19 aa, Mycobacterium
RRIHAELVRAGERVGPELV

SEQ ID NO: 618309 - protein, 21 aa, Mycobacterium
RRLHSALGYRTPHEVRIEYMN

SEQ ID NO: 618310 - protein, 17 aa, Mycobacterium
SAAMCRREELKLKIAAL

SEQ ID NO: 618311 - protein, 24 aa, Mycobacterium
SKSGFYEWWGRPASAAMCRREELK

SEQ ID NO: 618312 - protein, 19 aa, Mycobacterium
VVGGFDLPGVTLPALTIPA

SEQ ID NO: 618313 - protein, 28 aa, Mycobacterium
ADQARTIRIPVHMVEVINKLGRIQRELL

SEQ ID NO: 618314 - protein, 20 aa, Mycobacterium
AGVPLKAPVAGIAMGLVSDD

SEQ ID NO: 618315 - protein, 17 aa, Mycobacterium
ANPRASRTVPFVSKATA

SEQ ID NO: 618316 - protein, 19 aa, Mycobacterium
APGQPRLVAYYTTTGNAGI

SEQ ID NO: 618317 - protein, 27 aa, Mycobacterium
AQIYAWRKGIKTLYYIRLRQMALEGTE

SEQ ID NO: 618318 - protein, 20 aa, Mycobacterium
ARTHAIGQIVPGKVTKLVPF

SEQ ID NO: 618319 - protein, 27 aa, Mycobacterium
ATGVKRQEDFIGIHFFSPVDKMPLVEI

SEQ ID NO: 618320 - protein, 23 aa, Mycobacterium
AVRELRPDLVLLDLMLPGMNGID

SEQ ID NO: 618321 - protein, 25 aa, Mycobacterium
DLGVKRLWLVNEIRRLNCPDCGVIT

SEQ ID NO: 618322 - protein, 22 aa, Mycobacterium
DLLKCSFCGKSQKQVKKLIAGP

SEQ ID NO: 618323 - protein, 22 aa, Mycobacterium
DNGPELACSAMADWAEGQVGLH

SEQ ID NO: 618324 - protein, 24 aa, Mycobacterium
EANLRLVVSLAKRYTGRGMPLLDL

SEQ ID NO: 618325 - protein, 25 aa, Mycobacterium
EAPARAYNPLFIWGESGLGKTHLLH

SEQ ID NO: 618326 - protein, 20 aa, Mycobacterium
EGQVGLHFIPPGEPWRNGYV

SEQ ID NO: 618327 - protein, 21 aa, Mycobacterium
EIAEQLLRVLARRLRRTNNNL

SEQ ID NO: 618328 - protein, 26 aa, Mycobacterium
ENLFFKEKRYDLARVGRYKVNKKLGL

SEQ ID NO: 618329 - protein, 27 aa, Mycobacterium
EVARYLFRRVVSWGRSSNVFLRNGARL

SEQ ID NO: 618330 - protein, 19 aa, Mycobacterium
FEAPTITGLAHRVGADPVA

SEQ ID NO: 618331 - protein, 21 aa, Mycobacterium
FHDRFTASRLFGAPPGYVGYE

SEQ ID NO: 618332 - protein, 24 aa, Mycobacterium
FIPPGEPWRNGYVESFNSRIRDEC

SEQ ID NO: 618333 - protein, 25 aa, Mycobacterium
FSKERRLEPQITLGLLTDAAGFPLT

SEQ ID NO: 618334 - protein, 17 aa, Mycobacterium
FSRISDVLLPFLVTRQL

SEQ ID NO: 618335 - protein, 25 aa, Mycobacterium
FVPAFSGLFAPYWRSDARGAIVGLS

SEQ ID NO: 618336 - protein, 18 aa, Mycobacterium
GAQLRFTDIDGMRITAFI

SEQ ID NO: 618337 - protein, 18 aa, Mycobacterium
GDAAVSLMDAFRSADEVL

SEQ ID NO: 618338 - protein, 24 aa, Mycobacterium
GIETKGGVMTKLIERNTTIPTKRS

SEQ ID NO: 618339 - protein, 26 aa, Mycobacterium
GKVTKLVPFGAFVRVEEGIEGLVHIS

SEQ ID NO: 618340 - protein, 24 aa, Mycobacterium
GMRFDKGYISGYFVTDAERQEAVL

SEQ ID NO: 618341 - protein, 25 aa, Mycobacterium
GQGLMKNAYVGRTFIQPSQTIRQLG

SEQ ID NO: 618342 - protein, 33 aa, Mycobacterium; identical to SEQ ID NO: 81075

SEQ ID NO: 618343 - protein, 19 aa, Mycobacterium
IKTWSRRSTIIPDFIGHTF

SEQ ID NO: 618344 - protein, 18 aa, Mycobacterium
ISHDRWFLDRTCTHILAW

SEQ ID NO: 618345 - protein, 26 aa, Mycobacterium
KATQEDPWRHFARTHAIGQIVPGKVT

SEQ ID NO: 618346 - protein, 20 aa, Mycobacterium
KDVRRWWRSDSLWQAHDARY

SEQ ID NO: 618347 - protein, 32 aa, Mycobacterium
KFQKELGAMGFKFQFITLAGFHALNYSMFDLA

SEQ ID NO: 618348 - protein, 24 aa, Mycobacterium
KRCRIPAFVALGKRLAVYFDGILA

SEQ ID NO: 618349 - protein, 21 aa, Mycobacterium
LNCPDCGVITEAVPWARPGSR

SEQ ID NO: 618350 - protein, 35 aa, Mycobacterium; identical to SEQ ID NO: 82626

SEQ ID NO: 618351 - protein, 24 aa, Mycobacterium
MYAAGRIPGSFFRREGRPSTDAIL

SEQ ID NO: 618352 - protein, 19 aa, Mycobacterium
PPSIREIGDAVGLTSTSSV

SEQ ID NO: 618353 - protein, 19 aa, Mycobacterium
PRIDVTVRISGFFRDAFPH

SEQ ID NO: 618354 - protein, 20 aa, Mycobacterium
PTGLAGLGILISEAVRGEGG

SEQ ID NO: 618355 - protein, 23 aa, Mycobacterium
QTRRWNPKMKRFIFTDRNGIYII

SEQ ID NO: 618356 - protein, 20 aa, Mycobacterium
RIGAEVRDGDILVGKVTPKG

SEQ ID NO: 618357 - protein, 21 aa, Mycobacterium
RISDVLLPFLVTRQLICGAGK

SEQ ID NO: 618358 - protein, 36 aa, Mycobacterium; identical to SEQ ID NO: 17410

SEQ ID NO: 618359 - protein, 21 aa, Mycobacterium
RRKPFSVVLFDEIEKAHQEIY

SEQ ID NO: 618360 - protein, 18 aa, Mycobacterium
SLAQARVVIGDWKHEYNH

SEQ ID NO: 618361 - protein, 21 aa, Mycobacterium
STLMRCAWESVTAIINRGVAE

SEQ ID NO: 618362 - protein, 24 aa, Mycobacterium
SYIDYAMSVIVGRALPEVRDGLKP

SEQ ID NO: 618363 - protein, 18 aa, Mycobacterium
TAGDRPDVLVAMNPAALK

SEQ ID NO: 618364 - protein, 17 aa, Mycobacterium
TKRSETFTTADDNQPSV

SEQ ID NO: 618365 - protein, 25 aa, Mycobacterium
TLEDRLRTRFEWGLITDVQPPELET

SEQ ID NO: 618366 - protein, 18 aa, Mycobacterium
TQTGWSIKKFVRTARRYR

SEQ ID NO: 618367 - protein, 24 aa, Mycobacterium
TVSPQLYIALGISGAIQHRAGMQT

SEQ ID NO: 618368 - protein, 29 aa, Mycobacterium
VKRRLPIYAQPQWRQSLAAASARRAGLGP

SEQ ID NO: 618369 - protein, 18 aa, Mycobacterium
VMYFKDFNSGAMIQNVVD

SEQ ID NO: 618370 - protein, 26 aa, Mycobacterium
VPEAIICFDGFHIMRWINRALDAVFS

SEQ ID NO: 618371 - protein, 20 aa, Mycobacterium
VPWARPGSRFTRDFEDMVLW

SEQ ID NO: 618372 - protein, 18 aa, Mycobacterium
VRDGDILVGKVTPKGETE

SEQ ID NO: 618373 - protein, 24 aa, Mycobacterium
WDGLCSAYRILGFDSAAEGDNVFR

SEQ ID NO: 618374 - protein, 17 aa, Mycobacterium
WRTTRWALRTGENRLTD

SEQ ID NO: 618375 - protein, 24 aa, Mycobacterium
YDVKRAETGIIYIDEVDKIARKSE

SEQ ID NO: 618376 - protein, 22 aa, Mycobacterium
YNKLFEERIIFLGVQVDDASAN

SEQ ID NO: 618377 - protein, 21 aa, Mycobacterium
AAADLVSWAQLIGFTDTPELA

SEQ ID NO: 618378 - protein, 19 aa, Mycobacterium
AGHYGMCGRAYDPRFLFAW

SEQ ID NO: 618379 - protein, 22 aa, Mycobacterium
AGVVRLRFGLTDGQPRTLDEIG

SEQ ID NO: 618380 - protein, 18 aa, Mycobacterium
AHALAFAAEGARVVVNDI

SEQ ID NO: 618381 - protein, 23 aa, Mycobacterium
ALGEARISPYPVATHTARMDLVI

SEQ ID NO: 618382 - protein, 20 aa, Mycobacterium
APVEALIGVFDKIGVKTGID

SEQ ID NO: 618383 - protein, 19 aa, Mycobacterium
AQVSLAQMEYMLPRLRGWG

SEQ ID NO: 618384 - protein, 19 aa, Mycobacterium
ASIARKLGALTVGVVTRPF

SEQ ID NO: 618385 - protein, 19 aa, Mycobacterium
CRVIRRHGRVMVICSDPRH

SEQ ID NO: 618386 - protein, 18 aa, Mycobacterium
DIGEAVGIVAAQSIGEPG

SEQ ID NO: 618387 - protein, 22 aa, Mycobacterium
DIVVGGFDLPGITLPGLDIPAV

SEQ ID NO: 618388 - protein, 23 aa, Mycobacterium
DLTDYLLEMGIRVRYLHSEVDTL

SEQ ID NO: 618389 - protein, 25 aa, Mycobacterium
DPHHPPTRIAFMLTDTTPTAVLTTT

SEQ ID NO: 618390 - protein, 30 aa, Mycobacterium; identical to SEQ ID NO: 87610

SEQ ID NO: 618391 - protein, 23 aa, Mycobacterium
EAGSKVKVTIMFRGREQSRPELG

SEQ ID NO: 618392 - protein, 25 aa, Mycobacterium
EGPLPQTRFVLRKALAAHLPVILVV

SEQ ID NO: 618393 - protein, 25 aa, Mycobacterium
EYQRRLRAANALDFDDLIGETVAVL

SEQ ID NO: 618394 - protein, 24 aa, Mycobacterium
FEARFRFVEEMIRLGADARTDGHH

SEQ ID NO: 618395 - protein, 18 aa, Mycobacterium
FEPTLDYVVVKAPRFAFE

SEQ ID NO: 618396 - protein, 18 aa, Mycobacterium
FGGEVERGLSMVDGVLLL

SEQ ID NO: 618397 - protein, 17 aa, Mycobacterium
FIGHTFAVHDGRKHVPV

SEQ ID NO: 618398 - protein, 24 aa, Mycobacterium
FLESLRYDLAVQEIFVFTPKGDVI

SEQ ID NO: 618399 - protein, 17 aa, Mycobacterium
FSLCMDNGMPILVFNLL

SEQ ID NO: 618400 - protein, 18 aa, Mycobacterium
FYAQCAIDAGVAFVNALP

SEQ ID NO: 618401 - protein, 17 aa, Mycobacterium
GCADPLYRRAVRVSMGH

SEQ ID NO: 618402 - protein, 18 aa, Mycobacterium
GERLDAKALVAFTQSGDT

SEQ ID NO: 618403 - protein, 24 aa, Mycobacterium
GERRRVALCKLLLSKPDLLLLDEP

SEQ ID NO: 618404 - protein, 21 aa, Mycobacterium
GLANLPCHGFDPNAAWLEIVL

SEQ ID NO: 618405 - protein, 26 aa, Mycobacterium
GLKDPKRPSGSFIFAGPSGVGKTELS

SEQ ID NO: 618406 - protein, 17 aa, Mycobacterium
GNSKWAGEVLLREAHDL

SEQ ID NO: 618407 - protein, 19 aa, Mycobacterium
GQPGPRFGCGAGILAPHMS

SEQ ID NO: 618408 - protein, 19 aa, Mycobacterium
GVHISGGISNVSFSFRGNN

SEQ ID NO: 618409 - protein, 17 aa, Mycobacterium
HGARKGLADTALRTADS

SEQ ID NO: 618410 - protein, 26 aa, Mycobacterium
IEDFSGSMSLSFSDPRFDEVKAPVDE

SEQ ID NO: 618411 - protein, 26 aa, Mycobacterium
IIFDPNCFALATGIEEHATYGIDFIE

SEQ ID NO: 618412 - protein, 19 aa, Mycobacterium
INTMPGFTTISMYPRMWAA

SEQ ID NO: 618413 - protein, 21 aa, Mycobacterium
IPRAHRGIVAVNELPDLAERI

SEQ ID NO: 618414 - protein, 24 aa, Mycobacterium
ISQNWRLSGLAGEYITPVPAQQRL

SEQ ID NO: 618415 - protein, 22 aa, Mycobacterium
KGSPQRRGVCTRVYTTTPKKPN

SEQ ID NO: 618416 - protein, 40 aa, Mycobacterium; identical to SEQ ID NO: 81452

SEQ ID NO: 618417 - protein, 24 aa, Mycobacterium
LDLGSLVAGSRYRGDFEERLKKVL

SEQ ID NO: 618418 - protein, 18 aa, Mycobacterium
LEAVRKRPGMYIGSTGER

SEQ ID NO: 618419 - protein, 17 aa, Mycobacterium
LEDFDVFHPDRMASRIL

SEQ ID NO: 618420 - protein, 19 aa, Mycobacterium
LKEFMVRNTYIYPPKPSMR

SEQ ID NO: 618421 - protein, 17 aa, Mycobacterium
LKLKELAYMHAEGFAAG

SEQ ID NO: 618422 - protein, 20 aa, Mycobacterium
LNIKGPELLNKFVGETERHI

SEQ ID NO: 618423 - protein, 17 aa, Mycobacterium
LPEDRVVVELSPYDLSR

SEQ ID NO: 618424 - protein, 19 aa, Mycobacterium
LRNLFKLSSLASFEGQLGK

SEQ ID NO: 618425 - protein, 28 aa, Mycobacterium
LTPLEFDLLVALARKPRQVFTRDVLLEQ

SEQ ID NO: 618426 - protein, 20 aa, Mycobacterium
MAASMGEFLLAAGTKGKRYA

SEQ ID NO: 618427 - protein, 17 aa, Mycobacterium
MEYMLPRLRGWGESMSR

SEQ ID NO: 618428 - protein, 21 aa, Mycobacterium
MVIKDGRFGPYVTDGETNASL

SEQ ID NO: 618429 - protein, 19 aa, Mycobacterium
NGAVLPILALYVVAAEEQG

SEQ ID NO: 618430 - protein, 24 aa, Mycobacterium
NGERTGNVCLVTLGLNLFSRGVDP

SEQ ID NO: 618431 - protein, 26 aa, Mycobacterium
NKALADFAHRGWIRLEGKSVLISDSE

SEQ ID NO: 618432 - protein, 22 aa, Mycobacterium
PETIAYGLIPRAHRGIVAVNEL

SEQ ID NO: 618433 - protein, 18 aa, Mycobacterium
PVMAKARIGHFVEAQILQ

SEQ ID NO: 618434 - protein, 25 aa, Mycobacterium
PVPVAYHTFGGWKRSGFGDLNQHGP

SEQ ID NO: 618435 - protein, 25 aa, Mycobacterium
QACRDRGVGFSFGFPVDARVWDAVD

SEQ ID NO: 618436 - protein, 35 aa, Mycobacterium; identical to SEQ ID NO: 83529

SEQ ID NO: 618437 - protein, 23 aa, Mycobacterium
QMAEPKWVLAMGVCASSGGMFNN

SEQ ID NO: 618438 - protein, 17 aa, Mycobacterium
QPGPRFGCGAGILAPHM

SEQ ID NO: 618439 - protein, 21 aa, Mycobacterium
RAAVDSGYYPGQFQVGQTGKT

SEQ ID NO: 618440 - protein, 20 aa, Mycobacterium
RAVEKFDYTKGYKFSTYATW

SEQ ID NO: 618441 - protein, 24 aa, Mycobacterium
REKASEGTPVIVFFDEMDSIFRTR

SEQ ID NO: 618442 - protein, 23 aa, Mycobacterium
REVAAEFERPVLLFSGGKDSIVM

SEQ ID NO: 618443 - protein, 19 aa, Mycobacterium
RGFFTSRVIGTFVNEALAM

SEQ ID NO: 618444 - protein, 22 aa, Mycobacterium
RPAEEMLYLAMEDFRVDVVVGK

SEQ ID NO: 618445 - protein, 17 aa, Mycobacterium
RTPDRFVAGTVGQPGNR

SEQ ID NO: 618446 - protein, 18 aa, Mycobacterium
RVRLAMGVVTSIDPEILL

SEQ ID NO: 618447 - protein, 20 aa, Mycobacterium
RWFLMASPILRGGNLIVTEQ

SEQ ID NO: 618448 - protein, 19 aa, Mycobacterium
SLATDSWLSAASFQETTRV

SEQ ID NO: 618449 - protein, 27 aa, Mycobacterium
TARTAGHPPAWVPLPVHYADYTLWHHQ

SEQ ID NO: 618450 - protein, 25 aa, Mycobacterium
TARTAGHPPTWVPLPVHYADYTLWH

SEQ ID NO: 618451 - protein, 23 aa, Mycobacterium
TGAKEILCIRVLGGSSRRYAGIG

SEQ ID NO: 618452 - protein, 26 aa, Mycobacterium
TLGPKGRNVVLEKKWGAPTITNDGVS

SEQ ID NO: 618453 - protein, 25 aa, Mycobacterium
TVEGRPKHYWSIYQKMIVKGRDFDD

SEQ ID NO: 618454 - protein, 20 aa, Mycobacterium
TWRWATAIATAWRRIRAAFP

SEQ ID NO: 618455 - protein, 24 aa, Mycobacterium
TYGARAGAVVALLLPRSDHAILTI

SEQ ID NO: 618456 - protein, 20 aa, Mycobacterium
TYRITPLALWNARAAGHDAE

SEQ ID NO: 618457 - protein, 29 aa, Mycobacterium
VAEATSLVNLCTWPAGTRLVLRKERPHPG

SEQ ID NO: 618458 - protein, 18 aa, Mycobacterium
VAVTNCLNFGSPEDPGVM

SEQ ID NO: 618459 - protein, 29 aa, Mycobacterium
VDQDRCRGWRMCVSGCPYKKVYFNHKTGK

SEQ ID NO: 618460 - protein, 20 aa, Mycobacterium
VDTKAGYAFERIPKAEVEDL

SEQ ID NO: 618461 - protein, 17 aa, Mycobacterium
VTCTFHGHRRLSPDEVA

SEQ ID NO: 618462 - protein, 33 aa, Mycobacterium; identical to SEQ ID NO: 92789

SEQ ID NO: 618463 - protein, 28 aa, Mycobacterium
YTKGYKFSTYATWWIRQAITRAMADQAR

SEQ ID NO: 618464 - protein, 20 aa, Mycobacterium
ADLFLGVPFNIASYALLTHM

SEQ ID NO: 618465 - protein, 17 aa, Mycobacterium
AEIGRIPVDSIYSPVLK

SEQ ID NO: 618466 - protein, 26 aa, Mycobacterium
AEPRARLSRRALRWALEALVCQHLSV

SEQ ID NO: 618467 - protein, 21 aa, Mycobacterium
AEQRVALDLLLDESVGIVSLG

SEQ ID NO: 618468 - protein, 21 aa, Mycobacterium
AGDFWGGAGSVACQEFITQLG

SEQ ID NO: 618469 - protein, 24 aa, Mycobacterium
AGNYAQRLFPGMRVKYVSTEEFTN

SEQ ID NO: 618470 - protein, 24 aa, Mycobacterium
AGPRVRTAVLTKLYPTRSHTGAAQ

SEQ ID NO: 618471 - protein, 19 aa, Mycobacterium
AGRLHILEVQRLIRFMPKV

SEQ ID NO: 618472 - protein, 20 aa, Mycobacterium
AGVEACAGTGLVAPAADDIA

SEQ ID NO: 618473 - protein, 25 aa, Mycobacterium
AGVLKGEVKDVLLLDVTPLSLGIET

SEQ ID NO: 618474 - protein, 25 aa, Mycobacterium
AGVLLRYVPLTAKRVTGIVSRGGSI

SEQ ID NO: 618475 - protein, 24 aa, Mycobacterium
AGWFKARIAEAMGVSRKCVSTWIG

SEQ ID NO: 618476 - protein, 21 aa, Mycobacterium
AKTRALAGWKGYTTNLVGQPA

SEQ ID NO: 618477 - protein, 22 aa, Mycobacterium
ALLPHWRERRFGHVVNVSSAGV

SEQ ID NO: 618478 - protein, 27 aa, Mycobacterium
AMPAECLLDRNALIMGYSGVYSSFLKH

SEQ ID NO: 618479 - protein, 19 aa, Mycobacterium
ARQQLLALREEVDRLGQPP

SEQ ID NO: 618480 - protein, 23 aa, Mycobacterium
ASEVKRKGVLIGDTVVIRKAGDV

SEQ ID NO: 618481 - protein, 23 aa, Mycobacterium
AWEPKTGAVGSLWDVVRDRRLNH

SEQ ID NO: 618482 - protein, 23 aa, Mycobacterium
CAGFLRRAAAYFARHGIAGIEWV

SEQ ID NO: 618483 - protein, 33 aa, Mycobacterium; identical to SEQ ID NO: 87245

SEQ ID NO: 618484 - protein, 20 aa, Mycobacterium
DAVLYTRAGPEIGVASTKTF

SEQ ID NO: 618485 - protein, 17 aa, Mycobacterium
DAVPYLFEREGTNCENL

SEQ ID NO: 618486 - protein, 19 aa, Mycobacterium
DCSLQRRFQKLVEEAPAPF

SEQ ID NO: 618487 - protein, 22 aa, Mycobacterium
DDALMKITHVLRGEDLLPSTPR

SEQ ID NO: 618488 - protein, 22 aa, Mycobacterium
DDSRRLLQMIGRDMGLDIKRYS

SEQ ID NO: 618489 - protein, 23 aa, Mycobacterium
DEFRLYELIWQRTVASQMADARG

SEQ ID NO: 618490 - protein, 20 aa, Mycobacterium
DEKGATCAGFLRRAAAYFAR

SEQ ID NO: 618491 - protein, 18 aa, Mycobacterium
DGVLHEFTTVPGVKEDVT

SEQ ID NO: 618492 - protein, 26 aa, Mycobacterium
DIVPRYRTMRGYKVERRFGWDTHGLP

SEQ ID NO: 618493 - protein, 24 aa, Mycobacterium
DKSNWWAAYALWVFTLFGHPDVRL

SEQ ID NO: 618494 - protein, 18 aa, Mycobacterium
DLQPGSSIMPGKVNPVLP

SEQ ID NO: 618495 - protein, 17 aa, Mycobacterium
DPGLPAARVQFMVADAG

SEQ ID NO: 618496 - protein, 21 aa, Mycobacterium
DPIPHGLLFERFLNPERPSAP

SEQ ID NO: 618497 - protein, 23 aa, Mycobacterium
DRGLRFMSACGVADRNLQTAEIY

SEQ ID NO: 618498 - protein, 20 aa, Mycobacterium
DRPRWGWRRAAKMARRAGWK

SEQ ID NO: 618499 - protein, 22 aa, Mycobacterium
DVDAALHYLARMLVAGEDPRFV

SEQ ID NO: 618500 - protein, 22 aa, Mycobacterium
EITESTWHRWIAQYGGMKANEA

SEQ ID NO: 618501 - protein, 25 aa, Mycobacterium
EQGDPRFSDVSSRIFGTPHDVDVGA

SEQ ID NO: 618502 - protein, 20 aa, Mycobacterium
EVYDYLRLLYARAGTPHCPV

SEQ ID NO: 618503 - protein, 23 aa, Mycobacterium
FFNNYRPQFYFRTTDVTGVVTLP

SEQ ID NO: 618504 - protein, 26 aa, Mycobacterium
FGQPEIKLGVLPGMGGSQRLTRAIGK

SEQ ID NO: 618505 - protein, 25 aa, Mycobacterium
FKVLLKELQSLCLNVEVLSSDGAAI

SEQ ID NO: 618506 - protein, 18 aa, Mycobacterium
FPSACGKTNLAMLQPTIP

SEQ ID NO: 618507 - protein, 19 aa, Mycobacterium
FREGVGFTGVVLTKLDGDA

SEQ ID NO: 618508 - protein, 26 aa, Mycobacterium
GAGPGQRVALVFGRCAQAVTAILAVL

SEQ ID NO: 618509 - protein, 23 aa, Mycobacterium
GDGFARYWLHNGWVTMGGEKMSK

SEQ ID NO: 618510 - protein, 19 aa, Mycobacterium
GDVIPEVLGPVVDLRDGSE

SEQ ID NO: 618511 - protein, 20 aa, Mycobacterium
GESLLTYALCVEELARGWMS

SEQ ID NO: 618512 - protein, 24 aa, Mycobacterium
GIAEGCVRAGCALLGGETAEHPGL

SEQ ID NO: 618513 - protein, 18 aa, Mycobacterium
GPEVEVEGIISLKTGGCP

SEQ ID NO: 618514 - protein, 22 aa, Mycobacterium
GPPGCGKTLIAKAVANSLAKKM

SEQ ID NO: 618515 - protein, 21 aa, Mycobacterium
GPTGCGKTYLAQTLAKMLNVP

SEQ ID NO: 618516 - protein, 20 aa, Mycobacterium
GREAYPGDVFYLHSRLLERC

SEQ ID NO: 618517 - protein, 20 aa, Mycobacterium
GRIPVGGGWRAHGRGRGRGG

SEQ ID NO: 618518 - protein, 25 aa, Mycobacterium
GTKGKRYALPHARILMHQPLGGVTG

SEQ ID NO: 618519 - protein, 25 aa, Mycobacterium
HLPSARRLLLFKADGSVSVHADDRA

SEQ ID NO: 618520 - protein, 21 aa, Mycobacterium
HNVAFSKPPIGKRGYNEDEVD

SEQ ID NO: 618521 - protein, 17 aa, Mycobacterium
HTLRADIDYGLYEAKTT

SEQ ID NO: 618522 - protein, 23 aa, Mycobacterium
IAEEYYISFLLDRANRTYLAMCS

SEQ ID NO: 618523 - protein, 30 aa, Mycobacterium
IDKFAPRLSFFWGIGMNFFMEVAKLRAGRL

SEQ ID NO: 618524 - protein, 20 aa, Mycobacterium
IDLIMPIGKGQRALIVSPPK

SEQ ID NO: 618525 - protein, 17 aa, Mycobacterium
IDPGSPWQNAWIESFNG

SEQ ID NO: 618526 - protein, 23 aa, Mycobacterium
IEPLEPGFGYTLGNSLRRTLLSS

SEQ ID NO: 618527 - protein, 18 aa, Mycobacterium
KAMLQDMAILTGGQVISE

SEQ ID NO: 618528 - protein, 17 aa, Mycobacterium
KENLPGVHISGGISNVS

SEQ ID NO: 618529 - protein, 19 aa, Mycobacterium
KLKELIPRQQFEVPVQAAI

SEQ ID NO: 618530 - protein, 25 aa, Mycobacterium
KLRALKRLKVVAAFQQSGNSPMGMV

SEQ ID NO: 618531 - protein, 18 aa, Mycobacterium
KLTGEIQPGVTATDVVLT

SEQ ID NO: 618532 - protein, 18 aa, Mycobacterium
KQLRARSSVPVIMVTARD

SEQ ID NO: 618533 - protein, 17 aa, Mycobacterium
LAERVEVQVAYAIGKAA

SEQ ID NO: 618534 - protein, 18 aa, Mycobacterium
LASLHLVHDWNREFVRTS

SEQ ID NO: 618535 - protein, 25 aa, Mycobacterium
LDVMMPRLDGLEVCRQLRSTGDDLP

SEQ ID NO: 618536 - protein, 21 aa, Mycobacterium
LESRLDNVVYRAGLARTRRMA

SEQ ID NO: 618537 - protein, 24 aa, Mycobacterium
LFGSGKMFLPQVVKSARVMKKAVA

SEQ ID NO: 618538 - protein, 18 aa, Mycobacterium
LGGMDYLSPERVELRYTM

SEQ ID NO: 618539 - protein, 17 aa, Mycobacterium
LGGRAGYYDGIGAARDV

SEQ ID NO: 618540 - protein, 28 aa, Mycobacterium
LGIEFPIFAFTHCRDVVVAVSKAGGFGV

SEQ ID NO: 618541 - protein, 18 aa, Mycobacterium
LIAGPGVYICDECIDLCN

SEQ ID NO: 618542 - protein, 25 aa, Mycobacterium
LQLSKRGGGVALLLTNIREHGAPIK

SEQ ID NO: 618543 - protein, 18 aa, Mycobacterium
LRDCDPMTGVVIRASKTT

SEQ ID NO: 618544 - protein, 21 aa, Mycobacterium
LSDDEFGFFVVMLAVAGNETT

SEQ ID NO: 618545 - protein, 32 aa, Mycobacterium; identical to SEQ ID NO: 82438

SEQ ID NO: 618546 - protein, 20 aa, Mycobacterium
LVFPVKRLADLGFRVLATEG

SEQ ID NO: 618547 - protein, 22 aa, Mycobacterium
MRVPLEGGGRLVVELTPDEAAA

SEQ ID NO: 618548 - protein, 24 aa, Mycobacterium
MSPIRPNVIWAMDFQFDTTADGRT

SEQ ID NO: 618549 - protein, 18 aa, Mycobacterium
MVSRVWRAFGLAPHKQDS

SEQ ID NO: 618550 - protein, 26 aa, Mycobacterium
NELREMLPHNAVEYFVSYYDYYQPEA

SEQ ID NO: 618551 - protein, 19 aa, Mycobacterium
NKNGMPWASAQLEDLTGGI

SEQ ID NO: 618552 - protein, 23 aa, Mycobacterium
NYRAWRHFIAMRASEHADVEIRR

SEQ ID NO: 618553 - protein, 17 aa, Mycobacterium
NYSMVFDSYAEVPANVS

SEQ ID NO: 618554 - protein, 18 aa, Mycobacterium
PFDAYLTMRGLKTLVLRM

SEQ ID NO: 618555 - protein, 19 aa, Mycobacterium
PGMNGIDVCRVLRADSGVP

SEQ ID NO: 618556 - protein, 19 aa, Mycobacterium
PKITLACEVCKHRNYITKK

SEQ ID NO: 618557 - protein, 20 aa, Mycobacterium
PSTDAILTCRLIDRPLRPSF

SEQ ID NO: 618558 - protein, 18 aa, Mycobacterium
PTVEHTIEILKGLRDRYE

SEQ ID NO: 618559 - protein, 18 aa, Mycobacterium
PTVVVSVPRVFEKVYNTA

SEQ ID NO: 618560 - protein, 24 aa, Mycobacterium
PVREAIHAVFLFHAIKAGLDMGIV

SEQ ID NO: 618561 - protein, 25 aa, Mycobacterium
PVSMLIPRVVGFKLTGEIQPGVTAT

SEQ ID NO: 618562 - protein, 21 aa, Mycobacterium
QAEGLGQLFVRLLTANFEEAV

SEQ ID NO: 618563 - protein, 18 aa, Mycobacterium
QDSWKLSKDPLFVAKVRD

SEQ ID NO: 618564 - protein, 21 aa, Mycobacterium
QEIMTELEIAPTRRLRGLGDR

SEQ ID NO: 618565 - protein, 25 aa, Mycobacterium
QEPTVLPSRFPNLLANGSGGIAVGM

SEQ ID NO: 618566 - protein, 19 aa, Mycobacterium
QKAKVLAICNTNGSQIPRE

SEQ ID NO: 618567 - protein, 20 aa, Mycobacterium
QRRSASVTAVAWRTSAGAAA

SEQ ID NO: 618568 - protein, 20 aa, Mycobacterium
RDKRSLVFPVKRLADLGFRV

SEQ ID NO: 618569 - protein, 21 aa, Mycobacterium
RDTLLWAKLIDKYKGTMTAAP

SEQ ID NO: 618570 - protein, 23 aa, Mycobacterium
RFVACPFGGVGERMYRTGDLVCW

SEQ ID NO: 618571 - protein, 17 aa, Mycobacterium
RGTGARGLRAIMEEVLL

SEQ ID NO: 618572 - protein, 18 aa, Mycobacterium
RGWMSLAGAMGGHTVVAK

SEQ ID NO: 618573 - protein, 20 aa, Mycobacterium
RINHAYLFSGPRGCGKTSSA

SEQ ID NO: 618574 - protein, 17 aa, Mycobacterium
RKPRQVFTRDVLLEQVW

SEQ ID NO: 618575 - protein, 23 aa, Mycobacterium
RMYRTGDLVCWGRDGQLQYRGRV

SEQ ID NO: 618576 - protein, 20 aa, Mycobacterium
RPLSLGRLDRGWVVASETAA

SEQ ID NO: 618577 - protein, 21 aa, Mycobacterium
RTGTLTVCTMVPMRSVPHRVV

SEQ ID NO: 618578 - protein, 17 aa, Mycobacterium
RVERARIVLAVADGAGT

SEQ ID NO: 618579 - protein, 20 aa, Mycobacterium
RVISDVWLSNLLAWLTRRAS

SEQ ID NO: 618580 - protein, 18 aa, Mycobacterium
SEHCSYKSSKVHLRYFGE

SEQ ID NO: 618581 - protein, 18 aa, Mycobacterium
SGDLVRWNSSGVLEFVGR

SEQ ID NO: 618582 - protein, 18 aa, Mycobacterium
SIVLWPQVVKEVAPVPVL

SEQ ID NO: 618583 - protein, 22 aa, Mycobacterium
SKAGGFGVLGAVGFTPEQLEIE

SEQ ID NO: 618584 - protein, 26 aa, Mycobacterium
SLHAAKGLEWDAVFLVGLADGTLPIS

SEQ ID NO: 618585 - protein, 22 aa, Mycobacterium
SRIKLGQMCTAMSYRNPVYLAK

SEQ ID NO: 618586 - protein, 18 aa, Mycobacterium
SSWLNLVERWFAELTTKK

SEQ ID NO: 618587 - protein, 23 aa, Mycobacterium
STALYPPKRFLGAARNIEEGGSL

SEQ ID NO: 618588 - protein, 24 aa, Mycobacterium
SVACQEFITQLGRNFQVIYEQANS

SEQ ID NO: 618589 - protein, 17 aa, Mycobacterium
SVYARVNPFGFIETPYR

SEQ ID NO: 618590 - protein, 24 aa, Mycobacterium
TAAIAVEFARLYAVELEHYEKLEG

SEQ ID NO: 618591 - protein, 21 aa, Mycobacterium
TERHIRLIFQRAREKASEGTP

SEQ ID NO: 618592 - protein, 22 aa, Mycobacterium
TGGRIPREYIPSVDAGAQDAMQ

SEQ ID NO: 618593 - protein, 18 aa, Mycobacterium
THYLRVYLAQLRRKLEDD

SEQ ID NO: 618594 - protein, 25 aa, Mycobacterium
TLVRMAQPWSLRYPLVDGQGNFGSP

SEQ ID NO: 618595 - protein, 21 aa, Mycobacterium
TVARAYPRRKLHVVCDNYHTH

SEQ ID NO: 618596 - protein, 32 aa, Mycobacterium; identical to SEQ ID NO: 85362

SEQ ID NO: 618597 - protein, 19 aa, Mycobacterium
VEAYVGLDSFRHLAKERAL

SEQ ID NO: 618598 - protein, 18 aa, Mycobacterium
VLLDPGLRESVRHGVTTV

SEQ ID NO: 618599 - protein, 21 aa, Mycobacterium
VNARYLRICVLTQYKSHSLDR

SEQ ID NO: 618600 - protein, 17 aa, Mycobacterium
VNSVSMRGVVVIGEGEK

SEQ ID NO: 618601 - protein, 19 aa, Mycobacterium
VRDGLKPVHRRVLYAMYDS

SEQ ID NO: 618602 - protein, 23 aa, Mycobacterium
VTDMAHFFYIHFGLPTYFKNVFE

SEQ ID NO: 618603 - protein, 18 aa, Mycobacterium
VVATCYLLGVSTRRMDKL

SEQ ID NO: 618604 - protein, 19 aa, Mycobacterium
VVVLPCGAGKTLVGAAAMA

SEQ ID NO: 618605 - protein, 20 aa, Mycobacterium
VWLSNLLAWLTRRASATDVS

SEQ ID NO: 618606 - protein, 19 aa, Mycobacterium
WALEALVCQHLSVARVAEA

SEQ ID NO: 618607 - protein, 26 aa, Mycobacterium
WEVQGRGELALAVLVEQMRREGFELT

SEQ ID NO: 618608 - protein, 20 aa, Mycobacterium
WLEGLFHGIQTALFAQQMAA

SEQ ID NO: 618609 - protein, 23 aa, Mycobacterium
WLVKNPRVTLHFTPTSGSWLNLV

SEQ ID NO: 618610 - protein, 17 aa, Mycobacterium
WNAAIMVHRAQRPGVGV

SEQ ID NO: 618611 - protein, 19 aa, Mycobacterium
YFARHGIAGIEWVMTDNAW

SEQ ID NO: 618612 - protein, 22 aa, Mycobacterium
YTLRLPLDVLVVASANPEDYTN

SEQ ID NO: 618613 - protein, 23 aa, Mycobacterium
AAAKAAILASIAFHTRVTADDVY

SEQ ID NO: 618614 - protein, 24 aa, Mycobacterium
AAGLRSLLAYQWAHPGKQLLFMGQ

SEQ ID NO: 618615 - protein, 22 aa, Mycobacterium
AAQRRDMMWICRDGDRAKNHLL

SEQ ID NO: 618616 - protein, 19 aa, Mycobacterium
AARILLRSGKPVFLAANKV

SEQ ID NO: 618617 - protein, 23 aa, Mycobacterium
ACALLGLECVIYMGAVDTARQAL

SEQ ID NO: 618618 - protein, 18 aa, Mycobacterium
ACALVGRPELVFLDEPTA

SEQ ID NO: 618619 - protein, 25 aa, Mycobacterium
ADFGWRVVDAGGWSVGRLGEAVDAV

SEQ ID NO: 618620 - protein, 25 aa, Mycobacterium
ADHRGGRVGIDWSVGLQQQIARVAR

SEQ ID NO: 618621 - protein, 17 aa, Mycobacterium
ADIRESIHLRALGRQNP

SEQ ID NO: 618622 - protein, 17 aa, Mycobacterium
AEEAVEDVFPLPRELVG

SEQ ID NO: 618623 - protein, 18 aa, Mycobacterium
AEHILLRTVRCVSGTVEL

SEQ ID NO: 618624 - protein, 20 aa, Mycobacterium
AEIDDAFRWSEENPNLQRKA

SEQ ID NO: 618625 - protein, 26 aa, Mycobacterium
AEPLPRSLVWSAAWEMTREAELRARD

SEQ ID NO: 618626 - protein, 21 aa, Mycobacterium
AEPYLPLRAVRHLEKGRVVIF

SEQ ID NO: 618627 - protein, 26 aa, Mycobacterium
AEVFWQVVDARGWTPQHLHTAIDEAT

SEQ ID NO: 618628 - protein, 25 aa, Mycobacterium
AEVLGNWTGIPVFKLTEAETTRLLR

SEQ ID NO: 618629 - protein, 23 aa, Mycobacterium
AEVMPEDLIKFGLIPEFIGRLPV

SEQ ID NO: 618630 - protein, 18 aa, Mycobacterium
AEVWAIDGDGCFQMTNQE

SEQ ID NO: 618631 - protein, 18 aa, Mycobacterium
AEVYLDLVRQVPYFTDVN

SEQ ID NO: 618632 - protein, 18 aa, Mycobacterium
AFDLPGLTLPPLTIPAAT

SEQ ID NO: 618633 - protein, 17 aa, Mycobacterium
AGCVPGWAPLAVQYGDY

SEQ ID NO: 618634 - protein, 25 aa, Mycobacterium
AGILDVLDNYAFVRTSGYLAGPHDV

SEQ ID NO: 618635 - protein, 17 aa, Mycobacterium
AGLKAIYLSGWQVAGDA

SEQ ID NO: 618636 - protein, 25 aa, Mycobacterium
AGLSHPMGPLRLSDLVGLDTLKLIA

SEQ ID NO: 618637 - protein, 29 aa, Mycobacterium
AGPRPAVVPLSFTQSGLWFLEQVQGPSAV

SEQ ID NO: 618638 - protein, 21 aa, Mycobacterium
AHVDGVPCCTHIGPDGAGHFV

SEQ ID NO: 618639 - protein, 25 aa, Mycobacterium
AISSARTAAQFGIEPRVAMLSYSTG

SEQ ID NO: 618640 - protein, 25 aa, Mycobacterium
AIVKGLRTGTDFEYELQMAQMNKHI

SEQ ID NO: 618641 - protein, 19 aa, Mycobacterium
AMYSVMWSEHCSYKSSKVH

SEQ ID NO: 618642 - protein, 21 aa, Mycobacterium
ANNPLRLGGCLNSESAEKAAR

SEQ ID NO: 618643 - protein, 19 aa, Mycobacterium
APAKTSAAYMLGLLLQSES

SEQ ID NO: 618644 - protein, 19 aa, Mycobacterium
AQYERAWGTIEALKEKDEA

SEQ ID NO: 618645 - protein, 31 aa, Mycobacterium
ARERPARLPLSYAQTRLWFLHKYEGPSATYN

SEQ ID NO: 618646 - protein, 33 aa, Mycobacterium; identical to SEQ ID NO: 78145

SEQ ID NO: 618647 - protein, 18 aa, Mycobacterium
ARLQEVWMGRQIAEVKSK

SEQ ID NO: 618648 - protein, 26 aa, Mycobacterium
ARRVIGWRAATSMKTALVIDALEHAF

SEQ ID NO: 618649 - protein, 21 aa, Mycobacterium
ASAGHIYAVIGLKDTTTGDTL

SEQ ID NO: 618650 - protein, 17 aa, Mycobacterium
ATARPPTFVLFTTGFLE

SEQ ID NO: 618651 - protein, 20 aa, Mycobacterium
ATLPGAAWQRCRTHYTTNLM

SEQ ID NO: 618652 - protein, 18 aa, Mycobacterium
ATPEALVESALWEASLFE

SEQ ID NO: 618653 - protein, 24 aa, Mycobacterium
ATRAEGVACYQLFISGLLDVTDNV

SEQ ID NO: 618654 - protein, 18 aa, Mycobacterium
AVAGRPKEEYGLEPQGLD

SEQ ID NO: 618655 - protein, 23 aa, Mycobacterium
AVASRVGAPLGHDYAVISLSDRL

SEQ ID NO: 618656 - protein, 25 aa, Mycobacterium
AVRPEPFGALLYHFGTRKLSFLKNR

SEQ ID NO: 618657 - protein, 30 aa, Mycobacterium; identical to SEQ ID NO: 78436

SEQ ID NO: 618658 - protein, 18 aa, Mycobacterium
AYGGTFLQFSDYMRPAVR

SEQ ID NO: 618659 - protein, 17 aa, Mycobacterium
CADRGGLRYEITTALDR

SEQ ID NO: 618660 - protein, 24 aa, Mycobacterium
CDQLMPEYLRFVKGVVDAQDMSLN

SEQ ID NO: 618661 - protein, 25 aa, Mycobacterium
CDRPIADVCPVEWARMENRSVLQWD

SEQ ID NO: 618662 - protein, 23 aa, Mycobacterium
CPAPCEPACVLGINQDPVTIKQI

SEQ ID NO: 618663 - protein, 17 aa, Mycobacterium
DAEAAWRGAFLAHGSLT

SEQ ID NO: 618664 - protein, 23 aa, Mycobacterium
DAEKYRRLHVIVGDSNMCETTTM

SEQ ID NO: 618665 - protein, 24 aa, Mycobacterium
DAIDQWAFCALTRSPGARQFYDHR

SEQ ID NO: 618666 - protein, 18 aa, Mycobacterium
DAPWKDIEAQGWIAPAEC

SEQ ID NO: 618667 - protein, 24 aa, Mycobacterium
DATVEVAIRLGVDPRKADQMVRGT

SEQ ID NO: 618668 - protein, 29 aa, Mycobacterium
DCRTPTIASVHGWCIGGGVDLISAVDIRY

SEQ ID NO: 618669 - protein, 22 aa, Mycobacterium
DCTGLLPLASVAAMQGRIAMYH

SEQ ID NO: 618670 - protein, 25 aa, Mycobacterium
DELLDRVSSKYALVIYAAKRARQIN

SEQ ID NO: 618671 - protein, 25 aa, Mycobacterium
DFCDPEVVEALKFHLRDLAVTFRFG

SEQ ID NO: 618672 - protein, 20 aa, Mycobacterium
DGAGWLTFWRSLTARGLSGV

SEQ ID NO: 618673 - protein, 20 aa, Mycobacterium
DGQFGKWLQGARDWSISRNR

SEQ ID NO: 618674 - protein, 23 aa, Mycobacterium
DHGKAPVRRACYAADRTGHMILQ

SEQ ID NO: 618675 - protein, 18 aa, Mycobacterium
DIEAQGWIAPAECVEVRV

SEQ ID NO: 618676 - protein, 23 aa, Mycobacterium
DITVNVDGFWMLQALLDIRHVAP

SEQ ID NO: 618677 - protein, 19 aa, Mycobacterium
DKHKLALEREMLGLYVSGH

SEQ ID NO: 618678 - protein, 21 aa, Mycobacterium
DKLKDAGFYWATRSGVTVSMA

SEQ ID NO: 618679 - protein, 18 aa, Mycobacterium
DKLMGFGHRVYRAEDPRA

SEQ ID NO: 618680 - protein, 18 aa, Mycobacterium
DLIGFFVNTWVLRVNTSG

SEQ ID NO: 618681 - protein, 19 aa, Mycobacterium
DPRGWSHSAIRAILDNPAY

SEQ ID NO: 618682 - protein, 20 aa, Mycobacterium
DQMLAYNLSPSFNWDTTGMT

SEQ ID NO: 618683 - protein, 20 aa, Mycobacterium
DRIVSIGAFEHFGHDRYDDF

SEQ ID NO: 618684 - protein, 24 aa, Mycobacterium
DRLELSIGTVRRWRNRFAELRLDG

SEQ ID NO: 618685 - protein, 25 aa, Mycobacterium
DSLPPEFRAAVVLCDIEGLSYEEIG

SEQ ID NO: 618686 - protein, 19 aa, Mycobacterium
DVEGFPYKEIAEIMDTPIG

SEQ ID NO: 618687 - protein, 25 aa, Mycobacterium
DWHERETYDFFGIIFDGHPSLTRIE

SEQ ID NO: 618688 - protein, 24 aa, Mycobacterium
EACECPSGCPSCVQSPKCGNGNDP

SEQ ID NO: 618689 - protein, 25 aa, Mycobacterium
EAIDAEIPLLVVITEGIPVQDTAYA

SEQ ID NO: 618690 - protein, 19 aa, Mycobacterium
EALVPLVLAGTTHRETPRL

SEQ ID NO: 618691 - protein, 27 aa, Mycobacterium
EARGVPMTAGCVVPRGDVLELIDDIKD

SEQ ID NO: 618692 - protein, 20 aa, Mycobacterium
EARLTPLAMEMLREIDEETV

SEQ ID NO: 618693 - protein, 22 aa, Mycobacterium
EAVAAFGRGECFVERYLDKPRH

SEQ ID NO: 618694 - protein, 24 aa, Mycobacterium
EGTNLKAWLYRILTNTYINSYRKK

SEQ ID NO: 618695 - protein, 25 aa, Mycobacterium
EKATPELVAFMVRYTSGYLCVPLDG

SEQ ID NO: 618696 - protein, 19 aa, Mycobacterium
ELAIKTGRPLIGINDGAGA

SEQ ID NO: 618697 - protein, 22 aa, Mycobacterium
ELRRRVKAMSYGLAYGLSAYGL

SEQ ID NO: 618698 - protein, 21 aa, Mycobacterium
EPGIPESFKVLLKELQSLCLN

SEQ ID NO: 618699 - protein, 23 aa, Mycobacterium
EPMIPIYIFYSMFGFQRTGDGLW

SEQ ID NO: 618700 - protein, 19 aa, Mycobacterium
EQANINWGKAGRMRWKGKR

SEQ ID NO: 618701 - protein, 27 aa, Mycobacterium
ETDKPFLMPVEDVFTITGRGTVVTGRV

SEQ ID NO: 618702 - protein, 34 aa, Mycobacterium; identical to SEQ ID NO: 96427

SEQ ID NO: 618703 - protein, 23 aa, Mycobacterium
EVRVPAKALWRAQTQRAVENFPI

SEQ ID NO: 618704 - protein, 20 aa, Mycobacterium
FDALCAHLATMHPSRYLTLI

SEQ ID NO: 618705 - protein, 18 aa, Mycobacterium
FDDAGAIGRRYRRQDEIG

SEQ ID NO: 618706 - protein, 19 aa, Mycobacterium
FDDARPVLERASARETAAR

SEQ ID NO: 618707 - protein, 25 aa, Mycobacterium
FEAMTIDCPEEFVGAITQLMAARKG

SEQ ID NO: 618708 - protein, 26 aa, Mycobacterium
FEKTLRFWLERGVDGFRIDVAHGMAK

SEQ ID NO: 618709 - protein, 19 aa, Mycobacterium
FHAMYPRIDEWIAVRRKVD

SEQ ID NO: 618710 - protein, 18 aa, Mycobacterium
FLELAAIRTKAVRQGDPL

SEQ ID NO: 618711 - protein, 17 aa, Mycobacterium
FPGGVLGVALNLDEHSV

SEQ ID NO: 618712 - protein, 17 aa, Mycobacterium
FPGRVLLAEANQWPADV

SEQ ID NO: 618713 - protein, 17 aa, Mycobacterium
FPLMPRIFMAVRRESRF

SEQ ID NO: 618714 - protein, 22 aa, Mycobacterium
FTESVPGIPARARVTPRAKATM

SEQ ID NO: 618715 - protein, 30 aa, Mycobacterium; identical to SEQ ID NO: 199394

SEQ ID NO: 618716 - protein, 17 aa, Mycobacterium
FVMSNSFSNQVIAQIEL

SEQ ID NO: 618717 - protein, 28 aa, Mycobacterium
FYRFCAACTVPEVIRLARTIETWQAPII

SEQ ID NO: 618718 - protein, 24 aa, Mycobacterium
GAAGNTGVGFATKGGNGGNGGIGG

SEQ ID NO: 618719 - protein, 17 aa, Mycobacterium
GACIGPMGQRVRNVMSE

SEQ ID NO: 618720 - protein, 25 aa, Mycobacterium
GAEWRQAGCSMCLGMNPDQLAPGER

SEQ ID NO: 618721 - protein, 25 aa, Mycobacterium
GDDIAEVLALLGVRPVWDDASRRVV

SEQ ID NO: 618722 - protein, 21 aa, Mycobacterium
GDGAFGFSGMEWDTLVRHNVP

SEQ ID NO: 618723 - protein, 19 aa, Mycobacterium
GDRMWEFLDRLTSIALPRI

SEQ ID NO: 618724 - protein, 18 aa, Mycobacterium
GFDGASCGVNIGIGAQSP

SEQ ID NO: 618725 - protein, 18 aa, Mycobacterium
GFHTLKLQTYLTAGPKEA

SEQ ID NO: 618726 - protein, 17 aa, Mycobacterium
GFSTVWLTEHHFLEEYC

SEQ ID NO: 618727 - protein, 18 aa, Mycobacterium
GGDLEFADELTLGRALAG

SEQ ID NO: 618728 - protein, 20 aa, Mycobacterium
GGHHSWEDLDDLLLATYSEL

SEQ ID NO: 618729 - protein, 24 aa, Mycobacterium
GGSLYGIPMPPGLISHAPQGVHHG

SEQ ID NO: 618730 - protein, 21 aa, Mycobacterium
GGTCPLWNVYETFANPGKILV

SEQ ID NO: 618731 - protein, 19 aa, Mycobacterium
GHPLFAHITLLRSERSPIA

SEQ ID NO: 618732 - protein, 19 aa, Mycobacterium
GHSSLTLYIQLYLGGFGLE

SEQ ID NO: 618733 - protein, 19 aa, Mycobacterium
GIEFCKLSFAETRVRAQSL

SEQ ID NO: 618734 - protein, 25 aa, Mycobacterium
GIGAGADGGNGFAGGTGGDGGTGGN

SEQ ID NO: 618735 - protein, 19 aa, Mycobacterium
GKDISCNLGSLNIAKTMDS

SEQ ID NO: 618736 - protein, 18 aa, Mycobacterium
GKHLGVGVTSIYWYFRKK

SEQ ID NO: 618737 - protein, 31 aa, Mycobacterium; identical to SEQ ID NO: 80303

SEQ ID NO: 618738 - protein, 26 aa, Mycobacterium
GMVFQRPNPFPAMSIRDNVVAGLKLQ

SEQ ID NO: 618739 - protein, 24 aa, Mycobacterium
GNTEVKSFVQKVCNEQLTHWFEAN

SEQ ID NO: 618740 - protein, 17 aa, Mycobacterium
GPHDVYVSMNMVRKNGL

SEQ ID NO: 618741 - protein, 17 aa, Mycobacterium
GPLEASRPWATKDVVGA

SEQ ID NO: 618742 - protein, 22 aa, Mycobacterium
GPRKVSPLAVQMIMPNGAAAVV

SEQ ID NO: 618743 - protein, 21 aa, Mycobacterium
GPRRKGVRYFGPYSHAWAIRE

SEQ ID NO: 618744 - protein, 17 aa, Mycobacterium
GQIAGLNVLRIVNEPTA

SEQ ID NO: 618745 - protein, 23 aa, Mycobacterium
GQPRLRPPFPAVAGLYGCPTVIN

SEQ ID NO: 618746 - protein, 20 aa, Mycobacterium
GRDFTVDWVHLKLNDQAQRT

SEQ ID NO: 618747 - protein, 21 aa, Mycobacterium
GRLILADAIVRACEDNPDYLI

SEQ ID NO: 618748 - protein, 21 aa, Mycobacterium
GRRGRKADVEWINRRRLLRGS

SEQ ID NO: 618749 - protein, 19 aa, Mycobacterium
GRTVDFKNTVLIFTSNLGT

SEQ ID NO: 618750 - protein, 27 aa, Mycobacterium
GRVERMHRACLILTFGGGTNEVQRDII

SEQ ID NO: 618751 - protein, 20 aa, Mycobacterium
GRVKQMLLKIGWPAEDLAGY

SEQ ID NO: 618752 - protein, 19 aa, Mycobacterium
GSDMWKFRDTVIPNVALNA

SEQ ID NO: 618753 - protein, 21 aa, Mycobacterium
GSDSLLRMRLDLEECATGVTK

SEQ ID NO: 618754 - protein, 23 aa, Mycobacterium
GVDEARALYEWNHAKQILRIQAG

SEQ ID NO: 618755 - protein, 25 aa, Mycobacterium
GVDLSVRVLFEWPTVAGLASCVGGV

SEQ ID NO: 618756 - protein, 39 aa, Mycobacterium
GVGVGYWRRGGLSATRFVACPFGAAGSRMYRTGDLVCWG

SEQ ID NO: 618757 - protein, 19 aa, Mycobacterium
GVHYCLGANLARLEGRVAL

SEQ ID NO: 618758 - protein, 25 aa, Mycobacterium
HGGARVRAALVARERPARLPLSYAQ

SEQ ID NO: 618759 - protein, 18 aa, Mycobacterium
HGKELTWSQVVMAANTPM

SEQ ID NO: 618760 - protein, 19 aa, Mycobacterium
HHHELGWFARQALRLFDDL

SEQ ID NO: 618761 - protein, 18 aa, Mycobacterium
HKTFCIPHGGGGPGVGPV

SEQ ID NO: 618762 - protein, 18 aa, Mycobacterium
HQRVMLVEVMGRHAGWIA

SEQ ID NO: 618763 - protein, 17 aa, Mycobacterium
HTIRLMAGHELVTEGFA

SEQ ID NO: 618764 - protein, 25 aa, Mycobacterium
HTNRGDIKVALFGNHAPKTVANFVG

SEQ ID NO: 618765 - protein, 17 aa, Mycobacterium
HVTRPGQYEAPLGITLR

SEQ ID NO: 618766 - protein, 19 aa, Mycobacterium
IACGIEAMSRVGLGANAGP

SEQ ID NO: 618767 - protein, 18 aa, Mycobacterium
IAGITYRQLDYWARTSLV

SEQ ID NO: 618768 - protein, 24 aa, Mycobacterium
IASHNKLLGSFELTGIPPAPRGVP

SEQ ID NO: 618769 - protein, 23 aa, Mycobacterium
IDAAVALGRRVSFVGRSMVRNMG

SEQ ID NO: 618770 - protein, 18 aa, Mycobacterium
IDATGLLVTPGFVDLHTH

SEQ ID NO: 618771 - protein, 17 aa, Mycobacterium
IDGDGCFQMTNQELATC

SEQ ID NO: 618772 - protein, 21 aa, Mycobacterium
IDLERRRISLSLKQANEDYTE

SEQ ID NO: 618773 - protein, 19 aa, Mycobacterium
IDVAYRYFATPKRKFIIAD

SEQ ID NO: 618774 - protein, 17 aa, Mycobacterium
IFDSVYDIYRGVVTYVR

SEQ ID NO: 618775 - protein, 17 aa, Mycobacterium
IGDAVGLTSTSSVAHQL

SEQ ID NO: 618776 - protein, 20 aa, Mycobacterium
IGGLPRGRVIEIYGPESSGK

SEQ ID NO: 618777 - protein, 22 aa, Mycobacterium
IGPTRITTVLGILKAYTTRVGS

SEQ ID NO: 618778 - protein, 22 aa, Mycobacterium
IGQCFTGGFALAAAVDDSVLAP

SEQ ID NO: 618779 - protein, 18 aa, Mycobacterium
IHGGYGYSTEYDVERYFR

SEQ ID NO: 618780 - protein, 17 aa, Mycobacterium
IHSCPGAPLARAETRVA

SEQ ID NO: 618781 - protein, 25 aa, Mycobacterium
IIYDEVHLLPAPVFRMTADLQSKRR

SEQ ID NO: 618782 - protein, 19 aa, Mycobacterium
IKLRGDGMDVARCTVERLM

SEQ ID NO: 618783 - protein, 19 aa, Mycobacterium
IKSAVAFGALLSKGIGDTI

SEQ ID NO: 618784 - protein, 19 aa, Mycobacterium
ILLIKRRDNTLWALPGGGH

SEQ ID NO: 618785 - protein, 27 aa, Mycobacterium
ILQRYKDLQDIIAILGIDELSEEDKQL

SEQ ID NO: 618786 - protein, 23 aa, Mycobacterium
IPPELRPMVQLDGGRFATSDLND

SEQ ID NO: 618787 - protein, 24 aa, Mycobacterium
IQAIKGVEIGDGFETARRRGSRAH

SEQ ID NO: 618788 - protein, 23 aa, Mycobacterium
IQREVVARTGLRDCRTHGRTWDL

SEQ ID NO: 618789 - protein, 17 aa, Mycobacterium
IRLEGKSVLISDSERLA

SEQ ID NO: 618790 - protein, 19 aa, Mycobacterium
ITPFNFPAMIPLWKAGPAL

SEQ ID NO: 618791 - protein, 28 aa, Mycobacterium
ITSMPGIGFRLGAEFLAAVGDPALIGSA

SEQ ID NO: 618792 - protein, 24 aa, Mycobacterium
IVEEPPEHLIFIFATTEPEKVLPT

SEQ ID NO: 618793 - protein, 17 aa, Mycobacterium
IVIGQACEFDYSGTQAC

SEQ ID NO: 618794 - protein, 19 aa, Mycobacterium
IYSFLRLLLPAGLETTYRS

SEQ ID NO: 618795 - protein, 19 aa, Mycobacterium
KALLRRLVEAGTRVVQYGY

SEQ ID NO: 618796 - protein, 20 aa, Mycobacterium
KCGHLGGKVLIPTQQHIRTL

SEQ ID NO: 618797 - protein, 27 aa, Mycobacterium
KEFELLKYLAQHAGRVFTRAQLLHEVW

SEQ ID NO: 618798 - protein, 20 aa, Mycobacterium
KFASCDGCQLTLLDCEDELL

SEQ ID NO: 618799 - protein, 18 aa, Mycobacterium
KGERARIQMRVRTAMSAL

SEQ ID NO: 618800 - protein, 20 aa, Mycobacterium
KKDMFIVGGFNAYPAEIEGF

SEQ ID NO: 618801 - protein, 17 aa, Mycobacterium
KKHFRPEFLNRIDDIIV

SEQ ID NO: 618802 - protein, 18 aa, Mycobacterium
KMDALTRVLEVEPFEAMI

SEQ ID NO: 618803 - protein, 24 aa, Mycobacterium
KNYVSRLLAKLGMERRTQAAVFAS

SEQ ID NO: 618804 - protein, 28 aa, Mycobacterium
KPGVLARVAALFSRRGFNIESLAVGATE

SEQ ID NO: 618805 - protein, 20 aa, Mycobacterium
KPSASKGRYLKKITVSTTTG

SEQ ID NO: 618806 - protein, 27 aa, Mycobacterium
KQAEAYRAISLLLRRPPGREAYPGDVF

SEQ ID NO: 618807 - protein, 19 aa, Mycobacterium
KSRRFAYPPNLYVVDGGAP

SEQ ID NO: 618808 - protein, 27 aa, Mycobacterium
KTPAVKRWLTGHPRFVLHFTPTSSSWL

SEQ ID NO: 618809 - protein, 24 aa, Mycobacterium
KVDRSAAYAMRWVAKNVVAAGLAE

SEQ ID NO: 618810 - protein, 24 aa, Mycobacterium
KVGRIARVLGPRGLMPNPKTGTVT

SEQ ID NO: 618811 - protein, 18 aa, Mycobacterium
LAAEIPIRATVLHTADHQ

SEQ ID NO: 618812 - protein, 24 aa, Mycobacterium
LAGDAAHLMPVWQGQGYNSGIRDA

SEQ ID NO: 618813 - protein, 20 aa, Mycobacterium
LAREDLSVWVVTGDGDALSI

SEQ ID NO: 618814 - protein, 23 aa, Mycobacterium
LATCAIEGVPIKVALINNGNLGM

SEQ ID NO: 618815 - protein, 26 aa, Mycobacterium
LAVMPWNFPLWQAVRFAAPALMAGNV

SEQ ID NO: 618816 - protein, 23 aa, Mycobacterium
LAYGDMGLALPILAPGGVASALT

SEQ ID NO: 618817 - protein, 24 aa, Mycobacterium
LDGDARGGAALSVREVTGVPILFA

SEQ ID NO: 618818 - protein, 17 aa, Mycobacterium
LDKMGWRSSDTAELSYT

SEQ ID NO: 618819 - protein, 20 aa, Mycobacterium
LDTSVAISWIGKETGREVVA

SEQ ID NO: 618820 - protein, 18 aa, Mycobacterium
LDVARMVLFGQVGRELVN

SEQ ID NO: 618821 - protein, 17 aa, Mycobacterium
LEAEGHRILKLNIGNPA

SEQ ID NO: 618822 - protein, 21 aa, Mycobacterium
LEGKSSLGRLGLLTHSTAGFI

SEQ ID NO: 618823 - protein, 22 aa, Mycobacterium
LGALRMLAGDVIEMATGEGKTL

SEQ ID NO: 618824 - protein, 22 aa, Mycobacterium
LGEARISPYPVATHTARMDLVI

SEQ ID NO: 618825 - protein, 21 aa, Mycobacterium
LGNWFRAAGYDTHYDGKWHIS

SEQ ID NO: 618826 - protein, 17 aa, Mycobacterium
LGQWPFTSGPGFGHTRN

SEQ ID NO: 618827 - protein, 18 aa, Mycobacterium
LHGGYGYMREYPVARAYL

SEQ ID NO: 618828 - protein, 33 aa, Mycobacterium; identical to SEQ ID NO: 81998

SEQ ID NO: 618829 - protein, 19 aa, Mycobacterium
LIERLGRVLVAMTGDVGVR

SEQ ID NO: 618830 - protein, 18 aa, Mycobacterium
LITTPGLINVDFADVKGI

SEQ ID NO: 618831 - protein, 19 aa, Mycobacterium
LKIVARAGVGLDNVDVDAA

SEQ ID NO: 618832 - protein, 19 aa, Mycobacterium
LKNKIALMCDVDIDGVIST

SEQ ID NO: 618833 - protein, 17 aa, Mycobacterium
LKPGDYVVVQVSKDPVG

SEQ ID NO: 618834 - protein, 24 aa, Mycobacterium
LLEVEEVYLPLARLIHLQVAARQR

SEQ ID NO: 618835 - protein, 18 aa, Mycobacterium
LLGAHGGLHQKWFNLYDE

SEQ ID NO: 618836 - protein, 19 aa, Mycobacterium
LLPGRDGLVHISKLGKGKR

SEQ ID NO: 618837 - protein, 21 aa, Mycobacterium
LNALVGLARPGKFGGDVSHLN

SEQ ID NO: 618838 - protein, 23 aa, Mycobacterium
LNEAFASVVLKFQKDLNIPDEKL

SEQ ID NO: 618839 - protein, 25 aa, Mycobacterium
LNFRDVLNVLGLYPGDPGPIGGDFA

SEQ ID NO: 618840 - protein, 18 aa, Mycobacterium
LNVEVPIRAVFNAPTVAE

SEQ ID NO: 618841 - protein, 17 aa, Mycobacterium
LPEAQLDRFAIRLELRY

SEQ ID NO: 618842 - protein, 23 aa, Mycobacterium
LPLPAEAASALFQVVSQRYLKTS

SEQ ID NO: 618843 - protein, 18 aa, Mycobacterium
LPNMRTVLHCLPPKDWTE

SEQ ID NO: 618844 - protein, 21 aa, Mycobacterium
LPRLRGWGESMSRQAGGRAGG

SEQ ID NO: 618845 - protein, 17 aa, Mycobacterium
LPVTGYADLVRAVKARV

SEQ ID NO: 618846 - protein, 25 aa, Mycobacterium
LQHPRCVYQILKRHYARYTPEMVER

SEQ ID NO: 618847 - protein, 24 aa, Mycobacterium
LQSARAQILAGFCDVALVIGADTT

SEQ ID NO: 618848 - protein, 21 aa, Mycobacterium
LRRAVRLLAQLTRQVAVVQYP

SEQ ID NO: 618849 - protein, 19 aa, Mycobacterium
LRTEMGYPLHGHELSLDIS

SEQ ID NO: 618850 - protein, 17 aa, Mycobacterium
LRTVRCVSGTVELMMSC

SEQ ID NO: 618851 - protein, 23 aa, Mycobacterium
LSAGHARALLSLEAGPEAQEELA

SEQ ID NO: 618852 - protein, 17 aa, Mycobacterium
LSKDPLFVAKVRDVVGL

SEQ ID NO: 618853 - protein, 19 aa, Mycobacterium
LSPALTFGGANLNFFPMGA

SEQ ID NO: 618854 - protein, 17 aa, Mycobacterium
LSSAPVWCSDIRAGAGL

SEQ ID NO: 618855 - protein, 25 aa, Mycobacterium
LTSIALPRIRDFRGLSPKQFDGVGN

SEQ ID NO: 618856 - protein, 18 aa, Mycobacterium
LVASFAIDELLDYRSRRP

SEQ ID NO: 618857 - protein, 17 aa, Mycobacterium
LVDACRLSRARVVVTPH

SEQ ID NO: 618858 - protein, 22 aa, Mycobacterium
LVEMRRVRDLQPYIGKEIEAKI

SEQ ID NO: 618859 - protein, 18 aa, Mycobacterium
LVRYWRLLKFKLANPHII

SEQ ID NO: 618860 - protein, 17 aa, Mycobacterium
LVSKGFTPRRIRELEPR

SEQ ID NO: 618861 - protein, 20 aa, Mycobacterium
LWKKVAPKLSAGRVQSVATR

SEQ ID NO: 618862 - protein, 26 aa, Mycobacterium
LYIQLYLGGFGLELSDIESLRTWGSK

SEQ ID NO: 618863 - protein, 17 aa, Mycobacterium
MAMWPGAAVSGWYFSHP

SEQ ID NO: 618864 - protein, 23 aa, Mycobacterium
MDEGLRFAIREGGRTVGAGRVTK

SEQ ID NO: 618865 - protein, 17 aa, Mycobacterium
MGDSHVGLQARLMSQAL

SEQ ID NO: 618866 - protein, 19 aa, Mycobacterium
MGVSGCARECAEARGKDVG

SEQ ID NO: 618867 - protein, 18 aa, Mycobacterium
MLCYRRRGHNEGDDPSMT

SEQ ID NO: 618868 - protein, 18 aa, Mycobacterium
MLEAAVIAGLTSQGVDAL

SEQ ID NO: 618869 - protein, 35 aa, Mycobacterium
MTNHAAGWVRMDFIVPSRGLIGFRTDFLTLTRGTG

SEQ ID NO: 618870 - protein, 25 aa, Mycobacterium
MWQTTECWRQWINIGNFPDHPWRAY

SEQ ID NO: 618871 - protein, 17 aa, Mycobacterium
MYLCRELTDLSLPKIGQ

SEQ ID NO: 618872 - protein, 19 aa, Mycobacterium
NAGVHACAVIMSSEPLTEA

SEQ ID NO: 618873 - protein, 19 aa, Mycobacterium
NCEIVPWCRFARKNYFYPD

SEQ ID NO: 618874 - protein, 21 aa, Mycobacterium
NDRDRLVVIIAGYRADLDKFL

SEQ ID NO: 618875 - protein, 22 aa, Mycobacterium
NGADGDIGVAGIGAGADGGNGF

SEQ ID NO: 618876 - protein, 18 aa, Mycobacterium
NITGSARFRNLIKAEDYD

SEQ ID NO: 618877 - protein, 19 aa, Mycobacterium
NQINNVLAFPGVFRGALDA

SEQ ID NO: 618878 - protein, 18 aa, Mycobacterium
NRLVGILHGCLRHRTRYD

SEQ ID NO: 618879 - protein, 19 aa, Mycobacterium
NRRLYDAIDQWAFCALTRS

SEQ ID NO: 618880 - protein, 24 aa, Mycobacterium
NSTRTRFSFEMGIAQLGGHAVVVD

SEQ ID NO: 618881 - protein, 26 aa, Mycobacterium
NTPVVWRGPMLHRALQQFLADVYWGD

SEQ ID NO: 618882 - protein, 20 aa, Mycobacterium
NTTIPTKRSETFTTADDNQP

SEQ ID NO: 618883 - protein, 25 aa, Mycobacterium
PADLLDRWAPGRIMLNAYGPTETTV

SEQ ID NO: 618884 - protein, 26 aa, Mycobacterium
PAMSKFEVLTAMAFAAFADAPVDVAV

SEQ ID NO: 618885 - protein, 20 aa, Mycobacterium
PAVEAGERLGFLPGTLSEKI

SEQ ID NO: 618886 - protein, 26 aa, Mycobacterium
PEMAYFEVLHELKLIVDLMYEGGIAR

SEQ ID NO: 618887 - protein, 18 aa, Mycobacterium
PFSREKVISGVRRACQGR

SEQ ID NO: 618888 - protein, 20 aa, Mycobacterium
PFTPRAKKVLELSLREALQL

SEQ ID NO: 618889 - protein, 18 aa, Mycobacterium
PGDQLVLGASNPVRDAAL

SEQ ID NO: 618890 - protein, 24 aa, Mycobacterium
PHHPHARIAFMLTDTTPTAVLTTT

SEQ ID NO: 618891 - protein, 18 aa, Mycobacterium
PHLCSRAFITEQYDRYVR

SEQ ID NO: 618892 - protein, 25 aa, Mycobacterium
PILNARFALNAANARWGSLYDALYG

SEQ ID NO: 618893 - protein, 28 aa, Mycobacterium
PILRWRKRKWLCPSTVCTRKVFTESVPG

SEQ ID NO: 618894 - protein, 19 aa, Mycobacterium
PKELVARVRARLRRNDDEP

SEQ ID NO: 618895 - protein, 19 aa, Mycobacterium
PKLRRAGLDYHDLASVTVH

SEQ ID NO: 618896 - protein, 22 aa, Mycobacterium
PLPTEKNVYCVIRSPHKYKDSR

SEQ ID NO: 618897 - protein, 23 aa, Mycobacterium
PNPKATVALLRRVEDVLDIEVPL

SEQ ID NO: 618898 - protein, 28 aa, Mycobacterium
PNVGGICIGCTMPGFPDKFMPFMDEPPG

SEQ ID NO: 618899 - protein, 22 aa, Mycobacterium
PPELETRIAILRKKAQMERLAV

SEQ ID NO: 618900 - protein, 19 aa, Mycobacterium
PPGCGKTFVVRALASTGQL

SEQ ID NO: 618901 - protein, 17 aa, Mycobacterium
PPSVKGILVTEGVRGDG

SEQ ID NO: 618902 - protein, 18 aa, Mycobacterium
PQVVKEVAPVPVLAAGGI

SEQ ID NO: 618903 - protein, 18 aa, Mycobacterium
PRECDAVLYTRAGPEIGV

SEQ ID NO: 618904 - protein, 21 aa, Mycobacterium
PRGVPQIEVTFDIDANGIVHV

SEQ ID NO: 618905 - protein, 20 aa, Mycobacterium
PRQASSLSLAKIRSALKAAG

SEQ ID NO: 618906 - protein, 21 aa, Mycobacterium
PRYAELIKRTQWWGRQMLIWG

SEQ ID NO: 618907 - protein, 25 aa, Mycobacterium
PTQKEIFIPGGRMFRDLTRLSAAGI

SEQ ID NO: 618908 - protein, 26 aa, Mycobacterium
PVWCSDIRAGAGLVLAGLVADGDTEV

SEQ ID NO: 618909 - protein, 19 aa, Mycobacterium
QAIGVAFGATVDRAPELLH

SEQ ID NO: 618910 - protein, 24 aa, Mycobacterium
QEIDLRFADALSMADNVMTFRYVI

SEQ ID NO: 618911 - protein, 26 aa, Mycobacterium
QINYLRCIGCGLCIEACPTRALTMTN

SEQ ID NO: 618912 - protein, 23 aa, Mycobacterium
QLARARALLLGRDYVIPEDVKAL

SEQ ID NO: 618913 - protein, 19 aa, Mycobacterium
QPTEFNDIVAVLALYRPGP

SEQ ID NO: 618914 - protein, 23 aa, Mycobacterium
QRQLEMRLNRQLADIEKLQVNVR

SEQ ID NO: 618915 - protein, 20 aa, Mycobacterium
QSGGFGCMLQMGHEWANPAA

SEQ ID NO: 618916 - protein, 24 aa, Mycobacterium
QTSGWSLTAQDVFNNVARTCIEAM

SEQ ID NO: 618917 - protein, 20 aa, Mycobacterium
QVGNFPGLWTEWNGKYRDTV

SEQ ID NO: 618918 - protein, 26 aa, Mycobacterium
QVNRKVLPGYILVRMDLTDDSWAAVR

SEQ ID NO: 618919 - protein, 17 aa, Mycobacterium
RACEALYHFAWDEFCDW

SEQ ID NO: 618920 - protein, 17 aa, Mycobacterium
RFGCGAGILAPHMSAAG

SEQ ID NO: 618921 - protein, 26 aa, Mycobacterium
RFTAYDCARLRFILTAQRDHYLPLKV

SEQ ID NO: 618922 - protein, 21 aa, Mycobacterium
RGNFASGYRGKLWTFRQYSGF

SEQ ID NO: 618923 - protein, 25 aa, Mycobacterium
RGSAKRITAVMPFYPYARQDKKHRG

SEQ ID NO: 618924 - protein, 20 aa, Mycobacterium
RGSGAVMVLAGPPGVGKTSL

SEQ ID NO: 618925 - protein, 19 aa, Mycobacterium
RIGAIEFATTIAPGLRDVL

SEQ ID NO: 618926 - protein, 17 aa, Mycobacterium
RILDRLYGYEVSPVLWK

SEQ ID NO: 618927 - protein, 18 aa, Mycobacterium
RIRAELNVEVPIRAVFNA

SEQ ID NO: 618928 - protein, 21 aa, Mycobacterium
RLGRRVTEIALVFKRAPHLPF

SEQ ID NO: 618929 - protein, 20 aa, Mycobacterium
RMGALALHVAKIARRRHPQH

SEQ ID NO: 618930 - protein, 18 aa, Mycobacterium
RMSKRAGTVITLDDLVEA

SEQ ID NO: 618931 - protein, 19 aa, Mycobacterium
RNNVVLSRRAWLEQTQSEV

SEQ ID NO: 618932 - protein, 20 aa, Mycobacterium
RPQVWDVLEEVIAEHPVLLN

SEQ ID NO: 618933 - protein, 19 aa, Mycobacterium
RPVPFIIGVAGSVAVGKST

SEQ ID NO: 618934 - protein, 18 aa, Mycobacterium
RRLTEVRKNGVLPYLRPD

SEQ ID NO: 618935 - protein, 20 aa, Mycobacterium
RRRRELLRRNNLDGTLQEIK

SEQ ID NO: 618936 - protein, 19 aa, Mycobacterium
RSLEHLVDVVLHFEGDRNG

SEQ ID NO: 618937 - protein, 21 aa, Mycobacterium
RSYVLHPYQMVKDLRTEYEVG

SEQ ID NO: 618938 - protein, 21 aa, Mycobacterium
RTYALLKRRGTQFVVVSAAEP

SEQ ID NO: 618939 - protein, 20 aa, Mycobacterium
RVCHARKPACGVCVLAKDCP

SEQ ID NO: 618940 - protein, 18 aa, Mycobacterium
RVGHSLDPKADYGPLVTE

SEQ ID NO: 618941 - protein, 17 aa, Mycobacterium
RVHPAPMETCGAVADLD

SEQ ID NO: 618942 - protein, 18 aa, Mycobacterium
RVRWACTRRSRRVTPSRH

SEQ ID NO: 618943 - protein, 21 aa, Mycobacterium
RVSFVGRSMVRNMGIARELGF

SEQ ID NO: 618944 - protein, 20 aa, Mycobacterium
RVSLAHALIGWTRGTGLMGH

SEQ ID NO: 618945 - protein, 24 aa, Mycobacterium
RVVVPDFQLSLAIGKEGQNARLAA

SEQ ID NO: 618946 - protein, 19 aa, Mycobacterium
RYAEALPLTVIGAAIPALE

SEQ ID NO: 618947 - protein, 20 aa, Mycobacterium
RYILPSFIEHSSFGVKESNP

SEQ ID NO: 618948 - protein, 19 aa, Mycobacterium
SAASSLRKAKKLRVRLPLP

SEQ ID NO: 618949 - protein, 21 aa, Mycobacterium
SALQNAASIAGLFLTTEAVVA

SEQ ID NO: 618950 - protein, 19 aa, Mycobacterium
SDTAEFGGYLSGPRVIDAG

SEQ ID NO: 618951 - protein, 25 aa, Mycobacterium
SEPLTEAIPLWKRPQDGAIITGWDY

SEQ ID NO: 618952 - protein, 19 aa, Mycobacterium
SFTLPRNGIVGVIGPNGVG

SEQ ID NO: 618953 - protein, 20 aa, Mycobacterium
SGSSDYLAGRAFSFISAIDS

SEQ ID NO: 618954 - protein, 30 aa, Mycobacterium
SHVPAHSQLAWVLGCFTGFGQASRMTQFKD

SEQ ID NO: 618955 - protein, 17 aa, Mycobacterium
SLQTTRMAFHAIKAGEG

SEQ ID NO: 618956 - protein, 17 aa, Mycobacterium
SLRLIADTIEFCAAEVP

SEQ ID NO: 618957 - protein, 23 aa, Mycobacterium
SNICTAQVLLAVMAAMYASYHGA

SEQ ID NO: 618958 - protein, 18 aa, Mycobacterium
SPSTYYEWMKRTPSKQQL

SEQ ID NO: 618959 - protein, 17 aa, Mycobacterium
SRWNAGKDLSFVPLRPE

SEQ ID NO: 618960 - protein, 24 aa, Mycobacterium
STNLPRVLGGLGVAIISTSSGLLT

SEQ ID NO: 618961 - protein, 25 aa, Mycobacterium
SVDRRPDLPSGKGLVIAEGVLVVQR

SEQ ID NO: 618962 - protein, 17 aa, Mycobacterium
SVFMVIHAALTVVLATL

SEQ ID NO: 618963 - protein, 19 aa, Mycobacterium
TDVDDWWEYGWVFHAMNTN

SEQ ID NO: 618964 - protein, 22 aa, Mycobacterium
TEFLPGSLIDRAEFEAENRRVV

SEQ ID NO: 618965 - protein, 25 aa, Mycobacterium
TEPEAFKWIQRAAMDRRTTMKRVAE

SEQ ID NO: 618966 - protein, 23 aa, Mycobacterium
TFSEAYKVAALDVMNKVRALNQF

SEQ ID NO: 618967 - protein, 28 aa, Mycobacterium
TGAMGVPDYLGWDWKSKAGIPIVCVPGC

SEQ ID NO: 618968 - protein, 21 aa, Mycobacterium
TGARGLRAIMEEVLLPVMYDI

SEQ ID NO: 618969 - protein, 19 aa, Mycobacterium
TGMELRAAIDAGDVVVADK

SEQ ID NO: 618970 - protein, 18 aa, Mycobacterium
TGTGGIQGAGGQGGTGGT

SEQ ID NO: 618971 - protein, 22 aa, Mycobacterium
TGWDYPSCEAIGLLKMDFLGLR

SEQ ID NO: 618972 - protein, 24 aa, Mycobacterium
TGYVMPHWPKPWGRAADAVEQLVI

SEQ ID NO: 618973 - protein, 17 aa, Mycobacterium
TIIPDFIGHTFAVHDGR

SEQ ID NO: 618974 - protein, 18 aa, Mycobacterium
TVAALGCSVLMEIGPQPV

SEQ ID NO: 618975 - protein, 30 aa, Mycobacterium
TVDAVTFDLRWKAACGLPITAGAFHSTTLT

SEQ ID NO: 618976 - protein, 18 aa, Mycobacterium
TVIDVLRGKLEFESGEEG

SEQ ID NO: 618977 - protein, 24 aa, Mycobacterium
TVITRKAYGGAYCVMGSKDMGCDV

SEQ ID NO: 618978 - protein, 19 aa, Mycobacterium
TVNVCKYNLGWGAVGMCTH

SEQ ID NO: 618979 - protein, 27 aa, Mycobacterium
TVRSYNCLKREGVHTVGELVSRTESDL

SEQ ID NO: 618980 - protein, 19 aa, Mycobacterium
TWDLLRLTRMPTVQVDIGY

SEQ ID NO: 618981 - protein, 21 aa, Mycobacterium
TYCPTWAGMVYVAFVIDAFAR

SEQ ID NO: 618982 - protein, 26 aa, Mycobacterium
VAALQRSDLLIALGTRFDDRVTGKLD

SEQ ID NO: 618983 - protein, 26 aa, Mycobacterium
VAIFRARPSPFYIMDEVEAALDDTNL

SEQ ID NO: 618984 - protein, 28 aa, Mycobacterium
VDDPLAMYLFDLCTLPLNLAGHCGMSVP

SEQ ID NO: 618985 - protein, 24 aa, Mycobacterium
VDLDLPRDALIVFTGLSGSGKSSL

SEQ ID NO: 618986 - protein, 25 aa, Mycobacterium
VESFGFKYGLPMDADMVMDVRFLPN

SEQ ID NO: 618987 - protein, 24 aa, Mycobacterium
VGERLPEYMVPAAVMVVEGLPLTA

SEQ ID NO: 618988 - protein, 19 aa, Mycobacterium
VGGTWHWNTYPGIAVDIPS

SEQ ID NO: 618989 - protein, 20 aa, Mycobacterium
VGILHGCLRHRTRYDEHKAW

SEQ ID NO: 618990 - protein, 29 aa, Mycobacterium
VGLTAQRFVACPFGPAGSRMYRSGDLVRW

SEQ ID NO: 618991 - protein, 19 aa, Mycobacterium
VGVLPTPAVAYLTGAYDAD

SEQ ID NO: 618992 - protein, 31 aa, Mycobacterium
VGVSRPTVIKWRDRFAAFGIEGLDDEPRSGR

SEQ ID NO: 618993 - protein, 25 aa, Mycobacterium
VHKKGSALVPSWVAFAVTGLLEQHF

SEQ ID NO: 618994 - protein, 17 aa, Mycobacterium
VHRADLIGQHIGETEAK

SEQ ID NO: 618995 - protein, 31 aa, Mycobacterium; identical to SEQ ID NO: 85697

SEQ ID NO: 618996 - protein, 20 aa, Mycobacterium
VIVRQMLRRVTIIDSGSTEF

SEQ ID NO: 618997 - protein, 17 aa, Mycobacterium
VKSALDLGVPVTGIAEA

SEQ ID NO: 618998 - protein, 17 aa, Mycobacterium
VKYHLGATGVYLQMFGD

SEQ ID NO: 618999 - protein, 23 aa, Mycobacterium
VLAERIGALLLEVNRRFGTPVPP

SEQ ID NO: 619000 - protein, 25 aa, Mycobacterium
VNPTGKFVLGGPMGDAGLTGRKIIV

SEQ ID NO: 619001 - protein, 28 aa, Mycobacterium
VRQLRLRDIGGIVVIDFIDMVLESNRDL

SEQ ID NO: 619002 - protein, 18 aa, Mycobacterium
VRSVLTCTTGTGVCATCY

SEQ ID NO: 619003 - protein, 18 aa, Mycobacterium
VRWIETQDLLFIEEAAGG

SEQ ID NO: 619004 - protein, 20 aa, Mycobacterium
VSAKGEFLGGAIAPGVQVSS

SEQ ID NO: 619005 - protein, 20 aa, Mycobacterium
VSLGKRKGKIVVEFGSVDDL

SEQ ID NO: 619006 - protein, 23 aa, Mycobacterium
VYARKIVGWKVATEMTQKLVTDA

SEQ ID NO: 619007 - protein, 17 aa, Mycobacterium
WCRQVLDLLDQVRNAAP

SEQ ID NO: 619008 - protein, 25 aa, Mycobacterium
WDDTPEGFGRIAATTARQVMLQRFR

SEQ ID NO: 619009 - protein, 20 aa, Mycobacterium
WEFLDRLTSIALPRIRDFRG

SEQ ID NO: 619010 - protein, 19 aa, Mycobacterium
WELEDLSFAILHPKKYEEI

SEQ ID NO: 619011 - protein, 20 aa, Mycobacterium
WLGLLDPDIRYVVPVRTTRE

SEQ ID NO: 619012 - protein, 21 aa, Mycobacterium
WLIERLQRPTLVMAPNKTLAA

SEQ ID NO: 619013 - protein, 20 aa, Mycobacterium
WLNLVEVFFSIITRQAIRRG

SEQ ID NO: 619014 - protein, 17 aa, Mycobacterium
WQHGVFIGATLGSEQTA

SEQ ID NO: 619015 - protein, 17 aa, Mycobacterium
WTCMIPRQVAEELGQPL

SEQ ID NO: 619016 - protein, 23 aa, Mycobacterium
WTSLAHWAQWCFVVARTEKGSKR

SEQ ID NO: 619017 - protein, 18 aa, Mycobacterium
YARHTGGTFVFRIEDTDA

SEQ ID NO: 619018 - protein, 25 aa, Mycobacterium
YFGDLRTGMMGVWIGAIQNMYPELG

SEQ ID NO: 619019 - protein, 17 aa, Mycobacterium
YIEIWNLVFMQNERGEG

SEQ ID NO: 619020 - protein, 19 aa, Mycobacterium
YRGKLWTFRQYSGFGTAEE

SEQ ID NO: 619021 - protein, 18 aa, Mycobacterium
YRSLPGLGVILGARVLGE

SEQ ID NO: 619022 - protein, 24 aa, Mycobacterium
YVINPRMVRGLDYYTKTTFEFVHD

SEQ ID NO: 619023 - protein, 19 aa, Mycobacterium
YVNQPWTIRQYAGFSTAAE

SEQ ID NO: 619024 - protein, 18 aa, Mycobacterium
YVPCEVCQGARYNRETLE

SEQ ID NO: 619025 - protein, 18 aa, Mycobacterium
AAALALGAQGAWTGSQWL

SEQ ID NO: 619026 - protein, 22 aa, Mycobacterium
AAELSLATAEWVAFYNRQRPNG

SEQ ID NO: 619027 - protein, 25 aa, Mycobacterium
AAGHPFAATGGRIVAQLAKQLAEKK

SEQ ID NO: 619028 - protein, 19 aa, Mycobacterium
AALAQALPAYMVPAAVVVV

SEQ ID NO: 619029 - protein, 24 aa, Mycobacterium
AARPDLLAFTAFPKQIWRQIWSNN

SEQ ID NO: 619030 - protein, 23 aa, Mycobacterium
AATMKRLFLELGGKSATIVLEDA

SEQ ID NO: 619031 - protein, 24 aa, Mycobacterium
AAVNGFCVGGGIGLVGNSDVIVAS

SEQ ID NO: 619032 - protein, 23 aa, Mycobacterium
ADAGRFLTTIKHRLEEGAFEADL

SEQ ID NO: 619033 - protein, 17 aa, Mycobacterium
ADALLVRSATTVDAEVL

SEQ ID NO: 619034 - protein, 24 aa, Mycobacterium
ADDPRRRLAAAMAKASAGECQSLV

SEQ ID NO: 619035 - protein, 19 aa, Mycobacterium
ADLHMIGKDIIRFHTVYWP

SEQ ID NO: 619036 - protein, 21 aa, Mycobacterium
ADLQSRRRLGLTATLIREDGR

SEQ ID NO: 619037 - protein, 18 aa, Mycobacterium
ADMIRLIIRDEAVHGYYI

SEQ ID NO: 619038 - protein, 19 aa, Mycobacterium
ADTIEFCAAEVPKFNAISV

SEQ ID NO: 619039 - protein, 22 aa, Mycobacterium
ADVEASGLWPGKVVTEVSPAGD

SEQ ID NO: 619040 - protein, 18 aa, Mycobacterium
AEGLPYRSVLGLADLGLG

SEQ ID NO: 619041 - protein, 17 aa, Mycobacterium
AEGYAAAAVLAMPDQHL

SEQ ID NO: 619042 - protein, 18 aa, Mycobacterium
AEHLHVHVVPRWGGDANF

SEQ ID NO: 619043 - protein, 23 aa, Mycobacterium
AELRRRVKAMSYGLAYGLSAYGL

SEQ ID NO: 619044 - protein, 26 aa, Mycobacterium
AELVARVKALLRRRGATATSSSETIT

SEQ ID NO: 619045 - protein, 21 aa, Mycobacterium
AELYDGFTMNCLSWIEALGFC

SEQ ID NO: 619046 - protein, 18 aa, Mycobacterium
AEMLRRNGIPCDEVRKHF

SEQ ID NO: 619047 - protein, 24 aa, Mycobacterium
AEVKKAAAEHGLWYPPDPSSFEIC

SEQ ID NO: 619048 - protein, 24 aa, Mycobacterium
AEVLGNWTGIPVFKLTEEETTRLL

SEQ ID NO: 619049 - protein, 25 aa, Mycobacterium
AFEPQRAGVWLARRPGLARLINLYG

SEQ ID NO: 619050 - protein, 19 aa, Mycobacterium
AFYFACPATVLGPYDDAPT

SEQ ID NO: 619051 - protein, 19 aa, Mycobacterium
AFYGPQFALTFPVLTHYGV

SEQ ID NO: 619052 - protein, 24 aa, Mycobacterium
AGASFLRRDGSVWTTDKDGIILAL

SEQ ID NO: 619053 - protein, 18 aa, Mycobacterium
AGEIDVLVCTTVIEVGVD

SEQ ID NO: 619054 - protein, 26 aa, Mycobacterium
AGGGGRGMRVVRELSALPAEVEAARR

SEQ ID NO: 619055 - protein, 18 aa, Mycobacterium
AGIALSIMGTGLAAAALA

SEQ ID NO: 619056 - protein, 17 aa, Mycobacterium
AGILPGSLYHHFESKEA

SEQ ID NO: 619057 - protein, 17 aa, Mycobacterium
AGMRVDAGLARLLGLSR

SEQ ID NO: 619058 - protein, 17 aa, Mycobacterium
AGNIADVATVLFSNNNT

SEQ ID NO: 619059 - protein, 17 aa, Mycobacterium
AGPEAIVAVALPRSARL

SEQ ID NO: 619060 - protein, 25 aa, Mycobacterium
AGPEPRYTPSTALADFIRCRDLTCR

SEQ ID NO: 619061 - protein, 21 aa, Mycobacterium
AGRDFTVDWVHLKLNDQAQRT

SEQ ID NO: 619062 - protein, 18 aa, Mycobacterium
AGRGDRGLDELVGMFVNT

SEQ ID NO: 619063 - protein, 18 aa, Mycobacterium
AHLRPELGGQGFGQVKLA

SEQ ID NO: 619064 - protein, 19 aa, Mycobacterium
AHVDLYFEAAVAGAIPVIR

SEQ ID NO: 619065 - protein, 18 aa, Mycobacterium
AIEAHLDRGRGPVATVLI

SEQ ID NO: 619066 - protein, 17 aa, Mycobacterium
AIIARELGIPAVVGAGD

SEQ ID NO: 619067 - protein, 26 aa, Mycobacterium
AIPKLRQGSYFPDWLLERRKRAERAL

SEQ ID NO: 619068 - protein, 18 aa, Mycobacterium
AIVHKLRRVLSGLDSHQA

SEQ ID NO: 619069 - protein, 19 aa, Mycobacterium
AKADARRKVRDGGEREMRQ

SEQ ID NO: 619070 - protein, 18 aa, Mycobacterium
AKLLHAFGECTVPRVTLV

SEQ ID NO: 619071 - protein, 24 aa, Mycobacterium
AKRLVDFAAGLAFALRGSFDKVAT

SEQ ID NO: 619072 - protein, 22 aa, Mycobacterium
AKRTLAVAVYNHYKRIQAGEKS

SEQ ID NO: 619073 - protein, 19 aa, Mycobacterium
AKTAFLTNVSHEFRTPLTL

SEQ ID NO: 619074 - protein, 21 aa, Mycobacterium
AKTIKGYSLGAHFQGRNATHQ

SEQ ID NO: 619075 - protein, 18 aa, Mycobacterium
ALAADWRVSGDNVKFGAT

SEQ ID NO: 619076 - protein, 19 aa, Mycobacterium
ALAAVEAFFGAGAQRQLDV

SEQ ID NO: 619077 - protein, 18 aa, Mycobacterium
ALARAGFHTLKLQTYLTA

SEQ ID NO: 619078 - protein, 27 aa, Mycobacterium
ALELDWYEHLGLCPKGEAEALLRSGAT

SEQ ID NO: 619079 - protein, 18 aa, Mycobacterium
ALERAGVVTGVITQNVDL

SEQ ID NO: 619080 - protein, 29 aa, Mycobacterium
ALEVKEGPAALPWGDLGVDVVVESTGIFT

SEQ ID NO: 619081 - protein, 23 aa, Mycobacterium
ALGNLPLIYPFLVNDPGEGTQAK

SEQ ID NO: 619082 - protein, 25 aa, Mycobacterium
ALINRYATVCGMTGTALAAGEQLRQ

SEQ ID NO: 619083 - protein, 32 aa, Mycobacterium; identical to SEQ ID NO: 196639

SEQ ID NO: 619084 - protein, 25 aa, Mycobacterium
ALPEEFRMAVYYADVEGFPYKEIAE

SEQ ID NO: 619085 - protein, 23 aa, Mycobacterium
ALPEIGHACGHNIIAASAVGTAL

SEQ ID NO: 619086 - protein, 18 aa, Mycobacterium
ALTAPAPHHTRPVRFVWL

SEQ ID NO: 619087 - protein, 28 aa, Mycobacterium
ALYMDRYPLVSAISRPLIVKHLVAAARE

SEQ ID NO: 619088 - protein, 18 aa, Mycobacterium
AMEKFDYTKGFKFSTYAT

SEQ ID NO: 619089 - protein, 20 aa, Mycobacterium
APTHIAAAFDVSRQTFRSER

SEQ ID NO: 619090 - protein, 22 aa, Mycobacterium
AQGYSRVRVDGVVHPLTDPPKL

SEQ ID NO: 619091 - protein, 25 aa, Mycobacterium
AQMGKDGWLTLNWPKEYGGQDRSPM

SEQ ID NO: 619092 - protein, 19 aa, Mycobacterium
AQNGRYGPYLKRGTDSRSL

SEQ ID NO: 619093 - protein, 24 aa, Mycobacterium
ARDLPCHTGIRLLGGSSHALGRVN

SEQ ID NO: 619094 - protein, 26 aa, Mycobacterium
ARFVRLCDAFGIPLVVVVDVPGYLPG

SEQ ID NO: 619095 - protein, 20 aa, Mycobacterium
ARKKPPFGIGQIGKSFRNEI

SEQ ID NO: 619096 - protein, 18 aa, Mycobacterium
ARPTGSVRHVEVFQMDGV

SEQ ID NO: 619097 - protein, 19 aa, Mycobacterium
ARRTLRAGFTTVRNLGLFV

SEQ ID NO: 619098 - protein, 21 aa, Mycobacterium
ARVLQALLARWDHHPRVDLVT

SEQ ID NO: 619099 - protein, 27 aa, Mycobacterium
ARVLRPGGRLGLVWNTRDERLGWVREL

SEQ ID NO: 619100 - protein, 26 aa, Mycobacterium
ARVVAKIYCGLGLLKRENIREVHRAD

SEQ ID NO: 619101 - protein, 18 aa, Mycobacterium
ASIAGLFLTTEAVVADKP

SEQ ID NO: 619102 - protein, 25 aa, Mycobacterium
ASKNPKEHFDFFPLTVDVEERMYAA

SEQ ID NO: 619103 - protein, 19 aa, Mycobacterium
ASKVARTTLYRHFSSSTQL

SEQ ID NO: 619104 - protein, 17 aa, Mycobacterium
ASSFGVENIAAVATSYG

SEQ ID NO: 619105 - protein, 22 aa, Mycobacterium
ATELALGTAEWVAFYNRQRPNG

SEQ ID NO: 619106 - protein, 27 aa, Mycobacterium
ATETRIARVFLDYCIDLHLAGQLDVQT

SEQ ID NO: 619107 - protein, 17 aa, Mycobacterium
ATFCQPQVASFGLTEEQ

SEQ ID NO: 619108 - protein, 23 aa, Mycobacterium
ATPIPRTVALTVYGDLETSTLRE

SEQ ID NO: 619109 - protein, 18 aa, Mycobacterium
AVAGRPKEEYGIEPTGLD

SEQ ID NO: 619110 - protein, 18 aa, Mycobacterium
AVDIRYASADAKFSVREV

SEQ ID NO: 619111 - protein, 19 aa, Mycobacterium
AVEAGERLGFLPGTLSEKI

SEQ ID NO: 619112 - protein, 25 aa, Mycobacterium
AVGVARAAYEYALDYACQREQFGRK

SEQ ID NO: 619113 - protein, 22 aa, Mycobacterium
AVLDRNGLRPSRIWVTEDGLVV

SEQ ID NO: 619114 - protein, 22 aa, Mycobacterium
AVLKSGAAYLAIDVNHPDGRIG

SEQ ID NO: 619115 - protein, 27 aa, Mycobacterium
AVNELSCYRYEVVLRKGPVGVRSLAGL

SEQ ID NO: 619116 - protein, 19 aa, Mycobacterium
AVQTRVWRGRPDPVRDARA

SEQ ID NO: 619117 - protein, 19 aa, Mycobacterium
AWSGSRFAQRPVLPEDIHR

SEQ ID NO: 619118 - protein, 19 aa, Mycobacterium
AYAARAGITCAVLIPQGKI

SEQ ID NO: 619119 - protein, 18 aa, Mycobacterium
AYVTWDYCRGYADASLNE

SEQ ID NO: 619120 - protein, 19 aa, Mycobacterium
CAAEVPRFNAISVAGAHFR

SEQ ID NO: 619121 - protein, 20 aa, Mycobacterium
CAQDLLWGPAMRNYPDLKFA

SEQ ID NO: 619122 - protein, 18 aa, Mycobacterium
CAVLSEFGVVIAPSTYYA

SEQ ID NO: 619123 - protein, 24 aa, Mycobacterium
CDCGPQLDAAMAMVAREGRGVVLY

SEQ ID NO: 619124 - protein, 27 aa, Mycobacterium
CEALYHFAWDEFCDWYVELAKTQLAEG

SEQ ID NO: 619125 - protein, 25 aa, Mycobacterium
CGYWRRSGLTASRFVACPFGALGAR

SEQ ID NO: 619126 - protein, 23 aa, Mycobacterium
CPECRRGEYRRCAVNGIATMFGF

SEQ ID NO: 619127 - protein, 19 aa, Mycobacterium
CYQFGDAKPVYALEGSIAV

SEQ ID NO: 619128 - protein, 25 aa, Mycobacterium
DAAAVQIMTVWVSKGLQFPVVYLPF

SEQ ID NO: 619129 - protein, 22 aa, Mycobacterium
DADRYRRLHVIIGDANLAETST

SEQ ID NO: 619130 - protein, 28 aa, Mycobacterium
DAELRIAQAQLVGWLEGLFHGIQTALFA

SEQ ID NO: 619131 - protein, 26 aa, Mycobacterium
DAIARFKRLDGFDVRFLTGTDEHGLK

SEQ ID NO: 619132 - protein, 18 aa, Mycobacterium
DAKEWLAFGPEVLGMEAV

SEQ ID NO: 619133 - protein, 31 aa, Mycobacterium; identical to SEQ ID NO: 87302

SEQ ID NO: 619134 - protein, 26 aa, Mycobacterium
DAKRLVDFAAGLAFALRGSFDKVATK

SEQ ID NO: 619135 - protein, 22 aa, Mycobacterium
DATQIHGGYGFMNEYPVARHYR

SEQ ID NO: 619136 - protein, 18 aa, Mycobacterium
DAVTRLVGLTGITFTNVF

SEQ ID NO: 619137 - protein, 23 aa, Mycobacterium
DCTEIDEILTLRVMTMTDEEKAQ

SEQ ID NO: 619138 - protein, 19 aa, Mycobacterium
DDIDPAWLEGVTTVGVTSG

SEQ ID NO: 619139 - protein, 26 aa, Mycobacterium
DEGVMLASRRSWWRIAAAIEDQSARP

SEQ ID NO: 619140 - protein, 17 aa, Mycobacterium
DELGRILGVKGRVLPMC

SEQ ID NO: 619141 - protein, 23 aa, Mycobacterium
DELPLPRPKYEIFVYSPRVEGVH

SEQ ID NO: 619142 - protein, 23 aa, Mycobacterium
DGADIGARCELLRGARVWPGVSI

SEQ ID NO: 619143 - protein, 22 aa, Mycobacterium
DGPDLVLRWAALLHDIGKPATR

SEQ ID NO: 619144 - protein, 17 aa, Mycobacterium
DGQKRLKNARVLVIGAG

SEQ ID NO: 619145 - protein, 18 aa, Mycobacterium
DGQVGFGALNSGTGNIGL

SEQ ID NO: 619146 - protein, 22 aa, Mycobacterium
DISKLRYHKIVLMADADVDGQH

SEQ ID NO: 619147 - protein, 20 aa, Mycobacterium
DITCPVLAFVGEVDDIGQPA

SEQ ID NO: 619148 - protein, 17 aa, Mycobacterium
DLAVTFRFGEEVTAVDV

SEQ ID NO: 619149 - protein, 19 aa, Mycobacterium
DLLWSRPIKEYPDLKIALS

SEQ ID NO: 619150 - protein, 24 aa, Mycobacterium
DLVEAIGVDAARYSLIRSSVDTPI

SEQ ID NO: 619151 - protein, 26 aa, Mycobacterium
DMSRKRNLVDFGFRLPSAVDNRPLTW

SEQ ID NO: 619152 - protein, 24 aa, Mycobacterium
DMVVTHLFQVMAFVVMEPPTALEP

SEQ ID NO: 619153 - protein, 25 aa, Mycobacterium
DPPFEGMWWLYVPMAFDDFAIVLII

SEQ ID NO: 619154 - protein, 18 aa, Mycobacterium
DPQGCLTFSLGQDPDKLP

SEQ ID NO: 619155 - protein, 24 aa, Mycobacterium
DPRMKANVGIRRRLAPLLDNDRNQ

SEQ ID NO: 619156 - protein, 23 aa, Mycobacterium
DQEKLCLLVMLGVRADGRKELVA

SEQ ID NO: 619157 - protein, 17 aa, Mycobacterium
DQLAAWAGLAPVSRDSG

SEQ ID NO: 619158 - protein, 26 aa, Mycobacterium
DQLMKAALPFGLWVPVLPGTRQVTVG

SEQ ID NO: 619159 - protein, 25 aa, Mycobacterium
DQWWVADFTYTWTLAGFVYTAFCVD

SEQ ID NO: 619160 - protein, 19 aa, Mycobacterium
DRAALPYVVGTIAGDDTVF

SEQ ID NO: 619161 - protein, 29 aa, Mycobacterium
DRGALPVKLCYAGPFFRYERPQAGRYRQL

SEQ ID NO: 619162 - protein, 19 aa, Mycobacterium
DRKVAFKRSYRDVDVLLVD

SEQ ID NO: 619163 - protein, 23 aa, Mycobacterium
DRPAFKTCVAHGIVLGSDGQKMS

SEQ ID NO: 619164 - protein, 17 aa, Mycobacterium
DSLRLARREVLLDHSTL

SEQ ID NO: 619165 - protein, 22 aa, Mycobacterium
DSSGNPYLAFSAMLMAGLDGIK

SEQ ID NO: 619166 - protein, 36 aa, Mycobacterium; identical to SEQ ID NO: 79016

SEQ ID NO: 619167 - protein, 18 aa, Mycobacterium
DVDTPWRKLPAKARKAIL

SEQ ID NO: 619168 - protein, 18 aa, Mycobacterium
DVNTGAFISGDYSNGAFW

SEQ ID NO: 619169 - protein, 18 aa, Mycobacterium
DVPLRVAVMGCVVNGPGE

SEQ ID NO: 619170 - protein, 19 aa, Mycobacterium
DVVGLLLERSVEAVIAILA

SEQ ID NO: 619171 - protein, 20 aa, Mycobacterium
EAAGRLMFYGQGAGGAPTAS

SEQ ID NO: 619172 - protein, 18 aa, Mycobacterium
EACPAELVDQWAPGRTLI

SEQ ID NO: 619173 - protein, 22 aa, Mycobacterium
EADGRRPRILVAKMGQDGHDRG

SEQ ID NO: 619174 - protein, 22 aa, Mycobacterium
EALGKIYAGMGIVRHPEIREVR

SEQ ID NO: 619175 - protein, 20 aa, Mycobacterium
EAVLRRYRMPLLRDLDQASG

SEQ ID NO: 619176 - protein, 23 aa, Mycobacterium
EDSRGRTSLVITELPYQVNHDNF

SEQ ID NO: 619177 - protein, 19 aa, Mycobacterium
EDVRARIGVLSQVPSLWAE

SEQ ID NO: 619178 - protein, 17 aa, Mycobacterium
EFIPRPVKSSFREGLTV

SEQ ID NO: 619179 - protein, 18 aa, Mycobacterium
EFTEAWTTFATVEKSWAY

SEQ ID NO: 619180 - protein, 21 aa, Mycobacterium
EGLPAGSALLVVKRGPNAGSR

SEQ ID NO: 619181 - protein, 20 aa, Mycobacterium
EGQLGKWSRMDAEIIAEHAE

SEQ ID NO: 619182 - protein, 19 aa, Mycobacterium
EGVDVPRLSVGIYATSAST

SEQ ID NO: 619183 - protein, 20 aa, Mycobacterium
EGVKSEFPDQMLAYNCSPSF

SEQ ID NO: 619184 - protein, 25 aa, Mycobacterium
EHTRRVPGYHILKAHMSSSIKRSQP

SEQ ID NO: 619185 - protein, 26 aa, Mycobacterium
EHYEKLEGVPLTFAGKVNRLAIMVRG

SEQ ID NO: 619186 - protein, 18 aa, Mycobacterium
EIRKEGKIGRVYYPAPYM

SEQ ID NO: 619187 - protein, 29 aa, Mycobacterium
EKHDLAFGTSRWSSKLVHGGLRYLATGNV

SEQ ID NO: 619188 - protein, 17 aa, Mycobacterium
EKLEAFANFGFPESHAL

SEQ ID NO: 619189 - protein, 18 aa, Mycobacterium
EKLLELLPNRVITDSIGS

SEQ ID NO: 619190 - protein, 26 aa, Mycobacterium
ELKLDRKIAERRVFPAVDVNPSGTRK

SEQ ID NO: 619191 - protein, 24 aa, Mycobacterium
ELLAHCYRMTGSLHDAEDLVQETL

SEQ ID NO: 619192 - protein, 19 aa, Mycobacterium
ELLPELTLAQKWDLTATEL

SEQ ID NO: 619193 - protein, 21 aa, Mycobacterium
ELRIGLATAEDIRQWSYGEVK

SEQ ID NO: 619194 - protein, 18 aa, Mycobacterium
ELVYAVLNLYPYNPGHLM

SEQ ID NO: 619195 - protein, 23 aa, Mycobacterium
EMRVLRGETDFSWAESPRSRTRH

SEQ ID NO: 619196 - protein, 18 aa, Mycobacterium
ENIREVHRADLIGQHIGE

SEQ ID NO: 619197 - protein, 30 aa, Mycobacterium; identical to SEQ ID NO: 198681

SEQ ID NO: 619198 - protein, 24 aa, Mycobacterium
EPLRLLFKDEVRAVGRELGLPEEI

SEQ ID NO: 619199 - protein, 24 aa, Mycobacterium
EQIYEMYRLLAIAKYEERYVIPTA

SEQ ID NO: 619200 - protein, 29 aa, Mycobacterium
EQVKIRGYRIECGEVAAALAALDGVDQAV

SEQ ID NO: 619201 - protein, 28 aa, Mycobacterium
EQVKIRGYRIECGEVTAALTTLDGVDQA

SEQ ID NO: 619202 - protein, 25 aa, Mycobacterium
ERKRFSSAILPAWARKSPQMSEVLP

SEQ ID NO: 619203 - protein, 27 aa, Mycobacterium
ERLTRAWTGLRAMRSYALATMDVEQPG

SEQ ID NO: 619204 - protein, 25 aa, Mycobacterium
ERPFPLDLVPRVISAAEWSRLERGI

SEQ ID NO: 619205 - protein, 19 aa, Mycobacterium
ERRKEICGRAYRILTEEVG

SEQ ID NO: 619206 - protein, 17 aa, Mycobacterium
ERVALALLTYVEERTDG

SEQ ID NO: 619207 - protein, 18 aa, Mycobacterium
ERVGKRGLGFGAEVRSKA

SEQ ID NO: 619208 - protein, 18 aa, Mycobacterium
ERYFRDAPLMIVGEGTNE

SEQ ID NO: 619209 - protein, 17 aa, Mycobacterium
ESAYDRYYGDPTNKPNP

SEQ ID NO: 619210 - protein, 19 aa, Mycobacterium
ESIADRLAEAFAERMHQRV

SEQ ID NO: 619211 - protein, 25 aa, Mycobacterium
ESTHTKAAYLLHAWQPHLTGPTTTH

SEQ ID NO: 619212 - protein, 20 aa, Mycobacterium
ETFADLELAWGPTWSGSLKS

SEQ ID NO: 619213 - protein, 17 aa, Mycobacterium
ETLRLHPPLIILMRVAK

SEQ ID NO: 619214 - protein, 25 aa, Mycobacterium
ETMVKAYAGFRSFREGTNLKAWLYR

SEQ ID NO: 619215 - protein, 20 aa, Mycobacterium
ETPACFEPTLDYVVVKAPRF

SEQ ID NO: 619216 - protein, 20 aa, Mycobacterium
ETREIWSYGSGYGGNALLGK

SEQ ID NO: 619217 - protein, 19 aa, Mycobacterium
EVIGPKGKMINSITEETGA

SEQ ID NO: 619218 - protein, 18 aa, Mycobacterium
EVKRRDRALLSKDATIRE

SEQ ID NO: 619219 - protein, 19 aa, Mycobacterium
EVLDALQELTRLAVHQKTG

SEQ ID NO: 619220 - protein, 19 aa, Mycobacterium
EVLETEYLKRPLIDGPAPE

SEQ ID NO: 619221 - protein, 24 aa, Mycobacterium
EVPSRAYVSAFGFKGPDQQKPAGV

SEQ ID NO: 619222 - protein, 22 aa, Mycobacterium
EVRGAEVVDLLAALNTGHDGGA

SEQ ID NO: 619223 - protein, 21 aa, Mycobacterium
EVTGVPILFASTGEKLEDFDV

SEQ ID NO: 619224 - protein, 24 aa, Mycobacterium
EVVRSPRELWQLVVDKRITVLSQT

SEQ ID NO: 619225 - protein, 23 aa, Mycobacterium
EWAESRRYLGLDVLSKSRTVNDT

SEQ ID NO: 619226 - protein, 24 aa, Mycobacterium
EYAEVQPLKGARISGSLHMTVQTA

SEQ ID NO: 619227 - protein, 19 aa, Mycobacterium
EYDRAIGYEAAYAGTSFAT

SEQ ID NO: 619228 - protein, 19 aa, Mycobacterium
FADDARVLLVFGGSQGAVS

SEQ ID NO: 619229 - protein, 18 aa, Mycobacterium
FAGSWGYQVTSYYAPTSR

SEQ ID NO: 619230 - protein, 21 aa, Mycobacterium
FAIELGRLGGLGVLNGEGLIG

SEQ ID NO: 619231 - protein, 17 aa, Mycobacterium
FASEVAMEIALNAVRIH

SEQ ID NO: 619232 - protein, 17 aa, Mycobacterium
FDAVCFTSSSTVRNLVG

SEQ ID NO: 619233 - protein, 24 aa, Mycobacterium
FDPTRAMPAYNWMTVAKSALESVN

SEQ ID NO: 619234 - protein, 17 aa, Mycobacterium
FENAIAVVMAFGGSTNA

SEQ ID NO: 619235 - protein, 17 aa, Mycobacterium
FEVLRAIVADFVATKEP

SEQ ID NO: 619236 - protein, 22 aa, Mycobacterium
FEVNEAFAPVPLAWLAETGADP

SEQ ID NO: 619237 - protein, 18 aa, Mycobacterium
FFSALPQYLPDIAAVDIQ

SEQ ID NO: 619238 - protein, 17 aa, Mycobacterium
FFVKALHSIGAPLEPGQ

SEQ ID NO: 619239 - protein, 18 aa, Mycobacterium
FGAYPAVIARELDRYLPF

SEQ ID NO: 619240 - protein, 31 aa, Mycobacterium; identical to SEQ ID NO: 199120

SEQ ID NO: 619241 - protein, 31 aa, Mycobacterium; identical to SEQ ID NO: 79705

SEQ ID NO: 619242 - protein, 22 aa, Mycobacterium
FGLEVPGNIYTRIGNPTTDVVE

SEQ ID NO: 619243 - protein, 25 aa, Mycobacterium
FGLIPEFIGRLPVVASVTNLDKESL

SEQ ID NO: 619244 - protein, 19 aa, Mycobacterium
FGPEVKRRIMIGTYALSAG

SEQ ID NO: 619245 - protein, 25 aa, Mycobacterium
FGPVARGGLRWSDRRDDFRTEILGL

SEQ ID NO: 619246 - protein, 26 aa, Mycobacterium
FGTTQRFGVPMGFGGPHAGYLSVHAK

SEQ ID NO: 619247 - protein, 21 aa, Mycobacterium
FKHVAEMFAELEATALRSYPR

SEQ ID NO: 619248 - protein, 18 aa, Mycobacterium
FLKRVRKVVDDEFPGRVL

SEQ ID NO: 619249 - protein, 17 aa, Mycobacterium
FLLQGGDCAETFTDNTE

SEQ ID NO: 619250 - protein, 18 aa, Mycobacterium
FLLQRPLLTAIRRTEPTV

SEQ ID NO: 619251 - protein, 25 aa, Mycobacterium
FLPELGLRRENIVFISGIGCSSRFP

SEQ ID NO: 619252 - protein, 20 aa, Mycobacterium
FLRWGQGAFDDFKVVPPGTG

SEQ ID NO: 619253 - protein, 18 aa, Mycobacterium
FMEVCGGHTHTIYRHGIE

SEQ ID NO: 619254 - protein, 27 aa, Mycobacterium
FMSSTARLKCPFTSLGVAPEAASSYLL

SEQ ID NO: 619255 - protein, 18 aa, Mycobacterium
FNAEKGFGFIAPEDGSAD

SEQ ID NO: 619256 - protein, 17 aa, Mycobacterium
FPKQIWRQIWSNNPQER

SEQ ID NO: 619257 - protein, 21 aa, Mycobacterium
FQMMGLCQILRDGVIPPNRSL

SEQ ID NO: 619258 - protein, 20 aa, Mycobacterium
FQNTCRWRDLRKITIAQVQG

SEQ ID NO: 619259 - protein, 30 aa, Mycobacterium
FRPKVWPPVRRIDGAYGDRNLVCSCPPVEA

SEQ ID NO: 619260 - protein, 21 aa, Mycobacterium
FSAGGPVLWPDLEAILVVPNN

SEQ ID NO: 619261 - protein, 24 aa, Mycobacterium
FSEPCTDCRGSGSIIEHPCDECKG

SEQ ID NO: 619262 - protein, 18 aa, Mycobacterium
FSRQLKLLAKELEVPVVA

SEQ ID NO: 619263 - protein, 18 aa, Mycobacterium
FTEHLPATFVYAGIDVER

SEQ ID NO: 619264 - protein, 20 aa, Mycobacterium
FTSSKVMCWVALDRGAKLAE

SEQ ID NO: 619265 - protein, 17 aa, Mycobacterium
FVAAFDVDAKKVGFDLS

SEQ ID NO: 619266 - protein, 21 aa, Mycobacterium
FVIGASNRFAHAATLAIAEAP

SEQ ID NO: 619267 - protein, 29 aa, Mycobacterium
FVSGDMNNGFFWRGTGQGLIGADYTITIP

SEQ ID NO: 619268 - protein, 19 aa, Mycobacterium
FVTLCKTLGKPVNFVPVID

SEQ ID NO: 619269 - protein, 27 aa, Mycobacterium
FVVCNEILPRWGVETVFVDGDDLSQWE

SEQ ID NO: 619270 - protein, 21 aa, Mycobacterium
FWNREYDILVCTTIVETGLDI

SEQ ID NO: 619271 - protein, 21 aa, Mycobacterium
GADSGMLAALYVLAALGEQDR

SEQ ID NO: 619272 - protein, 21 aa, Mycobacterium
GANTGDGNWGWGNTGGGNIGW

SEQ ID NO: 619273 - protein, 20 aa, Mycobacterium
GAPDRLWVADFTYCRTRAGW

SEQ ID NO: 619274 - protein, 19 aa, Mycobacterium
GARMYRTGDVVRWGPDGQL

SEQ ID NO: 619275 - protein, 25 aa, Mycobacterium
GDGLAGLFSQGADKISVFGLGVANH

SEQ ID NO: 619276 - protein, 24 aa, Mycobacterium
GDIHVFHAKAIVFATGGSGRMYKT

SEQ ID NO: 619277 - protein, 25 aa, Mycobacterium
GDILTRLTAPVIRGLGIGIVPAATR

SEQ ID NO: 619278 - protein, 19 aa, Mycobacterium
GDRGLDELVGMFVNTLVLR

SEQ ID NO: 619279 - protein, 18 aa, Mycobacterium
GDTTRSWYVIDATDVVLG

SEQ ID NO: 619280 - protein, 17 aa, Mycobacterium
GEAIPAQAIAQVCELTW

SEQ ID NO: 619281 - protein, 19 aa, Mycobacterium
GEEKFIREARLCRKYGAAV

SEQ ID NO: 619282 - protein, 25 aa, Mycobacterium
GEGKLYLCAIKDVFSNRIVGYSIDS

SEQ ID NO: 619283 - protein, 23 aa, Mycobacterium
GEGKRLYPLTADRAKPAVPFGGA

SEQ ID NO: 619284 - protein, 20 aa, Mycobacterium
GENIPAWLVFDQQYRDRYIF

SEQ ID NO: 619285 - protein, 17 aa, Mycobacterium
GFGRIGRNFYRALLAQQ

SEQ ID NO: 619286 - protein, 23 aa, Mycobacterium
GFSHFTLLLVHALRQQFSRVRVF

SEQ ID NO: 619287 - protein, 19 aa, Mycobacterium
GGAHYCLGANLARRELAEA

SEQ ID NO: 619288 - protein, 24 aa, Mycobacterium
GGERNRLNLALTLKEGGNLILLDE

SEQ ID NO: 619289 - protein, 23 aa, Mycobacterium
GGERNRLNLALTLKQGGNLILLD

SEQ ID NO: 619290 - protein, 19 aa, Mycobacterium
GGGTRRCVGAAFANMEMDV

SEQ ID NO: 619291 - protein, 18 aa, Mycobacterium
GGIGWIPFYLDRSDRHYT

SEQ ID NO: 619292 - protein, 24 aa, Mycobacterium
GGKALKFYASVRMDVRRIETLKDG

SEQ ID NO: 619293 - protein, 17 aa, Mycobacterium
GGLGIAVTKSWGMIDNR

SEQ ID NO: 619294 - protein, 18 aa, Mycobacterium
GGLLRYGIPEFKMEKRVL

SEQ ID NO: 619295 - protein, 26 aa, Mycobacterium
GGNGGAAGWWGTGGAGGAGGEGGAAG

SEQ ID NO: 619296 - protein, 20 aa, Mycobacterium
GGTPLRSRVGHSYIKALMAD

SEQ ID NO: 619297 - protein, 19 aa, Mycobacterium
GGYTYGGRIAALADAAREN

SEQ ID NO: 619298 - protein, 24 aa, Mycobacterium
GHKGARLTTQVSLAGRYLVYVPGA

SEQ ID NO: 619299 - protein, 24 aa, Mycobacterium
GIEPWGISNFQIFPNIEILIYGGW

SEQ ID NO: 619300 - protein, 19 aa, Mycobacterium
GIGRAFAVELARRGGRVVC

SEQ ID NO: 619301 - protein, 18 aa, Mycobacterium
GIMPDRHLGSALHAAHNE

SEQ ID NO: 619302 - protein, 17 aa, Mycobacterium
GISESLGGSGSVGGSTA

SEQ ID NO: 619303 - protein, 19 aa, Mycobacterium
GKDISCNLGSLNIAKAMDS

SEQ ID NO: 619304 - protein, 20 aa, Mycobacterium
GKGFAGTMKRHGFRGQGASH

SEQ ID NO: 619305 - protein, 18 aa, Mycobacterium
GKGLSRLVRQNCDEVVSI

SEQ ID NO: 619306 - protein, 21 aa, Mycobacterium
GKSATTAWLIERLQRPTLVMA

SEQ ID NO: 619307 - protein, 26 aa, Mycobacterium
GKTALVAALCRQLRDELSLAVLTNDI

SEQ ID NO: 619308 - protein, 19 aa, Mycobacterium
GLDNLTFVINCNLQRLDGP

SEQ ID NO: 619309 - protein, 26 aa, Mycobacterium
GLDSRAYRLDWPAGTTVYEIDQPQVL

SEQ ID NO: 619310 - protein, 27 aa, Mycobacterium
GLEKCIGCELCAWACPADAIYVEGADN

SEQ ID NO: 619311 - protein, 19 aa, Mycobacterium
GLETMCVGGGQGMAMVIER

SEQ ID NO: 619312 - protein, 17 aa, Mycobacterium
GLGESLLTYALCVEELA

SEQ ID NO: 619313 - protein, 19 aa, Mycobacterium
GLGGCPFAPGATGNIATED

SEQ ID NO: 619314 - protein, 19 aa, Mycobacterium
GLGREYALTLAREGASVVV

SEQ ID NO: 619315 - protein, 32 aa, Mycobacterium
GLLAKYAIEHWTRLPVEVELASEFRYRDPVLD

SEQ ID NO: 619316 - protein, 19 aa, Mycobacterium
GLRRSMAKAGYCDLKEFQK

SEQ ID NO: 619317 - protein, 22 aa, Mycobacterium
GLSALPWQRFGGPAALGEYLQE

SEQ ID NO: 619318 - protein, 24 aa, Mycobacterium
GLSVLRYAIRTEIRLITSELATDL

SEQ ID NO: 619319 - protein, 19 aa, Mycobacterium
GMLELLLRELDVHPGDVIE

SEQ ID NO: 619320 - protein, 17 aa, Mycobacterium
GMLKYGFDDARPVLERA

SEQ ID NO: 619321 - protein, 21 aa, Mycobacterium
GNATFGAACRGCALRPQCTTS

SEQ ID NO: 619322 - protein, 26 aa, Mycobacterium
GNRPHCIYRGYCLQGCKVNAKASPYV

SEQ ID NO: 619323 - protein, 22 aa, Mycobacterium
GPARARYLMLRLLERAGEQRVA

SEQ ID NO: 619324 - protein, 19 aa, Mycobacterium
GPASHYATTGPEIWADTDG

SEQ ID NO: 619325 - protein, 17 aa, Mycobacterium
GPKGGPGMREMLAITGA

SEQ ID NO: 619326 - protein, 23 aa, Mycobacterium
GPRGCGKTSSARILARSLNCAQG

SEQ ID NO: 619327 - protein, 19 aa, Mycobacterium
GPRVKRTLTANGLRQLISF

SEQ ID NO: 619328 - protein, 18 aa, Mycobacterium
GPTLMVSDLFDFSLYVDA

SEQ ID NO: 619329 - protein, 21 aa, Mycobacterium
GQAFWSFGGLFFVDSPEQRRL

SEQ ID NO: 619330 - protein, 17 aa, Mycobacterium
GQFREWLGLLDPDIRYV

SEQ ID NO: 619331 - protein, 23 aa, Mycobacterium
GQPGPRFGCGAGILAPHMSAAGA

SEQ ID NO: 619332 - protein, 22 aa, Mycobacterium
GQRRFWFMWDDLVRGAIGAIVL

SEQ ID NO: 619333 - protein, 27 aa, Mycobacterium
GQVLKEIQSRLGFLLDVGLDYLSLSRA

SEQ ID NO: 619334 - protein, 27 aa, Mycobacterium
GQVLKEIQSRLGFLLDVGLEYLSLSRA

SEQ ID NO: 619335 - protein, 25 aa, Mycobacterium
GRAYDPRFLFAWPSAKSAVMGGAQL

SEQ ID NO: 619336 - protein, 19 aa, Mycobacterium
GRFTLGLGASGPQVIEGFH

SEQ ID NO: 619337 - protein, 24 aa, Mycobacterium
GRIPLPVPGFGVWALDSLRRANRY

SEQ ID NO: 619338 - protein, 29 aa, Mycobacterium
GRSGEPFPYPVTVGYMYIMKLHHLVDDKI

SEQ ID NO: 619339 - protein, 20 aa, Mycobacterium
GSAIAQHWMYDGKHVLIVFD

SEQ ID NO: 619340 - protein, 21 aa, Mycobacterium
GSCSWKIYVKDGIITWETQQT

SEQ ID NO: 619341 - protein, 20 aa, Mycobacterium
GSCVPLLKQLLEAEGVEQSK

SEQ ID NO: 619342 - protein, 18 aa, Mycobacterium
GSELMDKWVGSSEKAVRE

SEQ ID NO: 619343 - protein, 24 aa, Mycobacterium
GSTGERGLHHLIWEVVDNAVDEAM

SEQ ID NO: 619344 - protein, 24 aa, Mycobacterium
GSTGERGLHHLIWEVVDNSVDEAM

SEQ ID NO: 619345 - protein, 19 aa, Mycobacterium
GSVVSPLFSAFGPEPIATR

SEQ ID NO: 619346 - protein, 26 aa, Mycobacterium
GVAKHYGVSVAICPPRRGNRKGVVEK

SEQ ID NO: 619347 - protein, 18 aa, Mycobacterium
GVESMCAVLSEFGVVIAP

SEQ ID NO: 619348 - protein, 19 aa, Mycobacterium
GVFNLGDGVSGWVNTIPSM

SEQ ID NO: 619349 - protein, 24 aa, Mycobacterium
GVGGRAAVQIGRRLARLARTHQVI

SEQ ID NO: 619350 - protein, 39 aa, Mycobacterium
GVGVGYWRRGGLSATRFVACPFGAGGSRMYRTGDLVCWG

SEQ ID NO: 619351 - protein, 37 aa, Mycobacterium
GVGYWRRGGLSAARFVACPFGAAGSRMYRTGDLVCWG

SEQ ID NO: 619352 - protein, 37 aa, Mycobacterium
GVGYWRRGGLSATRFVACPFGAAGSRMYRTGDLVCWG

SEQ ID NO: 619353 - protein, 20 aa, Mycobacterium
GVLRRLAAMRSYMRDINLGR

SEQ ID NO: 619354 - protein, 19 aa, Mycobacterium
GVSARFAIAAAETVAAAAR

SEQ ID NO: 619355 - protein, 25 aa, Mycobacterium
GVSFWASLFPAVWSFCLALRSRGLG

SEQ ID NO: 619356 - protein, 22 aa, Mycobacterium
GYKISVPHAVRISPDGIYLHER

SEQ ID NO: 619357 - protein, 17 aa, Mycobacterium
HADCAKVGITSIRRDLP

SEQ ID NO: 619358 - protein, 21 aa, Mycobacterium
HAKGKLTARERIYALLDEDSF

SEQ ID NO: 619359 - protein, 22 aa, Mycobacterium
HALKERYSRITVHDKGKRFNSD

SEQ ID NO: 619360 - protein, 20 aa, Mycobacterium
HARGLGVLIDAVFNHLGPSG

SEQ ID NO: 619361 - protein, 23 aa, Mycobacterium
HDEGWLAEHMLILKLISPENKAY

SEQ ID NO: 619362 - protein, 23 aa, Mycobacterium
HDLSSLRLLGSVGEPINPEAWRW

SEQ ID NO: 619363 - protein, 18 aa, Mycobacterium
HDPLVMRRALEYATGLGV

SEQ ID NO: 619364 - protein, 17 aa, Mycobacterium
HEDLKKLPFPMLSDIKR

SEQ ID NO: 619365 - protein, 25 aa, Mycobacterium
HEDLKRFFDGFPRNAHPMPVLSSAV

SEQ ID NO: 619366 - protein, 21 aa, Mycobacterium
HFRFVECSRLVNGRPDGDVTP

SEQ ID NO: 619367 - protein, 20 aa, Mycobacterium
HGESGKVIGIRVFSREDDDE

SEQ ID NO: 619368 - protein, 21 aa, Mycobacterium
HGLSWGFDRIFAASANHSVWF

SEQ ID NO: 619369 - protein, 17 aa, Mycobacterium
HGNLEWLPGKTLGMSAA

SEQ ID NO: 619370 - protein, 24 aa, Mycobacterium
HGNSVPRFHITWGTGPALVEIFAR

SEQ ID NO: 619371 - protein, 27 aa, Mycobacterium
HISTLLLTLLFRFMKPLVENGHIFLAQ

SEQ ID NO: 619372 - protein, 29 aa, Mycobacterium
HISTLLLTLLFRFMRPLIENGHVFLAQPP

SEQ ID NO: 619373 - protein, 22 aa, Mycobacterium
HKLSDDEFGFFVILLAVAGNET

SEQ ID NO: 619374 - protein, 25 aa, Mycobacterium
HMFFHRLGPVLARRLLLTGDIIEAG

SEQ ID NO: 619375 - protein, 25 aa, Mycobacterium
HNGELPAVRVGRSFRVHAKAVHDML

SEQ ID NO: 619376 - protein, 24 aa, Mycobacterium
HNLRELAEAVYWCLDNHEADEEAT

SEQ ID NO: 619377 - protein, 20 aa, Mycobacterium
HNPVLGRRVWVDRWDTGLVD

SEQ ID NO: 619378 - protein, 17 aa, Mycobacterium
HSEIMGTINQQRTVLEG

SEQ ID NO: 619379 - protein, 31 aa, Mycobacterium; identical to SEQ ID NO: 80871

SEQ ID NO: 619380 - protein, 32 aa, Mycobacterium
HSRFSTNTFPSWPLAHPFRRVAHNGEINTVTG

SEQ ID NO: 619381 - protein, 24 aa, Mycobacterium
HTAVKISPRRSGPVVWVKDASRSV

SEQ ID NO: 619382 - protein, 18 aa, Mycobacterium
HTDTRLILLDSLPTLDTN

SEQ ID NO: 619383 - protein, 21 aa, Mycobacterium
HVHVVPRWGGDANFITIIGGS

SEQ ID NO: 619384 - protein, 26 aa, Mycobacterium
HVSGHAYAGELLFLYNGVRPRNVMPV

SEQ ID NO: 619385 - protein, 25 aa, Mycobacterium
IAAELPMQMICILLGVPESERHWLF

SEQ ID NO: 619386 - protein, 25 aa, Mycobacterium
IAAHWRYKEAKGRNGVPHPHAAAEI

SEQ ID NO: 619387 - protein, 17 aa, Mycobacterium
IAFAGGIHMCLGMHLAR

SEQ ID NO: 619388 - protein, 25 aa, Mycobacterium
IAGERPALVPLSFAQSRLWFLEQLQ

SEQ ID NO: 619389 - protein, 17 aa, Mycobacterium
IAGRVAQIRAEIENSDS

SEQ ID NO: 619390 - protein, 17 aa, Mycobacterium
IASKGGYEAVQMRAVAD

SEQ ID NO: 619391 - protein, 24 aa, Mycobacterium
IASLNYLLSSHVWRQDHNGASHQD

SEQ ID NO: 619392 - protein, 23 aa, Mycobacterium
IATWKRIAAALKRDPYGRTARQV

SEQ ID NO: 619393 - protein, 30 aa, Mycobacterium; identical to SEQ ID NO: 201010

SEQ ID NO: 619394 - protein, 18 aa, Mycobacterium
ICPLTAGLPPQAFADAVD

SEQ ID NO: 619395 - protein, 19 aa, Mycobacterium
IDCCSRRVAGWAIADHMRT

SEQ ID NO: 619396 - protein, 17 aa, Mycobacterium
IDVLARLGGDEFAWQVP

SEQ ID NO: 619397 - protein, 23 aa, Mycobacterium
IEELLRGADMVFVTAGEGGGTGT

SEQ ID NO: 619398 - protein, 19 aa, Mycobacterium
IEEMLRWTSPVKNMCRTLT

SEQ ID NO: 619399 - protein, 18 aa, Mycobacterium
IEGVKRFISGGDVGDTAE

SEQ ID NO: 619400 - protein, 18 aa, Mycobacterium
IEQGLKGVEFIAINTDAQ

SEQ ID NO: 619401 - protein, 19 aa, Mycobacterium
IEQGLKGVEFIAINTDAQA

SEQ ID NO: 619402 - protein, 17 aa, Mycobacterium
IGASGLRQMHELVRQLR

SEQ ID NO: 619403 - protein, 22 aa, Mycobacterium
IGGAKRGKAIIILNPADPPMIM

SEQ ID NO: 619404 - protein, 20 aa, Mycobacterium
IGGLPRGRVVEIYGPESSGK

SEQ ID NO: 619405 - protein, 19 aa, Mycobacterium
IGQAFGRDHTTVMYAQRKI

SEQ ID NO: 619406 - protein, 24 aa, Mycobacterium
IGQTEVRPILLWHAFEESEHKAVA

SEQ ID NO: 619407 - protein, 20 aa, Mycobacterium
IGRPDAWEVQGRGELALAVL

SEQ ID NO: 619408 - protein, 17 aa, Mycobacterium
IGTMIKQLLEEVRAAPL

SEQ ID NO: 619409 - protein, 17 aa, Mycobacterium
IGVVGLLNVQYALKDDV

SEQ ID NO: 619410 - protein, 26 aa, Mycobacterium
IHESAKRICKEAHYYGAGTVEYLVGQ

SEQ ID NO: 619411 - protein, 19 aa, Mycobacterium
IHETREWILRNSPVPVGTV

SEQ ID NO: 619412 - protein, 17 aa, Mycobacterium
IHGYCVAGGTDIALHAD

SEQ ID NO: 619413 - protein, 25 aa, Mycobacterium
IIIAGAGAIGMEFAYVLKNYGVDVT

SEQ ID NO: 619414 - protein, 27 aa, Mycobacterium
IKPQRGRISTWPLPEAFNGITVNGVLA

SEQ ID NO: 619415 - protein, 24 aa, Mycobacterium
IKVVREIVSGLGLKEAKDLVDGAP

SEQ ID NO: 619416 - protein, 23 aa, Mycobacterium
ILDNPAYRGIRVWGKQEKYEVLV

SEQ ID NO: 619417 - protein, 22 aa, Mycobacterium
ILGRSRWAPSVFGCQAPDSGNA

SEQ ID NO: 619418 - protein, 20 aa, Mycobacterium
INRHIKRGGKVWINIFPDRP

SEQ ID NO: 619419 - protein, 26 aa, Mycobacterium
IPDFVKLAEALGCVGLRCEREEDVAD

SEQ ID NO: 619420 - protein, 19 aa, Mycobacterium
IPDMAQWGIFLRNHDELTL

SEQ ID NO: 619421 - protein, 24 aa, Mycobacterium
IPTDWGRCVLTIGVFDGVHRGHAE

SEQ ID NO: 619422 - protein, 17 aa, Mycobacterium
IPVDSIYSPVLKVTYKV

SEQ ID NO: 619423 - protein, 19 aa, Mycobacterium
IPVRRSWRLNERHYGALQG

SEQ ID NO: 619424 - protein, 18 aa, Mycobacterium
IRGEVLRILAGVDGEIRR

SEQ ID NO: 619425 - protein, 17 aa, Mycobacterium
IRHPRDVALALAAGASN

SEQ ID NO: 619426 - protein, 17 aa, Mycobacterium
IRKEGKIGRVYYPAPYM

SEQ ID NO: 619427 - protein, 18 aa, Mycobacterium
IRLEGKSVLISDSERLAR

SEQ ID NO: 619428 - protein, 20 aa, Mycobacterium
IRRVRREVPGAGEVVASQCS

SEQ ID NO: 619429 - protein, 22 aa, Mycobacterium
IRWMGSGPLTGLAEIQLPDLQP

SEQ ID NO: 619430 - protein, 25 aa, Mycobacterium
ITDRLKDMYICGGFNVYPAEVEQVL

SEQ ID NO: 619431 - protein, 26 aa, Mycobacterium
ITEVPMKRFDLMNGIQVRGTYAVSQA

SEQ ID NO: 619432 - protein, 23 aa, Mycobacterium
ITGWDYPSCEAIGLLKMDFLGLR

SEQ ID NO: 619433 - protein, 18 aa, Mycobacterium
ITPFNFPAMIPLWKAGPA

SEQ ID NO: 619434 - protein, 20 aa, Mycobacterium
ITQVKVRSVLTCTTGTGVCA

SEQ ID NO: 619435 - protein, 34 aa, Mycobacterium; identical to SEQ ID NO: 81328

SEQ ID NO: 619436 - protein, 23 aa, Mycobacterium
KAGEGDAFISAGVETVSRFGKGN

SEQ ID NO: 619437 - protein, 18 aa, Mycobacterium
KAIGYGMPGIRVDGNDVL

SEQ ID NO: 619438 - protein, 17 aa, Mycobacterium
KALGHAYGGGSQYYSMW

SEQ ID NO: 619439 - protein, 25 aa, Mycobacterium
KAMQFLRGGRRWLLKSPQHLEQVPV

SEQ ID NO: 619440 - protein, 21 aa, Mycobacterium
KAPKDRDIAMVFQSYALYPHM

SEQ ID NO: 619441 - protein, 21 aa, Mycobacterium
KDLRRARAAALNIVPTSTGAA

SEQ ID NO: 619442 - protein, 22 aa, Mycobacterium
KDPRDAHFITSRICGICGDNHA

SEQ ID NO: 619443 - protein, 17 aa, Mycobacterium
KDRHGRSILTVRDQNTF

SEQ ID NO: 619444 - protein, 27 aa, Mycobacterium
KEFELLKYLAQHAGRVFTRAQLLQEVW

SEQ ID NO: 619445 - protein, 21 aa, Mycobacterium
KETPACFEPTLDYVVVKAPRF

SEQ ID NO: 619446 - protein, 24 aa, Mycobacterium
KEVGPRIVPIIPDEARTFGMDSWF

SEQ ID NO: 619447 - protein, 25 aa, Mycobacterium
KEYASRGTWIWPPEPSLRLIADTIE

SEQ ID NO: 619448 - protein, 17 aa, Mycobacterium
KEYPDLKIALSEGGTGW

SEQ ID NO: 619449 - protein, 21 aa, Mycobacterium
KGGGHKRAYRVIDFRRNDKDG

SEQ ID NO: 619450 - protein, 23 aa, Mycobacterium
KGGPGMREMLAITGAIKGAGLGK

SEQ ID NO: 619451 - protein, 27 aa, Mycobacterium
KHGAKMVTAVACARVPKLTVVIGGSYG

SEQ ID NO: 619452 - protein, 28 aa, Mycobacterium
KHGAKMVTAVACARVPKLTVVIGGSYGA

SEQ ID NO: 619453 - protein, 25 aa, Mycobacterium
KINEPRFPSFKGIMAAKKKEVTVLT

SEQ ID NO: 619454 - protein, 18 aa, Mycobacterium
KKFLRYNANKALMNLGYE

SEQ ID NO: 619455 - protein, 19 aa, Mycobacterium
KLFGLSRERVRQIEREVMA

SEQ ID NO: 619456 - protein, 18 aa, Mycobacterium
KLLGLPMGVDVCYTNHAE

SEQ ID NO: 619457 - protein, 26 aa, Mycobacterium
KLLHSVKVIPSRGAWLEFDVDKRDTV

SEQ ID NO: 619458 - protein, 24 aa, Mycobacterium
KLLQRPEEVAARRGLPIEDVAPAG

SEQ ID NO: 619459 - protein, 28 aa, Mycobacterium
KPVPNKNIRLVIEWLDRYAEALPLTVIG

SEQ ID NO: 619460 - protein, 20 aa, Mycobacterium
KRMGIEGIYLGGWATSAKGS

SEQ ID NO: 619461 - protein, 19 aa, Mycobacterium
KRMQAVNELSCYRYEVVLR

SEQ ID NO: 619462 - protein, 19 aa, Mycobacterium
KRTGVPISTHTHAGLRRGL

SEQ ID NO: 619463 - protein, 18 aa, Mycobacterium
KRVALVFSAYPTKHARIG

SEQ ID NO: 619464 - protein, 22 aa, Mycobacterium
KRVDNMTMAWGLEGRVPFLDHE

SEQ ID NO: 619465 - protein, 23 aa, Mycobacterium
KRYTGRGMAFLDLIQEGNLGLIR

SEQ ID NO: 619466 - protein, 25 aa, Mycobacterium
KTGKAEKCTLCYPRMEVGLPTICSE

SEQ ID NO: 619467 - protein, 21 aa, Mycobacterium
KTWELGDGWAKHVTVEVALGT

SEQ ID NO: 619468 - protein, 28 aa, Mycobacterium
KVGLYCRNRIEIVIAMLGIVKAGAILVN

SEQ ID NO: 619469 - protein, 22 aa, Mycobacterium
KVLICGYGDVGKGCAESLAGQG

SEQ ID NO: 619470 - protein, 19 aa, Mycobacterium
KVRSGWDDLVLAGGVESMS

SEQ ID NO: 619471 - protein, 18 aa, Mycobacterium
KWAGEVLLREAHDLCGLP

SEQ ID NO: 619472 - protein, 20 aa, Mycobacterium
LAAAYAQRWEIESVFDELKT

SEQ ID NO: 619473 - protein, 19 aa, Mycobacterium
LAHAKIQVELARLMTQRAA

SEQ ID NO: 619474 - protein, 17 aa, Mycobacterium
LALGIGVHDITAGYRAY

SEQ ID NO: 619475 - protein, 26 aa, Mycobacterium
LAMLRRLMMDDSFFRGELIYVFDGDA

SEQ ID NO: 619476 - protein, 25 aa, Mycobacterium
LAMNARIALHVRVLYGRDPHHITEA

SEQ ID NO: 619477 - protein, 18 aa, Mycobacterium
LAPGTGLRDGLERILRGR

SEQ ID NO: 619478 - protein, 23 aa, Mycobacterium
LAQLAPDCVEYWGTDFSASTIEM

SEQ ID NO: 619479 - protein, 19 aa, Mycobacterium
LAQVQARAVAAVREHDRRL

SEQ ID NO: 619480 - protein, 18 aa, Mycobacterium
LATAVVIEAHDEWQVTRR

SEQ ID NO: 619481 - protein, 18 aa, Mycobacterium
LAYGYARNQMSAYVELQE

SEQ ID NO: 619482 - protein, 21 aa, Mycobacterium
LCDKRKIPLLFLQNIAGFMVG

SEQ ID NO: 619483 - protein, 18 aa, Mycobacterium
LCSPTRASLLTGRNATTV

SEQ ID NO: 619484 - protein, 19 aa, Mycobacterium
LDAEFPKFRQLLPAEHTAV

SEQ ID NO: 619485 - protein, 17 aa, Mycobacterium
LDAPICLTWELTYACNL

SEQ ID NO: 619486 - protein, 17 aa, Mycobacterium
LDARIAGRVGLRPDVRR

SEQ ID NO: 619487 - protein, 26 aa, Mycobacterium
LDDKGRLTLPAKFRDALAGGLMVTKS

SEQ ID NO: 619488 - protein, 27 aa, Mycobacterium
LDDKGRLTLPAKFRDALAGGLMVTKSQ

SEQ ID NO: 619489 - protein, 20 aa, Mycobacterium
LDEAALRVARDIAAKDTRVI

SEQ ID NO: 619490 - protein, 21 aa, Mycobacterium
LDFAGNADFAIAIRTALMRNG

SEQ ID NO: 619491 - protein, 19 aa, Mycobacterium
LDFFAELTIYTSTACLIGL

SEQ ID NO: 619492 - protein, 26 aa, Mycobacterium
LDLSKLARPTSTWTYMVNDNPLSDDT

SEQ ID NO: 619493 - protein, 19 aa, Mycobacterium
LDRLAELGVSEIFGVPGDY

SEQ ID NO: 619494 - protein, 21 aa, Mycobacterium
LDRLYGYEVSPVLWKKVAPKL

SEQ ID NO: 619495 - protein, 17 aa, Mycobacterium
LDVPVVAGGVLDHRTAL

SEQ ID NO: 619496 - protein, 26 aa, Mycobacterium
LDVTLRGAVSIARRLQDPLAELVKIE

SEQ ID NO: 619497 - protein, 26 aa, Mycobacterium
LEANLRLVVSLAKRYTGRGMAFLDLI

SEQ ID NO: 619498 - protein, 17 aa, Mycobacterium
LEARIDSLAARNSKLME

SEQ ID NO: 619499 - protein, 20 aa, Mycobacterium
LEGKSSLGRLGLLTHSTAGF

SEQ ID NO: 619500 - protein, 18 aa, Mycobacterium
LEHGHVIQVFGLPNMRTV

SEQ ID NO: 619501 - protein, 19 aa, Mycobacterium
LEIGVGTGLLLAQLAPDCV

SEQ ID NO: 619502 - protein, 17 aa, Mycobacterium
LELAWGPTWSGSLKSLW

SEQ ID NO: 619503 - protein, 19 aa, Mycobacterium
LEMNTRLQVEHPVTEETTG

SEQ ID NO: 619504 - protein, 23 aa, Mycobacterium
LERLGKVWAAMAITEPGFGSDSA

SEQ ID NO: 619505 - protein, 24 aa, Mycobacterium
LESAAKWREIFGADNYFLELMDHG

SEQ ID NO: 619506 - protein, 22 aa, Mycobacterium
LEVEPFEAMIVFVRTKQATEEV

SEQ ID NO: 619507 - protein, 19 aa, Mycobacterium
LFASWRSDPSFVLNLSPFD

SEQ ID NO: 619508 - protein, 18 aa, Mycobacterium
LFCIHATSGISWPYQTLA

SEQ ID NO: 619509 - protein, 24 aa, Mycobacterium
LFDGSDTVTLVWLGQRRIPGIDSG

SEQ ID NO: 619510 - protein, 18 aa, Mycobacterium
LFRYPGVRSDSSIFTLSF

SEQ ID NO: 619511 - protein, 21 aa, Mycobacterium
LGAALAEYGRRVLLVDMDPQG

SEQ ID NO: 619512 - protein, 19 aa, Mycobacterium
LGDPPYYAFRIVLGDLGTS

SEQ ID NO: 619513 - protein, 17 aa, Mycobacterium
LGDTFRWKGENVATTQV

SEQ ID NO: 619514 - protein, 26 aa, Mycobacterium
LGDYRMLPRATFCQPQVASFGLTEQQ

SEQ ID NO: 619515 - protein, 18 aa, Mycobacterium
LGFVEAQGGGTILLARGD

SEQ ID NO: 619516 - protein, 29 aa, Mycobacterium
LGHLGFFVLDGWLRPVPVGVVGELYVAGV

SEQ ID NO: 619517 - protein, 19 aa, Mycobacterium
LGICNGFQVLCEAGLLPGA

SEQ ID NO: 619518 - protein, 26 aa, Mycobacterium
LGIRLKLNPLREVIRGKRLIVVDDSI

SEQ ID NO: 619519 - protein, 18 aa, Mycobacterium
LGLFEINEAASLVQDAAH

SEQ ID NO: 619520 - protein, 23 aa, Mycobacterium
LGPSGKRPGAIAERVKKTWELGD

SEQ ID NO: 619521 - protein, 20 aa, Mycobacterium
LGQYADWIFCLVRTDPQAPK

SEQ ID NO: 619522 - protein, 19 aa, Mycobacterium
LGSALARLEGRVALEEILK

SEQ ID NO: 619523 - protein, 19 aa, Mycobacterium
LGVGVTSIYWYFRKKDDLL

SEQ ID NO: 619524 - protein, 23 aa, Mycobacterium
LHAHVLLQRDVHYIVRDDAVHLI

SEQ ID NO: 619525 - protein, 19 aa, Mycobacterium
LHHALALAGRHLRRHPNAQ

SEQ ID NO: 619526 - protein, 18 aa, Mycobacterium
LHIPRTTWYDDVRFEEVS

SEQ ID NO: 619527 - protein, 17 aa, Mycobacterium
LHLDILVDRMRREFKVE

SEQ ID NO: 619528 - protein, 18 aa, Mycobacterium
LHLDILVDRMRREFKVEA

SEQ ID NO: 619529 - protein, 22 aa, Mycobacterium
LHPEYRTMPMVWYIPPLSPVVD

SEQ ID NO: 619530 - protein, 34 aa, Mycobacterium
LHQCGLPKLMALELFKPFVMKRLVDLNHAQNIKS

SEQ ID NO: 619531 - protein, 18 aa, Mycobacterium
LHSSLSYQSPIDYEAQYR

SEQ ID NO: 619532 - protein, 27 aa, Mycobacterium
LHTHLPWLAHHGRWPVGEEWLYQSWAA

SEQ ID NO: 619533 - protein, 18 aa, Mycobacterium
LIEPGVRTGIPLLVDNPK

SEQ ID NO: 619534 - protein, 25 aa, Mycobacterium
LIGQFGIGFYSSFMVADKVELLTRK

SEQ ID NO: 619535 - protein, 19 aa, Mycobacterium
LIMDSLRYWVTEMHVDGFR

SEQ ID NO: 619536 - protein, 22 aa, Mycobacterium
LIPDQRAGCSLADSITADELRA

SEQ ID NO: 619537 - protein, 18 aa, Mycobacterium
LIRFAEAAIQVMGKGGDH

SEQ ID NO: 619538 - protein, 20 aa, Mycobacterium
LKIALSEGGTGWIPYFLERA

SEQ ID NO: 619539 - protein, 20 aa, Mycobacterium
LKVGTSVAVLPGRHPVLVAK

SEQ ID NO: 619540 - protein, 17 aa, Mycobacterium
LLDAEGLFDPRLKRPIP

SEQ ID NO: 619541 - protein, 21 aa, Mycobacterium
LLDIGCGWGATMRRAIEKYDV

SEQ ID NO: 619542 - protein, 18 aa, Mycobacterium
LLDQEGRDDLALRIAVQP

SEQ ID NO: 619543 - protein, 17 aa, Mycobacterium
LLDSGAHFGHQTRRWNP

SEQ ID NO: 619544 - protein, 20 aa, Mycobacterium
LLEIEPALKALEGVVMELDD

SEQ ID NO: 619545 - protein, 19 aa, Mycobacterium
LLERGRFDGLFIADVLGTY

SEQ ID NO: 619546 - protein, 28 aa, Mycobacterium
LLGKKCYSLRIASAMAHDEGWLAEHMLI

SEQ ID NO: 619547 - protein, 20 aa, Mycobacterium
LLKIGWPAEDLAGYVDGEAH

SEQ ID NO: 619548 - protein, 29 aa, Mycobacterium
LLRQLRLGEYDVLVGINLLREGLDLPEVS

SEQ ID NO: 619549 - protein, 20 aa, Mycobacterium
LLRRMGRAEFVRADIRNPFI

SEQ ID NO: 619550 - protein, 22 aa, Mycobacterium
LLSGEIFSCFSMTEPQGGADPR

SEQ ID NO: 619551 - protein, 23 aa, Mycobacterium
LLVSGRASFELTQKAVMAGIPVL

SEQ ID NO: 619552 - protein, 29 aa, Mycobacterium
LLYKLLRSDWLEPRWMVGIDPESEGLARA

SEQ ID NO: 619553 - protein, 19 aa, Mycobacterium
LMDAVPVTLGQEFGGYARQ

SEQ ID NO: 619554 - protein, 19 aa, Mycobacterium
LMDAVPVTLGQEFSGYARQ

SEQ ID NO: 619555 - protein, 29 aa, Mycobacterium
LMSVTPKSSWPWVRTLLHSVFDQPDAESV

SEQ ID NO: 619556 - protein, 20 aa, Mycobacterium
LNKEIKRRADVVEIFPNPAA

SEQ ID NO: 619557 - protein, 17 aa, Mycobacterium
LNVGCIPSKALLRNAEL

SEQ ID NO: 619558 - protein, 18 aa, Mycobacterium
LPATFVYAGIDVERSGVF

SEQ ID NO: 619559 - protein, 28 aa, Mycobacterium
LPFLHKELYREYALRPPKGVLLYGPPGC

SEQ ID NO: 619560 - protein, 19 aa, Mycobacterium
LPGSIIIAGAGAIGMEFAY

SEQ ID NO: 619561 - protein, 17 aa, Mycobacterium
LPKTRSGKIMRRLLRDV

SEQ ID NO: 619562 - protein, 19 aa, Mycobacterium
LPLGAGRLTREWLPDDPPG

SEQ ID NO: 619563 - protein, 26 aa, Mycobacterium
LPSYPHPRLMPDFWEFPTVSMGLGPL

SEQ ID NO: 619564 - protein, 26 aa, Mycobacterium
LPSYPHPRLMPDFWEFPTVSMGLGPM

SEQ ID NO: 619565 - protein, 24 aa, Mycobacterium
LPTRPRATLVLRKDADHSINRLRL

SEQ ID NO: 619566 - protein, 24 aa, Mycobacterium
LQAEGRGATMIFTRTKRTAQKVAD

SEQ ID NO: 619567 - protein, 18 aa, Mycobacterium
LQGWTLDRLPAVDRAILR

SEQ ID NO: 619568 - protein, 25 aa, Mycobacterium
LQLSKRGGGVALLLSNIREHGAPIK

SEQ ID NO: 619569 - protein, 19 aa, Mycobacterium
LQNRLPCIYLVDSGGAFLP

SEQ ID NO: 619570 - protein, 22 aa, Mycobacterium
LQTRPPVVTVMGHVDHGKTRLL

SEQ ID NO: 619571 - protein, 21 aa, Mycobacterium
LRADLLRPWANWVTPKEERTR

SEQ ID NO: 619572 - protein, 25 aa, Mycobacterium
LRESVRLMRELWRGDRVDFDGEYYR

SEQ ID NO: 619573 - protein, 20 aa, Mycobacterium
LRHEIGIDIIAWECDYPHSD

SEQ ID NO: 619574 - protein, 23 aa, Mycobacterium
LRLHPPLIILMRVAKGEFEVEGF

SEQ ID NO: 619575 - protein, 18 aa, Mycobacterium
LRLLHPVIPFITEALWQA

SEQ ID NO: 619576 - protein, 20 aa, Mycobacterium
LRLLLPAGLETTYRSSGNLL

SEQ ID NO: 619577 - protein, 18 aa, Mycobacterium
LRPPKGVLLYGPPGCGKT

SEQ ID NO: 619578 - protein, 30 aa, Mycobacterium
LRQRSDGRWIWRWDPAFISSNFDVLQGNLM

SEQ ID NO: 619579 - protein, 18 aa, Mycobacterium
LRVQMRGEIARLQKRLGT

SEQ ID NO: 619580 - protein, 18 aa, Mycobacterium
LSALVAHLVGADALVLLS

SEQ ID NO: 619581 - protein, 27 aa, Mycobacterium
LSDDELLGFCLLLLIAGHETTSNLLAN

SEQ ID NO: 619582 - protein, 24 aa, Mycobacterium
LSDLELYLFFSLLFSAGAETTRNA

SEQ ID NO: 619583 - protein, 22 aa, Mycobacterium
LSFAQSRLWFLEQLQGPSAVYN

SEQ ID NO: 619584 - protein, 27 aa, Mycobacterium
LSFSRYELLRLLAFSRTGALPITKASD

SEQ ID NO: 619585 - protein, 20 aa, Mycobacterium
LSFTLPRNGIVGVIGPNGVG

SEQ ID NO: 619586 - protein, 21 aa, Mycobacterium
LSGDHQVGFGGWNSGSGNVGL

SEQ ID NO: 619587 - protein, 23 aa, Mycobacterium
LSGRLSTSAHRWLAGHQLGDTVV

SEQ ID NO: 619588 - protein, 22 aa, Mycobacterium
LSKAQILDRVWSYDFGGRSNIV

SEQ ID NO: 619589 - protein, 27 aa, Mycobacterium
LSLMVKAGVQWGLFGGAVENLGTERHH

SEQ ID NO: 619590 - protein, 17 aa, Mycobacterium
LSPSFNWDTTGMTDEEM

SEQ ID NO: 619591 - protein, 17 aa, Mycobacterium
LSRHRRADDLYTLNCEE

SEQ ID NO: 619592 - protein, 17 aa, Mycobacterium
LSTYKMVFGHRGINIPV

SEQ ID NO: 619593 - protein, 18 aa, Mycobacterium
LTALPMRRAIVMVICGKA

SEQ ID NO: 619594 - protein, 19 aa, Mycobacterium
LTDAIALLIAEGHPVHVVV

SEQ ID NO: 619595 - protein, 20 aa, Mycobacterium
LTDHSPRLTIANGLSPERLR

SEQ ID NO: 619596 - protein, 17 aa, Mycobacterium
LTGLKRISRRAMSAPSS

SEQ ID NO: 619597 - protein, 18 aa, Mycobacterium
LTGSGQVGFGGWNSGSGN

SEQ ID NO: 619598 - protein, 18 aa, Mycobacterium
LTLPGRSLLFVRNVGHLM

SEQ ID NO: 619599 - protein, 20 aa, Mycobacterium
LTMRGLKTLVLRMQRHSENA

SEQ ID NO: 619600 - protein, 22 aa, Mycobacterium
LTPWAQRGVMLLNRVLTVRPSN

SEQ ID NO: 619601 - protein, 18 aa, Mycobacterium
LTSPELATLMAHVKLALK

SEQ ID NO: 619602 - protein, 18 aa, Mycobacterium
LTTRVIDLIMPIGKGQRA

SEQ ID NO: 619603 - protein, 19 aa, Mycobacterium
LVDDFGINTDNMFGFWDWV

SEQ ID NO: 619604 - protein, 23 aa, Mycobacterium
LVEMRRVRDLQPYIGKEIEAKII

SEQ ID NO: 619605 - protein, 17 aa, Mycobacterium
LVFDTVITRTVRFPETS

SEQ ID NO: 619606 - protein, 17 aa, Mycobacterium
LWDKGLAYEGYRVLPYC

SEQ ID NO: 619607 - protein, 19 aa, Mycobacterium
LYLATVIDCCSRRVAGWAI

SEQ ID NO: 619608 - protein, 18 aa, Mycobacterium
LYLPGAPIGSLAGYVNDP

SEQ ID NO: 619609 - protein, 25 aa, Mycobacterium
LYPRKGVSELTRFTPEAVVEKYGLT

SEQ ID NO: 619610 - protein, 18 aa, Mycobacterium
MAADAGLTSSSWARGPHH

SEQ ID NO: 619611 - protein, 23 aa, Mycobacterium
MATGELRATMALTEPGGGSDLQN

SEQ ID NO: 619612 - protein, 29 aa, Mycobacterium
MCTIGDPLLDLGWLLATWRQPDGSSVFSH

SEQ ID NO: 619613 - protein, 17 aa, Mycobacterium
MDVRFLPNPHWVDELRP

SEQ ID NO: 619614 - protein, 17 aa, Mycobacterium
MEARVALTELFKRIRGY

SEQ ID NO: 619615 - protein, 18 aa, Mycobacterium
MEVFAGFSENADWNVGRL

SEQ ID NO: 619616 - protein, 24 aa, Mycobacterium
MGAEADALCGAGYGERSAERTNSR

SEQ ID NO: 619617 - protein, 17 aa, Mycobacterium
MGFIYLMQNLPQERISI

SEQ ID NO: 619618 - protein, 24 aa, Mycobacterium
MGPEGRAAIGLGDGVVRISVGLEG

SEQ ID NO: 619619 - protein, 26 aa, Mycobacterium
MGRIDPRTRWLLRELVYALLVKKDHA

SEQ ID NO: 619620 - protein, 25 aa, Mycobacterium
MIGKPGAGVCPVRGHSNVQGDRTMG

SEQ ID NO: 619621 - protein, 17 aa, Mycobacterium
MMSSMLGGMGIPGMGRK

SEQ ID NO: 619622 - protein, 21 aa, Mycobacterium
MPGMDGFGVLRRLRADGIDAP

SEQ ID NO: 619623 - protein, 22 aa, Mycobacterium
MRWKGKRPTVRGVVMNPVDHPH

SEQ ID NO: 619624 - protein, 23 aa, Mycobacterium
MTPGCTKEACHFRDLAAEFAAVG

SEQ ID NO: 619625 - protein, 17 aa, Mycobacterium
MVSALKAVWGEFQQPVV

SEQ ID NO: 619626 - protein, 17 aa, Mycobacterium
MWAASGVDYPTLLATMV

SEQ ID NO: 619627 - protein, 18 aa, Mycobacterium
MWHAMRHAGHDMGRDQVA

SEQ ID NO: 619628 - protein, 24 aa, Mycobacterium
MYLFSPYDVERVYGLPFADISVTE

SEQ ID NO: 619629 - protein, 18 aa, Mycobacterium
MYSVMWSEHCSYKSSKVH

SEQ ID NO: 619630 - protein, 18 aa, Mycobacterium
NAAGLGVDAVVFGSGCAD

SEQ ID NO: 619631 - protein, 25 aa, Mycobacterium
NDPDWQRFHLIGATNPVYFALLARR

SEQ ID NO: 619632 - protein, 24 aa, Mycobacterium
NDPDWQRFHLIGATNTVYFALLAR

SEQ ID NO: 619633 - protein, 22 aa, Mycobacterium
NEDEVDAFLDLVENELTRLIEE

SEQ ID NO: 619634 - protein, 25 aa, Mycobacterium
NEIPSRAYVSAFGFKGPDQQKPAGV

SEQ ID NO: 619635 - protein, 21 aa, Mycobacterium
NFGSGNWGGFNLGSGNIGSYN

SEQ ID NO: 619636 - protein, 23 aa, Mycobacterium
NLARAKMGLPVPVTSRHTLLLGP

SEQ ID NO: 619637 - protein, 23 aa, Mycobacterium
NNNWFAAYAYWYFKLYGHEKVKL

SEQ ID NO: 619638 - protein, 17 aa, Mycobacterium
NNTPFQWGKQMASHLGG

SEQ ID NO: 619639 - protein, 18 aa, Mycobacterium
NPECHLMVVLVDERPEEV

SEQ ID NO: 619640 - protein, 17 aa, Mycobacterium
NRGKRSIGLDMSVPEGK

SEQ ID NO: 619641 - protein, 18 aa, Mycobacterium
NRMISWPYTKLMNSNNMV

SEQ ID NO: 619642 - protein, 21 aa, Mycobacterium
NRNQGAFGFSEPCTDCRGSGS

SEQ ID NO: 619643 - protein, 18 aa, Mycobacterium
NRSACVRIPITGNNPKAK

SEQ ID NO: 619644 - protein, 32 aa, Mycobacterium
NSWSVKVPRRLKELHLRLGAATAELSQRLGRA

SEQ ID NO: 619645 - protein, 17 aa, Mycobacterium
NTLWPRTLVATAAVQNL

SEQ ID NO: 619646 - protein, 25 aa, Mycobacterium
NVPRLVPGWTKPIVIGRHAFGDQYR

SEQ ID NO: 619647 - protein, 22 aa, Mycobacterium
NVVALFTGFGWWRGLTDTDVWA

SEQ ID NO: 619648 - protein, 22 aa, Mycobacterium
NWIKEFDPRFNVRYRDDKSYPV

SEQ ID NO: 619649 - protein, 26 aa, Mycobacterium
NWYAFDPCCPFGGYKNSGIGRENGPE

SEQ ID NO: 619650 - protein, 19 aa, Mycobacterium
PAMVIADLLGVPREDRTQF

SEQ ID NO: 619651 - protein, 20 aa, Mycobacterium
PDTWVLWNLTGGPRGGVHVT

SEQ ID NO: 619652 - protein, 27 aa, Mycobacterium
PEAIVAVALPRSARLVVALLAIAKTGA

SEQ ID NO: 619653 - protein, 17 aa, Mycobacterium
PECELVIVVGSRNSSNS

SEQ ID NO: 619654 - protein, 24 aa, Mycobacterium
PEHPFPVWTERGGPATIVPMFLLY

SEQ ID NO: 619655 - protein, 17 aa, Mycobacterium
PELGYRLLQRLGADVAE

SEQ ID NO: 619656 - protein, 21 aa, Mycobacterium
PELPVGVRLIFQAAEELMPGG

SEQ ID NO: 619657 - protein, 22 aa, Mycobacterium
PEPTFVPVLGRIAAGGPILAEE

SEQ ID NO: 619658 - protein, 21 aa, Mycobacterium
PERRRGMAVIISDFLGPINWM

SEQ ID NO: 619659 - protein, 22 aa, Mycobacterium
PEWPQMLLRALMFRLAVHALHP

SEQ ID NO: 619660 - protein, 18 aa, Mycobacterium
PFAGRLLGDMGADVIKVE

SEQ ID NO: 619661 - protein, 18 aa, Mycobacterium
PFDLLLQLIFAHRLDVTE

SEQ ID NO: 619662 - protein, 21 aa, Mycobacterium
PFGGAYRLIDFVLSNLVNARY

SEQ ID NO: 619663 - protein, 18 aa, Mycobacterium
PFTPRAKKVLELSLREAL

SEQ ID NO: 619664 - protein, 20 aa, Mycobacterium
PGAPLARAETRVAIERLLDR

SEQ ID NO: 619665 - protein, 20 aa, Mycobacterium
PGIPESFKVLLKELQSLCLN

SEQ ID NO: 619666 - protein, 19 aa, Mycobacterium
PGKLPAIRQQIWTLIRAAK

SEQ ID NO: 619667 - protein, 18 aa, Mycobacterium
PHRGRLNVLANIVGKPYS

SEQ ID NO: 619668 - protein, 18 aa, Mycobacterium
PKPPPQRITLTLPAIQRS

SEQ ID NO: 619669 - protein, 23 aa, Mycobacterium
PKVVLVTGACRFLGGYLTARLAQ

SEQ ID NO: 619670 - protein, 19 aa, Mycobacterium
PLACPGLLGAMTVGATTVF

SEQ ID NO: 619671 - protein, 19 aa, Mycobacterium
PLSRHRRADDLYTLNCEEP

SEQ ID NO: 619672 - protein, 18 aa, Mycobacterium
PPELYRITYDGSIADEPH

SEQ ID NO: 619673 - protein, 19 aa, Mycobacterium
PPGCGKTFVVRALASSGRL

SEQ ID NO: 619674 - protein, 17 aa, Mycobacterium
PPQWFRVPSNTYFNEGA

SEQ ID NO: 619675 - protein, 17 aa, Mycobacterium
PQISFFFYTHGDFFEEI

SEQ ID NO: 619676 - protein, 22 aa, Mycobacterium
PQYRIAVADARTRRDGRSIEVI

SEQ ID NO: 619677 - protein, 20 aa, Mycobacterium
PRGHSVPVPGELGGAAMVID

SEQ ID NO: 619678 - protein, 18 aa, Mycobacterium
PRGTDWHPHRGFETVTYM

SEQ ID NO: 619679 - protein, 20 aa, Mycobacterium
PRLRGWGESMSRQAGGRAGG

SEQ ID NO: 619680 - protein, 23 aa, Mycobacterium
PRRHPGKRSPLWHQRQRAAQLLD

SEQ ID NO: 619681 - protein, 24 aa, Mycobacterium
PSTDEPFSALAFKVATHPFFGKLT

SEQ ID NO: 619682 - protein, 18 aa, Mycobacterium
PSVPHVLIEPGVRTGIPL

SEQ ID NO: 619683 - protein, 24 aa, Mycobacterium
PTASLDIWWCQGFSEPEAGSDLAS

SEQ ID NO: 619684 - protein, 24 aa, Mycobacterium
PTGPYHLLGWSFGGVLAHQIAIEL

SEQ ID NO: 619685 - protein, 18 aa, Mycobacterium
PTRKAAEVTGMHRSTATR

SEQ ID NO: 619686 - protein, 18 aa, Mycobacterium
PTVFQRLAPGIMPLSVAE

SEQ ID NO: 619687 - protein, 24 aa, Mycobacterium
PVEIREFLEGYVIGQDTAKRTLAV

SEQ ID NO: 619688 - protein, 38 aa, Mycobacterium
PVLKATGPQQIWSWDITDLRSPWRGVAFKAYSILDIYS

SEQ ID NO: 619689 - protein, 26 aa, Mycobacterium
PVRLAELFVEAGLPPGVFQVVHGDKE

SEQ ID NO: 619690 - protein, 18 aa, Mycobacterium
PYGTVLIIGAWNYPFYLT

SEQ ID NO: 619691 - protein, 17 aa, Mycobacterium
PYSELFGPNALGTAELI

SEQ ID NO: 619692 - protein, 26 aa, Mycobacterium
QATRCMDCGIPFCHNGCPLGNLIPEW

SEQ ID NO: 619693 - protein, 17 aa, Mycobacterium
QDPDWRAAITHVAIDLS

SEQ ID NO: 619694 - protein, 19 aa, Mycobacterium
QEILFPALLPRAPYETTNR

SEQ ID NO: 619695 - protein, 24 aa, Mycobacterium
QFTGHLPAGFSFVPGHEIVGIVEH

SEQ ID NO: 619696 - protein, 24 aa, Mycobacterium
QGAWPRFGLELPELLPDKLTGLKR

SEQ ID NO: 619697 - protein, 25 aa, Mycobacterium
QGHASPGIYARAFLEGRLTTDQLDG

SEQ ID NO: 619698 - protein, 20 aa, Mycobacterium
QGYGSLGLMTSVLMTADGKT

SEQ ID NO: 619699 - protein, 29 aa, Mycobacterium
QHVKPGKGPAFVRTKLKNVLSGKVVDKTY

SEQ ID NO: 619700 - protein, 17 aa, Mycobacterium
QKVSLISAFSSRARLLL

SEQ ID NO: 619701 - protein, 24 aa, Mycobacterium
QLARASVMALSYVAQSARGIYQPA

SEQ ID NO: 619702 - protein, 19 aa, Mycobacterium
QLFPTADGYLALFITHDGF

SEQ ID NO: 619703 - protein, 27 aa, Mycobacterium
QLSGGMCQRALIAIGLAGRPRLLIADE

SEQ ID NO: 619704 - protein, 18 aa, Mycobacterium
QLTMRVFTGLTLLDTIQG

SEQ ID NO: 619705 - protein, 17 aa, Mycobacterium
QLVVPVLNARFALNAAN

SEQ ID NO: 619706 - protein, 26 aa, Mycobacterium
QMPIHMRLPKLKGFRNRFRTEYEIVN

SEQ ID NO: 619707 - protein, 18 aa, Mycobacterium
QNARLAARLTGWRIDIRG

SEQ ID NO: 619708 - protein, 19 aa, Mycobacterium
QPTIPGWRAETLGDDIAWM

SEQ ID NO: 619709 - protein, 17 aa, Mycobacterium
QQFSRVRVFAFIDTTDE

SEQ ID NO: 619710 - protein, 19 aa, Mycobacterium
QREILILRVVVGLSAEETA

SEQ ID NO: 619711 - protein, 26 aa, Mycobacterium
QRFLPPTFRGEMIWCQLFSEPGAGSD

SEQ ID NO: 619712 - protein, 18 aa, Mycobacterium
QRPELWNLYNGRHHKGEH

SEQ ID NO: 619713 - protein, 24 aa, Mycobacterium
QSRTIRLPVHLVEQVNKLARIKRE

SEQ ID NO: 619714 - protein, 24 aa, Mycobacterium
QTSGWSLTAQDAFNNVARTCIEAM

SEQ ID NO: 619715 - protein, 19 aa, Mycobacterium
QTVAMAKWWTTERAMKVLD

SEQ ID NO: 619716 - protein, 17 aa, Mycobacterium
QVFPVLTPLAVDPAHPF

SEQ ID NO: 619717 - protein, 17 aa, Mycobacterium
QVGFGGWNSGSGNVGLF

SEQ ID NO: 619718 - protein, 27 aa, Mycobacterium
QVNRKVLPGYILVRMELNDESWGAVRN

SEQ ID NO: 619719 - protein, 21 aa, Mycobacterium
RAAEAVALLALIAGQDVEPVD

SEQ ID NO: 619720 - protein, 26 aa, Mycobacterium
RAAEPWEVAATIAFLASDYSSYLTGE

SEQ ID NO: 619721 - protein, 21 aa, Mycobacterium
RAAFEAGWIQPTWPREHGGRS

SEQ ID NO: 619722 - protein, 20 aa, Mycobacterium
RAAGCSRATLYRYFENREAL

SEQ ID NO: 619723 - protein, 31 aa, Mycobacterium; identical to SEQ ID NO: 195348

SEQ ID NO: 619724 - protein, 19 aa, Mycobacterium
RAGASLINMEFVQFHPTGM

SEQ ID NO: 619725 - protein, 21 aa, Mycobacterium
RAKPAVPFGGAYRLIDFVLSN

SEQ ID NO: 619726 - protein, 19 aa, Mycobacterium
RAMIDLSTMVGRVISPTNR

SEQ ID NO: 619727 - protein, 17 aa, Mycobacterium
RATLPRLGELAIGGTAV

SEQ ID NO: 619728 - protein, 31 aa, Mycobacterium
RAYAKKFRFPTFLGAFKYYTSYTLKTFDGKR

SEQ ID NO: 619729 - protein, 23 aa, Mycobacterium
RDGEAIGALLTRMGAQDTRLTWE

SEQ ID NO: 619730 - protein, 17 aa, Mycobacterium
RDGLHMASLAGAWTALV

SEQ ID NO: 619731 - protein, 26 aa, Mycobacterium
RDLVLRRLTEALARDRTRHQVSEVTS

SEQ ID NO: 619732 - protein, 25 aa, Mycobacterium
REALKSALQYPALAGPVFDTLTVES

SEQ ID NO: 619733 - protein, 26 aa, Mycobacterium
REHDILAFERQWWKYAGSKEDAIKEL

SEQ ID NO: 619734 - protein, 18 aa, Mycobacterium
RFGDAFIPMDETLAHAAV

SEQ ID NO: 619735 - protein, 29 aa, Mycobacterium
RFSFNVKGGRCEACTGDGTIKIEMNFLPD

SEQ ID NO: 619736 - protein, 24 aa, Mycobacterium
RFYERKEIRDIVAYLRVLDNPGDA

SEQ ID NO: 619737 - protein, 21 aa, Mycobacterium
RGGCMAAKFFTGLPLDGPDPE

SEQ ID NO: 619738 - protein, 24 aa, Mycobacterium
RGKGCDICKPVVASILASTGSDHI

SEQ ID NO: 619739 - protein, 19 aa, Mycobacterium
RGPQVPFTDVFLHGLIRDE

SEQ ID NO: 619740 - protein, 21 aa, Mycobacterium
RGPVATVLIQRGTLRVGDSVV

SEQ ID NO: 619741 - protein, 20 aa, Mycobacterium
RGRDMPVGVLVGSWHTIEGL

SEQ ID NO: 619742 - protein, 25 aa, Mycobacterium
RGSAKRITAILPFYPYARQDKKHRG

SEQ ID NO: 619743 - protein, 18 aa, Mycobacterium
RGVLSVRAKIKVRLTQLR

SEQ ID NO: 619744 - protein, 20 aa, Mycobacterium
RGVPQIEVTFDIDANGIVHV

SEQ ID NO: 619745 - protein, 19 aa, Mycobacterium
RGWLTAPVIVLSARTDSSD

SEQ ID NO: 619746 - protein, 23 aa, Mycobacterium
RHVSRGKLLPRERVDRLLDPGSP

SEQ ID NO: 619747 - protein, 22 aa, Mycobacterium
RINVNCAGIGNAIKTLSKDGPF

SEQ ID NO: 619748 - protein, 19 aa, Mycobacterium
RIPYLVAFQNNSGVRDVYG

SEQ ID NO: 619749 - protein, 24 aa, Mycobacterium
RIQEGVVSLGLYSRIFRNNILASG

SEQ ID NO: 619750 - protein, 17 aa, Mycobacterium
RISNALVAMAIESLGAQ

SEQ ID NO: 619751 - protein, 17 aa, Mycobacterium
RKGKIVVEFGSVDDLQR

SEQ ID NO: 619752 - protein, 23 aa, Mycobacterium
RKGWTLQEAERWLAPNLGYNPED

SEQ ID NO: 619753 - protein, 26 aa, Mycobacterium
RKTLKAVAVKAPFFGDRRKAFLEDLA

SEQ ID NO: 619754 - protein, 25 aa, Mycobacterium
RLANALRSWSVLRFEVTEDPSPGVD

SEQ ID NO: 619755 - protein, 17 aa, Mycobacterium
RLEGRAFGDVPLNLEYK

SEQ ID NO: 619756 - protein, 24 aa, Mycobacterium
RLGITTDWKSRWYADKQYADYVKE

SEQ ID NO: 619757 - protein, 18 aa, Mycobacterium
RLGLLPMYAVNQDKHGTA

SEQ ID NO: 619758 - protein, 18 aa, Mycobacterium
RLIVELLYATGIRVSELC

SEQ ID NO: 619759 - protein, 19 aa, Mycobacterium
RLLLPAGLETTYRSSGNLL

SEQ ID NO: 619760 - protein, 24 aa, Mycobacterium
RLLQRLGADVAEYGFVETSAKQDG

SEQ ID NO: 619761 - protein, 20 aa, Mycobacterium
RLSFTAALRVVRQSVAHQGA

SEQ ID NO: 619762 - protein, 20 aa, Mycobacterium
RLVGLTGITFTNVFNACATA

SEQ ID NO: 619763 - protein, 19 aa, Mycobacterium
RMQGYEVLWQPGMDHAGIA

SEQ ID NO: 619764 - protein, 23 aa, Mycobacterium
RMRWKGKRPSVRGVVMNPVDHPH

SEQ ID NO: 619765 - protein, 17 aa, Mycobacterium
RNNVLKLSQGEFVTVSK

SEQ ID NO: 619766 - protein, 23 aa, Mycobacterium
RNQIELFTALLLSLPGSPVLYYG

SEQ ID NO: 619767 - protein, 26 aa, Mycobacterium
RNVSHGCPNLSPANAQWFYDNFGSGD

SEQ ID NO: 619768 - protein, 25 aa, Mycobacterium
RNVWANAVIFCGHFPDGAEKFTKTD

SEQ ID NO: 619769 - protein, 19 aa, Mycobacterium
RPDALVLDVMMPRLDGLEV

SEQ ID NO: 619770 - protein, 19 aa, Mycobacterium
RPEFLNRIDDIIVFHQLTR

SEQ ID NO: 619771 - protein, 25 aa, Mycobacterium
RPGDGWRLAMDLLPYERSTCFWQRI

SEQ ID NO: 619772 - protein, 20 aa, Mycobacterium
RPGDVISLGATSWRITEITH

SEQ ID NO: 619773 - protein, 17 aa, Mycobacterium
RPIGLIIGLQLSANPFV

SEQ ID NO: 619774 - protein, 17 aa, Mycobacterium
RPIRINRVGDLGVLDSD

SEQ ID NO: 619775 - protein, 19 aa, Mycobacterium
RPMHEKIVGRIAVSDLARR

SEQ ID NO: 619776 - protein, 19 aa, Mycobacterium
RPQDGAIITGWDYPSCEAI

SEQ ID NO: 619777 - protein, 26 aa, Mycobacterium
RPQGVSGLNAVVSWPAEEWGRDPAGF

SEQ ID NO: 619778 - protein, 20 aa, Mycobacterium
RPRMLYDYFQQLFAQVTNPP

SEQ ID NO: 619779 - protein, 18 aa, Mycobacterium
RPVKSSFREGLTVLEYFI

SEQ ID NO: 619780 - protein, 24 aa, Mycobacterium
RQMIADRELETWLVVDMSASLDFG

SEQ ID NO: 619781 - protein, 27 aa, Mycobacterium
RQRENLSWSAPRLHLVDLQYSDVRLDK

SEQ ID NO: 619782 - protein, 22 aa, Mycobacterium
RQRFLAEQGYGYIIRDADDLLG

SEQ ID NO: 619783 - protein, 32 aa, Mycobacterium; identical to SEQ ID NO: 91351

SEQ ID NO: 619784 - protein, 24 aa, Mycobacterium
RRARKGEFRKLWISRINAAARAND

SEQ ID NO: 619785 - protein, 23 aa, Mycobacterium
RRDHGGVIFIDLRDASGVAQVVF

SEQ ID NO: 619786 - protein, 19 aa, Mycobacterium
RRFSPEMRLSMTSALEHYT

SEQ ID NO: 619787 - protein, 19 aa, Mycobacterium
RRITEGAAMIRSKGEAGTG

SEQ ID NO: 619788 - protein, 24 aa, Mycobacterium
RRLARHRKAVCPELVATAPRQVYS

SEQ ID NO: 619789 - protein, 17 aa, Mycobacterium
RRSCPECGRRFTTVETA

SEQ ID NO: 619790 - protein, 18 aa, Mycobacterium
RRTLRAGFTTVRNLGLFV

SEQ ID NO: 619791 - protein, 18 aa, Mycobacterium
RRTNVLYALIRDNRTWQP

SEQ ID NO: 619792 - protein, 23 aa, Mycobacterium
RSARAWLFTVARNMIIDDRRSAR

SEQ ID NO: 619793 - protein, 18 aa, Mycobacterium
RSELARKGIARGKSVVAL

SEQ ID NO: 619794 - protein, 24 aa, Mycobacterium
RSIKTAKLRAAQRVQRFLDAAQAI

SEQ ID NO: 619795 - protein, 23 aa, Mycobacterium
RSLNATKVFAWPDAEVAVMGAKA

SEQ ID NO: 619796 - protein, 19 aa, Mycobacterium
RSLRACIDLAALGENTIAV

SEQ ID NO: 619797 - protein, 26 aa, Mycobacterium
RSYYADFEGVLAFLQRKMAQTESEQM

SEQ ID NO: 619798 - protein, 20 aa, Mycobacterium
RTFPLRSSFAPSYNMTINLV

SEQ ID NO: 619799 - protein, 28 aa, Mycobacterium
RTSGEQRLSGFLLWQSAYSEMWFTEAHW

SEQ ID NO: 619800 - protein, 27 aa, Mycobacterium
RTTVNLKACIKAAADRVVFINTGFLDR

SEQ ID NO: 619801 - protein, 18 aa, Mycobacterium
RTVDFKNTVLIFTSNLGT

SEQ ID NO: 619802 - protein, 19 aa, Mycobacterium
RVALSALTMAEWFRDEAGQ

SEQ ID NO: 619803 - protein, 23 aa, Mycobacterium
RVDLAPEDRLNWWVDPDAAVAAE

SEQ ID NO: 619804 - protein, 25 aa, Mycobacterium
RVDNDPDIRCCILTGAGGYFCAGMD

SEQ ID NO: 619805 - protein, 18 aa, Mycobacterium
RVEACGLCGTDHEQFTGH

SEQ ID NO: 619806 - protein, 23 aa, Mycobacterium
RVFEELSLRGCVAALDGSDVIRA

SEQ ID NO: 619807 - protein, 17 aa, Mycobacterium
RVLEIGVGTGLLLAQLA

SEQ ID NO: 619808 - protein, 29 aa, Mycobacterium
RVMREMGWRGACKRRRVRTTIADPAATRA

SEQ ID NO: 619809 - protein, 25 aa, Mycobacterium
RVPPQRRGIGFVFQHYAAFKHLTVR

SEQ ID NO: 619810 - protein, 20 aa, Mycobacterium
RVPTEKGYREFVDRLDDVKP

SEQ ID NO: 619811 - protein, 29 aa, Mycobacterium
RVQLKGANLEFALGYSHPVVIEAPEGITF

SEQ ID NO: 619812 - protein, 18 aa, Mycobacterium
RVRFTSPHPAEFTDDVIE

SEQ ID NO: 619813 - protein, 25 aa, Mycobacterium
RVVEIGGPFSLELCGGTHVHNSAQI

SEQ ID NO: 619814 - protein, 26 aa, Mycobacterium
RYHSIWLPDHMVSFWPDSIWTPEFTD

SEQ ID NO: 619815 - protein, 19 aa, Mycobacterium
RYILPSFIEHSSFGVKESN

SEQ ID NO: 619816 - protein, 25 aa, Mycobacterium
RYRDRGRPFLAFLYGIAAHKVADAH

SEQ ID NO: 619817 - protein, 18 aa, Mycobacterium
SAALRRVELTRPRSVVGK

SEQ ID NO: 619818 - protein, 18 aa, Mycobacterium
SALAARGAHGARTDHGGV

SEQ ID NO: 619819 - protein, 18 aa, Mycobacterium
SAYSEMWFTEAHWPAFRR

SEQ ID NO: 619820 - protein, 17 aa, Mycobacterium
SDLLEAIELGFLLELAE

SEQ ID NO: 619821 - protein, 22 aa, Mycobacterium
SEIEEALRYGVVKMNVDTDTQY

SEQ ID NO: 619822 - protein, 19 aa, Mycobacterium
SELAPLLCAGIIGYRSLLR

SEQ ID NO: 619823 - protein, 17 aa, Mycobacterium
SEPELFGMFSRSHVFPI

SEQ ID NO: 619824 - protein, 26 aa, Mycobacterium
SESNAMWALSIPIPFIKPVGAGAGGY

SEQ ID NO: 619825 - protein, 27 aa, Mycobacterium
SESWFKTLKYAPAFPERFESIHHARDF

SEQ ID NO: 619826 - protein, 19 aa, Mycobacterium
SEVAMEIALNAVRIHGGYG

SEQ ID NO: 619827 - protein, 22 aa, Mycobacterium
SFSQFKRSALPNGPKVSHGGAL

SEQ ID NO: 619828 - protein, 18 aa, Mycobacterium
SGGRGVGSAENFSVVEAL

SEQ ID NO: 619829 - protein, 19 aa, Mycobacterium
SGMPRLYREAPLMGIWEGS

SEQ ID NO: 619830 - protein, 17 aa, Mycobacterium
SGSSRDWAAKGTLLLGV

SEQ ID NO: 619831 - protein, 35 aa, Mycobacterium
SGVGGRLYSGNGIPDIFGRPLIGDGADGAPGTGQA

SEQ ID NO: 619832 - protein, 19 aa, Mycobacterium
SLFFVPKFLFDFETGELGE

SEQ ID NO: 619833 - protein, 23 aa, Mycobacterium
SLGHPRKGLFLVHTDAVDSVLGT

SEQ ID NO: 619834 - protein, 24 aa, Mycobacterium
SLISAFSSRARLLLLDEPSSGLDP

SEQ ID NO: 619835 - protein, 17 aa, Mycobacterium
SMFDLAYGYARNQMSAY

SEQ ID NO: 619836 - protein, 20 aa, Mycobacterium
SPEDFLALLVAERVSVLSQT

SEQ ID NO: 619837 - protein, 18 aa, Mycobacterium
SPGFTLYSLSGHVTRPGQ

SEQ ID NO: 619838 - protein, 23 aa, Mycobacterium
SPIGKRNGWLSGLHATELLGAVQ

SEQ ID NO: 619839 - protein, 25 aa, Mycobacterium
SPQLFKQLLMVAGMERYYQIARCYR

SEQ ID NO: 619840 - protein, 27 aa, Mycobacterium
SQAGCGMACPFCATGQGGLTRNLSTAE

SEQ ID NO: 619841 - protein, 18 aa, Mycobacterium
SQLKPVFRPNGTVTAGNA

SEQ ID NO: 619842 - protein, 25 aa, Mycobacterium
SRFVACPFGALGARMYRTGDVVRWG

SEQ ID NO: 619843 - protein, 23 aa, Mycobacterium
SRTIRLPVHLVEQVNKLARIKRE

SEQ ID NO: 619844 - protein, 21 aa, Mycobacterium
SRWWKEEREGVFVDFNQNAKD

SEQ ID NO: 619845 - protein, 17 aa, Mycobacterium
SSAEAAAATPLQDLLNV

SEQ ID NO: 619846 - protein, 18 aa, Mycobacterium
SSLASFEGQLGKWSRMDA

SEQ ID NO: 619847 - protein, 18 aa, Mycobacterium
SSLLSRRDVVVVASVSCI

SEQ ID NO: 619848 - protein, 25 aa, Mycobacterium
STDPSQIAQAGGQGGTGGTGGAAGQ

SEQ ID NO: 619849 - protein, 22 aa, Mycobacterium
STKDLKDAFTFNVATAHALTVA

SEQ ID NO: 619850 - protein, 25 aa, Mycobacterium
STLQRPSMRGVPFSFVRVDRAGNMS

SEQ ID NO: 619851 - protein, 18 aa, Mycobacterium
STRFFPMLTTAAGTVKPA

SEQ ID NO: 619852 - protein, 18 aa, Mycobacterium
SVPSARRYLPGSLIMETT

SEQ ID NO: 619853 - protein, 23 aa, Mycobacterium
SVSDALDILRWAPQAASEPVAKV

SEQ ID NO: 619854 - protein, 20 aa, Mycobacterium
SYSESFGLVAVEAQACGTPV

SEQ ID NO: 619855 - protein, 20 aa, Mycobacterium
TAGSGEAWLAICPATPQLVQ

SEQ ID NO: 619856 - protein, 29 aa, Mycobacterium
TARVKRGMAEMLKGGVIMDVVTPEQARIA

SEQ ID NO: 619857 - protein, 21 aa, Mycobacterium
TAVACPRFVDFVERGVTSGRQ

SEQ ID NO: 619858 - protein, 28 aa, Mycobacterium
TAWLRDRLSEVLPAYMVPAAFIEIDELP

SEQ ID NO: 619859 - protein, 18 aa, Mycobacterium
TCRYLESATNILLVGPPG

SEQ ID NO: 619860 - protein, 18 aa, Mycobacterium
TDAPRYAELIKRTQWWGR

SEQ ID NO: 619861 - protein, 17 aa, Mycobacterium
TDGRWRIAQRVAQDRVI

SEQ ID NO: 619862 - protein, 23 aa, Mycobacterium
TDKAKSLLAKRGFDPVLGARPLR

SEQ ID NO: 619863 - protein, 22 aa, Mycobacterium
TDKGRALAVAVMRKHRLAERLL

SEQ ID NO: 619864 - protein, 19 aa, Mycobacterium
TDSAVRRYVTDAGPLLPRL

SEQ ID NO: 619865 - protein, 19 aa, Mycobacterium
TEKNFKWIARSADGWITTP

SEQ ID NO: 619866 - protein, 17 aa, Mycobacterium
TEPKARALRPYAEKLIT

SEQ ID NO: 619867 - protein, 20 aa, Mycobacterium
TGADVSIAFVPPAFSKDAII

SEQ ID NO: 619868 - protein, 17 aa, Mycobacterium
TGDLVCWGPDGQLQYLG

SEQ ID NO: 619869 - protein, 23 aa, Mycobacterium
TGKLRPPVFGILRYIADAVDEID

SEQ ID NO: 619870 - protein, 24 aa, Mycobacterium
TGPELLSRAAALNWDTTAPATVVV

SEQ ID NO: 619871 - protein, 25 aa, Mycobacterium
TIKSAVAFGALLSRGIGDTIRVSLS

SEQ ID NO: 619872 - protein, 22 aa, Mycobacterium
TIRLGKYDIGIAIGLDKHPRGA

SEQ ID NO: 619873 - protein, 17 aa, Mycobacterium
TKGLSLFFVPKFLFDFE

SEQ ID NO: 619874 - protein, 25 aa, Mycobacterium
TLHSVKVIPGRGAWLEFDVDKRDTV

SEQ ID NO: 619875 - protein, 23 aa, Mycobacterium
TLTGDGIGIVFRKGLPLEDMEFH

SEQ ID NO: 619876 - protein, 21 aa, Mycobacterium
TMKYRPNYPGVFTDLDSARAW

SEQ ID NO: 619877 - protein, 28 aa, Mycobacterium
TNHIDKWKFTVPFVCGATNLGEALRRIT

SEQ ID NO: 619878 - protein, 17 aa, Mycobacterium
TNLWLTIHESIGHATEY

SEQ ID NO: 619879 - protein, 18 aa, Mycobacterium
TPSGYRLDGVKSLVPAAA

SEQ ID NO: 619880 - protein, 18 aa, Mycobacterium
TRAPRFGAYIASKAALDS

SEQ ID NO: 619881 - protein, 17 aa, Mycobacterium
TRKSRRLRTDLVGGDQA

SEQ ID NO: 619882 - protein, 17 aa, Mycobacterium
TRPEVRGGLGGFAGLFA

SEQ ID NO: 619883 - protein, 25 aa, Mycobacterium
TRTRVSFEVAGKWMSADVINVSASG

SEQ ID NO: 619884 - protein, 29 aa, Mycobacterium
TSGRIERFLQLWAEGSMTIAMPSTPSNYF

SEQ ID NO: 619885 - protein, 24 aa, Mycobacterium
TTNRGVGAWGEILGDTTVAAAMLD

SEQ ID NO: 619886 - protein, 18 aa, Mycobacterium
TTPEFTTPPLVVDPVSVA

SEQ ID NO: 619887 - protein, 18 aa, Mycobacterium
TVRSNLLFFRSRGDSGRW

SEQ ID NO: 619888 - protein, 38 aa, Mycobacterium
TVVPIGAPVPGAGVFVLDGWLRPVPPGTVGELYVAGAG

SEQ ID NO: 619889 - protein, 18 aa, Mycobacterium
TVVPLLPAQDFKRVGEGD

SEQ ID NO: 619890 - protein, 26 aa, Mycobacterium
TYGIDFIEACAWIKENLPGVHISGGI

SEQ ID NO: 619891 - protein, 23 aa, Mycobacterium
TYPFQHRRYWLDPAPRADVSAAG

SEQ ID NO: 619892 - protein, 19 aa, Mycobacterium
VADAYRFLPTLGEVDLHLF

SEQ ID NO: 619893 - protein, 26 aa, Mycobacterium
VAEELGQPLPLFIKWDDAEYGLRAGE

SEQ ID NO: 619894 - protein, 24 aa, Mycobacterium
VAGLSSPRIVGWIMRTDSSDLPWH

SEQ ID NO: 619895 - protein, 23 aa, Mycobacterium
VAHPDRRTVLLIGDGAAQLTVQE

SEQ ID NO: 619896 - protein, 18 aa, Mycobacterium
VAMVVDMHGRRSRDIVDK

SEQ ID NO: 619897 - protein, 24 aa, Mycobacterium
VATAPRQVYSWDITKLAGPVKGVY

SEQ ID NO: 619898 - protein, 17 aa, Mycobacterium
VATKLFAARGYHGTRMD

SEQ ID NO: 619899 - protein, 18 aa, Mycobacterium
VAVGPRPDKVLHVTALVE

SEQ ID NO: 619900 - protein, 19 aa, Mycobacterium
VCEPFLVRAGMVARTPRGR

SEQ ID NO: 619901 - protein, 22 aa, Mycobacterium
VDEIRKAVRYQIKHGAQLIKVC

SEQ ID NO: 619902 - protein, 25 aa, Mycobacterium
VDIGRGRNGVLYAGEVNWEAAGLGG

SEQ ID NO: 619903 - protein, 22 aa, Mycobacterium
VDRDEVLLDIGYKTEGVIPARE

SEQ ID NO: 619904 - protein, 19 aa, Mycobacterium
VDTAVLCDRCQGKGTNGDS

SEQ ID NO: 619905 - protein, 21 aa, Mycobacterium
VDTSFSMVMENRWLPMKRTAL

SEQ ID NO: 619906 - protein, 20 aa, Mycobacterium
VEALVGLGFAAKQAEEATDK

SEQ ID NO: 619907 - protein, 20 aa, Mycobacterium
VEELGIDVFLVMPFTTDFMK

SEQ ID NO: 619908 - protein, 23 aa, Mycobacterium
VELPLMEVRALLDLGDVAKATRK

SEQ ID NO: 619909 - protein, 25 aa, Mycobacterium
VEMEREGLEIPLLIGGATTSRAHTA

SEQ ID NO: 619910 - protein, 21 aa, Mycobacterium
VEMRNRLKSATGLALSPTLIF

SEQ ID NO: 619911 - protein, 19 aa, Mycobacterium
VERFGDLVFDTVITRTVRF

SEQ ID NO: 619912 - protein, 25 aa, Mycobacterium
VERRYRAWIRWNAAIMVHRAQRPGV

SEQ ID NO: 619913 - protein, 18 aa, Mycobacterium
VFLVMPFTTDFMKLTPDR

SEQ ID NO: 619914 - protein, 23 aa, Mycobacterium
VFTRAQLLHEVWGYDFFGGTRTV

SEQ ID NO: 619915 - protein, 24 aa, Mycobacterium
VFYLHSRLLERCAKLSDELGGGSL

SEQ ID NO: 619916 - protein, 22 aa, Mycobacterium
VGAGGAGMRAAVEAGPRVRTAV

SEQ ID NO: 619917 - protein, 17 aa, Mycobacterium
VGEEWLYQSWAAAYLPL

SEQ ID NO: 619918 - protein, 20 aa, Mycobacterium
VGFKGSRKSTPFAAQLAAEN

SEQ ID NO: 619919 - protein, 22 aa, Mycobacterium
VGFKGSRKSTPFAAQLAAENAA

SEQ ID NO: 619920 - protein, 22 aa, Mycobacterium
VGGGSGWWNFASGGVGYSGVGN

SEQ ID NO: 619921 - protein, 18 aa, Mycobacterium
VGGRGSGAVMVLAGPPGV

SEQ ID NO: 619922 - protein, 17 aa, Mycobacterium
VGLALRGFVPVPEIQFD

SEQ ID NO: 619923 - protein, 22 aa, Mycobacterium
VGLGCSLVALSDIVYIAEDAYL

SEQ ID NO: 619924 - protein, 25 aa, Mycobacterium
VGMAYDLCMSRNIPLSMTLGRHVND

SEQ ID NO: 619925 - protein, 29 aa, Mycobacterium
VGQIIPWNFPILMAVWKLAPALAAGNAVV

SEQ ID NO: 619926 - protein, 18 aa, Mycobacterium
VGSSRANLFTSISGGINA

SEQ ID NO: 619927 - protein, 27 aa, Mycobacterium
VGTGAGVSGLWLLSGMSDDGVLTTIDI

SEQ ID NO: 619928 - protein, 17 aa, Mycobacterium
VHSCPGGPLARVEGRVS

SEQ ID NO: 619929 - protein, 18 aa, Mycobacterium
VINRHVFESLAMNARIAL

SEQ ID NO: 619930 - protein, 19 aa, Mycobacterium
VKAAVDVFKEKLIRRDISM

SEQ ID NO: 619931 - protein, 27 aa, Mycobacterium
VKDCIQVLGGIGCTWEHDAHLYLRRAH

SEQ ID NO: 619932 - protein, 23 aa, Mycobacterium
VKGGRRFSFTALVIVGDGNGMVG

SEQ ID NO: 619933 - protein, 24 aa, Mycobacterium
VLADRGFFSYALWRNASDTGADLL

SEQ ID NO: 619934 - protein, 24 aa, Mycobacterium
VLAGFPGTVASFWQQAGRSGRRGQ

SEQ ID NO: 619935 - protein, 26 aa, Mycobacterium
VLERLRPGDFYRPAHQNVYDAILDLY

SEQ ID NO: 619936 - protein, 18 aa, Mycobacterium
VLGWRAQHSQSHYAAAKA

SEQ ID NO: 619937 - protein, 17 aa, Mycobacterium
VLLPGLPYLGLEHRAAW

SEQ ID NO: 619938 - protein, 23 aa, Mycobacterium
VLLSDPWACSRFAEHEVVVPLVV

SEQ ID NO: 619939 - protein, 19 aa, Mycobacterium
VLMETRPSALVAIAALSRL

SEQ ID NO: 619940 - protein, 24 aa, Mycobacterium
VLPELKGKLDGYALRVPIPTGSVT

SEQ ID NO: 619941 - protein, 24 aa, Mycobacterium
VLSRAQLLELVWGYDFAADTNVVD

SEQ ID NO: 619942 - protein, 22 aa, Mycobacterium
VNGPCVGAGLALCLAADIRICS

SEQ ID NO: 619943 - protein, 23 aa, Mycobacterium
VNHPDGRIGFMIEDAAPVAVITT

SEQ ID NO: 619944 - protein, 18 aa, Mycobacterium
VNTGMGFEGPVHRANFDA

SEQ ID NO: 619945 - protein, 26 aa, Mycobacterium
VPAFALGDYEWILAFEAPELHRIVDL

SEQ ID NO: 619946 - protein, 21 aa, Mycobacterium
VPARLHPGSFYALPQSPQLFK

SEQ ID NO: 619947 - protein, 18 aa, Mycobacterium
VPEGAIVVFSAHGVAPTV

SEQ ID NO: 619948 - protein, 22 aa, Mycobacterium
VPGSFRPGRAISGFVTGAQGLG

SEQ ID NO: 619949 - protein, 23 aa, Mycobacterium
VPLPTEKNVYCVIRSPHKYKDSR

SEQ ID NO: 619950 - protein, 22 aa, Mycobacterium
VPRTKRGVISYAARDIGERLDA

SEQ ID NO: 619951 - protein, 21 aa, Mycobacterium
VPSERTGSVARCYSLCSSPFT

SEQ ID NO: 619952 - protein, 24 aa, Mycobacterium
VPVNPSGGLACFGEAIPAQAIAQV

SEQ ID NO: 619953 - protein, 19 aa, Mycobacterium
VPVYPTCHYVMGGIPTTVT

SEQ ID NO: 619954 - protein, 18 aa, Mycobacterium
VQELFEARVPRGKAPIAD

SEQ ID NO: 619955 - protein, 22 aa, Mycobacterium
VRESLRRSLSFNGYSVELAHDG

SEQ ID NO: 619956 - protein, 25 aa, Mycobacterium
VRLGGPRLKDVAGLSLTKLFVGSEG

SEQ ID NO: 619957 - protein, 18 aa, Mycobacterium
VRPGCAVAVRLDAGHSRE

SEQ ID NO: 619958 - protein, 19 aa, Mycobacterium
VRRQFYWHRFFSHQPDLNY

SEQ ID NO: 619959 - protein, 24 aa, Mycobacterium
VRRYIIGCALRWMRDFHADGLRLD

SEQ ID NO: 619960 - protein, 21 aa, Mycobacterium
VRTSGYLAGPHDVYVSMNMVR

SEQ ID NO: 619961 - protein, 25 aa, Mycobacterium
VSARPSDSVAIALRVGVPIYVEEAV

SEQ ID NO: 619962 - protein, 18 aa, Mycobacterium
VSDLFDFSLYVDARIEDI

SEQ ID NO: 619963 - protein, 17 aa, Mycobacterium
VSIPAAFASVVAAHPHA

SEQ ID NO: 619964 - protein, 18 aa, Mycobacterium
VSLIGAGMRSHPGVTATF

SEQ ID NO: 619965 - protein, 24 aa, Mycobacterium
VSPEKRTRLGVGHFVETLETYRRQ

SEQ ID NO: 619966 - protein, 19 aa, Mycobacterium
VSPVLWKKVAPKLSAGRVQ

SEQ ID NO: 619967 - protein, 18 aa, Mycobacterium
VTGGLTFAGGPWNNYVTH

SEQ ID NO: 619968 - protein, 26 aa, Mycobacterium
VTLGPRGRHVVLAKAFGGPAVTNDGV

SEQ ID NO: 619969 - protein, 20 aa, Mycobacterium
VTPLRARIAERLEQSGPTVS

SEQ ID NO: 619970 - protein, 24 aa, Mycobacterium
VVEVARSSFYAWLAGADGRAARRA

SEQ ID NO: 619971 - protein, 23 aa, Mycobacterium
VVKVARIAGQYAKPRSADIDALG

SEQ ID NO: 619972 - protein, 19 aa, Mycobacterium
VWRALRASMRSVLEETTLA

SEQ ID NO: 619973 - protein, 17 aa, Mycobacterium
VYFPSLSGQTFVYKGML

SEQ ID NO: 619974 - protein, 19 aa, Mycobacterium
VYVPCEVCHGARYNRETLE

SEQ ID NO: 619975 - protein, 17 aa, Mycobacterium
WAGEVLLREAHDLCGLP

SEQ ID NO: 619976 - protein, 19 aa, Mycobacterium
WDRPIRRSLAFGRGQHFCI

SEQ ID NO: 619977 - protein, 25 aa, Mycobacterium
WEPHALHIAVEFVHPVIMGKRALPA

SEQ ID NO: 619978 - protein, 20 aa, Mycobacterium
WFASNCAGEAFVVLAKPEGA

SEQ ID NO: 619979 - protein, 17 aa, Mycobacterium
WFPSLKIYNRNGQLYTA

SEQ ID NO: 619980 - protein, 17 aa, Mycobacterium
WGESMSRQAGGRAGGAG

SEQ ID NO: 619981 - protein, 19 aa, Mycobacterium
WGIAAAMTRGDISVTGVDP

SEQ ID NO: 619982 - protein, 17 aa, Mycobacterium
WGPAYATETHYLRVYLA

SEQ ID NO: 619983 - protein, 18 aa, Mycobacterium
WGSSYGPIGEACRRARRK

SEQ ID NO: 619984 - protein, 26 aa, Mycobacterium
WKAGPALACGNAFVLKPSERDPSVPV

SEQ ID NO: 619985 - protein, 17 aa, Mycobacterium
WKLFIDAFVEFYHAPIL

SEQ ID NO: 619986 - protein, 25 aa, Mycobacterium
WNAGKDLSFVPLRPERVVEVRYDHM

SEQ ID NO: 619987 - protein, 18 aa, Mycobacterium
WQLGMTRHFLAGDAQPRY

SEQ ID NO: 619988 - protein, 25 aa, Mycobacterium
WRQADKYDVPRICFVNKMDKIGADF

SEQ ID NO: 619989 - protein, 25 aa, Mycobacterium
WRQADKYDVPRICFVNKMDKLGADF

SEQ ID NO: 619990 - protein, 20 aa, Mycobacterium
WTDAQVIDAIWRLRRSNKLF

SEQ ID NO: 619991 - protein, 24 aa, Mycobacterium
WTRVPYEVLERISTRITNEVPEVN

SEQ ID NO: 619992 - protein, 18 aa, Mycobacterium
WTSLIAYADYVWLAVRTN

SEQ ID NO: 619993 - protein, 24 aa, Mycobacterium
WVNMLRCTLAAFGAGVGGADTVLV

SEQ ID NO: 619994 - protein, 21 aa, Mycobacterium
WVVFEEEYFRAGAPGRASANG

SEQ ID NO: 619995 - protein, 20 aa, Mycobacterium
YAGHQFGGFVPRLGDGRALL

SEQ ID NO: 619996 - protein, 26 aa, Mycobacterium
YARVAREALPHAILIADRFHLVKKAN

SEQ ID NO: 619997 - protein, 17 aa, Mycobacterium
YDRAIGYEAAYAGTSFA

SEQ ID NO: 619998 - protein, 30 aa, Mycobacterium
YEAKTTFGRIGVKVWIYKGDIVGGKRELAA

SEQ ID NO: 619999 - protein, 19 aa, Mycobacterium
YERLGIPTIATVPWTTDRL

SEQ ID NO: 620000 - protein, 17 aa, Mycobacterium
YESRPGDVISLGATSWR

SEQ ID NO: 620001 - protein, 17 aa, Mycobacterium
YGVKIPDEDLAGLRTVG

SEQ ID NO: 620002 - protein, 17 aa, Mycobacterium
YLMSRQTPFSAIIAGLT

SEQ ID NO: 620003 - protein, 19 aa, Mycobacterium
YLYRDGSDFVFMDSQDYEQ

SEQ ID NO: 620004 - protein, 22 aa, Mycobacterium
YRADSMVNWCPGLGTVLANEEV

SEQ ID NO: 620005 - protein, 24 aa, Mycobacterium
YRPWAGEIRARHTGSLVSDRAGTI

SEQ ID NO: 620006 - protein, 24 aa, Mycobacterium
YSGPTAALTDVWRALRASMRSVLE

SEQ ID NO: 620007 - protein, 22 aa, Mycobacterium
YSPRVEGVHLRFGPVARGGLRW

SEQ ID NO: 620008 - protein, 27 aa, Mycobacterium
YTKGFKFSTYATWWIRQAITRGMADQS

SEQ ID NO: 620009 - protein, 18 aa, Mycobacterium
YVAGAGVGCGYWRRSGLT

SEQ ID NO: 620010 - protein, 21 aa, Mycobacterium
YVERYMKLLAPKWQMMSDPQL

SEQ ID NO: 620011 - protein, 19 aa, Mycobacterium
YVSDGRFTLGLGASGPQVI

SEQ ID NO: 620012 - protein, 19 aa, Mycobacterium
AAAFAAMKPYLALYMGGMG

SEQ ID NO: 620013 - protein, 26 aa, Mycobacterium
AAAGAKFAAVFARRGLIAEFGISWIL

SEQ ID NO: 620014 - protein, 23 aa, Mycobacterium
AAAGRISYRLGLQGPAVAVDTAC

SEQ ID NO: 620015 - protein, 23 aa, Mycobacterium
AAAGRISYRLGLQGPSVAVDTAC

SEQ ID NO: 620016 - protein, 18 aa, Mycobacterium
AAALALGAQGAWTGSQWV

SEQ ID NO: 620017 - protein, 18 aa, Mycobacterium
AAALWSLGLGEPHAVSAM

SEQ ID NO: 620018 - protein, 23 aa, Mycobacterium
AAAQRLPFLPIRAGLGSSVPDFW

SEQ ID NO: 620019 - protein, 23 aa, Mycobacterium
AAARRLSALPVVAAVGKYDATLA

SEQ ID NO: 620020 - protein, 18 aa, Mycobacterium
AADCALFVIAANEGVDEP

SEQ ID NO: 620021 - protein, 17 aa, Mycobacterium
AADFIKANVSKPVVGYV

SEQ ID NO: 620022 - protein, 19 aa, Mycobacterium
AAEATRVGMPYVNQRWLGG

SEQ ID NO: 620023 - protein, 21 aa, Mycobacterium
AAGALQRFGADTAVAITGIAG

SEQ ID NO: 620024 - protein, 19 aa, Mycobacterium
AAGFGAIPAPPTFVVSSAH

SEQ ID NO: 620025 - protein, 19 aa, Mycobacterium
AAGGKCFYTTPLKALSNQK

SEQ ID NO: 620026 - protein, 20 aa, Mycobacterium
AAGLRGVEKGYVLGPQAEDN

SEQ ID NO: 620027 - protein, 24 aa, Mycobacterium
AAGLSRAHFSRMFTRTFGESPRAY

SEQ ID NO: 620028 - protein, 20 aa, Mycobacterium
AAGVGEMFDTLLVFENFPTG

SEQ ID NO: 620029 - protein, 18 aa, Mycobacterium
AAGVPVCMARVHACIDGM

SEQ ID NO: 620030 - protein, 24 aa, Mycobacterium
AAHLVHPGDLVILIAYGTMEEAEA

SEQ ID NO: 620031 - protein, 17 aa, Mycobacterium
AAHRGMDQLPLAKSASG

SEQ ID NO: 620032 - protein, 25 aa, Mycobacterium
AAHRRAHGLPAISLGWGLWDQASAM

SEQ ID NO: 620033 - protein, 17 aa, Mycobacterium
AAHVLDITAPIAENIKA

SEQ ID NO: 620034 - protein, 26 aa, Mycobacterium
AAIARPELLAEMARQFGSQCIVLSVD

SEQ ID NO: 620035 - protein, 27 aa, Mycobacterium
AAITPWNFPVVLAFMKLAPALVAGNTV

SEQ ID NO: 620036 - protein, 24 aa, Mycobacterium
AALAARGWLGMTVPVEYGGHGRSF

SEQ ID NO: 620037 - protein, 17 aa, Mycobacterium
AALALPSPKARELVRQA

SEQ ID NO: 620038 - protein, 26 aa, Mycobacterium
AALDLCPRIRVNAIAPGSILTSALDV

SEQ ID NO: 620039 - protein, 18 aa, Mycobacterium
AALEREVAEHVVPVVHND

SEQ ID NO: 620040 - protein, 17 aa, Mycobacterium
AALETLAVVAYRQPVTR

SEQ ID NO: 620041 - protein, 20 aa, Mycobacterium
AALGDKVARRVLESGEREEL

SEQ ID NO: 620042 - protein, 27 aa, Mycobacterium
AALGVLRPRGRLMVVAIWEAPAGIDIN

SEQ ID NO: 620043 - protein, 24 aa, Mycobacterium
AALRELSARLGLTARVAHVEGDDL

SEQ ID NO: 620044 - protein, 24 aa, Mycobacterium
AALSRRGPHRVLRGDLAFAGLPGV

SEQ ID NO: 620045 - protein, 17 aa, Mycobacterium
AALTRAIHKLPIKARIV

SEQ ID NO: 620046 - protein, 19 aa, Mycobacterium
AALTVTFGGLKPVHALADC

SEQ ID NO: 620047 - protein, 19 aa, Mycobacterium
AALWKAAGITSPIDEIDAA

SEQ ID NO: 620048 - protein, 18 aa, Mycobacterium
AAMDFVAGVMVFPGGGVD

SEQ ID NO: 620049 - protein, 24 aa, Mycobacterium
AANRIANTVAVSFVQERERIIRQQ

SEQ ID NO: 620050 - protein, 26 aa, Mycobacterium
AAPASDSAGFKWLAPYTGSAIAQHWM

SEQ ID NO: 620051 - protein, 20 aa, Mycobacterium
AAPLRPGKGPIALRVHLGTP

SEQ ID NO: 620052 - protein, 17 aa, Mycobacterium
AAPSVGLMQPWRFIRIT

SEQ ID NO: 620053 - protein, 18 aa, Mycobacterium
AAPYAAALGRAFQLTNFL

SEQ ID NO: 620054 - protein, 25 aa, Mycobacterium
AAQRAGLELLAFGGRFVEIGKADVY

SEQ ID NO: 620055 - protein, 23 aa, Mycobacterium
AAQRAVVIGAGFIGCEVAASLRS

SEQ ID NO: 620056 - protein, 24 aa, Mycobacterium
AARHVSAVLGRRVGPSTGTNLWGA

SEQ ID NO: 620057 - protein, 17 aa, Mycobacterium
AARRIVRRWSRSQAIYS

SEQ ID NO: 620058 - protein, 23 aa, Mycobacterium
AARTRPVRIAPRMAIAAKALDTF

SEQ ID NO: 620059 - protein, 17 aa, Mycobacterium
AATLTRRQLGAVLDAAA

SEQ ID NO: 620060 - protein, 20 aa, Mycobacterium
AATQDPRSWAALPRAGAVIF

SEQ ID NO: 620061 - protein, 20 aa, Mycobacterium
AATQDPRSWAALPRAGAVVF

SEQ ID NO: 620062 - protein, 18 aa, Mycobacterium
AAVDGRGGGKADLAQGSG

SEQ ID NO: 620063 - protein, 24 aa, Mycobacterium
AAVLPSHYEPFGIVALEAAAAGTP

SEQ ID NO: 620064 - protein, 17 aa, Mycobacterium
AAVQLARHWGLEVFATA

SEQ ID NO: 620065 - protein, 23 aa, Mycobacterium
AAVRAELPERCVIDGEIVIATDH

SEQ ID NO: 620066 - protein, 21 aa, Mycobacterium
AAVRPRMCEAAGRVADGLAGH

SEQ ID NO: 620067 - protein, 26 aa, Mycobacterium
AAVRRLAQRLALAAGRRLDDAQPWVD

SEQ ID NO: 620068 - protein, 17 aa, Mycobacterium
AAWRVLRVSRWAVEAQR

SEQ ID NO: 620069 - protein, 20 aa, Mycobacterium
ACAKEIRRNAARGVHSLTFS

SEQ ID NO: 620070 - protein, 19 aa, Mycobacterium
ACEPVCPVEAIYYEDDLPE

SEQ ID NO: 620071 - protein, 17 aa, Mycobacterium
ACPLGSHARRLNPRDTA

SEQ ID NO: 620072 - protein, 21 aa, Mycobacterium
ACPQCHGLGRIHEVTEETLVP

SEQ ID NO: 620073 - protein, 22 aa, Mycobacterium
ADAALLVVMRGRLMQALPGGGV

SEQ ID NO: 620074 - protein, 30 aa, Mycobacterium
ADACRAAGVGFSFGYPVDWRVQDAVDTLTL

SEQ ID NO: 620075 - protein, 20 aa, Mycobacterium
ADAMPAQWSLMVLLAAWLAM

SEQ ID NO: 620076 - protein, 20 aa, Mycobacterium
ADFPRMLKLTQELFGSDDSE

SEQ ID NO: 620077 - protein, 18 aa, Mycobacterium
ADGADVVQFFLGNPQSWK

SEQ ID NO: 620078 - protein, 18 aa, Mycobacterium
ADGLLVMPFNSARHFAER

SEQ ID NO: 620079 - protein, 19 aa, Mycobacterium
ADGLRALFTTWITAPQPDI

SEQ ID NO: 620080 - protein, 25 aa, Mycobacterium
ADGLVAGALRLTADYVANRKQFGKP

SEQ ID NO: 620081 - protein, 19 aa, Mycobacterium
ADGPITMGALADSISVRQA

SEQ ID NO: 620082 - protein, 22 aa, Mycobacterium
ADGRCKAFAAAADGTGWGEGAA

SEQ ID NO: 620083 - protein, 18 aa, Mycobacterium
ADGTVLWMADERAVAEHV

SEQ ID NO: 620084 - protein, 22 aa, Mycobacterium
ADGWRLKTRAMTFIRRSGVHDS

SEQ ID NO: 620085 - protein, 21 aa, Mycobacterium
ADGYLALFITHDGFWKSFAAE

SEQ ID NO: 620086 - protein, 19 aa, Mycobacterium
ADHAVGGVVIFPGAGFVEL

SEQ ID NO: 620087 - protein, 21 aa, Mycobacterium
ADHRLPHGVTFIGQPLWGSIG

SEQ ID NO: 620088 - protein, 17 aa, Mycobacterium
ADHRLPQGVTFIGQPLW

SEQ ID NO: 620089 - protein, 31 aa, Mycobacterium
ADHVFSRIDIPGWLARTGFQMLDPIKTAQSR

SEQ ID NO: 620090 - protein, 31 aa, Mycobacterium; identical to SEQ ID NO: 77538

SEQ ID NO: 620091 - protein, 18 aa, Mycobacterium
ADIAMAFERYRTVTGDHS

SEQ ID NO: 620092 - protein, 25 aa, Mycobacterium
ADIAWYGPEPSWWAQRLGVDEGLAE

SEQ ID NO: 620093 - protein, 17 aa, Mycobacterium
ADKGFGFLSQEDGEDVY

SEQ ID NO: 620094 - protein, 18 aa, Mycobacterium
ADLARLGRDGILALSSDE

SEQ ID NO: 620095 - protein, 19 aa, Mycobacterium
ADLHMIGKDIIRFHAVYWP

SEQ ID NO: 620096 - protein, 19 aa, Mycobacterium
ADLLGKRLHRALGPLVHVN

SEQ ID NO: 620097 - protein, 22 aa, Mycobacterium
ADLPEITHFVAGLGTTGTLMGT

SEQ ID NO: 620098 - protein, 22 aa, Mycobacterium
ADLPEKVREAALREVGKLERSS

SEQ ID NO: 620099 - protein, 24 aa, Mycobacterium
ADLTNRSTIRWTLHQLVASGVVSV

SEQ ID NO: 620100 - protein, 18 aa, Mycobacterium
ADMAMKVEAARLMVYTAA

SEQ ID NO: 620101 - protein, 25 aa, Mycobacterium
ADNDEWLKWLLVRRGSGGEFDLQFS

SEQ ID NO: 620102 - protein, 24 aa, Mycobacterium
ADPDRYAGELAHIIGCEPDDVLRV

SEQ ID NO: 620103 - protein, 25 aa, Mycobacterium
ADPEVVRALDMLFILHADHEQNCST

SEQ ID NO: 620104 - protein, 20 aa, Mycobacterium
ADPFGHHWSLGQPVREVSME

SEQ ID NO: 620105 - protein, 23 aa, Mycobacterium
ADPIRNGQRWEVLAVDPDAGRIA

SEQ ID NO: 620106 - protein, 20 aa, Mycobacterium
ADPLPMLTLFDKQVTLRMGQ

SEQ ID NO: 620107 - protein, 18 aa, Mycobacterium
ADPRLAIVEEEQFGPVVP

SEQ ID NO: 620108 - protein, 21 aa, Mycobacterium
ADPRPAVLSDHDWLINQRGVA

SEQ ID NO: 620109 - protein, 19 aa, Mycobacterium
ADQLAAWAGLAPVSRDSGK

SEQ ID NO: 620110 - protein, 22 aa, Mycobacterium
ADQRTFGGWMLADLVEVDGSVV

SEQ ID NO: 620111 - protein, 19 aa, Mycobacterium
ADTIEFCAAEVPRFNAISV

SEQ ID NO: 620112 - protein, 18 aa, Mycobacterium
ADTLLMLGTDFPYQQFYP

SEQ ID NO: 620113 - protein, 21 aa, Mycobacterium
ADVGGTWYWNRYPGIACDVES

SEQ ID NO: 620114 - protein, 18 aa, Mycobacterium
ADVIPLPVFDARKEAEQW

SEQ ID NO: 620115 - protein, 19 aa, Mycobacterium
ADVLRAWGKLGYPRRAKRL

SEQ ID NO: 620116 - protein, 22 aa, Mycobacterium
ADVSLPVVRAFVTRIKDRAKGA

SEQ ID NO: 620117 - protein, 19 aa, Mycobacterium
ADVVARFLPYFTDVIVGDL

SEQ ID NO: 620118 - protein, 21 aa, Mycobacterium
AEAALYFATDRSRYVTGTVLP

SEQ ID NO: 620119 - protein, 24 aa, Mycobacterium
AEACDVPTRFSCRSGVCHVCVTGV

SEQ ID NO: 620120 - protein, 19 aa, Mycobacterium
AEALKESFGCDGQPGSYTD

SEQ ID NO: 620121 - protein, 17 aa, Mycobacterium
AEAMYLTSGYVYESAAA

SEQ ID NO: 620122 - protein, 20 aa, Mycobacterium
AEARAHFGFADDARVLLVFG

SEQ ID NO: 620123 - protein, 21 aa, Mycobacterium
AEARPDIAYEIVALDTVMFTE

SEQ ID NO: 620124 - protein, 17 aa, Mycobacterium
AEAVPNMALVVYDNPGA

SEQ ID NO: 620125 - protein, 17 aa, Mycobacterium
AECLEVGKQWELQRRIA

SEQ ID NO: 620126 - protein, 24 aa, Mycobacterium
AECLLDRNALIMGYSGVYSSFLKH

SEQ ID NO: 620127 - protein, 20 aa, Mycobacterium
AEEKFGFLLEAFTFGAPPHG

SEQ ID NO: 620128 - protein, 17 aa, Mycobacterium
AEFPSIRVVTVMVQAEV

SEQ ID NO: 620129 - protein, 23 aa, Mycobacterium
AEGLRVTAVRSRLMAPLSGQGGM

SEQ ID NO: 620130 - protein, 22 aa, Mycobacterium
AEHARLAVVGNRAVLHGPSRAG

SEQ ID NO: 620131 - protein, 19 aa, Mycobacterium
AEHLPDWQPGPGRGGMSLW

SEQ ID NO: 620132 - protein, 23 aa, Mycobacterium
AELFAAEVMPHFQGQAQPTLDAA

SEQ ID NO: 620133 - protein, 24 aa, Mycobacterium
AELIAHCYRMLGSVHDAEDLVQET

SEQ ID NO: 620134 - protein, 20 aa, Mycobacterium
AELMLRKATWLYDNGKPCGR

SEQ ID NO: 620135 - protein, 22 aa, Mycobacterium
AELYSAAKIRGFLHLYVGEEAV

SEQ ID NO: 620136 - protein, 22 aa, Mycobacterium
AEMHARISGLADYFAVDELDAI

SEQ ID NO: 620137 - protein, 25 aa, Mycobacterium
AEPEDFVGALIYLLSDASSFYTGQV

SEQ ID NO: 620138 - protein, 25 aa, Mycobacterium
AERAEVYASLGLRLDYDPHLRRVTA

SEQ ID NO: 620139 - protein, 23 aa, Mycobacterium
AERAKRIRFGTGVISLSYHNPLW

SEQ ID NO: 620140 - protein, 20 aa, Mycobacterium
AERALALMVDRARNRVAFGR

SEQ ID NO: 620141 - protein, 18 aa, Mycobacterium
AERYQFLRWGQGAFDDFK

SEQ ID NO: 620142 - protein, 21 aa, Mycobacterium
AESSALRMVVFAGEALDPSRL

SEQ ID NO: 620143 - protein, 33 aa, Mycobacterium
AETVLHEMAHMWFGDLVTMTWWDDLWLNESFAT

SEQ ID NO: 620144 - protein, 23 aa, Mycobacterium
AEVWHRLTGNFWLPEKVPVSNDI

SEQ ID NO: 620145 - protein, 30 aa, Mycobacterium
AEYWYRNLREPVEFYSCVAQLLAHSERVFV

SEQ ID NO: 620146 - protein, 22 aa, Mycobacterium
AFAGPRFLMRIAELEMHPLDTR

SEQ ID NO: 620147 - protein, 24 aa, Mycobacterium
AFATMACLYPDRIFLGVGTGEALN

SEQ ID NO: 620148 - protein, 21 aa, Mycobacterium
AFDKSRLGLRALPMLDSYAGL

SEQ ID NO: 620149 - protein, 17 aa, Mycobacterium
AFDNGPWPTTPPKERAA

SEQ ID NO: 620150 - protein, 19 aa, Mycobacterium
AFEAVGYAKFTGRVGVCAA

SEQ ID NO: 620151 - protein, 20 aa, Mycobacterium
AFEYAARLGYDGVELMVWAE

SEQ ID NO: 620152 - protein, 19 aa, Mycobacterium
AFGPVLGERVMLGMDEPVH

SEQ ID NO: 620153 - protein, 22 aa, Mycobacterium
AFHAVRRAELLLGETVMVLGAG

SEQ ID NO: 620154 - protein, 18 aa, Mycobacterium
AFKALTLGEPFGCMCGRN

SEQ ID NO: 620155 - protein, 21 aa, Mycobacterium
AFLEMNTRLQVEHPVTELITG

SEQ ID NO: 620156 - protein, 20 aa, Mycobacterium
AFLGGPVIKDGRPVDFGSFL

SEQ ID NO: 620157 - protein, 25 aa, Mycobacterium
AFLRGLPADGWLRIIATCTEIGHDW

SEQ ID NO: 620158 - protein, 26 aa, Mycobacterium
AFLSKTFEQACCSLGINLQPAHPDQP

SEQ ID NO: 620159 - protein, 28 aa, Mycobacterium
AFNRELCARFGVSPIEFDGRSDALLHGF

SEQ ID NO: 620160 - protein, 24 aa, Mycobacterium
AFREPGPRLELMNELGVDRSLMFP

SEQ ID NO: 620161 - protein, 24 aa, Mycobacterium
AFTAFPRAHWQKIWSNNPIERLNK

SEQ ID NO: 620162 - protein, 23 aa, Mycobacterium
AFTRSRLTGYIPHIDSVASQVLA

SEQ ID NO: 620163 - protein, 23 aa, Mycobacterium
AGADSLKGLCPFHDEKSPSFHVR

SEQ ID NO: 620164 - protein, 21 aa, Mycobacterium
AGALKGGRLVVMPTDTVYGIG

SEQ ID NO: 620165 - protein, 26 aa, Mycobacterium
AGARDFQRFLIGKLRDIRAVVLNASL

SEQ ID NO: 620166 - protein, 24 aa, Mycobacterium
AGASFLRRDGSVWTTDKDGIIMAL

SEQ ID NO: 620167 - protein, 19 aa, Mycobacterium
AGASIQLLGKEGTYASLRM

SEQ ID NO: 620168 - protein, 21 aa, Mycobacterium
AGAVIELVHLATLYHDDVMDE

SEQ ID NO: 620169 - protein, 20 aa, Mycobacterium
AGAVLAEWGADVIKVEHAVT

SEQ ID NO: 620170 - protein, 34 aa, Mycobacterium
AGAYERRSLAIGSHWPFEQWGRFLPEQTTAVSIL

SEQ ID NO: 620171 - protein, 17 aa, Mycobacterium
AGDFLALCESFGLPVIS

SEQ ID NO: 620172 - protein, 18 aa, Mycobacterium
AGDFWGGAGSVACQEFIS

SEQ ID NO: 620173 - protein, 17 aa, Mycobacterium
AGDGVWAIYTVDADGGA

SEQ ID NO: 620174 - protein, 26 aa, Mycobacterium
AGDHAAICWPLLVGMAKAKYYLLTCE

SEQ ID NO: 620175 - protein, 20 aa, Mycobacterium
AGERGLCAGGDVVSIYHSAR

SEQ ID NO: 620176 - protein, 18 aa, Mycobacterium
AGGQVFLVDCGRGVLQRA

SEQ ID NO: 620177 - protein, 21 aa, Mycobacterium
AGGSFCAGMDLKAFARGELPI

SEQ ID NO: 620178 - protein, 20 aa, Mycobacterium
AGGSFCAGMDLKAFARGENV

SEQ ID NO: 620179 - protein, 24 aa, Mycobacterium
AGGTGGTAGWLYGSGGSGGAGGAG

SEQ ID NO: 620180 - protein, 20 aa, Mycobacterium
AGGVCAALFHRERTGEPTIV

SEQ ID NO: 620181 - protein, 22 aa, Mycobacterium
AGHASWALGVAKSMLDDVQELA

SEQ ID NO: 620182 - protein, 20 aa, Mycobacterium
AGICFPREYGGLGLDYEYQK

SEQ ID NO: 620183 - protein, 25 aa, Mycobacterium
AGILDVLDNYAFVRTSGYLAGPNDV

SEQ ID NO: 620184 - protein, 18 aa, Mycobacterium
AGKLPVTLFTAGGIATPA

SEQ ID NO: 620185 - protein, 17 aa, Mycobacterium
AGLDGYSAADCVALLRE

SEQ ID NO: 620186 - protein, 21 aa, Mycobacterium
AGLIADIWLANLMAFVGGRAT

SEQ ID NO: 620187 - protein, 18 aa, Mycobacterium
AGLRGVEKGYVLGPQAED

SEQ ID NO: 620188 - protein, 19 aa, Mycobacterium
AGMHPWGKWGNDFTEYGVA

SEQ ID NO: 620189 - protein, 20 aa, Mycobacterium
AGMRSHPGVTATFCEALAEA

SEQ ID NO: 620190 - protein, 22 aa, Mycobacterium
AGNGGAGGDGWTNGNGGDGGDG

SEQ ID NO: 620191 - protein, 18 aa, Mycobacterium
AGPEIGVASTKTFLAQIT

SEQ ID NO: 620192 - protein, 18 aa, Mycobacterium
AGPEIGVASTKTFLAQVT

SEQ ID NO: 620193 - protein, 26 aa, Mycobacterium
AGPFDRWPTGLGFERFYGFLGGDTSQ

SEQ ID NO: 620194 - protein, 25 aa, Mycobacterium
AGPRARTAVLTKLYPTRSHTGAAQG

SEQ ID NO: 620195 - protein, 27 aa, Mycobacterium
AGQGCAITTRLVVPRARYDEAVAIAAG

SEQ ID NO: 620196 - protein, 27 aa, Mycobacterium
AGRHLSFSGGRHFCLGAALARAEGEVG

SEQ ID NO: 620197 - protein, 22 aa, Mycobacterium
AGRLRFACLPTPATLDDFDVDA

SEQ ID NO: 620198 - protein, 20 aa, Mycobacterium
AGRLSIPFTTGLLVGIGETL

SEQ ID NO: 620199 - protein, 25 aa, Mycobacterium
AGSEPMLAAAAAWDGLSAELGEAAE

SEQ ID NO: 620200 - protein, 18 aa, Mycobacterium
AGSMARRLLLNSRMGLLA

SEQ ID NO: 620201 - protein, 17 aa, Mycobacterium
AGSRATHIVVWATLDKS

SEQ ID NO: 620202 - protein, 20 aa, Mycobacterium
AGSRATHIVVWATLDKSKGR

SEQ ID NO: 620203 - protein, 19 aa, Mycobacterium
AGSSIQLLGKEASYASLRM

SEQ ID NO: 620204 - protein, 43 aa, Mycobacterium
AGTDEVSEAIASLFSGHALDYQSLGARMTAFHDQFVAALTAGG

SEQ ID NO: 620205 - protein, 19 aa, Mycobacterium
AGTGVRFTPTLTFTRDTTS

SEQ ID NO: 620206 - protein, 19 aa, Mycobacterium
AGVGCTRLAIHAVTANGEE

SEQ ID NO: 620207 - protein, 24 aa, Mycobacterium
AGVLKGEVKDVLLLDVTPLSLGIE

SEQ ID NO: 620208 - protein, 21 aa, Mycobacterium
AGVRPRMCEVAGRVADGLAGH

SEQ ID NO: 620209 - protein, 19 aa, Mycobacterium
AGYALAGRHVHVVTINDYL

SEQ ID NO: 620210 - protein, 23 aa, Mycobacterium
AGYRGEIKVALINLDPAEPIVVH

SEQ ID NO: 620211 - protein, 17 aa, Mycobacterium
AGYRRFLERRLREAFGF

SEQ ID NO: 620212 - protein, 17 aa, Mycobacterium
AGYRRFLERRLRETFGF

SEQ ID NO: 620213 - protein, 24 aa, Mycobacterium
AGYSALRLAPRFVDPSTLNPPGSL

SEQ ID NO: 620214 - protein, 25 aa, Mycobacterium
AHALHSPFWWLKCAVGVSNTDHRAV

SEQ ID NO: 620215 - protein, 17 aa, Mycobacterium
AHARSAVGVSELPLDAP

SEQ ID NO: 620216 - protein, 24 aa, Mycobacterium
AHDEGWLAEHMLILKLISPENKAY

SEQ ID NO: 620217 - protein, 20 aa, Mycobacterium
AHDIRETFGRMAMNDEETAA

SEQ ID NO: 620218 - protein, 23 aa, Mycobacterium
AHEGSLRFGDKVVLGRDNVINCY

SEQ ID NO: 620219 - protein, 17 aa, Mycobacterium
AHGPYAVGITGEDAQLF

SEQ ID NO: 620220 - protein, 17 aa, Mycobacterium
AHGYLGVVAPVTMTPLW

SEQ ID NO: 620221 - protein, 17 aa, Mycobacterium
AHLSQWCFVVARTEKGS

SEQ ID NO: 620222 - protein, 20 aa, Mycobacterium
AHRRGIRVITDLVMNHTSES

SEQ ID NO: 620223 - protein, 19 aa, Mycobacterium
AHTLPVLLAGADFIFSGFG

SEQ ID NO: 620224 - protein, 23 aa, Mycobacterium
AHTVRPAFEIIKTVPDVSTVSSI

SEQ ID NO: 620225 - protein, 29 aa, Mycobacterium
AIAAVLPGCASRGGIRPLATGYAITAVPT

SEQ ID NO: 620226 - protein, 18 aa, Mycobacterium
AIAGELYVAPSTVKTHVQ

SEQ ID NO: 620227 - protein, 17 aa, Mycobacterium
AIAHGMLTMGLGGGYVT

SEQ ID NO: 620228 - protein, 17 aa, Mycobacterium
AICDGGFALDVRYAPTR

SEQ ID NO: 620229 - protein, 31 aa, Mycobacterium; identical to SEQ ID NO: 196477

SEQ ID NO: 620230 - protein, 32 aa, Mycobacterium; identical to SEQ ID NO: 77862

SEQ ID NO: 620231 - protein, 17 aa, Mycobacterium
AIDSGFDAVEIHLGHNY

SEQ ID NO: 620232 - protein, 18 aa, Mycobacterium
AIEAHLDRGRGPVATVLV

SEQ ID NO: 620233 - protein, 23 aa, Mycobacterium
AIFDKGKALALYHTKRLASPGQR

SEQ ID NO: 620234 - protein, 20 aa, Mycobacterium
AIGKAAPVGLFVETFGSETV

SEQ ID NO: 620235 - protein, 17 aa, Mycobacterium
AIGMFFPGPYRVPKASF

SEQ ID NO: 620236 - protein, 23 aa, Mycobacterium
AILAGEVHFAIGYTEPEAGTDLA

SEQ ID NO: 620237 - protein, 24 aa, Mycobacterium
AILTARHLDCWVLGTVCKGGKEGP

SEQ ID NO: 620238 - protein, 17 aa, Mycobacterium
AIMSVALLLAHLGEDDA

SEQ ID NO: 620239 - protein, 20 aa, Mycobacterium
AINAVAARIGERVREVAPTL

SEQ ID NO: 620240 - protein, 17 aa, Mycobacterium
AIPKLSVVRPADANETA

SEQ ID NO: 620241 - protein, 19 aa, Mycobacterium
AIQVPPNGFPVILGPDHPV

SEQ ID NO: 620242 - protein, 19 aa, Mycobacterium
AIQVPPNGLPVILGPDHPV

SEQ ID NO: 620243 - protein, 30 aa, Mycobacterium
AISFKIARMEARAHVARTAYYEAAAKMLAG

SEQ ID NO: 620244 - protein, 25 aa, Mycobacterium
AIVKGLRTGTDFEYELQMAQMNKHV

SEQ ID NO: 620245 - protein, 18 aa, Mycobacterium
AIVLAEFGYGAVPGPFVP

SEQ ID NO: 620246 - protein, 17 aa, Mycobacterium
AIVPAAGLGTRFLPATK

SEQ ID NO: 620247 - protein, 22 aa, Mycobacterium
AIYRAVLALLMLTGSMGRNGGG

SEQ ID NO: 620248 - protein, 21 aa, Mycobacterium
AKALRSGGVVIVFPGGDYDAY

SEQ ID NO: 620249 - protein, 22 aa, Mycobacterium
AKAQGIPAQFLVDILSDLRTDR

SEQ ID NO: 620250 - protein, 23 aa, Mycobacterium
AKASLNGPVNWRGPRPTDRMVDR

SEQ ID NO: 620251 - protein, 20 aa, Mycobacterium
AKDVTAYLQGPGHELMGAAP

SEQ ID NO: 620252 - protein, 26 aa, Mycobacterium
AKELYEIRTLFGVMFQDGALFGSMNL

SEQ ID NO: 620253 - protein, 20 aa, Mycobacterium
AKFGMTLCALGIAEEMRDEG

SEQ ID NO: 620254 - protein, 18 aa, Mycobacterium
AKGGAAVFQMMGLCQILR

SEQ ID NO: 620255 - protein, 17 aa, Mycobacterium
AKIAFLMLPGVGTKEDI

SEQ ID NO: 620256 - protein, 18 aa, Mycobacterium
AKIAFLMLPGVGTKEDIK

SEQ ID NO: 620257 - protein, 17 aa, Mycobacterium
AKLGGPVDKDEWFMTPQ

SEQ ID NO: 620258 - protein, 18 aa, Mycobacterium
AKLGIGPPITDGFYYDFD

SEQ ID NO: 620259 - protein, 20 aa, Mycobacterium
AKLPTIAAYAYKKSVGQPFL

SEQ ID NO: 620260 - protein, 17 aa, Mycobacterium
AKLTEWLKLALDEPHLL

SEQ ID NO: 620261 - protein, 17 aa, Mycobacterium
AKPGYGRVGEAMSGAVH

SEQ ID NO: 620262 - protein, 20 aa, Mycobacterium
AKPREIHIVPELPKTRSGKI

SEQ ID NO: 620263 - protein, 24 aa, Mycobacterium
AKPRPARPELVVLCDVSGSVAGFS

SEQ ID NO: 620264 - protein, 23 aa, Mycobacterium
AKQRGHKGLAYVLVGEDGTLGGP

SEQ ID NO: 620265 - protein, 22 aa, Mycobacterium
AKRPLMADAMLRVFFEAYEIVA

SEQ ID NO: 620266 - protein, 22 aa, Mycobacterium
AKRTLAVAVYNHYKRIQAGEKG

SEQ ID NO: 620267 - protein, 17 aa, Mycobacterium
AKSALDAVVSRWHAESS

SEQ ID NO: 620268 - protein, 25 aa, Mycobacterium
AKSFARLGIRCFGFSPLRLPPDLDF

SEQ ID NO: 620269 - protein, 24 aa, Mycobacterium
AKTGKLRPALFVVPTDAPGFTYTP

SEQ ID NO: 620270 - protein, 20 aa, Mycobacterium
AKTIFWNGPMGVFEFPAFAA

SEQ ID NO: 620271 - protein, 22 aa, Mycobacterium
AKTRALAGWKGYTTNLVGQPAS

SEQ ID NO: 620272 - protein, 18 aa, Mycobacterium
AKTVCALLSDWLPATTGT

SEQ ID NO: 620273 - protein, 19 aa, Mycobacterium
AKYGLRRHIHFNSHVDRAH

SEQ ID NO: 620274 - protein, 30 aa, Mycobacterium
AKYKSEPWARLGVNVDHDFEPLYIISPEKK

SEQ ID NO: 620275 - protein, 18 aa, Mycobacterium
ALAADWRVSGDNAKFGAT

SEQ ID NO: 620276 - protein, 25 aa, Mycobacterium
ALAAELRLPLVLVIDTAGPALSADA

SEQ ID NO: 620277 - protein, 23 aa, Mycobacterium
ALADGVVRPVVFLAYSGEARWRD

SEQ ID NO: 620278 - protein, 22 aa, Mycobacterium
ALAEQCRRLDALGIGYEIVPGV

SEQ ID NO: 620279 - protein, 19 aa, Mycobacterium
ALAHLGGHPVAVVANQPQV

SEQ ID NO: 620280 - protein, 19 aa, Mycobacterium
ALAKCFAHNDGIRVLPDTI

SEQ ID NO: 620281 - protein, 19 aa, Mycobacterium
ALAQCLRGGTPDEVAKLVL

SEQ ID NO: 620282 - protein, 18 aa, Mycobacterium
ALARLGMFAPALSYLEEP

SEQ ID NO: 620283 - protein, 24 aa, Mycobacterium
ALAYMDLRPGTPMRDIAVDAVFVG

SEQ ID NO: 620284 - protein, 24 aa, Mycobacterium
ALDEGRIVLVAGFQGVSQDTRDVT

SEQ ID NO: 620285 - protein, 23 aa, Mycobacterium
ALDKLRLEAFRNKDLDVDTSDLH

SEQ ID NO: 620286 - protein, 20 aa, Mycobacterium
ALEDGYRVFAELAPHPLLTR

SEQ ID NO: 620287 - protein, 20 aa, Mycobacterium
ALEDYRRILAAGVNVVGSSA

SEQ ID NO: 620288 - protein, 19 aa, Mycobacterium
ALEEIRKILTEAGVEISYD

SEQ ID NO: 620289 - protein, 24 aa, Mycobacterium
ALENTRFWAPLSLTAEQKHSIDDP

SEQ ID NO: 620290 - protein, 38 aa, Mycobacterium
ALFGHPSFRYHGWGPRMWTWVQMMGLRKFQEMVFTGRP

SEQ ID NO: 620291 - protein, 22 aa, Mycobacterium
ALGAEVRWASCNIFSTQDHAAA

SEQ ID NO: 620292 - protein, 17 aa, Mycobacterium
ALGAFGLTEAGGGSDAG

SEQ ID NO: 620293 - protein, 21 aa, Mycobacterium
ALGAQGAWTGSQWLMVEESSN

SEQ ID NO: 620294 - protein, 23 aa, Mycobacterium
ALGDLPLIYPFLVNDPGEGTQAK

SEQ ID NO: 620295 - protein, 18 aa, Mycobacterium
ALGPGPLCQDGRHAQRVA

SEQ ID NO: 620296 - protein, 18 aa, Mycobacterium
ALIALKPDCVIYAASGPE

SEQ ID NO: 620297 - protein, 18 aa, Mycobacterium
ALLDACFQAVGAHPDVQV

SEQ ID NO: 620298 - protein, 24 aa, Mycobacterium
ALLGEPGQGFLILQTRLAGGRLHH

SEQ ID NO: 620299 - protein, 17 aa, Mycobacterium
ALMDIDTIYVWTHDSIG

SEQ ID NO: 620300 - protein, 26 aa, Mycobacterium
ALMRSCTGWPSGVWIDEPRRTAPDGS

SEQ ID NO: 620301 - protein, 24 aa, Mycobacterium
ALMSGFERRGRWNVPKKLTTFTLW

SEQ ID NO: 620302 - protein, 24 aa, Mycobacterium
ALNTAVWSGGSFIYVPPGVHVDIP

SEQ ID NO: 620303 - protein, 24 aa, Mycobacterium
ALPEEFRMAVYYADVEGFPYKEIA

SEQ ID NO: 620304 - protein, 20 aa, Mycobacterium
ALPFSRSVNVSSEWQYHTPL

SEQ ID NO: 620305 - protein, 19 aa, Mycobacterium
ALPPFNQRLVNSMFTLSTL

SEQ ID NO: 620306 - protein, 18 aa, Mycobacterium
ALQELEPACAALAAQRPD

SEQ ID NO: 620307 - protein, 24 aa, Mycobacterium
ALRCLKRQLARIVYRHLHTDENTR

SEQ ID NO: 620308 - protein, 23 aa, Mycobacterium
ALSQARFEFRWNDQFALSLDPDT

SEQ ID NO: 620309 - protein, 19 aa, Mycobacterium
ALTELFKRIRGYEVDEANA

SEQ ID NO: 620310 - protein, 18 aa, Mycobacterium
ALTGRPLIGNGANGAPGT

SEQ ID NO: 620311 - protein, 17 aa, Mycobacterium
ALTLAREGASVVVNDLG

SEQ ID NO: 620312 - protein, 17 aa, Mycobacterium
ALTSLPGVGEWTAAETA

SEQ ID NO: 620313 - protein, 24 aa, Mycobacterium
ALTYRPSDALARFIRARDLTCRFP

SEQ ID NO: 620314 - protein, 26 aa, Mycobacterium
ALVNSWSAAFARYGRTVGQVLLTAHD

SEQ ID NO: 620315 - protein, 21 aa, Mycobacterium
ALVPGRPAPRLVTAAAVEAMK

SEQ ID NO: 620316 - protein, 17 aa, Mycobacterium
ALVQAYNDWHVEEWCGA

SEQ ID NO: 620317 - protein, 19 aa, Mycobacterium
ALVVGGFTRQAARPDADFI

SEQ ID NO: 620318 - protein, 24 aa, Mycobacterium
ALWRRFKAAQDVFFTARNAATAEK

SEQ ID NO: 620319 - protein, 19 aa, Mycobacterium
AMEKFDYAKGFKFSTYATW

SEQ ID NO: 620320 - protein, 27 aa, Mycobacterium
AMIDVLRFWLGLGIDGFRLDAVPYLFE

SEQ ID NO: 620321 - protein, 20 aa, Mycobacterium
AMLPPVKPPPGFAVRYEPAV

SEQ ID NO: 620322 - protein, 20 aa, Mycobacterium
AMTPWIWPTMHLNPPQWIQP

SEQ ID NO: 620323 - protein, 32 aa, Mycobacterium
AMVDHCLGVVFYPVIPAGSWVATTEFKLNLLQ

SEQ ID NO: 620324 - protein, 27 aa, Mycobacterium
AMVDHCLGVVFYPVIPLGSWVATTEFK

SEQ ID NO: 620325 - protein, 18 aa, Mycobacterium
AMVTDRRVLLTLPISHLY

SEQ ID NO: 620326 - protein, 18 aa, Mycobacterium
ANAARLAIEAGFDAVEIH

SEQ ID NO: 620327 - protein, 23 aa, Mycobacterium
ANADERFRIAAKGHDVVLRVSVS

SEQ ID NO: 620328 - protein, 20 aa, Mycobacterium
ANGKGFCGGHVARWGPDENP

SEQ ID NO: 620329 - protein, 19 aa, Mycobacterium
ANGKGFCSGHAIGNNAVDY

SEQ ID NO: 620330 - protein, 19 aa, Mycobacterium
ANIGSIMGIGFPPYTGGSA

SEQ ID NO: 620331 - protein, 22 aa, Mycobacterium
ANKRPEVVRVYLPPDGNTLLSV

SEQ ID NO: 620332 - protein, 33 aa, Mycobacterium; identical to SEQ ID NO: 196738

SEQ ID NO: 620333 - protein, 33 aa, Mycobacterium
ANLNFFPMGAWAKRTGTIFIRRQTKDIPVYRFV

SEQ ID NO: 620334 - protein, 24 aa, Mycobacterium
ANMAPELFAGILAQVPFVDPLTTI

SEQ ID NO: 620335 - protein, 17 aa, Mycobacterium
ANMQRQAVPLVRSEAPL

SEQ ID NO: 620336 - protein, 25 aa, Mycobacterium
ANPTPKGCVFEYVYLARPDSTIAGR

SEQ ID NO: 620337 - protein, 20 aa, Mycobacterium
ANQQWGVWGAGAAMTPGNKN

SEQ ID NO: 620338 - protein, 17 aa, Mycobacterium
ANSKWAGEVLLREAHDL

SEQ ID NO: 620339 - protein, 25 aa, Mycobacterium
ANVSDLPRGGLIIANSDEFTKRNLA

SEQ ID NO: 620340 - protein, 17 aa, Mycobacterium
APANRWSVRTVGDLELL

SEQ ID NO: 620341 - protein, 18 aa, Mycobacterium
APARAMIFDSVYDIYRGV

SEQ ID NO: 620342 - protein, 18 aa, Mycobacterium
APDDRWQGSGANAYAAAN

SEQ ID NO: 620343 - protein, 25 aa, Mycobacterium
APDIPRERFSALTRLDHNRAISQLA

SEQ ID NO: 620344 - protein, 19 aa, Mycobacterium
APDKPWFSYVCPGAGHAPH

SEQ ID NO: 620345 - protein, 24 aa, Mycobacterium
APDLEILGNLGLVIGGGFDTTTAL

SEQ ID NO: 620346 - protein, 24 aa, Mycobacterium
APDMEILGNLGLIIGGGFDTTTAL

SEQ ID NO: 620347 - protein, 18 aa, Mycobacterium
APELYRITYDGSIADEPH

SEQ ID NO: 620348 - protein, 22 aa, Mycobacterium
APFAASLIGDFGAQVIKIEDPG

SEQ ID NO: 620349 - protein, 19 aa, Mycobacterium
APGGVAYACSFRITEAVYF

SEQ ID NO: 620350 - protein, 20 aa, Mycobacterium
APGGVAYACSFRITEAVYFV

SEQ ID NO: 620351 - protein, 17 aa, Mycobacterium
APGHTPGSSVLWLDAGR

SEQ ID NO: 620352 - protein, 18 aa, Mycobacterium
APGSFSWHVLTSLADDVQ

SEQ ID NO: 620353 - protein, 25 aa, Mycobacterium
APGVPMVFPPWFERFQIKYFNPAVK

SEQ ID NO: 620354 - protein, 19 aa, Mycobacterium
APGYLKVEALYAVTAEGAL

SEQ ID NO: 620355 - protein, 18 aa, Mycobacterium
APISGAMGFLMTMLAQDC

SEQ ID NO: 620356 - protein, 17 aa, Mycobacterium
APISREMILNFVAQHSL

SEQ ID NO: 620357 - protein, 25 aa, Mycobacterium
APISRVDLLVCRNTLMYLNAETQRN

SEQ ID NO: 620358 - protein, 18 aa, Mycobacterium
APMPAPRAILAAAVEGAQ

SEQ ID NO: 620359 - protein, 22 aa, Mycobacterium
APNARPPVCKIMDYGKFKYEAA

SEQ ID NO: 620360 - protein, 20 aa, Mycobacterium
APNFAYALLAKRLRRQAKPG

SEQ ID NO: 620361 - protein, 18 aa, Mycobacterium
APPGIPVDIGPGATVAHL

SEQ ID NO: 620362 - protein, 18 aa, Mycobacterium
APPGLAINPLVNRYKTRD

SEQ ID NO: 620363 - protein, 24 aa, Mycobacterium
APPTFVVSSAHWRADDDMFGALGL

SEQ ID NO: 620364 - protein, 23 aa, Mycobacterium
APSRLFGANGLRTGPDGRVYIAQ

SEQ ID NO: 620365 - protein, 18 aa, Mycobacterium
APTAELLAAGTDEVSEAI

SEQ ID NO: 620366 - protein, 20 aa, Mycobacterium
APTPVADRFVRYGNRDNTVS

SEQ ID NO: 620367 - protein, 23 aa, Mycobacterium
APTVAELAQWISVHGGARVRAAL

SEQ ID NO: 620368 - protein, 18 aa, Mycobacterium
APVIEKAYAAGPCSGHLT

SEQ ID NO: 620369 - protein, 19 aa, Mycobacterium
APVKARGGMFAQLCADLPW

SEQ ID NO: 620370 - protein, 20 aa, Mycobacterium
APWILPKWDSRYGVLHDRVS

SEQ ID NO: 620371 - protein, 18 aa, Mycobacterium
AQARRIADEIGYPVLVRP

SEQ ID NO: 620372 - protein, 25 aa, Mycobacterium
AQATAGAPAHDWLTLTGGAIGYGIP

SEQ ID NO: 620373 - protein, 23 aa, Mycobacterium
AQFIRAGSIIQLLLGNIGRPGGG

SEQ ID NO: 620374 - protein, 19 aa, Mycobacterium
AQGIPPQFLVDILTNLRTD

SEQ ID NO: 620375 - protein, 26 aa, Mycobacterium
AQGRRVRRLAVSHAFHSVLMEPMLEQ

SEQ ID NO: 620376 - protein, 18 aa, Mycobacterium
AQGWRVAIVDSLPYGGTC

SEQ ID NO: 620377 - protein, 18 aa, Mycobacterium
AQILDRVWSYDFGGRSNI

SEQ ID NO: 620378 - protein, 24 aa, Mycobacterium
AQIRSIPTLMAFKKGKLLFNQPGA

SEQ ID NO: 620379 - protein, 19 aa, Mycobacterium
AQLAPLVFEGTSFGGALMT

SEQ ID NO: 620380 - protein, 17 aa, Mycobacterium
AQLGSLVAVLVLESTGT

SEQ ID NO: 620381 - protein, 20 aa, Mycobacterium
AQLIKVCCSGGVMSLTGPPG

SEQ ID NO: 620382 - protein, 20 aa, Mycobacterium
AQLLLPHFVASVLNAEPQCR

SEQ ID NO: 620383 - protein, 27 aa, Mycobacterium
AQLPIPVWWPAEARAAFIEEYASEAAC

SEQ ID NO: 620384 - protein, 17 aa, Mycobacterium
AQNNGGSICRIATHCTE

SEQ ID NO: 620385 - protein, 21 aa, Mycobacterium
AQRCPDRPGLIDELGTLTWRQ

SEQ ID NO: 620386 - protein, 18 aa, Mycobacterium
AQRLPGLLPPLSESESLE

SEQ ID NO: 620387 - protein, 18 aa, Mycobacterium
AQSRYRIFIVDEAHMVTT

SEQ ID NO: 620388 - protein, 25 aa, Mycobacterium
AQTGIQLYVKRVFIMGDCDQLMPEY

SEQ ID NO: 620389 - protein, 23 aa, Mycobacterium
AQTKRLRIGLMVTSNRFRPPSML

SEQ ID NO: 620390 - protein, 27 aa, Mycobacterium
ARACGVGLRAFELAVRYAQQRETFGKP

SEQ ID NO: 620391 - protein, 18 aa, Mycobacterium
ARADECWSQIQKLMTRRG

SEQ ID NO: 620392 - protein, 19 aa, Mycobacterium
ARAFSGVKIACVGQATADK

SEQ ID NO: 620393 - protein, 20 aa, Mycobacterium
ARAFVNRPLVLLADEPTGNL

SEQ ID NO: 620394 - protein, 20 aa, Mycobacterium
ARAKGMRNRVTWTVTKWDPP

SEQ ID NO: 620395 - protein, 24 aa, Mycobacterium
ARALIAVRGLHRFAAAEGLAELDV

SEQ ID NO: 620396 - protein, 18 aa, Mycobacterium
ARALRPYAEKLITHAKKG

SEQ ID NO: 620397 - protein, 23 aa, Mycobacterium
ARANARGLVVVRMGSETKGSEGV

SEQ ID NO: 620398 - protein, 21 aa, Mycobacterium
ARAVEIVERLWLSALWGGLPE

SEQ ID NO: 620399 - protein, 21 aa, Mycobacterium
ARAYVNRPLVLLADEPTGNLD

SEQ ID NO: 620400 - protein, 18 aa, Mycobacterium
ARCGADVVIASRNLDNCV

SEQ ID NO: 620401 - protein, 24 aa, Mycobacterium
ARDRRQPLRFALGIMDEPRRHLQD

SEQ ID NO: 620402 - protein, 17 aa, Mycobacterium
ARDSAPSLVFLDEVDAL

SEQ ID NO: 620403 - protein, 27 aa, Mycobacterium
ARDWQRLLFDNGWLLPAQPPEFGGRNA

SEQ ID NO: 620404 - protein, 30 aa, Mycobacterium; identical to SEQ ID NO: 78140

SEQ ID NO: 620405 - protein, 19 aa, Mycobacterium
ARFMTRWQGEPDPRHVEAI

SEQ ID NO: 620406 - protein, 21 aa, Mycobacterium
ARFQLDIMRVPGIIVARTDAE

SEQ ID NO: 620407 - protein, 26 aa, Mycobacterium
ARFVRLCDAFGIPLVVIVDVPGYLPG

SEQ ID NO: 620408 - protein, 17 aa, Mycobacterium
ARGLTGVHLVISDAHVG

SEQ ID NO: 620409 - protein, 19 aa, Mycobacterium
ARHSSGLSVQTFLRGIHVV

SEQ ID NO: 620410 - protein, 25 aa, Mycobacterium
ARIADRPAAVLLHLGPGLGNGLANL

SEQ ID NO: 620411 - protein, 20 aa, Mycobacterium
ARIDLAFFVGERWTEAGEPA

SEQ ID NO: 620412 - protein, 20 aa, Mycobacterium
ARKGIARGKSVVALVYAGGV

SEQ ID NO: 620413 - protein, 18 aa, Mycobacterium
ARKVAGWGADAMIVQGGE

SEQ ID NO: 620414 - protein, 17 aa, Mycobacterium
ARLGLRESATFDRTTIA

SEQ ID NO: 620415 - protein, 24 aa, Mycobacterium
ARLQKRLGTTTVYVTHDQTEAMTL

SEQ ID NO: 620416 - protein, 21 aa, Mycobacterium
ARLRVILRRAGKGSAEPRNSR

SEQ ID NO: 620417 - protein, 18 aa, Mycobacterium
ARMYRTGDVVRWGADGQL

SEQ ID NO: 620418 - protein, 20 aa, Mycobacterium
ARNGRIHAVTEIVAGQTPST

SEQ ID NO: 620419 - protein, 19 aa, Mycobacterium
ARNGRIHAVTELVAGQTPS

SEQ ID NO: 620420 - protein, 23 aa, Mycobacterium
ARPDLTLDLVRPGIAVYGLSPVP

SEQ ID NO: 620421 - protein, 19 aa, Mycobacterium
ARPGEDWTGSEQFSGDNPF

SEQ ID NO: 620422 - protein, 17 aa, Mycobacterium
ARPPTFVLFTTGFLEAG

SEQ ID NO: 620423 - protein, 24 aa, Mycobacterium
ARQALRLFDDLRLEHGRLDQPIPV

SEQ ID NO: 620424 - protein, 22 aa, Mycobacterium
ARQRLYLSRAIVRSSWGQPMLN

SEQ ID NO: 620425 - protein, 20 aa, Mycobacterium
ARRFARNDYDILLIGHEGHE

SEQ ID NO: 620426 - protein, 18 aa, Mycobacterium
ARRRGISVLGDRPPMVSV

SEQ ID NO: 620427 - protein, 20 aa, Mycobacterium
ARSAWQAALDYATQRTQFGR

SEQ ID NO: 620428 - protein, 21 aa, Mycobacterium
ARTLGSLALMGVRVEELIVNQ

SEQ ID NO: 620429 - protein, 19 aa, Mycobacterium
ARVAEGHPVAWIHATALRT

SEQ ID NO: 620430 - protein, 17 aa, Mycobacterium
ARVANLVERLKAAEKEL

SEQ ID NO: 620431 - protein, 25 aa, Mycobacterium
ARVDQLPLIWKRLVDAGMESGHAYG

SEQ ID NO: 620432 - protein, 19 aa, Mycobacterium
ARVGKSLIVQLKYGPSRER

SEQ ID NO: 620433 - protein, 22 aa, Mycobacterium
ARVLQALLARWDHHPRVDLVTT

SEQ ID NO: 620434 - protein, 22 aa, Mycobacterium
ARVLQALLARWEHHPRVDLVTT

SEQ ID NO: 620435 - protein, 19 aa, Mycobacterium
ARVQFLREAFEVDILTIGL

SEQ ID NO: 620436 - protein, 17 aa, Mycobacterium
ARVQHNLARLAELLLLW

SEQ ID NO: 620437 - protein, 25 aa, Mycobacterium
ARVVKAQVPLSEMFGYVGDLRSKTQ

SEQ ID NO: 620438 - protein, 21 aa, Mycobacterium
ARYDVTFSLGDGLRPGSIADA

SEQ ID NO: 620439 - protein, 23 aa, Mycobacterium
ARYGRDRIGLLTGDMSVNADAPV

SEQ ID NO: 620440 - protein, 26 aa, Mycobacterium
ARYWAQHLRKPVRFYDGVTRLLAGGE

SEQ ID NO: 620441 - protein, 18 aa, Mycobacterium
ASAIDRAALPYVVGTIAG

SEQ ID NO: 620442 - protein, 17 aa, Mycobacterium
ASDLSLAVMRLARQLRF

SEQ ID NO: 620443 - protein, 26 aa, Mycobacterium
ASDPLRAGMRLGLIPTVAPYVLPTVL

SEQ ID NO: 620444 - protein, 25 aa, Mycobacterium
ASELYPVLCGSAFKNKGVQPMLDAV

SEQ ID NO: 620445 - protein, 18 aa, Mycobacterium
ASFMPKPFAEHPGSAMHT

SEQ ID NO: 620446 - protein, 18 aa, Mycobacterium
ASGKVGVVHVCIDPKANS

SEQ ID NO: 620447 - protein, 17 aa, Mycobacterium
ASGLPMGGDLEFADELT

SEQ ID NO: 620448 - protein, 17 aa, Mycobacterium
ASGRVSYVLGLEGPAVS

SEQ ID NO: 620449 - protein, 26 aa, Mycobacterium
ASGVNWNFFGSFVFGTPGFPLSDVPL

SEQ ID NO: 620450 - protein, 26 aa, Mycobacterium
ASIRTAFCHHVHFFATREAAEPWLAE

SEQ ID NO: 620451 - protein, 33 aa, Mycobacterium
ASKGDSADGVWSRMKFEGGVHRVQRVPVTESQG

SEQ ID NO: 620452 - protein, 21 aa, Mycobacterium
ASKNAIPWGDFDTHLAHLRDL

SEQ ID NO: 620453 - protein, 22 aa, Mycobacterium
ASKRIAPIVVLTAFSQRDLVER

SEQ ID NO: 620454 - protein, 18 aa, Mycobacterium
ASLCSLGMNVTVLEATER

SEQ ID NO: 620455 - protein, 25 aa, Mycobacterium
ASLEALCALPMVVNATADLVFSANA

SEQ ID NO: 620456 - protein, 25 aa, Mycobacterium
ASLHAGHLVPLLALRRFQRAGHRPI

SEQ ID NO: 620457 - protein, 24 aa, Mycobacterium
ASMPAMIRAGGKMWGADGRQKDTK

SEQ ID NO: 620458 - protein, 24 aa, Mycobacterium
ASMPAMIRLGGKMYGADGRTKDTK

SEQ ID NO: 620459 - protein, 27 aa, Mycobacterium
ASNEYPVGFAWAMCTPFQFTKQFASHF

SEQ ID NO: 620460 - protein, 20 aa, Mycobacterium
ASNPRFSVSRVDIDRGGPTY

SEQ ID NO: 620461 - protein, 19 aa, Mycobacterium
ASNTHRWFGAYGVTKSAVD

SEQ ID NO: 620462 - protein, 17 aa, Mycobacterium
ASSGVVAARIFTPAEMF

SEQ ID NO: 620463 - protein, 20 aa, Mycobacterium
ASSLFRVSRLNCSITTSDGT

SEQ ID NO: 620464 - protein, 24 aa, Mycobacterium
ASSSRAGLGYEVIVSRLDDEANIA

SEQ ID NO: 620465 - protein, 20 aa, Mycobacterium
ASTKVQSWDIFKCVRQVLEV

SEQ ID NO: 620466 - protein, 18 aa, Mycobacterium
ASVHPGDVVQARWTVTGK

SEQ ID NO: 620467 - protein, 20 aa, Mycobacterium
ATAAFGRGECFVERYLDKPR

SEQ ID NO: 620468 - protein, 18 aa, Mycobacterium
ATDTGVAVDGRFSGISIA

SEQ ID NO: 620469 - protein, 24 aa, Mycobacterium
ATEELRAQWLPKMASGEMIGAIAM

SEQ ID NO: 620470 - protein, 18 aa, Mycobacterium
ATGASWPLLDAGLSHVER

SEQ ID NO: 620471 - protein, 22 aa, Mycobacterium
ATGLESTMRFILSAKSAYVDGQ

SEQ ID NO: 620472 - protein, 19 aa, Mycobacterium
ATGLVNLSAWPAGTRLILR

SEQ ID NO: 620473 - protein, 23 aa, Mycobacterium
ATGRAVGVLADLQGPKIRLGRFA

SEQ ID NO: 620474 - protein, 20 aa, Mycobacterium
ATGRRFEALSALSAGVKDVR

SEQ ID NO: 620475 - protein, 26 aa, Mycobacterium
ATHLSRLVPQHMMRRLFFTAATVDAA

SEQ ID NO: 620476 - protein, 23 aa, Mycobacterium
ATKADLYAAVDAMRADMRELLEQ

SEQ ID NO: 620477 - protein, 26 aa, Mycobacterium
ATKEVAWRTADMGWIESVRFGETMRK

SEQ ID NO: 620478 - protein, 23 aa, Mycobacterium
ATKVDGGWRINGHKIWTSLAQYA

SEQ ID NO: 620479 - protein, 18 aa, Mycobacterium
ATLARSGATLVLHLAAAQ

SEQ ID NO: 620480 - protein, 30 aa, Mycobacterium; identical to SEQ ID NO: 78309

SEQ ID NO: 620481 - protein, 26 aa, Mycobacterium
ATLRISSQLLANWLRHGVITEEDVKT

SEQ ID NO: 620482 - protein, 24 aa, Mycobacterium
ATLRRELTRSIGVEWNDVDPHTGM

SEQ ID NO: 620483 - protein, 19 aa, Mycobacterium
ATLVIKPGWGFSFDYQPGQ

SEQ ID NO: 620484 - protein, 17 aa, Mycobacterium
ATMAFAQAWQSVTDIRV

SEQ ID NO: 620485 - protein, 18 aa, Mycobacterium
ATMHPSRYLTLIEGVTAV

SEQ ID NO: 620486 - protein, 19 aa, Mycobacterium
ATMPDPIITLARTFMNQPT

SEQ ID NO: 620487 - protein, 19 aa, Mycobacterium
ATQYELWKAIWSSLNDGNF

SEQ ID NO: 620488 - protein, 19 aa, Mycobacterium
ATRRLALTGTPFRSDDSPI

SEQ ID NO: 620489 - protein, 17 aa, Mycobacterium
ATSARRALVLNLVAEPG

SEQ ID NO: 620490 - protein, 17 aa, Mycobacterium
ATWDCFGGLVEMPAMSR

SEQ ID NO: 620491 - protein, 17 aa, Mycobacterium
ATWGIAAAMTRGDISVT

SEQ ID NO: 620492 - protein, 17 aa, Mycobacterium
AVAFMCANIAIELDGLR

SEQ ID NO: 620493 - protein, 22 aa, Mycobacterium
AVASRVGAPLGHDYAVISLSDR

SEQ ID NO: 620494 - protein, 18 aa, Mycobacterium
AVCTAMLDLYQNEGIIAE

SEQ ID NO: 620495 - protein, 25 aa, Mycobacterium
AVDRAILRVAVWELLYADDVPEPVA

SEQ ID NO: 620496 - protein, 21 aa, Mycobacterium
AVDYLEIWDAQAWQDYQQTHE

SEQ ID NO: 620497 - protein, 19 aa, Mycobacterium
AVEDVFPLPRELVGEGSLF

SEQ ID NO: 620498 - protein, 19 aa, Mycobacterium
AVERVMVVRDRVRTEPPHP

SEQ ID NO: 620499 - protein, 23 aa, Mycobacterium
AVFDFLNTRCLTIAGGTEQILLT

SEQ ID NO: 620500 - protein, 18 aa, Mycobacterium
AVGDGWRVAMTTLMNERS

SEQ ID NO: 620501 - protein, 25 aa, Mycobacterium
AVGVARAAYEYALEYACQREQFGRK

SEQ ID NO: 620502 - protein, 26 aa, Mycobacterium
AVIISDFLGPINWMRPLRAIAGRHEV

SEQ ID NO: 620503 - protein, 24 aa, Mycobacterium
AVIPRAHGSALFERGETQIMGVTT

SEQ ID NO: 620504 - protein, 22 aa, Mycobacterium
AVLDRNGLRPSRIWVTDDGLVV

SEQ ID NO: 620505 - protein, 18 aa, Mycobacterium
AVLECAGVHDILAKSLGS

SEQ ID NO: 620506 - protein, 27 aa, Mycobacterium
AVLHTALRLPRDAKLVVDGQDVVADVH

SEQ ID NO: 620507 - protein, 19 aa, Mycobacterium
AVLKAGAAYLPIDPAHPDE

SEQ ID NO: 620508 - protein, 25 aa, Mycobacterium
AVLSRAQLLELVWGYDFAADTNVVD

SEQ ID NO: 620509 - protein, 26 aa, Mycobacterium
AVLSRAQLLELVWGYDFAADTNVVDV

SEQ ID NO: 620510 - protein, 21 aa, Mycobacterium
AVNDLRPGWVTPLDLPLIAGA

SEQ ID NO: 620511 - protein, 23 aa, Mycobacterium
AVNGVAFAGGFLLAQQCDLVVAA

SEQ ID NO: 620512 - protein, 20 aa, Mycobacterium
AVQLDGRFVLGVGSGEALNE

SEQ ID NO: 620513 - protein, 18 aa, Mycobacterium
AVRAHYAPVFSRLGPYDR

SEQ ID NO: 620514 - protein, 20 aa, Mycobacterium
AVSADWGLDEILLPSTGPAE

SEQ ID NO: 620515 - protein, 18 aa, Mycobacterium
AVTGCLIAGVPFVPVPAD

SEQ ID NO: 620516 - protein, 17 aa, Mycobacterium
AVTPEKQFTLFFDDVRV

SEQ ID NO: 620517 - protein, 28 aa, Mycobacterium
AVTRARNSGMPVLFWLDPYRPHENELIK

SEQ ID NO: 620518 - protein, 23 aa, Mycobacterium
AVVPRAHGSALFERGETQILGVT

SEQ ID NO: 620519 - protein, 23 aa, Mycobacterium
AVYLADCRKLGITVLPPDVNESL

SEQ ID NO: 620520 - protein, 19 aa, Mycobacterium
AWAALPRAGAVIFATGGMD

SEQ ID NO: 620521 - protein, 26 aa, Mycobacterium
AWDPITRIVGSLGIYTKIDFENREVV

SEQ ID NO: 620522 - protein, 18 aa, Mycobacterium
AWEMKGRFPDILNNPATG

SEQ ID NO: 620523 - protein, 20 aa, Mycobacterium
AWGAPQRWVIDANWKTGADN

SEQ ID NO: 620524 - protein, 18 aa, Mycobacterium
AWGLPYAALMAGADLVLP

SEQ ID NO: 620525 - protein, 18 aa, Mycobacterium
AWSVRWVILHVINELARH

SEQ ID NO: 620526 - protein, 23 aa, Mycobacterium
AWVLCAAIAHNLLRAAGVLAGGA

SEQ ID NO: 620527 - protein, 19 aa, Mycobacterium
AYACSFRITEAVYFVERLV

SEQ ID NO: 620528 - protein, 18 aa, Mycobacterium
AYADWVWLAVRTNPEAKK

SEQ ID NO: 620529 - protein, 22 aa, Mycobacterium
AYAEGLRALYLYTATFQDAAVA

SEQ ID NO: 620530 - protein, 25 aa, Mycobacterium
AYAGGVRAGHRLKFWTPGGSSTPLL

SEQ ID NO: 620531 - protein, 25 aa, Mycobacterium
AYANRFGYNVVRDFTGHGIGTTFHN

SEQ ID NO: 620532 - protein, 18 aa, Mycobacterium
AYEPVWAIGTGRVASAAD

SEQ ID NO: 620533 - protein, 17 aa, Mycobacterium
AYFAALLGLPFVAVMPA

SEQ ID NO: 620534 - protein, 19 aa, Mycobacterium
AYTPWYLVRYWRLLKFKLA

SEQ ID NO: 620535 - protein, 21 aa, Mycobacterium
AYVPGMCDYVVMVRNRSKVFL

SEQ ID NO: 620536 - protein, 20 aa, Mycobacterium
CADGRYVAVGAIEPQFYAAM

SEQ ID NO: 620537 - protein, 18 aa, Mycobacterium
CAGITTYSPLRHWNAGPG

SEQ ID NO: 620538 - protein, 22 aa, Mycobacterium
CALLGLECVIYMGAVDTARQAL

SEQ ID NO: 620539 - protein, 20 aa, Mycobacterium
CAVEGCSPARSWSAPEADDV

SEQ ID NO: 620540 - protein, 25 aa, Mycobacterium
CDAELRPYTGWSVRDVICQDPDAPS

SEQ ID NO: 620541 - protein, 18 aa, Mycobacterium
CDAIREMMLHPAGVLGLS

SEQ ID NO: 620542 - protein, 24 aa, Mycobacterium
CDCGPQLDAAMAMVAREGRGIVLY

SEQ ID NO: 620543 - protein, 17 aa, Mycobacterium
CDLQRPAAVNQLQVVGE

SEQ ID NO: 620544 - protein, 19 aa, Mycobacterium
CDLQRPGAVNQLQIVGERA

SEQ ID NO: 620545 - protein, 28 aa, Mycobacterium
CEDIGVDIAFNWDHFFPLYGDPDGAHFE

SEQ ID NO: 620546 - protein, 25 aa, Mycobacterium
CEIRTRRFGAYEVHATSAPLDEDAS

SEQ ID NO: 620547 - protein, 17 aa, Mycobacterium
CEPVCPVEAIYYEDDVP

SEQ ID NO: 620548 - protein, 18 aa, Mycobacterium
CEPVCPVEAIYYEDDVPD

SEQ ID NO: 620549 - protein, 17 aa, Mycobacterium
CEPVCPVESIYYEDDLP

SEQ ID NO: 620550 - protein, 27 aa, Mycobacterium
CGAPVLTLRTDRDWIADIVRFVESRRR

SEQ ID NO: 620551 - protein, 20 aa, Mycobacterium
CGECGFCKQGAEALCGAVGF

SEQ ID NO: 620552 - protein, 25 aa, Mycobacterium
CGIDPEVYSGFAFGMGLERTLQFRN

SEQ ID NO: 620553 - protein, 18 aa, Mycobacterium
CGILVLKRLSDAERDGDR

SEQ ID NO: 620554 - protein, 19 aa, Mycobacterium
CGLTASRFVACPFGGVGAR

SEQ ID NO: 620555 - protein, 17 aa, Mycobacterium
CGMVNPNVLRACGIDPE

SEQ ID NO: 620556 - protein, 18 aa, Mycobacterium
CGNGVRVFAHYLRASGLE

SEQ ID NO: 620557 - protein, 30 aa, Mycobacterium
CHYCHRSLYHLCQRPGWIGFTRNGGLANYV

SEQ ID NO: 620558 - protein, 30 aa, Mycobacterium
CILPSRILLPRSRYDEGIEILKNMMENFPV

SEQ ID NO: 620559 - protein, 23 aa, Mycobacterium
CKAANALTGLGLVAGDRVAIYMP

SEQ ID NO: 620560 - protein, 20 aa, Mycobacterium
CLDAGVKVGCFRPPTVPAGT

SEQ ID NO: 620561 - protein, 23 aa, Mycobacterium
CLSEARYGIIWGSMGAARSAWQA

SEQ ID NO: 620562 - protein, 21 aa, Mycobacterium
CMDARLDVYRILGLGDGEAHV

SEQ ID NO: 620563 - protein, 20 aa, Mycobacterium
CMDNGMPILVFNLLTNGNIA

SEQ ID NO: 620564 - protein, 20 aa, Mycobacterium
CNPYLAFAVLLAAGLRGVEK

SEQ ID NO: 620565 - protein, 24 aa, Mycobacterium
CNRCPVTTDCLSWALNTGQDSGVW

SEQ ID NO: 620566 - protein, 17 aa, Mycobacterium
CPDLDTCMYTLGGGVDP

SEQ ID NO: 620567 - protein, 17 aa, Mycobacterium
CPQRAFPALGRALDLDE

SEQ ID NO: 620568 - protein, 19 aa, Mycobacterium
CPYHRWIFNNDGRFAGAPR

SEQ ID NO: 620569 - protein, 21 aa, Mycobacterium
CQDFARLAIACLRANGLAASY

SEQ ID NO: 620570 - protein, 28 aa, Mycobacterium
CQDFARLAIACLRANGLAASYVSGYLAT

SEQ ID NO: 620571 - protein, 25 aa, Mycobacterium
CQQGFCGTCKVKVLAGQVDHRGRAA

SEQ ID NO: 620572 - protein, 22 aa, Mycobacterium
CQSILGYVVRWIDAGVGCSKVP

SEQ ID NO: 620573 - protein, 22 aa, Mycobacterium
CQSILGYVVRWIDQGVGCSKVP

SEQ ID NO: 620574 - protein, 21 aa, Mycobacterium
CQYGAQGIRCNAVAPGVTLTP

SEQ ID NO: 620575 - protein, 17 aa, Mycobacterium
CRDCPECRRGEYRRCAV

SEQ ID NO: 620576 - protein, 17 aa, Mycobacterium
CRDLGIATVAVYSDADA

SEQ ID NO: 620577 - protein, 17 aa, Mycobacterium
CRDVVAAVTNAGGFGVL

SEQ ID NO: 620578 - protein, 21 aa, Mycobacterium
CRFPGCTVPATRCDIDHTTPF

SEQ ID NO: 620579 - protein, 17 aa, Mycobacterium
CRIGERSSHTWFVLTHL

SEQ ID NO: 620580 - protein, 27 aa, Mycobacterium
CRQHHLLKTFWGWRDEQLPDGTLIWRL

SEQ ID NO: 620581 - protein, 17 aa, Mycobacterium
CRSDLGGALVLSEFTGA

SEQ ID NO: 620582 - protein, 17 aa, Mycobacterium
CSAEINGRPRLMCMTRM

SEQ ID NO: 620583 - protein, 18 aa, Mycobacterium
CSIQRRYQKLVEIAPAQG

SEQ ID NO: 620584 - protein, 18 aa, Mycobacterium
CSPHAAPTRPSTPPAPCA

SEQ ID NO: 620585 - protein, 20 aa, Mycobacterium
CTSLNEVICHGIPDSTVIED

SEQ ID NO: 620586 - protein, 19 aa, Mycobacterium
CTYREGLSAVRIDGGVAGN

SEQ ID NO: 620587 - protein, 18 aa, Mycobacterium
CTYREGLSAVRVDGGVAG

SEQ ID NO: 620588 - protein, 24 aa, Mycobacterium
CVAAGIPAVTFWAAVPHYVSHPPN

SEQ ID NO: 620589 - protein, 20 aa, Mycobacterium
CVEFAAARPGMLGLQTALSV

SEQ ID NO: 620590 - protein, 21 aa, Mycobacterium
CVFFMRDVRSAQYFEQMKGRG

SEQ ID NO: 620591 - protein, 17 aa, Mycobacterium
CVGAAFAQMQIKAIFSV

SEQ ID NO: 620592 - protein, 17 aa, Mycobacterium
DAAAVTVNFRFAPDRSV

SEQ ID NO: 620593 - protein, 23 aa, Mycobacterium
DAAETWVPGHLTGHARADWLEGF

SEQ ID NO: 620594 - protein, 22 aa, Mycobacterium
DAAHAMPPWIGQGMSAGVRDAA

SEQ ID NO: 620595 - protein, 19 aa, Mycobacterium
DAANMIASYEFLRLLEHRL

SEQ ID NO: 620596 - protein, 18 aa, Mycobacterium
DAASKVFAAEGFAGATID

SEQ ID NO: 620597 - protein, 22 aa, Mycobacterium
DAAVALGRRVSFVGRSMVRNMG

SEQ ID NO: 620598 - protein, 17 aa, Mycobacterium
DADADAWHVADADEAVH

SEQ ID NO: 620599 - protein, 20 aa, Mycobacterium
DADGLRALFTTWITAPQPDI

SEQ ID NO: 620600 - protein, 23 aa, Mycobacterium
DADKYRRLHVIIGDANLAETSTY

SEQ ID NO: 620601 - protein, 29 aa, Mycobacterium
DADLAVLGYYEWREGLLRGLAAHHAGMLP

SEQ ID NO: 620602 - protein, 23 aa, Mycobacterium
DAEFRVGTMGLGWDSEAQTVVVE

SEQ ID NO: 620603 - protein, 27 aa, Mycobacterium
DAELRIAQAQLVGWLEGLFHGIQTALF

SEQ ID NO: 620604 - protein, 33 aa, Mycobacterium
DAELRIAQAQLVGWLEGLFHGIQTALFAQQMAA

SEQ ID NO: 620605 - protein, 17 aa, Mycobacterium
DAFQEFYHAPVLHANQS

SEQ ID NO: 620606 - protein, 26 aa, Mycobacterium
DAGTTYRPGTRFGPMGIRRSTNLFGT

SEQ ID NO: 620607 - protein, 17 aa, Mycobacterium
DAGVAFVNALPVFIASD

SEQ ID NO: 620608 - protein, 17 aa, Mycobacterium
DAGVDLFLCDSTNSEIP

SEQ ID NO: 620609 - protein, 23 aa, Mycobacterium
DAHARLLVWELIDALRRDGVTVV

SEQ ID NO: 620610 - protein, 23 aa, Mycobacterium
DAHPVPGRWLPNGCMATSGSLIR

SEQ ID NO: 620611 - protein, 22 aa, Mycobacterium
DALIRRRRISMIRSIYPGQTAT

SEQ ID NO: 620612 - protein, 17 aa, Mycobacterium
DALRIPMQYLAELFTAG

SEQ ID NO: 620613 - protein, 25 aa, Mycobacterium
DALSTARFEFRWNDQFALSLDPDTA

SEQ ID NO: 620614 - protein, 17 aa, Mycobacterium
DALSVLVRLLASLHDDD

SEQ ID NO: 620615 - protein, 20 aa, Mycobacterium
DAMPTFRQVFMAGASGMTLE

SEQ ID NO: 620616 - protein, 18 aa, Mycobacterium
DANFGWSARDACYSYGSF

SEQ ID NO: 620617 - protein, 20 aa, Mycobacterium
DANIGSIMGIGFPPYTGGSA

SEQ ID NO: 620618 - protein, 20 aa, Mycobacterium
DANMVVPMPFHLGYHESPVP

SEQ ID NO: 620619 - protein, 19 aa, Mycobacterium
DAPGCKRVLFSNDYYPAIA

SEQ ID NO: 620620 - protein, 22 aa, Mycobacterium
DARFGWPKRNGFVQPLVDAELL

SEQ ID NO: 620621 - protein, 18 aa, Mycobacterium
DASLLLVVLTRFLPPDDP

SEQ ID NO: 620622 - protein, 17 aa, Mycobacterium
DAVIGVNLTGTWRTLRA

SEQ ID NO: 620623 - protein, 23 aa, Mycobacterium
DAVTGMAGLLAWSQAPTRALGRF

SEQ ID NO: 620624 - protein, 25 aa, Mycobacterium
DAYFSYPPLQGFGMPSGECSIEPWV

SEQ ID NO: 620625 - protein, 19 aa, Mycobacterium
DAYVTWDYCRGYADASLNE

SEQ ID NO: 620626 - protein, 19 aa, Mycobacterium
DCGGFHRAAAVLHLTQSAV

SEQ ID NO: 620627 - protein, 24 aa, Mycobacterium
DCTGLLPLASVAAMQGRIAMYHAL

SEQ ID NO: 620628 - protein, 17 aa, Mycobacterium
DCVGHGLAAATVMGQLR

SEQ ID NO: 620629 - protein, 37 aa, Mycobacterium
DCYDYTGHVLFTWHLPELWRRFTITLRRTLRRELRAS

SEQ ID NO: 620630 - protein, 18 aa, Mycobacterium
DDAAYAFALSRLSDQNLE

SEQ ID NO: 620631 - protein, 18 aa, Mycobacterium
DDAHLRAIAQLNFANARR

SEQ ID NO: 620632 - protein, 17 aa, Mycobacterium
DDARPVLERASARETAA

SEQ ID NO: 620633 - protein, 34 aa, Mycobacterium; identical to SEQ ID NO: 87337

SEQ ID NO: 620634 - protein, 17 aa, Mycobacterium
DDGCCSHGAFLSDDDDR

SEQ ID NO: 620635 - protein, 24 aa, Mycobacterium
DDGIGIDEYVDWLIEAGYPIERID

SEQ ID NO: 620636 - protein, 24 aa, Mycobacterium
DDHLRHCVRDAAAAGGPAADAKLT

SEQ ID NO: 620637 - protein, 24 aa, Mycobacterium
DDIEICGFATLLGGAGAETVTKLM

SEQ ID NO: 620638 - protein, 17 aa, Mycobacterium
DDLRIAVDGGFLSVTEE

SEQ ID NO: 620639 - protein, 19 aa, Mycobacterium
DDPRWLVKHLPKAARDAVM

SEQ ID NO: 620640 - protein, 17 aa, Mycobacterium
DDPRWLVKHLPKHARDA

SEQ ID NO: 620641 - protein, 17 aa, Mycobacterium
DDQFPIDVFQTGSGTSS

SEQ ID NO: 620642 - protein, 17 aa, Mycobacterium
DDSLGMRRVEVLCANCH

SEQ ID NO: 620643 - protein, 24 aa, Mycobacterium
DDTPEGFGRIAATTARQVILQRLR

SEQ ID NO: 620644 - protein, 30 aa, Mycobacterium
DEALRLRELLKFEFLFSARAQFEKDLADEV

SEQ ID NO: 620645 - protein, 23 aa, Mycobacterium
DEDRELLESFDLTYGEDEGGEED

SEQ ID NO: 620646 - protein, 28 aa, Mycobacterium
DEEFARAAGMPGVFGMGLLHGGVLAQRL

SEQ ID NO: 620647 - protein, 24 aa, Mycobacterium
DEFAEGYCLPTILNNALYMDRYPL

SEQ ID NO: 620648 - protein, 25 aa, Mycobacterium
DEFAEGYCLPTILSNALYMDRYPLV

SEQ ID NO: 620649 - protein, 26 aa, Mycobacterium
DEGHTWKCLADGLGAITHIATPKKGT

SEQ ID NO: 620650 - protein, 24 aa, Mycobacterium
DEGRSVAGAAHFLEHLLFKSTPTR

SEQ ID NO: 620651 - protein, 19 aa, Mycobacterium
DEIEAAVGLAERDPAVKVI

SEQ ID NO: 620652 - protein, 20 aa, Mycobacterium
DEIGSGLAVFHPKGGIVRRE

SEQ ID NO: 620653 - protein, 30 aa, Mycobacterium
DEIPEIAHAWLFDHLIPIAGDVTGPVLEGW

SEQ ID NO: 620654 - protein, 22 aa, Mycobacterium
DENRAALAVAEVWDNGKPVREA

SEQ ID NO: 620655 - protein, 22 aa, Mycobacterium
DERMAPIPSLLAVAGVHHHLVR

SEQ ID NO: 620656 - protein, 21 aa, Mycobacterium
DEVVDVVLLWWRDGDGDLVDT

SEQ ID NO: 620657 - protein, 23 aa, Mycobacterium
DFKQCPLLYRFRAIDRLPEAPSA

SEQ ID NO: 620658 - protein, 18 aa, Mycobacterium
DFNRRPWPTSELRSTSGP

SEQ ID NO: 620659 - protein, 21 aa, Mycobacterium
DFPGDRGWDAGRLFDPDPDAL

SEQ ID NO: 620660 - protein, 21 aa, Mycobacterium
DFRLERDGVLVSWAVPKNLPE

SEQ ID NO: 620661 - protein, 24 aa, Mycobacterium
DFVECGVSYGFLSSAIMEYLDWDR

SEQ ID NO: 620662 - protein, 24 aa, Mycobacterium
DGDEPIELWAWVGAYDHVVLCQLW

SEQ ID NO: 620663 - protein, 22 aa, Mycobacterium
DGDLLKGVRFFGGGCTTQSIVM

SEQ ID NO: 620664 - protein, 25 aa, Mycobacterium
DGEFVKFGPSWAWPKPVQPHIPVLV

SEQ ID NO: 620665 - protein, 25 aa, Mycobacterium
DGEFVKFGPSWAWPKPVQSHIPVLV

SEQ ID NO: 620666 - protein, 23 aa, Mycobacterium
DGEGRGGRRGRRFRDRRRRGERS

SEQ ID NO: 620667 - protein, 20 aa, Mycobacterium
DGGAHYGMICDASYSTYFLA

SEQ ID NO: 620668 - protein, 20 aa, Mycobacterium
DGGAHYGMICDASYSTYFLT

SEQ ID NO: 620669 - protein, 19 aa, Mycobacterium
DGGEWAVGDIAEWGKIGGM

SEQ ID NO: 620670 - protein, 18 aa, Mycobacterium
DGGGAGWVGNAGNGGAGG

SEQ ID NO: 620671 - protein, 17 aa, Mycobacterium
DGGGAVFYSVVSRDSLD

SEQ ID NO: 620672 - protein, 22 aa, Mycobacterium
DGIRLGDYDIGIAIGLDKHPRG

SEQ ID NO: 620673 - protein, 20 aa, Mycobacterium
DGLYRLTPRTGRTHQLRVHM

SEQ ID NO: 620674 - protein, 26 aa, Mycobacterium
DGMSELRGLITPELRATFEAVEAKLG

SEQ ID NO: 620675 - protein, 20 aa, Mycobacterium
DGNDVLACYAVTAEAAARAR

SEQ ID NO: 620676 - protein, 19 aa, Mycobacterium
DGQFGKWLQGARDWSISRN

SEQ ID NO: 620677 - protein, 20 aa, Mycobacterium
DGRGPVLVHALEGFSDAGHA

SEQ ID NO: 620678 - protein, 28 aa, Mycobacterium
DGRIKGAVEEFVRWATPIMTFRRTAARD

SEQ ID NO: 620679 - protein, 17 aa, Mycobacterium
DGRSIEVIGRYHPKEDP

SEQ ID NO: 620680 - protein, 17 aa, Mycobacterium
DGRWVVSIRCAQLSADR

SEQ ID NO: 620681 - protein, 20 aa, Mycobacterium
DGSCVYACPVNCIHPSPDEP

SEQ ID NO: 620682 - protein, 17 aa, Mycobacterium
DGSDFVFMDSEDFEQHP

SEQ ID NO: 620683 - protein, 17 aa, Mycobacterium
DGSDFVFMDSQDYEQHP

SEQ ID NO: 620684 - protein, 17 aa, Mycobacterium
DGSYTLTGHKWFTSAPM

SEQ ID NO: 620685 - protein, 19 aa, Mycobacterium
DGTLLWTQRRSIFARGEGG

SEQ ID NO: 620686 - protein, 25 aa, Mycobacterium
DGVARLFEHGRICGVEDGPPETVFA

SEQ ID NO: 620687 - protein, 18 aa, Mycobacterium
DGVIPPNRSLDCVDDELA

SEQ ID NO: 620688 - protein, 23 aa, Mycobacterium
DGVPRVETHLEWQMTPHTDPSWN

SEQ ID NO: 620689 - protein, 20 aa, Mycobacterium
DGWVHFDAPAGMLIPDSVAT

SEQ ID NO: 620690 - protein, 26 aa, Mycobacterium
DHAGKWRVVFFWPKDFTFVCPTEIAA

SEQ ID NO: 620691 - protein, 18 aa, Mycobacterium
DHPAFYWYAERISEQRAV

SEQ ID NO: 620692 - protein, 26 aa, Mycobacterium
DHVYEAALAWARRFSDHPVDVLAAAK

SEQ ID NO: 620693 - protein, 19 aa, Mycobacterium
DIALRRPSLDDVFLSMTTD

SEQ ID NO: 620694 - protein, 23 aa, Mycobacterium
DIARTAVLSAGWPETVPGVTVDR

SEQ ID NO: 620695 - protein, 18 aa, Mycobacterium
DIEAQGWIAPAECIEVRV

SEQ ID NO: 620696 - protein, 25 aa, Mycobacterium
DINVKIDKGEFVFLIGPSGSGKSTF

SEQ ID NO: 620697 - protein, 20 aa, Mycobacterium
DIPEALGLDQRASFYEETGA

SEQ ID NO: 620698 - protein, 17 aa, Mycobacterium
DIQTTLSTYGWVTEDAE

SEQ ID NO: 620699 - protein, 22 aa, Mycobacterium
DITKLRYHKIVLMADADVDGQH

SEQ ID NO: 620700 - protein, 22 aa, Mycobacterium
DIVAVLALYRPGPMGMNAHNDY

SEQ ID NO: 620701 - protein, 24 aa, Mycobacterium
DIWGRRRLAYEIAKHAEGIYVVVD

SEQ ID NO: 620702 - protein, 18 aa, Mycobacterium
DIYDEFLELAAIRTKAVR

SEQ ID NO: 620703 - protein, 18 aa, Mycobacterium
DIYWCTADPGWVTGTSYG

SEQ ID NO: 620704 - protein, 18 aa, Mycobacterium
DKGARWDPAELGPVVADL

SEQ ID NO: 620705 - protein, 20 aa, Mycobacterium
DKHKLALEREMLGLYVSGHP

SEQ ID NO: 620706 - protein, 24 aa, Mycobacterium
DKLDLKPGMTLLDIGCGWGTTMKR

SEQ ID NO: 620707 - protein, 24 aa, Mycobacterium
DKLDYLVDLGVDFVELMPVNSFAG

SEQ ID NO: 620708 - protein, 18 aa, Mycobacterium
DKLSVGLGRLAAEDPTLR

SEQ ID NO: 620709 - protein, 24 aa, Mycobacterium
DKPPGVAETIDWVAALVSLGVADL

SEQ ID NO: 620710 - protein, 27 aa, Mycobacterium
DKRLPRIAGPCGMVIFGVTGDLARKKV

SEQ ID NO: 620711 - protein, 32 aa, Mycobacterium
DKSIPGMLMAAARLDLASVFFYNGSIMPGVAK

SEQ ID NO: 620712 - protein, 24 aa, Mycobacterium
DLAARVGAPLVLRGVGVRRVADDR

SEQ ID NO: 620713 - protein, 18 aa, Mycobacterium
DLAILIGPDQEWQQSEEF

SEQ ID NO: 620714 - protein, 19 aa, Mycobacterium
DLAKRCGKPLMIHNREADA

SEQ ID NO: 620715 - protein, 18 aa, Mycobacterium
DLALQCAPDHPWAREHRN

SEQ ID NO: 620716 - protein, 19 aa, Mycobacterium
DLAYGYARNQMSAYVELQE

SEQ ID NO: 620717 - protein, 18 aa, Mycobacterium
DLAYRDAAGYAYFAGRLG

SEQ ID NO: 620718 - protein, 25 aa, Mycobacterium
DLDKGRYGLVPVHCDVWEGFIFVNF

SEQ ID NO: 620719 - protein, 27 aa, Mycobacterium
DLEDLPPRIVFVGGGYISFEFAHIAAR

SEQ ID NO: 620720 - protein, 26 aa, Mycobacterium
DLFEVNEAFAPVVLAWAHDTGADLAK

SEQ ID NO: 620721 - protein, 19 aa, Mycobacterium
DLFLGVPFNIASYALLTHM

SEQ ID NO: 620722 - protein, 18 aa, Mycobacterium
DLGEEFDDNFVFPPGMVL

SEQ ID NO: 620723 - protein, 18 aa, Mycobacterium
DLGQEWDDNFVFPDGMLL

SEQ ID NO: 620724 - protein, 24 aa, Mycobacterium
DLHLPWQWGAEWFLDQLVDGDMAN

SEQ ID NO: 620725 - protein, 19 aa, Mycobacterium
DLLALGALLHDIGKGRGAD

SEQ ID NO: 620726 - protein, 19 aa, Mycobacterium
DLMRHKRGFTDPAPANMEN

SEQ ID NO: 620727 - protein, 21 aa, Mycobacterium
DLPLLLLDEGHCLRDQALDVC

SEQ ID NO: 620728 - protein, 24 aa, Mycobacterium
DLPWAQRLSQVWRMHDHDERNASL

SEQ ID NO: 620729 - protein, 33 aa, Mycobacterium
DLQFRPEVSDGLFLRLAVTSVDSLACAYAAVLA

SEQ ID NO: 620730 - protein, 21 aa, Mycobacterium
DLRLVVVDYLQLMSSGKKVES

SEQ ID NO: 620731 - protein, 24 aa, Mycobacterium
DLSTLRFALSGAEPVEPADVEDLL

SEQ ID NO: 620732 - protein, 25 aa, Mycobacterium
DLTARVCGICPVAYQVSACNAIEDA

SEQ ID NO: 620733 - protein, 20 aa, Mycobacterium
DLTGCMALGITGPILRATGL

SEQ ID NO: 620734 - protein, 20 aa, Mycobacterium
DLTRRIALRHTVDMVRVTME

SEQ ID NO: 620735 - protein, 18 aa, Mycobacterium
DLVFPLQVVINLSDPATD

SEQ ID NO: 620736 - protein, 25 aa, Mycobacterium
DLVLRRLTEALARDRTRHQVSEVTS

SEQ ID NO: 620737 - protein, 26 aa, Mycobacterium
DMAPICQLFHTLPIPWVEPIDISNAV

SEQ ID NO: 620738 - protein, 24 aa, Mycobacterium
DMTRRLAREEAMLVGGSCGMAVVA

SEQ ID NO: 620739 - protein, 18 aa, Mycobacterium
DMYLFSPYDVERVYGVPF

SEQ ID NO: 620740 - protein, 17 aa, Mycobacterium
DNDRLSALVAHLVGADA

SEQ ID NO: 620741 - protein, 22 aa, Mycobacterium
DNGIKIFGPGGHKLDDATEDRI

SEQ ID NO: 620742 - protein, 19 aa, Mycobacterium
DPASVRVWSCFATVGDHLP

SEQ ID NO: 620743 - protein, 18 aa, Mycobacterium
DPCHQCMGDGRVRARREI

SEQ ID NO: 620744 - protein, 18 aa, Mycobacterium
DPDLPPSHHYLAAYHWLD

SEQ ID NO: 620745 - protein, 23 aa, Mycobacterium
DPDLRGVKMPKRRRTRAQNTART

SEQ ID NO: 620746 - protein, 31 aa, Mycobacterium
DPDTAFLELCPFAAWGSKFPVGGSVVVGIGV

SEQ ID NO: 620747 - protein, 27 aa, Mycobacterium
DPDTLRYLRDFRFGGDIDGYAEGELYF

SEQ ID NO: 620748 - protein, 19 aa, Mycobacterium
DPEMLRYFDSVGISLDSRL

SEQ ID NO: 620749 - protein, 20 aa, Mycobacterium
DPEVPPALRRLVLEGRAGVE

SEQ ID NO: 620750 - protein, 18 aa, Mycobacterium
DPGVRLIGFEAAGDGVET

SEQ ID NO: 620751 - protein, 25 aa, Mycobacterium
DPLFTRTGAGLAFTPGGLRLASRAV

SEQ ID NO: 620752 - protein, 18 aa, Mycobacterium
DPLLRLSTFFDDGSVELL

SEQ ID NO: 620753 - protein, 22 aa, Mycobacterium
DPLRPRFQGLLPAQTRRRKAAD

SEQ ID NO: 620754 - protein, 17 aa, Mycobacterium
DPMECAELLDWPAKLRL

SEQ ID NO: 620755 - protein, 22 aa, Mycobacterium
DPNKHLAFGYGVHFCLGAALAR

SEQ ID NO: 620756 - protein, 24 aa, Mycobacterium
DPNKHLAFGYGVHFCMGAALARME

SEQ ID NO: 620757 - protein, 22 aa, Mycobacterium
DPRVPATGGFVLFYHLLWELTH

SEQ ID NO: 620758 - protein, 17 aa, Mycobacterium
DPSFSEKSLGFKSFSDF

SEQ ID NO: 620759 - protein, 22 aa, Mycobacterium
DPTELRAALATQLPHYMVPTAL

SEQ ID NO: 620760 - protein, 17 aa, Mycobacterium
DPVALHHYMTFHSVVPA

SEQ ID NO: 620761 - protein, 18 aa, Mycobacterium
DPVEWKRDQALKFGATHV

SEQ ID NO: 620762 - protein, 18 aa, Mycobacterium
DPVGEVLRGYTLPNGLQL

SEQ ID NO: 620763 - protein, 17 aa, Mycobacterium
DPVIGPFFEGGLMLLDF

SEQ ID NO: 620764 - protein, 25 aa, Mycobacterium
DPVIPRLFQAMGFLGDGAREIIAAR

SEQ ID NO: 620765 - protein, 24 aa, Mycobacterium
DPYRMASQLGMPPWRVQKAQKQAR

SEQ ID NO: 620766 - protein, 20 aa, Mycobacterium
DQDFTAWLALFATECAYEVR

SEQ ID NO: 620767 - protein, 17 aa, Mycobacterium
DQLRLTGTHWGCDTSNC

SEQ ID NO: 620768 - protein, 19 aa, Mycobacterium
DQMGEWRAAAVERIVGLSP

SEQ ID NO: 620769 - protein, 20 aa, Mycobacterium
DQRPAVHALYGFARYADDIL

SEQ ID NO: 620770 - protein, 17 aa, Mycobacterium
DQSWRYKDLTYWTELAK

SEQ ID NO: 620771 - protein, 24 aa, Mycobacterium
DQVLRSGLFGPWDKPEIIEKLELP

SEQ ID NO: 620772 - protein, 29 aa, Mycobacterium
DQYEIKGCIAHGGLGWVYLAFDKNVNDRP

SEQ ID NO: 620773 - protein, 20 aa, Mycobacterium
DRAALPYVVGTVAGDDTILV

SEQ ID NO: 620774 - protein, 22 aa, Mycobacterium
DRCDLDHTVPYPAGPTHASNLK

SEQ ID NO: 620775 - protein, 25 aa, Mycobacterium
DRDGQPRWTPIIAHLSDGRRVVARS

SEQ ID NO: 620776 - protein, 23 aa, Mycobacterium
DRDGVRTPMQWTPDRNAGFSKAN

SEQ ID NO: 620777 - protein, 23 aa, Mycobacterium
DRDGVRTPMQWTPDRNAGFSTAN

SEQ ID NO: 620778 - protein, 24 aa, Mycobacterium
DRDWAPKVYGAWHLHQATTDQPLD

SEQ ID NO: 620779 - protein, 19 aa, Mycobacterium
DREKHGALRGSMTVLAVNT

SEQ ID NO: 620780 - protein, 26 aa, Mycobacterium
DRFNELVMRAGLTWQQVVVLRAYAKY

SEQ ID NO: 620781 - protein, 19 aa, Mycobacterium
DRFTARLVVRRVKDARFRD

SEQ ID NO: 620782 - protein, 20 aa, Mycobacterium
DRGPWKLIIAQHFASADELM

SEQ ID NO: 620783 - protein, 21 aa, Mycobacterium
DRHLLRPLREVIWGHDENLLN

SEQ ID NO: 620784 - protein, 20 aa, Mycobacterium
DRIVSIGAFEHFGRQRYGRF

SEQ ID NO: 620785 - protein, 20 aa, Mycobacterium
DRIVSIGAFEHFGYDRYDDF

SEQ ID NO: 620786 - protein, 20 aa, Mycobacterium
DRLAELRPGDPILGEEGGGP

SEQ ID NO: 620787 - protein, 30 aa, Mycobacterium
DRLRRVAGDWQLCRRRLLLDQTVLLAKNLS

SEQ ID NO: 620788 - protein, 26 aa, Mycobacterium
DRLVARIDAKLGFPQRDPHGDPIPAS

SEQ ID NO: 620789 - protein, 22 aa, Mycobacterium
DRPADRPLWLGSVKSNMGHTQA

SEQ ID NO: 620790 - protein, 20 aa, Mycobacterium
DRPMEFLGNLVLLIVGGNDT

SEQ ID NO: 620791 - protein, 20 aa, Mycobacterium
DRPTGTFTFAELLAHELSVE

SEQ ID NO: 620792 - protein, 17 aa, Mycobacterium
DRPYPPIADYRGASHQF

SEQ ID NO: 620793 - protein, 24 aa, Mycobacterium
DRRAREVGDVIGWDLQFVVAPNAE

SEQ ID NO: 620794 - protein, 18 aa, Mycobacterium
DRRGLPAPQFSGAAVYRG

SEQ ID NO: 620795 - protein, 18 aa, Mycobacterium
DRRPAIVAGASSGIGAAT

SEQ ID NO: 620796 - protein, 22 aa, Mycobacterium
DRRQLIEFCLLASQYDGLAATM

SEQ ID NO: 620797 - protein, 25 aa, Mycobacterium
DRVGLRIVVEIKRDAVAKVVLNNLY

SEQ ID NO: 620798 - protein, 21 aa, Mycobacterium
DRVLPIVPMFHANAWGLPYAA

SEQ ID NO: 620799 - protein, 23 aa, Mycobacterium
DRVREVAALIPGAMRGLVSERQL

SEQ ID NO: 620800 - protein, 20 aa, Mycobacterium
DRYDPIWGDKGGLFTIARAI

SEQ ID NO: 620801 - protein, 20 aa, Mycobacterium
DRYIPSRALADYVRCRDLTC

SEQ ID NO: 620802 - protein, 24 aa, Mycobacterium
DRYRKCFSDGLYLTGDLAKKDADG

SEQ ID NO: 620803 - protein, 21 aa, Mycobacterium
DSCRECDNCKAGLEQYCTGTG

SEQ ID NO: 620804 - protein, 18 aa, Mycobacterium
DSCRGGCMAAKFFTGLPL

SEQ ID NO: 620805 - protein, 20 aa, Mycobacterium
DSELNWCNPSGRALGTPPTA

SEQ ID NO: 620806 - protein, 22 aa, Mycobacterium
DSERPLLMWLRELAQFGCPVDE

SEQ ID NO: 620807 - protein, 18 aa, Mycobacterium
DSFHHLWYQLTQISVKMK

SEQ ID NO: 620808 - protein, 17 aa, Mycobacterium
DSGDEWEAFLGKDEDLY

SEQ ID NO: 620809 - protein, 20 aa, Mycobacterium
DSGIGRAVAVAFAKEGADVA

SEQ ID NO: 620810 - protein, 23 aa, Mycobacterium
DSIDPLWWGWRNHMKIFFNNKGV

SEQ ID NO: 620811 - protein, 21 aa, Mycobacterium
DSLRIFPATHYVAGPERMAHA

SEQ ID NO: 620812 - protein, 24 aa, Mycobacterium
DSMVEAAICDGDWVVVRQQNVADN

SEQ ID NO: 620813 - protein, 23 aa, Mycobacterium
DSTTETFAAITLEVDTRRWAGVP

SEQ ID NO: 620814 - protein, 24 aa, Mycobacterium
DTALAAYLVRPGQRSFALDDLSLR

SEQ ID NO: 620815 - protein, 23 aa, Mycobacterium
DTALAAYLVRPGQRSFTLDDLSL

SEQ ID NO: 620816 - protein, 24 aa, Mycobacterium
DTDVWAWCHSPAFDVSAWELWGAL

SEQ ID NO: 620817 - protein, 24 aa, Mycobacterium
DTEIPSPAAGVLTKIVAQEDDTVE

SEQ ID NO: 620818 - protein, 19 aa, Mycobacterium
DTGRARTAGISSFGISGTN

SEQ ID NO: 620819 - protein, 24 aa, Mycobacterium
DTGVPRPGLSTIFSPSRSTFGVDL

SEQ ID NO: 620820 - protein, 23 aa, Mycobacterium
DTINIRYARPLGVDRTEVRYTFF

SEQ ID NO: 620821 - protein, 24 aa, Mycobacterium
DTLVNCVGIFDFYRRIQDIPAERI

SEQ ID NO: 620822 - protein, 26 aa, Mycobacterium
DTLVRMAQPWSLRYPLVDGQGNFGSP

SEQ ID NO: 620823 - protein, 26 aa, Mycobacterium
DTMRGGKFLNNWRMAELHAQEAPDRV

SEQ ID NO: 620824 - protein, 21 aa, Mycobacterium
DTRTVLGFCLSVIHNGEVRGQ

SEQ ID NO: 620825 - protein, 22 aa, Mycobacterium
DTVFARLCKAMGRPELATDDRF

SEQ ID NO: 620826 - protein, 17 aa, Mycobacterium
DTVHPFFAIAKEINVQF

SEQ ID NO: 620827 - protein, 18 aa, Mycobacterium
DTWIPGWRPRDLSTANFP

SEQ ID NO: 620828 - protein, 19 aa, Mycobacterium
DTYGFPIELTLEMAAEAGL

SEQ ID NO: 620829 - protein, 19 aa, Mycobacterium
DTYGFPIELTLEMASEAGL

SEQ ID NO: 620830 - protein, 26 aa, Mycobacterium
DTYRGRWTYAPGEVFADLAAAVADGA

SEQ ID NO: 620831 - protein, 17 aa, Mycobacterium
DVAGLRADADFMIWTHA

SEQ ID NO: 620832 - protein, 19 aa, Mycobacterium
DVAHCIYAGLTTDTGSFRW

SEQ ID NO: 620833 - protein, 24 aa, Mycobacterium
DVEALCAAAARLQGHSYAALTTPE

SEQ ID NO: 620834 - protein, 26 aa, Mycobacterium
DVEFYKWTQWIFLQIYNAWFDTAANK

SEQ ID NO: 620835 - protein, 23 aa, Mycobacterium
DVFKEKLIRRDISMKAFDAGEPQ

SEQ ID NO: 620836 - protein, 25 aa, Mycobacterium
DVFSRRILGWRVMSTKATPLVTSVL

SEQ ID NO: 620837 - protein, 18 aa, Mycobacterium
DVFVPRHRFLSYKAMNDG

SEQ ID NO: 620838 - protein, 23 aa, Mycobacterium
DVIARFDPVLGLEVHVELSTVTK

SEQ ID NO: 620839 - protein, 21 aa, Mycobacterium
DVKPLECVFFMRDVRSAQYFE

SEQ ID NO: 620840 - protein, 19 aa, Mycobacterium
DVLGFKLRDSMRMPPQVVG

SEQ ID NO: 620841 - protein, 18 aa, Mycobacterium
DVLIFAWGATVPMIAHAA

SEQ ID NO: 620842 - protein, 25 aa, Mycobacterium
DVNVKIDKGEFVFLIGPSGSGKSTF

SEQ ID NO: 620843 - protein, 20 aa, Mycobacterium
DVPGTCYTRTGGFVDGVADF

SEQ ID NO: 620844 - protein, 19 aa, Mycobacterium
DVRPELVSFTFGVPPPDVI

SEQ ID NO: 620845 - protein, 17 aa, Mycobacterium
DVSELLPELTLAQKWDL

SEQ ID NO: 620846 - protein, 17 aa, Mycobacterium
DVSFPLGVLTSVTGVSG

SEQ ID NO: 620847 - protein, 17 aa, Mycobacterium
DVTRAEFEYAITHEGAL

SEQ ID NO: 620848 - protein, 24 aa, Mycobacterium
DVTRCPRNILTFSHGAHHCLGAAA

SEQ ID NO: 620849 - protein, 18 aa, Mycobacterium
DVVQARWTVTGKHAQAGA

SEQ ID NO: 620850 - protein, 31 aa, Mycobacterium
DVWFVGKKGGPGWVEWGGCGMVHPNVLRAAG

SEQ ID NO: 620851 - protein, 23 aa, Mycobacterium
DWAAKGTLLLGVRAVIAESFERI

SEQ ID NO: 620852 - protein, 19 aa, Mycobacterium
DWFRPKAMRALKVRVDELA

SEQ ID NO: 620853 - protein, 25 aa, Mycobacterium
DWVPAHFPKDAWALGRFDGTALYEH

SEQ ID NO: 620854 - protein, 32 aa, Mycobacterium; identical to SEQ ID NO: 95714

SEQ ID NO: 620855 - protein, 28 aa, Mycobacterium
DYAKGFKFSTYATWWIRQAITRGMADQS

SEQ ID NO: 620856 - protein, 18 aa, Mycobacterium
DYAPVVMVNWEFFDNQTP

SEQ ID NO: 620857 - protein, 27 aa, Mycobacterium
DYDMSMARLLYWGCDVWLNNPLRPLEA

SEQ ID NO: 620858 - protein, 17 aa, Mycobacterium
DYLLPRQRDRAALTEDE

SEQ ID NO: 620859 - protein, 19 aa, Mycobacterium
EAAAKMLAGKPFKKEAAIA

SEQ ID NO: 620860 - protein, 23 aa, Mycobacterium
EAAKGVAMPLRLTSPAPCTNCHG

SEQ ID NO: 620861 - protein, 19 aa, Mycobacterium
EACRDELIEVVRLLEQGGL

SEQ ID NO: 620862 - protein, 18 aa, Mycobacterium
EADFPMPDPIALGHEAIG

SEQ ID NO: 620863 - protein, 19 aa, Mycobacterium
EADGADVVQFFLGNPQSWK

SEQ ID NO: 620864 - protein, 21 aa, Mycobacterium
EADGRRPRILVAKMGQDGHDR

SEQ ID NO: 620865 - protein, 17 aa, Mycobacterium
EAEGAKADARRKVRDGG

SEQ ID NO: 620866 - protein, 18 aa, Mycobacterium
EAFADFLSGFHIVDEHFR

SEQ ID NO: 620867 - protein, 19 aa, Mycobacterium
EAGARWILDLGPGDILTRL

SEQ ID NO: 620868 - protein, 22 aa, Mycobacterium
EAGDGPPLLLLHGSGPGVTGWR

SEQ ID NO: 620869 - protein, 35 aa, Mycobacterium
EAGVSSPVGFRWFRHAGGVNPCLPETVSGRYLSSD

SEQ ID NO: 620870 - protein, 25 aa, Mycobacterium
EAIDAEIPLLVVITEGIPVQDSAYA

SEQ ID NO: 620871 - protein, 22 aa, Mycobacterium
EAIKELFSMSATRYYQVLNALV

SEQ ID NO: 620872 - protein, 24 aa, Mycobacterium
EAIRASGLSAGIIDAGLSRGLAGV

SEQ ID NO: 620873 - protein, 27 aa, Mycobacterium
EAIRGLSKVAALEWGRDNIRVNVICPF

SEQ ID NO: 620874 - protein, 20 aa, Mycobacterium
EAIVDRIDYIVSLGETVMSP

SEQ ID NO: 620875 - protein, 19 aa, Mycobacterium
EAKSALDALVSRWHAESSW

SEQ ID NO: 620876 - protein, 24 aa, Mycobacterium
EALADGVVRPVVFLAYSGQARWRD

SEQ ID NO: 620877 - protein, 25 aa, Mycobacterium
EALARSRRALAEFNVEGLATVIPFH

SEQ ID NO: 620878 - protein, 19 aa, Mycobacterium
EALELTWRSLGEIGNLSSA

SEQ ID NO: 620879 - protein, 18 aa, Mycobacterium
EALIRLDLAEMLREEGYE

SEQ ID NO: 620880 - protein, 21 aa, Mycobacterium
EALPLRAIDMTVRRNAFGRQV

SEQ ID NO: 620881 - protein, 24 aa, Mycobacterium
EALPSRPVQVIGFTSVPGAGDNFL

SEQ ID NO: 620882 - protein, 24 aa, Mycobacterium
EALPSRPVQVIGFTSVPGAGDNLL

SEQ ID NO: 620883 - protein, 19 aa, Mycobacterium
EALQLPLWGGLGEEDRLRA

SEQ ID NO: 620884 - protein, 21 aa, Mycobacterium
EALRRRTLVTAAQYLALGIDP

SEQ ID NO: 620885 - protein, 19 aa, Mycobacterium
EALTAPAPHHTRPVRFVWV

SEQ ID NO: 620886 - protein, 28 aa, Mycobacterium
EAMAREVRRGGLPLQRLVNGESMAAVAR

SEQ ID NO: 620887 - protein, 26 aa, Mycobacterium
EANIAPWLRAAHRYGAKVKWAEVDIE

SEQ ID NO: 620888 - protein, 26 aa, Mycobacterium
EARAAGLKAANTWHASRAIQEAREAC

SEQ ID NO: 620889 - protein, 19 aa, Mycobacterium
EARAALADTVVRRGDTPLP

SEQ ID NO: 620890 - protein, 22 aa, Mycobacterium
EAREFGVHAGMPLRAAARRCPD

SEQ ID NO: 620891 - protein, 22 aa, Mycobacterium
EARTRIRPHFFPFTEPSAEVDV

SEQ ID NO: 620892 - protein, 23 aa, Mycobacterium
EARYGLETMCIGGGQGLAAVFER

SEQ ID NO: 620893 - protein, 18 aa, Mycobacterium
EASAIKWYCSQAATDVAM

SEQ ID NO: 620894 - protein, 21 aa, Mycobacterium
EASYFGPSFMINWLHNSYGGY

SEQ ID NO: 620895 - protein, 25 aa, Mycobacterium
EAVGACARGLMSREDVDIIERAICP

SEQ ID NO: 620896 - protein, 24 aa, Mycobacterium
EAYADMPLFLFHLLEYMDVEYELD

SEQ ID NO: 620897 - protein, 26 aa, Mycobacterium
EAYANRFGYNVVRDFTGHGIGTTFHN

SEQ ID NO: 620898 - protein, 24 aa, Mycobacterium
ECVGEFRDGVWLIELGDLSNGELL

SEQ ID NO: 620899 - protein, 24 aa, Mycobacterium
EDAIKELFSMSATRYYQVLNALVD

SEQ ID NO: 620900 - protein, 21 aa, Mycobacterium
EDCHFCSQSGLFSSPVRSAWL

SEQ ID NO: 620901 - protein, 19 aa, Mycobacterium
EDGEKRIPLDVSEGDTVIY

SEQ ID NO: 620902 - protein, 18 aa, Mycobacterium
EDHLDWHGTMAAYTEAKA

SEQ ID NO: 620903 - protein, 19 aa, Mycobacterium
EDLINRWTWIPFGAGKHRC

SEQ ID NO: 620904 - protein, 18 aa, Mycobacterium
EDLINRWTWIPFGAGRHR

SEQ ID NO: 620905 - protein, 22 aa, Mycobacterium
EDSRGRTSIVITELPYQVNHDN

SEQ ID NO: 620906 - protein, 17 aa, Mycobacterium
EDSRLLTRELFYTAVTR

SEQ ID NO: 620907 - protein, 19 aa, Mycobacterium
EDYRTFWTQFGKVVKEGLL

SEQ ID NO: 620908 - protein, 23 aa, Mycobacterium
EEAITLAADWIWERSREEDLAPL

SEQ ID NO: 620909 - protein, 30 aa, Mycobacterium
EEALKRLGIGGGFFSFGIMHYYLTGMHTPG

SEQ ID NO: 620910 - protein, 25 aa, Mycobacterium
EEGWDQRAPLGWNMKDPTPVAKTVC

SEQ ID NO: 620911 - protein, 17 aa, Mycobacterium
EEKFVREARLCRKYGAA

SEQ ID NO: 620912 - protein, 21 aa, Mycobacterium
EELKPGPATRLVFDLDPGEGV

SEQ ID NO: 620913 - protein, 19 aa, Mycobacterium
EELVFRVNYLGGDMPTFTL

SEQ ID NO: 620914 - protein, 34 aa, Mycobacterium; identical to SEQ ID NO: 95900

SEQ ID NO: 620915 - protein, 20 aa, Mycobacterium
EEPQRIELCLGAEVTARLVD

SEQ ID NO: 620916 - protein, 30 aa, Mycobacterium
EERRTTLNLKACIKAAADRVVFINTGFLDR

SEQ ID NO: 620917 - protein, 20 aa, Mycobacterium
EERYRLCSTVHTKIAVVKSI

SEQ ID NO: 620918 - protein, 18 aa, Mycobacterium
EESVFRIDHYLGKETVQN

SEQ ID NO: 620919 - protein, 24 aa, Mycobacterium
EEVVLRLRALLRRTGVTTVDSGAQ

SEQ ID NO: 620920 - protein, 24 aa, Mycobacterium
EFDGRIITVPFSFKEIDDDGLISY

SEQ ID NO: 620921 - protein, 17 aa, Mycobacterium
EFERFLAQQAEKKFDDD

SEQ ID NO: 620922 - protein, 18 aa, Mycobacterium
EFSRACEALYHFAWDEFC

SEQ ID NO: 620923 - protein, 19 aa, Mycobacterium
EFTHMITALFLDGVKAPTQ

SEQ ID NO: 620924 - protein, 24 aa, Mycobacterium
EFTRTGFTGGLNWYRNFDRNWETT

SEQ ID NO: 620925 - protein, 19 aa, Mycobacterium
EGAGMKVAFARLAQQISGF

SEQ ID NO: 620926 - protein, 18 aa, Mycobacterium
EGALYLRMDDFPARLVIV

SEQ ID NO: 620927 - protein, 21 aa, Mycobacterium
EGAMTPGALAIRERVRPPSMT

SEQ ID NO: 620928 - protein, 19 aa, Mycobacterium
EGDLAKLRASIVNTQALAD

SEQ ID NO: 620929 - protein, 21 aa, Mycobacterium
EGEDFFIRSVRNFQSSIDDPQ

SEQ ID NO: 620930 - protein, 18 aa, Mycobacterium
EGGSSWGNQMRSYVLHPY

SEQ ID NO: 620931 - protein, 23 aa, Mycobacterium
EGGYGFDPERLWATVYLDDDEAI

SEQ ID NO: 620932 - protein, 20 aa, Mycobacterium
EGIEILKNMMENFPVGDPWT

SEQ ID NO: 620933 - protein, 24 aa, Mycobacterium
EGIGRPRVEPSFLPGVVDRMVAVP

SEQ ID NO: 620934 - protein, 23 aa, Mycobacterium
EGIIAAAAIRCMGGAIQAQLAPK

SEQ ID NO: 620935 - protein, 18 aa, Mycobacterium
EGMLRCGLQAAAQRLPFL

SEQ ID NO: 620936 - protein, 29 aa, Mycobacterium
EGRCATCQGEGFVAVELLFLPGTYATCPA

SEQ ID NO: 620937 - protein, 18 aa, Mycobacterium
EGVDVPRLSVGVYATSAS

SEQ ID NO: 620938 - protein, 26 aa, Mycobacterium
EGVRLLRPGGVIVVHRAALGGRAGDP

SEQ ID NO: 620939 - protein, 24 aa, Mycobacterium
EGWDQRAPIGWNMKDPTPVAKTVC

SEQ ID NO: 620940 - protein, 22 aa, Mycobacterium
EHEVDCIVFATGFDVCKRGTPF

SEQ ID NO: 620941 - protein, 20 aa, Mycobacterium
EHIADTFIAMGWELAEGPEV

SEQ ID NO: 620942 - protein, 17 aa, Mycobacterium
EHILLRTVRCVSGTVEL

SEQ ID NO: 620943 - protein, 21 aa, Mycobacterium
EHLAALRAIPKLSVVRPADAN

SEQ ID NO: 620944 - protein, 23 aa, Mycobacterium
EHPEIFKQYFGTVIPAGDNKFSA

SEQ ID NO: 620945 - protein, 19 aa, Mycobacterium
EHRVGSIAMYRQLRDDPNQ

SEQ ID NO: 620946 - protein, 19 aa, Mycobacterium
EIADALLAALERRHEVADA

SEQ ID NO: 620947 - protein, 24 aa, Mycobacterium
EIADRAGVSKPVLYQHFSSKLELY

SEQ ID NO: 620948 - protein, 18 aa, Mycobacterium
EIAELITMLVRFRTQAVA

SEQ ID NO: 620949 - protein, 18 aa, Mycobacterium
EIAILGRHAHGFDPRDLS

SEQ ID NO: 620950 - protein, 27 aa, Mycobacterium
EIAIRAFRAAYEMGIATVAVYPYEDRN

SEQ ID NO: 620951 - protein, 25 aa, Mycobacterium
EIASHNKLLGSFELTGIPPAPRGVP

SEQ ID NO: 620952 - protein, 30 aa, Mycobacterium; identical to SEQ ID NO: 87769

SEQ ID NO: 620953 - protein, 25 aa, Mycobacterium
EIDKVFVVACGTAYHSGLLAKYAIE

SEQ ID NO: 620954 - protein, 18 aa, Mycobacterium
EIEPRTGRHLGNFPQAFT

SEQ ID NO: 620955 - protein, 23 aa, Mycobacterium
EIFWQVVDAQGWTPQHLHTAIDE

SEQ ID NO: 620956 - protein, 20 aa, Mycobacterium
EIGACKILASQVLKSIGLRA

SEQ ID NO: 620957 - protein, 24 aa, Mycobacterium
EIGPSIGCPLLLKEVGHGIGAAAV

SEQ ID NO: 620958 - protein, 26 aa, Mycobacterium
EIGRPSRLKGAGFYEYVDGKRVGLWP

SEQ ID NO: 620959 - protein, 19 aa, Mycobacterium
EIKPYKWESTRGVGNSFGN

SEQ ID NO: 620960 - protein, 18 aa, Mycobacterium
EILGRLAMEKMLAGLSTR

SEQ ID NO: 620961 - protein, 18 aa, Mycobacterium
EINSVRMFSGAGSEPMLA

SEQ ID NO: 620962 - protein, 18 aa, Mycobacterium
EINVMGAMQLFAACQKAP

SEQ ID NO: 620963 - protein, 20 aa, Mycobacterium
EIPERVNVIRVMMMELNRIS

SEQ ID NO: 620964 - protein, 23 aa, Mycobacterium
EIPTNWPGPTLVYRLLTRKPHSG

SEQ ID NO: 620965 - protein, 20 aa, Mycobacterium
EIPVGFSHGLILSEGKVVAS

SEQ ID NO: 620966 - protein, 32 aa, Mycobacterium
EIRKARKSIAQFKLREGMPIGARVTLRGDRMW

SEQ ID NO: 620967 - protein, 32 aa, Mycobacterium; identical to SEQ ID NO: 79290

SEQ ID NO: 620968 - protein, 18 aa, Mycobacterium
EKAAELLVSTNRKLDKAA

SEQ ID NO: 620969 - protein, 25 aa, Mycobacterium
EKATPELVAFMVRYTSGYLCVPLAG

SEQ ID NO: 620970 - protein, 21 aa, Mycobacterium
EKAYAAGPCSGHLTDIEHIVL

SEQ ID NO: 620971 - protein, 18 aa, Mycobacterium
EKFREVLETEYLKRPLID

SEQ ID NO: 620972 - protein, 18 aa, Mycobacterium
EKGPRLGVLGVVVEIDGR

SEQ ID NO: 620973 - protein, 29 aa, Mycobacterium
EKHDLAFGTSRWSSKLVHGGLRYLASGNV

SEQ ID NO: 620974 - protein, 18 aa, Mycobacterium
EKLFPLIRRYALAYHVVF

SEQ ID NO: 620975 - protein, 22 aa, Mycobacterium
EKRLKRKQWDQFVFSTPPAGSG

SEQ ID NO: 620976 - protein, 36 aa, Mycobacterium; identical to SEQ ID NO: 87794

SEQ ID NO: 620977 - protein, 24 aa, Mycobacterium
EKVLRRAGLTLADIDLFEVNEAFA

SEQ ID NO: 620978 - protein, 17 aa, Mycobacterium
EKVQAAGHQVIWQCDPM

SEQ ID NO: 620979 - protein, 21 aa, Mycobacterium
EKYRIVAAPVQFDETPPAPAR

SEQ ID NO: 620980 - protein, 23 aa, Mycobacterium
ELAAQISGWGKLTLKEIDNTIDD

SEQ ID NO: 620981 - protein, 20 aa, Mycobacterium
ELAARTPLGVALSGEDHAWS

SEQ ID NO: 620982 - protein, 19 aa, Mycobacterium
ELAVKTGRPLIGINDGAGA

SEQ ID NO: 620983 - protein, 21 aa, Mycobacterium
ELCDEFDALLIFDEVQTGCGI

SEQ ID NO: 620984 - protein, 19 aa, Mycobacterium
ELDAYVVRRLNLPFRDVDW

SEQ ID NO: 620985 - protein, 19 aa, Mycobacterium
ELDERVKVVAFSHHSNVTG

SEQ ID NO: 620986 - protein, 17 aa, Mycobacterium
ELEASIMDRLWNRDPDA

SEQ ID NO: 620987 - protein, 20 aa, Mycobacterium
ELEPVFLAEAGFSLHDVLAN

SEQ ID NO: 620988 - protein, 23 aa, Mycobacterium
ELFCARDPFGIKPLFMATGPGGT

SEQ ID NO: 620989 - protein, 22 aa, Mycobacterium
ELGEAAESFASVTSGLAGAGQA

SEQ ID NO: 620990 - protein, 18 aa, Mycobacterium
ELGEVVWIVDLNRQSLDR

SEQ ID NO: 620991 - protein, 21 aa, Mycobacterium
ELGIGVGWCREEFALMGERFE

SEQ ID NO: 620992 - protein, 25 aa, Mycobacterium
ELGKGMLLAIHLGRIKDAEGVRPEQ

SEQ ID NO: 620993 - protein, 26 aa, Mycobacterium
ELKLDRKISERRVFPAVDVNPSGTRK

SEQ ID NO: 620994 - protein, 20 aa, Mycobacterium
ELLAIVSAMVCNRIDKVTVN

SEQ ID NO: 620995 - protein, 19 aa, Mycobacterium
ELLPELTLAQKWDLTVNEL

SEQ ID NO: 620996 - protein, 26 aa, Mycobacterium
ELNEFSLRVLHSFLADPGRPPRSGAD

SEQ ID NO: 620997 - protein, 19 aa, Mycobacterium
ELPPGGRLGLYGFGGSAHI

SEQ ID NO: 620998 - protein, 31 aa, Mycobacterium
ELQRLRLATQLRAGLFGVLYVLDEPSAGLHP

SEQ ID NO: 620999 - protein, 26 aa, Mycobacterium
ELRAFCARLLGIAAQRVRVIMRDTGG

SEQ ID NO: 621000 - protein, 17 aa, Mycobacterium
ELREARRRIKLLELENE

SEQ ID NO: 621001 - protein, 17 aa, Mycobacterium
ELRNRLKTLTGVTLSAT

SEQ ID NO: 621002 - protein, 24 aa, Mycobacterium
ELSRAVFSKGIFPAVDPLASSSTI

SEQ ID NO: 621003 - protein, 24 aa, Mycobacterium
ELSRSVFSKGIFPAVDPLASSSTI

SEQ ID NO: 621004 - protein, 18 aa, Mycobacterium
ELTALALQRIYLDRVAKL

SEQ ID NO: 621005 - protein, 24 aa, Mycobacterium
ELTEAIKLVALVADRGAQVRMEFS

SEQ ID NO: 621006 - protein, 17 aa, Mycobacterium
ELTVPGVAQTVTLTRVA

SEQ ID NO: 621007 - protein, 21 aa, Mycobacterium
ELVEVIQPVLFAVMIALAETL

SEQ ID NO: 621008 - protein, 18 aa, Mycobacterium
ELWFGAHPGDPAWLETDN

SEQ ID NO: 621009 - protein, 29 aa, Mycobacterium
ELWQQPGRGPGRFWGVYGLKKAIAVVEIA

SEQ ID NO: 621010 - protein, 27 aa, Mycobacterium
ELYGKGHGYMACLPRGRVRAVRHDLSA

SEQ ID NO: 621011 - protein, 18 aa, Mycobacterium
EMAAMLLGLCDVESKVAA

SEQ ID NO: 621012 - protein, 19 aa, Mycobacterium
EMLARADSVGVFQVESRAQ

SEQ ID NO: 621013 - protein, 23 aa, Mycobacterium
EMLTMGFAEEVDRILSETPEYKQ

SEQ ID NO: 621014 - protein, 23 aa, Mycobacterium
EMRDLPGQFGLVAANGGIMSKYS

SEQ ID NO: 621015 - protein, 20 aa, Mycobacterium
EMRYRAVLEVLDGAPVTAVA

SEQ ID NO: 621016 - protein, 24 aa, Mycobacterium
EMVEGRGPCYLDLRHVPQADLEVL

SEQ ID NO: 621017 - protein, 19 aa, Mycobacterium
EMVRRCRRDPTDVGLVTGL

SEQ ID NO: 621018 - protein, 20 aa, Mycobacterium
EMYDCNFLNSVVPRDQLEAE

SEQ ID NO: 621019 - protein, 17 aa, Mycobacterium
ENFRPGTLEKWDLGYDV

SEQ ID NO: 621020 - protein, 17 aa, Mycobacterium
ENFRPGTLEKWNLGYDV

SEQ ID NO: 621021 - protein, 24 aa, Mycobacterium
ENFRPGTLERWGLGWEELHAANPR

SEQ ID NO: 621022 - protein, 18 aa, Mycobacterium
ENLRRLAHVAALLADCGN

SEQ ID NO: 621023 - protein, 24 aa, Mycobacterium
ENRLPPVHVFAGINLSFGAMGPLL

SEQ ID NO: 621024 - protein, 20 aa, Mycobacterium
ENRSRFVIEPLEPGFGYTLG

SEQ ID NO: 621025 - protein, 28 aa, Mycobacterium
ENSELAALRRPGSFLARQVPQFLKLLES

SEQ ID NO: 621026 - protein, 21 aa, Mycobacterium
EPCSALDPISTMAIEELISEL

SEQ ID NO: 621027 - protein, 19 aa, Mycobacterium
EPELAFAEHRSCAKAQALV

SEQ ID NO: 621028 - protein, 20 aa, Mycobacterium
EPGHGLRIGYFAQEHDTLDN

SEQ ID NO: 621029 - protein, 21 aa, Mycobacterium
EPGLQEKPLSIALREIHGDLL

SEQ ID NO: 621030 - protein, 18 aa, Mycobacterium
EPGMTLLDIGCGWGATMR

SEQ ID NO: 621031 - protein, 19 aa, Mycobacterium
EPGRRLSLIDLLDPNEHER

SEQ ID NO: 621032 - protein, 18 aa, Mycobacterium
EPIAIVAVSCRFPGAPDP

SEQ ID NO: 621033 - protein, 25 aa, Mycobacterium
EPLRLLFKDEVRAVGRELGLPEEIV

SEQ ID NO: 621034 - protein, 22 aa, Mycobacterium
EPRLLKIGEWMGRYNINRSIKD

SEQ ID NO: 621035 - protein, 18 aa, Mycobacterium
EPRYGEGVYALRNIDEGF

SEQ ID NO: 621036 - protein, 20 aa, Mycobacterium
EPTFRRSVIYIVEHNDGGTL

SEQ ID NO: 621037 - protein, 20 aa, Mycobacterium
EPTPRRLTIVVSNDNGGGIF

SEQ ID NO: 621038 - protein, 24 aa, Mycobacterium
EPTVLPSRFPNLLANGSGGIAVGM

SEQ ID NO: 621039 - protein, 22 aa, Mycobacterium
EPVDISNAVLFLASDESRYITG

SEQ ID NO: 621040 - protein, 18 aa, Mycobacterium
EPVEWKRDQALKFGATHV

SEQ ID NO: 621041 - protein, 25 aa, Mycobacterium
EPVLKLLKITGDWQKFKGLPGAEGR

SEQ ID NO: 621042 - protein, 24 aa, Mycobacterium
EPVPELAQAFGISRATAYRYLAKL

SEQ ID NO: 621043 - protein, 20 aa, Mycobacterium
EPYIPLRAVRHLEKGRVVIF

SEQ ID NO: 621044 - protein, 27 aa, Mycobacterium
EQALRDAWFWAHEVMAVGMVWNTAATS

SEQ ID NO: 621045 - protein, 20 aa, Mycobacterium
EQANINWGKAGRMRWKGKRP

SEQ ID NO: 621046 - protein, 18 aa, Mycobacterium
EQFHQRFVQILDAARTAY

SEQ ID NO: 621047 - protein, 19 aa, Mycobacterium
EQIMPGFLAFHPMGALVGQ

SEQ ID NO: 621048 - protein, 21 aa, Mycobacterium
EQKRTRVGTGIFLQYESEYVK

SEQ ID NO: 621049 - protein, 22 aa, Mycobacterium
EQLKRVSLELGGKSAAIILDDA

SEQ ID NO: 621050 - protein, 24 aa, Mycobacterium
EQQKLKVLVSIFGRETPVELTFNQ

SEQ ID NO: 621051 - protein, 28 aa, Mycobacterium
EQVKIRGYRIECGEVAAALAALDGVDQA

SEQ ID NO: 621052 - protein, 22 aa, Mycobacterium
EQVKIRGYRIECGEVAAALTAL

SEQ ID NO: 621053 - protein, 29 aa, Mycobacterium
EQVKIRGYRIECGEVTAALTALDGVDQAV

SEQ ID NO: 621054 - protein, 18 aa, Mycobacterium
ERAPAPALHRLTVGALRA

SEQ ID NO: 621055 - protein, 18 aa, Mycobacterium
ERAYQIFGNNEFGLPPGD

SEQ ID NO: 621056 - protein, 17 aa, Mycobacterium
ERDNCPQRAFPALGRAL

SEQ ID NO: 621057 - protein, 31 aa, Mycobacterium
EREGVNLTFLPFIARAVIDALKIHPNINASY

SEQ ID NO: 621058 - protein, 20 aa, Mycobacterium
ERGRRWPVIISGTITDASGR

SEQ ID NO: 621059 - protein, 19 aa, Mycobacterium
ERILYYTGISYKIGEVHDG

SEQ ID NO: 621060 - protein, 19 aa, Mycobacterium
ERISNALVAMAIESLGAQA

SEQ ID NO: 621061 - protein, 18 aa, Mycobacterium
ERLIVAVGAVAAMELALE

SEQ ID NO: 621062 - protein, 17 aa, Mycobacterium
ERLMRDAPFLLIGEGTS

SEQ ID NO: 621063 - protein, 23 aa, Mycobacterium
ERLRDWRFYDGFRVDAGAPARHP

SEQ ID NO: 621064 - protein, 23 aa, Mycobacterium
ERLSRLGGIVGTAFQISDDIIDI

SEQ ID NO: 621065 - protein, 27 aa, Mycobacterium
ERPETAADEIVRWATPVTSFQRTALED

SEQ ID NO: 621066 - protein, 19 aa, Mycobacterium
ERPIPGWLQVVGERQRILV

SEQ ID NO: 621067 - protein, 17 aa, Mycobacterium
ERPTMAALLVKDSVNAA

SEQ ID NO: 621068 - protein, 23 aa, Mycobacterium
ERRFARHYVHAGMIGWDGHKMSK

SEQ ID NO: 621069 - protein, 26 aa, Mycobacterium
ERRYRTWIRWNAAIMVHRAQRPGVGV

SEQ ID NO: 621070 - protein, 19 aa, Mycobacterium
ERSGFRFGGSGRSMAETPL

SEQ ID NO: 621071 - protein, 22 aa, Mycobacterium
ERTKRIRLGTGVISLAYHNPLW

SEQ ID NO: 621072 - protein, 17 aa, Mycobacterium
ERTQIRALGLLKGACAQ

SEQ ID NO: 621073 - protein, 26 aa, Mycobacterium
ESAEHGRSWSRWSFIGAGAPSALTVR

SEQ ID NO: 621074 - protein, 26 aa, Mycobacterium
ESAENGRSWSRWSFIGAGAPSALTVR

SEQ ID NO: 621075 - protein, 26 aa, Mycobacterium
ESAENGRSWSRWSFIGAGAPTALTVR

SEQ ID NO: 621076 - protein, 17 aa, Mycobacterium
ESAETQTAMGFSQDPDT

SEQ ID NO: 621077 - protein, 24 aa, Mycobacterium
ESAFQCPYHGWTYRNNGDLIAIPA

SEQ ID NO: 621078 - protein, 19 aa, Mycobacterium
ESEPMIIGKAFAVKVNANI

SEQ ID NO: 621079 - protein, 27 aa, Mycobacterium
ESFEFWREFLASLKARGLSGVHLVISD

SEQ ID NO: 621080 - protein, 27 aa, Mycobacterium
ESFEFWREFLASLKARGLTGVHLVISD

SEQ ID NO: 621081 - protein, 25 aa, Mycobacterium
ESGKMTGRPRLEVVDPSAAAQLAET

SEQ ID NO: 621082 - protein, 27 aa, Mycobacterium
ESGLRGGILIPARWVGYPPYHDRRYDK

SEQ ID NO: 621083 - protein, 17 aa, Mycobacterium
ESGWTFDHFYPIFSDPT

SEQ ID NO: 621084 - protein, 19 aa, Mycobacterium
ESLPRNALGKVLKKQLLSE

SEQ ID NO: 621085 - protein, 19 aa, Mycobacterium
ESLSREFRGLLDRVPPADT

SEQ ID NO: 621086 - protein, 25 aa, Mycobacterium
ESMPVPILTLRQWRPLDAARMEVWS

SEQ ID NO: 621087 - protein, 24 aa, Mycobacterium
ESNAPVLLGLIGLWYSNFMGAQSR

SEQ ID NO: 621088 - protein, 17 aa, Mycobacterium
ESPMGKHVKAMAAIDEF

SEQ ID NO: 621089 - protein, 20 aa, Mycobacterium
ESQRGNVIPVEITVYEDRSF

SEQ ID NO: 621090 - protein, 20 aa, Mycobacterium
ESSVAFQAAHARFVEVAAKV

SEQ ID NO: 621091 - protein, 23 aa, Mycobacterium
ESTAGSLQAQWRGAAGTAAQAAV

SEQ ID NO: 621092 - protein, 24 aa, Mycobacterium
ESTVGDAFARMFGGSIVPQEVEAL

SEQ ID NO: 621093 - protein, 17 aa, Mycobacterium
ESVDLIKSGGFRIGAGE

SEQ ID NO: 621094 - protein, 17 aa, Mycobacterium
ESVKYAKERQSFGQPIG

SEQ ID NO: 621095 - protein, 17 aa, Mycobacterium
ESVTEGTVTRWLKQEGD

SEQ ID NO: 621096 - protein, 20 aa, Mycobacterium
ESYAPLMAYLVRSMQSGGEL

SEQ ID NO: 621097 - protein, 19 aa, Mycobacterium
ETAELLYGTALLAEGGALD

SEQ ID NO: 621098 - protein, 23 aa, Mycobacterium
ETAWKLAKQYFKLTGKPGKHKVI

SEQ ID NO: 621099 - protein, 17 aa, Mycobacterium
ETAYAWRTILARGNGSG

SEQ ID NO: 621100 - protein, 18 aa, Mycobacterium
ETAYCLGVEKLLGITDQI

SEQ ID NO: 621101 - protein, 20 aa, Mycobacterium
ETIKSALLTAYRHTEGHQND

SEQ ID NO: 621102 - protein, 17 aa, Mycobacterium
ETLLRAWQHPEVVGDTE

SEQ ID NO: 621103 - protein, 23 aa, Mycobacterium
ETLNLANLPGYRVGGTIHIIVNN

SEQ ID NO: 621104 - protein, 20 aa, Mycobacterium
ETLTTLVIRGEGGFGGVPGQ

SEQ ID NO: 621105 - protein, 26 aa, Mycobacterium
ETLVALGAEVRWASCNIFSTQDHAAA

SEQ ID NO: 621106 - protein, 20 aa, Mycobacterium
ETRARTTAVAGYDLTFSPVK

SEQ ID NO: 621107 - protein, 17 aa, Mycobacterium
ETRIELFTQSTDTRPEE

SEQ ID NO: 621108 - protein, 23 aa, Mycobacterium
ETSKRYMHHYNFPPFSTGETGRV

SEQ ID NO: 621109 - protein, 23 aa, Mycobacterium
ETTKRYMHHYNFPPFSTGETGRV

SEQ ID NO: 621110 - protein, 17 aa, Mycobacterium
ETYGALFDRLKDGKISQ

SEQ ID NO: 621111 - protein, 32 aa, Mycobacterium
EVACIPSLYEGFSLPAVEAMASGTPIVASRAG

SEQ ID NO: 621112 - protein, 19 aa, Mycobacterium
EVACPFHDWRWGGDGRCKL

SEQ ID NO: 621113 - protein, 19 aa, Mycobacterium
EVADTYFALMDRLGTDGLL

SEQ ID NO: 621114 - protein, 28 aa, Mycobacterium
EVAEVWRRGSVIGSWLLDLTAIALHESP

SEQ ID NO: 621115 - protein, 32 aa, Mycobacterium
EVALYRLLESWGMRPGLVMGHSVGELSAAHVS

SEQ ID NO: 621116 - protein, 25 aa, Mycobacterium
EVEGGKIRVAEGWAHGPEIDKGARW

SEQ ID NO: 621117 - protein, 18 aa, Mycobacterium
EVEINIACSLGMLTAEQV

SEQ ID NO: 621118 - protein, 18 aa, Mycobacterium
EVFPFVFTAARLTEHHTA

SEQ ID NO: 621119 - protein, 24 aa, Mycobacterium
EVIEKMRVAGRIAAGALAEAGKAV

SEQ ID NO: 621120 - protein, 17 aa, Mycobacterium
EVITSMPGIGFRLGAEF

SEQ ID NO: 621121 - protein, 20 aa, Mycobacterium
EVKLYPEGHFAIYVDDAFER

SEQ ID NO: 621122 - protein, 27 aa, Mycobacterium
EVLGAGIPLFGICFGNQILGRALGLST

SEQ ID NO: 621123 - protein, 23 aa, Mycobacterium
EVLPNYSGGLGILAGDHLKAASD

SEQ ID NO: 621124 - protein, 23 aa, Mycobacterium
EVLPNYSGGLGILAGDHLKSASD

SEQ ID NO: 621125 - protein, 22 aa, Mycobacterium
EVLRILRRRSLAALRAQVEPVS

SEQ ID NO: 621126 - protein, 23 aa, Mycobacterium
EVLRRELRRPSWRRETVALGTNT

SEQ ID NO: 621127 - protein, 22 aa, Mycobacterium
EVMPEDLIKFGLIPEFIGRLPV

SEQ ID NO: 621128 - protein, 22 aa, Mycobacterium
EVPNYRPFWAITKHADIMDIER

SEQ ID NO: 621129 - protein, 26 aa, Mycobacterium
EVQIPKLRAGSFFPSLLERRRRIDKA

SEQ ID NO: 621130 - protein, 17 aa, Mycobacterium
EVRAVPAAAQASILVLP

SEQ ID NO: 621131 - protein, 19 aa, Mycobacterium
EVRHECLEYALAHDERFGI

SEQ ID NO: 621132 - protein, 35 aa, Mycobacterium
EVRMGMRVEAVWKPREEWGFGIDNIEYFRPTGEPD

SEQ ID NO: 621133 - protein, 17 aa, Mycobacterium
EVRRYFRDYSWGMRVPR

SEQ ID NO: 621134 - protein, 22 aa, Mycobacterium
EVSALTAAQFAAHAQMYQAVSA

SEQ ID NO: 621135 - protein, 25 aa, Mycobacterium
EVSPVLWKKVAPKLSAGRVQSVATR

SEQ ID NO: 621136 - protein, 17 aa, Mycobacterium
EVTRKLDKMGWRSSDTA

SEQ ID NO: 621137 - protein, 23 aa, Mycobacterium
EVVDRWAPGRVMINAYGPTEATV

SEQ ID NO: 621138 - protein, 19 aa, Mycobacterium
EVVDSVAWLTINRPEARNA

SEQ ID NO: 621139 - protein, 18 aa, Mycobacterium
EVVRRLRAAGAVIVGKTN

SEQ ID NO: 621140 - protein, 19 aa, Mycobacterium
EVYDYLRLLYARAGTPHCP

SEQ ID NO: 621141 - protein, 35 aa, Mycobacterium; identical to SEQ ID NO: 198923

SEQ ID NO: 621142 - protein, 24 aa, Mycobacterium
EWMLDIRLKALRTFDKKPMPNWGS

SEQ ID NO: 621143 - protein, 21 aa, Mycobacterium
EYDVAEGWVRVEVPTAKDRRG

SEQ ID NO: 621144 - protein, 17 aa, Mycobacterium
EYGGLGLDYEYQKAFDA

SEQ ID NO: 621145 - protein, 17 aa, Mycobacterium
EYLDMFYNLGIAGRAMR

SEQ ID NO: 621146 - protein, 19 aa, Mycobacterium
FAAAAGFSQPILHGLCTYG

SEQ ID NO: 621147 - protein, 20 aa, Mycobacterium
FAAGATMWSIAPSWEPHALH

SEQ ID NO: 621148 - protein, 35 aa, Mycobacterium
FAAVRQFRASVCVLGPLVGRCKRAKVALPGGDAIG

SEQ ID NO: 621149 - protein, 32 aa, Mycobacterium; identical to SEQ ID NO: 79584

SEQ ID NO: 621150 - protein, 20 aa, Mycobacterium
FADHLARVGLYPDAPKLPAV

SEQ ID NO: 621151 - protein, 19 aa, Mycobacterium
FAEAQLAGFGTQFGPEHLK

SEQ ID NO: 621152 - protein, 25 aa, Mycobacterium
FAGPVLRPSSTLVRRIREFAETAAE

SEQ ID NO: 621153 - protein, 17 aa, Mycobacterium
FAHPVLLERSRAAELAT

SEQ ID NO: 621154 - protein, 21 aa, Mycobacterium
FAIELGRLGGLAVLNGEGLIG

SEQ ID NO: 621155 - protein, 24 aa, Mycobacterium
FAKLREPLEVPGLLDVQIDSFEWL

SEQ ID NO: 621156 - protein, 19 aa, Mycobacterium
FAPITRWAAGVPTARAIPE

SEQ ID NO: 621157 - protein, 24 aa, Mycobacterium
FAPPTLHAMGIRVATSFPSFSKRT

SEQ ID NO: 621158 - protein, 20 aa, Mycobacterium
FAQSSTVLFLGRHVGYPVAL

SEQ ID NO: 621159 - protein, 17 aa, Mycobacterium
FARHGFTEIEGTPVTAE

SEQ ID NO: 621160 - protein, 29 aa, Mycobacterium
FATAPLVVSGCIMMRVCHLDTCPVGVATQ

SEQ ID NO: 621161 - protein, 22 aa, Mycobacterium
FATDHLRLVGLHSHIGSQIFDV

SEQ ID NO: 621162 - protein, 17 aa, Mycobacterium
FAVELAKADGLRVIADA

SEQ ID NO: 621163 - protein, 21 aa, Mycobacterium
FAVLEPRADGFRNYVRPGEKA

SEQ ID NO: 621164 - protein, 25 aa, Mycobacterium
FAYPLPVAVICRLLGVPLEDEPQFS

SEQ ID NO: 621165 - protein, 27 aa, Mycobacterium
FCAVLAFSRWRFVRFATDERASTTLAL

SEQ ID NO: 621166 - protein, 19 aa, Mycobacterium
FCDLPGVVQHFSIPASAFD

SEQ ID NO: 621167 - protein, 19 aa, Mycobacterium
FCVTRCGYCDFNTYTPAEL

SEQ ID NO: 621168 - protein, 24 aa, Mycobacterium
FDAELRFAMPGVRVADPKACQCGE

SEQ ID NO: 621169 - protein, 18 aa, Mycobacterium
FDAIGITVLEGYGLTETA

SEQ ID NO: 621170 - protein, 20 aa, Mycobacterium
FDAVIAVHLKGHFATMRHAA

SEQ ID NO: 621171 - protein, 18 aa, Mycobacterium
FDDNFVFPPGMVLVLEPV

SEQ ID NO: 621172 - protein, 20 aa, Mycobacterium
FDFRGTDTTIAWKGDEAIEL

SEQ ID NO: 621173 - protein, 19 aa, Mycobacterium
FDFVREIIEQGAIPDDVTI

SEQ ID NO: 621174 - protein, 19 aa, Mycobacterium
FDGDGMLHVVGFRDGKAFY

SEQ ID NO: 621175 - protein, 20 aa, Mycobacterium
FDKPYLLAMANAGPGTNGSQ

SEQ ID NO: 621176 - protein, 24 aa, Mycobacterium
FDNLRRGGIQFADTRGYAYDRRDV

SEQ ID NO: 621177 - protein, 24 aa, Mycobacterium
FDPSRAMPAYNWMTVAKSALESVN

SEQ ID NO: 621178 - protein, 18 aa, Mycobacterium
FDPVLGLEVHVELSTATK

SEQ ID NO: 621179 - protein, 26 aa, Mycobacterium
FDQHRDWLRLMARLSTTMAKQASGLE

SEQ ID NO: 621180 - protein, 28 aa, Mycobacterium
FEAAVPPGRLGWGWAKFAFNSWTTLSWV

SEQ ID NO: 621181 - protein, 21 aa, Mycobacterium
FEAGNTFLLPPTWTQLDSLDG

SEQ ID NO: 621182 - protein, 18 aa, Mycobacterium
FEALSALSAGVKDVRAVI

SEQ ID NO: 621183 - protein, 19 aa, Mycobacterium
FEHPYPFARRMSTLDHLTG

SEQ ID NO: 621184 - protein, 23 aa, Mycobacterium
FEIKEFKSGAARMAVEAGVPIVP

SEQ ID NO: 621185 - protein, 17 aa, Mycobacterium
FELLRARSQLIIITHQK

SEQ ID NO: 621186 - protein, 18 aa, Mycobacterium
FELLRFLMRNPRRALSRT

SEQ ID NO: 621187 - protein, 37 aa, Mycobacterium
FELTWPALPAETFPATGVLPPWALISPHPENLSPDLN

SEQ ID NO: 621188 - protein, 21 aa, Mycobacterium
FEMPPHLRMAMVQSLLVRSLV

SEQ ID NO: 621189 - protein, 20 aa, Mycobacterium
FEPKPDWRNPFSYQPEIWDY

SEQ ID NO: 621190 - protein, 24 aa, Mycobacterium
FEQARKRFDAAWNHQNGDHPINDS

SEQ ID NO: 621191 - protein, 17 aa, Mycobacterium
FESMEALGLVLIDESFR

SEQ ID NO: 621192 - protein, 21 aa, Mycobacterium
FESVAPYARRLLLPQDAPKVD

SEQ ID NO: 621193 - protein, 19 aa, Mycobacterium
FETMASFMLVEHANGALFD

SEQ ID NO: 621194 - protein, 25 aa, Mycobacterium
FETSDRIGGNWAFGNPNGHSSAYRS

SEQ ID NO: 621195 - protein, 18 aa, Mycobacterium
FEVYADGIDLVIFEEFGS

SEQ ID NO: 621196 - protein, 18 aa, Mycobacterium
FFCVVDLHAITLPQDPEA

SEQ ID NO: 621197 - protein, 22 aa, Mycobacterium
FFEGVMMPELFMADAVGATGKP

SEQ ID NO: 621198 - protein, 17 aa, Mycobacterium
FFGRPGVNKGEKSAFPQ

SEQ ID NO: 621199 - protein, 30 aa, Mycobacterium
FFLHIPFPPVELFMQLPWRTEIIQGLLGAD

SEQ ID NO: 621200 - protein, 24 aa, Mycobacterium
FFRHFPTKEAVLFQDYETQLEWLA

SEQ ID NO: 621201 - protein, 18 aa, Mycobacterium
FFRVSREITCAQANLMPA

SEQ ID NO: 621202 - protein, 17 aa, Mycobacterium
FFSITSLAGLRQEDRAV

SEQ ID NO: 621203 - protein, 17 aa, Mycobacterium
FGAILDRGAGHFRLGPY

SEQ ID NO: 621204 - protein, 20 aa, Mycobacterium
FGALKYAAKYYGHFASVSSH

SEQ ID NO: 621205 - protein, 18 aa, Mycobacterium
FGDKGYWLVTKHADVKEV

SEQ ID NO: 621206 - protein, 17 aa, Mycobacterium
FGDRRKAMLQDMAILTG

SEQ ID NO: 621207 - protein, 18 aa, Mycobacterium
FGEAIPAQAIAQVCELTW

SEQ ID NO: 621208 - protein, 19 aa, Mycobacterium
FGEFKGWAKAQGRHSNIGY

SEQ ID NO: 621209 - protein, 25 aa, Mycobacterium
FGEGPRWFEGLLWFSDMLGEAVHTS

SEQ ID NO: 621210 - protein, 24 aa, Mycobacterium
FGFGGGGAHFCLGANLARREIRVV

SEQ ID NO: 621211 - protein, 26 aa, Mycobacterium
FGFSPLRLPPDLDFTALFHGVDERVP

SEQ ID NO: 621212 - protein, 19 aa, Mycobacterium
FGGVVPEIASRAHLEALGP

SEQ ID NO: 621213 - protein, 31 aa, Mycobacterium; identical to SEQ ID NO: 96675

SEQ ID NO: 621214 - protein, 18 aa, Mycobacterium
FGIEYPIFVFTPSEKVAA

SEQ ID NO: 621215 - protein, 23 aa, Mycobacterium
FGIPEVKRGLVAGGGGLLRLPQR

SEQ ID NO: 621216 - protein, 17 aa, Mycobacterium
FGLGCVAGAAGVARLHD

SEQ ID NO: 621217 - protein, 26 aa, Mycobacterium
FGLIPEFIGRLPVVASVTNLDRESLV

SEQ ID NO: 621218 - protein, 18 aa, Mycobacterium
FGLLRAGAVPVMCLPGHR

SEQ ID NO: 621219 - protein, 18 aa, Mycobacterium
FGNIIRLLPPLTIGDELL

SEQ ID NO: 621220 - protein, 25 aa, Mycobacterium
FGPEHQPRIALRADMDALPMAERTG

SEQ ID NO: 621221 - protein, 17 aa, Mycobacterium
FGPGNRAPLSFPMAGWN

SEQ ID NO: 621222 - protein, 17 aa, Mycobacterium
FGPYLSSASNPWGEGIN

SEQ ID NO: 621223 - protein, 25 aa, Mycobacterium
FGQPEIKLGVLPGMGGSQRLTRAIG

SEQ ID NO: 621224 - protein, 26 aa, Mycobacterium
FGRELFVEKVWDWKRESGGAIGGQMR

SEQ ID NO: 621225 - protein, 20 aa, Mycobacterium
FGRIEGRPVGIVANQPTQFA

SEQ ID NO: 621226 - protein, 27 aa, Mycobacterium
FGSSSFRYAGPAGRDWTTADLAGKRIA

SEQ ID NO: 621227 - protein, 17 aa, Mycobacterium
FGSTAAIFPVDEETISY

SEQ ID NO: 621228 - protein, 32 aa, Mycobacterium; identical to SEQ ID NO: 79733

SEQ ID NO: 621229 - protein, 26 aa, Mycobacterium
FGTTQRFGVPMGFGGPHAGYLAVHAN

SEQ ID NO: 621230 - protein, 28 aa, Mycobacterium
FGVPPPDVIRRLGALGLLVMVTVTSAYE

SEQ ID NO: 621231 - protein, 23 aa, Mycobacterium
FGVQWQLVRRLVTIVEFSFAARC

SEQ ID NO: 621232 - protein, 17 aa, Mycobacterium
FGVRFPGPLGLAAGFDK

SEQ ID NO: 621233 - protein, 18 aa, Mycobacterium
FGYACPLGSHARRLNPRD

SEQ ID NO: 621234 - protein, 24 aa, Mycobacterium
FHALRASNKIAIERGTHFKGFEKS

SEQ ID NO: 621235 - protein, 18 aa, Mycobacterium
FHDLKLRAVIGTAEQLAN

SEQ ID NO: 621236 - protein, 25 aa, Mycobacterium
FHLRNRLVVAAMHWDGDVTGLVRSH

SEQ ID NO: 621237 - protein, 17 aa, Mycobacterium
FHNFGYKAGILACLQTG

SEQ ID NO: 621238 - protein, 23 aa, Mycobacterium
FHRMAVDAFASLAADAIEAAQQT

SEQ ID NO: 621239 - protein, 17 aa, Mycobacterium
FHVEGLATVIPFHRAVV

SEQ ID NO: 621240 - protein, 19 aa, Mycobacterium
FIADGAIEVGGRLPINTHG

SEQ ID NO: 621241 - protein, 17 aa, Mycobacterium
FITTPRCTQAMIRGSGV

SEQ ID NO: 621242 - protein, 19 aa, Mycobacterium
FKGDERWRNLPTPSGNTFE

SEQ ID NO: 621243 - protein, 26 aa, Mycobacterium
FKKSDEIYTFMDLWFYHCNPRHHSIA

SEQ ID NO: 621244 - protein, 20 aa, Mycobacterium
FKPLYGTSLVTGWASIHGFP

SEQ ID NO: 621245 - protein, 18 aa, Mycobacterium
FKTYHPFDGDGMLHVVGF

SEQ ID NO: 621246 - protein, 18 aa, Mycobacterium
FLARDAQHLYVFQRTPST

SEQ ID NO: 621247 - protein, 18 aa, Mycobacterium
FLEGCGRTDFPGGDSDEI

SEQ ID NO: 621248 - protein, 18 aa, Mycobacterium
FLEGCGRTDFPGGDSDEM

SEQ ID NO: 621249 - protein, 17 aa, Mycobacterium
FLGNLVLLIVGGNDTTR

SEQ ID NO: 621250 - protein, 19 aa, Mycobacterium
FLIKRTRTIPVDRGAGAGA

SEQ ID NO: 621251 - protein, 18 aa, Mycobacterium
FLIMPKLIPALIAGCTVI

SEQ ID NO: 621252 - protein, 18 aa, Mycobacterium
FLLGRRFDTGSVFINSHT

SEQ ID NO: 621253 - protein, 18 aa, Mycobacterium
FLLQGGDCAETFVDNTEP

SEQ ID NO: 621254 - protein, 18 aa, Mycobacterium
FLQKYGKATPEALVESAL

SEQ ID NO: 621255 - protein, 17 aa, Mycobacterium
FLQRIPEQPVRPISATR

SEQ ID NO: 621256 - protein, 21 aa, Mycobacterium
FLRASDIARAITFVAETPRGG

SEQ ID NO: 621257 - protein, 18 aa, Mycobacterium
FMATRTAFFDEFFLGAAD

SEQ ID NO: 621258 - protein, 17 aa, Mycobacterium
FMHVLPVGWVEPVDISN

SEQ ID NO: 621259 - protein, 19 aa, Mycobacterium
FMKMITPAALLRCLVEGAD

SEQ ID NO: 621260 - protein, 26 aa, Mycobacterium
FNQASGRIKLAWFLLNAARYMPVLVY

SEQ ID NO: 621261 - protein, 17 aa, Mycobacterium
FPDATVVRLERDYRSTP

SEQ ID NO: 621262 - protein, 19 aa, Mycobacterium
FPDRPALELDGWAVARPLS

SEQ ID NO: 621263 - protein, 43 aa, Mycobacterium
FPESHALSFASLVFYSSWFKLHHPAAFCAALLRAQPMGFYSPQ

SEQ ID NO: 621264 - protein, 23 aa, Mycobacterium
FPESYNRRALMRFVTSVKSGSDY

SEQ ID NO: 621265 - protein, 25 aa, Mycobacterium
FPGEISGGMRKRAGLARALVLDPQI

SEQ ID NO: 621266 - protein, 25 aa, Mycobacterium
FPGEISGGMRKRAGLARSLVLDPQI

SEQ ID NO: 621267 - protein, 25 aa, Mycobacterium
FPGEISGGMRKRASLARALVMDPQI

SEQ ID NO: 621268 - protein, 25 aa, Mycobacterium
FPLFAFSHCRDVVAAVTNAGGFGVL

SEQ ID NO: 621269 - protein, 19 aa, Mycobacterium
FPMLSDIKRELSLATGVLN

SEQ ID NO: 621270 - protein, 20 aa, Mycobacterium
FPPAGTLTGIAKRELRGVPT

SEQ ID NO: 621271 - protein, 23 aa, Mycobacterium
FPRCAAGLREGRLSADQVGVIAA

SEQ ID NO: 621272 - protein, 18 aa, Mycobacterium
FPTLIDLYLQGRLPLEQF

SEQ ID NO: 621273 - protein, 21 aa, Mycobacterium
FQAAHARFVEVAAKVNALLDI

SEQ ID NO: 621274 - protein, 24 aa, Mycobacterium
FQAEARQLLDLMIHSVYSNKDSFL

SEQ ID NO: 621275 - protein, 24 aa, Mycobacterium
FQAEARQLLDLMVHSVYSNKDSFL

SEQ ID NO: 621276 - protein, 25 aa, Mycobacterium
FQDKALEGFTMFALNQGEVCTCPSR

SEQ ID NO: 621277 - protein, 26 aa, Mycobacterium
FQDKALEGFTMFALNQGEVCTCPSRS

SEQ ID NO: 621278 - protein, 22 aa, Mycobacterium
FQGDQLPGYGWVFPMGNGMFNI

SEQ ID NO: 621279 - protein, 20 aa, Mycobacterium
FQLGSLWYISLDYINHQTSL

SEQ ID NO: 621280 - protein, 20 aa, Mycobacterium
FQLGSMWYISLDYINHQTSL

SEQ ID NO: 621281 - protein, 19 aa, Mycobacterium
FQMSKPVIPLLRQGGGGSI

SEQ ID NO: 621282 - protein, 18 aa, Mycobacterium
FQNIRLFGEMTALENVMV

SEQ ID NO: 621283 - protein, 19 aa, Mycobacterium
FRADSVLGVAGLVNAARAG

SEQ ID NO: 621284 - protein, 18 aa, Mycobacterium
FRADVIAVARKGEAPLRQ

SEQ ID NO: 621285 - protein, 25 aa, Mycobacterium
FRAIDRLGPELSLREIAEEAGTAKP

SEQ ID NO: 621286 - protein, 17 aa, Mycobacterium
FRDAPLMIVGEGTNEIQ

SEQ ID NO: 621287 - protein, 17 aa, Mycobacterium
FRDLTRLSAAGIPTIAL

SEQ ID NO: 621288 - protein, 20 aa, Mycobacterium
FRDYSWGMRVPRRLRELHVQ

SEQ ID NO: 621289 - protein, 21 aa, Mycobacterium
FRELGNPYLPVRWSTDNPDSI

SEQ ID NO: 621290 - protein, 22 aa, Mycobacterium
FRFDLAATLAREFYEVDRLATF

SEQ ID NO: 621291 - protein, 21 aa, Mycobacterium
FRFDLAATLARELHDVDRLSA

SEQ ID NO: 621292 - protein, 17 aa, Mycobacterium
FRGERLVNSMFTLSTLV

SEQ ID NO: 621293 - protein, 17 aa, Mycobacterium
FRGGPDFILEQYRRNGP

SEQ ID NO: 621294 - protein, 21 aa, Mycobacterium
FRKCIECFLCQNVCHVVRDHE

SEQ ID NO: 621295 - protein, 17 aa, Mycobacterium
FRKLVSRGFTPRQVEAV

SEQ ID NO: 621296 - protein, 17 aa, Mycobacterium
FRLGLGTQVRTHVVRRY

SEQ ID NO: 621297 - protein, 18 aa, Mycobacterium
FRQFSFPGGIPSHVAAQT

SEQ ID NO: 621298 - protein, 19 aa, Mycobacterium
FRRAFSWLPAQFASQSDAP

SEQ ID NO: 621299 - protein, 17 aa, Mycobacterium
FRYNTIITEETSAGRYS

SEQ ID NO: 621300 - protein, 19 aa, Mycobacterium
FSAKFASAVAKNPFVGDPI

SEQ ID NO: 621301 - protein, 19 aa, Mycobacterium
FSDGSLIVGIGSPPRTPDV

SEQ ID NO: 621302 - protein, 20 aa, Mycobacterium
FSDVLKAMGVYPGLDGAAPV

SEQ ID NO: 621303 - protein, 18 aa, Mycobacterium
FSEGGGMLVVERLSDAQR

SEQ ID NO: 621304 - protein, 18 aa, Mycobacterium
FSGKILAPAHLPQEQSQR

SEQ ID NO: 621305 - protein, 19 aa, Mycobacterium
FSGKILAPAHLPQEQSQRP

SEQ ID NO: 621306 - protein, 24 aa, Mycobacterium
FSHGGSLKSSWYGDCLPERDFPTL

SEQ ID NO: 621307 - protein, 18 aa, Mycobacterium
FSHGRDWGSPSIPEKMDL

SEQ ID NO: 621308 - protein, 20 aa, Mycobacterium
FSHPQSQYFVVGRLAQDQVA

SEQ ID NO: 621309 - protein, 20 aa, Mycobacterium
FSHPQSQYFVVGRMAQDQVA

SEQ ID NO: 621310 - protein, 17 aa, Mycobacterium
FSHVPWLSSQLLGAVEA

SEQ ID NO: 621311 - protein, 18 aa, Mycobacterium
FSPSEWELSFPRRPGMPD

SEQ ID NO: 621312 - protein, 17 aa, Mycobacterium
FSRSGALPITKASDRLQ

SEQ ID NO: 621313 - protein, 30 aa, Mycobacterium
FSSDAAMARRCVDAGWLLSLSGTASFRNAR

SEQ ID NO: 621314 - protein, 17 aa, Mycobacterium
FSTAIGIGGDPVIGTTH

SEQ ID NO: 621315 - protein, 24 aa, Mycobacterium
FTAALGGLVDRFGLAGERLGVVVG

SEQ ID NO: 621316 - protein, 17 aa, Mycobacterium
FTAYKLLIADVVGGDLK

SEQ ID NO: 621317 - protein, 23 aa, Mycobacterium
FTCDVGSPVVWAARYLSMNGRRR

SEQ ID NO: 621318 - protein, 24 aa, Mycobacterium
FTDWPDPWVLVGALAQVTRRLKFV

SEQ ID NO: 621319 - protein, 25 aa, Mycobacterium
FTGQVWPGDLLSFGGRVTGVREAGG

SEQ ID NO: 621320 - protein, 22 aa, Mycobacterium
FTGVPCIVDLATMREAIGDLGG

SEQ ID NO: 621321 - protein, 26 aa, Mycobacterium
FTMNCLSWIEALGFCGIGEAKEFLDG

SEQ ID NO: 621322 - protein, 17 aa, Mycobacterium
FTNICYTGCRFCAFAQR

SEQ ID NO: 621323 - protein, 25 aa, Mycobacterium
FTNICYTGCRFCAFAQRKGDADAYS

SEQ ID NO: 621324 - protein, 22 aa, Mycobacterium
FTRAQLLQEVWGYDFFGGTRTV

SEQ ID NO: 621325 - protein, 20 aa, Mycobacterium
FTRQAARPDADFILELGNRG

SEQ ID NO: 621326 - protein, 27 aa, Mycobacterium
FTSDIKNLLPMFAVFKPTVVVSVPRVF

SEQ ID NO: 621327 - protein, 20 aa, Mycobacterium
FTSLDPRAPFGGAKASGLGR

SEQ ID NO: 621328 - protein, 18 aa, Mycobacterium
FTSLMAIYDTMQYVRADI

SEQ ID NO: 621329 - protein, 17 aa, Mycobacterium
FTSPHPAEFTDDVIEAM

SEQ ID NO: 621330 - protein, 18 aa, Mycobacterium
FVAPWGMFTTAEFALIAR

SEQ ID NO: 621331 - protein, 23 aa, Mycobacterium
FVASALARLGPLLVVTATGREAD

SEQ ID NO: 621332 - protein, 19 aa, Mycobacterium
FVDVRFCDLPGIMQHFTIP

SEQ ID NO: 621333 - protein, 19 aa, Mycobacterium
FVEVAAKVNALLDIAQVNL

SEQ ID NO: 621334 - protein, 17 aa, Mycobacterium
FVGAATFEALSGQPVHT

SEQ ID NO: 621335 - protein, 24 aa, Mycobacterium
FVGELRAGLRAADCALFVIAANEG

SEQ ID NO: 621336 - protein, 19 aa, Mycobacterium
FVHFNWRAQHEDLKKLPFP

SEQ ID NO: 621337 - protein, 31 aa, Mycobacterium
FVILNWRAVCGQCRACKRGRPHLCFDTFNAT

SEQ ID NO: 621338 - protein, 18 aa, Mycobacterium
FVPPKFAKDAIIEAIDAE

SEQ ID NO: 621339 - protein, 18 aa, Mycobacterium
FVPSAGAVLAEWGADVIK

SEQ ID NO: 621340 - protein, 24 aa, Mycobacterium
FVPSAGAVLAEWGADVVKVEHAVT

SEQ ID NO: 621341 - protein, 17 aa, Mycobacterium
FVRCLESGYAANVEAVV

SEQ ID NO: 621342 - protein, 17 aa, Mycobacterium
FVRCVESGYAANVEAVI

SEQ ID NO: 621343 - protein, 21 aa, Mycobacterium
FVRGEGAGVVVLKRLTDAVRD

SEQ ID NO: 621344 - protein, 18 aa, Mycobacterium
FVVPVWRSMYEGMQPGGY

SEQ ID NO: 621345 - protein, 17 aa, Mycobacterium
FVVYSVCDDDPYLQVVL

SEQ ID NO: 621346 - protein, 19 aa, Mycobacterium
FWGGAGSVACQEFISQLGR

SEQ ID NO: 621347 - protein, 20 aa, Mycobacterium
FYERREIRDIVAYLRVLDNP

SEQ ID NO: 621348 - protein, 24 aa, Mycobacterium
FYKYPAEHWIHLRTTNPIESTFAT

SEQ ID NO: 621349 - protein, 19 aa, Mycobacterium
GAAAGRGGMGMAPVGHGGH

SEQ ID NO: 621350 - protein, 18 aa, Mycobacterium
GAAARYLGVPGEQELLGR

SEQ ID NO: 621351 - protein, 26 aa, Mycobacterium
GAAEALRWAMMRGEPLVVLADALAEA

SEQ ID NO: 621352 - protein, 19 aa, Mycobacterium
GAAGFKLHEDWGTTPAAID

SEQ ID NO: 621353 - protein, 19 aa, Mycobacterium
GAAKHARKVAGWGADAMIV

SEQ ID NO: 621354 - protein, 20 aa, Mycobacterium
GAALARLESRIALERLLDFM

SEQ ID NO: 621355 - protein, 23 aa, Mycobacterium
GAALGNGIGRYALDKAADYARNR

SEQ ID NO: 621356 - protein, 17 aa, Mycobacterium
GAAQGITAWAALHQAQR

SEQ ID NO: 621357 - protein, 17 aa, Mycobacterium
GAARSAWQAALDYATQR

SEQ ID NO: 621358 - protein, 18 aa, Mycobacterium
GACELLGIDPLYVANEGK

SEQ ID NO: 621359 - protein, 19 aa, Mycobacterium
GADAWALQDVLALGVTAGA

SEQ ID NO: 621360 - protein, 23 aa, Mycobacterium
GADEVFAGYHWYPPMGSPAAASL

SEQ ID NO: 621361 - protein, 23 aa, Mycobacterium
GADPAHQGLHMWLAEFPQPRPPR

SEQ ID NO: 621362 - protein, 25 aa, Mycobacterium
GAEYFEMMSAFLLDGARQVSAPTLL

SEQ ID NO: 621363 - protein, 25 aa, Mycobacterium
GAEYVYRFAPLVGIYGGTLEVFRNM

SEQ ID NO: 621364 - protein, 17 aa, Mycobacterium
GAFQGSFSYLLQDEDGQ

SEQ ID NO: 621365 - protein, 29 aa, Mycobacterium
GAGPEYSHLTLSWVYDWMAQGVPVVAMHR

SEQ ID NO: 621366 - protein, 17 aa, Mycobacterium
GAHLGPMGLEGAVRLGM

SEQ ID NO: 621367 - protein, 19 aa, Mycobacterium
GAIPGRNGGLVVVRSAIKR

SEQ ID NO: 621368 - protein, 18 aa, Mycobacterium
GAIVPWNVPQFLIMPKLI

SEQ ID NO: 621369 - protein, 24 aa, Mycobacterium
GAKRPLPHFDDLLFLGASMSRYPL

SEQ ID NO: 621370 - protein, 25 aa, Mycobacterium
GAKVICRRSRLMTRISGSGAMASVE

SEQ ID NO: 621371 - protein, 17 aa, Mycobacterium
GALEGLDNLTFVINCNL

SEQ ID NO: 621372 - protein, 24 aa, Mycobacterium
GALVAPVCDFRIMSRQGAIFTAGP

SEQ ID NO: 621373 - protein, 18 aa, Mycobacterium
GAMLARAELRAVFDELLL

SEQ ID NO: 621374 - protein, 18 aa, Mycobacterium
GANLARLEGRVALDELLN

SEQ ID NO: 621375 - protein, 18 aa, Mycobacterium
GANMQRQAVPLVRSEAPL

SEQ ID NO: 621376 - protein, 18 aa, Mycobacterium
GANVIPIQLPVGSEGDFE

SEQ ID NO: 621377 - protein, 20 aa, Mycobacterium
GAQDTRLVWEERRMRREVRA

SEQ ID NO: 621378 - protein, 18 aa, Mycobacterium
GAQLRLTDHNGWRITCFA

SEQ ID NO: 621379 - protein, 21 aa, Mycobacterium
GARFEVMPGCGHWPQYEDAKT

SEQ ID NO: 621380 - protein, 19 aa, Mycobacterium
GARGRRLDVRQARTVVHQT

SEQ ID NO: 621381 - protein, 26 aa, Mycobacterium
GARVVKAHVPLSEMFGYVGDLRSKTQ

SEQ ID NO: 621382 - protein, 19 aa, Mycobacterium
GASGFKLHEDWGSTPAAID

SEQ ID NO: 621383 - protein, 23 aa, Mycobacterium
GASVLKQLVAYVGLEHFLAGLRD

SEQ ID NO: 621384 - protein, 30 aa, Mycobacterium; identical to SEQ ID NO: 97057

SEQ ID NO: 621385 - protein, 25 aa, Mycobacterium
GATEILAGLAPRGGGGVRLADAIGT

SEQ ID NO: 621386 - protein, 25 aa, Mycobacterium
GAVELTGAWPGLRCDVDTPADLAAA

SEQ ID NO: 621387 - protein, 18 aa, Mycobacterium
GAVSRAHRGVLFLDECAE

SEQ ID NO: 621388 - protein, 24 aa, Mycobacterium
GAYEVNEAFAPVPLAWLKDIGADE

SEQ ID NO: 621389 - protein, 18 aa, Mycobacterium
GCACKIPPGELEDVVRGL

SEQ ID NO: 621390 - protein, 17 aa, Mycobacterium
GCASSAWTLGFYALHNW

SEQ ID NO: 621391 - protein, 22 aa, Mycobacterium
GCTRVWRFDRMATVCDPGSGRV

SEQ ID NO: 621392 - protein, 19 aa, Mycobacterium
GDAHCFRNAGGLVTDDAIR

SEQ ID NO: 621393 - protein, 22 aa, Mycobacterium
GDAPGYTTVWARMFAGDAAAGH

SEQ ID NO: 621394 - protein, 22 aa, Mycobacterium
GDCLPERDFPTLIDLYLQGRLP

SEQ ID NO: 621395 - protein, 22 aa, Mycobacterium
GDDIRARFVVLASGPFHRPKLP

SEQ ID NO: 621396 - protein, 24 aa, Mycobacterium
GDDLRLVVIDGRVVAAALRMPPEI

SEQ ID NO: 621397 - protein, 26 aa, Mycobacterium
GDELLWGIEDCRNLSARLEIDLLGMA

SEQ ID NO: 621398 - protein, 18 aa, Mycobacterium
GDEPLKRKVASTLLESFL

SEQ ID NO: 621399 - protein, 24 aa, Mycobacterium
GDEVSVAVVGLFRGLGQDYQLFGA

SEQ ID NO: 621400 - protein, 18 aa, Mycobacterium
GDFARRGLDPDLAPLYAQ

SEQ ID NO: 621401 - protein, 17 aa, Mycobacterium
GDFGGVWYWNRYPGLQC

SEQ ID NO: 621402 - protein, 23 aa, Mycobacterium
GDFVKIDFGALVAGYHSDMTRTF

SEQ ID NO: 621403 - protein, 20 aa, Mycobacterium
GDGIAFAGVAKYPARVKCAL

SEQ ID NO: 621404 - protein, 20 aa, Mycobacterium
GDGLGIVFRKGLPLEDMEFH

SEQ ID NO: 621405 - protein, 23 aa, Mycobacterium
GDGWRVAMGTLTFERGVSTLGQQ

SEQ ID NO: 621406 - protein, 20 aa, Mycobacterium
GDKAVKMVFVEGGTKQTTRN

SEQ ID NO: 621407 - protein, 25 aa, Mycobacterium
GDKSNWWAAYALWVFTLFGHPDVRL

SEQ ID NO: 621408 - protein, 32 aa, Mycobacterium
GDLATIWRGGCIIRAKFLNRIKDAFDEDPDLP

SEQ ID NO: 621409 - protein, 27 aa, Mycobacterium
GDLLEYWSGRRWPSGRHRVLPPQPDAP

SEQ ID NO: 621410 - protein, 17 aa, Mycobacterium
GDLNQVWTNIIDNAIQA

SEQ ID NO: 621411 - protein, 24 aa, Mycobacterium
GDLRGRFRWWGLYTQRKPGYDGTW

SEQ ID NO: 621412 - protein, 18 aa, Mycobacterium
GDPLFYSSYMHLHTRLTQ

SEQ ID NO: 621413 - protein, 17 aa, Mycobacterium
GDPYQLAPVKARGGMFD

SEQ ID NO: 621414 - protein, 20 aa, Mycobacterium
GDQFMTEFLPGHYDFLQRLF

SEQ ID NO: 621415 - protein, 25 aa, Mycobacterium
GDQTMFRKLFESVIAGHVKVLIGRK

SEQ ID NO: 621416 - protein, 23 aa, Mycobacterium
GDRNVVSVGFNWTMGNHVVPPKP

SEQ ID NO: 621417 - protein, 20 aa, Mycobacterium
GDRPIPSWLQVVGERQRILI

SEQ ID NO: 621418 - protein, 20 aa, Mycobacterium
GDRVRRAGVSSFGISGTNAH

SEQ ID NO: 621419 - protein, 21 aa, Mycobacterium
GDSLSGLFYAGPDRMSIFNAG

SEQ ID NO: 621420 - protein, 19 aa, Mycobacterium
GDTLVLLESMKMEIPVLAE

SEQ ID NO: 621421 - protein, 19 aa, Mycobacterium
GDTPLPVRTPLPVQLPEPM

SEQ ID NO: 621422 - protein, 21 aa, Mycobacterium
GDTRVPTWVVVGDKATVGEAT

SEQ ID NO: 621423 - protein, 19 aa, Mycobacterium
GDVDWAALAAAPGPLILHA

SEQ ID NO: 621424 - protein, 22 aa, Mycobacterium
GDVGISHVVFKPGTVEQIRSVI

SEQ ID NO: 621425 - protein, 22 aa, Mycobacterium
GEAACGTCHVIVAPEWSDTVGL

SEQ ID NO: 621426 - protein, 21 aa, Mycobacterium
GEAFAPTRAHTWLSHHPHTRL

SEQ ID NO: 621427 - protein, 20 aa, Mycobacterium
GEALAAAAAIYGYFTDFLAD

SEQ ID NO: 621428 - protein, 39 aa, Mycobacterium
GEALEPARLGPWLANHGRRPRLINMYGITETTVHASFRE

SEQ ID NO: 621429 - protein, 25 aa, Mycobacterium
GEALLSGLLRAGRQVKDLVVAERIP

SEQ ID NO: 621430 - protein, 26 aa, Mycobacterium
GEALREFGVRVLVIRPGQVRTRMSAH

SEQ ID NO: 621431 - protein, 18 aa, Mycobacterium
GEHQLDWLHRLRREMPNL

SEQ ID NO: 621432 - protein, 22 aa, Mycobacterium
GEIEWAKASLIGPEEYPAAVAA

SEQ ID NO: 621433 - protein, 17 aa, Mycobacterium
GEIRYLDAVLHNSKGEP

SEQ ID NO: 621434 - protein, 24 aa, Mycobacterium
GELGEPFTTVGLCCYRDGSDSVAW

SEQ ID NO: 621435 - protein, 17 aa, Mycobacterium
GELNRFVFAMPEQLGRV

SEQ ID NO: 621436 - protein, 24 aa, Mycobacterium
GELPAHLRRSITWDRGSEMASWKH

SEQ ID NO: 621437 - protein, 17 aa, Mycobacterium
GELPHFAGERGTFLKAP

SEQ ID NO: 621438 - protein, 26 aa, Mycobacterium
GENESPAAFAKRMVGSAAAVYATNDP

SEQ ID NO: 621439 - protein, 19 aa, Mycobacterium
GEPHAISAMHGRGVADLLD

SEQ ID NO: 621440 - protein, 21 aa, Mycobacterium
GEQELRPLLGEQVSVAAVNGP

SEQ ID NO: 621441 - protein, 19 aa, Mycobacterium
GEQLLGRWVHQARRAACAG

SEQ ID NO: 621442 - protein, 22 aa, Mycobacterium
GEQRSSNFMLWQAAYAEYIFQD

SEQ ID NO: 621443 - protein, 19 aa, Mycobacterium
GEVLERSLVHLGLKHYFLV

SEQ ID NO: 621444 - protein, 36 aa, Mycobacterium; identical to SEQ ID NO: 88385

SEQ ID NO: 621445 - protein, 17 aa, Mycobacterium
GEWTFAFPQGSMTDEPI

SEQ ID NO: 621446 - protein, 19 aa, Mycobacterium
GFDAVCFTSSSTVRNLVGI

SEQ ID NO: 621447 - protein, 23 aa, Mycobacterium
GFDAVFTAEAWGSDAYTPLAWWG

SEQ ID NO: 621448 - protein, 20 aa, Mycobacterium
GFDCSGLMLYAFAGVGIKLD

SEQ ID NO: 621449 - protein, 24 aa, Mycobacterium
GFDEVARLGAQVTIFRLGSDPGLA

SEQ ID NO: 621450 - protein, 17 aa, Mycobacterium
GFDFTGYKRTSLMRRVR

SEQ ID NO: 621451 - protein, 19 aa, Mycobacterium
GFDRLRLIQRIADRLPEKA

SEQ ID NO: 621452 - protein, 26 aa, Mycobacterium
GFGPEVKRRIMIGAYALSAGYYDAYY

SEQ ID NO: 621453 - protein, 17 aa, Mycobacterium
GFGRIGRNFFRALDAQK

SEQ ID NO: 621454 - protein, 20 aa, Mycobacterium
GFGSMVMGLISFDGQVATFA

SEQ ID NO: 621455 - protein, 20 aa, Mycobacterium
GFNIGRAVAVQLGYDFLPGT

SEQ ID NO: 621456 - protein, 22 aa, Mycobacterium
GFRFDLAATLARELHDVDRLSA

SEQ ID NO: 621457 - protein, 24 aa, Mycobacterium
GFSRGSLNVIARRAGVAKGSLFQY

SEQ ID NO: 621458 - protein, 17 aa, Mycobacterium
GFYSHPWAWNEIGFGGP

SEQ ID NO: 621459 - protein, 18 aa, Mycobacterium
GGAEMSRSEFYREGRVPL

SEQ ID NO: 621460 - protein, 22 aa, Mycobacterium
GGAGAPGLVSFNGSNGGNGGNG

SEQ ID NO: 621461 - protein, 22 aa, Mycobacterium
GGAGGTGGWLYGNGGAGGAGGA

SEQ ID NO: 621462 - protein, 18 aa, Mycobacterium
GGAHKCIGMQFGTLEVKA

SEQ ID NO: 621463 - protein, 18 aa, Mycobacterium
GGAHKCIGMVFGQLEVKT

SEQ ID NO: 621464 - protein, 22 aa, Mycobacterium
GGAIALGHPFGMTGARITATLL

SEQ ID NO: 621465 - protein, 22 aa, Mycobacterium
GGAIALGHPFGMTGARITTTLL

SEQ ID NO: 621466 - protein, 20 aa, Mycobacterium
GGAIEACARKLFVHPNTIRY

SEQ ID NO: 621467 - protein, 20 aa, Mycobacterium
GGAIEACARKLFVHPNTVRY

SEQ ID NO: 621468 - protein, 24 aa, Mycobacterium
GGAMFPRPAAWSITTQPLPGLEGG

SEQ ID NO: 621469 - protein, 18 aa, Mycobacterium
GGAVLPVYDPLFDSKKLR

SEQ ID NO: 621470 - protein, 18 aa, Mycobacterium
GGAVLPVYDPLFDSQKLR

SEQ ID NO: 621471 - protein, 24 aa, Mycobacterium
GGCLPKDIRAFMARAGELGANQAL

SEQ ID NO: 621472 - protein, 18 aa, Mycobacterium
GGDAWVRAMMLVDAGVDV

SEQ ID NO: 621473 - protein, 21 aa, Mycobacterium
GGDGRCKLVPYAKRTPKTART

SEQ ID NO: 621474 - protein, 18 aa, Mycobacterium
GGDLEFADELTLGRALTG

SEQ ID NO: 621475 - protein, 20 aa, Mycobacterium
GGDLRRMGISAATVAALGQA

SEQ ID NO: 621476 - protein, 19 aa, Mycobacterium
GGDLRRMGISASTVAALGQ

SEQ ID NO: 621477 - protein, 24 aa, Mycobacterium
GGDYRLGVRMNHSIDIAAGAEHFG

SEQ ID NO: 621478 - protein, 24 aa, Mycobacterium
GGEGKRLYPLTADRAKPAVPFGGA

SEQ ID NO: 621479 - protein, 18 aa, Mycobacterium
GGFGTLLMLGHDWASPEA

SEQ ID NO: 621480 - protein, 18 aa, Mycobacterium
GGGAHKCIGMHFGTLEVK

SEQ ID NO: 621481 - protein, 19 aa, Mycobacterium
GGGAHKCIGMVFGQLEIKT

SEQ ID NO: 621482 - protein, 18 aa, Mycobacterium
GGGIPWRKQDQFFNAPAN

SEQ ID NO: 621483 - protein, 17 aa, Mycobacterium
GGGSIWQQTVLREEMWA

SEQ ID NO: 621484 - protein, 20 aa, Mycobacterium
GGGVHFCLGAQLARLELRVM

SEQ ID NO: 621485 - protein, 22 aa, Mycobacterium
GGISRKADKWVHLLENRTPVVA

SEQ ID NO: 621486 - protein, 23 aa, Mycobacterium
GGIVDCAIALGFEKMQPGSLGGG

SEQ ID NO: 621487 - protein, 22 aa, Mycobacterium
GGKTFPLPNPFLVMATQNPIEH

SEQ ID NO: 621488 - protein, 19 aa, Mycobacterium
GGKVWRFVDTAGLRRKVGQ

SEQ ID NO: 621489 - protein, 30 aa, Mycobacterium
GGLEVRGPQRWRIKANWKIGAENFAGDMYH

SEQ ID NO: 621490 - protein, 23 aa, Mycobacterium
GGLKVTTANAWFAARPSGTEDVY

SEQ ID NO: 621491 - protein, 18 aa, Mycobacterium
GGLLHHAPSLLAFTNPTV

SEQ ID NO: 621492 - protein, 17 aa, Mycobacterium
GGPDFILEQYRRNGPIH

SEQ ID NO: 621493 - protein, 17 aa, Mycobacterium
GGPGMREMLAITGAIKG

SEQ ID NO: 621494 - protein, 18 aa, Mycobacterium
GGPLARVEGRVSIERILD

SEQ ID NO: 621495 - protein, 24 aa, Mycobacterium
GGPPPRLALSLGDTLAGMFGAQGA

SEQ ID NO: 621496 - protein, 23 aa, Mycobacterium
GGPRKVSPLAVQMIMPNGAAAVV

SEQ ID NO: 621497 - protein, 24 aa, Mycobacterium
GGQAGNIARLSWLAAGYPEEVPGV

SEQ ID NO: 621498 - protein, 17 aa, Mycobacterium
GGQRMVLRMPGARADAA

SEQ ID NO: 621499 - protein, 18 aa, Mycobacterium
GGRIGWNVVTGYLPAAAR

SEQ ID NO: 621500 - protein, 18 aa, Mycobacterium
GGRLSWALADRLHISRGE

SEQ ID NO: 621501 - protein, 19 aa, Mycobacterium
GGSGARILTTLLYHMRDNN

SEQ ID NO: 621502 - protein, 24 aa, Mycobacterium
GGTGGAAGWLIGNGGAGGQGGVAG

SEQ ID NO: 621503 - protein, 18 aa, Mycobacterium
GGTGGFGDKGYWLVTKHA

SEQ ID NO: 621504 - protein, 18 aa, Mycobacterium
GGTGWIPYFLERVDRTYE

SEQ ID NO: 621505 - protein, 23 aa, Mycobacterium
GGTWRINTYPGLACDVKSHLYSY

SEQ ID NO: 621506 - protein, 32 aa, Mycobacterium
GGVARTVRASTIWDDVRECVGGYTCHLGFESG

SEQ ID NO: 621507 - protein, 26 aa, Mycobacterium
GGVGLIGFGGAGGFGGASGFGTGGAG

SEQ ID NO: 621508 - protein, 18 aa, Mycobacterium
GGVYLDIPAAVLGEVIDA

SEQ ID NO: 621509 - protein, 18 aa, Mycobacterium
GGYQRFVAGVGRPLSESS

SEQ ID NO: 621510 - protein, 21 aa, Mycobacterium
GHDGDYRFGQQIVVSHDGGDY

SEQ ID NO: 621511 - protein, 25 aa, Mycobacterium
GHHCAWPLHRRFGIAATARASFAVY

SEQ ID NO: 621512 - protein, 23 aa, Mycobacterium
GHLIEVNAGPVLKVQPNLRYATD

SEQ ID NO: 621513 - protein, 24 aa, Mycobacterium
GHPDRPPTHFGFSLGDVTTGIMGA

SEQ ID NO: 621514 - protein, 24 aa, Mycobacterium
GHSLGGGVAMQFAYQFPHLVERLI

SEQ ID NO: 621515 - protein, 25 aa, Mycobacterium
GHSLGGGVAMQFAYQFPQLVDRLIL

SEQ ID NO: 621516 - protein, 19 aa, Mycobacterium
GHVAAWRVGAEFAGMEFGQ

SEQ ID NO: 621517 - protein, 18 aa, Mycobacterium
GIDFTNIYFYTVLFHALR

SEQ ID NO: 621518 - protein, 18 aa, Mycobacterium
GIDFTNIYFYTVLYHALR

SEQ ID NO: 621519 - protein, 24 aa, Mycobacterium
GIDPEVYSGFAFGMGLERTLQFRN

SEQ ID NO: 621520 - protein, 26 aa, Mycobacterium
GIEVVECSPPYDWAEQTALMSSRVIL

SEQ ID NO: 621521 - protein, 23 aa, Mycobacterium
GIGPTRIRTVLGILKAYTTRVGS

SEQ ID NO: 621522 - protein, 27 aa, Mycobacterium
GIGTIAAAFWPKPVVVRMSDFKTNEYA

SEQ ID NO: 621523 - protein, 23 aa, Mycobacterium
GIHGQEVLTEWLGMADSEYEALV

SEQ ID NO: 621524 - protein, 19 aa, Mycobacterium
GIISAGRVGTALGVALERA

SEQ ID NO: 621525 - protein, 18 aa, Mycobacterium
GILGRTAHVTSPCHSTGQ

SEQ ID NO: 621526 - protein, 32 aa, Mycobacterium
GILNFVFGEMWLRPGLGMKERRLITVACVAFQ

SEQ ID NO: 621527 - protein, 22 aa, Mycobacterium
GIPKLRIEEAAARTQARIDSGQ

SEQ ID NO: 621528 - protein, 19 aa, Mycobacterium
GIPPKWAAVRRLVMGAING

SEQ ID NO: 621529 - protein, 24 aa, Mycobacterium
GITLNVRAVIAFKVGNDTESIIAA

SEQ ID NO: 621530 - protein, 17 aa, Mycobacterium
GIVPAAFYRHFESMEAL

SEQ ID NO: 621531 - protein, 25 aa, Mycobacterium
GKAIDAGWIDGPRIVPAGHAITPTG

SEQ ID NO: 621532 - protein, 17 aa, Mycobacterium
GKDWTPTQHQIWADEMQ

SEQ ID NO: 621533 - protein, 18 aa, Mycobacterium
GKDWTPTQHQIWADEMQL

SEQ ID NO: 621534 - protein, 18 aa, Mycobacterium
GKFSEQLLADHLQKVSLS

SEQ ID NO: 621535 - protein, 20 aa, Mycobacterium
GKGFAGTMKRHGFRGQGAAH

SEQ ID NO: 621536 - protein, 26 aa, Mycobacterium
GKHSAIAALPWFWSDQYDLKLQIAGL

SEQ ID NO: 621537 - protein, 26 aa, Mycobacterium
GKKCYSLRIASAMAHDEGWLAEHMLI

SEQ ID NO: 621538 - protein, 23 aa, Mycobacterium
GKKIKRLSLLSGGEKSLTAVAML

SEQ ID NO: 621539 - protein, 19 aa, Mycobacterium
GKLPSEVFREHFLTCFIAD

SEQ ID NO: 621540 - protein, 20 aa, Mycobacterium
GKPDYRWAKEQTEARPADDV

SEQ ID NO: 621541 - protein, 25 aa, Mycobacterium
GKQEVWNAIRLLRSEGRTVVLTTHD

SEQ ID NO: 621542 - protein, 20 aa, Mycobacterium
GKRKRTRTGFGKRKSTKRAI

SEQ ID NO: 621543 - protein, 18 aa, Mycobacterium
GKRSIGLDMSVPEGKEVL

SEQ ID NO: 621544 - protein, 26 aa, Mycobacterium
GKRVTFAAFPWRWVGGDGCIVRLVAI

SEQ ID NO: 621545 - protein, 22 aa, Mycobacterium
GKSATTAWLIERLQRPTLVMAP

SEQ ID NO: 621546 - protein, 18 aa, Mycobacterium
GLAAGRLSRIVISALSSG

SEQ ID NO: 621547 - protein, 19 aa, Mycobacterium
GLAEIMRLGIALGAKGATL

SEQ ID NO: 621548 - protein, 19 aa, Mycobacterium
GLAGIPWFLIEALLEQGAD

SEQ ID NO: 621549 - protein, 20 aa, Mycobacterium
GLAGRPRLLIADEPTSALDV

SEQ ID NO: 621550 - protein, 17 aa, Mycobacterium
GLAHPLAQCHIEVELAK

SEQ ID NO: 621551 - protein, 18 aa, Mycobacterium
GLAVPNWPVEWGGKDWTP

SEQ ID NO: 621552 - protein, 18 aa, Mycobacterium
GLDLVRAQLLVAMGRPLP

SEQ ID NO: 621553 - protein, 23 aa, Mycobacterium
GLDREADDFFAFIADVSGANNNE

SEQ ID NO: 621554 - protein, 19 aa, Mycobacterium
GLDYEIWDDGWTVVTKDRK

SEQ ID NO: 621555 - protein, 19 aa, Mycobacterium
GLERAQIRALGLLKGACAQ

SEQ ID NO: 621556 - protein, 28 aa, Mycobacterium
GLFDPRLKRPIPFLPNMIGLITGRASAA

SEQ ID NO: 621557 - protein, 19 aa, Mycobacterium
GLFGPWDRPDIKGILPDEL

SEQ ID NO: 621558 - protein, 25 aa, Mycobacterium
GLGCELRHAHRLVYSEGLDLSGDPN

SEQ ID NO: 621559 - protein, 23 aa, Mycobacterium
GLGFSMKWNMGWMHDTLDYISRD

SEQ ID NO: 621560 - protein, 24 aa, Mycobacterium
GLGQPLRAVGTGNRAGSTGPSSPT

SEQ ID NO: 621561 - protein, 17 aa, Mycobacterium
GLGRRRPDIAVTILRLA

SEQ ID NO: 621562 - protein, 17 aa, Mycobacterium
GLHPVVAIYSTFLNRAF

SEQ ID NO: 621563 - protein, 19 aa, Mycobacterium
GLIGSRWLAHYTATSGYLD

SEQ ID NO: 621564 - protein, 19 aa, Mycobacterium
GLKSYRGDMINGFPPDAAA

SEQ ID NO: 621565 - protein, 20 aa, Mycobacterium
GLLLMIPNMYKIAGELTSAV

SEQ ID NO: 621566 - protein, 17 aa, Mycobacterium
GLLRELADLTGLSAQVT

SEQ ID NO: 621567 - protein, 18 aa, Mycobacterium
GLLSGLVGAGGGHGGAGG

SEQ ID NO: 621568 - protein, 18 aa, Mycobacterium
GLMLYAFAGVGIKLDHYS

SEQ ID NO: 621569 - protein, 29 aa, Mycobacterium
GLNAVIRAVVRTCDARYGSSVVGFQDGWR

SEQ ID NO: 621570 - protein, 22 aa, Mycobacterium
GLPDDLKFALVEPLRLLFKDEV

SEQ ID NO: 621571 - protein, 18 aa, Mycobacterium
GLPVLGHMIEIFRGGPDF

SEQ ID NO: 621572 - protein, 26 aa, Mycobacterium
GLRELHVVEAWGLIFVSMAAQPPPFD

SEQ ID NO: 621573 - protein, 25 aa, Mycobacterium
GLRTRLFAAPGWVVSPGVVKALPGN

SEQ ID NO: 621574 - protein, 24 aa, Mycobacterium
GLSHPMGPLRLSDLVGLDTLKLIA

SEQ ID NO: 621575 - protein, 18 aa, Mycobacterium
GLTSALCYGARPHPSYNP

SEQ ID NO: 621576 - protein, 19 aa, Mycobacterium
GLTTKPWVKTNMAPGSQVV

SEQ ID NO: 621577 - protein, 19 aa, Mycobacterium
GLVALPWHGAYSASKFGLR

SEQ ID NO: 621578 - protein, 19 aa, Mycobacterium
GLVGHGFGGSAAVFAAAGM

SEQ ID NO: 621579 - protein, 26 aa, Mycobacterium
GLWSATPPPTGWRLLDTAVEQAQIDS

SEQ ID NO: 621580 - protein, 24 aa, Mycobacterium
GLYAKARAGEITHFTGIDSPYQRP

SEQ ID NO: 621581 - protein, 17 aa, Mycobacterium
GLYAVVVDREMSALLDG

SEQ ID NO: 621582 - protein, 25 aa, Mycobacterium
GLYQYRPEPPFVLGAEIAGVVRSAP

SEQ ID NO: 621583 - protein, 26 aa, Mycobacterium
GMEPDLKWERFITAVRLLAERLGVRQ

SEQ ID NO: 621584 - protein, 20 aa, Mycobacterium
GMEPYERFWVRDEITGQEFQ

SEQ ID NO: 621585 - protein, 18 aa, Mycobacterium
GMLKYGFDDARPVLERAS

SEQ ID NO: 621586 - protein, 18 aa, Mycobacterium
GMRSHPGVTATFCEALAA

SEQ ID NO: 621587 - protein, 19 aa, Mycobacterium
GMSGARITLHVALELARRG

SEQ ID NO: 621588 - protein, 21 aa, Mycobacterium
GMSLRSPARFLATAERLVQLW

SEQ ID NO: 621589 - protein, 22 aa, Mycobacterium
GMSPHGCWATFVTCDGALATPI

SEQ ID NO: 621590 - protein, 19 aa, Mycobacterium
GMTLSQLGAQVIRVDPIGG

SEQ ID NO: 621591 - protein, 22 aa, Mycobacterium
GNGDCVAFFWFADAPDRVPGIS

SEQ ID NO: 621592 - protein, 20 aa, Mycobacterium
GNGPLAAFVHALGDVGFDVA

SEQ ID NO: 621593 - protein, 27 aa, Mycobacterium
GNMIKPMLARGELRLVGATTLDEYRKY

SEQ ID NO: 621594 - protein, 23 aa, Mycobacterium
GNPPEIVGAALFLASDASSFTTG

SEQ ID NO: 621595 - protein, 18 aa, Mycobacterium
GNTFEWNPDSTYVRKPPY

SEQ ID NO: 621596 - protein, 18 aa, Mycobacterium
GNTLPGLTCHSDAGSQFT

SEQ ID NO: 621597 - protein, 24 aa, Mycobacterium
GNYRAWRHFIAMRASEHADVEIRR

SEQ ID NO: 621598 - protein, 24 aa, Mycobacterium
GPALMVSDLFDFSVYVDARIEDIE

SEQ ID NO: 621599 - protein, 17 aa, Mycobacterium
GPAPVTHLRDLIRARRW

SEQ ID NO: 621600 - protein, 19 aa, Mycobacterium
GPDHKLLEQGWRTRKNAHG

SEQ ID NO: 621601 - protein, 28 aa, Mycobacterium
GPFYDGAVFHRVIRGFMIQGGDPTGTGR

SEQ ID NO: 621602 - protein, 18 aa, Mycobacterium
GPHVDLSRTVGWFTTKYP

SEQ ID NO: 621603 - protein, 19 aa, Mycobacterium
GPIALARLIPAGVDVRGNS

SEQ ID NO: 621604 - protein, 25 aa, Mycobacterium
GPITWAVELDERWVVIGPNGAGKTS

SEQ ID NO: 621605 - protein, 19 aa, Mycobacterium
GPLDEAIRASIAIPGVIAP

SEQ ID NO: 621606 - protein, 20 aa, Mycobacterium
GPLTECLADVVARFLPYFTD

SEQ ID NO: 621607 - protein, 21 aa, Mycobacterium
GPLTECLADVVVRFLPYFTDV

SEQ ID NO: 621608 - protein, 18 aa, Mycobacterium
GPMGLPELTSTKWIAWGD

SEQ ID NO: 621609 - protein, 19 aa, Mycobacterium
GPMGLPELTSTKWIVWGDG

SEQ ID NO: 621610 - protein, 23 aa, Mycobacterium
GPPGCGKTLIAKAVANSLAKKMA

SEQ ID NO: 621611 - protein, 19 aa, Mycobacterium
GPPPPARWSRRKPEAAARL

SEQ ID NO: 621612 - protein, 18 aa, Mycobacterium
GPVLEGWTLLSALAAQTK

SEQ ID NO: 621613 - protein, 24 aa, Mycobacterium
GPWIADRLLELGVELAHITICGDR

SEQ ID NO: 621614 - protein, 23 aa, Mycobacterium
GQAAETFAILNLAGAGDHIVSSP

SEQ ID NO: 621615 - protein, 17 aa, Mycobacterium
GQDFKGKLPSEVFREHF

SEQ ID NO: 621616 - protein, 27 aa, Mycobacterium
GQGGAGGRGGLLIGLGGNGGTGGFSGP

SEQ ID NO: 621617 - protein, 22 aa, Mycobacterium
GQLGRDRVPTFLLPANPVSALV

SEQ ID NO: 621618 - protein, 17 aa, Mycobacterium
GQLLSEDKWDLVVVDTP

SEQ ID NO: 621619 - protein, 22 aa, Mycobacterium
GQLPGHKVYPWVAEVRHSTPGV

SEQ ID NO: 621620 - protein, 21 aa, Mycobacterium
GQLRAVTNWVGPVGTGARLAN

SEQ ID NO: 621621 - protein, 22 aa, Mycobacterium
GQPGPRFGCGAGILAPHMSAAG

SEQ ID NO: 621622 - protein, 23 aa, Mycobacterium
GQPRLRPPFPAVAGLYACPTVVN

SEQ ID NO: 621623 - protein, 24 aa, Mycobacterium
GQQDSRYPLAPARVVADTRAALGR

SEQ ID NO: 621624 - protein, 18 aa, Mycobacterium
GQSIPAIAGELYVAPSTV

SEQ ID NO: 621625 - protein, 18 aa, Mycobacterium
GQSSRIENYLGFPDGVSG

SEQ ID NO: 621626 - protein, 17 aa, Mycobacterium
GRAAMFAGLADSTLSRD

SEQ ID NO: 621627 - protein, 20 aa, Mycobacterium
GRAEIRAIFRSSKVGIIAGC

SEQ ID NO: 621628 - protein, 20 aa, Mycobacterium
GRAEIRAIFRSSKVGNIAGC

SEQ ID NO: 621629 - protein, 24 aa, Mycobacterium
GRAKIVKFSGCYHGHSDALLADAG

SEQ ID NO: 621630 - protein, 18 aa, Mycobacterium
GRAMAAGGQAVFELAPQG

SEQ ID NO: 621631 - protein, 19 aa, Mycobacterium
GRARRIERFLSQNMMAAEQ

SEQ ID NO: 621632 - protein, 20 aa, Mycobacterium
GRASELESLIAAPTASLEAL

SEQ ID NO: 621633 - protein, 25 aa, Mycobacterium
GRAYDPRFLFAWPSAKSAVMGGTQL

SEQ ID NO: 621634 - protein, 22 aa, Mycobacterium
GRCKRARVALPGGDAIGSRPLD

SEQ ID NO: 621635 - protein, 19 aa, Mycobacterium
GRCPSGVATQSAWLQHGLD

SEQ ID NO: 621636 - protein, 20 aa, Mycobacterium
GRDDLALRIAVQPGGCAGLR

SEQ ID NO: 621637 - protein, 25 aa, Mycobacterium
GRELFVDKVWDWKRESGGAIGGQMR

SEQ ID NO: 621638 - protein, 24 aa, Mycobacterium
GREPRGVLEIAYRCPNGEPGVVKT

SEQ ID NO: 621639 - protein, 26 aa, Mycobacterium
GRGEGFCAGFDLSAYADRTGSAGGTG

SEQ ID NO: 621640 - protein, 20 aa, Mycobacterium
GRGEGFCAGFDLSAYAEGSS

SEQ ID NO: 621641 - protein, 19 aa, Mycobacterium
GRGGFAGMLLGSVSTAVVH

SEQ ID NO: 621642 - protein, 20 aa, Mycobacterium
GRGNPALNEVGWRQAGLAAR

SEQ ID NO: 621643 - protein, 21 aa, Mycobacterium
GRGPVATVLVQRGTLRVGDSV

SEQ ID NO: 621644 - protein, 21 aa, Mycobacterium
GRGSQWAGMGRQLLADEPAFA

SEQ ID NO: 621645 - protein, 24 aa, Mycobacterium
GRGVTVGRPLGLLLTRRSENATVT

SEQ ID NO: 621646 - protein, 21 aa, Mycobacterium
GRGYVLRRLLRRIIRAAKLLG

SEQ ID NO: 621647 - protein, 25 aa, Mycobacterium
GRIDRRGRMLWSLPKGHIEMGETAE

SEQ ID NO: 621648 - protein, 21 aa, Mycobacterium
GRIIFIGSVSGMWGIGNQANY

SEQ ID NO: 621649 - protein, 24 aa, Mycobacterium
GRIIVVEVMGRYAGWIALNAGMAS

SEQ ID NO: 621650 - protein, 27 aa, Mycobacterium
GRILGVKGRVLPMCPIALQIEADVSGL

SEQ ID NO: 621651 - protein, 22 aa, Mycobacterium
GRILRVRGRGVPKRSGGNGDLL

SEQ ID NO: 621652 - protein, 22 aa, Mycobacterium
GRILRVRGRGVPKRSGGSGDLL

SEQ ID NO: 621653 - protein, 21 aa, Mycobacterium
GRINHAYLFSGPRGCGKTSSA

SEQ ID NO: 621654 - protein, 19 aa, Mycobacterium
GRKEIRLAEHEMPGLMALR

SEQ ID NO: 621655 - protein, 19 aa, Mycobacterium
GRLAGRGFAAYGTAKAALS

SEQ ID NO: 621656 - protein, 22 aa, Mycobacterium
GRLREAVRVFGFHLSGLDMRQN

SEQ ID NO: 621657 - protein, 19 aa, Mycobacterium
GRLSIPFTTGLLVGIGETL

SEQ ID NO: 621658 - protein, 20 aa, Mycobacterium
GRNDIRIEAALAKLWSSEMA

SEQ ID NO: 621659 - protein, 20 aa, Mycobacterium
GRPGPEFRPSEVARLGYLAG

SEQ ID NO: 621660 - protein, 20 aa, Mycobacterium
GRPYYNAIVWQDTRTDRIAS

SEQ ID NO: 621661 - protein, 19 aa, Mycobacterium
GRQGRRGRRFRDRRRRGER

SEQ ID NO: 621662 - protein, 25 aa, Mycobacterium
GRRGEPGPPFFAAYGEWMGTPPPTW

SEQ ID NO: 621663 - protein, 20 aa, Mycobacterium
GRRIASMIPGARFEVMPGCG

SEQ ID NO: 621664 - protein, 20 aa, Mycobacterium
GRRLAEPGPYSMLEVLAPTM

SEQ ID NO: 621665 - protein, 25 aa, Mycobacterium
GRRRPDIAVTILRLANMIGPAMDTT

SEQ ID NO: 621666 - protein, 18 aa, Mycobacterium
GRSAALGYDGKWVLHPDQ

SEQ ID NO: 621667 - protein, 23 aa, Mycobacterium
GRSELRLAAEAVLDALDDAGLSP

SEQ ID NO: 621668 - protein, 28 aa, Mycobacterium
GRSGEPFPYPVTVGYMYILKLHHLVDDK

SEQ ID NO: 621669 - protein, 18 aa, Mycobacterium
GRSGGKRVLVRDISEYTA

SEQ ID NO: 621670 - protein, 25 aa, Mycobacterium
GRSYSPRFLFAWPNSKSAVMGPAQL

SEQ ID NO: 621671 - protein, 26 aa, Mycobacterium
GRVEPEMLRRALLYAIERKRAELIAA

SEQ ID NO: 621672 - protein, 18 aa, Mycobacterium
GRVGVCAATSGPGAVHLL

SEQ ID NO: 621673 - protein, 18 aa, Mycobacterium
GRVRLLPLETDWYYFARL

SEQ ID NO: 621674 - protein, 24 aa, Mycobacterium
GRYGPPRRWLVVTGTNGKTTTTSM

SEQ ID NO: 621675 - protein, 20 aa, Mycobacterium
GRYLLFKGEFAHNAPSRSPF

SEQ ID NO: 621676 - protein, 26 aa, Mycobacterium
GSDGQWRLSPKAMRRLGETALRDVAQ

SEQ ID NO: 621677 - protein, 26 aa, Mycobacterium
GSDGQWRLSPKAMRRLGETALRDVVQ

SEQ ID NO: 621678 - protein, 24 aa, Mycobacterium
GSEELKQQWLPGIASGETIMAFAI

SEQ ID NO: 621679 - protein, 18 aa, Mycobacterium
GSERIVPAPVTFVDIAGL

SEQ ID NO: 621680 - protein, 19 aa, Mycobacterium
GSFNPGHVNTGWFNTGDTN

SEQ ID NO: 621681 - protein, 17 aa, Mycobacterium
GSGARIMTTLLYHMRDK

SEQ ID NO: 621682 - protein, 21 aa, Mycobacterium
GSGKGSPEWWVVNVKPGRVLF

SEQ ID NO: 621683 - protein, 21 aa, Mycobacterium
GSGKSTLVCKVLGDVMARQLG

SEQ ID NO: 621684 - protein, 18 aa, Mycobacterium
GSIPRYDNAFALSNFNSD

SEQ ID NO: 621685 - protein, 25 aa, Mycobacterium
GSKDMGADVVVAWPTAQIAVMGASG

SEQ ID NO: 621686 - protein, 17 aa, Mycobacterium
GSKWMFPLLDSMAEVYK

SEQ ID NO: 621687 - protein, 19 aa, Mycobacterium
GSNVARTVFKSMLTAVLDR

SEQ ID NO: 621688 - protein, 23 aa, Mycobacterium
GSNVARTVFKSMLTAVLDRMPDY

SEQ ID NO: 621689 - protein, 18 aa, Mycobacterium
GSPGAFQGSFSYLLQDED

SEQ ID NO: 621690 - protein, 17 aa, Mycobacterium
GSSAFKVDFAIEGDIPW

SEQ ID NO: 621691 - protein, 19 aa, Mycobacterium
GSSIMPGKVNPVLPEAVTQ

SEQ ID NO: 621692 - protein, 17 aa, Mycobacterium
GSSYGPIGEACRRARRK

SEQ ID NO: 621693 - protein, 24 aa, Mycobacterium
GSTEHWQAWLQRYGGDYTDDAERR

SEQ ID NO: 621694 - protein, 37 aa, Mycobacterium
GSVAHFDWLVGCGVPFKAEFFSEPGWEPMGDQGLMYS

SEQ ID NO: 621695 - protein, 25 aa, Mycobacterium
GSVARLRFGPATHRKVKKWLAEGDF

SEQ ID NO: 621696 - protein, 18 aa, Mycobacterium
GSVPELFNALNAEITFEE

SEQ ID NO: 621697 - protein, 17 aa, Mycobacterium
GTCKDIPLMLATPHVLV

SEQ ID NO: 621698 - protein, 20 aa, Mycobacterium
GTDHCDWIILGAMLGDDKGI

SEQ ID NO: 621699 - protein, 19 aa, Mycobacterium
GTEQWLIELMEGVEDIPGT

SEQ ID NO: 621700 - protein, 24 aa, Mycobacterium
GTGKSVFLKSLIGLLRPERGSVVI

SEQ ID NO: 621701 - protein, 25 aa, Mycobacterium
GTGSTMGAEGSSGDGGTGGLGGAGG

SEQ ID NO: 621702 - protein, 25 aa, Mycobacterium
GTGSTMGAEGSSGDGGTGGLGGDGG

SEQ ID NO: 621703 - protein, 19 aa, Mycobacterium
GTGSTMGSAGTAGDGGTGG

SEQ ID NO: 621704 - protein, 18 aa, Mycobacterium
GTGTDSTDPTLAGQAGGQ

SEQ ID NO: 621705 - protein, 18 aa, Mycobacterium
GTGTPLFCIHATSGISWP

SEQ ID NO: 621706 - protein, 28 aa, Mycobacterium
GTHRLLQTGVRWKDLGLVVVDEEQRFGV

SEQ ID NO: 621707 - protein, 18 aa, Mycobacterium
GTINLCIVSPTGYIRDTF

SEQ ID NO: 621708 - protein, 17 aa, Mycobacterium
GTITPFAMIQLADRGQF

SEQ ID NO: 621709 - protein, 22 aa, Mycobacterium
GTMYRAGRVWRGKQVEVSIVAE

SEQ ID NO: 621710 - protein, 22 aa, Mycobacterium
GTPFQRLNFMVGKLNRAMQRNP

SEQ ID NO: 621711 - protein, 20 aa, Mycobacterium
GTQACRVLRAEGLQVSLVNS

SEQ ID NO: 621712 - protein, 21 aa, Mycobacterium
GTSALRLAPVLGASRTIAVVS

SEQ ID NO: 621713 - protein, 17 aa, Mycobacterium
GTTCCFATQDKVWVTGP

SEQ ID NO: 621714 - protein, 19 aa, Mycobacterium
GTTMKRAVERFDVNVIGLT

SEQ ID NO: 621715 - protein, 24 aa, Mycobacterium
GTWDLFKYPGIRSDSDMFTLGFRF

SEQ ID NO: 621716 - protein, 19 aa, Mycobacterium
GTWHYWWQAHLLDCLVDAQ

SEQ ID NO: 621717 - protein, 24 aa, Mycobacterium
GTYATCPACGGARYSDETLEVTYR

SEQ ID NO: 621718 - protein, 20 aa, Mycobacterium
GVALSLVYRDGRLERAATRG

SEQ ID NO: 621719 - protein, 17 aa, Mycobacterium
GVARGTFYFHFPTKEHV

SEQ ID NO: 621720 - protein, 17 aa, Mycobacterium
GVCLGHQAIGVAFGGTV

SEQ ID NO: 621721 - protein, 26 aa, Mycobacterium
GVDAKWASSISGYWRRGRTEETFRQW

SEQ ID NO: 621722 - protein, 24 aa, Mycobacterium
GVDGFPNLFLVSGPGAPAVLANMV

SEQ ID NO: 621723 - protein, 18 aa, Mycobacterium
GVDPALVDDVIWGCVMQA

SEQ ID NO: 621724 - protein, 21 aa, Mycobacterium
GVEEARKGFFRVPLIGGTITH

SEQ ID NO: 621725 - protein, 23 aa, Mycobacterium
GVEEARKGFFRVPLIRGTITHPV

SEQ ID NO: 621726 - protein, 20 aa, Mycobacterium
GVEVHWVYRGGRADLVPEDR

SEQ ID NO: 621727 - protein, 25 aa, Mycobacterium
GVGDAFRAGFLTGRSAGLSLERSAQ

SEQ ID NO: 621728 - protein, 20 aa, Mycobacterium
GVGGNGAWGAGGIGGDGGVG

SEQ ID NO: 621729 - protein, 22 aa, Mycobacterium
GVGRPQFSAVVECAAAARQLGG

SEQ ID NO: 621730 - protein, 17 aa, Mycobacterium
GVGTLVMTHYVPAIIAG

SEQ ID NO: 621731 - protein, 20 aa, Mycobacterium
GVGVFGCGECGFCKQGAEAL

SEQ ID NO: 621732 - protein, 39 aa, Mycobacterium
GVGVGYWRRGGLSAARFVACPFGAAGSRMYRTGDLVCWG

SEQ ID NO: 621733 - protein, 18 aa, Mycobacterium
GVGVTSIYWYFRKKDDLL

SEQ ID NO: 621734 - protein, 37 aa, Mycobacterium
GVGYWRRGGLSAARFVACPFGAGGSRMYRTGDLVCWG

SEQ ID NO: 621735 - protein, 18 aa, Mycobacterium
GVHRCIGSNVARTVFKSM

SEQ ID NO: 621736 - protein, 17 aa, Mycobacterium
GVHRVQRVPVTESQGRV

SEQ ID NO: 621737 - protein, 23 aa, Mycobacterium
GVIWGIDSFDQWGVELGKTQAKA

SEQ ID NO: 621738 - protein, 19 aa, Mycobacterium
GVLGFKKSDEIYTFMDLWF

SEQ ID NO: 621739 - protein, 17 aa, Mycobacterium
GVLSRRIDPRNGTVLVW

SEQ ID NO: 621740 - protein, 28 aa, Mycobacterium
GVNRTLWSGMTWQYWKALRRLDPSEFEF

SEQ ID NO: 621741 - protein, 26 aa, Mycobacterium
GVPIWGDVELAWRLDAAGRYGPPRRW

SEQ ID NO: 621742 - protein, 26 aa, Mycobacterium
GVPRTLRLDQMIRYYVEHQLDVIIRR

SEQ ID NO: 621743 - protein, 24 aa, Mycobacterium
GVRDELPHSLAVVIDEVNPREDRD

SEQ ID NO: 621744 - protein, 19 aa, Mycobacterium
GVSARFAIAAAETVAASAR

SEQ ID NO: 621745 - protein, 17 aa, Mycobacterium
GVSEPFSREKVISGVRR

SEQ ID NO: 621746 - protein, 17 aa, Mycobacterium
GVSRPTVYRRFPDTRSI

SEQ ID NO: 621747 - protein, 26 aa, Mycobacterium
GVTARLRPSMLEFMDSVAINAVEDTL

SEQ ID NO: 621748 - protein, 17 aa, Mycobacterium
GVTEPFSREKVISGVRR

SEQ ID NO: 621749 - protein, 17 aa, Mycobacterium
GVTPAGLLHHFESKEQL

SEQ ID NO: 621750 - protein, 17 aa, Mycobacterium
GVVADPFGHHWSLGQPV

SEQ ID NO: 621751 - protein, 19 aa, Mycobacterium
GVVGHGFGGSAAVFAAAGM

SEQ ID NO: 621752 - protein, 20 aa, Mycobacterium
GVVVLPCGAGKTLVGAAAMA

SEQ ID NO: 621753 - protein, 23 aa, Mycobacterium
GVVWGIDSFDQWGVELGKTQAKA

SEQ ID NO: 621754 - protein, 17 aa, Mycobacterium
GVWYWNRYPGLQCDNES

SEQ ID NO: 621755 - protein, 18 aa, Mycobacterium
GVYPGLDGAAPVIGGECV

SEQ ID NO: 621756 - protein, 21 aa, Mycobacterium
GVYRFLLKRNRRLYGVAYTLD

SEQ ID NO: 621757 - protein, 18 aa, Mycobacterium
GWAALGWDTLGNKLLIFQ

SEQ ID NO: 621758 - protein, 20 aa, Mycobacterium
GWADGVVELRDRFGGQTREL

SEQ ID NO: 621759 - protein, 24 aa, Mycobacterium
GWHKICVERGILPGMQELVRRIGD

SEQ ID NO: 621760 - protein, 18 aa, Mycobacterium
GWMLVCWPDDPNPINAGS

SEQ ID NO: 621761 - protein, 17 aa, Mycobacterium
GWMSLAGAMGGHTVVAK

SEQ ID NO: 621762 - protein, 19 aa, Mycobacterium
GWQTYGEVVVRFEQSSNLR

SEQ ID NO: 621763 - protein, 21 aa, Mycobacterium
GWRVVELDVSYGPRTGGKSKV

SEQ ID NO: 621764 - protein, 25 aa, Mycobacterium
GWSAYPRILDFAAFASIADEVDAKL

SEQ ID NO: 621765 - protein, 19 aa, Mycobacterium
GYCSDFGRTWIVGRDPSPR

SEQ ID NO: 621766 - protein, 21 aa, Mycobacterium
GYISFEFAHIAARAGSHPIIL

SEQ ID NO: 621767 - protein, 19 aa, Mycobacterium
GYKGISIPTASRINGVRGG

SEQ ID NO: 621768 - protein, 24 aa, Mycobacterium
GYLARADMMFALSVPLPGHHIINA

SEQ ID NO: 621769 - protein, 18 aa, Mycobacterium
GYMSKIFNDAWMSSYGFL

SEQ ID NO: 621770 - protein, 17 aa, Mycobacterium
GYQRFFVERFPGIVERI

SEQ ID NO: 621771 - protein, 21 aa, Mycobacterium
GYRVLCPDLRGAGWSSAPRSR

SEQ ID NO: 621772 - protein, 18 aa, Mycobacterium
GYVLRRLLRRVIRSAKLL

SEQ ID NO: 621773 - protein, 18 aa, Mycobacterium
GYVRLCVMAPRQWRGLRR

SEQ ID NO: 621774 - protein, 18 aa, Mycobacterium
GYYPGQFQVGQTGKTVSP

SEQ ID NO: 621775 - protein, 24 aa, Mycobacterium
GYYQIRGGIPYAIAKSLAAAPFAD

SEQ ID NO: 621776 - protein, 19 aa, Mycobacterium
HAAEVLALLGPNGAGKTTT

SEQ ID NO: 621777 - protein, 17 aa, Mycobacterium
HAAKVLNLRSTLLTLAG

SEQ ID NO: 621778 - protein, 20 aa, Mycobacterium
HADDVRYRIIADHSRTAAIL

SEQ ID NO: 621779 - protein, 18 aa, Mycobacterium
HAEACRWEHVMSEDVERR

SEQ ID NO: 621780 - protein, 19 aa, Mycobacterium
HAFEMPYGPSVPALYGLIA

SEQ ID NO: 621781 - protein, 17 aa, Mycobacterium
HAIKAGEGHAFISAGVE

SEQ ID NO: 621782 - protein, 23 aa, Mycobacterium
HAKARGANILARIMGASITSDGF

SEQ ID NO: 621783 - protein, 17 aa, Mycobacterium
HAKEQKAKVLAICNTNG

SEQ ID NO: 621784 - protein, 18 aa, Mycobacterium
HAKEQKAKVLAICNTNGS

SEQ ID NO: 621785 - protein, 22 aa, Mycobacterium
HAKGKLTARERILALLDEGSFV

SEQ ID NO: 621786 - protein, 31 aa, Mycobacterium
HASNLKCLCRFHHLLKTFWTGPRGWTDRQHP

SEQ ID NO: 621787 - protein, 23 aa, Mycobacterium
HCFAGKDRTGFVVATVLEAVGVD

SEQ ID NO: 621788 - protein, 22 aa, Mycobacterium
HCFGCGEGGDVYAFIQKIEHVS

SEQ ID NO: 621789 - protein, 24 aa, Mycobacterium
HDDGPRPTLCVIHGFMGSSYLLNG

SEQ ID NO: 621790 - protein, 17 aa, Mycobacterium
HDGMGWLAQRGYVPLGY

SEQ ID NO: 621791 - protein, 19 aa, Mycobacterium
HDHHSRRGLLLLVGRRRRL

SEQ ID NO: 621792 - protein, 25 aa, Mycobacterium
HDLADWRWGIDVNVLGVIHGIKAFV

SEQ ID NO: 621793 - protein, 27 aa, Mycobacterium
HDPRRFATDLLERFRDLIVLQAVPDAV

SEQ ID NO: 621794 - protein, 29 aa, Mycobacterium
HDQMRLALLLCAVRPEIGGVLIRGEKGTA

SEQ ID NO: 621795 - protein, 21 aa, Mycobacterium
HDRMEILSWFLVERDAPEWLR

SEQ ID NO: 621796 - protein, 26 aa, Mycobacterium
HDVFHIDRGYPLFVENLAILGAEIER

SEQ ID NO: 621797 - protein, 20 aa, Mycobacterium
HDVPAKGWLVGEVHNGIAQM

SEQ ID NO: 621798 - protein, 23 aa, Mycobacterium
HDYDLSSLFLLASTAALFSPSIK

SEQ ID NO: 621799 - protein, 24 aa, Mycobacterium
HEEFPRIDPAVICLVHDGGDRAVL

SEQ ID NO: 621800 - protein, 22 aa, Mycobacterium
HEGSLRIGDKVVLGRDNVINTY

SEQ ID NO: 621801 - protein, 23 aa, Mycobacterium
HEPDAGGHFGVYGGRYVAEALMA

SEQ ID NO: 621802 - protein, 19 aa, Mycobacterium
HERGIRVITDLVMNHTSDS

SEQ ID NO: 621803 - protein, 25 aa, Mycobacterium
HESAKRICKEAGYYGAGTVEYLVGQ

SEQ ID NO: 621804 - protein, 18 aa, Mycobacterium
HEVWKAGEPVSLSPTEFT

SEQ ID NO: 621805 - protein, 24 aa, Mycobacterium
HFFVCSTHDWILFFTTQGRVYRAK

SEQ ID NO: 621806 - protein, 25 aa, Mycobacterium
HGANLHGRYLLPHFLIHDIADVAAD

SEQ ID NO: 621807 - protein, 18 aa, Mycobacterium
HGDFKDIRGVMVHHTGSD

SEQ ID NO: 621808 - protein, 21 aa, Mycobacterium
HGFRFFDNRDLLGFVDGTENP

SEQ ID NO: 621809 - protein, 17 aa, Mycobacterium
HGGALSPRGDWRAPSDM

SEQ ID NO: 621810 - protein, 23 aa, Mycobacterium
HGGLRYLEQLEFGLVREALHERE

SEQ ID NO: 621811 - protein, 20 aa, Mycobacterium
HGGPGITFIPGFNAGRAALA

SEQ ID NO: 621812 - protein, 23 aa, Mycobacterium
HGKALRSATTFELDDVIDPAESR

SEQ ID NO: 621813 - protein, 20 aa, Mycobacterium
HGKLTGLITVKDFVKTEQFP

SEQ ID NO: 621814 - protein, 17 aa, Mycobacterium
HGMECLFHEKPFAGVNG

SEQ ID NO: 621815 - protein, 27 aa, Mycobacterium
HGRANGIFLPHVLRYNASLPTKFMPAP

SEQ ID NO: 621816 - protein, 21 aa, Mycobacterium
HGYCMGGGIYLGLLTDFCVAS

SEQ ID NO: 621817 - protein, 22 aa, Mycobacterium
HHRAAWRAARLLVLDAFTTAEA

SEQ ID NO: 621818 - protein, 31 aa, Mycobacterium; identical to SEQ ID NO: 80789

SEQ ID NO: 621819 - protein, 17 aa, Mycobacterium
HITWYTVLACFKLGIVI

SEQ ID NO: 621820 - protein, 22 aa, Mycobacterium
HKDLRRARAAALNIVPTSTGAA

SEQ ID NO: 621821 - protein, 23 aa, Mycobacterium
HKGARLTTQVSLAGRYLVYVPGA

SEQ ID NO: 621822 - protein, 19 aa, Mycobacterium
HKTFCIPHGGGGPGVGPVA

SEQ ID NO: 621823 - protein, 19 aa, Mycobacterium
HLAALRAIPNLSVVRPGDP

SEQ ID NO: 621824 - protein, 24 aa, Mycobacterium
HLAKAGLTCLGWPVEHGGRGLSTA

SEQ ID NO: 621825 - protein, 17 aa, Mycobacterium
HLERMLSLDDVFDRDEL

SEQ ID NO: 621826 - protein, 21 aa, Mycobacterium
HLHAFEVKWLCAVVEVARSSF

SEQ ID NO: 621827 - protein, 17 aa, Mycobacterium
HLLAGLTQFHTALQNRF

SEQ ID NO: 621828 - protein, 17 aa, Mycobacterium
HLLALSASSPWWGGEDT

SEQ ID NO: 621829 - protein, 38 aa, Mycobacterium
HLLKEIQLRMVFGYDMFDDFPAVLALIADGKLALAPQI

SEQ ID NO: 621830 - protein, 20 aa, Mycobacterium
HLLWHRRLVVDLSRTVLDDR

SEQ ID NO: 621831 - protein, 19 aa, Mycobacterium
HLTLVPALRDALAKVGRPD

SEQ ID NO: 621832 - protein, 18 aa, Mycobacterium
HMFGPEADLAVAIQRITR

SEQ ID NO: 621833 - protein, 24 aa, Mycobacterium
HMLGPRGGAFVVAQTRLGGGRIHH

SEQ ID NO: 621834 - protein, 22 aa, Mycobacterium
HMRADVTVGSFLSGGIDSTAIA

SEQ ID NO: 621835 - protein, 30 aa, Mycobacterium; identical to SEQ ID NO: 80824

SEQ ID NO: 621836 - protein, 19 aa, Mycobacterium
HNRVRMIVASFLVKDLHLP

SEQ ID NO: 621837 - protein, 18 aa, Mycobacterium
HPEIEGFSITAGNACGAN

SEQ ID NO: 621838 - protein, 23 aa, Mycobacterium
HPEQAWFPRARSATELSEVTAEN

SEQ ID NO: 621839 - protein, 18 aa, Mycobacterium
HPKLPGTVYTAAKELEEA

SEQ ID NO: 621840 - protein, 25 aa, Mycobacterium
HPLDRVPPAVLFGGGVLPAYALAEI

SEQ ID NO: 621841 - protein, 24 aa, Mycobacterium
HPLGATGLAQCAELTWQLRGAADK

SEQ ID NO: 621842 - protein, 26 aa, Mycobacterium
HPMEVGAFPLALARRSLSGSNIGGIA

SEQ ID NO: 621843 - protein, 17 aa, Mycobacterium
HPNLVRKLFSLEVPEIA

SEQ ID NO: 621844 - protein, 20 aa, Mycobacterium
HPYLDTVLFLLGVTRGEIEA

SEQ ID NO: 621845 - protein, 26 aa, Mycobacterium
HQEAFPLVITHGWPGSIVEFHNVIEP

SEQ ID NO: 621846 - protein, 17 aa, Mycobacterium
HRAFLRMINDPDQRAEF

SEQ ID NO: 621847 - protein, 17 aa, Mycobacterium
HRGRLNVLANIVGKPYS

SEQ ID NO: 621848 - protein, 19 aa, Mycobacterium
HRGTLLEQRRCGVAERFEC

SEQ ID NO: 621849 - protein, 26 aa, Mycobacterium
HRHLFSVLMDREWKHGVAAAVDVTLL

SEQ ID NO: 621850 - protein, 26 aa, Mycobacterium
HRHLFTVLMDREWKHGVAAAVDVTLL

SEQ ID NO: 621851 - protein, 17 aa, Mycobacterium
HRHMRSLLNKAFTPRAI

SEQ ID NO: 621852 - protein, 17 aa, Mycobacterium
HRIGVSVVVPGAVKTGL

SEQ ID NO: 621853 - protein, 25 aa, Mycobacterium
HRMLANWLAYCGWARDDTLVRRLEN

SEQ ID NO: 621854 - protein, 17 aa, Mycobacterium
HRPGWLPIPLRSIARLT

SEQ ID NO: 621855 - protein, 23 aa, Mycobacterium
HRPRRASSPFGQFAAVADAVNPA

SEQ ID NO: 621856 - protein, 20 aa, Mycobacterium
HRPTPCATLAAWLNTQTGIL

SEQ ID NO: 621857 - protein, 23 aa, Mycobacterium
HRRLEVGGEYAFRREGELHLFTP

SEQ ID NO: 621858 - protein, 23 aa, Mycobacterium
HRTFHYPGGLVDFVKHINRTKSP

SEQ ID NO: 621859 - protein, 18 aa, Mycobacterium
HRVMGVNVLGVMAGTRDA

SEQ ID NO: 621860 - protein, 17 aa, Mycobacterium
HSARIFCDITMPDGSPS

SEQ ID NO: 621861 - protein, 18 aa, Mycobacterium
HSDPEFAAAAGFSQPILH

SEQ ID NO: 621862 - protein, 32 aa, Mycobacterium
HSRFSTNTFPSWPLAHPFRFVAHNGEINTVRG

SEQ ID NO: 621863 - protein, 30 aa, Mycobacterium
HSVARSHVEVALKHPIKLIANALGSPPKDV

SEQ ID NO: 621864 - protein, 26 aa, Mycobacterium
HSYAFDFSVWEIWGALLHGGRLVVVP

SEQ ID NO: 621865 - protein, 21 aa, Mycobacterium
HTVKDILGRFGHVDYLVNNAG

SEQ ID NO: 621866 - protein, 20 aa, Mycobacterium
HVAEAMGVVAAETIAGAETL

SEQ ID NO: 621867 - protein, 19 aa, Mycobacterium
HVLPVGWVEPVDISNAVLF

SEQ ID NO: 621868 - protein, 17 aa, Mycobacterium
HVMGRGILYGTLGNGGT

SEQ ID NO: 621869 - protein, 17 aa, Mycobacterium
HVVALPMRVRFRGITTR

SEQ ID NO: 621870 - protein, 17 aa, Mycobacterium
HVVFKPGTIEQIRSVIR

SEQ ID NO: 621871 - protein, 18 aa, Mycobacterium
HVVRAGGAPAPGELGYED

SEQ ID NO: 621872 - protein, 19 aa, Mycobacterium
HWEVRRILKAYVDAQTLSD

SEQ ID NO: 621873 - protein, 30 aa, Mycobacterium
HYDKSNEFFKLWLDPSMTYSCGYFDENPDP

SEQ ID NO: 621874 - protein, 23 aa, Mycobacterium
HYLESWLLPSLGLRATVFHFNPG

SEQ ID NO: 621875 - protein, 17 aa, Mycobacterium
HYLGCVHLQRLLREPPA

SEQ ID NO: 621876 - protein, 19 aa, Mycobacterium
HYNPWDQRLCLVPNGDLFR

SEQ ID NO: 621877 - protein, 26 aa, Mycobacterium
IAAALALGAEGVWCGSVWLTTEEAET

SEQ ID NO: 621878 - protein, 19 aa, Mycobacterium
IAAALKLLQDRSFSSLSLR

SEQ ID NO: 621879 - protein, 26 aa, Mycobacterium
IAAALTEWFTVDWHRAIVDKWRAAGV

SEQ ID NO: 621880 - protein, 18 aa, Mycobacterium
IAAASFFAKNMLPLLTST

SEQ ID NO: 621881 - protein, 20 aa, Mycobacterium
IAALKAKYLTREDVPEDIVA

SEQ ID NO: 621882 - protein, 24 aa, Mycobacterium
IAALSRLGAIAVVMRPDADLAASV

SEQ ID NO: 621883 - protein, 18 aa, Mycobacterium
IAARAGVGMGTIYRHFPT

SEQ ID NO: 621884 - protein, 22 aa, Mycobacterium
IAARGVGVGQILAITFTNKAAA

SEQ ID NO: 621885 - protein, 23 aa, Mycobacterium
IAASGRPGAVLVDIPKDVLQGQC

SEQ ID NO: 621886 - protein, 24 aa, Mycobacterium
IAASGRWVPDFLSLPIAIENSLKN

SEQ ID NO: 621887 - protein, 22 aa, Mycobacterium
IADACGFAVPYYELVDERPVLD

SEQ ID NO: 621888 - protein, 20 aa, Mycobacterium
IADAVAWGAIGARTTESQVH

SEQ ID NO: 621889 - protein, 18 aa, Mycobacterium
IADLIEWRRKHEKHIERI

SEQ ID NO: 621890 - protein, 19 aa, Mycobacterium
IADVLRCIDGPLASVRDIG

SEQ ID NO: 621891 - protein, 18 aa, Mycobacterium
IAGPFHFYHCSIPCEGGG

SEQ ID NO: 621892 - protein, 19 aa, Mycobacterium
IAGRAMRRIGAIEFATTIA

SEQ ID NO: 621893 - protein, 24 aa, Mycobacterium
IAGYKVPRSLWLVDEVKRSPAGKP

SEQ ID NO: 621894 - protein, 17 aa, Mycobacterium
IAIALACDPELLIADEP

SEQ ID NO: 621895 - protein, 22 aa, Mycobacterium
IAKGSLRGGLVLGLEDSSSRMS

SEQ ID NO: 621896 - protein, 20 aa, Mycobacterium
IALAETLRGYGIVPDAVIGH

SEQ ID NO: 621897 - protein, 18 aa, Mycobacterium
IALTPARLLMVVITDSGR

SEQ ID NO: 621898 - protein, 20 aa, Mycobacterium
IAPGLFKTPLLGSLPEEAQK

SEQ ID NO: 621899 - protein, 18 aa, Mycobacterium
IAPSRFHVVPVLAYSPDP

SEQ ID NO: 621900 - protein, 19 aa, Mycobacterium
IAQVHGWCVGGASDYALCA

SEQ ID NO: 621901 - protein, 25 aa, Mycobacterium
IARLQKRLGTTTVYVTHDQTEAMTL

SEQ ID NO: 621902 - protein, 23 aa, Mycobacterium
IARRLPLDFPDDVTMRISHEAIY

SEQ ID NO: 621903 - protein, 25 aa, Mycobacterium
IARRVFATCRRLGLGTVAVYTDPDA

SEQ ID NO: 621904 - protein, 24 aa, Mycobacterium
IARSFAAALGLQFTRVQFTPDLLP

SEQ ID NO: 621905 - protein, 23 aa, Mycobacterium
IASGETIMAFAITEPDAGSNSHN

SEQ ID NO: 621906 - protein, 17 aa, Mycobacterium
IATMAPGGIVFALSNPD

SEQ ID NO: 621907 - protein, 18 aa, Mycobacterium
IAVNCVGPSTAVRTPGAA

SEQ ID NO: 621908 - protein, 17 aa, Mycobacterium
IAVPGCYPTAALLALLP

SEQ ID NO: 621909 - protein, 24 aa, Mycobacterium
IAVTRLGITSVRFTGGEPLLARHL

SEQ ID NO: 621910 - protein, 18 aa, Mycobacterium
ICARRGPTLQWVRSEETA

SEQ ID NO: 621911 - protein, 26 aa, Mycobacterium
ICGPETLRSLYFLSSRVSGGSPHAIR

SEQ ID NO: 621912 - protein, 20 aa, Mycobacterium
ICSQNRLWSVFGKKRGKNGK

SEQ ID NO: 621913 - protein, 19 aa, Mycobacterium
IDAFVEFYHAPILHQGQYT

SEQ ID NO: 621914 - protein, 22 aa, Mycobacterium
IDGLLREIRLVRALSGTDVPHA

SEQ ID NO: 621915 - protein, 17 aa, Mycobacterium
IDGQKMWLTNGGSSTLV

SEQ ID NO: 621916 - protein, 22 aa, Mycobacterium
IDGSCRRFGAGAGNAPVEALIG

SEQ ID NO: 621917 - protein, 23 aa, Mycobacterium
IDLDPQPGVAFEQARTVAVDVLR

SEQ ID NO: 621918 - protein, 21 aa, Mycobacterium
IDLERRRISLSLKQANEDYTD

SEQ ID NO: 621919 - protein, 27 aa, Mycobacterium
IDPANNVEFFFLRPKDIAIYVGSGQLD

SEQ ID NO: 621920 - protein, 17 aa, Mycobacterium
IDPEYYKKFMSVNLDGA

SEQ ID NO: 621921 - protein, 20 aa, Mycobacterium
IDPFRAAKTLNMNFFVHDPF

SEQ ID NO: 621922 - protein, 18 aa, Mycobacterium
IDPSIPFEVACLVGCGVT

SEQ ID NO: 621923 - protein, 23 aa, Mycobacterium
IDPYLRPLYDALHDMMDPELIPK

SEQ ID NO: 621924 - protein, 24 aa, Mycobacterium
IDPYLRPLYDALYDMMDPELIPKL

SEQ ID NO: 621925 - protein, 24 aa, Mycobacterium
IDQRSACRHPDWTGPDDLTIKINE

SEQ ID NO: 621926 - protein, 17 aa, Mycobacterium
IDRATLQPGPTFIKQFR

SEQ ID NO: 621927 - protein, 18 aa, Mycobacterium
IDSVAALVPRAEIEGEMG

SEQ ID NO: 621928 - protein, 19 aa, Mycobacterium
IDVAFPLGVLTSVTGVSGS

SEQ ID NO: 621929 - protein, 18 aa, Mycobacterium
IDVAYRYFATAKRKFIIA

SEQ ID NO: 621930 - protein, 26 aa, Mycobacterium
IDVCMGPWPALSLRDACQRGDWTEAA

SEQ ID NO: 621931 - protein, 30 aa, Mycobacterium
IDWEMCTIGDPLLDLGWMLVCWPDDPNPIN

SEQ ID NO: 621932 - protein, 25 aa, Mycobacterium
IEAVLECREALAVNVKPKFAVDAMV

SEQ ID NO: 621933 - protein, 18 aa, Mycobacterium
IEEGVRWEPPLLTITRVA

SEQ ID NO: 621934 - protein, 22 aa, Mycobacterium
IEELLRGADMVFVTAGEGGGTG

SEQ ID NO: 621935 - protein, 26 aa, Mycobacterium
IEFPIFAFTHCRDVVVAVSKAGGFGV

SEQ ID NO: 621936 - protein, 20 aa, Mycobacterium
IELTARMLATLLDFPYEQRH

SEQ ID NO: 621937 - protein, 17 aa, Mycobacterium
IERRYATALGQAELAQS

SEQ ID NO: 621938 - protein, 23 aa, Mycobacterium
IETICRYRLPVTVVILNNGGVYR

SEQ ID NO: 621939 - protein, 26 aa, Mycobacterium
IETNVEFWAAVILDFARVPANMMPAM

SEQ ID NO: 621940 - protein, 20 aa, Mycobacterium
IEVIEFCLGIPHLLKGEYTE

SEQ ID NO: 621941 - protein, 17 aa, Mycobacterium
IEVVTDMWGRPRVRLSG

SEQ ID NO: 621942 - protein, 17 aa, Mycobacterium
IEVVTDMWGRPRVRLTG

SEQ ID NO: 621943 - protein, 21 aa, Mycobacterium
IEWAESAGLDTAWMPQVPNDF

SEQ ID NO: 621944 - protein, 18 aa, Mycobacterium
IFGALLRGARLVIVPDDV

SEQ ID NO: 621945 - protein, 18 aa, Mycobacterium
IFGIPGGAVLPVYDPLFD

SEQ ID NO: 621946 - protein, 25 aa, Mycobacterium
IGAAHGRYGGVWAHDETRKSLGVAG

SEQ ID NO: 621947 - protein, 22 aa, Mycobacterium
IGARRFDPRLGRASLSAIWTQY

SEQ ID NO: 621948 - protein, 23 aa, Mycobacterium
IGDGALGFWKAVREVFPATKEQR

SEQ ID NO: 621949 - protein, 21 aa, Mycobacterium
IGDLFGGLFGRGGSARPSRPR

SEQ ID NO: 621950 - protein, 26 aa, Mycobacterium
IGDVGRPDLLASIGFTREELAEKLYD

SEQ ID NO: 621951 - protein, 24 aa, Mycobacterium
IGERSSHTWFVLTHLLGKPGVRNY

SEQ ID NO: 621952 - protein, 22 aa, Mycobacterium
IGETLVRGRIDAVFADPDGGAT

SEQ ID NO: 621953 - protein, 20 aa, Mycobacterium
IGGGFGNKVPIYPGYVCAIV

SEQ ID NO: 621954 - protein, 20 aa, Mycobacterium
IGGGGRYDGLMRELGGQDLS

SEQ ID NO: 621955 - protein, 21 aa, Mycobacterium
IGILPRHIPLVAQLVDDAMVR

SEQ ID NO: 621956 - protein, 17 aa, Mycobacterium
IGLALNCEIVPWCRFAR

SEQ ID NO: 621957 - protein, 18 aa, Mycobacterium
IGLLPRLEGTVHINIGLL

SEQ ID NO: 621958 - protein, 17 aa, Mycobacterium
IGMVFGQLEIKTVMHRL

SEQ ID NO: 621959 - protein, 24 aa, Mycobacterium
IGPEGLPSVFVYDGYPGGAGFAER

SEQ ID NO: 621960 - protein, 18 aa, Mycobacterium
IGPGKAQYTLCCNESGGV

SEQ ID NO: 621961 - protein, 19 aa, Mycobacterium
IGQAFGRDHTTVMYAEKKI

SEQ ID NO: 621962 - protein, 26 aa, Mycobacterium
IGRGVTVGRPLGLLLTRRSENATVTL

SEQ ID NO: 621963 - protein, 22 aa, Mycobacterium
IGSGSRPGHPVARHEYISNGLP

SEQ ID NO: 621964 - protein, 25 aa, Mycobacterium
IGTGEFMCVYWPSRGQEAIAAAMGV
